United States Patent 7,888,497 (BIOINFORMATICALLY DETECTABLE GROUP OF NOVEL REGULATORY OLIGONUCLEOTIDES AND USES THEREOF) - sequence listing, part 90

SEQ ID NO: 3801878 - DNA, 20 bp, Homo sapiens
ctttcaatggtttgcaagga

SEQ ID NO: 3801879 - DNA, 21 bp, Homo sapiens
ctttcaatggtttgcaaggaa

SEQ ID NO: 3801880 - DNA, 15 bp, Homo sapiens
ctttcagtgaaagca

SEQ ID NO: 3801881 - DNA, 23 bp, Homo sapiens
ctttgcaggacttgcacacaggg

SEQ ID NO: 3801882 - DNA, 20 bp, Homo sapiens
ctttggggcttttacaccag

SEQ ID NO: 3801883 - DNA, 20 bp, Homo sapiens
gaaaatgcaacaacatgtat

SEQ ID NO: 3801884 - DNA, 20 bp, Homo sapiens
gaaacccacagtttgagacc

SEQ ID NO: 3801885 - DNA, 16 bp, Homo sapiens
gaaagacagagctggg

SEQ ID NO: 3801886 - DNA, 18 bp, Homo sapiens
gaacacagaacaggaact

SEQ ID NO: 3801887 - DNA, 16 bp, Homo sapiens
gaaccaaacaccttca

SEQ ID NO: 3801888 - DNA, 21 bp, Homo sapiens
gaagagagtccatatttcaat

SEQ ID NO: 3801889 - DNA, 13 bp, Homo sapiens
gaagagtgaaccc

SEQ ID NO: 3801890 - DNA, 17 bp, Homo sapiens
gaaggcagcaggtggca

SEQ ID NO: 3801891 - DNA, 13 bp, Homo sapiens
gaatataaacact

SEQ ID NO: 3801892 - DNA, 15 bp, Homo sapiens
gacctatagtaagtg

SEQ ID NO: 3801893 - DNA, 18 bp, Homo sapiens
gactatattgtacacacc

SEQ ID NO: 3801894 - DNA, 15 bp, Homo sapiens
gactgagggctgggt

SEQ ID NO: 3801895 - DNA, 14 bp, Homo sapiens
gacttcaatttccc

SEQ ID NO: 3801896 - DNA, 15 bp, Homo sapiens
gagctggttgaattg

SEQ ID NO: 3801897 - DNA, 16 bp, Homo sapiens
gaggctctctctgcct

SEQ ID NO: 3801898 - DNA, 16 bp, Homo sapiens
gagggctccctgctcc

SEQ ID NO: 3801899 - DNA, 20 bp, Homo sapiens
gagtagaaagacagagctgg

SEQ ID NO: 3801900 - DNA, 16 bp, Homo sapiens
gatagtattgtgcata

SEQ ID NO: 3801901 - DNA, 15 bp, Homo sapiens
gatcccagcccaccc

SEQ ID NO: 3801902 - DNA, 22 bp, Homo sapiens
gatcccttccccctgctgatca

SEQ ID NO: 3801903 - DNA, 17 bp, Homo sapiens
gatgtgggtcaaggaat

SEQ ID NO: 3801904 - DNA, 20 bp, Homo sapiens
gattttgaaaaagtaggctg

SEQ ID NO: 3801905 - DNA, 17 bp, Homo sapiens
gcacagcccaaagaagg

SEQ ID NO: 3801906 - DNA, 14 bp, Homo sapiens
gcactgcccatccc

SEQ ID NO: 3801907 - DNA, 19 bp, Homo sapiens
gcactgcccatcccacccc

SEQ ID NO: 3801908 - DNA, 19 bp, Homo sapiens
gcagagaagggcaggagag

SEQ ID NO: 3801909 - DNA, 19 bp, Homo sapiens
gcagatcccagcccaccct

SEQ ID NO: 3801910 - DNA, 22 bp, Homo sapiens
gcaggtgtcttggacccacctg

SEQ ID NO: 3801911 - DNA, 12 bp, Homo sapiens
gcagtttgtgaa

SEQ ID NO: 3801912 - DNA, 13 bp, Homo sapiens
gcatgaaggtttc

SEQ ID NO: 3801913 - DNA, 11 bp, Homo sapiens
gccaaacagga

SEQ ID NO: 3801914 - DNA, 22 bp, Homo sapiens
gcccaattcttacaaacatgtg

SEQ ID NO: 3801915 - DNA, 21 bp, Homo sapiens
gccccacgggactctggtggc

SEQ ID NO: 3801916 - DNA, 18 bp, Homo sapiens
gcccctttcttccccacc

SEQ ID NO: 3801917 - DNA, 19 bp, Homo sapiens
gcccctttcttccccaccc

SEQ ID NO: 3801918 - DNA, 21 bp, Homo sapiens
gcctagtctacagtactgaca

SEQ ID NO: 3801919 - DNA, 13 bp, Homo sapiens
gccttatgaggtc

SEQ ID NO: 3801920 - DNA, 16 bp, Homo sapiens
gccttatgaggtcaag

SEQ ID NO: 3801921 - DNA, 14 bp, Homo sapiens
gccttgaagtgttt

SEQ ID NO: 3801922 - DNA, 21 bp, Homo sapiens
gccttgctgacctcccagcct

SEQ ID NO: 3801923 - DNA, 21 bp, Homo sapiens
gctcacgcctgtaatcccagc

SEQ ID NO: 3801924 - DNA, 22 bp, Homo sapiens
gctcactcattgcagatcccag

SEQ ID NO: 3801925 - DNA, 12 bp, Homo sapiens
gctcaggccagt

SEQ ID NO: 3801926 - DNA, 14 bp, Homo sapiens
gctccctccctcca

SEQ ID NO: 3801927 - DNA, 16 bp, Homo sapiens
gctccctgctccctcc

SEQ ID NO: 3801928 - DNA, 17 bp, Homo sapiens
gctctgccctggaacct

SEQ ID NO: 3801929 - DNA, 17 bp, Homo sapiens
gctgacctcccagcctt

SEQ ID NO: 3801930 - DNA, 13 bp, Homo sapiens
gctgccgccacca

SEQ ID NO: 3801931 - DNA, 18 bp, Homo sapiens
gctggcggggtcccccct

SEQ ID NO: 3801932 - DNA, 21 bp, Homo sapiens
gctggcggggtcccccctcca

SEQ ID NO: 3801933 - DNA, 22 bp, Homo sapiens
gcttctccctttagttctgctg

SEQ ID NO: 3801934 - DNA, 23 bp, Homo sapiens
gcttctccctttagttctgctgt

SEQ ID NO: 3801935 - DNA, 20 bp, Homo sapiens
ggaaaaggcagggagcgagg

SEQ ID NO: 3801936 - DNA, 17 bp, Homo sapiens
ggaaactggatgaggtc

SEQ ID NO: 3801937 - DNA, 23 bp, Homo sapiens
ggaaagggttcacataggctctc

SEQ ID NO: 3801938 - DNA, 16 bp, Homo sapiens
ggaagatttgtctact

SEQ ID NO: 3801939 - DNA, 18 bp, Homo sapiens
ggaagtaaatacagcaat

SEQ ID NO: 3801940 - DNA, 21 bp, Homo sapiens
ggaagttttgtggaggagctc

SEQ ID NO: 3801941 - DNA, 15 bp, Homo sapiens
ggaatggcacagccc

SEQ ID NO: 3801942 - DNA, 20 bp, Homo sapiens
ggaattcatctctctttaat

SEQ ID NO: 3801943 - DNA, 14 bp, Homo sapiens
ggacagaagaaggc

SEQ ID NO: 3801944 - DNA, 17 bp, Homo sapiens
ggactctggtggctgcc

SEQ ID NO: 3801945 - DNA, 21 bp, Homo sapiens
ggagaggaagatttgtctact

SEQ ID NO: 3801946 - DNA, 18 bp, Homo sapiens
ggagagtgagggctccct

SEQ ID NO: 3801947 - DNA, 19 bp, Homo sapiens
ggatcttgaagaagctctt

SEQ ID NO: 3801948 - DNA, 16 bp, Homo sapiens
ggcaacatagtgagac

SEQ ID NO: 3801949 - DNA, 21 bp, Homo sapiens
ggccagtaatcccagtgactt

SEQ ID NO: 3801950 - DNA, 14 bp, Homo sapiens
ggcccacaggttta

SEQ ID NO: 3801951 - DNA, 13 bp, Homo sapiens
ggctgaggctgcc

SEQ ID NO: 3801952 - DNA, 21 bp, Homo sapiens
ggctgaggctgccctgaccct

SEQ ID NO: 3801953 - DNA, 12 bp, Homo sapiens
ggctgccagctt

SEQ ID NO: 3801954 - DNA, 22 bp, Homo sapiens
gggaatggcacagcccaaagaa

SEQ ID NO: 3801955 - DNA, 17 bp, Homo sapiens
gggagctggttgaattg

SEQ ID NO: 3801956 - DNA, 16 bp, Homo sapiens
gggagtttgagaccag

SEQ ID NO: 3801957 - DNA, 15 bp, Homo sapiens
ggggaattcatctct

SEQ ID NO: 3801958 - DNA, 17 bp, Homo sapiens
gggtaggcaggtgtctt

SEQ ID NO: 3801959 - DNA, 12 bp, Homo sapiens
gggtcaaggaat

SEQ ID NO: 3801960 - DNA, 16 bp, Homo sapiens
aaaaagtaggctgccg

SEQ ID NO: 3801961 - DNA, 16 bp, Homo sapiens
aaaatctgtggtggtc

SEQ ID NO: 3801962 - DNA, 14 bp, Homo sapiens
aaaattagccaggt

SEQ ID NO: 3801963 - DNA, 14 bp, Homo sapiens
aaagacagagctgg

SEQ ID NO: 3801964 - DNA, 14 bp, Homo sapiens
aaagcaaggactgc

SEQ ID NO: 3801965 - DNA, 16 bp, Homo sapiens
aaagcatcacttggga

SEQ ID NO: 3801966 - DNA, 16 bp, Homo sapiens
aaatgcaacaacatgt

SEQ ID NO: 3801967 - DNA, 11 bp, Homo sapiens
aaatgtgactt

SEQ ID NO: 3801968 - DNA, 13 bp, Homo sapiens
aacaacatgtata

SEQ ID NO: 3801969 - DNA, 14 bp, Homo sapiens
aacactatatggca

SEQ ID NO: 3801970 - DNA, 21 bp, Homo sapiens
aacactatatggcagtgtctt

SEQ ID NO: 3801971 - DNA, 17 bp, Homo sapiens
aacactgcttgtgtttt

SEQ ID NO: 3801972 - DNA, 16 bp, Homo sapiens
aacactgtcttgaaga

SEQ ID NO: 3801973 - DNA, 13 bp, Homo sapiens
aacatttgttgaa

SEQ ID NO: 3801974 - DNA, 18 bp, Homo sapiens
aacccacagtttgagacc

SEQ ID NO: 3801975 - DNA, 12 bp, Homo sapiens
aactcaatattt

SEQ ID NO: 3801976 - DNA, 17 bp, Homo sapiens
aagaaggaaaaggcagg

SEQ ID NO: 3801977 - DNA, 21 bp, Homo sapiens
aagccctatccttctctgcct

SEQ ID NO: 3801978 - DNA, 12 bp, Homo sapiens
aaggctcagccc

SEQ ID NO: 3801979 - DNA, 16 bp, Homo sapiens
aaggctcagccccacg

SEQ ID NO: 3801980 - DNA, 20 bp, Homo sapiens
aagggttacttgctgctcac

SEQ ID NO: 3801981 - DNA, 21 bp, Homo sapiens
aagtgcttaacatttgttgaa

SEQ ID NO: 3801982 - DNA, 20 bp, Homo sapiens
aagtttatggccttgaagtg

SEQ ID NO: 3801983 - DNA, 21 bp, Homo sapiens
aagtttatggccttgaagtgt

SEQ ID NO: 3801984 - DNA, 22 bp, Homo sapiens
aataatgtttataagctgggca

SEQ ID NO: 3801985 - DNA, 18 bp, Homo sapiens
aatgcaacaacatgtata

SEQ ID NO: 3801986 - DNA, 14 bp, Homo sapiens
aatggtttgaatat

SEQ ID NO: 3801987 - DNA, 18 bp, Homo sapiens
aatggtttgcaaggaagc

SEQ ID NO: 3801988 - DNA, 12 bp, Homo sapiens
aattaacactgc

SEQ ID NO: 3801989 - DNA, 23 bp, Homo sapiens
aattgtctttattaacaaacagg

SEQ ID NO: 3801990 - DNA, 10 bp, Homo sapiens
acaaacagga

SEQ ID NO: 3801991 - DNA, 19 bp, Homo sapiens
acaaacatgtggttaatgc

SEQ ID NO: 3801992 - DNA, 14 bp, Homo sapiens
acaagaatggtgtg

SEQ ID NO: 3801993 - DNA, 13 bp, Homo sapiens
acaatttaaagca

SEQ ID NO: 3801994 - DNA, 14 bp, Homo sapiens
acaatttaaagcaa

SEQ ID NO: 3801995 - DNA, 20 bp, Homo sapiens
acaatttaaagcaaaggagt

SEQ ID NO: 3801996 - DNA, 15 bp, Homo sapiens
acaccttatatttac

SEQ ID NO: 3801997 - DNA, 14 bp, Homo sapiens
acagagctgggatg

SEQ ID NO: 3801998 - DNA, 13 bp, Homo sapiens
acagatgcaagca

SEQ ID NO: 3801999 - DNA, 22 bp, Homo sapiens
acaggaactagattataagcct

SEQ ID NO: 3802000 - DNA, 19 bp, Homo sapiens
acataggctctcaggtgcc

SEQ ID NO: 3802001 - DNA, 20 bp, Homo sapiens
acatgtataatatttttaat

SEQ ID NO: 3802002 - DNA, 14 bp, Homo sapiens
accaaacaccttca

SEQ ID NO: 3802003 - DNA, 18 bp, Homo sapiens
acccacctgaaatgcagt

SEQ ID NO: 3802004 - DNA, 20 bp, Homo sapiens
accgacttcaatttcccacc

SEQ ID NO: 3802005 - DNA, 22 bp, Homo sapiens
accgacttcaatttcccaccca

SEQ ID NO: 3802006 - DNA, 19 bp, Homo sapiens
acctgaggtcgggagtttg

SEQ ID NO: 3802007 - DNA, 19 bp, Homo sapiens
acgccattgcactccagcc

SEQ ID NO: 3802008 - DNA, 15 bp, Homo sapiens
gtaatcccagtgact

SEQ ID NO: 3802009 - DNA, 22 bp, Homo sapiens
gtcttggacccacctgaaatgc

SEQ ID NO: 3802010 - DNA, 17 bp, Homo sapiens
gtgagaccctgtctcta

SEQ ID NO: 3802011 - DNA, 14 bp, Homo sapiens
gtgggtcaaggaat

SEQ ID NO: 3802012 - DNA, 15 bp, Homo sapiens
gttcactgcagcatg

SEQ ID NO: 3802013 - DNA, 18 bp, Homo sapiens
gttgaagtgagagtttgg

SEQ ID NO: 3802014 - DNA, 20 bp, Homo sapiens
gttgacttgacagaacactg

SEQ ID NO: 3802015 - DNA, 18 bp, Homo sapiens
gtttaaggctgaggctgc

SEQ ID NO: 3802016 - DNA, 14 bp, Homo sapiens
gtttgcaaggaagc

SEQ ID NO: 3802017 - DNA, 15 bp, Homo sapiens
gtttgcaaggaagcc

SEQ ID NO: 3802018 - DNA, 22 bp, Homo sapiens
gtttgcaaggaagccacagctg

SEQ ID NO: 3802019 - DNA, 22 bp, Homo sapiens
taactcaatattttccatgaaa

SEQ ID NO: 3802020 - DNA, 10 bp, Homo sapiens
taaggctcag

SEQ ID NO: 3802021 - DNA, 16 bp, Homo sapiens
taaggctgaggctgcc

SEQ ID NO: 3802022 - DNA, 21 bp, Homo sapiens
taattaaataaaaatctgtgg

SEQ ID NO: 3802023 - DNA, 22 bp, Homo sapiens
taatttgatagtattgtgcata

SEQ ID NO: 3802024 - DNA, 13 bp, Homo sapiens
tacgtatgagacg

SEQ ID NO: 3802025 - DNA, 22 bp, Homo sapiens
tactagggaggctgaggcagga

SEQ ID NO: 3802026 - DNA, 22 bp, Homo sapiens
tactctttgggatcttgaagaa

SEQ ID NO: 3802027 - DNA, 13 bp, Homo sapiens
tagccaaacagga

SEQ ID NO: 3802028 - DNA, 12 bp, Homo sapiens
tagccaggtgtg

SEQ ID NO: 3802029 - DNA, 15 bp, Homo sapiens
tagcttggaaactgg

SEQ ID NO: 3802030 - DNA, 19 bp, Homo sapiens
taggaaattgattttgaaa

SEQ ID NO: 3802031 - DNA, 13 bp, Homo sapiens
taggggaaagaaa

SEQ ID NO: 3802032 - DNA, 22 bp, Homo sapiens
taggtcgccagtgaaatagaac

SEQ ID NO: 3802033 - DNA, 16 bp, Homo sapiens
tagttctgctgtctcc

SEQ ID NO: 3802034 - DNA, 17 bp, Homo sapiens
tagttctgctgtctccc

SEQ ID NO: 3802035 - DNA, 15 bp, Homo sapiens
tatagtaagtgctta

SEQ ID NO: 3802036 - DNA, 16 bp, Homo sapiens
tatggcagtgtctttc

SEQ ID NO: 3802037 - DNA, 14 bp, Homo sapiens
tatgtttttgtgta

SEQ ID NO: 3802038 - DNA, 15 bp, Homo sapiens
tattaacaaacagga

SEQ ID NO: 3802039 - DNA, 20 bp, Homo sapiens
tatttcttaaacaaatgtat

SEQ ID NO: 3802040 - DNA, 22 bp, Homo sapiens
tatttgttaatggtttgaatat

SEQ ID NO: 3802041 - DNA, 20 bp, Homo sapiens
tattttccatgaaaatgcaa

SEQ ID NO: 3802042 - DNA, 17 bp, Homo sapiens
tatttttaattaaataa

SEQ ID NO: 3802043 - DNA, 23 bp, Homo sapiens
tcaatctgcagtttgtgaacttc

SEQ ID NO: 3802044 - DNA, 16 bp, Homo sapiens
tcaatttcccacccat

SEQ ID NO: 3802045 - DNA, 17 bp, Homo sapiens
tcaatttcccacccatc

SEQ ID NO: 3802046 - DNA, 20 bp, Homo sapiens
tcacgcctgtaatcccagca

SEQ ID NO: 3802047 - DNA, 21 bp, Homo sapiens
tcacgcctgtaatcccagcac

SEQ ID NO: 3802048 - DNA, 23 bp, Homo sapiens
tcactcgaacccgggaggcagag

SEQ ID NO: 3802049 - DNA, 19 bp, Homo sapiens
tcagccttgctgacctccc

SEQ ID NO: 3802050 - DNA, 21 bp, Homo sapiens
tcaggccagtaatcccagtga

SEQ ID NO: 3802051 - DNA, 13 bp, Homo sapiens
tcatattgcttct

SEQ ID NO: 3802052 - DNA, 17 bp, Homo sapiens
tcatattgcttctccct

SEQ ID NO: 3802053 - DNA, 21 bp, Homo sapiens
tcatttcatagccaaacagga

SEQ ID NO: 3802054 - DNA, 20 bp, Homo sapiens
tcatttgctaactagcttgg

SEQ ID NO: 3802055 - DNA, 18 bp, Homo sapiens
tccagaaagcaaggactg

SEQ ID NO: 3802056 - DNA, 20 bp, Homo sapiens
tccattccctggagtttggg

SEQ ID NO: 3802057 - DNA, 16 bp, Homo sapiens
tcccacccatctccag

SEQ ID NO: 3802058 - DNA, 14 bp, Homo sapiens
tcccagcccaccct

SEQ ID NO: 3802059 - DNA, 16 bp, Homo sapiens
tcccagctactaggga

SEQ ID NO: 3802060 - DNA, 20 bp, Homo sapiens
tccccctgctgatcaatctg

SEQ ID NO: 3802061 - DNA, 21 bp, Homo sapiens
tccctgctccctccctccacc

SEQ ID NO: 3802062 - DNA, 19 bp, Homo sapiens
tccggaagtaaatacagca

SEQ ID NO: 3802063 - DNA, 22 bp, Homo sapiens
tccggaagtaaatacagcaatt

SEQ ID NO: 3802064 - DNA, 23 bp, Homo sapiens
tccttcacgaggaatctgggcct

SEQ ID NO: 3802065 - DNA, 16 bp, Homo sapiens
tcgggagtttgagacc

SEQ ID NO: 3802066 - DNA, 17 bp, Homo sapiens
tctgaaaattaacactg

SEQ ID NO: 3802067 - DNA, 20 bp, Homo sapiens
tctgccctggaacctaccag

SEQ ID NO: 3802068 - DNA, 15 bp, Homo sapiens
tctgcctagtctaca

SEQ ID NO: 3802069 - DNA, 13 bp, Homo sapiens
tctgctgtctccc

SEQ ID NO: 3802070 - DNA, 22 bp, Homo sapiens
tctggggactgcattggactga

SEQ ID NO: 3802071 - DNA, 14 bp, Homo sapiens
tcttacaaacatgt

SEQ ID NO: 3802072 - DNA, 14 bp, Homo sapiens
tcttccagaaagca

SEQ ID NO: 3802073 - DNA, 13 bp, Homo sapiens
tcttccccaccct

SEQ ID NO: 3802074 - DNA, 14 bp, Homo sapiens
tcttgttcactgca

SEQ ID NO: 3802075 - DNA, 16 bp, Homo sapiens
tgaaaaagtaggctgc

SEQ ID NO: 3802076 - DNA, 18 bp, Homo sapiens
tgaaaatgcaacaacatg

SEQ ID NO: 3802077 - DNA, 21 bp, Homo sapiens
tgaaaatgcaacaacatgtat

SEQ ID NO: 3802078 - DNA, 16 bp, Homo sapiens
tgaaaattaacactgc

SEQ ID NO: 3802079 - DNA, 19 bp, Homo sapiens
tgaaacccacagtttgaga

SEQ ID NO: 3802080 - DNA, 21 bp, Homo sapiens
tgaaacccacagtttgagacc

SEQ ID NO: 3802081 - DNA, 13 bp, Homo sapiens
tgaaggtttctga

SEQ ID NO: 3802082 - DNA, 13 bp, Homo sapiens
tgacagaacactg

SEQ ID NO: 3802083 - DNA, 14 bp, Homo sapiens
tgacagaacactgt

SEQ ID NO: 3802084 - DNA, 15 bp, Homo sapiens
tgacctcccagcctt

SEQ ID NO: 3802085 - DNA, 17 bp, Homo sapiens
tgaccttctaggaagct

SEQ ID NO: 3802086 - DNA, 15 bp, Homo sapiens
tgacttaggaggctg

SEQ ID NO: 3802087 - DNA, 16 bp, Homo sapiens
tgacttaggaggctga

SEQ ID NO: 3802088 - DNA, 16 bp, Homo sapiens
tgagaccctgtctcta

SEQ ID NO: 3802089 - DNA, 14 bp, Homo sapiens
tgaggcaggagaat

SEQ ID NO: 3802090 - DNA, 14 bp, Homo sapiens
tgaggtcaagaaat

SEQ ID NO: 3802091 - DNA, 15 bp, Homo sapiens
tgaggtcaagaaatg

SEQ ID NO: 3802092 - DNA, 13 bp, Homo sapiens
tgaggtgggagga

SEQ ID NO: 3802093 - DNA, 21 bp, Homo sapiens
tgatcaatctgcagtttgtga

SEQ ID NO: 3802094 - DNA, 21 bp, Homo sapiens
tgatcccttccccctgctgat

SEQ ID NO: 3802095 - DNA, 23 bp, Homo sapiens
tgatcccttccccctgctgatca

SEQ ID NO: 3802096 - DNA, 18 bp, Homo sapiens
tgatgtgggtcaaggaat

SEQ ID NO: 3802097 - DNA, 13 bp, Homo sapiens
tgcaacaacatgt

SEQ ID NO: 3802098 - DNA, 12 bp, Homo sapiens
tgcactccagcc

SEQ ID NO: 3802099 - DNA, 17 bp, Homo sapiens
tgcactccagcctgggc

SEQ ID NO: 3802100 - DNA, 20 bp, Homo sapiens
tgcagatcccagcccaccct

SEQ ID NO: 3802101 - DNA, 14 bp, Homo sapiens
tgcagcatgcccag

SEQ ID NO: 3802102 - DNA, 21 bp, Homo sapiens
tgccacgcacaggtgctgacc

SEQ ID NO: 3802103 - DNA, 15 bp, Homo sapiens
tgccagcttgtgagc

SEQ ID NO: 3802104 - DNA, 19 bp, Homo sapiens
tgccagtcttccagaaagc

SEQ ID NO: 3802105 - DNA, 20 bp, Homo sapiens
tgccatggacagaagaaggc

SEQ ID NO: 3802106 - DNA, 23 bp, Homo sapiens
tgccatggacagaagaaggcagc

SEQ ID NO: 3802107 - DNA, 15 bp, Homo sapiens
tgcccatcccacccc

SEQ ID NO: 3802108 - DNA, 18 bp, Homo sapiens
tgcccctttcttccccac

SEQ ID NO: 3802109 - DNA, 18 bp, Homo sapiens
tgcccttcattcagcctt

SEQ ID NO: 3802110 - DNA, 13 bp, Homo sapiens
tgccgccaccacg

SEQ ID NO: 3802111 - DNA, 17 bp, Homo sapiens
tgcttaacatttgttga

SEQ ID NO: 3802112 - DNA, 18 bp, Homo sapiens
tgcttaacatttgttgaa

SEQ ID NO: 3802113 - DNA, 12 bp, Homo sapiens
tggacagaagaa

SEQ ID NO: 3802114 - DNA, 19 bp, Homo sapiens
tggagaaaccctgtctcta

SEQ ID NO: 3802115 - DNA, 20 bp, Homo sapiens
tggaggagctcaggacacta

SEQ ID NO: 3802116 - DNA, 20 bp, Homo sapiens
tggcccagcactgcccatcc

SEQ ID NO: 3802117 - DNA, 14 bp, Homo sapiens
tggccttgaagtgt

SEQ ID NO: 3802118 - DNA, 15 bp, Homo sapiens
tggccttgaagtgtt

SEQ ID NO: 3802119 - DNA, 14 bp, Homo sapiens
tgggcctcttattt

SEQ ID NO: 3802120 - DNA, 17 bp, Homo sapiens
tggggactgcattggac

SEQ ID NO: 3802121 - DNA, 22 bp, Homo sapiens
tgggtaggcaggtgtcttggac

SEQ ID NO: 3802122 - DNA, 18 bp, Homo sapiens
tggtctggctctgctgga

SEQ ID NO: 3802123 - DNA, 15 bp, Homo sapiens
ctgcagtttgtgaac

SEQ ID NO: 3802124 - DNA, 18 bp, Homo sapiens
ctgcagtttgtgaacttc

SEQ ID NO: 3802125 - DNA, 21 bp, Homo sapiens
ctgcatggtgggagctggttg

SEQ ID NO: 3802126 - DNA, 16 bp, Homo sapiens
ctgccagcttgtgagc

SEQ ID NO: 3802127 - DNA, 13 bp, Homo sapiens
ctgccagttgaag

SEQ ID NO: 3802128 - DNA, 17 bp, Homo sapiens
ctgcccatcccacccca

SEQ ID NO: 3802129 - DNA, 18 bp, Homo sapiens
ctgcccatcccaccccat

SEQ ID NO: 3802130 - DNA, 18 bp, Homo sapiens
ctgcccctttcttcccca

SEQ ID NO: 3802131 - DNA, 20 bp, Homo sapiens
ctgcccctttcttccccacc

SEQ ID NO: 3802132 - DNA, 11 bp, Homo sapiens
ctgccgccacc

SEQ ID NO: 3802133 - DNA, 14 bp, Homo sapiens
ctgccgccaccacg

SEQ ID NO: 3802134 - DNA, 10 bp, Homo sapiens
ctgctgatca

SEQ ID NO: 3802135 - DNA, 22 bp, Homo sapiens
ctgctgatcaatctgcagtttg

SEQ ID NO: 3802136 - DNA, 12 bp, Homo sapiens
ctgctgtctccc

SEQ ID NO: 3802137 - DNA, 13 bp, Homo sapiens
ctggtggctgcca

SEQ ID NO: 3802138 - DNA, 14 bp, Homo sapiens
ctggtggctgccag

SEQ ID NO: 3802139 - DNA, 14 bp, Homo sapiens
ctgtaatcccagca

SEQ ID NO: 3802140 - DNA, 20 bp, Homo sapiens
ctgtaatcccagcactttgg

SEQ ID NO: 3802141 - DNA, 22 bp, Homo sapiens
ctgtaatcccagcactttggga

SEQ ID NO: 3802142 - DNA, 14 bp, Homo sapiens
ctgtaatcccagct

SEQ ID NO: 3802143 - DNA, 14 bp, Homo sapiens
cttagctctgccct

SEQ ID NO: 3802144 - DNA, 17 bp, Homo sapiens
cttatttcgtttctggg

SEQ ID NO: 3802145 - DNA, 15 bp, Homo sapiens
cttcaatttcccacc

SEQ ID NO: 3802146 - DNA, 18 bp, Homo sapiens
cttcaatttcccacccat

SEQ ID NO: 3802147 - DNA, 15 bp, Homo sapiens
cttccagaaagcaag

SEQ ID NO: 3802148 - DNA, 21 bp, Homo sapiens
cttggaaactggatgaggtca

SEQ ID NO: 3802149 - DNA, 20 bp, Homo sapiens
cttggacccacctgaaatgc

SEQ ID NO: 3802150 - DNA, 19 bp, Homo sapiens
cttggcccagcactgccca

SEQ ID NO: 3802151 - DNA, 15 bp, Homo sapiens
cttgtgagctatcta

SEQ ID NO: 3802152 - DNA, 16 bp, Homo sapiens
cttgttcactgcagca

SEQ ID NO: 3802153 - DNA, 17 bp, Homo sapiens
ctttagtaaatgaaact

SEQ ID NO: 3802154 - DNA, 18 bp, Homo sapiens
ctttattaacaaacagga

SEQ ID NO: 3802155 - DNA, 15 bp, Homo sapiens
ctttcttccccaccc

SEQ ID NO: 3802156 - DNA, 20 bp, Homo sapiens
ctttgggaggccaaggcggg

SEQ ID NO: 3802157 - DNA, 16 bp, Homo sapiens
ctttgggatcttgaag

SEQ ID NO: 3802158 - DNA, 18 bp, Homo sapiens
ctttgggatcttgaagaa

SEQ ID NO: 3802159 - DNA, 17 bp, Homo sapiens
cttttatttcttaaaca

SEQ ID NO: 3802160 - DNA, 16 bp, Homo sapiens
gaaaaagtaggctgcc

SEQ ID NO: 3802161 - DNA, 11 bp, Homo sapiens
gaaaaggcagg

SEQ ID NO: 3802162 - DNA, 21 bp, Homo sapiens
gaaaccattatgaagaagaga

SEQ ID NO: 3802163 - DNA, 15 bp, Homo sapiens
gaaagcaaggactgc

SEQ ID NO: 3802164 - DNA, 15 bp, Homo sapiens
gaaattgattttgaa

SEQ ID NO: 3802165 - DNA, 17 bp, Homo sapiens
gaactagattataagcc

SEQ ID NO: 3802166 - DNA, 15 bp, Homo sapiens
gaacttcacaagaat

SEQ ID NO: 3802167 - DNA, 18 bp, Homo sapiens
gaacttcacaagaatggt

SEQ ID NO: 3802168 - DNA, 15 bp, Homo sapiens
gaagatttgtctact

SEQ ID NO: 3802169 - DNA, 18 bp, Homo sapiens
gaataggggaaagaaatt

SEQ ID NO: 3802170 - DNA, 12 bp, Homo sapiens
gacagaaagcaa

SEQ ID NO: 3802171 - DNA, 14 bp, Homo sapiens
gacagaacactgtc

SEQ ID NO: 3802172 - DNA, 19 bp, Homo sapiens
gaccaacatggagaaaccc

SEQ ID NO: 3802173 - DNA, 14 bp, Homo sapiens
gaccagcctgggca

SEQ ID NO: 3802174 - DNA, 15 bp, Homo sapiens
gaccttctaggaagc

SEQ ID NO: 3802175 - DNA, 17 bp, Homo sapiens
gactctggtggctgcca

SEQ ID NO: 3802176 - DNA, 20 bp, Homo sapiens
gacttcaatttcccacccat

SEQ ID NO: 3802177 - DNA, 23 bp, Homo sapiens
gacttcaatttcccacccatctc

SEQ ID NO: 3802178 - DNA, 15 bp, Homo sapiens
gagaccagcctgggc

SEQ ID NO: 3802179 - DNA, 16 bp, Homo sapiens
gagcttagctctgccc

SEQ ID NO: 3802180 - DNA, 18 bp, Homo sapiens
gaggagctcaggacacta

SEQ ID NO: 3802181 - DNA, 15 bp, Homo sapiens
gaggctgaggcagga

SEQ ID NO: 3802182 - DNA, 23 bp, Homo sapiens
gagggctccctgctccctccctc

SEQ ID NO: 3802183 - DNA, 20 bp, Homo sapiens
gaggtcgggagtttgagacc

SEQ ID NO: 3802184 - DNA, 23 bp, Homo sapiens
gagttgacttgacagaacactgt

SEQ ID NO: 3802185 - DNA, 13 bp, Homo sapiens
gatcccagcccac

SEQ ID NO: 3802186 - DNA, 20 bp, Homo sapiens
gatcccttccccctgctgat

SEQ ID NO: 3802187 - DNA, 16 bp, Homo sapiens
gatgggcccaattctt

SEQ ID NO: 3802188 - DNA, 22 bp, Homo sapiens
gattgcgtggaattgtgctgag

SEQ ID NO: 3802189 - DNA, 21 bp, Homo sapiens
gcactgcccatcccaccccat

SEQ ID NO: 3802190 - DNA, 15 bp, Homo sapiens
gcagatcccagccca

SEQ ID NO: 3802191 - DNA, 14 bp, Homo sapiens
gcagcatgcccagt

SEQ ID NO: 3802192 - DNA, 14 bp, Homo sapiens
gcatatcacttgat

SEQ ID NO: 3802193 - DNA, 16 bp, Homo sapiens
gccacgcacaggtgct

SEQ ID NO: 3802194 - DNA, 17 bp, Homo sapiens
gccaggaaaccctcttc

SEQ ID NO: 3802195 - DNA, 14 bp, Homo sapiens
gccagtaatcccag

SEQ ID NO: 3802196 - DNA, 16 bp, Homo sapiens
gccagtcttccagaaa

SEQ ID NO: 3802197 - DNA, 19 bp, Homo sapiens
gccagtgatgctaaaggtt

SEQ ID NO: 3802198 - DNA, 20 bp, Homo sapiens
gccagtgatgctaaaggttg

SEQ ID NO: 3802199 - DNA, 17 bp, Homo sapiens
gcccctttcttccccac

SEQ ID NO: 3802200 - DNA, 14 bp, Homo sapiens
gccctgacccttcc

SEQ ID NO: 3802201 - DNA, 15 bp, Homo sapiens
gccctgacccttcca

SEQ ID NO: 3802202 - DNA, 12 bp, Homo sapiens
gccgccaccacg

SEQ ID NO: 3802203 - DNA, 20 bp, Homo sapiens
gcctgggcaacaagagcgaa

SEQ ID NO: 3802204 - DNA, 14 bp, Homo sapiens
gcctgtaatcccag

SEQ ID NO: 3802205 - DNA, 15 bp, Homo sapiens
gcctgtaatcccagc

SEQ ID NO: 3802206 - DNA, 17 bp, Homo sapiens
gcctgtaatcccagcac

SEQ ID NO: 3802207 - DNA, 21 bp, Homo sapiens
gcctgtaatcccagcactttg

SEQ ID NO: 3802208 - DNA, 11 bp, Homo sapiens
gccttgaagtg

SEQ ID NO: 3802209 - DNA, 16 bp, Homo sapiens
gcgggcggatcacctg

SEQ ID NO: 3802210 - DNA, 18 bp, Homo sapiens
gcggtggctcacgcctgt

SEQ ID NO: 3802211 - DNA, 21 bp, Homo sapiens
gctaactagcttggaaactgg

SEQ ID NO: 3802212 - DNA, 19 bp, Homo sapiens
gctactagggaggctgagg

SEQ ID NO: 3802213 - DNA, 22 bp, Homo sapiens
gctatttttatttgtttgtgca

SEQ ID NO: 3802214 - DNA, 17 bp, Homo sapiens
gctcacgcctgtaatcc

SEQ ID NO: 3802215 - DNA, 22 bp, Homo sapiens
gctcacgcctgtaatcccagca

SEQ ID NO: 3802216 - DNA, 13 bp, Homo sapiens
gctcagccccacg

SEQ ID NO: 3802217 - DNA, 23 bp, Homo sapiens
gctcaggccagtaatcccagtga

SEQ ID NO: 3802218 - DNA, 17 bp, Homo sapiens
gctccctgctccctccc

SEQ ID NO: 3802219 - DNA, 19 bp, Homo sapiens
gctgacctatagtaagtgc

SEQ ID NO: 3802220 - DNA, 13 bp, Homo sapiens
gctgagttggtgt

SEQ ID NO: 3802221 - DNA, 14 bp, Homo sapiens
gctgggcatggtcg

SEQ ID NO: 3802222 - DNA, 14 bp, Homo sapiens
ggaggctgaggcag

SEQ ID NO: 3802223 - DNA, 23 bp, Homo sapiens
ggatcttgaagaagctcttttgg

SEQ ID NO: 3802224 - DNA, 13 bp, Homo sapiens
ggatgcagcatta

SEQ ID NO: 3802225 - DNA, 20 bp, Homo sapiens
ggcaacaagagcgaaactcc

SEQ ID NO: 3802226 - DNA, 21 bp, Homo sapiens
ggcccagcactgcccatccca

SEQ ID NO: 3802227 - DNA, 21 bp, Homo sapiens
ggctcacgcctgtaatcccag

SEQ ID NO: 3802228 - DNA, 12 bp, Homo sapiens
ggctgaggcagg

SEQ ID NO: 3802229 - DNA, 14 bp, Homo sapiens
ggctgaggctgccc

SEQ ID NO: 3802230 - DNA, 18 bp, Homo sapiens
gggactctggtggctgcc

SEQ ID NO: 3802231 - DNA, 19 bp, Homo sapiens
gggttacttgctgctcaca

SEQ ID NO: 3802232 - DNA, 19 bp, Homo sapiens
ggtcgctcaggccagtaat

SEQ ID NO: 3802233 - DNA, 17 bp, Homo sapiens
ggtgttgacatgtgctt

SEQ ID NO: 3802234 - DNA, 15 bp, Homo sapiens
ggtttgaatataaac

SEQ ID NO: 3802235 - DNA, 14 bp, Homo sapiens
ggtttgcaaggaag

SEQ ID NO: 3802236 - DNA, 14 bp, Homo sapiens
gtaaatacagcaat

SEQ ID NO: 3802237 - DNA, 20 bp, Homo sapiens
gtaatcccagcactttggga

SEQ ID NO: 3802238 - DNA, 20 bp, Homo sapiens
gtaatcccagctactaggga

SEQ ID NO: 3802239 - DNA, 19 bp, Homo sapiens
acctaggtcgccagtgaaa

SEQ ID NO: 3802240 - DNA, 21 bp, Homo sapiens
acctaggtcgccagtgaaata

SEQ ID NO: 3802241 - DNA, 23 bp, Homo sapiens
acctaggtcgccagtgaaataga

SEQ ID NO: 3802242 - DNA, 21 bp, Homo sapiens
acgtgttatattccatactta

SEQ ID NO: 3802243 - DNA, 17 bp, Homo sapiens
actacaatttaaagcaa

SEQ ID NO: 3802244 - DNA, 16 bp, Homo sapiens
actagggaggctgagg

SEQ ID NO: 3802245 - DNA, 19 bp, Homo sapiens
actagggaggctgaggcag

SEQ ID NO: 3802246 - DNA, 21 bp, Homo sapiens
actcattgcagatcccagccc

SEQ ID NO: 3802247 - DNA, 12 bp, Homo sapiens
actccagcctgg

SEQ ID NO: 3802248 - DNA, 14 bp, Homo sapiens
actgacagaaagca

SEQ ID NO: 3802249 - DNA, 16 bp, Homo sapiens
actgcttgtgttttta

SEQ ID NO: 3802250 - DNA, 17 bp, Homo sapiens
acttcaatttcccaccc

SEQ ID NO: 3802251 - DNA, 19 bp, Homo sapiens
acttcaatttcccacccat

SEQ ID NO: 3802252 - DNA, 14 bp, Homo sapiens
acttcacaagaatg

SEQ ID NO: 3802253 - DNA, 16 bp, Homo sapiens
agaaaccctgtctcta

SEQ ID NO: 3802254 - DNA, 18 bp, Homo sapiens
agaaagacagagctggga

SEQ ID NO: 3802255 - DNA, 21 bp, Homo sapiens
agaagaaggcagcaggtggca

SEQ ID NO: 3802256 - DNA, 20 bp, Homo sapiens
agaagggttacttgctgctc

SEQ ID NO: 3802257 - DNA, 12 bp, Homo sapiens
agaccagcctgg

SEQ ID NO: 3802258 - DNA, 22 bp, Homo sapiens
agactggagggttgagacccag

SEQ ID NO: 3802259 - DNA, 23 bp, Homo sapiens
agcaaaggagtagaaagacagag

SEQ ID NO: 3802260 - DNA, 22 bp, Homo sapiens
agcaattaataatgtttataag

SEQ ID NO: 3802261 - DNA, 16 bp, Homo sapiens
agcactgcccatccca

SEQ ID NO: 3802262 - DNA, 13 bp, Homo sapiens
agccaaacaggag

SEQ ID NO: 3802263 - DNA, 14 bp, Homo sapiens
agcccaaagaagga

SEQ ID NO: 3802264 - DNA, 16 bp, Homo sapiens
agcccaaagaaggaaa

SEQ ID NO: 3802265 - DNA, 13 bp, Homo sapiens
agccttgctgacc

SEQ ID NO: 3802266 - DNA, 21 bp, Homo sapiens
agccttgctgacctcccagcc

SEQ ID NO: 3802267 - DNA, 13 bp, Homo sapiens
agctccagttcga

SEQ ID NO: 3802268 - DNA, 18 bp, Homo sapiens
agctctgccctggaacct

SEQ ID NO: 3802269 - DNA, 17 bp, Homo sapiens
agctgggatgtttctgt

SEQ ID NO: 3802270 - DNA, 21 bp, Homo sapiens
agctggtggtatctgagttga

SEQ ID NO: 3802271 - DNA, 20 bp, Homo sapiens
aggaaagggttcacataggc

SEQ ID NO: 3802272 - DNA, 14 bp, Homo sapiens
aggaactagattat

SEQ ID NO: 3802273 - DNA, 18 bp, Homo sapiens
aggaagatttgtctactt

SEQ ID NO: 3802274 - DNA, 15 bp, Homo sapiens
aggaagccacagctg

SEQ ID NO: 3802275 - DNA, 16 bp, Homo sapiens
aggaagccacagctgg

SEQ ID NO: 3802276 - DNA, 18 bp, Homo sapiens
aggaagccacagctggtg

SEQ ID NO: 3802277 - DNA, 20 bp, Homo sapiens
aggagaatcactcgaacccg

SEQ ID NO: 3802278 - DNA, 14 bp, Homo sapiens
aggagacccacagg

SEQ ID NO: 3802279 - DNA, 16 bp, Homo sapiens
aggaggctgaggtggg

SEQ ID NO: 3802280 - DNA, 18 bp, Homo sapiens
aggccagtaatcccagtg

SEQ ID NO: 3802281 - DNA, 15 bp, Homo sapiens
aggctctcaggtgcc

SEQ ID NO: 3802282 - DNA, 13 bp, Homo sapiens
aggctgaggctgc

SEQ ID NO: 3802283 - DNA, 15 bp, Homo sapiens
aggctgaggctgccc

SEQ ID NO: 3802284 - DNA, 19 bp, Homo sapiens
aggctgccctgacccttcc

SEQ ID NO: 3802285 - DNA, 13 bp, Homo sapiens
agggaagttttgt

SEQ ID NO: 3802286 - DNA, 21 bp, Homo sapiens
agggagaagactatattgtac

SEQ ID NO: 3802287 - DNA, 20 bp, Homo sapiens
agggctccctgctccctccc

SEQ ID NO: 3802288 - DNA, 19 bp, Homo sapiens
agggttcacataggctctc

SEQ ID NO: 3802289 - DNA, 22 bp, Homo sapiens
aggtatgaccttctaggaagct

SEQ ID NO: 3802290 - DNA, 18 bp, Homo sapiens
aggtcaagaaatgtgact

SEQ ID NO: 3802291 - DNA, 21 bp, Homo sapiens
aggtcaagaaatgtgacttgg

SEQ ID NO: 3802292 - DNA, 21 bp, Homo sapiens
aggtttaaggctgaggctgcc

SEQ ID NO: 3802293 - DNA, 14 bp, Homo sapiens
aggtttctgaaaat

SEQ ID NO: 3802294 - DNA, 18 bp, Homo sapiens
agtactgacagaaagcaa

SEQ ID NO: 3802295 - DNA, 20 bp, Homo sapiens
agtagaaagacagagctggg

SEQ ID NO: 3802296 - DNA, 21 bp, Homo sapiens
agtccatatttcaatttccaa

SEQ ID NO: 3802297 - DNA, 23 bp, Homo sapiens
agtccatatttcaatttccaaga

SEQ ID NO: 3802298 - DNA, 23 bp, Homo sapiens
agtctacagtactgacagaaagc

SEQ ID NO: 3802299 - DNA, 15 bp, Homo sapiens
agtcttccagaaagc

SEQ ID NO: 3802300 - DNA, 13 bp, Homo sapiens
agtgagagtttgg

SEQ ID NO: 3802301 - DNA, 21 bp, Homo sapiens
agtgccacgcacaggtgctga

SEQ ID NO: 3802302 - DNA, 13 bp, Homo sapiens
agtgtcttgttca

SEQ ID NO: 3802303 - DNA, 14 bp, Homo sapiens
agttctgctgtctc

SEQ ID NO: 3802304 - DNA, 16 bp, Homo sapiens
agttctgctgtctccc

SEQ ID NO: 3802305 - DNA, 19 bp, Homo sapiens
agtttgagaccagcccgac

SEQ ID NO: 3802306 - DNA, 11 bp, Homo sapiens
agtttgtgaac

SEQ ID NO: 3802307 - DNA, 18 bp, Homo sapiens
ataagccttatgaggtca

SEQ ID NO: 3802308 - DNA, 14 bp, Homo sapiens
ataatatttttaat

SEQ ID NO: 3802309 - DNA, 13 bp, Homo sapiens
atactgtcaagcc

SEQ ID NO: 3802310 - DNA, 17 bp, Homo sapiens
atactgtcaagccctat

SEQ ID NO: 3802311 - DNA, 14 bp, Homo sapiens
atagccaaacagga

SEQ ID NO: 3802312 - DNA, 15 bp, Homo sapiens
atataaacactatat

SEQ ID NO: 3802313 - DNA, 11 bp, Homo sapiens
atattttaatt

SEQ ID NO: 3802314 - DNA, 18 bp, Homo sapiens
atattttccatgaaaatg

SEQ ID NO: 3802315 - DNA, 20 bp, Homo sapiens
atcaatctgcagtttgtgaa

SEQ ID NO: 3802316 - DNA, 17 bp, Homo sapiens
atcccagcccaccctgc

SEQ ID NO: 3802317 - DNA, 14 bp, Homo sapiens
atgatcccttcccc

SEQ ID NO: 3802318 - DNA, 19 bp, Homo sapiens
atgatcccttccccctgct

SEQ ID NO: 3802319 - DNA, 14 bp, Homo sapiens
atgcaacaacatgt

SEQ ID NO: 3802320 - DNA, 21 bp, Homo sapiens
atgcaacaacatgtataatat

SEQ ID NO: 3802321 - DNA, 15 bp, Homo sapiens
atgcagtatcatctg

SEQ ID NO: 3802322 - DNA, 17 bp, Homo sapiens
atgccatggacagaaga

SEQ ID NO: 3802323 - DNA, 16 bp, Homo sapiens
atggagaaaccctgtc

SEQ ID NO: 3802324 - DNA, 15 bp, Homo sapiens
atggcagtgtctttc

SEQ ID NO: 3802325 - DNA, 18 bp, Homo sapiens
atggccttgaagtgtttt

SEQ ID NO: 3802326 - DNA, 21 bp, Homo sapiens
atggtttgaatataaacacta

SEQ ID NO: 3802327 - DNA, 22 bp, Homo sapiens
atggtttgaatataaacactat

SEQ ID NO: 3802328 - DNA, 23 bp, Homo sapiens
atgtataatatttttaattaaat

SEQ ID NO: 3802329 - DNA, 17 bp, Homo sapiens
atgtgacttggccgggc

SEQ ID NO: 3802330 - DNA, 21 bp, Homo sapiens
attatgatgtgggtcaaggaa

SEQ ID NO: 3802331 - DNA, 17 bp, Homo sapiens
attcttacaaacatgtg

SEQ ID NO: 3802332 - DNA, 17 bp, Homo sapiens
attgcagatcccagccc

SEQ ID NO: 3802333 - DNA, 23 bp, Homo sapiens
attgtctttattaacaaacagga

SEQ ID NO: 3802334 - DNA, 21 bp, Homo sapiens
atttcaatttccaagagctga

SEQ ID NO: 3802335 - DNA, 18 bp, Homo sapiens
atttgtctacttgctcca

SEQ ID NO: 3802336 - DNA, 15 bp, Homo sapiens
attttccatgaaaat

SEQ ID NO: 3802337 - DNA, 22 bp, Homo sapiens
caaaaaaaaaaaagtgtcttgt

SEQ ID NO: 3802338 - DNA, 12 bp, Homo sapiens
caaacaccttca

SEQ ID NO: 3802339 - DNA, 23 bp, Homo sapiens
caaacaccttcagtgctggtggc

SEQ ID NO: 3802340 - DNA, 20 bp, Homo sapiens
caaacatgtggttaatgcca

SEQ ID NO: 3802341 - DNA, 14 bp, Homo sapiens
caacaagagcgaaa

SEQ ID NO: 3802342 - DNA, 15 bp, Homo sapiens
caacatagtgagacc

SEQ ID NO: 3802343 - DNA, 19 bp, Homo sapiens
caacatgtataatattttt

SEQ ID NO: 3802344 - DNA, 17 bp, Homo sapiens
caagagcgaaactccat

SEQ ID NO: 3802345 - DNA, 20 bp, Homo sapiens
caaggcgggcggatcacctg

SEQ ID NO: 3802346 - DNA, 13 bp, Homo sapiens
caatattttccat

SEQ ID NO: 3802347 - DNA, 15 bp, Homo sapiens
caatattttccatga

SEQ ID NO: 3802348 - DNA, 16 bp, Homo sapiens
caatattttccatgaa

SEQ ID NO: 3802349 - DNA, 20 bp, Homo sapiens
caatattttccatgaaaatg

SEQ ID NO: 3802350 - DNA, 16 bp, Homo sapiens
caatggtttgcaagga

SEQ ID NO: 3802351 - DNA, 17 bp, Homo sapiens
caatggtttgcaaggaa

SEQ ID NO: 3802352 - DNA, 18 bp, Homo sapiens
caatggtttgcaaggaag

SEQ ID NO: 3802353 - DNA, 19 bp, Homo sapiens
caatggtttgcaaggaagc

SEQ ID NO: 3802354 - DNA, 14 bp, Homo sapiens
tgatcccttccccc

SEQ ID NO: 3802355 - DNA, 20 bp, Homo sapiens
tgatcccttccccctgctga

SEQ ID NO: 3802356 - DNA, 17 bp, Homo sapiens
tgatttactctttggga

SEQ ID NO: 3802357 - DNA, 15 bp, Homo sapiens
tgcaacaacatgtat

SEQ ID NO: 3802358 - DNA, 19 bp, Homo sapiens
tgcaaggaagccacagctg

SEQ ID NO: 3802359 - DNA, 15 bp, Homo sapiens
tgcactccagcctgg

SEQ ID NO: 3802360 - DNA, 19 bp, Homo sapiens
tgcagatcccagcccaccc

SEQ ID NO: 3802361 - DNA, 21 bp, Homo sapiens
tgcagatcccagcccaccctg

SEQ ID NO: 3802362 - DNA, 20 bp, Homo sapiens
tgcaggacttgcacacaggg

SEQ ID NO: 3802363 - DNA, 13 bp, Homo sapiens
tgcagtttgtgaa

SEQ ID NO: 3802364 - DNA, 14 bp, Homo sapiens
tgcagtttgtgaac

SEQ ID NO: 3802365 - DNA, 17 bp, Homo sapiens
tgcatagagccacgtat

SEQ ID NO: 3802366 - DNA, 17 bp, Homo sapiens
tgcatatatacatatat

SEQ ID NO: 3802367 - DNA, 13 bp, Homo sapiens
tgcatgaaggttt

SEQ ID NO: 3802368 - DNA, 18 bp, Homo sapiens
tgcatgaaggtttctgaa

SEQ ID NO: 3802369 - DNA, 19 bp, Homo sapiens
tgcatgaaggtttctgaaa

SEQ ID NO: 3802370 - DNA, 21 bp, Homo sapiens
tgcatgaaggtttctgaaaat

SEQ ID NO: 3802371 - DNA, 21 bp, Homo sapiens
tgcatggtgggagctggttga

SEQ ID NO: 3802372 - DNA, 16 bp, Homo sapiens
tgccagcttgtgagct

SEQ ID NO: 3802373 - DNA, 18 bp, Homo sapiens
tgccatggacagaagaag

SEQ ID NO: 3802374 - DNA, 16 bp, Homo sapiens
tgcccatcccacccca

SEQ ID NO: 3802375 - DNA, 19 bp, Homo sapiens
tgcccatcccaccccatga

SEQ ID NO: 3802376 - DNA, 17 bp, Homo sapiens
tgcccctttcttcccca

SEQ ID NO: 3802377 - DNA, 21 bp, Homo sapiens
tgcccctttcttccccaccct

SEQ ID NO: 3802378 - DNA, 15 bp, Homo sapiens
tgccctgacccttcc

SEQ ID NO: 3802379 - DNA, 15 bp, Homo sapiens
tgcctgtaatcccag

SEQ ID NO: 3802380 - DNA, 20 bp, Homo sapiens
tgctgacctatagtaagtgc

SEQ ID NO: 3802381 - DNA, 19 bp, Homo sapiens
tggaggagctcaggacact

SEQ ID NO: 3802382 - DNA, 18 bp, Homo sapiens
tggcacagcccaaagaag

SEQ ID NO: 3802383 - DNA, 23 bp, Homo sapiens
tggcccagcactgcccatcccac

SEQ ID NO: 3802384 - DNA, 17 bp, Homo sapiens
tggctcacgcctgtaat

SEQ ID NO: 3802385 - DNA, 18 bp, Homo sapiens
tgggaggccaaggcgggc

SEQ ID NO: 3802386 - DNA, 19 bp, Homo sapiens
tgggatcttgaagaagctc

SEQ ID NO: 3802387 - DNA, 14 bp, Homo sapiens
tgggatgtttctgt

SEQ ID NO: 3802388 - DNA, 14 bp, Homo sapiens
tgggtaggcaggtg

SEQ ID NO: 3802389 - DNA, 13 bp, Homo sapiens
tgggtcaaggaat

SEQ ID NO: 3802390 - DNA, 23 bp, Homo sapiens
tggtacatgcctgtaatcccagc

SEQ ID NO: 3802391 - DNA, 20 bp, Homo sapiens
tggtcgctcaggccagtaat

SEQ ID NO: 3802392 - DNA, 21 bp, Homo sapiens
tgtctttattaacaaacagga

SEQ ID NO: 3802393 - DNA, 13 bp, Homo sapiens
tgtgacttggccg

SEQ ID NO: 3802394 - DNA, 14 bp, Homo sapiens
tgtggttaatgcca

SEQ ID NO: 3802395 - DNA, 14 bp, Homo sapiens
tgttcactgcagca

SEQ ID NO: 3802396 - DNA, 14 bp, Homo sapiens
tgttgacatgtgct

SEQ ID NO: 3802397 - DNA, 12 bp, Homo sapiens
tgtttttaactc

SEQ ID NO: 3802398 - DNA, 22 bp, Homo sapiens
ttaaacaaatgtatgattacat

SEQ ID NO: 3802399 - DNA, 19 bp, Homo sapiens
ttaacactgcttgtgtttt

SEQ ID NO: 3802400 - DNA, 12 bp, Homo sapiens
ttaactcaatat

SEQ ID NO: 3802401 - DNA, 15 bp, Homo sapiens
ttacaaacatgtggt

SEQ ID NO: 3802402 - DNA, 12 bp, Homo sapiens
ttacttgctgct

SEQ ID NO: 3802403 - DNA, 20 bp, Homo sapiens
ttagctctgccctggaacct

SEQ ID NO: 3802404 - DNA, 15 bp, Homo sapiens
ttataagccttatga

SEQ ID NO: 3802405 - DNA, 20 bp, Homo sapiens
ttatgatgtgggtcaaggaa

SEQ ID NO: 3802406 - DNA, 15 bp, Homo sapiens
ttatgccttttattt

SEQ ID NO: 3802407 - DNA, 22 bp, Homo sapiens
ttcaatggtttgcaaggaagcc

SEQ ID NO: 3802408 - DNA, 23 bp, Homo sapiens
ttcaatggtttgcaaggaagcca

SEQ ID NO: 3802409 - DNA, 17 bp, Homo sapiens
ttcatagccaaacagga

SEQ ID NO: 3802410 - DNA, 13 bp, Homo sapiens
ttccaagagctga

SEQ ID NO: 3802411 - DNA, 14 bp, Homo sapiens
ttcccacccatctc

SEQ ID NO: 3802412 - DNA, 12 bp, Homo sapiens
ttcttccccacc

SEQ ID NO: 3802413 - DNA, 18 bp, Homo sapiens
ttgaagaagctcttttgg

SEQ ID NO: 3802414 - DNA, 15 bp, Homo sapiens
ttgaatataaacact

SEQ ID NO: 3802415 - DNA, 16 bp, Homo sapiens
ttgaatataaacacta

SEQ ID NO: 3802416 - DNA, 18 bp, Homo sapiens
ttgaatataaacactata

SEQ ID NO: 3802417 - DNA, 14 bp, Homo sapiens
ttgacagaacactg

SEQ ID NO: 3802418 - DNA, 15 bp, Homo sapiens
ttgacagaacactgt

SEQ ID NO: 3802419 - DNA, 17 bp, Homo sapiens
ttgacagaacactgtct

SEQ ID NO: 3802420 - DNA, 16 bp, Homo sapiens
ttgagaccagcctggg

SEQ ID NO: 3802421 - DNA, 13 bp, Homo sapiens
ttgcactccagcc

SEQ ID NO: 3802422 - DNA, 13 bp, Homo sapiens
ttgggattaatat

SEQ ID NO: 3802423 - DNA, 15 bp, Homo sapiens
ttgttcactgcagca

SEQ ID NO: 3802424 - DNA, 17 bp, Homo sapiens
tttaaggctgaggctgc

SEQ ID NO: 3802425 - DNA, 20 bp, Homo sapiens
tttatgccttttatttctta

SEQ ID NO: 3802426 - DNA, 15 bp, Homo sapiens
tttatggccttgaag

SEQ ID NO: 3802427 - DNA, 19 bp, Homo sapiens
tttatggccttgaagtgtt

SEQ ID NO: 3802428 - DNA, 21 bp, Homo sapiens
tttcaatggtttgcaaggaag

SEQ ID NO: 3802429 - DNA, 14 bp, Homo sapiens
tttcaatttccaag

SEQ ID NO: 3802430 - DNA, 19 bp, Homo sapiens
tttcaatttccaagagctg

SEQ ID NO: 3802431 - DNA, 19 bp, Homo sapiens
tttcatagccaaacaggag

SEQ ID NO: 3802432 - DNA, 15 bp, Homo sapiens
tttcatattgcttct

SEQ ID NO: 3802433 - DNA, 14 bp, Homo sapiens
tttccaagagctga

SEQ ID NO: 3802434 - DNA, 19 bp, Homo sapiens
tttctaaggctcagcccca

SEQ ID NO: 3802435 - DNA, 23 bp, Homo sapiens
tttgaaaaagtaggctgccgcca

SEQ ID NO: 3802436 - DNA, 19 bp, Homo sapiens
tttgaatataaacactata

SEQ ID NO: 3802437 - DNA, 17 bp, Homo sapiens
tttgagaccagcctggg

SEQ ID NO: 3802438 - DNA, 21 bp, Homo sapiens
tttgcaaggaagccacagctg

SEQ ID NO: 3802439 - DNA, 19 bp, Homo sapiens
tttgcaggacttgcacaca

SEQ ID NO: 3802440 - DNA, 22 bp, Homo sapiens
tttgctaactagcttggaaact

SEQ ID NO: 3802441 - DNA, 18 bp, Homo sapiens
tttggtgatactgtcaag

SEQ ID NO: 3802442 - DNA, 13 bp, Homo sapiens
ttttaactcaata

SEQ ID NO: 3802443 - DNA, 21 bp, Homo sapiens
ttttgaaaaagtaggctgccg

SEQ ID NO: 3802444 - DNA, 15 bp, Homo sapiens
tttttgtgtatttgt

SEQ ID NO: 3802445 - DNA, 17 bp, Homo sapiens
aaaacaatattgtttct

SEQ ID NO: 3802446 - DNA, 14 bp, Homo sapiens
aaaagttgaaatta

SEQ ID NO: 3802447 - DNA, 15 bp, Homo sapiens
aaacaatattgtttc

SEQ ID NO: 3802448 - DNA, 17 bp, Homo sapiens
aaacaatattgtttcta

SEQ ID NO: 3802449 - DNA, 19 bp, Homo sapiens
aaacatcagttactctgaa

SEQ ID NO: 3802450 - DNA, 17 bp, Homo sapiens
aaagacaaattctgttt

SEQ ID NO: 3802451 - DNA, 19 bp, Homo sapiens
aaagacaaattctgtttct

SEQ ID NO: 3802452 - DNA, 14 bp, Homo sapiens
aaagatttcttgag

SEQ ID NO: 3802453 - DNA, 16 bp, Homo sapiens
aaaggcattctctgaa

SEQ ID NO: 3802454 - DNA, 19 bp, Homo sapiens
aaatgactaaaaaacaaag

SEQ ID NO: 3802455 - DNA, 19 bp, Homo sapiens
aaattcacaagttgtgttt

SEQ ID NO: 3802456 - DNA, 21 bp, Homo sapiens
aaattcgctgcaacctgttga

SEQ ID NO: 3802457 - DNA, 15 bp, Homo sapiens
aaattctgtttcttg

SEQ ID NO: 3802458 - DNA, 22 bp, Homo sapiens
aaattgaaaggcattctctgaa

SEQ ID NO: 3802459 - DNA, 21 bp, Homo sapiens
aacatcagttactctgaaggg

SEQ ID NO: 3802460 - DNA, 14 bp, Homo sapiens
aactgcattgagaa

SEQ ID NO: 3802461 - DNA, 12 bp, Homo sapiens
aagacaacatta

SEQ ID NO: 3802462 - DNA, 21 bp, Homo sapiens
aagacaacattaaaacaatat

SEQ ID NO: 3802463 - DNA, 20 bp, Homo sapiens
aagagaatattagctttact

SEQ ID NO: 3802464 - DNA, 12 bp, Homo sapiens
aaggtaaaattg

SEQ ID NO: 3802465 - DNA, 12 bp, Homo sapiens
aagtatactgta

SEQ ID NO: 3802466 - DNA, 14 bp, Homo sapiens
aagtgaatttttct

SEQ ID NO: 3802467 - DNA, 19 bp, Homo sapiens
aagtgaatttttctctaac

SEQ ID NO: 3802468 - DNA, 16 bp, Homo sapiens
aagtttcagttgattt

SEQ ID NO: 3802469 - DNA, 22 bp, Homo sapiens
aatagaaggatgtacatttcca

SEQ ID NO: 3802470 - DNA, 22 bp, Homo sapiens
aatagttcaaagccaagtttat

SEQ ID NO: 3802471 - DNA, 16 bp, Homo sapiens
tctagcaaatgttatg

SEQ ID NO: 3802472 - DNA, 13 bp, Homo sapiens
tctcatctgtgat

SEQ ID NO: 3802473 - DNA, 17 bp, Homo sapiens
tctcatctgtgattccc

SEQ ID NO: 3802474 - DNA, 22 bp, Homo sapiens
tctctaactcagaaacatcagt

SEQ ID NO: 3802475 - DNA, 20 bp, Homo sapiens
gacgtaggaacggtaaattt

SEQ ID NO: 3802476 - DNA, 23 bp, Homo sapiens
gagaactgcatatgtttcgctga

SEQ ID NO: 3802477 - DNA, 23 bp, Homo sapiens
gagaatattagctttactgtttg

SEQ ID NO: 3802478 - DNA, 18 bp, Homo sapiens
gagaattcttacatgttt

SEQ ID NO: 3802479 - DNA, 18 bp, Homo sapiens
gagtggatgatgtttcgt

SEQ ID NO: 3802480 - DNA, 19 bp, Homo sapiens
gagttttgttttaaaatta

SEQ ID NO: 3802481 - DNA, 13 bp, Homo sapiens
gataaagatttct

SEQ ID NO: 3802482 - DNA, 18 bp, Homo sapiens
gataaatcagtggttatt

SEQ ID NO: 3802483 - DNA, 22 bp, Homo sapiens
gatatatgtgtttttcacattt

SEQ ID NO: 3802484 - DNA, 18 bp, Homo sapiens
gatgggtttgacaaggtt

SEQ ID NO: 3802485 - DNA, 18 bp, Homo sapiens
gattttacaattgaaatg

SEQ ID NO: 3802486 - DNA, 19 bp, Homo sapiens
gattttacaattgaaatga

SEQ ID NO: 3802487 - DNA, 13 bp, Homo sapiens
gcatacaatctga

SEQ ID NO: 3802488 - DNA, 21 bp, Homo sapiens
gcatatgtttcgctgatatat

SEQ ID NO: 3802489 - DNA, 16 bp, Homo sapiens
gcatcttactgaaggt

SEQ ID NO: 3802490 - DNA, 15 bp, Homo sapiens
gccaagtttatatac

SEQ ID NO: 3802491 - DNA, 17 bp, Homo sapiens
gccaagtttatatacaa

SEQ ID NO: 3802492 - DNA, 23 bp, Homo sapiens
gcctcctctctcagtttttatat

SEQ ID NO: 3802493 - DNA, 17 bp, Homo sapiens
gctactctgttccttca

SEQ ID NO: 3802494 - DNA, 18 bp, Homo sapiens
gctgatatatgtgttttt

SEQ ID NO: 3802495 - DNA, 14 bp, Homo sapiens
gctgtatcttgttt

SEQ ID NO: 3802496 - DNA, 18 bp, Homo sapiens
gctgtatcttgtttttcc

SEQ ID NO: 3802497 - DNA, 13 bp, Homo sapiens
gctgtattcttct

SEQ ID NO: 3802498 - DNA, 18 bp, Homo sapiens
gcttaatgacactagcta

SEQ ID NO: 3802499 - DNA, 16 bp, Homo sapiens
gctttactgtttgtta

SEQ ID NO: 3802500 - DNA, 16 bp, Homo sapiens
ggatgtacatttccaa

SEQ ID NO: 3802501 - DNA, 21 bp, Homo sapiens
ggtcctttgggaaaggagaag

SEQ ID NO: 3802502 - DNA, 20 bp, Homo sapiens
ggttatttagggaactgctt

SEQ ID NO: 3802503 - DNA, 18 bp, Homo sapiens
gtaactgcattgagaact

SEQ ID NO: 3802504 - DNA, 19 bp, Homo sapiens
gtaactgcattgagaactg

SEQ ID NO: 3802505 - DNA, 21 bp, Homo sapiens
gtaggaacggtaaatttctgt

SEQ ID NO: 3802506 - DNA, 17 bp, Homo sapiens
gtatcaggacgagaatg

SEQ ID NO: 3802507 - DNA, 14 bp, Homo sapiens
gtcacatacaatta

SEQ ID NO: 3802508 - DNA, 17 bp, Homo sapiens
gtgaaatagttcaaagc

SEQ ID NO: 3802509 - DNA, 16 bp, Homo sapiens
gtgaatttttctctaa

SEQ ID NO: 3802510 - DNA, 15 bp, Homo sapiens
gtggatgatgtttcg

SEQ ID NO: 3802511 - DNA, 15 bp, Homo sapiens
gtgtttctagggaaa

SEQ ID NO: 3802512 - DNA, 14 bp, Homo sapiens
gttactctgaaggg

SEQ ID NO: 3802513 - DNA, 22 bp, Homo sapiens
gttgatagcaagtgaatttttc

SEQ ID NO: 3802514 - DNA, 20 bp, Homo sapiens
gtttcgtgaagtatactgta

SEQ ID NO: 3802515 - DNA, 18 bp, Homo sapiens
gtttctagggaaatgaaa

SEQ ID NO: 3802516 - DNA, 14 bp, Homo sapiens
taaaacaatattgt

SEQ ID NO: 3802517 - DNA, 18 bp, Homo sapiens
taaaacaatattgtttct

SEQ ID NO: 3802518 - DNA, 13 bp, Homo sapiens
taaaattgaaagg

SEQ ID NO: 3802519 - DNA, 19 bp, Homo sapiens
taaagacaaagacaaattc

SEQ ID NO: 3802520 - DNA, 23 bp, Homo sapiens
taagcaacatctagcaaatgtta

SEQ ID NO: 3802521 - DNA, 15 bp, Homo sapiens
taatatcaatagaag

SEQ ID NO: 3802522 - DNA, 12 bp, Homo sapiens
taatatgagaat

SEQ ID NO: 3802523 - DNA, 16 bp, Homo sapiens
tacaattgaaatgact

SEQ ID NO: 3802524 - DNA, 21 bp, Homo sapiens
tacatttccaaattcacaagt

SEQ ID NO: 3802525 - DNA, 18 bp, Homo sapiens
tagattaagagatgggtt

SEQ ID NO: 3802526 - DNA, 19 bp, Homo sapiens
tagctttactgtttgttat

SEQ ID NO: 3802527 - DNA, 18 bp, Homo sapiens
tatcactgacacaaaaag

SEQ ID NO: 3802528 - DNA, 16 bp, Homo sapiens
tatcatgcaaatgctg

SEQ ID NO: 3802529 - DNA, 14 bp, Homo sapiens
tatcttgtttttcc

SEQ ID NO: 3802530 - DNA, 14 bp, Homo sapiens
tatgtaactgcatt

SEQ ID NO: 3802531 - DNA, 24 bp, Homo sapiens
tatgtaactgcattgagaactgca

SEQ ID NO: 3802532 - DNA, 12 bp, Homo sapiens
tattacatcttt

SEQ ID NO: 3802533 - DNA, 22 bp, Homo sapiens
tattatcatgcaaatgctgtat

SEQ ID NO: 3802534 - DNA, 18 bp, Homo sapiens
tcaaagccaagtttatat

SEQ ID NO: 3802535 - DNA, 19 bp, Homo sapiens
tcaaaggtagccatcatgg

SEQ ID NO: 3802536 - DNA, 18 bp, Homo sapiens
tcacatacaattattttt

SEQ ID NO: 3802537 - DNA, 17 bp, Homo sapiens
tcacatcctgtgtttct

SEQ ID NO: 3802538 - DNA, 19 bp, Homo sapiens
tcacatcctgtgtttctag

SEQ ID NO: 3802539 - DNA, 19 bp, Homo sapiens
tcactgacacaaaaagtag

SEQ ID NO: 3802540 - DNA, 21 bp, Homo sapiens
tcagaaatttaattcatgttt

SEQ ID NO: 3802541 - DNA, 21 bp, Homo sapiens
tcagatcatttcaaaactcat

SEQ ID NO: 3802542 - DNA, 22 bp, Homo sapiens
tcatttcctatgtaactgcatt

SEQ ID NO: 3802543 - DNA, 13 bp, Homo sapiens
tccactactgcta

SEQ ID NO: 3802544 - DNA, 14 bp, Homo sapiens
tccctcctgctact

SEQ ID NO: 3802545 - DNA, 20 bp, Homo sapiens
tccttcacatcctgtgtttc

SEQ ID NO: 3802546 - DNA, 17 bp, Homo sapiens
tcgtgaagtatactgta

SEQ ID NO: 3802547 - DNA, 15 bp, Homo sapiens
tctaactcagaaaca

SEQ ID NO: 3802548 - DNA, 18 bp, Homo sapiens
tctctaactcagaaacat

SEQ ID NO: 3802549 - DNA, 21 bp, Homo sapiens
tctctaactcagaaacatcag

SEQ ID NO: 3802550 - DNA, 22 bp, Homo sapiens
tctgaagagtgggtttcacaag

SEQ ID NO: 3802551 - DNA, 22 bp, Homo sapiens
tctggcgacagttttccttctc

SEQ ID NO: 3802552 - DNA, 23 bp, Homo sapiens
tcttactgaaggtaaaattgaaa

SEQ ID NO: 3802553 - DNA, 20 bp, Homo sapiens
tcttgtttttccactactgc

SEQ ID NO: 3802554 - DNA, 21 bp, Homo sapiens
tcttgtttttccactactgct

SEQ ID NO: 3802555 - DNA, 13 bp, Homo sapiens
tgaatttttctct

SEQ ID NO: 3802556 - DNA, 20 bp, Homo sapiens
tgagttttgttttaaaatta

SEQ ID NO: 3802557 - DNA, 17 bp, Homo sapiens
tgattccctcctgctac

SEQ ID NO: 3802558 - DNA, 18 bp, Homo sapiens
tgattccctcctgctact

SEQ ID NO: 3802559 - DNA, 14 bp, Homo sapiens
tgcatcttactgaa

SEQ ID NO: 3802560 - DNA, 18 bp, Homo sapiens
tgcatcttactgaaggta

SEQ ID NO: 3802561 - DNA, 22 bp, Homo sapiens
tgcatcttactgaaggtaaaat

SEQ ID NO: 3802562 - DNA, 15 bp, Homo sapiens
tgcattgagaactgc

SEQ ID NO: 3802563 - DNA, 22 bp, Homo sapiens
tgcgaatggttccattctctct

SEQ ID NO: 3802564 - DNA, 15 bp, Homo sapiens
tgctactctgttcct

SEQ ID NO: 3802565 - DNA, 12 bp, Homo sapiens
tggatgatgttt

SEQ ID NO: 3802566 - DNA, 17 bp, Homo sapiens
tggatgatgtttcgtga

SEQ ID NO: 3802567 - DNA, 16 bp, Homo sapiens
tggctatttaaagaca

SEQ ID NO: 3802568 - DNA, 21 bp, Homo sapiens
tgggagaattcttacatgttt

SEQ ID NO: 3802569 - DNA, 16 bp, Homo sapiens
tgtcctttttgttatt

SEQ ID NO: 3802570 - DNA, 18 bp, Homo sapiens
tgttatggcttaatgaca

SEQ ID NO: 3802571 - DNA, 19 bp, Homo sapiens
tgtttcgtgaagtatactg

SEQ ID NO: 3802572 - DNA, 20 bp, Homo sapiens
tgtttcgtgaagtatactgt

SEQ ID NO: 3802573 - DNA, 15 bp, Homo sapiens
tgtttctagggaaat

SEQ ID NO: 3802574 - DNA, 13 bp, Homo sapiens
tgtttttcacatt

SEQ ID NO: 3802575 - DNA, 15 bp, Homo sapiens
ttaaatataatatgc

SEQ ID NO: 3802576 - DNA, 14 bp, Homo sapiens
ttaattcatgtttc

SEQ ID NO: 3802577 - DNA, 12 bp, Homo sapiens
ttacatgttttc

SEQ ID NO: 3802578 - DNA, 22 bp, Homo sapiens
ttacatgttttctttgctttaa

SEQ ID NO: 3802579 - DNA, 13 bp, Homo sapiens
ttacctgtgaaat

SEQ ID NO: 3802580 - DNA, 13 bp, Homo sapiens
ttactctgaaggg

SEQ ID NO: 3802581 - DNA, 19 bp, Homo sapiens
ttactgaaggtaaaattga

SEQ ID NO: 3802582 - DNA, 20 bp, Homo sapiens
ttactgaaggtaaaattgaa

SEQ ID NO: 3802583 - DNA, 15 bp, Homo sapiens
ttactgtttgttatg

SEQ ID NO: 3802584 - DNA, 13 bp, Homo sapiens
ttagccacaaaat

SEQ ID NO: 3802585 - DNA, 17 bp, Homo sapiens
ttagctttactgtttgt

SEQ ID NO: 3802586 - DNA, 15 bp, Homo sapiens
ttaggctattcacaa

SEQ ID NO: 3802587 - DNA, 16 bp, Homo sapiens
ttaggctattcacaac

SEQ ID NO: 3802588 - DNA, 12 bp, Homo sapiens
ttattacatctt

SEQ ID NO: 3802589 - DNA, 23 bp, Homo sapiens
ttcaaagccaagtttatatacaa

SEQ ID NO: 3802590 - DNA, 22 bp, Homo sapiens
ttcatcttggtcacatacaatt

SEQ ID NO: 3802591 - DNA, 12 bp, Homo sapiens
ttcatgtttctt

SEQ ID NO: 3802592 - DNA, 18 bp, Homo sapiens
ttcccttttacatactgc

SEQ ID NO: 3802593 - DNA, 18 bp, Homo sapiens
ttcgtgaagtatactgta

SEQ ID NO: 3802594 - DNA, 19 bp, Homo sapiens
ttgaaaggcattctctgaa

SEQ ID NO: 3802595 - DNA, 17 bp, Homo sapiens
ttgcgaatggttccatt

SEQ ID NO: 3802596 - DNA, 19 bp, Homo sapiens
ttgttatggcttaatgaca

SEQ ID NO: 3802597 - DNA, 12 bp, Homo sapiens
aaaacaaagaag

SEQ ID NO: 3802598 - DNA, 15 bp, Homo sapiens
aaaacaatattgttt

SEQ ID NO: 3802599 - DNA, 18 bp, Homo sapiens
aaaacaatattgtttcta

SEQ ID NO: 3802600 - DNA, 16 bp, Homo sapiens
aaaacatccagataca

SEQ ID NO: 3802601 - DNA, 16 bp, Homo sapiens
aaacaatattgtttct

SEQ ID NO: 3802602 - DNA, 16 bp, Homo sapiens
aaacatcagttactct

SEQ ID NO: 3802603 - DNA, 22 bp, Homo sapiens
aaactcatttcctatgtaactg

SEQ ID NO: 3802604 - DNA, 23 bp, Homo sapiens
aaagccaagtttatatacaatta

SEQ ID NO: 3802605 - DNA, 14 bp, Homo sapiens
aaagtagattaaga

SEQ ID NO: 3802606 - DNA, 22 bp, Homo sapiens
aaatgactaaaaaacaaagaag

SEQ ID NO: 3802607 - DNA, 13 bp, Homo sapiens
aaattctgtttct

SEQ ID NO: 3802608 - DNA, 14 bp, Homo sapiens
aaattctgtttctt

SEQ ID NO: 3802609 - DNA, 15 bp, Homo sapiens
aaattgggaaaggag

SEQ ID NO: 3802610 - DNA, 17 bp, Homo sapiens
aaatttaattcatgttt

SEQ ID NO: 3802611 - DNA, 21 bp, Homo sapiens
aacattaaaacaatattgttt

SEQ ID NO: 3802612 - DNA, 17 bp, Homo sapiens
aacggtaaatttctgtg

SEQ ID NO: 3802613 - DNA, 21 bp, Homo sapiens
aactcagaaacatcagttact

SEQ ID NO: 3802614 - DNA, 20 bp, Homo sapiens
aactgcattgagaactgcat

SEQ ID NO: 3802615 - DNA, 15 bp, Homo sapiens
aagacaacattaaaa

SEQ ID NO: 3802616 - DNA, 13 bp, Homo sapiens
aagcagtaactga

SEQ ID NO: 3802617 - DNA, 23 bp, Homo sapiens
aagctgaatacattctgctttca

SEQ ID NO: 3802618 - DNA, 16 bp, Homo sapiens
aaggtaaaattgaaag

SEQ ID NO: 3802619 - DNA, 18 bp, Homo sapiens
aagtatactgtattttta

SEQ ID NO: 3802620 - DNA, 17 bp, Homo sapiens
aagtgaatttttctcta

SEQ ID NO: 3802621 - DNA, 17 bp, Homo sapiens
aagttgaaattaaccat

SEQ ID NO: 3802622 - DNA, 15 bp, Homo sapiens
aatacattctgcttt

SEQ ID NO: 3802623 - DNA, 21 bp, Homo sapiens
aatattagctttactgtttgt

SEQ ID NO: 3802624 - DNA, 14 bp, Homo sapiens
aatcagatcatttc

SEQ ID NO: 3802625 - DNA, 17 bp, Homo sapiens
aatctgaggcctcctct

SEQ ID NO: 3802626 - DNA, 18 bp, Homo sapiens
aattcgctgcaacctgtt

SEQ ID NO: 3802627 - DNA, 12 bp, Homo sapiens
aattctgtttct

SEQ ID NO: 3802628 - DNA, 13 bp, Homo sapiens
aattcttacatgt

SEQ ID NO: 3802629 - DNA, 22 bp, Homo sapiens
aattgaaaggcattctctgaag

SEQ ID NO: 3802630 - DNA, 19 bp, Homo sapiens
aatttaattcatgtttctt

SEQ ID NO: 3802631 - DNA, 20 bp, Homo sapiens
aatttttctctaactcagaa

SEQ ID NO: 3802632 - DNA, 18 bp, Homo sapiens
acaaagacaaattctgtt

SEQ ID NO: 3802633 - DNA, 16 bp, Homo sapiens
acaaattctgtttctt

SEQ ID NO: 3802634 - DNA, 13 bp, Homo sapiens
acaaggttcttcc

SEQ ID NO: 3802635 - DNA, 22 bp, Homo sapiens
acaaggttcttcccttttacat

SEQ ID NO: 3802636 - DNA, 18 bp, Homo sapiens
acaagtgaaaaacatcca

SEQ ID NO: 3802637 - DNA, 18 bp, Homo sapiens
acaattatatcagtcctc

SEQ ID NO: 3802638 - DNA, 18 bp, Homo sapiens
acaattatttttacagtt

SEQ ID NO: 3802639 - DNA, 22 bp, Homo sapiens
acagttttccttctcatctgtg

SEQ ID NO: 3802640 - DNA, 12 bp, Homo sapiens
acatactgctgt

SEQ ID NO: 3802641 - DNA, 15 bp, Homo sapiens
acatcagttactctg

SEQ ID NO: 3802642 - DNA, 18 bp, Homo sapiens
acatcagttactctgaag

SEQ ID NO: 3802643 - DNA, 20 bp, Homo sapiens
acatcagttactctgaaggg

SEQ ID NO: 3802644 - DNA, 23 bp, Homo sapiens
acatcctgtgtttctagggaaat

SEQ ID NO: 3802645 - DNA, 12 bp, Homo sapiens
acatctttcaca

SEQ ID NO: 3802646 - DNA, 13 bp, Homo sapiens
acatctttcacat

SEQ ID NO: 3802647 - DNA, 15 bp, Homo sapiens
acatctttcacattg

SEQ ID NO: 3802648 - DNA, 18 bp, Homo sapiens
acattctgctttcatctt

SEQ ID NO: 3802649 - DNA, 20 bp, Homo sapiens
accagagataatatgagaat

SEQ ID NO: 3802650 - DNA, 20 bp, Homo sapiens
acctaagtttcagttgattt

SEQ ID NO: 3802651 - DNA, 14 bp, Homo sapiens
acctttttccttcc

SEQ ID NO: 3802652 - DNA, 18 bp, Homo sapiens
actatattatcatgcaaa

SEQ ID NO: 3802653 - DNA, 14 bp, Homo sapiens
actcagaaacatca

SEQ ID NO: 3802654 - DNA, 20 bp, Homo sapiens
actctgttccttcacatcct

SEQ ID NO: 3802655 - DNA, 20 bp, Homo sapiens
actgtatttttacctttttc

SEQ ID NO: 3802656 - DNA, 14 bp, Homo sapiens
agaaacatcagtta

SEQ ID NO: 3802657 - DNA, 22 bp, Homo sapiens
agaaatttaattcatgtttctt

SEQ ID NO: 3802658 - DNA, 15 bp, Homo sapiens
agaactgcatatgtt

SEQ ID NO: 3802659 - DNA, 20 bp, Homo sapiens
agaactgcatatgtttcgct

SEQ ID NO: 3802660 - DNA, 17 bp, Homo sapiens
agaaggatgtacatttc

SEQ ID NO: 3802661 - DNA, 23 bp, Homo sapiens
agaatattagctttactgtttgt

SEQ ID NO: 3802662 - DNA, 20 bp, Homo sapiens
agaattcttacatgttttct

SEQ ID NO: 3802663 - DNA, 23 bp, Homo sapiens
agaattcttacatgttttctttg

SEQ ID NO: 3802664 - DNA, 17 bp, Homo sapiens
agacaaattctgtttct

SEQ ID NO: 3802665 - DNA, 22 bp, Homo sapiens
agagaatattagctttactgtt

SEQ ID NO: 3802666 - DNA, 13 bp, Homo sapiens
agataaactcaga

SEQ ID NO: 3802667 - DNA, 19 bp, Homo sapiens
agataaactcagaaattta

SEQ ID NO: 3802668 - DNA, 17 bp, Homo sapiens
agcaaatgttatgcata

SEQ ID NO: 3802669 - DNA, 20 bp, Homo sapiens
agcatgaatttttttcatct

SEQ ID NO: 3802670 - DNA, 13 bp, Homo sapiens
agccatcatggat

SEQ ID NO: 3802671 - DNA, 15 bp, Homo sapiens
agctttactgtttgt

SEQ ID NO: 3802672 - DNA, 14 bp, Homo sapiens
agggaaatgaaaga

SEQ ID NO: 3802673 - DNA, 20 bp, Homo sapiens
agtcagtgcccaactgttat

SEQ ID NO: 3802674 - DNA, 17 bp, Homo sapiens
agtgcccaactgttata

SEQ ID NO: 3802675 - DNA, 18 bp, Homo sapiens
agttttccttctcatctg

SEQ ID NO: 3802676 - DNA, 22 bp, Homo sapiens
agttttccttctcatctgtgat

SEQ ID NO: 3802677 - DNA, 18 bp, Homo sapiens
agttttgttttaaaatta

SEQ ID NO: 3802678 - DNA, 20 bp, Homo sapiens
ataaagatttcttgagtttt

SEQ ID NO: 3802679 - DNA, 19 bp, Homo sapiens
atagcaagtgaatttttct

SEQ ID NO: 3802680 - DNA, 19 bp, Homo sapiens
atatgcacacagtgctttc

SEQ ID NO: 3802681 - DNA, 19 bp, Homo sapiens
atatgtgtttttcacattt

SEQ ID NO: 3802682 - DNA, 20 bp, Homo sapiens
atattagctttactgtttgt

SEQ ID NO: 3802683 - DNA, 21 bp, Homo sapiens
atattagctttactgtttgtt

SEQ ID NO: 3802684 - DNA, 19 bp, Homo sapiens
atattatcatgcaaatgct

SEQ ID NO: 3802685 - DNA, 21 bp, Homo sapiens
atcagtcctctttcaaaggta

SEQ ID NO: 3802686 - DNA, 15 bp, Homo sapiens
atcttgtttttccac

SEQ ID NO: 3802687 - DNA, 21 bp, Homo sapiens
atgatgtttcgtgaagtatac

SEQ ID NO: 3802688 - DNA, 15 bp, Homo sapiens
atgcataaagtcagt

SEQ ID NO: 3802689 - DNA, 18 bp, Homo sapiens
atgcatcttactgaaggt

SEQ ID NO: 3802690 - DNA, 20 bp, Homo sapiens
atgtaactgcattgagaact

SEQ ID NO: 3802691 - DNA, 17 bp, Homo sapiens
atgttatgcataaagtc

SEQ ID NO: 3802692 - DNA, 22 bp, Homo sapiens
atgtttcgctgatatatgtgtt

SEQ ID NO: 3802693 - DNA, 23 bp, Homo sapiens
atgtttcgtgaagtatactgtat

SEQ ID NO: 3802694 - DNA, 15 bp, Homo sapiens
attaaccatagatgt

SEQ ID NO: 3802695 - DNA, 15 bp, Homo sapiens
attacatctttcaca

SEQ ID NO: 3802696 - DNA, 17 bp, Homo sapiens
attagccacaaaattgg

SEQ ID NO: 3802697 - DNA, 13 bp, Homo sapiens
attcatgtttctt

SEQ ID NO: 3802698 - DNA, 15 bp, Homo sapiens
attcatgtttcttaa

SEQ ID NO: 3802699 - DNA, 15 bp, Homo sapiens
attctctctcctgta

SEQ ID NO: 3802700 - DNA, 12 bp, Homo sapiens
attctgtttctt

SEQ ID NO: 3802701 - DNA, 18 bp, Homo sapiens
attgaaaggcattctctg

SEQ ID NO: 3802702 - DNA, 16 bp, Homo sapiens
attgaaatgactaaaa

SEQ ID NO: 3802703 - DNA, 22 bp, Homo sapiens
attgagaactgcatatgtttcg

SEQ ID NO: 3802704 - DNA, 16 bp, Homo sapiens
atttaaagacaaagac

SEQ ID NO: 3802705 - DNA, 15 bp, Homo sapiens
atttaattcatgttt

SEQ ID NO: 3802706 - DNA, 14 bp, Homo sapiens
atttcaaaactcat

SEQ ID NO: 3802707 - DNA, 21 bp, Homo sapiens
atttcttgagttttgttttaa

SEQ ID NO: 3802708 - DNA, 20 bp, Homo sapiens
atttttacctttttccttcc

SEQ ID NO: 3802709 - DNA, 23 bp, Homo sapiens
caaaattgggaaaggagtagaaa

SEQ ID NO: 3802710 - DNA, 14 bp, Homo sapiens
caaagaagacaaca

SEQ ID NO: 3802711 - DNA, 20 bp, Homo sapiens
caaagacaaattctgtttct

SEQ ID NO: 3802712 - DNA, 21 bp, Homo sapiens
caaagacaaattctgtttctt

SEQ ID NO: 3802713 - DNA, 19 bp, Homo sapiens
caaagtatcaggacgagaa

SEQ ID NO: 3802714 - DNA, 19 bp, Homo sapiens
caactatattatcatgcaa

SEQ ID NO: 3802715 - DNA, 14 bp, Homo sapiens
caatattgtttcta

SEQ ID NO: 3802716 - DNA, 13 bp, Homo sapiens
caattatttttac

SEQ ID NO: 3802717 - DNA, 14 bp, Homo sapiens
cacaagttgtgttt

SEQ ID NO: 3802718 - DNA, 22 bp, Homo sapiens
cagaaacatcagttactctgaa

SEQ ID NO: 3802719 - DNA, 22 bp, Homo sapiens
cagaaatttaattcatgtttct

SEQ ID NO: 3802720 - DNA, 23 bp, Homo sapiens
cagaaatttaattcatgtttctt

SEQ ID NO: 3802721 - DNA, 21 bp, Homo sapiens
cagacacttttttgagtggat

SEQ ID NO: 3802722 - DNA, 14 bp, Homo sapiens
cagtggttatttag

SEQ ID NO: 3802723 - DNA, 13 bp, Homo sapiens
cagttttccattg

SEQ ID NO: 3802724 - DNA, 22 bp, Homo sapiens
catcagttactctgaagggcat

SEQ ID NO: 3802725 - DNA, 13 bp, Homo sapiens
catcttactgaag

SEQ ID NO: 3802726 - DNA, 21 bp, Homo sapiens
catgaatttttttcatcttct

SEQ ID NO: 3802727 - DNA, 22 bp, Homo sapiens
catgcaaatgctgtattcttct

SEQ ID NO: 3802728 - DNA, 14 bp, Homo sapiens
catgcatcttactg

SEQ ID NO: 3802729 - DNA, 12 bp, Homo sapiens
cattaaaacaat

SEQ ID NO: 3802730 - DNA, 22 bp, Homo sapiens
cattaaaacaatattgtttcta

SEQ ID NO: 3802731 - DNA, 17 bp, Homo sapiens
cattcaaaagttgaaat

SEQ ID NO: 3802732 - DNA, 16 bp, Homo sapiens
cattctctctcctgta

SEQ ID NO: 3802733 - DNA, 12 bp, Homo sapiens
cattctctgaag

SEQ ID NO: 3802734 - DNA, 13 bp, Homo sapiens
cattctctgaaga

SEQ ID NO: 3802735 - DNA, 20 bp, Homo sapiens
cattctgctttcatcttggt

SEQ ID NO: 3802736 - DNA, 19 bp, Homo sapiens
cattgagaactgcatatgt

SEQ ID NO: 3802737 - DNA, 15 bp, Homo sapiens
ccgtggcactgcata

SEQ ID NO: 3802738 - DNA, 20 bp, Homo sapiens
cctaagtttcagttgatttt

SEQ ID NO: 3802739 - DNA, 15 bp, Homo sapiens
cctcctgctactctg

SEQ ID NO: 3802740 - DNA, 13 bp, Homo sapiens
cctgtgtttctag

SEQ ID NO: 3802741 - DNA, 18 bp, Homo sapiens
ccttttacatactgctgt

SEQ ID NO: 3802742 - DNA, 13 bp, Homo sapiens
cgctgatatatgt

SEQ ID NO: 3802743 - DNA, 17 bp, Homo sapiens
cgtgaagtatactgtat

SEQ ID NO: 3802744 - DNA, 13 bp, Homo sapiens
ctaagtttcagtt

SEQ ID NO: 3802745 - DNA, 15 bp, Homo sapiens
ctactctgttccttc

SEQ ID NO: 3802746 - DNA, 16 bp, Homo sapiens
ctactctgttccttca

SEQ ID NO: 3802747 - DNA, 19 bp, Homo sapiens
ctactctgttccttcacat

SEQ ID NO: 3802748 - DNA, 22 bp, Homo sapiens
ctactttgtcctttttgttatt

SEQ ID NO: 3802749 - DNA, 15 bp, Homo sapiens
ctctctcctgtactt

SEQ ID NO: 3802750 - DNA, 23 bp, Homo sapiens
ctctgaagggcatcatgcatctt

SEQ ID NO: 3802751 - DNA, 22 bp, Homo sapiens
ctctgttccttcacatcctgtg

SEQ ID NO: 3802752 - DNA, 15 bp, Homo sapiens
ctgaaggtaaaattg

SEQ ID NO: 3802753 - DNA, 16 bp, Homo sapiens
ctgaatacattctgct

SEQ ID NO: 3802754 - DNA, 17 bp, Homo sapiens
ctgcattgagaactgca

SEQ ID NO: 3802755 - DNA, 19 bp, Homo sapiens
ctggcgacagttttccttc

SEQ ID NO: 3802756 - DNA, 18 bp, Homo sapiens
ctgtatcttgtttttcca

SEQ ID NO: 3802757 - DNA, 12 bp, Homo sapiens
ctgtttgttatg

SEQ ID NO: 3802758 - DNA, 14 bp, Homo sapiens
cttacatgttttct

SEQ ID NO: 3802759 - DNA, 21 bp, Homo sapiens
cttacatgttttctttgcttt

SEQ ID NO: 3802760 - DNA, 15 bp, Homo sapiens
ctttactgtttgtta

SEQ ID NO: 3802761 - DNA, 17 bp, Homo sapiens
ctttccgtggcactgca

SEQ ID NO: 3802762 - DNA, 19 bp, Homo sapiens
ctttccgtggcactgcata

SEQ ID NO: 3802763 - DNA, 22 bp, Homo sapiens
ctttgggaaaggagaagttaag

SEQ ID NO: 3802764 - DNA, 20 bp, Homo sapiens
gaaacatcagttactctgaa

SEQ ID NO: 3802765 - DNA, 15 bp, Homo sapiens
gaaaggagtagaaaa

SEQ ID NO: 3802766 - DNA, 16 bp, Homo sapiens
gaaaggcattctctga

SEQ ID NO: 3802767 - DNA, 17 bp, Homo sapiens
gaaaggcattctctgaa

SEQ ID NO: 3802768 - DNA, 18 bp, Homo sapiens
gaaatagttcaaagccaa

SEQ ID NO: 3802769 - DNA, 20 bp, Homo sapiens
gaaatttaattcatgtttct

SEQ ID NO: 3802770 - DNA, 21 bp, Homo sapiens
gaactgcatatgtttcgctga

SEQ ID NO: 3802771 - DNA, 16 bp, Homo sapiens
gaaggatgtacatttc

SEQ ID NO: 3802772 - DNA, 12 bp, Homo sapiens
gaatattagctt

SEQ ID NO: 3802773 - DNA, 14 bp, Homo sapiens
gaatttttctctaa

SEQ ID NO: 3802774 - DNA, 17 bp, Homo sapiens
gacaaattctgtttctt

SEQ ID NO: 3802775 - DNA, 19 bp, Homo sapiens
gagaactgcatatgtttcg

SEQ ID NO: 3802776 - DNA, 13 bp, Homo sapiens
gagaatgagggtc

SEQ ID NO: 3802777 - DNA, 22 bp, Homo sapiens
gagaattcttacatgttttctt

SEQ ID NO: 3802778 - DNA, 17 bp, Homo sapiens
gagttaggctattcaca

SEQ ID NO: 3802779 - DNA, 21 bp, Homo sapiens
gatacacccaaagtatcagga

SEQ ID NO: 3802780 - DNA, 15 bp, Homo sapiens
gatgtacatttccaa

SEQ ID NO: 3802781 - DNA, 22 bp, Homo sapiens
gatgtacatttccaaattcaca

SEQ ID NO: 3802782 - DNA, 21 bp, Homo sapiens
gattccctcctgctactctgt

SEQ ID NO: 3802783 - DNA, 18 bp, Homo sapiens
gcaacatctagcaaatgt

SEQ ID NO: 3802784 - DNA, 20 bp, Homo sapiens
gcaagtgaatttttctctaa

SEQ ID NO: 3802785 - DNA, 15 bp, Homo sapiens
gcatcttactgaagg

SEQ ID NO: 3802786 - DNA, 23 bp, Homo sapiens
gcatcttactgaaggtaaaattg

SEQ ID NO: 3802787 - DNA, 12 bp, Homo sapiens
gcattgagaact

SEQ ID NO: 3802788 - DNA, 21 bp, Homo sapiens
gcattgagaactgcatatgtt

SEQ ID NO: 3802789 - DNA, 20 bp, Homo sapiens
gccaagtttatatacaatta

SEQ ID NO: 3802790 - DNA, 20 bp, Homo sapiens
gctaatatcaatagaaggat

SEQ ID NO: 3802791 - DNA, 18 bp, Homo sapiens
gctactctgttccttcac

SEQ ID NO: 3802792 - DNA, 23 bp, Homo sapiens
ggcatcatgcatcttactgaagg

SEQ ID NO: 3802793 - DNA, 12 bp, Homo sapiens
ggcattctctga

SEQ ID NO: 3802794 - DNA, 13 bp, Homo sapiens
ggtaaatttctgt

SEQ ID NO: 3802795 - DNA, 16 bp, Homo sapiens
gtaaaattgaaaggca

SEQ ID NO: 3802796 - DNA, 11 bp, Homo sapiens
gttactctgaa

SEQ ID NO: 3802797 - DNA, 23 bp, Homo sapiens
gttgatagcaagtgaatttttct

SEQ ID NO: 3802798 - DNA, 12 bp, Homo sapiens
gttttaaaatta

SEQ ID NO: 3802799 - DNA, 15 bp, Homo sapiens
gtttttccactactg

SEQ ID NO: 3802800 - DNA, 16 bp, Homo sapiens
gtttttccactactgc

SEQ ID NO: 3802801 - DNA, 18 bp, Homo sapiens
gtttttccactactgcta

SEQ ID NO: 3802802 - DNA, 14 bp, Homo sapiens
taaaattaaagcta

SEQ ID NO: 3802803 - DNA, 11 bp, Homo sapiens
taaagacaaag

SEQ ID NO: 3802804 - DNA, 20 bp, Homo sapiens
taaagacaaagacaaattct

SEQ ID NO: 3802805 - DNA, 22 bp, Homo sapiens
taaagacaaagacaaattctgt

SEQ ID NO: 3802806 - DNA, 22 bp, Homo sapiens
taactcagaaacatcagttact

SEQ ID NO: 3802807 - DNA, 14 bp, Homo sapiens
taattcatgtttct

SEQ ID NO: 3802808 - DNA, 15 bp, Homo sapiens
taattcatgtttctt

SEQ ID NO: 3802809 - DNA, 18 bp, Homo sapiens
tacaattatttttacagt

SEQ ID NO: 3802810 - DNA, 22 bp, Homo sapiens
tacaattatttttacagttctc

SEQ ID NO: 3802811 - DNA, 14 bp, Homo sapiens
tacatctttcacat

SEQ ID NO: 3802812 - DNA, 15 bp, Homo sapiens
tacatctttcacatt

SEQ ID NO: 3802813 - DNA, 13 bp, Homo sapiens
tacctgtgaaata

SEQ ID NO: 3802814 - DNA, 12 bp, Homo sapiens
tactctgaaggg

SEQ ID NO: 3802815 - DNA, 22 bp, Homo sapiens
tactctgaagggcatcatgcat

SEQ ID NO: 3802816 - DNA, 17 bp, Homo sapiens
tactgaaggtaaaattg

SEQ ID NO: 3802817 - DNA, 13 bp, Homo sapiens
tagaaaaagcagt

SEQ ID NO: 3802818 - DNA, 21 bp, Homo sapiens
tagaaggatgtacatttccaa

SEQ ID NO: 3802819 - DNA, 22 bp, Homo sapiens
tagcaagtgaatttttctctaa

SEQ ID NO: 3802820 - DNA, 20 bp, Homo sapiens
tagccacaaaattgggaaag

SEQ ID NO: 3802821 - DNA, 13 bp, Homo sapiens
tagggaaatgaaa

SEQ ID NO: 3802822 - DNA, 16 bp, Homo sapiens
tagggaaatgaaagaa

SEQ ID NO: 3802823 - DNA, 14 bp, Homo sapiens
tagtctattagcca

SEQ ID NO: 3802824 - DNA, 22 bp, Homo sapiens
tatattatcatgcaaatgctgt

SEQ ID NO: 3802825 - DNA, 15 bp, Homo sapiens
tatcatgcaaatgct

SEQ ID NO: 3802826 - DNA, 17 bp, Homo sapiens
tatcatgcaaatgctgt

SEQ ID NO: 3802827 - DNA, 18 bp, Homo sapiens
tatcttgtttttccacta

SEQ ID NO: 3802828 - DNA, 22 bp, Homo sapiens
tatcttgtttttccactactgc

SEQ ID NO: 3802829 - DNA, 17 bp, Homo sapiens
tatgtgtttttcacatt

SEQ ID NO: 3802830 - DNA, 16 bp, Homo sapiens
tattagctttactgtt

SEQ ID NO: 3802831 - DNA, 18 bp, Homo sapiens
tattatcatgcaaatgct

SEQ ID NO: 3802832 - DNA, 18 bp, Homo sapiens
tatttaaagacaaagaca

SEQ ID NO: 3802833 - DNA, 16 bp, Homo sapiens
tcacaagtgaaaaaca

SEQ ID NO: 3802834 - DNA, 22 bp, Homo sapiens
tcacaagtgaaaaacatccaga

SEQ ID NO: 3802835 - DNA, 18 bp, Homo sapiens
tcacatcctgtgtttcta

SEQ ID NO: 3802836 - DNA, 18 bp, Homo sapiens
tcagaaacatcagttact

SEQ ID NO: 3802837 - DNA, 22 bp, Homo sapiens
tcagaaacatcagttactctga

SEQ ID NO: 3802838 - DNA, 14 bp, Homo sapiens
tcagaaatttaatt

SEQ ID NO: 3802839 - DNA, 19 bp, Homo sapiens
tcaggacgagaatgagggt

SEQ ID NO: 3802840 - DNA, 16 bp, Homo sapiens
tcagtgcccaactgtt

SEQ ID NO: 3802841 - DNA, 20 bp, Homo sapiens
tcagtggttatttagggaac

SEQ ID NO: 3802842 - DNA, 16 bp, Homo sapiens
tcagttactctgaagg

SEQ ID NO: 3802843 - DNA, 20 bp, Homo sapiens
tcatgcaaatgctgtattct

SEQ ID NO: 3802844 - DNA, 16 bp, Homo sapiens
tcatgtttcttaaatg

SEQ ID NO: 3802845 - DNA, 20 bp, Homo sapiens
tcccttttacatactgctgt

SEQ ID NO: 3802846 - DNA, 19 bp, Homo sapiens
tcctgtgtttctagggaaa

SEQ ID NO: 3802847 - DNA, 14 bp, Homo sapiens
tccttcacatcctg

SEQ ID NO: 3802848 - DNA, 13 bp, Homo sapiens
tcctttgggaaag

SEQ ID NO: 3802849 - DNA, 13 bp, Homo sapiens
tcctttttgttat

SEQ ID NO: 3802850 - DNA, 19 bp, Homo sapiens
tcgctgatatatgtgtttt

SEQ ID NO: 3802851 - DNA, 19 bp, Homo sapiens
tcgtgaagtatactgtatt

SEQ ID NO: 3802852 - DNA, 13 bp, Homo sapiens
tctagggaaatga

SEQ ID NO: 3802853 - DNA, 17 bp, Homo sapiens
tctagggaaatgaaaga

SEQ ID NO: 3802854 - DNA, 20 bp, Homo sapiens
tctctaactcagaaacatca

SEQ ID NO: 3802855 - DNA, 14 bp, Homo sapiens
tctctcctgtactt

SEQ ID NO: 3802856 - DNA, 23 bp, Homo sapiens
tctctgaagagtgggtttcacaa

SEQ ID NO: 3802857 - DNA, 16 bp, Homo sapiens
tctctggcgacagttt

SEQ ID NO: 3802858 - DNA, 17 bp, Homo sapiens
tctctggcgacagtttt

SEQ ID NO: 3802859 - DNA, 23 bp, Homo sapiens
tctgaggcctcctctctcagttt

SEQ ID NO: 3802860 - DNA, 13 bp, Homo sapiens
tcttactgaaggt

SEQ ID NO: 3802861 - DNA, 22 bp, Homo sapiens
tcttcccttttacatactgctg

SEQ ID NO: 3802862 - DNA, 22 bp, Homo sapiens
tctttcaaaggtagccatcatg

SEQ ID NO: 3802863 - DNA, 17 bp, Homo sapiens
tgaaaggcattctctga

SEQ ID NO: 3802864 - DNA, 19 bp, Homo sapiens
tgaaaggcattctctgaag

SEQ ID NO: 3802865 - DNA, 19 bp, Homo sapiens
tgaaatagttcaaagccaa

SEQ ID NO: 3802866 - DNA, 22 bp, Homo sapiens
tgaaattaaccatagatgtaga

SEQ ID NO: 3802867 - DNA, 19 bp, Homo sapiens
tgaagagtgggtttcacaa

SEQ ID NO: 3802868 - DNA, 21 bp, Homo sapiens
tgaaggtaaaattgaaaggca

SEQ ID NO: 3802869 - DNA, 15 bp, Homo sapiens
tgactaaaaaacaaa

SEQ ID NO: 3802870 - DNA, 22 bp, Homo sapiens
tgactaaaaaacaaagaagaca

SEQ ID NO: 3802871 - DNA, 17 bp, Homo sapiens
tgagaatcagatcattt

SEQ ID NO: 3802872 - DNA, 20 bp, Homo sapiens
tgagaatcagatcatttcaa

SEQ ID NO: 3802873 - DNA, 17 bp, Homo sapiens
tgcataaagtcagtgcc

SEQ ID NO: 3802874 - DNA, 17 bp, Homo sapiens
tgcatcttactgaaggt

SEQ ID NO: 3802875 - DNA, 14 bp, Homo sapiens
tgcccaactgttat

SEQ ID NO: 3802876 - DNA, 14 bp, Homo sapiens
tgctgtctatgtgg

SEQ ID NO: 3802877 - DNA, 19 bp, Homo sapiens
tgctttcatcttggtcaca

SEQ ID NO: 3802878 - DNA, 17 bp, Homo sapiens
tgctttccgtggcactg

SEQ ID NO: 3802879 - DNA, 14 bp, Homo sapiens
tggatgatgtttcg

SEQ ID NO: 3802880 - DNA, 16 bp, Homo sapiens
tgggaaaggagtagaa

SEQ ID NO: 3802881 - DNA, 23 bp, Homo sapiens
tgtaactgcattgagaactgcat

SEQ ID NO: 3802882 - DNA, 21 bp, Homo sapiens
tgtaactggcagttttccatt

SEQ ID NO: 3802883 - DNA, 18 bp, Homo sapiens
tgttataggttgttggat

SEQ ID NO: 3802884 - DNA, 21 bp, Homo sapiens
ttaaagacaaagacaaattct

SEQ ID NO: 3802885 - DNA, 15 bp, Homo sapiens
ttaattcatgtttct

SEQ ID NO: 3802886 - DNA, 14 bp, Homo sapiens
ttacaattgaaatg

SEQ ID NO: 3802887 - DNA, 22 bp, Homo sapiens
ttactctgaagggcatcatgca

SEQ ID NO: 3802888 - DNA, 18 bp, Homo sapiens
ttactgaaggtaaaattg

SEQ ID NO: 3802889 - DNA, 15 bp, Homo sapiens
ttagctttactgttt

SEQ ID NO: 3802890 - DNA, 16 bp, Homo sapiens
ttatcatgcaaatgct

SEQ ID NO: 3802891 - DNA, 21 bp, Homo sapiens
ttatttagggaactgcttgac

SEQ ID NO: 3802892 - DNA, 19 bp, Homo sapiens
ttcacatcctgtgtttcta

SEQ ID NO: 3802893 - DNA, 23 bp, Homo sapiens
ttccaaattcacaagttgtgttt

SEQ ID NO: 3802894 - DNA, 17 bp, Homo sapiens
ttcccttttacatactg

SEQ ID NO: 3802895 - DNA, 17 bp, Homo sapiens
ttccttcacatcctgtg

SEQ ID NO: 3802896 - DNA, 14 bp, Homo sapiens
ttccttctcatctg

SEQ ID NO: 3802897 - DNA, 12 bp, Homo sapiens
ttcgctgcaacc

SEQ ID NO: 3802898 - DNA, 20 bp, Homo sapiens
ttcttcccttttacatactg

SEQ ID NO: 3802899 - DNA, 22 bp, Homo sapiens
ttctttggtggagataaagatt

SEQ ID NO: 3802900 - DNA, 20 bp, Homo sapiens
ttgaaaggcattctctgaag

SEQ ID NO: 3802901 - DNA, 21 bp, Homo sapiens
ttgagttttgttttaaaatta

SEQ ID NO: 3802902 - DNA, 16 bp, Homo sapiens
ttggtggagataaaga

SEQ ID NO: 3802903 - DNA, 18 bp, Homo sapiens
ttgttttaaaattaaagc

SEQ ID NO: 3802904 - DNA, 14 bp, Homo sapiens
tttaattcatgttt

SEQ ID NO: 3802905 - DNA, 15 bp, Homo sapiens
tttccaaattcacaa

SEQ ID NO: 3802906 - DNA, 23 bp, Homo sapiens
tttccaaattcacaagttgtgtt

SEQ ID NO: 3802907 - DNA, 15 bp, Homo sapiens
tttctagggaaatga

SEQ ID NO: 3802908 - DNA, 15 bp, Homo sapiens
tttcttaaatgggct

SEQ ID NO: 3802909 - DNA, 15 bp, Homo sapiens
tttggtggagataaa

SEQ ID NO: 3802910 - DNA, 14 bp, Homo sapiens
ttttacaattgaaa

SEQ ID NO: 3802911 - DNA, 16 bp, Homo sapiens
ttttacaattgaaatg

SEQ ID NO: 3802912 - DNA, 16 bp, Homo sapiens
ttttacatactgctgt

SEQ ID NO: 3802913 - DNA, 16 bp, Homo sapiens
ttttgttttaaaatta

SEQ ID NO: 3802914 - DNA, 14 bp, Homo sapiens
atcctgtgtttcta

SEQ ID NO: 3802915 - DNA, 18 bp, Homo sapiens
atcctgtgtttctaggga

SEQ ID NO: 3802916 - DNA, 14 bp, Homo sapiens
atcttactgaaggt

SEQ ID NO: 3802917 - DNA, 15 bp, Homo sapiens
atcttactgaaggta

SEQ ID NO: 3802918 - DNA, 14 bp, Homo sapiens
atcttctctggcga

SEQ ID NO: 3802919 - DNA, 14 bp, Homo sapiens
atgaaagaaaggcc

SEQ ID NO: 3802920 - DNA, 23 bp, Homo sapiens
atgaatttttttcatcttctctg

SEQ ID NO: 3802921 - DNA, 16 bp, Homo sapiens
atgcatcttactgaag

SEQ ID NO: 3802922 - DNA, 19 bp, Homo sapiens
atgctgtattcttctttgg

SEQ ID NO: 3802923 - DNA, 20 bp, Homo sapiens
atgtacatttccaaattcac

SEQ ID NO: 3802924 - DNA, 17 bp, Homo sapiens
atgtgtattttattaca

SEQ ID NO: 3802925 - DNA, 18 bp, Homo sapiens
atgtttcttaaatgggct

SEQ ID NO: 3802926 - DNA, 18 bp, Homo sapiens
atgttttctttgctttaa

SEQ ID NO: 3802927 - DNA, 20 bp, Homo sapiens
attaaaacaatattgtttct

SEQ ID NO: 3802928 - DNA, 15 bp, Homo sapiens
attaaatataatatg

SEQ ID NO: 3802929 - DNA, 20 bp, Homo sapiens
attagctttactgtttgtta

SEQ ID NO: 3802930 - DNA, 15 bp, Homo sapiens
attcttacatgtttt

SEQ ID NO: 3802931 - DNA, 17 bp, Homo sapiens
attcttacatgttttct

SEQ ID NO: 3802932 - DNA, 19 bp, Homo sapiens
attggctatttaaagacaa

SEQ ID NO: 3802933 - DNA, 16 bp, Homo sapiens
atttagggaactgctt

SEQ ID NO: 3802934 - DNA, 13 bp, Homo sapiens
atttctgtgggag

SEQ ID NO: 3802935 - DNA, 15 bp, Homo sapiens
atttgcgaatggttc

SEQ ID NO: 3802936 - DNA, 20 bp, Homo sapiens
attttattacatctttcaca

SEQ ID NO: 3802937 - DNA, 21 bp, Homo sapiens
caaatgttatgcataaagtca

SEQ ID NO: 3802938 - DNA, 18 bp, Homo sapiens
caactatattatcatgca

SEQ ID NO: 3802939 - DNA, 19 bp, Homo sapiens
caagtgaatttttctctaa

SEQ ID NO: 3802940 - DNA, 23 bp, Homo sapiens
caatagaaggatgtacatttcca

SEQ ID NO: 3802941 - DNA, 16 bp, Homo sapiens
cacaaaattgggaaag

SEQ ID NO: 3802942 - DNA, 12 bp, Homo sapiens
cacaagtgaaaa

SEQ ID NO: 3802943 - DNA, 22 bp, Homo sapiens
cacagtgctttccgtggcactg

SEQ ID NO: 3802944 - DNA, 19 bp, Homo sapiens
cagaaacatcagttactct

SEQ ID NO: 3802945 - DNA, 13 bp, Homo sapiens
cagtcctctttca

SEQ ID NO: 3802946 - DNA, 13 bp, Homo sapiens
cagttactctgaa

SEQ ID NO: 3802947 - DNA, 16 bp, Homo sapiens
cagttactctgaaggg

SEQ ID NO: 3802948 - DNA, 11 bp, Homo sapiens
catactgctgt

SEQ ID NO: 3802949 - DNA, 22 bp, Homo sapiens
catatgtttcgctgatatatgt

SEQ ID NO: 3802950 - DNA, 16 bp, Homo sapiens
catcatgcatcttact

SEQ ID NO: 3802951 - DNA, 18 bp, Homo sapiens
catctagcaaatgttatg

SEQ ID NO: 3802952 - DNA, 15 bp, Homo sapiens
catctgtgattccct

SEQ ID NO: 3802953 - DNA, 15 bp, Homo sapiens
catcttactgaaggt

SEQ ID NO: 3802954 - DNA, 12 bp, Homo sapiens
catctttcacat

SEQ ID NO: 3802955 - DNA, 10 bp, Homo sapiens
catgtttctt

SEQ ID NO: 3802956 - DNA, 21 bp, Homo sapiens
cattaaaacaatattgtttct

SEQ ID NO: 3802957 - DNA, 16 bp, Homo sapiens
cattcaaaagttgaaa

SEQ ID NO: 3802958 - DNA, 18 bp, Homo sapiens
cattcaaaagttgaaatt

SEQ ID NO: 3802959 - DNA, 18 bp, Homo sapiens
cattgagaactgcatatg

SEQ ID NO: 3802960 - DNA, 23 bp, Homo sapiens
cattgagaactgcatatgtttcg

SEQ ID NO: 3802961 - DNA, 24 bp, Homo sapiens
ccaagggagttaggctattcacaa

SEQ ID NO: 3802962 - DNA, 14 bp, Homo sapiens
ccaagtttatatac

SEQ ID NO: 3802963 - DNA, 14 bp, Homo sapiens
ccattctctctcct

SEQ ID NO: 3802964 - DNA, 20 bp, Homo sapiens
ccttcacatcctgtgtttct

SEQ ID NO: 3802965 - DNA, 17 bp, Homo sapiens
ccttttacatactgctg

SEQ ID NO: 3802966 - DNA, 19 bp, Homo sapiens
cgctgcaacctgttgatag

SEQ ID NO: 3802967 - DNA, 19 bp, Homo sapiens
ctaagtttcagttgatttt

SEQ ID NO: 3802968 - DNA, 15 bp, Homo sapiens
ctatgtaactgcatt

SEQ ID NO: 3802969 - DNA, 16 bp, Homo sapiens
ctattagccacaaaat

SEQ ID NO: 3802970 - DNA, 11 bp, Homo sapiens
ctattcacaac

SEQ ID NO: 3802971 - DNA, 15 bp, Homo sapiens
ctcattcaaaagttg

SEQ ID NO: 3802972 - DNA, 18 bp, Homo sapiens
ctcctgctactctgttcc

SEQ ID NO: 3802973 - DNA, 12 bp, Homo sapiens
ctctcagttttt

SEQ ID NO: 3802974 - DNA, 22 bp, Homo sapiens
ctctgaagggcatcatgcatct

SEQ ID NO: 3802975 - DNA, 20 bp, Homo sapiens
ctgaagagtgggtttcacaa

SEQ ID NO: 3802976 - DNA, 17 bp, Homo sapiens
ctgaaggtaaaattgaa

SEQ ID NO: 3802977 - DNA, 18 bp, Homo sapiens
ctgacacaaaaagtagat

SEQ ID NO: 3802978 - DNA, 21 bp, Homo sapiens
ctgatatatgtgtttttcaca

SEQ ID NO: 3802979 - DNA, 22 bp, Homo sapiens
ctgctactctgttccttcacat

SEQ ID NO: 3802980 - DNA, 20 bp, Homo sapiens
ctggcgacagttttccttct

SEQ ID NO: 3802981 - DNA, 21 bp, Homo sapiens
ctgtatttttacctttttcct

SEQ ID NO: 3802982 - DNA, 18 bp, Homo sapiens
cttatcactgacacaaaa

SEQ ID NO: 3802983 - DNA, 20 bp, Homo sapiens
cttcacatcctgtgtttcta

SEQ ID NO: 3802984 - DNA, 21 bp, Homo sapiens
cttcacatcctgtgtttctag

SEQ ID NO: 3802985 - DNA, 12 bp, Homo sapiens
ctttactgtttg

SEQ ID NO: 3802986 - DNA, 15 bp, Homo sapiens
ctttgggaaaggaga

SEQ ID NO: 3802987 - DNA, 13 bp, Homo sapiens
cttttacatactg

SEQ ID NO: 3802988 - DNA, 23 bp, Homo sapiens
gaaacatcagttactctgaaggg

SEQ ID NO: 3802989 - DNA, 16 bp, Homo sapiens
gaaatttaattcatgt

SEQ ID NO: 3802990 - DNA, 21 bp, Homo sapiens
gaaatttaattcatgtttctt

SEQ ID NO: 3802991 - DNA, 17 bp, Homo sapiens
gaacggtaaatttctgt

SEQ ID NO: 3802992 - DNA, 17 bp, Homo sapiens
gaagagtgggtttcaca

SEQ ID NO: 3802993 - DNA, 17 bp, Homo sapiens
gaaggatgtacatttcc

SEQ ID NO: 3802994 - DNA, 18 bp, Homo sapiens
gaagggcatcatgcatct

SEQ ID NO: 3802995 - DNA, 21 bp, Homo sapiens
gaatattagctttactgtttg

SEQ ID NO: 3802996 - DNA, 18 bp, Homo sapiens
gaattcttacatgttttc

SEQ ID NO: 3802997 - DNA, 22 bp, Homo sapiens
gaattcttacatgttttctttg

SEQ ID NO: 3802998 - DNA, 20 bp, Homo sapiens
gaatttttttcatcttctct

SEQ ID NO: 3802999 - DNA, 22 bp, Homo sapiens
gaatttttttcatcttctctgg

SEQ ID NO: 3803000 - DNA, 14 bp, Homo sapiens
gacaaattctgttt

SEQ ID NO: 3803001 - DNA, 15 bp, Homo sapiens
gacaaattctgtttc

SEQ ID NO: 3803002 - DNA, 16 bp, Homo sapiens
gacacaaaaagtagat

SEQ ID NO: 3803003 - DNA, 19 bp, Homo sapiens
gacacttttttgagtggat

SEQ ID NO: 3803004 - DNA, 22 bp, Homo sapiens
gacagttttccttctcatctgt

SEQ ID NO: 3803005 - DNA, 18 bp, Homo sapiens
gagaacctaagtttcagt

SEQ ID NO: 3803006 - DNA, 18 bp, Homo sapiens
gagaactgcatatgtttc

SEQ ID NO: 3803007 - DNA, 15 bp, Homo sapiens
gagataatatgagaa

SEQ ID NO: 3803008 - DNA, 18 bp, Homo sapiens
gagttaggctattcacaa

SEQ ID NO: 3803009 - DNA, 19 bp, Homo sapiens
gatacacccaaagtatcag

SEQ ID NO: 3803010 - DNA, 20 bp, Homo sapiens
gatagcaagtgaatttttct

SEQ ID NO: 3803011 - DNA, 20 bp, Homo sapiens
gatatatgtgtttttcacat

SEQ ID NO: 3803012 - DNA, 20 bp, Homo sapiens
gcgagaacctaagtttcagt

SEQ ID NO: 3803013 - DNA, 16 bp, Homo sapiens
gctgtatcttgttttt

SEQ ID NO: 3803014 - DNA, 16 bp, Homo sapiens
ggtagccatcatggat

SEQ ID NO: 3803015 - DNA, 13 bp, Homo sapiens
ggttcttcccttt

SEQ ID NO: 3803016 - DNA, 22 bp, Homo sapiens
gtaactgcattgagaactgcat

SEQ ID NO: 3803017 - DNA, 23 bp, Homo sapiens
gtatcttgtttttccactactgc

SEQ ID NO: 3803018 - DNA, 15 bp, Homo sapiens
gtcctctttcaaagg

SEQ ID NO: 3803019 - DNA, 19 bp, Homo sapiens
gtgaagtatactgtatttt

SEQ ID NO: 3803020 - DNA, 15 bp, Homo sapiens
gtgaatttttctcta

SEQ ID NO: 3803021 - DNA, 22 bp, Homo sapiens
gtgctttccgtggcactgcata

SEQ ID NO: 3803022 - DNA, 18 bp, Homo sapiens
gtgtaactggcagttttc

SEQ ID NO: 3803023 - DNA, 11 bp, Homo sapiens
gtgtttctagg

SEQ ID NO: 3803024 - DNA, 21 bp, Homo sapiens
gttattagggtggtatttagt

SEQ ID NO: 3803025 - DNA, 16 bp, Homo sapiens
gtttacctgtgaaata

SEQ ID NO: 3803026 - DNA, 15 bp, Homo sapiens
gtttctagggaaatg

SEQ ID NO: 3803027 - DNA, 17 bp, Homo sapiens
gtttttccactactgct

SEQ ID NO: 3803028 - DNA, 11 bp, Homo sapiens
taaatcagtgg

SEQ ID NO: 3803029 - DNA, 13 bp, Homo sapiens
taactgacaactt

SEQ ID NO: 3803030 - DNA, 17 bp, Homo sapiens
taactgcattgagaact

SEQ ID NO: 3803031 - DNA, 24 bp, Homo sapiens
taactggcagttttccattggttt

SEQ ID NO: 3803032 - DNA, 17 bp, Homo sapiens
taagtttcagttgattt

SEQ ID NO: 3803033 - DNA, 15 bp, Homo sapiens
tacaattatatcagt

SEQ ID NO: 3803034 - DNA, 14 bp, Homo sapiens
tacaattgaaatga

SEQ ID NO: 3803035 - DNA, 13 bp, Homo sapiens
tacatactgctgt

SEQ ID NO: 3803036 - DNA, 23 bp, Homo sapiens
tttaattcatgtttcttaaatgg

SEQ ID NO: 3803037 - DNA, 15 bp, Homo sapiens
tttacatactgctgt

SEQ ID NO: 3803038 - DNA, 20 bp, Homo sapiens
tttcaaaactcatttcctat

SEQ ID NO: 3803039 - DNA, 14 bp, Homo sapiens
tttctagggaaatg

SEQ ID NO: 3803040 - DNA, 18 bp, Homo sapiens
tttctagggaaatgaaag

SEQ ID NO: 3803041 - DNA, 23 bp, Homo sapiens
tttgatatccaaagctgaataca

SEQ ID NO: 3803042 - DNA, 18 bp, Homo sapiens
ttttgagtggatgatgtt

SEQ ID NO: 3803043 - DNA, 11 bp, Homo sapiens
tttttctctaa

SEQ ID NO: 3803044 - DNA, 12 bp, Homo sapiens
ttttttcatctt

SEQ ID NO: 3803045 - DNA, 11 bp, Homo sapiens
aaaattaaagc

SEQ ID NO: 3803046 - DNA, 23 bp, Homo sapiens
aaacatcagttactctgaagggc

SEQ ID NO: 3803047 - DNA, 16 bp, Homo sapiens
aaagacaaattctgtt

SEQ ID NO: 3803048 - DNA, 22 bp, Homo sapiens
aaagacaaattctgtttcttga

SEQ ID NO: 3803049 - DNA, 18 bp, Homo sapiens
aaagctaaagtatctgta

SEQ ID NO: 3803050 - DNA, 18 bp, Homo sapiens
aaaggcattctctgaaga

SEQ ID NO: 3803051 - DNA, 13 bp, Homo sapiens
aaatgtgtatttt

SEQ ID NO: 3803052 - DNA, 20 bp, Homo sapiens
aaattaaccatagatgtaga

SEQ ID NO: 3803053 - DNA, 18 bp, Homo sapiens
aaattcacaagttgtgtt

SEQ ID NO: 3803054 - DNA, 23 bp, Homo sapiens
aaattgaaaggcattctctgaag

SEQ ID NO: 3803055 - DNA, 17 bp, Homo sapiens
aacaaagaagacaacat

SEQ ID NO: 3803056 - DNA, 18 bp, Homo sapiens
aacatcagttactctgaa

SEQ ID NO: 3803057 - DNA, 17 bp, Homo sapiens
aacatctagcaaatgtt

SEQ ID NO: 3803058 - DNA, 23 bp, Homo sapiens
aacattaaaacaatattgtttct

SEQ ID NO: 3803059 - DNA, 21 bp, Homo sapiens
aacctgttgatagcaagtgaa

SEQ ID NO: 3803060 - DNA, 22 bp, Homo sapiens
aactcatttcctatgtaactgc

SEQ ID NO: 3803061 - DNA, 17 bp, Homo sapiens
aactggcagttttccat

SEQ ID NO: 3803062 - DNA, 18 bp, Homo sapiens
aagacaaattctgtttct

SEQ ID NO: 3803063 - DNA, 13 bp, Homo sapiens
aagatttcttgag

SEQ ID NO: 3803064 - DNA, 13 bp, Homo sapiens
aagctgaatacat

SEQ ID NO: 3803065 - DNA, 13 bp, Homo sapiens
aaggagtagaaaa

SEQ ID NO: 3803066 - DNA, 16 bp, Homo sapiens
aaggatgtacatttcc

SEQ ID NO: 3803067 - DNA, 12 bp, Homo sapiens
aaggcattctct

SEQ ID NO: 3803068 - DNA, 14 bp, Homo sapiens
aaggcattctctga

SEQ ID NO: 3803069 - DNA, 17 bp, Homo sapiens
aaggcattctctgaaga

SEQ ID NO: 3803070 - DNA, 20 bp, Homo sapiens
aagtcagtgcccaactgtta

SEQ ID NO: 3803071 - DNA, 21 bp, Homo sapiens
aagtcagtgcccaactgttat

SEQ ID NO: 3803072 - DNA, 11 bp, Homo sapiens
aagtgtaactg

SEQ ID NO: 3803073 - DNA, 15 bp, Homo sapiens
aatattagctttact

SEQ ID NO: 3803074 - DNA, 17 bp, Homo sapiens
aatgactaaaaaacaaa

SEQ ID NO: 3803075 - DNA, 20 bp, Homo sapiens
aatgactaaaaaacaaagaa

SEQ ID NO: 3803076 - DNA, 15 bp, Homo sapiens
aattcttacatgttt

SEQ ID NO: 3803077 - DNA, 21 bp, Homo sapiens
aattgaaaggcattctctgaa

SEQ ID NO: 3803078 - DNA, 18 bp, Homo sapiens
aatttaattcatgtttct

SEQ ID NO: 3803079 - DNA, 18 bp, Homo sapiens
acaaagaagacaacatta

SEQ ID NO: 3803080 - DNA, 22 bp, Homo sapiens
acaaagacaaattctgtttctt

SEQ ID NO: 3803081 - DNA, 15 bp, Homo sapiens
acaaattctgtttct

SEQ ID NO: 3803082 - DNA, 16 bp, Homo sapiens
acaacattaaaacaat

SEQ ID NO: 3803083 - DNA, 12 bp, Homo sapiens
acaattgaaatg

SEQ ID NO: 3803084 - DNA, 16 bp, Homo sapiens
acatcctgtgtttcta

SEQ ID NO: 3803085 - DNA, 14 bp, Homo sapiens
actctgttccttca

SEQ ID NO: 3803086 - DNA, 22 bp, Homo sapiens
actctgttccttcacatcctgt

SEQ ID NO: 3803087 - DNA, 14 bp, Homo sapiens
actgcatacaatct

SEQ ID NO: 3803088 - DNA, 15 bp, Homo sapiens
actgcattgagaact

SEQ ID NO: 3803089 - DNA, 16 bp, Homo sapiens
actggcagttttccat

SEQ ID NO: 3803090 - DNA, 22 bp, Homo sapiens
acttttttgagtggatgatgtt

SEQ ID NO: 3803091 - DNA, 16 bp, Homo sapiens
agaaacatcagttact

SEQ ID NO: 3803092 - DNA, 21 bp, Homo sapiens
agaaacatcagttactctgaa

SEQ ID NO: 3803093 - DNA, 17 bp, Homo sapiens
agaaatttaattcatgt

SEQ ID NO: 3803094 - DNA, 21 bp, Homo sapiens
agaactgcatatgtttcgctg

SEQ ID NO: 3803095 - DNA, 22 bp, Homo sapiens
agaagagaatattagctttact

SEQ ID NO: 3803096 - DNA, 16 bp, Homo sapiens
agaaggatgtacattt

SEQ ID NO: 3803097 - DNA, 15 bp, Homo sapiens
agaagttaagcaaca

SEQ ID NO: 3803098 - DNA, 20 bp, Homo sapiens
agaatattagctttactgtt

SEQ ID NO: 3803099 - DNA, 17 bp, Homo sapiens
agaatcagatcatttca

SEQ ID NO: 3803100 - DNA, 17 bp, Homo sapiens
agggcatcatgcatctt

SEQ ID NO: 3803101 - DNA, 19 bp, Homo sapiens
aggtaaaattgaaaggcat

SEQ ID NO: 3803102 - DNA, 19 bp, Homo sapiens
aggttcttcccttttacat

SEQ ID NO: 3803103 - DNA, 15 bp, Homo sapiens
agtgcccaactgtta

SEQ ID NO: 3803104 - DNA, 13 bp, Homo sapiens
agtggatgatgtt

SEQ ID NO: 3803105 - DNA, 15 bp, Homo sapiens
agtggatgatgtttc

SEQ ID NO: 3803106 - DNA, 15 bp, Homo sapiens
agtgggtttcacaag

SEQ ID NO: 3803107 - DNA, 21 bp, Homo sapiens
agtgggtttcacaagtgaaaa

SEQ ID NO: 3803108 - DNA, 21 bp, Homo sapiens
agttgattttacaattgaaat

SEQ ID NO: 3803109 - DNA, 14 bp, Homo sapiens
agttttccttctca

SEQ ID NO: 3803110 - DNA, 12 bp, Homo sapiens
ataatatgagaa

SEQ ID NO: 3803111 - DNA, 19 bp, Homo sapiens
atacaccagagataatatg

SEQ ID NO: 3803112 - DNA, 19 bp, Homo sapiens
atagaaggatgtacatttc

SEQ ID NO: 3803113 - DNA, 13 bp, Homo sapiens
atagcaagtgaat

SEQ ID NO: 3803114 - DNA, 22 bp, Homo sapiens
atagcaagtgaatttttctcta

SEQ ID NO: 3803115 - DNA, 13 bp, Homo sapiens
atatatgtgtttt

SEQ ID NO: 3803116 - DNA, 15 bp, Homo sapiens
atatatgtgtttttc

SEQ ID NO: 3803117 - DNA, 21 bp, Homo sapiens
atatatgtgtttttcacattt

SEQ ID NO: 3803118 - DNA, 18 bp, Homo sapiens
atcagttactctgaaggg

SEQ ID NO: 3803119 - DNA, 19 bp, Homo sapiens
atcatgcaaatgctgtatt

SEQ ID NO: 3803120 - DNA, 21 bp, Homo sapiens
aaaacatccagatacacccaa

SEQ ID NO: 3803121 - DNA, 12 bp, Homo sapiens
aaaagttgaaat

SEQ ID NO: 3803122 - DNA, 14 bp, Homo sapiens
aaacaatattgttt

SEQ ID NO: 3803123 - DNA, 20 bp, Homo sapiens
aaacatcagttactctgaag

SEQ ID NO: 3803124 - DNA, 22 bp, Homo sapiens
aaacatcagttactctgaaggg

SEQ ID NO: 3803125 - DNA, 15 bp, Homo sapiens
aaactcatttcctat

SEQ ID NO: 3803126 - DNA, 19 bp, Homo sapiens
aaagaagacaacattaaaa

SEQ ID NO: 3803127 - DNA, 17 bp, Homo sapiens
aaagcagtaactgacaa

SEQ ID NO: 3803128 - DNA, 12 bp, Homo sapiens
aaagttgaaatt

SEQ ID NO: 3803129 - DNA, 12 bp, Homo sapiens
aaatgaaagaaa

SEQ ID NO: 3803130 - DNA, 20 bp, Homo sapiens
aaattgaaaggcattctctg

SEQ ID NO: 3803131 - DNA, 20 bp, Homo sapiens
aaattgggaaaggagtagaa

SEQ ID NO: 3803132 - DNA, 18 bp, Homo sapiens
aaatttaattcatgtttc

SEQ ID NO: 3803133 - DNA, 16 bp, Homo sapiens
aacaatattgtttcta

SEQ ID NO: 3803134 - DNA, 19 bp, Homo sapiens
aacatcagttactctgaag

SEQ ID NO: 3803135 - DNA, 16 bp, Homo sapiens
aagacaaattctgttt

SEQ ID NO: 3803136 - DNA, 15 bp, Homo sapiens
aaggatgtacatttc

SEQ ID NO: 3803137 - DNA, 21 bp, Homo sapiens
aaggttcttcccttttacata

SEQ ID NO: 3803138 - DNA, 12 bp, Homo sapiens
aagtgtaactgg

SEQ ID NO: 3803139 - DNA, 19 bp, Homo sapiens
aatagaaggatgtacattt

SEQ ID NO: 3803140 - DNA, 20 bp, Homo sapiens
aatagaaggatgtacatttc

SEQ ID NO: 3803141 - DNA, 18 bp, Homo sapiens
aatattagctttactgtt

SEQ ID NO: 3803142 - DNA, 19 bp, Homo sapiens
aatattagctttactgttt

SEQ ID NO: 3803143 - DNA, 15 bp, Homo sapiens
aatcagatcatttca

SEQ ID NO: 3803144 - DNA, 14 bp, Homo sapiens
aattcatgtttctt

SEQ ID NO: 3803145 - DNA, 17 bp, Homo sapiens
aattgaaaggcattctc

SEQ ID NO: 3803146 - DNA, 23 bp, Homo sapiens
aatttaattcatgtttcttaaat

SEQ ID NO: 3803147 - DNA, 21 bp, Homo sapiens
aatttttttcatcttctctgg

SEQ ID NO: 3803148 - DNA, 19 bp, Homo sapiens
acaaagacaaattctgttt

SEQ ID NO: 3803149 - DNA, 17 bp, Homo sapiens
acaaccactcattcaaa

SEQ ID NO: 3803150 - DNA, 14 bp, Homo sapiens
acaatattgtttct

SEQ ID NO: 3803151 - DNA, 15 bp, Homo sapiens
acaatattgtttcta

SEQ ID NO: 3803152 - DNA, 22 bp, Homo sapiens
acactagctaatatcaatagaa

SEQ ID NO: 3803153 - DNA, 16 bp, Homo sapiens
acatacaattattttt

SEQ ID NO: 3803154 - DNA, 14 bp, Homo sapiens
acatcctgtgtttc

SEQ ID NO: 3803155 - DNA, 15 bp, Homo sapiens
acattaaaacaatat

SEQ ID NO: 3803156 - DNA, 22 bp, Homo sapiens
acattaaaacaatattgtttct

SEQ ID NO: 3803157 - DNA, 15 bp, Homo sapiens
acctttttccttcct

SEQ ID NO: 3803158 - DNA, 20 bp, Homo sapiens
actactgctaccacaactat

SEQ ID NO: 3803159 - DNA, 15 bp, Homo sapiens
actcagaaacatcag

SEQ ID NO: 3803160 - DNA, 13 bp, Homo sapiens
actcattcaaaag

SEQ ID NO: 3803161 - DNA, 21 bp, Homo sapiens
actcattcaaaagttgaaatt

SEQ ID NO: 3803162 - DNA, 16 bp, Homo sapiens
actcatttcctatgta

SEQ ID NO: 3803163 - DNA, 20 bp, Homo sapiens
actctgaagggcatcatgca

SEQ ID NO: 3803164 - DNA, 21 bp, Homo sapiens
actctgaagggcatcatgcat

SEQ ID NO: 3803165 - DNA, 17 bp, Homo sapiens
actgaaggtaaaattga

SEQ ID NO: 3803166 - DNA, 21 bp, Homo sapiens
agaaatttaattcatgtttct

SEQ ID NO: 3803167 - DNA, 19 bp, Homo sapiens
agaagttaagcaacatcta

SEQ ID NO: 3803168 - DNA, 21 bp, Homo sapiens
agaatattagctttactgttt

SEQ ID NO: 3803169 - DNA, 16 bp, Homo sapiens
agaattcttacatgtt

SEQ ID NO: 3803170 - DNA, 19 bp, Homo sapiens
agaattcttacatgttttc

SEQ ID NO: 3803171 - DNA, 19 bp, Homo sapiens
agacaaattctgtttcttg

SEQ ID NO: 3803172 - DNA, 21 bp, Homo sapiens
agacaaattctgtttcttgag

SEQ ID NO: 3803173 - DNA, 18 bp, Homo sapiens
agataaagatttcttgag

SEQ ID NO: 3803174 - DNA, 15 bp, Homo sapiens
agataatatgagaat

SEQ ID NO: 3803175 - DNA, 19 bp, Homo sapiens
agatttcttgagttttgtt

SEQ ID NO: 3803176 - DNA, 15 bp, Homo sapiens
agctgaatacattct

SEQ ID NO: 3803177 - DNA, 18 bp, Homo sapiens
agctgaatacattctgct

SEQ ID NO: 3803178 - DNA, 20 bp, Homo sapiens
aggaacggtaaatttctgtg

SEQ ID NO: 3803179 - DNA, 15 bp, Homo sapiens
agtgaatttttctct

SEQ ID NO: 3803180 - DNA, 16 bp, Homo sapiens
agtgaatttttctcta

SEQ ID NO: 3803181 - DNA, 17 bp, Homo sapiens
agtgaatttttctctaa

SEQ ID NO: 3803182 - DNA, 20 bp, Homo sapiens
agtgaatttttctctaactc

SEQ ID NO: 3803183 - DNA, 23 bp, Homo sapiens
agtgaatttttctctaactcaga

SEQ ID NO: 3803184 - DNA, 20 bp, Homo sapiens
agtggatgatgtttcgtgaa

SEQ ID NO: 3803185 - DNA, 16 bp, Homo sapiens
agttactctgaagggc

SEQ ID NO: 3803186 - DNA, 18 bp, Homo sapiens
agttaggctattcacaac

SEQ ID NO: 3803187 - DNA, 12 bp, Homo sapiens
agttttccttct

SEQ ID NO: 3803188 - DNA, 23 bp, Homo sapiens
agttttccttctcatctgtgatt

SEQ ID NO: 3803189 - DNA, 15 bp, Homo sapiens
atagttcaaagccaa

SEQ ID NO: 3803190 - DNA, 14 bp, Homo sapiens
atatacaattatat

SEQ ID NO: 3803191 - DNA, 17 bp, Homo sapiens
atatgtgtttttcacat

SEQ ID NO: 3803192 - DNA, 21 bp, Homo sapiens
atattatcatgcaaatgctgt

SEQ ID NO: 3803193 - DNA, 18 bp, Homo sapiens
atcagatcatttcaaaac

SEQ ID NO: 3803194 - DNA, 19 bp, Homo sapiens
atcagtggttatttaggga

SEQ ID NO: 3803195 - DNA, 22 bp, Homo sapiens
atcatgcatcttactgaaggta

SEQ ID NO: 3803196 - DNA, 20 bp, Homo sapiens
atccagatacacccaaagta

SEQ ID NO: 3803197 - DNA, 14 bp, Homo sapiens
atctagcaaatgtt

SEQ ID NO: 3803198 - DNA, 18 bp, Homo sapiens
atctagcaaatgttatgc

SEQ ID NO: 3803199 - DNA, 22 bp, Homo sapiens
atgaatttttttcatcttctct

SEQ ID NO: 3803200 - DNA, 21 bp, Homo sapiens
atgcacacagtgctttccgtg

SEQ ID NO: 3803201 - DNA, 23 bp, Homo sapiens
atgtaactgcattgagaactgca

SEQ ID NO: 3803202 - DNA, 18 bp, Homo sapiens
attaaaacaatattgttt

SEQ ID NO: 3803203 - DNA, 21 bp, Homo sapiens
attaaaacaatattgtttcta

SEQ ID NO: 3803204 - DNA, 17 bp, Homo sapiens
attaaagctaaagtatc

SEQ ID NO: 3803205 - DNA, 16 bp, Homo sapiens
attacatctttcacat

SEQ ID NO: 3803206 - DNA, 22 bp, Homo sapiens
attacatctttcacattggcta

SEQ ID NO: 3803207 - DNA, 23 bp, Homo sapiens
attgcattaaatataatatgcac

SEQ ID NO: 3803208 - DNA, 17 bp, Homo sapiens
atttccaaattcacaag

SEQ ID NO: 3803209 - DNA, 13 bp, Homo sapiens
attttacaattga

SEQ ID NO: 3803210 - DNA, 21 bp, Homo sapiens
attttacaattgaaatgacta

SEQ ID NO: 3803211 - DNA, 21 bp, Homo sapiens
caaaactcatttcctatgtaa

SEQ ID NO: 3803212 - DNA, 15 bp, Homo sapiens
caaatgctgtattct

SEQ ID NO: 3803213 - DNA, 13 bp, Homo sapiens
caaatgttatgca

SEQ ID NO: 3803214 - DNA, 14 bp, Homo sapiens
caaattctgtttct

SEQ ID NO: 3803215 - DNA, 15 bp, Homo sapiens
caaattctgtttctt

SEQ ID NO: 3803216 - DNA, 16 bp, Homo sapiens
cacaagtgaaaaacat

SEQ ID NO: 3803217 - DNA, 21 bp, Homo sapiens
cactactgctaccacaactat

SEQ ID NO: 3803218 - DNA, 19 bp, Homo sapiens
cactgacacaaaaagtaga

SEQ ID NO: 3803219 - DNA, 23 bp, Homo sapiens
cagaaacatcagttactctgaag

SEQ ID NO: 3803220 - DNA, 13 bp, Homo sapiens
cagttttccttct

SEQ ID NO: 3803221 - DNA, 15 bp, Homo sapiens
cataaagtcagtgcc

SEQ ID NO: 3803222 - DNA, 15 bp, Homo sapiens
catcctgtgtttcta

SEQ ID NO: 3803223 - DNA, 14 bp, Homo sapiens
catctagcaaatgt

SEQ ID NO: 3803224 - DNA, 14 bp, Homo sapiens
catcttactgaagg

SEQ ID NO: 3803225 - DNA, 13 bp, Homo sapiens
catctttcacatt

SEQ ID NO: 3803226 - DNA, 14 bp, Homo sapiens
catgcaaatgctgt

SEQ ID NO: 3803227 - DNA, 16 bp, Homo sapiens
catgcatcttactgaa

SEQ ID NO: 3803228 - DNA, 17 bp, Homo sapiens
catttccaaattcacaa

SEQ ID NO: 3803229 - DNA, 17 bp, Homo sapiens
catttcctatgtaactg

SEQ ID NO: 3803230 - DNA, 19 bp, Homo sapiens
catttcctatgtaactgca

SEQ ID NO: 3803231 - DNA, 21 bp, Homo sapiens
catttgcgaatggttccattc

SEQ ID NO: 3803232 - DNA, 21 bp, Homo sapiens
ccagatacacccaaagtatca

SEQ ID NO: 3803233 - DNA, 12 bp, Homo sapiens
cccaactgttat

SEQ ID NO: 3803234 - DNA, 16 bp, Homo sapiens
cctgctactctgttcc

SEQ ID NO: 3803235 - DNA, 12 bp, Homo sapiens
cctgtacttttt

SEQ ID NO: 3803236 - DNA, 13 bp, Homo sapiens
cctttttccttcc

SEQ ID NO: 3803237 - DNA, 19 bp, Homo sapiens
ctaactcagaaacatcagt

SEQ ID NO: 3803238 - DNA, 22 bp, Homo sapiens
ctactctgttccttcacatcct

SEQ ID NO: 3803239 - DNA, 14 bp, Homo sapiens
ctactttgtccttt

SEQ ID NO: 3803240 - DNA, 20 bp, Homo sapiens
ctactttgtcctttttgtta

SEQ ID NO: 3803241 - DNA, 21 bp, Homo sapiens
ctatgtaactgcattgagaac

SEQ ID NO: 3803242 - DNA, 19 bp, Homo sapiens
ctcattcaaaagttgaaat

SEQ ID NO: 3803243 - DNA, 13 bp, Homo sapiens
ctctgaagagtgg

SEQ ID NO: 3803244 - DNA, 21 bp, Homo sapiens
ctctgaagagtgggtttcaca

SEQ ID NO: 3803245 - DNA, 17 bp, Homo sapiens
ctctgaagggcatcatg

SEQ ID NO: 3803246 - DNA, 16 bp, Homo sapiens
ctctggcgacagtttt

SEQ ID NO: 3803247 - DNA, 19 bp, Homo sapiens
ctgaaggtaaaattgaaag

SEQ ID NO: 3803248 - DNA, 15 bp, Homo sapiens
ctgatatatgtgttt

SEQ ID NO: 3803249 - DNA, 22 bp, Homo sapiens
ctgatatatgtgtttttcacat

SEQ ID NO: 3803250 - DNA, 15 bp, Homo sapiens
ctgcaacctgttgat

SEQ ID NO: 3803251 - DNA, 14 bp, Homo sapiens
ctgcatacaatctg

SEQ ID NO: 3803252 - DNA, 17 bp, Homo sapiens
ctgctactctgttcctt

SEQ ID NO: 3803253 - DNA, 15 bp, Homo sapiens
ctgttccttcacatc

SEQ ID NO: 3803254 - DNA, 18 bp, Homo sapiens
ctgttccttcacatcctg

SEQ ID NO: 3803255 - DNA, 21 bp, Homo sapiens
ctgttccttcacatcctgtgt

SEQ ID NO: 3803256 - DNA, 12 bp, Homo sapiens
cttactgaaggt

SEQ ID NO: 3803257 - DNA, 12 bp, Homo sapiens
cttctcatctgt

SEQ ID NO: 3803258 - DNA, 14 bp, Homo sapiens
cttggtcacataca

SEQ ID NO: 3803259 - DNA, 18 bp, Homo sapiens
cttgtttttccactactg

SEQ ID NO: 3803260 - DNA, 14 bp, Homo sapiens
ctttactgtttgtt

SEQ ID NO: 3803261 - DNA, 14 bp, Homo sapiens
cttttacatactgc

SEQ ID NO: 3803262 - DNA, 22 bp, Homo sapiens
ctttttccagacacttttttga

SEQ ID NO: 3803263 - DNA, 16 bp, Homo sapiens
gaaaggagtagaaaaa

SEQ ID NO: 3803264 - DNA, 19 bp, Homo sapiens
gaaatgactaaaaaacaaa

SEQ ID NO: 3803265 - DNA, 15 bp, Homo sapiens
gaaggatgtacattt

SEQ ID NO: 3803266 - DNA, 20 bp, Homo sapiens
gaaggatgtacatttccaaa

SEQ ID NO: 3803267 - DNA, 13 bp, Homo sapiens
gaaggtaaaattg

SEQ ID NO: 3803268 - DNA, 19 bp, Homo sapiens
gaatcagatcatttcaaaa

SEQ ID NO: 3803269 - DNA, 16 bp, Homo sapiens
gaatttttttcatctt

SEQ ID NO: 3803270 - DNA, 14 bp, Homo sapiens
gacaaagacaaatt

SEQ ID NO: 3803271 - DNA, 12 bp, Homo sapiens
gacaaattctgt

SEQ ID NO: 3803272 - DNA, 16 bp, Homo sapiens
gacaaattctgtttct

SEQ ID NO: 3803273 - DNA, 20 bp, Homo sapiens
gagaatcagatcatttcaaa

SEQ ID NO: 3803274 - DNA, 16 bp, Homo sapiens
gagaattcttacatgt

SEQ ID NO: 3803275 - DNA, 13 bp, Homo sapiens
gagttttgtttta

SEQ ID NO: 3803276 - DNA, 16 bp, Homo sapiens
gataaagatttcttga

SEQ ID NO: 3803277 - DNA, 17 bp, Homo sapiens
gataatatgagaatcag

SEQ ID NO: 3803278 - DNA, 22 bp, Homo sapiens
gattaagagatgggtttgacaa

SEQ ID NO: 3803279 - DNA, 19 bp, Homo sapiens
gcattaaatataatatgca

SEQ ID NO: 3803280 - DNA, 14 bp, Homo sapiens
gcattctctgaaga

SEQ ID NO: 3803281 - DNA, 22 bp, Homo sapiens
gcattgagaactgcatatgttt

SEQ ID NO: 3803282 - DNA, 17 bp, Homo sapiens
gctgatatatgtgtttt

SEQ ID NO: 3803283 - DNA, 20 bp, Homo sapiens
gctgatatatgtgtttttca

SEQ ID NO: 3803284 - DNA, 21 bp, Homo sapiens
ggaaaggagtagaaaaagcag

SEQ ID NO: 3803285 - DNA, 15 bp, Homo sapiens
ggaaatgaaagaaag

SEQ ID NO: 3803286 - DNA, 20 bp, Homo sapiens
ggaacggtaaatttctgtgg

SEQ ID NO: 3803287 - DNA, 21 bp, Homo sapiens
ggatctggtagggggaaaatg

SEQ ID NO: 3803288 - DNA, 18 bp, Homo sapiens
ggcgacagttttccttct

SEQ ID NO: 3803289 - DNA, 13 bp, Homo sapiens
ggctattcacaac

SEQ ID NO: 3803290 - DNA, 13 bp, Homo sapiens
gggcatcatgcat

SEQ ID NO: 3803291 - DNA, 13 bp, Homo sapiens
gtaactgacaact

SEQ ID NO: 3803292 - DNA, 18 bp, Homo sapiens
gtaggaacggtaaatttc

SEQ ID NO: 3803293 - DNA, 21 bp, Homo sapiens
gtgaaatagttcaaagccaag

SEQ ID NO: 3803294 - DNA, 17 bp, Homo sapiens
gtgaagtatactgtatt

SEQ ID NO: 3803295 - DNA, 14 bp, Homo sapiens
gtgaatttttctct

SEQ ID NO: 3803296 - DNA, 14 bp, Homo sapiens
gttttaaaattaaa

SEQ ID NO: 3803297 - DNA, 17 bp, Homo sapiens
gttttgttttaaaatta

SEQ ID NO: 3803298 - DNA, 14 bp, Homo sapiens
taaaaaacaaagaa

SEQ ID NO: 3803299 - DNA, 19 bp, Homo sapiens
taaaaaacaaagaagacaa

SEQ ID NO: 3803300 - DNA, 15 bp, Homo sapiens
taaagacaaagacaa

SEQ ID NO: 3803301 - DNA, 14 bp, Homo sapiens
taaagatttcttga

SEQ ID NO: 3803302 - DNA, 23 bp, Homo sapiens
taactggcagttttccattggtt

SEQ ID NO: 3803303 - DNA, 19 bp, Homo sapiens
tacaattatatcagtcctc

SEQ ID NO: 3803304 - DNA, 13 bp, Homo sapiens
tacaattgaaatg

SEQ ID NO: 3803305 - DNA, 19 bp, Homo sapiens
tacaccagagataatatga

SEQ ID NO: 3803306 - DNA, 20 bp, Homo sapiens
tacaccagagataatatgag

SEQ ID NO: 3803307 - DNA, 12 bp, Homo sapiens
tacatactgctg

SEQ ID NO: 3803308 - DNA, 20 bp, Homo sapiens
tacatctttcacattggcta

SEQ ID NO: 3803309 - DNA, 19 bp, Homo sapiens
tactctgaagggcatcatg

SEQ ID NO: 3803310 - DNA, 14 bp, Homo sapiens
tactctgttccttc

SEQ ID NO: 3803311 - DNA, 19 bp, Homo sapiens
tactctgttccttcacatc

SEQ ID NO: 3803312 - DNA, 20 bp, Homo sapiens
tactttgtcctttttgttat

SEQ ID NO: 3803313 - DNA, 15 bp, Homo sapiens
tagataaactcagaa

SEQ ID NO: 3803314 - DNA, 18 bp, Homo sapiens
tagcaagtgaatttttct

SEQ ID NO: 3803315 - DNA, 20 bp, Homo sapiens
taggaacggtaaatttctgt

SEQ ID NO: 3803316 - DNA, 14 bp, Homo sapiens
taggctattcacaa

SEQ ID NO: 3803317 - DNA, 15 bp, Homo sapiens
taggctattcacaac

SEQ ID NO: 3803318 - DNA, 18 bp, Homo sapiens
tatatgtgtttttcacat

SEQ ID NO: 3803319 - DNA, 20 bp, Homo sapiens
tatattatcatgcaaatgct

SEQ ID NO: 3803320 - DNA, 15 bp, Homo sapiens
tatgtgtttttcaca

SEQ ID NO: 3803321 - DNA, 16 bp, Homo sapiens
tatgtgtttttcacat

SEQ ID NO: 3803322 - DNA, 17 bp, Homo sapiens
tattacatctttcacat

SEQ ID NO: 3803323 - DNA, 14 bp, Homo sapiens
tattagctttactg

SEQ ID NO: 3803324 - DNA, 11 bp, Homo sapiens
tattgtttcta

SEQ ID NO: 3803325 - DNA, 12 bp, Homo sapiens
tatttaaagaca

SEQ ID NO: 3803326 - DNA, 13 bp, Homo sapiens
tatttaaagacaa

SEQ ID NO: 3803327 - DNA, 17 bp, Homo sapiens
tatttaaagacaaagac

SEQ ID NO: 3803328 - DNA, 17 bp, Homo sapiens
tatttagggaactgctt

SEQ ID NO: 3803329 - DNA, 18 bp, Homo sapiens
tcaaaactcatttcctat

SEQ ID NO: 3803330 - DNA, 14 bp, Homo sapiens
tcaaaagttgaaat

SEQ ID NO: 3803331 - DNA, 20 bp, Homo sapiens
tcacaagttgtgtttgatat

SEQ ID NO: 3803332 - DNA, 16 bp, Homo sapiens
tcattcaaaagttgaa

SEQ ID NO: 3803333 - DNA, 18 bp, Homo sapiens
tcattcaaaagttgaaat

SEQ ID NO: 3803334 - DNA, 22 bp, Homo sapiens
tcattcaaaagttgaaattaac

SEQ ID NO: 3803335 - DNA, 13 bp, Homo sapiens
tcccttttacata

SEQ ID NO: 3803336 - DNA, 22 bp, Homo sapiens
tcgctgatatatgtgtttttca

SEQ ID NO: 3803337 - DNA, 15 bp, Homo sapiens
tctagcaaatgttat

SEQ ID NO: 3803338 - DNA, 22 bp, Homo sapiens
tctctctcctgtactttttcca

SEQ ID NO: 3803339 - DNA, 22 bp, Homo sapiens
tctctggcgacagttttccttc

SEQ ID NO: 3803340 - DNA, 14 bp, Homo sapiens
tcttacatgttttc

SEQ ID NO: 3803341 - DNA, 15 bp, Homo sapiens
tcttacatgttttct

SEQ ID NO: 3803342 - DNA, 19 bp, Homo sapiens
tcttcccttttacatactg

SEQ ID NO: 3803343 - DNA, 21 bp, Homo sapiens
tcttcccttttacatactgct

SEQ ID NO: 3803344 - DNA, 22 bp, Homo sapiens
tcttgtttttccactactgcta

SEQ ID NO: 3803345 - DNA, 20 bp, Homo sapiens
tctttcaaaggtagccatca

SEQ ID NO: 3803346 - DNA, 10 bp, Homo sapiens
tctttcacat

SEQ ID NO: 3803347 - DNA, 15 bp, Homo sapiens
tgaatttttctctaa

SEQ ID NO: 3803348 - DNA, 22 bp, Homo sapiens
tgaatttttctctaactcagaa

SEQ ID NO: 3803349 - DNA, 20 bp, Homo sapiens
tgagaactgcatatgtttcg

SEQ ID NO: 3803350 - DNA, 23 bp, Homo sapiens
tgatagcaagtgaatttttctct

SEQ ID NO: 3803351 - DNA, 21 bp, Homo sapiens
tgatatatgtgtttttcacat

SEQ ID NO: 3803352 - DNA, 15 bp, Homo sapiens
tgcaaatgctgtatt

SEQ ID NO: 3803353 - DNA, 17 bp, Homo sapiens
tgcattgagaactgcat

SEQ ID NO: 3803354 - DNA, 20 bp, Homo sapiens
tgctttccgtggcactgcat

SEQ ID NO: 3803355 - DNA, 21 bp, Homo sapiens
tgctttccgtggcactgcata

SEQ ID NO: 3803356 - DNA, 19 bp, Homo sapiens
tggcactgcatacaatctg

SEQ ID NO: 3803357 - DNA, 17 bp, Homo sapiens
tgggaaaggagtagaaa

SEQ ID NO: 3803358 - DNA, 22 bp, Homo sapiens
tgggagaattcttacatgtttt

SEQ ID NO: 3803359 - DNA, 19 bp, Homo sapiens
tggtagggggaaaatgtgt

SEQ ID NO: 3803360 - DNA, 22 bp, Homo sapiens
tggttatttagggaactgcttg

SEQ ID NO: 3803361 - DNA, 18 bp, Homo sapiens
tgtacatttccaaattca

SEQ ID NO: 3803362 - DNA, 21 bp, Homo sapiens
tgtacatttccaaattcacaa

SEQ ID NO: 3803363 - DNA, 22 bp, Homo sapiens
tgtacatttccaaattcacaag

SEQ ID NO: 3803364 - DNA, 15 bp, Homo sapiens
tgtactttttccaga

SEQ ID NO: 3803365 - DNA, 21 bp, Homo sapiens
tgtgaaatagttcaaagccaa

SEQ ID NO: 3803366 - DNA, 18 bp, Homo sapiens
tgttccttcacatcctgt

SEQ ID NO: 3803367 - DNA, 19 bp, Homo sapiens
tgttggataaatcagtggt

SEQ ID NO: 3803368 - DNA, 21 bp, Homo sapiens
tgtttcgctgatatatgtgtt

SEQ ID NO: 3803369 - DNA, 12 bp, Homo sapiens
tgtttgttatgg

SEQ ID NO: 3803370 - DNA, 19 bp, Homo sapiens
ttaaagctaaagtatctgt

SEQ ID NO: 3803371 - DNA, 23 bp, Homo sapiens
ttaaatgggctactttgtccttt

SEQ ID NO: 3803372 - DNA, 13 bp, Homo sapiens
ttaattcatgttt

SEQ ID NO: 3803373 - DNA, 13 bp, Homo sapiens
ttacaattgaaat

SEQ ID NO: 3803374 - DNA, 15 bp, Homo sapiens
ttacaattgaaatga

SEQ ID NO: 3803375 - DNA, 17 bp, Homo sapiens
ttacaattgaaatgact

SEQ ID NO: 3803376 - DNA, 15 bp, Homo sapiens
ttacatctttcacat

SEQ ID NO: 3803377 - DNA, 16 bp, Homo sapiens
ttagctttactgtttg

SEQ ID NO: 3803378 - DNA, 19 bp, Homo sapiens
ttatatcagtcctctttca

SEQ ID NO: 3803379 - DNA, 11 bp, Homo sapiens
ttatcatgcaa

SEQ ID NO: 3803380 - DNA, 18 bp, Homo sapiens
ttattacatctttcacat

SEQ ID NO: 3803381 - DNA, 18 bp, Homo sapiens
ttatttagggaactgctt

SEQ ID NO: 3803382 - DNA, 16 bp, Homo sapiens
ttcaaaagttgaaatt

SEQ ID NO: 3803383 - DNA, 16 bp, Homo sapiens
ttcagttgattttaca

SEQ ID NO: 3803384 - DNA, 13 bp, Homo sapiens
ttcatgtttctta

SEQ ID NO: 3803385 - DNA, 15 bp, Homo sapiens
ttccactactgctac

SEQ ID NO: 3803386 - DNA, 15 bp, Homo sapiens
ttccctcctgctact

SEQ ID NO: 3803387 - DNA, 19 bp, Homo sapiens
ttcccttttacatactgct

SEQ ID NO: 3803388 - DNA, 21 bp, Homo sapiens
ttcccttttacatactgctgt

SEQ ID NO: 3803389 - DNA, 14 bp, Homo sapiens
ttcctatgtaactg

SEQ ID NO: 3803390 - DNA, 15 bp, Homo sapiens
ttctagggaaatgaa

SEQ ID NO: 3803391 - DNA, 23 bp, Homo sapiens
ttctctgaagagtgggtttcaca

SEQ ID NO: 3803392 - DNA, 15 bp, Homo sapiens
ttctgctttcatctt

SEQ ID NO: 3803393 - DNA, 21 bp, Homo sapiens
ttcttaaatgggctactttgt

SEQ ID NO: 3803394 - DNA, 14 bp, Homo sapiens
ttcttacatgtttt

SEQ ID NO: 3803395 - DNA, 19 bp, Homo sapiens
ttgagaactgcatatgttt

SEQ ID NO: 3803396 - DNA, 21 bp, Homo sapiens
ttgagaactgcatatgtttcg

SEQ ID NO: 3803397 - DNA, 12 bp, Homo sapiens
ttgagttttgtt

SEQ ID NO: 3803398 - DNA, 14 bp, Homo sapiens
ttgttatggcttaa

SEQ ID NO: 3803399 - DNA, 20 bp, Homo sapiens
ttgttttaaaattaaagcta

SEQ ID NO: 3803400 - DNA, 14 bp, Homo sapiens
tttaagtgtaactg

SEQ ID NO: 3803401 - DNA, 16 bp, Homo sapiens
tttaattcatgtttct

SEQ ID NO: 3803402 - DNA, 15 bp, Homo sapiens
tttacctgtgaaata

SEQ ID NO: 3803403 - DNA, 16 bp, Homo sapiens
tttacctgtgaaatag

SEQ ID NO: 3803404 - DNA, 14 bp, Homo sapiens
tttactgtttgtta

SEQ ID NO: 3803405 - DNA, 14 bp, Homo sapiens
tttccactactgct

SEQ ID NO: 3803406 - DNA, 16 bp, Homo sapiens
tttccgtggcactgca

SEQ ID NO: 3803407 - DNA, 16 bp, Homo sapiens
tttgagtggatgatgt

SEQ ID NO: 3803408 - DNA, 20 bp, Homo sapiens
tttgagtggatgatgtttcg

SEQ ID NO: 3803409 - DNA, 21 bp, Homo sapiens
tttgagtggatgatgtttcgt

SEQ ID NO: 3803410 - DNA, 15 bp, Homo sapiens
ttttacatactgctg

SEQ ID NO: 3803411 - DNA, 21 bp, Homo sapiens
ttttcatcttctctggcgaca

SEQ ID NO: 3803412 - DNA, 15 bp, Homo sapiens
ttttccactactgct

SEQ ID NO: 3803413 - DNA, 16 bp, Homo sapiens
ttttccattggtttac

SEQ ID NO: 3803414 - DNA, 16 bp, Homo sapiens
aatatgagaatcagat

SEQ ID NO: 3803415 - DNA, 18 bp, Homo sapiens
aatatgcacacagtgctt

SEQ ID NO: 3803416 - DNA, 13 bp, Homo sapiens
aatattgtttcta

SEQ ID NO: 3803417 - DNA, 22 bp, Homo sapiens
aattatatcagtcctctttcaa

SEQ ID NO: 3803418 - DNA, 17 bp, Homo sapiens
aattatttttacagttc

SEQ ID NO: 3803419 - DNA, 13 bp, Homo sapiens
aattctgtttctt

SEQ ID NO: 3803420 - DNA, 16 bp, Homo sapiens
aattctgtttcttgag

SEQ ID NO: 3803421 - DNA, 22 bp, Homo sapiens
aatttttctctaactcagaaac

SEQ ID NO: 3803422 - DNA, 12 bp, Homo sapiens
acaaattctgtt

SEQ ID NO: 3803423 - DNA, 14 bp, Homo sapiens
acaagttgtgtttg

SEQ ID NO: 3803424 - DNA, 15 bp, Homo sapiens
acaagttgtgtttga

SEQ ID NO: 3803425 - DNA, 21 bp, Homo sapiens
acaattatttttacagttctc

SEQ ID NO: 3803426 - DNA, 14 bp, Homo sapiens
acagttttccttct

SEQ ID NO: 3803427 - DNA, 22 bp, Homo sapiens
acatacaattatttttacagtt

SEQ ID NO: 3803428 - DNA, 12 bp, Homo sapiens
acattctgcttt

SEQ ID NO: 3803429 - DNA, 21 bp, Homo sapiens
actcagaaatttaattcatgt

SEQ ID NO: 3803430 - DNA, 17 bp, Homo sapiens
actctgttccttcacat

SEQ ID NO: 3803431 - DNA, 23 bp, Homo sapiens
actgacacaaaaagtagattaag

SEQ ID NO: 3803432 - DNA, 22 bp, Homo sapiens
actggcagttttccattggttt

SEQ ID NO: 3803433 - DNA, 12 bp, Homo sapiens
actgtttgttat

SEQ ID NO: 3803434 - DNA, 11 bp, Homo sapiens
actttttccag

SEQ ID NO: 3803435 - DNA, 23 bp, Homo sapiens
agaaacatcagttactctgaagg

SEQ ID NO: 3803436 - DNA, 19 bp, Homo sapiens
agaactgcatatgtttcgc

SEQ ID NO: 3803437 - DNA, 19 bp, Homo sapiens
agaatattagctttactgt

SEQ ID NO: 3803438 - DNA, 17 bp, Homo sapiens
agaattcttacatgttt

SEQ ID NO: 3803439 - DNA, 18 bp, Homo sapiens
agacaaattctgtttctt

SEQ ID NO: 3803440 - DNA, 16 bp, Homo sapiens
agagtgggtttcacaa

SEQ ID NO: 3803441 - DNA, 14 bp, Homo sapiens
agataaagatttct

SEQ ID NO: 3803442 - DNA, 17 bp, Homo sapiens
agataaagatttcttga

SEQ ID NO: 3803443 - DNA, 17 bp, Homo sapiens
agataatatgagaatca

SEQ ID NO: 3803444 - DNA, 19 bp, Homo sapiens
agatgtagataaactcaga

SEQ ID NO: 3803445 - DNA, 21 bp, Homo sapiens
agcaacatctagcaaatgtta

SEQ ID NO: 3803446 - DNA, 14 bp, Homo sapiens
agcaagtgaatttt

SEQ ID NO: 3803447 - DNA, 17 bp, Homo sapiens
agcagtaactgacaact

SEQ ID NO: 3803448 - DNA, 16 bp, Homo sapiens
aggaacggtaaatttc

SEQ ID NO: 3803449 - DNA, 13 bp, Homo sapiens
aggcattctctga

SEQ ID NO: 3803450 - DNA, 23 bp, Homo sapiens
aggttcttcccttttacatactg

SEQ ID NO: 3803451 - DNA, 14 bp, Homo sapiens
agtaactgacaact

SEQ ID NO: 3803452 - DNA, 14 bp, Homo sapiens
agtctattagccac

SEQ ID NO: 3803453 - DNA, 14 bp, Homo sapiens
agtgcccaactgtt

SEQ ID NO: 3803454 - DNA, 15 bp, Homo sapiens
agttactctgaaggg

SEQ ID NO: 3803455 - DNA, 23 bp, Homo sapiens
agttgattttacaattgaaatga

SEQ ID NO: 3803456 - DNA, 15 bp, Homo sapiens
ataatatgagaatca

SEQ ID NO: 3803457 - DNA, 12 bp, Homo sapiens
ataatatgcaca

SEQ ID NO: 3803458 - DNA, 20 bp, Homo sapiens
ataatatgcacacagtgctt

SEQ ID NO: 3803459 - DNA, 22 bp, Homo sapiens
atagatgtagataaactcagaa

SEQ ID NO: 3803460 - DNA, 23 bp, Homo sapiens
atataatatgcacacagtgcttt

SEQ ID NO: 3803461 - DNA, 23 bp, Homo sapiens
atatatgtgtttttcacatttgc

SEQ ID NO: 3803462 - DNA, 22 bp, Homo sapiens
atatgtgtttttcacatttgcg

SEQ ID NO: 3803463 - DNA, 12 bp, Homo sapiens
atattgtttcta

SEQ ID NO: 3803464 - DNA, 22 bp, Homo sapiens
atcagatcatttcaaaactcat

SEQ ID NO: 3803465 - DNA, 20 bp, Homo sapiens
atctggtagggggaaaatgt

SEQ ID NO: 3803466 - DNA, 23 bp, Homo sapiens
atcttgtttttccactactgcta

SEQ ID NO: 3803467 - DNA, 21 bp, Homo sapiens
atgaatttttttcatcttctc

SEQ ID NO: 3803468 - DNA, 14 bp, Homo sapiens
atgcatcttactga

SEQ ID NO: 3803469 - DNA, 18 bp, Homo sapiens
atgtagataaactcagaa

SEQ ID NO: 3803470 - DNA, 19 bp, Homo sapiens
atgtagataaactcagaaa

SEQ ID NO: 3803471 - DNA, 22 bp, Homo sapiens
atgtggctgtatcttgtttttc

SEQ ID NO: 3803472 - DNA, 18 bp, Homo sapiens
atgttatgcataaagtca

SEQ ID NO: 3803473 - DNA, 20 bp, Homo sapiens
atgtttcgtgaagtatactg

SEQ ID NO: 3803474 - DNA, 14 bp, Homo sapiens
attaaaacaatatt

SEQ ID NO: 3803475 - DNA, 18 bp, Homo sapiens
attaaagctaaagtatct

SEQ ID NO: 3803476 - DNA, 18 bp, Homo sapiens
attacatctttcacattg

SEQ ID NO: 3803477 - DNA, 15 bp, Homo sapiens
attagctttactgtt

SEQ ID NO: 3803478 - DNA, 15 bp, Homo sapiens
attatcatgcaaatg

SEQ ID NO: 3803479 - DNA, 17 bp, Homo sapiens
attatcatgcaaatgct

SEQ ID NO: 3803480 - DNA, 16 bp, Homo sapiens
attcaaaagttgaaat

SEQ ID NO: 3803481 - DNA, 12 bp, Homo sapiens
attcatgtttct

SEQ ID NO: 3803482 - DNA, 14 bp, Homo sapiens
attccctcctgcta

SEQ ID NO: 3803483 - DNA, 21 bp, Homo sapiens
attccctcctgctactctgtt

SEQ ID NO: 3803484 - DNA, 14 bp, Homo sapiens
attgagaactgcat

SEQ ID NO: 3803485 - DNA, 18 bp, Homo sapiens
attgagaactgcatatgt

SEQ ID NO: 3803486 - DNA, 17 bp, Homo sapiens
atttaattcatgtttct

SEQ ID NO: 3803487 - DNA, 18 bp, Homo sapiens
atttagggaactgcttga

SEQ ID NO: 3803488 - DNA, 20 bp, Homo sapiens
atttcctatgtaactgcatt

SEQ ID NO: 3803489 - DNA, 16 bp, Homo sapiens
atttctgtgggagaat

SEQ ID NO: 3803490 - DNA, 17 bp, Homo sapiens
attttacaattgaaatg

SEQ ID NO: 3803491 - DNA, 13 bp, Homo sapiens
caacatctagcaa

SEQ ID NO: 3803492 - DNA, 20 bp, Homo sapiens
caacattaaaacaatattgt

SEQ ID NO: 3803493 - DNA, 23 bp, Homo sapiens
caattatatcagtcctctttcaa

SEQ ID NO: 3803494 - DNA, 17 bp, Homo sapiens
cacatcctgtgtttcta

SEQ ID NO: 3803495 - DNA, 21 bp, Homo sapiens
cacttttttgagtggatgatg

SEQ ID NO: 3803496 - DNA, 17 bp, Homo sapiens
cagaaacatcagttact

SEQ ID NO: 3803497 - DNA, 15 bp, Homo sapiens
cagttactctgaagg

SEQ ID NO: 3803498 - DNA, 22 bp, Homo sapiens
cagttttccttctcatctgtga

SEQ ID NO: 3803499 - DNA, 21 bp, Homo sapiens
catcctgtgtttctagggaaa

SEQ ID NO: 3803500 - DNA, 22 bp, Homo sapiens
catcctgtgtttctagggaaat

SEQ ID NO: 3803501 - DNA, 16 bp, Homo sapiens
catgcaaatgctgtat

SEQ ID NO: 3803502 - DNA, 17 bp, Homo sapiens
catgcatcttactgaag

SEQ ID NO: 3803503 - DNA, 13 bp, Homo sapiens
cctacaccattcc

SEQ ID NO: 3803504 - DNA, 13 bp, Homo sapiens
cctgctactctgt

SEQ ID NO: 3803505 - DNA, 19 bp, Homo sapiens
cctgtgaaatagttcaaag

SEQ ID NO: 3803506 - DNA, 17 bp, Homo sapiens
ctatgtggctgtatctt

SEQ ID NO: 3803507 - DNA, 12 bp, Homo sapiens
ctcatctgtgat

SEQ ID NO: 3803508 - DNA, 17 bp, Homo sapiens
ctcctgtactttttcca

SEQ ID NO: 3803509 - DNA, 18 bp, Homo sapiens
ctctcctgtactttttcc

SEQ ID NO: 3803510 - DNA, 20 bp, Homo sapiens
ctctctcctgtactttttcc

SEQ ID NO: 3803511 - DNA, 22 bp, Homo sapiens
ctctgaagagtgggtttcacaa

SEQ ID NO: 3803512 - DNA, 23 bp, Homo sapiens
ctctgaagagtgggtttcacaag

SEQ ID NO: 3803513 - DNA, 19 bp, Homo sapiens
ctctgaagggcatcatgca

SEQ ID NO: 3803514 - DNA, 16 bp, Homo sapiens
ctctgttccttcacat

SEQ ID NO: 3803515 - DNA, 18 bp, Homo sapiens
ctgaatacattctgcttt

SEQ ID NO: 3803516 - DNA, 13 bp, Homo sapiens
ctgacaacttgaa

SEQ ID NO: 3803517 - DNA, 18 bp, Homo sapiens
ctgctactctgttccttc

SEQ ID NO: 3803518 - DNA, 15 bp, Homo sapiens
ctggcagttttccat

SEQ ID NO: 3803519 - DNA, 12 bp, Homo sapiens
ctgtgaaatagt

SEQ ID NO: 3803520 - DNA, 14 bp, Homo sapiens
cttcccttttacat

SEQ ID NO: 3803521 - DNA, 17 bp, Homo sapiens
ctttggtggagataaag

SEQ ID NO: 3803522 - DNA, 17 bp, Homo sapiens
ctttgtcctttttgtta

SEQ ID NO: 3803523 - DNA, 17 bp, Homo sapiens
cttttacatactgctgt

SEQ ID NO: 3803524 - DNA, 22 bp, Homo sapiens
gaaaaagcagtaactgacaact

SEQ ID NO: 3803525 - DNA, 19 bp, Homo sapiens
gaaacatcagttactctga

SEQ ID NO: 3803526 - DNA, 13 bp, Homo sapiens
gaaatgaaagaaa

SEQ ID NO: 3803527 - DNA, 23 bp, Homo sapiens
gaaatttaattcatgtttcttaa

SEQ ID NO: 3803528 - DNA, 15 bp, Homo sapiens
gaacggtaaatttct

SEQ ID NO: 3803529 - DNA, 15 bp, Homo sapiens
gaactgcatatgttt

SEQ ID NO: 3803530 - DNA, 18 bp, Homo sapiens
gaagagtgggtttcacaa

SEQ ID NO: 3803531 - DNA, 19 bp, Homo sapiens
gaattcttacatgttttct

SEQ ID NO: 3803532 - DNA, 21 bp, Homo sapiens
gacaaagacaaattctgtttc

SEQ ID NO: 3803533 - DNA, 20 bp, Homo sapiens
gacaaattctgtttcttgag

SEQ ID NO: 3803534 - DNA, 12 bp, Homo sapiens
gacaacattaaa

SEQ ID NO: 3803535 - DNA, 22 bp, Homo sapiens
gacaaggttcttcccttttaca

SEQ ID NO: 3803536 - DNA, 22 bp, Homo sapiens
tactgtatttttacctttttcc

SEQ ID NO: 3803537 - DNA, 17 bp, Homo sapiens
tagaaggatgtacattt

SEQ ID NO: 3803538 - DNA, 20 bp, Homo sapiens
tagatgtagataaactcaga

SEQ ID NO: 3803539 - DNA, 23 bp, Homo sapiens
tagatgtagataaactcagaaat

SEQ ID NO: 3803540 - DNA, 14 bp, Homo sapiens
tatattatcatgca

SEQ ID NO: 3803541 - DNA, 14 bp, Homo sapiens
tatgcataaagtca

SEQ ID NO: 3803542 - DNA, 15 bp, Homo sapiens
tatgcataaagtcag

SEQ ID NO: 3803543 - DNA, 15 bp, Homo sapiens
tattagccacaaaat

SEQ ID NO: 3803544 - DNA, 23 bp, Homo sapiens
tattagccacaaaattgggaaag

SEQ ID NO: 3803545 - DNA, 16 bp, Homo sapiens
tattatcatgcaaatg

SEQ ID NO: 3803546 - DNA, 18 bp, Homo sapiens
tatttagggaactgcttg

SEQ ID NO: 3803547 - DNA, 21 bp, Homo sapiens
tattttattacatctttcaca

SEQ ID NO: 3803548 - DNA, 15 bp, Homo sapiens
tcaaaagttgaaatt

SEQ ID NO: 3803549 - DNA, 16 bp, Homo sapiens
tcaaaagttgaaatta

SEQ ID NO: 3803550 - DNA, 23 bp, Homo sapiens
tcagaaatttaattcatgtttct

SEQ ID NO: 3803551 - DNA, 17 bp, Homo sapiens
tcagttactctgaaggg

SEQ ID NO: 3803552 - DNA, 13 bp, Homo sapiens
tcatcttctctgg

SEQ ID NO: 3803553 - DNA, 11 bp, Homo sapiens
tcatgtttctt

SEQ ID NO: 3803554 - DNA, 15 bp, Homo sapiens
tcatgtttcttaaat

SEQ ID NO: 3803555 - DNA, 13 bp, Homo sapiens
tccaaattcacaa

SEQ ID NO: 3803556 - DNA, 13 bp, Homo sapiens
tccagacactttt

SEQ ID NO: 3803557 - DNA, 22 bp, Homo sapiens
tccattggtttacctgtgaaat

SEQ ID NO: 3803558 - DNA, 17 bp, Homo sapiens
tcccttttacatactgc

SEQ ID NO: 3803559 - DNA, 19 bp, Homo sapiens
tcccttttacatactgctg

SEQ ID NO: 3803560 - DNA, 14 bp, Homo sapiens
tcctgctactctgt

SEQ ID NO: 3803561 - DNA, 18 bp, Homo sapiens
tcctgctactctgttcct

SEQ ID NO: 3803562 - DNA, 12 bp, Homo sapiens
tcctgtgtttct

SEQ ID NO: 3803563 - DNA, 21 bp, Homo sapiens
tccttatcactgacacaaaaa

SEQ ID NO: 3803564 - DNA, 14 bp, Homo sapiens
tcctttttgttatt

SEQ ID NO: 3803565 - DNA, 22 bp, Homo sapiens
tctctgaagagtgggtttcaca

SEQ ID NO: 3803566 - DNA, 18 bp, Homo sapiens
tctggcgacagttttcct

SEQ ID NO: 3803567 - DNA, 13 bp, Homo sapiens
tctgttccttcac

SEQ ID NO: 3803568 - DNA, 15 bp, Homo sapiens
tctgttccttcacat

SEQ ID NO: 3803569 - DNA, 21 bp, Homo sapiens
tcttctctggcgacagttttc

SEQ ID NO: 3803570 - DNA, 21 bp, Homo sapiens
tcttgagttttgttttaaaat

SEQ ID NO: 3803571 - DNA, 13 bp, Homo sapiens
tcttgtttttcca

SEQ ID NO: 3803572 - DNA, 18 bp, Homo sapiens
tgaaattaaccatagatg

SEQ ID NO: 3803573 - DNA, 15 bp, Homo sapiens
tgaagtatactgtat

SEQ ID NO: 3803574 - DNA, 21 bp, Homo sapiens
tgaatttttttcatcttctct

SEQ ID NO: 3803575 - DNA, 23 bp, Homo sapiens
tgaatttttttcatcttctctgg

SEQ ID NO: 3803576 - DNA, 17 bp, Homo sapiens
tgagaactgcatatgtt

SEQ ID NO: 3803577 - DNA, 18 bp, Homo sapiens
tgagtggatgatgtttcg

SEQ ID NO: 3803578 - DNA, 13 bp, Homo sapiens
tgatatatgtgtt

SEQ ID NO: 3803579 - DNA, 19 bp, Homo sapiens
tgattttacaattgaaatg

SEQ ID NO: 3803580 - DNA, 14 bp, Homo sapiens
tgcaacctgttgat

SEQ ID NO: 3803581 - DNA, 14 bp, Homo sapiens
tgcacacagtgctt

SEQ ID NO: 3803582 - DNA, 13 bp, Homo sapiens
tgcatatgtttcg

SEQ ID NO: 3803583 - DNA, 16 bp, Homo sapiens
tgctactctgttcctt

SEQ ID NO: 3803584 - DNA, 20 bp, Homo sapiens
tggagataaagatttcttga

SEQ ID NO: 3803585 - DNA, 17 bp, Homo sapiens
tggctgtatcttgtttt

SEQ ID NO: 3803586 - DNA, 16 bp, Homo sapiens
tgggctactttgtcct

SEQ ID NO: 3803587 - DNA, 22 bp, Homo sapiens
tgggtttcacaagtgaaaaaca

SEQ ID NO: 3803588 - DNA, 17 bp, Homo sapiens
tgtcctttttgttatta

SEQ ID NO: 3803589 - DNA, 20 bp, Homo sapiens
tgttggataaatcagtggtt

SEQ ID NO: 3803590 - DNA, 15 bp, Homo sapiens
tgtttcgtgaagtat

SEQ ID NO: 3803591 - DNA, 20 bp, Homo sapiens
ttaaaacaatattgtttcta

SEQ ID NO: 3803592 - DNA, 14 bp, Homo sapiens
ttacatactgctgt

SEQ ID NO: 3803593 - DNA, 18 bp, Homo sapiens
ttacatgttttctttgct

SEQ ID NO: 3803594 - DNA, 18 bp, Homo sapiens
ttatcactgacacaaaaa

SEQ ID NO: 3803595 - DNA, 17 bp, Homo sapiens
ttatttagggaactgct

SEQ ID NO: 3803596 - DNA, 17 bp, Homo sapiens
ttcaaaagttgaaatta

SEQ ID NO: 3803597 - DNA, 18 bp, Homo sapiens
ttcacatcctgtgtttct

SEQ ID NO: 3803598 - DNA, 21 bp, Homo sapiens
ttcacatcctgtgtttctagg

SEQ ID NO: 3803599 - DNA, 15 bp, Homo sapiens
ttccaaattcacaag

SEQ ID NO: 3803600 - DNA, 16 bp, Homo sapiens
ttccttctcatctgtg

SEQ ID NO: 3803601 - DNA, 17 bp, Homo sapiens
ttcgtgaagtatactgt

SEQ ID NO: 3803602 - DNA, 21 bp, Homo sapiens
ttcgtgaagtatactgtattt

SEQ ID NO: 3803603 - DNA, 22 bp, Homo sapiens
ttctgtgggagaattcttacat

SEQ ID NO: 3803604 - DNA, 11 bp, Homo sapiens
ttctgtttctt

SEQ ID NO: 3803605 - DNA, 13 bp, Homo sapiens
ttcttacatgttt

SEQ ID NO: 3803606 - DNA, 21 bp, Homo sapiens
ttcttcccttttacatactgc

SEQ ID NO: 3803607 - DNA, 22 bp, Homo sapiens
ttcttcccttttacatactgct

SEQ ID NO: 3803608 - DNA, 21 bp, Homo sapiens
ttgaaaggcattctctgaaga

SEQ ID NO: 3803609 - DNA, 17 bp, Homo sapiens
ttgagtggatgatgttt

SEQ ID NO: 3803610 - DNA, 19 bp, Homo sapiens
ttgagtggatgatgtttcg

SEQ ID NO: 3803611 - DNA, 13 bp, Homo sapiens
ttgattttacaat

SEQ ID NO: 3803612 - DNA, 23 bp, Homo sapiens
ttgattttacaattgaaatgact

SEQ ID NO: 3803613 - DNA, 22 bp, Homo sapiens
tttaagtgtaactggcagtttt

SEQ ID NO: 3803614 - DNA, 15 bp, Homo sapiens
tttacaattgaaatg

SEQ ID NO: 3803615 - DNA, 16 bp, Homo sapiens
tttacaattgaaatga

SEQ ID NO: 3803616 - DNA, 16 bp, Homo sapiens
tttattacatctttca

SEQ ID NO: 3803617 - DNA, 13 bp, Homo sapiens
tttccactactgc

SEQ ID NO: 3803618 - DNA, 15 bp, Homo sapiens
tttccactactgcta

SEQ ID NO: 3803619 - DNA, 21 bp, Homo sapiens
tttccattggtttacctgtga

SEQ ID NO: 3803620 - DNA, 15 bp, Homo sapiens
tttccttctcatctg

SEQ ID NO: 3803621 - DNA, 18 bp, Homo sapiens
tttccttctcatctgtga

SEQ ID NO: 3803622 - DNA, 17 bp, Homo sapiens
tttgatatccaaagctg

SEQ ID NO: 3803623 - DNA, 15 bp, Homo sapiens
tttgttttaaaatta

SEQ ID NO: 3803624 - DNA, 13 bp, Homo sapiens
ttttccactactg

SEQ ID NO: 3803625 - DNA, 17 bp, Homo sapiens
ttttctctaactcagaa

SEQ ID NO: 3803626 - DNA, 18 bp, Homo sapiens
gaatttccttactcttga

SEQ ID NO: 3803627 - DNA, 11 bp, Homo sapiens
ttatatttcca

SEQ ID NO: 3803628 - DNA, 15 bp, Homo sapiens
aaaacaggcaaattc

SEQ ID NO: 3803629 - DNA, 18 bp, Homo sapiens
taattatttcactttaga

SEQ ID NO: 3803630 - DNA, 16 bp, Homo sapiens
agtaaaggcaaactta

SEQ ID NO: 3803631 - DNA, 15 bp, Homo sapiens
tagaatatatttcct

SEQ ID NO: 3803632 - DNA, 23 bp, Homo sapiens
aagagcaggcacatggaggagct

SEQ ID NO: 3803633 - DNA, 21 bp, Homo sapiens
aagaggaaaatgaataataca

SEQ ID NO: 3803634 - DNA, 19 bp, Homo sapiens
aagagggtgaacaaagaaa

SEQ ID NO: 3803635 - DNA, 21 bp, Homo sapiens
aagaggtatttatctttactt

SEQ ID NO: 3803636 - DNA, 21 bp, Homo sapiens
aagataatcttagctgccaag

SEQ ID NO: 3803637 - DNA, 18 bp, Homo sapiens
aagatgagctgcagcccc

SEQ ID NO: 3803638 - DNA, 19 bp, Homo sapiens
aagatgcttctcactgcca

SEQ ID NO: 3803639 - DNA, 18 bp, Homo sapiens
aagatgttgtgtcttgtg

SEQ ID NO: 3803640 - DNA, 21 bp, Homo sapiens
aagattatatatcataaagta

SEQ ID NO: 3803641 - DNA, 23 bp, Homo sapiens
aagattatatatcataaagtatg

SEQ ID NO: 3803642 - DNA, 20 bp, Homo sapiens
aagattttcctattccttgg

SEQ ID NO: 3803643 - DNA, 20 bp, Homo sapiens
aagcactgctgtgtccgctt

SEQ ID NO: 3803644 - DNA, 23 bp, Homo sapiens
aagcagacgtgagtgtgactttt

SEQ ID NO: 3803645 - DNA, 11 bp, Homo sapiens
aagcagagcca

SEQ ID NO: 3803646 - DNA, 12 bp, Homo sapiens
aagcagagccaa

SEQ ID NO: 3803647 - DNA, 19 bp, Homo sapiens
aagcagagccaaggccacc

SEQ ID NO: 3803648 - DNA, 14 bp, Homo sapiens
aagcagaggaagga

SEQ ID NO: 3803649 - DNA, 21 bp, Homo sapiens
aagcagaggaaggagaggaga

SEQ ID NO: 3803650 - DNA, 18 bp, Homo sapiens
aagccggcagaaatagct

SEQ ID NO: 3803651 - DNA, 21 bp, Homo sapiens
aagcctgcctaggaattccca

SEQ ID NO: 3803652 - DNA, 14 bp, Homo sapiens
aagctcagtggcaa

SEQ ID NO: 3803653 - DNA, 18 bp, Homo sapiens
aagctctgaacaaaagct

SEQ ID NO: 3803654 - DNA, 14 bp, Homo sapiens
aagctctgcctccc

SEQ ID NO: 3803655 - DNA, 19 bp, Homo sapiens
aagctgcaccctcaggcag

SEQ ID NO: 3803656 - DNA, 21 bp, Homo sapiens
aagctgtagaactctgcaggc

SEQ ID NO: 3803657 - DNA, 18 bp, Homo sapiens
aagctgttactgtcttca

SEQ ID NO: 3803658 - DNA, 18 bp, Homo sapiens
aagcttcaaactgcatga

SEQ ID NO: 3803659 - DNA, 14 bp, Homo sapiens
aagctttctccttt

SEQ ID NO: 3803660 - DNA, 15 bp, Homo sapiens
aaggaattctaggca

SEQ ID NO: 3803661 - DNA, 17 bp, Homo sapiens
aaggacaacctgcccct

SEQ ID NO: 3803662 - DNA, 20 bp, Homo sapiens
aaggagaaaatgcattatgt

SEQ ID NO: 3803663 - DNA, 16 bp, Homo sapiens
aaggagccagccagga

SEQ ID NO: 3803664 - DNA, 18 bp, Homo sapiens
aaggaggaagagaaaaaa

SEQ ID NO: 3803665 - DNA, 20 bp, Homo sapiens
aaggaggaagagaaaaaata

SEQ ID NO: 3803666 - DNA, 16 bp, Homo sapiens
aaggaggaaggagcct

SEQ ID NO: 3803667 - DNA, 17 bp, Homo sapiens
aaggagtagtattttgg

SEQ ID NO: 3803668 - DNA, 23 bp, Homo sapiens
aaggcagtgaacacactcagcag

SEQ ID NO: 3803669 - DNA, 23 bp, Homo sapiens
aaggctatggggatagatgtgtg

SEQ ID NO: 3803670 - DNA, 18 bp, Homo sapiens
aaggctctgaaagccagc

SEQ ID NO: 3803671 - DNA, 15 bp, Homo sapiens
aaggctgaccaagag

SEQ ID NO: 3803672 - DNA, 19 bp, Homo sapiens
aaggctgaccaagagagaa

SEQ ID NO: 3803673 - DNA, 12 bp, Homo sapiens
aaggctgagagc

SEQ ID NO: 3803674 - DNA, 17 bp, Homo sapiens
aaggctgagagctctct

SEQ ID NO: 3803675 - DNA, 14 bp, Homo sapiens
aaggctgatgcatt

SEQ ID NO: 3803676 - DNA, 16 bp, Homo sapiens
aaggctgggggaagaa

SEQ ID NO: 3803677 - DNA, 19 bp, Homo sapiens
aaggctgggggaagaagct

SEQ ID NO: 3803678 - DNA, 17 bp, Homo sapiens
aaggctgggtccagggg

SEQ ID NO: 3803679 - DNA, 18 bp, Homo sapiens
aaggtattaaattgatgt

SEQ ID NO: 3803680 - DNA, 22 bp, Homo sapiens
aaggtattaaattgatgttgct

SEQ ID NO: 3803681 - DNA, 13 bp, Homo sapiens
aaggtctttggtt

SEQ ID NO: 3803682 - DNA, 20 bp, Homo sapiens
aaggttttcctcttctattt

SEQ ID NO: 3803683 - DNA, 22 bp, Homo sapiens
aagtaaccaggccccagcctcc

SEQ ID NO: 3803684 - DNA, 18 bp, Homo sapiens
aagtaatctttaaactgg

SEQ ID NO: 3803685 - DNA, 11 bp, Homo sapiens
aagtaatgaaa

SEQ ID NO: 3803686 - DNA, 21 bp, Homo sapiens
aagtataggataaattacatt

SEQ ID NO: 3803687 - DNA, 23 bp, Homo sapiens
aagtataggataaattacattaa

SEQ ID NO: 3803688 - DNA, 14 bp, Homo sapiens
aagtatatattcta

SEQ ID NO: 3803689 - DNA, 11 bp, Homo sapiens
aagtatttagg

SEQ ID NO: 3803690 - DNA, 16 bp, Homo sapiens
aagtatttaggttttt

SEQ ID NO: 3803691 - DNA, 21 bp, Homo sapiens
aagtcaagtgaaaaaggagga

SEQ ID NO: 3803692 - DNA, 17 bp, Homo sapiens
aagtcacatataaaagt

SEQ ID NO: 3803693 - DNA, 14 bp, Homo sapiens
aagtcaccggagct

SEQ ID NO: 3803694 - DNA, 21 bp, Homo sapiens
aagtcaggcccttattttcaa

SEQ ID NO: 3803695 - DNA, 20 bp, Homo sapiens
aagtccttgacctctataaa

SEQ ID NO: 3803696 - DNA, 15 bp, Homo sapiens
aagtctctctgtgaa

SEQ ID NO: 3803697 - DNA, 18 bp, Homo sapiens
aagtcttccctgatcaag

SEQ ID NO: 3803698 - DNA, 21 bp, Homo sapiens
aagtgaaaaaggaggaagaga

SEQ ID NO: 3803699 - DNA, 17 bp, Homo sapiens
aagtgcggtgctttagc

SEQ ID NO: 3803700 - DNA, 20 bp, Homo sapiens
aagtgtgggtctgtgtgtgt

SEQ ID NO: 3803701 - DNA, 20 bp, Homo sapiens
aagtttgagatcagcctggg

SEQ ID NO: 3803702 - DNA, 14 bp, Homo sapiens
aagttttctttcca

SEQ ID NO: 3803703 - DNA, 13 bp, Homo sapiens
aataaaaccagct

SEQ ID NO: 3803704 - DNA, 15 bp, Homo sapiens
aataaactagggttt

SEQ ID NO: 3803705 - DNA, 21 bp, Homo sapiens
aataaactagggttttggcct

SEQ ID NO: 3803706 - DNA, 13 bp, Homo sapiens
aataaagcagagc

SEQ ID NO: 3803707 - DNA, 16 bp, Homo sapiens
aataaagcagagccaa

SEQ ID NO: 3803708 - DNA, 20 bp, Homo sapiens
aataaagcagagccaaggcc

SEQ ID NO: 3803709 - DNA, 21 bp, Homo sapiens
aataaagcagagccaaggcca

SEQ ID NO: 3803710 - DNA, 16 bp, Homo sapiens
aataaaggagaagaga

SEQ ID NO: 3803711 - DNA, 15 bp, Homo sapiens
aataatagggaaaat

SEQ ID NO: 3803712 - DNA, 19 bp, Homo sapiens
aataatccttaaactagct

SEQ ID NO: 3803713 - DNA, 16 bp, Homo sapiens
aatacaattaaaggtc

SEQ ID NO: 3803714 - DNA, 20 bp, Homo sapiens
aatacgccagaactgcttta

SEQ ID NO: 3803715 - DNA, 18 bp, Homo sapiens
aatacgttgttaaatggt

SEQ ID NO: 3803716 - DNA, 20 bp, Homo sapiens
aatactctaccctcttagaa

SEQ ID NO: 3803717 - DNA, 16 bp, Homo sapiens
aatagagacacagaga

SEQ ID NO: 3803718 - DNA, 19 bp, Homo sapiens
aatagcacatgattttctt

SEQ ID NO: 3803719 - DNA, 14 bp, Homo sapiens
aatattcaataaag

SEQ ID NO: 3803720 - DNA, 15 bp, Homo sapiens
aatattcaataaagc

SEQ ID NO: 3803721 - DNA, 12 bp, Homo sapiens
aatatttgtaca

SEQ ID NO: 3803722 - DNA, 14 bp, Homo sapiens
aatatttgtacata

SEQ ID NO: 3803723 - DNA, 20 bp, Homo sapiens
aatcagagctggcagcctcc

SEQ ID NO: 3803724 - DNA, 14 bp, Homo sapiens
aatcagcatttagt

SEQ ID NO: 3803725 - DNA, 11 bp, Homo sapiens
aatcagcctgc

SEQ ID NO: 3803726 - DNA, 18 bp, Homo sapiens
aatcagcctgctccagct

SEQ ID NO: 3803727 - DNA, 22 bp, Homo sapiens
aatcagtcatgtgtaatatgca

SEQ ID NO: 3803728 - DNA, 13 bp, Homo sapiens
aatcattgtatca

SEQ ID NO: 3803729 - DNA, 18 bp, Homo sapiens
aatctggcaaagttatat

SEQ ID NO: 3803730 - DNA, 17 bp, Homo sapiens
aatgaattaaataaacc

SEQ ID NO: 3803731 - DNA, 21 bp, Homo sapiens
aatgaccagtaattgtgaaaa

SEQ ID NO: 3803732 - DNA, 14 bp, Homo sapiens
aatgagcattagct

SEQ ID NO: 3803733 - DNA, 13 bp, Homo sapiens
aatgagcctggca

SEQ ID NO: 3803734 - DNA, 15 bp, Homo sapiens
aatgatcaaaacatg

SEQ ID NO: 3803735 - DNA, 21 bp, Homo sapiens
aatgatgatcctaggcatttg

SEQ ID NO: 3803736 - DNA, 18 bp, Homo sapiens
aatgatggcaattttgta

SEQ ID NO: 3803737 - DNA, 14 bp, Homo sapiens
aatgcataaatgca

SEQ ID NO: 3803738 - DNA, 22 bp, Homo sapiens
aatgcattataggatcatttgt

SEQ ID NO: 3803739 - DNA, 23 bp, Homo sapiens
aatgcattataggatcatttgtt

SEQ ID NO: 3803740 - DNA, 23 bp, Homo sapiens
agttgattcagctctgcaagaat

SEQ ID NO: 3803741 - DNA, 20 bp, Homo sapiens
agttgattgcgagaattttc

SEQ ID NO: 3803742 - DNA, 21 bp, Homo sapiens
agtttatttttttgatggcta

SEQ ID NO: 3803743 - DNA, 22 bp, Homo sapiens
agtttcaagtatccttgttgac

SEQ ID NO: 3803744 - DNA, 18 bp, Homo sapiens
agtttgagatcagcctgg

SEQ ID NO: 3803745 - DNA, 20 bp, Homo sapiens
agtttgagatcagcctgggc

SEQ ID NO: 3803746 - DNA, 19 bp, Homo sapiens
agtttgtggtaaaaagatt

SEQ ID NO: 3803747 - DNA, 14 bp, Homo sapiens
ataaactaggtaaa

SEQ ID NO: 3803748 - DNA, 13 bp, Homo sapiens
ataaacttcagag

SEQ ID NO: 3803749 - DNA, 21 bp, Homo sapiens
ataaagcagagccaaggccac

SEQ ID NO: 3803750 - DNA, 22 bp, Homo sapiens
ataaagcagagccaaggccacc

SEQ ID NO: 3803751 - DNA, 13 bp, Homo sapiens
ataaaggtattta

SEQ ID NO: 3803752 - DNA, 19 bp, Homo sapiens
ataaagtatggtattgaaa

SEQ ID NO: 3803753 - DNA, 14 bp, Homo sapiens
ataaataaaatgac

SEQ ID NO: 3803754 - DNA, 12 bp, Homo sapiens
ataaatgctgaa

SEQ ID NO: 3803755 - DNA, 14 bp, Homo sapiens
ataacaacttcata

SEQ ID NO: 3803756 - DNA, 13 bp, Homo sapiens
ataacatgtaaaa

SEQ ID NO: 3803757 - DNA, 16 bp, Homo sapiens
ataactgagcttagag

SEQ ID NO: 3803758 - DNA, 22 bp, Homo sapiens
aatgccctacctgcctgttctc

SEQ ID NO: 3803759 - DNA, 14 bp, Homo sapiens
aatgctagaagaaa

SEQ ID NO: 3803760 - DNA, 21 bp, Homo sapiens
aatgctattcagataaggcag

SEQ ID NO: 3803761 - DNA, 16 bp, Homo sapiens
aatgcttccaagcatg

SEQ ID NO: 3803762 - DNA, 18 bp, Homo sapiens
aatgcttctgcctcagct

SEQ ID NO: 3803763 - DNA, 15 bp, Homo sapiens
aatggaaaggagagg

SEQ ID NO: 3803764 - DNA, 18 bp, Homo sapiens
aatggcacgatctcagct

SEQ ID NO: 3803765 - DNA, 22 bp, Homo sapiens
aatggcacgatctcagctcacc

SEQ ID NO: 3803766 - DNA, 15 bp, Homo sapiens
aatgtaacttttgta

SEQ ID NO: 3803767 - DNA, 22 bp, Homo sapiens
aatgtaacttttgtaagacaaa

SEQ ID NO: 3803768 - DNA, 14 bp, Homo sapiens
aatgtcagaaactc

SEQ ID NO: 3803769 - DNA, 13 bp, Homo sapiens
aatgtcccagagg

SEQ ID NO: 3803770 - DNA, 14 bp, Homo sapiens
aatgtcccagaggc

SEQ ID NO: 3803771 - DNA, 17 bp, Homo sapiens
aatgtgaaaagaaaaat

SEQ ID NO: 3803772 - DNA, 17 bp, Homo sapiens
aatgtggcagctgtctc

SEQ ID NO: 3803773 - DNA, 21 bp, Homo sapiens
aatgtggcccctgaacaagaa

SEQ ID NO: 3803774 - DNA, 21 bp, Homo sapiens
aatgttctctcttctccacct

SEQ ID NO: 3803775 - DNA, 14 bp, Homo sapiens
aatgttggaatgtt

SEQ ID NO: 3803776 - DNA, 12 bp, Homo sapiens
aattatgtttct

SEQ ID NO: 3803777 - DNA, 13 bp, Homo sapiens
aattcctcatttg

SEQ ID NO: 3803778 - DNA, 14 bp, Homo sapiens
aattcctcatttgt

SEQ ID NO: 3803779 - DNA, 15 bp, Homo sapiens
aattcctcatttgtt

SEQ ID NO: 3803780 - DNA, 20 bp, Homo sapiens
aattcctcatttgttcatta

SEQ ID NO: 3803781 - DNA, 14 bp, Homo sapiens
aattctgtttttct

SEQ ID NO: 3803782 - DNA, 17 bp, Homo sapiens
aattgaaggagaaaatg

SEQ ID NO: 3803783 - DNA, 20 bp, Homo sapiens
aattgaaggagaaaatgcat

SEQ ID NO: 3803784 - DNA, 15 bp, Homo sapiens
aattgatttcaagac

SEQ ID NO: 3803785 - DNA, 11 bp, Homo sapiens
aattgtgatgt

SEQ ID NO: 3803786 - DNA, 23 bp, Homo sapiens
aattgttgctaatcttcttatgc

SEQ ID NO: 3803787 - DNA, 16 bp, Homo sapiens
aatttctaccatttca

SEQ ID NO: 3803788 - DNA, 18 bp, Homo sapiens
aattttactgacagaaat

SEQ ID NO: 3803789 - DNA, 21 bp, Homo sapiens
aattttactgacagaaatgca

SEQ ID NO: 3803790 - DNA, 17 bp, Homo sapiens
aattttcaaataaggaa

SEQ ID NO: 3803791 - DNA, 22 bp, Homo sapiens
aattttctttagcttttaccaa

SEQ ID NO: 3803792 - DNA, 18 bp, Homo sapiens
aattttctttcatacatt

SEQ ID NO: 3803793 - DNA, 20 bp, Homo sapiens
aattttctttcatacattat

SEQ ID NO: 3803794 - DNA, 13 bp, Homo sapiens
aattttgttgctg

SEQ ID NO: 3803795 - DNA, 19 bp, Homo sapiens
aatttttttttcctagccc

SEQ ID NO: 3803796 - DNA, 22 bp, Homo sapiens
acaaacatctaataagtatata

SEQ ID NO: 3803797 - DNA, 23 bp, Homo sapiens
acaaacctgaaaagatgttgtgt

SEQ ID NO: 3803798 - DNA, 24 bp, Homo sapiens
acaaaggttgagatgtaaaaggta

SEQ ID NO: 3803799 - DNA, 21 bp, Homo sapiens
acaaaggttttcctcttctat

SEQ ID NO: 3803800 - DNA, 14 bp, Homo sapiens
acaaagttcactgt

SEQ ID NO: 3803801 - DNA, 22 bp, Homo sapiens
acaaagttcactgtttattgaa

SEQ ID NO: 3803802 - DNA, 12 bp, Homo sapiens
acaaattgtttt

SEQ ID NO: 3803803 - DNA, 18 bp, Homo sapiens
acaaattgtttttactgt

SEQ ID NO: 3803804 - DNA, 23 bp, Homo sapiens
acaacatttttgtacattatgtt

SEQ ID NO: 3803805 - DNA, 20 bp, Homo sapiens
acaacttttaaagaaaaata

SEQ ID NO: 3803806 - DNA, 13 bp, Homo sapiens
acaagagtgaatt

SEQ ID NO: 3803807 - DNA, 13 bp, Homo sapiens
acaagctgcaccc

SEQ ID NO: 3803808 - DNA, 19 bp, Homo sapiens
acaagctgcaccctcaggc

SEQ ID NO: 3803809 - DNA, 12 bp, Homo sapiens
acaatgtaaagt

SEQ ID NO: 3803810 - DNA, 19 bp, Homo sapiens
acaatgtgaaaagaaaaat

SEQ ID NO: 3803811 - DNA, 18 bp, Homo sapiens
acacaaacgggctcagca

SEQ ID NO: 3803812 - DNA, 22 bp, Homo sapiens
acacacagaggaagagcaggca

SEQ ID NO: 3803813 - DNA, 21 bp, Homo sapiens
acacagaggaagagcaggcac

SEQ ID NO: 3803814 - DNA, 15 bp, Homo sapiens
acacagatatgcaca

SEQ ID NO: 3803815 - DNA, 13 bp, Homo sapiens
acaccagccctgc

SEQ ID NO: 3803816 - DNA, 23 bp, Homo sapiens
acaccagccctgctgcttcctaa

SEQ ID NO: 3803817 - DNA, 14 bp, Homo sapiens
acacccactggcca

SEQ ID NO: 3803818 - DNA, 14 bp, Homo sapiens
acaccccagcccac

SEQ ID NO: 3803819 - DNA, 17 bp, Homo sapiens
acaccccgacttttgtt

SEQ ID NO: 3803820 - DNA, 21 bp, Homo sapiens
acacccgacaccagccctgct

SEQ ID NO: 3803821 - DNA, 13 bp, Homo sapiens
acacctcccagga

SEQ ID NO: 3803822 - DNA, 19 bp, Homo sapiens
acacctcccaggagacagt

SEQ ID NO: 3803823 - DNA, 21 bp, Homo sapiens
acacctctgcacaagctgcac

SEQ ID NO: 3803824 - DNA, 16 bp, Homo sapiens
acacctcttggggagt

SEQ ID NO: 3803825 - DNA, 14 bp, Homo sapiens
acacctgccctgcc

SEQ ID NO: 3803826 - DNA, 15 bp, Homo sapiens
acacctgccctgccc

SEQ ID NO: 3803827 - DNA, 22 bp, Homo sapiens
acacctgccctgccctgccacc

SEQ ID NO: 3803828 - DNA, 15 bp, Homo sapiens
acacggacactcaaa

SEQ ID NO: 3803829 - DNA, 18 bp, Homo sapiens
acacggaggcatctgcac

SEQ ID NO: 3803830 - DNA, 23 bp, Homo sapiens
acactacttgagaaaatgcagga

SEQ ID NO: 3803831 - DNA, 14 bp, Homo sapiens
acactgagccccac

SEQ ID NO: 3803832 - DNA, 17 bp, Homo sapiens
acagaacccctacatga

SEQ ID NO: 3803833 - DNA, 17 bp, Homo sapiens
acagagacagaaacaga

SEQ ID NO: 3803834 - DNA, 23 bp, Homo sapiens
acagagacaggcccaagagatga

SEQ ID NO: 3803835 - DNA, 16 bp, Homo sapiens
acagagatatgcacac

SEQ ID NO: 3803836 - DNA, 14 bp, Homo sapiens
acagagccagaggc

SEQ ID NO: 3803837 - DNA, 15 bp, Homo sapiens
acagagccagaggca

SEQ ID NO: 3803838 - DNA, 20 bp, Homo sapiens
acagagttggtgttcataat

SEQ ID NO: 3803839 - DNA, 20 bp, Homo sapiens
acagatactcctccaaggtt

SEQ ID NO: 3803840 - DNA, 14 bp, Homo sapiens
acagatatgcacac

SEQ ID NO: 3803841 - DNA, 19 bp, Homo sapiens
acagatatgcacacacatg

SEQ ID NO: 3803842 - DNA, 16 bp, Homo sapiens
acagatgcacacacag

SEQ ID NO: 3803843 - DNA, 19 bp, Homo sapiens
acagcaattcctcaggcta

SEQ ID NO: 3803844 - DNA, 14 bp, Homo sapiens
acagcatctctatg

SEQ ID NO: 3803845 - DNA, 12 bp, Homo sapiens
acagcctggctg

SEQ ID NO: 3803846 - DNA, 20 bp, Homo sapiens
acagcctgggaccagggcat

SEQ ID NO: 3803847 - DNA, 14 bp, Homo sapiens
acagcgcctcctgg

SEQ ID NO: 3803848 - DNA, 20 bp, Homo sapiens
acagctcaagtcttccctga

SEQ ID NO: 3803849 - DNA, 17 bp, Homo sapiens
acaggcaccagatggga

SEQ ID NO: 3803850 - DNA, 18 bp, Homo sapiens
acaggcccaagagatgaa

SEQ ID NO: 3803851 - DNA, 13 bp, Homo sapiens
acagggagctggc

SEQ ID NO: 3803852 - DNA, 15 bp, Homo sapiens
acaggttagctgctc

SEQ ID NO: 3803853 - DNA, 17 bp, Homo sapiens
acagtagaggcatgaac

SEQ ID NO: 3803854 - DNA, 12 bp, Homo sapiens
acagtgagcctg

SEQ ID NO: 3803855 - DNA, 21 bp, Homo sapiens
acagtgagcctgaattttgtt

SEQ ID NO: 3803856 - DNA, 19 bp, Homo sapiens
acagtgtttcctgagtagc

SEQ ID NO: 3803857 - DNA, 15 bp, Homo sapiens
acataaataaaatga

SEQ ID NO: 3803858 - DNA, 19 bp, Homo sapiens
acataaataaaatgaccag

SEQ ID NO: 3803859 - DNA, 23 bp, Homo sapiens
acatatatgtatatgtatatcta

SEQ ID NO: 3803860 - DNA, 15 bp, Homo sapiens
acatcacttgtacaa

SEQ ID NO: 3803861 - DNA, 19 bp, Homo sapiens
acatccaggcaatggccta

SEQ ID NO: 3803862 - DNA, 15 bp, Homo sapiens
acatgaaacagaaac

SEQ ID NO: 3803863 - DNA, 16 bp, Homo sapiens
actccgcccagcctct

SEQ ID NO: 3803864 - DNA, 17 bp, Homo sapiens
actccgcccagcctctc

SEQ ID NO: 3803865 - DNA, 13 bp, Homo sapiens
actcctgacctcg

SEQ ID NO: 3803866 - DNA, 17 bp, Homo sapiens
actcgactctgctgctc

SEQ ID NO: 3803867 - DNA, 15 bp, Homo sapiens
actcgatgaatgtgt

SEQ ID NO: 3803868 - DNA, 22 bp, Homo sapiens
actctgaggacatggagagaga

SEQ ID NO: 3803869 - DNA, 12 bp, Homo sapiens
actctgcaggaa

SEQ ID NO: 3803870 - DNA, 12 bp, Homo sapiens
actctgctgctc

SEQ ID NO: 3803871 - DNA, 12 bp, Homo sapiens
actctgttcctg

SEQ ID NO: 3803872 - DNA, 13 bp, Homo sapiens
actcttggccaga

SEQ ID NO: 3803873 - DNA, 18 bp, Homo sapiens
actctttgctacaataaa

SEQ ID NO: 3803874 - DNA, 19 bp, Homo sapiens
actctttgctacaataaat

SEQ ID NO: 3803875 - DNA, 14 bp, Homo sapiens
actgaaggctttca

SEQ ID NO: 3803876 - DNA, 17 bp, Homo sapiens
actgaagtgcagctcag

SEQ ID NO: 3803877 - DNA, 18 bp, Homo sapiens
actgaagtgcagctcagg

SEQ ID NO: 3803878 - DNA, 14 bp, Homo sapiens
actgagccccacct

SEQ ID NO: 3803879 - DNA, 16 bp, Homo sapiens
actgagcttagagtat

SEQ ID NO: 3803880 - DNA, 16 bp, Homo sapiens
actgaggaattttctt

SEQ ID NO: 3803881 - DNA, 15 bp, Homo sapiens
actgaggccattatt

SEQ ID NO: 3803882 - DNA, 14 bp, Homo sapiens
actgattccagcaa

SEQ ID NO: 3803883 - DNA, 15 bp, Homo sapiens
actgattccagcaag

SEQ ID NO: 3803884 - DNA, 14 bp, Homo sapiens
actgcaagctctgc

SEQ ID NO: 3803885 - DNA, 15 bp, Homo sapiens
actgcaagctctgcc

SEQ ID NO: 3803886 - DNA, 16 bp, Homo sapiens
actgcaagctctgcct

SEQ ID NO: 3803887 - DNA, 20 bp, Homo sapiens
actgcaagctctgcctcccg

SEQ ID NO: 3803888 - DNA, 19 bp, Homo sapiens
actgcactcatagggtgct

SEQ ID NO: 3803889 - DNA, 17 bp, Homo sapiens
actgccaaaaatagaaa

SEQ ID NO: 3803890 - DNA, 15 bp, Homo sapiens
actgccaaaacaatg

SEQ ID NO: 3803891 - DNA, 13 bp, Homo sapiens
actgccgcctcct

SEQ ID NO: 3803892 - DNA, 20 bp, Homo sapiens
actgcgccacggcactccag

SEQ ID NO: 3803893 - DNA, 15 bp, Homo sapiens
actgctgatgctgaa

SEQ ID NO: 3803894 - DNA, 19 bp, Homo sapiens
actgctgatgctgaaataa

SEQ ID NO: 3803895 - DNA, 22 bp, Homo sapiens
actgctgatgctgaaataaact

SEQ ID NO: 3803896 - DNA, 17 bp, Homo sapiens
actgctgtgtccgcttt

SEQ ID NO: 3803897 - DNA, 16 bp, Homo sapiens
actggaccactgggca

SEQ ID NO: 3803898 - DNA, 20 bp, Homo sapiens
actggaccactgggcaatga

SEQ ID NO: 3803899 - DNA, 21 bp, Homo sapiens
actggaccactgggcaatgat

SEQ ID NO: 3803900 - DNA, 16 bp, Homo sapiens
actggcatctccctga

SEQ ID NO: 3803901 - DNA, 19 bp, Homo sapiens
actggccagtcctagagct

SEQ ID NO: 3803902 - DNA, 22 bp, Homo sapiens
actgggatgggaacactggtgg

SEQ ID NO: 3803903 - DNA, 15 bp, Homo sapiens
actgggctctgagga

SEQ ID NO: 3803904 - DNA, 16 bp, Homo sapiens
actgggctctgaggag

SEQ ID NO: 3803905 - DNA, 22 bp, Homo sapiens
actgggctctgaggagtggagt

SEQ ID NO: 3803906 - DNA, 16 bp, Homo sapiens
actggggcaggggccg

SEQ ID NO: 3803907 - DNA, 20 bp, Homo sapiens
actggtgatgggacaattct

SEQ ID NO: 3803908 - DNA, 12 bp, Homo sapiens
actgtggccttg

SEQ ID NO: 3803909 - DNA, 15 bp, Homo sapiens
actgtggccttggtc

SEQ ID NO: 3803910 - DNA, 22 bp, Homo sapiens
actgtgtccctctctctggaaa

SEQ ID NO: 3803911 - DNA, 22 bp, Homo sapiens
actgttctctttaaaatatttg

SEQ ID NO: 3803912 - DNA, 23 bp, Homo sapiens
actgttctctttaaaatatttgt

SEQ ID NO: 3803913 - DNA, 16 bp, Homo sapiens
acttattgcctgggca

SEQ ID NO: 3803914 - DNA, 18 bp, Homo sapiens
acttattgcctgggcagt

SEQ ID NO: 3803915 - DNA, 21 bp, Homo sapiens
acttattgcctgggcagtgcc

SEQ ID NO: 3803916 - DNA, 16 bp, Homo sapiens
acttatttttgacagt

SEQ ID NO: 3803917 - DNA, 15 bp, Homo sapiens
acttcatagatgaga

SEQ ID NO: 3803918 - DNA, 22 bp, Homo sapiens
acttcgggaggtcgaggcagga

SEQ ID NO: 3803919 - DNA, 19 bp, Homo sapiens
acttcttttgctcttagct

SEQ ID NO: 3803920 - DNA, 20 bp, Homo sapiens
acttgagaaaatgcaggaga

SEQ ID NO: 3803921 - DNA, 13 bp, Homo sapiens
acttgaggacaca

SEQ ID NO: 3803922 - DNA, 15 bp, Homo sapiens
acttgaggacacatg

SEQ ID NO: 3803923 - DNA, 16 bp, Homo sapiens
acttgaggacacatgt

SEQ ID NO: 3803924 - DNA, 14 bp, Homo sapiens
acttgcatgaatta

SEQ ID NO: 3803925 - DNA, 13 bp, Homo sapiens
acttgcctggggc

SEQ ID NO: 3803926 - DNA, 13 bp, Homo sapiens
acttgtcatgtga

SEQ ID NO: 3803927 - DNA, 13 bp, Homo sapiens
acttgtgtatatt

SEQ ID NO: 3803928 - DNA, 14 bp, Homo sapiens
acttgtgtctctgt

SEQ ID NO: 3803929 - DNA, 20 bp, Homo sapiens
actttctgaaataacatggc

SEQ ID NO: 3803930 - DNA, 18 bp, Homo sapiens
acttttaaagaaaaatat

SEQ ID NO: 3803931 - DNA, 17 bp, Homo sapiens
acttttgtaagacaaag

SEQ ID NO: 3803932 - DNA, 17 bp, Homo sapiens
agaaaaaatattttccc

SEQ ID NO: 3803933 - DNA, 16 bp, Homo sapiens
agaaaatgctagaaga

SEQ ID NO: 3803934 - DNA, 13 bp, Homo sapiens
agaaacaaacatc

SEQ ID NO: 3803935 - DNA, 15 bp, Homo sapiens
agaaatagctatgga

SEQ ID NO: 3803936 - DNA, 20 bp, Homo sapiens
agaaattttactgacagaaa

SEQ ID NO: 3803937 - DNA, 14 bp, Homo sapiens
agaacacccactgg

SEQ ID NO: 3803938 - DNA, 16 bp, Homo sapiens
agaacacccactggcc

SEQ ID NO: 3803939 - DNA, 18 bp, Homo sapiens
agaacacccactggccag

SEQ ID NO: 3803940 - DNA, 14 bp, Homo sapiens
agaactgccccatc

SEQ ID NO: 3803941 - DNA, 15 bp, Homo sapiens
agaagagagatcaaa

SEQ ID NO: 3803942 - DNA, 16 bp, Homo sapiens
agaagatctgcttccc

SEQ ID NO: 3803943 - DNA, 23 bp, Homo sapiens
agaagatctgcttccctggggcc

SEQ ID NO: 3803944 - DNA, 16 bp, Homo sapiens
agaagcggctggcagc

SEQ ID NO: 3803945 - DNA, 22 bp, Homo sapiens
agaaggaattctaggcatccca

SEQ ID NO: 3803946 - DNA, 22 bp, Homo sapiens
agaagtggaagtgcttgatatg

SEQ ID NO: 3803947 - DNA, 12 bp, Homo sapiens
agaagtgtatat

SEQ ID NO: 3803948 - DNA, 15 bp, Homo sapiens
agaagttcttaaata

SEQ ID NO: 3803949 - DNA, 22 bp, Homo sapiens
agaagtttgagatcagcctggg

SEQ ID NO: 3803950 - DNA, 15 bp, Homo sapiens
agaataaaatactct

SEQ ID NO: 3803951 - DNA, 17 bp, Homo sapiens
agaataaggcacaaaat

SEQ ID NO: 3803952 - DNA, 18 bp, Homo sapiens
agaatctatatttaacaa

SEQ ID NO: 3803953 - DNA, 13 bp, Homo sapiens
agaatgatttcat

SEQ ID NO: 3803954 - DNA, 13 bp, Homo sapiens
agaatgtcagtat

SEQ ID NO: 3803955 - DNA, 16 bp, Homo sapiens
agaatgtcagtatgtg

SEQ ID NO: 3803956 - DNA, 21 bp, Homo sapiens
agaattgcttgaacccaggag

SEQ ID NO: 3803957 - DNA, 22 bp, Homo sapiens
agaattgcttgaacccaggagg

SEQ ID NO: 3803958 - DNA, 16 bp, Homo sapiens
agaatttctaccattt

SEQ ID NO: 3803959 - DNA, 19 bp, Homo sapiens
agaattttcaaataaggaa

SEQ ID NO: 3803960 - DNA, 19 bp, Homo sapiens
agacaaacacctcccagga

SEQ ID NO: 3803961 - DNA, 12 bp, Homo sapiens
agacaaagcaaa

SEQ ID NO: 3803962 - DNA, 23 bp, Homo sapiens
agacaaatctatgccactcagaa

SEQ ID NO: 3803963 - DNA, 20 bp, Homo sapiens
agacaagatggctggaagga

SEQ ID NO: 3803964 - DNA, 20 bp, Homo sapiens
agacactgccacacagggtc

SEQ ID NO: 3803965 - DNA, 18 bp, Homo sapiens
agacagaaacagagagag

SEQ ID NO: 3803966 - DNA, 17 bp, Homo sapiens
agacagagagagactga

SEQ ID NO: 3803967 - DNA, 15 bp, Homo sapiens
agacagatactcctc

SEQ ID NO: 3803968 - DNA, 22 bp, Homo sapiens
agacagatactcctccaaggtt

SEQ ID NO: 3803969 - DNA, 16 bp, Homo sapiens
agacaggcccaagaga

SEQ ID NO: 3803970 - DNA, 23 bp, Homo sapiens
agacaggcccaagagatgaagag

SEQ ID NO: 3803971 - DNA, 19 bp, Homo sapiens
agacaggcgctggacagag

SEQ ID NO: 3803972 - DNA, 22 bp, Homo sapiens
gcctctagaacacccactggcc

SEQ ID NO: 3803973 - DNA, 21 bp, Homo sapiens
gcctctccactcatgtgactc

SEQ ID NO: 3803974 - DNA, 22 bp, Homo sapiens
gcctctgcccagcctgccccag

SEQ ID NO: 3803975 - DNA, 22 bp, Homo sapiens
gcctgagaagagagatcaaatg

SEQ ID NO: 3803976 - DNA, 16 bp, Homo sapiens
gcctgcctcttctcta

SEQ ID NO: 3803977 - DNA, 17 bp, Homo sapiens
gcctgcctgggcctccc

SEQ ID NO: 3803978 - DNA, 18 bp, Homo sapiens
gcctgctccagctgttca

SEQ ID NO: 3803979 - DNA, 16 bp, Homo sapiens
gcctggctccgtccag

SEQ ID NO: 3803980 - DNA, 12 bp, Homo sapiens
gcctgggcagtg

SEQ ID NO: 3803981 - DNA, 13 bp, Homo sapiens
gcctgggcctccc

SEQ ID NO: 3803982 - DNA, 24 bp, Homo sapiens
gcctgggcctcccaaagtgctagg

SEQ ID NO: 3803983 - DNA, 18 bp, Homo sapiens
gcctgggcgacagagcaa

SEQ ID NO: 3803984 - DNA, 19 bp, Homo sapiens
gcctgggcgacagagcaag

SEQ ID NO: 3803985 - DNA, 14 bp, Homo sapiens
gcctggttagaggc

SEQ ID NO: 3803986 - DNA, 14 bp, Homo sapiens
gcctgtaatcccag

SEQ ID NO: 3803987 - DNA, 15 bp, Homo sapiens
gcctgtggagagaaa

SEQ ID NO: 3803988 - DNA, 14 bp, Homo sapiens
gcctgttctccaga

SEQ ID NO: 3803989 - DNA, 19 bp, Homo sapiens
gccttccctccccacagtc

SEQ ID NO: 3803990 - DNA, 15 bp, Homo sapiens
gccttgtcacgccag

SEQ ID NO: 3803991 - DNA, 17 bp, Homo sapiens
gccttgtcacgccagac

SEQ ID NO: 3803992 - DNA, 13 bp, Homo sapiens
gcgagcccttagc

SEQ ID NO: 3803993 - DNA, 19 bp, Homo sapiens
gcgagcccttagccttgct

SEQ ID NO: 3803994 - DNA, 17 bp, Homo sapiens
gcgcacaaggctgacca

SEQ ID NO: 3803995 - DNA, 16 bp, Homo sapiens
gcgccacggcactcca

SEQ ID NO: 3803996 - DNA, 19 bp, Homo sapiens
gcgcccagccaagaataaa

SEQ ID NO: 3803997 - DNA, 11 bp, Homo sapiens
gcgcctcctgg

SEQ ID NO: 3803998 - DNA, 18 bp, Homo sapiens
gcggctgggaggagggca

SEQ ID NO: 3803999 - DNA, 19 bp, Homo sapiens
gctaagctaggaatgaaat

SEQ ID NO: 3804000 - DNA, 22 bp, Homo sapiens
gctaattctttgacctgttggg

SEQ ID NO: 3804001 - DNA, 18 bp, Homo sapiens
gctacaataaatgctgaa

SEQ ID NO: 3804002 - DNA, 18 bp, Homo sapiens
cggtgtggagaagcggct

SEQ ID NO: 3804003 - DNA, 18 bp, Homo sapiens
cggtttccgtggcaaccc

SEQ ID NO: 3804004 - DNA, 23 bp, Homo sapiens
cgtcaagttgcagatctttttgt

SEQ ID NO: 3804005 - DNA, 14 bp, Homo sapiens
cgtcacccttggta

SEQ ID NO: 3804006 - DNA, 21 bp, Homo sapiens
cgtcacccttggtagagttta

SEQ ID NO: 3804007 - DNA, 19 bp, Homo sapiens
cgtcagctgggacaccccg

SEQ ID NO: 3804008 - DNA, 19 bp, Homo sapiens
cgtccacagagtataaata

SEQ ID NO: 3804009 - DNA, 19 bp, Homo sapiens
cgtccaggagcctgtgcct

SEQ ID NO: 3804010 - DNA, 22 bp, Homo sapiens
cgtctggcgagcccttagcctt

SEQ ID NO: 3804011 - DNA, 13 bp, Homo sapiens
cgtggacacctgc

SEQ ID NO: 3804012 - DNA, 17 bp, Homo sapiens
cgtggacacctgccctg

SEQ ID NO: 3804013 - DNA, 19 bp, Homo sapiens
cgtggacacctgccctgcc

SEQ ID NO: 3804014 - DNA, 17 bp, Homo sapiens
cgtggcaaccctcagct

SEQ ID NO: 3804015 - DNA, 23 bp, Homo sapiens
cgtggctgtggcatccagagtcc

SEQ ID NO: 3804016 - DNA, 20 bp, Homo sapiens
cgtgtaaccatggacccaat

SEQ ID NO: 3804017 - DNA, 13 bp, Homo sapiens
cgtgtctggcaca

SEQ ID NO: 3804018 - DNA, 17 bp, Homo sapiens
cgttagaggagcaacag

SEQ ID NO: 3804019 - DNA, 17 bp, Homo sapiens
cgtttgactagccatct

SEQ ID NO: 3804020 - DNA, 17 bp, Homo sapiens
cgttttatgtgaatgtg

SEQ ID NO: 3804021 - DNA, 13 bp, Homo sapiens
ctaaaactctcaa

SEQ ID NO: 3804022 - DNA, 15 bp, Homo sapiens
ctaaaatatttattt

SEQ ID NO: 3804023 - DNA, 12 bp, Homo sapiens
ctaacctgccga

SEQ ID NO: 3804024 - DNA, 21 bp, Homo sapiens
ctaacctgccgagagtccatc

SEQ ID NO: 3804025 - DNA, 16 bp, Homo sapiens
ctaactcttagaagtg

SEQ ID NO: 3804026 - DNA, 15 bp, Homo sapiens
ctaacttattgcctg

SEQ ID NO: 3804027 - DNA, 19 bp, Homo sapiens
ctaagatactgctgatgct

SEQ ID NO: 3804028 - DNA, 17 bp, Homo sapiens
ctaagctaggaatgaaa

SEQ ID NO: 3804029 - DNA, 14 bp, Homo sapiens
ctaagctttctcct

SEQ ID NO: 3804030 - DNA, 15 bp, Homo sapiens
ctaagctttctcctt

SEQ ID NO: 3804031 - DNA, 22 bp, Homo sapiens
ctaaggaagacacagcccagac

SEQ ID NO: 3804032 - DNA, 16 bp, Homo sapiens
ctaataaagagactga

SEQ ID NO: 3804033 - DNA, 17 bp, Homo sapiens
ctaatagagacacagag

SEQ ID NO: 3804034 - DNA, 14 bp, Homo sapiens
ctaatctctttatt

SEQ ID NO: 3804035 - DNA, 17 bp, Homo sapiens
ctaatgaagtgtttcct

SEQ ID NO: 3804036 - DNA, 19 bp, Homo sapiens
ctacaaaaagcataaaaat

SEQ ID NO: 3804037 - DNA, 11 bp, Homo sapiens
ctacaataaat

SEQ ID NO: 3804038 - DNA, 12 bp, Homo sapiens
ctacaataaatg

SEQ ID NO: 3804039 - DNA, 16 bp, Homo sapiens
ctacaataaatgctga

SEQ ID NO: 3804040 - DNA, 20 bp, Homo sapiens
ctacagaagtggaagtgctt

SEQ ID NO: 3804041 - DNA, 14 bp, Homo sapiens
ctacatgaaacaga

SEQ ID NO: 3804042 - DNA, 16 bp, Homo sapiens
ctacatgaaacagaaa

SEQ ID NO: 3804043 - DNA, 13 bp, Homo sapiens
ctaccatttcaga

SEQ ID NO: 3804044 - DNA, 21 bp, Homo sapiens
ctacccactctttgctacaat

SEQ ID NO: 3804045 - DNA, 23 bp, Homo sapiens
ctacccactctttgctacaataa

SEQ ID NO: 3804046 - DNA, 21 bp, Homo sapiens
ctaccccccctcctgctgcct

SEQ ID NO: 3804047 - DNA, 13 bp, Homo sapiens
ctaccccctgtgc

SEQ ID NO: 3804048 - DNA, 14 bp, Homo sapiens
ctaccccctgtgcc

SEQ ID NO: 3804049 - DNA, 13 bp, Homo sapiens
ctactactctgcc

SEQ ID NO: 3804050 - DNA, 13 bp, Homo sapiens
ctactcctcacag

SEQ ID NO: 3804051 - DNA, 15 bp, Homo sapiens
ctactcctcacagca

SEQ ID NO: 3804052 - DNA, 17 bp, Homo sapiens
ctactggtcttgtggaa

SEQ ID NO: 3804053 - DNA, 14 bp, Homo sapiens
ctagaacacaggca

SEQ ID NO: 3804054 - DNA, 21 bp, Homo sapiens
ctagaacacaggcaaaatcct

SEQ ID NO: 3804055 - DNA, 15 bp, Homo sapiens
ctagaacacccactg

SEQ ID NO: 3804056 - DNA, 16 bp, Homo sapiens
ctagagctcctgtccc

SEQ ID NO: 3804057 - DNA, 14 bp, Homo sapiens
ctgccacctgtctg

SEQ ID NO: 3804058 - DNA, 11 bp, Homo sapiens
ctgccaggaga

SEQ ID NO: 3804059 - DNA, 13 bp, Homo sapiens
ctgccaggcatgg

SEQ ID NO: 3804060 - DNA, 14 bp, Homo sapiens
ctgccatgccagct

SEQ ID NO: 3804061 - DNA, 17 bp, Homo sapiens
ctgccatgccagcttat

SEQ ID NO: 3804062 - DNA, 13 bp, Homo sapiens
ctgcccagcctgc

SEQ ID NO: 3804063 - DNA, 18 bp, Homo sapiens
ctgcccgcctcggcctcc

SEQ ID NO: 3804064 - DNA, 20 bp, Homo sapiens
ctgcccggcagggtcctaga

SEQ ID NO: 3804065 - DNA, 18 bp, Homo sapiens
ctgcccgggagctcagga

SEQ ID NO: 3804066 - DNA, 19 bp, Homo sapiens
ctgcccgggagctcaggaa

SEQ ID NO: 3804067 - DNA, 11 bp, Homo sapiens
ctgccctgcca

SEQ ID NO: 3804068 - DNA, 15 bp, Homo sapiens
ctgccctgccacctg

SEQ ID NO: 3804069 - DNA, 21 bp, Homo sapiens
ctgccctgccacctgtctgtc

SEQ ID NO: 3804070 - DNA, 21 bp, Homo sapiens
ctgccctgtaccccagcactt

SEQ ID NO: 3804071 - DNA, 14 bp, Homo sapiens
ctgccctgtccctg

SEQ ID NO: 3804072 - DNA, 18 bp, Homo sapiens
ctgccctgtccctgtccc

SEQ ID NO: 3804073 - DNA, 21 bp, Homo sapiens
ctgcccttcagcatcctcagt

SEQ ID NO: 3804074 - DNA, 22 bp, Homo sapiens
ctgccgagagtccatcagcctc

SEQ ID NO: 3804075 - DNA, 23 bp, Homo sapiens
ctgccgagagtccatcagcctcc

SEQ ID NO: 3804076 - DNA, 14 bp, Homo sapiens
ctgcctaataaaga

SEQ ID NO: 3804077 - DNA, 12 bp, Homo sapiens
ctgcctcagcct

SEQ ID NO: 3804078 - DNA, 17 bp, Homo sapiens
ctgcctcagcctcctga

SEQ ID NO: 3804079 - DNA, 15 bp, Homo sapiens
ctgcctcagcttccc

SEQ ID NO: 3804080 - DNA, 18 bp, Homo sapiens
ctgcctcagcttcccaag

SEQ ID NO: 3804081 - DNA, 14 bp, Homo sapiens
ctgcctcttctcta

SEQ ID NO: 3804082 - DNA, 16 bp, Homo sapiens
ctgcctgacactgagc

SEQ ID NO: 3804083 - DNA, 21 bp, Homo sapiens
ctgcctgacactgagccccac

SEQ ID NO: 3804084 - DNA, 17 bp, Homo sapiens
ctgcctgggcctcccaa

SEQ ID NO: 3804085 - DNA, 22 bp, Homo sapiens
ctgcgagagaccctacagacag

SEQ ID NO: 3804086 - DNA, 17 bp, Homo sapiens
ctgctatcaaagaggtt

SEQ ID NO: 3804087 - DNA, 15 bp, Homo sapiens
ctgctcatccaaagt

SEQ ID NO: 3804088 - DNA, 17 bp, Homo sapiens
ctgctcatccaaagttg

SEQ ID NO: 3804089 - DNA, 21 bp, Homo sapiens
ctgctgactgttttctcttga

SEQ ID NO: 3804090 - DNA, 20 bp, Homo sapiens
ctgctgatgctgaaataaac

SEQ ID NO: 3804091 - DNA, 14 bp, Homo sapiens
ctgctgcctaataa

SEQ ID NO: 3804092 - DNA, 17 bp, Homo sapiens
ctgctgcctaataaaga

SEQ ID NO: 3804093 - DNA, 19 bp, Homo sapiens
ctgcttcagtgtatggaaa

SEQ ID NO: 3804094 - DNA, 12 bp, Homo sapiens
ctgcttccctgg

SEQ ID NO: 3804095 - DNA, 16 bp, Homo sapiens
ctgcttttctcccaga

SEQ ID NO: 3804096 - DNA, 19 bp, Homo sapiens
ctggaaggagccagccagg

SEQ ID NO: 3804097 - DNA, 15 bp, Homo sapiens
ctggaatacatgaaa

SEQ ID NO: 3804098 - DNA, 12 bp, Homo sapiens
ctggaccagcct

SEQ ID NO: 3804099 - DNA, 19 bp, Homo sapiens
ctggagaagaccctccccg

SEQ ID NO: 3804100 - DNA, 14 bp, Homo sapiens
ctggagtgcagtgg

SEQ ID NO: 3804101 - DNA, 14 bp, Homo sapiens
ctggatctgtgagg

SEQ ID NO: 3804102 - DNA, 20 bp, Homo sapiens
ctggcaattaccagaacaat

SEQ ID NO: 3804103 - DNA, 16 bp, Homo sapiens
ctggcacagcctggct

SEQ ID NO: 3804104 - DNA, 18 bp, Homo sapiens
ctggcagcctccagtggg

SEQ ID NO: 3804105 - DNA, 21 bp, Homo sapiens
ctggcagtaacctagtgaatt

SEQ ID NO: 3804106 - DNA, 17 bp, Homo sapiens
ctggccagtcctagagc

SEQ ID NO: 3804107 - DNA, 20 bp, Homo sapiens
ctggcctctagaacacccac

SEQ ID NO: 3804108 - DNA, 13 bp, Homo sapiens
ctggcgagccctt

SEQ ID NO: 3804109 - DNA, 15 bp, Homo sapiens
ctggctcccagggcc

SEQ ID NO: 3804110 - DNA, 22 bp, Homo sapiens
ctggctgaggatttcaagcctg

SEQ ID NO: 3804111 - DNA, 17 bp, Homo sapiens
ctggctggcccagagtt

SEQ ID NO: 3804112 - DNA, 21 bp, Homo sapiens
ctggctgggtggcaccagcag

SEQ ID NO: 3804113 - DNA, 18 bp, Homo sapiens
ctggctgtggcctaacct

SEQ ID NO: 3804114 - DNA, 17 bp, Homo sapiens
ctgggaaccatgaagct

SEQ ID NO: 3804115 - DNA, 20 bp, Homo sapiens
ctgggaaccatgaagctgga

SEQ ID NO: 3804116 - DNA, 13 bp, Homo sapiens
ctgggaagggaag

SEQ ID NO: 3804117 - DNA, 15 bp, Homo sapiens
ctgggaagggaagga

SEQ ID NO: 3804118 - DNA, 16 bp, Homo sapiens
ctgggaccagggcata

SEQ ID NO: 3804119 - DNA, 19 bp, Homo sapiens
ctgggaggagggcaggcat

SEQ ID NO: 3804120 - DNA, 22 bp, Homo sapiens
cttttaaagaaaaatatgatac

SEQ ID NO: 3804121 - DNA, 11 bp, Homo sapiens
cttttgaagaa

SEQ ID NO: 3804122 - DNA, 20 bp, Homo sapiens
cttttgtaagacaaaggttt

SEQ ID NO: 3804123 - DNA, 17 bp, Homo sapiens
cttttgtcctgttattt

SEQ ID NO: 3804124 - DNA, 14 bp, Homo sapiens
ctttttctaccttt

SEQ ID NO: 3804125 - DNA, 14 bp, Homo sapiens
ctttttttctctcc

SEQ ID NO: 3804126 - DNA, 15 bp, Homo sapiens
gaaaaaggaggaaga

SEQ ID NO: 3804127 - DNA, 17 bp, Homo sapiens
gaaaaatccagaaagaa

SEQ ID NO: 3804128 - DNA, 18 bp, Homo sapiens
gaaaaatccagaaagaaa

SEQ ID NO: 3804129 - DNA, 20 bp, Homo sapiens
gaaaagacattgaaagctct

SEQ ID NO: 3804130 - DNA, 21 bp, Homo sapiens
gaaaagagatggcctgagaag

SEQ ID NO: 3804131 - DNA, 14 bp, Homo sapiens
gaaaagatgtgctc

SEQ ID NO: 3804132 - DNA, 21 bp, Homo sapiens
gaaaatacctattttatatga

SEQ ID NO: 3804133 - DNA, 20 bp, Homo sapiens
gaaaatcagcctgctccagc

SEQ ID NO: 3804134 - DNA, 13 bp, Homo sapiens
gaaaatcctacca

SEQ ID NO: 3804135 - DNA, 14 bp, Homo sapiens
gaaaatcctaccaa

SEQ ID NO: 3804136 - DNA, 22 bp, Homo sapiens
gaaaatgcaggagagcttcccc

SEQ ID NO: 3804137 - DNA, 19 bp, Homo sapiens
gaaaatgctagaagaaaac

SEQ ID NO: 3804138 - DNA, 20 bp, Homo sapiens
gaaaatgctagaagaaaaca

SEQ ID NO: 3804139 - DNA, 23 bp, Homo sapiens
gaaacaaaaacactaaaaataaa

SEQ ID NO: 3804140 - DNA, 15 bp, Homo sapiens
gaaacagagagagac

SEQ ID NO: 3804141 - DNA, 18 bp, Homo sapiens
gaaactgaggaattttct

SEQ ID NO: 3804142 - DNA, 17 bp, Homo sapiens
gaaagccctgagctttc

SEQ ID NO: 3804143 - DNA, 21 bp, Homo sapiens
gaaagccctgagctttctgct

SEQ ID NO: 3804144 - DNA, 16 bp, Homo sapiens
gaaattggaagagcac

SEQ ID NO: 3804145 - DNA, 23 bp, Homo sapiens
gaacacagcctgggaccagggca

SEQ ID NO: 3804146 - DNA, 18 bp, Homo sapiens
gaacacccactggccagt

SEQ ID NO: 3804147 - DNA, 22 bp, Homo sapiens
gaacacccactggccagtccta

SEQ ID NO: 3804148 - DNA, 12 bp, Homo sapiens
gaacatccaagg

SEQ ID NO: 3804149 - DNA, 20 bp, Homo sapiens
gaacatccaaggagaaacag

SEQ ID NO: 3804150 - DNA, 23 bp, Homo sapiens
gaacatccaaggagaaacagaga

SEQ ID NO: 3804151 - DNA, 13 bp, Homo sapiens
gaaccacagtcat

SEQ ID NO: 3804152 - DNA, 16 bp, Homo sapiens
gaacccaggaggtgga

SEQ ID NO: 3804153 - DNA, 22 bp, Homo sapiens
gaaccgacttttctaaagctct

SEQ ID NO: 3804154 - DNA, 12 bp, Homo sapiens
gaaccgaggcag

SEQ ID NO: 3804155 - DNA, 15 bp, Homo sapiens
gaaccgaggcaggga

SEQ ID NO: 3804156 - DNA, 14 bp, Homo sapiens
gaactctgcaggca

SEQ ID NO: 3804157 - DNA, 12 bp, Homo sapiens
gaactgccccat

SEQ ID NO: 3804158 - DNA, 18 bp, Homo sapiens
gaactgccccatctcctc

SEQ ID NO: 3804159 - DNA, 13 bp, Homo sapiens
gaacttgaggaca

SEQ ID NO: 3804160 - DNA, 14 bp, Homo sapiens
gaacttgaggacac

SEQ ID NO: 3804161 - DNA, 15 bp, Homo sapiens
gaacttgaggacaca

SEQ ID NO: 3804162 - DNA, 17 bp, Homo sapiens
gaacttgaggacacatg

SEQ ID NO: 3804163 - DNA, 18 bp, Homo sapiens
gaacttgaggacacatgt

SEQ ID NO: 3804164 - DNA, 21 bp, Homo sapiens
gaacttgaggacacatgtcca

SEQ ID NO: 3804165 - DNA, 19 bp, Homo sapiens
gaagacacagcccagacaa

SEQ ID NO: 3804166 - DNA, 21 bp, Homo sapiens
gaagacacagcccagacaaga

SEQ ID NO: 3804167 - DNA, 16 bp, Homo sapiens
gaagagagatcaaatg

SEQ ID NO: 3804168 - DNA, 19 bp, Homo sapiens
gaagagagatcaaatggaa

SEQ ID NO: 3804169 - DNA, 12 bp, Homo sapiens
gaagagccttgc

SEQ ID NO: 3804170 - DNA, 19 bp, Homo sapiens
gaagcccaataaacctctt

SEQ ID NO: 3804171 - DNA, 14 bp, Homo sapiens
gaagcggctggcag

SEQ ID NO: 3804172 - DNA, 13 bp, Homo sapiens
gaagcgttgtcct

SEQ ID NO: 3804173 - DNA, 19 bp, Homo sapiens
gaagcgttgtcctcagccc

SEQ ID NO: 3804174 - DNA, 16 bp, Homo sapiens
gaagctgccctgccca

SEQ ID NO: 3804175 - DNA, 17 bp, Homo sapiens
gaaggagccagccagga

SEQ ID NO: 3804176 - DNA, 19 bp, Homo sapiens
gaaggatcccatgagctcc

SEQ ID NO: 3804177 - DNA, 12 bp, Homo sapiens
gaaggcaaaaaa

SEQ ID NO: 3804178 - DNA, 15 bp, Homo sapiens
gaaggctatggggat

SEQ ID NO: 3804179 - DNA, 18 bp, Homo sapiens
gaaggctgggtccagggg

SEQ ID NO: 3804180 - DNA, 22 bp, Homo sapiens
gaagtgacattgtaagaggtgg

SEQ ID NO: 3804181 - DNA, 13 bp, Homo sapiens
gaagtgtatatag

SEQ ID NO: 3804182 - DNA, 16 bp, Homo sapiens
gaataatacattgaat

SEQ ID NO: 3804183 - DNA, 15 bp, Homo sapiens
gaatacaattaaagg

SEQ ID NO: 3804184 - DNA, 16 bp, Homo sapiens
gaatacaattaaaggt

SEQ ID NO: 3804185 - DNA, 23 bp, Homo sapiens
gaatattttgttttgtgcagaga

SEQ ID NO: 3804186 - DNA, 13 bp, Homo sapiens
gaatctatattta

SEQ ID NO: 3804187 - DNA, 20 bp, Homo sapiens
gaatgatgatcctaggcatt

SEQ ID NO: 3804188 - DNA, 15 bp, Homo sapiens
gaatgtcccagaggc

SEQ ID NO: 3804189 - DNA, 22 bp, Homo sapiens
gaattgcttgaacccaggaggt

SEQ ID NO: 3804190 - DNA, 16 bp, Homo sapiens
gaattgggagcttggg

SEQ ID NO: 3804191 - DNA, 16 bp, Homo sapiens
gaatttctaaatgttg

SEQ ID NO: 3804192 - DNA, 22 bp, Homo sapiens
gaatttgacctaggcaagtttg

SEQ ID NO: 3804193 - DNA, 19 bp, Homo sapiens
gaattttctttcatacatt

SEQ ID NO: 3804194 - DNA, 12 bp, Homo sapiens
gacaacattttt

SEQ ID NO: 3804195 - DNA, 21 bp, Homo sapiens
gacaacatttttgtacattat

SEQ ID NO: 3804196 - DNA, 19 bp, Homo sapiens
gacaatgtgaaaagaaaaa

SEQ ID NO: 3804197 - DNA, 18 bp, Homo sapiens
gacacagcccagacaaga

SEQ ID NO: 3804198 - DNA, 23 bp, Homo sapiens
gacaccagccctgctgcttccta

SEQ ID NO: 3804199 - DNA, 20 bp, Homo sapiens
gacacctaggctagggtggg

SEQ ID NO: 3804200 - DNA, 12 bp, Homo sapiens
gacacctgccct

SEQ ID NO: 3804201 - DNA, 15 bp, Homo sapiens
gacacctgccctgcc

SEQ ID NO: 3804202 - DNA, 16 bp, Homo sapiens
gacactacatatctaa

SEQ ID NO: 3804203 - DNA, 19 bp, Homo sapiens
gacagaaacagagagagac

SEQ ID NO: 3804204 - DNA, 20 bp, Homo sapiens
gacagaacccctacatgaaa

SEQ ID NO: 3804205 - DNA, 22 bp, Homo sapiens
gacagagacagaaacagagaga

SEQ ID NO: 3804206 - DNA, 15 bp, Homo sapiens
gacagagagagactg

SEQ ID NO: 3804207 - DNA, 15 bp, Homo sapiens
gacagagccagaggc

SEQ ID NO: 3804208 - DNA, 17 bp, Homo sapiens
gacagaggggcagggga

SEQ ID NO: 3804209 - DNA, 14 bp, Homo sapiens
gacaggcccaagag

SEQ ID NO: 3804210 - DNA, 22 bp, Homo sapiens
gacaggcccaagagatgaagag

SEQ ID NO: 3804211 - DNA, 19 bp, Homo sapiens
gacaggcgctggacagagg

SEQ ID NO: 3804212 - DNA, 23 bp, Homo sapiens
gacatccatgttccgagaagaac

SEQ ID NO: 3804213 - DNA, 15 bp, Homo sapiens
gacatggagagagac

SEQ ID NO: 3804214 - DNA, 12 bp, Homo sapiens
gaccacacctcc

SEQ ID NO: 3804215 - DNA, 17 bp, Homo sapiens
gaccacacctccctgaa

SEQ ID NO: 3804216 - DNA, 21 bp, Homo sapiens
gaccagagccccacacggagg

SEQ ID NO: 3804217 - DNA, 14 bp, Homo sapiens
gaccattgtcttcc

SEQ ID NO: 3804218 - DNA, 21 bp, Homo sapiens
gacccccactgccgcctcctt

SEQ ID NO: 3804219 - DNA, 15 bp, Homo sapiens
gaccctccccgcacc

SEQ ID NO: 3804220 - DNA, 17 bp, Homo sapiens
gaccctccccgcacccc

SEQ ID NO: 3804221 - DNA, 19 bp, Homo sapiens
gacctacctgcagtgggaa

SEQ ID NO: 3804222 - DNA, 19 bp, Homo sapiens
gacctcgtgatttgcctgc

SEQ ID NO: 3804223 - DNA, 18 bp, Homo sapiens
gacctctgaatgtcccag

SEQ ID NO: 3804224 - DNA, 22 bp, Homo sapiens
gacctctgaatgtcccagaggc

SEQ ID NO: 3804225 - DNA, 16 bp, Homo sapiens
gaccttacaggccctc

SEQ ID NO: 3804226 - DNA, 19 bp, Homo sapiens
gacgtgagtgtgacttttt

SEQ ID NO: 3804227 - DNA, 16 bp, Homo sapiens
gactaatagagacaca

SEQ ID NO: 3804228 - DNA, 15 bp, Homo sapiens
gatcccatgagctcc

SEQ ID NO: 3804229 - DNA, 17 bp, Homo sapiens
gatcccatgagctcctt

SEQ ID NO: 3804230 - DNA, 18 bp, Homo sapiens
gatcctaggcatttgctg

SEQ ID NO: 3804231 - DNA, 16 bp, Homo sapiens
gatctcttgagcctgg

SEQ ID NO: 3804232 - DNA, 20 bp, Homo sapiens
gatctgcagggggtgtgtct

SEQ ID NO: 3804233 - DNA, 22 bp, Homo sapiens
gatctgcccgcctcggcctccc

SEQ ID NO: 3804234 - DNA, 23 bp, Homo sapiens
gatctgcccgcctcggcctccca

SEQ ID NO: 3804235 - DNA, 19 bp, Homo sapiens
gatctgcttccctggggcc

SEQ ID NO: 3804236 - DNA, 14 bp, Homo sapiens
gatgaacatctaac

SEQ ID NO: 3804237 - DNA, 12 bp, Homo sapiens
gatgactaaaat

SEQ ID NO: 3804238 - DNA, 15 bp, Homo sapiens
gatgactaaaatatt

SEQ ID NO: 3804239 - DNA, 18 bp, Homo sapiens
gatgactaaaatatttat

SEQ ID NO: 3804240 - DNA, 16 bp, Homo sapiens
gatgactagaggcagg

SEQ ID NO: 3804241 - DNA, 16 bp, Homo sapiens
gatgagaaaactgaga

SEQ ID NO: 3804242 - DNA, 13 bp, Homo sapiens
gatgatcctaggc

SEQ ID NO: 3804243 - DNA, 14 bp, Homo sapiens
gatgcacagagata

SEQ ID NO: 3804244 - DNA, 23 bp, Homo sapiens
gatgctgaaataaactagggttt

SEQ ID NO: 3804245 - DNA, 16 bp, Homo sapiens
gatggagaaacaggct

SEQ ID NO: 3804246 - DNA, 14 bp, Homo sapiens
gatggagagagggg

SEQ ID NO: 3804247 - DNA, 22 bp, Homo sapiens
gatggccgggcgcggtggctca

SEQ ID NO: 3804248 - DNA, 14 bp, Homo sapiens
gatggctggaagga

SEQ ID NO: 3804249 - DNA, 19 bp, Homo sapiens
gatggctggaaggagccag

SEQ ID NO: 3804250 - DNA, 19 bp, Homo sapiens
gatggcttatttgtataat

SEQ ID NO: 3804251 - DNA, 15 bp, Homo sapiens
gatgggtcagttgta

SEQ ID NO: 3804252 - DNA, 18 bp, Homo sapiens
gatggtcttgatctcctg

SEQ ID NO: 3804253 - DNA, 18 bp, Homo sapiens
gatggttcttcacctcct

SEQ ID NO: 3804254 - DNA, 20 bp, Homo sapiens
gatgtgctcccaccaggcag

SEQ ID NO: 3804255 - DNA, 15 bp, Homo sapiens
gattatatatcataa

SEQ ID NO: 3804256 - DNA, 19 bp, Homo sapiens
gattatatatcataaagta

SEQ ID NO: 3804257 - DNA, 20 bp, Homo sapiens
gattatatatcataaagtat

SEQ ID NO: 3804258 - DNA, 19 bp, Homo sapiens
gattccagcaagaccaaat

SEQ ID NO: 3804259 - DNA, 11 bp, Homo sapiens
gattcccagag

SEQ ID NO: 3804260 - DNA, 14 bp, Homo sapiens
gattcccagagaga

SEQ ID NO: 3804261 - DNA, 19 bp, Homo sapiens
gattcccagagagacgctg

SEQ ID NO: 3804262 - DNA, 13 bp, Homo sapiens
gattcccagagca

SEQ ID NO: 3804263 - DNA, 17 bp, Homo sapiens
gattcctcccccagagc

SEQ ID NO: 3804264 - DNA, 19 bp, Homo sapiens
gattgttccataataaact

SEQ ID NO: 3804265 - DNA, 22 bp, Homo sapiens
gattgttctgtccagtttccaa

SEQ ID NO: 3804266 - DNA, 12 bp, Homo sapiens
gatttaaatcag

SEQ ID NO: 3804267 - DNA, 20 bp, Homo sapiens
gatttcatgctatctctgtg

SEQ ID NO: 3804268 - DNA, 17 bp, Homo sapiens
gatttctgctccaaatt

SEQ ID NO: 3804269 - DNA, 14 bp, Homo sapiens
gatttgtcccaggt

SEQ ID NO: 3804270 - DNA, 18 bp, Homo sapiens
gattttcaaagctttttc

SEQ ID NO: 3804271 - DNA, 19 bp, Homo sapiens
gattttcaaagctttttcc

SEQ ID NO: 3804272 - DNA, 16 bp, Homo sapiens
gattttcgacgtttga

SEQ ID NO: 3804273 - DNA, 23 bp, Homo sapiens
gattttcttttgttttcttcatt

SEQ ID NO: 3804274 - DNA, 16 bp, Homo sapiens
gcaaaagatgcttctc

SEQ ID NO: 3804275 - DNA, 22 bp, Homo sapiens
gcaaaagatgcttctcactgcc

SEQ ID NO: 3804276 - DNA, 20 bp, Homo sapiens
gcaaaataattttaaacaaa

SEQ ID NO: 3804277 - DNA, 15 bp, Homo sapiens
gcaaagaactgcccc

SEQ ID NO: 3804278 - DNA, 17 bp, Homo sapiens
gcaaagaactgccccat

SEQ ID NO: 3804279 - DNA, 23 bp, Homo sapiens
gcaacatgcttcatgaaaatcct

SEQ ID NO: 3804280 - DNA, 19 bp, Homo sapiens
gcaaccctcagctgcctca

SEQ ID NO: 3804281 - DNA, 18 bp, Homo sapiens
gcaactacagaagtggaa

SEQ ID NO: 3804282 - DNA, 19 bp, Homo sapiens
gcaactacagaagtggaag

SEQ ID NO: 3804283 - DNA, 17 bp, Homo sapiens
gcaagaattgaagcagg

SEQ ID NO: 3804284 - DNA, 12 bp, Homo sapiens
gcaagctctgcc

SEQ ID NO: 3804285 - DNA, 16 bp, Homo sapiens
gcaagctctgcctccc

SEQ ID NO: 3804286 - DNA, 21 bp, Homo sapiens
gcaatctgtaactgcttttcg

SEQ ID NO: 3804287 - DNA, 14 bp, Homo sapiens
gcaattttgtaacg

SEQ ID NO: 3804288 - DNA, 22 bp, Homo sapiens
gcacaagctgcaccctcaggca

SEQ ID NO: 3804289 - DNA, 20 bp, Homo sapiens
gcacacacacggatgcacac

SEQ ID NO: 3804290 - DNA, 13 bp, Homo sapiens
gcacacacatgga

SEQ ID NO: 3804291 - DNA, 12 bp, Homo sapiens
gcacacctgtgg

SEQ ID NO: 3804292 - DNA, 12 bp, Homo sapiens
gcacagcctggc

SEQ ID NO: 3804293 - DNA, 19 bp, Homo sapiens
gcacatagagatatgcaca

SEQ ID NO: 3804294 - DNA, 20 bp, Homo sapiens
gcaccactgcactccagcct

SEQ ID NO: 3804295 - DNA, 21 bp, Homo sapiens
gcaccactgcactccagcctg

SEQ ID NO: 3804296 - DNA, 16 bp, Homo sapiens
gcaccagcagcctgga

SEQ ID NO: 3804297 - DNA, 12 bp, Homo sapiens
gcaccataactt

SEQ ID NO: 3804298 - DNA, 20 bp, Homo sapiens
gcaccatctctgattttcaa

SEQ ID NO: 3804299 - DNA, 14 bp, Homo sapiens
gcaccccccaagct

SEQ ID NO: 3804300 - DNA, 16 bp, Homo sapiens
gcaccctcaggcaggt

SEQ ID NO: 3804301 - DNA, 14 bp, Homo sapiens
gcaccggggcctgg

SEQ ID NO: 3804302 - DNA, 20 bp, Homo sapiens
gcaccggggcctgggcagga

SEQ ID NO: 3804303 - DNA, 14 bp, Homo sapiens
gcacgatctcagct

SEQ ID NO: 3804304 - DNA, 13 bp, Homo sapiens
gcacgcacatgcc

SEQ ID NO: 3804305 - DNA, 15 bp, Homo sapiens
gcactccagcctggg

SEQ ID NO: 3804306 - DNA, 15 bp, Homo sapiens
gcactggggcagggg

SEQ ID NO: 3804307 - DNA, 18 bp, Homo sapiens
gcactggggcaggggccg

SEQ ID NO: 3804308 - DNA, 14 bp, Homo sapiens
gcactgtggccttg

SEQ ID NO: 3804309 - DNA, 15 bp, Homo sapiens
gcactgttgctgact

SEQ ID NO: 3804310 - DNA, 16 bp, Homo sapiens
gcagaagccccaactg

SEQ ID NO: 3804311 - DNA, 19 bp, Homo sapiens
gcagacctacctgcagtgg

SEQ ID NO: 3804312 - DNA, 12 bp, Homo sapiens
gcagagccaagg

SEQ ID NO: 3804313 - DNA, 15 bp, Homo sapiens
gcagagccaaggcca

SEQ ID NO: 3804314 - DNA, 14 bp, Homo sapiens
gcagaggcagacag

SEQ ID NO: 3804315 - DNA, 15 bp, Homo sapiens
gcagaggcagacagg

SEQ ID NO: 3804316 - DNA, 15 bp, Homo sapiens
gcagatctttttgtg

SEQ ID NO: 3804317 - DNA, 23 bp, Homo sapiens
gcagatctttttgtgaaattcaa

SEQ ID NO: 3804318 - DNA, 14 bp, Homo sapiens
gcagcaaagtgtca

SEQ ID NO: 3804319 - DNA, 12 bp, Homo sapiens
gcagcacctcct

SEQ ID NO: 3804320 - DNA, 18 bp, Homo sapiens
gcagcagggagggcttct

SEQ ID NO: 3804321 - DNA, 20 bp, Homo sapiens
gcagcagggagggcttctgc

SEQ ID NO: 3804322 - DNA, 13 bp, Homo sapiens
gcagccccccaga

SEQ ID NO: 3804323 - DNA, 15 bp, Homo sapiens
gcagcctccagtggg

SEQ ID NO: 3804324 - DNA, 15 bp, Homo sapiens
gcaggaaatcagagc

SEQ ID NO: 3804325 - DNA, 15 bp, Homo sapiens
gcaggagagcttccc

SEQ ID NO: 3804326 - DNA, 15 bp, Homo sapiens
gcaggaggcaggata

SEQ ID NO: 3804327 - DNA, 22 bp, Homo sapiens
gcaggcagatttactgtcccag

SEQ ID NO: 3804328 - DNA, 21 bp, Homo sapiens
gcaggcatcggggagccggga

SEQ ID NO: 3804329 - DNA, 22 bp, Homo sapiens
gcaggcatcggggagccgggag

SEQ ID NO: 3804330 - DNA, 16 bp, Homo sapiens
gcagggagggcttctg

SEQ ID NO: 3804331 - DNA, 14 bp, Homo sapiens
gcagggaggggact

SEQ ID NO: 3804332 - DNA, 15 bp, Homo sapiens
gcagtgaactgagac

SEQ ID NO: 3804333 - DNA, 21 bp, Homo sapiens
gcagttaatggggtagaggag

SEQ ID NO: 3804334 - DNA, 21 bp, Homo sapiens
gcatccagagtccctgcctgg

SEQ ID NO: 3804335 - DNA, 16 bp, Homo sapiens
gcatcccaggggacca

SEQ ID NO: 3804336 - DNA, 19 bp, Homo sapiens
gcatcccaggggaccacac

SEQ ID NO: 3804337 - DNA, 23 bp, Homo sapiens
gcatctctatgaagagaaggagg

SEQ ID NO: 3804338 - DNA, 12 bp, Homo sapiens
gcatctgcaccc

SEQ ID NO: 3804339 - DNA, 21 bp, Homo sapiens
gcatgaattactgtatataaa

SEQ ID NO: 3804340 - DNA, 14 bp, Homo sapiens
gcatgcgcacaagg

SEQ ID NO: 3804341 - DNA, 14 bp, Homo sapiens
gcatgggagggagg

SEQ ID NO: 3804342 - DNA, 21 bp, Homo sapiens
gcattcacagcgcctcctgga

SEQ ID NO: 3804343 - DNA, 20 bp, Homo sapiens
gcattgtgtcagaaacatga

SEQ ID NO: 3804344 - DNA, 23 bp, Homo sapiens
gcatttgctgaatacagaggcaa

SEQ ID NO: 3804345 - DNA, 22 bp, Homo sapiens
gcattttgctaaatgtgaatga

SEQ ID NO: 3804346 - DNA, 10 bp, Homo sapiens
gccaaggcca

SEQ ID NO: 3804347 - DNA, 18 bp, Homo sapiens
gccaaggctgagagctct

SEQ ID NO: 3804348 - DNA, 15 bp, Homo sapiens
gccaaggtgggagga

SEQ ID NO: 3804349 - DNA, 23 bp, Homo sapiens
gccaaggtgggaggattgcttga

SEQ ID NO: 3804350 - DNA, 23 bp, Homo sapiens
gccaatctcttctaaaaaaaaac

SEQ ID NO: 3804351 - DNA, 13 bp, Homo sapiens
gccacactgggct

SEQ ID NO: 3804352 - DNA, 15 bp, Homo sapiens
gccacactgggctca

SEQ ID NO: 3804353 - DNA, 11 bp, Homo sapiens
gccacattttg

SEQ ID NO: 3804354 - DNA, 15 bp, Homo sapiens
gccaccgcgcccagc

SEQ ID NO: 3804355 - DNA, 10 bp, Homo sapiens
gccacctgtc

SEQ ID NO: 3804356 - DNA, 13 bp, Homo sapiens
gccacctgtctgt

SEQ ID NO: 3804357 - DNA, 13 bp, Homo sapiens
gccactctgttcc

SEQ ID NO: 3804358 - DNA, 15 bp, Homo sapiens
gccagctgccgacca

SEQ ID NO: 3804359 - DNA, 20 bp, Homo sapiens
gccagctgccgaccagagcc

SEQ ID NO: 3804360 - DNA, 14 bp, Homo sapiens
gccaggatggaatg

SEQ ID NO: 3804361 - DNA, 17 bp, Homo sapiens
gccaggggaaaatcagc

SEQ ID NO: 3804362 - DNA, 22 bp, Homo sapiens
gccagtcctagagctcctgtcc

SEQ ID NO: 3804363 - DNA, 21 bp, Homo sapiens
gccatcatgtttacagaggac

SEQ ID NO: 3804364 - DNA, 18 bp, Homo sapiens
gccatgccagcttatctc

SEQ ID NO: 3804365 - DNA, 19 bp, Homo sapiens
gccatgccagcttatctca

SEQ ID NO: 3804366 - DNA, 14 bp, Homo sapiens
gccatgctcctggc

SEQ ID NO: 3804367 - DNA, 24 bp, Homo sapiens
gccatgctcctggcccactgcatc

SEQ ID NO: 3804368 - DNA, 12 bp, Homo sapiens
gccattggagtc

SEQ ID NO: 3804369 - DNA, 15 bp, Homo sapiens
gccatttgctttttc

SEQ ID NO: 3804370 - DNA, 18 bp, Homo sapiens
gcccaagggcctcccacc

SEQ ID NO: 3804371 - DNA, 15 bp, Homo sapiens
gcccacccctcaaca

SEQ ID NO: 3804372 - DNA, 10 bp, Homo sapiens
gcccaccctg

SEQ ID NO: 3804373 - DNA, 19 bp, Homo sapiens
gcccaccctgctcctcctg

SEQ ID NO: 3804374 - DNA, 18 bp, Homo sapiens
gccccagaaggcagggaa

SEQ ID NO: 3804375 - DNA, 16 bp, Homo sapiens
gccccagcctccaggc

SEQ ID NO: 3804376 - DNA, 13 bp, Homo sapiens
gccccatctcctc

SEQ ID NO: 3804377 - DNA, 22 bp, Homo sapiens
gccccatctcctcccatggcct

SEQ ID NO: 3804378 - DNA, 20 bp, Homo sapiens
gcccccaactccgcccagcc

SEQ ID NO: 3804379 - DNA, 20 bp, Homo sapiens
gccccccagagagagctctg

SEQ ID NO: 3804380 - DNA, 16 bp, Homo sapiens
gcccctccccagccct

SEQ ID NO: 3804381 - DNA, 16 bp, Homo sapiens
gccctcccacctccgc

SEQ ID NO: 3804382 - DNA, 16 bp, Homo sapiens
gccctgagctttctgc

SEQ ID NO: 3804383 - DNA, 17 bp, Homo sapiens
gccctgccacctgtctg

SEQ ID NO: 3804384 - DNA, 11 bp, Homo sapiens
gccctgcccaa

SEQ ID NO: 3804385 - DNA, 17 bp, Homo sapiens
gccctgctgcttcctaa

SEQ ID NO: 3804386 - DNA, 18 bp, Homo sapiens
gccctgctgcttcctaac

SEQ ID NO: 3804387 - DNA, 23 bp, Homo sapiens
gccctggtggtggctcgggaggc

SEQ ID NO: 3804388 - DNA, 17 bp, Homo sapiens
gccctgtccctgtcccc

SEQ ID NO: 3804389 - DNA, 20 bp, Homo sapiens
gcccttagccttgctgtaga

SEQ ID NO: 3804390 - DNA, 21 bp, Homo sapiens
gcccttagccttgctgtagag

SEQ ID NO: 3804391 - DNA, 18 bp, Homo sapiens
gcccttattttcaagaaa

SEQ ID NO: 3804392 - DNA, 16 bp, Homo sapiens
gccctttgcaggccca

SEQ ID NO: 3804393 - DNA, 14 bp, Homo sapiens
gccgaccagagccc

SEQ ID NO: 3804394 - DNA, 17 bp, Homo sapiens
gccgaccagagccccac

SEQ ID NO: 3804395 - DNA, 17 bp, Homo sapiens
gccgagattgcaccact

SEQ ID NO: 3804396 - DNA, 16 bp, Homo sapiens
gccgccatgctcctgg

SEQ ID NO: 3804397 - DNA, 17 bp, Homo sapiens
gccgccccagccccttc

SEQ ID NO: 3804398 - DNA, 13 bp, Homo sapiens
gccgggagcctga

SEQ ID NO: 3804399 - DNA, 14 bp, Homo sapiens
gccgggagcctgac

SEQ ID NO: 3804400 - DNA, 17 bp, Homo sapiens
gcctaggaattcccagc

SEQ ID NO: 3804401 - DNA, 13 bp, Homo sapiens
gcctcaaatgcag

SEQ ID NO: 3804402 - DNA, 20 bp, Homo sapiens
gcctcatttcttcctctgca

SEQ ID NO: 3804403 - DNA, 21 bp, Homo sapiens
gcctccaggcccccaactccg

SEQ ID NO: 3804404 - DNA, 21 bp, Homo sapiens
gcctccagtgggaggacagag

SEQ ID NO: 3804405 - DNA, 23 bp, Homo sapiens
gcctccatcctaccccctgtgcc

SEQ ID NO: 3804406 - DNA, 13 bp, Homo sapiens
gcctcccaccaga

SEQ ID NO: 3804407 - DNA, 14 bp, Homo sapiens
gcctcctcaccccc

SEQ ID NO: 3804408 - DNA, 19 bp, Homo sapiens
gcctccttcttaactctgc

SEQ ID NO: 3804409 - DNA, 13 bp, Homo sapiens
gcctcggcctccc

SEQ ID NO: 3804410 - DNA, 17 bp, Homo sapiens
gcctctagaacacccac

SEQ ID NO: 3804411 - DNA, 20 bp, Homo sapiens
gcctctagaacacccactgg

SEQ ID NO: 3804412 - DNA, 21 bp, Homo sapiens
gcctctagaacacccactggc

SEQ ID NO: 3804413 - DNA, 17 bp, Homo sapiens
cctgcaccgccccttct

SEQ ID NO: 3804414 - DNA, 15 bp, Homo sapiens
cctgcaccggggcct

SEQ ID NO: 3804415 - DNA, 15 bp, Homo sapiens
cctgcagcagagcct

SEQ ID NO: 3804416 - DNA, 16 bp, Homo sapiens
cctgcatgcaactaat

SEQ ID NO: 3804417 - DNA, 13 bp, Homo sapiens
cctgccacctgtc

SEQ ID NO: 3804418 - DNA, 16 bp, Homo sapiens
cctgccacctgtctgt

SEQ ID NO: 3804419 - DNA, 18 bp, Homo sapiens
cctgccatcatgtttaca

SEQ ID NO: 3804420 - DNA, 15 bp, Homo sapiens
cctgccctgccacct

SEQ ID NO: 3804421 - DNA, 17 bp, Homo sapiens
cctgccctgccacctgt

SEQ ID NO: 3804422 - DNA, 16 bp, Homo sapiens
cctgccctgccctgcc

SEQ ID NO: 3804423 - DNA, 16 bp, Homo sapiens
cctgccctgtccctgt

SEQ ID NO: 3804424 - DNA, 16 bp, Homo sapiens
cctgcccttcagcatc

SEQ ID NO: 3804425 - DNA, 14 bp, Homo sapiens
cctgccgagagtcc

SEQ ID NO: 3804426 - DNA, 22 bp, Homo sapiens
cctgccgagagtccatcagcct

SEQ ID NO: 3804427 - DNA, 15 bp, Homo sapiens
cctgcctgggcctcc

SEQ ID NO: 3804428 - DNA, 13 bp, Homo sapiens
cctgcctgttctc

SEQ ID NO: 3804429 - DNA, 16 bp, Homo sapiens
cctgcctgttctccag

SEQ ID NO: 3804430 - DNA, 19 bp, Homo sapiens
cctgcgagagaccctacag

SEQ ID NO: 3804431 - DNA, 23 bp, Homo sapiens
cctgcgagagaccctacagacag

SEQ ID NO: 3804432 - DNA, 12 bp, Homo sapiens
cctgctccagct

SEQ ID NO: 3804433 - DNA, 13 bp, Homo sapiens
cctgctccagctg

SEQ ID NO: 3804434 - DNA, 13 bp, Homo sapiens
cctgctcctcctg

SEQ ID NO: 3804435 - DNA, 16 bp, Homo sapiens
cctgctcctcctgccc

SEQ ID NO: 3804436 - DNA, 17 bp, Homo sapiens
cctgctcctcctgccct

SEQ ID NO: 3804437 - DNA, 22 bp, Homo sapiens
cctgctcctcctgccctgtccc

SEQ ID NO: 3804438 - DNA, 16 bp, Homo sapiens
cctgcttttctcccag

SEQ ID NO: 3804439 - DNA, 22 bp, Homo sapiens
cctggaaggacatccatgttcc

SEQ ID NO: 3804440 - DNA, 14 bp, Homo sapiens
cctggcccactgca

SEQ ID NO: 3804441 - DNA, 14 bp, Homo sapiens
cctggcccttggct

SEQ ID NO: 3804442 - DNA, 21 bp, Homo sapiens
cctggcctgtggagagaaagc

SEQ ID NO: 3804443 - DNA, 12 bp, Homo sapiens
cctggctcagcc

SEQ ID NO: 3804444 - DNA, 16 bp, Homo sapiens
cctgggaccagggcat

SEQ ID NO: 3804445 - DNA, 20 bp, Homo sapiens
cctgggaggtcaaggctgca

SEQ ID NO: 3804446 - DNA, 14 bp, Homo sapiens
cctgggcaggaggg

SEQ ID NO: 3804447 - DNA, 14 bp, Homo sapiens
cctgggcagtgccc

SEQ ID NO: 3804448 - DNA, 16 bp, Homo sapiens
cctgggcagtgcccac

SEQ ID NO: 3804449 - DNA, 19 bp, Homo sapiens
cctgggcctcagcctccag

SEQ ID NO: 3804450 - DNA, 22 bp, Homo sapiens
cctgggcctcagcctccaggca

SEQ ID NO: 3804451 - DNA, 20 bp, Homo sapiens
cctggggccacatagctcat

SEQ ID NO: 3804452 - DNA, 21 bp, Homo sapiens
cctgggtgacccccactgccg

SEQ ID NO: 3804453 - DNA, 19 bp, Homo sapiens
cctggtgcactggccccac

SEQ ID NO: 3804454 - DNA, 20 bp, Homo sapiens
cctgtaatcctagcactttg

SEQ ID NO: 3804455 - DNA, 15 bp, Homo sapiens
cctgtagagtgggag

SEQ ID NO: 3804456 - DNA, 23 bp, Homo sapiens
cctgtatattctcttgtctggct

SEQ ID NO: 3804457 - DNA, 17 bp, Homo sapiens
cctgtatgtctccagta

SEQ ID NO: 3804458 - DNA, 15 bp, Homo sapiens
cctgtccataaagta

SEQ ID NO: 3804459 - DNA, 16 bp, Homo sapiens
cctgtccccctcccct

SEQ ID NO: 3804460 - DNA, 17 bp, Homo sapiens
cctgtccccctcccctc

SEQ ID NO: 3804461 - DNA, 18 bp, Homo sapiens
cctgtccctacccactct

SEQ ID NO: 3804462 - DNA, 20 bp, Homo sapiens
cctgtgcctcctcaccccca

SEQ ID NO: 3804463 - DNA, 15 bp, Homo sapiens
cctgtgcctgaccct

SEQ ID NO: 3804464 - DNA, 23 bp, Homo sapiens
cctgttattttttatttccacat

SEQ ID NO: 3804465 - DNA, 17 bp, Homo sapiens
cctgttctccagatgga

SEQ ID NO: 3804466 - DNA, 19 bp, Homo sapiens
ccttaaggccacactggca

SEQ ID NO: 3804467 - DNA, 18 bp, Homo sapiens
ccttaaggctcttttgta

SEQ ID NO: 3804468 - DNA, 23 bp, Homo sapiens
ccttagccttgctgtagagactt

SEQ ID NO: 3804469 - DNA, 22 bp, Homo sapiens
ccttagctggcattacagctgg

SEQ ID NO: 3804470 - DNA, 14 bp, Homo sapiens
ccttattttcaaga

SEQ ID NO: 3804471 - DNA, 13 bp, Homo sapiens
ccctgccacctgt

SEQ ID NO: 3804472 - DNA, 18 bp, Homo sapiens
ccctgccacctgtctgtc

SEQ ID NO: 3804473 - DNA, 20 bp, Homo sapiens
ccctgccatcatgtttacag

SEQ ID NO: 3804474 - DNA, 10 bp, Homo sapiens
ccctgcccaa

SEQ ID NO: 3804475 - DNA, 17 bp, Homo sapiens
ccctgccctgccacctg

SEQ ID NO: 3804476 - DNA, 15 bp, Homo sapiens
ccctgctgcttccta

SEQ ID NO: 3804477 - DNA, 16 bp, Homo sapiens
ccctgctgcttcctaa

SEQ ID NO: 3804478 - DNA, 18 bp, Homo sapiens
ccctgctgcttcctaact

SEQ ID NO: 3804479 - DNA, 23 bp, Homo sapiens
ccctgctgcttcctaacttattg

SEQ ID NO: 3804480 - DNA, 20 bp, Homo sapiens
ccctgcttttctcccagaag

SEQ ID NO: 3804481 - DNA, 21 bp, Homo sapiens
ccctgcttttctcccagaagg

SEQ ID NO: 3804482 - DNA, 22 bp, Homo sapiens
ccctgcttttctcccagaaggc

SEQ ID NO: 3804483 - DNA, 24 bp, Homo sapiens
ccctgcttttctcccagaaggctg

SEQ ID NO: 3804484 - DNA, 17 bp, Homo sapiens
ccctgtagcagcattac

SEQ ID NO: 3804485 - DNA, 23 bp, Homo sapiens
ccctgtagcagcattacagaaat

SEQ ID NO: 3804486 - DNA, 15 bp, Homo sapiens
cccttggtagagttt

SEQ ID NO: 3804487 - DNA, 18 bp, Homo sapiens
cccttggtagagtttatt

SEQ ID NO: 3804488 - DNA, 14 bp, Homo sapiens
ccgaccccatctca

SEQ ID NO: 3804489 - DNA, 15 bp, Homo sapiens
ccgagattgcaccac

SEQ ID NO: 3804490 - DNA, 13 bp, Homo sapiens
ccgcaccccccaa

SEQ ID NO: 3804491 - DNA, 15 bp, Homo sapiens
ccgccaccacacccg

SEQ ID NO: 3804492 - DNA, 16 bp, Homo sapiens
ccgccatgctcctggc

SEQ ID NO: 3804493 - DNA, 14 bp, Homo sapiens
ccgcccagcctctc

SEQ ID NO: 3804494 - DNA, 14 bp, Homo sapiens
ccgccccagcccct

SEQ ID NO: 3804495 - DNA, 19 bp, Homo sapiens
ccgcctcccttatgcagga

SEQ ID NO: 3804496 - DNA, 15 bp, Homo sapiens
ccgcctcggcctccc

SEQ ID NO: 3804497 - DNA, 18 bp, Homo sapiens
ccgctctggatcctgcac

SEQ ID NO: 3804498 - DNA, 19 bp, Homo sapiens
ccggaggtgtcaccttcct

SEQ ID NO: 3804499 - DNA, 18 bp, Homo sapiens
ccggcagggtcctagaaa

SEQ ID NO: 3804500 - DNA, 16 bp, Homo sapiens
ccggctttgtggcact

SEQ ID NO: 3804501 - DNA, 17 bp, Homo sapiens
ccggctttgtggcactg

SEQ ID NO: 3804502 - DNA, 20 bp, Homo sapiens
ccgggacacctaggctaggg

SEQ ID NO: 3804503 - DNA, 15 bp, Homo sapiens
ccggggcctgggcag

SEQ ID NO: 3804504 - DNA, 21 bp, Homo sapiens
ccgggggcagtctgagagagg

SEQ ID NO: 3804505 - DNA, 15 bp, Homo sapiens
ccggtggaaggcctt

SEQ ID NO: 3804506 - DNA, 17 bp, Homo sapiens
ccgtctggcgagccctt

SEQ ID NO: 3804507 - DNA, 16 bp, Homo sapiens
ccgtggcaaccctcag

SEQ ID NO: 3804508 - DNA, 13 bp, Homo sapiens
cctaacttattgc

SEQ ID NO: 3804509 - DNA, 23 bp, Homo sapiens
cctaacttattgcctgggcagtg

SEQ ID NO: 3804510 - DNA, 13 bp, Homo sapiens
cctaataaagaga

SEQ ID NO: 3804511 - DNA, 14 bp, Homo sapiens
cctaccaacctctg

SEQ ID NO: 3804512 - DNA, 13 bp, Homo sapiens
cctacccactctt

SEQ ID NO: 3804513 - DNA, 14 bp, Homo sapiens
cctacccactcttt

SEQ ID NO: 3804514 - DNA, 20 bp, Homo sapiens
cctacccactctttgctaca

SEQ ID NO: 3804515 - DNA, 16 bp, Homo sapiens
cctacctgtgcctgac

SEQ ID NO: 3804516 - DNA, 21 bp, Homo sapiens
cctagaaattccccaccctga

SEQ ID NO: 3804517 - DNA, 16 bp, Homo sapiens
cctagagctcctgtcc

SEQ ID NO: 3804518 - DNA, 19 bp, Homo sapiens
cctagagctcctgtcccta

SEQ ID NO: 3804519 - DNA, 22 bp, Homo sapiens
cctagagctcctgtccctaccc

SEQ ID NO: 3804520 - DNA, 17 bp, Homo sapiens
cctagcactttgggagg

SEQ ID NO: 3804521 - DNA, 13 bp, Homo sapiens
cctagccctctca

SEQ ID NO: 3804522 - DNA, 20 bp, Homo sapiens
cctagccctctcacatttat

SEQ ID NO: 3804523 - DNA, 16 bp, Homo sapiens
cctaggattcctcccc

SEQ ID NO: 3804524 - DNA, 17 bp, Homo sapiens
cctaggattcctccccc

SEQ ID NO: 3804525 - DNA, 23 bp, Homo sapiens
cctaggcatttgctgaatacaga

SEQ ID NO: 3804526 - DNA, 19 bp, Homo sapiens
cctagttttctcctcccag

SEQ ID NO: 3804527 - DNA, 20 bp, Homo sapiens
cctagttttctcctcccagg

SEQ ID NO: 3804528 - DNA, 15 bp, Homo sapiens
cctcagcctcctgag

SEQ ID NO: 3804529 - DNA, 12 bp, Homo sapiens
cctcagctgcct

SEQ ID NO: 3804530 - DNA, 17 bp, Homo sapiens
cctcaggtgagaagcag

SEQ ID NO: 3804531 - DNA, 22 bp, Homo sapiens
cctcaggtgagaagcagaggaa

SEQ ID NO: 3804532 - DNA, 18 bp, Homo sapiens
cctcattagcattttgct

SEQ ID NO: 3804533 - DNA, 18 bp, Homo sapiens
cctcatttcttcctctgc

SEQ ID NO: 3804534 - DNA, 19 bp, Homo sapiens
cctcatttcttcctctgca

SEQ ID NO: 3804535 - DNA, 23 bp, Homo sapiens
cctccaaacactgggctctgagg

SEQ ID NO: 3804536 - DNA, 22 bp, Homo sapiens
cctccagccctctcactgtgtc

SEQ ID NO: 3804537 - DNA, 23 bp, Homo sapiens
cctccagtgggaggacagagccg

SEQ ID NO: 3804538 - DNA, 15 bp, Homo sapiens
cctccattctgacca

SEQ ID NO: 3804539 - DNA, 19 bp, Homo sapiens
cctcccaacagagctgggc

SEQ ID NO: 3804540 - DNA, 20 bp, Homo sapiens
cctcccaccagtggccccca

SEQ ID NO: 3804541 - DNA, 20 bp, Homo sapiens
cctcccagctttctgtgtgc

SEQ ID NO: 3804542 - DNA, 13 bp, Homo sapiens
cctcccagtcctc

SEQ ID NO: 3804543 - DNA, 12 bp, Homo sapiens
cctcccatggcc

SEQ ID NO: 3804544 - DNA, 18 bp, Homo sapiens
cctccgtccaggagcctg

SEQ ID NO: 3804545 - DNA, 14 bp, Homo sapiens
cctcctctgcccgg

SEQ ID NO: 3804546 - DNA, 15 bp, Homo sapiens
cctcctctgcccggg

SEQ ID NO: 3804547 - DNA, 15 bp, Homo sapiens
cctcctgagtagctg

SEQ ID NO: 3804548 - DNA, 17 bp, Homo sapiens
cctcctgctgcctaata

SEQ ID NO: 3804549 - DNA, 15 bp, Homo sapiens
cctcgactcagcacc

SEQ ID NO: 3804550 - DNA, 22 bp, Homo sapiens
cctcggcctcccaaagtgctgg

SEQ ID NO: 3804551 - DNA, 14 bp, Homo sapiens
cctcggtgtggaga

SEQ ID NO: 3804552 - DNA, 18 bp, Homo sapiens
cctcggtgtggagaagcg

SEQ ID NO: 3804553 - DNA, 17 bp, Homo sapiens
cctcgtggacacctgcc

SEQ ID NO: 3804554 - DNA, 22 bp, Homo sapiens
cctcgttactctcacctcgtga

SEQ ID NO: 3804555 - DNA, 17 bp, Homo sapiens
cctctagaacacccact

SEQ ID NO: 3804556 - DNA, 18 bp, Homo sapiens
cctctagaacacccactg

SEQ ID NO: 3804557 - DNA, 18 bp, Homo sapiens
cctctcattccagaggaa

SEQ ID NO: 3804558 - DNA, 16 bp, Homo sapiens
cctctccaagtctctc

SEQ ID NO: 3804559 - DNA, 21 bp, Homo sapiens
cctctccaagtctctctgtga

SEQ ID NO: 3804560 - DNA, 23 bp, Homo sapiens
cctctccaagtctctctgtgaat

SEQ ID NO: 3804561 - DNA, 17 bp, Homo sapiens
cctctgaatgtcccaga

SEQ ID NO: 3804562 - DNA, 18 bp, Homo sapiens
cctctgaatgtcccagag

SEQ ID NO: 3804563 - DNA, 21 bp, Homo sapiens
cctctgaatgtcccagaggct

SEQ ID NO: 3804564 - DNA, 17 bp, Homo sapiens
cctctgcacaagctgca

SEQ ID NO: 3804565 - DNA, 20 bp, Homo sapiens
cctctgcacaagctgcaccc

SEQ ID NO: 3804566 - DNA, 23 bp, Homo sapiens
cctcttggggagtttagggtggg

SEQ ID NO: 3804567 - DNA, 13 bp, Homo sapiens
cctgaaagccctg

SEQ ID NO: 3804568 - DNA, 14 bp, Homo sapiens
cctgaaatttcaga

SEQ ID NO: 3804569 - DNA, 19 bp, Homo sapiens
cctgaagagaagggcaggg

SEQ ID NO: 3804570 - DNA, 15 bp, Homo sapiens
cctgacactgagccc

SEQ ID NO: 3804571 - DNA, 17 bp, Homo sapiens
cctgacactgagcccca

SEQ ID NO: 3804572 - DNA, 19 bp, Homo sapiens
cctgaccctcatctttctt

SEQ ID NO: 3804573 - DNA, 16 bp, Homo sapiens
cctgaccttctccagg

SEQ ID NO: 3804574 - DNA, 22 bp, Homo sapiens
cctgaccttctccagggacaga

SEQ ID NO: 3804575 - DNA, 12 bp, Homo sapiens
cctgactttctc

SEQ ID NO: 3804576 - DNA, 21 bp, Homo sapiens
cctgagatactgaagtgcagc

SEQ ID NO: 3804577 - DNA, 14 bp, Homo sapiens
cctgagctttctgc

SEQ ID NO: 3804578 - DNA, 14 bp, Homo sapiens
cctgagtagctggg

SEQ ID NO: 3804579 - DNA, 19 bp, Homo sapiens
cctgagtttcaagtatcct

SEQ ID NO: 3804580 - DNA, 17 bp, Homo sapiens
cattctcctgcctcagc

SEQ ID NO: 3804581 - DNA, 13 bp, Homo sapiens
cattcttcctagt

SEQ ID NO: 3804582 - DNA, 18 bp, Homo sapiens
cattcttcctagttttct

SEQ ID NO: 3804583 - DNA, 12 bp, Homo sapiens
cattctttccca

SEQ ID NO: 3804584 - DNA, 12 bp, Homo sapiens
cattgaaagctc

SEQ ID NO: 3804585 - DNA, 23 bp, Homo sapiens
cattgcctcatttcttcctctgc

SEQ ID NO: 3804586 - DNA, 18 bp, Homo sapiens
cattgctgggcttgtctg

SEQ ID NO: 3804587 - DNA, 12 bp, Homo sapiens
cattgtcttcca

SEQ ID NO: 3804588 - DNA, 17 bp, Homo sapiens
cattgtcttccaacccc

SEQ ID NO: 3804589 - DNA, 19 bp, Homo sapiens
cattgtcttccaaccccag

SEQ ID NO: 3804590 - DNA, 23 bp, Homo sapiens
cattgtcttccaaccccagctgg

SEQ ID NO: 3804591 - DNA, 22 bp, Homo sapiens
cattgtgtcagaaacatgaaat

SEQ ID NO: 3804592 - DNA, 15 bp, Homo sapiens
catttaaaaaaaatc

SEQ ID NO: 3804593 - DNA, 16 bp, Homo sapiens
catttatgaagcaagc

SEQ ID NO: 3804594 - DNA, 13 bp, Homo sapiens
catttgagtgtct

SEQ ID NO: 3804595 - DNA, 14 bp, Homo sapiens
catttgccagattg

SEQ ID NO: 3804596 - DNA, 14 bp, Homo sapiens
catttgttcattaa

SEQ ID NO: 3804597 - DNA, 17 bp, Homo sapiens
catttttgtacattatg

SEQ ID NO: 3804598 - DNA, 21 bp, Homo sapiens
ccaaagctgttggtctgtccc

SEQ ID NO: 3804599 - DNA, 17 bp, Homo sapiens
ccaaatatatcaaaacg

SEQ ID NO: 3804600 - DNA, 23 bp, Homo sapiens
ccaaatatatcaaaacgttttat

SEQ ID NO: 3804601 - DNA, 14 bp, Homo sapiens
ccaaatcaggctgg

SEQ ID NO: 3804602 - DNA, 23 bp, Homo sapiens
ccaaattttcaataaatttctgc

SEQ ID NO: 3804603 - DNA, 15 bp, Homo sapiens
ccaacccagcctgag

SEQ ID NO: 3804604 - DNA, 16 bp, Homo sapiens
ccaaccccagctggcc

SEQ ID NO: 3804605 - DNA, 17 bp, Homo sapiens
ccaagctgttttcttct

SEQ ID NO: 3804606 - DNA, 18 bp, Homo sapiens
ccaagctgttttcttcta

SEQ ID NO: 3804607 - DNA, 18 bp, Homo sapiens
ccaaggagaaacagagac

SEQ ID NO: 3804608 - DNA, 20 bp, Homo sapiens
ccaagggcctcccaccagag

SEQ ID NO: 3804609 - DNA, 18 bp, Homo sapiens
ccaaggtgggaggattgc

SEQ ID NO: 3804610 - DNA, 15 bp, Homo sapiens
ccaaggttgtcctgg

SEQ ID NO: 3804611 - DNA, 20 bp, Homo sapiens
ccaagtaaccaggccccagc

SEQ ID NO: 3804612 - DNA, 24 bp, Homo sapiens
ccaagtaaccaggccccagcctcc

SEQ ID NO: 3804613 - DNA, 12 bp, Homo sapiens
ccaagtctctct

SEQ ID NO: 3804614 - DNA, 15 bp, Homo sapiens
ccaagtctctctgtg

SEQ ID NO: 3804615 - DNA, 17 bp, Homo sapiens
ccaagtctctctgtgaa

SEQ ID NO: 3804616 - DNA, 18 bp, Homo sapiens
ccaagtctctctgtgaat

SEQ ID NO: 3804617 - DNA, 19 bp, Homo sapiens
ccaagtctctctgtgaata

SEQ ID NO: 3804618 - DNA, 16 bp, Homo sapiens
ccaatcggctacccct

SEQ ID NO: 3804619 - DNA, 20 bp, Homo sapiens
ccaatgttctctcttctcca

SEQ ID NO: 3804620 - DNA, 16 bp, Homo sapiens
ccaattcacctcgtta

SEQ ID NO: 3804621 - DNA, 15 bp, Homo sapiens
ccacaaatgctattc

SEQ ID NO: 3804622 - DNA, 20 bp, Homo sapiens
ccacaacctccacctcctgg

SEQ ID NO: 3804623 - DNA, 12 bp, Homo sapiens
ccacacacagag

SEQ ID NO: 3804624 - DNA, 17 bp, Homo sapiens
ccacacacagaggaaga

SEQ ID NO: 3804625 - DNA, 18 bp, Homo sapiens
ccacacacagaggaagag

SEQ ID NO: 3804626 - DNA, 20 bp, Homo sapiens
ccacacagacttgggcaggg

SEQ ID NO: 3804627 - DNA, 12 bp, Homo sapiens
ccacaccccagc

SEQ ID NO: 3804628 - DNA, 15 bp, Homo sapiens
ccacaccccagccca

SEQ ID NO: 3804629 - DNA, 16 bp, Homo sapiens
ccacaccccagcccac

SEQ ID NO: 3804630 - DNA, 17 bp, Homo sapiens
ccacaccccagcccacc

SEQ ID NO: 3804631 - DNA, 16 bp, Homo sapiens
ccacacctccctgaac

SEQ ID NO: 3804632 - DNA, 17 bp, Homo sapiens
ccacagaaaggccactc

SEQ ID NO: 3804633 - DNA, 19 bp, Homo sapiens
ccacatagctcataagctg

SEQ ID NO: 3804634 - DNA, 22 bp, Homo sapiens
ccacattgcctcatttcttcct

SEQ ID NO: 3804635 - DNA, 13 bp, Homo sapiens
ccaccagccgccc

SEQ ID NO: 3804636 - DNA, 18 bp, Homo sapiens
ccaccagccgccccagcc

SEQ ID NO: 3804637 - DNA, 19 bp, Homo sapiens
ccaccagccgccccagccc

SEQ ID NO: 3804638 - DNA, 20 bp, Homo sapiens
ccaccagccgccccagcccc

SEQ ID NO: 3804639 - DNA, 19 bp, Homo sapiens
ccaccaggcagctccagct

SEQ ID NO: 3804640 - DNA, 20 bp, Homo sapiens
ccaccctcgtggacacctgc

SEQ ID NO: 3804641 - DNA, 17 bp, Homo sapiens
ccaccctgaaagccctg

SEQ ID NO: 3804642 - DNA, 20 bp, Homo sapiens
ccaccctgctcctcctgccc

SEQ ID NO: 3804643 - DNA, 17 bp, Homo sapiens
ccacctcccacaaagga

SEQ ID NO: 3804644 - DNA, 14 bp, Homo sapiens
ccacctcctgggtt

SEQ ID NO: 3804645 - DNA, 13 bp, Homo sapiens
ccacctctcaata

SEQ ID NO: 3804646 - DNA, 11 bp, Homo sapiens
ccacctgtctg

SEQ ID NO: 3804647 - DNA, 18 bp, Homo sapiens
cccaggattcccagagag

SEQ ID NO: 3804648 - DNA, 18 bp, Homo sapiens
cccaggctagagtgcagt

SEQ ID NO: 3804649 - DNA, 17 bp, Homo sapiens
cccaggctggagtgcaa

SEQ ID NO: 3804650 - DNA, 18 bp, Homo sapiens
cccaggctggagtgcaat

SEQ ID NO: 3804651 - DNA, 18 bp, Homo sapiens
cccagtgccgagaaggaa

SEQ ID NO: 3804652 - DNA, 13 bp, Homo sapiens
cccatgagctcct

SEQ ID NO: 3804653 - DNA, 19 bp, Homo sapiens
cccatgttggtcaggctgg

SEQ ID NO: 3804654 - DNA, 12 bp, Homo sapiens
cccattcttcct

SEQ ID NO: 3804655 - DNA, 16 bp, Homo sapiens
ccccaacgaaaagcac

SEQ ID NO: 3804656 - DNA, 19 bp, Homo sapiens
ccccaagatgagctgcagc

SEQ ID NO: 3804657 - DNA, 23 bp, Homo sapiens
ccccacaccccagcccaccctgc

SEQ ID NO: 3804658 - DNA, 21 bp, Homo sapiens
ccccaccctcgtggacacctg

SEQ ID NO: 3804659 - DNA, 15 bp, Homo sapiens
ccccactcacaggga

SEQ ID NO: 3804660 - DNA, 16 bp, Homo sapiens
ccccagaaggcaggga

SEQ ID NO: 3804661 - DNA, 14 bp, Homo sapiens
ccccagacctctga

SEQ ID NO: 3804662 - DNA, 14 bp, Homo sapiens
ccccagccccttct

SEQ ID NO: 3804663 - DNA, 21 bp, Homo sapiens
ccccagccccttctcccagca

SEQ ID NO: 3804664 - DNA, 22 bp, Homo sapiens
ccccagccccttctcccagcac

SEQ ID NO: 3804665 - DNA, 11 bp, Homo sapiens
ccccagcctcc

SEQ ID NO: 3804666 - DNA, 12 bp, Homo sapiens
ccccagctggcc

SEQ ID NO: 3804667 - DNA, 14 bp, Homo sapiens
ccccagctggcctc

SEQ ID NO: 3804668 - DNA, 20 bp, Homo sapiens
ccccatctcctcccatggcc

SEQ ID NO: 3804669 - DNA, 19 bp, Homo sapiens
cccccaagctgttttcttc

SEQ ID NO: 3804670 - DNA, 18 bp, Homo sapiens
cccccagagagagctctg

SEQ ID NO: 3804671 - DNA, 20 bp, Homo sapiens
cccccaggattcccagagag

SEQ ID NO: 3804672 - DNA, 18 bp, Homo sapiens
ccccctcccctcccagtc

SEQ ID NO: 3804673 - DNA, 12 bp, Homo sapiens
ccccgctctgga

SEQ ID NO: 3804674 - DNA, 17 bp, Homo sapiens
ccccgtgggccatggca

SEQ ID NO: 3804675 - DNA, 14 bp, Homo sapiens
cccctccccagccc

SEQ ID NO: 3804676 - DNA, 17 bp, Homo sapiens
cccctcgactcagcacc

SEQ ID NO: 3804677 - DNA, 18 bp, Homo sapiens
cccctcgactcagcacca

SEQ ID NO: 3804678 - DNA, 16 bp, Homo sapiens
ccccttctcccagcac

SEQ ID NO: 3804679 - DNA, 13 bp, Homo sapiens
ccctacctgcctg

SEQ ID NO: 3804680 - DNA, 14 bp, Homo sapiens
ccctacctgtgcct

SEQ ID NO: 3804681 - DNA, 18 bp, Homo sapiens
ccctacttcttttgctct

SEQ ID NO: 3804682 - DNA, 16 bp, Homo sapiens
ccctcaacacctctgc

SEQ ID NO: 3804683 - DNA, 14 bp, Homo sapiens
ccctcatctttctt

SEQ ID NO: 3804684 - DNA, 13 bp, Homo sapiens
ccctcccagtcct

SEQ ID NO: 3804685 - DNA, 21 bp, Homo sapiens
ccctcccagtcctccagacca

SEQ ID NO: 3804686 - DNA, 15 bp, Homo sapiens
ccctcgactcagcac

SEQ ID NO: 3804687 - DNA, 17 bp, Homo sapiens
ccctcgactcagcacca

SEQ ID NO: 3804688 - DNA, 16 bp, Homo sapiens
ccctcgtggacacctg

SEQ ID NO: 3804689 - DNA, 18 bp, Homo sapiens
ccctgaaagccctgagct

SEQ ID NO: 3804690 - DNA, 13 bp, Homo sapiens
ccctgaccttctc

SEQ ID NO: 3804691 - DNA, 19 bp, Homo sapiens
ccctgaccttctccaggga

SEQ ID NO: 3804692 - DNA, 20 bp, Homo sapiens
ccctgatcaagtcaccggag

SEQ ID NO: 3804693 - DNA, 18 bp, Homo sapiens
tggtgggggcctcggtgt

SEQ ID NO: 3804694 - DNA, 16 bp, Homo sapiens
tggttcagctaagcta

SEQ ID NO: 3804695 - DNA, 14 bp, Homo sapiens
tgtaaaaaatgtaa

SEQ ID NO: 3804696 - DNA, 15 bp, Homo sapiens
ttgctttttcaccag

SEQ ID NO: 3804697 - DNA, 21 bp, Homo sapiens
ttggaaaaatccagaaagaaa

SEQ ID NO: 3804698 - DNA, 13 bp, Homo sapiens
ttggaattttctt

SEQ ID NO: 3804699 - DNA, 15 bp, Homo sapiens
tgaggacacatgtcc

SEQ ID NO: 3804700 - DNA, 22 bp, Homo sapiens
tgaggagtggagttctctgttc

SEQ ID NO: 3804701 - DNA, 16 bp, Homo sapiens
tgaggccattatttca

SEQ ID NO: 3804702 - DNA, 13 bp, Homo sapiens
tgaggccccaggc

SEQ ID NO: 3804703 - DNA, 13 bp, Homo sapiens
tgagggagagact

SEQ ID NO: 3804704 - DNA, 18 bp, Homo sapiens
tgaggtcaataaagcaga

SEQ ID NO: 3804705 - DNA, 22 bp, Homo sapiens
tgaggtcaataaagcagagcca

SEQ ID NO: 3804706 - DNA, 23 bp, Homo sapiens
tgaggtcaataaagcagagccaa

SEQ ID NO: 3804707 - DNA, 18 bp, Homo sapiens
agactagattctcacctg

SEQ ID NO: 3804708 - DNA, 13 bp, Homo sapiens
agactgagggaga

SEQ ID NO: 3804709 - DNA, 23 bp, Homo sapiens
agactgcgccacggcactccagc

SEQ ID NO: 3804710 - DNA, 19 bp, Homo sapiens
agacttcccacggctcctc

SEQ ID NO: 3804711 - DNA, 22 bp, Homo sapiens
agacttcctgtaagattgcttt

SEQ ID NO: 3804712 - DNA, 10 bp, Homo sapiens
agagaagaga

SEQ ID NO: 3804713 - DNA, 22 bp, Homo sapiens
agagaatttctaccatttcaga

SEQ ID NO: 3804714 - DNA, 19 bp, Homo sapiens
agagacaaacacctcccag

SEQ ID NO: 3804715 - DNA, 20 bp, Homo sapiens
agagacaaacacctcccagg

SEQ ID NO: 3804716 - DNA, 13 bp, Homo sapiens
agagacacagaga

SEQ ID NO: 3804717 - DNA, 21 bp, Homo sapiens
agagacagaaacagagagaga

SEQ ID NO: 3804718 - DNA, 15 bp, Homo sapiens
agagacagagagaga

SEQ ID NO: 3804719 - DNA, 20 bp, Homo sapiens
agagacaggcccaagagatg

SEQ ID NO: 3804720 - DNA, 17 bp, Homo sapiens
agagagactgagggaga

SEQ ID NO: 3804721 - DNA, 14 bp, Homo sapiens
agagaggccttttg

SEQ ID NO: 3804722 - DNA, 17 bp, Homo sapiens
agagagggaattctctt

SEQ ID NO: 3804723 - DNA, 13 bp, Homo sapiens
agagatatgcaca

SEQ ID NO: 3804724 - DNA, 19 bp, Homo sapiens
agagatcaaatggaaagga

SEQ ID NO: 3804725 - DNA, 14 bp, Homo sapiens
agagcaagactctg

SEQ ID NO: 3804726 - DNA, 20 bp, Homo sapiens
agagcaggcacatggaggag

SEQ ID NO: 3804727 - DNA, 12 bp, Homo sapiens
agagccaaggcc

SEQ ID NO: 3804728 - DNA, 13 bp, Homo sapiens
agagccaaggcca

SEQ ID NO: 3804729 - DNA, 14 bp, Homo sapiens
agagccaaggccac

SEQ ID NO: 3804730 - DNA, 21 bp, Homo sapiens
agagccttgcggaaggttcta

SEQ ID NO: 3804731 - DNA, 17 bp, Homo sapiens
agagctcctgtccctac

SEQ ID NO: 3804732 - DNA, 21 bp, Homo sapiens
agagctcctgtccctacccac

SEQ ID NO: 3804733 - DNA, 22 bp, Homo sapiens
agagctcctgtccctacccact

SEQ ID NO: 3804734 - DNA, 13 bp, Homo sapiens
agagctctctctt

SEQ ID NO: 3804735 - DNA, 22 bp, Homo sapiens
agagctgagtggcagccgcctc

SEQ ID NO: 3804736 - DNA, 18 bp, Homo sapiens
agagctggcagcctccag

SEQ ID NO: 3804737 - DNA, 10 bp, Homo sapiens
agagctgggc

SEQ ID NO: 3804738 - DNA, 20 bp, Homo sapiens
agaggaaaatgaataataca

SEQ ID NO: 3804739 - DNA, 13 bp, Homo sapiens
agaggaagagcag

SEQ ID NO: 3804740 - DNA, 16 bp, Homo sapiens
agaggaaggagaggag

SEQ ID NO: 3804741 - DNA, 14 bp, Homo sapiens
agaggagggcatgg

SEQ ID NO: 3804742 - DNA, 23 bp, Homo sapiens
agaggcacctaaacttgggtaca

SEQ ID NO: 3804743 - DNA, 13 bp, Homo sapiens
agaggcagggagg

SEQ ID NO: 3804744 - DNA, 19 bp, Homo sapiens
agaggccccggctgggtga

SEQ ID NO: 3804745 - DNA, 24 bp, Homo sapiens
agagggaggagaatgagcctcggc

SEQ ID NO: 3804746 - DNA, 20 bp, Homo sapiens
agaggggaataatagaagaa

SEQ ID NO: 3804747 - DNA, 16 bp, Homo sapiens
agaggggcaggggagt

SEQ ID NO: 3804748 - DNA, 16 bp, Homo sapiens
agagggtgtcctgcac

SEQ ID NO: 3804749 - DNA, 13 bp, Homo sapiens
agaggtggggagg

SEQ ID NO: 3804750 - DNA, 17 bp, Homo sapiens
agagtccctgcctggac

SEQ ID NO: 3804751 - DNA, 17 bp, Homo sapiens
agagtgacaggcaccag

SEQ ID NO: 3804752 - DNA, 19 bp, Homo sapiens
agagttggtgttcataatt

SEQ ID NO: 3804753 - DNA, 19 bp, Homo sapiens
agagtttatttttttgatg

SEQ ID NO: 3804754 - DNA, 21 bp, Homo sapiens
agagtttatttttttgatggc

SEQ ID NO: 3804755 - DNA, 23 bp, Homo sapiens
agagtttatttttttgatggcta

SEQ ID NO: 3804756 - DNA, 19 bp, Homo sapiens
agataaggcagaactagga

SEQ ID NO: 3804757 - DNA, 19 bp, Homo sapiens
agataatcttagctgccaa

SEQ ID NO: 3804758 - DNA, 23 bp, Homo sapiens
agatactgaagtgcagctcagga

SEQ ID NO: 3804759 - DNA, 22 bp, Homo sapiens
agatactgctgatgctgaaata

SEQ ID NO: 3804760 - DNA, 11 bp, Homo sapiens
agatatgcaca

SEQ ID NO: 3804761 - DNA, 14 bp, Homo sapiens
agatccacacacag

SEQ ID NO: 3804762 - DNA, 16 bp, Homo sapiens
agatccacacacagag

SEQ ID NO: 3804763 - DNA, 18 bp, Homo sapiens
agatcccaacactgccag

SEQ ID NO: 3804764 - DNA, 19 bp, Homo sapiens
agatcccaacactgccagc

SEQ ID NO: 3804765 - DNA, 20 bp, Homo sapiens
agatcccaacactgccagca

SEQ ID NO: 3804766 - DNA, 19 bp, Homo sapiens
agatctgcttccctggggc

SEQ ID NO: 3804767 - DNA, 20 bp, Homo sapiens
agatgaagagtgagagggca

SEQ ID NO: 3804768 - DNA, 15 bp, Homo sapiens
agatgagaggcagag

SEQ ID NO: 3804769 - DNA, 14 bp, Homo sapiens
agatgcagcaaaat

SEQ ID NO: 3804770 - DNA, 21 bp, Homo sapiens
agatgcagcaaaatgtgaatg

SEQ ID NO: 3804771 - DNA, 16 bp, Homo sapiens
agatgcttctcactgc

SEQ ID NO: 3804772 - DNA, 19 bp, Homo sapiens
agatggagtctcgctctgc

SEQ ID NO: 3804773 - DNA, 22 bp, Homo sapiens
agatgggatgggctttctcagt

SEQ ID NO: 3804774 - DNA, 17 bp, Homo sapiens
agatgtaaaaggtatta

SEQ ID NO: 3804775 - DNA, 18 bp, Homo sapiens
agatgtgctcccaccagg

SEQ ID NO: 3804776 - DNA, 18 bp, Homo sapiens
agattatatatcataaag

SEQ ID NO: 3804777 - DNA, 19 bp, Homo sapiens
agattatatatcataaagt

SEQ ID NO: 3804778 - DNA, 14 bp, Homo sapiens
agattgggataagg

SEQ ID NO: 3804779 - DNA, 20 bp, Homo sapiens
agatttactgtcccaggagc

SEQ ID NO: 3804780 - DNA, 18 bp, Homo sapiens
agcaaaagatgcttctca

SEQ ID NO: 3804781 - DNA, 15 bp, Homo sapiens
agcaaaatgtgaatg

SEQ ID NO: 3804782 - DNA, 16 bp, Homo sapiens
agcaaagtgtcagtgt

SEQ ID NO: 3804783 - DNA, 17 bp, Homo sapiens
agcaaagtgtcagtgtt

SEQ ID NO: 3804784 - DNA, 18 bp, Homo sapiens
agcaaagtgtcagtgttg

SEQ ID NO: 3804785 - DNA, 19 bp, Homo sapiens
agcaaattctgtttttcta

SEQ ID NO: 3804786 - DNA, 20 bp, Homo sapiens
agcaacatgcttcatgaaaa

SEQ ID NO: 3804787 - DNA, 21 bp, Homo sapiens
agcaagccggcagaaatagct

SEQ ID NO: 3804788 - DNA, 18 bp, Homo sapiens
agcaccacattgcctcat

SEQ ID NO: 3804789 - DNA, 20 bp, Homo sapiens
agcactgctgtgtccgcttt

SEQ ID NO: 3804790 - DNA, 11 bp, Homo sapiens
agcagagccaa

SEQ ID NO: 3804791 - DNA, 13 bp, Homo sapiens
agcagagccaagg

SEQ ID NO: 3804792 - DNA, 17 bp, Homo sapiens
agcagagccaaggccac

SEQ ID NO: 3804793 - DNA, 17 bp, Homo sapiens
agcagaggaaggagagg

SEQ ID NO: 3804794 - DNA, 14 bp, Homo sapiens
agcagcattacaga

SEQ ID NO: 3804795 - DNA, 16 bp, Homo sapiens
agcagccccctgcccg

SEQ ID NO: 3804796 - DNA, 19 bp, Homo sapiens
agcaggcacatggaggagc

SEQ ID NO: 3804797 - DNA, 20 bp, Homo sapiens
agcagggagggcttctgcca

SEQ ID NO: 3804798 - DNA, 19 bp, Homo sapiens
agcatagttattttacaaa

SEQ ID NO: 3804799 - DNA, 16 bp, Homo sapiens
agcatcaccatgcatg

SEQ ID NO: 3804800 - DNA, 17 bp, Homo sapiens
agcatgacaacttttaa

SEQ ID NO: 3804801 - DNA, 21 bp, Homo sapiens
agcatgggactgtgcctttgg

SEQ ID NO: 3804802 - DNA, 22 bp, Homo sapiens
agcatgggactgtgcctttggg

SEQ ID NO: 3804803 - DNA, 17 bp, Homo sapiens
agcatttcccttccttc

SEQ ID NO: 3804804 - DNA, 17 bp, Homo sapiens
aggcagaggcagacagg

SEQ ID NO: 3804805 - DNA, 22 bp, Homo sapiens
aggcagggaaaggctctgaaag

SEQ ID NO: 3804806 - DNA, 12 bp, Homo sapiens
aggcagggaggg

SEQ ID NO: 3804807 - DNA, 13 bp, Homo sapiens
aggcagggagggg

SEQ ID NO: 3804808 - DNA, 14 bp, Homo sapiens
aggcagggagggga

SEQ ID NO: 3804809 - DNA, 16 bp, Homo sapiens
aggcagggaggggact

SEQ ID NO: 3804810 - DNA, 21 bp, Homo sapiens
aggcagtgaacacactcagca

SEQ ID NO: 3804811 - DNA, 16 bp, Homo sapiens
aggcatctgagtgtga

SEQ ID NO: 3804812 - DNA, 20 bp, Homo sapiens
aggcatgagggatcacaggg

SEQ ID NO: 3804813 - DNA, 23 bp, Homo sapiens
aggccacactggcatctccctga

SEQ ID NO: 3804814 - DNA, 17 bp, Homo sapiens
aggccattctttcccaa

SEQ ID NO: 3804815 - DNA, 18 bp, Homo sapiens
aggccattctttcccaac

SEQ ID NO: 3804816 - DNA, 12 bp, Homo sapiens
aggcccaagaga

SEQ ID NO: 3804817 - DNA, 16 bp, Homo sapiens
gcttctgcctcagctt

SEQ ID NO: 3804818 - DNA, 13 bp, Homo sapiens
gcttgaacccagg

SEQ ID NO: 3804819 - DNA, 15 bp, Homo sapiens
gcttgaacccaggag

SEQ ID NO: 3804820 - DNA, 19 bp, Homo sapiens
gctttcctcatcaggccat

SEQ ID NO: 3804821 - DNA, 14 bp, Homo sapiens
gctttgtggcactg

SEQ ID NO: 3804822 - DNA, 22 bp, Homo sapiens
gctttgtggcactggggcaggg

SEQ ID NO: 3804823 - DNA, 15 bp, Homo sapiens
gcttttctcccagaa

SEQ ID NO: 3804824 - DNA, 20 bp, Homo sapiens
gcttttctcccagaaggctg

SEQ ID NO: 3804825 - DNA, 13 bp, Homo sapiens
gctttttccagag

SEQ ID NO: 3804826 - DNA, 13 bp, Homo sapiens
ggaaaaatagcct

SEQ ID NO: 3804827 - DNA, 15 bp, Homo sapiens
ggaaaaatagcctgc

SEQ ID NO: 3804828 - DNA, 15 bp, Homo sapiens
ggaaaaatccagaaa

SEQ ID NO: 3804829 - DNA, 15 bp, Homo sapiens
ggaaaatcagcctgc

SEQ ID NO: 3804830 - DNA, 19 bp, Homo sapiens
ggaaaatcagcctgctcca

SEQ ID NO: 3804831 - DNA, 23 bp, Homo sapiens
ggaaacccatcttcacgcctggg

SEQ ID NO: 3804832 - DNA, 15 bp, Homo sapiens
ggaaaggagaggaaa

SEQ ID NO: 3804833 - DNA, 15 bp, Homo sapiens
ggaaaggctctgaaa

SEQ ID NO: 3804834 - DNA, 22 bp, Homo sapiens
ggaacactggtgggcagctgag

SEQ ID NO: 3804835 - DNA, 16 bp, Homo sapiens
ggaacaggaaactgat

SEQ ID NO: 3804836 - DNA, 14 bp, Homo sapiens
ggaagagcaggcac

SEQ ID NO: 3804837 - DNA, 17 bp, Homo sapiens
ggaagctgccctgccca

SEQ ID NO: 3804838 - DNA, 12 bp, Homo sapiens
ggaagtgtgggt

SEQ ID NO: 3804839 - DNA, 21 bp, Homo sapiens
ggaagtgtgggtctgtgtgtg

SEQ ID NO: 3804840 - DNA, 22 bp, Homo sapiens
ggaatagaaaagatgagaggca

SEQ ID NO: 3804841 - DNA, 13 bp, Homo sapiens
ggaattctcttgg

SEQ ID NO: 3804842 - DNA, 11 bp, Homo sapiens
ggaattttctt

SEQ ID NO: 3804843 - DNA, 14 bp, Homo sapiens
ggacaacctgcccc

SEQ ID NO: 3804844 - DNA, 19 bp, Homo sapiens
ggacaacctgcccctcccc

SEQ ID NO: 3804845 - DNA, 17 bp, Homo sapiens
gtcagtatgtggaagtg

SEQ ID NO: 3804846 - DNA, 21 bp, Homo sapiens
gtcagtatgtggaagtgtggg

SEQ ID NO: 3804847 - DNA, 13 bp, Homo sapiens
gtcagttgtatca

SEQ ID NO: 3804848 - DNA, 14 bp, Homo sapiens
gtcagtttggaatg

SEQ ID NO: 3804849 - DNA, 11 bp, Homo sapiens
gtcattaaatg

SEQ ID NO: 3804850 - DNA, 21 bp, Homo sapiens
gtccagcttctcttgaaaact

SEQ ID NO: 3804851 - DNA, 20 bp, Homo sapiens
gtcccaggagcaaatgctgg

SEQ ID NO: 3804852 - DNA, 13 bp, Homo sapiens
gtccctacccact

SEQ ID NO: 3804853 - DNA, 14 bp, Homo sapiens
gtccctacccactc

SEQ ID NO: 3804854 - DNA, 20 bp, Homo sapiens
gtccctacccactctttgct

SEQ ID NO: 3804855 - DNA, 12 bp, Homo sapiens
gtccctctagct

SEQ ID NO: 3804856 - DNA, 13 bp, Homo sapiens
gtccctctctctg

SEQ ID NO: 3804857 - DNA, 21 bp, Homo sapiens
gtccggtccctgtcccagtgc

SEQ ID NO: 3804858 - DNA, 23 bp, Homo sapiens
gtcctagaaattccccaccctga

SEQ ID NO: 3804859 - DNA, 17 bp, Homo sapiens
gtcctagagctcctgtc

SEQ ID NO: 3804860 - DNA, 19 bp, Homo sapiens
gtcctagagctcctgtccc

SEQ ID NO: 3804861 - DNA, 22 bp, Homo sapiens
gtcctagagctcctgtccctac

SEQ ID NO: 3804862 - DNA, 13 bp, Homo sapiens
gtcctcacagcct

SEQ ID NO: 3804863 - DNA, 17 bp, Homo sapiens
gtctcaaaaaaagaaaa

SEQ ID NO: 3804864 - DNA, 12 bp, Homo sapiens
gtctccctcctc

SEQ ID NO: 3804865 - DNA, 14 bp, Homo sapiens
gtctctctgtgaat

SEQ ID NO: 3804866 - DNA, 18 bp, Homo sapiens
gtctctctgtgaatacaa

SEQ ID NO: 3804867 - DNA, 17 bp, Homo sapiens
gtctcttctcagagcag

SEQ ID NO: 3804868 - DNA, 15 bp, Homo sapiens
gtctgagagaggcca

SEQ ID NO: 3804869 - DNA, 23 bp, Homo sapiens
gtctgctcagacagaacccctac

SEQ ID NO: 3804870 - DNA, 17 bp, Homo sapiens
gtctggcacagcctggc

SEQ ID NO: 3804871 - DNA, 16 bp, Homo sapiens
gtctggcgagccctta

SEQ ID NO: 3804872 - DNA, 17 bp, Homo sapiens
gtctggcgagcccttag

SEQ ID NO: 3804873 - DNA, 15 bp, Homo sapiens
gtctgtcccaccagc

SEQ ID NO: 3804874 - DNA, 16 bp, Homo sapiens
gtctgtctgtctgtcc

SEQ ID NO: 3804875 - DNA, 17 bp, Homo sapiens
gtcttcactgctctgcc

SEQ ID NO: 3804876 - DNA, 16 bp, Homo sapiens
gtcttcagtaagccgt

SEQ ID NO: 3804877 - DNA, 14 bp, Homo sapiens
gtcttccaacccca

SEQ ID NO: 3804878 - DNA, 17 bp, Homo sapiens
gtcttttgaagaagttc

SEQ ID NO: 3804879 - DNA, 23 bp, Homo sapiens
gtgaacaaagaaaagacattgaa

SEQ ID NO: 3804880 - DNA, 13 bp, Homo sapiens
gtgaactgagact

SEQ ID NO: 3804881 - DNA, 19 bp, Homo sapiens
gtgaacttgggccactgtg

SEQ ID NO: 3804882 - DNA, 15 bp, Homo sapiens
gtgaatacaattaaa

SEQ ID NO: 3804883 - DNA, 14 bp, Homo sapiens
gtgaatttctaaat

SEQ ID NO: 3804884 - DNA, 19 bp, Homo sapiens
gtgaatttctgaaagatga

SEQ ID NO: 3804885 - DNA, 17 bp, Homo sapiens
gtgaatttttttttcct

SEQ ID NO: 3804886 - DNA, 18 bp, Homo sapiens
gtgaccatgttttgttta

SEQ ID NO: 3804887 - DNA, 21 bp, Homo sapiens
gtgactatggagctgagcagg

SEQ ID NO: 3804888 - DNA, 12 bp, Homo sapiens
gtgactctttcc

SEQ ID NO: 3804889 - DNA, 23 bp, Homo sapiens
gtgaggtgacttgcctggggcca

SEQ ID NO: 3804890 - DNA, 18 bp, Homo sapiens
gtgagtgtgactttttga

SEQ ID NO: 3804891 - DNA, 14 bp, Homo sapiens
gtgagttaaagaga

SEQ ID NO: 3804892 - DNA, 22 bp, Homo sapiens
gtgataattttatttataaact

SEQ ID NO: 3804893 - DNA, 16 bp, Homo sapiens
gtgatcacgatccagt

SEQ ID NO: 3804894 - DNA, 21 bp, Homo sapiens
gtgatctgcccgcctcggcct

SEQ ID NO: 3804895 - DNA, 17 bp, Homo sapiens
gtgattggcaggaggca

SEQ ID NO: 3804896 - DNA, 15 bp, Homo sapiens
gtgcacaaatattta

SEQ ID NO: 3804897 - DNA, 16 bp, Homo sapiens
gtgcactggccccacc

SEQ ID NO: 3804898 - DNA, 12 bp, Homo sapiens
gtgccactgacc

SEQ ID NO: 3804899 - DNA, 21 bp, Homo sapiens
gtgccactgaccgggatccag

SEQ ID NO: 3804900 - DNA, 13 bp, Homo sapiens
gtgcctggccctt

SEQ ID NO: 3804901 - DNA, 17 bp, Homo sapiens
gtgcctggcccttggct

SEQ ID NO: 3804902 - DNA, 14 bp, Homo sapiens
gtgccttttgccat

SEQ ID NO: 3804903 - DNA, 16 bp, Homo sapiens
gtgctcccaccaggca

SEQ ID NO: 3804904 - DNA, 19 bp, Homo sapiens
gtgctcgcctctgcccagc

SEQ ID NO: 3804905 - DNA, 22 bp, Homo sapiens
gtgctctgaggtcaataaagca

SEQ ID NO: 3804906 - DNA, 19 bp, Homo sapiens
gtggaagtgtgggtctgtg

SEQ ID NO: 3804907 - DNA, 11 bp, Homo sapiens
gtggacacctg

SEQ ID NO: 3804908 - DNA, 14 bp, Homo sapiens
gtggacacctgccc

SEQ ID NO: 3804909 - DNA, 19 bp, Homo sapiens
gtggacacctgccctgccc

SEQ ID NO: 3804910 - DNA, 13 bp, Homo sapiens
gtggcaccagcag

SEQ ID NO: 3804911 - DNA, 11 bp, Homo sapiens
gtggcagctgt

SEQ ID NO: 3804912 - DNA, 22 bp, Homo sapiens
gtggcctaacctgccgagagtc

SEQ ID NO: 3804913 - DNA, 21 bp, Homo sapiens
gtggctgggaagggaaggaag

SEQ ID NO: 3804914 - DNA, 23 bp, Homo sapiens
gtgggaggatctcttgagcctgg

SEQ ID NO: 3804915 - DNA, 13 bp, Homo sapiens
gtgggagtgtgta

SEQ ID NO: 3804916 - DNA, 14 bp, Homo sapiens
gtgggcagctgagg

SEQ ID NO: 3804917 - DNA, 15 bp, Homo sapiens
gtgggcagctgagga

SEQ ID NO: 3804918 - DNA, 22 bp, Homo sapiens
gtgggcggatcacttgaggtcg

SEQ ID NO: 3804919 - DNA, 12 bp, Homo sapiens
gtggggagggag

SEQ ID NO: 3804920 - DNA, 16 bp, Homo sapiens
gtgggggtctgtgtgt

SEQ ID NO: 3804921 - DNA, 19 bp, Homo sapiens
gtggggtaggttgggagaa

SEQ ID NO: 3804922 - DNA, 16 bp, Homo sapiens
gtgggtctgtgtgtgt

SEQ ID NO: 3804923 - DNA, 14 bp, Homo sapiens
gtggtggctcggga

SEQ ID NO: 3804924 - DNA, 14 bp, Homo sapiens
gtgtagctttgctc

SEQ ID NO: 3804925 - DNA, 15 bp, Homo sapiens
gtgtcagcactcagg

SEQ ID NO: 3804926 - DNA, 16 bp, Homo sapiens
gtgtccctctctctgg

SEQ ID NO: 3804927 - DNA, 18 bp, Homo sapiens
gtgtccctctctctggaa

SEQ ID NO: 3804928 - DNA, 15 bp, Homo sapiens
gtgtgtatgtggggg

SEQ ID NO: 3804929 - DNA, 20 bp, Homo sapiens
gtgtgtcacccttaggccag

SEQ ID NO: 3804930 - DNA, 14 bp, Homo sapiens
gtgtgttgtgtgtg

SEQ ID NO: 3804931 - DNA, 14 bp, Homo sapiens
gtgtgtttatgtgt

SEQ ID NO: 3804932 - DNA, 16 bp, Homo sapiens
gtgtgtttatgtgtgt

SEQ ID NO: 3804933 - DNA, 16 bp, Homo sapiens
gtgttgaaaatgttca

SEQ ID NO: 3804934 - DNA, 17 bp, Homo sapiens
gtgttgaaaatgttcag

SEQ ID NO: 3804935 - DNA, 20 bp, Homo sapiens
gttaaaggaagtttgttcac

SEQ ID NO: 3804936 - DNA, 17 bp, Homo sapiens
gttatgggatgtaaaca

SEQ ID NO: 3804937 - DNA, 15 bp, Homo sapiens
gttcaagaccagcct

SEQ ID NO: 3804938 - DNA, 19 bp, Homo sapiens
gttcagctaagctaggaat

SEQ ID NO: 3804939 - DNA, 12 bp, Homo sapiens
gttcatgagaat

SEQ ID NO: 3804940 - DNA, 18 bp, Homo sapiens
gttcattaaacgtcattc

SEQ ID NO: 3804941 - DNA, 13 bp, Homo sapiens
gttccataataaa

SEQ ID NO: 3804942 - DNA, 17 bp, Homo sapiens
gttcctgcagcagagcc

SEQ ID NO: 3804943 - DNA, 19 bp, Homo sapiens
gttcgccgtctggcgagcc

SEQ ID NO: 3804944 - DNA, 19 bp, Homo sapiens
gttctaactcttagaagtg

SEQ ID NO: 3804945 - DNA, 13 bp, Homo sapiens
gttctgccaggag

SEQ ID NO: 3804946 - DNA, 22 bp, Homo sapiens
gttcttacctgtatgtctccag

SEQ ID NO: 3804947 - DNA, 22 bp, Homo sapiens
gttcttagctgaacaatgaatg

SEQ ID NO: 3804948 - DNA, 15 bp, Homo sapiens
gttgacacggccatg

SEQ ID NO: 3804949 - DNA, 14 bp, Homo sapiens
gttgggagaatgtc

SEQ ID NO: 3804950 - DNA, 21 bp, Homo sapiens
gttgggagaatgtcagtatgt

SEQ ID NO: 3804951 - DNA, 23 bp, Homo sapiens
gttggggtggtttttgagccatg

SEQ ID NO: 3804952 - DNA, 12 bp, Homo sapiens
gttgtgtgtggg

SEQ ID NO: 3804953 - DNA, 13 bp, Homo sapiens
gttgtgtgtggga

SEQ ID NO: 3804954 - DNA, 22 bp, Homo sapiens
gttgtgtgtgggagtgtgtaat

SEQ ID NO: 3804955 - DNA, 21 bp, Homo sapiens
gtttccgtggcaaccctcagc

SEQ ID NO: 3804956 - DNA, 18 bp, Homo sapiens
gtttgggggcttccctgg

SEQ ID NO: 3804957 - DNA, 11 bp, Homo sapiens
gttttggcctg

SEQ ID NO: 3804958 - DNA, 16 bp, Homo sapiens
gtttttcatactgaat

SEQ ID NO: 3804959 - DNA, 16 bp, Homo sapiens
gtttttgtcttaaaaa

SEQ ID NO: 3804960 - DNA, 23 bp, Homo sapiens
taaaaaactgctgactgttttct

SEQ ID NO: 3804961 - DNA, 12 bp, Homo sapiens
taaaaaatgtaa

SEQ ID NO: 3804962 - DNA, 13 bp, Homo sapiens
taaaaaatgtaaa

SEQ ID NO: 3804963 - DNA, 14 bp, Homo sapiens
taaaaagattatat

SEQ ID NO: 3804964 - DNA, 19 bp, Homo sapiens
taaaacaatgtttttcata

SEQ ID NO: 3804965 - DNA, 12 bp, Homo sapiens
taaaactcagaa

SEQ ID NO: 3804966 - DNA, 19 bp, Homo sapiens
taaaactcagaatataaca

SEQ ID NO: 3804967 - DNA, 22 bp, Homo sapiens
taaaagttaaactacttgtaaa

SEQ ID NO: 3804968 - DNA, 18 bp, Homo sapiens
taaaatagcacatgattt

SEQ ID NO: 3804969 - DNA, 13 bp, Homo sapiens
taaaatatttatt

SEQ ID NO: 3804970 - DNA, 20 bp, Homo sapiens
taaaatctggcaaagttata

SEQ ID NO: 3804971 - DNA, 15 bp, Homo sapiens
taaaattgtgatgtg

SEQ ID NO: 3804972 - DNA, 14 bp, Homo sapiens
taaaatttgttgtt

SEQ ID NO: 3804973 - DNA, 18 bp, Homo sapiens
taaacaagtaagaaaaat

SEQ ID NO: 3804974 - DNA, 19 bp, Homo sapiens
taaacaagtaagaaaaata

SEQ ID NO: 3804975 - DNA, 16 bp, Homo sapiens
taaacaatgtaaagta

SEQ ID NO: 3804976 - DNA, 17 bp, Homo sapiens
taaacacagtgtttcct

SEQ ID NO: 3804977 - DNA, 20 bp, Homo sapiens
taaacagtgagcctgaattt

SEQ ID NO: 3804978 - DNA, 19 bp, Homo sapiens
taaactagggttttggcct

SEQ ID NO: 3804979 - DNA, 16 bp, Homo sapiens
taaactcaaaatattt

SEQ ID NO: 3804980 - DNA, 20 bp, Homo sapiens
taaactccttaacttcaggg

SEQ ID NO: 3804981 - DNA, 17 bp, Homo sapiens
taaagcagagccaaggc

SEQ ID NO: 3804982 - DNA, 18 bp, Homo sapiens
taaagcagagccaaggcc

SEQ ID NO: 3804983 - DNA, 20 bp, Homo sapiens
taaagcctgagtttgctttc

SEQ ID NO: 3804984 - DNA, 15 bp, Homo sapiens
taaaggtcctgccct

SEQ ID NO: 3804985 - DNA, 15 bp, Homo sapiens
taaagtaattttgtg

SEQ ID NO: 3804986 - DNA, 17 bp, Homo sapiens
taaatatttatttatgt

SEQ ID NO: 3804987 - DNA, 14 bp, Homo sapiens
taaatgtaagaaag

SEQ ID NO: 3804988 - DNA, 16 bp, Homo sapiens
taaattgatgttgctg

SEQ ID NO: 3804989 - DNA, 19 bp, Homo sapiens
taaccaattcctcatttgt

SEQ ID NO: 3804990 - DNA, 23 bp, Homo sapiens
taaccaggccccagcctccaggc

SEQ ID NO: 3804991 - DNA, 13 bp, Homo sapiens
taacttattgcct

SEQ ID NO: 3804992 - DNA, 18 bp, Homo sapiens
taagaaaatgctagaaga

SEQ ID NO: 3804993 - DNA, 21 bp, Homo sapiens
taagagggtgaacaaagaaaa

SEQ ID NO: 3804994 - DNA, 23 bp, Homo sapiens
taagatactgctgatgctgaaat

SEQ ID NO: 3804995 - DNA, 13 bp, Homo sapiens
taagctcagtggc

SEQ ID NO: 3804996 - DNA, 22 bp, Homo sapiens
taagctgtagaactctgcaggc

SEQ ID NO: 3804997 - DNA, 22 bp, Homo sapiens
taagctgttactgtcttcagta

SEQ ID NO: 3804998 - DNA, 16 bp, Homo sapiens
taagctttctcctttg

SEQ ID NO: 3804999 - DNA, 13 bp, Homo sapiens
taaggaagacaat

SEQ ID NO: 3805000 - DNA, 13 bp, Homo sapiens
taagtaatgaaag

SEQ ID NO: 3805001 - DNA, 22 bp, Homo sapiens
taagtgccaggatggaatgatg

SEQ ID NO: 3805002 - DNA, 12 bp, Homo sapiens
taatagaagaac

SEQ ID NO: 3805003 - DNA, 19 bp, Homo sapiens
taatatctgagaagtgtat

SEQ ID NO: 3805004 - DNA, 22 bp, Homo sapiens
taatcaggtcctcagagaattt

SEQ ID NO: 3805005 - DNA, 17 bp, Homo sapiens
taattatgtgatataaa

SEQ ID NO: 3805006 - DNA, 15 bp, Homo sapiens
taatttaaaattgtg

SEQ ID NO: 3805007 - DNA, 19 bp, Homo sapiens
taatttaaaattgtgatgt

SEQ ID NO: 3805008 - DNA, 22 bp, Homo sapiens
taatttacacacttgcatgaat

SEQ ID NO: 3805009 - DNA, 20 bp, Homo sapiens
taatttctagaaacaaacat

SEQ ID NO: 3805010 - DNA, 18 bp, Homo sapiens
tacaaattgtttttactg

SEQ ID NO: 3805011 - DNA, 13 bp, Homo sapiens
tacaataaatgct

SEQ ID NO: 3805012 - DNA, 17 bp, Homo sapiens
tacacatatatgtatat

SEQ ID NO: 3805013 - DNA, 18 bp, Homo sapiens
tacagaggacagtatttg

SEQ ID NO: 3805014 - DNA, 12 bp, Homo sapiens
tacattatgtta

SEQ ID NO: 3805015 - DNA, 21 bp, Homo sapiens
tacattatgttattggaattt

SEQ ID NO: 3805016 - DNA, 22 bp, Homo sapiens
tacattatgttattggaatttt

SEQ ID NO: 3805017 - DNA, 17 bp, Homo sapiens
tacattgaattagaaac

SEQ ID NO: 3805018 - DNA, 12 bp, Homo sapiens
taccatttcaga

SEQ ID NO: 3805019 - DNA, 16 bp, Homo sapiens
taccatttcagagagg

SEQ ID NO: 3805020 - DNA, 19 bp, Homo sapiens
taccccccctcctgctgcc

SEQ ID NO: 3805021 - DNA, 19 bp, Homo sapiens
tacccctcgactcagcacc

SEQ ID NO: 3805022 - DNA, 21 bp, Homo sapiens
tacccctcgactcagcaccac

SEQ ID NO: 3805023 - DNA, 20 bp, Homo sapiens
tacctgggcatactaataaa

SEQ ID NO: 3805024 - DNA, 12 bp, Homo sapiens
tacctgtgcctg

SEQ ID NO: 3805025 - DNA, 13 bp, Homo sapiens
tactctgccaatc

SEQ ID NO: 3805026 - DNA, 22 bp, Homo sapiens
tactgaagatgcagcaaaatgt

SEQ ID NO: 3805027 - DNA, 11 bp, Homo sapiens
tactgtcccag

SEQ ID NO: 3805028 - DNA, 21 bp, Homo sapiens
tactgtcttcagtaagccgtg

SEQ ID NO: 3805029 - DNA, 20 bp, Homo sapiens
tacttatttttgacagtgtt

SEQ ID NO: 3805030 - DNA, 21 bp, Homo sapiens
tacttttaaacagtgagcctg

SEQ ID NO: 3805031 - DNA, 17 bp, Homo sapiens
tagaaagagatacagag

SEQ ID NO: 3805032 - DNA, 16 bp, Homo sapiens
tagaacacccactggc

SEQ ID NO: 3805033 - DNA, 22 bp, Homo sapiens
tagaagaacatccaaggagaaa

SEQ ID NO: 3805034 - DNA, 12 bp, Homo sapiens
tagaagtgacat

SEQ ID NO: 3805035 - DNA, 13 bp, Homo sapiens
tagaccaaaataa

SEQ ID NO: 3805036 - DNA, 12 bp, Homo sapiens
tagagctcctgt

SEQ ID NO: 3805037 - DNA, 18 bp, Homo sapiens
tagagctcctgtccctac

SEQ ID NO: 3805038 - DNA, 20 bp, Homo sapiens
tagagctcctgtccctaccc

SEQ ID NO: 3805039 - DNA, 22 bp, Homo sapiens
tagaggagggcatgggagggag

SEQ ID NO: 3805040 - DNA, 23 bp, Homo sapiens
tagagggaggagaatgagcctcg

SEQ ID NO: 3805041 - DNA, 11 bp, Homo sapiens
tagagtgacag

SEQ ID NO: 3805042 - DNA, 22 bp, Homo sapiens
tagagtgacaggcaccagatgg

SEQ ID NO: 3805043 - DNA, 22 bp, Homo sapiens
tagagtttatttttttgatggc

SEQ ID NO: 3805044 - DNA, 16 bp, Homo sapiens
tagatccacacacaga

SEQ ID NO: 3805045 - DNA, 22 bp, Homo sapiens
tagattttagaccctattgctg

SEQ ID NO: 3805046 - DNA, 17 bp, Homo sapiens
tagcacatgattttctt

SEQ ID NO: 3805047 - DNA, 18 bp, Homo sapiens
tagcacatgattttcttt

SEQ ID NO: 3805048 - DNA, 19 bp, Homo sapiens
tagcatggcccgggcctta

SEQ ID NO: 3805049 - DNA, 22 bp, Homo sapiens
tagcattttgctaaatgtgaat

SEQ ID NO: 3805050 - DNA, 20 bp, Homo sapiens
tagccaggatggtcttgatc

SEQ ID NO: 3805051 - DNA, 14 bp, Homo sapiens
tagcccaaaaccaa

SEQ ID NO: 3805052 - DNA, 17 bp, Homo sapiens
tagccttgctgtagaga

SEQ ID NO: 3805053 - DNA, 20 bp, Homo sapiens
tagccttgctgtagagactt

SEQ ID NO: 3805054 - DNA, 13 bp, Homo sapiens
tagctacctgcta

SEQ ID NO: 3805055 - DNA, 15 bp, Homo sapiens
tagctacttttcaga

SEQ ID NO: 3805056 - DNA, 19 bp, Homo sapiens
tagctgagattacaggcgc

SEQ ID NO: 3805057 - DNA, 12 bp, Homo sapiens
tagctgccaagt

SEQ ID NO: 3805058 - DNA, 15 bp, Homo sapiens
tagcttttaccaacc

SEQ ID NO: 3805059 - DNA, 23 bp, Homo sapiens
taggaagttacctggatgccatt

SEQ ID NO: 3805060 - DNA, 17 bp, Homo sapiens
taggataaattacatta

SEQ ID NO: 3805061 - DNA, 16 bp, Homo sapiens
taggcaagtttgttca

SEQ ID NO: 3805062 - DNA, 13 bp, Homo sapiens
tcactgctctgcc

SEQ ID NO: 3805063 - DNA, 18 bp, Homo sapiens
tcactggtagaccaaaat

SEQ ID NO: 3805064 - DNA, 20 bp, Homo sapiens
tcactggtagaccaaaataa

SEQ ID NO: 3805065 - DNA, 14 bp, Homo sapiens
tcacttgagacaaa

SEQ ID NO: 3805066 - DNA, 15 bp, Homo sapiens
tcacttgtacaaaat

SEQ ID NO: 3805067 - DNA, 19 bp, Homo sapiens
tcagaaacatgaaatgctt

SEQ ID NO: 3805068 - DNA, 22 bp, Homo sapiens
tcagaaactcgatgaatgtgtt

SEQ ID NO: 3805069 - DNA, 18 bp, Homo sapiens
tcagacagaacccctaca

SEQ ID NO: 3805070 - DNA, 15 bp, Homo sapiens
tcagacttacttact

SEQ ID NO: 3805071 - DNA, 19 bp, Homo sapiens
tcagagaacctaataagtg

SEQ ID NO: 3805072 - DNA, 12 bp, Homo sapiens
tcagagaatttc

SEQ ID NO: 3805073 - DNA, 22 bp, Homo sapiens
tcagagaggccttttggaatgt

SEQ ID NO: 3805074 - DNA, 18 bp, Homo sapiens
tcagagatgaacatctaa

SEQ ID NO: 3805075 - DNA, 15 bp, Homo sapiens
tcagagcagcactgg

SEQ ID NO: 3805076 - DNA, 22 bp, Homo sapiens
tcagagctggcagcctccagtg

SEQ ID NO: 3805077 - DNA, 20 bp, Homo sapiens
tcagatcattatcagcctgt

SEQ ID NO: 3805078 - DNA, 12 bp, Homo sapiens
tcagatcctacc

SEQ ID NO: 3805079 - DNA, 19 bp, Homo sapiens
tcagattcccagagcaaaa

SEQ ID NO: 3805080 - DNA, 17 bp, Homo sapiens
tcagatttgccttattg

SEQ ID NO: 3805081 - DNA, 12 bp, Homo sapiens
tcagcagccccc

SEQ ID NO: 3805082 - DNA, 11 bp, Homo sapiens
tcagcctccag

SEQ ID NO: 3805083 - DNA, 12 bp, Homo sapiens
tcagcctcctga

SEQ ID NO: 3805084 - DNA, 10 bp, Homo sapiens
tcagcctggg

SEQ ID NO: 3805085 - DNA, 23 bp, Homo sapiens
tcagctctgcaagaattgaagca

SEQ ID NO: 3805086 - DNA, 15 bp, Homo sapiens
tcagctgaacctggg

SEQ ID NO: 3805087 - DNA, 14 bp, Homo sapiens
tcaggaggctgagg

SEQ ID NO: 3805088 - DNA, 17 bp, Homo sapiens
tcaggcaggtgggatgg

SEQ ID NO: 3805089 - DNA, 23 bp, Homo sapiens
tcaggggtgtgcggcctttggct

SEQ ID NO: 3805090 - DNA, 15 bp, Homo sapiens
tcaggtgagaagcag

SEQ ID NO: 3805091 - DNA, 16 bp, Homo sapiens
tcaggtgagaagcaga

SEQ ID NO: 3805092 - DNA, 12 bp, Homo sapiens
tcaggtgccact

SEQ ID NO: 3805093 - DNA, 22 bp, Homo sapiens
tcaggtgtggcggtgcgtgcct

SEQ ID NO: 3805094 - DNA, 13 bp, Homo sapiens
tcagtaagccgtg

SEQ ID NO: 3805095 - DNA, 14 bp, Homo sapiens
tcagtaatttgagg

SEQ ID NO: 3805096 - DNA, 14 bp, Homo sapiens
tcagtatgtggaag

SEQ ID NO: 3805097 - DNA, 22 bp, Homo sapiens
tcagtctttaatctgagaggcc

SEQ ID NO: 3805098 - DNA, 13 bp, Homo sapiens
tcatagaaatgta

SEQ ID NO: 3805099 - DNA, 22 bp, Homo sapiens
tcatagaaatgtaacttttgta

SEQ ID NO: 3805100 - DNA, 14 bp, Homo sapiens
tcatatattatcaa

SEQ ID NO: 3805101 - DNA, 17 bp, Homo sapiens
tcatcaaagaacaaaca

SEQ ID NO: 3805102 - DNA, 12 bp, Homo sapiens
tcatctttcttc

SEQ ID NO: 3805103 - DNA, 14 bp, Homo sapiens
tcatctttcttcca

SEQ ID NO: 3805104 - DNA, 17 bp, Homo sapiens
tcatctttcttccaaac

SEQ ID NO: 3805105 - DNA, 16 bp, Homo sapiens
tcatgaaaatcctacc

SEQ ID NO: 3805106 - DNA, 22 bp, Homo sapiens
tcatgaaaatcctaccaacctc

SEQ ID NO: 3805107 - DNA, 16 bp, Homo sapiens
tcatgaacacagcctg

SEQ ID NO: 3805108 - DNA, 21 bp, Homo sapiens
tcatgcattctagtgcagaag

SEQ ID NO: 3805109 - DNA, 15 bp, Homo sapiens
tcatgctatctctgt

SEQ ID NO: 3805110 - DNA, 17 bp, Homo sapiens
tcatgtgactctttcca

SEQ ID NO: 3805111 - DNA, 18 bp, Homo sapiens
tcatgtgactctttccaa

SEQ ID NO: 3805112 - DNA, 14 bp, Homo sapiens
tcattccagaggaa

SEQ ID NO: 3805113 - DNA, 15 bp, Homo sapiens
tcatttagtgctaaa

SEQ ID NO: 3805114 - DNA, 16 bp, Homo sapiens
tcatttcttcctctgc

SEQ ID NO: 3805115 - DNA, 12 bp, Homo sapiens
tcatttgttcat

SEQ ID NO: 3805116 - DNA, 16 bp, Homo sapiens
tcatttgttcattaaa

SEQ ID NO: 3805117 - DNA, 13 bp, Homo sapiens
tccaaacactggg

SEQ ID NO: 3805118 - DNA, 14 bp, Homo sapiens
tccaaacaggctca

SEQ ID NO: 3805119 - DNA, 20 bp, Homo sapiens
tccaaagggcagtaaagttt

SEQ ID NO: 3805120 - DNA, 19 bp, Homo sapiens
tccaaccccagctggcctc

SEQ ID NO: 3805121 - DNA, 16 bp, Homo sapiens
tccaagctttgggttg

SEQ ID NO: 3805122 - DNA, 23 bp, Homo sapiens
tccacacacagaggaagagcagg

SEQ ID NO: 3805123 - DNA, 20 bp, Homo sapiens
tccacgtgctcgcctctgcc

SEQ ID NO: 3805124 - DNA, 16 bp, Homo sapiens
tccactgccaaaacaa

SEQ ID NO: 3805125 - DNA, 20 bp, Homo sapiens
tccagaccattgtcttccaa

SEQ ID NO: 3805126 - DNA, 20 bp, Homo sapiens
tccagaggctattattttca

SEQ ID NO: 3805127 - DNA, 20 bp, Homo sapiens
tccagagtccctgcctggac

SEQ ID NO: 3805128 - DNA, 13 bp, Homo sapiens
tccaggagcctgg

SEQ ID NO: 3805129 - DNA, 12 bp, Homo sapiens
tccagggacaga

SEQ ID NO: 3805130 - DNA, 17 bp, Homo sapiens
tccagggacagaagcag

SEQ ID NO: 3805131 - DNA, 14 bp, Homo sapiens
tccaggggagggaa

SEQ ID NO: 3805132 - DNA, 18 bp, Homo sapiens
tccaggtgcctggccctt

SEQ ID NO: 3805133 - DNA, 23 bp, Homo sapiens
tccaggtgcctggcccttggctt

SEQ ID NO: 3805134 - DNA, 20 bp, Homo sapiens
tccaggtttaagctgttact

SEQ ID NO: 3805135 - DNA, 16 bp, Homo sapiens
tccagttccagttccc

SEQ ID NO: 3805136 - DNA, 13 bp, Homo sapiens
tccagtttccaaa

SEQ ID NO: 3805137 - DNA, 11 bp, Homo sapiens
tccataataaa

SEQ ID NO: 3805138 - DNA, 16 bp, Homo sapiens
tccatcctaccccctg

SEQ ID NO: 3805139 - DNA, 22 bp, Homo sapiens
tccatgctggtgtggccaaggc

SEQ ID NO: 3805140 - DNA, 20 bp, Homo sapiens
tcccaaagtgctaggattac

SEQ ID NO: 3805141 - DNA, 14 bp, Homo sapiens
tcccaacactgcca

SEQ ID NO: 3805142 - DNA, 14 bp, Homo sapiens
tcccacaaaggaga

SEQ ID NO: 3805143 - DNA, 19 bp, Homo sapiens
tcccagaaggctgggtcca

SEQ ID NO: 3805144 - DNA, 16 bp, Homo sapiens
tcccagatacttgggg

SEQ ID NO: 3805145 - DNA, 16 bp, Homo sapiens
tcccagtcctccagac

SEQ ID NO: 3805146 - DNA, 19 bp, Homo sapiens
tcccagtgccgagaaggaa

SEQ ID NO: 3805147 - DNA, 22 bp, Homo sapiens
tcccagtgccgagaaggaagcc

SEQ ID NO: 3805148 - DNA, 15 bp, Homo sapiens
tcccatggccttccc

SEQ ID NO: 3805149 - DNA, 12 bp, Homo sapiens
tccccaccctga

SEQ ID NO: 3805150 - DNA, 17 bp, Homo sapiens
tccccgtgggccatggc

SEQ ID NO: 3805151 - DNA, 14 bp, Homo sapiens
tcccctcccagtcc

SEQ ID NO: 3805152 - DNA, 18 bp, Homo sapiens
tccctacccactctttgc

SEQ ID NO: 3805153 - DNA, 18 bp, Homo sapiens
tccctattagagaagaga

SEQ ID NO: 3805154 - DNA, 21 bp, Homo sapiens
tccctcccaacagagctgggc

SEQ ID NO: 3805155 - DNA, 22 bp, Homo sapiens
tccctccccacagtcctcacag

SEQ ID NO: 3805156 - DNA, 19 bp, Homo sapiens
tccctgaccttctccaggg

SEQ ID NO: 3805157 - DNA, 20 bp, Homo sapiens
tccctgggcctcagcctcca

SEQ ID NO: 3805158 - DNA, 23 bp, Homo sapiens
tccctgggcctcagcctccaggc

SEQ ID NO: 3805159 - DNA, 17 bp, Homo sapiens
tccctgttaataaacag

SEQ ID NO: 3805160 - DNA, 16 bp, Homo sapiens
tcccttccttcctctc

SEQ ID NO: 3805161 - DNA, 14 bp, Homo sapiens
tcccttgaccttaa

SEQ ID NO: 3805162 - DNA, 22 bp, Homo sapiens
tccctttccaaatgcccagctt

SEQ ID NO: 3805163 - DNA, 20 bp, Homo sapiens
tccgtcacccttggtagagt

SEQ ID NO: 3805164 - DNA, 19 bp, Homo sapiens
tccgtggcaaccctcagct

SEQ ID NO: 3805165 - DNA, 13 bp, Homo sapiens
tcctaccccctgt

SEQ ID NO: 3805166 - DNA, 15 bp, Homo sapiens
tcctactcaacaaaa

SEQ ID NO: 3805167 - DNA, 22 bp, Homo sapiens
tcctagagctcctgtccctacc

SEQ ID NO: 3805168 - DNA, 13 bp, Homo sapiens
tcctaggcatttg

SEQ ID NO: 3805169 - DNA, 19 bp, Homo sapiens
tcctcacagcctctccctt

SEQ ID NO: 3805170 - DNA, 20 bp, Homo sapiens
tcctcacccccagctttgct

SEQ ID NO: 3805171 - DNA, 13 bp, Homo sapiens
agaacacccactg

SEQ ID NO: 3805172 - DNA, 19 bp, Homo sapiens
agaacccctacatgaaaca

SEQ ID NO: 3805173 - DNA, 19 bp, Homo sapiens
agaactgccccatctcctc

SEQ ID NO: 3805174 - DNA, 21 bp, Homo sapiens
agaactgccccatctcctccc

SEQ ID NO: 3805175 - DNA, 13 bp, Homo sapiens
agaagaacatcca

SEQ ID NO: 3805176 - DNA, 21 bp, Homo sapiens
agaagagattgtggtttcatt

SEQ ID NO: 3805177 - DNA, 22 bp, Homo sapiens
agaagatctgcttccctggggc

SEQ ID NO: 3805178 - DNA, 15 bp, Homo sapiens
agaagcggctggcag

SEQ ID NO: 3805179 - DNA, 20 bp, Homo sapiens
agaaggctgggtccagggga

SEQ ID NO: 3805180 - DNA, 20 bp, Homo sapiens
agaaggttgctctagattga

SEQ ID NO: 3805181 - DNA, 17 bp, Homo sapiens
agaagtaggcatgaggg

SEQ ID NO: 3805182 - DNA, 21 bp, Homo sapiens
agaatcctaggctccacccca

SEQ ID NO: 3805183 - DNA, 14 bp, Homo sapiens
agaatgatttcatg

SEQ ID NO: 3805184 - DNA, 15 bp, Homo sapiens
agaatgtcagtatgt

SEQ ID NO: 3805185 - DNA, 19 bp, Homo sapiens
agaatgtcagtatgtggaa

SEQ ID NO: 3805186 - DNA, 20 bp, Homo sapiens
agaattataattagttcctc

SEQ ID NO: 3805187 - DNA, 23 bp, Homo sapiens
agaattgccttaaggccacactg

SEQ ID NO: 3805188 - DNA, 12 bp, Homo sapiens
agaattgcttga

SEQ ID NO: 3805189 - DNA, 20 bp, Homo sapiens
agaatttctaccatttcaga

SEQ ID NO: 3805190 - DNA, 18 bp, Homo sapiens
agacaaaggttttcctct

SEQ ID NO: 3805191 - DNA, 20 bp, Homo sapiens
agacaatgtgaaaagaaaaa

SEQ ID NO: 3805192 - DNA, 16 bp, Homo sapiens
agacacagcccagaca

SEQ ID NO: 3805193 - DNA, 18 bp, Homo sapiens
agacaccctaatgtggca

SEQ ID NO: 3805194 - DNA, 17 bp, Homo sapiens
agacaccgttcattcag

SEQ ID NO: 3805195 - DNA, 16 bp, Homo sapiens
agacactacatatcta

SEQ ID NO: 3805196 - DNA, 16 bp, Homo sapiens
agacagaaacagagag

SEQ ID NO: 3805197 - DNA, 20 bp, Homo sapiens
agacagaaacagagagagac

SEQ ID NO: 3805198 - DNA, 12 bp, Homo sapiens
agacagagacag

SEQ ID NO: 3805199 - DNA, 18 bp, Homo sapiens
agacaggcccaagagatg

SEQ ID NO: 3805200 - DNA, 22 bp, Homo sapiens
agacaggcccaagagatgaaga

SEQ ID NO: 3805201 - DNA, 17 bp, Homo sapiens
agacagtagaggcatga

SEQ ID NO: 3805202 - DNA, 15 bp, Homo sapiens
agacagttcaagaaa

SEQ ID NO: 3805203 - DNA, 22 bp, Homo sapiens
agacatctcaggatttcaccag

SEQ ID NO: 3805204 - DNA, 13 bp, Homo sapiens
agaccaaaataaa

SEQ ID NO: 3805205 - DNA, 23 bp, Homo sapiens
agaccaccagccgccccagcccc

SEQ ID NO: 3805206 - DNA, 16 bp, Homo sapiens
agaccattgtcttcca

SEQ ID NO: 3805207 - DNA, 23 bp, Homo sapiens
agacctctgaatgtcccagaggc

SEQ ID NO: 3805208 - DNA, 22 bp, Homo sapiens
agacgctgtgattggcaggagg

SEQ ID NO: 3805209 - DNA, 21 bp, Homo sapiens
agacgtgagtgtgactttttg

SEQ ID NO: 3805210 - DNA, 16 bp, Homo sapiens
agactaatagagacac

SEQ ID NO: 3805211 - DNA, 16 bp, Homo sapiens
agactctttggacact

SEQ ID NO: 3805212 - DNA, 17 bp, Homo sapiens
agactgagggagagact

SEQ ID NO: 3805213 - DNA, 23 bp, Homo sapiens
agactgcgatttgtcccaggtcc

SEQ ID NO: 3805214 - DNA, 19 bp, Homo sapiens
agactgcttccaattttct

SEQ ID NO: 3805215 - DNA, 22 bp, Homo sapiens
agagaaaaaatattttcctgcc

SEQ ID NO: 3805216 - DNA, 17 bp, Homo sapiens
agagaccctacagacag

SEQ ID NO: 3805217 - DNA, 15 bp, Homo sapiens
agagactcaaagaga

SEQ ID NO: 3805218 - DNA, 14 bp, Homo sapiens
agagactgagggag

SEQ ID NO: 3805219 - DNA, 20 bp, Homo sapiens
agagactgagggagagactc

SEQ ID NO: 3805220 - DNA, 21 bp, Homo sapiens
agagagaaagaagtaggcatg

SEQ ID NO: 3805221 - DNA, 20 bp, Homo sapiens
agagagacagagacagagag

SEQ ID NO: 3805222 - DNA, 17 bp, Homo sapiens
agagagactcaaagaga

SEQ ID NO: 3805223 - DNA, 22 bp, Homo sapiens
agagaggccattctttcccaac

SEQ ID NO: 3805224 - DNA, 23 bp, Homo sapiens
agagaggccattctttcccaaca

SEQ ID NO: 3805225 - DNA, 18 bp, Homo sapiens
agagagggaattctcttg

SEQ ID NO: 3805226 - DNA, 13 bp, Homo sapiens
agagatacagagg

SEQ ID NO: 3805227 - DNA, 14 bp, Homo sapiens
agagatatgcacac

SEQ ID NO: 3805228 - DNA, 19 bp, Homo sapiens
agagatgaagagtgagagg

SEQ ID NO: 3805229 - DNA, 20 bp, Homo sapiens
agagatggcctgagaagaga

SEQ ID NO: 3805230 - DNA, 16 bp, Homo sapiens
agagattgtggtttca

SEQ ID NO: 3805231 - DNA, 13 bp, Homo sapiens
agagcaggcacat

SEQ ID NO: 3805232 - DNA, 14 bp, Homo sapiens
agagccagaggcac

SEQ ID NO: 3805233 - DNA, 14 bp, Homo sapiens
agagccccacacgg

SEQ ID NO: 3805234 - DNA, 18 bp, Homo sapiens
agagctcctgtccctacc

SEQ ID NO: 3805235 - DNA, 23 bp, Homo sapiens
agagctcctgtccctacccactc

SEQ ID NO: 3805236 - DNA, 14 bp, Homo sapiens
agagctctctcttc

SEQ ID NO: 3805237 - DNA, 17 bp, Homo sapiens
agaggaaaatgaataat

SEQ ID NO: 3805238 - DNA, 15 bp, Homo sapiens
agaggaaggaaaagg

SEQ ID NO: 3805239 - DNA, 24 bp, Homo sapiens
agaggcatgaacacacatggatgc

SEQ ID NO: 3805240 - DNA, 19 bp, Homo sapiens
agaggccttttggaatgtg

SEQ ID NO: 3805241 - DNA, 19 bp, Homo sapiens
agaggctattattttcact

SEQ ID NO: 3805242 - DNA, 22 bp, Homo sapiens
agagggactgttcttttgtccc

SEQ ID NO: 3805243 - DNA, 17 bp, Homo sapiens
agaggtatttatcttta

SEQ ID NO: 3805244 - DNA, 23 bp, Homo sapiens
agaggtggggagggagacagaga

SEQ ID NO: 3805245 - DNA, 18 bp, Homo sapiens
agaggtggtggggaccag

SEQ ID NO: 3805246 - DNA, 11 bp, Homo sapiens
agagtgggagc

SEQ ID NO: 3805247 - DNA, 19 bp, Homo sapiens
agagtggggatatgattta

SEQ ID NO: 3805248 - DNA, 14 bp, Homo sapiens
agagtgtgcctgaa

SEQ ID NO: 3805249 - DNA, 22 bp, Homo sapiens
agagtttatttttttgatggct

SEQ ID NO: 3805250 - DNA, 13 bp, Homo sapiens
agataatccctgt

SEQ ID NO: 3805251 - DNA, 17 bp, Homo sapiens
agatactgaagtgcagc

SEQ ID NO: 3805252 - DNA, 19 bp, Homo sapiens
agatattaggggggaaagt

SEQ ID NO: 3805253 - DNA, 13 bp, Homo sapiens
agatcagcctggg

SEQ ID NO: 3805254 - DNA, 15 bp, Homo sapiens
agatcagcctgggca

SEQ ID NO: 3805255 - DNA, 15 bp, Homo sapiens
agatccacacacaga

SEQ ID NO: 3805256 - DNA, 18 bp, Homo sapiens
agatccacacacagagga

SEQ ID NO: 3805257 - DNA, 17 bp, Homo sapiens
agatgaagagtgagagg

SEQ ID NO: 3805258 - DNA, 19 bp, Homo sapiens
agatgaagagtgagagggc

SEQ ID NO: 3805259 - DNA, 14 bp, Homo sapiens
agatgatttggtca

SEQ ID NO: 3805260 - DNA, 17 bp, Homo sapiens
agatgcacacacagatg

SEQ ID NO: 3805261 - DNA, 19 bp, Homo sapiens
agatgcacacacagatgca

SEQ ID NO: 3805262 - DNA, 19 bp, Homo sapiens
agatgcagcaaaatgtgaa

SEQ ID NO: 3805263 - DNA, 18 bp, Homo sapiens
agatgcttctcactgcca

SEQ ID NO: 3805264 - DNA, 22 bp, Homo sapiens
agatggaatagaaaagatgaga

SEQ ID NO: 3805265 - DNA, 17 bp, Homo sapiens
agatggagaaacaggct

SEQ ID NO: 3805266 - DNA, 20 bp, Homo sapiens
agatgtgctcccaccaggca

SEQ ID NO: 3805267 - DNA, 22 bp, Homo sapiens
agatgtgctcccaccaggcagc

SEQ ID NO: 3805268 - DNA, 15 bp, Homo sapiens
agattatatatcata

SEQ ID NO: 3805269 - DNA, 16 bp, Homo sapiens
agattatatatcataa

SEQ ID NO: 3805270 - DNA, 13 bp, Homo sapiens
agattcccagagc

SEQ ID NO: 3805271 - DNA, 17 bp, Homo sapiens
agattgataagtaatga

SEQ ID NO: 3805272 - DNA, 16 bp, Homo sapiens
agattgcaccactgca

SEQ ID NO: 3805273 - DNA, 17 bp, Homo sapiens
agatttctgctccaaat

SEQ ID NO: 3805274 - DNA, 18 bp, Homo sapiens
agatttttgctcttctgt

SEQ ID NO: 3805275 - DNA, 23 bp, Homo sapiens
agcaaaatgtgaatgggaaaaga

SEQ ID NO: 3805276 - DNA, 19 bp, Homo sapiens
agcaaagccacattttgca

SEQ ID NO: 3805277 - DNA, 21 bp, Homo sapiens
agcaactcctgttctttgggc

SEQ ID NO: 3805278 - DNA, 13 bp, Homo sapiens
atctccctgacct

SEQ ID NO: 3805279 - DNA, 12 bp, Homo sapiens
atctcctcccac

SEQ ID NO: 3805280 - DNA, 14 bp, Homo sapiens
atctcggctcactg

SEQ ID NO: 3805281 - DNA, 17 bp, Homo sapiens
atctgagaagtgtatat

SEQ ID NO: 3805282 - DNA, 18 bp, Homo sapiens
atctgagaagtgtatata

SEQ ID NO: 3805283 - DNA, 20 bp, Homo sapiens
atctgcagggggtgtgtctg

SEQ ID NO: 3805284 - DNA, 15 bp, Homo sapiens
atctgctgtatatgg

SEQ ID NO: 3805285 - DNA, 17 bp, Homo sapiens
atctgcttccctggggc

SEQ ID NO: 3805286 - DNA, 15 bp, Homo sapiens
atctggccacactgg

SEQ ID NO: 3805287 - DNA, 20 bp, Homo sapiens
atctggccacactgggctca

SEQ ID NO: 3805288 - DNA, 16 bp, Homo sapiens
atctgtacctctgcct

SEQ ID NO: 3805289 - DNA, 22 bp, Homo sapiens
atctgtgaggggctctctcatg

SEQ ID NO: 3805290 - DNA, 16 bp, Homo sapiens
atcttagctgccaagt

SEQ ID NO: 3805291 - DNA, 21 bp, Homo sapiens
atcttccccaacgaaaagcac

SEQ ID NO: 3805292 - DNA, 18 bp, Homo sapiens
atctttaaactggctggc

SEQ ID NO: 3805293 - DNA, 13 bp, Homo sapiens
atgaaacagaaac

SEQ ID NO: 3805294 - DNA, 22 bp, Homo sapiens
atgaaacagaaacaaaaacact

SEQ ID NO: 3805295 - DNA, 17 bp, Homo sapiens
atgaaaccgcattttgg

SEQ ID NO: 3805296 - DNA, 16 bp, Homo sapiens
atgaacttgaggacac

SEQ ID NO: 3805297 - DNA, 17 bp, Homo sapiens
atgaacttgaggacaca

SEQ ID NO: 3805298 - DNA, 19 bp, Homo sapiens
atgaacttgaggacacatg

SEQ ID NO: 3805299 - DNA, 22 bp, Homo sapiens
atgaacttgaggacacatgtcc

SEQ ID NO: 3805300 - DNA, 23 bp, Homo sapiens
atgaagctggaagcactgctgtg

SEQ ID NO: 3805301 - DNA, 18 bp, Homo sapiens
atgaatgtgttgatttga

SEQ ID NO: 3805302 - DNA, 16 bp, Homo sapiens
atgaattaaataaacc

SEQ ID NO: 3805303 - DNA, 19 bp, Homo sapiens
atgacaacttttaaagaaa

SEQ ID NO: 3805304 - DNA, 19 bp, Homo sapiens
atgactagaggcagggagg

SEQ ID NO: 3805305 - DNA, 18 bp, Homo sapiens
atgagagttccagattgt

SEQ ID NO: 3805306 - DNA, 17 bp, Homo sapiens
atgagcaactcctgttc

SEQ ID NO: 3805307 - DNA, 11 bp, Homo sapiens
atgagcctggc

SEQ ID NO: 3805308 - DNA, 14 bp, Homo sapiens
atgagcctggcaag

SEQ ID NO: 3805309 - DNA, 19 bp, Homo sapiens
atgagctccttaaggctct

SEQ ID NO: 3805310 - DNA, 20 bp, Homo sapiens
atgatactctcagattttaa

SEQ ID NO: 3805311 - DNA, 13 bp, Homo sapiens
atgatcaaaacat

SEQ ID NO: 3805312 - DNA, 17 bp, Homo sapiens
atgattaaaaagaataa

SEQ ID NO: 3805313 - DNA, 14 bp, Homo sapiens
atgcacacacacag

SEQ ID NO: 3805314 - DNA, 20 bp, Homo sapiens
atgcaccctcatacacagaa

SEQ ID NO: 3805315 - DNA, 16 bp, Homo sapiens
atgcagcaaaatgtga

SEQ ID NO: 3805316 - DNA, 14 bp, Homo sapiens
atgcataaatgcat

SEQ ID NO: 3805317 - DNA, 22 bp, Homo sapiens
atgcattcccggtgcagaacag

SEQ ID NO: 3805318 - DNA, 20 bp, Homo sapiens
atgcattctagtgcagaagc

SEQ ID NO: 3805319 - DNA, 20 bp, Homo sapiens
atgccctacctgcctgttct

SEQ ID NO: 3805320 - DNA, 13 bp, Homo sapiens
atgctatctctgt

SEQ ID NO: 3805321 - DNA, 14 bp, Homo sapiens
atgctcctggccca

SEQ ID NO: 3805322 - DNA, 15 bp, Homo sapiens
atgctgaaataaact

SEQ ID NO: 3805323 - DNA, 18 bp, Homo sapiens
atgctgaaataaactagg

SEQ ID NO: 3805324 - DNA, 15 bp, Homo sapiens
atgctgaaatctatt

SEQ ID NO: 3805325 - DNA, 22 bp, Homo sapiens
atgctgtaactttctgaaataa

SEQ ID NO: 3805326 - DNA, 15 bp, Homo sapiens
atggaaaggagagga

SEQ ID NO: 3805327 - DNA, 19 bp, Homo sapiens
atggaaaggagaggaaaga

SEQ ID NO: 3805328 - DNA, 22 bp, Homo sapiens
atggaaaggagaggaaagaact

SEQ ID NO: 3805329 - DNA, 20 bp, Homo sapiens
atggaatagaaaagatgaga

SEQ ID NO: 3805330 - DNA, 20 bp, Homo sapiens
atggcccgggccttatccag

SEQ ID NO: 3805331 - DNA, 21 bp, Homo sapiens
atggccgggcgcggtggctca

SEQ ID NO: 3805332 - DNA, 20 bp, Homo sapiens
atggctaagatactgctgat

SEQ ID NO: 3805333 - DNA, 19 bp, Homo sapiens
atggcttatttgtataatg

SEQ ID NO: 3805334 - DNA, 16 bp, Homo sapiens
atgggagggagggaga

SEQ ID NO: 3805335 - DNA, 19 bp, Homo sapiens
atgggagggagggagaggt

SEQ ID NO: 3805336 - DNA, 13 bp, Homo sapiens
atgggcgaccagg

SEQ ID NO: 3805337 - DNA, 21 bp, Homo sapiens
atgggcgaccagggccatctc

SEQ ID NO: 3805338 - DNA, 20 bp, Homo sapiens
atggggatagatgtgtggac

SEQ ID NO: 3805339 - DNA, 18 bp, Homo sapiens
atggtcttgatctcctga

SEQ ID NO: 3805340 - DNA, 20 bp, Homo sapiens
atggtcttgatctcctgagc

SEQ ID NO: 3805341 - DNA, 16 bp, Homo sapiens
atggttctcaggcctg

SEQ ID NO: 3805342 - DNA, 16 bp, Homo sapiens
atgtaaagtaagacat

SEQ ID NO: 3805343 - DNA, 17 bp, Homo sapiens
atgtaacttttgtaaga

SEQ ID NO: 3805344 - DNA, 13 bp, Homo sapiens
atgtatatgtata

SEQ ID NO: 3805345 - DNA, 16 bp, Homo sapiens
atgtatcatagaaatg

SEQ ID NO: 3805346 - DNA, 17 bp, Homo sapiens
atgtatcatagaaatgt

SEQ ID NO: 3805347 - DNA, 13 bp, Homo sapiens
atgtcagtatgtg

SEQ ID NO: 3805348 - DNA, 16 bp, Homo sapiens
atgtcgtaggtaaact

SEQ ID NO: 3805349 - DNA, 11 bp, Homo sapiens
atgtgaatgtg

SEQ ID NO: 3805350 - DNA, 16 bp, Homo sapiens
atgtgacaacattttt

SEQ ID NO: 3805351 - DNA, 16 bp, Homo sapiens
atgtgacaggtaaact

SEQ ID NO: 3805352 - DNA, 15 bp, Homo sapiens
atgtgctcccaccag

SEQ ID NO: 3805353 - DNA, 16 bp, Homo sapiens
atgtggaagtgtgggt

SEQ ID NO: 3805354 - DNA, 22 bp, Homo sapiens
atgtggaagtgtgggtctgtgt

SEQ ID NO: 3805355 - DNA, 16 bp, Homo sapiens
atgtggcagctgtctc

SEQ ID NO: 3805356 - DNA, 17 bp, Homo sapiens
atgtgggggtctgtgtg

SEQ ID NO: 3805357 - DNA, 18 bp, Homo sapiens
atgtgggggtctgtgtgt

SEQ ID NO: 3805358 - DNA, 22 bp, Homo sapiens
atgtgtgtgtgttgtgtgtggg

SEQ ID NO: 3805359 - DNA, 18 bp, Homo sapiens
atgttatgggatgtaaac

SEQ ID NO: 3805360 - DNA, 23 bp, Homo sapiens
atgttatgggatgtaaacaatgt

SEQ ID NO: 3805361 - DNA, 16 bp, Homo sapiens
atgttattggaatttt

SEQ ID NO: 3805362 - DNA, 23 bp, Homo sapiens
atgttattggaattttctttcat

SEQ ID NO: 3805363 - DNA, 15 bp, Homo sapiens
atgtttacagaggac

SEQ ID NO: 3805364 - DNA, 19 bp, Homo sapiens
atgtttacagaggacagta

SEQ ID NO: 3805365 - DNA, 21 bp, Homo sapiens
attaaaatctggcaaagttat

SEQ ID NO: 3805366 - DNA, 16 bp, Homo sapiens
attaaacgtcattcag

SEQ ID NO: 3805367 - DNA, 13 bp, Homo sapiens
attaaggaagaca

SEQ ID NO: 3805368 - DNA, 21 bp, Homo sapiens
attacaaagttcactgtttat

SEQ ID NO: 3805369 - DNA, 19 bp, Homo sapiens
attacagaaatacataggc

SEQ ID NO: 3805370 - DNA, 13 bp, Homo sapiens
attacattaaaat

SEQ ID NO: 3805371 - DNA, 16 bp, Homo sapiens
attaccagaacaatta

SEQ ID NO: 3805372 - DNA, 20 bp, Homo sapiens
attactgtatataaactcct

SEQ ID NO: 3805373 - DNA, 15 bp, Homo sapiens
attacttatttttga

SEQ ID NO: 3805374 - DNA, 11 bp, Homo sapiens
attagccagga

SEQ ID NO: 3805375 - DNA, 21 bp, Homo sapiens
attatgttattggaattttct

SEQ ID NO: 3805376 - DNA, 22 bp, Homo sapiens
attatttcaaccgcttgccata

SEQ ID NO: 3805377 - DNA, 12 bp, Homo sapiens
attcaataaagc

SEQ ID NO: 3805378 - DNA, 13 bp, Homo sapiens
attcaataaagct

SEQ ID NO: 3805379 - DNA, 18 bp, Homo sapiens
attcacagcgcctcctgg

SEQ ID NO: 3805380 - DNA, 18 bp, Homo sapiens
attcagctctgcaagaat

SEQ ID NO: 3805381 - DNA, 23 bp, Homo sapiens
attccagactgcttccaattttc

SEQ ID NO: 3805382 - DNA, 19 bp, Homo sapiens
attcctcatttgttcatta

SEQ ID NO: 3805383 - DNA, 23 bp, Homo sapiens
attcctcatttgttcattaaacg

SEQ ID NO: 3805384 - DNA, 18 bp, Homo sapiens
attcctttgaagaggaaa

SEQ ID NO: 3805385 - DNA, 17 bp, Homo sapiens
attcgctggggaagggg

SEQ ID NO: 3805386 - DNA, 22 bp, Homo sapiens
aaaaaactgctgactgttttct

SEQ ID NO: 3805387 - DNA, 18 bp, Homo sapiens
aaaaagattatatatcat

SEQ ID NO: 3805388 - DNA, 16 bp, Homo sapiens
aaaaatccagaaagaa

SEQ ID NO: 3805389 - DNA, 13 bp, Homo sapiens
aaaaatggtaatt

SEQ ID NO: 3805390 - DNA, 15 bp, Homo sapiens
aaaaccaatgttctc

SEQ ID NO: 3805391 - DNA, 21 bp, Homo sapiens
aaaaccaatgttctctcttct

SEQ ID NO: 3805392 - DNA, 15 bp, Homo sapiens
actctttgctacaat

SEQ ID NO: 3805393 - DNA, 24 bp, Homo sapiens
actctttgctacaataaatgctga

SEQ ID NO: 3805394 - DNA, 20 bp, Homo sapiens
actgaaggctttcagggcct

SEQ ID NO: 3805395 - DNA, 21 bp, Homo sapiens
actgaccgggatccagttcca

SEQ ID NO: 3805396 - DNA, 20 bp, Homo sapiens
actgaggaattttctttgtg

SEQ ID NO: 3805397 - DNA, 22 bp, Homo sapiens
actgattccagcaagaccaaat

SEQ ID NO: 3805398 - DNA, 13 bp, Homo sapiens
actgcaagctctg

SEQ ID NO: 3805399 - DNA, 19 bp, Homo sapiens
actgcaagctctgcctccc

SEQ ID NO: 3805400 - DNA, 9 bp, Homo sapiens
actgcactc

SEQ ID NO: 3805401 - DNA, 14 bp, Homo sapiens
actgcactccagcc

SEQ ID NO: 3805402 - DNA, 18 bp, Homo sapiens
actgcactccagcctggg

SEQ ID NO: 3805403 - DNA, 20 bp, Homo sapiens
actgcactccagcctgggtg

SEQ ID NO: 3805404 - DNA, 15 bp, Homo sapiens
actgccccatctcct

SEQ ID NO: 3805405 - DNA, 21 bp, Homo sapiens
actggcagtaacctagtgaat

SEQ ID NO: 3805406 - DNA, 21 bp, Homo sapiens
actggccagtcctagagctcc

SEQ ID NO: 3805407 - DNA, 23 bp, Homo sapiens
actggccagtcctagagctcctg

SEQ ID NO: 3805408 - DNA, 17 bp, Homo sapiens
actggtgggcagctgag

SEQ ID NO: 3805409 - DNA, 22 bp, Homo sapiens
actgtaaatatttatttatgtg

SEQ ID NO: 3805410 - DNA, 14 bp, Homo sapiens
actgtatataaact

SEQ ID NO: 3805411 - DNA, 15 bp, Homo sapiens
actgtcactgttcct

SEQ ID NO: 3805412 - DNA, 14 bp, Homo sapiens
actgtcccaggagc

SEQ ID NO: 3805413 - DNA, 21 bp, Homo sapiens
actgtcccaggagcaaatgct

SEQ ID NO: 3805414 - DNA, 12 bp, Homo sapiens
actgtcttcagt

SEQ ID NO: 3805415 - DNA, 15 bp, Homo sapiens
actgtcttttgaaga

SEQ ID NO: 3805416 - DNA, 16 bp, Homo sapiens
actgtgaagagaacca

SEQ ID NO: 3805417 - DNA, 21 bp, Homo sapiens
actgtgtccctctctctggaa

SEQ ID NO: 3805418 - DNA, 16 bp, Homo sapiens
acttactcccattttc

SEQ ID NO: 3805419 - DNA, 17 bp, Homo sapiens
acttatttatgaacctg

SEQ ID NO: 3805420 - DNA, 19 bp, Homo sapiens
acttatttttgacagtgtt

SEQ ID NO: 3805421 - DNA, 16 bp, Homo sapiens
acttcagctgactttt

SEQ ID NO: 3805422 - DNA, 19 bp, Homo sapiens
acttcaggagctgacagag

SEQ ID NO: 3805423 - DNA, 20 bp, Homo sapiens
acttcatagatgagaaaact

SEQ ID NO: 3805424 - DNA, 19 bp, Homo sapiens
acttccaagtgataatttt

SEQ ID NO: 3805425 - DNA, 20 bp, Homo sapiens
acttccaagtgataatttta

SEQ ID NO: 3805426 - DNA, 22 bp, Homo sapiens
acttccacaagagtgaatttga

SEQ ID NO: 3805427 - DNA, 20 bp, Homo sapiens
acttccacttgtgtatattt

SEQ ID NO: 3805428 - DNA, 14 bp, Homo sapiens
acttccgtcaccct

SEQ ID NO: 3805429 - DNA, 17 bp, Homo sapiens
acttcgggaggtcgagg

SEQ ID NO: 3805430 - DNA, 20 bp, Homo sapiens
acttcgggaggtcgaggcag

SEQ ID NO: 3805431 - DNA, 15 bp, Homo sapiens
acttgagaaaatgca

SEQ ID NO: 3805432 - DNA, 19 bp, Homo sapiens
acttgagaaaatgcaggag

SEQ ID NO: 3805433 - DNA, 14 bp, Homo sapiens
acttgaggacacat

SEQ ID NO: 3805434 - DNA, 18 bp, Homo sapiens
acttgtacaaaataaaca

SEQ ID NO: 3805435 - DNA, 23 bp, Homo sapiens
acttgtgtatattttaatgaata

SEQ ID NO: 3805436 - DNA, 15 bp, Homo sapiens
actttaaaataaaat

SEQ ID NO: 3805437 - DNA, 12 bp, Homo sapiens
acttttaaacag

SEQ ID NO: 3805438 - DNA, 15 bp, Homo sapiens
acttttaaagaaaaa

SEQ ID NO: 3805439 - DNA, 17 bp, Homo sapiens
acttttcctccctcagt

SEQ ID NO: 3805440 - DNA, 22 bp, Homo sapiens
acttttctaaagctctgaacaa

SEQ ID NO: 3805441 - DNA, 12 bp, Homo sapiens
acttttgtaaga

SEQ ID NO: 3805442 - DNA, 14 bp, Homo sapiens
acttttgtgtgaaa

SEQ ID NO: 3805443 - DNA, 18 bp, Homo sapiens
actttttctttgattttc

SEQ ID NO: 3805444 - DNA, 21 bp, Homo sapiens
actttttgcaccttattttct

SEQ ID NO: 3805445 - DNA, 13 bp, Homo sapiens
agaaaaagaaaaa

SEQ ID NO: 3805446 - DNA, 17 bp, Homo sapiens
agaaaagagggagagat

SEQ ID NO: 3805447 - DNA, 19 bp, Homo sapiens
agaaaagatgagaggcaga

SEQ ID NO: 3805448 - DNA, 19 bp, Homo sapiens
agaaaatgcaggagagctt

SEQ ID NO: 3805449 - DNA, 17 bp, Homo sapiens
agaaacagagagagaca

SEQ ID NO: 3805450 - DNA, 16 bp, Homo sapiens
agaaacataaataaaa

SEQ ID NO: 3805451 - DNA, 17 bp, Homo sapiens
agaaacataaataaaat

SEQ ID NO: 3805452 - DNA, 22 bp, Homo sapiens
agaaacataaataaaatgacca

SEQ ID NO: 3805453 - DNA, 13 bp, Homo sapiens
agaaactgaggaa

SEQ ID NO: 3805454 - DNA, 16 bp, Homo sapiens
agaaactgaggaattt

SEQ ID NO: 3805455 - DNA, 18 bp, Homo sapiens
agaaactgaggaattttc

SEQ ID NO: 3805456 - DNA, 12 bp, Homo sapiens
agaaacttagag

SEQ ID NO: 3805457 - DNA, 23 bp, Homo sapiens
agaaattttactgacagaaatgc

SEQ ID NO: 3805458 - DNA, 17 bp, Homo sapiens
agaacaatgtcagaaac

SEQ ID NO: 3805459 - DNA, 20 bp, Homo sapiens
agaacacagcaattcctcag

SEQ ID NO: 3805460 - DNA, 15 bp, Homo sapiens
agaacacccactggc

SEQ ID NO: 3805461 - DNA, 17 bp, Homo sapiens
agaacacccactggcca

SEQ ID NO: 3805462 - DNA, 18 bp, Homo sapiens
agaacatccaaggagaaa

SEQ ID NO: 3805463 - DNA, 17 bp, Homo sapiens
agaacccctacatgaaa

SEQ ID NO: 3805464 - DNA, 14 bp, Homo sapiens
agaactctgcaggc

SEQ ID NO: 3805465 - DNA, 14 bp, Homo sapiens
agaagaagtgtgtc

SEQ ID NO: 3805466 - DNA, 16 bp, Homo sapiens
agaagcagaggaagga

SEQ ID NO: 3805467 - DNA, 13 bp, Homo sapiens
agaagcaggagta

SEQ ID NO: 3805468 - DNA, 23 bp, Homo sapiens
agaagcatcaccatgcatggtgg

SEQ ID NO: 3805469 - DNA, 15 bp, Homo sapiens
agaaggcagggaaag

SEQ ID NO: 3805470 - DNA, 16 bp, Homo sapiens
agaaggttgctctaga

SEQ ID NO: 3805471 - DNA, 21 bp, Homo sapiens
agaagtaggcatgagggatca

SEQ ID NO: 3805472 - DNA, 17 bp, Homo sapiens
agaagtcaacagtgaaa

SEQ ID NO: 3805473 - DNA, 13 bp, Homo sapiens
agaagtgtatata

SEQ ID NO: 3805474 - DNA, 14 bp, Homo sapiens
agaatataacatgt

SEQ ID NO: 3805475 - DNA, 15 bp, Homo sapiens
agaatgaaatactct

SEQ ID NO: 3805476 - DNA, 17 bp, Homo sapiens
agaatgtcagtatgtgg

SEQ ID NO: 3805477 - DNA, 23 bp, Homo sapiens
agaattgcttgaacccaggaggt

SEQ ID NO: 3805478 - DNA, 21 bp, Homo sapiens
agaatttctaccatttcagag

SEQ ID NO: 3805479 - DNA, 14 bp, Homo sapiens
agacaattcagaag

SEQ ID NO: 3805480 - DNA, 19 bp, Homo sapiens
agacaccgttcattcaggc

SEQ ID NO: 3805481 - DNA, 14 bp, Homo sapiens
agacagaaacagag

SEQ ID NO: 3805482 - DNA, 17 bp, Homo sapiens
agacagaaacagagaga

SEQ ID NO: 3805483 - DNA, 17 bp, Homo sapiens
agacagaacccctacat

SEQ ID NO: 3805484 - DNA, 21 bp, Homo sapiens
agacagatactcctccaaggt

SEQ ID NO: 3805485 - DNA, 19 bp, Homo sapiens
agaccaaatcattgtatca

SEQ ID NO: 3805486 - DNA, 20 bp, Homo sapiens
agaccaccagccgccccagc

SEQ ID NO: 3805487 - DNA, 17 bp, Homo sapiens
agaccattgtcttccaa

SEQ ID NO: 3805488 - DNA, 18 bp, Homo sapiens
agaccattgtcttccaac

SEQ ID NO: 3805489 - DNA, 22 bp, Homo sapiens
agaccattgtcttccaacccca

SEQ ID NO: 3805490 - DNA, 23 bp, Homo sapiens
agaccattgtcttccaaccccag

SEQ ID NO: 3805491 - DNA, 17 bp, Homo sapiens
agacccggtcctgccct

SEQ ID NO: 3805492 - DNA, 12 bp, Homo sapiens
agaccctgttct

SEQ ID NO: 3805493 - DNA, 13 bp, Homo sapiens
agaccctgttcta

SEQ ID NO: 3805494 - DNA, 20 bp, Homo sapiens
agacctctgaatgtcccaga

SEQ ID NO: 3805495 - DNA, 22 bp, Homo sapiens
agacctctgaatgtcccagagg

SEQ ID NO: 3805496 - DNA, 18 bp, Homo sapiens
agacctctgtgcacttat

SEQ ID NO: 3805497 - DNA, 23 bp, Homo sapiens
agacgctgtgattggcaggaggc

SEQ ID NO: 3805498 - DNA, 14 bp, Homo sapiens
agacgggccctggt

SEQ ID NO: 3805499 - DNA, 23 bp, Homo sapiens
agactccaagattcaaagagact

SEQ ID NO: 3805500 - DNA, 21 bp, Homo sapiens
agactgcgccacggcactcca

SEQ ID NO: 3805501 - DNA, 18 bp, Homo sapiens
agagaaaaatggcctgca

SEQ ID NO: 3805502 - DNA, 21 bp, Homo sapiens
agagaagagattgtggtttca

SEQ ID NO: 3805503 - DNA, 23 bp, Homo sapiens
agagaatttctaccatttcagag

SEQ ID NO: 3805504 - DNA, 15 bp, Homo sapiens
agagacacagagatg

SEQ ID NO: 3805505 - DNA, 18 bp, Homo sapiens
agagacaggcccaagaga

SEQ ID NO: 3805506 - DNA, 15 bp, Homo sapiens
agagaccctacagac

SEQ ID NO: 3805507 - DNA, 18 bp, Homo sapiens
agagactcaaagagactc

SEQ ID NO: 3805508 - DNA, 19 bp, Homo sapiens
agagactcaaagagactcc

SEQ ID NO: 3805509 - DNA, 21 bp, Homo sapiens
agagactccaagattcaaaga

SEQ ID NO: 3805510 - DNA, 13 bp, Homo sapiens
agagagacagaga

SEQ ID NO: 3805511 - DNA, 21 bp, Homo sapiens
agagagacagagacagagaga

SEQ ID NO: 3805512 - DNA, 14 bp, Homo sapiens
agagagagacagag

SEQ ID NO: 3805513 - DNA, 21 bp, Homo sapiens
agagagatcaaatggaaagga

SEQ ID NO: 3805514 - DNA, 22 bp, Homo sapiens
agagaggggaataatagaagaa

SEQ ID NO: 3805515 - DNA, 15 bp, Homo sapiens
agagatcaaatggaa

SEQ ID NO: 3805516 - DNA, 16 bp, Homo sapiens
agagcagcactggggt

SEQ ID NO: 3805517 - DNA, 18 bp, Homo sapiens
agagcaggcacatggagg

SEQ ID NO: 3805518 - DNA, 15 bp, Homo sapiens
agagccccacacgga

SEQ ID NO: 3805519 - DNA, 15 bp, Homo sapiens
agagctcctgtccct

SEQ ID NO: 3805520 - DNA, 14 bp, Homo sapiens
agagctctgcacgt

SEQ ID NO: 3805521 - DNA, 16 bp, Homo sapiens
agagcttcccccaagg

SEQ ID NO: 3805522 - DNA, 16 bp, Homo sapiens
agaggaaaatgaataa

SEQ ID NO: 3805523 - DNA, 20 bp, Homo sapiens
agaggacagtatttgtgggg

SEQ ID NO: 3805524 - DNA, 18 bp, Homo sapiens
agaggcaactgcattggc

SEQ ID NO: 3805525 - DNA, 20 bp, Homo sapiens
agaggctagtctcttctcag

SEQ ID NO: 3805526 - DNA, 19 bp, Homo sapiens
agaggtgaggtgacttgcc

SEQ ID NO: 3805527 - DNA, 17 bp, Homo sapiens
agagtcctcattataaa

SEQ ID NO: 3805528 - DNA, 22 bp, Homo sapiens
agagtcttccaggtgcctggcc

SEQ ID NO: 3805529 - DNA, 21 bp, Homo sapiens
agagtgacaggcaccagatgg

SEQ ID NO: 3805530 - DNA, 14 bp, Homo sapiens
agagtgagagggca

SEQ ID NO: 3805531 - DNA, 19 bp, Homo sapiens
agagtggggtaggttggga

SEQ ID NO: 3805532 - DNA, 23 bp, Homo sapiens
agagttcattcaaaatgtccagc

SEQ ID NO: 3805533 - DNA, 18 bp, Homo sapiens
agataatattaaggaaga

SEQ ID NO: 3805534 - DNA, 22 bp, Homo sapiens
agataatattaaggaagacaat

SEQ ID NO: 3805535 - DNA, 16 bp, Homo sapiens
agatcaaatggaaagg

SEQ ID NO: 3805536 - DNA, 15 bp, Homo sapiens
agatcctacccctga

SEQ ID NO: 3805537 - DNA, 20 bp, Homo sapiens
agatctgcttccctggggcc

SEQ ID NO: 3805538 - DNA, 16 bp, Homo sapiens
agatgagaggcagagg

SEQ ID NO: 3805539 - DNA, 24 bp, Homo sapiens
agatgatacttccaagtgataatt

SEQ ID NO: 3805540 - DNA, 23 bp, Homo sapiens
agatgcacacacaccgatgctga

SEQ ID NO: 3805541 - DNA, 15 bp, Homo sapiens
agatgcttctcactg

SEQ ID NO: 3805542 - DNA, 17 bp, Homo sapiens
agatggaatagaaaaga

SEQ ID NO: 3805543 - DNA, 21 bp, Homo sapiens
agatggaatagaaaagatgag

SEQ ID NO: 3805544 - DNA, 23 bp, Homo sapiens
agatggagaaacaggctctgaga

SEQ ID NO: 3805545 - DNA, 22 bp, Homo sapiens
agatggatccacgtgctcgcct

SEQ ID NO: 3805546 - DNA, 23 bp, Homo sapiens
agatggtcacacagagatacgca

SEQ ID NO: 3805547 - DNA, 22 bp, Homo sapiens
agattatatatcataaagtatg

SEQ ID NO: 3805548 - DNA, 18 bp, Homo sapiens
agattgagagaagagaca

SEQ ID NO: 3805549 - DNA, 20 bp, Homo sapiens
agattgctttaagaaactgt

SEQ ID NO: 3805550 - DNA, 11 bp, Homo sapiens
agcaaatgctg

SEQ ID NO: 3805551 - DNA, 22 bp, Homo sapiens
agcaaatgctggatgagcaact

SEQ ID NO: 3805552 - DNA, 19 bp, Homo sapiens
agcaagaccaaatcattgt

SEQ ID NO: 3805553 - DNA, 20 bp, Homo sapiens
agcaaggacaacctgcccct

SEQ ID NO: 3805554 - DNA, 19 bp, Homo sapiens
agcaatctgcattttaaca

SEQ ID NO: 3805555 - DNA, 20 bp, Homo sapiens
agcaatctgcattttaacaa

SEQ ID NO: 3805556 - DNA, 21 bp, Homo sapiens
agcaatctgcattttaacaag

SEQ ID NO: 3805557 - DNA, 18 bp, Homo sapiens
agcacatgattttctttt

SEQ ID NO: 3805558 - DNA, 20 bp, Homo sapiens
agcacatgattttcttttgt

SEQ ID NO: 3805559 - DNA, 17 bp, Homo sapiens
agcaccacattgcctca

SEQ ID NO: 3805560 - DNA, 20 bp, Homo sapiens
agcaccacattgcctcattt

SEQ ID NO: 3805561 - DNA, 17 bp, Homo sapiens
agcagacctacctgcag

SEQ ID NO: 3805562 - DNA, 15 bp, Homo sapiens
agcagagccaaggcc

SEQ ID NO: 3805563 - DNA, 16 bp, Homo sapiens
agcagagccaaggcca

SEQ ID NO: 3805564 - DNA, 18 bp, Homo sapiens
agcagagccaaggccacc

SEQ ID NO: 3805565 - DNA, 18 bp, Homo sapiens
agcagagtcttccaggtg

SEQ ID NO: 3805566 - DNA, 13 bp, Homo sapiens
agcagcactgggg

SEQ ID NO: 3805567 - DNA, 16 bp, Homo sapiens
agcagcctggaccctg

SEQ ID NO: 3805568 - DNA, 19 bp, Homo sapiens
agcataaaaattagccaag

SEQ ID NO: 3805569 - DNA, 16 bp, Homo sapiens
agcatcctcagttcct

SEQ ID NO: 3805570 - DNA, 19 bp, Homo sapiens
agcatgacaacttttaaag

SEQ ID NO: 3805571 - DNA, 20 bp, Homo sapiens
agcatgacaacttttaaaga

SEQ ID NO: 3805572 - DNA, 22 bp, Homo sapiens
agcattagctacttttcagaat

SEQ ID NO: 3805573 - DNA, 22 bp, Homo sapiens
agcattttgctaaatgtgaatg

SEQ ID NO: 3805574 - DNA, 22 bp, Homo sapiens
agccaccgcgcccagccaagaa

SEQ ID NO: 3805575 - DNA, 15 bp, Homo sapiens
agccactctgttcct

SEQ ID NO: 3805576 - DNA, 13 bp, Homo sapiens
agccaggactcct

SEQ ID NO: 3805577 - DNA, 16 bp, Homo sapiens
agccataccagggtga

SEQ ID NO: 3805578 - DNA, 16 bp, Homo sapiens
agccatctcaagcaag

SEQ ID NO: 3805579 - DNA, 15 bp, Homo sapiens
agccccacctctcca

SEQ ID NO: 3805580 - DNA, 22 bp, Homo sapiens
agccccacctctccaagtctct

SEQ ID NO: 3805581 - DNA, 18 bp, Homo sapiens
agccccttctcccagcac

SEQ ID NO: 3805582 - DNA, 17 bp, Homo sapiens
agccctctcactgtgtc

SEQ ID NO: 3805583 - DNA, 18 bp, Homo sapiens
agccctgctgcttcctaa

SEQ ID NO: 3805584 - DNA, 13 bp, Homo sapiens
agccgccccagcc

SEQ ID NO: 3805585 - DNA, 14 bp, Homo sapiens
agccgcctccctta

SEQ ID NO: 3805586 - DNA, 21 bp, Homo sapiens
agccgcctcccttatgcagga

SEQ ID NO: 3805587 - DNA, 14 bp, Homo sapiens
agcctcaaatgcag

SEQ ID NO: 3805588 - DNA, 21 bp, Homo sapiens
agcctccaggcccccaactcc

SEQ ID NO: 3805589 - DNA, 15 bp, Homo sapiens
agcctctccccgctc

SEQ ID NO: 3805590 - DNA, 23 bp, Homo sapiens
agcctctgaaaaccaatgttctc

SEQ ID NO: 3805591 - DNA, 21 bp, Homo sapiens
agcctgaattttgttgctgtt

SEQ ID NO: 3805592 - DNA, 14 bp, Homo sapiens
agcctgggaccagg

SEQ ID NO: 3805593 - DNA, 12 bp, Homo sapiens
agcctgtgcctc

SEQ ID NO: 3805594 - DNA, 14 bp, Homo sapiens
agccttgctgtaga

SEQ ID NO: 3805595 - DNA, 16 bp, Homo sapiens
agccttgctgtagaga

SEQ ID NO: 3805596 - DNA, 18 bp, Homo sapiens
agccttgctgtagagact

SEQ ID NO: 3805597 - DNA, 12 bp, Homo sapiens
agcgcctcctgg

SEQ ID NO: 3805598 - DNA, 14 bp, Homo sapiens
agcgcctcctggac

SEQ ID NO: 3805599 - DNA, 23 bp, Homo sapiens
agcggctggcagcccacccctca

SEQ ID NO: 3805600 - DNA, 17 bp, Homo sapiens
agctaagctaggaatga

SEQ ID NO: 3805601 - DNA, 13 bp, Homo sapiens
agctaggaatgaa

SEQ ID NO: 3805602 - DNA, 17 bp, Homo sapiens
agctattcaggaggctg

SEQ ID NO: 3805603 - DNA, 21 bp, Homo sapiens
agctcaggaaccgaggcaggg

SEQ ID NO: 3805604 - DNA, 18 bp, Homo sapiens
agctcataagctgtagaa

SEQ ID NO: 3805605 - DNA, 18 bp, Homo sapiens
agctcctgtccctaccca

SEQ ID NO: 3805606 - DNA, 21 bp, Homo sapiens
agctcctgtccctacccactc

SEQ ID NO: 3805607 - DNA, 16 bp, Homo sapiens
agctgaacaatgaatg

SEQ ID NO: 3805608 - DNA, 15 bp, Homo sapiens
agctgaacctgggta

SEQ ID NO: 3805609 - DNA, 19 bp, Homo sapiens
agctgacagagccagaggc

SEQ ID NO: 3805610 - DNA, 21 bp, Homo sapiens
agctgacttttctgtccgagc

SEQ ID NO: 3805611 - DNA, 22 bp, Homo sapiens
agctgagatggagtcctcgact

SEQ ID NO: 3805612 - DNA, 20 bp, Homo sapiens
agctgaggacacaccccaca

SEQ ID NO: 3805613 - DNA, 18 bp, Homo sapiens
agctgcatacagtttgca

SEQ ID NO: 3805614 - DNA, 13 bp, Homo sapiens
agctgccgaccag

SEQ ID NO: 3805615 - DNA, 14 bp, Homo sapiens
agctgcctgtgcct

SEQ ID NO: 3805616 - DNA, 21 bp, Homo sapiens
agctggcaatgccctacctgc

SEQ ID NO: 3805617 - DNA, 18 bp, Homo sapiens
agctggcctctagaacac

SEQ ID NO: 3805618 - DNA, 15 bp, Homo sapiens
agctggttagaaatg

SEQ ID NO: 3805619 - DNA, 22 bp, Homo sapiens
agctgtagaactctgcaggcag

SEQ ID NO: 3805620 - DNA, 13 bp, Homo sapiens
agctgttcagctg

SEQ ID NO: 3805621 - DNA, 14 bp, Homo sapiens
agctgttcagctgg

SEQ ID NO: 3805622 - DNA, 14 bp, Homo sapiens
agcttatctcaggg

SEQ ID NO: 3805623 - DNA, 19 bp, Homo sapiens
agcttcccaagtagctgag

SEQ ID NO: 3805624 - DNA, 17 bp, Homo sapiens
agcttctcttgaaaact

SEQ ID NO: 3805625 - DNA, 15 bp, Homo sapiens
agctttagctggagg

SEQ ID NO: 3805626 - DNA, 12 bp, Homo sapiens
agctttctcctt

SEQ ID NO: 3805627 - DNA, 14 bp, Homo sapiens
agctttctcctttg

SEQ ID NO: 3805628 - DNA, 16 bp, Homo sapiens
agctttgaaaattcag

SEQ ID NO: 3805629 - DNA, 18 bp, Homo sapiens
agctttgctctttggtag

SEQ ID NO: 3805630 - DNA, 20 bp, Homo sapiens
agctttgggttggagctgtt

SEQ ID NO: 3805631 - DNA, 15 bp, Homo sapiens
aggaaatcagagctg

SEQ ID NO: 3805632 - DNA, 20 bp, Homo sapiens
aggaagagcaggcacatgga

SEQ ID NO: 3805633 - DNA, 15 bp, Homo sapiens
aggaaggagaggaga

SEQ ID NO: 3805634 - DNA, 23 bp, Homo sapiens
aggaatgaaatcctgcttcagtg

SEQ ID NO: 3805635 - DNA, 12 bp, Homo sapiens
aggacacatgtc

SEQ ID NO: 3805636 - DNA, 13 bp, Homo sapiens
aggacacatgtcc

SEQ ID NO: 3805637 - DNA, 20 bp, Homo sapiens
aggagacaggttagctgctc

SEQ ID NO: 3805638 - DNA, 18 bp, Homo sapiens
aggagaggggcacagggt

SEQ ID NO: 3805639 - DNA, 13 bp, Homo sapiens
aggagcaaatgct

SEQ ID NO: 3805640 - DNA, 19 bp, Homo sapiens
aggaggctgaggcaccaga

SEQ ID NO: 3805641 - DNA, 15 bp, Homo sapiens
aggagggaggtgctt

SEQ ID NO: 3805642 - DNA, 13 bp, Homo sapiens
aggagggcaggca

SEQ ID NO: 3805643 - DNA, 22 bp, Homo sapiens
aggagggttgggcgtgctacct

SEQ ID NO: 3805644 - DNA, 15 bp, Homo sapiens
aggagtagtattttg

SEQ ID NO: 3805645 - DNA, 17 bp, Homo sapiens
aggatagctatatttta

SEQ ID NO: 3805646 - DNA, 23 bp, Homo sapiens
aggatagctatattttatttctg

SEQ ID NO: 3805647 - DNA, 15 bp, Homo sapiens
aggatatccccaggg

SEQ ID NO: 3805648 - DNA, 19 bp, Homo sapiens
aggatatccccagggaaac

SEQ ID NO: 3805649 - DNA, 18 bp, Homo sapiens
aggatctcttgagcctgg

SEQ ID NO: 3805650 - DNA, 22 bp, Homo sapiens
aggatctcttgagcctgggagg

SEQ ID NO: 3805651 - DNA, 16 bp, Homo sapiens
aggatggagagagggg

SEQ ID NO: 3805652 - DNA, 17 bp, Homo sapiens
aggatggagagagggga

SEQ ID NO: 3805653 - DNA, 15 bp, Homo sapiens
aggattcctccccca

SEQ ID NO: 3805654 - DNA, 17 bp, Homo sapiens
aggcaaaatccttgctt

SEQ ID NO: 3805655 - DNA, 19 bp, Homo sapiens
aggcaaaatccttgcttat

SEQ ID NO: 3805656 - DNA, 18 bp, Homo sapiens
aggcaagtgtatattttg

SEQ ID NO: 3805657 - DNA, 13 bp, Homo sapiens
aggcacatggagg

SEQ ID NO: 3805658 - DNA, 24 bp, Homo sapiens
aggcagatttactgtcccaggagc

SEQ ID NO: 3805659 - DNA, 13 bp, Homo sapiens
aggcagctccagc

SEQ ID NO: 3805660 - DNA, 18 bp, Homo sapiens
aggcaggatatccccagg

SEQ ID NO: 3805661 - DNA, 17 bp, Homo sapiens
aggcaggtgggatggat

SEQ ID NO: 3805662 - DNA, 17 bp, Homo sapiens
aggcatcccaggggacc

SEQ ID NO: 3805663 - DNA, 18 bp, Homo sapiens
aggcatcccaggggacca

SEQ ID NO: 3805664 - DNA, 23 bp, Homo sapiens
aggcatcccaggggaccacacct

SEQ ID NO: 3805665 - DNA, 15 bp, Homo sapiens
aggcatgagggatca

SEQ ID NO: 3805666 - DNA, 22 bp, Homo sapiens
aggcatgagggatcacagggcc

SEQ ID NO: 3805667 - DNA, 23 bp, Homo sapiens
aggcatgagggatcacagggccc

SEQ ID NO: 3805668 - DNA, 16 bp, Homo sapiens
aggcatttgctgaata

SEQ ID NO: 3805669 - DNA, 20 bp, Homo sapiens
aggcatttgctgaatacaga

SEQ ID NO: 3805670 - DNA, 16 bp, Homo sapiens
aggccaaggtgggagg

SEQ ID NO: 3805671 - DNA, 12 bp, Homo sapiens
aggccacactgg

SEQ ID NO: 3805672 - DNA, 14 bp, Homo sapiens
aggccattctttcc

SEQ ID NO: 3805673 - DNA, 15 bp, Homo sapiens
aggccattctttccc

SEQ ID NO: 3805674 - DNA, 15 bp, Homo sapiens
aggccccagcctcca

SEQ ID NO: 3805675 - DNA, 12 bp, Homo sapiens
aggcctggggac

SEQ ID NO: 3805676 - DNA, 14 bp, Homo sapiens
aggctagagtgcag

SEQ ID NO: 3805677 - DNA, 14 bp, Homo sapiens
aggctagtctcttc

SEQ ID NO: 3805678 - DNA, 23 bp, Homo sapiens
aggctagtctcttctcagagcag

SEQ ID NO: 3805679 - DNA, 16 bp, Homo sapiens
aggctattattttcac

SEQ ID NO: 3805680 - DNA, 18 bp, Homo sapiens
aggctattattttcactg

SEQ ID NO: 3805681 - DNA, 20 bp, Homo sapiens
aggctcagagggtgtcctgc

SEQ ID NO: 3805682 - DNA, 22 bp, Homo sapiens
aggctccaccccatccagttca

SEQ ID NO: 3805683 - DNA, 18 bp, Homo sapiens
aggctctgaaagccagct

SEQ ID NO: 3805684 - DNA, 15 bp, Homo sapiens
aggctgaccaagaga

SEQ ID NO: 3805685 - DNA, 19 bp, Homo sapiens
aggctgaccaagagagaaa

SEQ ID NO: 3805686 - DNA, 20 bp, Homo sapiens
aggctgaccaagagagaaag

SEQ ID NO: 3805687 - DNA, 17 bp, Homo sapiens
aggctgggggaagaagc

SEQ ID NO: 3805688 - DNA, 22 bp, Homo sapiens
aggctgggggaagaagctctct

SEQ ID NO: 3805689 - DNA, 17 bp, Homo sapiens
aggctgggtccagggga

SEQ ID NO: 3805690 - DNA, 19 bp, Homo sapiens
aggctgggtccaggggagg

SEQ ID NO: 3805691 - DNA, 21 bp, Homo sapiens
aggctggtctcgaactcctga

SEQ ID NO: 3805692 - DNA, 16 bp, Homo sapiens
agggaaaagctaagag

SEQ ID NO: 3805693 - DNA, 22 bp, Homo sapiens
agggaaaggctctgaaagccag

SEQ ID NO: 3805694 - DNA, 23 bp, Homo sapiens
agggaaggatcccatgagctcct

SEQ ID NO: 3805695 - DNA, 13 bp, Homo sapiens
agggagacagaga

SEQ ID NO: 3805696 - DNA, 13 bp, Homo sapiens
agggagagactct

SEQ ID NO: 3805697 - DNA, 18 bp, Homo sapiens
agggagagatgagtgggt

SEQ ID NO: 3805698 - DNA, 13 bp, Homo sapiens
agggatcacaggg

SEQ ID NO: 3805699 - DNA, 14 bp, Homo sapiens
agggatcacagggc

SEQ ID NO: 3805700 - DNA, 22 bp, Homo sapiens
agggatcacagggccccagaag

SEQ ID NO: 3805701 - DNA, 15 bp, Homo sapiens
agggatgactaaaat

SEQ ID NO: 3805702 - DNA, 16 bp, Homo sapiens
agggcatattaaaggc

SEQ ID NO: 3805703 - DNA, 17 bp, Homo sapiens
agggcatgggagggagg

SEQ ID NO: 3805704 - DNA, 15 bp, Homo sapiens
agggccatctcctcc

SEQ ID NO: 3805705 - DNA, 15 bp, Homo sapiens
agggccatgaacttt

SEQ ID NO: 3805706 - DNA, 21 bp, Homo sapiens
agggcttttttttgagaatac

SEQ ID NO: 3805707 - DNA, 17 bp, Homo sapiens
aggggaataatagaaga

SEQ ID NO: 3805708 - DNA, 19 bp, Homo sapiens
aggggaataatagaagaac

SEQ ID NO: 3805709 - DNA, 19 bp, Homo sapiens
aggggactatttatgaagg

SEQ ID NO: 3805710 - DNA, 19 bp, Homo sapiens
aggggactggtgatgggac

SEQ ID NO: 3805711 - DNA, 17 bp, Homo sapiens
aggggagggaaaagcta

SEQ ID NO: 3805712 - DNA, 17 bp, Homo sapiens
aggggccgggggcagtc

SEQ ID NO: 3805713 - DNA, 23 bp, Homo sapiens
aggggcttggtgtttgtaagaaa

SEQ ID NO: 3805714 - DNA, 15 bp, Homo sapiens
agggggagagggctg

SEQ ID NO: 3805715 - DNA, 21 bp, Homo sapiens
agggtggggggggggcgcggc

SEQ ID NO: 3805716 - DNA, 13 bp, Homo sapiens
agggttgtgccca

SEQ ID NO: 3805717 - DNA, 14 bp, Homo sapiens
aggtatttatcttt

SEQ ID NO: 3805718 - DNA, 21 bp, Homo sapiens
aggtcaaggctgcagtgagcc

SEQ ID NO: 3805719 - DNA, 21 bp, Homo sapiens
aaaacgttttatgtgaatgtg

SEQ ID NO: 3805720 - DNA, 20 bp, Homo sapiens
aaaactgctgactgttttct

SEQ ID NO: 3805721 - DNA, 22 bp, Homo sapiens
aaaactgctgactgttttctct

SEQ ID NO: 3805722 - DNA, 15 bp, Homo sapiens
aaaagattatatatc

SEQ ID NO: 3805723 - DNA, 11 bp, Homo sapiens
aaaaggcagga

SEQ ID NO: 3805724 - DNA, 15 bp, Homo sapiens
aaaaggcgcatctaa

SEQ ID NO: 3805725 - DNA, 14 bp, Homo sapiens
aaaagggaggggga

SEQ ID NO: 3805726 - DNA, 23 bp, Homo sapiens
aaaaggtagatcctgagatgatt

SEQ ID NO: 3805727 - DNA, 11 bp, Homo sapiens
aaaagtatata

SEQ ID NO: 3805728 - DNA, 16 bp, Homo sapiens
aaaagttaaactactt

SEQ ID NO: 3805729 - DNA, 13 bp, Homo sapiens
aaaataaaaatgg

SEQ ID NO: 3805730 - DNA, 14 bp, Homo sapiens
aaaataaacaaata

SEQ ID NO: 3805731 - DNA, 19 bp, Homo sapiens
aaaataattttaaacaaag

SEQ ID NO: 3805732 - DNA, 13 bp, Homo sapiens
aaaataccaagga

SEQ ID NO: 3805733 - DNA, 20 bp, Homo sapiens
aaaatacctattttatatga

SEQ ID NO: 3805734 - DNA, 16 bp, Homo sapiens
aaaatattttcctgcc

SEQ ID NO: 3805735 - DNA, 21 bp, Homo sapiens
aaaatcagcctgctccagctg

SEQ ID NO: 3805736 - DNA, 22 bp, Homo sapiens
aaaatcccttacctcggtgcct

SEQ ID NO: 3805737 - DNA, 18 bp, Homo sapiens
aaaatcctaccaacctct

SEQ ID NO: 3805738 - DNA, 19 bp, Homo sapiens
aaaatgaccagtaattgtg

SEQ ID NO: 3805739 - DNA, 20 bp, Homo sapiens
aaaatgaccagtaattgtga

SEQ ID NO: 3805740 - DNA, 19 bp, Homo sapiens
aaaatggccatttgctttt

SEQ ID NO: 3805741 - DNA, 23 bp, Homo sapiens
aaaatggccatttgctttttcac

SEQ ID NO: 3805742 - DNA, 17 bp, Homo sapiens
aaaatgggaagactgag

SEQ ID NO: 3805743 - DNA, 19 bp, Homo sapiens
aaacacaaacgggctcagc

SEQ ID NO: 3805744 - DNA, 16 bp, Homo sapiens
aaacacaccgatgcac

SEQ ID NO: 3805745 - DNA, 17 bp, Homo sapiens
aaacataaataaaatga

SEQ ID NO: 3805746 - DNA, 19 bp, Homo sapiens
aaacatgctgaaatctatt

SEQ ID NO: 3805747 - DNA, 16 bp, Homo sapiens
aaacatggcctttgct

SEQ ID NO: 3805748 - DNA, 16 bp, Homo sapiens
aaaccgccaaggctgg

SEQ ID NO: 3805749 - DNA, 18 bp, Homo sapiens
aaactatatttatttatg

SEQ ID NO: 3805750 - DNA, 14 bp, Homo sapiens
aaactgaggaattt

SEQ ID NO: 3805751 - DNA, 19 bp, Homo sapiens
aaactgaggaattttcttt

SEQ ID NO: 3805752 - DNA, 19 bp, Homo sapiens
aaactgatgtttaaaagtc

SEQ ID NO: 3805753 - DNA, 20 bp, Homo sapiens
aaactgttctctttaaaata

SEQ ID NO: 3805754 - DNA, 20 bp, Homo sapiens
aaacttccacaagagtgaat

SEQ ID NO: 3805755 - DNA, 11 bp, Homo sapiens
aaagaacccca

SEQ ID NO: 3805756 - DNA, 23 bp, Homo sapiens
aaagagactaatagagacacaga

SEQ ID NO: 3805757 - DNA, 15 bp, Homo sapiens
aaagatgagtaattt

SEQ ID NO: 3805758 - DNA, 17 bp, Homo sapiens
aaagatgcttctcactg

SEQ ID NO: 3805759 - DNA, 21 bp, Homo sapiens
aaagattatatatcataaagt

SEQ ID NO: 3805760 - DNA, 22 bp, Homo sapiens
aaagattatatatcataaagta

SEQ ID NO: 3805761 - DNA, 12 bp, Homo sapiens
aaagcagagcca

SEQ ID NO: 3805762 - DNA, 15 bp, Homo sapiens
aaagcagagccaagg

SEQ ID NO: 3805763 - DNA, 19 bp, Homo sapiens
aaagccagctgccgaccag

SEQ ID NO: 3805764 - DNA, 16 bp, Homo sapiens
aaagcctcctccagcc

SEQ ID NO: 3805765 - DNA, 21 bp, Homo sapiens
aaaggagagctagcagcaggg

SEQ ID NO: 3805766 - DNA, 20 bp, Homo sapiens
aaaggctctgaaagccagct

SEQ ID NO: 3805767 - DNA, 12 bp, Homo sapiens
aaaggcttttgg

SEQ ID NO: 3805768 - DNA, 17 bp, Homo sapiens
aaaggtcgcacctcctt

SEQ ID NO: 3805769 - DNA, 16 bp, Homo sapiens
aaagtaatctttaaac

SEQ ID NO: 3805770 - DNA, 16 bp, Homo sapiens
aaagtgtagcaccctg

SEQ ID NO: 3805771 - DNA, 16 bp, Homo sapiens
aaataaaatgaccagt

SEQ ID NO: 3805772 - DNA, 21 bp, Homo sapiens
aaataaatgtatcatagaaat

SEQ ID NO: 3805773 - DNA, 14 bp, Homo sapiens
aaataatagggaaa

SEQ ID NO: 3805774 - DNA, 15 bp, Homo sapiens
aaatagaaagtgacc

SEQ ID NO: 3805775 - DNA, 18 bp, Homo sapiens
aaatagcaacatgcttca

SEQ ID NO: 3805776 - DNA, 15 bp, Homo sapiens
aaatagcacatgatt

SEQ ID NO: 3805777 - DNA, 18 bp, Homo sapiens
aaatatagatcagttata

SEQ ID NO: 3805778 - DNA, 15 bp, Homo sapiens
aaatatttgtacata

SEQ ID NO: 3805779 - DNA, 21 bp, Homo sapiens
aaatcagcctgctccagctgt

SEQ ID NO: 3805780 - DNA, 15 bp, Homo sapiens
aaatccagaaagaaa

SEQ ID NO: 3805781 - DNA, 15 bp, Homo sapiens
aaatcccatttaaaa

SEQ ID NO: 3805782 - DNA, 18 bp, Homo sapiens
aaatcccttacctcggtg

SEQ ID NO: 3805783 - DNA, 19 bp, Homo sapiens
aaatcctaccaacctctga

SEQ ID NO: 3805784 - DNA, 13 bp, Homo sapiens
aaatgagcctggc

SEQ ID NO: 3805785 - DNA, 14 bp, Homo sapiens
aaatgccaatctct

SEQ ID NO: 3805786 - DNA, 17 bp, Homo sapiens
aaatgctgaatgaatcc

SEQ ID NO: 3805787 - DNA, 19 bp, Homo sapiens
aaatggccatttgcttttt

SEQ ID NO: 3805788 - DNA, 18 bp, Homo sapiens
aaatgtaacttttgtaag

SEQ ID NO: 3805789 - DNA, 17 bp, Homo sapiens
aaatgtatcatagaaat

SEQ ID NO: 3805790 - DNA, 20 bp, Homo sapiens
aaattcaacctgtgtcttat

SEQ ID NO: 3805791 - DNA, 16 bp, Homo sapiens
aaattccccaccctga

SEQ ID NO: 3805792 - DNA, 17 bp, Homo sapiens
aaattctgttttgtaaa

SEQ ID NO: 3805793 - DNA, 13 bp, Homo sapiens
aaattgtttttac

SEQ ID NO: 3805794 - DNA, 18 bp, Homo sapiens
aaattttactgacagaaa

SEQ ID NO: 3805795 - DNA, 19 bp, Homo sapiens
aaattttactgacagaaat

SEQ ID NO: 3805796 - DNA, 23 bp, Homo sapiens
aaatttttcttccttaaactcct

SEQ ID NO: 3805797 - DNA, 19 bp, Homo sapiens
aacaaaaacactaaaaata

SEQ ID NO: 3805798 - DNA, 14 bp, Homo sapiens
aacaatgtcagaaa

SEQ ID NO: 3805799 - DNA, 19 bp, Homo sapiens
aacacaaacgggctcagca

SEQ ID NO: 3805800 - DNA, 17 bp, Homo sapiens
aacacacatggatgcac

SEQ ID NO: 3805801 - DNA, 22 bp, Homo sapiens
aacacagcctgggaccagggca

SEQ ID NO: 3805802 - DNA, 14 bp, Homo sapiens
aacacccactggcc

SEQ ID NO: 3805803 - DNA, 15 bp, Homo sapiens
aacactaaaaataaa

SEQ ID NO: 3805804 - DNA, 19 bp, Homo sapiens
aacagagacaggcccaaga

SEQ ID NO: 3805805 - DNA, 19 bp, Homo sapiens
aacagcttaaagagaaaaa

SEQ ID NO: 3805806 - DNA, 20 bp, Homo sapiens
aacagtgtatttggaaaatg

SEQ ID NO: 3805807 - DNA, 14 bp, Homo sapiens
aacataaataaaat

SEQ ID NO: 3805808 - DNA, 22 bp, Homo sapiens
aacatggcctttgcttgaaaga

SEQ ID NO: 3805809 - DNA, 18 bp, Homo sapiens
aacatttttgtacattat

SEQ ID NO: 3805810 - DNA, 19 bp, Homo sapiens
aacatttttgtacattatg

SEQ ID NO: 3805811 - DNA, 22 bp, Homo sapiens
aaccatccctgatgtctgtctg

SEQ ID NO: 3805812 - DNA, 19 bp, Homo sapiens
aaccctcagctgcctcatc

SEQ ID NO: 3805813 - DNA, 17 bp, Homo sapiens
aacctccacctcctggg

SEQ ID NO: 3805814 - DNA, 17 bp, Homo sapiens
aacctgtccataaagta

SEQ ID NO: 3805815 - DNA, 22 bp, Homo sapiens
aaccttcatgatgaattacttc

SEQ ID NO: 3805816 - DNA, 17 bp, Homo sapiens
aacgtccacagagtata

SEQ ID NO: 3805817 - DNA, 17 bp, Homo sapiens
aactagggaagataata

SEQ ID NO: 3805818 - DNA, 15 bp, Homo sapiens
aactcaaaatatttg

SEQ ID NO: 3805819 - DNA, 17 bp, Homo sapiens
aactcaaactcttaaaa

SEQ ID NO: 3805820 - DNA, 13 bp, Homo sapiens
aactcctgttctt

SEQ ID NO: 3805821 - DNA, 14 bp, Homo sapiens
aactctgcaggaaa

SEQ ID NO: 3805822 - DNA, 17 bp, Homo sapiens
aactcttggccagagct

SEQ ID NO: 3805823 - DNA, 20 bp, Homo sapiens
aactcttggccagagctgag

SEQ ID NO: 3805824 - DNA, 12 bp, Homo sapiens
aactgaggaatt

SEQ ID NO: 3805825 - DNA, 16 bp, Homo sapiens
aactgaggaattttct

SEQ ID NO: 3805826 - DNA, 21 bp, Homo sapiens
aactgcactcatagggtgctc

SEQ ID NO: 3805827 - DNA, 15 bp, Homo sapiens
aactgctgactgttt

SEQ ID NO: 3805828 - DNA, 21 bp, Homo sapiens
aactgctgactgttttctctt

SEQ ID NO: 3805829 - DNA, 17 bp, Homo sapiens
aactgcttttcggaaca

SEQ ID NO: 3805830 - DNA, 14 bp, Homo sapiens
aacttgaggacaca

SEQ ID NO: 3805831 - DNA, 15 bp, Homo sapiens
aacttttaaagaaaa

SEQ ID NO: 3805832 - DNA, 15 bp, Homo sapiens
aacttttgtgtgaaa

SEQ ID NO: 3805833 - DNA, 11 bp, Homo sapiens
aagaaaacact

SEQ ID NO: 3805834 - DNA, 16 bp, Homo sapiens
aagaaactgaggaatt

SEQ ID NO: 3805835 - DNA, 19 bp, Homo sapiens
aagaaactgaggaattttc

SEQ ID NO: 3805836 - DNA, 17 bp, Homo sapiens
aagaaccccagacctct

SEQ ID NO: 3805837 - DNA, 18 bp, Homo sapiens
aagaactgccccatctcc

SEQ ID NO: 3805838 - DNA, 23 bp, Homo sapiens
aagaactgccccatctcctccca

SEQ ID NO: 3805839 - DNA, 16 bp, Homo sapiens
aagaagttcttaaata

SEQ ID NO: 3805840 - DNA, 19 bp, Homo sapiens
aagacaatgtgaaaagaaa

SEQ ID NO: 3805841 - DNA, 16 bp, Homo sapiens
aagacacagcccagac

SEQ ID NO: 3805842 - DNA, 19 bp, Homo sapiens
aagagacaaacacctccca

SEQ ID NO: 3805843 - DNA, 14 bp, Homo sapiens
aagagatacagagg

SEQ ID NO: 3805844 - DNA, 13 bp, Homo sapiens
aagagatgaagag

SEQ ID NO: 3805845 - DNA, 16 bp, Homo sapiens
aagagattgtggtttc

SEQ ID NO: 3805846 - DNA, 13 bp, Homo sapiens
aagaggaaaatga

SEQ ID NO: 3805847 - DNA, 14 bp, Homo sapiens
aagaggaaaatgaa

SEQ ID NO: 3805848 - DNA, 18 bp, Homo sapiens
aagaggttttaaaaaaat

SEQ ID NO: 3805849 - DNA, 19 bp, Homo sapiens
aagataatattaaggaaga

SEQ ID NO: 3805850 - DNA, 10 bp, Homo sapiens
aagatactgc

SEQ ID NO: 3805851 - DNA, 17 bp, Homo sapiens
aagatactgctgatgct

SEQ ID NO: 3805852 - DNA, 23 bp, Homo sapiens
aagatactgctgatgctgaaata

SEQ ID NO: 3805853 - DNA, 14 bp, Homo sapiens
aagattatatatca

SEQ ID NO: 3805854 - DNA, 15 bp, Homo sapiens
aagattatatatcat

SEQ ID NO: 3805855 - DNA, 12 bp, Homo sapiens
aagattgcttta

SEQ ID NO: 3805856 - DNA, 18 bp, Homo sapiens
aagattgctttaagaaac

SEQ ID NO: 3805857 - DNA, 13 bp, Homo sapiens
aagcaagccggca

SEQ ID NO: 3805858 - DNA, 13 bp, Homo sapiens
aagcactgctgtg

SEQ ID NO: 3805859 - DNA, 22 bp, Homo sapiens
aagcactgtttaactgggagtg

SEQ ID NO: 3805860 - DNA, 22 bp, Homo sapiens
aagcaggagtaagtttctcatc

SEQ ID NO: 3805861 - DNA, 15 bp, Homo sapiens
aagccagctgccgac

SEQ ID NO: 3805862 - DNA, 19 bp, Homo sapiens
aagccctgagctttctgct

SEQ ID NO: 3805863 - DNA, 21 bp, Homo sapiens
aagccgtgattttcattgctg

SEQ ID NO: 3805864 - DNA, 16 bp, Homo sapiens
aagcctcccacgactg

SEQ ID NO: 3805865 - DNA, 19 bp, Homo sapiens
aagctctgaacaaaagctt

SEQ ID NO: 3805866 - DNA, 15 bp, Homo sapiens
aagctctgcctcccg

SEQ ID NO: 3805867 - DNA, 15 bp, Homo sapiens
aagctgccctgccca

SEQ ID NO: 3805868 - DNA, 21 bp, Homo sapiens
aagctgctgagaatctagcct

SEQ ID NO: 3805869 - DNA, 11 bp, Homo sapiens
aagctgggcag

SEQ ID NO: 3805870 - DNA, 15 bp, Homo sapiens
aagctgggcaggttg

SEQ ID NO: 3805871 - DNA, 16 bp, Homo sapiens
aagctttctcctttga

SEQ ID NO: 3805872 - DNA, 20 bp, Homo sapiens
aaggaattctaggcatccca

SEQ ID NO: 3805873 - DNA, 21 bp, Homo sapiens
aaggacaacctgcccctcccc

SEQ ID NO: 3805874 - DNA, 19 bp, Homo sapiens
aaggagaaacagagacagg

SEQ ID NO: 3805875 - DNA, 11 bp, Homo sapiens
aaggagagcta

SEQ ID NO: 3805876 - DNA, 17 bp, Homo sapiens
aaggagaggaaagaact

SEQ ID NO: 3805877 - DNA, 17 bp, Homo sapiens
aaggcacaaaattttgt

SEQ ID NO: 3805878 - DNA, 15 bp, Homo sapiens
aaggcatctgagtgt

SEQ ID NO: 3805879 - DNA, 17 bp, Homo sapiens
aaggctgaccaagagag

SEQ ID NO: 3805880 - DNA, 11 bp, Homo sapiens
aaggctgagag

SEQ ID NO: 3805881 - DNA, 22 bp, Homo sapiens
aaggctgggggaagaagctctc

SEQ ID NO: 3805882 - DNA, 22 bp, Homo sapiens
aaggctttcagggcctccagcc

SEQ ID NO: 3805883 - DNA, 20 bp, Homo sapiens
aaggtagatcctgagatgat

SEQ ID NO: 3805884 - DNA, 13 bp, Homo sapiens
aaggtcctgccct

SEQ ID NO: 3805885 - DNA, 18 bp, Homo sapiens
aaggtcgcacctccttgg

SEQ ID NO: 3805886 - DNA, 11 bp, Homo sapiens
aaggtgggagg

SEQ ID NO: 3805887 - DNA, 15 bp, Homo sapiens
aagtaaatagcaaca

SEQ ID NO: 3805888 - DNA, 16 bp, Homo sapiens
aagtagtagtgtcttc

SEQ ID NO: 3805889 - DNA, 22 bp, Homo sapiens
aagtataggataaattacatta

SEQ ID NO: 3805890 - DNA, 21 bp, Homo sapiens
aagtcactggccagtggctgg

SEQ ID NO: 3805891 - DNA, 13 bp, Homo sapiens
aagtctctctgtg

SEQ ID NO: 3805892 - DNA, 14 bp, Homo sapiens
aagtctctctgtga

SEQ ID NO: 3805893 - DNA, 17 bp, Homo sapiens
aagtctctctgtgaata

SEQ ID NO: 3805894 - DNA, 23 bp, Homo sapiens
aagtctctctgtgaatacaatta

SEQ ID NO: 3805895 - DNA, 22 bp, Homo sapiens
aagtcttccctgatcaagtcac

SEQ ID NO: 3805896 - DNA, 17 bp, Homo sapiens
aagtgcagctcaggaga

SEQ ID NO: 3805897 - DNA, 15 bp, Homo sapiens
aataaaacaatgttt

SEQ ID NO: 3805898 - DNA, 22 bp, Homo sapiens
aataaactagggttttggcctg

SEQ ID NO: 3805899 - DNA, 15 bp, Homo sapiens
aataaagcagagcca

SEQ ID NO: 3805900 - DNA, 22 bp, Homo sapiens
aataaagcagagccaaggccac

SEQ ID NO: 3805901 - DNA, 17 bp, Homo sapiens
aataaaggagaagagat

SEQ ID NO: 3805902 - DNA, 20 bp, Homo sapiens
aataaccaattcctcatttg

SEQ ID NO: 3805903 - DNA, 16 bp, Homo sapiens
aataagtgctactttg

SEQ ID NO: 3805904 - DNA, 20 bp, Homo sapiens
aataatacattgaattagaa

SEQ ID NO: 3805905 - DNA, 13 bp, Homo sapiens
aatacaattaaag

SEQ ID NO: 3805906 - DNA, 14 bp, Homo sapiens
aatacaattaaagg

SEQ ID NO: 3805907 - DNA, 15 bp, Homo sapiens
aatacaattaaaggt

SEQ ID NO: 3805908 - DNA, 20 bp, Homo sapiens
aatacagtatctcagggcct

SEQ ID NO: 3805909 - DNA, 17 bp, Homo sapiens
aatacattgaattagaa

SEQ ID NO: 3805910 - DNA, 17 bp, Homo sapiens
aatagcaacatgcttca

SEQ ID NO: 3805911 - DNA, 21 bp, Homo sapiens
aatatctgagaagtgtatata

SEQ ID NO: 3805912 - DNA, 17 bp, Homo sapiens
aatattgttgtttacca

SEQ ID NO: 3805913 - DNA, 13 bp, Homo sapiens
aatcagcctgctc

SEQ ID NO: 3805914 - DNA, 19 bp, Homo sapiens
aatcagcctgctccagctg

SEQ ID NO: 3805915 - DNA, 14 bp, Homo sapiens
aatcaggctttgtc

SEQ ID NO: 3805916 - DNA, 22 bp, Homo sapiens
aatccacgaattcttctggggt

SEQ ID NO: 3805917 - DNA, 17 bp, Homo sapiens
aatccagaaagaaaaaa

SEQ ID NO: 3805918 - DNA, 16 bp, Homo sapiens
aatcctaccaacctct

SEQ ID NO: 3805919 - DNA, 18 bp, Homo sapiens
aatcctaccaacctctga

SEQ ID NO: 3805920 - DNA, 17 bp, Homo sapiens
aatccttgcttatgaca

SEQ ID NO: 3805921 - DNA, 19 bp, Homo sapiens
aatctctttattaaaacag

SEQ ID NO: 3805922 - DNA, 16 bp, Homo sapiens
aatctggcaaagttat

SEQ ID NO: 3805923 - DNA, 19 bp, Homo sapiens
aatctggcaaagttatatt

SEQ ID NO: 3805924 - DNA, 15 bp, Homo sapiens
aatctgtaactgctt

SEQ ID NO: 3805925 - DNA, 16 bp, Homo sapiens
aatcttagctgccaag

SEQ ID NO: 3805926 - DNA, 18 bp, Homo sapiens
aatgaccagtaattgtga

SEQ ID NO: 3805927 - DNA, 15 bp, Homo sapiens
aatgagcctggcaag

SEQ ID NO: 3805928 - DNA, 18 bp, Homo sapiens
aatgaggtccctctagct

SEQ ID NO: 3805929 - DNA, 22 bp, Homo sapiens
aatgatttcatgctatctctgt

SEQ ID NO: 3805930 - DNA, 19 bp, Homo sapiens
aatgcttctgcctcagctt

SEQ ID NO: 3805931 - DNA, 21 bp, Homo sapiens
aatgcttctgcctcagcttcc

SEQ ID NO: 3805932 - DNA, 17 bp, Homo sapiens
aatggccatttgctttt

SEQ ID NO: 3805933 - DNA, 19 bp, Homo sapiens
aatggtgttactaaagtca

SEQ ID NO: 3805934 - DNA, 19 bp, Homo sapiens
aatgtatcatagaaatgta

SEQ ID NO: 3805935 - DNA, 16 bp, Homo sapiens
aatgtcagtatgtgga

SEQ ID NO: 3805936 - DNA, 22 bp, Homo sapiens
aatgtcagtatgtggaagtgtg

SEQ ID NO: 3805937 - DNA, 12 bp, Homo sapiens
aatgtccagctt

SEQ ID NO: 3805938 - DNA, 12 bp, Homo sapiens
aatgtcccagag

SEQ ID NO: 3805939 - DNA, 15 bp, Homo sapiens
aatgtgaaaagaaaa

SEQ ID NO: 3805940 - DNA, 17 bp, Homo sapiens
aatgtgaatgggaaaag

SEQ ID NO: 3805941 - DNA, 21 bp, Homo sapiens
aatgtgattcctttgaagagg

SEQ ID NO: 3805942 - DNA, 23 bp, Homo sapiens
aattaaaccagactctgttgcaa

SEQ ID NO: 3805943 - DNA, 20 bp, Homo sapiens
aattacaaagttcactgttt

SEQ ID NO: 3805944 - DNA, 16 bp, Homo sapiens
aattactggacatatg

SEQ ID NO: 3805945 - DNA, 18 bp, Homo sapiens
aattactgtatataaact

SEQ ID NO: 3805946 - DNA, 17 bp, Homo sapiens
aattcaacctgtgtctt

SEQ ID NO: 3805947 - DNA, 16 bp, Homo sapiens
aattccacaccctcac

SEQ ID NO: 3805948 - DNA, 23 bp, Homo sapiens
aattcctcatttgttcattaaac

SEQ ID NO: 3805949 - DNA, 19 bp, Homo sapiens
aattctgtcactcaccact

SEQ ID NO: 3805950 - DNA, 20 bp, Homo sapiens
aattctgttttgtaaatgta

SEQ ID NO: 3805951 - DNA, 14 bp, Homo sapiens
aattgactgtcact

SEQ ID NO: 3805952 - DNA, 23 bp, Homo sapiens
aattgctcctgcatgcaactaat

SEQ ID NO: 3805953 - DNA, 17 bp, Homo sapiens
aatttcagttctagttg

SEQ ID NO: 3805954 - DNA, 12 bp, Homo sapiens
aatttctgcttg

SEQ ID NO: 3805955 - DNA, 14 bp, Homo sapiens
aatttgaagtaatg

SEQ ID NO: 3805956 - DNA, 14 bp, Homo sapiens
aatttgaggacaac

SEQ ID NO: 3805957 - DNA, 14 bp, Homo sapiens
aattttaaacaaag

SEQ ID NO: 3805958 - DNA, 19 bp, Homo sapiens
aattttactgacagaaatg

SEQ ID NO: 3805959 - DNA, 19 bp, Homo sapiens
aattttctttcatacatta

SEQ ID NO: 3805960 - DNA, 15 bp, Homo sapiens
aattttgtaacgaag

SEQ ID NO: 3805961 - DNA, 16 bp, Homo sapiens
acaaaaagcataaaaa

SEQ ID NO: 3805962 - DNA, 20 bp, Homo sapiens
acaaaacacaggttttttca

SEQ ID NO: 3805963 - DNA, 12 bp, Homo sapiens
acaaaataaaca

SEQ ID NO: 3805964 - DNA, 15 bp, Homo sapiens
acaaaattttgttta

SEQ ID NO: 3805965 - DNA, 15 bp, Homo sapiens
acaaacaaataaata

SEQ ID NO: 3805966 - DNA, 14 bp, Homo sapiens
acaaaccatgcaaa

SEQ ID NO: 3805967 - DNA, 15 bp, Homo sapiens
acaaacgggctcagc

SEQ ID NO: 3805968 - DNA, 18 bp, Homo sapiens
acaaagttcactgtttat

SEQ ID NO: 3805969 - DNA, 18 bp, Homo sapiens
acaaatatttattttctt

SEQ ID NO: 3805970 - DNA, 22 bp, Homo sapiens
acaaatatttattttctttctg

SEQ ID NO: 3805971 - DNA, 23 bp, Homo sapiens
acaaatatttattttctttctgt

SEQ ID NO: 3805972 - DNA, 12 bp, Homo sapiens
acaaatccacga

SEQ ID NO: 3805973 - DNA, 21 bp, Homo sapiens
acaaatctatgccactcagaa

SEQ ID NO: 3805974 - DNA, 20 bp, Homo sapiens
acaacatttttgtacattat

SEQ ID NO: 3805975 - DNA, 16 bp, Homo sapiens
acaacttttaaagaaa

SEQ ID NO: 3805976 - DNA, 23 bp, Homo sapiens
acaagctgcaccctcaggcaggt

SEQ ID NO: 3805977 - DNA, 18 bp, Homo sapiens
acaaggctgaccaagaga

SEQ ID NO: 3805978 - DNA, 13 bp, Homo sapiens
acaagtaagaaaa

SEQ ID NO: 3805979 - DNA, 11 bp, Homo sapiens
acaataaatgc

SEQ ID NO: 3805980 - DNA, 12 bp, Homo sapiens
acaataaatgct

SEQ ID NO: 3805981 - DNA, 21 bp, Homo sapiens
acaataaatgctgaatgaatc

SEQ ID NO: 3805982 - DNA, 15 bp, Homo sapiens
acaatgtttttcata

SEQ ID NO: 3805983 - DNA, 16 bp, Homo sapiens
acacacagagatatgc

SEQ ID NO: 3805984 - DNA, 19 bp, Homo sapiens
acacacagatatacacatg

SEQ ID NO: 3805985 - DNA, 22 bp, Homo sapiens
acacacagatggtcacacagag

SEQ ID NO: 3805986 - DNA, 23 bp, Homo sapiens
acacaccccacaccccagcccac

SEQ ID NO: 3805987 - DNA, 16 bp, Homo sapiens
acacaccgatgtacac

SEQ ID NO: 3805988 - DNA, 23 bp, Homo sapiens
acacacggatgcacacacagatg

SEQ ID NO: 3805989 - DNA, 13 bp, Homo sapiens
acacactcagcag

SEQ ID NO: 3805990 - DNA, 19 bp, Homo sapiens
acacactcagcagccccct

SEQ ID NO: 3805991 - DNA, 23 bp, Homo sapiens
acacagactgcgatttgtcccag

SEQ ID NO: 3805992 - DNA, 17 bp, Homo sapiens
acacagaggaagagcag

SEQ ID NO: 3805993 - DNA, 19 bp, Homo sapiens
acacagcccagacaagatg

SEQ ID NO: 3805994 - DNA, 16 bp, Homo sapiens
acacatatatgtatat

SEQ ID NO: 3805995 - DNA, 19 bp, Homo sapiens
acacccaaagaggtattta

SEQ ID NO: 3805996 - DNA, 11 bp, Homo sapiens
acacccactgg

SEQ ID NO: 3805997 - DNA, 13 bp, Homo sapiens
acacccactggcc

SEQ ID NO: 3805998 - DNA, 11 bp, Homo sapiens
acaccccagcc

SEQ ID NO: 3805999 - DNA, 13 bp, Homo sapiens
acaccccagccca

SEQ ID NO: 3806000 - DNA, 17 bp, Homo sapiens
acacctgccctgccctg

SEQ ID NO: 3806001 - DNA, 14 bp, Homo sapiens
acactaaaaataaa

SEQ ID NO: 3806002 - DNA, 17 bp, Homo sapiens
acactacttgagaaaat

SEQ ID NO: 3806003 - DNA, 22 bp, Homo sapiens
acactagtaccttcagatccta

SEQ ID NO: 3806004 - DNA, 11 bp, Homo sapiens
acactgagccc

SEQ ID NO: 3806005 - DNA, 18 bp, Homo sapiens
acactggcatctccctga

SEQ ID NO: 3806006 - DNA, 16 bp, Homo sapiens
acactgggctcacatt

SEQ ID NO: 3806007 - DNA, 17 bp, Homo sapiens
acactgggctctgagga

SEQ ID NO: 3806008 - DNA, 20 bp, Homo sapiens
acactggtgggcagctgagg

SEQ ID NO: 3806009 - DNA, 12 bp, Homo sapiens
acagaaacaaaa

SEQ ID NO: 3806010 - DNA, 22 bp, Homo sapiens
acagaaacagagagagacagag

SEQ ID NO: 3806011 - DNA, 12 bp, Homo sapiens
acagaagcagga

SEQ ID NO: 3806012 - DNA, 21 bp, Homo sapiens
acagacactcccacttggcat

SEQ ID NO: 3806013 - DNA, 17 bp, Homo sapiens
acagagacagagagaga

SEQ ID NO: 3806014 - DNA, 21 bp, Homo sapiens
acagagcaagtgagaccctgt

SEQ ID NO: 3806015 - DNA, 19 bp, Homo sapiens
acagagccggtttccgtgg

SEQ ID NO: 3806016 - DNA, 14 bp, Homo sapiens
acagaggaagagca

SEQ ID NO: 3806017 - DNA, 18 bp, Homo sapiens
acagaggaagagcaggca

SEQ ID NO: 3806018 - DNA, 13 bp, Homo sapiens
acagaggggcagg

SEQ ID NO: 3806019 - DNA, 17 bp, Homo sapiens
acagatatacacatgga

SEQ ID NO: 3806020 - DNA, 21 bp, Homo sapiens
acagatgcacacacagatgca

SEQ ID NO: 3806021 - DNA, 19 bp, Homo sapiens
acagatggtcacacagaga

SEQ ID NO: 3806022 - DNA, 17 bp, Homo sapiens
acagcaattcctcaggc

SEQ ID NO: 3806023 - DNA, 19 bp, Homo sapiens
acagcctgggaccagggca

SEQ ID NO: 3806024 - DNA, 12 bp, Homo sapiens
acagcgcctcct

SEQ ID NO: 3806025 - DNA, 19 bp, Homo sapiens
acaggcatgagccaccatg

SEQ ID NO: 3806026 - DNA, 22 bp, Homo sapiens
acaggcccaagagatgaagagt

SEQ ID NO: 3806027 - DNA, 17 bp, Homo sapiens
acaggggcaccctccaa

SEQ ID NO: 3806028 - DNA, 18 bp, Homo sapiens
acaggtaaactatcttgg

SEQ ID NO: 3806029 - DNA, 16 bp, Homo sapiens
acagtcctcacagcct

SEQ ID NO: 3806030 - DNA, 18 bp, Homo sapiens
acagtcctcacagcctct

SEQ ID NO: 3806031 - DNA, 20 bp, Homo sapiens
acagtgctgaccagacagcc

SEQ ID NO: 3806032 - DNA, 16 bp, Homo sapiens
acagtgtttcctgagt

SEQ ID NO: 3806033 - DNA, 16 bp, Homo sapiens
acagttcaagaaagct

SEQ ID NO: 3806034 - DNA, 15 bp, Homo sapiens
acatagttatttatt

SEQ ID NO: 3806035 - DNA, 12 bp, Homo sapiens
acatataaaagt

SEQ ID NO: 3806036 - DNA, 14 bp, Homo sapiens
acatataaaagtta

SEQ ID NO: 3806037 - DNA, 22 bp, Homo sapiens
acatataaaagttaaactactt

SEQ ID NO: 3806038 - DNA, 14 bp, Homo sapiens
acatccaaggagaa

SEQ ID NO: 3806039 - DNA, 13 bp, Homo sapiens
acatgaaacagaa

SEQ ID NO: 3806040 - DNA, 16 bp, Homo sapiens
acatgcttgaataact

SEQ ID NO: 3806041 - DNA, 14 bp, Homo sapiens
acatggcctttgct

SEQ ID NO: 3806042 - DNA, 13 bp, Homo sapiens
acattatgttatt

SEQ ID NO: 3806043 - DNA, 17 bp, Homo sapiens
acattatgttattggaa

SEQ ID NO: 3806044 - DNA, 21 bp, Homo sapiens
acattatgttattggaatttt

SEQ ID NO: 3806045 - DNA, 23 bp, Homo sapiens
acattatgttattggaattttct

SEQ ID NO: 3806046 - DNA, 14 bp, Homo sapiens
acattgaaagctct

SEQ ID NO: 3806047 - DNA, 18 bp, Homo sapiens
acattgaattagaaacat

SEQ ID NO: 3806048 - DNA, 18 bp, Homo sapiens
acatttttgtacattatg

SEQ ID NO: 3806049 - DNA, 20 bp, Homo sapiens
acatttttgtacattatgtt

SEQ ID NO: 3806050 - DNA, 15 bp, Homo sapiens
accaagagagaaaga

SEQ ID NO: 3806051 - DNA, 23 bp, Homo sapiens
accaagttggaacatccttggaa

SEQ ID NO: 3806052 - DNA, 16 bp, Homo sapiens
accacacctccctgaa

SEQ ID NO: 3806053 - DNA, 14 bp, Homo sapiens
accacattgcctca

SEQ ID NO: 3806054 - DNA, 15 bp, Homo sapiens
accacattgcctcat

SEQ ID NO: 3806055 - DNA, 19 bp, Homo sapiens
accactagggtcctggccc

SEQ ID NO: 3806056 - DNA, 17 bp, Homo sapiens
accactgcactccagcc

SEQ ID NO: 3806057 - DNA, 14 bp, Homo sapiens
accacttcagctga

SEQ ID NO: 3806058 - DNA, 13 bp, Homo sapiens
accacttccctgc

SEQ ID NO: 3806059 - DNA, 23 bp, Homo sapiens
accagaattgcttgaacccagga

SEQ ID NO: 3806060 - DNA, 20 bp, Homo sapiens
accagagccccacacggagg

SEQ ID NO: 3806061 - DNA, 20 bp, Homo sapiens
accagccctgctgcttccta

SEQ ID NO: 3806062 - DNA, 21 bp, Homo sapiens
accagccctgctgcttcctaa

SEQ ID NO: 3806063 - DNA, 23 bp, Homo sapiens
accagccctgctgcttcctaact

SEQ ID NO: 3806064 - DNA, 15 bp, Homo sapiens
accagccgccccagc

SEQ ID NO: 3806065 - DNA, 22 bp, Homo sapiens
accagcgtgtgactactccccc

SEQ ID NO: 3806066 - DNA, 13 bp, Homo sapiens
accaggccccagc

SEQ ID NO: 3806067 - DNA, 22 bp, Homo sapiens
accagggcatattaaaggcttt

SEQ ID NO: 3806068 - DNA, 20 bp, Homo sapiens
accagggtgagttaaagaga

SEQ ID NO: 3806069 - DNA, 13 bp, Homo sapiens
accatgaaaaata

SEQ ID NO: 3806070 - DNA, 13 bp, Homo sapiens
accatgaagctgg

SEQ ID NO: 3806071 - DNA, 16 bp, Homo sapiens
accatgcaaatgctat

SEQ ID NO: 3806072 - DNA, 15 bp, Homo sapiens
accatgcacccctga

SEQ ID NO: 3806073 - DNA, 14 bp, Homo sapiens
accattctcctgcc

SEQ ID NO: 3806074 - DNA, 20 bp, Homo sapiens
accattgtcttccaacccca

SEQ ID NO: 3806075 - DNA, 13 bp, Homo sapiens
acccactctttgc

SEQ ID NO: 3806076 - DNA, 17 bp, Homo sapiens
acccactctttgctaca

SEQ ID NO: 3806077 - DNA, 17 bp, Homo sapiens
acccactggccagtcct

SEQ ID NO: 3806078 - DNA, 23 bp, Homo sapiens
acccactggccagtcctagagct

SEQ ID NO: 3806079 - DNA, 15 bp, Homo sapiens
acccagcctgagtgc

SEQ ID NO: 3806080 - DNA, 22 bp, Homo sapiens
acccagctatggttctctcgca

SEQ ID NO: 3806081 - DNA, 16 bp, Homo sapiens
accccacaccccagcc

SEQ ID NO: 3806082 - DNA, 16 bp, Homo sapiens
accccagacctctgaa

SEQ ID NO: 3806083 - DNA, 16 bp, Homo sapiens
accccagcccaccctg

SEQ ID NO: 3806084 - DNA, 12 bp, Homo sapiens
accccagctggc

SEQ ID NO: 3806085 - DNA, 18 bp, Homo sapiens
accccatctctacaaaaa

SEQ ID NO: 3806086 - DNA, 16 bp, Homo sapiens
acccccagctttgcta

SEQ ID NO: 3806087 - DNA, 20 bp, Homo sapiens
acccctcaacacctctgcac

SEQ ID NO: 3806088 - DNA, 19 bp, Homo sapiens
acccgacaccagccctgct

SEQ ID NO: 3806089 - DNA, 20 bp, Homo sapiens
accctacagacagtatgtct

SEQ ID NO: 3806090 - DNA, 19 bp, Homo sapiens
accctattgctgcttgagg

SEQ ID NO: 3806091 - DNA, 16 bp, Homo sapiens
accctgaaagccctga

SEQ ID NO: 3806092 - DNA, 21 bp, Homo sapiens
accctgctcctcctgccctgt

SEQ ID NO: 3806093 - DNA, 17 bp, Homo sapiens
accgccaaggctggggg

SEQ ID NO: 3806094 - DNA, 22 bp, Homo sapiens
acctactttttctttgattttc

SEQ ID NO: 3806095 - DNA, 20 bp, Homo sapiens
acctcccacaaaggagagct

SEQ ID NO: 3806096 - DNA, 20 bp, Homo sapiens
acctccctgaaccatccctg

SEQ ID NO: 3806097 - DNA, 22 bp, Homo sapiens
acctcgtgatttgcctgcctgg

SEQ ID NO: 3806098 - DNA, 19 bp, Homo sapiens
acctcgttactctcacctc

SEQ ID NO: 3806099 - DNA, 24 bp, Homo sapiens
acctctgaatgtcccagaggctag

SEQ ID NO: 3806100 - DNA, 21 bp, Homo sapiens
acctctgcacaagctgcaccc

SEQ ID NO: 3806101 - DNA, 12 bp, Homo sapiens
acctgaaaagat

SEQ ID NO: 3806102 - DNA, 20 bp, Homo sapiens
acctgcacgtgatctgctgg

SEQ ID NO: 3806103 - DNA, 17 bp, Homo sapiens
acctgccctgccctgcc

SEQ ID NO: 3806104 - DNA, 18 bp, Homo sapiens
acctgccctgccctgcca

SEQ ID NO: 3806105 - DNA, 20 bp, Homo sapiens
acctgccctgccctgccacc

SEQ ID NO: 3806106 - DNA, 23 bp, Homo sapiens
acctgccctgccctgccacctgt

SEQ ID NO: 3806107 - DNA, 16 bp, Homo sapiens
acctgccgagagtcca

SEQ ID NO: 3806108 - DNA, 17 bp, Homo sapiens
acctgcctgttctccag

SEQ ID NO: 3806109 - DNA, 21 bp, Homo sapiens
acctgggcatactaataaagt

SEQ ID NO: 3806110 - DNA, 21 bp, Homo sapiens
acctgggtaactagggaagat

SEQ ID NO: 3806111 - DNA, 17 bp, Homo sapiens
acctgtatgtctccagt

SEQ ID NO: 3806112 - DNA, 15 bp, Homo sapiens
acctgtccataaagt

SEQ ID NO: 3806113 - DNA, 18 bp, Homo sapiens
acctgtctgtctgtctgt

SEQ ID NO: 3806114 - DNA, 22 bp, Homo sapiens
accttagctggcattacagctg

SEQ ID NO: 3806115 - DNA, 12 bp, Homo sapiens
accttctccagg

SEQ ID NO: 3806116 - DNA, 15 bp, Homo sapiens
accttctgtggctgt

SEQ ID NO: 3806117 - DNA, 20 bp, Homo sapiens
acgcgtatctaggctttggt

SEQ ID NO: 3806118 - DNA, 19 bp, Homo sapiens
acggaaaatgccaatctct

SEQ ID NO: 3806119 - DNA, 19 bp, Homo sapiens
acggacactcaaaagctgg

SEQ ID NO: 3806120 - DNA, 16 bp, Homo sapiens
acggatgcacacacag

SEQ ID NO: 3806121 - DNA, 13 bp, Homo sapiens
acggcactccagc

SEQ ID NO: 3806122 - DNA, 20 bp, Homo sapiens
acggcactccagcctgggcg

SEQ ID NO: 3806123 - DNA, 22 bp, Homo sapiens
acggctgcctgacactgagccc

SEQ ID NO: 3806124 - DNA, 18 bp, Homo sapiens
acggcttttacttaaacc

SEQ ID NO: 3806125 - DNA, 21 bp, Homo sapiens
acgtcactggaccactgggca

SEQ ID NO: 3806126 - DNA, 14 bp, Homo sapiens
acgttgttaaatgg

SEQ ID NO: 3806127 - DNA, 18 bp, Homo sapiens
acgtttgactagccatct

SEQ ID NO: 3806128 - DNA, 16 bp, Homo sapiens
actaagctttctcctt

SEQ ID NO: 3806129 - DNA, 19 bp, Homo sapiens
actaatagagacacagaga

SEQ ID NO: 3806130 - DNA, 20 bp, Homo sapiens
actacctttgtccaggcctg

SEQ ID NO: 3806131 - DNA, 15 bp, Homo sapiens
actactactctgcca

SEQ ID NO: 3806132 - DNA, 14 bp, Homo sapiens
actactctgccaat

SEQ ID NO: 3806133 - DNA, 20 bp, Homo sapiens
actagattctcacctgcctt

SEQ ID NO: 3806134 - DNA, 17 bp, Homo sapiens
actagggaagataatat

SEQ ID NO: 3806135 - DNA, 17 bp, Homo sapiens
actagggttttggcctg

SEQ ID NO: 3806136 - DNA, 18 bp, Homo sapiens
actcaaaagctgggcagg

SEQ ID NO: 3806137 - DNA, 17 bp, Homo sapiens
actcaaaatatttgtac

SEQ ID NO: 3806138 - DNA, 19 bp, Homo sapiens
actcaaaatatttgtacat

SEQ ID NO: 3806139 - DNA, 17 bp, Homo sapiens
actcactgccaaaaata

SEQ ID NO: 3806140 - DNA, 13 bp, Homo sapiens
actcagcaccaca

SEQ ID NO: 3806141 - DNA, 16 bp, Homo sapiens
actcatgtgactcttt

SEQ ID NO: 3806142 - DNA, 20 bp, Homo sapiens
actccatgtgtgctgtcctc

SEQ ID NO: 3806143 - DNA, 15 bp, Homo sapiens
actccgcccagcctc

SEQ ID NO: 3806144 - DNA, 18 bp, Homo sapiens
actccgcccagcctctcc

SEQ ID NO: 3806145 - DNA, 22 bp, Homo sapiens
actccgcccagcctctccccgc

SEQ ID NO: 3806146 - DNA, 18 bp, Homo sapiens
actcctcacagcatctct

SEQ ID NO: 3806147 - DNA, 22 bp, Homo sapiens
actcgtgtctggcacagcctgg

SEQ ID NO: 3806148 - DNA, 17 bp, Homo sapiens
actctaacactcgactc

SEQ ID NO: 3806149 - DNA, 18 bp, Homo sapiens
actctaccctcttagaaa

SEQ ID NO: 3806150 - DNA, 21 bp, Homo sapiens
actctaccctcttagaaaaac

SEQ ID NO: 3806151 - DNA, 15 bp, Homo sapiens
actctagggaaaaac

SEQ ID NO: 3806152 - DNA, 14 bp, Homo sapiens
actctcacctcgtg

SEQ ID NO: 3806153 - DNA, 21 bp, Homo sapiens
actctcacctcgtgatatcca

SEQ ID NO: 3806154 - DNA, 22 bp, Homo sapiens
actctgcaggaaatcagagctg

SEQ ID NO: 3806155 - DNA, 13 bp, Homo sapiens
actctgcaggcag

SEQ ID NO: 3806156 - DNA, 11 bp, Homo sapiens
actctgccaat

SEQ ID NO: 3806157 - DNA, 16 bp, Homo sapiens
ttagctggcattacag

SEQ ID NO: 3806158 - DNA, 18 bp, Homo sapiens
ttaggttggcaaaaaggc

SEQ ID NO: 3806159 - DNA, 14 bp, Homo sapiens
ttatcattctgctt

SEQ ID NO: 3806160 - DNA, 17 bp, Homo sapiens
ttatcctgaaatttcag

SEQ ID NO: 3806161 - DNA, 16 bp, Homo sapiens
ttatgccacctgaata

SEQ ID NO: 3806162 - DNA, 17 bp, Homo sapiens
ttatgccttgctatttt

SEQ ID NO: 3806163 - DNA, 17 bp, Homo sapiens
ttatgggatgtaaacaa

SEQ ID NO: 3806164 - DNA, 16 bp, Homo sapiens
ttatgtgatataaaat

SEQ ID NO: 3806165 - DNA, 15 bp, Homo sapiens
ttatttatttatgga

SEQ ID NO: 3806166 - DNA, 15 bp, Homo sapiens
ttattttacaaattg

SEQ ID NO: 3806167 - DNA, 14 bp, Homo sapiens
ttatttttcaagta

SEQ ID NO: 3806168 - DNA, 23 bp, Homo sapiens
ttatttttgacagtgttgaaaat

SEQ ID NO: 3806169 - DNA, 22 bp, Homo sapiens
ttatttttttgatggctaagat

SEQ ID NO: 3806170 - DNA, 22 bp, Homo sapiens
ttcaaagagactaatagagaca

SEQ ID NO: 3806171 - DNA, 12 bp, Homo sapiens
ttcaagaaactg

SEQ ID NO: 3806172 - DNA, 23 bp, Homo sapiens
ttcaagaaactgaggaattttct

SEQ ID NO: 3806173 - DNA, 19 bp, Homo sapiens
ttcaagtaataaaacaatg

SEQ ID NO: 3806174 - DNA, 14 bp, Homo sapiens
ttcacagcgcctcc

SEQ ID NO: 3806175 - DNA, 18 bp, Homo sapiens
ttcacagcgcctcctgga

SEQ ID NO: 3806176 - DNA, 14 bp, Homo sapiens
ttcaccagaagtta

SEQ ID NO: 3806177 - DNA, 18 bp, Homo sapiens
ttcaccagatttgctaat

SEQ ID NO: 3806178 - DNA, 19 bp, Homo sapiens
ttcaccgtattagccagga

SEQ ID NO: 3806179 - DNA, 13 bp, Homo sapiens
ttcacggaagagc

SEQ ID NO: 3806180 - DNA, 17 bp, Homo sapiens
ttcacggaagagccttg

SEQ ID NO: 3806181 - DNA, 15 bp, Homo sapiens
ttcactgtagaatga

SEQ ID NO: 3806182 - DNA, 22 bp, Homo sapiens
ttcagaagacacaggggagcag

SEQ ID NO: 3806183 - DNA, 22 bp, Homo sapiens
ttcagaattgaaggagaaaatg

SEQ ID NO: 3806184 - DNA, 23 bp, Homo sapiens
ttcagagtcctcattataaaatg

SEQ ID NO: 3806185 - DNA, 12 bp, Homo sapiens
ttcagatcctac

SEQ ID NO: 3806186 - DNA, 22 bp, Homo sapiens
ttcagattcccagagcaaaata

SEQ ID NO: 3806187 - DNA, 14 bp, Homo sapiens
ttcagctaagctag

SEQ ID NO: 3806188 - DNA, 18 bp, Homo sapiens
ttcagctattagcaactg

SEQ ID NO: 3806189 - DNA, 17 bp, Homo sapiens
ttcagctctgcaagaat

SEQ ID NO: 3806190 - DNA, 17 bp, Homo sapiens
ttcagctgacttttctg

SEQ ID NO: 3806191 - DNA, 16 bp, Homo sapiens
ttcatacattatattc

SEQ ID NO: 3806192 - DNA, 18 bp, Homo sapiens
ttcatatatgaggacttg

SEQ ID NO: 3806193 - DNA, 20 bp, Homo sapiens
ttcatcttccaactcaaact

SEQ ID NO: 3806194 - DNA, 16 bp, Homo sapiens
ttcatgaaaatcctac

SEQ ID NO: 3806195 - DNA, 20 bp, Homo sapiens
ttcatgcattctagtgcaga

SEQ ID NO: 3806196 - DNA, 14 bp, Homo sapiens
ttcattcaaaatgt

SEQ ID NO: 3806197 - DNA, 19 bp, Homo sapiens
ttcattcaaaatgtccagc

SEQ ID NO: 3806198 - DNA, 14 bp, Homo sapiens
ttccaaatcaggct

SEQ ID NO: 3806199 - DNA, 13 bp, Homo sapiens
ttccaaccccagc

SEQ ID NO: 3806200 - DNA, 14 bp, Homo sapiens
ttccaaccccagct

SEQ ID NO: 3806201 - DNA, 15 bp, Homo sapiens
ttccaaccccagctg

SEQ ID NO: 3806202 - DNA, 20 bp, Homo sapiens
ttccaaccccagctggcctc

SEQ ID NO: 3806203 - DNA, 21 bp, Homo sapiens
ttccaattttctggaatacat

SEQ ID NO: 3806204 - DNA, 19 bp, Homo sapiens
ttccagaggctattatttt

SEQ ID NO: 3806205 - DNA, 14 bp, Homo sapiens
ttccagatgtggat

SEQ ID NO: 3806206 - DNA, 14 bp, Homo sapiens
ttccagattgttct

SEQ ID NO: 3806207 - DNA, 18 bp, Homo sapiens
ttccaggtttaagctgtt

SEQ ID NO: 3806208 - DNA, 22 bp, Homo sapiens
ttccataataaacttctggtgt

SEQ ID NO: 3806209 - DNA, 19 bp, Homo sapiens
ttcccactaagctttctcc

SEQ ID NO: 3806210 - DNA, 21 bp, Homo sapiens
ttcccactaagctttctcctt

SEQ ID NO: 3806211 - DNA, 23 bp, Homo sapiens
ttcccagagcaaaataattttaa

SEQ ID NO: 3806212 - DNA, 18 bp, Homo sapiens
ttccccaacgaaaagcac

SEQ ID NO: 3806213 - DNA, 17 bp, Homo sapiens
ttcccccaaggctgatg

SEQ ID NO: 3806214 - DNA, 21 bp, Homo sapiens
ttcccccaaggctgatgcatt

SEQ ID NO: 3806215 - DNA, 18 bp, Homo sapiens
ttcccggtgcagaacagg

SEQ ID NO: 3806216 - DNA, 18 bp, Homo sapiens
ttccgtgacgtcactgga

SEQ ID NO: 3806217 - DNA, 11 bp, Homo sapiens
ttcctaactta

SEQ ID NO: 3806218 - DNA, 13 bp, Homo sapiens
ttcctaacttatt

SEQ ID NO: 3806219 - DNA, 14 bp, Homo sapiens
ttcctagtatatta

SEQ ID NO: 3806220 - DNA, 15 bp, Homo sapiens
ttcctagttttctcc

SEQ ID NO: 3806221 - DNA, 13 bp, Homo sapiens
ttcctcattagca

SEQ ID NO: 3806222 - DNA, 20 bp, Homo sapiens
ttcctcatttgttcattaaa

SEQ ID NO: 3806223 - DNA, 13 bp, Homo sapiens
ttcctctgcattt

SEQ ID NO: 3806224 - DNA, 20 bp, Homo sapiens
ttccttttgcaacaagacaa

SEQ ID NO: 3806225 - DNA, 22 bp, Homo sapiens
ttcgccgtctggcgagccctta

SEQ ID NO: 3806226 - DNA, 11 bp, Homo sapiens
ttcgctgggga

SEQ ID NO: 3806227 - DNA, 19 bp, Homo sapiens
ttctacacatatatgtata

SEQ ID NO: 3806228 - DNA, 14 bp, Homo sapiens
ttctaccatttcag

SEQ ID NO: 3806229 - DNA, 15 bp, Homo sapiens
ttctaccatttcaga

SEQ ID NO: 3806230 - DNA, 13 bp, Homo sapiens
ttctacgccaggg

SEQ ID NO: 3806231 - DNA, 21 bp, Homo sapiens
ttctagagagggaattctctt

SEQ ID NO: 3806232 - DNA, 15 bp, Homo sapiens
ttctagttctgccag

SEQ ID NO: 3806233 - DNA, 22 bp, Homo sapiens
ttctagttgattgcgagaattt

SEQ ID NO: 3806234 - DNA, 14 bp, Homo sapiens
ttctcacctgcctt

SEQ ID NO: 3806235 - DNA, 21 bp, Homo sapiens
ttctcactgccatgccagctt

SEQ ID NO: 3806236 - DNA, 18 bp, Homo sapiens
ttctccaacaagttgcct

SEQ ID NO: 3806237 - DNA, 21 bp, Homo sapiens
ttctccacctcccacaaagga

SEQ ID NO: 3806238 - DNA, 15 bp, Homo sapiens
ttctcgacttcagga

SEQ ID NO: 3806239 - DNA, 17 bp, Homo sapiens
ttctctactctagggaa

SEQ ID NO: 3806240 - DNA, 16 bp, Homo sapiens
ttctcttggctggctt

SEQ ID NO: 3806241 - DNA, 14 bp, Homo sapiens
ttctcttgtctggc

SEQ ID NO: 3806242 - DNA, 17 bp, Homo sapiens
ttctcttgtctggctgc

SEQ ID NO: 3806243 - DNA, 14 bp, Homo sapiens
ttctctttaaaata

SEQ ID NO: 3806244 - DNA, 19 bp, Homo sapiens
ttctctttaaaatatttgt

SEQ ID NO: 3806245 - DNA, 14 bp, Homo sapiens
ttctgaccatttca

SEQ ID NO: 3806246 - DNA, 17 bp, Homo sapiens
ttctggaatacatgaaa

SEQ ID NO: 3806247 - DNA, 18 bp, Homo sapiens
ttctgtccagtttccaaa

SEQ ID NO: 3806248 - DNA, 15 bp, Homo sapiens
ttcttacctgtatgt

SEQ ID NO: 3806249 - DNA, 12 bp, Homo sapiens
ttcttatgagct

SEQ ID NO: 3806250 - DNA, 14 bp, Homo sapiens
ttcttcctctgcat

SEQ ID NO: 3806251 - DNA, 19 bp, Homo sapiens
ttctttccaaaatcaggct

SEQ ID NO: 3806252 - DNA, 12 bp, Homo sapiens
ttctttgtgtag

SEQ ID NO: 3806253 - DNA, 19 bp, Homo sapiens
ttctttgtgtagctttgct

SEQ ID NO: 3806254 - DNA, 19 bp, Homo sapiens
ttcttttgttttcttcatt

SEQ ID NO: 3806255 - DNA, 20 bp, Homo sapiens
ttcttttgttttcttcattt

SEQ ID NO: 3806256 - DNA, 22 bp, Homo sapiens
ttgaagaggaaaatgaataata

SEQ ID NO: 3806257 - DNA, 22 bp, Homo sapiens
ttgacagagttggtgttcataa

SEQ ID NO: 3806258 - DNA, 16 bp, Homo sapiens
ttgacctctataaact

SEQ ID NO: 3806259 - DNA, 21 bp, Homo sapiens
ttgactagccatctcaagcaa

SEQ ID NO: 3806260 - DNA, 23 bp, Homo sapiens
ttgagatggagtctcgctctgct

SEQ ID NO: 3806261 - DNA, 14 bp, Homo sapiens
ttgagcctgggagg

SEQ ID NO: 3806262 - DNA, 16 bp, Homo sapiens
ttgaggacacatgtcc

SEQ ID NO: 3806263 - DNA, 22 bp, Homo sapiens
ttgatctaatgaagtgtttcct

SEQ ID NO: 3806264 - DNA, 20 bp, Homo sapiens
ttgatgaaacgtcatgtgtt

SEQ ID NO: 3806265 - DNA, 15 bp, Homo sapiens
ttgcaccactgcact

SEQ ID NO: 3806266 - DNA, 18 bp, Homo sapiens
ttgcaccactgcactcca

SEQ ID NO: 3806267 - DNA, 22 bp, Homo sapiens
ttgcacctacgggggcatctga

SEQ ID NO: 3806268 - DNA, 15 bp, Homo sapiens
ttgcctgcctgggcc

SEQ ID NO: 3806269 - DNA, 15 bp, Homo sapiens
ttgcctgggcagtgc

SEQ ID NO: 3806270 - DNA, 15 bp, Homo sapiens
ttgctacaataaatg

SEQ ID NO: 3806271 - DNA, 19 bp, Homo sapiens
ttgctacaataaatgctga

SEQ ID NO: 3806272 - DNA, 22 bp, Homo sapiens
ttgctgactactactctgccaa

SEQ ID NO: 3806273 - DNA, 23 bp, Homo sapiens
ttggaattttctttcatacatta

SEQ ID NO: 3806274 - DNA, 20 bp, Homo sapiens
ttggagataatctagaacac

SEQ ID NO: 3806275 - DNA, 18 bp, Homo sapiens
ttggatcctactcaacaa

SEQ ID NO: 3806276 - DNA, 20 bp, Homo sapiens
ttggatcctactcaacaaaa

SEQ ID NO: 3806277 - DNA, 17 bp, Homo sapiens
ttggcaaaaaggcagga

SEQ ID NO: 3806278 - DNA, 22 bp, Homo sapiens
ttggctttgggttgcaggacct

SEQ ID NO: 3806279 - DNA, 15 bp, Homo sapiens
ttgggggcttccctg

SEQ ID NO: 3806280 - DNA, 12 bp, Homo sapiens
ttgtacaaaata

SEQ ID NO: 3806281 - DNA, 20 bp, Homo sapiens
ttgtccggtggaaggccttc

SEQ ID NO: 3806282 - DNA, 14 bp, Homo sapiens
ttgtctgctcccaa

SEQ ID NO: 3806283 - DNA, 22 bp, Homo sapiens
ttgtcttaaaaagtggaaaaat

SEQ ID NO: 3806284 - DNA, 13 bp, Homo sapiens
ttgtcttccaacc

SEQ ID NO: 3806285 - DNA, 18 bp, Homo sapiens
ttgtcttccaaccccagc

SEQ ID NO: 3806286 - DNA, 21 bp, Homo sapiens
ttgtggaattgggagcttggg

SEQ ID NO: 3806287 - DNA, 10 bp, Homo sapiens
ttgtgtgtgg

SEQ ID NO: 3806288 - DNA, 16 bp, Homo sapiens
ttgtgtgtgggagtgt

SEQ ID NO: 3806289 - DNA, 16 bp, Homo sapiens
ttgttttgtgcagaga

SEQ ID NO: 3806290 - DNA, 21 bp, Homo sapiens
tttaaaaaaaatagaagctat

SEQ ID NO: 3806291 - DNA, 22 bp, Homo sapiens
tttaaaaaaagtatatattcta

SEQ ID NO: 3806292 - DNA, 20 bp, Homo sapiens
tttaaaactcagaatataac

SEQ ID NO: 3806293 - DNA, 23 bp, Homo sapiens
tttaaaactcagaatataacatg

SEQ ID NO: 3806294 - DNA, 21 bp, Homo sapiens
tttaatatctgagaagtgtat

SEQ ID NO: 3806295 - DNA, 17 bp, Homo sapiens
tttactgattccagcaa

SEQ ID NO: 3806296 - DNA, 13 bp, Homo sapiens
tttactgtcccag

SEQ ID NO: 3806297 - DNA, 11 bp, Homo sapiens
tttacttaaac

SEQ ID NO: 3806298 - DNA, 19 bp, Homo sapiens
tttagaccctattgctgct

SEQ ID NO: 3806299 - DNA, 23 bp, Homo sapiens
tttagttcaatatttgttactgt

SEQ ID NO: 3806300 - DNA, 17 bp, Homo sapiens
tttatccgtagttttga

SEQ ID NO: 3806301 - DNA, 18 bp, Homo sapiens
tttatcctgaaatttcag

SEQ ID NO: 3806302 - DNA, 11 bp, Homo sapiens
tttatgtgtgt

SEQ ID NO: 3806303 - DNA, 22 bp, Homo sapiens
tttatttttttgatggctaaga

SEQ ID NO: 3806304 - DNA, 14 bp, Homo sapiens
tttcaaagaaggaa

SEQ ID NO: 3806305 - DNA, 14 bp, Homo sapiens
tttcaaataaggaa

SEQ ID NO: 3806306 - DNA, 19 bp, Homo sapiens
tttcaagaaactgaggaat

SEQ ID NO: 3806307 - DNA, 15 bp, Homo sapiens
tttcaagtaataaaa

SEQ ID NO: 3806308 - DNA, 16 bp, Homo sapiens
tttcaataaatttctg

SEQ ID NO: 3806309 - DNA, 20 bp, Homo sapiens
tttcagattcccagagcaaa

SEQ ID NO: 3806310 - DNA, 21 bp, Homo sapiens
tttcagctattagcaactgtg

SEQ ID NO: 3806311 - DNA, 12 bp, Homo sapiens
tttcatacatta

SEQ ID NO: 3806312 - DNA, 19 bp, Homo sapiens
tttccaaccggctttgtgg

SEQ ID NO: 3806313 - DNA, 14 bp, Homo sapiens
tttccacataaagg

SEQ ID NO: 3806314 - DNA, 22 bp, Homo sapiens
tttccctcccaacagagctggg

SEQ ID NO: 3806315 - DNA, 22 bp, Homo sapiens
tttctaaagctctgaacaaaag

SEQ ID NO: 3806316 - DNA, 16 bp, Homo sapiens
tttctaccatttcaga

SEQ ID NO: 3806317 - DNA, 19 bp, Homo sapiens
tttctgaagtacttaaact

SEQ ID NO: 3806318 - DNA, 22 bp, Homo sapiens
tttctgctccaaattttcaata

SEQ ID NO: 3806319 - DNA, 19 bp, Homo sapiens
tttgacagtgttgaaaatg

SEQ ID NO: 3806320 - DNA, 14 bp, Homo sapiens
tttgacttggaaaa

SEQ ID NO: 3806321 - DNA, 16 bp, Homo sapiens
tttgagatcagcctgg

SEQ ID NO: 3806322 - DNA, 18 bp, Homo sapiens
tttgcacccatgccatag

SEQ ID NO: 3806323 - DNA, 16 bp, Homo sapiens
tttgcattagacagat

SEQ ID NO: 3806324 - DNA, 12 bp, Homo sapiens
tttgcattgtgt

SEQ ID NO: 3806325 - DNA, 18 bp, Homo sapiens
tttgcattgtgtcagaaa

SEQ ID NO: 3806326 - DNA, 14 bp, Homo sapiens
tttgcctgcctggg

SEQ ID NO: 3806327 - DNA, 12 bp, Homo sapiens
tttgctacaata

SEQ ID NO: 3806328 - DNA, 19 bp, Homo sapiens
tttgctatgagctggggat

SEQ ID NO: 3806329 - DNA, 23 bp, Homo sapiens
tttggcagcaaagtgtcagtgtt

SEQ ID NO: 3806330 - DNA, 22 bp, Homo sapiens
tttgggaggccaaggtgggagg

SEQ ID NO: 3806331 - DNA, 15 bp, Homo sapiens
tttgggggcttccct

SEQ ID NO: 3806332 - DNA, 17 bp, Homo sapiens
tttgtaaatttatgtga

SEQ ID NO: 3806333 - DNA, 15 bp, Homo sapiens
tttgtacattatgtt

SEQ ID NO: 3806334 - DNA, 15 bp, Homo sapiens
tttgtactgaaaaat

SEQ ID NO: 3806335 - DNA, 22 bp, Homo sapiens
tttgtagtgatttttatgccac

SEQ ID NO: 3806336 - DNA, 14 bp, Homo sapiens
tttgtcttaaaaag

SEQ ID NO: 3806337 - DNA, 15 bp, Homo sapiens
tttgtgtgaaataat

SEQ ID NO: 3806338 - DNA, 19 bp, Homo sapiens
ttttaaatgcataaatgca

SEQ ID NO: 3806339 - DNA, 19 bp, Homo sapiens
ttttaataaagattctatt

SEQ ID NO: 3806340 - DNA, 20 bp, Homo sapiens
ttttatatgatgggggaaaa

SEQ ID NO: 3806341 - DNA, 15 bp, Homo sapiens
ttttatgatgctatt

SEQ ID NO: 3806342 - DNA, 20 bp, Homo sapiens
ttttatttccacataaaggt

SEQ ID NO: 3806343 - DNA, 15 bp, Homo sapiens
ttttcaagaaactga

SEQ ID NO: 3806344 - DNA, 16 bp, Homo sapiens
ttttcactgtagaatg

SEQ ID NO: 3806345 - DNA, 17 bp, Homo sapiens
ttttctggaatacatga

SEQ ID NO: 3806346 - DNA, 13 bp, Homo sapiens
ttttctttccaaa

SEQ ID NO: 3806347 - DNA, 13 bp, Homo sapiens
ttttctttgattt

SEQ ID NO: 3806348 - DNA, 15 bp, Homo sapiens
ttttctttgattttc

SEQ ID NO: 3806349 - DNA, 19 bp, Homo sapiens
ttttgaaaaaagtatagga

SEQ ID NO: 3806350 - DNA, 21 bp, Homo sapiens
ttttgaagaagttcttaaata

SEQ ID NO: 3806351 - DNA, 19 bp, Homo sapiens
ttttgacagtgttgaaaat

SEQ ID NO: 3806352 - DNA, 23 bp, Homo sapiens
ttttgacagtgttgaaaatgttc

SEQ ID NO: 3806353 - DNA, 13 bp, Homo sapiens
ttttgataaaaga

SEQ ID NO: 3806354 - DNA, 13 bp, Homo sapiens
ttttgatggctaa

SEQ ID NO: 3806355 - DNA, 15 bp, Homo sapiens
ttttgctcttctgta

SEQ ID NO: 3806356 - DNA, 16 bp, Homo sapiens
ttttgctcttctgtat

SEQ ID NO: 3806357 - DNA, 13 bp, Homo sapiens
ttttgtacattat

SEQ ID NO: 3806358 - DNA, 17 bp, Homo sapiens
ttttgtacattatgtta

SEQ ID NO: 3806359 - DNA, 17 bp, Homo sapiens
ttttgtttaaaactcag

SEQ ID NO: 3806360 - DNA, 16 bp, Homo sapiens
ttttgtttaccagaga

SEQ ID NO: 3806361 - DNA, 17 bp, Homo sapiens
tttttctggaggctggc

SEQ ID NO: 3806362 - DNA, 14 bp, Homo sapiens
tttttgtacattat

SEQ ID NO: 3806363 - DNA, 13 bp, Homo sapiens
ttttttatttcca

SEQ ID NO: 3806364 - DNA, 20 bp, Homo sapiens
gaagcgttgtcctcagcccc

SEQ ID NO: 3806365 - DNA, 18 bp, Homo sapiens
gaagctggaagcactgct

SEQ ID NO: 3806366 - DNA, 17 bp, Homo sapiens
gaaggctttcagggcct

SEQ ID NO: 3806367 - DNA, 19 bp, Homo sapiens
gaagggcagggctgaggcc

SEQ ID NO: 3806368 - DNA, 18 bp, Homo sapiens
gaagtgcagctcaggaga

SEQ ID NO: 3806369 - DNA, 17 bp, Homo sapiens
gaagtgtgggtctgtgt

SEQ ID NO: 3806370 - DNA, 21 bp, Homo sapiens
gaagtgtgggtctgtgtgtgt

SEQ ID NO: 3806371 - DNA, 24 bp, Homo sapiens
gaagtgtgggtctgtgtgtgtgta

SEQ ID NO: 3806372 - DNA, 13 bp, Homo sapiens
gaagttacctgga

SEQ ID NO: 3806373 - DNA, 20 bp, Homo sapiens
gaagttacctggatgccatt

SEQ ID NO: 3806374 - DNA, 17 bp, Homo sapiens
gaataaagaatgaatgg

SEQ ID NO: 3806375 - DNA, 15 bp, Homo sapiens
gaataatagaagaac

SEQ ID NO: 3806376 - DNA, 14 bp, Homo sapiens
gaatacaattaaag

SEQ ID NO: 3806377 - DNA, 22 bp, Homo sapiens
gaatagaaaagatgagaggcag

SEQ ID NO: 3806378 - DNA, 17 bp, Homo sapiens
gaatattgatgttaaca

SEQ ID NO: 3806379 - DNA, 14 bp, Homo sapiens
gaatgatttcatgc

SEQ ID NO: 3806380 - DNA, 16 bp, Homo sapiens
gaatgtcagtatgtgg

SEQ ID NO: 3806381 - DNA, 18 bp, Homo sapiens
gaatgtcagtatgtggaa

SEQ ID NO: 3806382 - DNA, 14 bp, Homo sapiens
gaatgtcccagagg

SEQ ID NO: 3806383 - DNA, 22 bp, Homo sapiens
gaattacactcaaggaaaagat

SEQ ID NO: 3806384 - DNA, 15 bp, Homo sapiens
gaattactgtatata

SEQ ID NO: 3806385 - DNA, 18 bp, Homo sapiens
gaattagaaacataaata

SEQ ID NO: 3806386 - DNA, 16 bp, Homo sapiens
gaattttctttcatac

SEQ ID NO: 3806387 - DNA, 20 bp, Homo sapiens
gaattttctttcatacatta

SEQ ID NO: 3806388 - DNA, 23 bp, Homo sapiens
gaattttctttgtgtagctttgc

SEQ ID NO: 3806389 - DNA, 22 bp, Homo sapiens
gaatttttttttcctagccctc

SEQ ID NO: 3806390 - DNA, 19 bp, Homo sapiens
gacaaacacctcccaggag

SEQ ID NO: 3806391 - DNA, 15 bp, Homo sapiens
gacaacatttttgta

SEQ ID NO: 3806392 - DNA, 22 bp, Homo sapiens
gacaacatttttgtacattatg

SEQ ID NO: 3806393 - DNA, 21 bp, Homo sapiens
gacacaccccacaccccagcc

SEQ ID NO: 3806394 - DNA, 23 bp, Homo sapiens
gacacaccccacaccccagccca

SEQ ID NO: 3806395 - DNA, 14 bp, Homo sapiens
gacacagagatgga

SEQ ID NO: 3806396 - DNA, 14 bp, Homo sapiens
gacaccagccctgc

SEQ ID NO: 3806397 - DNA, 16 bp, Homo sapiens
gacacctaggctaggg

SEQ ID NO: 3806398 - DNA, 13 bp, Homo sapiens
gacacctgccctg

SEQ ID NO: 3806399 - DNA, 14 bp, Homo sapiens
gacacctgccctgc

SEQ ID NO: 3806400 - DNA, 16 bp, Homo sapiens
gacacctgccctgccc

SEQ ID NO: 3806401 - DNA, 22 bp, Homo sapiens
gacacctgccctgccctgccac

SEQ ID NO: 3806402 - DNA, 22 bp, Homo sapiens
gacactgagccccacctctcca

SEQ ID NO: 3806403 - DNA, 16 bp, Homo sapiens
gacagagacagagaga

SEQ ID NO: 3806404 - DNA, 12 bp, Homo sapiens
gacagagccaga

SEQ ID NO: 3806405 - DNA, 14 bp, Homo sapiens
gacagagccagagg

SEQ ID NO: 3806406 - DNA, 16 bp, Homo sapiens
gacagagccagaggca

SEQ ID NO: 3806407 - DNA, 17 bp, Homo sapiens
gacagagccagaggcac

SEQ ID NO: 3806408 - DNA, 21 bp, Homo sapiens
gacaggcccaagagatgaaga

SEQ ID NO: 3806409 - DNA, 22 bp, Homo sapiens
gacatcacttgtacaaaataaa

SEQ ID NO: 3806410 - DNA, 18 bp, Homo sapiens
gaccacaaaacttttcta

SEQ ID NO: 3806411 - DNA, 20 bp, Homo sapiens
gaccacacctccctgaacca

SEQ ID NO: 3806412 - DNA, 23 bp, Homo sapiens
gaccaccagccgccccagcccct

SEQ ID NO: 3806413 - DNA, 16 bp, Homo sapiens
gaccctattgctgctt

SEQ ID NO: 3806414 - DNA, 15 bp, Homo sapiens
gaccctcatctttct

SEQ ID NO: 3806415 - DNA, 20 bp, Homo sapiens
gaccctcatctttcttccaa

SEQ ID NO: 3806416 - DNA, 12 bp, Homo sapiens
gaccctgtctca

SEQ ID NO: 3806417 - DNA, 23 bp, Homo sapiens
gaccctgtctcaaaaaaagaaaa

SEQ ID NO: 3806418 - DNA, 18 bp, Homo sapiens
gacctcaggtgagaagca

SEQ ID NO: 3806419 - DNA, 16 bp, Homo sapiens
gaccttctccagggac

SEQ ID NO: 3806420 - DNA, 17 bp, Homo sapiens
gacctttcctgaggaag

SEQ ID NO: 3806421 - DNA, 20 bp, Homo sapiens
gacgctgtgattggcaggag

SEQ ID NO: 3806422 - DNA, 22 bp, Homo sapiens
gacgctgtgattggcaggaggc

SEQ ID NO: 3806423 - DNA, 17 bp, Homo sapiens
gacgtttgactagccat

SEQ ID NO: 3806424 - DNA, 18 bp, Homo sapiens
gactactactctgccaat

SEQ ID NO: 3806425 - DNA, 20 bp, Homo sapiens
gactagaggcagggagggga

SEQ ID NO: 3806426 - DNA, 22 bp, Homo sapiens
gactagaggcagggaggggact

SEQ ID NO: 3806427 - DNA, 15 bp, Homo sapiens
gactatggagctgag

SEQ ID NO: 3806428 - DNA, 12 bp, Homo sapiens
gactcaaagaga

SEQ ID NO: 3806429 - DNA, 10 bp, Homo sapiens
gactcagcac

SEQ ID NO: 3806430 - DNA, 24 bp, Homo sapiens
gactgcgccacggcactccagcct

SEQ ID NO: 3806431 - DNA, 18 bp, Homo sapiens
gacttcccacggctcctc

SEQ ID NO: 3806432 - DNA, 14 bp, Homo sapiens
gacttgcctggggc

SEQ ID NO: 3806433 - DNA, 18 bp, Homo sapiens
gacttgcctggggccaca

SEQ ID NO: 3806434 - DNA, 13 bp, Homo sapiens
gacttgtgtctct

SEQ ID NO: 3806435 - DNA, 13 bp, Homo sapiens
gagaaaactgaga

SEQ ID NO: 3806436 - DNA, 15 bp, Homo sapiens
gagaaaactgagagg

SEQ ID NO: 3806437 - DNA, 21 bp, Homo sapiens
gagaaggagggttgtgcccac

SEQ ID NO: 3806438 - DNA, 21 bp, Homo sapiens
gagaatttctaccatttcaga

SEQ ID NO: 3806439 - DNA, 18 bp, Homo sapiens
gagacaaatctatgccac

SEQ ID NO: 3806440 - DNA, 21 bp, Homo sapiens
gagacagaaacagagagagac

SEQ ID NO: 3806441 - DNA, 12 bp, Homo sapiens
gagaccacctct

SEQ ID NO: 3806442 - DNA, 14 bp, Homo sapiens
gagactgagggaga

SEQ ID NO: 3806443 - DNA, 15 bp, Homo sapiens
gagactgggatggga

SEQ ID NO: 3806444 - DNA, 15 bp, Homo sapiens
gagacttccgtcacc

SEQ ID NO: 3806445 - DNA, 14 bp, Homo sapiens
gagagacgctgtga

SEQ ID NO: 3806446 - DNA, 13 bp, Homo sapiens
gagagacgggccc

SEQ ID NO: 3806447 - DNA, 17 bp, Homo sapiens
gagagactgagggagag

SEQ ID NO: 3806448 - DNA, 13 bp, Homo sapiens
gagagaggccatt

SEQ ID NO: 3806449 - DNA, 21 bp, Homo sapiens
gagagaggccattctttccca

SEQ ID NO: 3806450 - DNA, 18 bp, Homo sapiens
gagaggccttttggaatg

SEQ ID NO: 3806451 - DNA, 21 bp, Homo sapiens
gagagggcatgcgcacaaggc

SEQ ID NO: 3806452 - DNA, 22 bp, Homo sapiens
gagaggtggggagggagacaga

SEQ ID NO: 3806453 - DNA, 17 bp, Homo sapiens
gagatcaaatggaaagg

SEQ ID NO: 3806454 - DNA, 13 bp, Homo sapiens
gagatcagcctgg

SEQ ID NO: 3806455 - DNA, 20 bp, Homo sapiens
gagatcccaacactgccagc

SEQ ID NO: 3806456 - DNA, 21 bp, Homo sapiens
gagatggagtctcgctctgct

SEQ ID NO: 3806457 - DNA, 17 bp, Homo sapiens
gagatgtaaaaggtatt

SEQ ID NO: 3806458 - DNA, 14 bp, Homo sapiens
gagcaaatgctgga

SEQ ID NO: 3806459 - DNA, 15 bp, Homo sapiens
gagcaagagaacatt

SEQ ID NO: 3806460 - DNA, 20 bp, Homo sapiens
gagcaaggacaacctgcccc

SEQ ID NO: 3806461 - DNA, 22 bp, Homo sapiens
gagcacaagaggagatccaggg

SEQ ID NO: 3806462 - DNA, 19 bp, Homo sapiens
gagcaggcacatggaggag

SEQ ID NO: 3806463 - DNA, 23 bp, Homo sapiens
gagccaccgcgcccagccaagaa

SEQ ID NO: 3806464 - DNA, 15 bp, Homo sapiens
gagccactacctttg

SEQ ID NO: 3806465 - DNA, 12 bp, Homo sapiens
gagccagaggca

SEQ ID NO: 3806466 - DNA, 16 bp, Homo sapiens
gagcccccacattctc

SEQ ID NO: 3806467 - DNA, 12 bp, Homo sapiens
gagcccttagcc

SEQ ID NO: 3806468 - DNA, 20 bp, Homo sapiens
gagcccttagccttgctgta

SEQ ID NO: 3806469 - DNA, 23 bp, Homo sapiens
gagcccttagccttgctgtagag

SEQ ID NO: 3806470 - DNA, 15 bp, Homo sapiens
gagcctggcaagaat

SEQ ID NO: 3806471 - DNA, 20 bp, Homo sapiens
gagctcaggaaccgaggcag

SEQ ID NO: 3806472 - DNA, 14 bp, Homo sapiens
gagctcctgtccct

SEQ ID NO: 3806473 - DNA, 15 bp, Homo sapiens
gagctcctgtcccta

SEQ ID NO: 3806474 - DNA, 19 bp, Homo sapiens
gagctcctgtccctaccca

SEQ ID NO: 3806475 - DNA, 20 bp, Homo sapiens
gagctcctgtccctacccac

SEQ ID NO: 3806476 - DNA, 13 bp, Homo sapiens
gagctgacagagc

SEQ ID NO: 3806477 - DNA, 16 bp, Homo sapiens
gagctgcagcccccca

SEQ ID NO: 3806478 - DNA, 17 bp, Homo sapiens
gagctggcagcctccag

SEQ ID NO: 3806479 - DNA, 18 bp, Homo sapiens
gagctggcagcctccagt

SEQ ID NO: 3806480 - DNA, 13 bp, Homo sapiens
gagcttgggaatg

SEQ ID NO: 3806481 - DNA, 20 bp, Homo sapiens
gagcttgggggatgactaga

SEQ ID NO: 3806482 - DNA, 15 bp, Homo sapiens
gaggacaaccattcc

SEQ ID NO: 3806483 - DNA, 17 bp, Homo sapiens
gaggacatggagagaga

SEQ ID NO: 3806484 - DNA, 15 bp, Homo sapiens
gaggagggcaggcat

SEQ ID NO: 3806485 - DNA, 13 bp, Homo sapiens
gaggagggcatgg

SEQ ID NO: 3806486 - DNA, 12 bp, Homo sapiens
gaggatggagag

SEQ ID NO: 3806487 - DNA, 13 bp, Homo sapiens
gaggatggagaga

SEQ ID NO: 3806488 - DNA, 15 bp, Homo sapiens
gaggatttcaagcct

SEQ ID NO: 3806489 - DNA, 17 bp, Homo sapiens
gaggatttcaagcctgc

SEQ ID NO: 3806490 - DNA, 14 bp, Homo sapiens
gaggcagggaagga

SEQ ID NO: 3806491 - DNA, 17 bp, Homo sapiens
gaggccaaggtgggagg

SEQ ID NO: 3806492 - DNA, 23 bp, Homo sapiens
gaggctagtctcttctcagagca

SEQ ID NO: 3806493 - DNA, 20 bp, Homo sapiens
gaggctattattttcactgt

SEQ ID NO: 3806494 - DNA, 13 bp, Homo sapiens
gagggaaaagcta

SEQ ID NO: 3806495 - DNA, 12 bp, Homo sapiens
gagggagaggtg

SEQ ID NO: 3806496 - DNA, 15 bp, Homo sapiens
gagggagggagaggt

SEQ ID NO: 3806497 - DNA, 15 bp, Homo sapiens
gagggatcacagggc

SEQ ID NO: 3806498 - DNA, 9 bp, Homo sapiens
gagggctgc

SEQ ID NO: 3806499 - DNA, 16 bp, Homo sapiens
gagggctgcctttgga

SEQ ID NO: 3806500 - DNA, 18 bp, Homo sapiens
gaggggaataatagaaga

SEQ ID NO: 3806501 - DNA, 13 bp, Homo sapiens
gaggggtctttta

SEQ ID NO: 3806502 - DNA, 11 bp, Homo sapiens
gaggtcaataa

SEQ ID NO: 3806503 - DNA, 16 bp, Homo sapiens
gaggtcaataaagcag

SEQ ID NO: 3806504 - DNA, 18 bp, Homo sapiens
gaggtcaataaagcagag

SEQ ID NO: 3806505 - DNA, 23 bp, Homo sapiens
gaggtcaataaagcagagccaag

SEQ ID NO: 3806506 - DNA, 15 bp, Homo sapiens
gaggtcgaggcagga

SEQ ID NO: 3806507 - DNA, 22 bp, Homo sapiens
gaggtcgggagttcaagaccag

SEQ ID NO: 3806508 - DNA, 16 bp, Homo sapiens
gaggtgacttgcctgg

SEQ ID NO: 3806509 - DNA, 17 bp, Homo sapiens
gaggtgacttgcctggg

SEQ ID NO: 3806510 - DNA, 19 bp, Homo sapiens
gaggtgacttgcctggggc

SEQ ID NO: 3806511 - DNA, 23 bp, Homo sapiens
gaggtgacttgcctggggccaca

SEQ ID NO: 3806512 - DNA, 15 bp, Homo sapiens
gaggtgagaccacct

SEQ ID NO: 3806513 - DNA, 11 bp, Homo sapiens
gaggtgggagg

SEQ ID NO: 3806514 - DNA, 15 bp, Homo sapiens
gaggtggtggggacc

SEQ ID NO: 3806515 - DNA, 23 bp, Homo sapiens
gaggtggtggggaccagctaatt

SEQ ID NO: 3806516 - DNA, 20 bp, Homo sapiens
gaggttgcagtgaactgaga

SEQ ID NO: 3806517 - DNA, 21 bp, Homo sapiens
gagtagctgggactacaggca

SEQ ID NO: 3806518 - DNA, 15 bp, Homo sapiens
gagtccatcagcctc

SEQ ID NO: 3806519 - DNA, 19 bp, Homo sapiens
gagtccctgcctggaccag

SEQ ID NO: 3806520 - DNA, 23 bp, Homo sapiens
gagtccctgcctggaccagcctc

SEQ ID NO: 3806521 - DNA, 13 bp, Homo sapiens
gagtcccttagaa

SEQ ID NO: 3806522 - DNA, 14 bp, Homo sapiens
gagtctcgctctgc

SEQ ID NO: 3806523 - DNA, 15 bp, Homo sapiens
gagtctcgctctgct

SEQ ID NO: 3806524 - DNA, 22 bp, Homo sapiens
gagtctcgctctgctgcccagg

SEQ ID NO: 3806525 - DNA, 18 bp, Homo sapiens
gagtcttcactgctctgc

SEQ ID NO: 3806526 - DNA, 19 bp, Homo sapiens
gagtcttcactgctctgcc

SEQ ID NO: 3806527 - DNA, 17 bp, Homo sapiens
gagtcttccaggtgcct

SEQ ID NO: 3806528 - DNA, 17 bp, Homo sapiens
gagtgaatttgacctag

SEQ ID NO: 3806529 - DNA, 16 bp, Homo sapiens
gagtgacaggcaccag

SEQ ID NO: 3806530 - DNA, 13 bp, Homo sapiens
gagttggctggga

SEQ ID NO: 3806531 - DNA, 15 bp, Homo sapiens
gagtttagggtgggg

SEQ ID NO: 3806532 - DNA, 19 bp, Homo sapiens
gataaggcagaactaggag

SEQ ID NO: 3806533 - DNA, 21 bp, Homo sapiens
gataattttatttataaacta

SEQ ID NO: 3806534 - DNA, 15 bp, Homo sapiens
gatacagaatgaatc

SEQ ID NO: 3806535 - DNA, 22 bp, Homo sapiens
gatagatgtgtggacacattgg

SEQ ID NO: 3806536 - DNA, 21 bp, Homo sapiens
gatcaaaacatgcttgaataa

SEQ ID NO: 3806537 - DNA, 17 bp, Homo sapiens
gatcaagccaaaaaaga

SEQ ID NO: 3806538 - DNA, 18 bp, Homo sapiens
gatcagttataagtagca

SEQ ID NO: 3806539 - DNA, 14 bp, Homo sapiens
gatcattatcagcc

SEQ ID NO: 3806540 - DNA, 14 bp, Homo sapiens
gatccacacacaga

SEQ ID NO: 3806541 - DNA, 18 bp, Homo sapiens
gatccacacacagaggaa

SEQ ID NO: 3806542 - DNA, 22 bp, Homo sapiens
gatccagttccagttcccatgg

SEQ ID NO: 3806543 - DNA, 17 bp, Homo sapiens
gatcccaacactgccag

SEQ ID NO: 3806544 - DNA, 17 bp, Homo sapiens
gatctcttgagcctggg

SEQ ID NO: 3806545 - DNA, 16 bp, Homo sapiens
gatctgcttccctggg

SEQ ID NO: 3806546 - DNA, 18 bp, Homo sapiens
gatctgcttccctggggc

SEQ ID NO: 3806547 - DNA, 19 bp, Homo sapiens
gatctttttgtgaaattca

SEQ ID NO: 3806548 - DNA, 21 bp, Homo sapiens
gatgaagagtgagagggcatg

SEQ ID NO: 3806549 - DNA, 15 bp, Homo sapiens
gatgactagaggcag

SEQ ID NO: 3806550 - DNA, 17 bp, Homo sapiens
gatgagaaaactgagag

SEQ ID NO: 3806551 - DNA, 11 bp, Homo sapiens
gatgagaggca

SEQ ID NO: 3806552 - DNA, 15 bp, Homo sapiens
gatgagaggcagagg

SEQ ID NO: 3806553 - DNA, 14 bp, Homo sapiens
gatgatcctaggca

SEQ ID NO: 3806554 - DNA, 16 bp, Homo sapiens
gatgcacacacagata

SEQ ID NO: 3806555 - DNA, 20 bp, Homo sapiens
gatgcacacgcacatagaga

SEQ ID NO: 3806556 - DNA, 21 bp, Homo sapiens
gatgcattcccggtgcagaac

SEQ ID NO: 3806557 - DNA, 16 bp, Homo sapiens
gatggaatagaaaaga

SEQ ID NO: 3806558 - DNA, 21 bp, Homo sapiens
gatggagaaacaggctctgag

SEQ ID NO: 3806559 - DNA, 13 bp, Homo sapiens
gatggcctgagaa

SEQ ID NO: 3806560 - DNA, 19 bp, Homo sapiens
gatgggaacactggtgggc

SEQ ID NO: 3806561 - DNA, 20 bp, Homo sapiens
gatggtcttgatctcctgag

SEQ ID NO: 3806562 - DNA, 19 bp, Homo sapiens
gatgtgctcccaccaggca

SEQ ID NO: 3806563 - DNA, 20 bp, Homo sapiens
gatgttaacaagaggggaaa

SEQ ID NO: 3806564 - DNA, 18 bp, Homo sapiens
gattaaccacttcagctg

SEQ ID NO: 3806565 - DNA, 19 bp, Homo sapiens
gattaaccacttcagctga

SEQ ID NO: 3806566 - DNA, 21 bp, Homo sapiens
gattaaccacttcagctgact

SEQ ID NO: 3806567 - DNA, 13 bp, Homo sapiens
gattatatatcat

SEQ ID NO: 3806568 - DNA, 18 bp, Homo sapiens
gattatatatcataaagt

SEQ ID NO: 3806569 - DNA, 21 bp, Homo sapiens
gattatatatcataaagtatg

SEQ ID NO: 3806570 - DNA, 13 bp, Homo sapiens
gattcccagagag

SEQ ID NO: 3806571 - DNA, 17 bp, Homo sapiens
gattcctttgaagagga

SEQ ID NO: 3806572 - DNA, 17 bp, Homo sapiens
gattctcacctgccttc

SEQ ID NO: 3806573 - DNA, 16 bp, Homo sapiens
gattgataagtaatga

SEQ ID NO: 3806574 - DNA, 19 bp, Homo sapiens
gattgataagtaatgaaag

SEQ ID NO: 3806575 - DNA, 23 bp, Homo sapiens
gattgcaggagtccctgccatca

SEQ ID NO: 3806576 - DNA, 17 bp, Homo sapiens
gattggcaggaggcagg

SEQ ID NO: 3806577 - DNA, 20 bp, Homo sapiens
gattggcaggaggcaggata

SEQ ID NO: 3806578 - DNA, 21 bp, Homo sapiens
gatttcacaggtcttgcccaa

SEQ ID NO: 3806579 - DNA, 16 bp, Homo sapiens
gatttcatgctatctc

SEQ ID NO: 3806580 - DNA, 18 bp, Homo sapiens
gatttcatgctatctctg

SEQ ID NO: 3806581 - DNA, 14 bp, Homo sapiens
gatttgagaaattt

SEQ ID NO: 3806582 - DNA, 20 bp, Homo sapiens
gatttggggctcagagtggg

SEQ ID NO: 3806583 - DNA, 14 bp, Homo sapiens
gattttcttttgtt

SEQ ID NO: 3806584 - DNA, 21 bp, Homo sapiens
gatttttgctcttctgtatgt

SEQ ID NO: 3806585 - DNA, 14 bp, Homo sapiens
gcaaaaaggcagga

SEQ ID NO: 3806586 - DNA, 15 bp, Homo sapiens
gcaaaagatgcttct

SEQ ID NO: 3806587 - DNA, 16 bp, Homo sapiens
gcaaagaactgcccca

SEQ ID NO: 3806588 - DNA, 20 bp, Homo sapiens
gcaaccctggtgtgctgggc

SEQ ID NO: 3806589 - DNA, 18 bp, Homo sapiens
gcaactgcattggctttg

SEQ ID NO: 3806590 - DNA, 21 bp, Homo sapiens
gcaagactctgtctcaataaa

SEQ ID NO: 3806591 - DNA, 13 bp, Homo sapiens
gcaagagaacatt

SEQ ID NO: 3806592 - DNA, 15 bp, Homo sapiens
gcaagccggcagaaa

SEQ ID NO: 3806593 - DNA, 17 bp, Homo sapiens
gcaagctctgcctcccg

SEQ ID NO: 3806594 - DNA, 20 bp, Homo sapiens
gcaatgccctacctgcctgt

SEQ ID NO: 3806595 - DNA, 20 bp, Homo sapiens
gcaatgcttctgcctcagct

SEQ ID NO: 3806596 - DNA, 20 bp, Homo sapiens
gcaatggcacgatctcagct

SEQ ID NO: 3806597 - DNA, 13 bp, Homo sapiens
gcacaaatattta

SEQ ID NO: 3806598 - DNA, 19 bp, Homo sapiens
gcacaaggctgaccaagag

SEQ ID NO: 3806599 - DNA, 22 bp, Homo sapiens
gcacacacacaccaatgcgcac

SEQ ID NO: 3806600 - DNA, 14 bp, Homo sapiens
gcacacacacagag

SEQ ID NO: 3806601 - DNA, 17 bp, Homo sapiens
gcacacacacggatgca

SEQ ID NO: 3806602 - DNA, 18 bp, Homo sapiens
gcacagagatatgcacac

SEQ ID NO: 3806603 - DNA, 19 bp, Homo sapiens
gcacagcctggctgtggcc

SEQ ID NO: 3806604 - DNA, 20 bp, Homo sapiens
gcacatagagatatgcacac

SEQ ID NO: 3806605 - DNA, 14 bp, Homo sapiens
gcacatgattttct

SEQ ID NO: 3806606 - DNA, 22 bp, Homo sapiens
gcacatggaggagcttggggga

SEQ ID NO: 3806607 - DNA, 16 bp, Homo sapiens
gcaccacattgcctca

SEQ ID NO: 3806608 - DNA, 18 bp, Homo sapiens
gcaccacattgcctcatt

SEQ ID NO: 3806609 - DNA, 23 bp, Homo sapiens
gcaccagatgggatgggctttct

SEQ ID NO: 3806610 - DNA, 13 bp, Homo sapiens
gcaccagcagcct

SEQ ID NO: 3806611 - DNA, 14 bp, Homo sapiens
gcaccagcagcctg

SEQ ID NO: 3806612 - DNA, 19 bp, Homo sapiens
gcaccctcaggcaggtggg

SEQ ID NO: 3806613 - DNA, 20 bp, Homo sapiens
gcaccctcatacacagaaac

SEQ ID NO: 3806614 - DNA, 19 bp, Homo sapiens
gcaccctccaaacactggg

SEQ ID NO: 3806615 - DNA, 19 bp, Homo sapiens
gcaccctcgatgaagccca

SEQ ID NO: 3806616 - DNA, 16 bp, Homo sapiens
gcaccggggcctgggc

SEQ ID NO: 3806617 - DNA, 14 bp, Homo sapiens
gcacctacgggggc

SEQ ID NO: 3806618 - DNA, 13 bp, Homo sapiens
gcactccagcctg

SEQ ID NO: 3806619 - DNA, 22 bp, Homo sapiens
gcactgaaggctttcagggcct

SEQ ID NO: 3806620 - DNA, 14 bp, Homo sapiens
gcactggccccacc

SEQ ID NO: 3806621 - DNA, 23 bp, Homo sapiens
gcagaatcctaggctccacccca

SEQ ID NO: 3806622 - DNA, 22 bp, Homo sapiens
gcagacttgagtctgaggcccc

SEQ ID NO: 3806623 - DNA, 13 bp, Homo sapiens
gcagagccaaggc

SEQ ID NO: 3806624 - DNA, 19 bp, Homo sapiens
gcagatttactgtcccagg

SEQ ID NO: 3806625 - DNA, 14 bp, Homo sapiens
gcagccgcctccct

SEQ ID NO: 3806626 - DNA, 22 bp, Homo sapiens
gcagcctccagtgggaggacag

SEQ ID NO: 3806627 - DNA, 14 bp, Homo sapiens
gcagcctggaccct

SEQ ID NO: 3806628 - DNA, 21 bp, Homo sapiens
gcagctgaggacacaccccac

SEQ ID NO: 3806629 - DNA, 19 bp, Homo sapiens
gcaggaaatcagagctggc

SEQ ID NO: 3806630 - DNA, 15 bp, Homo sapiens
gcaggacatgtgctc

SEQ ID NO: 3806631 - DNA, 20 bp, Homo sapiens
gcaggaggatcacttgagtc

SEQ ID NO: 3806632 - DNA, 13 bp, Homo sapiens
gcaggaggcagga

SEQ ID NO: 3806633 - DNA, 15 bp, Homo sapiens
gcaggcacatggagg

SEQ ID NO: 3806634 - DNA, 23 bp, Homo sapiens
gcaggcatcggggagccgggagc

SEQ ID NO: 3806635 - DNA, 20 bp, Homo sapiens
gcaggccaagtcaggccctt

SEQ ID NO: 3806636 - DNA, 19 bp, Homo sapiens
gcaggctgcaaccctggtg

SEQ ID NO: 3806637 - DNA, 22 bp, Homo sapiens
gcagggaaaggctctgaaagcc

SEQ ID NO: 3806638 - DNA, 14 bp, Homo sapiens
gcagtgaactgaga

SEQ ID NO: 3806639 - DNA, 16 bp, Homo sapiens
gcatactaataaagta

SEQ ID NO: 3806640 - DNA, 13 bp, Homo sapiens
gcatcccagggga

SEQ ID NO: 3806641 - DNA, 15 bp, Homo sapiens
gcatcccaggggacc

SEQ ID NO: 3806642 - DNA, 21 bp, Homo sapiens
gcatcccaggggaccacacct

SEQ ID NO: 3806643 - DNA, 20 bp, Homo sapiens
gcatcctcagttcctgcagc

SEQ ID NO: 3806644 - DNA, 18 bp, Homo sapiens
gcatctgagtccagctcc

SEQ ID NO: 3806645 - DNA, 20 bp, Homo sapiens
gcatgagggatcacagggcc

SEQ ID NO: 3806646 - DNA, 21 bp, Homo sapiens
gcatgcgcacaaggctgacca

SEQ ID NO: 3806647 - DNA, 18 bp, Homo sapiens
gcattatatttgtaaatt

SEQ ID NO: 3806648 - DNA, 14 bp, Homo sapiens
gcatttgctgaata

SEQ ID NO: 3806649 - DNA, 17 bp, Homo sapiens
gcatttgctgaatacag

SEQ ID NO: 3806650 - DNA, 22 bp, Homo sapiens
gcattttgggtgccattaaata

SEQ ID NO: 3806651 - DNA, 19 bp, Homo sapiens
gccaaagcctcctccagcc

SEQ ID NO: 3806652 - DNA, 16 bp, Homo sapiens
gccaagcccacctgca

SEQ ID NO: 3806653 - DNA, 19 bp, Homo sapiens
gccaagcccacctgcacgt

SEQ ID NO: 3806654 - DNA, 14 bp, Homo sapiens
gccaaggctgagag

SEQ ID NO: 3806655 - DNA, 14 bp, Homo sapiens
gccaaggtgggagg

SEQ ID NO: 3806656 - DNA, 18 bp, Homo sapiens
gccaatcggctacccctc

SEQ ID NO: 3806657 - DNA, 16 bp, Homo sapiens
gccacctgaataaaga

SEQ ID NO: 3806658 - DNA, 15 bp, Homo sapiens
gccacctgtctgtct

SEQ ID NO: 3806659 - DNA, 15 bp, Homo sapiens
gccacgattgcagga

SEQ ID NO: 3806660 - DNA, 18 bp, Homo sapiens
gccactgtgaagagaacc

SEQ ID NO: 3806661 - DNA, 22 bp, Homo sapiens
gccaggggaaaatcagcctgct

SEQ ID NO: 3806662 - DNA, 13 bp, Homo sapiens
gccagtcctagag

SEQ ID NO: 3806663 - DNA, 24 bp, Homo sapiens
gccagtcctagagctcctgtccct

SEQ ID NO: 3806664 - DNA, 23 bp, Homo sapiens
gccagtggctggatctgtgaggg

SEQ ID NO: 3806665 - DNA, 17 bp, Homo sapiens
gccatcatgtttacaga

SEQ ID NO: 3806666 - DNA, 13 bp, Homo sapiens
gccatctcctccc

SEQ ID NO: 3806667 - DNA, 13 bp, Homo sapiens
gccatgaactttg

SEQ ID NO: 3806668 - DNA, 14 bp, Homo sapiens
gccattccaacagc

SEQ ID NO: 3806669 - DNA, 12 bp, Homo sapiens
gccattcccact

SEQ ID NO: 3806670 - DNA, 12 bp, Homo sapiens
gccattctttcc

SEQ ID NO: 3806671 - DNA, 20 bp, Homo sapiens
gcccaagggcctcccaccag

SEQ ID NO: 3806672 - DNA, 11 bp, Homo sapiens
gcccagcctct

SEQ ID NO: 3806673 - DNA, 12 bp, Homo sapiens
gcccagcctctc

SEQ ID NO: 3806674 - DNA, 13 bp, Homo sapiens
gcccagcctctcc

SEQ ID NO: 3806675 - DNA, 19 bp, Homo sapiens
gcccaggctagagtgcagt

SEQ ID NO: 3806676 - DNA, 20 bp, Homo sapiens
gcccaggctagagtgcagtg

SEQ ID NO: 3806677 - DNA, 19 bp, Homo sapiens
gcccaggctggagtgcaat

SEQ ID NO: 3806678 - DNA, 20 bp, Homo sapiens
gcccaggctggagtgcaatg

SEQ ID NO: 3806679 - DNA, 19 bp, Homo sapiens
gcccaggctggagtgcagt

SEQ ID NO: 3806680 - DNA, 20 bp, Homo sapiens
gcccatgggagctggttaga

SEQ ID NO: 3806681 - DNA, 20 bp, Homo sapiens
gccccaaggaccttacaggc

SEQ ID NO: 3806682 - DNA, 21 bp, Homo sapiens
gccccaccctcgtggacacct

SEQ ID NO: 3806683 - DNA, 23 bp, Homo sapiens
gccccaccctcgtggacacctgc

SEQ ID NO: 3806684 - DNA, 15 bp, Homo sapiens
gccccagaaggcagg

SEQ ID NO: 3806685 - DNA, 11 bp, Homo sapiens
gccccagcccc

SEQ ID NO: 3806686 - DNA, 21 bp, Homo sapiens
gccccagccccttctcccagc

SEQ ID NO: 3806687 - DNA, 23 bp, Homo sapiens
gccccagccccttctcccagcac

SEQ ID NO: 3806688 - DNA, 23 bp, Homo sapiens
gccccccagagagagctctgcac

SEQ ID NO: 3806689 - DNA, 14 bp, Homo sapiens
gcccgaccccatct

SEQ ID NO: 3806690 - DNA, 15 bp, Homo sapiens
gcccgggagctcagg

SEQ ID NO: 3806691 - DNA, 13 bp, Homo sapiens
gcccgggtgcagg

SEQ ID NO: 3806692 - DNA, 20 bp, Homo sapiens
gccctaggattcctccccca

SEQ ID NO: 3806693 - DNA, 23 bp, Homo sapiens
gccctaggattcctcccccagag

SEQ ID NO: 3806694 - DNA, 14 bp, Homo sapiens
gccctgagctttct

SEQ ID NO: 3806695 - DNA, 15 bp, Homo sapiens
gccctgccacctgtc

SEQ ID NO: 3806696 - DNA, 20 bp, Homo sapiens
gccctgcccttcagcatcct

SEQ ID NO: 3806697 - DNA, 16 bp, Homo sapiens
gccctgtccctgtccc

SEQ ID NO: 3806698 - DNA, 16 bp, Homo sapiens
gcccttagccttgctg

SEQ ID NO: 3806699 - DNA, 23 bp, Homo sapiens
gccctttgcaggcccagcagact

SEQ ID NO: 3806700 - DNA, 12 bp, Homo sapiens
gccgccccagcc

SEQ ID NO: 3806701 - DNA, 21 bp, Homo sapiens
gccgggcgcggtggctcacgc

SEQ ID NO: 3806702 - DNA, 19 bp, Homo sapiens
gccgtctggcgagccctta

SEQ ID NO: 3806703 - DNA, 20 bp, Homo sapiens
gccgtgtaaccatggaccca

SEQ ID NO: 3806704 - DNA, 20 bp, Homo sapiens
gcctagatccacacacagag

SEQ ID NO: 3806705 - DNA, 22 bp, Homo sapiens
gcctattagtagttaattctgt

SEQ ID NO: 3806706 - DNA, 17 bp, Homo sapiens
gcctcagcctccaggca

SEQ ID NO: 3806707 - DNA, 15 bp, Homo sapiens
gcctcagcctcctga

SEQ ID NO: 3806708 - DNA, 16 bp, Homo sapiens
gcctcagcctcctgag

SEQ ID NO: 3806709 - DNA, 17 bp, Homo sapiens
gcctcagcctcctgagt

SEQ ID NO: 3806710 - DNA, 21 bp, Homo sapiens
gcctcatttcttcctctgcat

SEQ ID NO: 3806711 - DNA, 16 bp, Homo sapiens
gcctccattctgacca

SEQ ID NO: 3806712 - DNA, 17 bp, Homo sapiens
gcctccattctgaccat

SEQ ID NO: 3806713 - DNA, 16 bp, Homo sapiens
gcctcccaaagtgctg

SEQ ID NO: 3806714 - DNA, 14 bp, Homo sapiens
gcctcccacgactg

SEQ ID NO: 3806715 - DNA, 21 bp, Homo sapiens
gcctcctcacccccagctttg

SEQ ID NO: 3806716 - DNA, 13 bp, Homo sapiens
gcctcctccagcc

SEQ ID NO: 3806717 - DNA, 23 bp, Homo sapiens
gcctcctgagtagctgggactac

SEQ ID NO: 3806718 - DNA, 14 bp, Homo sapiens
gcctcggcctccca

SEQ ID NO: 3806719 - DNA, 23 bp, Homo sapiens
gcctcggcctcccaaagtgctgg

SEQ ID NO: 3806720 - DNA, 18 bp, Homo sapiens
gcctctagaacacccact

SEQ ID NO: 3806721 - DNA, 18 bp, Homo sapiens
gcctctccccgctctgga

SEQ ID NO: 3806722 - DNA, 14 bp, Homo sapiens
gcctctgcccagcc

SEQ ID NO: 3806723 - DNA, 17 bp, Homo sapiens
gcctctgcccagcctgc

SEQ ID NO: 3806724 - DNA, 16 bp, Homo sapiens
gcctgacactgagccc

SEQ ID NO: 3806725 - DNA, 18 bp, Homo sapiens
gcctgccccagcctccca

SEQ ID NO: 3806726 - DNA, 13 bp, Homo sapiens
gcctgcctgggcc

SEQ ID NO: 3806727 - DNA, 14 bp, Homo sapiens
gcctgcctgggcct

SEQ ID NO: 3806728 - DNA, 16 bp, Homo sapiens
gcctgcctgggcctcc

SEQ ID NO: 3806729 - DNA, 15 bp, Homo sapiens
gcctgctccagctgt

SEQ ID NO: 3806730 - DNA, 16 bp, Homo sapiens
gcctggaccagcctct

SEQ ID NO: 3806731 - DNA, 16 bp, Homo sapiens
gcctgggcaggaggga

SEQ ID NO: 3806732 - DNA, 14 bp, Homo sapiens
gcctgggcagtgcc

SEQ ID NO: 3806733 - DNA, 15 bp, Homo sapiens
gcctgggcagtgccc

SEQ ID NO: 3806734 - DNA, 12 bp, Homo sapiens
gcctgggcctcc

SEQ ID NO: 3806735 - DNA, 20 bp, Homo sapiens
gcctgggcgacagagcaaga

SEQ ID NO: 3806736 - DNA, 19 bp, Homo sapiens
gcctgggtgacccccactg

SEQ ID NO: 3806737 - DNA, 17 bp, Homo sapiens
gcctgttctccagatgg

SEQ ID NO: 3806738 - DNA, 21 bp, Homo sapiens
gccttgctattttaataaaga

SEQ ID NO: 3806739 - DNA, 18 bp, Homo sapiens
gccttggtctaacttttg

SEQ ID NO: 3806740 - DNA, 16 bp, Homo sapiens
gccttgtcacgccaga

SEQ ID NO: 3806741 - DNA, 18 bp, Homo sapiens
gcctttggacttgtcccg

SEQ ID NO: 3806742 - DNA, 19 bp, Homo sapiens
gcctttgggaggcagcatc

SEQ ID NO: 3806743 - DNA, 17 bp, Homo sapiens
gcgaagcgttgtcctca

SEQ ID NO: 3806744 - DNA, 12 bp, Homo sapiens
gcgagcccttag

SEQ ID NO: 3806745 - DNA, 11 bp, Homo sapiens
gcgcatctaac

SEQ ID NO: 3806746 - DNA, 23 bp, Homo sapiens
gcgccacggcactccagcctggg

SEQ ID NO: 3806747 - DNA, 12 bp, Homo sapiens
gcgcctcctgga

SEQ ID NO: 3806748 - DNA, 13 bp, Homo sapiens
gcgcctcctggac

SEQ ID NO: 3806749 - DNA, 18 bp, Homo sapiens
gcgctggacagaggggca

SEQ ID NO: 3806750 - DNA, 15 bp, Homo sapiens
gcggctggcagccca

SEQ ID NO: 3806751 - DNA, 22 bp, Homo sapiens
gcggctgggaggagggcaggca

SEQ ID NO: 3806752 - DNA, 22 bp, Homo sapiens
gcgttattggtcggcagccttc

SEQ ID NO: 3806753 - DNA, 18 bp, Homo sapiens
gctaaacaagtaagaaaa

SEQ ID NO: 3806754 - DNA, 18 bp, Homo sapiens
gctaagagggtgaacaaa

SEQ ID NO: 3806755 - DNA, 15 bp, Homo sapiens
gctacaataaatgct

SEQ ID NO: 3806756 - DNA, 20 bp, Homo sapiens
gctaccaaagcaccttagct

SEQ ID NO: 3806757 - DNA, 19 bp, Homo sapiens
gctacccctcgactcagca

SEQ ID NO: 3806758 - DNA, 21 bp, Homo sapiens
gctacccctcgactcagcacc

SEQ ID NO: 3806759 - DNA, 14 bp, Homo sapiens
gctagaagaaaaca

SEQ ID NO: 3806760 - DNA, 21 bp, Homo sapiens
gctagcatggcccgggcctta

SEQ ID NO: 3806761 - DNA, 13 bp, Homo sapiens
gctaggaatgaaa

SEQ ID NO: 3806762 - DNA, 18 bp, Homo sapiens
gctaggaatgaaatcctg

SEQ ID NO: 3806763 - DNA, 17 bp, Homo sapiens
gctagggtggggagaga

SEQ ID NO: 3806764 - DNA, 21 bp, Homo sapiens
gctagtctcttctcagagcag

SEQ ID NO: 3806765 - DNA, 20 bp, Homo sapiens
gctatctactgagacatgac

SEQ ID NO: 3806766 - DNA, 20 bp, Homo sapiens
gctatctctgtgtgcacaaa

SEQ ID NO: 3806767 - DNA, 17 bp, Homo sapiens
gctatgagctggggatg

SEQ ID NO: 3806768 - DNA, 21 bp, Homo sapiens
gctatggggatagatgtgtgg

SEQ ID NO: 3806769 - DNA, 14 bp, Homo sapiens
gctcacaaaccatg

SEQ ID NO: 3806770 - DNA, 23 bp, Homo sapiens
gctcactgcaagctctgcctccc

SEQ ID NO: 3806771 - DNA, 19 bp, Homo sapiens
gctcagagggtgtcctgca

SEQ ID NO: 3806772 - DNA, 21 bp, Homo sapiens
gctcagagggtgtcctgcacc

SEQ ID NO: 3806773 - DNA, 16 bp, Homo sapiens
gctcaggaaccgaggc

SEQ ID NO: 3806774 - DNA, 20 bp, Homo sapiens
gctcaggaaccgaggcaggg

SEQ ID NO: 3806775 - DNA, 11 bp, Homo sapiens
gctccagctgt

SEQ ID NO: 3806776 - DNA, 22 bp, Homo sapiens
gctcccagggccatgaactttg

SEQ ID NO: 3806777 - DNA, 14 bp, Homo sapiens
gctcctcctgccct

SEQ ID NO: 3806778 - DNA, 18 bp, Homo sapiens
gctcctcctgccctgtcc

SEQ ID NO: 3806779 - DNA, 20 bp, Homo sapiens
gctcctcctgccctgtccct

SEQ ID NO: 3806780 - DNA, 18 bp, Homo sapiens
gctcctggcccactgcat

SEQ ID NO: 3806781 - DNA, 16 bp, Homo sapiens
gctcctgtccctaccc

SEQ ID NO: 3806782 - DNA, 18 bp, Homo sapiens
gctcctgtccctacccac

SEQ ID NO: 3806783 - DNA, 19 bp, Homo sapiens
gctcctgtccctacccact

SEQ ID NO: 3806784 - DNA, 20 bp, Homo sapiens
gctctatggattatccactg

SEQ ID NO: 3806785 - DNA, 17 bp, Homo sapiens
gctctgaaagccagctg

SEQ ID NO: 3806786 - DNA, 21 bp, Homo sapiens
gctctgaggtcaataaagcag

SEQ ID NO: 3806787 - DNA, 13 bp, Homo sapiens
gctctgcctcccg

SEQ ID NO: 3806788 - DNA, 19 bp, Homo sapiens
gctcttctgtatgtgacaa

SEQ ID NO: 3806789 - DNA, 13 bp, Homo sapiens
gctctttggtaga

SEQ ID NO: 3806790 - DNA, 13 bp, Homo sapiens
gctgaaataaact

SEQ ID NO: 3806791 - DNA, 17 bp, Homo sapiens
gctgacagagccagagg

SEQ ID NO: 3806792 - DNA, 15 bp, Homo sapiens
gctgaccaagagaga

SEQ ID NO: 3806793 - DNA, 16 bp, Homo sapiens
gctgaccaagagagaa

SEQ ID NO: 3806794 - DNA, 20 bp, Homo sapiens
gctgactactactctgccaa

SEQ ID NO: 3806795 - DNA, 13 bp, Homo sapiens
gctgagagctctc

SEQ ID NO: 3806796 - DNA, 19 bp, Homo sapiens
gctgaggatttcaagcctg

SEQ ID NO: 3806797 - DNA, 23 bp, Homo sapiens
gctgagggtgagtgggtgaataa

SEQ ID NO: 3806798 - DNA, 13 bp, Homo sapiens
gctgagtggcagc

SEQ ID NO: 3806799 - DNA, 21 bp, Homo sapiens
gctgatgcattcccggtgcag

SEQ ID NO: 3806800 - DNA, 23 bp, Homo sapiens
gctgatgcattcccggtgcagaa

SEQ ID NO: 3806801 - DNA, 15 bp, Homo sapiens
gctgcaccctcaggc

SEQ ID NO: 3806802 - DNA, 16 bp, Homo sapiens
gctgcaccctcaggca

SEQ ID NO: 3806803 - DNA, 17 bp, Homo sapiens
gctgccgaccagagccc

SEQ ID NO: 3806804 - DNA, 23 bp, Homo sapiens
gctgcctgacactgagccccacc

SEQ ID NO: 3806805 - DNA, 13 bp, Homo sapiens
gctgctccccacg

SEQ ID NO: 3806806 - DNA, 13 bp, Homo sapiens
gctgcttcctaac

SEQ ID NO: 3806807 - DNA, 15 bp, Homo sapiens
gctggaaggagccag

SEQ ID NO: 3806808 - DNA, 14 bp, Homo sapiens
gctggatgagcaac

SEQ ID NO: 3806809 - DNA, 19 bp, Homo sapiens
gctggatgagcaactcctg

SEQ ID NO: 3806810 - DNA, 16 bp, Homo sapiens
gctggctcccagggcc

SEQ ID NO: 3806811 - DNA, 19 bp, Homo sapiens
gctggctcccagggccatg

SEQ ID NO: 3806812 - DNA, 20 bp, Homo sapiens
gctgggaataagtgccagga

SEQ ID NO: 3806813 - DNA, 21 bp, Homo sapiens
gctgggaggagggcaggcatc

SEQ ID NO: 3806814 - DNA, 14 bp, Homo sapiens
gctggggatgtctc

SEQ ID NO: 3806815 - DNA, 17 bp, Homo sapiens
gctgggtgccgggctgc

SEQ ID NO: 3806816 - DNA, 23 bp, Homo sapiens
gctgggtggcaccagcagcctgg

SEQ ID NO: 3806817 - DNA, 18 bp, Homo sapiens
gctgggttgtcactgaga

SEQ ID NO: 3806818 - DNA, 19 bp, Homo sapiens
gctgggttgtcactgagac

SEQ ID NO: 3806819 - DNA, 14 bp, Homo sapiens
gctgttcagctggt

SEQ ID NO: 3806820 - DNA, 16 bp, Homo sapiens
gctgtttgcgtgaatg

SEQ ID NO: 3806821 - DNA, 18 bp, Homo sapiens
gcttatgacatcacttgt

SEQ ID NO: 3806822 - DNA, 20 bp, Homo sapiens
gcttcatgaaaatcctacca

SEQ ID NO: 3806823 - DNA, 15 bp, Homo sapiens
gcttcctaacttatt

SEQ ID NO: 3806824 - DNA, 16 bp, Homo sapiens
gcttcctaacttattg

SEQ ID NO: 3806825 - DNA, 18 bp, Homo sapiens
gcttctagttctgccagg

SEQ ID NO: 3806826 - DNA, 15 bp, Homo sapiens
gcttctgcctcagct

SEQ ID NO: 3806827 - DNA, 14 bp, Homo sapiens
gcttgaacccagga

SEQ ID NO: 3806828 - DNA, 17 bp, Homo sapiens
gcttgaacccaggaggt

SEQ ID NO: 3806829 - DNA, 24 bp, Homo sapiens
gcttgggggatgactagaggcagg

SEQ ID NO: 3806830 - DNA, 18 bp, Homo sapiens
gctttagctggagggaga

SEQ ID NO: 3806831 - DNA, 16 bp, Homo sapiens
gctttgctaccaaagc

SEQ ID NO: 3806832 - DNA, 13 bp, Homo sapiens
gcttttctcccag

SEQ ID NO: 3806833 - DNA, 14 bp, Homo sapiens
gcttttctcccaga

SEQ ID NO: 3806834 - DNA, 18 bp, Homo sapiens
gcttttttttgagaatac

SEQ ID NO: 3806835 - DNA, 12 bp, Homo sapiens
ggaaaaaacatg

SEQ ID NO: 3806836 - DNA, 22 bp, Homo sapiens
ggaaaaccagactacttgggag

SEQ ID NO: 3806837 - DNA, 21 bp, Homo sapiens
ggaaaagagatggcctgagaa

SEQ ID NO: 3806838 - DNA, 17 bp, Homo sapiens
ggaaaatgccaatctct

SEQ ID NO: 3806839 - DNA, 20 bp, Homo sapiens
ggaaaggctctgaaagccag

SEQ ID NO: 3806840 - DNA, 18 bp, Homo sapiens
ggaacactaaaaccatat

SEQ ID NO: 3806841 - DNA, 14 bp, Homo sapiens
ggaactgctgggct

SEQ ID NO: 3806842 - DNA, 15 bp, Homo sapiens
ggaactgctgggctt

SEQ ID NO: 3806843 - DNA, 16 bp, Homo sapiens
ggaagacaatgtgaaa

SEQ ID NO: 3806844 - DNA, 22 bp, Homo sapiens
ggaagacaatgtgaaaagaaaa

SEQ ID NO: 3806845 - DNA, 13 bp, Homo sapiens
ggaagagaaaaaa

SEQ ID NO: 3806846 - DNA, 15 bp, Homo sapiens
ggaagagaaaaaata

SEQ ID NO: 3806847 - DNA, 17 bp, Homo sapiens
ggaaggatcccatgagc

SEQ ID NO: 3806848 - DNA, 22 bp, Homo sapiens
ggaaggatcccatgagctcctt

SEQ ID NO: 3806849 - DNA, 17 bp, Homo sapiens
ggaagtgcttgatatgt

SEQ ID NO: 3806850 - DNA, 22 bp, Homo sapiens
ggaagtgtgggtctgtgtgtgt

SEQ ID NO: 3806851 - DNA, 18 bp, Homo sapiens
ggaatagaaaagatgaga

SEQ ID NO: 3806852 - DNA, 22 bp, Homo sapiens
ggaattctcttggctggcttcc

SEQ ID NO: 3806853 - DNA, 23 bp, Homo sapiens
ggacacaccccacaccccagccc

SEQ ID NO: 3806854 - DNA, 11 bp, Homo sapiens
ggacacctgcc

SEQ ID NO: 3806855 - DNA, 13 bp, Homo sapiens
ggacacctgccct

SEQ ID NO: 3806856 - DNA, 16 bp, Homo sapiens
ggacacctgccctgcc

SEQ ID NO: 3806857 - DNA, 16 bp, Homo sapiens
ggacagaagcaggagt

SEQ ID NO: 3806858 - DNA, 19 bp, Homo sapiens
ggacagtatttgtggggag

SEQ ID NO: 3806859 - DNA, 22 bp, Homo sapiens
ggacatatgttaggaatactct

SEQ ID NO: 3806860 - DNA, 16 bp, Homo sapiens
ggacatggagagagac

SEQ ID NO: 3806861 - DNA, 12 bp, Homo sapiens
ggaccagggcat

SEQ ID NO: 3806862 - DNA, 13 bp, Homo sapiens
ggactccagttca

SEQ ID NO: 3806863 - DNA, 13 bp, Homo sapiens
ggagaaacagaga

SEQ ID NO: 3806864 - DNA, 14 bp, Homo sapiens
ggagaaacagagac

SEQ ID NO: 3806865 - DNA, 18 bp, Homo sapiens
ggagaagcggctggcagc

SEQ ID NO: 3806866 - DNA, 12 bp, Homo sapiens
ggagagagggga

SEQ ID NO: 3806867 - DNA, 14 bp, Homo sapiens
ggagagaggggaat

SEQ ID NO: 3806868 - DNA, 17 bp, Homo sapiens
ggagctaaggaagacac

SEQ ID NO: 3806869 - DNA, 15 bp, Homo sapiens
ggagcttgggaatgg

SEQ ID NO: 3806870 - DNA, 12 bp, Homo sapiens
ggaggaagagaa

SEQ ID NO: 3806871 - DNA, 14 bp, Homo sapiens
ggaggatggagaga

SEQ ID NO: 3806872 - DNA, 14 bp, Homo sapiens
ggaggcatctgcac

SEQ ID NO: 3806873 - DNA, 13 bp, Homo sapiens
ggagggaaaagct

SEQ ID NO: 3806874 - DNA, 14 bp, Homo sapiens
ggagggagggagag

SEQ ID NO: 3806875 - DNA, 12 bp, Homo sapiens
ggagggatttgg

SEQ ID NO: 3806876 - DNA, 17 bp, Homo sapiens
ggaggtgagaccacctc

SEQ ID NO: 3806877 - DNA, 20 bp, Homo sapiens
ggaggtggaggttgcagtga

SEQ ID NO: 3806878 - DNA, 16 bp, Homo sapiens
ggagtctcgctctgct

SEQ ID NO: 3806879 - DNA, 20 bp, Homo sapiens
ggagttcaagaccagcctgg

SEQ ID NO: 3806880 - DNA, 13 bp, Homo sapiens
ggatagatgtgtg

SEQ ID NO: 3806881 - DNA, 16 bp, Homo sapiens
ggatcacagcctctga

SEQ ID NO: 3806882 - DNA, 14 bp, Homo sapiens
ggatcacagggccc

SEQ ID NO: 3806883 - DNA, 17 bp, Homo sapiens
ggatcacagggccccag

SEQ ID NO: 3806884 - DNA, 17 bp, Homo sapiens
ggatcccatgagctcct

SEQ ID NO: 3806885 - DNA, 20 bp, Homo sapiens
ggatcccatgagctccttaa

SEQ ID NO: 3806886 - DNA, 12 bp, Homo sapiens
ggatcctgcact

SEQ ID NO: 3806887 - DNA, 19 bp, Homo sapiens
ggatgactagaggcaggga

SEQ ID NO: 3806888 - DNA, 18 bp, Homo sapiens
ggatgctggccacagaaa

SEQ ID NO: 3806889 - DNA, 14 bp, Homo sapiens
ggatgggaacactg

SEQ ID NO: 3806890 - DNA, 18 bp, Homo sapiens
ggatgggctttctcagtg

SEQ ID NO: 3806891 - DNA, 15 bp, Homo sapiens
ggattcccagagaga

SEQ ID NO: 3806892 - DNA, 16 bp, Homo sapiens
ggcaaagaactgcccc

SEQ ID NO: 3806893 - DNA, 20 bp, Homo sapiens
ggcaaagaactgccccatct

SEQ ID NO: 3806894 - DNA, 23 bp, Homo sapiens
ggcaaagaactgccccatctcct

SEQ ID NO: 3806895 - DNA, 16 bp, Homo sapiens
ggcaacgcacaaaaca

SEQ ID NO: 3806896 - DNA, 17 bp, Homo sapiens
ggcaatgccctacctgc

SEQ ID NO: 3806897 - DNA, 21 bp, Homo sapiens
ggcacagacactacatatcta

SEQ ID NO: 3806898 - DNA, 15 bp, Homo sapiens
ggcaccagcagcctg

SEQ ID NO: 3806899 - DNA, 16 bp, Homo sapiens
ggcacgatctcagctc

SEQ ID NO: 3806900 - DNA, 13 bp, Homo sapiens
ggcactgtggcct

SEQ ID NO: 3806901 - DNA, 24 bp, Homo sapiens
ggcagatttactgtcccaggagca

SEQ ID NO: 3806902 - DNA, 23 bp, Homo sapiens
ggcagctccagctgttacctgag

SEQ ID NO: 3806903 - DNA, 23 bp, Homo sapiens
ggcagctgaggacacaccccaca

SEQ ID NO: 3806904 - DNA, 12 bp, Homo sapiens
ggcagggtccta

SEQ ID NO: 3806905 - DNA, 20 bp, Homo sapiens
ggcagtctgagagaggccat

SEQ ID NO: 3806906 - DNA, 16 bp, Homo sapiens
ggcatccagagtccct

SEQ ID NO: 3806907 - DNA, 18 bp, Homo sapiens
ggcatccagagtccctgc

SEQ ID NO: 3806908 - DNA, 22 bp, Homo sapiens
ggcatccagagtccctgcctgg

SEQ ID NO: 3806909 - DNA, 19 bp, Homo sapiens
ggcatctccctgaccttct

SEQ ID NO: 3806910 - DNA, 15 bp, Homo sapiens
ggcatctgcaccctc

SEQ ID NO: 3806911 - DNA, 22 bp, Homo sapiens
ggcatctgcaccctcgatgaag

SEQ ID NO: 3806912 - DNA, 19 bp, Homo sapiens
ggcatgagggatcacaggg

SEQ ID NO: 3806913 - DNA, 19 bp, Homo sapiens
ggcatgcgcacaaggctga

SEQ ID NO: 3806914 - DNA, 14 bp, Homo sapiens
ggccacactgggct

SEQ ID NO: 3806915 - DNA, 16 bp, Homo sapiens
ggccactgtgaagaga

SEQ ID NO: 3806916 - DNA, 14 bp, Homo sapiens
ggccaggctgggct

SEQ ID NO: 3806917 - DNA, 18 bp, Homo sapiens
ggccagtcctagagctcc

SEQ ID NO: 3806918 - DNA, 19 bp, Homo sapiens
ggccagtggctggatctgt

SEQ ID NO: 3806919 - DNA, 23 bp, Homo sapiens
ggccccaccctcgtggacacctg

SEQ ID NO: 3806920 - DNA, 17 bp, Homo sapiens
ggccccagcctccaggc

SEQ ID NO: 3806921 - DNA, 13 bp, Homo sapiens
ggccccaggccct

SEQ ID NO: 3806922 - DNA, 20 bp, Homo sapiens
ggcccccactcacagggagc

SEQ ID NO: 3806923 - DNA, 22 bp, Homo sapiens
ggccctaggattcctcccccag

SEQ ID NO: 3806924 - DNA, 12 bp, Homo sapiens
ggccctgtgcct

SEQ ID NO: 3806925 - DNA, 18 bp, Homo sapiens
ggcctcagcctccaggca

SEQ ID NO: 3806926 - DNA, 22 bp, Homo sapiens
ggcctccagccctctcactgtg

SEQ ID NO: 3806927 - DNA, 19 bp, Homo sapiens
ggcctcttccgtgacgtca

SEQ ID NO: 3806928 - DNA, 14 bp, Homo sapiens
ggcctgggcaggag

SEQ ID NO: 3806929 - DNA, 17 bp, Homo sapiens
ggcctgggcaggaggga

SEQ ID NO: 3806930 - DNA, 19 bp, Homo sapiens
ggcctgggcaggagggagg

SEQ ID NO: 3806931 - DNA, 22 bp, Homo sapiens
ggccttctttctagagagggaa

SEQ ID NO: 3806932 - DNA, 17 bp, Homo sapiens
ggcgacagagcaagact

SEQ ID NO: 3806933 - DNA, 16 bp, Homo sapiens
ggcgagcccttagcct

SEQ ID NO: 3806934 - DNA, 11 bp, Homo sapiens
ggcgcaggagg

SEQ ID NO: 3806935 - DNA, 15 bp, Homo sapiens
ggcgtgctacctgca

SEQ ID NO: 3806936 - DNA, 18 bp, Homo sapiens
ggctaagatactgctgat

SEQ ID NO: 3806937 - DNA, 13 bp, Homo sapiens
ggctaggtacaca

SEQ ID NO: 3806938 - DNA, 19 bp, Homo sapiens
ggctagtctcttctcagag

SEQ ID NO: 3806939 - DNA, 14 bp, Homo sapiens
ggctccatgctggt

SEQ ID NO: 3806940 - DNA, 20 bp, Homo sapiens
ggctgcgtcgaactgtcctg

SEQ ID NO: 3806941 - DNA, 13 bp, Homo sapiens
ggctgggaggagg

SEQ ID NO: 3806942 - DNA, 19 bp, Homo sapiens
ggctgggttgtcactgaga

SEQ ID NO: 3806943 - DNA, 21 bp, Homo sapiens
ggctgggttgtcactgagact

SEQ ID NO: 3806944 - DNA, 21 bp, Homo sapiens
ggctgtggcatccagagtccc

SEQ ID NO: 3806945 - DNA, 19 bp, Homo sapiens
ggcttcaccagggttctga

SEQ ID NO: 3806946 - DNA, 21 bp, Homo sapiens
ggcttcacggaagagccttgc

SEQ ID NO: 3806947 - DNA, 21 bp, Homo sapiens
ggcttccctgggcctcagcct

SEQ ID NO: 3806948 - DNA, 12 bp, Homo sapiens
ggcttgcctgta

SEQ ID NO: 3806949 - DNA, 13 bp, Homo sapiens
gggaaaatcagcc

SEQ ID NO: 3806950 - DNA, 16 bp, Homo sapiens
gggaaccatgaagctg

SEQ ID NO: 3806951 - DNA, 15 bp, Homo sapiens
gggaaggatcccatg

SEQ ID NO: 3806952 - DNA, 14 bp, Homo sapiens
gggaattctcttgg

SEQ ID NO: 3806953 - DNA, 22 bp, Homo sapiens
gggagaatgtcagtatgtggaa

SEQ ID NO: 3806954 - DNA, 14 bp, Homo sapiens
gggaggagaatgag

SEQ ID NO: 3806955 - DNA, 21 bp, Homo sapiens
gggaggattgcttgagctcag

SEQ ID NO: 3806956 - DNA, 23 bp, Homo sapiens
gggaggattgcttgagctcagga

SEQ ID NO: 3806957 - DNA, 13 bp, Homo sapiens
gggatagatgtgt

SEQ ID NO: 3806958 - DNA, 14 bp, Homo sapiens
gggatagatgtgtg

SEQ ID NO: 3806959 - DNA, 20 bp, Homo sapiens
gggcaaagaactgccccatc

SEQ ID NO: 3806960 - DNA, 15 bp, Homo sapiens
gggcaccctccaaac

SEQ ID NO: 3806961 - DNA, 18 bp, Homo sapiens
gggcagtctgagagaggc

SEQ ID NO: 3806962 - DNA, 21 bp, Homo sapiens
gggcagtctgagagaggccat

SEQ ID NO: 3806963 - DNA, 15 bp, Homo sapiens
gggcatactaataaa

SEQ ID NO: 3806964 - DNA, 20 bp, Homo sapiens
gggcatctgagtccagctcc

SEQ ID NO: 3806965 - DNA, 16 bp, Homo sapiens
gggcatgggagggagg

SEQ ID NO: 3806966 - DNA, 18 bp, Homo sapiens
gggccatgaactttgtcc

SEQ ID NO: 3806967 - DNA, 20 bp, Homo sapiens
gggcctagatccacacacag

SEQ ID NO: 3806968 - DNA, 16 bp, Homo sapiens
gggcctcagcctccag

SEQ ID NO: 3806969 - DNA, 19 bp, Homo sapiens
gggcctcagcctccaggca

SEQ ID NO: 3806970 - DNA, 12 bp, Homo sapiens
gggcctgggcag

SEQ ID NO: 3806971 - DNA, 17 bp, Homo sapiens
gggcctgggcaggaggg

SEQ ID NO: 3806972 - DNA, 18 bp, Homo sapiens
gggcctggtcgttttcaa

SEQ ID NO: 3806973 - DNA, 23 bp, Homo sapiens
gggctaccccccctcctgctgcc

SEQ ID NO: 3806974 - DNA, 18 bp, Homo sapiens
gggctcagagtggggtag

SEQ ID NO: 3806975 - DNA, 22 bp, Homo sapiens
gggctcagcaaaagatgcttct

SEQ ID NO: 3806976 - DNA, 19 bp, Homo sapiens
ggggaaaatcagcctgctc

SEQ ID NO: 3806977 - DNA, 21 bp, Homo sapiens
ggggaaaatcagcctgctcca

SEQ ID NO: 3806978 - DNA, 24 bp, Homo sapiens
ggggaaaatcagcctgctccagct

SEQ ID NO: 3806979 - DNA, 18 bp, Homo sapiens
ggggagtttagggtgggg

SEQ ID NO: 3806980 - DNA, 13 bp, Homo sapiens
ggggatagatgtg

SEQ ID NO: 3806981 - DNA, 15 bp, Homo sapiens
ggggcagtctgagag

SEQ ID NO: 3806982 - DNA, 19 bp, Homo sapiens
ggggctgaggtgggaggat

SEQ ID NO: 3806983 - DNA, 14 bp, Homo sapiens
ggggcttccctggg

SEQ ID NO: 3806984 - DNA, 20 bp, Homo sapiens
gggtcgtcaccacctctcct

SEQ ID NO: 3806985 - DNA, 19 bp, Homo sapiens
gggtggcaccagcagcctg

SEQ ID NO: 3806986 - DNA, 13 bp, Homo sapiens
gggtggggagaga

SEQ ID NO: 3806987 - DNA, 14 bp, Homo sapiens
gggtggggagagac

SEQ ID NO: 3806988 - DNA, 18 bp, Homo sapiens
gggtggggagagacgggc

SEQ ID NO: 3806989 - DNA, 17 bp, Homo sapiens
gggtgtcctgcaccggg

SEQ ID NO: 3806990 - DNA, 21 bp, Homo sapiens
gggtgtcctgcaccggggcct

SEQ ID NO: 3806991 - DNA, 14 bp, Homo sapiens
gggttttggcctgc

SEQ ID NO: 3806992 - DNA, 18 bp, Homo sapiens
ggtaactagggaagataa

SEQ ID NO: 3806993 - DNA, 22 bp, Homo sapiens
ggtaattgttgctaatcttctt

SEQ ID NO: 3806994 - DNA, 20 bp, Homo sapiens
ggtagaaagagatacagagg

SEQ ID NO: 3806995 - DNA, 14 bp, Homo sapiens
ggtagaggagggca

SEQ ID NO: 3806996 - DNA, 12 bp, Homo sapiens
ggtagagtttat

SEQ ID NO: 3806997 - DNA, 22 bp, Homo sapiens
ggtagagtttatttttttgatg

SEQ ID NO: 3806998 - DNA, 16 bp, Homo sapiens
ggtagggaaataatag

SEQ ID NO: 3806999 - DNA, 16 bp, Homo sapiens
ggtcaataaagcagag

SEQ ID NO: 3807000 - DNA, 17 bp, Homo sapiens
ggtcaataaagcagagc

SEQ ID NO: 3807001 - DNA, 18 bp, Homo sapiens
ggtcaataaagcagagcc

SEQ ID NO: 3807002 - DNA, 19 bp, Homo sapiens
ggtcaataaagcagagcca

SEQ ID NO: 3807003 - DNA, 16 bp, Homo sapiens
ggtcaggtgccactga

SEQ ID NO: 3807004 - DNA, 10 bp, Homo sapiens
ggtccttcaa

SEQ ID NO: 3807005 - DNA, 13 bp, Homo sapiens
ggtcgaggcagga

SEQ ID NO: 3807006 - DNA, 13 bp, Homo sapiens
ggtcggccctgcc

SEQ ID NO: 3807007 - DNA, 13 bp, Homo sapiens
ggtctaacttttg

SEQ ID NO: 3807008 - DNA, 18 bp, Homo sapiens
ggtcttgatctcctgagc

SEQ ID NO: 3807009 - DNA, 15 bp, Homo sapiens
ggtgagaagcagagg

SEQ ID NO: 3807010 - DNA, 15 bp, Homo sapiens
ggtgagaccacctct

SEQ ID NO: 3807011 - DNA, 13 bp, Homo sapiens
ggtgcctggccct

SEQ ID NO: 3807012 - DNA, 15 bp, Homo sapiens
ggtgctctgaggtca

SEQ ID NO: 3807013 - DNA, 21 bp, Homo sapiens
ggtgcttctagttctgccagg

SEQ ID NO: 3807014 - DNA, 14 bp, Homo sapiens
ggtggcaccagcag

SEQ ID NO: 3807015 - DNA, 20 bp, Homo sapiens
ggtggcaccagcagcctgga

SEQ ID NO: 3807016 - DNA, 23 bp, Homo sapiens
ggtgggcggatcacttgaggtcg

SEQ ID NO: 3807017 - DNA, 13 bp, Homo sapiens
ggtgggggcctcg

SEQ ID NO: 3807018 - DNA, 15 bp, Homo sapiens
ggtggtggctcggga

SEQ ID NO: 3807019 - DNA, 21 bp, Homo sapiens
ggtgtcctgcaccggggcctg

SEQ ID NO: 3807020 - DNA, 14 bp, Homo sapiens
ggtgtggagaagcg

SEQ ID NO: 3807021 - DNA, 13 bp, Homo sapiens
ggttgaggtttca

SEQ ID NO: 3807022 - DNA, 17 bp, Homo sapiens
gtaaaaagattatatat

SEQ ID NO: 3807023 - DNA, 20 bp, Homo sapiens
gtaaaaagattatatatcat

SEQ ID NO: 3807024 - DNA, 21 bp, Homo sapiens
gtaaaaagattatatatcata

SEQ ID NO: 3807025 - DNA, 19 bp, Homo sapiens
gtaagaaaatgctagaaga

SEQ ID NO: 3807026 - DNA, 15 bp, Homo sapiens
gtaagacaaaggttt

SEQ ID NO: 3807027 - DNA, 13 bp, Homo sapiens
gtaagtacttcca

SEQ ID NO: 3807028 - DNA, 20 bp, Homo sapiens
gtaatttaaaattgtgatgt

SEQ ID NO: 3807029 - DNA, 16 bp, Homo sapiens
gtaattttgtgaaaga

SEQ ID NO: 3807030 - DNA, 16 bp, Homo sapiens
gtacaaaataaacaaa

SEQ ID NO: 3807031 - DNA, 16 bp, Homo sapiens
gtacaaagatatgcta

SEQ ID NO: 3807032 - DNA, 17 bp, Homo sapiens
gtacatagttatttatt

SEQ ID NO: 3807033 - DNA, 14 bp, Homo sapiens
gtagaccaaaataa

SEQ ID NO: 3807034 - DNA, 16 bp, Homo sapiens
gtagaccaaaataaaa

SEQ ID NO: 3807035 - DNA, 22 bp, Homo sapiens
gtagagacttccgtcacccttg

SEQ ID NO: 3807036 - DNA, 13 bp, Homo sapiens
gtagagtgggagc

SEQ ID NO: 3807037 - DNA, 15 bp, Homo sapiens
gtagatcctgagatg

SEQ ID NO: 3807038 - DNA, 12 bp, Homo sapiens
gtagctttgctc

SEQ ID NO: 3807039 - DNA, 17 bp, Homo sapiens
gtaggcatgagggatca

SEQ ID NO: 3807040 - DNA, 20 bp, Homo sapiens
gtaggcatgagggatcacag

SEQ ID NO: 3807041 - DNA, 23 bp, Homo sapiens
gtaggcatgagggatcacagggc

SEQ ID NO: 3807042 - DNA, 14 bp, Homo sapiens
gtaggttgggagaa

SEQ ID NO: 3807043 - DNA, 14 bp, Homo sapiens
gtagtagtgtcttc

SEQ ID NO: 3807044 - DNA, 19 bp, Homo sapiens
gtagtgatttttatgccac

SEQ ID NO: 3807045 - DNA, 22 bp, Homo sapiens
gtagtgtcttcctagtatatta

SEQ ID NO: 3807046 - DNA, 20 bp, Homo sapiens
gtataggataaattacatta

SEQ ID NO: 3807047 - DNA, 14 bp, Homo sapiens
gtatatattctaca

SEQ ID NO: 3807048 - DNA, 17 bp, Homo sapiens
gtatatgtatatctata

SEQ ID NO: 3807049 - DNA, 14 bp, Homo sapiens
gtatattagtttga

SEQ ID NO: 3807050 - DNA, 20 bp, Homo sapiens
gtatattctcttgtctggct

SEQ ID NO: 3807051 - DNA, 12 bp, Homo sapiens
gtatcatagaaa

SEQ ID NO: 3807052 - DNA, 15 bp, Homo sapiens
gtatcatagaaatgt

SEQ ID NO: 3807053 - DNA, 14 bp, Homo sapiens
gtatccactttgca

SEQ ID NO: 3807054 - DNA, 22 bp, Homo sapiens
gtatgaacttgaggacacatgt

SEQ ID NO: 3807055 - DNA, 15 bp, Homo sapiens
gtatgtggaagtgtg

SEQ ID NO: 3807056 - DNA, 16 bp, Homo sapiens
gtatgtggaagtgtgg

SEQ ID NO: 3807057 - DNA, 18 bp, Homo sapiens
gtatgtggaagtgtgggt

SEQ ID NO: 3807058 - DNA, 19 bp, Homo sapiens
gtatgtgggggtctgtgtg

SEQ ID NO: 3807059 - DNA, 13 bp, Homo sapiens
gtattagccagga

SEQ ID NO: 3807060 - DNA, 13 bp, Homo sapiens
gtatttatcttta

SEQ ID NO: 3807061 - DNA, 16 bp, Homo sapiens
gtcaagtgaaaaagga

SEQ ID NO: 3807062 - DNA, 17 bp, Homo sapiens
gtcacccttggtagagt

SEQ ID NO: 3807063 - DNA, 19 bp, Homo sapiens
gtcacccttggtagagttt

SEQ ID NO: 3807064 - DNA, 20 bp, Homo sapiens
gtcacccttggtagagttta

SEQ ID NO: 3807065 - DNA, 18 bp, Homo sapiens
gtcactaggatgcagatg

SEQ ID NO: 3807066 - DNA, 12 bp, Homo sapiens
gtcactgagact

SEQ ID NO: 3807067 - DNA, 19 bp, Homo sapiens
gtcactggaccactgggca

SEQ ID NO: 3807068 - DNA, 13 bp, Homo sapiens
gtcatagaaatta

SEQ ID NO: 3807069 - DNA, 13 bp, Homo sapiens
gtcatctgtttaa

SEQ ID NO: 3807070 - DNA, 19 bp, Homo sapiens
gtccagaccattgtcttcc

SEQ ID NO: 3807071 - DNA, 19 bp, Homo sapiens
gtccaggggagggaaaagc

SEQ ID NO: 3807072 - DNA, 24 bp, Homo sapiens
gtccagtgggaggtgagaccacct

SEQ ID NO: 3807073 - DNA, 12 bp, Homo sapiens
gtccataaagta

SEQ ID NO: 3807074 - DNA, 15 bp, Homo sapiens
gtccatcagcctcca

SEQ ID NO: 3807075 - DNA, 19 bp, Homo sapiens
gtccccctcccctcccagt

SEQ ID NO: 3807076 - DNA, 15 bp, Homo sapiens
gtccctacccactct

SEQ ID NO: 3807077 - DNA, 16 bp, Homo sapiens
gtccctgaagagaagg

SEQ ID NO: 3807078 - DNA, 23 bp, Homo sapiens
gtccctgcctggaccagcctctc

SEQ ID NO: 3807079 - DNA, 21 bp, Homo sapiens
gtccggtggaaggccttcttt

SEQ ID NO: 3807080 - DNA, 15 bp, Homo sapiens
gtcctagagctcctg

SEQ ID NO: 3807081 - DNA, 20 bp, Homo sapiens
gtcctagagctcctgtccct

SEQ ID NO: 3807082 - DNA, 20 bp, Homo sapiens
gtcctcacagcctctccctt

SEQ ID NO: 3807083 - DNA, 12 bp, Homo sapiens
gtcctcagcccc

SEQ ID NO: 3807084 - DNA, 15 bp, Homo sapiens
gtcctcattataaaa

SEQ ID NO: 3807085 - DNA, 20 bp, Homo sapiens
gtcctgcaccggggcctggg

SEQ ID NO: 3807086 - DNA, 13 bp, Homo sapiens
gtccttcaaaggc

SEQ ID NO: 3807087 - DNA, 18 bp, Homo sapiens
gtctaacttttgtgtgaa

SEQ ID NO: 3807088 - DNA, 21 bp, Homo sapiens
gtctccagtatccactttgca

SEQ ID NO: 3807089 - DNA, 12 bp, Homo sapiens
gtctctctgtga

SEQ ID NO: 3807090 - DNA, 13 bp, Homo sapiens
gtctctctgtgaa

SEQ ID NO: 3807091 - DNA, 13 bp, Homo sapiens
gtctcttctcaga

SEQ ID NO: 3807092 - DNA, 13 bp, Homo sapiens
gtctgagagaggc

SEQ ID NO: 3807093 - DNA, 15 bp, Homo sapiens
gtctgaggccccagg

SEQ ID NO: 3807094 - DNA, 19 bp, Homo sapiens
gtctggcgagcccttagcc

SEQ ID NO: 3807095 - DNA, 21 bp, Homo sapiens
gtctgtgtgtttatgtgtgtg

SEQ ID NO: 3807096 - DNA, 22 bp, Homo sapiens
gtctgtgtgtttatgtgtgtgt

SEQ ID NO: 3807097 - DNA, 18 bp, Homo sapiens
gtcttccaaccccagctg

SEQ ID NO: 3807098 - DNA, 21 bp, Homo sapiens
gtcttccaaccccagctggcc

SEQ ID NO: 3807099 - DNA, 23 bp, Homo sapiens
gtcttccaaccccagctggcctc

SEQ ID NO: 3807100 - DNA, 16 bp, Homo sapiens
gtgaacaaagaaaaga

SEQ ID NO: 3807101 - DNA, 23 bp, Homo sapiens
gtgaataatacagtatctcaggg

SEQ ID NO: 3807102 - DNA, 21 bp, Homo sapiens
gtgaatgatgatcctaggcat

SEQ ID NO: 3807103 - DNA, 22 bp, Homo sapiens
gtgaattacactcaaggaaaag

SEQ ID NO: 3807104 - DNA, 14 bp, Homo sapiens
gtgaccatgaaaaa

SEQ ID NO: 3807105 - DNA, 16 bp, Homo sapiens
gtgacttgcctggggc

SEQ ID NO: 3807106 - DNA, 14 bp, Homo sapiens
gtgagaccacctct

SEQ ID NO: 3807107 - DNA, 20 bp, Homo sapiens
gtgagaccacctctcaatat

SEQ ID NO: 3807108 - DNA, 22 bp, Homo sapiens
gtgagaccctgtctcaaaaaaa

SEQ ID NO: 3807109 - DNA, 15 bp, Homo sapiens
gtgagtgtgactttt

SEQ ID NO: 3807110 - DNA, 19 bp, Homo sapiens
gtgatatccacaaatgcta

SEQ ID NO: 3807111 - DNA, 20 bp, Homo sapiens
gtgatcacgatccagtctgc

SEQ ID NO: 3807112 - DNA, 15 bp, Homo sapiens
gtgatctgctggcct

SEQ ID NO: 3807113 - DNA, 21 bp, Homo sapiens
gtgatttttatgccacctgaa

SEQ ID NO: 3807114 - DNA, 22 bp, Homo sapiens
gtgcaatggcacgatctcagct

SEQ ID NO: 3807115 - DNA, 20 bp, Homo sapiens
gtgcacaaatatttattttc

SEQ ID NO: 3807116 - DNA, 13 bp, Homo sapiens
gtgcactggcccc

SEQ ID NO: 3807117 - DNA, 21 bp, Homo sapiens
gtgccaggatggaatgatggg

SEQ ID NO: 3807118 - DNA, 19 bp, Homo sapiens
gtgccttgtcacgccagac

SEQ ID NO: 3807119 - DNA, 14 bp, Homo sapiens
gtgcgcacacacag

SEQ ID NO: 3807120 - DNA, 12 bp, Homo sapiens
gtgctacctgca

SEQ ID NO: 3807121 - DNA, 14 bp, Homo sapiens
gtgctcgcctctgc

SEQ ID NO: 3807122 - DNA, 16 bp, Homo sapiens
gtgctctgaggtcaat

SEQ ID NO: 3807123 - DNA, 17 bp, Homo sapiens
gtgctgtcctctgaagg

SEQ ID NO: 3807124 - DNA, 21 bp, Homo sapiens
gtgcttctagttctgccagga

SEQ ID NO: 3807125 - DNA, 15 bp, Homo sapiens
gtgcttttaaatgca

SEQ ID NO: 3807126 - DNA, 18 bp, Homo sapiens
gtggaaaaatagcctgcc

SEQ ID NO: 3807127 - DNA, 20 bp, Homo sapiens
gtggaagtgtgggtctgtgt

SEQ ID NO: 3807128 - DNA, 22 bp, Homo sapiens
gtggaagtgtgggtctgtgtgt

SEQ ID NO: 3807129 - DNA, 18 bp, Homo sapiens
gtggacacctgccctgcc

SEQ ID NO: 3807130 - DNA, 16 bp, Homo sapiens
gtggacatcatgaagc

SEQ ID NO: 3807131 - DNA, 20 bp, Homo sapiens
gtggagaagcggctggcagc

SEQ ID NO: 3807132 - DNA, 22 bp, Homo sapiens
gtggagagaaagccaaggctgc

SEQ ID NO: 3807133 - DNA, 23 bp, Homo sapiens
gtggaggttgcagtgaactgaga

SEQ ID NO: 3807134 - DNA, 18 bp, Homo sapiens
gtggcaccagcagcctgg

SEQ ID NO: 3807135 - DNA, 19 bp, Homo sapiens
gtggcaccagcagcctgga

SEQ ID NO: 3807136 - DNA, 14 bp, Homo sapiens
gtggcatccagagt

SEQ ID NO: 3807137 - DNA, 23 bp, Homo sapiens
gtggcgtgatctcggctcactgc

SEQ ID NO: 3807138 - DNA, 18 bp, Homo sapiens
gtggctcgggaggcgaag

SEQ ID NO: 3807139 - DNA, 13 bp, Homo sapiens
gtgggaggacaga

SEQ ID NO: 3807140 - DNA, 15 bp, Homo sapiens
gtggggcctagatcc

SEQ ID NO: 3807141 - DNA, 15 bp, Homo sapiens
gtgggggtctgtgtg

SEQ ID NO: 3807142 - DNA, 16 bp, Homo sapiens
gtgggttagctacctg

SEQ ID NO: 3807143 - DNA, 23 bp, Homo sapiens
gtgtaatttaaaattgtgatgtg

SEQ ID NO: 3807144 - DNA, 19 bp, Homo sapiens
gtgtatggaaataaatgta

SEQ ID NO: 3807145 - DNA, 13 bp, Homo sapiens
gtgtatgtggggg

SEQ ID NO: 3807146 - DNA, 15 bp, Homo sapiens
gtgtctgctcagtaa

SEQ ID NO: 3807147 - DNA, 20 bp, Homo sapiens
gtgtgcacaaatatttattt

SEQ ID NO: 3807148 - DNA, 21 bp, Homo sapiens
gtgtggagaagcggctggcag

SEQ ID NO: 3807149 - DNA, 14 bp, Homo sapiens
gtgtgtaatttaaa

SEQ ID NO: 3807150 - DNA, 16 bp, Homo sapiens
gtgtgtgggagtgtgt

SEQ ID NO: 3807151 - DNA, 12 bp, Homo sapiens
gtgtgttgtgtg

SEQ ID NO: 3807152 - DNA, 15 bp, Homo sapiens
gtgttgtgtgtggga

SEQ ID NO: 3807153 - DNA, 23 bp, Homo sapiens
gtgtttaacggcactgtggcctt

SEQ ID NO: 3807154 - DNA, 12 bp, Homo sapiens
gtgtttatgtgt

SEQ ID NO: 3807155 - DNA, 21 bp, Homo sapiens
gttactgtcctgttttctaat

SEQ ID NO: 3807156 - DNA, 16 bp, Homo sapiens
gttaggaagttacctg

SEQ ID NO: 3807157 - DNA, 19 bp, Homo sapiens
gttcacaccattctcctgc

SEQ ID NO: 3807158 - DNA, 10 bp, Homo sapiens
gttcattaaa

SEQ ID NO: 3807159 - DNA, 21 bp, Homo sapiens
gttcattcaaaatgtccagct

SEQ ID NO: 3807160 - DNA, 17 bp, Homo sapiens
gttccagttcccatggt

SEQ ID NO: 3807161 - DNA, 18 bp, Homo sapiens
gttccataataaacttct

SEQ ID NO: 3807162 - DNA, 15 bp, Homo sapiens
gttctctttaaaata

SEQ ID NO: 3807163 - DNA, 20 bp, Homo sapiens
gttgacacggccatgaccac

SEQ ID NO: 3807164 - DNA, 22 bp, Homo sapiens
gttgcagatctttttgtgaaat

SEQ ID NO: 3807165 - DNA, 17 bp, Homo sapiens
gttgcagtgaactgaga

SEQ ID NO: 3807166 - DNA, 21 bp, Homo sapiens
gttgctgactactactctgcc

SEQ ID NO: 3807167 - DNA, 23 bp, Homo sapiens
gttgctgactactactctgccaa

SEQ ID NO: 3807168 - DNA, 18 bp, Homo sapiens
gttgcttttgcacctacg

SEQ ID NO: 3807169 - DNA, 22 bp, Homo sapiens
gttggaatgaattaaataaacc

SEQ ID NO: 3807170 - DNA, 18 bp, Homo sapiens
gttggagccactctgttc

SEQ ID NO: 3807171 - DNA, 13 bp, Homo sapiens
gttgtcactgaga

SEQ ID NO: 3807172 - DNA, 17 bp, Homo sapiens
gttgtcctcagccccgc

SEQ ID NO: 3807173 - DNA, 16 bp, Homo sapiens
gttgtgtgtgggagtg

SEQ ID NO: 3807174 - DNA, 14 bp, Homo sapiens
gtttaaaaaaagta

SEQ ID NO: 3807175 - DNA, 17 bp, Homo sapiens
gtttaaaaaaagtatat

SEQ ID NO: 3807176 - DNA, 22 bp, Homo sapiens
gtttaaaaaaagtatatattct

SEQ ID NO: 3807177 - DNA, 23 bp, Homo sapiens
gtttaaaaaaagtatatattcta

SEQ ID NO: 3807178 - DNA, 22 bp, Homo sapiens
gtttaaaactcagaatataaca

SEQ ID NO: 3807179 - DNA, 22 bp, Homo sapiens
gtttaacggcactgtggccttg

SEQ ID NO: 3807180 - DNA, 14 bp, Homo sapiens
gtttaatttacaca

SEQ ID NO: 3807181 - DNA, 13 bp, Homo sapiens
gtttatgtgtgtg

SEQ ID NO: 3807182 - DNA, 21 bp, Homo sapiens
gtttatttttttgatggctaa

SEQ ID NO: 3807183 - DNA, 22 bp, Homo sapiens
gtttatttttttgatggctaag

SEQ ID NO: 3807184 - DNA, 18 bp, Homo sapiens
gtttccctcccaacagag

SEQ ID NO: 3807185 - DNA, 14 bp, Homo sapiens
gtttcgacgtttga

SEQ ID NO: 3807186 - DNA, 21 bp, Homo sapiens
gtttgggggcttccctgggcc

SEQ ID NO: 3807187 - DNA, 17 bp, Homo sapiens
gttttatgtgaatgtgg

SEQ ID NO: 3807188 - DNA, 18 bp, Homo sapiens
gttttctcctcccaggaa

SEQ ID NO: 3807189 - DNA, 21 bp, Homo sapiens
gttttctcctcccaggaactg

SEQ ID NO: 3807190 - DNA, 16 bp, Homo sapiens
gttttcttaacttaaa

SEQ ID NO: 3807191 - DNA, 19 bp, Homo sapiens
gttttgatttgtactgaaa

SEQ ID NO: 3807192 - DNA, 14 bp, Homo sapiens
gttttgtaaatgta

SEQ ID NO: 3807193 - DNA, 18 bp, Homo sapiens
taaaaaaaatagaagcta

SEQ ID NO: 3807194 - DNA, 14 bp, Homo sapiens
taaaaaaagtatat

SEQ ID NO: 3807195 - DNA, 12 bp, Homo sapiens
taaaaagattat

SEQ ID NO: 3807196 - DNA, 19 bp, Homo sapiens
taaaaagattatatatcat

SEQ ID NO: 3807197 - DNA, 18 bp, Homo sapiens
taaaacaatgtttttcat

SEQ ID NO: 3807198 - DNA, 22 bp, Homo sapiens
taaaacagtgtatttggaaaat

SEQ ID NO: 3807199 - DNA, 13 bp, Homo sapiens
taaaactcagaat

SEQ ID NO: 3807200 - DNA, 17 bp, Homo sapiens
taaaactcagaatataa

SEQ ID NO: 3807201 - DNA, 22 bp, Homo sapiens
taaaaggtattaaattgatgtt

SEQ ID NO: 3807202 - DNA, 16 bp, Homo sapiens
taaaattgtgatgtgt

SEQ ID NO: 3807203 - DNA, 13 bp, Homo sapiens
taaacaaaggttg

SEQ ID NO: 3807204 - DNA, 16 bp, Homo sapiens
taaaccgccaaggctg

SEQ ID NO: 3807205 - DNA, 18 bp, Homo sapiens
taaaccgccaaggctggg

SEQ ID NO: 3807206 - DNA, 15 bp, Homo sapiens
taaactaggtaaaat

SEQ ID NO: 3807207 - DNA, 20 bp, Homo sapiens
taaactatcttggtgaattt

SEQ ID NO: 3807208 - DNA, 21 bp, Homo sapiens
taaactatcttggtgaatttt

SEQ ID NO: 3807209 - DNA, 22 bp, Homo sapiens
taaactatcttggtgaattttt

SEQ ID NO: 3807210 - DNA, 21 bp, Homo sapiens
taaactcaaaatatttgtaca

SEQ ID NO: 3807211 - DNA, 16 bp, Homo sapiens
taaagaaaaatatgat

SEQ ID NO: 3807212 - DNA, 13 bp, Homo sapiens
taaagagaaaaat

SEQ ID NO: 3807213 - DNA, 16 bp, Homo sapiens
taaagcagagccaagg

SEQ ID NO: 3807214 - DNA, 22 bp, Homo sapiens
taaagctttggacaagtccttg

SEQ ID NO: 3807215 - DNA, 13 bp, Homo sapiens
taaaggcttttgg

SEQ ID NO: 3807216 - DNA, 22 bp, Homo sapiens
taaaggtatttagaatatatta

SEQ ID NO: 3807217 - DNA, 19 bp, Homo sapiens
taaagtatggtattgaaac

SEQ ID NO: 3807218 - DNA, 15 bp, Homo sapiens
taaagtgtagcaccc

SEQ ID NO: 3807219 - DNA, 13 bp, Homo sapiens
taaataaaatgac

SEQ ID NO: 3807220 - DNA, 13 bp, Homo sapiens
taaataaaccctt

SEQ ID NO: 3807221 - DNA, 21 bp, Homo sapiens
taaatagggaaaaaacatgta

SEQ ID NO: 3807222 - DNA, 14 bp, Homo sapiens
taaatgctgaatga

SEQ ID NO: 3807223 - DNA, 17 bp, Homo sapiens
taaatggggctcacaaa

SEQ ID NO: 3807224 - DNA, 20 bp, Homo sapiens
taaatgtctagttgtaacac

SEQ ID NO: 3807225 - DNA, 17 bp, Homo sapiens
taaatgttggaatgtta

SEQ ID NO: 3807226 - DNA, 13 bp, Homo sapiens
taaattacattaa

SEQ ID NO: 3807227 - DNA, 19 bp, Homo sapiens
taacagaatattaaattag

SEQ ID NO: 3807228 - DNA, 16 bp, Homo sapiens
taaccaggccccagcc

SEQ ID NO: 3807229 - DNA, 19 bp, Homo sapiens
taaccaggccccagcctcc

SEQ ID NO: 3807230 - DNA, 22 bp, Homo sapiens
taacgcgtatctaggctttggt

SEQ ID NO: 3807231 - DNA, 22 bp, Homo sapiens
taacttattgcctgggcagtgc

SEQ ID NO: 3807232 - DNA, 13 bp, Homo sapiens
taacttttgtaag

SEQ ID NO: 3807233 - DNA, 18 bp, Homo sapiens
taacttttgtaagacaaa

SEQ ID NO: 3807234 - DNA, 16 bp, Homo sapiens
taacttttgtgtgaaa

SEQ ID NO: 3807235 - DNA, 22 bp, Homo sapiens
taagagggtgaacaaagaaaag

SEQ ID NO: 3807236 - DNA, 23 bp, Homo sapiens
taagattgctttaagaaactgtt

SEQ ID NO: 3807237 - DNA, 12 bp, Homo sapiens
taagtatttagg

SEQ ID NO: 3807238 - DNA, 20 bp, Homo sapiens
taagtatttaggtttttgtt

SEQ ID NO: 3807239 - DNA, 21 bp, Homo sapiens
taatagaagaacatccaagga

SEQ ID NO: 3807240 - DNA, 14 bp, Homo sapiens
taatagagacacag

SEQ ID NO: 3807241 - DNA, 17 bp, Homo sapiens
taatatctgagaagtgt

SEQ ID NO: 3807242 - DNA, 20 bp, Homo sapiens
taatattaaggaagacaatg

SEQ ID NO: 3807243 - DNA, 14 bp, Homo sapiens
taatctagaacaca

SEQ ID NO: 3807244 - DNA, 16 bp, Homo sapiens
taatgaagtgtttcct

SEQ ID NO: 3807245 - DNA, 15 bp, Homo sapiens
taatgatcaaaacat

SEQ ID NO: 3807246 - DNA, 21 bp, Homo sapiens
taatgttgggtagaaagagat

SEQ ID NO: 3807247 - DNA, 13 bp, Homo sapiens
taattcaataaaa

SEQ ID NO: 3807248 - DNA, 14 bp, Homo sapiens
taattgatttcaag

SEQ ID NO: 3807249 - DNA, 15 bp, Homo sapiens
taatttactgattcc

SEQ ID NO: 3807250 - DNA, 15 bp, Homo sapiens
tacaaaaagcataaa

SEQ ID NO: 3807251 - DNA, 19 bp, Homo sapiens
tacaaaataaacaaataac

SEQ ID NO: 3807252 - DNA, 14 bp, Homo sapiens
tacaaagttcactg

SEQ ID NO: 3807253 - DNA, 22 bp, Homo sapiens
tacaattaaaggtcctgccctc

SEQ ID NO: 3807254 - DNA, 14 bp, Homo sapiens
tacaatttctatta

SEQ ID NO: 3807255 - DNA, 22 bp, Homo sapiens
tacaatttctattatttttcaa

SEQ ID NO: 3807256 - DNA, 15 bp, Homo sapiens
tacacatggatgcac

SEQ ID NO: 3807257 - DNA, 13 bp, Homo sapiens
tacagaatgaatc

SEQ ID NO: 3807258 - DNA, 15 bp, Homo sapiens
tacagtatctcaggg

SEQ ID NO: 3807259 - DNA, 18 bp, Homo sapiens
tacagtatctcagggcct

SEQ ID NO: 3807260 - DNA, 16 bp, Homo sapiens
tacatcacttgagaca

SEQ ID NO: 3807261 - DNA, 16 bp, Homo sapiens
tacattatattcctct

SEQ ID NO: 3807262 - DNA, 22 bp, Homo sapiens
tacattatattcctctaaaact

SEQ ID NO: 3807263 - DNA, 14 bp, Homo sapiens
taccacttccctgc

SEQ ID NO: 3807264 - DNA, 15 bp, Homo sapiens
taccatttcagagag

SEQ ID NO: 3807265 - DNA, 20 bp, Homo sapiens
tacctactttttctttgatt

SEQ ID NO: 3807266 - DNA, 17 bp, Homo sapiens
tacctgcctgttctcca

SEQ ID NO: 3807267 - DNA, 19 bp, Homo sapiens
tacctgcctgttctccaga

SEQ ID NO: 3807268 - DNA, 22 bp, Homo sapiens
tacctgcctgttctccagatgg

SEQ ID NO: 3807269 - DNA, 15 bp, Homo sapiens
taccttcagatccta

SEQ ID NO: 3807270 - DNA, 17 bp, Homo sapiens
taccttcagatcctacc

SEQ ID NO: 3807271 - DNA, 18 bp, Homo sapiens
tacctttttttctctcct

SEQ ID NO: 3807272 - DNA, 16 bp, Homo sapiens
tactctaccctcttag

SEQ ID NO: 3807273 - DNA, 13 bp, Homo sapiens
tactgaagtgcag

SEQ ID NO: 3807274 - DNA, 19 bp, Homo sapiens
tactgctgatgctgaaata

SEQ ID NO: 3807275 - DNA, 17 bp, Homo sapiens
tacttatttttgacagt

SEQ ID NO: 3807276 - DNA, 21 bp, Homo sapiens
tagaaaaggctaggtacacag

SEQ ID NO: 3807277 - DNA, 17 bp, Homo sapiens
tagaaacaaacatctaa

SEQ ID NO: 3807278 - DNA, 14 bp, Homo sapiens
tagaaacataaata

SEQ ID NO: 3807279 - DNA, 18 bp, Homo sapiens
tagaaagagatacagagg

SEQ ID NO: 3807280 - DNA, 18 bp, Homo sapiens
tagaacacccactggcca

SEQ ID NO: 3807281 - DNA, 19 bp, Homo sapiens
tagaacacccactggccag

SEQ ID NO: 3807282 - DNA, 20 bp, Homo sapiens
tagaacacccactggccagt

SEQ ID NO: 3807283 - DNA, 19 bp, Homo sapiens
tagaagatctgcttccctg

SEQ ID NO: 3807284 - DNA, 19 bp, Homo sapiens
tagaagctataaagaaaag

SEQ ID NO: 3807285 - DNA, 21 bp, Homo sapiens
tagacatttgctatgagctgg

SEQ ID NO: 3807286 - DNA, 15 bp, Homo sapiens
tagagacacagagat

SEQ ID NO: 3807287 - DNA, 20 bp, Homo sapiens
tagagacggggtttccccat

SEQ ID NO: 3807288 - DNA, 19 bp, Homo sapiens
tagagctcctgtccctacc

SEQ ID NO: 3807289 - DNA, 21 bp, Homo sapiens
tagaggcatgaacacacatgg

SEQ ID NO: 3807290 - DNA, 13 bp, Homo sapiens
tagcacatgattt

SEQ ID NO: 3807291 - DNA, 16 bp, Homo sapiens
tagcactttgggaggc

SEQ ID NO: 3807292 - DNA, 17 bp, Homo sapiens
tagccatctcaagcaag

SEQ ID NO: 3807293 - DNA, 11 bp, Homo sapiens
tagctttgctc

SEQ ID NO: 3807294 - DNA, 18 bp, Homo sapiens
taggaactgctgggcttg

SEQ ID NO: 3807295 - DNA, 19 bp, Homo sapiens
taggcatcccaggggacca

SEQ ID NO: 3807296 - DNA, 13 bp, Homo sapiens
taggctagggtgg

SEQ ID NO: 3807297 - DNA, 16 bp, Homo sapiens
taggctagggtgggga

SEQ ID NO: 3807298 - DNA, 16 bp, Homo sapiens
tagggaaataataggg

SEQ ID NO: 3807299 - DNA, 13 bp, Homo sapiens
tagggaagataat

SEQ ID NO: 3807300 - DNA, 14 bp, Homo sapiens
tagtctcttctcag

SEQ ID NO: 3807301 - DNA, 20 bp, Homo sapiens
tagtctcttctcagagcagc

SEQ ID NO: 3807302 - DNA, 21 bp, Homo sapiens
tagtgatttttatgccacctg

SEQ ID NO: 3807303 - DNA, 19 bp, Homo sapiens
tagttcaatatttgttact

SEQ ID NO: 3807304 - DNA, 17 bp, Homo sapiens
tataaaatgggaagact

SEQ ID NO: 3807305 - DNA, 22 bp, Homo sapiens
tataaacatgcttgcattatat

SEQ ID NO: 3807306 - DNA, 13 bp, Homo sapiens
tataaacttcaga

SEQ ID NO: 3807307 - DNA, 22 bp, Homo sapiens
tatacctgggcatactaataaa

SEQ ID NO: 3807308 - DNA, 18 bp, Homo sapiens
tataggataaattacatt

SEQ ID NO: 3807309 - DNA, 15 bp, Homo sapiens
tataggatcatttgt

SEQ ID NO: 3807310 - DNA, 15 bp, Homo sapiens
tatatttaacaagat

SEQ ID NO: 3807311 - DNA, 16 bp, Homo sapiens
tatccacaaatgctat

SEQ ID NO: 3807312 - DNA, 17 bp, Homo sapiens
tatccacaaatgctatt

SEQ ID NO: 3807313 - DNA, 21 bp, Homo sapiens
tatcccacggaaaatgccaat

SEQ ID NO: 3807314 - DNA, 17 bp, Homo sapiens
tatcctgaaatttcaga

SEQ ID NO: 3807315 - DNA, 23 bp, Homo sapiens
tatctctgtgtgcacaaatattt

SEQ ID NO: 3807316 - DNA, 18 bp, Homo sapiens
tatctgagaagtgtatat

SEQ ID NO: 3807317 - DNA, 22 bp, Homo sapiens
tatctgagaagtgtatatagtt

SEQ ID NO: 3807318 - DNA, 18 bp, Homo sapiens
tatgaacttgaggacaca

SEQ ID NO: 3807319 - DNA, 23 bp, Homo sapiens
tatgaacttgaggacacatgtcc

SEQ ID NO: 3807320 - DNA, 20 bp, Homo sapiens
tatgacatcacttgtacaaa

SEQ ID NO: 3807321 - DNA, 23 bp, Homo sapiens
tatgaggacttgtgtctctgtgc

SEQ ID NO: 3807322 - DNA, 20 bp, Homo sapiens
tatgccacctgaataaagaa

SEQ ID NO: 3807323 - DNA, 17 bp, Homo sapiens
tatgccttcctgtttaa

SEQ ID NO: 3807324 - DNA, 17 bp, Homo sapiens
tatggaaataaatgtat

SEQ ID NO: 3807325 - DNA, 23 bp, Homo sapiens
tatgggatgtaaacaatgtaaag

SEQ ID NO: 3807326 - DNA, 18 bp, Homo sapiens
tatggggatagatgtgtg

SEQ ID NO: 3807327 - DNA, 12 bp, Homo sapiens
tatgtgaatgtg

SEQ ID NO: 3807328 - DNA, 12 bp, Homo sapiens
tatgtggaagtg

SEQ ID NO: 3807329 - DNA, 16 bp, Homo sapiens
tatgtggaagtgtggg

SEQ ID NO: 3807330 - DNA, 20 bp, Homo sapiens
tatgtgggggtctgtgtgtt

SEQ ID NO: 3807331 - DNA, 23 bp, Homo sapiens
tatgtgtgtgtgttgtgtgtggg

SEQ ID NO: 3807332 - DNA, 23 bp, Homo sapiens
tatgttattggaattttctttca

SEQ ID NO: 3807333 - DNA, 21 bp, Homo sapiens
tattaaattagacttcctgta

SEQ ID NO: 3807334 - DNA, 12 bp, Homo sapiens
tattagagaaga

SEQ ID NO: 3807335 - DNA, 22 bp, Homo sapiens
tattagtttgatttaatatctg

SEQ ID NO: 3807336 - DNA, 13 bp, Homo sapiens
tattcaataaagc

SEQ ID NO: 3807337 - DNA, 16 bp, Homo sapiens
tattcatgctttctcc

SEQ ID NO: 3807338 - DNA, 17 bp, Homo sapiens
tattccccattcttcct

SEQ ID NO: 3807339 - DNA, 22 bp, Homo sapiens
tattctacacatatatgtatat

SEQ ID NO: 3807340 - DNA, 19 bp, Homo sapiens
tattctcttgtctggctgc

SEQ ID NO: 3807341 - DNA, 13 bp, Homo sapiens
tattggaattttc

SEQ ID NO: 3807342 - DNA, 20 bp, Homo sapiens
tatttattttttttaagtat

SEQ ID NO: 3807343 - DNA, 18 bp, Homo sapiens
tatttccacataaaggta

SEQ ID NO: 3807344 - DNA, 17 bp, Homo sapiens
tatttgtctttaaacag

SEQ ID NO: 3807345 - DNA, 18 bp, Homo sapiens
tcaaaatatttgtacata

SEQ ID NO: 3807346 - DNA, 19 bp, Homo sapiens
tcaaaatatttgtacatag

SEQ ID NO: 3807347 - DNA, 16 bp, Homo sapiens
tcaaaatgtccagctt

SEQ ID NO: 3807348 - DNA, 18 bp, Homo sapiens
tcaaaattactggacata

SEQ ID NO: 3807349 - DNA, 15 bp, Homo sapiens
tcaaagaacaaacat

SEQ ID NO: 3807350 - DNA, 12 bp, Homo sapiens
tcaaagaaggaa

SEQ ID NO: 3807351 - DNA, 20 bp, Homo sapiens
tcaaagcggatgctggccac

SEQ ID NO: 3807352 - DNA, 15 bp, Homo sapiens
tcaaagctttttcca

SEQ ID NO: 3807353 - DNA, 16 bp, Homo sapiens
tcaaagctttttccag

SEQ ID NO: 3807354 - DNA, 17 bp, Homo sapiens
tcaaccgcttgccatat

SEQ ID NO: 3807355 - DNA, 15 bp, Homo sapiens
tcaaccgtacaatgg

SEQ ID NO: 3807356 - DNA, 12 bp, Homo sapiens
tcaagaaactga

SEQ ID NO: 3807357 - DNA, 13 bp, Homo sapiens
tcaagaaactgag

SEQ ID NO: 3807358 - DNA, 23 bp, Homo sapiens
tcaagaaactgaggaattttctt

SEQ ID NO: 3807359 - DNA, 20 bp, Homo sapiens
tcaagcaagtttaatcaatg

SEQ ID NO: 3807360 - DNA, 14 bp, Homo sapiens
tcaagccaaaaaag

SEQ ID NO: 3807361 - DNA, 14 bp, Homo sapiens
tcaagcctgcctag

SEQ ID NO: 3807362 - DNA, 18 bp, Homo sapiens
tcaataaagcagagccaa

SEQ ID NO: 3807363 - DNA, 19 bp, Homo sapiens
tcaataaagcagagccaag

SEQ ID NO: 3807364 - DNA, 22 bp, Homo sapiens
tcaataaagcagagccaaggcc

SEQ ID NO: 3807365 - DNA, 17 bp, Homo sapiens
tcaatattcaataaagc

SEQ ID NO: 3807366 - DNA, 22 bp, Homo sapiens
tcaattttctttagcttttacc

SEQ ID NO: 3807367 - DNA, 23 bp, Homo sapiens
tcaattttctttagcttttacca

SEQ ID NO: 3807368 - DNA, 16 bp, Homo sapiens
tcacagcgcctcctgg

SEQ ID NO: 3807369 - DNA, 17 bp, Homo sapiens
tcacagcgcctcctgga

SEQ ID NO: 3807370 - DNA, 16 bp, Homo sapiens
tcacagggccccagaa

SEQ ID NO: 3807371 - DNA, 19 bp, Homo sapiens
tcacaggtcttgcccaaag

SEQ ID NO: 3807372 - DNA, 22 bp, Homo sapiens
tcacatataaaagttaaactac

SEQ ID NO: 3807373 - DNA, 13 bp, Homo sapiens
tcaccacctctcc

SEQ ID NO: 3807374 - DNA, 19 bp, Homo sapiens
tcacccttggtagagttta

SEQ ID NO: 3807375 - DNA, 23 bp, Homo sapiens
tcaccggagctttcaaagaagga

SEQ ID NO: 3807376 - DNA, 18 bp, Homo sapiens
tcaccgtattagccagga

SEQ ID NO: 3807377 - DNA, 19 bp, Homo sapiens
tcaccgtattagccaggat

SEQ ID NO: 3807378 - DNA, 18 bp, Homo sapiens
tcacgccagacttcccac

SEQ ID NO: 3807379 - DNA, 19 bp, Homo sapiens
tcacgcctgtaatcctagc

SEQ ID NO: 3807380 - DNA, 20 bp, Homo sapiens
tcacgcctgtaatcctagca

SEQ ID NO: 3807381 - DNA, 17 bp, Homo sapiens
tcactgcaagctctgcc

SEQ ID NO: 3807382 - DNA, 17 bp, Homo sapiens
tcactgctctgccccca

SEQ ID NO: 3807383 - DNA, 19 bp, Homo sapiens
tcactgtttattgaagaac

SEQ ID NO: 3807384 - DNA, 10 bp, Homo sapiens
tcacttgagt

SEQ ID NO: 3807385 - DNA, 20 bp, Homo sapiens
tcagaatataacatgtaaaa

SEQ ID NO: 3807386 - DNA, 17 bp, Homo sapiens
tcagaattgaaggagaa

SEQ ID NO: 3807387 - DNA, 17 bp, Homo sapiens
tcagacaattcagaagc

SEQ ID NO: 3807388 - DNA, 16 bp, Homo sapiens
tcagagaggccttttg

SEQ ID NO: 3807389 - DNA, 21 bp, Homo sapiens
tcagagaggccttttggaatg

SEQ ID NO: 3807390 - DNA, 16 bp, Homo sapiens
tcagagcagcactggg

SEQ ID NO: 3807391 - DNA, 19 bp, Homo sapiens
tcagagctggcagcctcca

SEQ ID NO: 3807392 - DNA, 19 bp, Homo sapiens
tcagagtcctcattataaa

SEQ ID NO: 3807393 - DNA, 14 bp, Homo sapiens
tcagattcccagag

SEQ ID NO: 3807394 - DNA, 15 bp, Homo sapiens
tcagcaaaagatgct

SEQ ID NO: 3807395 - DNA, 17 bp, Homo sapiens
tcagcaccacattgcct

SEQ ID NO: 3807396 - DNA, 20 bp, Homo sapiens
tcagcaccacattgcctcat

SEQ ID NO: 3807397 - DNA, 23 bp, Homo sapiens
tcagccctgcccttcagcatcct

SEQ ID NO: 3807398 - DNA, 11 bp, Homo sapiens
tcagcctcctg

SEQ ID NO: 3807399 - DNA, 14 bp, Homo sapiens
tcagcctcctgagt

SEQ ID NO: 3807400 - DNA, 21 bp, Homo sapiens
tcagcctcctgagtagctggg

SEQ ID NO: 3807401 - DNA, 18 bp, Homo sapiens
tcagcctgctccagctgt

SEQ ID NO: 3807402 - DNA, 12 bp, Homo sapiens
tcagcctgggca

SEQ ID NO: 3807403 - DNA, 16 bp, Homo sapiens
tcagctgaacctgggt

SEQ ID NO: 3807404 - DNA, 17 bp, Homo sapiens
tcaggaaccgaggcagg

SEQ ID NO: 3807405 - DNA, 18 bp, Homo sapiens
tcaggcaggtgggatgga

SEQ ID NO: 3807406 - DNA, 15 bp, Homo sapiens
tcaggccgaaggagg

SEQ ID NO: 3807407 - DNA, 21 bp, Homo sapiens
tcaggctttgtctgctcccaa

SEQ ID NO: 3807408 - DNA, 16 bp, Homo sapiens
tcaggtgccactgacc

SEQ ID NO: 3807409 - DNA, 19 bp, Homo sapiens
tcaggtgtggcggtgcgtg

SEQ ID NO: 3807410 - DNA, 15 bp, Homo sapiens
tcagtaatttgagga

SEQ ID NO: 3807411 - DNA, 18 bp, Homo sapiens
tcagtaatttgaggacaa

SEQ ID NO: 3807412 - DNA, 21 bp, Homo sapiens
tcagtgtatggaaataaatgt

SEQ ID NO: 3807413 - DNA, 22 bp, Homo sapiens
tcataagctgtagaactctgca

SEQ ID NO: 3807414 - DNA, 13 bp, Homo sapiens
tcatacattatat

SEQ ID NO: 3807415 - DNA, 15 bp, Homo sapiens
tcatactgaagatgc

SEQ ID NO: 3807416 - DNA, 16 bp, Homo sapiens
tcatagggtgctctga

SEQ ID NO: 3807417 - DNA, 15 bp, Homo sapiens
tcatgaacacagcct

SEQ ID NO: 3807418 - DNA, 19 bp, Homo sapiens
tcatgtgactctttccaac

SEQ ID NO: 3807419 - DNA, 15 bp, Homo sapiens
tcattcagcagtcag

SEQ ID NO: 3807420 - DNA, 22 bp, Homo sapiens
tcatttaccataaaaatccttc

SEQ ID NO: 3807421 - DNA, 18 bp, Homo sapiens
tcatttagtgctaaacaa

SEQ ID NO: 3807422 - DNA, 22 bp, Homo sapiens
tccaaacactgggctctgagga

SEQ ID NO: 3807423 - DNA, 13 bp, Homo sapiens
tccaaccccagct

SEQ ID NO: 3807424 - DNA, 15 bp, Homo sapiens
tccaaccccagctgg

SEQ ID NO: 3807425 - DNA, 16 bp, Homo sapiens
tccaaccccagctggc

SEQ ID NO: 3807426 - DNA, 16 bp, Homo sapiens
tccaaggagaaacaga

SEQ ID NO: 3807427 - DNA, 20 bp, Homo sapiens
tccaaggagaaacagagaca

SEQ ID NO: 3807428 - DNA, 23 bp, Homo sapiens
tccaaggagaaacagagacaggc

SEQ ID NO: 3807429 - DNA, 16 bp, Homo sapiens
tccaagtctctctgtg

SEQ ID NO: 3807430 - DNA, 20 bp, Homo sapiens
tccaagtctctctgtgaata

SEQ ID NO: 3807431 - DNA, 16 bp, Homo sapiens
tccacaaatgctattc

SEQ ID NO: 3807432 - DNA, 13 bp, Homo sapiens
tccacacacagag

SEQ ID NO: 3807433 - DNA, 15 bp, Homo sapiens
tccacacacagagga

SEQ ID NO: 3807434 - DNA, 12 bp, Homo sapiens
tccacataaagg

SEQ ID NO: 3807435 - DNA, 12 bp, Homo sapiens
tccacctcctgg

SEQ ID NO: 3807436 - DNA, 13 bp, Homo sapiens
tccacctcctggg

SEQ ID NO: 3807437 - DNA, 21 bp, Homo sapiens
tccacttttaaaactatattt

SEQ ID NO: 3807438 - DNA, 17 bp, Homo sapiens
tccagaccattgtcttc

SEQ ID NO: 3807439 - DNA, 19 bp, Homo sapiens
tccagaccattgtcttcca

SEQ ID NO: 3807440 - DNA, 23 bp, Homo sapiens
tccagactgcttccaattttctg

SEQ ID NO: 3807441 - DNA, 19 bp, Homo sapiens
tccagagtccctgcctgga

SEQ ID NO: 3807442 - DNA, 22 bp, Homo sapiens
tccagcctgggcgacagagcaa

SEQ ID NO: 3807443 - DNA, 24 bp, Homo sapiens
tccagcctgggtgacagagcaagt

SEQ ID NO: 3807444 - DNA, 22 bp, Homo sapiens
tccaggcaatggcctaaacttc

SEQ ID NO: 3807445 - DNA, 18 bp, Homo sapiens
tccagggacagaagcagg

SEQ ID NO: 3807446 - DNA, 21 bp, Homo sapiens
tccaggggagggaaaagctaa

SEQ ID NO: 3807447 - DNA, 17 bp, Homo sapiens
tccaggtgcctggccct

SEQ ID NO: 3807448 - DNA, 22 bp, Homo sapiens
tccagtcaaagcggatgctggc

SEQ ID NO: 3807449 - DNA, 19 bp, Homo sapiens
tccagtggaagaagaaaac

SEQ ID NO: 3807450 - DNA, 17 bp, Homo sapiens
tccagtgggaggacaga

SEQ ID NO: 3807451 - DNA, 22 bp, Homo sapiens
tccagtgggaggacagagccgg

SEQ ID NO: 3807452 - DNA, 16 bp, Homo sapiens
tccagttcatgagaat

SEQ ID NO: 3807453 - DNA, 14 bp, Homo sapiens
tccagtttccaaag

SEQ ID NO: 3807454 - DNA, 21 bp, Homo sapiens
tccataataaacttctggtgt

SEQ ID NO: 3807455 - DNA, 20 bp, Homo sapiens
tccatcctaccccctgtgcc

SEQ ID NO: 3807456 - DNA, 21 bp, Homo sapiens
tcccaaagaagttctggtatg

SEQ ID NO: 3807457 - DNA, 20 bp, Homo sapiens
tcccaaagtgctgggattac

SEQ ID NO: 3807458 - DNA, 17 bp, Homo sapiens
tcccaacagagctgggc

SEQ ID NO: 3807459 - DNA, 20 bp, Homo sapiens
tcccaagtagctgagattac

SEQ ID NO: 3807460 - DNA, 20 bp, Homo sapiens
tcccaagtagtagtgtcttc

SEQ ID NO: 3807461 - DNA, 18 bp, Homo sapiens
tcccagatacttgggggg

SEQ ID NO: 3807462 - DNA, 16 bp, Homo sapiens
tcccagctattcagga

SEQ ID NO: 3807463 - DNA, 15 bp, Homo sapiens
tcccaggagacagtt

SEQ ID NO: 3807464 - DNA, 22 bp, Homo sapiens
tcccaggagacagttcaagaaa

SEQ ID NO: 3807465 - DNA, 18 bp, Homo sapiens
tcccaggagcaaatgctg

SEQ ID NO: 3807466 - DNA, 12 bp, Homo sapiens
tcccaggggacc

SEQ ID NO: 3807467 - DNA, 13 bp, Homo sapiens
tcccatggccttc

SEQ ID NO: 3807468 - DNA, 12 bp, Homo sapiens
tcccatggtgta

SEQ ID NO: 3807469 - DNA, 21 bp, Homo sapiens
tcccatggtgtatgtggtttt

SEQ ID NO: 3807470 - DNA, 18 bp, Homo sapiens
tccccacagtcctcacag

SEQ ID NO: 3807471 - DNA, 20 bp, Homo sapiens
tccccacagtcctcacagcc

SEQ ID NO: 3807472 - DNA, 14 bp, Homo sapiens
tccccattcttcct

SEQ ID NO: 3807473 - DNA, 22 bp, Homo sapiens
tccccattcttcctagttttct

SEQ ID NO: 3807474 - DNA, 15 bp, Homo sapiens
tcccccagagccact

SEQ ID NO: 3807475 - DNA, 17 bp, Homo sapiens
tccccctcccctcccag

SEQ ID NO: 3807476 - DNA, 14 bp, Homo sapiens
tccccgcacccccc

SEQ ID NO: 3807477 - DNA, 15 bp, Homo sapiens
tcccctcccagtcct

SEQ ID NO: 3807478 - DNA, 19 bp, Homo sapiens
tcccctgtagagtgggagc

SEQ ID NO: 3807479 - DNA, 22 bp, Homo sapiens
tcccctgtagagtgggagctga

SEQ ID NO: 3807480 - DNA, 12 bp, Homo sapiens
tcccggaggtgt

SEQ ID NO: 3807481 - DNA, 21 bp, Homo sapiens
tcccgggacacctaggctagg

SEQ ID NO: 3807482 - DNA, 12 bp, Homo sapiens
tccctacccact

SEQ ID NO: 3807483 - DNA, 13 bp, Homo sapiens
tccctacccactc

SEQ ID NO: 3807484 - DNA, 14 bp, Homo sapiens
tccctacccactct

SEQ ID NO: 3807485 - DNA, 15 bp, Homo sapiens
tccctacccactctt

SEQ ID NO: 3807486 - DNA, 18 bp, Homo sapiens
tccctagcctgcttttgt

SEQ ID NO: 3807487 - DNA, 16 bp, Homo sapiens
tccctcagtgccctca

SEQ ID NO: 3807488 - DNA, 15 bp, Homo sapiens
tccctgaaccatccc

SEQ ID NO: 3807489 - DNA, 17 bp, Homo sapiens
tccctgaccttctccag

SEQ ID NO: 3807490 - DNA, 21 bp, Homo sapiens
tccctgcttttctcccagaag

SEQ ID NO: 3807491 - DNA, 22 bp, Homo sapiens
tccctgcttttctcccagaagg

SEQ ID NO: 3807492 - DNA, 17 bp, Homo sapiens
tccctgggcctcagcct

SEQ ID NO: 3807493 - DNA, 21 bp, Homo sapiens
tccctgggcctcagcctccag

SEQ ID NO: 3807494 - DNA, 14 bp, Homo sapiens
tccctggggcccca

SEQ ID NO: 3807495 - DNA, 12 bp, Homo sapiens
tccctgtcccag

SEQ ID NO: 3807496 - DNA, 18 bp, Homo sapiens
tccctgttaataaacagc

SEQ ID NO: 3807497 - DNA, 20 bp, Homo sapiens
tcccttagaagatctgcttc

SEQ ID NO: 3807498 - DNA, 19 bp, Homo sapiens
tcccttatgcaggacatgt

SEQ ID NO: 3807499 - DNA, 22 bp, Homo sapiens
tccgcaattcatgtagtttctg

SEQ ID NO: 3807500 - DNA, 15 bp, Homo sapiens
tccgtagttttgata

SEQ ID NO: 3807501 - DNA, 16 bp, Homo sapiens
tccgtagttttgataa

SEQ ID NO: 3807502 - DNA, 17 bp, Homo sapiens
tccgtggcaaccctcag

SEQ ID NO: 3807503 - DNA, 16 bp, Homo sapiens
tcctaccccctgtgcc

SEQ ID NO: 3807504 - DNA, 21 bp, Homo sapiens
tcctagaaattccccaccctg

SEQ ID NO: 3807505 - DNA, 22 bp, Homo sapiens
tcctagaaattccccaccctga

SEQ ID NO: 3807506 - DNA, 21 bp, Homo sapiens
tcctagagctcctgtccctac

SEQ ID NO: 3807507 - DNA, 20 bp, Homo sapiens
tcctaggctccaccccatcc

SEQ ID NO: 3807508 - DNA, 23 bp, Homo sapiens
tcctagtatattagtttgattta

SEQ ID NO: 3807509 - DNA, 14 bp, Homo sapiens
tcctattccttggt

SEQ ID NO: 3807510 - DNA, 12 bp, Homo sapiens
tcctcacagcct

SEQ ID NO: 3807511 - DNA, 18 bp, Homo sapiens
tcctcacagcctctccct

SEQ ID NO: 3807512 - DNA, 16 bp, Homo sapiens
tcctcacccccagctt

SEQ ID NO: 3807513 - DNA, 20 bp, Homo sapiens
tcctcagagaatttctacca

SEQ ID NO: 3807514 - DNA, 11 bp, Homo sapiens
tcctcagcccc

SEQ ID NO: 3807515 - DNA, 18 bp, Homo sapiens
tcctcattagcattttgc

SEQ ID NO: 3807516 - DNA, 22 bp, Homo sapiens
tcctcatttgttcattaaacgt

SEQ ID NO: 3807517 - DNA, 12 bp, Homo sapiens
tcctccagacca

SEQ ID NO: 3807518 - DNA, 13 bp, Homo sapiens
tcctcccatggcc

SEQ ID NO: 3807519 - DNA, 21 bp, Homo sapiens
tcctcttggtgtcgtttccct

SEQ ID NO: 3807520 - DNA, 13 bp, Homo sapiens
tcctcttgtccta

SEQ ID NO: 3807521 - DNA, 13 bp, Homo sapiens
tcctgagtagctg

SEQ ID NO: 3807522 - DNA, 19 bp, Homo sapiens
tcctgcaccggggcctggg

SEQ ID NO: 3807523 - DNA, 12 bp, Homo sapiens
tcctgccctccc

SEQ ID NO: 3807524 - DNA, 15 bp, Homo sapiens
tcctgccctgtccct

SEQ ID NO: 3807525 - DNA, 18 bp, Homo sapiens
tcctgccctgtccctgtc

SEQ ID NO: 3807526 - DNA, 19 bp, Homo sapiens
tcctgcctcagcctcctga

SEQ ID NO: 3807527 - DNA, 18 bp, Homo sapiens
tcctgctaagttaatgtt

SEQ ID NO: 3807528 - DNA, 20 bp, Homo sapiens
tcctgctgcctaataaagag

SEQ ID NO: 3807529 - DNA, 21 bp, Homo sapiens
tcctgctgcctaataaagaga

SEQ ID NO: 3807530 - DNA, 16 bp, Homo sapiens
tcctggctcagcctca

SEQ ID NO: 3807531 - DNA, 13 bp, Homo sapiens
tcctgtccctacc

SEQ ID NO: 3807532 - DNA, 14 bp, Homo sapiens
tcctgtccctaccc

SEQ ID NO: 3807533 - DNA, 23 bp, Homo sapiens
tcctgtccctacccactctttgc

SEQ ID NO: 3807534 - DNA, 17 bp, Homo sapiens
tcctgtcccttgacctt

SEQ ID NO: 3807535 - DNA, 19 bp, Homo sapiens
tccttaaggctcttttgta

SEQ ID NO: 3807536 - DNA, 15 bp, Homo sapiens
tccttccaccaagtt

SEQ ID NO: 3807537 - DNA, 15 bp, Homo sapiens
tcgaactcctgacct

SEQ ID NO: 3807538 - DNA, 16 bp, Homo sapiens
tcgaactcctgacctc

SEQ ID NO: 3807539 - DNA, 12 bp, Homo sapiens
tcgactcagcac

SEQ ID NO: 3807540 - DNA, 17 bp, Homo sapiens
tcgagatcccaacactg

SEQ ID NO: 3807541 - DNA, 21 bp, Homo sapiens
tcgagatcccaacactgccag

SEQ ID NO: 3807542 - DNA, 22 bp, Homo sapiens
tcgagatcccaacactgccagc

SEQ ID NO: 3807543 - DNA, 16 bp, Homo sapiens
tcgagtgaatttctaa

SEQ ID NO: 3807544 - DNA, 23 bp, Homo sapiens
tcgatgaagcccaataaacctct

SEQ ID NO: 3807545 - DNA, 15 bp, Homo sapiens
tcgcctctgcccagc

SEQ ID NO: 3807546 - DNA, 17 bp, Homo sapiens
tcgctctgctgcccagg

SEQ ID NO: 3807547 - DNA, 13 bp, Homo sapiens
tcggccctgccca

SEQ ID NO: 3807548 - DNA, 14 bp, Homo sapiens
tcggccctgcccaa

SEQ ID NO: 3807549 - DNA, 22 bp, Homo sapiens
tcggctacccctcgactcagca

SEQ ID NO: 3807550 - DNA, 19 bp, Homo sapiens
tcgggaggtcgaggcagga

SEQ ID NO: 3807551 - DNA, 20 bp, Homo sapiens
tcggggagccgggagcctga

SEQ ID NO: 3807552 - DNA, 22 bp, Homo sapiens
tcgtgatatccacaaatgctat

SEQ ID NO: 3807553 - DNA, 17 bp, Homo sapiens
tcgtgatttgcctgcct

SEQ ID NO: 3807554 - DNA, 19 bp, Homo sapiens
tcgtgatttgcctgcctgg

SEQ ID NO: 3807555 - DNA, 19 bp, Homo sapiens
tcgtggacacctgccctgc

SEQ ID NO: 3807556 - DNA, 20 bp, Homo sapiens
tcgtggacacctgccctgcc

SEQ ID NO: 3807557 - DNA, 21 bp, Homo sapiens
tcgtgtctggcacagcctggc

SEQ ID NO: 3807558 - DNA, 21 bp, Homo sapiens
tctaccctcttagaaaaacca

SEQ ID NO: 3807559 - DNA, 19 bp, Homo sapiens
tctactccatgcacatagt

SEQ ID NO: 3807560 - DNA, 16 bp, Homo sapiens
tctactcctcacagca

SEQ ID NO: 3807561 - DNA, 23 bp, Homo sapiens
tctactggtcttgtggaattggg

SEQ ID NO: 3807562 - DNA, 14 bp, Homo sapiens
tctagaaacaaaca

SEQ ID NO: 3807563 - DNA, 15 bp, Homo sapiens
tctagaacacaggca

SEQ ID NO: 3807564 - DNA, 14 bp, Homo sapiens
tctagaacacccac

SEQ ID NO: 3807565 - DNA, 17 bp, Homo sapiens
tctagaacacccactgg

SEQ ID NO: 3807566 - DNA, 15 bp, Homo sapiens
tctagattgagagaa

SEQ ID NO: 3807567 - DNA, 12 bp, Homo sapiens
tctagggaaaaa

SEQ ID NO: 3807568 - DNA, 15 bp, Homo sapiens
tctagttctgccagg

SEQ ID NO: 3807569 - DNA, 21 bp, Homo sapiens
tctagttgattgcgagaattt

SEQ ID NO: 3807570 - DNA, 17 bp, Homo sapiens
tctattttgtaaactca

SEQ ID NO: 3807571 - DNA, 15 bp, Homo sapiens
tctcaagcaagtttc

SEQ ID NO: 3807572 - DNA, 18 bp, Homo sapiens
tctcaatattcaataaag

SEQ ID NO: 3807573 - DNA, 20 bp, Homo sapiens
tctcaatattcaataaagct

SEQ ID NO: 3807574 - DNA, 12 bp, Homo sapiens
tctcagagcagc

SEQ ID NO: 3807575 - DNA, 12 bp, Homo sapiens
tctcagggcctg

SEQ ID NO: 3807576 - DNA, 13 bp, Homo sapiens
tctcagggcctgg

SEQ ID NO: 3807577 - DNA, 17 bp, Homo sapiens
tctccaagtctctctgt

SEQ ID NO: 3807578 - DNA, 21 bp, Homo sapiens
tctccaagtctctctgtgaat

SEQ ID NO: 3807579 - DNA, 22 bp, Homo sapiens
tctccaagtctctctgtgaata

SEQ ID NO: 3807580 - DNA, 23 bp, Homo sapiens
tctccaagtctctctgtgaatac

SEQ ID NO: 3807581 - DNA, 19 bp, Homo sapiens
tctcccagaaggctgggtc

SEQ ID NO: 3807582 - DNA, 18 bp, Homo sapiens
tctccctcctctgcccgg

SEQ ID NO: 3807583 - DNA, 19 bp, Homo sapiens
tctccctgaccttctccag

SEQ ID NO: 3807584 - DNA, 20 bp, Homo sapiens
tctccctgaccttctccagg

SEQ ID NO: 3807585 - DNA, 23 bp, Homo sapiens
tctcctcccaccagtggccccca

SEQ ID NO: 3807586 - DNA, 12 bp, Homo sapiens
tctcctcccagg

SEQ ID NO: 3807587 - DNA, 16 bp, Homo sapiens
tctcctgcctcagcct

SEQ ID NO: 3807588 - DNA, 17 bp, Homo sapiens
tctcctgcctcagcctc

SEQ ID NO: 3807589 - DNA, 20 bp, Homo sapiens
tctcctgcctcagcctcctg

SEQ ID NO: 3807590 - DNA, 14 bp, Homo sapiens
tctcgaactcctga

SEQ ID NO: 3807591 - DNA, 20 bp, Homo sapiens
tctctaaactgctgttaatt

SEQ ID NO: 3807592 - DNA, 12 bp, Homo sapiens
tctctctggaaa

SEQ ID NO: 3807593 - DNA, 19 bp, Homo sapiens
tctctgagctccagtggaa

SEQ ID NO: 3807594 - DNA, 11 bp, Homo sapiens
tctctgttcta

SEQ ID NO: 3807595 - DNA, 13 bp, Homo sapiens
tctcttctcagag

SEQ ID NO: 3807596 - DNA, 16 bp, Homo sapiens
tctcttgtctggctgc

SEQ ID NO: 3807597 - DNA, 14 bp, Homo sapiens
tctgaccatttcag

SEQ ID NO: 3807598 - DNA, 18 bp, Homo sapiens
tctgaccatttcaggggt

SEQ ID NO: 3807599 - DNA, 17 bp, Homo sapiens
tctgaccgggtctgctt

SEQ ID NO: 3807600 - DNA, 16 bp, Homo sapiens
tctgagaagtgtatat

SEQ ID NO: 3807601 - DNA, 24 bp, Homo sapiens
tctgagatcaaaacggttttactg

SEQ ID NO: 3807602 - DNA, 23 bp, Homo sapiens
tctgaggagtggagttctctgtt

SEQ ID NO: 3807603 - DNA, 17 bp, Homo sapiens
tctgaggccccaggccc

SEQ ID NO: 3807604 - DNA, 18 bp, Homo sapiens
tctgaggccccaggccct

SEQ ID NO: 3807605 - DNA, 13 bp, Homo sapiens
tctgaggtcaata

SEQ ID NO: 3807606 - DNA, 21 bp, Homo sapiens
tctgaggtcaataaagcagag

SEQ ID NO: 3807607 - DNA, 23 bp, Homo sapiens
tctgaggtcaataaagcagagcc

SEQ ID NO: 3807608 - DNA, 20 bp, Homo sapiens
tctgcaagaattgaagcagg

SEQ ID NO: 3807609 - DNA, 19 bp, Homo sapiens
tctgcacaagctgcaccct

SEQ ID NO: 3807610 - DNA, 15 bp, Homo sapiens
tctgcattttaacaa

SEQ ID NO: 3807611 - DNA, 22 bp, Homo sapiens
tctgcccgcctcggcctcccaa

SEQ ID NO: 3807612 - DNA, 19 bp, Homo sapiens
tctgctcccaattcacctc

SEQ ID NO: 3807613 - DNA, 15 bp, Homo sapiens
tctggaaaggaggaa

SEQ ID NO: 3807614 - DNA, 22 bp, Homo sapiens
tctggaatacatgaaatataga

SEQ ID NO: 3807615 - DNA, 22 bp, Homo sapiens
tctggcacagcctggctgtggc

SEQ ID NO: 3807616 - DNA, 15 bp, Homo sapiens
tctggcgagccctta

SEQ ID NO: 3807617 - DNA, 18 bp, Homo sapiens
tctggcgagcccttagcc

SEQ ID NO: 3807618 - DNA, 20 bp, Homo sapiens
tctggcgagcccttagcctt

SEQ ID NO: 3807619 - DNA, 15 bp, Homo sapiens
tctgtctgtctgtcc

SEQ ID NO: 3807620 - DNA, 18 bp, Homo sapiens
tctgtctgtctgtcccaa

SEQ ID NO: 3807621 - DNA, 15 bp, Homo sapiens
tctgtgaatacaatt

SEQ ID NO: 3807622 - DNA, 23 bp, Homo sapiens
tctgttcctggctcagcctcaaa

SEQ ID NO: 3807623 - DNA, 12 bp, Homo sapiens
tctgttgttttt

SEQ ID NO: 3807624 - DNA, 23 bp, Homo sapiens
tcttacctgtatgtctccagtat

SEQ ID NO: 3807625 - DNA, 23 bp, Homo sapiens
tcttaggttggcaaaaaggcagg

SEQ ID NO: 3807626 - DNA, 22 bp, Homo sapiens
tcttattcatgctttctccttt

SEQ ID NO: 3807627 - DNA, 16 bp, Homo sapiens
tcttccaaccccagct

SEQ ID NO: 3807628 - DNA, 18 bp, Homo sapiens
tcttccaaccccagctgg

SEQ ID NO: 3807629 - DNA, 20 bp, Homo sapiens
tcttccccaacgaaaagcac

SEQ ID NO: 3807630 - DNA, 21 bp, Homo sapiens
tcttcttattcatgctttctc

SEQ ID NO: 3807631 - DNA, 14 bp, Homo sapiens
tcttgatctcctga

SEQ ID NO: 3807632 - DNA, 13 bp, Homo sapiens
tcttggccagagc

SEQ ID NO: 3807633 - DNA, 14 bp, Homo sapiens
tcttggccagagct

SEQ ID NO: 3807634 - DNA, 17 bp, Homo sapiens
tctttagcttttaccaa

SEQ ID NO: 3807635 - DNA, 14 bp, Homo sapiens
tctttcatacatta

SEQ ID NO: 3807636 - DNA, 21 bp, Homo sapiens
tctttgattttcgacgtttga

SEQ ID NO: 3807637 - DNA, 20 bp, Homo sapiens
tctttgctacaataaatgct

SEQ ID NO: 3807638 - DNA, 15 bp, Homo sapiens
tctttgtgtagcttt

SEQ ID NO: 3807639 - DNA, 19 bp, Homo sapiens
tcttttgtaaggtttttgt

SEQ ID NO: 3807640 - DNA, 17 bp, Homo sapiens
tcttttgttttcttcat

SEQ ID NO: 3807641 - DNA, 15 bp, Homo sapiens
tgaaaatcctaccaa

SEQ ID NO: 3807642 - DNA, 14 bp, Homo sapiens
tgaaaattcagtgg

SEQ ID NO: 3807643 - DNA, 13 bp, Homo sapiens
tgaaacagaaaca

SEQ ID NO: 3807644 - DNA, 14 bp, Homo sapiens
tgaaacagaaacaa

SEQ ID NO: 3807645 - DNA, 18 bp, Homo sapiens
tgaaagccctgagctttc

SEQ ID NO: 3807646 - DNA, 12 bp, Homo sapiens
tgaaatttcaga

SEQ ID NO: 3807647 - DNA, 14 bp, Homo sapiens
tgaacaagaattgg

SEQ ID NO: 3807648 - DNA, 19 bp, Homo sapiens
tgaacacacatggatgcac

SEQ ID NO: 3807649 - DNA, 12 bp, Homo sapiens
tgaacccaggag

SEQ ID NO: 3807650 - DNA, 13 bp, Homo sapiens
tgaacccaggagg

SEQ ID NO: 3807651 - DNA, 15 bp, Homo sapiens
tgaaccgacttttct

SEQ ID NO: 3807652 - DNA, 18 bp, Homo sapiens
tgaacttgaggacacatg

SEQ ID NO: 3807653 - DNA, 17 bp, Homo sapiens
tgaagaaattgtggggg

SEQ ID NO: 3807654 - DNA, 12 bp, Homo sapiens
tgaagaggaaaa

SEQ ID NO: 3807655 - DNA, 19 bp, Homo sapiens
tgaagaggaaaatgaataa

SEQ ID NO: 3807656 - DNA, 22 bp, Homo sapiens
tgaagaggaaaatgaataatac

SEQ ID NO: 3807657 - DNA, 18 bp, Homo sapiens
tgaagagtgagagggcat

SEQ ID NO: 3807658 - DNA, 20 bp, Homo sapiens
tgaagctggaagcactgctg

SEQ ID NO: 3807659 - DNA, 23 bp, Homo sapiens
tgaaggagaaaatgcattatgtg

SEQ ID NO: 3807660 - DNA, 19 bp, Homo sapiens
tgaagtgcagctcaggaga

SEQ ID NO: 3807661 - DNA, 20 bp, Homo sapiens
tgaagtgcagctcaggagac

SEQ ID NO: 3807662 - DNA, 12 bp, Homo sapiens
tgaataatacag

SEQ ID NO: 3807663 - DNA, 12 bp, Homo sapiens
tgaatacaatta

SEQ ID NO: 3807664 - DNA, 20 bp, Homo sapiens
tgaatacaattaaaggtcct

SEQ ID NO: 3807665 - DNA, 15 bp, Homo sapiens
tgaatattgatgtta

SEQ ID NO: 3807666 - DNA, 19 bp, Homo sapiens
tgaatattgatgttaacaa

SEQ ID NO: 3807667 - DNA, 12 bp, Homo sapiens
tgaatgtcccag

SEQ ID NO: 3807668 - DNA, 16 bp, Homo sapiens
tgaatgtcccagaggc

SEQ ID NO: 3807669 - DNA, 17 bp, Homo sapiens
tgaattaaataaaccct

SEQ ID NO: 3807670 - DNA, 21 bp, Homo sapiens
tgaattagaaacataaataaa

SEQ ID NO: 3807671 - DNA, 19 bp, Homo sapiens
tgaatttttttttcctagc

SEQ ID NO: 3807672 - DNA, 22 bp, Homo sapiens
tgacaacatttttgtacattat

SEQ ID NO: 3807673 - DNA, 17 bp, Homo sapiens
tgacactgagccccacc

SEQ ID NO: 3807674 - DNA, 18 bp, Homo sapiens
tgacactgagccccacct

SEQ ID NO: 3807675 - DNA, 14 bp, Homo sapiens
tgacagaaatgcaa

SEQ ID NO: 3807676 - DNA, 16 bp, Homo sapiens
tgacagtgttgaaaat

SEQ ID NO: 3807677 - DNA, 18 bp, Homo sapiens
tgacatcacttgtacaaa

SEQ ID NO: 3807678 - DNA, 18 bp, Homo sapiens
tgacattgtaagaggtgg

SEQ ID NO: 3807679 - DNA, 16 bp, Homo sapiens
tgaccaagagagaaag

SEQ ID NO: 3807680 - DNA, 22 bp, Homo sapiens
tgacccccactgccgcctcctt

SEQ ID NO: 3807681 - DNA, 12 bp, Homo sapiens
tgacgtttacat

SEQ ID NO: 3807682 - DNA, 17 bp, Homo sapiens
tgactactactctgcca

SEQ ID NO: 3807683 - DNA, 20 bp, Homo sapiens
tgactactactctgccaatc

SEQ ID NO: 3807684 - DNA, 21 bp, Homo sapiens
tgactagaggcagggagggga

SEQ ID NO: 3807685 - DNA, 18 bp, Homo sapiens
tgactccatgtgtgctgt

SEQ ID NO: 3807686 - DNA, 13 bp, Homo sapiens
tgactctttccaa

SEQ ID NO: 3807687 - DNA, 16 bp, Homo sapiens
tgactctttccaaccg

SEQ ID NO: 3807688 - DNA, 13 bp, Homo sapiens
tgactgtcactgt

SEQ ID NO: 3807689 - DNA, 16 bp, Homo sapiens
tgactgtcactgttcc

SEQ ID NO: 3807690 - DNA, 18 bp, Homo sapiens
tgagaagagagatcaaat

SEQ ID NO: 3807691 - DNA, 14 bp, Homo sapiens
tgagaagtgtatat

SEQ ID NO: 3807692 - DNA, 15 bp, Homo sapiens
tgagaccacctctca

SEQ ID NO: 3807693 - DNA, 22 bp, Homo sapiens
tgagagggcatgcgcacaaggc

SEQ ID NO: 3807694 - DNA, 14 bp, Homo sapiens
tgagatcagcctgg

SEQ ID NO: 3807695 - DNA, 16 bp, Homo sapiens
tgagatgatttggtca

SEQ ID NO: 3807696 - DNA, 14 bp, Homo sapiens
tgagatttcacagg

SEQ ID NO: 3807697 - DNA, 19 bp, Homo sapiens
tgagcattagctacttttc

SEQ ID NO: 3807698 - DNA, 21 bp, Homo sapiens
tgagctccttaaggctctttt

SEQ ID NO: 3807699 - DNA, 12 bp, Homo sapiens
tgagctgcagcc

SEQ ID NO: 3807700 - DNA, 14 bp, Homo sapiens
tgagctgcagcccc

SEQ ID NO: 3807701 - DNA, 20 bp, Homo sapiens
tgaggacacaccccacaccc

SEQ ID NO: 3807702 - DNA, 12 bp, Homo sapiens
tgaggacatgga

SEQ ID NO: 3807703 - DNA, 18 bp, Homo sapiens
tgaggacatggagagaga

SEQ ID NO: 3807704 - DNA, 17 bp, Homo sapiens
tgagggatcacagggcc

SEQ ID NO: 3807705 - DNA, 18 bp, Homo sapiens
tgagggatcacagggccc

SEQ ID NO: 3807706 - DNA, 16 bp, Homo sapiens
tgaggtcaataaagca

SEQ ID NO: 3807707 - DNA, 21 bp, Homo sapiens
tgaggtcaataaagcagagcc

SEQ ID NO: 3807708 - DNA, 13 bp, Homo sapiens
tgaggtgggagga

SEQ ID NO: 3807709 - DNA, 21 bp, Homo sapiens
tgaggtgggaggatctcttga

SEQ ID NO: 3807710 - DNA, 20 bp, Homo sapiens
tgagtcaccctacctgtgcc

SEQ ID NO: 3807711 - DNA, 22 bp, Homo sapiens
tgagttaaagagaggccccggc

SEQ ID NO: 3807712 - DNA, 18 bp, Homo sapiens
tgagttcataaatttatg

SEQ ID NO: 3807713 - DNA, 19 bp, Homo sapiens
tgagttgattcagctctgc

SEQ ID NO: 3807714 - DNA, 14 bp, Homo sapiens
tgagttggctggga

SEQ ID NO: 3807715 - DNA, 23 bp, Homo sapiens
tgataattttatttataaactag

SEQ ID NO: 3807716 - DNA, 12 bp, Homo sapiens
tgatacttccaa

SEQ ID NO: 3807717 - DNA, 14 bp, Homo sapiens
tgatataaaatatt

SEQ ID NO: 3807718 - DNA, 20 bp, Homo sapiens
tgatatatgagactttatgt

SEQ ID NO: 3807719 - DNA, 21 bp, Homo sapiens
tgatatccacaaatgctattc

SEQ ID NO: 3807720 - DNA, 20 bp, Homo sapiens
tgatatgtaagtacttccac

SEQ ID NO: 3807721 - DNA, 14 bp, Homo sapiens
tgatctcggctcac

SEQ ID NO: 3807722 - DNA, 22 bp, Homo sapiens
tgatggctaagatactgctgat

SEQ ID NO: 3807723 - DNA, 12 bp, Homo sapiens
tgatgttaacaa

SEQ ID NO: 3807724 - DNA, 20 bp, Homo sapiens
tgattcctttgaagaggaaa

SEQ ID NO: 3807725 - DNA, 15 bp, Homo sapiens
tgattgcgagaattt

SEQ ID NO: 3807726 - DNA, 16 bp, Homo sapiens
tgattgcgagaatttt

SEQ ID NO: 3807727 - DNA, 15 bp, Homo sapiens
tgatttgatatagat

SEQ ID NO: 3807728 - DNA, 14 bp, Homo sapiens
tgatttgcctgcct

SEQ ID NO: 3807729 - DNA, 22 bp, Homo sapiens
tgatttggtcagattgggataa

SEQ ID NO: 3807730 - DNA, 20 bp, Homo sapiens
tgattttcaaagctttttcc

SEQ ID NO: 3807731 - DNA, 13 bp, Homo sapiens
tgattttcattgc

SEQ ID NO: 3807732 - DNA, 22 bp, Homo sapiens
tgcaaagttttctttccaaaat

SEQ ID NO: 3807733 - DNA, 22 bp, Homo sapiens
tgcaacaagacaaagcaaagcc

SEQ ID NO: 3807734 - DNA, 19 bp, Homo sapiens
tgcaactaattcaataaaa

SEQ ID NO: 3807735 - DNA, 12 bp, Homo sapiens
tgcaagctctgc

SEQ ID NO: 3807736 - DNA, 14 bp, Homo sapiens
tgcaagctctgcct

SEQ ID NO: 3807737 - DNA, 15 bp, Homo sapiens
tgcacaagctgcacc

SEQ ID NO: 3807738 - DNA, 19 bp, Homo sapiens
tgcacacacagatgcacac

SEQ ID NO: 3807739 - DNA, 16 bp, Homo sapiens
tgcacacgcacataga

SEQ ID NO: 3807740 - DNA, 19 bp, Homo sapiens
tgcacagttggcccgggtg

SEQ ID NO: 3807741 - DNA, 17 bp, Homo sapiens
tgcaccctcaggcaggt

SEQ ID NO: 3807742 - DNA, 12 bp, Homo sapiens
tgcaccggggcc

SEQ ID NO: 3807743 - DNA, 17 bp, Homo sapiens
tgcactcatagggtgct

SEQ ID NO: 3807744 - DNA, 16 bp, Homo sapiens
tgcactctaacactcg

SEQ ID NO: 3807745 - DNA, 16 bp, Homo sapiens
tgcactggccccaccc

SEQ ID NO: 3807746 - DNA, 15 bp, Homo sapiens
tgcaggacctcaggt

SEQ ID NO: 3807747 - DNA, 16 bp, Homo sapiens
tgcaggcccagcagac

SEQ ID NO: 3807748 - DNA, 15 bp, Homo sapiens
tgcatcgtttcatct

SEQ ID NO: 3807749 - DNA, 17 bp, Homo sapiens
tgcatcgtttcatcttc

SEQ ID NO: 3807750 - DNA, 20 bp, Homo sapiens
tgcatgaattactgtatata

SEQ ID NO: 3807751 - DNA, 20 bp, Homo sapiens
tgcattcacagcgcctcctg

SEQ ID NO: 3807752 - DNA, 17 bp, Homo sapiens
tgccaaggttgtcctgg

SEQ ID NO: 3807753 - DNA, 15 bp, Homo sapiens
tgccaattagcaatt

SEQ ID NO: 3807754 - DNA, 18 bp, Homo sapiens
tgccaggatggaatgatg

SEQ ID NO: 3807755 - DNA, 10 bp, Homo sapiens
tgccaggcat

SEQ ID NO: 3807756 - DNA, 22 bp, Homo sapiens
tgccatgtcttgttcagaagac

SEQ ID NO: 3807757 - DNA, 19 bp, Homo sapiens
tgcccaggctagagtgcag

SEQ ID NO: 3807758 - DNA, 16 bp, Homo sapiens
tgcccatgggagctgg

SEQ ID NO: 3807759 - DNA, 17 bp, Homo sapiens
tgccccatctcctccca

SEQ ID NO: 3807760 - DNA, 17 bp, Homo sapiens
tgcccgggagctcagga

SEQ ID NO: 3807761 - DNA, 20 bp, Homo sapiens
tgccctacctgcctgttctc

SEQ ID NO: 3807762 - DNA, 18 bp, Homo sapiens
tgccctcattttatgtca

SEQ ID NO: 3807763 - DNA, 16 bp, Homo sapiens
tgccctgccacctgtc

SEQ ID NO: 3807764 - DNA, 19 bp, Homo sapiens
tgccctgccacctgtctgt

SEQ ID NO: 3807765 - DNA, 20 bp, Homo sapiens
tgccctgccacctgtctgtc

SEQ ID NO: 3807766 - DNA, 14 bp, Homo sapiens
tgccctgccctgcc

SEQ ID NO: 3807767 - DNA, 15 bp, Homo sapiens
tgccgaccagagccc

SEQ ID NO: 3807768 - DNA, 16 bp, Homo sapiens
tgcctcagcctcctga

SEQ ID NO: 3807769 - DNA, 15 bp, Homo sapiens
tgcctcagcttccca

SEQ ID NO: 3807770 - DNA, 20 bp, Homo sapiens
tgcctcatttcttcctctgc

SEQ ID NO: 3807771 - DNA, 12 bp, Homo sapiens
tgcctcctcacc

SEQ ID NO: 3807772 - DNA, 21 bp, Homo sapiens
tgcctcttctctactctaggg

SEQ ID NO: 3807773 - DNA, 15 bp, Homo sapiens
tgcctgacactgagc

SEQ ID NO: 3807774 - DNA, 19 bp, Homo sapiens
tgcctgacactgagcccca

SEQ ID NO: 3807775 - DNA, 15 bp, Homo sapiens
tgcctgcctgggcct

SEQ ID NO: 3807776 - DNA, 17 bp, Homo sapiens
tgcctgcctgggcctcc

SEQ ID NO: 3807777 - DNA, 18 bp, Homo sapiens
tgcctgcctgggcctccc

SEQ ID NO: 3807778 - DNA, 14 bp, Homo sapiens
tgcctggggccaca

SEQ ID NO: 3807779 - DNA, 14 bp, Homo sapiens
tgcctgttctccag

SEQ ID NO: 3807780 - DNA, 22 bp, Homo sapiens
tgccttaaggccacactggcat

SEQ ID NO: 3807781 - DNA, 13 bp, Homo sapiens
tgccttgctattt

SEQ ID NO: 3807782 - DNA, 15 bp, Homo sapiens
tgccttgtcacgcca

SEQ ID NO: 3807783 - DNA, 19 bp, Homo sapiens
tgccttgtgaaggaattat

SEQ ID NO: 3807784 - DNA, 14 bp, Homo sapiens
tgcgagaattttca

SEQ ID NO: 3807785 - DNA, 21 bp, Homo sapiens
tgcgagagaccctacagacag

SEQ ID NO: 3807786 - DNA, 17 bp, Homo sapiens
tgcgccacggcactcca

SEQ ID NO: 3807787 - DNA, 14 bp, Homo sapiens
tgctagaagaaaac

SEQ ID NO: 3807788 - DNA, 21 bp, Homo sapiens
tgctatctctgtgtgcacaaa

SEQ ID NO: 3807789 - DNA, 16 bp, Homo sapiens
tgctatgagctgggga

SEQ ID NO: 3807790 - DNA, 19 bp, Homo sapiens
tgctatgagctggggatgt

SEQ ID NO: 3807791 - DNA, 22 bp, Homo sapiens
tgctatgagctggggatgtctc

SEQ ID NO: 3807792 - DNA, 18 bp, Homo sapiens
tgctcacactacttgaga

SEQ ID NO: 3807793 - DNA, 17 bp, Homo sapiens
tgctcagtaatttgagg

SEQ ID NO: 3807794 - DNA, 19 bp, Homo sapiens
tgctcctgcatgcaactaa

SEQ ID NO: 3807795 - DNA, 20 bp, Homo sapiens
tgctctacaatgacacacaa

SEQ ID NO: 3807796 - DNA, 19 bp, Homo sapiens
tgctctgaggtcaataaag

SEQ ID NO: 3807797 - DNA, 22 bp, Homo sapiens
tgctctgaggtcaataaagcag

SEQ ID NO: 3807798 - DNA, 12 bp, Homo sapiens
tgctcttagctg

SEQ ID NO: 3807799 - DNA, 15 bp, Homo sapiens
tgctcttagctgtct

SEQ ID NO: 3807800 - DNA, 14 bp, Homo sapiens
tgctcttctttaga

SEQ ID NO: 3807801 - DNA, 12 bp, Homo sapiens
tgctgaaataaa

SEQ ID NO: 3807802 - DNA, 15 bp, Homo sapiens
tgctgaaataaacta

SEQ ID NO: 3807803 - DNA, 16 bp, Homo sapiens
tgctgaaataaactag

SEQ ID NO: 3807804 - DNA, 16 bp, Homo sapiens
tgctgcttcctaactt

SEQ ID NO: 3807805 - DNA, 12 bp, Homo sapiens
tgctgcttgagg

SEQ ID NO: 3807806 - DNA, 19 bp, Homo sapiens
tgctggactgtcatagaaa

SEQ ID NO: 3807807 - DNA, 13 bp, Homo sapiens
tgcttaagaatca

SEQ ID NO: 3807808 - DNA, 17 bp, Homo sapiens
tgcttcatgaaaatcct

SEQ ID NO: 3807809 - DNA, 20 bp, Homo sapiens
tgcttcatgaaaatcctacc

SEQ ID NO: 3807810 - DNA, 15 bp, Homo sapiens
tgcttccaattttct

SEQ ID NO: 3807811 - DNA, 16 bp, Homo sapiens
tgcttcctaacttatt

SEQ ID NO: 3807812 - DNA, 16 bp, Homo sapiens
tgcttgaacccaggag

SEQ ID NO: 3807813 - DNA, 16 bp, Homo sapiens
tgctttaagaaactgt

SEQ ID NO: 3807814 - DNA, 18 bp, Homo sapiens
tgcttttctcccagaagg

SEQ ID NO: 3807815 - DNA, 17 bp, Homo sapiens
tggaaaaatagcctgcc

SEQ ID NO: 3807816 - DNA, 13 bp, Homo sapiens
tggaaaaatccag

SEQ ID NO: 3807817 - DNA, 14 bp, Homo sapiens
tggaaaggagagga

SEQ ID NO: 3807818 - DNA, 17 bp, Homo sapiens
tggaaaggagaggaaag

SEQ ID NO: 3807819 - DNA, 15 bp, Homo sapiens
tggaaataaatgtat

SEQ ID NO: 3807820 - DNA, 15 bp, Homo sapiens
tggaaatacacagtg

SEQ ID NO: 3807821 - DNA, 17 bp, Homo sapiens
tggaaattggaagagca

SEQ ID NO: 3807822 - DNA, 19 bp, Homo sapiens
tggaaggagccagccagga

SEQ ID NO: 3807823 - DNA, 23 bp, Homo sapiens
tggaatagaaaagatgagaggca

SEQ ID NO: 3807824 - DNA, 20 bp, Homo sapiens
tggaatgatgggtcagttgt

SEQ ID NO: 3807825 - DNA, 20 bp, Homo sapiens
tggaattttctttcatacat

SEQ ID NO: 3807826 - DNA, 21 bp, Homo sapiens
tggaattttctttcatacatt

SEQ ID NO: 3807827 - DNA, 14 bp, Homo sapiens
tggacacctgccct

SEQ ID NO: 3807828 - DNA, 16 bp, Homo sapiens
tggacacctgccctgc

SEQ ID NO: 3807829 - DNA, 17 bp, Homo sapiens
tggacacctgccctgcc

SEQ ID NO: 3807830 - DNA, 18 bp, Homo sapiens
tggacacctgccctgccc

SEQ ID NO: 3807831 - DNA, 15 bp, Homo sapiens
tggaccactgggcaa

SEQ ID NO: 3807832 - DNA, 19 bp, Homo sapiens
tggaccactgggcaatgat

SEQ ID NO: 3807833 - DNA, 22 bp, Homo sapiens
tggaccagcctctccactcatg

SEQ ID NO: 3807834 - DNA, 21 bp, Homo sapiens
tggactgtcatagaaattaca

SEQ ID NO: 3807835 - DNA, 22 bp, Homo sapiens
tggaggagcttgggggatgact

SEQ ID NO: 3807836 - DNA, 20 bp, Homo sapiens
tggaggatggagagagggga

SEQ ID NO: 3807837 - DNA, 14 bp, Homo sapiens
tggaggcagacagc

SEQ ID NO: 3807838 - DNA, 18 bp, Homo sapiens
tggagtctcgctctgctg

SEQ ID NO: 3807839 - DNA, 19 bp, Homo sapiens
tggagtctcgctctgctgc

SEQ ID NO: 3807840 - DNA, 15 bp, Homo sapiens
tggatctgtgagggg

SEQ ID NO: 3807841 - DNA, 21 bp, Homo sapiens
tggcaccactagggtcctggc

SEQ ID NO: 3807842 - DNA, 16 bp, Homo sapiens
tggcaccagcagcctg

SEQ ID NO: 3807843 - DNA, 17 bp, Homo sapiens
tggcaccagcagcctgg

SEQ ID NO: 3807844 - DNA, 17 bp, Homo sapiens
tggcacgatctcagctc

SEQ ID NO: 3807845 - DNA, 14 bp, Homo sapiens
tggcagctgtctca

SEQ ID NO: 3807846 - DNA, 18 bp, Homo sapiens
tggcatctccctgacctt

SEQ ID NO: 3807847 - DNA, 15 bp, Homo sapiens
tggccacagaaaggc

SEQ ID NO: 3807848 - DNA, 14 bp, Homo sapiens
tggccagagctgag

SEQ ID NO: 3807849 - DNA, 15 bp, Homo sapiens
tggccagtcctagag

SEQ ID NO: 3807850 - DNA, 16 bp, Homo sapiens
tggccagtcctagagc

SEQ ID NO: 3807851 - DNA, 19 bp, Homo sapiens
tggcccacgcacttcggga

SEQ ID NO: 3807852 - DNA, 13 bp, Homo sapiens
tggcccactgcat

SEQ ID NO: 3807853 - DNA, 14 bp, Homo sapiens
tggcccactgcatc

SEQ ID NO: 3807854 - DNA, 19 bp, Homo sapiens
tggcccccactcacaggga

SEQ ID NO: 3807855 - DNA, 14 bp, Homo sapiens
tggcccctgaacaa

SEQ ID NO: 3807856 - DNA, 19 bp, Homo sapiens
tggccctgtgactatggct

SEQ ID NO: 3807857 - DNA, 16 bp, Homo sapiens
tggcctaacctgccga

SEQ ID NO: 3807858 - DNA, 14 bp, Homo sapiens
tggcgagcccttag

SEQ ID NO: 3807859 - DNA, 17 bp, Homo sapiens
tggcgagcccttagcct

SEQ ID NO: 3807860 - DNA, 22 bp, Homo sapiens
tggctgccttgtgaaggaatta

SEQ ID NO: 3807861 - DNA, 20 bp, Homo sapiens
tggctgtggcctaacctgcc

SEQ ID NO: 3807862 - DNA, 23 bp, Homo sapiens
tggcttcacggaagagccttgcg

SEQ ID NO: 3807863 - DNA, 23 bp, Homo sapiens
tggctttagccataccagggtga

SEQ ID NO: 3807864 - DNA, 22 bp, Homo sapiens
tgggagaatgtcagtatgtgga

SEQ ID NO: 3807865 - DNA, 14 bp, Homo sapiens
tgggaggaacctga

SEQ ID NO: 3807866 - DNA, 14 bp, Homo sapiens
tgggaggacagagc

SEQ ID NO: 3807867 - DNA, 15 bp, Homo sapiens
tgggaggacagagcc

SEQ ID NO: 3807868 - DNA, 17 bp, Homo sapiens
tgggaggacagagccgg

SEQ ID NO: 3807869 - DNA, 14 bp, Homo sapiens
tgggaggagggcag

SEQ ID NO: 3807870 - DNA, 18 bp, Homo sapiens
tgggaggagggcaggcat

SEQ ID NO: 3807871 - DNA, 16 bp, Homo sapiens
tgggaggatctcttga

SEQ ID NO: 3807872 - DNA, 20 bp, Homo sapiens
tgggaggatctcttgagcct

SEQ ID NO: 3807873 - DNA, 21 bp, Homo sapiens
tgggaggattgcttgagctca

SEQ ID NO: 3807874 - DNA, 20 bp, Homo sapiens
tgggaggccaaggtgggagg

SEQ ID NO: 3807875 - DNA, 13 bp, Homo sapiens
tgggcgacagagc

SEQ ID NO: 3807876 - DNA, 14 bp, Homo sapiens
tgggctctgaggag

SEQ ID NO: 3807877 - DNA, 17 bp, Homo sapiens
tgggcttgtctgtagat

SEQ ID NO: 3807878 - DNA, 21 bp, Homo sapiens
tgggcttgtctgtagatttta

SEQ ID NO: 3807879 - DNA, 13 bp, Homo sapiens
tggggagagacgg

SEQ ID NO: 3807880 - DNA, 21 bp, Homo sapiens
tggggagggagacagagacag

SEQ ID NO: 3807881 - DNA, 14 bp, Homo sapiens
tggggagggatttg

SEQ ID NO: 3807882 - DNA, 18 bp, Homo sapiens
tggggatagatgtgtgga

SEQ ID NO: 3807883 - DNA, 20 bp, Homo sapiens
tggggatagatgtgtggaca

SEQ ID NO: 3807884 - DNA, 16 bp, Homo sapiens
tggggcaggggccggg

SEQ ID NO: 3807885 - DNA, 18 bp, Homo sapiens
tggggcctagatccacac

SEQ ID NO: 3807886 - DNA, 20 bp, Homo sapiens
tgggggatcacagcctctga

SEQ ID NO: 3807887 - DNA, 23 bp, Homo sapiens
tgggggcttccctgggcctcagc

SEQ ID NO: 3807888 - DNA, 19 bp, Homo sapiens
tggggggctgaggtgggag

SEQ ID NO: 3807889 - DNA, 21 bp, Homo sapiens
tggggtaggttgggagaatgt

SEQ ID NO: 3807890 - DNA, 15 bp, Homo sapiens
tggggtcaggtgcca

SEQ ID NO: 3807891 - DNA, 21 bp, Homo sapiens
tgggtagaaagagatacagag

SEQ ID NO: 3807892 - DNA, 15 bp, Homo sapiens
tgggtcggccctgcc

SEQ ID NO: 3807893 - DNA, 12 bp, Homo sapiens
tgggtctgtgtg

SEQ ID NO: 3807894 - DNA, 17 bp, Homo sapiens
tgggtggcaccagcagc

SEQ ID NO: 3807895 - DNA, 23 bp, Homo sapiens
tggtaaaaagattatatatcata

SEQ ID NO: 3807896 - DNA, 18 bp, Homo sapiens
tggtactgcacattttgt

SEQ ID NO: 3807897 - DNA, 19 bp, Homo sapiens
tggtatgaacttgaggaca

SEQ ID NO: 3807898 - DNA, 20 bp, Homo sapiens
tggtcaggctggtctcgaac

SEQ ID NO: 3807899 - DNA, 16 bp, Homo sapiens
tggtcttatttgtaaa

SEQ ID NO: 3807900 - DNA, 21 bp, Homo sapiens
tggtttttaaaaaactgctga

SEQ ID NO: 3807901 - DNA, 23 bp, Homo sapiens
tggtttttaaaaaactgctgact

SEQ ID NO: 3807902 - DNA, 23 bp, Homo sapiens
tgtaaactcaaaatatttgtaca

SEQ ID NO: 3807903 - DNA, 15 bp, Homo sapiens
tgtaaatttatgtga

SEQ ID NO: 3807904 - DNA, 17 bp, Homo sapiens
tgtaaatttatgtgatg

SEQ ID NO: 3807905 - DNA, 20 bp, Homo sapiens
tgtaacttttgtaagacaaa

SEQ ID NO: 3807906 - DNA, 17 bp, Homo sapiens
tgtaatttaaaattgtg

SEQ ID NO: 3807907 - DNA, 21 bp, Homo sapiens
tgtaatttaaaattgtgatgt

SEQ ID NO: 3807908 - DNA, 17 bp, Homo sapiens
tgtacaaaataaacaaa

SEQ ID NO: 3807909 - DNA, 18 bp, Homo sapiens
tgtacaaagatatgctaa

SEQ ID NO: 3807910 - DNA, 18 bp, Homo sapiens
tgtacatagttatttatt

SEQ ID NO: 3807911 - DNA, 20 bp, Homo sapiens
tgtactgaaaaatggtaatt

SEQ ID NO: 3807912 - DNA, 12 bp, Homo sapiens
tgtagagacttc

SEQ ID NO: 3807913 - DNA, 20 bp, Homo sapiens
tgtagagacttccgtcaccc

SEQ ID NO: 3807914 - DNA, 12 bp, Homo sapiens
tgtagcagcatt

SEQ ID NO: 3807915 - DNA, 12 bp, Homo sapiens
tgtagctttgct

SEQ ID NO: 3807916 - DNA, 13 bp, Homo sapiens
tgtagctttgctc

SEQ ID NO: 3807917 - DNA, 13 bp, Homo sapiens
tgtatatagtttg

SEQ ID NO: 3807918 - DNA, 19 bp, Homo sapiens
tgtatatctatatctctaa

SEQ ID NO: 3807919 - DNA, 15 bp, Homo sapiens
tgtatcatagaaatg

SEQ ID NO: 3807920 - DNA, 14 bp, Homo sapiens
tgtcagaaacatga

SEQ ID NO: 3807921 - DNA, 12 bp, Homo sapiens
tgtcagaaactc

SEQ ID NO: 3807922 - DNA, 15 bp, Homo sapiens
tgtcagcatagaagt

SEQ ID NO: 3807923 - DNA, 16 bp, Homo sapiens
tgtcagctgaacctgg

SEQ ID NO: 3807924 - DNA, 18 bp, Homo sapiens
tgtcagtatgtggaagtg

SEQ ID NO: 3807925 - DNA, 22 bp, Homo sapiens
tgtcagtatgtggaagtgtggg

SEQ ID NO: 3807926 - DNA, 15 bp, Homo sapiens
tgtcatagaaattac

SEQ ID NO: 3807927 - DNA, 18 bp, Homo sapiens
tgtccagaccattgtctt

SEQ ID NO: 3807928 - DNA, 17 bp, Homo sapiens
tgtcccaggtcctcact

SEQ ID NO: 3807929 - DNA, 12 bp, Homo sapiens
tgtccctaccca

SEQ ID NO: 3807930 - DNA, 15 bp, Homo sapiens
tgtccctacccactc

SEQ ID NO: 3807931 - DNA, 19 bp, Homo sapiens
tgtccctgtccccctcccc

SEQ ID NO: 3807932 - DNA, 13 bp, Homo sapiens
tgtccgagctttg

SEQ ID NO: 3807933 - DNA, 14 bp, Homo sapiens
tgtccgagctttga

SEQ ID NO: 3807934 - DNA, 13 bp, Homo sapiens
tgtctactcctca

SEQ ID NO: 3807935 - DNA, 19 bp, Homo sapiens
tgtctactcctcacagcat

SEQ ID NO: 3807936 - DNA, 15 bp, Homo sapiens
tgtctgtctgtccca

SEQ ID NO: 3807937 - DNA, 17 bp, Homo sapiens
tgtcttccaaccccagc

SEQ ID NO: 3807938 - DNA, 20 bp, Homo sapiens
tgtcttccaaccccagctgg

SEQ ID NO: 3807939 - DNA, 21 bp, Homo sapiens
tgtcttccaaccccagctggc

SEQ ID NO: 3807940 - DNA, 23 bp, Homo sapiens
tgtcttccaaccccagctggcct

SEQ ID NO: 3807941 - DNA, 22 bp, Homo sapiens
tgtcttcctagtatattagttt

SEQ ID NO: 3807942 - DNA, 13 bp, Homo sapiens
tgtgaaaagaaaa

SEQ ID NO: 3807943 - DNA, 18 bp, Homo sapiens
tgtgacaacatttttgta

SEQ ID NO: 3807944 - DNA, 23 bp, Homo sapiens
tgtgacaacatttttgtacatta

SEQ ID NO: 3807945 - DNA, 15 bp, Homo sapiens
tgtgatataaaatat

SEQ ID NO: 3807946 - DNA, 21 bp, Homo sapiens
tgtgccagaggaaggaaaagg

SEQ ID NO: 3807947 - DNA, 17 bp, Homo sapiens
tgtgccttgtcacgcca

SEQ ID NO: 3807948 - DNA, 21 bp, Homo sapiens
tgtggagaagcggctggcagc

SEQ ID NO: 3807949 - DNA, 14 bp, Homo sapiens
tgtggatgataaaa

SEQ ID NO: 3807950 - DNA, 16 bp, Homo sapiens
tgtggcatccagagtc

SEQ ID NO: 3807951 - DNA, 22 bp, Homo sapiens
tgtggcccctgaacaagaattg

SEQ ID NO: 3807952 - DNA, 15 bp, Homo sapiens
tgtggcctaacctgc

SEQ ID NO: 3807953 - DNA, 11 bp, Homo sapiens
tgtgtaattta

SEQ ID NO: 3807954 - DNA, 22 bp, Homo sapiens
tgtgtaatttaaaattgtgatg

SEQ ID NO: 3807955 - DNA, 23 bp, Homo sapiens
tgtgtaatttaaaattgtgatgt

SEQ ID NO: 3807956 - DNA, 12 bp, Homo sapiens
tgtgtatgtggg

SEQ ID NO: 3807957 - DNA, 14 bp, Homo sapiens
tgtgtatgtggggg

SEQ ID NO: 3807958 - DNA, 23 bp, Homo sapiens
tgtgtatgtgggggtctgtgtgt

SEQ ID NO: 3807959 - DNA, 19 bp, Homo sapiens
tgtgtcagcatagaagtaa

SEQ ID NO: 3807960 - DNA, 11 bp, Homo sapiens
tgtgtgtatgt

SEQ ID NO: 3807961 - DNA, 12 bp, Homo sapiens
tgtgtgtgggag

SEQ ID NO: 3807962 - DNA, 14 bp, Homo sapiens
tgtgtgtgtatgtg

SEQ ID NO: 3807963 - DNA, 15 bp, Homo sapiens
tgtgtttatgtgtgt

SEQ ID NO: 3807964 - DNA, 14 bp, Homo sapiens
tgttaattgattaa

SEQ ID NO: 3807965 - DNA, 18 bp, Homo sapiens
tgttaattgattaaaatc

SEQ ID NO: 3807966 - DNA, 16 bp, Homo sapiens
tgttactgtcttcagt

SEQ ID NO: 3807967 - DNA, 22 bp, Homo sapiens
tgttattattacttatttttga

SEQ ID NO: 3807968 - DNA, 16 bp, Homo sapiens
tgttattggaattttc

SEQ ID NO: 3807969 - DNA, 20 bp, Homo sapiens
tgttattttttatttccaca

SEQ ID NO: 3807970 - DNA, 21 bp, Homo sapiens
tgttattttttatttccacat

SEQ ID NO: 3807971 - DNA, 22 bp, Homo sapiens
tgttcacaccattctcctgcct

SEQ ID NO: 3807972 - DNA, 19 bp, Homo sapiens
tgttcacttttcctccctc

SEQ ID NO: 3807973 - DNA, 21 bp, Homo sapiens
tgttcattaaacgtcattcag

SEQ ID NO: 3807974 - DNA, 18 bp, Homo sapiens
tgttctgtccagtttcca

SEQ ID NO: 3807975 - DNA, 13 bp, Homo sapiens
tgttgtcagctga

SEQ ID NO: 3807976 - DNA, 14 bp, Homo sapiens
tgttgtcagctgaa

SEQ ID NO: 3807977 - DNA, 21 bp, Homo sapiens
tgtttaaaactcagaatataa

SEQ ID NO: 3807978 - DNA, 16 bp, Homo sapiens
tgtttagaagaagtgt

SEQ ID NO: 3807979 - DNA, 13 bp, Homo sapiens
tgtttatgtgtgt

SEQ ID NO: 3807980 - DNA, 23 bp, Homo sapiens
tgttttctaatctctttattaaa

SEQ ID NO: 3807981 - DNA, 18 bp, Homo sapiens
tgttttcttcatttctct

SEQ ID NO: 3807982 - DNA, 11 bp, Homo sapiens
tgttttcttct

SEQ ID NO: 3807983 - DNA, 18 bp, Homo sapiens
ttaaaaagtggaaaaata

SEQ ID NO: 3807984 - DNA, 14 bp, Homo sapiens
ttaaaacccaagtg

SEQ ID NO: 3807985 - DNA, 21 bp, Homo sapiens
ttaaaatatttgtctttaaac

SEQ ID NO: 3807986 - DNA, 18 bp, Homo sapiens
ttaaaattgtgatgtgtc

SEQ ID NO: 3807987 - DNA, 23 bp, Homo sapiens
ttaaacagtgagcctgaattttg

SEQ ID NO: 3807988 - DNA, 14 bp, Homo sapiens
ttaaagatttctgc

SEQ ID NO: 3807989 - DNA, 13 bp, Homo sapiens
ttaaatcgttaga

SEQ ID NO: 3807990 - DNA, 16 bp, Homo sapiens
ttaactctgcaggaaa

SEQ ID NO: 3807991 - DNA, 14 bp, Homo sapiens
ttaaggcagtgact

SEQ ID NO: 3807992 - DNA, 23 bp, Homo sapiens
ttaataaacgtccacagagtata

SEQ ID NO: 3807993 - DNA, 14 bp, Homo sapiens
ttaatatctgagaa

SEQ ID NO: 3807994 - DNA, 17 bp, Homo sapiens
ttaatatctgagaagtg

SEQ ID NO: 3807995 - DNA, 18 bp, Homo sapiens
ttaccctaaaacatgtgt

SEQ ID NO: 3807996 - DNA, 16 bp, Homo sapiens
ttacctggatgccatt

SEQ ID NO: 3807997 - DNA, 19 bp, Homo sapiens
ttactattatttgctatat

SEQ ID NO: 3807998 - DNA, 14 bp, Homo sapiens
ttactgtatataaa

SEQ ID NO: 3807999 - DNA, 18 bp, Homo sapiens
ttactgtcctgttttcta

SEQ ID NO: 3808000 - DNA, 18 bp, Homo sapiens
ttacttaggtgtggggga

SEQ ID NO: 3808001 - DNA, 13 bp, Homo sapiens
ttagaaacataaa

SEQ ID NO: 3808002 - DNA, 16 bp, Homo sapiens
ttagaagaagtgtgtc

SEQ ID NO: 3808003 - DNA, 19 bp, Homo sapiens
ttagaagatctgcttccct

SEQ ID NO: 3808004 - DNA, 12 bp, Homo sapiens
ttagaatatatt

SEQ ID NO: 3808005 - DNA, 13 bp, Homo sapiens
ttagaggaaaagg

SEQ ID NO: 3808006 - DNA, 21 bp, Homo sapiens
ttagccttgctgtagagactt

SEQ ID NO: 3808007 - DNA, 17 bp, Homo sapiens
ctctggatcctgcactc

SEQ ID NO: 3808008 - DNA, 17 bp, Homo sapiens
ctctgtgaatacaatta

SEQ ID NO: 3808009 - DNA, 22 bp, Homo sapiens
ctctgtgcttttaaatgcataa

SEQ ID NO: 3808010 - DNA, 15 bp, Homo sapiens
ctctgttcctggctc

SEQ ID NO: 3808011 - DNA, 15 bp, Homo sapiens
ctcttagaaaaacca

SEQ ID NO: 3808012 - DNA, 13 bp, Homo sapiens
ctcttagctgtct

SEQ ID NO: 3808013 - DNA, 17 bp, Homo sapiens
ctcttctattttgtaaa

SEQ ID NO: 3808014 - DNA, 15 bp, Homo sapiens
ctcttctcagagcag

SEQ ID NO: 3808015 - DNA, 14 bp, Homo sapiens
ctcttgagcctggg

SEQ ID NO: 3808016 - DNA, 16 bp, Homo sapiens
ctcttgagcctgggag

SEQ ID NO: 3808017 - DNA, 18 bp, Homo sapiens
ctcttggccagagctgag

SEQ ID NO: 3808018 - DNA, 17 bp, Homo sapiens
ctctttgctacaataaa

SEQ ID NO: 3808019 - DNA, 23 bp, Homo sapiens
ctctttgctacaataaatgctga

SEQ ID NO: 3808020 - DNA, 13 bp, Homo sapiens
ctgaaatttcaga

SEQ ID NO: 3808021 - DNA, 16 bp, Homo sapiens
ctgaacaagaattgga

SEQ ID NO: 3808022 - DNA, 23 bp, Homo sapiens
ctgaagacaccgttcattcaggc

SEQ ID NO: 3808023 - DNA, 20 bp, Homo sapiens
ctgaaggctttcagggcctc

SEQ ID NO: 3808024 - DNA, 22 bp, Homo sapiens
ctgaagtcccagatacttgggg

SEQ ID NO: 3808025 - DNA, 17 bp, Homo sapiens
ctgaagtgcagctcagg

SEQ ID NO: 3808026 - DNA, 13 bp, Homo sapiens
ctgacagagccag

SEQ ID NO: 3808027 - DNA, 17 bp, Homo sapiens
ctgacagagccagaggc

SEQ ID NO: 3808028 - DNA, 14 bp, Homo sapiens
ctgaccaagagaga

SEQ ID NO: 3808029 - DNA, 18 bp, Homo sapiens
ctgaccatttcaggggtc

SEQ ID NO: 3808030 - DNA, 20 bp, Homo sapiens
ctgaccgggatccagttcca

SEQ ID NO: 3808031 - DNA, 16 bp, Homo sapiens
ctgaccgggtctgctt

SEQ ID NO: 3808032 - DNA, 15 bp, Homo sapiens
ctgaccttctccagg

SEQ ID NO: 3808033 - DNA, 20 bp, Homo sapiens
ctgaccttctccagggacag

SEQ ID NO: 3808034 - DNA, 17 bp, Homo sapiens
ctgactactactctgcc

SEQ ID NO: 3808035 - DNA, 22 bp, Homo sapiens
ctgagaagagagatcaaatgga

SEQ ID NO: 3808036 - DNA, 16 bp, Homo sapiens
ctgagaagtgtatata

SEQ ID NO: 3808037 - DNA, 21 bp, Homo sapiens
ctgagagaggccattctttcc

SEQ ID NO: 3808038 - DNA, 22 bp, Homo sapiens
ctgagagaggccattctttccc

SEQ ID NO: 3808039 - DNA, 23 bp, Homo sapiens
ctgagagctctctcttctctgtt

SEQ ID NO: 3808040 - DNA, 19 bp, Homo sapiens
ctgagatactgaagtgcag

SEQ ID NO: 3808041 - DNA, 20 bp, Homo sapiens
ctgagatactgaagtgcagc

SEQ ID NO: 3808042 - DNA, 21 bp, Homo sapiens
ctgagatcaaaacggttttac

SEQ ID NO: 3808043 - DNA, 15 bp, Homo sapiens
ctgagatttcacagg

SEQ ID NO: 3808044 - DNA, 14 bp, Homo sapiens
ctgagctttctgct

SEQ ID NO: 3808045 - DNA, 13 bp, Homo sapiens
ctgaggcaccaga

SEQ ID NO: 3808046 - DNA, 12 bp, Homo sapiens
ctgagggagaga

SEQ ID NO: 3808047 - DNA, 16 bp, Homo sapiens
ctgagggagagactct

SEQ ID NO: 3808048 - DNA, 21 bp, Homo sapiens
ctgaggtcaataaagcagagc

SEQ ID NO: 3808049 - DNA, 12 bp, Homo sapiens
ctgaggtgggag

SEQ ID NO: 3808050 - DNA, 22 bp, Homo sapiens
ctgaggtgggaggatctcttga

SEQ ID NO: 3808051 - DNA, 19 bp, Homo sapiens
ctgagtagctgggactaca

SEQ ID NO: 3808052 - DNA, 14 bp, Homo sapiens
ctgagtccagctcc

SEQ ID NO: 3808053 - DNA, 21 bp, Homo sapiens
ctgagtggcagccgcctccct

SEQ ID NO: 3808054 - DNA, 22 bp, Homo sapiens
ctgatcaagtcaccggagcttt

SEQ ID NO: 3808055 - DNA, 21 bp, Homo sapiens
ctgatgcattcccggtgcaga

SEQ ID NO: 3808056 - DNA, 16 bp, Homo sapiens
ctgatttgatatagat

SEQ ID NO: 3808057 - DNA, 23 bp, Homo sapiens
ctgatttgatgatacatttcatt

SEQ ID NO: 3808058 - DNA, 14 bp, Homo sapiens
ctgcaaccctggtg

SEQ ID NO: 3808059 - DNA, 20 bp, Homo sapiens
ctgcaagaattgaagcagga

SEQ ID NO: 3808060 - DNA, 16 bp, Homo sapiens
ctgcaagctctgcctc

SEQ ID NO: 3808061 - DNA, 19 bp, Homo sapiens
ctgcaagctctgcctcccg

SEQ ID NO: 3808062 - DNA, 16 bp, Homo sapiens
ctgcacaagctgcacc

SEQ ID NO: 3808063 - DNA, 14 bp, Homo sapiens
ctgcaccctcaggc

SEQ ID NO: 3808064 - DNA, 16 bp, Homo sapiens
ctgcaccggggcctgg

SEQ ID NO: 3808065 - DNA, 17 bp, Homo sapiens
ctgcactccagcctggg

SEQ ID NO: 3808066 - DNA, 14 bp, Homo sapiens
ctgcagcagagcct

SEQ ID NO: 3808067 - DNA, 18 bp, Homo sapiens
ctgcaggaaatagtcact

SEQ ID NO: 3808068 - DNA, 19 bp, Homo sapiens
ctgcaggaaatcagagctg

SEQ ID NO: 3808069 - DNA, 20 bp, Homo sapiens
ctgcaggaaatcagagctgg

SEQ ID NO: 3808070 - DNA, 22 bp, Homo sapiens
ctgcaggaaatcagagctggca

SEQ ID NO: 3808071 - DNA, 21 bp, Homo sapiens
ctgcaggcagatttactgtcc

SEQ ID NO: 3808072 - DNA, 20 bp, Homo sapiens
ctgcagggggtgtgtctgct

SEQ ID NO: 3808073 - DNA, 23 bp, Homo sapiens
ctgcagggggtgtgtctgctcag

SEQ ID NO: 3808074 - DNA, 16 bp, Homo sapiens
ctgcatcgtttcatct

SEQ ID NO: 3808075 - DNA, 22 bp, Homo sapiens
ctgcatcgtttcatcttccaac

SEQ ID NO: 3808076 - DNA, 21 bp, Homo sapiens
ctgcattcacagcgcctcctg

SEQ ID NO: 3808077 - DNA, 23 bp, Homo sapiens
ctgcattcacagcgcctcctgga

SEQ ID NO: 3808078 - DNA, 23 bp, Homo sapiens
ctgcattttgtacaaatccacga

SEQ ID NO: 3808079 - DNA, 19 bp, Homo sapiens
ctgccaaaaatagaaagtg

SEQ ID NO: 3808080 - DNA, 12 bp, Homo sapiens
ctgccaaaacaa

SEQ ID NO: 3808081 - DNA, 11 bp, Homo sapiens
ctgccacctgt

SEQ ID NO: 3808082 - DNA, 16 bp, Homo sapiens
ctgccaggagacaggt

SEQ ID NO: 3808083 - DNA, 22 bp, Homo sapiens
ctgccatcatgtttacagagga

SEQ ID NO: 3808084 - DNA, 17 bp, Homo sapiens
ctgcccaagggcctccc

SEQ ID NO: 3808085 - DNA, 22 bp, Homo sapiens
ctgcccaagggcctcccaccag

SEQ ID NO: 3808086 - DNA, 14 bp, Homo sapiens
ctgccccagcctcc

SEQ ID NO: 3808087 - DNA, 18 bp, Homo sapiens
ctgcccctccccagccct

SEQ ID NO: 3808088 - DNA, 19 bp, Homo sapiens
ctgcccgcctcggcctccc

SEQ ID NO: 3808089 - DNA, 22 bp, Homo sapiens
ctgcccgcctcggcctcccaaa

SEQ ID NO: 3808090 - DNA, 23 bp, Homo sapiens
ctgccctcccacctccgctggga

SEQ ID NO: 3808091 - DNA, 13 bp, Homo sapiens
ctgccctgtaccc

SEQ ID NO: 3808092 - DNA, 13 bp, Homo sapiens
ctgccgaccagag

SEQ ID NO: 3808093 - DNA, 15 bp, Homo sapiens
ctgccgaccagagcc

SEQ ID NO: 3808094 - DNA, 16 bp, Homo sapiens
ctgccgaccagagccc

SEQ ID NO: 3808095 - DNA, 15 bp, Homo sapiens
ctgcctaataaagag

SEQ ID NO: 3808096 - DNA, 21 bp, Homo sapiens
ctgcctcatcgtggctgggaa

SEQ ID NO: 3808097 - DNA, 18 bp, Homo sapiens
ctgcctccattctgacca

SEQ ID NO: 3808098 - DNA, 19 bp, Homo sapiens
ctgcctgacactgagcccc

SEQ ID NO: 3808099 - DNA, 15 bp, Homo sapiens
ctgcctgggcctccc

SEQ ID NO: 3808100 - DNA, 21 bp, Homo sapiens
ctgcctgggcctcccaaagtg

SEQ ID NO: 3808101 - DNA, 18 bp, Homo sapiens
ctgcctgttctccagatg

SEQ ID NO: 3808102 - DNA, 13 bp, Homo sapiens
ctgccttgccatg

SEQ ID NO: 3808103 - DNA, 18 bp, Homo sapiens
ctgcgccacggcactcca

SEQ ID NO: 3808104 - DNA, 13 bp, Homo sapiens
ctgctcagacaga

SEQ ID NO: 3808105 - DNA, 14 bp, Homo sapiens
ctgctccagctgtt

SEQ ID NO: 3808106 - DNA, 15 bp, Homo sapiens
ctgctccagctgttc

SEQ ID NO: 3808107 - DNA, 19 bp, Homo sapiens
ctgctccagctgttcagct

SEQ ID NO: 3808108 - DNA, 20 bp, Homo sapiens
ctgctccagctgttcagctg

SEQ ID NO: 3808109 - DNA, 16 bp, Homo sapiens
ctgctcgaagaacaat

SEQ ID NO: 3808110 - DNA, 23 bp, Homo sapiens
ctgctctgcccccaactcccgga

SEQ ID NO: 3808111 - DNA, 20 bp, Homo sapiens
ctgctgcccaggctagagtg

SEQ ID NO: 3808112 - DNA, 14 bp, Homo sapiens
ctgctgcttcctaa

SEQ ID NO: 3808113 - DNA, 15 bp, Homo sapiens
ctgctgcttcctaac

SEQ ID NO: 3808114 - DNA, 11 bp, Homo sapiens
ctgctgggctt

SEQ ID NO: 3808115 - DNA, 23 bp, Homo sapiens
ctgctgttaattgattaaaatct

SEQ ID NO: 3808116 - DNA, 14 bp, Homo sapiens
ctgcttccctgggg

SEQ ID NO: 3808117 - DNA, 15 bp, Homo sapiens
ctgcttccctggggc

SEQ ID NO: 3808118 - DNA, 17 bp, Homo sapiens
ctgcttccctggggccc

SEQ ID NO: 3808119 - DNA, 16 bp, Homo sapiens
ctgcttccgtatttta

SEQ ID NO: 3808120 - DNA, 14 bp, Homo sapiens
ctgcttctgcattc

SEQ ID NO: 3808121 - DNA, 13 bp, Homo sapiens
ctgcttgaggcaa

SEQ ID NO: 3808122 - DNA, 21 bp, Homo sapiens
ctgcttgaggcaactcatctt

SEQ ID NO: 3808123 - DNA, 18 bp, Homo sapiens
ctggacttcctataatac

SEQ ID NO: 3808124 - DNA, 12 bp, Homo sapiens
ctggaggtttgt

SEQ ID NO: 3808125 - DNA, 19 bp, Homo sapiens
ctggagttcagcagtgatg

SEQ ID NO: 3808126 - DNA, 18 bp, Homo sapiens
ctggatacagaatgaatc

SEQ ID NO: 3808127 - DNA, 14 bp, Homo sapiens
ctggatcctgcact

SEQ ID NO: 3808128 - DNA, 18 bp, Homo sapiens
ctggatgagcaactcctg

SEQ ID NO: 3808129 - DNA, 21 bp, Homo sapiens
ctggcaatgccctacctgcct

SEQ ID NO: 3808130 - DNA, 21 bp, Homo sapiens
ctggcacagcctggctgtggc

SEQ ID NO: 3808131 - DNA, 11 bp, Homo sapiens
ctggcagccca

SEQ ID NO: 3808132 - DNA, 13 bp, Homo sapiens
ctggcagcctcca

SEQ ID NO: 3808133 - DNA, 18 bp, Homo sapiens
ctggcatctccctgacct

SEQ ID NO: 3808134 - DNA, 15 bp, Homo sapiens
ctggcattacagctg

SEQ ID NO: 3808135 - DNA, 13 bp, Homo sapiens
ctggccacactgg

SEQ ID NO: 3808136 - DNA, 14 bp, Homo sapiens
ctggccacactggg

SEQ ID NO: 3808137 - DNA, 16 bp, Homo sapiens
ctggccagtcctagag

SEQ ID NO: 3808138 - DNA, 18 bp, Homo sapiens
ctggccagtcctagagct

SEQ ID NO: 3808139 - DNA, 20 bp, Homo sapiens
ctggccagtcctagagctcc

SEQ ID NO: 3808140 - DNA, 12 bp, Homo sapiens
ctggcccactgc

SEQ ID NO: 3808141 - DNA, 13 bp, Homo sapiens
ctggcccactgca

SEQ ID NO: 3808142 - DNA, 23 bp, Homo sapiens
ctggccccaccctcgtggacacc

SEQ ID NO: 3808143 - DNA, 14 bp, Homo sapiens
ctggcctctagaac

SEQ ID NO: 3808144 - DNA, 21 bp, Homo sapiens
ctggcctctagaacacccact

SEQ ID NO: 3808145 - DNA, 23 bp, Homo sapiens
ctggcctctagaacacccactgg

SEQ ID NO: 3808146 - DNA, 14 bp, Homo sapiens
ctggctcccagggc

SEQ ID NO: 3808147 - DNA, 18 bp, Homo sapiens
ctggctcccagggccatg

SEQ ID NO: 3808148 - DNA, 20 bp, Homo sapiens
ctggctccgtccaggagcct

SEQ ID NO: 3808149 - DNA, 18 bp, Homo sapiens
ctgggaaccatgaagctg

SEQ ID NO: 3808150 - DNA, 18 bp, Homo sapiens
ctgggaggtcaaggctgc

SEQ ID NO: 3808151 - DNA, 19 bp, Homo sapiens
ctgggaggtcaaggctgca

SEQ ID NO: 3808152 - DNA, 22 bp, Homo sapiens
ctgggcagtgcccaccatgcac

SEQ ID NO: 3808153 - DNA, 18 bp, Homo sapiens
ctgggcctcagcctccag

SEQ ID NO: 3808154 - DNA, 20 bp, Homo sapiens
ctgggcctcagcctccaggc

SEQ ID NO: 3808155 - DNA, 18 bp, Homo sapiens
ctggggccacatagctca

SEQ ID NO: 3808156 - DNA, 16 bp, Homo sapiens
ctggggccgaaagaac

SEQ ID NO: 3808157 - DNA, 15 bp, Homo sapiens
ctgggggaagaagct

SEQ ID NO: 3808158 - DNA, 18 bp, Homo sapiens
ctggggtcaggtgccact

SEQ ID NO: 3808159 - DNA, 22 bp, Homo sapiens
ctggggtcaggtgccactgacc

SEQ ID NO: 3808160 - DNA, 15 bp, Homo sapiens
ctgggtccaggggag

SEQ ID NO: 3808161 - DNA, 16 bp, Homo sapiens
ctgggtcggccctgcc

SEQ ID NO: 3808162 - DNA, 17 bp, Homo sapiens
ctgggtcggccctgccc

SEQ ID NO: 3808163 - DNA, 19 bp, Homo sapiens
ctgggtcggccctgcccaa

SEQ ID NO: 3808164 - DNA, 18 bp, Homo sapiens
ctgggtggcaccagcagc

SEQ ID NO: 3808165 - DNA, 20 bp, Homo sapiens
ctgggtggcaccagcagcct

SEQ ID NO: 3808166 - DNA, 18 bp, Homo sapiens
ctgggttgtcactgagac

SEQ ID NO: 3808167 - DNA, 18 bp, Homo sapiens
ctggtcttatttgtaaag

SEQ ID NO: 3808168 - DNA, 19 bp, Homo sapiens
ctggtgcactggccccacc

SEQ ID NO: 3808169 - DNA, 16 bp, Homo sapiens
ctggtgtggccaaggc

SEQ ID NO: 3808170 - DNA, 20 bp, Homo sapiens
ctgtaatcctagcactttgg

SEQ ID NO: 3808171 - DNA, 22 bp, Homo sapiens
ctgtagaactctgcaggcagat

SEQ ID NO: 3808172 - DNA, 17 bp, Homo sapiens
ctgtagagacttccgtc

SEQ ID NO: 3808173 - DNA, 13 bp, Homo sapiens
ctgtagagtggga

SEQ ID NO: 3808174 - DNA, 14 bp, Homo sapiens
ctgtccataaagta

SEQ ID NO: 3808175 - DNA, 23 bp, Homo sapiens
ctgtccataaagtaattttgtga

SEQ ID NO: 3808176 - DNA, 22 bp, Homo sapiens
ctgtcccagtgccgagaaggaa

SEQ ID NO: 3808177 - DNA, 22 bp, Homo sapiens
ctgtccccctcccctcccagtc

SEQ ID NO: 3808178 - DNA, 23 bp, Homo sapiens
ctgtccccctcccctcccagtcc

SEQ ID NO: 3808179 - DNA, 13 bp, Homo sapiens
ctgtccctaccca

SEQ ID NO: 3808180 - DNA, 16 bp, Homo sapiens
ctgtccctacccactc

SEQ ID NO: 3808181 - DNA, 14 bp, Homo sapiens
ctgtccgagctttg

SEQ ID NO: 3808182 - DNA, 22 bp, Homo sapiens
ctgtctcaaaaaaagaaaaaga

SEQ ID NO: 3808183 - DNA, 15 bp, Homo sapiens
ctgtctgctcagaca

SEQ ID NO: 3808184 - DNA, 14 bp, Homo sapiens
ctgtctgtctgtcc

SEQ ID NO: 3808185 - DNA, 15 bp, Homo sapiens
ctgtctgtctgtccc

SEQ ID NO: 3808186 - DNA, 15 bp, Homo sapiens
ctgtgaagagaacca

SEQ ID NO: 3808187 - DNA, 20 bp, Homo sapiens
ctgtgaatacaattaaaggt

SEQ ID NO: 3808188 - DNA, 15 bp, Homo sapiens
ctgtgcattagatat

SEQ ID NO: 3808189 - DNA, 13 bp, Homo sapiens
ctgtgcctcctca

SEQ ID NO: 3808190 - DNA, 20 bp, Homo sapiens
ctgtgccttgtcacgccaga

SEQ ID NO: 3808191 - DNA, 17 bp, Homo sapiens
ctgtggatgataaaaca

SEQ ID NO: 3808192 - DNA, 17 bp, Homo sapiens
ctgtgtcagcatagaag

SEQ ID NO: 3808193 - DNA, 15 bp, Homo sapiens
ctgtgtgtgtgtatg

SEQ ID NO: 3808194 - DNA, 20 bp, Homo sapiens
ctgtgtgtgtgtatgtgggg

SEQ ID NO: 3808195 - DNA, 17 bp, Homo sapiens
ctgtgtgtttatgtgtg

SEQ ID NO: 3808196 - DNA, 17 bp, Homo sapiens
ctgttcacttttcctcc

SEQ ID NO: 3808197 - DNA, 9 bp, Homo sapiens
ctgttgttt

SEQ ID NO: 3808198 - DNA, 18 bp, Homo sapiens
ctgttttgtaaatgtaag

SEQ ID NO: 3808199 - DNA, 17 bp, Homo sapiens
cttaaaaatcattctaa

SEQ ID NO: 3808200 - DNA, 20 bp, Homo sapiens
cttaatcaggtcctcagaga

SEQ ID NO: 3808201 - DNA, 21 bp, Homo sapiens
cttacaggccctccctgttaa

SEQ ID NO: 3808202 - DNA, 20 bp, Homo sapiens
cttaccgtgggcactgaagg

SEQ ID NO: 3808203 - DNA, 21 bp, Homo sapiens
cttacctcggtgccttcctct

SEQ ID NO: 3808204 - DNA, 14 bp, Homo sapiens
cttagaggaaaagg

SEQ ID NO: 3808205 - DNA, 15 bp, Homo sapiens
cttagaggaaaaggg

SEQ ID NO: 3808206 - DNA, 15 bp, Homo sapiens
cttagccttgctgta

SEQ ID NO: 3808207 - DNA, 22 bp, Homo sapiens
cttagccttgctgtagagactt

SEQ ID NO: 3808208 - DNA, 17 bp, Homo sapiens
cttaggttggcaaaaag

SEQ ID NO: 3808209 - DNA, 12 bp, Homo sapiens
cttattttcaag

SEQ ID NO: 3808210 - DNA, 13 bp, Homo sapiens
cttcacgcctggg

SEQ ID NO: 3808211 - DNA, 23 bp, Homo sapiens
cttcagagtcctcattataaaat

SEQ ID NO: 3808212 - DNA, 17 bp, Homo sapiens
cttcagtgtatggaaat

SEQ ID NO: 3808213 - DNA, 20 bp, Homo sapiens
cttcatagatgagaaaactg

SEQ ID NO: 3808214 - DNA, 19 bp, Homo sapiens
cttcatgaaaatcctacca

SEQ ID NO: 3808215 - DNA, 20 bp, Homo sapiens
cttccaaccccagctggcct

SEQ ID NO: 3808216 - DNA, 21 bp, Homo sapiens
cttccaaccccagctggcctc

SEQ ID NO: 3808217 - DNA, 19 bp, Homo sapiens
cttccaggtgcctggccct

SEQ ID NO: 3808218 - DNA, 23 bp, Homo sapiens
cttccccaacgaaaagcacatcc

SEQ ID NO: 3808219 - DNA, 13 bp, Homo sapiens
cttccctgggcct

SEQ ID NO: 3808220 - DNA, 14 bp, Homo sapiens
cttcctaacttatt

SEQ ID NO: 3808221 - DNA, 15 bp, Homo sapiens
cttcctctcctgtct

SEQ ID NO: 3808222 - DNA, 23 bp, Homo sapiens
cttcctggggcatctggcgaatc

SEQ ID NO: 3808223 - DNA, 16 bp, Homo sapiens
cttctattttgtaaac

SEQ ID NO: 3808224 - DNA, 13 bp, Homo sapiens
cttctccagggac

SEQ ID NO: 3808225 - DNA, 10 bp, Homo sapiens
cttctgcagt

SEQ ID NO: 3808226 - DNA, 13 bp, Homo sapiens
cttctgcctcagc

SEQ ID NO: 3808227 - DNA, 22 bp, Homo sapiens
cttctgtatgtgacaacatttt

SEQ ID NO: 3808228 - DNA, 23 bp, Homo sapiens
cttcttattcatgctttctcctt

SEQ ID NO: 3808229 - DNA, 13 bp, Homo sapiens
cttcttttgctct

SEQ ID NO: 3808230 - DNA, 22 bp, Homo sapiens
cttgaaaacctcatttaccata

SEQ ID NO: 3808231 - DNA, 15 bp, Homo sapiens
cttgaacccaggagg

SEQ ID NO: 3808232 - DNA, 19 bp, Homo sapiens
cttgagaaaatgcaggaga

SEQ ID NO: 3808233 - DNA, 20 bp, Homo sapiens
cttgagaaaatgcaggagag

SEQ ID NO: 3808234 - DNA, 21 bp, Homo sapiens
cttgagaaaatgcaggagagc

SEQ ID NO: 3808235 - DNA, 14 bp, Homo sapiens
cttgagagggtgga

SEQ ID NO: 3808236 - DNA, 12 bp, Homo sapiens
cttgaggacaca

SEQ ID NO: 3808237 - DNA, 18 bp, Homo sapiens
cttgaggacacatgtcca

SEQ ID NO: 3808238 - DNA, 20 bp, Homo sapiens
cttgagttgattcagctctg

SEQ ID NO: 3808239 - DNA, 13 bp, Homo sapiens
cttgatctcctga

SEQ ID NO: 3808240 - DNA, 15 bp, Homo sapiens
cttgatctcctgagc

SEQ ID NO: 3808241 - DNA, 20 bp, Homo sapiens
cttggaaaaatccagaaaga

SEQ ID NO: 3808242 - DNA, 23 bp, Homo sapiens
cttggagggcatgaagacagata

SEQ ID NO: 3808243 - DNA, 14 bp, Homo sapiens
cttggccagagctg

SEQ ID NO: 3808244 - DNA, 15 bp, Homo sapiens
cttggccagagctga

SEQ ID NO: 3808245 - DNA, 24 bp, Homo sapiens
cttgggggatgactagaggcaggg

SEQ ID NO: 3808246 - DNA, 22 bp, Homo sapiens
cttggtgaatttttttttccta

SEQ ID NO: 3808247 - DNA, 12 bp, Homo sapiens
cttgtacaaaat

SEQ ID NO: 3808248 - DNA, 13 bp, Homo sapiens
cttgtacaaaata

SEQ ID NO: 3808249 - DNA, 13 bp, Homo sapiens
cttgtcacgccag

SEQ ID NO: 3808250 - DNA, 23 bp, Homo sapiens
cttgtcactggtagaccaaaata

SEQ ID NO: 3808251 - DNA, 18 bp, Homo sapiens
cttgtggaattgggagct

SEQ ID NO: 3808252 - DNA, 22 bp, Homo sapiens
ctttaaaatatttgtctttaaa

SEQ ID NO: 3808253 - DNA, 16 bp, Homo sapiens
ctttagcttttaccaa

SEQ ID NO: 3808254 - DNA, 14 bp, Homo sapiens
ctttattaaaacag

SEQ ID NO: 3808255 - DNA, 13 bp, Homo sapiens
ctttcagggcctc

SEQ ID NO: 3808256 - DNA, 15 bp, Homo sapiens
ctttcagggcctcca

SEQ ID NO: 3808257 - DNA, 16 bp, Homo sapiens
ctttcatacattatat

SEQ ID NO: 3808258 - DNA, 18 bp, Homo sapiens
ctttccaaatgcccagct

SEQ ID NO: 3808259 - DNA, 13 bp, Homo sapiens
ctttcccaacacc

SEQ ID NO: 3808260 - DNA, 13 bp, Homo sapiens
ctttcttccaaac

SEQ ID NO: 3808261 - DNA, 13 bp, Homo sapiens
ctttgaagaggaa

SEQ ID NO: 3808262 - DNA, 14 bp, Homo sapiens
ctttgaagaggaaa

SEQ ID NO: 3808263 - DNA, 18 bp, Homo sapiens
ctttgcacagctctccgg

SEQ ID NO: 3808264 - DNA, 17 bp, Homo sapiens
ctttgctacaataaatg

SEQ ID NO: 3808265 - DNA, 19 bp, Homo sapiens
ctttgctacaataaatgct

SEQ ID NO: 3808266 - DNA, 22 bp, Homo sapiens
ctttgctacaataaatgctgaa

SEQ ID NO: 3808267 - DNA, 17 bp, Homo sapiens
ctttggccattccaaca

SEQ ID NO: 3808268 - DNA, 17 bp, Homo sapiens
ctttgtgtagctttgct

SEQ ID NO: 3808269 - DNA, 18 bp, Homo sapiens
ctttgtgtagctttgctc

SEQ ID NO: 3808270 - DNA, 23 bp, Homo sapiens
ctttgtgtccattgatgtcattc

SEQ ID NO: 3808271 - DNA, 20 bp, Homo sapiens
ctttgtttgttgtcagctga

SEQ ID NO: 3808272 - DNA, 22 bp, Homo sapiens
cttttgaagaagttcttaaata

SEQ ID NO: 3808273 - DNA, 22 bp, Homo sapiens
cttttgctcttagctgtctgct

SEQ ID NO: 3808274 - DNA, 19 bp, Homo sapiens
gaaaaaatattttcctgcc

SEQ ID NO: 3808275 - DNA, 11 bp, Homo sapiens
gaaaaagaaaa

SEQ ID NO: 3808276 - DNA, 16 bp, Homo sapiens
gaaaaagaaaaaatat

SEQ ID NO: 3808277 - DNA, 12 bp, Homo sapiens
gaaaaaggagga

SEQ ID NO: 3808278 - DNA, 19 bp, Homo sapiens
gaaaacctcatttaccata

SEQ ID NO: 3808279 - DNA, 22 bp, Homo sapiens
gaaaactgttctctttaaaata

SEQ ID NO: 3808280 - DNA, 23 bp, Homo sapiens
gaaaagaaaaatgagcctggcaa

SEQ ID NO: 3808281 - DNA, 14 bp, Homo sapiens
gaaaagagatggcc

SEQ ID NO: 3808282 - DNA, 18 bp, Homo sapiens
gaaaagagggagagatga

SEQ ID NO: 3808283 - DNA, 14 bp, Homo sapiens
gaaaatcagcctgc

SEQ ID NO: 3808284 - DNA, 16 bp, Homo sapiens
gaaaatcagcctgctc

SEQ ID NO: 3808285 - DNA, 13 bp, Homo sapiens
gaaaatgaataat

SEQ ID NO: 3808286 - DNA, 14 bp, Homo sapiens
gaaaatgcaggaga

SEQ ID NO: 3808287 - DNA, 15 bp, Homo sapiens
gaaaatgcattatgt

SEQ ID NO: 3808288 - DNA, 14 bp, Homo sapiens
gaaacaaaaacact

SEQ ID NO: 3808289 - DNA, 19 bp, Homo sapiens
gaaacaaaaacactaaaaa

SEQ ID NO: 3808290 - DNA, 14 bp, Homo sapiens
gaaacagaaacaaa

SEQ ID NO: 3808291 - DNA, 16 bp, Homo sapiens
gaaacagagacaggcc

SEQ ID NO: 3808292 - DNA, 17 bp, Homo sapiens
gaaacagagacaggccc

SEQ ID NO: 3808293 - DNA, 19 bp, Homo sapiens
gaaacagagacaggcccaa

SEQ ID NO: 3808294 - DNA, 13 bp, Homo sapiens
gaaacagagagag

SEQ ID NO: 3808295 - DNA, 13 bp, Homo sapiens
gaaacataaataa

SEQ ID NO: 3808296 - DNA, 18 bp, Homo sapiens
gaaacataaataaaatga

SEQ ID NO: 3808297 - DNA, 19 bp, Homo sapiens
gaaacctgtccataaagta

SEQ ID NO: 3808298 - DNA, 22 bp, Homo sapiens
gaaactgaggaattttctttgt

SEQ ID NO: 3808299 - DNA, 16 bp, Homo sapiens
gaaacttagaggaaaa

SEQ ID NO: 3808300 - DNA, 14 bp, Homo sapiens
gaaaggagaggaaa

SEQ ID NO: 3808301 - DNA, 17 bp, Homo sapiens
gaaaggctctgaaagcc

SEQ ID NO: 3808302 - DNA, 19 bp, Homo sapiens
gaaaggctctgaaagccag

SEQ ID NO: 3808303 - DNA, 15 bp, Homo sapiens
gaaatcagagctggc

SEQ ID NO: 3808304 - DNA, 16 bp, Homo sapiens
gaaatcagagctggca

SEQ ID NO: 3808305 - DNA, 17 bp, Homo sapiens
gaaattacacccaaaga

SEQ ID NO: 3808306 - DNA, 23 bp, Homo sapiens
gaaatttcagattcccagagcaa

SEQ ID NO: 3808307 - DNA, 22 bp, Homo sapiens
gaacacagcctgggaccagggc

SEQ ID NO: 3808308 - DNA, 13 bp, Homo sapiens
gaacacccactgg

SEQ ID NO: 3808309 - DNA, 17 bp, Homo sapiens
gaacacccactggccag

SEQ ID NO: 3808310 - DNA, 17 bp, Homo sapiens
gaacagataatccctgt

SEQ ID NO: 3808311 - DNA, 13 bp, Homo sapiens
gaacccaggaggt

SEQ ID NO: 3808312 - DNA, 18 bp, Homo sapiens
gaaccccagacctctgaa

SEQ ID NO: 3808313 - DNA, 22 bp, Homo sapiens
gaacctaataagtgctactttg

SEQ ID NO: 3808314 - DNA, 23 bp, Homo sapiens
gaacctgggaaccatgaagctgg

SEQ ID NO: 3808315 - DNA, 13 bp, Homo sapiens
gaactgagactgc

SEQ ID NO: 3808316 - DNA, 20 bp, Homo sapiens
gaactgctgggcttggcagc

SEQ ID NO: 3808317 - DNA, 21 bp, Homo sapiens
gaactgctttatcccacggaa

SEQ ID NO: 3808318 - DNA, 16 bp, Homo sapiens
gaacttgaggacacat

SEQ ID NO: 3808319 - DNA, 16 bp, Homo sapiens
gaactttttttccccc

SEQ ID NO: 3808320 - DNA, 17 bp, Homo sapiens
gaagaacatccaaggag

SEQ ID NO: 3808321 - DNA, 20 bp, Homo sapiens
gaagaacatccaaggagaaa

SEQ ID NO: 3808322 - DNA, 14 bp, Homo sapiens
gaagaagctctctc

SEQ ID NO: 3808323 - DNA, 14 bp, Homo sapiens
gaagaagttcttaa

SEQ ID NO: 3808324 - DNA, 12 bp, Homo sapiens
gaagacacagac

SEQ ID NO: 3808325 - DNA, 21 bp, Homo sapiens
gaagacacagactgcgatttg

SEQ ID NO: 3808326 - DNA, 17 bp, Homo sapiens
gaagagaagggcagggc

SEQ ID NO: 3808327 - DNA, 15 bp, Homo sapiens
gaagaggaaaatgaa

SEQ ID NO: 3808328 - DNA, 20 bp, Homo sapiens
gaagataatattaaggaaga

SEQ ID NO: 3808329 - DNA, 17 bp, Homo sapiens
gaagatctgcttccctg

SEQ ID NO: 3808330 - DNA, 19 bp, Homo sapiens
gaagatctgcttccctggg

SEQ ID NO: 3808331 - DNA, 20 bp, Homo sapiens
gaagatctgcttccctgggg

SEQ ID NO: 3808332 - DNA, 22 bp, Homo sapiens
gaagatctgcttccctggggcc

SEQ ID NO: 3808333 - DNA, 21 bp, Homo sapiens
gaagatgcagcaaaatgtgaa

SEQ ID NO: 3808334 - DNA, 18 bp, Homo sapiens
gaagcaagccggcagaaa

SEQ ID NO: 3808335 - DNA, 14 bp, Homo sapiens
gaagcccaataaac

SEQ ID NO: 3808336 - DNA, 12 bp, Homo sapiens
ccccagcccacc

SEQ ID NO: 3808337 - DNA, 15 bp, Homo sapiens
ccccagcctccaggc

SEQ ID NO: 3808338 - DNA, 15 bp, Homo sapiens
ccccagctggcctct

SEQ ID NO: 3808339 - DNA, 19 bp, Homo sapiens
ccccaggattcccagagag

SEQ ID NO: 3808340 - DNA, 21 bp, Homo sapiens
ccccatctcctcccatggcct

SEQ ID NO: 3808341 - DNA, 21 bp, Homo sapiens
ccccattcttcctagttttct

SEQ ID NO: 3808342 - DNA, 22 bp, Homo sapiens
cccccactcacagggagctggc

SEQ ID NO: 3808343 - DNA, 23 bp, Homo sapiens
cccccagctttgctaccaaagca

SEQ ID NO: 3808344 - DNA, 21 bp, Homo sapiens
ccccccaagatgagctgcagc

SEQ ID NO: 3808345 - DNA, 22 bp, Homo sapiens
ccccctgtgccttgtcacgcca

SEQ ID NO: 3808346 - DNA, 16 bp, Homo sapiens
cccctcaacacctctg

SEQ ID NO: 3808347 - DNA, 22 bp, Homo sapiens
cccctgcccgaccccatctcat

SEQ ID NO: 3808348 - DNA, 23 bp, Homo sapiens
cccctggtgcactggccccaccc

SEQ ID NO: 3808349 - DNA, 19 bp, Homo sapiens
cccgcaccccccaagctgt

SEQ ID NO: 3808350 - DNA, 15 bp, Homo sapiens
cccggaggtgtcacc

SEQ ID NO: 3808351 - DNA, 20 bp, Homo sapiens
ccctacagttgaaaaacagc

SEQ ID NO: 3808352 - DNA, 13 bp, Homo sapiens
ccctacccactct

SEQ ID NO: 3808353 - DNA, 16 bp, Homo sapiens
ccctacccactctttg

SEQ ID NO: 3808354 - DNA, 13 bp, Homo sapiens
ccctcagctgcct

SEQ ID NO: 3808355 - DNA, 14 bp, Homo sapiens
ccctcccagtcctc

SEQ ID NO: 3808356 - DNA, 21 bp, Homo sapiens
ccctccccacagtcctcacag

SEQ ID NO: 3808357 - DNA, 14 bp, Homo sapiens
ccctccccagccct

SEQ ID NO: 3808358 - DNA, 18 bp, Homo sapiens
ccctcgtggacacctgcc

SEQ ID NO: 3808359 - DNA, 18 bp, Homo sapiens
ccctgaccttctccaggg

SEQ ID NO: 3808360 - DNA, 16 bp, Homo sapiens
ccctgagctttctgct

SEQ ID NO: 3808361 - DNA, 20 bp, Homo sapiens
ccctgatgttcgccgtctgg

SEQ ID NO: 3808362 - DNA, 23 bp, Homo sapiens
ccctgattttatcattctgcttc

SEQ ID NO: 3808363 - DNA, 14 bp, Homo sapiens
ccctgccacctgtc

SEQ ID NO: 3808364 - DNA, 14 bp, Homo sapiens
ccctgcccaagggc

SEQ ID NO: 3808365 - DNA, 20 bp, Homo sapiens
ccctgcccaagggcctccca

SEQ ID NO: 3808366 - DNA, 19 bp, Homo sapiens
ccctgcccgaccccatctc

SEQ ID NO: 3808367 - DNA, 15 bp, Homo sapiens
ccctgccctgccacc

SEQ ID NO: 3808368 - DNA, 19 bp, Homo sapiens
ccctgcccttcagcatcct

SEQ ID NO: 3808369 - DNA, 18 bp, Homo sapiens
ccctgctcctcctgccct

SEQ ID NO: 3808370 - DNA, 17 bp, Homo sapiens
ccctgcttttctcccag

SEQ ID NO: 3808371 - DNA, 21 bp, Homo sapiens
ccctggaaggacatccatgtt

SEQ ID NO: 3808372 - DNA, 18 bp, Homo sapiens
ccctgggcctcagcctcc

SEQ ID NO: 3808373 - DNA, 22 bp, Homo sapiens
ccctgggcctcagcctccaggc

SEQ ID NO: 3808374 - DNA, 21 bp, Homo sapiens
ccctgtagagtgggagctgag

SEQ ID NO: 3808375 - DNA, 20 bp, Homo sapiens
ccctgtctcaaaaaaagaaa

SEQ ID NO: 3808376 - DNA, 24 bp, Homo sapiens
ccctgtgccttggtgtgctgtatc

SEQ ID NO: 3808377 - DNA, 19 bp, Homo sapiens
ccctgttctaactcttaga

SEQ ID NO: 3808378 - DNA, 19 bp, Homo sapiens
cccttacctcggtgccttc

SEQ ID NO: 3808379 - DNA, 20 bp, Homo sapiens
cccttagccttgctgtagag

SEQ ID NO: 3808380 - DNA, 19 bp, Homo sapiens
ccctttaaaggtcgcacct

SEQ ID NO: 3808381 - DNA, 20 bp, Homo sapiens
ccctttgcaggcccagcaga

SEQ ID NO: 3808382 - DNA, 20 bp, Homo sapiens
ccgacaccagccctgctgct

SEQ ID NO: 3808383 - DNA, 13 bp, Homo sapiens
ccgaccagagccc

SEQ ID NO: 3808384 - DNA, 22 bp, Homo sapiens
ccgacttttgtttaccagagaa

SEQ ID NO: 3808385 - DNA, 13 bp, Homo sapiens
ccgagaagaacag

SEQ ID NO: 3808386 - DNA, 20 bp, Homo sapiens
ccgagagtccatcagcctcc

SEQ ID NO: 3808387 - DNA, 21 bp, Homo sapiens
ccgagagtccatcagcctcca

SEQ ID NO: 3808388 - DNA, 21 bp, Homo sapiens
ccgagattgcaccactgcact

SEQ ID NO: 3808389 - DNA, 17 bp, Homo sapiens
ccgccaaggctggggga

SEQ ID NO: 3808390 - DNA, 17 bp, Homo sapiens
ccgccccagccccttct

SEQ ID NO: 3808391 - DNA, 14 bp, Homo sapiens
ccgcctcggcctcc

SEQ ID NO: 3808392 - DNA, 21 bp, Homo sapiens
ccggagctttcaaagaaggaa

SEQ ID NO: 3808393 - DNA, 22 bp, Homo sapiens
ccggctgggtcggccctgccca

SEQ ID NO: 3808394 - DNA, 12 bp, Homo sapiens
ccggcttgcctg

SEQ ID NO: 3808395 - DNA, 19 bp, Homo sapiens
ccggctttgtggcactggg

SEQ ID NO: 3808396 - DNA, 15 bp, Homo sapiens
ccgggagctcaggaa

SEQ ID NO: 3808397 - DNA, 14 bp, Homo sapiens
ccggtgcagaacag

SEQ ID NO: 3808398 - DNA, 15 bp, Homo sapiens
ccgtattagccagga

SEQ ID NO: 3808399 - DNA, 20 bp, Homo sapiens
ccgtcacccttggtagagtt

SEQ ID NO: 3808400 - DNA, 23 bp, Homo sapiens
ccgtcacccttggtagagtttat

SEQ ID NO: 3808401 - DNA, 18 bp, Homo sapiens
ccgtctggcgagccctta

SEQ ID NO: 3808402 - DNA, 23 bp, Homo sapiens
ccgtggctgtggcatccagagtc

SEQ ID NO: 3808403 - DNA, 15 bp, Homo sapiens
ccgtgggccatggca

SEQ ID NO: 3808404 - DNA, 16 bp, Homo sapiens
cctaacttattgcctg

SEQ ID NO: 3808405 - DNA, 18 bp, Homo sapiens
cctaatgagaagtcaaca

SEQ ID NO: 3808406 - DNA, 17 bp, Homo sapiens
cctaatgtggcagctgt

SEQ ID NO: 3808407 - DNA, 22 bp, Homo sapiens
cctacagacagtatgtctactc

SEQ ID NO: 3808408 - DNA, 13 bp, Homo sapiens
cctaccaacctct

SEQ ID NO: 3808409 - DNA, 16 bp, Homo sapiens
cctacctgcctgttct

SEQ ID NO: 3808410 - DNA, 15 bp, Homo sapiens
cctacctgtgcctga

SEQ ID NO: 3808411 - DNA, 16 bp, Homo sapiens
cctacttcttttgctc

SEQ ID NO: 3808412 - DNA, 23 bp, Homo sapiens
cctactttttctttgattttcga

SEQ ID NO: 3808413 - DNA, 17 bp, Homo sapiens
cctagagctcctgtccc

SEQ ID NO: 3808414 - DNA, 18 bp, Homo sapiens
cctagagctcctgtccct

SEQ ID NO: 3808415 - DNA, 20 bp, Homo sapiens
cctagagctcctgtccctac

SEQ ID NO: 3808416 - DNA, 21 bp, Homo sapiens
cctagagctcctgtccctacc

SEQ ID NO: 3808417 - DNA, 19 bp, Homo sapiens
cctagatccacacacagag

SEQ ID NO: 3808418 - DNA, 16 bp, Homo sapiens
cctaggctagggtggg

SEQ ID NO: 3808419 - DNA, 15 bp, Homo sapiens
cctaggctccacccc

SEQ ID NO: 3808420 - DNA, 15 bp, Homo sapiens
cctagttttctcctc

SEQ ID NO: 3808421 - DNA, 18 bp, Homo sapiens
cctagttttctcctccca

SEQ ID NO: 3808422 - DNA, 15 bp, Homo sapiens
cctataatacaaata

SEQ ID NO: 3808423 - DNA, 17 bp, Homo sapiens
cctattagagaagagat

SEQ ID NO: 3808424 - DNA, 13 bp, Homo sapiens
cctattccttggt

SEQ ID NO: 3808425 - DNA, 15 bp, Homo sapiens
cctcacagcatctct

SEQ ID NO: 3808426 - DNA, 17 bp, Homo sapiens
cctcacagcctctccct

SEQ ID NO: 3808427 - DNA, 18 bp, Homo sapiens
cctcacagcctctccctt

SEQ ID NO: 3808428 - DNA, 17 bp, Homo sapiens
cctcacccccagctttg

SEQ ID NO: 3808429 - DNA, 16 bp, Homo sapiens
cctcagcctccaggca

SEQ ID NO: 3808430 - DNA, 12 bp, Homo sapiens
cctcagcctcct

SEQ ID NO: 3808431 - DNA, 14 bp, Homo sapiens
cctcagcctcctga

SEQ ID NO: 3808432 - DNA, 12 bp, Homo sapiens
cctcaggcaggt

SEQ ID NO: 3808433 - DNA, 16 bp, Homo sapiens
cctcaggtgagaagca

SEQ ID NO: 3808434 - DNA, 20 bp, Homo sapiens
cctcaggtgagaagcagagg

SEQ ID NO: 3808435 - DNA, 18 bp, Homo sapiens
cctcatcgtggctgggaa

SEQ ID NO: 3808436 - DNA, 13 bp, Homo sapiens
cctcattataaaa

SEQ ID NO: 3808437 - DNA, 15 bp, Homo sapiens
cctcatttgttcatt

SEQ ID NO: 3808438 - DNA, 16 bp, Homo sapiens
cctccaaacactgggc

SEQ ID NO: 3808439 - DNA, 14 bp, Homo sapiens
cctccagaccacca

SEQ ID NO: 3808440 - DNA, 16 bp, Homo sapiens
cctccagaccaccagc

SEQ ID NO: 3808441 - DNA, 17 bp, Homo sapiens
cctccagtgggaggaca

SEQ ID NO: 3808442 - DNA, 17 bp, Homo sapiens
cctccatcctaccccct

SEQ ID NO: 3808443 - DNA, 22 bp, Homo sapiens
cctccatcctaccccctgtgcc

SEQ ID NO: 3808444 - DNA, 15 bp, Homo sapiens
cctcccaacagagct

SEQ ID NO: 3808445 - DNA, 18 bp, Homo sapiens
cctcccatggccttccct

SEQ ID NO: 3808446 - DNA, 14 bp, Homo sapiens
cctcccccagagcc

SEQ ID NO: 3808447 - DNA, 15 bp, Homo sapiens
cctcccccagagcca

SEQ ID NO: 3808448 - DNA, 14 bp, Homo sapiens
cctccccctgtccc

SEQ ID NO: 3808449 - DNA, 16 bp, Homo sapiens
cctcccctcccagtcc

SEQ ID NO: 3808450 - DNA, 22 bp, Homo sapiens
cctccctgttaataaacagctc

SEQ ID NO: 3808451 - DNA, 21 bp, Homo sapiens
cctcctccagccgccatgctc

SEQ ID NO: 3808452 - DNA, 16 bp, Homo sapiens
cctcctgagtagctgg

SEQ ID NO: 3808453 - DNA, 11 bp, Homo sapiens
cctcctgctgc

SEQ ID NO: 3808454 - DNA, 12 bp, Homo sapiens
cctcggcctccc

SEQ ID NO: 3808455 - DNA, 16 bp, Homo sapiens
cctcggtgccttcctc

SEQ ID NO: 3808456 - DNA, 19 bp, Homo sapiens
cctcgtgatttgcctgcct

SEQ ID NO: 3808457 - DNA, 20 bp, Homo sapiens
cctcgtgatttgcctgcctg

SEQ ID NO: 3808458 - DNA, 16 bp, Homo sapiens
cctcgtggacacctgc

SEQ ID NO: 3808459 - DNA, 18 bp, Homo sapiens
cctcgtggacacctgccc

SEQ ID NO: 3808460 - DNA, 20 bp, Homo sapiens
cctcgtggacacctgccctg

SEQ ID NO: 3808461 - DNA, 21 bp, Homo sapiens
cctcgtggacacctgccctgc

SEQ ID NO: 3808462 - DNA, 18 bp, Homo sapiens
cctcgttactctcacctc

SEQ ID NO: 3808463 - DNA, 24 bp, Homo sapiens
cctctagaacacccactggccagt

SEQ ID NO: 3808464 - DNA, 20 bp, Homo sapiens
cctctcaatattcaataaag

SEQ ID NO: 3808465 - DNA, 20 bp, Homo sapiens
cctctgaatgtcccagaggc

SEQ ID NO: 3808466 - DNA, 11 bp, Homo sapiens
cctctgcacaa

SEQ ID NO: 3808467 - DNA, 19 bp, Homo sapiens
cctctgcacaagctgcacc

SEQ ID NO: 3808468 - DNA, 14 bp, Homo sapiens
cctctgcattttgt

SEQ ID NO: 3808469 - DNA, 12 bp, Homo sapiens
cctctgcccagc

SEQ ID NO: 3808470 - DNA, 21 bp, Homo sapiens
cctctgcccagcctgccccag

SEQ ID NO: 3808471 - DNA, 21 bp, Homo sapiens
cctgaaaagatgttgtgtctt

SEQ ID NO: 3808472 - DNA, 14 bp, Homo sapiens
cctgaaagccctga

SEQ ID NO: 3808473 - DNA, 21 bp, Homo sapiens
cctgaacaagaattggaagct

SEQ ID NO: 3808474 - DNA, 15 bp, Homo sapiens
cctgaattattccaa

SEQ ID NO: 3808475 - DNA, 21 bp, Homo sapiens
cctgaattttgttgctgtttt

SEQ ID NO: 3808476 - DNA, 19 bp, Homo sapiens
cctgacactgagccccacc

SEQ ID NO: 3808477 - DNA, 21 bp, Homo sapiens
cctgacactgagccccacctc

SEQ ID NO: 3808478 - DNA, 18 bp, Homo sapiens
cctgaccctcatctttct

SEQ ID NO: 3808479 - DNA, 22 bp, Homo sapiens
cctgaccctcatctttcttcca

SEQ ID NO: 3808480 - DNA, 21 bp, Homo sapiens
cctgaccttctccagggacag

SEQ ID NO: 3808481 - DNA, 22 bp, Homo sapiens
cctgagctcgtgatctgcccgc

SEQ ID NO: 3808482 - DNA, 21 bp, Homo sapiens
cctgcagcagagcctggaaga

SEQ ID NO: 3808483 - DNA, 15 bp, Homo sapiens
cctgcatgcaactaa

SEQ ID NO: 3808484 - DNA, 18 bp, Homo sapiens
cctgcatgcaactaattc

SEQ ID NO: 3808485 - DNA, 14 bp, Homo sapiens
cctgccacctgtct

SEQ ID NO: 3808486 - DNA, 12 bp, Homo sapiens
cctgccaggcat

SEQ ID NO: 3808487 - DNA, 20 bp, Homo sapiens
cctgccatcatgtttacaga

SEQ ID NO: 3808488 - DNA, 23 bp, Homo sapiens
cctgcccaagggcctcccaccag

SEQ ID NO: 3808489 - DNA, 17 bp, Homo sapiens
cctgcccctccccagcc

SEQ ID NO: 3808490 - DNA, 12 bp, Homo sapiens
cctgccctgcca

SEQ ID NO: 3808491 - DNA, 18 bp, Homo sapiens
cctgccctgccacctgtc

SEQ ID NO: 3808492 - DNA, 17 bp, Homo sapiens
cctgccctgtccctgtc

SEQ ID NO: 3808493 - DNA, 17 bp, Homo sapiens
cctgcccttcagcatcc

SEQ ID NO: 3808494 - DNA, 14 bp, Homo sapiens
cctgcccttgtttt

SEQ ID NO: 3808495 - DNA, 23 bp, Homo sapiens
cctgccgagagtccatcagcctc

SEQ ID NO: 3808496 - DNA, 17 bp, Homo sapiens
cctgcctcagcctcctg

SEQ ID NO: 3808497 - DNA, 19 bp, Homo sapiens
cctgcctcagcctcctgag

SEQ ID NO: 3808498 - DNA, 20 bp, Homo sapiens
cctgcctcagcctcctgagt

SEQ ID NO: 3808499 - DNA, 12 bp, Homo sapiens
cctgcctggacc

SEQ ID NO: 3808500 - DNA, 16 bp, Homo sapiens
cctgcctgggcctccc

SEQ ID NO: 3808501 - DNA, 18 bp, Homo sapiens
cctgcctgggcctcccaa

SEQ ID NO: 3808502 - DNA, 17 bp, Homo sapiens
cctgcctgttctccaga

SEQ ID NO: 3808503 - DNA, 22 bp, Homo sapiens
cctgcctgttctccagatggag

SEQ ID NO: 3808504 - DNA, 14 bp, Homo sapiens
cctgctccagctgt

SEQ ID NO: 3808505 - DNA, 21 bp, Homo sapiens
cctgctcctcctgccctgtcc

SEQ ID NO: 3808506 - DNA, 22 bp, Homo sapiens
cctgctgcctaataaagagact

SEQ ID NO: 3808507 - DNA, 16 bp, Homo sapiens
cctgctgcttcctaac

SEQ ID NO: 3808508 - DNA, 17 bp, Homo sapiens
cctgctgcttcctaact

SEQ ID NO: 3808509 - DNA, 19 bp, Homo sapiens
cctgctgcttcctaactta

SEQ ID NO: 3808510 - DNA, 21 bp, Homo sapiens
cctgctgcttcctaacttatt

SEQ ID NO: 3808511 - DNA, 17 bp, Homo sapiens
cctgcttttctcccaga

SEQ ID NO: 3808512 - DNA, 18 bp, Homo sapiens
cctgcttttctcccagaa

SEQ ID NO: 3808513 - DNA, 23 bp, Homo sapiens
cctgcttttctcccagaaggctg

SEQ ID NO: 3808514 - DNA, 20 bp, Homo sapiens
cctggaaggacatccatgtt

SEQ ID NO: 3808515 - DNA, 15 bp, Homo sapiens
cctggaccagcctct

SEQ ID NO: 3808516 - DNA, 16 bp, Homo sapiens
cctggaccagcctctc

SEQ ID NO: 3808517 - DNA, 13 bp, Homo sapiens
cctggaccctgtg

SEQ ID NO: 3808518 - DNA, 14 bp, Homo sapiens
cctggccctcttct

SEQ ID NO: 3808519 - DNA, 15 bp, Homo sapiens
cctgggaaccatgaa

SEQ ID NO: 3808520 - DNA, 14 bp, Homo sapiens
cctgggaccagggc

SEQ ID NO: 3808521 - DNA, 15 bp, Homo sapiens
cctgggaccagggca

SEQ ID NO: 3808522 - DNA, 19 bp, Homo sapiens
cctgggcagtgcccaccat

SEQ ID NO: 3808523 - DNA, 20 bp, Homo sapiens
cctgggcctcagcctccagg

SEQ ID NO: 3808524 - DNA, 14 bp, Homo sapiens
cctgggcctcccaa

SEQ ID NO: 3808525 - DNA, 16 bp, Homo sapiens
cctgggcgacagagca

SEQ ID NO: 3808526 - DNA, 17 bp, Homo sapiens
cctgggcgacagagcaa

SEQ ID NO: 3808527 - DNA, 23 bp, Homo sapiens
cctgtagagtgggagctgagtgg

SEQ ID NO: 3808528 - DNA, 19 bp, Homo sapiens
cctgtccctacccactctt

SEQ ID NO: 3808529 - DNA, 16 bp, Homo sapiens
cctgtccctgtccccc

SEQ ID NO: 3808530 - DNA, 18 bp, Homo sapiens
cctgtgactatggctctg

SEQ ID NO: 3808531 - DNA, 16 bp, Homo sapiens
ccttaaggctcttttg

SEQ ID NO: 3808532 - DNA, 18 bp, Homo sapiens
ccttaataaacgtccaca

SEQ ID NO: 3808533 - DNA, 15 bp, Homo sapiens
ccttagccttgctgt

SEQ ID NO: 3808534 - DNA, 16 bp, Homo sapiens
ccttagccttgctgta

SEQ ID NO: 3808535 - DNA, 17 bp, Homo sapiens
ccttagccttgctgtag

SEQ ID NO: 3808536 - DNA, 14 bp, Homo sapiens
ccttcagatcctac

SEQ ID NO: 3808537 - DNA, 19 bp, Homo sapiens
ccttccaaatcaggctggg

SEQ ID NO: 3808538 - DNA, 20 bp, Homo sapiens
ccttctccaacaagttgcct

SEQ ID NO: 3808539 - DNA, 15 bp, Homo sapiens
ccttctccagggaca

SEQ ID NO: 3808540 - DNA, 14 bp, Homo sapiens
ccttctcccagcac

SEQ ID NO: 3808541 - DNA, 20 bp, Homo sapiens
ccttctgggcagaccttgac

SEQ ID NO: 3808542 - DNA, 20 bp, Homo sapiens
ccttgagttgattcagctct

SEQ ID NO: 3808543 - DNA, 22 bp, Homo sapiens
ccttgagttgattcagctctgc

SEQ ID NO: 3808544 - DNA, 11 bp, Homo sapiens
ccttgctattt

SEQ ID NO: 3808545 - DNA, 18 bp, Homo sapiens
ccttgctgtagagacttc

SEQ ID NO: 3808546 - DNA, 23 bp, Homo sapiens
cctttgaagaggaaaatgaataa

SEQ ID NO: 3808547 - DNA, 19 bp, Homo sapiens
cctttgccccggcttgcct

SEQ ID NO: 3808548 - DNA, 11 bp, Homo sapiens
cctttggcttc

SEQ ID NO: 3808549 - DNA, 19 bp, Homo sapiens
cgaaacctgtccataaagt

SEQ ID NO: 3808550 - DNA, 15 bp, Homo sapiens
cgaagcgttgtcctc

SEQ ID NO: 3808551 - DNA, 13 bp, Homo sapiens
cgaccccatctca

SEQ ID NO: 3808552 - DNA, 13 bp, Homo sapiens
cgactctgctgct

SEQ ID NO: 3808553 - DNA, 15 bp, Homo sapiens
cgagatcccaacact

SEQ ID NO: 3808554 - DNA, 21 bp, Homo sapiens
cgagatcccaacactgccagc

SEQ ID NO: 3808555 - DNA, 22 bp, Homo sapiens
cgagatcccaacactgccagca

SEQ ID NO: 3808556 - DNA, 20 bp, Homo sapiens
cgagattgcaccactgcact

SEQ ID NO: 3808557 - DNA, 13 bp, Homo sapiens
cgagcccttagcc

SEQ ID NO: 3808558 - DNA, 15 bp, Homo sapiens
cgagcccttagcctt

SEQ ID NO: 3808559 - DNA, 19 bp, Homo sapiens
cgagcccttagccttgctg

SEQ ID NO: 3808560 - DNA, 22 bp, Homo sapiens
cgagtgaatttctaaatgttgg

SEQ ID NO: 3808561 - DNA, 12 bp, Homo sapiens
cgatctcagctc

SEQ ID NO: 3808562 - DNA, 23 bp, Homo sapiens
cgatgaatgtgttgatttgagaa

SEQ ID NO: 3808563 - DNA, 16 bp, Homo sapiens
cgatgtacacacacag

SEQ ID NO: 3808564 - DNA, 17 bp, Homo sapiens
cgcaccccccaagctgt

SEQ ID NO: 3808565 - DNA, 11 bp, Homo sapiens
cgcacctcctt

SEQ ID NO: 3808566 - DNA, 23 bp, Homo sapiens
cgcacttcgggaggtcgaggcag

SEQ ID NO: 3808567 - DNA, 13 bp, Homo sapiens
cgccaaggctggg

SEQ ID NO: 3808568 - DNA, 20 bp, Homo sapiens
cgccacggcactccagcctg

SEQ ID NO: 3808569 - DNA, 22 bp, Homo sapiens
cgccaggggaaaatcagcctgc

SEQ ID NO: 3808570 - DNA, 15 bp, Homo sapiens
cgccatgctcctggc

SEQ ID NO: 3808571 - DNA, 14 bp, Homo sapiens
cgcctcggcctccc

SEQ ID NO: 3808572 - DNA, 19 bp, Homo sapiens
cgcggtggctcacgcctgt

SEQ ID NO: 3808573 - DNA, 18 bp, Homo sapiens
cgctctggatcctgcact

SEQ ID NO: 3808574 - DNA, 21 bp, Homo sapiens
cgctgggaggaacctgaacct

SEQ ID NO: 3808575 - DNA, 15 bp, Homo sapiens
cggatgcacagagat

SEQ ID NO: 3808576 - DNA, 20 bp, Homo sapiens
cggccaggctgggctctggg

SEQ ID NO: 3808577 - DNA, 22 bp, Homo sapiens
cggcccacacccgacaccagcc

SEQ ID NO: 3808578 - DNA, 15 bp, Homo sapiens
cggctgcctgacact

SEQ ID NO: 3808579 - DNA, 14 bp, Homo sapiens
cggctggcagccca

SEQ ID NO: 3808580 - DNA, 21 bp, Homo sapiens
cggctgggtcggccctgccca

SEQ ID NO: 3808581 - DNA, 22 bp, Homo sapiens
cggctgggtcggccctgcccaa

SEQ ID NO: 3808582 - DNA, 14 bp, Homo sapiens
cggcttcaccaggg

SEQ ID NO: 3808583 - DNA, 11 bp, Homo sapiens
cgggctcagca

SEQ ID NO: 3808584 - DNA, 17 bp, Homo sapiens
cggggcctgggcaggag

SEQ ID NO: 3808585 - DNA, 14 bp, Homo sapiens
cggggtttccccat

SEQ ID NO: 3808586 - DNA, 22 bp, Homo sapiens
cgggtcatctgtacctctgcct

SEQ ID NO: 3808587 - DNA, 21 bp, Homo sapiens
cgtagatttttgctcttctgt

SEQ ID NO: 3808588 - DNA, 12 bp, Homo sapiens
cgtaggtaaact

SEQ ID NO: 3808589 - DNA, 21 bp, Homo sapiens
cgtcggggaggctcctgcctg

SEQ ID NO: 3808590 - DNA, 18 bp, Homo sapiens
cgtgatctcggctcactg

SEQ ID NO: 3808591 - DNA, 13 bp, Homo sapiens
cgtgctacctgca

SEQ ID NO: 3808592 - DNA, 12 bp, Homo sapiens
cgtggctgggaa

SEQ ID NO: 3808593 - DNA, 13 bp, Homo sapiens
cgtgggccatggc

SEQ ID NO: 3808594 - DNA, 21 bp, Homo sapiens
cgtgtctggcacagcctggct

SEQ ID NO: 3808595 - DNA, 23 bp, Homo sapiens
ctaaaatatttattttttttaag

SEQ ID NO: 3808596 - DNA, 14 bp, Homo sapiens
ctaaagctttggac

SEQ ID NO: 3808597 - DNA, 16 bp, Homo sapiens
ctaaagtcacatataa

SEQ ID NO: 3808598 - DNA, 16 bp, Homo sapiens
ctaaatgttggaatgt

SEQ ID NO: 3808599 - DNA, 14 bp, Homo sapiens
ctaagctaggaatg

SEQ ID NO: 3808600 - DNA, 11 bp, Homo sapiens
ctaataaagag

SEQ ID NO: 3808601 - DNA, 19 bp, Homo sapiens
ctaataagtgctactttgc

SEQ ID NO: 3808602 - DNA, 19 bp, Homo sapiens
ctaatgatcaaaacatgct

SEQ ID NO: 3808603 - DNA, 21 bp, Homo sapiens
ctaattctttgacctgttggg

SEQ ID NO: 3808604 - DNA, 21 bp, Homo sapiens
ctaatttatcctgaaatttca

SEQ ID NO: 3808605 - DNA, 17 bp, Homo sapiens
ctacaataaatgctgaa

SEQ ID NO: 3808606 - DNA, 22 bp, Homo sapiens
ctacaataaatgctgaatgaat

SEQ ID NO: 3808607 - DNA, 19 bp, Homo sapiens
ctacacatatatgtatatg

SEQ ID NO: 3808608 - DNA, 13 bp, Homo sapiens
ctacagttgaaaa

SEQ ID NO: 3808609 - DNA, 19 bp, Homo sapiens
ctacagttgaaaaacagct

SEQ ID NO: 3808610 - DNA, 18 bp, Homo sapiens
ctaccccccctcctgctg

SEQ ID NO: 3808611 - DNA, 16 bp, Homo sapiens
ctacctgcagtgggaa

SEQ ID NO: 3808612 - DNA, 15 bp, Homo sapiens
ctacctgcctgttct

SEQ ID NO: 3808613 - DNA, 12 bp, Homo sapiens
ctacctgtgcct

SEQ ID NO: 3808614 - DNA, 14 bp, Homo sapiens
ctacctttttttct

SEQ ID NO: 3808615 - DNA, 19 bp, Homo sapiens
ctacctttttttctctcct

SEQ ID NO: 3808616 - DNA, 15 bp, Homo sapiens
ctactactctgccaa

SEQ ID NO: 3808617 - DNA, 22 bp, Homo sapiens
ctactctgccaatcggctaccc

SEQ ID NO: 3808618 - DNA, 21 bp, Homo sapiens
ctacttgagaaaatgcaggag

SEQ ID NO: 3808619 - DNA, 13 bp, Homo sapiens
ctacttttcagaa

SEQ ID NO: 3808620 - DNA, 19 bp, Homo sapiens
ctagaacacaggcaaaatc

SEQ ID NO: 3808621 - DNA, 22 bp, Homo sapiens
ctagaacacaggcaaaatcctt

SEQ ID NO: 3808622 - DNA, 14 bp, Homo sapiens
ctagaacacccact

SEQ ID NO: 3808623 - DNA, 22 bp, Homo sapiens
ctagaacacccactggccagtc

SEQ ID NO: 3808624 - DNA, 14 bp, Homo sapiens
ctagagctcctgtc

SEQ ID NO: 3808625 - DNA, 18 bp, Homo sapiens
ctagaggcagggagggga

SEQ ID NO: 3808626 - DNA, 20 bp, Homo sapiens
ctagagtgacaggcaccaga

SEQ ID NO: 3808627 - DNA, 19 bp, Homo sapiens
ctagatccacacacagagg

SEQ ID NO: 3808628 - DNA, 15 bp, Homo sapiens
ctagattctcacctg

SEQ ID NO: 3808629 - DNA, 19 bp, Homo sapiens
ctagcatggcccgggcctt

SEQ ID NO: 3808630 - DNA, 21 bp, Homo sapiens
ctagcattaccacttccctgc

SEQ ID NO: 3808631 - DNA, 18 bp, Homo sapiens
ctagccatctcaagcaag

SEQ ID NO: 3808632 - DNA, 13 bp, Homo sapiens
ctagccctctcac

SEQ ID NO: 3808633 - DNA, 18 bp, Homo sapiens
ctagccctctcacattta

SEQ ID NO: 3808634 - DNA, 22 bp, Homo sapiens
ctagccttaatcaggtcctcag

SEQ ID NO: 3808635 - DNA, 18 bp, Homo sapiens
ctagctaaaaccaaagga

SEQ ID NO: 3808636 - DNA, 21 bp, Homo sapiens
ctagctttagctggagggaga

SEQ ID NO: 3808637 - DNA, 16 bp, Homo sapiens
ctaggaatgaaatcct

SEQ ID NO: 3808638 - DNA, 17 bp, Homo sapiens
ctaggaatgaaatcctg

SEQ ID NO: 3808639 - DNA, 15 bp, Homo sapiens
ctaggcatcccaggg

SEQ ID NO: 3808640 - DNA, 13 bp, Homo sapiens
ctaggcctgggga

SEQ ID NO: 3808641 - DNA, 15 bp, Homo sapiens
ctaggctagggtggg

SEQ ID NO: 3808642 - DNA, 15 bp, Homo sapiens
ctagggttttggcct

SEQ ID NO: 3808643 - DNA, 17 bp, Homo sapiens
ctagggttttggcctgc

SEQ ID NO: 3808644 - DNA, 21 bp, Homo sapiens
ctagtctcttctcagagcagc

SEQ ID NO: 3808645 - DNA, 14 bp, Homo sapiens
ctagttctgccagg

SEQ ID NO: 3808646 - DNA, 15 bp, Homo sapiens
ctagttctgccagga

SEQ ID NO: 3808647 - DNA, 16 bp, Homo sapiens
ctagttttctcctccc

SEQ ID NO: 3808648 - DNA, 17 bp, Homo sapiens
ctagttttctcctccca

SEQ ID NO: 3808649 - DNA, 18 bp, Homo sapiens
ctagttttctcctcccag

SEQ ID NO: 3808650 - DNA, 15 bp, Homo sapiens
ctatatctctaaact

SEQ ID NO: 3808651 - DNA, 20 bp, Homo sapiens
ctatattccgggtgccattc

SEQ ID NO: 3808652 - DNA, 16 bp, Homo sapiens
ctatatttaacaagat

SEQ ID NO: 3808653 - DNA, 20 bp, Homo sapiens
ctatattttatttctgaaga

SEQ ID NO: 3808654 - DNA, 14 bp, Homo sapiens
ctattgtagagcca

SEQ ID NO: 3808655 - DNA, 23 bp, Homo sapiens
ctattttatatgatgggggaaaa

SEQ ID NO: 3808656 - DNA, 20 bp, Homo sapiens
ctcaaacctccaaaagccct

SEQ ID NO: 3808657 - DNA, 22 bp, Homo sapiens
ctcaaatgcagtatttttgttg

SEQ ID NO: 3808658 - DNA, 23 bp, Homo sapiens
ctcaagcaagtttaatcaatgat

SEQ ID NO: 3808659 - DNA, 18 bp, Homo sapiens
ctcaatattcaataaagc

SEQ ID NO: 3808660 - DNA, 19 bp, Homo sapiens
ctcaatattcaataaagct

SEQ ID NO: 3808661 - DNA, 18 bp, Homo sapiens
ctcacagcctctccctta

SEQ ID NO: 3808662 - DNA, 12 bp, Homo sapiens
ctcacattccca

SEQ ID NO: 3808663 - DNA, 15 bp, Homo sapiens
ctcacattcccaagg

SEQ ID NO: 3808664 - DNA, 17 bp, Homo sapiens
ctcaccacaacctccac

SEQ ID NO: 3808665 - DNA, 17 bp, Homo sapiens
ctcacccccagctttgc

SEQ ID NO: 3808666 - DNA, 19 bp, Homo sapiens
ctcacccccagctttgcta

SEQ ID NO: 3808667 - DNA, 23 bp, Homo sapiens
ctcagagaatttctaccatttca

SEQ ID NO: 3808668 - DNA, 16 bp, Homo sapiens
ctcagagggtgtcctg

SEQ ID NO: 3808669 - DNA, 21 bp, Homo sapiens
ctcagcaccacattgcctcat

SEQ ID NO: 3808670 - DNA, 14 bp, Homo sapiens
ctcagcagccccct

SEQ ID NO: 3808671 - DNA, 14 bp, Homo sapiens
ctcagcctccaggc

SEQ ID NO: 3808672 - DNA, 13 bp, Homo sapiens
ctcagcctcctga

SEQ ID NO: 3808673 - DNA, 18 bp, Homo sapiens
ctcagcctcctgagtagc

SEQ ID NO: 3808674 - DNA, 22 bp, Homo sapiens
ctcagctcaccacaacctccac

SEQ ID NO: 3808675 - DNA, 14 bp, Homo sapiens
ctcagcttcccaag

SEQ ID NO: 3808676 - DNA, 22 bp, Homo sapiens
ctcagcttcccaagtagctgag

SEQ ID NO: 3808677 - DNA, 20 bp, Homo sapiens
ctcaggcctgactctcagca

SEQ ID NO: 3808678 - DNA, 14 bp, Homo sapiens
ctcaggctgctgct

SEQ ID NO: 3808679 - DNA, 15 bp, Homo sapiens
ctcagggcctggtcg

SEQ ID NO: 3808680 - DNA, 14 bp, Homo sapiens
ctcaggtgagaagc

SEQ ID NO: 3808681 - DNA, 23 bp, Homo sapiens
ctcatgatagaaggctatgggga

SEQ ID NO: 3808682 - DNA, 14 bp, Homo sapiens
ctcatgtgactctt

SEQ ID NO: 3808683 - DNA, 17 bp, Homo sapiens
ctcatttcttcctctgc

SEQ ID NO: 3808684 - DNA, 14 bp, Homo sapiens
ctccaaacactggg

SEQ ID NO: 3808685 - DNA, 15 bp, Homo sapiens
ctccaaacactgggc

SEQ ID NO: 3808686 - DNA, 20 bp, Homo sapiens
ctccaaacactgggctctga

SEQ ID NO: 3808687 - DNA, 22 bp, Homo sapiens
ctccaaacactgggctctgagg

SEQ ID NO: 3808688 - DNA, 23 bp, Homo sapiens
ctccaaacactgggctctgagga

SEQ ID NO: 3808689 - DNA, 15 bp, Homo sapiens
ctccaagtctctctg

SEQ ID NO: 3808690 - DNA, 21 bp, Homo sapiens
ctccaagtctctctgtgaata

SEQ ID NO: 3808691 - DNA, 14 bp, Homo sapiens
ctccacctcctggg

SEQ ID NO: 3808692 - DNA, 16 bp, Homo sapiens
ctccagaccaccagcc

SEQ ID NO: 3808693 - DNA, 12 bp, Homo sapiens
ctccagcctggg

SEQ ID NO: 3808694 - DNA, 19 bp, Homo sapiens
ctccagctgttacctgaga

SEQ ID NO: 3808695 - DNA, 20 bp, Homo sapiens
ctccagctgttacctgagat

SEQ ID NO: 3808696 - DNA, 18 bp, Homo sapiens
ctccaggcccccaactcc

SEQ ID NO: 3808697 - DNA, 13 bp, Homo sapiens
ctccagggacaga

SEQ ID NO: 3808698 - DNA, 18 bp, Homo sapiens
ctccagggacagaagcag

SEQ ID NO: 3808699 - DNA, 18 bp, Homo sapiens
ctccatcctaccccctgt

SEQ ID NO: 3808700 - DNA, 22 bp, Homo sapiens
ctccatcctaccccctgtgcct

SEQ ID NO: 3808701 - DNA, 23 bp, Homo sapiens
ctccatcctaccccctgtgcctt

SEQ ID NO: 3808702 - DNA, 12 bp, Homo sapiens
ctccatgctggt

SEQ ID NO: 3808703 - DNA, 15 bp, Homo sapiens
ctccatgctggtgtg

SEQ ID NO: 3808704 - DNA, 13 bp, Homo sapiens
ctccatgtgtgct

SEQ ID NO: 3808705 - DNA, 16 bp, Homo sapiens
ctcccaaagtgctggg

SEQ ID NO: 3808706 - DNA, 14 bp, Homo sapiens
ctcccaccagagac

SEQ ID NO: 3808707 - DNA, 20 bp, Homo sapiens
ctcccaccaggcagctccag

SEQ ID NO: 3808708 - DNA, 22 bp, Homo sapiens
ctcccaccaggcagctccagct

SEQ ID NO: 3808709 - DNA, 15 bp, Homo sapiens
ctcccacctccgctg

SEQ ID NO: 3808710 - DNA, 17 bp, Homo sapiens
ctcccagctttctgtgt

SEQ ID NO: 3808711 - DNA, 12 bp, Homo sapiens
ctcccagggcca

SEQ ID NO: 3808712 - DNA, 20 bp, Homo sapiens
ctcccagggccatgaacttt

SEQ ID NO: 3808713 - DNA, 14 bp, Homo sapiens
ctccccacagtcct

SEQ ID NO: 3808714 - DNA, 21 bp, Homo sapiens
ctccccacagtcctcacagcc

SEQ ID NO: 3808715 - DNA, 20 bp, Homo sapiens
ctccccacgtcagctgggac

SEQ ID NO: 3808716 - DNA, 15 bp, Homo sapiens
ctccccgctctggat

SEQ ID NO: 3808717 - DNA, 15 bp, Homo sapiens
ctcccctcccagtcc

SEQ ID NO: 3808718 - DNA, 16 bp, Homo sapiens
ctcccctcccagtcct

SEQ ID NO: 3808719 - DNA, 23 bp, Homo sapiens
ctccctcagtgccctcattttat

SEQ ID NO: 3808720 - DNA, 16 bp, Homo sapiens
ctccgcacacctgtgg

SEQ ID NO: 3808721 - DNA, 22 bp, Homo sapiens
ctccgtccaggagcctgtgcct

SEQ ID NO: 3808722 - DNA, 20 bp, Homo sapiens
ctcctcacccccagctttgc

SEQ ID NO: 3808723 - DNA, 16 bp, Homo sapiens
ctcctcctgccctgtc

SEQ ID NO: 3808724 - DNA, 24 bp, Homo sapiens
ctcctctgcccgggagctcaggaa

SEQ ID NO: 3808725 - DNA, 14 bp, Homo sapiens
ctcctgacctcgtg

SEQ ID NO: 3808726 - DNA, 19 bp, Homo sapiens
ctcctgagtagctgggact

SEQ ID NO: 3808727 - DNA, 16 bp, Homo sapiens
ctcctgccctgtccct

SEQ ID NO: 3808728 - DNA, 18 bp, Homo sapiens
ctcctgccctgtccctgt

SEQ ID NO: 3808729 - DNA, 13 bp, Homo sapiens
ctcctgcctcagc

SEQ ID NO: 3808730 - DNA, 15 bp, Homo sapiens
ctcctgcctcagcct

SEQ ID NO: 3808731 - DNA, 19 bp, Homo sapiens
ctcctggcccactgcatcg

SEQ ID NO: 3808732 - DNA, 15 bp, Homo sapiens
ctcctgtccctaccc

SEQ ID NO: 3808733 - DNA, 20 bp, Homo sapiens
ctcctgtccctacccactct

SEQ ID NO: 3808734 - DNA, 24 bp, Homo sapiens
ctcctgtccctacccactctttgc

SEQ ID NO: 3808735 - DNA, 17 bp, Homo sapiens
ctcctttggccattcca

SEQ ID NO: 3808736 - DNA, 16 bp, Homo sapiens
ctcctttttctacctt

SEQ ID NO: 3808737 - DNA, 22 bp, Homo sapiens
ctcgacttcaggagctgacaga

SEQ ID NO: 3808738 - DNA, 23 bp, Homo sapiens
ctcgagatcccaacactgccagc

SEQ ID NO: 3808739 - DNA, 12 bp, Homo sapiens
ctcgagtgaatt

SEQ ID NO: 3808740 - DNA, 13 bp, Homo sapiens
ctcgcctctgccc

SEQ ID NO: 3808741 - DNA, 16 bp, Homo sapiens
ctcgcctctgcccagc

SEQ ID NO: 3808742 - DNA, 19 bp, Homo sapiens
ctcgcctctgcccagcctg

SEQ ID NO: 3808743 - DNA, 11 bp, Homo sapiens
ctcgctctgct

SEQ ID NO: 3808744 - DNA, 15 bp, Homo sapiens
ctcggctcactgcaa

SEQ ID NO: 3808745 - DNA, 16 bp, Homo sapiens
ctcgtggacacctgcc

SEQ ID NO: 3808746 - DNA, 15 bp, Homo sapiens
ctcgtgtctggcaca

SEQ ID NO: 3808747 - DNA, 20 bp, Homo sapiens
ctctaccatcccctgtagag

SEQ ID NO: 3808748 - DNA, 19 bp, Homo sapiens
ctctagaacacccactggc

SEQ ID NO: 3808749 - DNA, 10 bp, Homo sapiens
ctctcaatat

SEQ ID NO: 3808750 - DNA, 21 bp, Homo sapiens
ctctcaatattcaataaagct

SEQ ID NO: 3808751 - DNA, 13 bp, Homo sapiens
ctctcacctcgtg

SEQ ID NO: 3808752 - DNA, 14 bp, Homo sapiens
ctctcactgtgtcc

SEQ ID NO: 3808753 - DNA, 13 bp, Homo sapiens
ctctccaagtctc

SEQ ID NO: 3808754 - DNA, 16 bp, Homo sapiens
ctctccaagtctctct

SEQ ID NO: 3808755 - DNA, 20 bp, Homo sapiens
ctctccaagtctctctgtga

SEQ ID NO: 3808756 - DNA, 17 bp, Homo sapiens
ctctcctgtctccctcc

SEQ ID NO: 3808757 - DNA, 19 bp, Homo sapiens
ctctcctttggccattcca

SEQ ID NO: 3808758 - DNA, 16 bp, Homo sapiens
ctctctgtgaatacaa

SEQ ID NO: 3808759 - DNA, 13 bp, Homo sapiens
ctctcttctctgt

SEQ ID NO: 3808760 - DNA, 16 bp, Homo sapiens
ctctgaatgtcccaga

SEQ ID NO: 3808761 - DNA, 19 bp, Homo sapiens
ctctgaggtcaataaagca

SEQ ID NO: 3808762 - DNA, 22 bp, Homo sapiens
ctctgcaagaattgaagcagga

SEQ ID NO: 3808763 - DNA, 15 bp, Homo sapiens
ctctgcacaagctgc

SEQ ID NO: 3808764 - DNA, 16 bp, Homo sapiens
ctctgcacaagctgca

SEQ ID NO: 3808765 - DNA, 17 bp, Homo sapiens
ctctgcacaagctgcac

SEQ ID NO: 3808766 - DNA, 23 bp, Homo sapiens
ctctgcaggcagatttactgtcc

SEQ ID NO: 3808767 - DNA, 14 bp, Homo sapiens
ctctgcccagcctg

SEQ ID NO: 3808768 - DNA, 20 bp, Homo sapiens
ctctgcccccaactcccgga

SEQ ID NO: 3808769 - DNA, 22 bp, Homo sapiens
ctctgcccccaactcccggagg

SEQ ID NO: 3808770 - DNA, 14 bp, Homo sapiens
ctctgcccgggagc

SEQ ID NO: 3808771 - DNA, 14 bp, Homo sapiens
ctctgctgcccagg

SEQ ID NO: 3808772 - DNA, 16 bp, Homo sapiens
ctctggatcctgcact

SEQ ID NO: 3808773 - DNA, 15 bp, Homo sapiens
aggtcaataaagcag

SEQ ID NO: 3808774 - DNA, 20 bp, Homo sapiens
aggtcaataaagcagagcca

SEQ ID NO: 3808775 - DNA, 12 bp, Homo sapiens
aggtcctgccct

SEQ ID NO: 3808776 - DNA, 13 bp, Homo sapiens
aggtcctgccctc

SEQ ID NO: 3808777 - DNA, 18 bp, Homo sapiens
aggtctttggttcagcta

SEQ ID NO: 3808778 - DNA, 18 bp, Homo sapiens
aggtgacttgcctggggc

SEQ ID NO: 3808779 - DNA, 23 bp, Homo sapiens
aggtgaggtgacttgcctggggc

SEQ ID NO: 3808780 - DNA, 15 bp, Homo sapiens
aggtgccactgaccg

SEQ ID NO: 3808781 - DNA, 15 bp, Homo sapiens
aggtgcctggccctt

SEQ ID NO: 3808782 - DNA, 21 bp, Homo sapiens
aggttgcagtgaactgagact

SEQ ID NO: 3808783 - DNA, 14 bp, Homo sapiens
aggtttaagctgtt

SEQ ID NO: 3808784 - DNA, 17 bp, Homo sapiens
agtaacttacttaggtg

SEQ ID NO: 3808785 - DNA, 16 bp, Homo sapiens
agtataggataaatta

SEQ ID NO: 3808786 - DNA, 22 bp, Homo sapiens
agtataggataaattacattaa

SEQ ID NO: 3808787 - DNA, 14 bp, Homo sapiens
agtcaacagtgaaa

SEQ ID NO: 3808788 - DNA, 21 bp, Homo sapiens
agtcaggtgtggcggtgcgtg

SEQ ID NO: 3808789 - DNA, 12 bp, Homo sapiens
agtccagctccc

SEQ ID NO: 3808790 - DNA, 19 bp, Homo sapiens
agtccagctccccccaaga

SEQ ID NO: 3808791 - DNA, 13 bp, Homo sapiens
agtccatcagcct

SEQ ID NO: 3808792 - DNA, 14 bp, Homo sapiens
agtccctgcctgga

SEQ ID NO: 3808793 - DNA, 21 bp, Homo sapiens
agtccctgcctggaccagcct

SEQ ID NO: 3808794 - DNA, 12 bp, Homo sapiens
agtcctagagct

SEQ ID NO: 3808795 - DNA, 13 bp, Homo sapiens
agtcctagagctc

SEQ ID NO: 3808796 - DNA, 14 bp, Homo sapiens
agtcctcacagcct

SEQ ID NO: 3808797 - DNA, 18 bp, Homo sapiens
agtcctcacagcctctcc

SEQ ID NO: 3808798 - DNA, 21 bp, Homo sapiens
agtcctcacagcctctccctt

SEQ ID NO: 3808799 - DNA, 14 bp, Homo sapiens
agtctcgctctgct

SEQ ID NO: 3808800 - DNA, 18 bp, Homo sapiens
agtctctatgatcttggc

SEQ ID NO: 3808801 - DNA, 13 bp, Homo sapiens
agtctctctgtga

SEQ ID NO: 3808802 - DNA, 17 bp, Homo sapiens
agtctctctgtgaatac

SEQ ID NO: 3808803 - DNA, 18 bp, Homo sapiens
agtctctctgtgaataca

SEQ ID NO: 3808804 - DNA, 20 bp, Homo sapiens
agtctctctgtgaatacaat

SEQ ID NO: 3808805 - DNA, 21 bp, Homo sapiens
agtctctctgtgaatacaatt

SEQ ID NO: 3808806 - DNA, 14 bp, Homo sapiens
agtctcttctcaga

SEQ ID NO: 3808807 - DNA, 17 bp, Homo sapiens
agtcttcactgctctgc

SEQ ID NO: 3808808 - DNA, 20 bp, Homo sapiens
agtgaacacactcagcagcc

SEQ ID NO: 3808809 - DNA, 16 bp, Homo sapiens
agtgaacttgggccac

SEQ ID NO: 3808810 - DNA, 18 bp, Homo sapiens
agtgaccatgaaaaataa

SEQ ID NO: 3808811 - DNA, 14 bp, Homo sapiens
agtgcagctcagga

SEQ ID NO: 3808812 - DNA, 22 bp, Homo sapiens
agtgcagtggtgcgatcttggc

SEQ ID NO: 3808813 - DNA, 19 bp, Homo sapiens
agtgccaaggttgtcctgg

SEQ ID NO: 3808814 - DNA, 22 bp, Homo sapiens
agtgctaaacaagtaagaaaaa

SEQ ID NO: 3808815 - DNA, 19 bp, Homo sapiens
agtgcttgatatgtaagta

SEQ ID NO: 3808816 - DNA, 18 bp, Homo sapiens
agtggaaaaatagcctgc

SEQ ID NO: 3808817 - DNA, 19 bp, Homo sapiens
agtggaaaaatagcctgcc

SEQ ID NO: 3808818 - DNA, 22 bp, Homo sapiens
agtggaaacatgctgaaatcta

SEQ ID NO: 3808819 - DNA, 19 bp, Homo sapiens
agtggcccccactcacagg

SEQ ID NO: 3808820 - DNA, 13 bp, Homo sapiens
agtgggaggacag

SEQ ID NO: 3808821 - DNA, 18 bp, Homo sapiens
agtgggaggacagagccg

SEQ ID NO: 3808822 - DNA, 18 bp, Homo sapiens
agtgggggatcacagcct

SEQ ID NO: 3808823 - DNA, 16 bp, Homo sapiens
agtggggtaggttggg

SEQ ID NO: 3808824 - DNA, 13 bp, Homo sapiens
agtgtcagtgttg

SEQ ID NO: 3808825 - DNA, 20 bp, Homo sapiens
agtgtgcctgaagtcccaga

SEQ ID NO: 3808826 - DNA, 21 bp, Homo sapiens
agttaatggggtagaggaggg

SEQ ID NO: 3808827 - DNA, 15 bp, Homo sapiens
agttattttacaaat

SEQ ID NO: 3808828 - DNA, 18 bp, Homo sapiens
agttctagttgattgcga

SEQ ID NO: 3808829 - DNA, 17 bp, Homo sapiens
agttgaaaaacagctga

SEQ ID NO: 3808830 - DNA, 18 bp, Homo sapiens
agttgattcagctctgca

SEQ ID NO: 3808831 - DNA, 18 bp, Homo sapiens
agttgattgcgagaattt

SEQ ID NO: 3808832 - DNA, 20 bp, Homo sapiens
agttgtatcagcacgtgtgg

SEQ ID NO: 3808833 - DNA, 19 bp, Homo sapiens
agtttgagatcagcctggg

SEQ ID NO: 3808834 - DNA, 19 bp, Homo sapiens
agtttgatttaatatctga

SEQ ID NO: 3808835 - DNA, 17 bp, Homo sapiens
agtttgtggtaaaaaga

SEQ ID NO: 3808836 - DNA, 17 bp, Homo sapiens
agttttctcctcccagg

SEQ ID NO: 3808837 - DNA, 13 bp, Homo sapiens
ataaaatgaccag

SEQ ID NO: 3808838 - DNA, 17 bp, Homo sapiens
ataaaatgtaattactt

SEQ ID NO: 3808839 - DNA, 23 bp, Homo sapiens
ataaactagggttttggcctgcc

SEQ ID NO: 3808840 - DNA, 20 bp, Homo sapiens
ataaactccttaacttcagg

SEQ ID NO: 3808841 - DNA, 12 bp, Homo sapiens
ataaagcagagc

SEQ ID NO: 3808842 - DNA, 14 bp, Homo sapiens
ataaaggtatttag

SEQ ID NO: 3808843 - DNA, 14 bp, Homo sapiens
ataaattacattaa

SEQ ID NO: 3808844 - DNA, 15 bp, Homo sapiens
ataaattacattaaa

SEQ ID NO: 3808845 - DNA, 15 bp, Homo sapiens
ataacatgtaaaatc

SEQ ID NO: 3808846 - DNA, 20 bp, Homo sapiens
ataaccaattcctcatttgt

SEQ ID NO: 3808847 - DNA, 16 bp, Homo sapiens
ataaccttcatgatga

SEQ ID NO: 3808848 - DNA, 14 bp, Homo sapiens
ataagtgctacttt

SEQ ID NO: 3808849 - DNA, 17 bp, Homo sapiens
ataataaacttctggtg

SEQ ID NO: 3808850 - DNA, 13 bp, Homo sapiens
ataatagaagaac

SEQ ID NO: 3808851 - DNA, 12 bp, Homo sapiens
ataatctagaac

SEQ ID NO: 3808852 - DNA, 15 bp, Homo sapiens
ataatctagaacaca

SEQ ID NO: 3808853 - DNA, 17 bp, Homo sapiens
ataatgaggagtttatg

SEQ ID NO: 3808854 - DNA, 15 bp, Homo sapiens
ataattttaaacaaa

SEQ ID NO: 3808855 - DNA, 23 bp, Homo sapiens
atacaattaaaggtcctgccctc

SEQ ID NO: 3808856 - DNA, 14 bp, Homo sapiens
atacagaatgaatc

SEQ ID NO: 3808857 - DNA, 18 bp, Homo sapiens
atacctgggcatactaat

SEQ ID NO: 3808858 - DNA, 21 bp, Homo sapiens
atactgaagtgcagctcagga

SEQ ID NO: 3808859 - DNA, 14 bp, Homo sapiens
atactgctgatgct

SEQ ID NO: 3808860 - DNA, 21 bp, Homo sapiens
atactgctgatgctgaaataa

SEQ ID NO: 3808861 - DNA, 14 bp, Homo sapiens
atagatgagaaaac

SEQ ID NO: 3808862 - DNA, 21 bp, Homo sapiens
atagatgagaaaactgagagg

SEQ ID NO: 3808863 - DNA, 15 bp, Homo sapiens
atagcaacatgcttc

SEQ ID NO: 3808864 - DNA, 23 bp, Homo sapiens
atagcacatgattttcttttgtt

SEQ ID NO: 3808865 - DNA, 17 bp, Homo sapiens
atagttattttacaaat

SEQ ID NO: 3808866 - DNA, 20 bp, Homo sapiens
atataaaagttaaactactt

SEQ ID NO: 3808867 - DNA, 14 bp, Homo sapiens
atataaaatattca

SEQ ID NO: 3808868 - DNA, 15 bp, Homo sapiens
atataacatgtaaaa

SEQ ID NO: 3808869 - DNA, 13 bp, Homo sapiens
atatatcaaaacg

SEQ ID NO: 3808870 - DNA, 21 bp, Homo sapiens
atatatgtatatgtatatcta

SEQ ID NO: 3808871 - DNA, 15 bp, Homo sapiens
atatcataaagtatg

SEQ ID NO: 3808872 - DNA, 17 bp, Homo sapiens
atatctctaaactgctg

SEQ ID NO: 3808873 - DNA, 18 bp, Homo sapiens
atatctgagaagtgtata

SEQ ID NO: 3808874 - DNA, 14 bp, Homo sapiens
atatgtaagtactt

SEQ ID NO: 3808875 - DNA, 15 bp, Homo sapiens
atatgtaagtacttc

SEQ ID NO: 3808876 - DNA, 18 bp, Homo sapiens
atatgttaggaatactct

SEQ ID NO: 3808877 - DNA, 12 bp, Homo sapiens
atattaaaggct

SEQ ID NO: 3808878 - DNA, 22 bp, Homo sapiens
atattaaggaagacaatgtgaa

SEQ ID NO: 3808879 - DNA, 15 bp, Homo sapiens
atattcaataaagct

SEQ ID NO: 3808880 - DNA, 21 bp, Homo sapiens
atattccgggtgccattccca

SEQ ID NO: 3808881 - DNA, 21 bp, Homo sapiens
atattctacacatatatgtat

SEQ ID NO: 3808882 - DNA, 22 bp, Homo sapiens
atattctacacatatatgtata

SEQ ID NO: 3808883 - DNA, 20 bp, Homo sapiens
atattctcttgtctggctgc

SEQ ID NO: 3808884 - DNA, 15 bp, Homo sapiens
atattgatgttaaca

SEQ ID NO: 3808885 - DNA, 13 bp, Homo sapiens
atatttatttatg

SEQ ID NO: 3808886 - DNA, 17 bp, Homo sapiens
atatttgtctttaaaca

SEQ ID NO: 3808887 - DNA, 21 bp, Homo sapiens
atcaaaattctgttttgtaaa

SEQ ID NO: 3808888 - DNA, 23 bp, Homo sapiens
atcaaaattctgttttgtaaatg

SEQ ID NO: 3808889 - DNA, 22 bp, Homo sapiens
atcaaatggaaaggagaggaaa

SEQ ID NO: 3808890 - DNA, 12 bp, Homo sapiens
atcaagtcaccg

SEQ ID NO: 3808891 - DNA, 21 bp, Homo sapiens
atcacagcctctgaaaaccaa

SEQ ID NO: 3808892 - DNA, 12 bp, Homo sapiens
atcacagggccc

SEQ ID NO: 3808893 - DNA, 16 bp, Homo sapiens
atcacagggccccaga

SEQ ID NO: 3808894 - DNA, 17 bp, Homo sapiens
atcacttgtacaaaata

SEQ ID NO: 3808895 - DNA, 21 bp, Homo sapiens
atcacttgtacaaaataaaca

SEQ ID NO: 3808896 - DNA, 20 bp, Homo sapiens
atcagagctggcagcctcca

SEQ ID NO: 3808897 - DNA, 21 bp, Homo sapiens
atcagagctggcagcctccag

SEQ ID NO: 3808898 - DNA, 17 bp, Homo sapiens
atcagcctgctccagct

SEQ ID NO: 3808899 - DNA, 20 bp, Homo sapiens
atcagcctgggcaatgtgat

SEQ ID NO: 3808900 - DNA, 15 bp, Homo sapiens
atcatagaaatgtaa

SEQ ID NO: 3808901 - DNA, 21 bp, Homo sapiens
atcatgtcgtaggtaaactaa

SEQ ID NO: 3808902 - DNA, 18 bp, Homo sapiens
atcatgtttacagaggac

SEQ ID NO: 3808903 - DNA, 22 bp, Homo sapiens
atcattaaagcctgagtttgct

SEQ ID NO: 3808904 - DNA, 22 bp, Homo sapiens
atcattctgcttccgtatttta

SEQ ID NO: 3808905 - DNA, 13 bp, Homo sapiens
atccaaggagaaa

SEQ ID NO: 3808906 - DNA, 16 bp, Homo sapiens
atccacaaatgctatt

SEQ ID NO: 3808907 - DNA, 21 bp, Homo sapiens
atccagagtccctgcctggac

SEQ ID NO: 3808908 - DNA, 14 bp, Homo sapiens
atccagtctgcaga

SEQ ID NO: 3808909 - DNA, 19 bp, Homo sapiens
atccatagcacctccacat

SEQ ID NO: 3808910 - DNA, 17 bp, Homo sapiens
atcccaacactgccagc

SEQ ID NO: 3808911 - DNA, 20 bp, Homo sapiens
atcccacggaaaatgccaat

SEQ ID NO: 3808912 - DNA, 12 bp, Homo sapiens
atcccagctatt

SEQ ID NO: 3808913 - DNA, 12 bp, Homo sapiens
atcccaggggac

SEQ ID NO: 3808914 - DNA, 20 bp, Homo sapiens
atcccaggggaccacacctc

SEQ ID NO: 3808915 - DNA, 14 bp, Homo sapiens
atcccatttaaaaa

SEQ ID NO: 3808916 - DNA, 15 bp, Homo sapiens
atcccatttaaaaaa

SEQ ID NO: 3808917 - DNA, 15 bp, Homo sapiens
atcccctgtagagtg

SEQ ID NO: 3808918 - DNA, 16 bp, Homo sapiens
atcctaccccctgtgc

SEQ ID NO: 3808919 - DNA, 16 bp, Homo sapiens
atcctaggcatttgct

SEQ ID NO: 3808920 - DNA, 19 bp, Homo sapiens
atcctcagttcctgcagca

SEQ ID NO: 3808921 - DNA, 22 bp, Homo sapiens
atcctcagttcctgcagcagag

SEQ ID NO: 3808922 - DNA, 16 bp, Homo sapiens
atcctgaaatttcaga

SEQ ID NO: 3808923 - DNA, 15 bp, Homo sapiens
atctatatttaacaa

SEQ ID NO: 3808924 - DNA, 15 bp, Homo sapiens
atctcaagcaagttt

SEQ ID NO: 3808925 - DNA, 16 bp, Homo sapiens
atctccctgaccttct

SEQ ID NO: 3808926 - DNA, 21 bp, Homo sapiens
atctccctgaccttctccagg

SEQ ID NO: 3808927 - DNA, 15 bp, Homo sapiens
atctctgtgtgcaca

SEQ ID NO: 3808928 - DNA, 15 bp, Homo sapiens
atctcttgagcctgg

SEQ ID NO: 3808929 - DNA, 18 bp, Homo sapiens
atctcttgagcctgggag

SEQ ID NO: 3808930 - DNA, 16 bp, Homo sapiens
atctctttttttctgg

SEQ ID NO: 3808931 - DNA, 20 bp, Homo sapiens
atctgagaggccacagtgca

SEQ ID NO: 3808932 - DNA, 19 bp, Homo sapiens
atctggacttcctataata

SEQ ID NO: 3808933 - DNA, 21 bp, Homo sapiens
atctggccacactgggctcac

SEQ ID NO: 3808934 - DNA, 22 bp, Homo sapiens
atctgtcaaagaaaacttccaa

SEQ ID NO: 3808935 - DNA, 21 bp, Homo sapiens
atctgtgaggggctctctcat

SEQ ID NO: 3808936 - DNA, 20 bp, Homo sapiens
atcttcttatgcaatttcct

SEQ ID NO: 3808937 - DNA, 15 bp, Homo sapiens
atgaaaatcctacca

SEQ ID NO: 3808938 - DNA, 20 bp, Homo sapiens
atgaaaatcctaccaacctc

SEQ ID NO: 3808939 - DNA, 21 bp, Homo sapiens
atgaaaatcctaccaacctct

SEQ ID NO: 3808940 - DNA, 18 bp, Homo sapiens
atgaaacagaaacaaaaa

SEQ ID NO: 3808941 - DNA, 22 bp, Homo sapiens
atgaacacacatggatgcacac

SEQ ID NO: 3808942 - DNA, 21 bp, Homo sapiens
atgaacttgaggacacatgtc

SEQ ID NO: 3808943 - DNA, 18 bp, Homo sapiens
atgaagagtgagagggca

SEQ ID NO: 3808944 - DNA, 21 bp, Homo sapiens
atgaagctggaagcactgctg

SEQ ID NO: 3808945 - DNA, 21 bp, Homo sapiens
atgaatattgatgttaacaag

SEQ ID NO: 3808946 - DNA, 14 bp, Homo sapiens
atgaattaaataaa

SEQ ID NO: 3808947 - DNA, 18 bp, Homo sapiens
atgaattactgtatataa

SEQ ID NO: 3808948 - DNA, 11 bp, Homo sapiens
atgagaatcta

SEQ ID NO: 3808949 - DNA, 13 bp, Homo sapiens
atgagccaccatg

SEQ ID NO: 3808950 - DNA, 16 bp, Homo sapiens
atgagggatcacaggg

SEQ ID NO: 3808951 - DNA, 15 bp, Homo sapiens
atgaggtccctctag

SEQ ID NO: 3808952 - DNA, 22 bp, Homo sapiens
atgagtgggttagctacctgct

SEQ ID NO: 3808953 - DNA, 15 bp, Homo sapiens
atgatgatcctaggc

SEQ ID NO: 3808954 - DNA, 14 bp, Homo sapiens
atgatgggggaaaa

SEQ ID NO: 3808955 - DNA, 19 bp, Homo sapiens
atgattaaccacttcagct

SEQ ID NO: 3808956 - DNA, 14 bp, Homo sapiens
atgattttcttttg

SEQ ID NO: 3808957 - DNA, 20 bp, Homo sapiens
atgcaactaattcaataaaa

SEQ ID NO: 3808958 - DNA, 13 bp, Homo sapiens
atgcacagagata

SEQ ID NO: 3808959 - DNA, 17 bp, Homo sapiens
atgcacgcacacatcag

SEQ ID NO: 3808960 - DNA, 21 bp, Homo sapiens
atgcattataggatcatttgt

SEQ ID NO: 3808961 - DNA, 16 bp, Homo sapiens
atgccattgtatttct

SEQ ID NO: 3808962 - DNA, 16 bp, Homo sapiens
atgctagaagaaaaca

SEQ ID NO: 3808963 - DNA, 17 bp, Homo sapiens
atgctgaaataaactag

SEQ ID NO: 3808964 - DNA, 15 bp, Homo sapiens
atgctgaatgaatcc

SEQ ID NO: 3808965 - DNA, 17 bp, Homo sapiens
atgctggatgagcaact

SEQ ID NO: 3808966 - DNA, 14 bp, Homo sapiens
atgctggccacaga

SEQ ID NO: 3808967 - DNA, 18 bp, Homo sapiens
atgctggctcccagggcc

SEQ ID NO: 3808968 - DNA, 19 bp, Homo sapiens
atgctggctcccagggcca

SEQ ID NO: 3808969 - DNA, 13 bp, Homo sapiens
atgcttctcactg

SEQ ID NO: 3808970 - DNA, 20 bp, Homo sapiens
atgcttctcactgccatgcc

SEQ ID NO: 3808971 - DNA, 13 bp, Homo sapiens
atgctttctcctt

SEQ ID NO: 3808972 - DNA, 14 bp, Homo sapiens
atgctttctccttt

SEQ ID NO: 3808973 - DNA, 21 bp, Homo sapiens
atggaatgatgggtcagttgt

SEQ ID NO: 3808974 - DNA, 21 bp, Homo sapiens
atggagagagactcaaagaga

SEQ ID NO: 3808975 - DNA, 13 bp, Homo sapiens
atggagagagggg

SEQ ID NO: 3808976 - DNA, 16 bp, Homo sapiens
atggaggatggagaga

SEQ ID NO: 3808977 - DNA, 20 bp, Homo sapiens
atggcctttgcttgaaagaa

SEQ ID NO: 3808978 - DNA, 18 bp, Homo sapiens
atgggactgtgcctttgg

SEQ ID NO: 3808979 - DNA, 17 bp, Homo sapiens
atgggatgggctttctc

SEQ ID NO: 3808980 - DNA, 15 bp, Homo sapiens
atgggctttctcagt

SEQ ID NO: 3808981 - DNA, 19 bp, Homo sapiens
atggtcttgatctcctgag

SEQ ID NO: 3808982 - DNA, 14 bp, Homo sapiens
atgtaacttttgta

SEQ ID NO: 3808983 - DNA, 22 bp, Homo sapiens
atgtacacacacagatgcacac

SEQ ID NO: 3808984 - DNA, 20 bp, Homo sapiens
atgtatatctatatctctaa

SEQ ID NO: 3808985 - DNA, 21 bp, Homo sapiens
atgtcagaaactcgatgaatg

SEQ ID NO: 3808986 - DNA, 13 bp, Homo sapiens
atgtcattaaatg

SEQ ID NO: 3808987 - DNA, 13 bp, Homo sapiens
atgtcccagaggc

SEQ ID NO: 3808988 - DNA, 13 bp, Homo sapiens
atgtgacaacatt

SEQ ID NO: 3808989 - DNA, 14 bp, Homo sapiens
atgtgatataaaat

SEQ ID NO: 3808990 - DNA, 23 bp, Homo sapiens
atgtgattcctttgaagaggaaa

SEQ ID NO: 3808991 - DNA, 16 bp, Homo sapiens
atgtgcgcacacacag

SEQ ID NO: 3808992 - DNA, 18 bp, Homo sapiens
atgtgctcccaccaggca

SEQ ID NO: 3808993 - DNA, 20 bp, Homo sapiens
atgtgctcccaccaggcagc

SEQ ID NO: 3808994 - DNA, 13 bp, Homo sapiens
atgtggaagtgtg

SEQ ID NO: 3808995 - DNA, 23 bp, Homo sapiens
atgtggaagtgtgggtctgtgtg

SEQ ID NO: 3808996 - DNA, 23 bp, Homo sapiens
atgtggcaataaaggagaagaga

SEQ ID NO: 3808997 - DNA, 23 bp, Homo sapiens
atgtgtgtgtgttgtgtgtggga

SEQ ID NO: 3808998 - DNA, 17 bp, Homo sapiens
atgttatgggatgtaaa

SEQ ID NO: 3808999 - DNA, 20 bp, Homo sapiens
atgttatgggatgtaaacaa

SEQ ID NO: 3809000 - DNA, 15 bp, Homo sapiens
atgttattggaattt

SEQ ID NO: 3809001 - DNA, 19 bp, Homo sapiens
atgttattggaattttctt

SEQ ID NO: 3809002 - DNA, 17 bp, Homo sapiens
atgttctctcttctcca

SEQ ID NO: 3809003 - DNA, 15 bp, Homo sapiens
atgttgctggactgt

SEQ ID NO: 3809004 - DNA, 18 bp, Homo sapiens
atgtttttcatactgaat

SEQ ID NO: 3809005 - DNA, 13 bp, Homo sapiens
attaaaggctttt

SEQ ID NO: 3809006 - DNA, 19 bp, Homo sapiens
attaaaggcttttggcagc

SEQ ID NO: 3809007 - DNA, 14 bp, Homo sapiens
attacacccaaaga

SEQ ID NO: 3809008 - DNA, 17 bp, Homo sapiens
attacttatttttgaca

SEQ ID NO: 3809009 - DNA, 17 bp, Homo sapiens
attagaaacataaataa

SEQ ID NO: 3809010 - DNA, 15 bp, Homo sapiens
attagaagacaacag

SEQ ID NO: 3809011 - DNA, 17 bp, Homo sapiens
attagcaactgtgctac

SEQ ID NO: 3809012 - DNA, 22 bp, Homo sapiens
attagctacttttcagaattga

SEQ ID NO: 3809013 - DNA, 21 bp, Homo sapiens
attagtttgatttaatatctg

SEQ ID NO: 3809014 - DNA, 17 bp, Homo sapiens
attataggatcatttgt

SEQ ID NO: 3809015 - DNA, 18 bp, Homo sapiens
attatatatcataaagta

SEQ ID NO: 3809016 - DNA, 14 bp, Homo sapiens
attatcaaaattct

SEQ ID NO: 3809017 - DNA, 20 bp, Homo sapiens
attatgagtctctatgatct

SEQ ID NO: 3809018 - DNA, 15 bp, Homo sapiens
attatgttattggaa

SEQ ID NO: 3809019 - DNA, 20 bp, Homo sapiens
attattacttatttttgaca

SEQ ID NO: 3809020 - DNA, 21 bp, Homo sapiens
attatttcaaccgcttgccat

SEQ ID NO: 3809021 - DNA, 14 bp, Homo sapiens
attcaaaatgtcca

SEQ ID NO: 3809022 - DNA, 15 bp, Homo sapiens
attcaaaatgtccag

SEQ ID NO: 3809023 - DNA, 14 bp, Homo sapiens
attcaacctgtgtc

SEQ ID NO: 3809024 - DNA, 18 bp, Homo sapiens
attcaacctgtgtcttat

SEQ ID NO: 3809025 - DNA, 17 bp, Homo sapiens
attcacagcgcctcctg

SEQ ID NO: 3809026 - DNA, 15 bp, Homo sapiens
attcagaagcatcac

SEQ ID NO: 3809027 - DNA, 21 bp, Homo sapiens
attcagataaggcagaactag

SEQ ID NO: 3809028 - DNA, 17 bp, Homo sapiens
attcaggaggctgaggc

SEQ ID NO: 3809029 - DNA, 14 bp, Homo sapiens
attcatgctttctc

SEQ ID NO: 3809030 - DNA, 18 bp, Homo sapiens
attcatgctttctccttt

SEQ ID NO: 3809031 - DNA, 16 bp, Homo sapiens
attcatgtagtttctg

SEQ ID NO: 3809032 - DNA, 14 bp, Homo sapiens
attccaacagctca

SEQ ID NO: 3809033 - DNA, 21 bp, Homo sapiens
attcccactaagctttctcct

SEQ ID NO: 3809034 - DNA, 22 bp, Homo sapiens
attccccaccctgaaagccctg

SEQ ID NO: 3809035 - DNA, 16 bp, Homo sapiens
attcctttgaagagga

SEQ ID NO: 3809036 - DNA, 15 bp, Homo sapiens
attctacacatatat

SEQ ID NO: 3809037 - DNA, 16 bp, Homo sapiens
attctaggcatcccag

SEQ ID NO: 3809038 - DNA, 17 bp, Homo sapiens
attcttcctagttttct

SEQ ID NO: 3809039 - DNA, 16 bp, Homo sapiens
attctttcccaacacc

SEQ ID NO: 3809040 - DNA, 23 bp, Homo sapiens
attgcaggagtccctgccatcat

SEQ ID NO: 3809041 - DNA, 15 bp, Homo sapiens
attgcctgggcagtg

SEQ ID NO: 3809042 - DNA, 17 bp, Homo sapiens
attgcctgggcagtgcc

SEQ ID NO: 3809043 - DNA, 17 bp, Homo sapiens
attgcttgaacccagga

SEQ ID NO: 3809044 - DNA, 14 bp, Homo sapiens
attgcttgagctca

SEQ ID NO: 3809045 - DNA, 16 bp, Homo sapiens
attggcaggaggcagg

SEQ ID NO: 3809046 - DNA, 23 bp, Homo sapiens
attggctttgggttgcaggacct

SEQ ID NO: 3809047 - DNA, 18 bp, Homo sapiens
attgggagcttgggaatg

SEQ ID NO: 3809048 - DNA, 20 bp, Homo sapiens
attggtccaacccagcctga

SEQ ID NO: 3809049 - DNA, 18 bp, Homo sapiens
attgtagagccagaggtc

SEQ ID NO: 3809050 - DNA, 19 bp, Homo sapiens
attgtcttccaaccccagc

SEQ ID NO: 3809051 - DNA, 23 bp, Homo sapiens
attgtcttccaaccccagctggc

SEQ ID NO: 3809052 - DNA, 13 bp, Homo sapiens
attgtgatgtgtc

SEQ ID NO: 3809053 - DNA, 14 bp, Homo sapiens
attgtgatgtgtcc

SEQ ID NO: 3809054 - DNA, 20 bp, Homo sapiens
attgtgtcagaaacatgaaa

SEQ ID NO: 3809055 - DNA, 22 bp, Homo sapiens
attgtgtcagaaacatgaaatg

SEQ ID NO: 3809056 - DNA, 14 bp, Homo sapiens
atttaaaaaaaatc

SEQ ID NO: 3809057 - DNA, 15 bp, Homo sapiens
atttaaaattgtgat

SEQ ID NO: 3809058 - DNA, 19 bp, Homo sapiens
atttaaaattgtgatgtgt

SEQ ID NO: 3809059 - DNA, 16 bp, Homo sapiens
atttaatatctgagaa

SEQ ID NO: 3809060 - DNA, 22 bp, Homo sapiens
atttaatatctgagaagtgtat

SEQ ID NO: 3809061 - DNA, 16 bp, Homo sapiens
atttactgattccagc

SEQ ID NO: 3809062 - DNA, 18 bp, Homo sapiens
atttactgattccagcaa

SEQ ID NO: 3809063 - DNA, 14 bp, Homo sapiens
atttactgtcccag

SEQ ID NO: 3809064 - DNA, 16 bp, Homo sapiens
atttactgtcccagga

SEQ ID NO: 3809065 - DNA, 23 bp, Homo sapiens
atttaggtttttgtttgtttcct

SEQ ID NO: 3809066 - DNA, 12 bp, Homo sapiens
atttataaacta

SEQ ID NO: 3809067 - DNA, 12 bp, Homo sapiens
atttatggagga

SEQ ID NO: 3809068 - DNA, 15 bp, Homo sapiens
atttatgtgtatatg

SEQ ID NO: 3809069 - DNA, 16 bp, Homo sapiens
atttatgtgtatatgg

SEQ ID NO: 3809070 - DNA, 18 bp, Homo sapiens
atttcaccagaagttaca

SEQ ID NO: 3809071 - DNA, 18 bp, Homo sapiens
atttcagattcccagagc

SEQ ID NO: 3809072 - DNA, 22 bp, Homo sapiens
atttcaggggtcgtcaccacct

SEQ ID NO: 3809073 - DNA, 20 bp, Homo sapiens
atttcccttccttcctctcc

SEQ ID NO: 3809074 - DNA, 19 bp, Homo sapiens
atttccttttttgttatta

SEQ ID NO: 3809075 - DNA, 14 bp, Homo sapiens
atttctagaaacaa

SEQ ID NO: 3809076 - DNA, 16 bp, Homo sapiens
atttcttcctctgcat

SEQ ID NO: 3809077 - DNA, 13 bp, Homo sapiens
atttgcctgcctg

SEQ ID NO: 3809078 - DNA, 23 bp, Homo sapiens
atttgcctgcctgggcctcccaa

SEQ ID NO: 3809079 - DNA, 20 bp, Homo sapiens
atttgctatgagctggggat

SEQ ID NO: 3809080 - DNA, 18 bp, Homo sapiens
atttgctttttcaccaga

SEQ ID NO: 3809081 - DNA, 18 bp, Homo sapiens
atttgtaaatttatgtga

SEQ ID NO: 3809082 - DNA, 15 bp, Homo sapiens
atttgttcattaaac

SEQ ID NO: 3809083 - DNA, 16 bp, Homo sapiens
atttgttcattaaacg

SEQ ID NO: 3809084 - DNA, 15 bp, Homo sapiens
atttgttggaatgaa

SEQ ID NO: 3809085 - DNA, 15 bp, Homo sapiens
attttaatgaatatt

SEQ ID NO: 3809086 - DNA, 15 bp, Homo sapiens
attttactgacagaa

SEQ ID NO: 3809087 - DNA, 23 bp, Homo sapiens
attttcaagaaactgaggaattt

SEQ ID NO: 3809088 - DNA, 19 bp, Homo sapiens
attttctggaatacatgaa

SEQ ID NO: 3809089 - DNA, 19 bp, Homo sapiens
attttctttcatacattat

SEQ ID NO: 3809090 - DNA, 23 bp, Homo sapiens
attttctttgtgtagctttgctc

SEQ ID NO: 3809091 - DNA, 20 bp, Homo sapiens
attttgctaaatgtgaatga

SEQ ID NO: 3809092 - DNA, 10 bp, Homo sapiens
attttgtaaa

SEQ ID NO: 3809093 - DNA, 17 bp, Homo sapiens
attttgtaaactcaaaa

SEQ ID NO: 3809094 - DNA, 20 bp, Homo sapiens
attttgtacaaagatatgct

SEQ ID NO: 3809095 - DNA, 21 bp, Homo sapiens
attttgtacaaagatatgcta

SEQ ID NO: 3809096 - DNA, 19 bp, Homo sapiens
attttgttgctgttttgat

SEQ ID NO: 3809097 - DNA, 23 bp, Homo sapiens
attttgttgctgttttgatttgt

SEQ ID NO: 3809098 - DNA, 19 bp, Homo sapiens
atttttgtacattatgtta

SEQ ID NO: 3809099 - DNA, 17 bp, Homo sapiens
atttttttgatggctaa

SEQ ID NO: 3809100 - DNA, 14 bp, Homo sapiens
caaaaagatttatt

SEQ ID NO: 3809101 - DNA, 18 bp, Homo sapiens
caaaagatgcttctcact

SEQ ID NO: 3809102 - DNA, 16 bp, Homo sapiens
caaagaggtatttatc

SEQ ID NO: 3809103 - DNA, 14 bp, Homo sapiens
caaagccacatttt

SEQ ID NO: 3809104 - DNA, 16 bp, Homo sapiens
caaagctttttccaga

SEQ ID NO: 3809105 - DNA, 16 bp, Homo sapiens
caaaggagagtcaaca

SEQ ID NO: 3809106 - DNA, 20 bp, Homo sapiens
caaagggcagtaaagttttc

SEQ ID NO: 3809107 - DNA, 11 bp, Homo sapiens
caaaggttttc

SEQ ID NO: 3809108 - DNA, 19 bp, Homo sapiens
caaagtgctgggattacag

SEQ ID NO: 3809109 - DNA, 19 bp, Homo sapiens
caaagttcccactccttca

SEQ ID NO: 3809110 - DNA, 16 bp, Homo sapiens
caaatatttattttct

SEQ ID NO: 3809111 - DNA, 23 bp, Homo sapiens
caaatgctgtaactttctgaaat

SEQ ID NO: 3809112 - DNA, 14 bp, Homo sapiens
caaatggaaaggag

SEQ ID NO: 3809113 - DNA, 14 bp, Homo sapiens
caaccattccagac

SEQ ID NO: 3809114 - DNA, 12 bp, Homo sapiens
caaccccagctg

SEQ ID NO: 3809115 - DNA, 15 bp, Homo sapiens
caaccccagctggcc

SEQ ID NO: 3809116 - DNA, 13 bp, Homo sapiens
caaccctcagctg

SEQ ID NO: 3809117 - DNA, 12 bp, Homo sapiens
caacctgcccct

SEQ ID NO: 3809118 - DNA, 17 bp, Homo sapiens
caacctgcccctcccca

SEQ ID NO: 3809119 - DNA, 18 bp, Homo sapiens
caacgaaaagcacatcca

SEQ ID NO: 3809120 - DNA, 22 bp, Homo sapiens
caacgaaaagcacatccaggca

SEQ ID NO: 3809121 - DNA, 17 bp, Homo sapiens
caactccgcccagcctc

SEQ ID NO: 3809122 - DNA, 15 bp, Homo sapiens
caagaatgaaatact

SEQ ID NO: 3809123 - DNA, 17 bp, Homo sapiens
caagacaaagcaaagcc

SEQ ID NO: 3809124 - DNA, 18 bp, Homo sapiens
caagactctttggacact

SEQ ID NO: 3809125 - DNA, 13 bp, Homo sapiens
caagaggggaaaa

SEQ ID NO: 3809126 - DNA, 19 bp, Homo sapiens
caagatgagctgcagcccc

SEQ ID NO: 3809127 - DNA, 21 bp, Homo sapiens
caagatgagctgcagcccccc

SEQ ID NO: 3809128 - DNA, 17 bp, Homo sapiens
caagccttggctctacc

SEQ ID NO: 3809129 - DNA, 16 bp, Homo sapiens
caagctctgcctcccg

SEQ ID NO: 3809130 - DNA, 18 bp, Homo sapiens
caagctgcaccctcaggc

SEQ ID NO: 3809131 - DNA, 16 bp, Homo sapiens
caaggacaacctgccc

SEQ ID NO: 3809132 - DNA, 20 bp, Homo sapiens
caaggacaacctgcccctcc

SEQ ID NO: 3809133 - DNA, 19 bp, Homo sapiens
caaggaccttacaggccct

SEQ ID NO: 3809134 - DNA, 18 bp, Homo sapiens
caaggagaaacagagaca

SEQ ID NO: 3809135 - DNA, 15 bp, Homo sapiens
caaggctgcagtgag

SEQ ID NO: 3809136 - DNA, 22 bp, Homo sapiens
caagggtaactcttggccagag

SEQ ID NO: 3809137 - DNA, 14 bp, Homo sapiens
caaggtctttggtt

SEQ ID NO: 3809138 - DNA, 23 bp, Homo sapiens
caaggtgggaggattgcttgagc

SEQ ID NO: 3809139 - DNA, 20 bp, Homo sapiens
caagtccttgacctctataa

SEQ ID NO: 3809140 - DNA, 14 bp, Homo sapiens
caagtctctctgtg

SEQ ID NO: 3809141 - DNA, 16 bp, Homo sapiens
caagtctctctgtgaa

SEQ ID NO: 3809142 - DNA, 18 bp, Homo sapiens
caagtctctctgtgaata

SEQ ID NO: 3809143 - DNA, 23 bp, Homo sapiens
caagtgaaaaaggaggaagagaa

SEQ ID NO: 3809144 - DNA, 19 bp, Homo sapiens
caagtgagaccctgtctca

SEQ ID NO: 3809145 - DNA, 23 bp, Homo sapiens
caagtgataattttatttataaa

SEQ ID NO: 3809146 - DNA, 22 bp, Homo sapiens
caagtgtggtagagtgtgcctg

SEQ ID NO: 3809147 - DNA, 11 bp, Homo sapiens
caataaagcag

SEQ ID NO: 3809148 - DNA, 16 bp, Homo sapiens
caataaagcagagcca

SEQ ID NO: 3809149 - DNA, 17 bp, Homo sapiens
caataaagcagagccaa

SEQ ID NO: 3809150 - DNA, 18 bp, Homo sapiens
caataaagcagagccaag

SEQ ID NO: 3809151 - DNA, 23 bp, Homo sapiens
caataaagctgctgagaatctag

SEQ ID NO: 3809152 - DNA, 22 bp, Homo sapiens
caataaaggagaagagatcatt

SEQ ID NO: 3809153 - DNA, 16 bp, Homo sapiens
caataaatgctgaatg

SEQ ID NO: 3809154 - DNA, 15 bp, Homo sapiens
caataaatttctgct

SEQ ID NO: 3809155 - DNA, 14 bp, Homo sapiens
caatattcaataaa

SEQ ID NO: 3809156 - DNA, 17 bp, Homo sapiens
caatattcgctgtgtca

SEQ ID NO: 3809157 - DNA, 17 bp, Homo sapiens
caatccataactttagt

SEQ ID NO: 3809158 - DNA, 21 bp, Homo sapiens
caatgatggcaattttgtaac

SEQ ID NO: 3809159 - DNA, 20 bp, Homo sapiens
caatggcacgatctcagctc

SEQ ID NO: 3809160 - DNA, 19 bp, Homo sapiens
caatgtgaaaagaaaaatg

SEQ ID NO: 3809161 - DNA, 17 bp, Homo sapiens
caatgtgataaaacccc

SEQ ID NO: 3809162 - DNA, 21 bp, Homo sapiens
caattcttctcgacttcagga

SEQ ID NO: 3809163 - DNA, 19 bp, Homo sapiens
caattttctggaatacatg

SEQ ID NO: 3809164 - DNA, 16 bp, Homo sapiens
caattttctttagctt

SEQ ID NO: 3809165 - DNA, 11 bp, Homo sapiens
caattttgtaa

SEQ ID NO: 3809166 - DNA, 17 bp, Homo sapiens
cacaaacgggctcagca

SEQ ID NO: 3809167 - DNA, 19 bp, Homo sapiens
cacaacctccacctcctgg

SEQ ID NO: 3809168 - DNA, 21 bp, Homo sapiens
cacacacagagatatgcacac

SEQ ID NO: 3809169 - DNA, 15 bp, Homo sapiens
cacacacggatgcac

SEQ ID NO: 3809170 - DNA, 24 bp, Homo sapiens
cacacacggatgcacacacagatg

SEQ ID NO: 3809171 - DNA, 22 bp, Homo sapiens
cacacagagatatgcacacaca

SEQ ID NO: 3809172 - DNA, 12 bp, Homo sapiens
cacacagaggaa

SEQ ID NO: 3809173 - DNA, 20 bp, Homo sapiens
cacacagatatgcacacaca

SEQ ID NO: 3809174 - DNA, 17 bp, Homo sapiens
cacacatggatgcacac

SEQ ID NO: 3809175 - DNA, 13 bp, Homo sapiens
cacaccccacacc

SEQ ID NO: 3809176 - DNA, 19 bp, Homo sapiens
cacaccccacaccccagcc

SEQ ID NO: 3809177 - DNA, 14 bp, Homo sapiens
cacacctccctgaa

SEQ ID NO: 3809178 - DNA, 16 bp, Homo sapiens
cacacctccctgaacc

SEQ ID NO: 3809179 - DNA, 22 bp, Homo sapiens
cacacggacactcaaaagctgg

SEQ ID NO: 3809180 - DNA, 18 bp, Homo sapiens
cacagatatacacatgga

SEQ ID NO: 3809181 - DNA, 20 bp, Homo sapiens
cacagatatacacatggatg

SEQ ID NO: 3809182 - DNA, 18 bp, Homo sapiens
cacagatatgcacacaca

SEQ ID NO: 3809183 - DNA, 22 bp, Homo sapiens
cacagatgcacacacagatgca

SEQ ID NO: 3809184 - DNA, 18 bp, Homo sapiens
cacagatggtcacacaga

SEQ ID NO: 3809185 - DNA, 16 bp, Homo sapiens
cacagcatctctatga

SEQ ID NO: 3809186 - DNA, 18 bp, Homo sapiens
cacagcccagacaagatg

SEQ ID NO: 3809187 - DNA, 13 bp, Homo sapiens
cacagcgcctcct

SEQ ID NO: 3809188 - DNA, 16 bp, Homo sapiens
cacaggcaaaatcctt

SEQ ID NO: 3809189 - DNA, 22 bp, Homo sapiens
cacaggggcaaagaactgcccc

SEQ ID NO: 3809190 - DNA, 20 bp, Homo sapiens
cacaggttttttcaatttat

SEQ ID NO: 3809191 - DNA, 20 bp, Homo sapiens
cacagttggcccgggtgcag

SEQ ID NO: 3809192 - DNA, 13 bp, Homo sapiens
cacataaaggtat

SEQ ID NO: 3809193 - DNA, 22 bp, Homo sapiens
cacataatgaggtccctctagc

SEQ ID NO: 3809194 - DNA, 18 bp, Homo sapiens
cacatccaggcaatggcc

SEQ ID NO: 3809195 - DNA, 19 bp, Homo sapiens
cacattttgtacaaagata

SEQ ID NO: 3809196 - DNA, 20 bp, Homo sapiens
cacattttgtacaaagatat

SEQ ID NO: 3809197 - DNA, 22 bp, Homo sapiens
caccaagttggaacatccttgg

SEQ ID NO: 3809198 - DNA, 16 bp, Homo sapiens
caccacattgcctcat

SEQ ID NO: 3809199 - DNA, 15 bp, Homo sapiens
caccagcagcctgga

SEQ ID NO: 3809200 - DNA, 17 bp, Homo sapiens
caccagccctgctgctt

SEQ ID NO: 3809201 - DNA, 21 bp, Homo sapiens
caccagccctgctgcttccta

SEQ ID NO: 3809202 - DNA, 16 bp, Homo sapiens
caccagccgccccagc

SEQ ID NO: 3809203 - DNA, 17 bp, Homo sapiens
caccagccgccccagcc

SEQ ID NO: 3809204 - DNA, 20 bp, Homo sapiens
caccagccgccccagcccct

SEQ ID NO: 3809205 - DNA, 17 bp, Homo sapiens
caccaggcagctccagc

SEQ ID NO: 3809206 - DNA, 12 bp, Homo sapiens
cacccactggcc

SEQ ID NO: 3809207 - DNA, 18 bp, Homo sapiens
cacccactggccagtcct

SEQ ID NO: 3809208 - DNA, 23 bp, Homo sapiens
cacccactggccagtcctagagc

SEQ ID NO: 3809209 - DNA, 15 bp, Homo sapiens
caccccacaccccag

SEQ ID NO: 3809210 - DNA, 16 bp, Homo sapiens
caccccacaccccagc

SEQ ID NO: 3809211 - DNA, 20 bp, Homo sapiens
caccccacaccccagcccac

SEQ ID NO: 3809212 - DNA, 12 bp, Homo sapiens
cacccccagctt

SEQ ID NO: 3809213 - DNA, 16 bp, Homo sapiens
caccctacctgtgcct

SEQ ID NO: 3809214 - DNA, 22 bp, Homo sapiens
caccctccaaacactgggctct

SEQ ID NO: 3809215 - DNA, 20 bp, Homo sapiens
caccctcgtggacacctgcc

SEQ ID NO: 3809216 - DNA, 23 bp, Homo sapiens
caccctcgtggacacctgccctg

SEQ ID NO: 3809217 - DNA, 16 bp, Homo sapiens
caccgatgcacacgca

SEQ ID NO: 3809218 - DNA, 19 bp, Homo sapiens
caccgtattagccaggatg

SEQ ID NO: 3809219 - DNA, 23 bp, Homo sapiens
cacctctcaatattcaataaagc

SEQ ID NO: 3809220 - DNA, 19 bp, Homo sapiens
cacctctgcacaagctgca

SEQ ID NO: 3809221 - DNA, 14 bp, Homo sapiens
cacctgccctgccc

SEQ ID NO: 3809222 - DNA, 21 bp, Homo sapiens
cacctgccctgccctgccacc

SEQ ID NO: 3809223 - DNA, 23 bp, Homo sapiens
cacctgccctgccctgccacctg

SEQ ID NO: 3809224 - DNA, 13 bp, Homo sapiens
caccttagctggc

SEQ ID NO: 3809225 - DNA, 23 bp, Homo sapiens
cacgcacatgccaatgcacgcac

SEQ ID NO: 3809226 - DNA, 12 bp, Homo sapiens
cacgcctgggtg

SEQ ID NO: 3809227 - DNA, 19 bp, Homo sapiens
cacgcctgtaatcctagca

SEQ ID NO: 3809228 - DNA, 13 bp, Homo sapiens
cacggcactccag

SEQ ID NO: 3809229 - DNA, 14 bp, Homo sapiens
cacggcactccagc

SEQ ID NO: 3809230 - DNA, 19 bp, Homo sapiens
cacggcactccagcctggg

SEQ ID NO: 3809231 - DNA, 14 bp, Homo sapiens
cacggccatgacca

SEQ ID NO: 3809232 - DNA, 22 bp, Homo sapiens
cacggctcctcgagatcccaac

SEQ ID NO: 3809233 - DNA, 20 bp, Homo sapiens
cactaagctttctcctttga

SEQ ID NO: 3809234 - DNA, 20 bp, Homo sapiens
cactacctttgtccaggcct

SEQ ID NO: 3809235 - DNA, 21 bp, Homo sapiens
cactacctttgtccaggcctg

SEQ ID NO: 3809236 - DNA, 22 bp, Homo sapiens
cactaggcaagtgtatattttg

SEQ ID NO: 3809237 - DNA, 18 bp, Homo sapiens
cactcaaaagctgggcag

SEQ ID NO: 3809238 - DNA, 18 bp, Homo sapiens
cactcacagggagctggc

SEQ ID NO: 3809239 - DNA, 12 bp, Homo sapiens
cactcagcagcc

SEQ ID NO: 3809240 - DNA, 13 bp, Homo sapiens
cactcagcagccc

SEQ ID NO: 3809241 - DNA, 15 bp, Homo sapiens
cactcatagggtgct

SEQ ID NO: 3809242 - DNA, 17 bp, Homo sapiens
cactcatagggtgctct

SEQ ID NO: 3809243 - DNA, 22 bp, Homo sapiens
cactccacataaggggtttagt

SEQ ID NO: 3809244 - DNA, 14 bp, Homo sapiens
cactccagcctggg

SEQ ID NO: 3809245 - DNA, 16 bp, Homo sapiens
cactccagcctgggtg

SEQ ID NO: 3809246 - DNA, 20 bp, Homo sapiens
cactctttgctacaataaat

SEQ ID NO: 3809247 - DNA, 21 bp, Homo sapiens
cactgaaggctttcagggcct

SEQ ID NO: 3809248 - DNA, 20 bp, Homo sapiens
cactgcaacttctacctccg

SEQ ID NO: 3809249 - DNA, 20 bp, Homo sapiens
cactgcactccagcctgggt

SEQ ID NO: 3809250 - DNA, 17 bp, Homo sapiens
cactgccatgccagctt

SEQ ID NO: 3809251 - DNA, 16 bp, Homo sapiens
cactgctctgccccca

SEQ ID NO: 3809252 - DNA, 16 bp, Homo sapiens
cactggaccactgggc

SEQ ID NO: 3809253 - DNA, 17 bp, Homo sapiens
cactggcatctccctga

SEQ ID NO: 3809254 - DNA, 12 bp, Homo sapiens
cactggccagtc

SEQ ID NO: 3809255 - DNA, 13 bp, Homo sapiens
cactggggcaggg

SEQ ID NO: 3809256 - DNA, 20 bp, Homo sapiens
cactggggtttgggggcttc

SEQ ID NO: 3809257 - DNA, 18 bp, Homo sapiens
cactggtgggcagctgag

SEQ ID NO: 3809258 - DNA, 12 bp, Homo sapiens
cactgtggcctt

SEQ ID NO: 3809259 - DNA, 23 bp, Homo sapiens
cacttcgggaggtcgaggcagga

SEQ ID NO: 3809260 - DNA, 13 bp, Homo sapiens
cacttgagtccag

SEQ ID NO: 3809261 - DNA, 17 bp, Homo sapiens
cactttgcacagctctc

SEQ ID NO: 3809262 - DNA, 12 bp, Homo sapiens
cactttgggagg

SEQ ID NO: 3809263 - DNA, 16 bp, Homo sapiens
cacttttcctccctca

SEQ ID NO: 3809264 - DNA, 20 bp, Homo sapiens
cagaaacaaaaacactaaaa

SEQ ID NO: 3809265 - DNA, 12 bp, Homo sapiens
cagaaacatgaa

SEQ ID NO: 3809266 - DNA, 20 bp, Homo sapiens
cagaaactcgatgaatgtgt

SEQ ID NO: 3809267 - DNA, 13 bp, Homo sapiens
cagaaggcaggga

SEQ ID NO: 3809268 - DNA, 14 bp, Homo sapiens
cagaaggctgggtc

SEQ ID NO: 3809269 - DNA, 23 bp, Homo sapiens
cagaagtttgagatcagcctggg

SEQ ID NO: 3809270 - DNA, 15 bp, Homo sapiens
cagaatataacatgt

SEQ ID NO: 3809271 - DNA, 21 bp, Homo sapiens
cagaattgcttgaacccagga

SEQ ID NO: 3809272 - DNA, 22 bp, Homo sapiens
cagaattgcttgaacccaggag

SEQ ID NO: 3809273 - DNA, 21 bp, Homo sapiens
cagaccaccagccgccccagc

SEQ ID NO: 3809274 - DNA, 16 bp, Homo sapiens
cagaccattgtcttcc

SEQ ID NO: 3809275 - DNA, 17 bp, Homo sapiens
cagaccattgtcttcca

SEQ ID NO: 3809276 - DNA, 18 bp, Homo sapiens
cagaccattgtcttccaa

SEQ ID NO: 3809277 - DNA, 24 bp, Homo sapiens
cagaccattgtcttccaaccccag

SEQ ID NO: 3809278 - DNA, 20 bp, Homo sapiens
cagacgtgagtgtgactttt

SEQ ID NO: 3809279 - DNA, 18 bp, Homo sapiens
cagactgcgatttgtccc

SEQ ID NO: 3809280 - DNA, 14 bp, Homo sapiens
cagactgcttccaa

SEQ ID NO: 3809281 - DNA, 17 bp, Homo sapiens
cagagaaaaagggaggg

SEQ ID NO: 3809282 - DNA, 22 bp, Homo sapiens
cagagaatttctaccatttcag

SEQ ID NO: 3809283 - DNA, 23 bp, Homo sapiens
cagagaatttctaccatttcaga

SEQ ID NO: 3809284 - DNA, 19 bp, Homo sapiens
cagagacagaaacagagag

SEQ ID NO: 3809285 - DNA, 22 bp, Homo sapiens
cagagacagaaacagagagaga

SEQ ID NO: 3809286 - DNA, 14 bp, Homo sapiens
cagagacaggccca

SEQ ID NO: 3809287 - DNA, 23 bp, Homo sapiens
cagagacaggcccaagagatgaa

SEQ ID NO: 3809288 - DNA, 13 bp, Homo sapiens
cagagagagacag

SEQ ID NO: 3809289 - DNA, 16 bp, Homo sapiens
cagagagagacagaga

SEQ ID NO: 3809290 - DNA, 14 bp, Homo sapiens
cagagcaaaataat

SEQ ID NO: 3809291 - DNA, 19 bp, Homo sapiens
cagagcaagactctgtctc

SEQ ID NO: 3809292 - DNA, 14 bp, Homo sapiens
cagagcaagtgaga

SEQ ID NO: 3809293 - DNA, 14 bp, Homo sapiens
cagagcagcactgg

SEQ ID NO: 3809294 - DNA, 15 bp, Homo sapiens
cagagcagcactggg

SEQ ID NO: 3809295 - DNA, 16 bp, Homo sapiens
cagagccccacacgga

SEQ ID NO: 3809296 - DNA, 23 bp, Homo sapiens
cagagccccacacggaggcatct

SEQ ID NO: 3809297 - DNA, 22 bp, Homo sapiens
cagagctgagtggcagccgcct

SEQ ID NO: 3809298 - DNA, 15 bp, Homo sapiens
cagaggaagagcagg

SEQ ID NO: 3809299 - DNA, 16 bp, Homo sapiens
cagaggaagagcaggc

SEQ ID NO: 3809300 - DNA, 23 bp, Homo sapiens
cagaggctagtctcttctcagag

SEQ ID NO: 3809301 - DNA, 17 bp, Homo sapiens
cagaggggcaggggagt

SEQ ID NO: 3809302 - DNA, 17 bp, Homo sapiens
cagagtcctcattataa

SEQ ID NO: 3809303 - DNA, 15 bp, Homo sapiens
cagataatccctgta

SEQ ID NO: 3809304 - DNA, 19 bp, Homo sapiens
cagatacttggggggctga

SEQ ID NO: 3809305 - DNA, 18 bp, Homo sapiens
cagatatacacatggatg

SEQ ID NO: 3809306 - DNA, 23 bp, Homo sapiens
cagatcattatcagcctgtgcca

SEQ ID NO: 3809307 - DNA, 12 bp, Homo sapiens
cagatcctaccc

SEQ ID NO: 3809308 - DNA, 14 bp, Homo sapiens
cagattcccagagc

SEQ ID NO: 3809309 - DNA, 17 bp, Homo sapiens
cagattcccagagcaaa

SEQ ID NO: 3809310 - DNA, 16 bp, Homo sapiens
cagatttactgtccca

SEQ ID NO: 3809311 - DNA, 22 bp, Homo sapiens
cagcaaaatgtgaatgggaaaa

SEQ ID NO: 3809312 - DNA, 17 bp, Homo sapiens
cagcaaagtgtcagtgt

SEQ ID NO: 3809313 - DNA, 18 bp, Homo sapiens
cagcaaagtgtcagtgtt

SEQ ID NO: 3809314 - DNA, 17 bp, Homo sapiens
cagcacgtgtggcctgt

SEQ ID NO: 3809315 - DNA, 16 bp, Homo sapiens
cagcagccccctgccc

SEQ ID NO: 3809316 - DNA, 22 bp, Homo sapiens
cagcagcctggaccctgtggat

SEQ ID NO: 3809317 - DNA, 19 bp, Homo sapiens
cagcatcccagccagggtt

SEQ ID NO: 3809318 - DNA, 18 bp, Homo sapiens
cagccaaagcctcctcca

SEQ ID NO: 3809319 - DNA, 21 bp, Homo sapiens
cagccaaagcctcctccagcc

SEQ ID NO: 3809320 - DNA, 15 bp, Homo sapiens
cagccaggactcctt

SEQ ID NO: 3809321 - DNA, 22 bp, Homo sapiens
cagccaggactccttagactga

SEQ ID NO: 3809322 - DNA, 16 bp, Homo sapiens
cagccccttctcccag

SEQ ID NO: 3809323 - DNA, 15 bp, Homo sapiens
cagccctgctgcttc

SEQ ID NO: 3809324 - DNA, 18 bp, Homo sapiens
cagccgccccagcccctt

SEQ ID NO: 3809325 - DNA, 18 bp, Homo sapiens
cagcctccaggcccccaa

SEQ ID NO: 3809326 - DNA, 21 bp, Homo sapiens
cagcctccatcctaccccctg

SEQ ID NO: 3809327 - DNA, 13 bp, Homo sapiens
cagcctcctgagt

SEQ ID NO: 3809328 - DNA, 16 bp, Homo sapiens
cagcctcctgagtagc

SEQ ID NO: 3809329 - DNA, 23 bp, Homo sapiens
cagcctctccactcatgtgactc

SEQ ID NO: 3809330 - DNA, 17 bp, Homo sapiens
cagcctctgaaaaccaa

SEQ ID NO: 3809331 - DNA, 22 bp, Homo sapiens
cagcctgccccagcctgcccca

SEQ ID NO: 3809332 - DNA, 23 bp, Homo sapiens
cagcctggctgtggcctaacctg

SEQ ID NO: 3809333 - DNA, 16 bp, Homo sapiens
cagcctgggcaatgtg

SEQ ID NO: 3809334 - DNA, 19 bp, Homo sapiens
cagcctgggcgacagagca

SEQ ID NO: 3809335 - DNA, 19 bp, Homo sapiens
cagctattagcaactgtgc

SEQ ID NO: 3809336 - DNA, 22 bp, Homo sapiens
cagctattcaggaggctgaggc

SEQ ID NO: 3809337 - DNA, 22 bp, Homo sapiens
cagctcaagtcttccctgatca

SEQ ID NO: 3809338 - DNA, 15 bp, Homo sapiens
cagctctactggtct

SEQ ID NO: 3809339 - DNA, 17 bp, Homo sapiens
cagctgccgaccagagc

SEQ ID NO: 3809340 - DNA, 14 bp, Homo sapiens
cagctggcctctag

SEQ ID NO: 3809341 - DNA, 13 bp, Homo sapiens
cagcttctcttga

SEQ ID NO: 3809342 - DNA, 21 bp, Homo sapiens
cagctttgtttgttgtcagct

SEQ ID NO: 3809343 - DNA, 16 bp, Homo sapiens
caggaaatcagagctg

SEQ ID NO: 3809344 - DNA, 17 bp, Homo sapiens
caggaaatcagagctgg

SEQ ID NO: 3809345 - DNA, 12 bp, Homo sapiens
caggaactgggc

SEQ ID NO: 3809346 - DNA, 13 bp, Homo sapiens
caggaactgggcc

SEQ ID NO: 3809347 - DNA, 13 bp, Homo sapiens
caggacctcaggt

SEQ ID NO: 3809348 - DNA, 18 bp, Homo sapiens
caggagagcttcccccaa

SEQ ID NO: 3809349 - DNA, 12 bp, Homo sapiens
caggagcctggc

SEQ ID NO: 3809350 - DNA, 20 bp, Homo sapiens
caggagctgacagagccaga

SEQ ID NO: 3809351 - DNA, 22 bp, Homo sapiens
caggagtttgagaccaacctgg

SEQ ID NO: 3809352 - DNA, 16 bp, Homo sapiens
caggatatccccaggg

SEQ ID NO: 3809353 - DNA, 23 bp, Homo sapiens
caggatggccgggcgcggtggct

SEQ ID NO: 3809354 - DNA, 14 bp, Homo sapiens
caggattcccagag

SEQ ID NO: 3809355 - DNA, 22 bp, Homo sapiens
caggcaacgcacaaaacagaaa

SEQ ID NO: 3809356 - DNA, 22 bp, Homo sapiens
caggcacccccaggattcccag

SEQ ID NO: 3809357 - DNA, 21 bp, Homo sapiens
caggcagatttactgtcccag

SEQ ID NO: 3809358 - DNA, 18 bp, Homo sapiens
caggcccaagagatgaag

SEQ ID NO: 3809359 - DNA, 15 bp, Homo sapiens
caggccccagcctcc

SEQ ID NO: 3809360 - DNA, 15 bp, Homo sapiens
caggcctgactctca

SEQ ID NO: 3809361 - DNA, 14 bp, Homo sapiens
caggcgcacaccac

SEQ ID NO: 3809362 - DNA, 15 bp, Homo sapiens
caggctcagagggtg

SEQ ID NO: 3809363 - DNA, 21 bp, Homo sapiens
caggctgggttgtcactgaga

SEQ ID NO: 3809364 - DNA, 23 bp, Homo sapiens
caggctgggttgtcactgagact

SEQ ID NO: 3809365 - DNA, 23 bp, Homo sapiens
caggctggtctcgaactcctgac

SEQ ID NO: 3809366 - DNA, 14 bp, Homo sapiens
cagggaaaggctct

SEQ ID NO: 3809367 - DNA, 11 bp, Homo sapiens
cagggacagaa

SEQ ID NO: 3809368 - DNA, 16 bp, Homo sapiens
cagggagggcttctgc

SEQ ID NO: 3809369 - DNA, 12 bp, Homo sapiens
cagggaggggac

SEQ ID NO: 3809370 - DNA, 21 bp, Homo sapiens
cagggaggggactatttatga

SEQ ID NO: 3809371 - DNA, 19 bp, Homo sapiens
cagggcatattaaaggctt

SEQ ID NO: 3809372 - DNA, 17 bp, Homo sapiens
cagggccccagaaggca

SEQ ID NO: 3809373 - DNA, 15 bp, Homo sapiens
caggggaccacacct

SEQ ID NO: 3809374 - DNA, 20 bp, Homo sapiens
caggggagggaaaagctaag

SEQ ID NO: 3809375 - DNA, 20 bp, Homo sapiens
cagggtattccagagtgggg

SEQ ID NO: 3809376 - DNA, 21 bp, Homo sapiens
cagggtattccagagtgggga

SEQ ID NO: 3809377 - DNA, 18 bp, Homo sapiens
cagggtgagttaaagaga

SEQ ID NO: 3809378 - DNA, 19 bp, Homo sapiens
caggtagggagctaaggaa

SEQ ID NO: 3809379 - DNA, 20 bp, Homo sapiens
caggtcctcagagaatttct

SEQ ID NO: 3809380 - DNA, 14 bp, Homo sapiens
caggtcttgcccaa

SEQ ID NO: 3809381 - DNA, 16 bp, Homo sapiens
caggtcttgcccaaag

SEQ ID NO: 3809382 - DNA, 13 bp, Homo sapiens
caggtgagaagca

SEQ ID NO: 3809383 - DNA, 15 bp, Homo sapiens
caggtgccactgacc

SEQ ID NO: 3809384 - DNA, 16 bp, Homo sapiens
caggtgccactgaccg

SEQ ID NO: 3809385 - DNA, 23 bp, Homo sapiens
caggtgtgagccaccgcgcccag

SEQ ID NO: 3809386 - DNA, 12 bp, Homo sapiens
caggtgttcttc

SEQ ID NO: 3809387 - DNA, 14 bp, Homo sapiens
caggttggtggggg

SEQ ID NO: 3809388 - DNA, 16 bp, Homo sapiens
caggtttaagctgtta

SEQ ID NO: 3809389 - DNA, 17 bp, Homo sapiens
cagtaatttgaggacaa

SEQ ID NO: 3809390 - DNA, 13 bp, Homo sapiens
cagtatctcaggg

SEQ ID NO: 3809391 - DNA, 22 bp, Homo sapiens
cagtatttttgttgtgttctgt

SEQ ID NO: 3809392 - DNA, 20 bp, Homo sapiens
cagtcaaagcggatgctggc

SEQ ID NO: 3809393 - DNA, 20 bp, Homo sapiens
cagtcctagagctcctgtcc

SEQ ID NO: 3809394 - DNA, 15 bp, Homo sapiens
cagtgcacacggatg

SEQ ID NO: 3809395 - DNA, 23 bp, Homo sapiens
cagtgcacacggatgcacagaga

SEQ ID NO: 3809396 - DNA, 23 bp, Homo sapiens
cagtgctgaccagacagcctccc

SEQ ID NO: 3809397 - DNA, 17 bp, Homo sapiens
cagtggcaagaatgaaa

SEQ ID NO: 3809398 - DNA, 15 bp, Homo sapiens
cagtggcccccactc

SEQ ID NO: 3809399 - DNA, 21 bp, Homo sapiens
cagtggcccccactcacaggg

SEQ ID NO: 3809400 - DNA, 20 bp, Homo sapiens
cagtgggaggacagagccgg

SEQ ID NO: 3809401 - DNA, 15 bp, Homo sapiens
cagtgtcagcactca

SEQ ID NO: 3809402 - DNA, 21 bp, Homo sapiens
cagttataagtagcaggccaa

SEQ ID NO: 3809403 - DNA, 14 bp, Homo sapiens
cagttcctgcagca

SEQ ID NO: 3809404 - DNA, 18 bp, Homo sapiens
cagttgaaaaacagctga

SEQ ID NO: 3809405 - DNA, 14 bp, Homo sapiens
cataaataaaatga

SEQ ID NO: 3809406 - DNA, 18 bp, Homo sapiens
cataatttcagttctagt

SEQ ID NO: 3809407 - DNA, 16 bp, Homo sapiens
catacagtttgcactt

SEQ ID NO: 3809408 - DNA, 23 bp, Homo sapiens
cataccagggtgagttaaagaga

SEQ ID NO: 3809409 - DNA, 22 bp, Homo sapiens
catagagatatgcacacacaga

SEQ ID NO: 3809410 - DNA, 14 bp, Homo sapiens
catatatgtatatg

SEQ ID NO: 3809411 - DNA, 18 bp, Homo sapiens
catatatgtatatgtata

SEQ ID NO: 3809412 - DNA, 13 bp, Homo sapiens
catattaaaggct

SEQ ID NO: 3809413 - DNA, 14 bp, Homo sapiens
catcaccatgcatg

SEQ ID NO: 3809414 - DNA, 19 bp, Homo sapiens
catcacttgtacaaaataa

SEQ ID NO: 3809415 - DNA, 13 bp, Homo sapiens
catcatgtttaca

SEQ ID NO: 3809416 - DNA, 22 bp, Homo sapiens
catccaaggagaaacagagaca

SEQ ID NO: 3809417 - DNA, 13 bp, Homo sapiens
catccagagtccc

SEQ ID NO: 3809418 - DNA, 17 bp, Homo sapiens
catccagagtccctgcc

SEQ ID NO: 3809419 - DNA, 20 bp, Homo sapiens
catccagagtccctgcctgg

SEQ ID NO: 3809420 - DNA, 21 bp, Homo sapiens
catccagagtccctgcctgga

SEQ ID NO: 3809421 - DNA, 19 bp, Homo sapiens
catccatgttccgagaaga

SEQ ID NO: 3809422 - DNA, 13 bp, Homo sapiens
catcccaggggac

SEQ ID NO: 3809423 - DNA, 14 bp, Homo sapiens
catcccctgtagag

SEQ ID NO: 3809424 - DNA, 21 bp, Homo sapiens
catcccctgtagagtgggagc

SEQ ID NO: 3809425 - DNA, 23 bp, Homo sapiens
catctccctgaccttctccaggg

SEQ ID NO: 3809426 - DNA, 20 bp, Homo sapiens
catctcctcccatggccttc

SEQ ID NO: 3809427 - DNA, 23 bp, Homo sapiens
catctcctcccatggccttccct

SEQ ID NO: 3809428 - DNA, 16 bp, Homo sapiens
catctctacaaaaagc

SEQ ID NO: 3809429 - DNA, 15 bp, Homo sapiens
catcttcacgcctgg

SEQ ID NO: 3809430 - DNA, 16 bp, Homo sapiens
catgaaaatcctacca

SEQ ID NO: 3809431 - DNA, 21 bp, Homo sapiens
catgaaaatcctaccaacctc

SEQ ID NO: 3809432 - DNA, 14 bp, Homo sapiens
catgaacacacatg

SEQ ID NO: 3809433 - DNA, 21 bp, Homo sapiens
catgaagctggaagcactgct

SEQ ID NO: 3809434 - DNA, 13 bp, Homo sapiens
catgacaactttt

SEQ ID NO: 3809435 - DNA, 19 bp, Homo sapiens
catgacaacttttaaagaa

SEQ ID NO: 3809436 - DNA, 24 bp, Homo sapiens
catgattaaccacttcagctgact

SEQ ID NO: 3809437 - DNA, 16 bp, Homo sapiens
catgattcatgccaat

SEQ ID NO: 3809438 - DNA, 18 bp, Homo sapiens
catgcacccctgatgttc

SEQ ID NO: 3809439 - DNA, 19 bp, Homo sapiens
catgcattctagtgcagaa

SEQ ID NO: 3809440 - DNA, 20 bp, Homo sapiens
catgccagcttatctcaggg

SEQ ID NO: 3809441 - DNA, 23 bp, Homo sapiens
catgcgtgggtggggagggaggt

SEQ ID NO: 3809442 - DNA, 16 bp, Homo sapiens
catgctatctctgtgt

SEQ ID NO: 3809443 - DNA, 16 bp, Homo sapiens
catgctcctggcccac

SEQ ID NO: 3809444 - DNA, 22 bp, Homo sapiens
catgctggctcccagggccatg

SEQ ID NO: 3809445 - DNA, 16 bp, Homo sapiens
catgctggtgtggcca

SEQ ID NO: 3809446 - DNA, 19 bp, Homo sapiens
catgcttcatgaaaatcct

SEQ ID NO: 3809447 - DNA, 15 bp, Homo sapiens
catggagagagactc

SEQ ID NO: 3809448 - DNA, 22 bp, Homo sapiens
catggaggagcttgggggatga

SEQ ID NO: 3809449 - DNA, 13 bp, Homo sapiens
catggatgcacac

SEQ ID NO: 3809450 - DNA, 15 bp, Homo sapiens
catggatgcacgcac

SEQ ID NO: 3809451 - DNA, 12 bp, Homo sapiens
catggccttccc

SEQ ID NO: 3809452 - DNA, 16 bp, Homo sapiens
catggctaactggcga

SEQ ID NO: 3809453 - DNA, 12 bp, Homo sapiens
catgggaagaac

SEQ ID NO: 3809454 - DNA, 21 bp, Homo sapiens
catgggagctggttagaaatg

SEQ ID NO: 3809455 - DNA, 14 bp, Homo sapiens
catgggagggaggg

SEQ ID NO: 3809456 - DNA, 23 bp, Homo sapiens
catgtaaaaaatgtaaaatggag

SEQ ID NO: 3809457 - DNA, 15 bp, Homo sapiens
catgtatcactcact

SEQ ID NO: 3809458 - DNA, 18 bp, Homo sapiens
catgtatcactcactgcc

SEQ ID NO: 3809459 - DNA, 14 bp, Homo sapiens
catgtgactctttc

SEQ ID NO: 3809460 - DNA, 16 bp, Homo sapiens
catgtgactctttcca

SEQ ID NO: 3809461 - DNA, 21 bp, Homo sapiens
cattaaagcctgagtttgctt

SEQ ID NO: 3809462 - DNA, 22 bp, Homo sapiens
cattacctcagtgagaagccag

SEQ ID NO: 3809463 - DNA, 16 bp, Homo sapiens
cattcaaaatgtccag

SEQ ID NO: 3809464 - DNA, 21 bp, Homo sapiens
cattcaaaatgtccagcttct

SEQ ID NO: 3809465 - DNA, 15 bp, Homo sapiens
cattcagcagtcagt

SEQ ID NO: 3809466 - DNA, 14 bp, Homo sapiens
cattccagaggaag

SEQ ID NO: 3809467 - DNA, 20 bp, Homo sapiens
cattcccactaagctttctc

SEQ ID NO: 3809468 - DNA, 23 bp, Homo sapiens
cattcccactaagctttctcctt

SEQ ID NO: 3809469 - DNA, 14 bp, Homo sapiens
cattctaattacaa

SEQ ID NO: 3809470 - DNA, 13 bp, Homo sapiens
cattctaatttgc

SEQ ID NO: 3809471 - DNA, 14 bp, Homo sapiens
cattctagtgcaga

SEQ ID NO: 3809472 - DNA, 15 bp, Homo sapiens
cattctcctgcctca

SEQ ID NO: 3809473 - DNA, 22 bp, Homo sapiens
cattctcctgcctcagcctcct

SEQ ID NO: 3809474 - DNA, 23 bp, Homo sapiens
cattctcctgcctcagcctcctg

SEQ ID NO: 3809475 - DNA, 21 bp, Homo sapiens
cattcttcctagttttctcct

SEQ ID NO: 3809476 - DNA, 19 bp, Homo sapiens
cattgtccctgaagagaag

SEQ ID NO: 3809477 - DNA, 15 bp, Homo sapiens
cattgtcttccaacc

SEQ ID NO: 3809478 - DNA, 16 bp, Homo sapiens
catttgttggaatgaa

SEQ ID NO: 3809479 - DNA, 18 bp, Homo sapiens
cattttgctaaatgtgaa

SEQ ID NO: 3809480 - DNA, 21 bp, Homo sapiens
cattttgctaaatgtgaatga

SEQ ID NO: 3809481 - DNA, 13 bp, Homo sapiens
cattttgtacaaa

SEQ ID NO: 3809482 - DNA, 18 bp, Homo sapiens
catttttgtacattatgt

SEQ ID NO: 3809483 - DNA, 22 bp, Homo sapiens
ccaaacactgggctctgaggag

SEQ ID NO: 3809484 - DNA, 17 bp, Homo sapiens
ccaaatcattgtatcaa

SEQ ID NO: 3809485 - DNA, 13 bp, Homo sapiens
ccaacactgccag

SEQ ID NO: 3809486 - DNA, 15 bp, Homo sapiens
ccaacactgccagca

SEQ ID NO: 3809487 - DNA, 21 bp, Homo sapiens
ccaactccgcccagcctctcc

SEQ ID NO: 3809488 - DNA, 15 bp, Homo sapiens
ccaagagagaaagaa

SEQ ID NO: 3809489 - DNA, 12 bp, Homo sapiens
ccaagagatgaa

SEQ ID NO: 3809490 - DNA, 19 bp, Homo sapiens
ccaagattcaaagagacta

SEQ ID NO: 3809491 - DNA, 19 bp, Homo sapiens
ccaagccttggctctaccc

SEQ ID NO: 3809492 - DNA, 14 bp, Homo sapiens
ccaaggagaaacag

SEQ ID NO: 3809493 - DNA, 15 bp, Homo sapiens
ccaaggagaaacaga

SEQ ID NO: 3809494 - DNA, 14 bp, Homo sapiens
ccaaggctggggga

SEQ ID NO: 3809495 - DNA, 22 bp, Homo sapiens
ccaagggtaactcttggccaga

SEQ ID NO: 3809496 - DNA, 21 bp, Homo sapiens
ccaagtaaccaggccccagcc

SEQ ID NO: 3809497 - DNA, 20 bp, Homo sapiens
ccaagtcaagtgaaaaagga

SEQ ID NO: 3809498 - DNA, 18 bp, Homo sapiens
ccaatacgtagatttttg

SEQ ID NO: 3809499 - DNA, 17 bp, Homo sapiens
ccaatatttaccagacc

SEQ ID NO: 3809500 - DNA, 14 bp, Homo sapiens
ccacaaatgctatt

SEQ ID NO: 3809501 - DNA, 22 bp, Homo sapiens
ccacaaatgggaaaaccagact

SEQ ID NO: 3809502 - DNA, 14 bp, Homo sapiens
ccacaccccagccc

SEQ ID NO: 3809503 - DNA, 16 bp, Homo sapiens
ccacaccctcactgct

SEQ ID NO: 3809504 - DNA, 14 bp, Homo sapiens
ccacacctccctga

SEQ ID NO: 3809505 - DNA, 21 bp, Homo sapiens
ccacagaaaggccactcagga

SEQ ID NO: 3809506 - DNA, 18 bp, Homo sapiens
ccacagtcctcacagcct

SEQ ID NO: 3809507 - DNA, 11 bp, Homo sapiens
ccacataaagg

SEQ ID NO: 3809508 - DNA, 21 bp, Homo sapiens
ccaccagccgccccagcccct

SEQ ID NO: 3809509 - DNA, 18 bp, Homo sapiens
ccaccccatccagttcat

SEQ ID NO: 3809510 - DNA, 17 bp, Homo sapiens
ccaccctcgtggacacc

SEQ ID NO: 3809511 - DNA, 21 bp, Homo sapiens
ccaccctcgtggacacctgcc

SEQ ID NO: 3809512 - DNA, 16 bp, Homo sapiens
ccaccctgaaagccct

SEQ ID NO: 3809513 - DNA, 22 bp, Homo sapiens
ccaccctgctcctcctgccctg

SEQ ID NO: 3809514 - DNA, 14 bp, Homo sapiens
ccaccgcgcccagc

SEQ ID NO: 3809515 - DNA, 23 bp, Homo sapiens
ccacctctccaagtctctctgtg

SEQ ID NO: 3809516 - DNA, 16 bp, Homo sapiens
ccacctgtctgtctgt

SEQ ID NO: 3809517 - DNA, 23 bp, Homo sapiens
ccacgtgctcgcctctgcccagc

SEQ ID NO: 3809518 - DNA, 11 bp, Homo sapiens
ccactcacagg

SEQ ID NO: 3809519 - DNA, 21 bp, Homo sapiens
ccactctttgctacaataaat

SEQ ID NO: 3809520 - DNA, 20 bp, Homo sapiens
ccactgcactccagcctggg

SEQ ID NO: 3809521 - DNA, 13 bp, Homo sapiens
ccactggccagtc

SEQ ID NO: 3809522 - DNA, 19 bp, Homo sapiens
ccactggccagtcctagag

SEQ ID NO: 3809523 - DNA, 15 bp, Homo sapiens
ccactgtgaagagaa

SEQ ID NO: 3809524 - DNA, 12 bp, Homo sapiens
ccacttccctgc

SEQ ID NO: 3809525 - DNA, 20 bp, Homo sapiens
ccactttgcacagctctccg

SEQ ID NO: 3809526 - DNA, 20 bp, Homo sapiens
ccagaaggctgggtccaggg

SEQ ID NO: 3809527 - DNA, 21 bp, Homo sapiens
ccagaaggctgggtccagggg

SEQ ID NO: 3809528 - DNA, 22 bp, Homo sapiens
ccagaattgcttgaacccagga

SEQ ID NO: 3809529 - DNA, 18 bp, Homo sapiens
ccagaccaccagccgccc

SEQ ID NO: 3809530 - DNA, 16 bp, Homo sapiens
ccagactacttgggag

SEQ ID NO: 3809531 - DNA, 20 bp, Homo sapiens
ccagagccactacctttgtc

SEQ ID NO: 3809532 - DNA, 18 bp, Homo sapiens
ccagagccccacacggag

SEQ ID NO: 3809533 - DNA, 19 bp, Homo sapiens
ccagagccccacacggagg

SEQ ID NO: 3809534 - DNA, 17 bp, Homo sapiens
ccagaggaaggaaaagg

SEQ ID NO: 3809535 - DNA, 23 bp, Homo sapiens
ccagatgggatgggctttctcag

SEQ ID NO: 3809536 - DNA, 21 bp, Homo sapiens
ccagatttgctaatttatcct

SEQ ID NO: 3809537 - DNA, 20 bp, Homo sapiens
ccagcagccctggcctgtgg

SEQ ID NO: 3809538 - DNA, 11 bp, Homo sapiens
ccagcagcctg

SEQ ID NO: 3809539 - DNA, 20 bp, Homo sapiens
ccagcagcctggaccctgtg

SEQ ID NO: 3809540 - DNA, 11 bp, Homo sapiens
ccagccaggac

SEQ ID NO: 3809541 - DNA, 21 bp, Homo sapiens
ccagccctgctgcttcctaac

SEQ ID NO: 3809542 - DNA, 18 bp, Homo sapiens
ccagccctttgcaggccc

SEQ ID NO: 3809543 - DNA, 22 bp, Homo sapiens
ccagccctttgcaggcccagca

SEQ ID NO: 3809544 - DNA, 17 bp, Homo sapiens
ccagccgccccagcccc

SEQ ID NO: 3809545 - DNA, 18 bp, Homo sapiens
ccagccgccccagcccct

SEQ ID NO: 3809546 - DNA, 23 bp, Homo sapiens
ccagcctctccccgctctggatc

SEQ ID NO: 3809547 - DNA, 21 bp, Homo sapiens
ccagcctgggcgacagagcaa

SEQ ID NO: 3809548 - DNA, 21 bp, Homo sapiens
ccagctattcaggaggctgag

SEQ ID NO: 3809549 - DNA, 18 bp, Homo sapiens
ccagctgccgaccagagc

SEQ ID NO: 3809550 - DNA, 17 bp, Homo sapiens
ccagctggcctctagaa

SEQ ID NO: 3809551 - DNA, 19 bp, Homo sapiens
ccagcttaaaggggctaga

SEQ ID NO: 3809552 - DNA, 19 bp, Homo sapiens
ccaggactccttagactga

SEQ ID NO: 3809553 - DNA, 20 bp, Homo sapiens
ccaggactccttagactgat

SEQ ID NO: 3809554 - DNA, 17 bp, Homo sapiens
ccaggattcccagagag

SEQ ID NO: 3809555 - DNA, 18 bp, Homo sapiens
ccaggattcccagagaga

SEQ ID NO: 3809556 - DNA, 19 bp, Homo sapiens
ccaggattcccagagagac

SEQ ID NO: 3809557 - DNA, 13 bp, Homo sapiens
ccaggcaatggcc

SEQ ID NO: 3809558 - DNA, 19 bp, Homo sapiens
ccaggcaatggcctaaact

SEQ ID NO: 3809559 - DNA, 15 bp, Homo sapiens
ccaggccccagcctc

SEQ ID NO: 3809560 - DNA, 15 bp, Homo sapiens
ccaggcccccaactc

SEQ ID NO: 3809561 - DNA, 19 bp, Homo sapiens
ccaggggaaaatcagcctg

SEQ ID NO: 3809562 - DNA, 20 bp, Homo sapiens
ccaggggaaaatcagcctgc

SEQ ID NO: 3809563 - DNA, 13 bp, Homo sapiens
ccaggggaccaca

SEQ ID NO: 3809564 - DNA, 18 bp, Homo sapiens
ccaggggaccacacctcc

SEQ ID NO: 3809565 - DNA, 17 bp, Homo sapiens
ccaggggagggaaaagc

SEQ ID NO: 3809566 - DNA, 20 bp, Homo sapiens
ccagtcaaagcggatgctgg

SEQ ID NO: 3809567 - DNA, 14 bp, Homo sapiens
ccagtcctagagct

SEQ ID NO: 3809568 - DNA, 15 bp, Homo sapiens
ccagtcctagagctc

SEQ ID NO: 3809569 - DNA, 17 bp, Homo sapiens
ccagtcctagagctcct

SEQ ID NO: 3809570 - DNA, 23 bp, Homo sapiens
ccagtcctagagctcctgtccct

SEQ ID NO: 3809571 - DNA, 18 bp, Homo sapiens
ccagtggaagaagaaaac

SEQ ID NO: 3809572 - DNA, 17 bp, Homo sapiens
ccagtgggaggacagag

SEQ ID NO: 3809573 - DNA, 21 bp, Homo sapiens
ccagtgggaggacagagccgg

SEQ ID NO: 3809574 - DNA, 23 bp, Homo sapiens
ccagtgggaggtgagaccacctc

SEQ ID NO: 3809575 - DNA, 13 bp, Homo sapiens
ccatcaccagaca

SEQ ID NO: 3809576 - DNA, 22 bp, Homo sapiens
ccatcatgtttacagaggacag

SEQ ID NO: 3809577 - DNA, 16 bp, Homo sapiens
ccatcccctgtagagt

SEQ ID NO: 3809578 - DNA, 23 bp, Homo sapiens
ccatctcaagcaagtttaatcaa

SEQ ID NO: 3809579 - DNA, 14 bp, Homo sapiens
ccatgaactttgtc

SEQ ID NO: 3809580 - DNA, 20 bp, Homo sapiens
ccatgaagctggaagcactg

SEQ ID NO: 3809581 - DNA, 23 bp, Homo sapiens
ccatgaagctggaagcactgctg

SEQ ID NO: 3809582 - DNA, 21 bp, Homo sapiens
ccatgattaaccacttcagct

SEQ ID NO: 3809583 - DNA, 12 bp, Homo sapiens
ccatggccttcc

SEQ ID NO: 3809584 - DNA, 15 bp, Homo sapiens
ccatggccttccctc

SEQ ID NO: 3809585 - DNA, 23 bp, Homo sapiens
ccatgggcgaccagggccatctc

SEQ ID NO: 3809586 - DNA, 13 bp, Homo sapiens
ccatgtgtgctgt

SEQ ID NO: 3809587 - DNA, 11 bp, Homo sapiens
ccattaaatag

SEQ ID NO: 3809588 - DNA, 16 bp, Homo sapiens
ccattctcctgcctca

SEQ ID NO: 3809589 - DNA, 16 bp, Homo sapiens
ccattctgaccatttc

SEQ ID NO: 3809590 - DNA, 17 bp, Homo sapiens
ccattctgaccatttca

SEQ ID NO: 3809591 - DNA, 19 bp, Homo sapiens
ccattcttcctagttttct

SEQ ID NO: 3809592 - DNA, 20 bp, Homo sapiens
ccattctttcccaacacctc

SEQ ID NO: 3809593 - DNA, 16 bp, Homo sapiens
ccattgtcttccaacc

SEQ ID NO: 3809594 - DNA, 22 bp, Homo sapiens
ccattgtcttccaaccccagct

SEQ ID NO: 3809595 - DNA, 23 bp, Homo sapiens
ccattgtcttccaaccccagctg

SEQ ID NO: 3809596 - DNA, 13 bp, Homo sapiens
ccatttcagagag

SEQ ID NO: 3809597 - DNA, 13 bp, Homo sapiens
cccaacacctctt

SEQ ID NO: 3809598 - DNA, 16 bp, Homo sapiens
cccaacactgccagca

SEQ ID NO: 3809599 - DNA, 18 bp, Homo sapiens
cccaagatgagctgcagc

SEQ ID NO: 3809600 - DNA, 16 bp, Homo sapiens
cccaagggcctcccac

SEQ ID NO: 3809601 - DNA, 19 bp, Homo sapiens
cccaagggcctcccaccag

SEQ ID NO: 3809602 - DNA, 15 bp, Homo sapiens
cccacaccccagccc

SEQ ID NO: 3809603 - DNA, 17 bp, Homo sapiens
cccacaccccagcccac

SEQ ID NO: 3809604 - DNA, 20 bp, Homo sapiens
cccacctgcacgtgatctgc

SEQ ID NO: 3809605 - DNA, 20 bp, Homo sapiens
cccacgactgcccggcaggg

SEQ ID NO: 3809606 - DNA, 21 bp, Homo sapiens
cccacgactgcccggcagggt

SEQ ID NO: 3809607 - DNA, 22 bp, Homo sapiens
cccacggaaaatgccaatctct

SEQ ID NO: 3809608 - DNA, 16 bp, Homo sapiens
cccactaagctttctc

SEQ ID NO: 3809609 - DNA, 13 bp, Homo sapiens
cccactgccgcct

SEQ ID NO: 3809610 - DNA, 17 bp, Homo sapiens
cccactggccagtccta

SEQ ID NO: 3809611 - DNA, 23 bp, Homo sapiens
cccagaaggcagggaaaggctct

SEQ ID NO: 3809612 - DNA, 18 bp, Homo sapiens
cccagaatgcctcctgca

SEQ ID NO: 3809613 - DNA, 13 bp, Homo sapiens
cccagacctctga

SEQ ID NO: 3809614 - DNA, 21 bp, Homo sapiens
cccagattgataagtaatgaa

SEQ ID NO: 3809615 - DNA, 18 bp, Homo sapiens
cccagcacttgtgttgtc

SEQ ID NO: 3809616 - DNA, 15 bp, Homo sapiens
cccagccccttctcc

SEQ ID NO: 3809617 - DNA, 15 bp, Homo sapiens
cccagcctgccccag

SEQ ID NO: 3809618 - DNA, 21 bp, Homo sapiens
cccagcctgccccagcctccc

SEQ ID NO: 3809619 - DNA, 21 bp, Homo sapiens
cccagctatggttctctcgca

SEQ ID NO: 3809620 - DNA, 16 bp, Homo sapiens
cccagctggcctctag

SEQ ID NO: 3809621 - DNA, 15 bp, Homo sapiens
cccaggagacagttc

SEQ ID NO: 3809622 - DNA, 17 bp, Homo sapiens
cccaggagacagttcaa

SEQ ID NO: 3809623 - DNA, 14 bp, Homo sapiens
cccaggattcccag

SEQ ID NO: 3809624 - DNA, 15 bp, Homo sapiens
cccaggattcccaga

SEQ ID NO: 3809625 - DNA, 19 bp, Homo sapiens
cccaggctagagtgcagtg

SEQ ID NO: 3809626 - DNA, 19 bp, Homo sapiens
cccaggctggagtgcaatg

SEQ ID NO: 3809627 - DNA, 21 bp, Homo sapiens
cccatccagttcatgagaatc

SEQ ID NO: 3809628 - DNA, 15 bp, Homo sapiens
cccatctcctcccat

SEQ ID NO: 3809629 - DNA, 20 bp, Homo sapiens
cccatctcctcccatggcct

SEQ ID NO: 3809630 - DNA, 19 bp, Homo sapiens
cccatctctacaaaaagca

SEQ ID NO: 3809631 - DNA, 14 bp, Homo sapiens
cccatgagctcctt

SEQ ID NO: 3809632 - DNA, 15 bp, Homo sapiens
cccatgagctcctta

SEQ ID NO: 3809633 - DNA, 22 bp, Homo sapiens
cccatgagctccttaaggctct

SEQ ID NO: 3809634 - DNA, 15 bp, Homo sapiens
cccatggtgtatgtg

SEQ ID NO: 3809635 - DNA, 21 bp, Homo sapiens
cccattctgcctccattctga

SEQ ID NO: 3809636 - DNA, 20 bp, Homo sapiens
ccccaacgaaaagcacatcc

SEQ ID NO: 3809637 - DNA, 16 bp, Homo sapiens
ccccaagctgttttct

SEQ ID NO: 3809638 - DNA, 17 bp, Homo sapiens
ccccaagctgttttctt

SEQ ID NO: 3809639 - DNA, 16 bp, Homo sapiens
ccccacaccccagccc

SEQ ID NO: 3809640 - DNA, 17 bp, Homo sapiens
ccccacaccccagccca

SEQ ID NO: 3809641 - DNA, 18 bp, Homo sapiens
ccccacaccccagcccac

SEQ ID NO: 3809642 - DNA, 18 bp, Homo sapiens
ccccactgccgcctcctt

SEQ ID NO: 3809643 - DNA, 13 bp, Homo sapiens
ccccagacctctg

SEQ ID NO: 3809644 - DNA, 22 bp, Homo sapiens
ccccagagagagctctgcacgt

SEQ ID NO: 3809645 - DNA, 22 bp, Homo sapiens
ccccagagccactacctttgtc

SEQ ID NO: 3809646 - DNA, 18 bp, Homo sapiens
acagagttggtgttcata

SEQ ID NO: 3809647 - DNA, 18 bp, Homo sapiens
acagatgatacttccaag

SEQ ID NO: 3809648 - DNA, 13 bp, Homo sapiens
acagcctctccct

SEQ ID NO: 3809649 - DNA, 18 bp, Homo sapiens
acagcctgggaccagggc

SEQ ID NO: 3809650 - DNA, 13 bp, Homo sapiens
acagcgcctcctg

SEQ ID NO: 3809651 - DNA, 15 bp, Homo sapiens
acagcgcctcctgga

SEQ ID NO: 3809652 - DNA, 13 bp, Homo sapiens
acagctctagaca

SEQ ID NO: 3809653 - DNA, 15 bp, Homo sapiens
acaggtcttgcccaa

SEQ ID NO: 3809654 - DNA, 19 bp, Homo sapiens
acagtcctcacagcctctc

SEQ ID NO: 3809655 - DNA, 21 bp, Homo sapiens
acagtcctcacagcctctccc

SEQ ID NO: 3809656 - DNA, 19 bp, Homo sapiens
acagtgttgaaaatgttca

SEQ ID NO: 3809657 - DNA, 21 bp, Homo sapiens
acagtgttgaaaatgttcaga

SEQ ID NO: 3809658 - DNA, 21 bp, Homo sapiens
acagtgtttcctgagtagcag

SEQ ID NO: 3809659 - DNA, 12 bp, Homo sapiens
acagttcaagaa

SEQ ID NO: 3809660 - DNA, 16 bp, Homo sapiens
acagttgaaaaacagc

SEQ ID NO: 3809661 - DNA, 20 bp, Homo sapiens
acagttgaaaaacagctgag

SEQ ID NO: 3809662 - DNA, 13 bp, Homo sapiens
acatatatgtata

SEQ ID NO: 3809663 - DNA, 17 bp, Homo sapiens
acatatatgtatatgta

SEQ ID NO: 3809664 - DNA, 18 bp, Homo sapiens
acatcacctaacagaata

SEQ ID NO: 3809665 - DNA, 13 bp, Homo sapiens
acatccaaggaga

SEQ ID NO: 3809666 - DNA, 22 bp, Homo sapiens
acatccaaggagaaacagagac

SEQ ID NO: 3809667 - DNA, 13 bp, Homo sapiens
acatgattttctt

SEQ ID NO: 3809668 - DNA, 21 bp, Homo sapiens
acatgcttcatgaaaatccta

SEQ ID NO: 3809669 - DNA, 14 bp, Homo sapiens
acatggatgcacac

SEQ ID NO: 3809670 - DNA, 17 bp, Homo sapiens
acatgtatcactcactg

SEQ ID NO: 3809671 - DNA, 21 bp, Homo sapiens
acattaaaatagcacatgatt

SEQ ID NO: 3809672 - DNA, 15 bp, Homo sapiens
acattatattcctct

SEQ ID NO: 3809673 - DNA, 15 bp, Homo sapiens
acattgaaagctcta

SEQ ID NO: 3809674 - DNA, 22 bp, Homo sapiens
acattgaattagaaacataaat

SEQ ID NO: 3809675 - DNA, 11 bp, Homo sapiens
acattgcctca

SEQ ID NO: 3809676 - DNA, 13 bp, Homo sapiens
acattgcctcatt

SEQ ID NO: 3809677 - DNA, 20 bp, Homo sapiens
accaaagcaccttagctggc

SEQ ID NO: 3809678 - DNA, 17 bp, Homo sapiens
accaaatcattgtatca

SEQ ID NO: 3809679 - DNA, 16 bp, Homo sapiens
accaaattagcaggtg

SEQ ID NO: 3809680 - DNA, 20 bp, Homo sapiens
accaagagagaaagaagtag

SEQ ID NO: 3809681 - DNA, 23 bp, Homo sapiens
accaagtaaccaggccccagcct

SEQ ID NO: 3809682 - DNA, 15 bp, Homo sapiens
accaatgttctctct

SEQ ID NO: 3809683 - DNA, 14 bp, Homo sapiens
accacaacctccac

SEQ ID NO: 3809684 - DNA, 15 bp, Homo sapiens
accacctctcaatat

SEQ ID NO: 3809685 - DNA, 23 bp, Homo sapiens
accacctctcaatattcaataaa

SEQ ID NO: 3809686 - DNA, 21 bp, Homo sapiens
accactagggtcctggccctc

SEQ ID NO: 3809687 - DNA, 20 bp, Homo sapiens
accactgcactccagcctgg

SEQ ID NO: 3809688 - DNA, 21 bp, Homo sapiens
accactgcactccagcctggg

SEQ ID NO: 3809689 - DNA, 13 bp, Homo sapiens
accacttcagctg

SEQ ID NO: 3809690 - DNA, 18 bp, Homo sapiens
accagagaaaaagggagg

SEQ ID NO: 3809691 - DNA, 14 bp, Homo sapiens
accagagccccaca

SEQ ID NO: 3809692 - DNA, 17 bp, Homo sapiens
accagagccccacacgg

SEQ ID NO: 3809693 - DNA, 13 bp, Homo sapiens
accagcagcctgg

SEQ ID NO: 3809694 - DNA, 17 bp, Homo sapiens
accagccgccccagccc

SEQ ID NO: 3809695 - DNA, 17 bp, Homo sapiens
accaggcagctccagct

SEQ ID NO: 3809696 - DNA, 21 bp, Homo sapiens
accaggccccagcctccaggc

SEQ ID NO: 3809697 - DNA, 18 bp, Homo sapiens
accagggcagtgaaaatg

SEQ ID NO: 3809698 - DNA, 18 bp, Homo sapiens
accagtaattgtgaaaat

SEQ ID NO: 3809699 - DNA, 13 bp, Homo sapiens
accattgtcttcc

SEQ ID NO: 3809700 - DNA, 14 bp, Homo sapiens
accattgtcttcca

SEQ ID NO: 3809701 - DNA, 18 bp, Homo sapiens
accattgtcttccaaccc

SEQ ID NO: 3809702 - DNA, 20 bp, Homo sapiens
accatttcagagaggccttt

SEQ ID NO: 3809703 - DNA, 18 bp, Homo sapiens
acccaaagaggtatttat

SEQ ID NO: 3809704 - DNA, 14 bp, Homo sapiens
acccactggccagt

SEQ ID NO: 3809705 - DNA, 15 bp, Homo sapiens
accccagacctctga

SEQ ID NO: 3809706 - DNA, 12 bp, Homo sapiens
accccagcccac

SEQ ID NO: 3809707 - DNA, 14 bp, Homo sapiens
accccagctggcct

SEQ ID NO: 3809708 - DNA, 14 bp, Homo sapiens
acccccagctttgc

SEQ ID NO: 3809709 - DNA, 19 bp, Homo sapiens
acccccaggattcccagag

SEQ ID NO: 3809710 - DNA, 13 bp, Homo sapiens
accccctgtgcct

SEQ ID NO: 3809711 - DNA, 12 bp, Homo sapiens
accccgactttt

SEQ ID NO: 3809712 - DNA, 16 bp, Homo sapiens
acccctacatgaaaca

SEQ ID NO: 3809713 - DNA, 15 bp, Homo sapiens
acccctcgactcagc

SEQ ID NO: 3809714 - DNA, 19 bp, Homo sapiens
acccctcgactcagcacca

SEQ ID NO: 3809715 - DNA, 22 bp, Homo sapiens
acccggctgggtcggccctgcc

SEQ ID NO: 3809716 - DNA, 13 bp, Homo sapiens
accctattgctgc

SEQ ID NO: 3809717 - DNA, 15 bp, Homo sapiens
accctcaggcaggtg

SEQ ID NO: 3809718 - DNA, 13 bp, Homo sapiens
accctcatctttc

SEQ ID NO: 3809719 - DNA, 14 bp, Homo sapiens
accctccaaacact

SEQ ID NO: 3809720 - DNA, 18 bp, Homo sapiens
accctccaaacactgggc

SEQ ID NO: 3809721 - DNA, 22 bp, Homo sapiens
accctcgtggacacctgccctg

SEQ ID NO: 3809722 - DNA, 14 bp, Homo sapiens
accctcttagaaaa

SEQ ID NO: 3809723 - DNA, 18 bp, Homo sapiens
accctgctcctcctgccc

SEQ ID NO: 3809724 - DNA, 14 bp, Homo sapiens
acccttatgactcc

SEQ ID NO: 3809725 - DNA, 15 bp, Homo sapiens
acccttggtagagtt

SEQ ID NO: 3809726 - DNA, 16 bp, Homo sapiens
acccttggtagagttt

SEQ ID NO: 3809727 - DNA, 18 bp, Homo sapiens
acccttggtagagtttat

SEQ ID NO: 3809728 - DNA, 16 bp, Homo sapiens
accgggatccagttcc

SEQ ID NO: 3809729 - DNA, 13 bp, Homo sapiens
accggggcctggg

SEQ ID NO: 3809730 - DNA, 19 bp, Homo sapiens
accggggcctgggcaggag

SEQ ID NO: 3809731 - DNA, 12 bp, Homo sapiens
acctaggctagg

SEQ ID NO: 3809732 - DNA, 17 bp, Homo sapiens
acctaggctagggtggg

SEQ ID NO: 3809733 - DNA, 18 bp, Homo sapiens
acctcagttcattgtggt

SEQ ID NO: 3809734 - DNA, 14 bp, Homo sapiens
acctccctgaacca

SEQ ID NO: 3809735 - DNA, 13 bp, Homo sapiens
acctcctggtggt

SEQ ID NO: 3809736 - DNA, 17 bp, Homo sapiens
acctcggtgccttcctc

SEQ ID NO: 3809737 - DNA, 19 bp, Homo sapiens
acctcggtgccttcctctt

SEQ ID NO: 3809738 - DNA, 12 bp, Homo sapiens
acctctcaatat

SEQ ID NO: 3809739 - DNA, 19 bp, Homo sapiens
acctctcaatattcaataa

SEQ ID NO: 3809740 - DNA, 16 bp, Homo sapiens
acctctccaagtctct

SEQ ID NO: 3809741 - DNA, 18 bp, Homo sapiens
acctctccaagtctctct

SEQ ID NO: 3809742 - DNA, 22 bp, Homo sapiens
acctctccaagtctctctgtga

SEQ ID NO: 3809743 - DNA, 20 bp, Homo sapiens
acctctcctttggccattcc

SEQ ID NO: 3809744 - DNA, 15 bp, Homo sapiens
acctctgaatgtccc

SEQ ID NO: 3809745 - DNA, 19 bp, Homo sapiens
acctctgaatgtcccagag

SEQ ID NO: 3809746 - DNA, 18 bp, Homo sapiens
acctctgcacaagctgca

SEQ ID NO: 3809747 - DNA, 20 bp, Homo sapiens
acctgcaccgccccttctcc

SEQ ID NO: 3809748 - DNA, 21 bp, Homo sapiens
acctgccctgccctgccacct

SEQ ID NO: 3809749 - DNA, 19 bp, Homo sapiens
acctgcctgttctccagat

SEQ ID NO: 3809750 - DNA, 19 bp, Homo sapiens
acctggtactgcacatttt

SEQ ID NO: 3809751 - DNA, 12 bp, Homo sapiens
acctgtctgtct

SEQ ID NO: 3809752 - DNA, 20 bp, Homo sapiens
acctgtctgtctgtctgtcc

SEQ ID NO: 3809753 - DNA, 12 bp, Homo sapiens
acctgtgtctta

SEQ ID NO: 3809754 - DNA, 21 bp, Homo sapiens
accttagctggcattacagct

SEQ ID NO: 3809755 - DNA, 16 bp, Homo sapiens
ccagctggcctctaga

SEQ ID NO: 3809756 - DNA, 17 bp, Homo sapiens
ccagctgttcagctggt

SEQ ID NO: 3809757 - DNA, 16 bp, Homo sapiens
ccagcttatctcaggg

SEQ ID NO: 3809758 - DNA, 14 bp, Homo sapiens
ccaggaactgggcc

SEQ ID NO: 3809759 - DNA, 18 bp, Homo sapiens
ccaggagcaaatgctgga

SEQ ID NO: 3809760 - DNA, 23 bp, Homo sapiens
ccaggatggtcttgatctcctga

SEQ ID NO: 3809761 - DNA, 15 bp, Homo sapiens
ccaggattcccagag

SEQ ID NO: 3809762 - DNA, 20 bp, Homo sapiens
ccaggattcccagagagacg

SEQ ID NO: 3809763 - DNA, 23 bp, Homo sapiens
ccaggcaatggcctaaacttcag

SEQ ID NO: 3809764 - DNA, 16 bp, Homo sapiens
ccaggcagctccagct

SEQ ID NO: 3809765 - DNA, 17 bp, Homo sapiens
ccaggccccagcctcca

SEQ ID NO: 3809766 - DNA, 21 bp, Homo sapiens
ccaggccctaggattcctccc

SEQ ID NO: 3809767 - DNA, 19 bp, Homo sapiens
ccagggtgagttaaagaga

SEQ ID NO: 3809768 - DNA, 16 bp, Homo sapiens
ccaggtgcctggccct

SEQ ID NO: 3809769 - DNA, 21 bp, Homo sapiens
ccagtcctagagctcctgtcc

SEQ ID NO: 3809770 - DNA, 18 bp, Homo sapiens
ccagtcctccagaccacc

SEQ ID NO: 3809771 - DNA, 19 bp, Homo sapiens
ccagtcctccagaccacca

SEQ ID NO: 3809772 - DNA, 14 bp, Homo sapiens
ccataccagggtga

SEQ ID NO: 3809773 - DNA, 20 bp, Homo sapiens
ccatcatgtttacagaggac

SEQ ID NO: 3809774 - DNA, 17 bp, Homo sapiens
ccatcctaccccctgtg

SEQ ID NO: 3809775 - DNA, 18 bp, Homo sapiens
ccatctctgattttcaaa

SEQ ID NO: 3809776 - DNA, 23 bp, Homo sapiens
ccatctctgattttcaaagcttt

SEQ ID NO: 3809777 - DNA, 21 bp, Homo sapiens
ccatgaagctggaagcactgc

SEQ ID NO: 3809778 - DNA, 19 bp, Homo sapiens
ccatgattaaccacttcag

SEQ ID NO: 3809779 - DNA, 19 bp, Homo sapiens
ccatgcacccctgatgttc

SEQ ID NO: 3809780 - DNA, 13 bp, Homo sapiens
ccatgctcctggc

SEQ ID NO: 3809781 - DNA, 22 bp, Homo sapiens
ccatgggagctggttagaaatg

SEQ ID NO: 3809782 - DNA, 19 bp, Homo sapiens
ccatgggcgaccagggcca

SEQ ID NO: 3809783 - DNA, 14 bp, Homo sapiens
ccatggtgtatgtg

SEQ ID NO: 3809784 - DNA, 18 bp, Homo sapiens
ccatgttttgtttacggt

SEQ ID NO: 3809785 - DNA, 23 bp, Homo sapiens
ccattctcctgcctcagcctcct

SEQ ID NO: 3809786 - DNA, 20 bp, Homo sapiens
ccattcttcctagttttctc

SEQ ID NO: 3809787 - DNA, 14 bp, Homo sapiens
ccattctttcccaa

SEQ ID NO: 3809788 - DNA, 13 bp, Homo sapiens
ccattggtgttga

SEQ ID NO: 3809789 - DNA, 13 bp, Homo sapiens
ccattgtcttcca

SEQ ID NO: 3809790 - DNA, 14 bp, Homo sapiens
ccattgtcttccaa

SEQ ID NO: 3809791 - DNA, 20 bp, Homo sapiens
ccatttgccagattgcccca

SEQ ID NO: 3809792 - DNA, 14 bp, Homo sapiens
cccaacactgccag

SEQ ID NO: 3809793 - DNA, 15 bp, Homo sapiens
cccaacgaaaagcac

SEQ ID NO: 3809794 - DNA, 15 bp, Homo sapiens
cccaactcccggagg

SEQ ID NO: 3809795 - DNA, 20 bp, Homo sapiens
cccaactgatttttgtattt

SEQ ID NO: 3809796 - DNA, 22 bp, Homo sapiens
cccaaggaccttacaggccctc

SEQ ID NO: 3809797 - DNA, 16 bp, Homo sapiens
cccacaccccagccca

SEQ ID NO: 3809798 - DNA, 21 bp, Homo sapiens
cccacagtcctcacagcctct

SEQ ID NO: 3809799 - DNA, 23 bp, Homo sapiens
cccaccctcgtggacacctgccc

SEQ ID NO: 3809800 - DNA, 22 bp, Homo sapiens
cccaccctgctcctcctgccct

SEQ ID NO: 3809801 - DNA, 16 bp, Homo sapiens
cccactggccagtcct

SEQ ID NO: 3809802 - DNA, 22 bp, Homo sapiens
cccactggccagtcctagagct

SEQ ID NO: 3809803 - DNA, 13 bp, Homo sapiens
cccagaaggcagg

SEQ ID NO: 3809804 - DNA, 22 bp, Homo sapiens
cccagaaggctgggtccagggg

SEQ ID NO: 3809805 - DNA, 18 bp, Homo sapiens
cccagattgataagtaat

SEQ ID NO: 3809806 - DNA, 21 bp, Homo sapiens
cccagcagccctggcctgtgg

SEQ ID NO: 3809807 - DNA, 19 bp, Homo sapiens
cccagcccaccctgctcct

SEQ ID NO: 3809808 - DNA, 18 bp, Homo sapiens
cccagccccttctcccag

SEQ ID NO: 3809809 - DNA, 19 bp, Homo sapiens
cccagcctcccagctttct

SEQ ID NO: 3809810 - DNA, 13 bp, Homo sapiens
cccagcctgagtg

SEQ ID NO: 3809811 - DNA, 16 bp, Homo sapiens
cccagcctgccccagc

SEQ ID NO: 3809812 - DNA, 11 bp, Homo sapiens
cccagctggcc

SEQ ID NO: 3809813 - DNA, 12 bp, Homo sapiens
cccagctggcct

SEQ ID NO: 3809814 - DNA, 16 bp, Homo sapiens
cccagctttctgtgtg

SEQ ID NO: 3809815 - DNA, 20 bp, Homo sapiens
cccagctttctgtgtgcaca

SEQ ID NO: 3809816 - DNA, 23 bp, Homo sapiens
cccaggaggtggaggttgcagtg

SEQ ID NO: 3809817 - DNA, 19 bp, Homo sapiens
cccaggctggagtgcagtg

SEQ ID NO: 3809818 - DNA, 17 bp, Homo sapiens
cccaggggaccacacct

SEQ ID NO: 3809819 - DNA, 17 bp, Homo sapiens
cccagtgccgagaagga

SEQ ID NO: 3809820 - DNA, 14 bp, Homo sapiens
cccatccagttcat

SEQ ID NO: 3809821 - DNA, 20 bp, Homo sapiens
cccatggccttccctcccca

SEQ ID NO: 3809822 - DNA, 19 bp, Homo sapiens
cccatggtgtatgtggttt

SEQ ID NO: 3809823 - DNA, 20 bp, Homo sapiens
cccatggtgtatgtggtttt

SEQ ID NO: 3809824 - DNA, 21 bp, Homo sapiens
cccattcttcctagttttctc

SEQ ID NO: 3809825 - DNA, 17 bp, Homo sapiens
ccccaaaagtacttacc

SEQ ID NO: 3809826 - DNA, 14 bp, Homo sapiens
ccccaagctgtttt

SEQ ID NO: 3809827 - DNA, 19 bp, Homo sapiens
ccccacaccccagcccacc

SEQ ID NO: 3809828 - DNA, 13 bp, Homo sapiens
ccccacctctcca

SEQ ID NO: 3809829 - DNA, 15 bp, Homo sapiens
ccccagagccactac

SEQ ID NO: 3809830 - DNA, 23 bp, Homo sapiens
ccccagcctgccccagcctccca

SEQ ID NO: 3809831 - DNA, 11 bp, Homo sapiens
ccccagctggc

SEQ ID NO: 3809832 - DNA, 23 bp, Homo sapiens
ccccagctggcctctagaacacc

SEQ ID NO: 3809833 - DNA, 22 bp, Homo sapiens
ccccaggtggttatggagaggg

SEQ ID NO: 3809834 - DNA, 16 bp, Homo sapiens
ccccattcttcctagt

SEQ ID NO: 3809835 - DNA, 16 bp, Homo sapiens
cccccaggattcccag

SEQ ID NO: 3809836 - DNA, 14 bp, Homo sapiens
ccccgacttttgtt

SEQ ID NO: 3809837 - DNA, 21 bp, Homo sapiens
ccccgcgtggaactcgtgtct

SEQ ID NO: 3809838 - DNA, 15 bp, Homo sapiens
cccctcaacacctct

SEQ ID NO: 3809839 - DNA, 16 bp, Homo sapiens
cccctcgactcagcac

SEQ ID NO: 3809840 - DNA, 14 bp, Homo sapiens
cccgaccccatctc

SEQ ID NO: 3809841 - DNA, 16 bp, Homo sapiens
cccggcagggtcctag

SEQ ID NO: 3809842 - DNA, 18 bp, Homo sapiens
cccggctaatttttggat

SEQ ID NO: 3809843 - DNA, 21 bp, Homo sapiens
cccggctgggtcggccctgcc

SEQ ID NO: 3809844 - DNA, 23 bp, Homo sapiens
cccggctgggtcggccctgccca

SEQ ID NO: 3809845 - DNA, 13 bp, Homo sapiens
cccggcttgcctg

SEQ ID NO: 3809846 - DNA, 14 bp, Homo sapiens
cccgggagctcagg

SEQ ID NO: 3809847 - DNA, 12 bp, Homo sapiens
cccgggtgcagg

SEQ ID NO: 3809848 - DNA, 16 bp, Homo sapiens
cccgtgttcacaccat

SEQ ID NO: 3809849 - DNA, 12 bp, Homo sapiens
ccctacagacag

SEQ ID NO: 3809850 - DNA, 19 bp, Homo sapiens
ccctacttcttttgctctt

SEQ ID NO: 3809851 - DNA, 18 bp, Homo sapiens
ccctattagagaagagat

SEQ ID NO: 3809852 - DNA, 18 bp, Homo sapiens
ccctccaaacactgggct

SEQ ID NO: 3809853 - DNA, 21 bp, Homo sapiens
ccctccaaacactgggctctg

SEQ ID NO: 3809854 - DNA, 15 bp, Homo sapiens
ccctcccagtcctcc

SEQ ID NO: 3809855 - DNA, 16 bp, Homo sapiens
ccctccccacagtcct

SEQ ID NO: 3809856 - DNA, 17 bp, Homo sapiens
ccctccccacagtcctc

SEQ ID NO: 3809857 - DNA, 15 bp, Homo sapiens
ccctccccagccctt

SEQ ID NO: 3809858 - DNA, 16 bp, Homo sapiens
ccctccccgcaccccc

SEQ ID NO: 3809859 - DNA, 17 bp, Homo sapiens
ccctccccgcacccccc

SEQ ID NO: 3809860 - DNA, 17 bp, Homo sapiens
ccctcccctcccagtcc

SEQ ID NO: 3809861 - DNA, 16 bp, Homo sapiens
ccctcgactcagcacc

SEQ ID NO: 3809862 - DNA, 22 bp, Homo sapiens
ccctcgtggacacctgccctgc

SEQ ID NO: 3809863 - DNA, 20 bp, Homo sapiens
ctccattctgaccatttcag

SEQ ID NO: 3809864 - DNA, 14 bp, Homo sapiens
ctcccaacagagct

SEQ ID NO: 3809865 - DNA, 21 bp, Homo sapiens
ctcccaccaggcagctccagc

SEQ ID NO: 3809866 - DNA, 19 bp, Homo sapiens
ctcccaccagtggccccca

SEQ ID NO: 3809867 - DNA, 15 bp, Homo sapiens
ctcccagtcctccag

SEQ ID NO: 3809868 - DNA, 18 bp, Homo sapiens
ctcccagtcctccagacc

SEQ ID NO: 3809869 - DNA, 17 bp, Homo sapiens
ctcccatggccttccct

SEQ ID NO: 3809870 - DNA, 12 bp, Homo sapiens
ctcccccagagc

SEQ ID NO: 3809871 - DNA, 13 bp, Homo sapiens
ctcccccagagcc

SEQ ID NO: 3809872 - DNA, 14 bp, Homo sapiens
ctccccgctctgga

SEQ ID NO: 3809873 - DNA, 14 bp, Homo sapiens
ctcccctcccagtc

SEQ ID NO: 3809874 - DNA, 19 bp, Homo sapiens
ctccctgaccttctccagg

SEQ ID NO: 3809875 - DNA, 15 bp, Homo sapiens
ctccgcccagcctct

SEQ ID NO: 3809876 - DNA, 20 bp, Homo sapiens
ctccgtccaggagcctgtgc

SEQ ID NO: 3809877 - DNA, 14 bp, Homo sapiens
ctcctcacccccag

SEQ ID NO: 3809878 - DNA, 22 bp, Homo sapiens
ctcctccagccgccatgctcct

SEQ ID NO: 3809879 - DNA, 15 bp, Homo sapiens
ctcctcccatggcct

SEQ ID NO: 3809880 - DNA, 16 bp, Homo sapiens
ctcctcccatggcctt

SEQ ID NO: 3809881 - DNA, 14 bp, Homo sapiens
ctcctcctgccctg

SEQ ID NO: 3809882 - DNA, 24 bp, Homo sapiens
ctcctcgagatcccaacactgcca

SEQ ID NO: 3809883 - DNA, 18 bp, Homo sapiens
ctcctgagtagctgggac

SEQ ID NO: 3809884 - DNA, 16 bp, Homo sapiens
ctcctgcctcagcctc

SEQ ID NO: 3809885 - DNA, 19 bp, Homo sapiens
ctcctgcctcagcctcctg

SEQ ID NO: 3809886 - DNA, 16 bp, Homo sapiens
ctcctggcccactgca

SEQ ID NO: 3809887 - DNA, 18 bp, Homo sapiens
ctcctggcccactgcatc

SEQ ID NO: 3809888 - DNA, 17 bp, Homo sapiens
ctcctgtccctacccac

SEQ ID NO: 3809889 - DNA, 18 bp, Homo sapiens
ctcctgtccctacccact

SEQ ID NO: 3809890 - DNA, 16 bp, Homo sapiens
ctcctgtctccctcct

SEQ ID NO: 3809891 - DNA, 22 bp, Homo sapiens
ctccttaaggctcttttgtaag

SEQ ID NO: 3809892 - DNA, 17 bp, Homo sapiens
ctcctttttctaccttt

SEQ ID NO: 3809893 - DNA, 14 bp, Homo sapiens
ctcgaactcctgac

SEQ ID NO: 3809894 - DNA, 15 bp, Homo sapiens
ctcgaagaacaatgt

SEQ ID NO: 3809895 - DNA, 14 bp, Homo sapiens
ctcgactcagcacc

SEQ ID NO: 3809896 - DNA, 13 bp, Homo sapiens
ctcgagatcccaa

SEQ ID NO: 3809897 - DNA, 22 bp, Homo sapiens
ctcgagatcccaacactgccag

SEQ ID NO: 3809898 - DNA, 13 bp, Homo sapiens
ctcgctctgctgc

SEQ ID NO: 3809899 - DNA, 16 bp, Homo sapiens
ctcggcttcaccaggg

SEQ ID NO: 3809900 - DNA, 16 bp, Homo sapiens
ctcgtgatttgcctgc

SEQ ID NO: 3809901 - DNA, 17 bp, Homo sapiens
ctcgtggacacctgccc

SEQ ID NO: 3809902 - DNA, 18 bp, Homo sapiens
ctctaaactgctgttaat

SEQ ID NO: 3809903 - DNA, 16 bp, Homo sapiens
ctctacaaactcccac

SEQ ID NO: 3809904 - DNA, 16 bp, Homo sapiens
ctctagaacacccact

SEQ ID NO: 3809905 - DNA, 18 bp, Homo sapiens
ctctagaacacccactgg

SEQ ID NO: 3809906 - DNA, 18 bp, Homo sapiens
ctctccaagtctctctgt

SEQ ID NO: 3809907 - DNA, 19 bp, Homo sapiens
ctctccaagtctctctgtg

SEQ ID NO: 3809908 - DNA, 22 bp, Homo sapiens
ctctccaagtctctctgtgaat

SEQ ID NO: 3809909 - DNA, 19 bp, Homo sapiens
ctctccagcggtccaaagt

SEQ ID NO: 3809910 - DNA, 15 bp, Homo sapiens
ctctcctgtctccct

SEQ ID NO: 3809911 - DNA, 16 bp, Homo sapiens
ctctcggcttcaccag

SEQ ID NO: 3809912 - DNA, 13 bp, Homo sapiens
ctctctcctccct

SEQ ID NO: 3809913 - DNA, 14 bp, Homo sapiens
ctctctcttctctg

SEQ ID NO: 3809914 - DNA, 16 bp, Homo sapiens
ctctctggaaaggagg

SEQ ID NO: 3809915 - DNA, 14 bp, Homo sapiens
ctctctgtgaatac

SEQ ID NO: 3809916 - DNA, 17 bp, Homo sapiens
ctctctgtgaatacaat

SEQ ID NO: 3809917 - DNA, 15 bp, Homo sapiens
ctctgaatgtcccag

SEQ ID NO: 3809918 - DNA, 22 bp, Homo sapiens
ctctgaggtcaataaagcagag

SEQ ID NO: 3809919 - DNA, 13 bp, Homo sapiens
ctctgcacaagct

SEQ ID NO: 3809920 - DNA, 19 bp, Homo sapiens
ctctgcacaagctgcaccc

SEQ ID NO: 3809921 - DNA, 12 bp, Homo sapiens
ctctgcaggaaa

SEQ ID NO: 3809922 - DNA, 21 bp, Homo sapiens
ctctgcaggaaatcagagctg

SEQ ID NO: 3809923 - DNA, 23 bp, Homo sapiens
ctctgccaatcggctacccctcg

SEQ ID NO: 3809924 - DNA, 15 bp, Homo sapiens
ctctgcccagcctgc

SEQ ID NO: 3809925 - DNA, 13 bp, Homo sapiens
ctctgctgctcat

SEQ ID NO: 3809926 - DNA, 15 bp, Homo sapiens
ctctgctgctcatgg

SEQ ID NO: 3809927 - DNA, 15 bp, Homo sapiens
ctctggatcctgcac

SEQ ID NO: 3809928 - DNA, 18 bp, Homo sapiens
ctctgtgaatacaattaa

SEQ ID NO: 3809929 - DNA, 21 bp, Homo sapiens
ctctgtgaatacaattaaagg

SEQ ID NO: 3809930 - DNA, 14 bp, Homo sapiens
ctctgttcctggct

SEQ ID NO: 3809931 - DNA, 15 bp, Homo sapiens
ctctgttctagagtg

SEQ ID NO: 3809932 - DNA, 19 bp, Homo sapiens
ctctgttctagagtgacag

SEQ ID NO: 3809933 - DNA, 18 bp, Homo sapiens
ctcttagaagtgacattg

SEQ ID NO: 3809934 - DNA, 20 bp, Homo sapiens
ctcttccgtgacgtcactgg

SEQ ID NO: 3809935 - DNA, 19 bp, Homo sapiens
ctcttctattttgtaaact

SEQ ID NO: 3809936 - DNA, 15 bp, Homo sapiens
ctcttggccagagct

SEQ ID NO: 3809937 - DNA, 15 bp, Homo sapiens
ctcttggctggcttc

SEQ ID NO: 3809938 - DNA, 16 bp, Homo sapiens
ctctttgctacaataa

SEQ ID NO: 3809939 - DNA, 18 bp, Homo sapiens
ctctttgctacaataaat

SEQ ID NO: 3809940 - DNA, 21 bp, Homo sapiens
ctgaaaaatggtaattgttgc

SEQ ID NO: 3809941 - DNA, 15 bp, Homo sapiens
ctgaaataaactagg

SEQ ID NO: 3809942 - DNA, 18 bp, Homo sapiens
ctgaaataaactagggtt

SEQ ID NO: 3809943 - DNA, 12 bp, Homo sapiens
ctgaacaagaat

SEQ ID NO: 3809944 - DNA, 21 bp, Homo sapiens
ctgaacctgggtaactaggga

SEQ ID NO: 3809945 - DNA, 21 bp, Homo sapiens
ctgaagagaagggcagggctg

SEQ ID NO: 3809946 - DNA, 20 bp, Homo sapiens
ctgaagtacttaaacttcca

SEQ ID NO: 3809947 - DNA, 16 bp, Homo sapiens
ctgaatgtcccagagg

SEQ ID NO: 3809948 - DNA, 17 bp, Homo sapiens
ctgacactgagccccac

SEQ ID NO: 3809949 - DNA, 18 bp, Homo sapiens
ctgaccctcatctttctt

SEQ ID NO: 3809950 - DNA, 23 bp, Homo sapiens
ctgacctcgtgatttgcctgcct

SEQ ID NO: 3809951 - DNA, 17 bp, Homo sapiens
ctgaccttctccaggga

SEQ ID NO: 3809952 - DNA, 18 bp, Homo sapiens
ctgaccttctccagggac

SEQ ID NO: 3809953 - DNA, 18 bp, Homo sapiens
ctgactactactctgcca

SEQ ID NO: 3809954 - DNA, 15 bp, Homo sapiens
ctgactccatgtgtg

SEQ ID NO: 3809955 - DNA, 23 bp, Homo sapiens
ctgagaagagagatcaaatggaa

SEQ ID NO: 3809956 - DNA, 20 bp, Homo sapiens
ctgagactagattctcacct

SEQ ID NO: 3809957 - DNA, 24 bp, Homo sapiens
ctgagactgcgccacggcactcca

SEQ ID NO: 3809958 - DNA, 13 bp, Homo sapiens
ctgagaggtgagg

SEQ ID NO: 3809959 - DNA, 16 bp, Homo sapiens
ctgaggaattttcttt

SEQ ID NO: 3809960 - DNA, 21 bp, Homo sapiens
ctgaggagtggagttctctgt

SEQ ID NO: 3809961 - DNA, 14 bp, Homo sapiens
ctgaggatttcaag

SEQ ID NO: 3809962 - DNA, 17 bp, Homo sapiens
ctgaggatttcaagcct

SEQ ID NO: 3809963 - DNA, 18 bp, Homo sapiens
ctgaggatttcaagcctg

SEQ ID NO: 3809964 - DNA, 18 bp, Homo sapiens
ctgaggccattatttcaa

SEQ ID NO: 3809965 - DNA, 18 bp, Homo sapiens
ctgaggccccaggcccta

SEQ ID NO: 3809966 - DNA, 13 bp, Homo sapiens
ctgaggtcaataa

SEQ ID NO: 3809967 - DNA, 14 bp, Homo sapiens
ctgaggtcaataaa

SEQ ID NO: 3809968 - DNA, 16 bp, Homo sapiens
ctgaggtcaataaagc

SEQ ID NO: 3809969 - DNA, 18 bp, Homo sapiens
ctgaggtcaataaagcag

SEQ ID NO: 3809970 - DNA, 13 bp, Homo sapiens
ctgaggtgggagg

SEQ ID NO: 3809971 - DNA, 20 bp, Homo sapiens
ctgagtagctgggactacag

SEQ ID NO: 3809972 - DNA, 18 bp, Homo sapiens
gacaaaggttttcctctt

SEQ ID NO: 3809973 - DNA, 20 bp, Homo sapiens
gacaacatttttgtacatta

SEQ ID NO: 3809974 - DNA, 20 bp, Homo sapiens
gacaacttttaaagaaaaat

SEQ ID NO: 3809975 - DNA, 20 bp, Homo sapiens
gacaatgtgaaaagaaaaat

SEQ ID NO: 3809976 - DNA, 22 bp, Homo sapiens
gacacaccccacaccccagccc

SEQ ID NO: 3809977 - DNA, 18 bp, Homo sapiens
gacaccagccctgctgct

SEQ ID NO: 3809978 - DNA, 9 bp, Homo sapiens
gacacctgc

SEQ ID NO: 3809979 - DNA, 12 bp, Homo sapiens
gacactgagccc

SEQ ID NO: 3809980 - DNA, 16 bp, Homo sapiens
gacactgccacacagg

SEQ ID NO: 3809981 - DNA, 12 bp, Homo sapiens
gacagagagaga

SEQ ID NO: 3809982 - DNA, 13 bp, Homo sapiens
gacagagagagac

SEQ ID NO: 3809983 - DNA, 17 bp, Homo sapiens
gacagagagagactgag

SEQ ID NO: 3809984 - DNA, 19 bp, Homo sapiens
gacagagttggtgttcata

SEQ ID NO: 3809985 - DNA, 20 bp, Homo sapiens
gacagcctccccctgtcccc

SEQ ID NO: 3809986 - DNA, 11 bp, Homo sapiens
gacaggcccaa

SEQ ID NO: 3809987 - DNA, 15 bp, Homo sapiens
gacaggcccaagaga

SEQ ID NO: 3809988 - DNA, 15 bp, Homo sapiens
gacagtatttgtggg

SEQ ID NO: 3809989 - DNA, 23 bp, Homo sapiens
gacagtgttgaaaatgttcagaa

SEQ ID NO: 3809990 - DNA, 14 bp, Homo sapiens
gacagttcaagaaa

SEQ ID NO: 3809991 - DNA, 19 bp, Homo sapiens
gaccaaatcattgtatcaa

SEQ ID NO: 3809992 - DNA, 14 bp, Homo sapiens
gaccaagagagaaa

SEQ ID NO: 3809993 - DNA, 16 bp, Homo sapiens
gaccaagagagaaaga

SEQ ID NO: 3809994 - DNA, 22 bp, Homo sapiens
gaccaccagccgccccagcccc

SEQ ID NO: 3809995 - DNA, 16 bp, Homo sapiens
gaccacctctcaatat

SEQ ID NO: 3809996 - DNA, 14 bp, Homo sapiens
gaccagcctctcca

SEQ ID NO: 3809997 - DNA, 21 bp, Homo sapiens
gaccagctaattggtccaacc

SEQ ID NO: 3809998 - DNA, 15 bp, Homo sapiens
gaccagtaattgtga

SEQ ID NO: 3809999 - DNA, 19 bp, Homo sapiens
gaccattgtcttccaaccc

SEQ ID NO: 3810000 - DNA, 15 bp, Homo sapiens
gaccatttcaggggt

SEQ ID NO: 3810001 - DNA, 14 bp, Homo sapiens
gaccctacagacag

SEQ ID NO: 3810002 - DNA, 18 bp, Homo sapiens
gaccgggtctgcttctgc

SEQ ID NO: 3810003 - DNA, 17 bp, Homo sapiens
gacggggtttccccatg

SEQ ID NO: 3810004 - DNA, 18 bp, Homo sapiens
gactaatagagacacaga

SEQ ID NO: 3810005 - DNA, 20 bp, Homo sapiens
gactaatagagacacagaga

SEQ ID NO: 3810006 - DNA, 15 bp, Homo sapiens
gactactactctgcc

SEQ ID NO: 3810007 - DNA, 18 bp, Homo sapiens
gactacttgggagcaccg

SEQ ID NO: 3810008 - DNA, 20 bp, Homo sapiens
gactacttgggagcaccgcc

SEQ ID NO: 3810009 - DNA, 15 bp, Homo sapiens
gactagaggcaggga

SEQ ID NO: 3810010 - DNA, 17 bp, Homo sapiens
gactagattctcacctg

SEQ ID NO: 3810011 - DNA, 11 bp, Homo sapiens
gactcagcacc

SEQ ID NO: 3810012 - DNA, 23 bp, Homo sapiens
gactcagcaccacattgcctcat

SEQ ID NO: 3810013 - DNA, 19 bp, Homo sapiens
gactctgctgctcatggga

SEQ ID NO: 3810014 - DNA, 15 bp, Homo sapiens
gactgagggagagac

SEQ ID NO: 3810015 - DNA, 13 bp, Homo sapiens
gactgcccggcag

SEQ ID NO: 3810016 - DNA, 23 bp, Homo sapiens
gactgcgccacggcactccagcc

SEQ ID NO: 3810017 - DNA, 11 bp, Homo sapiens
gacttgcctgg

SEQ ID NO: 3810018 - DNA, 16 bp, Homo sapiens
gacttgtgtctctgtg

SEQ ID NO: 3810019 - DNA, 15 bp, Homo sapiens
gagaaaatgcaggag

SEQ ID NO: 3810020 - DNA, 17 bp, Homo sapiens
gagaaacaggctctgag

SEQ ID NO: 3810021 - DNA, 16 bp, Homo sapiens
gagaagcagaggaagg

SEQ ID NO: 3810022 - DNA, 15 bp, Homo sapiens
gagaagcggctggca

SEQ ID NO: 3810023 - DNA, 13 bp, Homo sapiens
gagaatgagcctc

SEQ ID NO: 3810024 - DNA, 19 bp, Homo sapiens
gagacaaacacctcccagg

SEQ ID NO: 3810025 - DNA, 20 bp, Homo sapiens
gagacagaaacagagagaga

SEQ ID NO: 3810026 - DNA, 14 bp, Homo sapiens
gagacagagagaga

SEQ ID NO: 3810027 - DNA, 15 bp, Homo sapiens
gagacagagagagac

SEQ ID NO: 3810028 - DNA, 18 bp, Homo sapiens
gagacagagagagactga

SEQ ID NO: 3810029 - DNA, 16 bp, Homo sapiens
gagacagtagaggcat

SEQ ID NO: 3810030 - DNA, 14 bp, Homo sapiens
gagaccctacagac

SEQ ID NO: 3810031 - DNA, 16 bp, Homo sapiens
gagaccctacagacag

SEQ ID NO: 3810032 - DNA, 21 bp, Homo sapiens
gagaccctgtctcaaaaaaag

SEQ ID NO: 3810033 - DNA, 21 bp, Homo sapiens
gagactaatagagacacagag

SEQ ID NO: 3810034 - DNA, 15 bp, Homo sapiens
gagagacagagacag

SEQ ID NO: 3810035 - DNA, 18 bp, Homo sapiens
gagagaccctacagacag

SEQ ID NO: 3810036 - DNA, 16 bp, Homo sapiens
gagagactgagggaga

SEQ ID NO: 3810037 - DNA, 15 bp, Homo sapiens
gagagatgagtgggt

SEQ ID NO: 3810038 - DNA, 21 bp, Homo sapiens
gagagctctctcttctctgtt

SEQ ID NO: 3810039 - DNA, 23 bp, Homo sapiens
gagaggccccggctgggtgagct

SEQ ID NO: 3810040 - DNA, 21 bp, Homo sapiens
gagaggggaataatagaagaa

SEQ ID NO: 3810041 - DNA, 13 bp, Homo sapiens
gagaggggcacag

SEQ ID NO: 3810042 - DNA, 20 bp, Homo sapiens
gagagtcaacatatgtgatt

SEQ ID NO: 3810043 - DNA, 22 bp, Homo sapiens
gagatatgcacacacacggatg

SEQ ID NO: 3810044 - DNA, 18 bp, Homo sapiens
gagatccagggcaaggcc

SEQ ID NO: 3810045 - DNA, 21 bp, Homo sapiens
gagatgaagagtgagagggca

SEQ ID NO: 3810046 - DNA, 18 bp, Homo sapiens
gagattgcaccactgcac

SEQ ID NO: 3810047 - DNA, 21 bp, Homo sapiens
gagattgcaccactgcactcc

SEQ ID NO: 3810048 - DNA, 15 bp, Homo sapiens
gagcaactcctgttc

SEQ ID NO: 3810049 - DNA, 12 bp, Homo sapiens
gagccaaggcca

SEQ ID NO: 3810050 - DNA, 13 bp, Homo sapiens
gagccaaggccac

SEQ ID NO: 3810051 - DNA, 13 bp, Homo sapiens
gagccagccagga

SEQ ID NO: 3810052 - DNA, 13 bp, Homo sapiens
gagcccttagcct

SEQ ID NO: 3810053 - DNA, 14 bp, Homo sapiens
gagcccttagcctt

SEQ ID NO: 3810054 - DNA, 13 bp, Homo sapiens
gagcctgggaggt

SEQ ID NO: 3810055 - DNA, 23 bp, Homo sapiens
gagctcaggaaccgaggcaggga

SEQ ID NO: 3810056 - DNA, 16 bp, Homo sapiens
gagctcctgtccctac

SEQ ID NO: 3810057 - DNA, 18 bp, Homo sapiens
gagctcctgtccctaccc

SEQ ID NO: 3810058 - DNA, 22 bp, Homo sapiens
gagctcctgtccctacccactc

SEQ ID NO: 3810059 - DNA, 23 bp, Homo sapiens
gagctcctgtccctacccactct

SEQ ID NO: 3810060 - DNA, 18 bp, Homo sapiens
gagctctctcttctctgt

SEQ ID NO: 3810061 - DNA, 16 bp, Homo sapiens
gagctgacagagccag

SEQ ID NO: 3810062 - DNA, 17 bp, Homo sapiens
gagctgacagagccaga

SEQ ID NO: 3810063 - DNA, 19 bp, Homo sapiens
gagctgcagccccccagag

SEQ ID NO: 3810064 - DNA, 13 bp, Homo sapiens
gaggaagagcagg

SEQ ID NO: 3810065 - DNA, 11 bp, Homo sapiens
gaggacagagc

SEQ ID NO: 3810066 - DNA, 13 bp, Homo sapiens
gaggacagagccg

SEQ ID NO: 3810067 - DNA, 14 bp, Homo sapiens
gaggacagagccgg

SEQ ID NO: 3810068 - DNA, 14 bp, Homo sapiens
gaggacttgtgtct

SEQ ID NO: 3810069 - DNA, 15 bp, Homo sapiens
gaggagcttggggga

SEQ ID NO: 3810070 - DNA, 21 bp, Homo sapiens
gaggagcttgggggatgacta

SEQ ID NO: 3810071 - DNA, 16 bp, Homo sapiens
gaggatctcttgagcc

SEQ ID NO: 3810072 - DNA, 19 bp, Homo sapiens
gaggatctcttgagcctgg

SEQ ID NO: 3810073 - DNA, 14 bp, Homo sapiens
gaggatggagagag

SEQ ID NO: 3810074 - DNA, 15 bp, Homo sapiens
gaggatgtctgggcc

SEQ ID NO: 3810075 - DNA, 21 bp, Homo sapiens
gaggcaggatatccccaggga

SEQ ID NO: 3810076 - DNA, 23 bp, Homo sapiens
gaggcaggatatccccagggaaa

SEQ ID NO: 3810077 - DNA, 22 bp, Homo sapiens
gaggcctctcattccagaggaa

SEQ ID NO: 3810078 - DNA, 21 bp, Homo sapiens
gaggcgaagcgttgtcctcag

SEQ ID NO: 3810079 - DNA, 16 bp, Homo sapiens
gagggaaaagctaaga

SEQ ID NO: 3810080 - DNA, 18 bp, Homo sapiens
gagggaaaagctaagagg

SEQ ID NO: 3810081 - DNA, 16 bp, Homo sapiens
ggcgcggctgggagga

SEQ ID NO: 3810082 - DNA, 20 bp, Homo sapiens
ggcgtgatctcggctcactg

SEQ ID NO: 3810083 - DNA, 19 bp, Homo sapiens
ggctaccccccctcctgct

SEQ ID NO: 3810084 - DNA, 19 bp, Homo sapiens
ggctacccctcgactcagc

SEQ ID NO: 3810085 - DNA, 20 bp, Homo sapiens
ggctacccctcgactcagca

SEQ ID NO: 3810086 - DNA, 21 bp, Homo sapiens
ggctacccctcgactcagcac

SEQ ID NO: 3810087 - DNA, 22 bp, Homo sapiens
ggctagtctcttctcagagcag

SEQ ID NO: 3810088 - DNA, 21 bp, Homo sapiens
ggctatggggatagatgtgtg

SEQ ID NO: 3810089 - DNA, 16 bp, Homo sapiens
ggctctgaggagtgga

SEQ ID NO: 3810090 - DNA, 21 bp, Homo sapiens
ggctgaggatttcaagcctgc

SEQ ID NO: 3810091 - DNA, 13 bp, Homo sapiens
ggctgaggtggga

SEQ ID NO: 3810092 - DNA, 15 bp, Homo sapiens
ggctgaggtgggagg

SEQ ID NO: 3810093 - DNA, 16 bp, Homo sapiens
ggctggaaggagccag

SEQ ID NO: 3810094 - DNA, 17 bp, Homo sapiens
ggctggatctgtgaggg

SEQ ID NO: 3810095 - DNA, 21 bp, Homo sapiens
ggctgggaggagggcaggcat

SEQ ID NO: 3810096 - DNA, 19 bp, Homo sapiens
ggctgggtcggccctgccc

SEQ ID NO: 3810097 - DNA, 13 bp, Homo sapiens
ggcttcaccaggg

SEQ ID NO: 3810098 - DNA, 23 bp, Homo sapiens
gggaaaatcagcctgctccagct

SEQ ID NO: 3810099 - DNA, 22 bp, Homo sapiens
gggaaaggctctgaaagccagc

SEQ ID NO: 3810100 - DNA, 12 bp, Homo sapiens
gggaattctctt

SEQ ID NO: 3810101 - DNA, 15 bp, Homo sapiens
gggaccagggcatat

SEQ ID NO: 3810102 - DNA, 19 bp, Homo sapiens
gggagaatgtcagtatgtg

SEQ ID NO: 3810103 - DNA, 12 bp, Homo sapiens
gggagagactct

SEQ ID NO: 3810104 - DNA, 22 bp, Homo sapiens
gggagataaaagaaccccagac

SEQ ID NO: 3810105 - DNA, 23 bp, Homo sapiens
gggagctcaggaaccgaggcagg

SEQ ID NO: 3810106 - DNA, 19 bp, Homo sapiens
gggagctggttagaaatgc

SEQ ID NO: 3810107 - DNA, 12 bp, Homo sapiens
gggaggagggca

SEQ ID NO: 3810108 - DNA, 23 bp, Homo sapiens
gggaggatctcttgagcctggga

SEQ ID NO: 3810109 - DNA, 14 bp, Homo sapiens
gggagggggagagg

SEQ ID NO: 3810110 - DNA, 11 bp, Homo sapiens
gggagtgtgta

SEQ ID NO: 3810111 - DNA, 16 bp, Homo sapiens
gggagtttagggtggg

SEQ ID NO: 3810112 - DNA, 14 bp, Homo sapiens
gggatcacagggcc

SEQ ID NO: 3810113 - DNA, 14 bp, Homo sapiens
gggatccagttcca

SEQ ID NO: 3810114 - DNA, 19 bp, Homo sapiens
gggcagtctgagagaggcc

SEQ ID NO: 3810115 - DNA, 11 bp, Homo sapiens
gggcagtgccc

SEQ ID NO: 3810116 - DNA, 18 bp, Homo sapiens
gggcatattaaaggcttt

SEQ ID NO: 3810117 - DNA, 22 bp, Homo sapiens
gggcatctgagtccagctcccc

SEQ ID NO: 3810118 - DNA, 23 bp, Homo sapiens
gggcctagatccacacacagagg

SEQ ID NO: 3810119 - DNA, 17 bp, Homo sapiens
gggcctcagcctccagg

SEQ ID NO: 3810120 - DNA, 13 bp, Homo sapiens
gggcgaccagggc

SEQ ID NO: 3810121 - DNA, 10 bp, Homo sapiens
gggctcagca

SEQ ID NO: 3810122 - DNA, 13 bp, Homo sapiens
gggcttccctggg

SEQ ID NO: 3810123 - DNA, 16 bp, Homo sapiens
gggcttccctgggcct

SEQ ID NO: 3810124 - DNA, 22 bp, Homo sapiens
gggcttccctgggcctcagcct

SEQ ID NO: 3810125 - DNA, 16 bp, Homo sapiens
ggggaaaatcagcctg

SEQ ID NO: 3810126 - DNA, 17 bp, Homo sapiens
ggggaaaatcagcctgc

SEQ ID NO: 3810127 - DNA, 21 bp, Homo sapiens
ggggcaggggagtgccaaggt

SEQ ID NO: 3810128 - DNA, 15 bp, Homo sapiens
ggggcgcggctggga

SEQ ID NO: 3810129 - DNA, 22 bp, Homo sapiens
gggggcatctgagtccagctcc

SEQ ID NO: 3810130 - DNA, 23 bp, Homo sapiens
ggggtctgtgtgtttatgtgtgt

SEQ ID NO: 3810131 - DNA, 18 bp, Homo sapiens
gggtcattcatggcctgg

SEQ ID NO: 3810132 - DNA, 15 bp, Homo sapiens
gggtcggccctgccc

SEQ ID NO: 3810133 - DNA, 11 bp, Homo sapiens
gggtctgcttc

SEQ ID NO: 3810134 - DNA, 19 bp, Homo sapiens
gggtgacagagcaagtgag

SEQ ID NO: 3810135 - DNA, 17 bp, Homo sapiens
gggtgctctgaggtcaa

SEQ ID NO: 3810136 - DNA, 23 bp, Homo sapiens
gggtgctctgaggtcaataaagc

SEQ ID NO: 3810137 - DNA, 15 bp, Homo sapiens
gggtggcaccagcag

SEQ ID NO: 3810138 - DNA, 19 bp, Homo sapiens
ggtaactcttggccagagc

SEQ ID NO: 3810139 - DNA, 18 bp, Homo sapiens
ggtaggaactgctgggct

SEQ ID NO: 3810140 - DNA, 16 bp, Homo sapiens
ggtatgaacttgagga

SEQ ID NO: 3810141 - DNA, 20 bp, Homo sapiens
ggtatgaacttgaggacaca

SEQ ID NO: 3810142 - DNA, 22 bp, Homo sapiens
ggtcccaagtagtagtgtcttc

SEQ ID NO: 3810143 - DNA, 23 bp, Homo sapiens
ggtcctagaaattccccaccctg

SEQ ID NO: 3810144 - DNA, 11 bp, Homo sapiens
ggtcctgccct

SEQ ID NO: 3810145 - DNA, 15 bp, Homo sapiens
ggtcggccctgccca

SEQ ID NO: 3810146 - DNA, 20 bp, Homo sapiens
ggtcgggagttcaagaccag

SEQ ID NO: 3810147 - DNA, 14 bp, Homo sapiens
ggtctgtcccacca

SEQ ID NO: 3810148 - DNA, 15 bp, Homo sapiens
ggtctgtcccaccag

SEQ ID NO: 3810149 - DNA, 18 bp, Homo sapiens
ggtgacttgcctggggcc

SEQ ID NO: 3810150 - DNA, 14 bp, Homo sapiens
ggtgccactgaccg

SEQ ID NO: 3810151 - DNA, 11 bp, Homo sapiens
ggtgtggggga

SEQ ID NO: 3810152 - DNA, 13 bp, Homo sapiens
ggtgtgggggaag

SEQ ID NO: 3810153 - DNA, 13 bp, Homo sapiens
ggttatggagagg

SEQ ID NO: 3810154 - DNA, 19 bp, Homo sapiens
ggttgggcgtgctacctgc

SEQ ID NO: 3810155 - DNA, 20 bp, Homo sapiens
ggtttaagcaatgcttctgc

SEQ ID NO: 3810156 - DNA, 11 bp, Homo sapiens
gtaaaatggag

SEQ ID NO: 3810157 - DNA, 23 bp, Homo sapiens
gtaaactcaaaatatttgtacat

SEQ ID NO: 3810158 - DNA, 17 bp, Homo sapiens
gtaaatttatgtgatgg

SEQ ID NO: 3810159 - DNA, 17 bp, Homo sapiens
gtaaccaggccccagcc

SEQ ID NO: 3810160 - DNA, 18 bp, Homo sapiens
gtaactcttggccagagc

SEQ ID NO: 3810161 - DNA, 21 bp, Homo sapiens
gtaactcttggccagagctga

SEQ ID NO: 3810162 - DNA, 15 bp, Homo sapiens
gtaacttttgtaaga

SEQ ID NO: 3810163 - DNA, 16 bp, Homo sapiens
gtaatctttaaactgg

SEQ ID NO: 3810164 - DNA, 21 bp, Homo sapiens
gtaattgttgctaatcttctt

SEQ ID NO: 3810165 - DNA, 16 bp, Homo sapiens
gtaatttgaggacaac

SEQ ID NO: 3810166 - DNA, 20 bp, Homo sapiens
gtacaaagatatgctaagca

SEQ ID NO: 3810167 - DNA, 20 bp, Homo sapiens
gtacacagctctagacactg

SEQ ID NO: 3810168 - DNA, 12 bp, Homo sapiens
gtagaactctgc

SEQ ID NO: 3810169 - DNA, 15 bp, Homo sapiens
gtagaccaaaataaa

SEQ ID NO: 3810170 - DNA, 15 bp, Homo sapiens
gtagagccagaggtc

SEQ ID NO: 3810171 - DNA, 23 bp, Homo sapiens
gtagaggcatgaacacacatgga

SEQ ID NO: 3810172 - DNA, 16 bp, Homo sapiens
gtagggagctaaggaa

SEQ ID NO: 3810173 - DNA, 22 bp, Homo sapiens
gtagttacatggtaattatgtg

SEQ ID NO: 3810174 - DNA, 15 bp, Homo sapiens
gtataggataaatta

SEQ ID NO: 3810175 - DNA, 18 bp, Homo sapiens
gtatatctatatctctaa

SEQ ID NO: 3810176 - DNA, 19 bp, Homo sapiens
gtatatctggccacactgg

SEQ ID NO: 3810177 - DNA, 18 bp, Homo sapiens
gtatatgtatatctatat

SEQ ID NO: 3810178 - DNA, 19 bp, Homo sapiens
gtatattttaatgaatatt

SEQ ID NO: 3810179 - DNA, 19 bp, Homo sapiens
gtatccactttgcacagct

SEQ ID NO: 3810180 - DNA, 19 bp, Homo sapiens
gtatcgctgccttgccatg

SEQ ID NO: 3810181 - DNA, 16 bp, Homo sapiens
gtatgaacttgaggac

SEQ ID NO: 3810182 - DNA, 19 bp, Homo sapiens
gtatgaacttgaggacaca

SEQ ID NO: 3810183 - DNA, 20 bp, Homo sapiens
gtatgaacttgaggacacat

SEQ ID NO: 3810184 - DNA, 13 bp, Homo sapiens
gtatgtctccagt

SEQ ID NO: 3810185 - DNA, 21 bp, Homo sapiens
gtatgtggaagtgtgggtctg

SEQ ID NO: 3810186 - DNA, 16 bp, Homo sapiens
gtatttggaaaatgtt

SEQ ID NO: 3810187 - DNA, 19 bp, Homo sapiens
gtattttgtttttgtctta

SEQ ID NO: 3810188 - DNA, 22 bp, Homo sapiens
gtattttgtttttgtcttaaaa

SEQ ID NO: 3810189 - DNA, 18 bp, Homo sapiens
tcactgcaagctctgcct

SEQ ID NO: 3810190 - DNA, 14 bp, Homo sapiens
tcactgctctgccc

SEQ ID NO: 3810191 - DNA, 20 bp, Homo sapiens
tcactgtagaatgatttcat

SEQ ID NO: 3810192 - DNA, 21 bp, Homo sapiens
tcactgtagaatgatttcatg

SEQ ID NO: 3810193 - DNA, 18 bp, Homo sapiens
tcactgtttattgaagaa

SEQ ID NO: 3810194 - DNA, 16 bp, Homo sapiens
tcacttgtacaaaata

SEQ ID NO: 3810195 - DNA, 17 bp, Homo sapiens
tcacttgtacaaaataa

SEQ ID NO: 3810196 - DNA, 12 bp, Homo sapiens
tcacttttcctc

SEQ ID NO: 3810197 - DNA, 13 bp, Homo sapiens
tcacttttcctcc

SEQ ID NO: 3810198 - DNA, 22 bp, Homo sapiens
tcagacaattcagaagcatcac

SEQ ID NO: 3810199 - DNA, 13 bp, Homo sapiens
tcagagaatttct

SEQ ID NO: 3810200 - DNA, 23 bp, Homo sapiens
tcagagaatttctaccatttcag

SEQ ID NO: 3810201 - DNA, 19 bp, Homo sapiens
tcagagggtgtcctgcacc

SEQ ID NO: 3810202 - DNA, 14 bp, Homo sapiens
tcagatcctacccc

SEQ ID NO: 3810203 - DNA, 21 bp, Homo sapiens
tcagattcccagagcaaaata

SEQ ID NO: 3810204 - DNA, 22 bp, Homo sapiens
tcagattcccagagcaaaataa

SEQ ID NO: 3810205 - DNA, 14 bp, Homo sapiens
tcagcagccccctg

SEQ ID NO: 3810206 - DNA, 14 bp, Homo sapiens
tcagccctgccctt

SEQ ID NO: 3810207 - DNA, 23 bp, Homo sapiens
tcagccgtgtaaccatggaccca

SEQ ID NO: 3810208 - DNA, 23 bp, Homo sapiens
tcagcctccatcctaccccctgt

SEQ ID NO: 3810209 - DNA, 20 bp, Homo sapiens
tcagcctcctgagtagctgg

SEQ ID NO: 3810210 - DNA, 21 bp, Homo sapiens
tcagcttcccaagtagctgag

SEQ ID NO: 3810211 - DNA, 22 bp, Homo sapiens
tcagcttcccaagtagctgaga

SEQ ID NO: 3810212 - DNA, 18 bp, Homo sapiens
tcaggaaccgaggcaggg

SEQ ID NO: 3810213 - DNA, 22 bp, Homo sapiens
tcaggagctgacagagccagag

SEQ ID NO: 3810214 - DNA, 22 bp, Homo sapiens
tcaggctgctgctctgccttca

SEQ ID NO: 3810215 - DNA, 19 bp, Homo sapiens
tcaggggtgtgcggccttt

SEQ ID NO: 3810216 - DNA, 23 bp, Homo sapiens
tcaggtgagaagcagaggaagga

SEQ ID NO: 3810217 - DNA, 17 bp, Homo sapiens
tcagtaatttgaggaca

SEQ ID NO: 3810218 - DNA, 22 bp, Homo sapiens
tcagtgtatggaaataaatgta

SEQ ID NO: 3810219 - DNA, 20 bp, Homo sapiens
tcagttcctgcagcagagcc

SEQ ID NO: 3810220 - DNA, 15 bp, Homo sapiens
tcagttctagttgat

SEQ ID NO: 3810221 - DNA, 13 bp, Homo sapiens
tcataaagtatgc

SEQ ID NO: 3810222 - DNA, 16 bp, Homo sapiens
tcataaatttatggtt

SEQ ID NO: 3810223 - DNA, 22 bp, Homo sapiens
tcataatttcagttctagttga

SEQ ID NO: 3810224 - DNA, 13 bp, Homo sapiens
tcatacacagaaa

SEQ ID NO: 3810225 - DNA, 13 bp, Homo sapiens
tcatactgaagat

SEQ ID NO: 3810226 - DNA, 23 bp, Homo sapiens
tcatagaaatgtaacttttgtaa

SEQ ID NO: 3810227 - DNA, 22 bp, Homo sapiens
tcatcccatgggcgaccagggc

SEQ ID NO: 3810228 - DNA, 23 bp, Homo sapiens
tcatcttaggttggcaaaaaggc

SEQ ID NO: 3810229 - DNA, 22 bp, Homo sapiens
tcatgatagaaggctatgggga

SEQ ID NO: 3810230 - DNA, 15 bp, Homo sapiens
tcatgctttctcctt

SEQ ID NO: 3810231 - DNA, 14 bp, Homo sapiens
tcattaaacgtcat

SEQ ID NO: 3810232 - DNA, 12 bp, Homo sapiens
tcattataaaat

SEQ ID NO: 3810233 - DNA, 17 bp, Homo sapiens
tcattcaaaatgtccag

SEQ ID NO: 3810234 - DNA, 19 bp, Homo sapiens
tcattcaggtgttctcttc

SEQ ID NO: 3810235 - DNA, 13 bp, Homo sapiens
tcatttgttcatt

SEQ ID NO: 3810236 - DNA, 22 bp, Homo sapiens
tccaaaaagatttattaattaa

SEQ ID NO: 3810237 - DNA, 21 bp, Homo sapiens
tccaaacactgggctctgagg

SEQ ID NO: 3810238 - DNA, 15 bp, Homo sapiens
tccaacaagttgcct

SEQ ID NO: 3810239 - DNA, 19 bp, Homo sapiens
tccaacagctcaagtcttc

SEQ ID NO: 3810240 - DNA, 15 bp, Homo sapiens
tccaacccagcctga

SEQ ID NO: 3810241 - DNA, 16 bp, Homo sapiens
tccaacccagcctgag

SEQ ID NO: 3810242 - DNA, 17 bp, Homo sapiens
tccaacccagcctgagt

SEQ ID NO: 3810243 - DNA, 14 bp, Homo sapiens
tccaaccccagctg

SEQ ID NO: 3810244 - DNA, 17 bp, Homo sapiens
tccaaccccagctggcc

SEQ ID NO: 3810245 - DNA, 21 bp, Homo sapiens
tccaaccggctttgtggcact

SEQ ID NO: 3810246 - DNA, 20 bp, Homo sapiens
tccaagattcaaagagacta

SEQ ID NO: 3810247 - DNA, 15 bp, Homo sapiens
tccaaggagaaacag

SEQ ID NO: 3810248 - DNA, 14 bp, Homo sapiens
tccaattttctgga

SEQ ID NO: 3810249 - DNA, 22 bp, Homo sapiens
tccacacacagaggaagagcag

SEQ ID NO: 3810250 - DNA, 14 bp, Homo sapiens
tccacagagtataa

SEQ ID NO: 3810251 - DNA, 14 bp, Homo sapiens
tccacataaaggta

SEQ ID NO: 3810252 - DNA, 14 bp, Homo sapiens
tccacctcctgggt

SEQ ID NO: 3810253 - DNA, 18 bp, Homo sapiens
tccacgtgctcgcctctg

SEQ ID NO: 3810254 - DNA, 11 bp, Homo sapiens
tccagaaagaa

SEQ ID NO: 3810255 - DNA, 16 bp, Homo sapiens
tccagaccattgtctt

SEQ ID NO: 3810256 - DNA, 18 bp, Homo sapiens
tccagaccattgtcttcc

SEQ ID NO: 3810257 - DNA, 22 bp, Homo sapiens
tccagaccattgtcttccaacc

SEQ ID NO: 3810258 - DNA, 15 bp, Homo sapiens
tccagagtccctgcc

SEQ ID NO: 3810259 - DNA, 21 bp, Homo sapiens
tccagagtccctgcctggacc

SEQ ID NO: 3810260 - DNA, 21 bp, Homo sapiens
tccagcaagaccaaatcattg

SEQ ID NO: 3810261 - DNA, 11 bp, Homo sapiens
tccagcctggg

SEQ ID NO: 3810262 - DNA, 13 bp, Homo sapiens
tccagcctgggtg

SEQ ID NO: 3810263 - DNA, 18 bp, Homo sapiens
tccagctccccccaagat

SEQ ID NO: 3810264 - DNA, 22 bp, Homo sapiens
tccagctgttacctgagatact

SEQ ID NO: 3810265 - DNA, 17 bp, Homo sapiens
tccagctgttcagctgg

SEQ ID NO: 3810266 - DNA, 18 bp, Homo sapiens
tccaggagcctgtgcctc

SEQ ID NO: 3810267 - DNA, 20 bp, Homo sapiens
tccaggggagggaaaagcta

SEQ ID NO: 3810268 - DNA, 23 bp, Homo sapiens
tccaggggagggaaaagctaaga

SEQ ID NO: 3810269 - DNA, 21 bp, Homo sapiens
tccaggtgcctggcccttggc

SEQ ID NO: 3810270 - DNA, 17 bp, Homo sapiens
tccaggtttaagctgtt

SEQ ID NO: 3810271 - DNA, 18 bp, Homo sapiens
tccaggtttaagctgtta

SEQ ID NO: 3810272 - DNA, 13 bp, Homo sapiens
tccagtctgcaga

SEQ ID NO: 3810273 - DNA, 14 bp, Homo sapiens
tccagtctgcagac

SEQ ID NO: 3810274 - DNA, 22 bp, Homo sapiens
tccagtggaagaagaaaacact

SEQ ID NO: 3810275 - DNA, 23 bp, Homo sapiens
tccagttcacaggccagaaaaca

SEQ ID NO: 3810276 - DNA, 19 bp, Homo sapiens
tccagttcatgagaatcta

SEQ ID NO: 3810277 - DNA, 12 bp, Homo sapiens
tccataaagtaa

SEQ ID NO: 3810278 - DNA, 16 bp, Homo sapiens
tcccaacactgccagc

SEQ ID NO: 3810279 - DNA, 16 bp, Homo sapiens
tcccacaaaggagagc

SEQ ID NO: 3810280 - DNA, 20 bp, Homo sapiens
tcccaccaggcagctccagc

SEQ ID NO: 3810281 - DNA, 21 bp, Homo sapiens
tcccaccaggcagctccagct

SEQ ID NO: 3810282 - DNA, 18 bp, Homo sapiens
tcccactaagctttctcc

SEQ ID NO: 3810283 - DNA, 14 bp, Homo sapiens
tcccagagagacgc

SEQ ID NO: 3810284 - DNA, 23 bp, Homo sapiens
tcccagctattcaggaggctgag

SEQ ID NO: 3810285 - DNA, 19 bp, Homo sapiens
tcccagctttctgtgtgca

SEQ ID NO: 3810286 - DNA, 18 bp, Homo sapiens
tcccaggggaccacacct

SEQ ID NO: 3810287 - DNA, 16 bp, Homo sapiens
tcccatggtgtatgtg

SEQ ID NO: 3810288 - DNA, 21 bp, Homo sapiens
tccccacagtcctcacagcct

SEQ ID NO: 3810289 - DNA, 15 bp, Homo sapiens
tccccagccctttgc

SEQ ID NO: 3810290 - DNA, 16 bp, Homo sapiens
tcccggtgcagaacag

SEQ ID NO: 3810291 - DNA, 15 bp, Homo sapiens
tccctgaccttctcc

SEQ ID NO: 3810292 - DNA, 16 bp, Homo sapiens
tccctgaccttctcca

SEQ ID NO: 3810293 - DNA, 20 bp, Homo sapiens
tccctgaccttctccaggga

SEQ ID NO: 3810294 - DNA, 13 bp, Homo sapiens
tccctgcctggac

SEQ ID NO: 3810295 - DNA, 18 bp, Homo sapiens
tccctgcttttctcccag

SEQ ID NO: 3810296 - DNA, 18 bp, Homo sapiens
tccctggaaggacatcca

SEQ ID NO: 3810297 - DNA, 19 bp, Homo sapiens
tgtaaacaatgtaaagtaa

SEQ ID NO: 3810298 - DNA, 20 bp, Homo sapiens
tgtaaactcaaaatatttgt

SEQ ID NO: 3810299 - DNA, 16 bp, Homo sapiens
tgtaaattatttatgt

SEQ ID NO: 3810300 - DNA, 15 bp, Homo sapiens
tgtaacttttgtaag

SEQ ID NO: 3810301 - DNA, 20 bp, Homo sapiens
tgtaagacaaaggttttcct

SEQ ID NO: 3810302 - DNA, 20 bp, Homo sapiens
tgtaatttaaaattgtgatg

SEQ ID NO: 3810303 - DNA, 22 bp, Homo sapiens
tgtaatttaaaattgtgatgtg

SEQ ID NO: 3810304 - DNA, 12 bp, Homo sapiens
tgtactgaaaaa

SEQ ID NO: 3810305 - DNA, 17 bp, Homo sapiens
tgtagaatgatttcatg

SEQ ID NO: 3810306 - DNA, 18 bp, Homo sapiens
tgtagaatgatttcatgc

SEQ ID NO: 3810307 - DNA, 13 bp, Homo sapiens
tgtagagtgggag

SEQ ID NO: 3810308 - DNA, 14 bp, Homo sapiens
tgtagagtgggagc

SEQ ID NO: 3810309 - DNA, 15 bp, Homo sapiens
tgtagctttgctctt

SEQ ID NO: 3810310 - DNA, 21 bp, Homo sapiens
tgtagtgatttttatgccacc

SEQ ID NO: 3810311 - DNA, 17 bp, Homo sapiens
tgtatatgtatatctat

SEQ ID NO: 3810312 - DNA, 23 bp, Homo sapiens
tgtatcaaattatttttaagttt

SEQ ID NO: 3810313 - DNA, 22 bp, Homo sapiens
tgtatccatccatggggctgat

SEQ ID NO: 3810314 - DNA, 21 bp, Homo sapiens
tgtatccccctgtagcagcat

SEQ ID NO: 3810315 - DNA, 18 bp, Homo sapiens
tgtatggaaataaatgta

SEQ ID NO: 3810316 - DNA, 20 bp, Homo sapiens
tgtatgtgggggtctgtgtg

SEQ ID NO: 3810317 - DNA, 21 bp, Homo sapiens
tgtatgtgggggtctgtgtgt

SEQ ID NO: 3810318 - DNA, 22 bp, Homo sapiens
tgtatgtgggggtctgtgtgtt

SEQ ID NO: 3810319 - DNA, 16 bp, Homo sapiens
tgtcagaaacatgaaa

SEQ ID NO: 3810320 - DNA, 19 bp, Homo sapiens
tgtcagctgaacctgggta

SEQ ID NO: 3810321 - DNA, 22 bp, Homo sapiens
tgtccagaccattgtcttccaa

SEQ ID NO: 3810322 - DNA, 19 bp, Homo sapiens
tgtccagcttctcttgaaa

SEQ ID NO: 3810323 - DNA, 13 bp, Homo sapiens
tgtccagtttcca

SEQ ID NO: 3810324 - DNA, 12 bp, Homo sapiens
tgtccataaagt

SEQ ID NO: 3810325 - DNA, 13 bp, Homo sapiens
tgtccataaagta

SEQ ID NO: 3810326 - DNA, 23 bp, Homo sapiens
tgtccataaagtaattttgtgaa

SEQ ID NO: 3810327 - DNA, 13 bp, Homo sapiens
tgtcccaccagct

SEQ ID NO: 3810328 - DNA, 16 bp, Homo sapiens
tgtcccaggtcctcac

SEQ ID NO: 3810329 - DNA, 19 bp, Homo sapiens
tgtccccctcccctcccag

SEQ ID NO: 3810330 - DNA, 15 bp, Homo sapiens
tgtccctctctctgg

SEQ ID NO: 3810331 - DNA, 16 bp, Homo sapiens
tgtccctctctctgga

SEQ ID NO: 3810332 - DNA, 16 bp, Homo sapiens
tgtcgtaggtaaacta

SEQ ID NO: 3810333 - DNA, 14 bp, Homo sapiens
tgtctactcctcac

SEQ ID NO: 3810334 - DNA, 17 bp, Homo sapiens
tgtctactcctcacagc

SEQ ID NO: 3810335 - DNA, 21 bp, Homo sapiens
tgtctcaaaaaaagaaaaaga

SEQ ID NO: 3810336 - DNA, 13 bp, Homo sapiens
tgtctgctcccaa

SEQ ID NO: 3810337 - DNA, 19 bp, Homo sapiens
tgtctggctgaggatttca

SEQ ID NO: 3810338 - DNA, 15 bp, Homo sapiens
tgtctgtctgtctgt

SEQ ID NO: 3810339 - DNA, 14 bp, Homo sapiens
tgtcttccaacccc

SEQ ID NO: 3810340 - DNA, 19 bp, Homo sapiens
tgtcttccaaccccagctg

SEQ ID NO: 3810341 - DNA, 22 bp, Homo sapiens
tgtcttccaaccccagctggcc

SEQ ID NO: 3810342 - DNA, 16 bp, Homo sapiens
tgtcttgtgtttttgt

SEQ ID NO: 3810343 - DNA, 21 bp, Homo sapiens
tgtcttgtgtttttgtcttat

SEQ ID NO: 3810344 - DNA, 17 bp, Homo sapiens
tgtgaaaagaaaaatga

SEQ ID NO: 3810345 - DNA, 21 bp, Homo sapiens
tgtgaaaagaaaaatgagcct

SEQ ID NO: 3810346 - DNA, 19 bp, Homo sapiens
tgtgaaattcaacctgtgt

SEQ ID NO: 3810347 - DNA, 12 bp, Homo sapiens
tgtgaatacaat

SEQ ID NO: 3810348 - DNA, 15 bp, Homo sapiens
tgtgaatacaattaa

SEQ ID NO: 3810349 - DNA, 16 bp, Homo sapiens
tgtgaatgggaaaaga

SEQ ID NO: 3810350 - DNA, 17 bp, Homo sapiens
tgtgactctttccaacc

SEQ ID NO: 3810351 - DNA, 16 bp, Homo sapiens
tgtgatataaaatatt

SEQ ID NO: 3810352 - DNA, 20 bp, Homo sapiens
tgtgattcctttgaagagga

SEQ ID NO: 3810353 - DNA, 16 bp, Homo sapiens
tgtgattggcaggagg

SEQ ID NO: 3810354 - DNA, 18 bp, Homo sapiens
tgtgcccacttcatagat

SEQ ID NO: 3810355 - DNA, 14 bp, Homo sapiens
tgtgcctcctcacc

SEQ ID NO: 3810356 - DNA, 17 bp, Homo sapiens
tgtgcctttgggaggca

SEQ ID NO: 3810357 - DNA, 15 bp, Homo sapiens
tgtgctctcggcttc

SEQ ID NO: 3810358 - DNA, 22 bp, Homo sapiens
tgtggcaataaaggagaagaga

SEQ ID NO: 3810359 - DNA, 16 bp, Homo sapiens
tgtggcagctgtctca

SEQ ID NO: 3810360 - DNA, 17 bp, Homo sapiens
tgtggccaaggctgaga

SEQ ID NO: 3810361 - DNA, 17 bp, Homo sapiens
tgtggcccctgaacaag

SEQ ID NO: 3810362 - DNA, 15 bp, Homo sapiens
tgtgggagtgtgtaa

SEQ ID NO: 3810363 - DNA, 16 bp, Homo sapiens
tgtgggggtctgtgtg

SEQ ID NO: 3810364 - DNA, 20 bp, Homo sapiens
tgtgggtctgtgtgtgtgta

SEQ ID NO: 3810365 - DNA, 14 bp, Homo sapiens
tgtgtagctttgct

SEQ ID NO: 3810366 - DNA, 17 bp, Homo sapiens
tgtgtagctttgctctt

SEQ ID NO: 3810367 - DNA, 13 bp, Homo sapiens
tgtgtatgtgggg

SEQ ID NO: 3810368 - DNA, 15 bp, Homo sapiens
tgtgtcagaaacatg

SEQ ID NO: 3810369 - DNA, 17 bp, Homo sapiens
tgtgtccctctctctgg

SEQ ID NO: 3810370 - DNA, 14 bp, Homo sapiens
tgtgtctgctcagt

SEQ ID NO: 3810371 - DNA, 16 bp, Homo sapiens
tgtgtgggagtgtgta

SEQ ID NO: 3810372 - DNA, 20 bp, Homo sapiens
tgtgtgtgggagtgtgtaat

SEQ ID NO: 3810373 - DNA, 16 bp, Homo sapiens
tgtgtgtgtgtatgtg

SEQ ID NO: 3810374 - DNA, 18 bp, Homo sapiens
tgtgtgttgtgtgtggga

SEQ ID NO: 3810375 - DNA, 21 bp, Homo sapiens
tgttaacaagaggggaaaaca

SEQ ID NO: 3810376 - DNA, 22 bp, Homo sapiens
tgttactgtcctgttttctaat

SEQ ID NO: 3810377 - DNA, 15 bp, Homo sapiens
tgttatgccttgcta

SEQ ID NO: 3810378 - DNA, 14 bp, Homo sapiens
tgttattggaattt

SEQ ID NO: 3810379 - DNA, 18 bp, Homo sapiens
tgttcagaaggttgctct

SEQ ID NO: 3810380 - DNA, 22 bp, Homo sapiens
tgttcagaaggttgctctagat

SEQ ID NO: 3810381 - DNA, 17 bp, Homo sapiens
tgttctaactcttagaa

SEQ ID NO: 3810382 - DNA, 19 bp, Homo sapiens
tgttctagagtgacaggca

SEQ ID NO: 3810383 - DNA, 15 bp, Homo sapiens
tgttctctcttctcc

SEQ ID NO: 3810384 - DNA, 21 bp, Homo sapiens
tgttctgtccagtttccaaag

SEQ ID NO: 3810385 - DNA, 22 bp, Homo sapiens
tgttcttacctgtatgtctcca

SEQ ID NO: 3810386 - DNA, 12 bp, Homo sapiens
tgttggaatgaa

SEQ ID NO: 3810387 - DNA, 16 bp, Homo sapiens
tgttgtgtgtgggagt

SEQ ID NO: 3810388 - DNA, 20 bp, Homo sapiens
tgtttaaaaaaagtatatat

SEQ ID NO: 3810389 - DNA, 14 bp, Homo sapiens
tgtttattgaagaa

SEQ ID NO: 3810390 - DNA, 21 bp, Homo sapiens
tgtttattgaagaactggcat

SEQ ID NO: 3810391 - DNA, 14 bp, Homo sapiens
tgtttcttgctgta

SEQ ID NO: 3810392 - DNA, 13 bp, Homo sapiens
tgttttcttcatt

SEQ ID NO: 3810393 - DNA, 20 bp, Homo sapiens
tgttttgccaaagactgtaa

SEQ ID NO: 3810394 - DNA, 13 bp, Homo sapiens
ttaaaaaaaatcc

SEQ ID NO: 3810395 - DNA, 18 bp, Homo sapiens
ttaaaaaaagtatatatt

SEQ ID NO: 3810396 - DNA, 16 bp, Homo sapiens
ttaaaaagaatgacgt

SEQ ID NO: 3810397 - DNA, 21 bp, Homo sapiens
ttaaaactcagaatataacat

SEQ ID NO: 3810398 - DNA, 16 bp, Homo sapiens
ttaaaataaaataatt

SEQ ID NO: 3810399 - DNA, 22 bp, Homo sapiens
ttaaaatatttgtctttaaaca

SEQ ID NO: 3810400 - DNA, 13 bp, Homo sapiens
ttaaaattgtgat

SEQ ID NO: 3810401 - DNA, 14 bp, Homo sapiens
ttaaacaaaggttg

SEQ ID NO: 3810402 - DNA, 18 bp, Homo sapiens
ttaaacagtgagcctgaa

SEQ ID NO: 3810403 - DNA, 22 bp, Homo sapiens
ttaaaccagactctgttgcaat

SEQ ID NO: 3810404 - DNA, 17 bp, Homo sapiens
ttaaaccgccaaggctg

SEQ ID NO: 3810405 - DNA, 12 bp, Homo sapiens
tttgctgggaga

SEQ ID NO: 3810406 - DNA, 14 bp, Homo sapiens
tttgcttgaaagaa

SEQ ID NO: 3810407 - DNA, 12 bp, Homo sapiens
tttggcctgcct

SEQ ID NO: 3810408 - DNA, 21 bp, Homo sapiens
tttggtccttcaaaggcttgt

SEQ ID NO: 3810409 - DNA, 15 bp, Homo sapiens
tttgtagtgattttt

SEQ ID NO: 3810410 - DNA, 14 bp, Homo sapiens
tttgtccaggcctg

SEQ ID NO: 3810411 - DNA, 13 bp, Homo sapiens
tttgtcttaaaaa

SEQ ID NO: 3810412 - DNA, 14 bp, Homo sapiens
tttgtctttaaaca

SEQ ID NO: 3810413 - DNA, 14 bp, Homo sapiens
tttgttgctgtttt

SEQ ID NO: 3810414 - DNA, 16 bp, Homo sapiens
tttgttgtcagctgaa

SEQ ID NO: 3810415 - DNA, 14 bp, Homo sapiens
tttgtttcctttgt

SEQ ID NO: 3810416 - DNA, 13 bp, Homo sapiens
tttgttttcttca

SEQ ID NO: 3810417 - DNA, 16 bp, Homo sapiens
tttgttttcttcattt

SEQ ID NO: 3810418 - DNA, 18 bp, Homo sapiens
tttgttttcttcatttct

SEQ ID NO: 3810419 - DNA, 18 bp, Homo sapiens
ttttaaaaaactgctgac

SEQ ID NO: 3810420 - DNA, 19 bp, Homo sapiens
ttttaaacagtgagcctga

SEQ ID NO: 3810421 - DNA, 19 bp, Homo sapiens
ttttaaagaaaaatatgat

SEQ ID NO: 3810422 - DNA, 15 bp, Homo sapiens
ttttaagggggaaaa

SEQ ID NO: 3810423 - DNA, 21 bp, Homo sapiens
ttttaatgaatattgatgtta

SEQ ID NO: 3810424 - DNA, 14 bp, Homo sapiens
ttttactgacagaa

SEQ ID NO: 3810425 - DNA, 17 bp, Homo sapiens
ttttatttataaactag

SEQ ID NO: 3810426 - DNA, 14 bp, Homo sapiens
ttttcaagaaactg

SEQ ID NO: 3810427 - DNA, 18 bp, Homo sapiens
ttttcaataaatttctgc

SEQ ID NO: 3810428 - DNA, 15 bp, Homo sapiens
ttttcccctttctgt

SEQ ID NO: 3810429 - DNA, 13 bp, Homo sapiens
ttttcctccctca

SEQ ID NO: 3810430 - DNA, 13 bp, Homo sapiens
ttttctcctccca

SEQ ID NO: 3810431 - DNA, 14 bp, Homo sapiens
ttttctcctcccag

SEQ ID NO: 3810432 - DNA, 14 bp, Homo sapiens
ttttctgtttctgt

SEQ ID NO: 3810433 - DNA, 14 bp, Homo sapiens
ttttctttcataca

SEQ ID NO: 3810434 - DNA, 16 bp, Homo sapiens
ttttctttgtgtagct

SEQ ID NO: 3810435 - DNA, 14 bp, Homo sapiens
ttttgttttcttca

SEQ ID NO: 3810436 - DNA, 22 bp, Homo sapiens
tttttatcatgtcgtaggtaaa

SEQ ID NO: 3810437 - DNA, 14 bp, Homo sapiens
aatttactgattcc

SEQ ID NO: 3810438 - DNA, 18 bp, Homo sapiens
aatttatcctgaaatttc

SEQ ID NO: 3810439 - DNA, 23 bp, Homo sapiens
aatttatcctgaaatttcagatt

SEQ ID NO: 3810440 - DNA, 14 bp, Homo sapiens
aatttatgtgatgg

SEQ ID NO: 3810441 - DNA, 19 bp, Homo sapiens
aatttctgaaagatgagta

SEQ ID NO: 3810442 - DNA, 13 bp, Homo sapiens
aatttgaggacaa

SEQ ID NO: 3810443 - DNA, 22 bp, Homo sapiens
aattttctggaatacatgaaat

SEQ ID NO: 3810444 - DNA, 21 bp, Homo sapiens
aattttctttcatacattata

SEQ ID NO: 3810445 - DNA, 23 bp, Homo sapiens
aattttctttcatacattatatt

SEQ ID NO: 3810446 - DNA, 14 bp, Homo sapiens
acaaaacttttcta

SEQ ID NO: 3810447 - DNA, 14 bp, Homo sapiens
acaaaataaacaaa

SEQ ID NO: 3810448 - DNA, 12 bp, Homo sapiens
acaaatatttat

SEQ ID NO: 3810449 - DNA, 18 bp, Homo sapiens
acaacagttctcttctag

SEQ ID NO: 3810450 - DNA, 18 bp, Homo sapiens
acaacatttttgtacatt

SEQ ID NO: 3810451 - DNA, 14 bp, Homo sapiens
acaaccattccaga

SEQ ID NO: 3810452 - DNA, 22 bp, Homo sapiens
acaagctgcaccctcaggcagg

SEQ ID NO: 3810453 - DNA, 13 bp, Homo sapiens
acaaggctgacca

SEQ ID NO: 3810454 - DNA, 11 bp, Homo sapiens
acaagttgcct

SEQ ID NO: 3810455 - DNA, 17 bp, Homo sapiens
acaatgtgaaaagaaaa

SEQ ID NO: 3810456 - DNA, 14 bp, Homo sapiens
acaatgtttttcat

SEQ ID NO: 3810457 - DNA, 18 bp, Homo sapiens
acacacatggatgagcac

SEQ ID NO: 3810458 - DNA, 19 bp, Homo sapiens
acacaccccacaccccagc

SEQ ID NO: 3810459 - DNA, 20 bp, Homo sapiens
acacaccccacaccccagcc

SEQ ID NO: 3810460 - DNA, 21 bp, Homo sapiens
acacaccccacaccccagccc

SEQ ID NO: 3810461 - DNA, 15 bp, Homo sapiens
acacactcagcagcc

SEQ ID NO: 3810462 - DNA, 17 bp, Homo sapiens
acacagagatatgcaca

SEQ ID NO: 3810463 - DNA, 12 bp, Homo sapiens
acacagaggaag

SEQ ID NO: 3810464 - DNA, 21 bp, Homo sapiens
acacagcctgggaccagggca

SEQ ID NO: 3810465 - DNA, 22 bp, Homo sapiens
acacagcctgggaccagggcat

SEQ ID NO: 3810466 - DNA, 14 bp, Homo sapiens
acacagtgtttcct

SEQ ID NO: 3810467 - DNA, 23 bp, Homo sapiens
acacagtgtttcctgagtagcag

SEQ ID NO: 3810468 - DNA, 20 bp, Homo sapiens
acacccaaagaggtatttat

SEQ ID NO: 3810469 - DNA, 12 bp, Homo sapiens
acacccactggc

SEQ ID NO: 3810470 - DNA, 15 bp, Homo sapiens
acacccactggccag

SEQ ID NO: 3810471 - DNA, 18 bp, Homo sapiens
acaccccacaccccagcc

SEQ ID NO: 3810472 - DNA, 12 bp, Homo sapiens
acaccccagccc

SEQ ID NO: 3810473 - DNA, 23 bp, Homo sapiens
acacctaggctagggtggggaga

SEQ ID NO: 3810474 - DNA, 22 bp, Homo sapiens
acacctccctgaaccatccctg

SEQ ID NO: 3810475 - DNA, 18 bp, Homo sapiens
acacctctgcacaagctg

SEQ ID NO: 3810476 - DNA, 12 bp, Homo sapiens
acacctgccctg

SEQ ID NO: 3810477 - DNA, 13 bp, Homo sapiens
acacctgccctgc

SEQ ID NO: 3810478 - DNA, 18 bp, Homo sapiens
acacctgccctgccctgc

SEQ ID NO: 3810479 - DNA, 20 bp, Homo sapiens
acacctgccctgccctgcca

SEQ ID NO: 3810480 - DNA, 23 bp, Homo sapiens
acacggatgcacagagatatgca

SEQ ID NO: 3810481 - DNA, 15 bp, Homo sapiens
acactcaaaagctgg

SEQ ID NO: 3810482 - DNA, 15 bp, Homo sapiens
acactcaaggaaaag

SEQ ID NO: 3810483 - DNA, 17 bp, Homo sapiens
acactgagccccacctc

SEQ ID NO: 3810484 - DNA, 11 bp, Homo sapiens
acactgccagc

SEQ ID NO: 3810485 - DNA, 17 bp, Homo sapiens
acactggcatctccctg

SEQ ID NO: 3810486 - DNA, 22 bp, Homo sapiens
acactgggctctgaggagtgga

SEQ ID NO: 3810487 - DNA, 21 bp, Homo sapiens
acactggtgggcagctgagga

SEQ ID NO: 3810488 - DNA, 20 bp, Homo sapiens
acagacagtatgtctactcc

SEQ ID NO: 3810489 - DNA, 23 bp, Homo sapiens
acagactgcgatttgtcccaggt

SEQ ID NO: 3810490 - DNA, 15 bp, Homo sapiens
acagagacaggccca

SEQ ID NO: 3810491 - DNA, 21 bp, Homo sapiens
acagagagagactgagggaga

SEQ ID NO: 3810492 - DNA, 13 bp, Homo sapiens
acagagccagagg

SEQ ID NO: 3810493 - DNA, 16 bp, Homo sapiens
acagaggaagagcagg

SEQ ID NO: 3810494 - DNA, 23 bp, Homo sapiens
acagaggacagtatttgtgggga

SEQ ID NO: 3810495 - DNA, 15 bp, Homo sapiens
acagatatacacatg

SEQ ID NO: 3810496 - DNA, 21 bp, Homo sapiens
acagatatgcacacacatgga

SEQ ID NO: 3810497 - DNA, 12 bp, Homo sapiens
acagatgatact

SEQ ID NO: 3810498 - DNA, 15 bp, Homo sapiens
acagcaattcctcag

SEQ ID NO: 3810499 - DNA, 23 bp, Homo sapiens
acagctcaagtcttccctgatca

SEQ ID NO: 3810500 - DNA, 19 bp, Homo sapiens
acaggcaaaatccttgctt

SEQ ID NO: 3810501 - DNA, 12 bp, Homo sapiens
acaggcaccaga

SEQ ID NO: 3810502 - DNA, 13 bp, Homo sapiens
acaggctctgaga

SEQ ID NO: 3810503 - DNA, 14 bp, Homo sapiens
acagggagctggca

SEQ ID NO: 3810504 - DNA, 20 bp, Homo sapiens
acagtcctcacagcctctcc

SEQ ID NO: 3810505 - DNA, 22 bp, Homo sapiens
acagtcctcacagcctctccct

SEQ ID NO: 3810506 - DNA, 14 bp, Homo sapiens
acagtgagcctgaa

SEQ ID NO: 3810507 - DNA, 17 bp, Homo sapiens
acagtgagcctgaattt

SEQ ID NO: 3810508 - DNA, 18 bp, Homo sapiens
acagtgagcctgaatttt

SEQ ID NO: 3810509 - DNA, 20 bp, Homo sapiens
acagttcaagaaagcttcaa

SEQ ID NO: 3810510 - DNA, 15 bp, Homo sapiens
acagttgaaaaacag

SEQ ID NO: 3810511 - DNA, 12 bp, Homo sapiens
acataaaggtat

SEQ ID NO: 3810512 - DNA, 18 bp, Homo sapiens
acatagagatatgcacac

SEQ ID NO: 3810513 - DNA, 14 bp, Homo sapiens
acatatatgtatat

SEQ ID NO: 3810514 - DNA, 16 bp, Homo sapiens
acatcacttgtacaaa

SEQ ID NO: 3810515 - DNA, 19 bp, Homo sapiens
acatcacttgtacaaaata

SEQ ID NO: 3810516 - DNA, 23 bp, Homo sapiens
acatccaaggagaaacagagaca

SEQ ID NO: 3810517 - DNA, 18 bp, Homo sapiens
acatctaataagtatata

SEQ ID NO: 3810518 - DNA, 22 bp, Homo sapiens
acatgattttcttttgttttct

SEQ ID NO: 3810519 - DNA, 20 bp, Homo sapiens
acatgcttcatgaaaatcct

SEQ ID NO: 3810520 - DNA, 23 bp, Homo sapiens
acatgcttcatgaaaatcctacc

SEQ ID NO: 3810521 - DNA, 13 bp, Homo sapiens
acatggagagaga

SEQ ID NO: 3810522 - DNA, 16 bp, Homo sapiens
acatggagagagactc

SEQ ID NO: 3810523 - DNA, 18 bp, Homo sapiens
acatggatgcacgcacat

SEQ ID NO: 3810524 - DNA, 21 bp, Homo sapiens
acatgtccagtgggaggtgag

SEQ ID NO: 3810525 - DNA, 18 bp, Homo sapiens
acattaaagatttctgct

SEQ ID NO: 3810526 - DNA, 16 bp, Homo sapiens
acattatgttattgga

SEQ ID NO: 3810527 - DNA, 15 bp, Homo sapiens
acattcctctgcagc

SEQ ID NO: 3810528 - DNA, 22 bp, Homo sapiens
acattctctaggagaaacttag

SEQ ID NO: 3810529 - DNA, 20 bp, Homo sapiens
acattttgtacaaagatatg

SEQ ID NO: 3810530 - DNA, 17 bp, Homo sapiens
acatttttgtacattat

SEQ ID NO: 3810531 - DNA, 14 bp, Homo sapiens
accaacccaaatat

SEQ ID NO: 3810532 - DNA, 19 bp, Homo sapiens
accaacctgaagacaccgt

SEQ ID NO: 3810533 - DNA, 13 bp, Homo sapiens
accaagagagaaa

SEQ ID NO: 3810534 - DNA, 22 bp, Homo sapiens
accacacctccctgaaccatcc

SEQ ID NO: 3810535 - DNA, 20 bp, Homo sapiens
accagagaaaaagggagggg

SEQ ID NO: 3810536 - DNA, 14 bp, Homo sapiens
accagcagcctgga

SEQ ID NO: 3810537 - DNA, 17 bp, Homo sapiens
accagcagcctggaccc

SEQ ID NO: 3810538 - DNA, 18 bp, Homo sapiens
accaggcagctccagctg

SEQ ID NO: 3810539 - DNA, 16 bp, Homo sapiens
accaggccccagcctc

SEQ ID NO: 3810540 - DNA, 19 bp, Homo sapiens
accagggcagtgaaaatga

SEQ ID NO: 3810541 - DNA, 14 bp, Homo sapiens
accatctctttacc

SEQ ID NO: 3810542 - DNA, 22 bp, Homo sapiens
accatgattaaccacttcagct

SEQ ID NO: 3810543 - DNA, 23 bp, Homo sapiens
accatgattaaccacttcagctg

SEQ ID NO: 3810544 - DNA, 21 bp, Homo sapiens
accattgtcttccaaccccag

SEQ ID NO: 3810545 - DNA, 19 bp, Homo sapiens
agctcctgtccctacccac

SEQ ID NO: 3810546 - DNA, 16 bp, Homo sapiens
agctctctcctccctt

SEQ ID NO: 3810547 - DNA, 15 bp, Homo sapiens
agctgacagagccag

SEQ ID NO: 3810548 - DNA, 16 bp, Homo sapiens
agctgacagagccaga

SEQ ID NO: 3810549 - DNA, 15 bp, Homo sapiens
agctgacttttctgt

SEQ ID NO: 3810550 - DNA, 17 bp, Homo sapiens
agctgcaccctcaggca

SEQ ID NO: 3810551 - DNA, 18 bp, Homo sapiens
agctgcaccctcaggcag

SEQ ID NO: 3810552 - DNA, 15 bp, Homo sapiens
agctgccaagtaaat

SEQ ID NO: 3810553 - DNA, 22 bp, Homo sapiens
agctgccaagtaaatagcaaca

SEQ ID NO: 3810554 - DNA, 14 bp, Homo sapiens
agctgctccccacg

SEQ ID NO: 3810555 - DNA, 17 bp, Homo sapiens
agctgctccccacgtca

SEQ ID NO: 3810556 - DNA, 13 bp, Homo sapiens
agctggaagcact

SEQ ID NO: 3810557 - DNA, 18 bp, Homo sapiens
agctggaagcactgctgt

SEQ ID NO: 3810558 - DNA, 15 bp, Homo sapiens
agctggcattacagc

SEQ ID NO: 3810559 - DNA, 17 bp, Homo sapiens
agctgtagaactctgca

SEQ ID NO: 3810560 - DNA, 20 bp, Homo sapiens
agctgtagaactctgcaggc

SEQ ID NO: 3810561 - DNA, 23 bp, Homo sapiens
agctgtagaactctgcaggcaga

SEQ ID NO: 3810562 - DNA, 14 bp, Homo sapiens
agctgttactgtct

SEQ ID NO: 3810563 - DNA, 20 bp, Homo sapiens
agcttagagtatacctccta

SEQ ID NO: 3810564 - DNA, 12 bp, Homo sapiens
agcttatctcag

SEQ ID NO: 3810565 - DNA, 17 bp, Homo sapiens
agcttcccccaaggctg

SEQ ID NO: 3810566 - DNA, 12 bp, Homo sapiens
agcttgggaatg

SEQ ID NO: 3810567 - DNA, 14 bp, Homo sapiens
agcttgggaatgga

SEQ ID NO: 3810568 - DNA, 17 bp, Homo sapiens
agctttcaaagaaggaa

SEQ ID NO: 3810569 - DNA, 13 bp, Homo sapiens
agctttctccttt

SEQ ID NO: 3810570 - DNA, 19 bp, Homo sapiens
agctttgaaaattcagtgg

SEQ ID NO: 3810571 - DNA, 21 bp, Homo sapiens
agctttgctaccaaagcacct

SEQ ID NO: 3810572 - DNA, 10 bp, Homo sapiens
agctttgctc

SEQ ID NO: 3810573 - DNA, 21 bp, Homo sapiens
agctttgctctttggtagaaa

SEQ ID NO: 3810574 - DNA, 22 bp, Homo sapiens
aggaactgctgggcttggcagc

SEQ ID NO: 3810575 - DNA, 16 bp, Homo sapiens
aggaagacacagccca

SEQ ID NO: 3810576 - DNA, 14 bp, Homo sapiens
aggaagagaaaaaa

SEQ ID NO: 3810577 - DNA, 12 bp, Homo sapiens
aggaagagcagg

SEQ ID NO: 3810578 - DNA, 23 bp, Homo sapiens
aggaattcccagcccaaagctgt

SEQ ID NO: 3810579 - DNA, 14 bp, Homo sapiens
aggaattttctttg

SEQ ID NO: 3810580 - DNA, 14 bp, Homo sapiens
aggacaacctgccc

SEQ ID NO: 3810581 - DNA, 15 bp, Homo sapiens
aggacaacctgcccc

SEQ ID NO: 3810582 - DNA, 21 bp, Homo sapiens
aggacaacctgcccctcccca

SEQ ID NO: 3810583 - DNA, 16 bp, Homo sapiens
aggacatggagagaga

SEQ ID NO: 3810584 - DNA, 18 bp, Homo sapiens
aggacatggagagagact

SEQ ID NO: 3810585 - DNA, 14 bp, Homo sapiens
aggagaaacagaga

SEQ ID NO: 3810586 - DNA, 15 bp, Homo sapiens
aggagaatgagcctc

SEQ ID NO: 3810587 - DNA, 15 bp, Homo sapiens
aggagagctagcagc

SEQ ID NO: 3810588 - DNA, 15 bp, Homo sapiens
aggagaggagagggg

SEQ ID NO: 3810589 - DNA, 16 bp, Homo sapiens
aggagaggggcacagg

SEQ ID NO: 3810590 - DNA, 19 bp, Homo sapiens
aggagctgacagagccaga

SEQ ID NO: 3810591 - DNA, 23 bp, Homo sapiens
aggagggttgggcgtgctacctg

SEQ ID NO: 3810592 - DNA, 21 bp, Homo sapiens
aggagtttgagaccaacctgg

SEQ ID NO: 3810593 - DNA, 15 bp, Homo sapiens
aggataaattacatt

SEQ ID NO: 3810594 - DNA, 21 bp, Homo sapiens
aggatcatttgttggaatgaa

SEQ ID NO: 3810595 - DNA, 19 bp, Homo sapiens
aggatcccatgagctcctt

SEQ ID NO: 3810596 - DNA, 12 bp, Homo sapiens
aggatctcttga

SEQ ID NO: 3810597 - DNA, 19 bp, Homo sapiens
aggatctcttgagcctggg

SEQ ID NO: 3810598 - DNA, 14 bp, Homo sapiens
aggatggagagagg

SEQ ID NO: 3810599 - DNA, 19 bp, Homo sapiens
aggatggagagaggggaat

SEQ ID NO: 3810600 - DNA, 22 bp, Homo sapiens
aggatggtcttgatctcctgag

SEQ ID NO: 3810601 - DNA, 13 bp, Homo sapiens
aggattcccagag

SEQ ID NO: 3810602 - DNA, 12 bp, Homo sapiens
aggatttcaagc

SEQ ID NO: 3810603 - DNA, 15 bp, Homo sapiens
aggatttcaagcctg

SEQ ID NO: 3810604 - DNA, 16 bp, Homo sapiens
aggatttcaagcctgc

SEQ ID NO: 3810605 - DNA, 15 bp, Homo sapiens
aggcaagtttgttca

SEQ ID NO: 3810606 - DNA, 19 bp, Homo sapiens
aggcaatggcctaaacttc

SEQ ID NO: 3810607 - DNA, 20 bp, Homo sapiens
aggcacaaaattttgtttaa

SEQ ID NO: 3810608 - DNA, 22 bp, Homo sapiens
aggcacccccaggattcccaga

SEQ ID NO: 3810609 - DNA, 13 bp, Homo sapiens
aggcatcccaggg

SEQ ID NO: 3810610 - DNA, 14 bp, Homo sapiens
aggcatctgcaccc

SEQ ID NO: 3810611 - DNA, 15 bp, Homo sapiens
aggcatggtggccca

SEQ ID NO: 3810612 - DNA, 18 bp, Homo sapiens
aggccaaggtgggaggat

SEQ ID NO: 3810613 - DNA, 18 bp, Homo sapiens
aggccaagtcaggccctt

SEQ ID NO: 3810614 - DNA, 12 bp, Homo sapiens
aggccactcagg

SEQ ID NO: 3810615 - DNA, 13 bp, Homo sapiens
aggccccagcctc

SEQ ID NO: 3810616 - DNA, 19 bp, Homo sapiens
aggccccagcctccaggcc

SEQ ID NO: 3810617 - DNA, 14 bp, Homo sapiens
aggccccaggccct

SEQ ID NO: 3810618 - DNA, 17 bp, Homo sapiens
aggccctaggattcctc

SEQ ID NO: 3810619 - DNA, 22 bp, Homo sapiens
aggccctaggattcctccccca

SEQ ID NO: 3810620 - DNA, 20 bp, Homo sapiens
aggcccttattttcaagaaa

SEQ ID NO: 3810621 - DNA, 22 bp, Homo sapiens
aggcccttattttcaagaaact

SEQ ID NO: 3810622 - DNA, 18 bp, Homo sapiens
aggcgaagcgttgtcctc

SEQ ID NO: 3810623 - DNA, 15 bp, Homo sapiens
aggcgctggacagag

SEQ ID NO: 3810624 - DNA, 14 bp, Homo sapiens
aggctagggtgggg

SEQ ID NO: 3810625 - DNA, 19 bp, Homo sapiens
aggctcagagggtgtcctg

SEQ ID NO: 3810626 - DNA, 22 bp, Homo sapiens
aggctgaccaagagagaaagaa

SEQ ID NO: 3810627 - DNA, 20 bp, Homo sapiens
aggctgaggcaccagaattg

SEQ ID NO: 3810628 - DNA, 17 bp, Homo sapiens
aggctgcagtgagccga

SEQ ID NO: 3810629 - DNA, 14 bp, Homo sapiens
aggctgggctctgg

SEQ ID NO: 3810630 - DNA, 14 bp, Homo sapiens
aggctttcagggcc

SEQ ID NO: 3810631 - DNA, 15 bp, Homo sapiens
agggaaaagctaaga

SEQ ID NO: 3810632 - DNA, 14 bp, Homo sapiens
agggaattctcttg

SEQ ID NO: 3810633 - DNA, 15 bp, Homo sapiens
agggaattctcttgg

SEQ ID NO: 3810634 - DNA, 18 bp, Homo sapiens
agggacagaagcaggagt

SEQ ID NO: 3810635 - DNA, 14 bp, Homo sapiens
agggagagatgagt

SEQ ID NO: 3810636 - DNA, 13 bp, Homo sapiens
agggagataaaag

SEQ ID NO: 3810637 - DNA, 15 bp, Homo sapiens
agggatcacagggcc

SEQ ID NO: 3810638 - DNA, 18 bp, Homo sapiens
agggatcagccctgccct

SEQ ID NO: 3810639 - DNA, 22 bp, Homo sapiens
agggatttggggctcagagtgg

SEQ ID NO: 3810640 - DNA, 15 bp, Homo sapiens
agggcctccagccct

SEQ ID NO: 3810641 - DNA, 22 bp, Homo sapiens
aggggagggaaaagctaagagg

SEQ ID NO: 3810642 - DNA, 15 bp, Homo sapiens
aggggcacagggtct

SEQ ID NO: 3810643 - DNA, 23 bp, Homo sapiens
agggggtgattagagggaggaga

SEQ ID NO: 3810644 - DNA, 14 bp, Homo sapiens
agggtaactcttgg

SEQ ID NO: 3810645 - DNA, 22 bp, Homo sapiens
agggtgtccggtccctgtccca

SEQ ID NO: 3810646 - DNA, 19 bp, Homo sapiens
aggtgacttgcctggggcc

SEQ ID NO: 3810647 - DNA, 16 bp, Homo sapiens
aggtgagaagcagagg

SEQ ID NO: 3810648 - DNA, 21 bp, Homo sapiens
aggtgagaagcagaggaagga

SEQ ID NO: 3810649 - DNA, 16 bp, Homo sapiens
aggtgagaccacctct

SEQ ID NO: 3810650 - DNA, 21 bp, Homo sapiens
aggtgcttctagttctgccag

SEQ ID NO: 3810651 - DNA, 22 bp, Homo sapiens
aggtgcttctagttctgccagg

SEQ ID NO: 3810652 - DNA, 23 bp, Homo sapiens
aggtgcttctagttctgccagga

SEQ ID NO: 3810653 - DNA, 18 bp, Homo sapiens
aggtggaggttgcagtga

SEQ ID NO: 3810654 - DNA, 15 bp, Homo sapiens
atggagagaggggaa

SEQ ID NO: 3810655 - DNA, 17 bp, Homo sapiens
atggagagaggggaata

SEQ ID NO: 3810656 - DNA, 18 bp, Homo sapiens
atggaggatggagagagg

SEQ ID NO: 3810657 - DNA, 15 bp, Homo sapiens
atggcaattttgtaa

SEQ ID NO: 3810658 - DNA, 19 bp, Homo sapiens
atggcacgatctcagctca

SEQ ID NO: 3810659 - DNA, 12 bp, Homo sapiens
atggccttccct

SEQ ID NO: 3810660 - DNA, 14 bp, Homo sapiens
atggccttccctcc

SEQ ID NO: 3810661 - DNA, 14 bp, Homo sapiens
atgggaaaagagat

SEQ ID NO: 3810662 - DNA, 22 bp, Homo sapiens
atgggagctggttagaaatgca

SEQ ID NO: 3810663 - DNA, 14 bp, Homo sapiens
atggtaattgttgc

SEQ ID NO: 3810664 - DNA, 14 bp, Homo sapiens
atggttcttcacct

SEQ ID NO: 3810665 - DNA, 16 bp, Homo sapiens
atgtaaaaaatgtaaa

SEQ ID NO: 3810666 - DNA, 18 bp, Homo sapiens
atgtaaacaatgtaaagt

SEQ ID NO: 3810667 - DNA, 18 bp, Homo sapiens
atgtaacttttgtaagac

SEQ ID NO: 3810668 - DNA, 14 bp, Homo sapiens
atgtatatgtatat

SEQ ID NO: 3810669 - DNA, 17 bp, Homo sapiens
atgtatatgtatatcta

SEQ ID NO: 3810670 - DNA, 18 bp, Homo sapiens
atgtatatgtatatctat

SEQ ID NO: 3810671 - DNA, 19 bp, Homo sapiens
atgtatatgtatatctata

SEQ ID NO: 3810672 - DNA, 13 bp, Homo sapiens
atgtcagaaactc

SEQ ID NO: 3810673 - DNA, 14 bp, Homo sapiens
atgtcagtatgtgg

SEQ ID NO: 3810674 - DNA, 14 bp, Homo sapiens
atgtgaatgtggca

SEQ ID NO: 3810675 - DNA, 23 bp, Homo sapiens
atgtgacaacatttttgtacatt

SEQ ID NO: 3810676 - DNA, 12 bp, Homo sapiens
atgtgactcttt

SEQ ID NO: 3810677 - DNA, 16 bp, Homo sapiens
atgtgactctttccaa

SEQ ID NO: 3810678 - DNA, 21 bp, Homo sapiens
atgtgactctttccaaccggc

SEQ ID NO: 3810679 - DNA, 18 bp, Homo sapiens
atgtgatataaaatattc

SEQ ID NO: 3810680 - DNA, 14 bp, Homo sapiens
atgtgattgttcca

SEQ ID NO: 3810681 - DNA, 19 bp, Homo sapiens
atgtgctcccaccaggcag

SEQ ID NO: 3810682 - DNA, 18 bp, Homo sapiens
atgtgctctcggcttcac

SEQ ID NO: 3810683 - DNA, 18 bp, Homo sapiens
atgtggcccctgaacaag

SEQ ID NO: 3810684 - DNA, 16 bp, Homo sapiens
atgtgggggtctgtgt

SEQ ID NO: 3810685 - DNA, 22 bp, Homo sapiens
atgttaacaagaggggaaaaca

SEQ ID NO: 3810686 - DNA, 17 bp, Homo sapiens
atgttattggaattttc

SEQ ID NO: 3810687 - DNA, 23 bp, Homo sapiens
atgttcagaaggttgctctagat

SEQ ID NO: 3810688 - DNA, 17 bp, Homo sapiens
atgtttacagaggacag

SEQ ID NO: 3810689 - DNA, 19 bp, Homo sapiens
attaaaaagaataaacaca

SEQ ID NO: 3810690 - DNA, 13 bp, Homo sapiens
attaaaacagtgt

SEQ ID NO: 3810691 - DNA, 14 bp, Homo sapiens
attaaaggcttttg

SEQ ID NO: 3810692 - DNA, 21 bp, Homo sapiens
attaaataacagtgtgtgacc

SEQ ID NO: 3810693 - DNA, 17 bp, Homo sapiens
attaaccacttcagctg

SEQ ID NO: 3810694 - DNA, 20 bp, Homo sapiens
attaaccacttcagctgact

SEQ ID NO: 3810695 - DNA, 19 bp, Homo sapiens
attacattgctttttcttg

SEQ ID NO: 3810696 - DNA, 18 bp, Homo sapiens
attacttatttttgacag

SEQ ID NO: 3810697 - DNA, 19 bp, Homo sapiens
attacttatttttgacagt

SEQ ID NO: 3810698 - DNA, 21 bp, Homo sapiens
attagagggaggagaatgagc

SEQ ID NO: 3810699 - DNA, 22 bp, Homo sapiens
attagatattaggggggaaagt

SEQ ID NO: 3810700 - DNA, 20 bp, Homo sapiens
attagtttgatttaatatct

SEQ ID NO: 3810701 - DNA, 22 bp, Homo sapiens
attagtttgatttaatatctga

SEQ ID NO: 3810702 - DNA, 12 bp, Homo sapiens
attatatatcat

SEQ ID NO: 3810703 - DNA, 19 bp, Homo sapiens
attatatatcataaagtat

SEQ ID NO: 3810704 - DNA, 20 bp, Homo sapiens
attatgttattggaattttc

SEQ ID NO: 3810705 - DNA, 22 bp, Homo sapiens
attatgttattggaattttctt

SEQ ID NO: 3810706 - DNA, 21 bp, Homo sapiens
attattacttatttttgacag

SEQ ID NO: 3810707 - DNA, 20 bp, Homo sapiens
attatttttcaagtaataaa

SEQ ID NO: 3810708 - DNA, 17 bp, Homo sapiens
attcaggtgttctcttc

SEQ ID NO: 3810709 - DNA, 15 bp, Homo sapiens
attcatgctttctcc

SEQ ID NO: 3810710 - DNA, 16 bp, Homo sapiens
attcatgctttctcct

SEQ ID NO: 3810711 - DNA, 17 bp, Homo sapiens
attcatgctttctcctt

SEQ ID NO: 3810712 - DNA, 17 bp, Homo sapiens
attcatggcctggggga

SEQ ID NO: 3810713 - DNA, 20 bp, Homo sapiens
attcccactaagctttctcc

SEQ ID NO: 3810714 - DNA, 22 bp, Homo sapiens
attcccactaagctttctcctt

SEQ ID NO: 3810715 - DNA, 23 bp, Homo sapiens
attcccactaagctttctccttt

SEQ ID NO: 3810716 - DNA, 19 bp, Homo sapiens
attcccagagcaaaataat

SEQ ID NO: 3810717 - DNA, 12 bp, Homo sapiens
attcccagccca

SEQ ID NO: 3810718 - DNA, 14 bp, Homo sapiens
attccccattcttc

SEQ ID NO: 3810719 - DNA, 17 bp, Homo sapiens
attcctcccccagagcc

SEQ ID NO: 3810720 - DNA, 15 bp, Homo sapiens
attcctctaaaactc

SEQ ID NO: 3810721 - DNA, 20 bp, Homo sapiens
attcctttgaagaggaaaat

SEQ ID NO: 3810722 - DNA, 19 bp, Homo sapiens
attctacacatatatgtat

SEQ ID NO: 3810723 - DNA, 13 bp, Homo sapiens
attctaggcatcc

SEQ ID NO: 3810724 - DNA, 17 bp, Homo sapiens
attctcttggctggctt

SEQ ID NO: 3810725 - DNA, 16 bp, Homo sapiens
attctcttgtctggct

SEQ ID NO: 3810726 - DNA, 17 bp, Homo sapiens
attctcttgtctggctg

SEQ ID NO: 3810727 - DNA, 19 bp, Homo sapiens
attctttcccaacacctct

SEQ ID NO: 3810728 - DNA, 21 bp, Homo sapiens
attgatgtcattcagcagtca

SEQ ID NO: 3810729 - DNA, 13 bp, Homo sapiens
attgatttcaaga

SEQ ID NO: 3810730 - DNA, 17 bp, Homo sapiens
attgccttaaggccaca

SEQ ID NO: 3810731 - DNA, 16 bp, Homo sapiens
attgcgagaattttca

SEQ ID NO: 3810732 - DNA, 18 bp, Homo sapiens
attgcttgagctcaggag

SEQ ID NO: 3810733 - DNA, 13 bp, Homo sapiens
attggaattttct

SEQ ID NO: 3810734 - DNA, 14 bp, Homo sapiens
attggcaggaggca

SEQ ID NO: 3810735 - DNA, 17 bp, Homo sapiens
attgtagagccagaggt

SEQ ID NO: 3810736 - DNA, 17 bp, Homo sapiens
attgtcttccaacccca

SEQ ID NO: 3810737 - DNA, 22 bp, Homo sapiens
attgtcttccaaccccagctgg

SEQ ID NO: 3810738 - DNA, 15 bp, Homo sapiens
attgtgattattgtt

SEQ ID NO: 3810739 - DNA, 18 bp, Homo sapiens
attgtgtcagaaacatga

SEQ ID NO: 3810740 - DNA, 20 bp, Homo sapiens
atttaaaattgtgatgtgtc

SEQ ID NO: 3810741 - DNA, 13 bp, Homo sapiens
atttaacaagatc

SEQ ID NO: 3810742 - DNA, 16 bp, Homo sapiens
atttagtgctaaacaa

SEQ ID NO: 3810743 - DNA, 19 bp, Homo sapiens
atttatcctgaaatttcag

SEQ ID NO: 3810744 - DNA, 14 bp, Homo sapiens
atttatttatgtag

SEQ ID NO: 3810745 - DNA, 18 bp, Homo sapiens
atttcaaccgcttgccat

SEQ ID NO: 3810746 - DNA, 19 bp, Homo sapiens
atttcaggggtcgtcacca

SEQ ID NO: 3810747 - DNA, 15 bp, Homo sapiens
atttccacataaagg

SEQ ID NO: 3810748 - DNA, 17 bp, Homo sapiens
atttccagccaaagcct

SEQ ID NO: 3810749 - DNA, 15 bp, Homo sapiens
atttcttcctctgca

SEQ ID NO: 3810750 - DNA, 22 bp, Homo sapiens
atttgaggacaaccattccaga

SEQ ID NO: 3810751 - DNA, 13 bp, Homo sapiens
atttgcattgtgt

SEQ ID NO: 3810752 - DNA, 14 bp, Homo sapiens
atttgcctgcctgg

SEQ ID NO: 3810753 - DNA, 17 bp, Homo sapiens
atttgcctgcctgggcc

SEQ ID NO: 3810754 - DNA, 23 bp, Homo sapiens
atttgctatattttaatattgtt

SEQ ID NO: 3810755 - DNA, 16 bp, Homo sapiens
atttgctatgagctgg

SEQ ID NO: 3810756 - DNA, 22 bp, Homo sapiens
atttgtggggagggatttgggg

SEQ ID NO: 3810757 - DNA, 14 bp, Homo sapiens
atttgttggaatga

SEQ ID NO: 3810758 - DNA, 11 bp, Homo sapiens
attttaacaag

SEQ ID NO: 3810759 - DNA, 14 bp, Homo sapiens
attttaagagaaaa

SEQ ID NO: 3810760 - DNA, 16 bp, Homo sapiens
attttaagggggaaaa

SEQ ID NO: 3810761 - DNA, 18 bp, Homo sapiens
attttaagggggaaaact

SEQ ID NO: 3810762 - DNA, 19 bp, Homo sapiens
attttaatttactgattcc

SEQ ID NO: 3810763 - DNA, 13 bp, Homo sapiens
cagaacaggggca

SEQ ID NO: 3810764 - DNA, 22 bp, Homo sapiens
cagaactaggagtcttcactgc

SEQ ID NO: 3810765 - DNA, 13 bp, Homo sapiens
cagaagcaggagt

SEQ ID NO: 3810766 - DNA, 23 bp, Homo sapiens
cagaaggttgctctagattgaga

SEQ ID NO: 3810767 - DNA, 13 bp, Homo sapiens
cagaatattaaat

SEQ ID NO: 3810768 - DNA, 20 bp, Homo sapiens
cagaccacaaaacttttcta

SEQ ID NO: 3810769 - DNA, 23 bp, Homo sapiens
cagaccattgtcttccaacccca

SEQ ID NO: 3810770 - DNA, 20 bp, Homo sapiens
cagacctctgaatgtcccag

SEQ ID NO: 3810771 - DNA, 21 bp, Homo sapiens
cagacctctgaatgtcccaga

SEQ ID NO: 3810772 - DNA, 23 bp, Homo sapiens
cagacctctgaatgtcccagagg

SEQ ID NO: 3810773 - DNA, 17 bp, Homo sapiens
cagacgtgagtgtgact

SEQ ID NO: 3810774 - DNA, 20 bp, Homo sapiens
cagactgcttccaattttct

SEQ ID NO: 3810775 - DNA, 12 bp, Homo sapiens
cagacttcccac

SEQ ID NO: 3810776 - DNA, 12 bp, Homo sapiens
cagagaaaaagg

SEQ ID NO: 3810777 - DNA, 15 bp, Homo sapiens
cagagaatttctacc

SEQ ID NO: 3810778 - DNA, 13 bp, Homo sapiens
cagagacagaaac

SEQ ID NO: 3810779 - DNA, 19 bp, Homo sapiens
cagagacaggcccaagaga

SEQ ID NO: 3810780 - DNA, 21 bp, Homo sapiens
cagagagagactgagggagag

SEQ ID NO: 3810781 - DNA, 20 bp, Homo sapiens
cagagcaagactctgtctca

SEQ ID NO: 3810782 - DNA, 20 bp, Homo sapiens
cagagcaagtgagaccctgt

SEQ ID NO: 3810783 - DNA, 14 bp, Homo sapiens
cagagccaaggcca

SEQ ID NO: 3810784 - DNA, 15 bp, Homo sapiens
cagagccaaggccac

SEQ ID NO: 3810785 - DNA, 16 bp, Homo sapiens
cagagccaaggccacc

SEQ ID NO: 3810786 - DNA, 14 bp, Homo sapiens
cagagccagaggca

SEQ ID NO: 3810787 - DNA, 23 bp, Homo sapiens
cagagctgagtggcagccgcctc

SEQ ID NO: 3810788 - DNA, 19 bp, Homo sapiens
cagagctggcagcctccag

SEQ ID NO: 3810789 - DNA, 21 bp, Homo sapiens
cagagctggcagcctccagtg

SEQ ID NO: 3810790 - DNA, 12 bp, Homo sapiens
cagaggaagagc

SEQ ID NO: 3810791 - DNA, 14 bp, Homo sapiens
cagaggaagagcag

SEQ ID NO: 3810792 - DNA, 11 bp, Homo sapiens
cagatcctacc

SEQ ID NO: 3810793 - DNA, 16 bp, Homo sapiens
cagatctttttgtgaa

SEQ ID NO: 3810794 - DNA, 15 bp, Homo sapiens
cagatgcacacacag

SEQ ID NO: 3810795 - DNA, 15 bp, Homo sapiens
cagatggagaaacag

SEQ ID NO: 3810796 - DNA, 17 bp, Homo sapiens
cagatgggatgggcttt

SEQ ID NO: 3810797 - DNA, 18 bp, Homo sapiens
cagattcccagagcaaaa

SEQ ID NO: 3810798 - DNA, 21 bp, Homo sapiens
cagattcccagagcaaaataa

SEQ ID NO: 3810799 - DNA, 16 bp, Homo sapiens
cagattgggataaggc

SEQ ID NO: 3810800 - DNA, 18 bp, Homo sapiens
cagatttactgtcccagg

SEQ ID NO: 3810801 - DNA, 17 bp, Homo sapiens
cagcaccacattgcctc

SEQ ID NO: 3810802 - DNA, 14 bp, Homo sapiens
cagcagcctggacc

SEQ ID NO: 3810803 - DNA, 18 bp, Homo sapiens
cagcagggagggcttctg

SEQ ID NO: 3810804 - DNA, 15 bp, Homo sapiens
cagcatttcccttcc

SEQ ID NO: 3810805 - DNA, 15 bp, Homo sapiens
cagccaaagcctcct

SEQ ID NO: 3810806 - DNA, 16 bp, Homo sapiens
cagccaaagcctcctc

SEQ ID NO: 3810807 - DNA, 15 bp, Homo sapiens
cagcccacccctcaa

SEQ ID NO: 3810808 - DNA, 19 bp, Homo sapiens
cagcccaccctgctcctcc

SEQ ID NO: 3810809 - DNA, 21 bp, Homo sapiens
cagcccaccctgctcctcctg

SEQ ID NO: 3810810 - DNA, 24 bp, Homo sapiens
cagccccgcgtggaactcgtgtct

SEQ ID NO: 3810811 - DNA, 20 bp, Homo sapiens
cagccccttctcccagcaca

SEQ ID NO: 3810812 - DNA, 21 bp, Homo sapiens
cagccccttctcccagcacac

SEQ ID NO: 3810813 - DNA, 13 bp, Homo sapiens
cagccctgctgct

SEQ ID NO: 3810814 - DNA, 22 bp, Homo sapiens
cagccctttgcaggcccagcag

SEQ ID NO: 3810815 - DNA, 15 bp, Homo sapiens
cagccgccccagccc

SEQ ID NO: 3810816 - DNA, 16 bp, Homo sapiens
cagccgccccagcccc

SEQ ID NO: 3810817 - DNA, 23 bp, Homo sapiens
cagccgcctcccttatgcaggac

SEQ ID NO: 3810818 - DNA, 15 bp, Homo sapiens
cagcctccagtggga

SEQ ID NO: 3810819 - DNA, 18 bp, Homo sapiens
cagcctccatcctacccc

SEQ ID NO: 3810820 - DNA, 17 bp, Homo sapiens
cagcctcccagctttct

SEQ ID NO: 3810821 - DNA, 11 bp, Homo sapiens
cagcctcctga

SEQ ID NO: 3810822 - DNA, 20 bp, Homo sapiens
cagcctctccccgctctgga

SEQ ID NO: 3810823 - DNA, 14 bp, Homo sapiens
cagcctgccccagc

SEQ ID NO: 3810824 - DNA, 22 bp, Homo sapiens
cagcctgccccagcctcccagc

SEQ ID NO: 3810825 - DNA, 12 bp, Homo sapiens
cagcctgctcca

SEQ ID NO: 3810826 - DNA, 15 bp, Homo sapiens
cagcctggaccctgt

SEQ ID NO: 3810827 - DNA, 17 bp, Homo sapiens
cagcctgggaccagggc

SEQ ID NO: 3810828 - DNA, 15 bp, Homo sapiens
cagctaagctaggaa

SEQ ID NO: 3810829 - DNA, 19 bp, Homo sapiens
cagctaggtggggcctaga

SEQ ID NO: 3810830 - DNA, 19 bp, Homo sapiens
cagctcaagtcttccctga

SEQ ID NO: 3810831 - DNA, 12 bp, Homo sapiens
cagctcaggaga

SEQ ID NO: 3810832 - DNA, 18 bp, Homo sapiens
cagctgccgaccagagcc

SEQ ID NO: 3810833 - DNA, 18 bp, Homo sapiens
cagctggttgaggtttca

SEQ ID NO: 3810834 - DNA, 15 bp, Homo sapiens
cagctgttcagctgg

SEQ ID NO: 3810835 - DNA, 16 bp, Homo sapiens
cagctgttcagctggt

SEQ ID NO: 3810836 - DNA, 19 bp, Homo sapiens
cagctgttcagctggttga

SEQ ID NO: 3810837 - DNA, 22 bp, Homo sapiens
cagctttgtttgttgtcagctg

SEQ ID NO: 3810838 - DNA, 23 bp, Homo sapiens
cagctttgtttgttgtcagctga

SEQ ID NO: 3810839 - DNA, 15 bp, Homo sapiens
caggaaccgaggcag

SEQ ID NO: 3810840 - DNA, 18 bp, Homo sapiens
caggacatgtgctctcgg

SEQ ID NO: 3810841 - DNA, 19 bp, Homo sapiens
caggactccttagactgat

SEQ ID NO: 3810842 - DNA, 21 bp, Homo sapiens
caggagagcttcccccaaggc

SEQ ID NO: 3810843 - DNA, 15 bp, Homo sapiens
caggagcaaatgctg

SEQ ID NO: 3810844 - DNA, 18 bp, Homo sapiens
caggagctgacagagcca

SEQ ID NO: 3810845 - DNA, 19 bp, Homo sapiens
caggagctgacagagccag

SEQ ID NO: 3810846 - DNA, 21 bp, Homo sapiens
caggagctgacagagccagag

SEQ ID NO: 3810847 - DNA, 23 bp, Homo sapiens
caggagctgacagagccagaggc

SEQ ID NO: 3810848 - DNA, 14 bp, Homo sapiens
caggaggctgaggc

SEQ ID NO: 3810849 - DNA, 15 bp, Homo sapiens
caggaggctgaggca

SEQ ID NO: 3810850 - DNA, 20 bp, Homo sapiens
caggaggtggaggttgcagt

SEQ ID NO: 3810851 - DNA, 17 bp, Homo sapiens
caggatatccccaggga

SEQ ID NO: 3810852 - DNA, 18 bp, Homo sapiens
caggatatccccagggaa

SEQ ID NO: 3810853 - DNA, 12 bp, Homo sapiens
caggattcccag

SEQ ID NO: 3810854 - DNA, 15 bp, Homo sapiens
caggattcccagaga

SEQ ID NO: 3810855 - DNA, 16 bp, Homo sapiens
caggattcccagagag

SEQ ID NO: 3810856 - DNA, 22 bp, Homo sapiens
caggcaatggcctaaacttcag

SEQ ID NO: 3810857 - DNA, 20 bp, Homo sapiens
caggcatcggggagccggga

SEQ ID NO: 3810858 - DNA, 21 bp, Homo sapiens
caggcccttattttcaagaaa

SEQ ID NO: 3810859 - DNA, 16 bp, Homo sapiens
caggcgctggacagag

SEQ ID NO: 3810860 - DNA, 12 bp, Homo sapiens
caggctctgaga

SEQ ID NO: 3810861 - DNA, 22 bp, Homo sapiens
caggctgggttgtcactgagac

SEQ ID NO: 3810862 - DNA, 23 bp, Homo sapiens
cagggaaaggctctgaaagccag

SEQ ID NO: 3810863 - DNA, 18 bp, Homo sapiens
cagggaaggatcccatga

SEQ ID NO: 3810864 - DNA, 14 bp, Homo sapiens
cagggacagaagca

SEQ ID NO: 3810865 - DNA, 15 bp, Homo sapiens
cagggacagaagcag

SEQ ID NO: 3810866 - DNA, 22 bp, Homo sapiens
cagggccatctcctcccaccag

SEQ ID NO: 3810867 - DNA, 13 bp, Homo sapiens
cagggccccagaa

SEQ ID NO: 3810868 - DNA, 16 bp, Homo sapiens
cagggctgaggcctct

SEQ ID NO: 3810869 - DNA, 17 bp, Homo sapiens
caggggaaaatcagcct

SEQ ID NO: 3810870 - DNA, 19 bp, Homo sapiens
caggggaaaatcagcctgc

SEQ ID NO: 3810871 - DNA, 19 bp, Homo sapiens
ccgggacacctaggctagg

SEQ ID NO: 3810872 - DNA, 13 bp, Homo sapiens
ccgggagctcagg

SEQ ID NO: 3810873 - DNA, 16 bp, Homo sapiens
ccgggtgccattccca

SEQ ID NO: 3810874 - DNA, 22 bp, Homo sapiens
ccgtctggcgagcccttagcct

SEQ ID NO: 3810875 - DNA, 20 bp, Homo sapiens
cctaacttattgcctgggca

SEQ ID NO: 3810876 - DNA, 15 bp, Homo sapiens
cctaataaagagact

SEQ ID NO: 3810877 - DNA, 22 bp, Homo sapiens
cctacagttgaaaaacagctga

SEQ ID NO: 3810878 - DNA, 17 bp, Homo sapiens
cctacccactctttgct

SEQ ID NO: 3810879 - DNA, 12 bp, Homo sapiens
cctacctgcctg

SEQ ID NO: 3810880 - DNA, 19 bp, Homo sapiens
cctacctgcctgttctcca

SEQ ID NO: 3810881 - DNA, 14 bp, Homo sapiens
cctacctgtgcctg

SEQ ID NO: 3810882 - DNA, 22 bp, Homo sapiens
cctacttcttttgctcttagct

SEQ ID NO: 3810883 - DNA, 13 bp, Homo sapiens
cctagagctcctg

SEQ ID NO: 3810884 - DNA, 14 bp, Homo sapiens
cctagagctcctgt

SEQ ID NO: 3810885 - DNA, 15 bp, Homo sapiens
cctagagctcctgtc

SEQ ID NO: 3810886 - DNA, 20 bp, Homo sapiens
cctagatccacacacagagg

SEQ ID NO: 3810887 - DNA, 16 bp, Homo sapiens
cctagttttctcctcc

SEQ ID NO: 3810888 - DNA, 21 bp, Homo sapiens
cctataatacaaatacacaat

SEQ ID NO: 3810889 - DNA, 16 bp, Homo sapiens
cctcaacacctctgca

SEQ ID NO: 3810890 - DNA, 12 bp, Homo sapiens
cctcacagcctc

SEQ ID NO: 3810891 - DNA, 13 bp, Homo sapiens
cctcacagcctct

SEQ ID NO: 3810892 - DNA, 15 bp, Homo sapiens
cctcacagcctctcc

SEQ ID NO: 3810893 - DNA, 19 bp, Homo sapiens
cctcacccccagctttgct

SEQ ID NO: 3810894 - DNA, 13 bp, Homo sapiens
cctcagcctccag

SEQ ID NO: 3810895 - DNA, 14 bp, Homo sapiens
cctcagcctccagg

SEQ ID NO: 3810896 - DNA, 13 bp, Homo sapiens
cctcagcctcctg

SEQ ID NO: 3810897 - DNA, 15 bp, Homo sapiens
cctcatccaaagttc

SEQ ID NO: 3810898 - DNA, 18 bp, Homo sapiens
cctccagaccaccagccg

SEQ ID NO: 3810899 - DNA, 11 bp, Homo sapiens
cctccagtggg

SEQ ID NO: 3810900 - DNA, 19 bp, Homo sapiens
cctccagtgggaggacaga

SEQ ID NO: 3810901 - DNA, 23 bp, Homo sapiens
cctccatcctaccccctgtgcct

SEQ ID NO: 3810902 - DNA, 14 bp, Homo sapiens
cctcccaaagtgct

SEQ ID NO: 3810903 - DNA, 17 bp, Homo sapiens
cctcccaaagtgctggg

SEQ ID NO: 3810904 - DNA, 15 bp, Homo sapiens
cctcccaccagtggc

SEQ ID NO: 3810905 - DNA, 19 bp, Homo sapiens
cctcccatggccttccctc

SEQ ID NO: 3810906 - DNA, 13 bp, Homo sapiens
cctccccacagtc

SEQ ID NO: 3810907 - DNA, 15 bp, Homo sapiens
cctccccgcaccccc

SEQ ID NO: 3810908 - DNA, 14 bp, Homo sapiens
cctcccctcccagt

SEQ ID NO: 3810909 - DNA, 13 bp, Homo sapiens
cctccctgaacca

SEQ ID NO: 3810910 - DNA, 16 bp, Homo sapiens
cctcctcacccccagc

SEQ ID NO: 3810911 - DNA, 12 bp, Homo sapiens
cctcctccagcc

SEQ ID NO: 3810912 - DNA, 20 bp, Homo sapiens
cctcctgccctgtccctgtc

SEQ ID NO: 3810913 - DNA, 23 bp, Homo sapiens
cctcctgccctgtccctgtcccc

SEQ ID NO: 3810914 - DNA, 23 bp, Homo sapiens
cctcctgctgcctaataaagaga

SEQ ID NO: 3810915 - DNA, 16 bp, Homo sapiens
cctcgactcagcacca

SEQ ID NO: 3810916 - DNA, 16 bp, Homo sapiens
cctcgtgatttgcctg

SEQ ID NO: 3810917 - DNA, 22 bp, Homo sapiens
cctcgtggacacctgccctgcc

SEQ ID NO: 3810918 - DNA, 15 bp, Homo sapiens
cctctagaacaccca

SEQ ID NO: 3810919 - DNA, 16 bp, Homo sapiens
cctctagaacacccac

SEQ ID NO: 3810920 - DNA, 19 bp, Homo sapiens
cctctagaacacccactgg

SEQ ID NO: 3810921 - DNA, 21 bp, Homo sapiens
cctctagaacacccactggcc

SEQ ID NO: 3810922 - DNA, 22 bp, Homo sapiens
cctctagaacacccactggcca

SEQ ID NO: 3810923 - DNA, 14 bp, Homo sapiens
cctctcactgtgtc

SEQ ID NO: 3810924 - DNA, 22 bp, Homo sapiens
cctctccaagtctctctgtgaa

SEQ ID NO: 3810925 - DNA, 23 bp, Homo sapiens
cctctccactcatgtgactcttt

SEQ ID NO: 3810926 - DNA, 16 bp, Homo sapiens
cctctgaatgtcccag

SEQ ID NO: 3810927 - DNA, 19 bp, Homo sapiens
cctctgcattttgtacaaa

SEQ ID NO: 3810928 - DNA, 14 bp, Homo sapiens
cctcttagaaaaac

SEQ ID NO: 3810929 - DNA, 18 bp, Homo sapiens
cctcttccgtgacgtcac

SEQ ID NO: 3810930 - DNA, 17 bp, Homo sapiens
cctcttctattttgtaa

SEQ ID NO: 3810931 - DNA, 22 bp, Homo sapiens
cctcttggggagtttagggtgg

SEQ ID NO: 3810932 - DNA, 16 bp, Homo sapiens
cctgaacaagaattgg

SEQ ID NO: 3810933 - DNA, 18 bp, Homo sapiens
cctgacactgagccccac

SEQ ID NO: 3810934 - DNA, 18 bp, Homo sapiens
cctgaccttctccaggga

SEQ ID NO: 3810935 - DNA, 19 bp, Homo sapiens
cctgaccttctccagggac

SEQ ID NO: 3810936 - DNA, 12 bp, Homo sapiens
cctgagaagaga

SEQ ID NO: 3810937 - DNA, 16 bp, Homo sapiens
cctgagctttctgcta

SEQ ID NO: 3810938 - DNA, 15 bp, Homo sapiens
cctgcaaaccttttt

SEQ ID NO: 3810939 - DNA, 17 bp, Homo sapiens
cctgcaccggggcctgg

SEQ ID NO: 3810940 - DNA, 14 bp, Homo sapiens
cctgcagcagagcc

SEQ ID NO: 3810941 - DNA, 12 bp, Homo sapiens
cctgccacctgt

SEQ ID NO: 3810942 - DNA, 15 bp, Homo sapiens
cctgccacctgtctg

SEQ ID NO: 3810943 - DNA, 17 bp, Homo sapiens
cctgccacctgtctgtc

SEQ ID NO: 3810944 - DNA, 15 bp, Homo sapiens
cctgccaggcatggt

SEQ ID NO: 3810945 - DNA, 16 bp, Homo sapiens
cctgccaggcatggtg

SEQ ID NO: 3810946 - DNA, 15 bp, Homo sapiens
cctgcccaagggcct

SEQ ID NO: 3810947 - DNA, 16 bp, Homo sapiens
cctgcccatgggagct

SEQ ID NO: 3810948 - DNA, 14 bp, Homo sapiens
cctgccctgccacc

SEQ ID NO: 3810949 - DNA, 21 bp, Homo sapiens
cctgccctgccacctgtctgt

SEQ ID NO: 3810950 - DNA, 15 bp, Homo sapiens
cctgccctgtccctg

SEQ ID NO: 3810951 - DNA, 16 bp, Homo sapiens
cctgcctcagcctcct

SEQ ID NO: 3810952 - DNA, 13 bp, Homo sapiens
cctgcctgggcct

SEQ ID NO: 3810953 - DNA, 20 bp, Homo sapiens
cctgcgagagaccctacaga

SEQ ID NO: 3810954 - DNA, 22 bp, Homo sapiens
cctgctccagctgttcagctgg

SEQ ID NO: 3810955 - DNA, 20 bp, Homo sapiens
cctgctcctcctgccctgtc

SEQ ID NO: 3810956 - DNA, 15 bp, Homo sapiens
cctgctgcctaataa

SEQ ID NO: 3810957 - DNA, 14 bp, Homo sapiens
cctgctgcttccta

SEQ ID NO: 3810958 - DNA, 14 bp, Homo sapiens
cctggaccagcctc

SEQ ID NO: 3810959 - DNA, 14 bp, Homo sapiens
cctggaccctgtgg

SEQ ID NO: 3810960 - DNA, 13 bp, Homo sapiens
cctggcccactgc

SEQ ID NO: 3810961 - DNA, 16 bp, Homo sapiens
cctggcccactgcatc

SEQ ID NO: 3810962 - DNA, 12 bp, Homo sapiens
cctgggcaggag

SEQ ID NO: 3810963 - DNA, 12 bp, Homo sapiens
cctgggcagtgc

SEQ ID NO: 3810964 - DNA, 13 bp, Homo sapiens
cctgggcagtgcc

SEQ ID NO: 3810965 - DNA, 18 bp, Homo sapiens
cctgggcagtgcccacca

SEQ ID NO: 3810966 - DNA, 17 bp, Homo sapiens
cctgggcatactaataa

SEQ ID NO: 3810967 - DNA, 16 bp, Homo sapiens
cctgggcctcagcctc

SEQ ID NO: 3810968 - DNA, 14 bp, Homo sapiens
cctgggcgacagag

SEQ ID NO: 3810969 - DNA, 23 bp, Homo sapiens
cctgggtggtatagggcgtttgg

SEQ ID NO: 3810970 - DNA, 18 bp, Homo sapiens
cctggtggtggctcggga

SEQ ID NO: 3810971 - DNA, 15 bp, Homo sapiens
cctgtaatcccagca

SEQ ID NO: 3810972 - DNA, 14 bp, Homo sapiens
cctgtaccccagca

SEQ ID NO: 3810973 - DNA, 19 bp, Homo sapiens
cctgtagagtgggagctga

SEQ ID NO: 3810974 - DNA, 14 bp, Homo sapiens
cctgtccataaagt

SEQ ID NO: 3810975 - DNA, 16 bp, Homo sapiens
cctgtccataaagtaa

SEQ ID NO: 3810976 - DNA, 23 bp, Homo sapiens
cctgtccccctcccctcccagtc

SEQ ID NO: 3810977 - DNA, 12 bp, Homo sapiens
cctgtccctacc

SEQ ID NO: 3810978 - DNA, 16 bp, Homo sapiens
cctgtccctacccact

SEQ ID NO: 3810979 - DNA, 17 bp, Homo sapiens
cctgtccctacccactc

SEQ ID NO: 3810980 - DNA, 21 bp, Homo sapiens
cctgtctccctcctctgcccg

SEQ ID NO: 3810981 - DNA, 19 bp, Homo sapiens
ctgaggacatggagagaga

SEQ ID NO: 3810982 - DNA, 15 bp, Homo sapiens
ctgaggtcaataaag

SEQ ID NO: 3810983 - DNA, 17 bp, Homo sapiens
ctgaggtcaataaagca

SEQ ID NO: 3810984 - DNA, 22 bp, Homo sapiens
ctgaggtcaataaagcagagcc

SEQ ID NO: 3810985 - DNA, 22 bp, Homo sapiens
ctgagtcaccctacctgtgcct

SEQ ID NO: 3810986 - DNA, 13 bp, Homo sapiens
ctgagtccagctc

SEQ ID NO: 3810987 - DNA, 16 bp, Homo sapiens
ctgagtccagctcccc

SEQ ID NO: 3810988 - DNA, 20 bp, Homo sapiens
ctgagtccagctccccccaa

SEQ ID NO: 3810989 - DNA, 16 bp, Homo sapiens
ctgatgcattcccggt

SEQ ID NO: 3810990 - DNA, 14 bp, Homo sapiens
ctgatgctgaaata

SEQ ID NO: 3810991 - DNA, 13 bp, Homo sapiens
ctgattgtattta

SEQ ID NO: 3810992 - DNA, 13 bp, Homo sapiens
ctgcacaagctgc

SEQ ID NO: 3810993 - DNA, 22 bp, Homo sapiens
ctgcacaagctgcaccctcagg

SEQ ID NO: 3810994 - DNA, 18 bp, Homo sapiens
ctgcaccggggcctgggc

SEQ ID NO: 3810995 - DNA, 19 bp, Homo sapiens
ctgcactcatagggtgctc

SEQ ID NO: 3810996 - DNA, 13 bp, Homo sapiens
ctgcactccagcc

SEQ ID NO: 3810997 - DNA, 18 bp, Homo sapiens
ctgcactccagcctgggt

SEQ ID NO: 3810998 - DNA, 20 bp, Homo sapiens
ctgcactccagcctgggtga

SEQ ID NO: 3810999 - DNA, 13 bp, Homo sapiens
ctgcagcagagcc

SEQ ID NO: 3811000 - DNA, 17 bp, Homo sapiens
ctgcaggaaatcagagc

SEQ ID NO: 3811001 - DNA, 17 bp, Homo sapiens
ctgcagggggtgtgtct

SEQ ID NO: 3811002 - DNA, 21 bp, Homo sapiens
ctgcattttaacaagcacccc

SEQ ID NO: 3811003 - DNA, 20 bp, Homo sapiens
ctgccaatcggctacccctc

SEQ ID NO: 3811004 - DNA, 21 bp, Homo sapiens
ctgccaatcggctacccctcg

SEQ ID NO: 3811005 - DNA, 11 bp, Homo sapiens
ctgccaggcat

SEQ ID NO: 3811006 - DNA, 23 bp, Homo sapiens
ctgccatcatgtttacagaggac

SEQ ID NO: 3811007 - DNA, 19 bp, Homo sapiens
ctgccatgccagcttatct

SEQ ID NO: 3811008 - DNA, 15 bp, Homo sapiens
ctgccatttctgaga

SEQ ID NO: 3811009 - DNA, 21 bp, Homo sapiens
ctgcccaagggcctcccacca

SEQ ID NO: 3811010 - DNA, 18 bp, Homo sapiens
ctgcccagcctgccccag

SEQ ID NO: 3811011 - DNA, 19 bp, Homo sapiens
ctgcccagcctgccccagc

SEQ ID NO: 3811012 - DNA, 18 bp, Homo sapiens
ctgccccagcctcccagc

SEQ ID NO: 3811013 - DNA, 13 bp, Homo sapiens
ctgccccatctcc

SEQ ID NO: 3811014 - DNA, 20 bp, Homo sapiens
ctgcccccaactcccggagg

SEQ ID NO: 3811015 - DNA, 21 bp, Homo sapiens
ctgccctcccacctccgctgg

SEQ ID NO: 3811016 - DNA, 13 bp, Homo sapiens
ctgccctgccacc

SEQ ID NO: 3811017 - DNA, 18 bp, Homo sapiens
ctgccctgccacctgtct

SEQ ID NO: 3811018 - DNA, 20 bp, Homo sapiens
ctgccctgccacctgtctgt

SEQ ID NO: 3811019 - DNA, 11 bp, Homo sapiens
ctgccctgccc

SEQ ID NO: 3811020 - DNA, 14 bp, Homo sapiens
ctgccctgccctgc

SEQ ID NO: 3811021 - DNA, 16 bp, Homo sapiens
ctgccctgtccctgtc

SEQ ID NO: 3811022 - DNA, 16 bp, Homo sapiens
ctgcccttcagcatcc

SEQ ID NO: 3811023 - DNA, 13 bp, Homo sapiens
ctgccgcctcctt

SEQ ID NO: 3811024 - DNA, 23 bp, Homo sapiens
ctgccggttcttaaatccatcct

SEQ ID NO: 3811025 - DNA, 18 bp, Homo sapiens
ctgcctaataaagagact

SEQ ID NO: 3811026 - DNA, 19 bp, Homo sapiens
ctgcctaggaattcccagc

SEQ ID NO: 3811027 - DNA, 14 bp, Homo sapiens
ctgcctcagcctcc

SEQ ID NO: 3811028 - DNA, 15 bp, Homo sapiens
ctgcctcagcctcct

SEQ ID NO: 3811029 - DNA, 18 bp, Homo sapiens
ctgcctcagcctcctgag

SEQ ID NO: 3811030 - DNA, 13 bp, Homo sapiens
ctgcctcttctct

SEQ ID NO: 3811031 - DNA, 18 bp, Homo sapiens
ctgcctgacactgagccc

SEQ ID NO: 3811032 - DNA, 12 bp, Homo sapiens
ctgcctgggcct

SEQ ID NO: 3811033 - DNA, 14 bp, Homo sapiens
ctgcctgggcctcc

SEQ ID NO: 3811034 - DNA, 18 bp, Homo sapiens
ctgcctgggcctcccaaa

SEQ ID NO: 3811035 - DNA, 14 bp, Homo sapiens
ctgcctgttctcca

SEQ ID NO: 3811036 - DNA, 16 bp, Homo sapiens
ctgcctgttctccaga

SEQ ID NO: 3811037 - DNA, 17 bp, Homo sapiens
ctgcctgttctccagat

SEQ ID NO: 3811038 - DNA, 20 bp, Homo sapiens
ctgcgagagaccctacagac

SEQ ID NO: 3811039 - DNA, 17 bp, Homo sapiens
ctgctcgaagaacaatg

SEQ ID NO: 3811040 - DNA, 22 bp, Homo sapiens
ctgctgcctaataaagagactg

SEQ ID NO: 3811041 - DNA, 13 bp, Homo sapiens
ctgctgcttccta

SEQ ID NO: 3811042 - DNA, 17 bp, Homo sapiens
ctgctgcttcctaactt

SEQ ID NO: 3811043 - DNA, 21 bp, Homo sapiens
ctgcttcagtgtatggaaata

SEQ ID NO: 3811044 - DNA, 24 bp, Homo sapiens
ctgcttccaattttctggaataca

SEQ ID NO: 3811045 - DNA, 10 bp, Homo sapiens
ctgcttccta

SEQ ID NO: 3811046 - DNA, 13 bp, Homo sapiens
ctgcttcctaact

SEQ ID NO: 3811047 - DNA, 14 bp, Homo sapiens
ctgcttcctaactt

SEQ ID NO: 3811048 - DNA, 20 bp, Homo sapiens
ctgcttgaggcaactcatct

SEQ ID NO: 3811049 - DNA, 22 bp, Homo sapiens
ctgcttgaggcaactcatctta

SEQ ID NO: 3811050 - DNA, 20 bp, Homo sapiens
ctgcttttcggaacactaaa

SEQ ID NO: 3811051 - DNA, 16 bp, Homo sapiens
ctggaagcactgctgt

SEQ ID NO: 3811052 - DNA, 20 bp, Homo sapiens
ctggaaggagccagccagga

SEQ ID NO: 3811053 - DNA, 18 bp, Homo sapiens
ctggaatacatgaaatat

SEQ ID NO: 3811054 - DNA, 14 bp, Homo sapiens
ctggaccactgggc

SEQ ID NO: 3811055 - DNA, 14 bp, Homo sapiens
ctggaccagcctct

SEQ ID NO: 3811056 - DNA, 18 bp, Homo sapiens
ctggaccagcctctccac

SEQ ID NO: 3811057 - DNA, 15 bp, Homo sapiens
ctggaccctgtggat

SEQ ID NO: 3811058 - DNA, 14 bp, Homo sapiens
ctggacctgaaggc

SEQ ID NO: 3811059 - DNA, 18 bp, Homo sapiens
ctggactgtcatagaaat

SEQ ID NO: 3811060 - DNA, 19 bp, Homo sapiens
ctggactgtcatagaaatt

SEQ ID NO: 3811061 - DNA, 19 bp, Homo sapiens
ctggatgagcaactcctgt

SEQ ID NO: 3811062 - DNA, 14 bp, Homo sapiens
ctggcaagaatgtg

SEQ ID NO: 3811063 - DNA, 14 bp, Homo sapiens
ctggcacagcctgg

SEQ ID NO: 3811064 - DNA, 23 bp, Homo sapiens
ctggcacagcctggctgtggcct

SEQ ID NO: 3811065 - DNA, 15 bp, Homo sapiens
ctggcagcctccagt

SEQ ID NO: 3811066 - DNA, 22 bp, Homo sapiens
ctggccagtcctagagctcctg

SEQ ID NO: 3811067 - DNA, 21 bp, Homo sapiens
ctggccagtggctggatctgt

SEQ ID NO: 3811068 - DNA, 15 bp, Homo sapiens
ctggcctctagaaca

SEQ ID NO: 3811069 - DNA, 16 bp, Homo sapiens
ctggctcccagggcca

SEQ ID NO: 3811070 - DNA, 21 bp, Homo sapiens
ctggctgaggatttcaagcct

SEQ ID NO: 3811071 - DNA, 15 bp, Homo sapiens
ctgggactacaggca

SEQ ID NO: 3811072 - DNA, 19 bp, Homo sapiens
ctgggatgggaacactggt

SEQ ID NO: 3811073 - DNA, 19 bp, Homo sapiens
ctgggcaatgatggcaatt

SEQ ID NO: 3811074 - DNA, 20 bp, Homo sapiens
ctgggcaggttggtgggggc

SEQ ID NO: 3811075 - DNA, 21 bp, Homo sapiens
ctgggcagtgcccaccatgca

SEQ ID NO: 3811076 - DNA, 18 bp, Homo sapiens
ctgggctaccccccctcc

SEQ ID NO: 3811077 - DNA, 15 bp, Homo sapiens
ctgggctctgaggag

SEQ ID NO: 3811078 - DNA, 16 bp, Homo sapiens
ctggggatgtctctca

SEQ ID NO: 3811079 - DNA, 22 bp, Homo sapiens
ctggggatgtctctcatgacca

SEQ ID NO: 3811080 - DNA, 13 bp, Homo sapiens
ctgggggaagaag

SEQ ID NO: 3811081 - DNA, 20 bp, Homo sapiens
ctgggtaactagggaagata

SEQ ID NO: 3811082 - DNA, 14 bp, Homo sapiens
ctgggtccagggga

SEQ ID NO: 3811083 - DNA, 21 bp, Homo sapiens
ctgggtgccgggctgcacaga

SEQ ID NO: 3811084 - DNA, 16 bp, Homo sapiens
ctgggtttaagcaatg

SEQ ID NO: 3811085 - DNA, 17 bp, Homo sapiens
ctggtctcgaactcctg

SEQ ID NO: 3811086 - DNA, 18 bp, Homo sapiens
ctggtctcgaactcctga

SEQ ID NO: 3811087 - DNA, 19 bp, Homo sapiens
ctggtctcgaactcctgac

SEQ ID NO: 3811088 - DNA, 16 bp, Homo sapiens
ctggtgcactggcccc

SEQ ID NO: 3811089 - DNA, 14 bp, Homo sapiens
gaattgaagcagga

SEQ ID NO: 3811090 - DNA, 19 bp, Homo sapiens
gaattgaaggagaaaatgc

SEQ ID NO: 3811091 - DNA, 17 bp, Homo sapiens
gaatttcccacataccc

SEQ ID NO: 3811092 - DNA, 16 bp, Homo sapiens
gacaaacacctcccag

SEQ ID NO: 3811093 - DNA, 17 bp, Homo sapiens
gacaaacacctcccagg

SEQ ID NO: 3811094 - DNA, 22 bp, Homo sapiens
gacaaacacctcccaggagaca

SEQ ID NO: 3811095 - DNA, 19 bp, Homo sapiens
gacaacatttttgtacatt

SEQ ID NO: 3811096 - DNA, 14 bp, Homo sapiens
gacaacctgcccct

SEQ ID NO: 3811097 - DNA, 12 bp, Homo sapiens
gacaatgtgaaa

SEQ ID NO: 3811098 - DNA, 18 bp, Homo sapiens
gacaatgtgaaaagaaaa

SEQ ID NO: 3811099 - DNA, 20 bp, Homo sapiens
gacacaccccacaccccagc

SEQ ID NO: 3811100 - DNA, 15 bp, Homo sapiens
gacacctaggctagg

SEQ ID NO: 3811101 - DNA, 10 bp, Homo sapiens
gacacctgcc

SEQ ID NO: 3811102 - DNA, 11 bp, Homo sapiens
gacacctgccc

SEQ ID NO: 3811103 - DNA, 23 bp, Homo sapiens
gacacctgccctgccctgccacc

SEQ ID NO: 3811104 - DNA, 16 bp, Homo sapiens
gacactgagccccacc

SEQ ID NO: 3811105 - DNA, 16 bp, Homo sapiens
gacagaaacagagaga

SEQ ID NO: 3811106 - DNA, 18 bp, Homo sapiens
gacagaaacagagagaga

SEQ ID NO: 3811107 - DNA, 18 bp, Homo sapiens
gacagaaatgcaatctcc

SEQ ID NO: 3811108 - DNA, 13 bp, Homo sapiens
gacagaagcagga

SEQ ID NO: 3811109 - DNA, 14 bp, Homo sapiens
gacagaagcaggag

SEQ ID NO: 3811110 - DNA, 21 bp, Homo sapiens
gacagagcaagtgagaccctg

SEQ ID NO: 3811111 - DNA, 18 bp, Homo sapiens
gacagcctccccctgtcc

SEQ ID NO: 3811112 - DNA, 18 bp, Homo sapiens
gacaggcaccagatggga

SEQ ID NO: 3811113 - DNA, 16 bp, Homo sapiens
gacaggcccaagagat

SEQ ID NO: 3811114 - DNA, 18 bp, Homo sapiens
gacaggcccaagagatga

SEQ ID NO: 3811115 - DNA, 16 bp, Homo sapiens
gacaggttagctgctc

SEQ ID NO: 3811116 - DNA, 21 bp, Homo sapiens
gacatatgttaggaatactct

SEQ ID NO: 3811117 - DNA, 15 bp, Homo sapiens
gacatcacttgtaca

SEQ ID NO: 3811118 - DNA, 16 bp, Homo sapiens
gacatcacttgtacaa

SEQ ID NO: 3811119 - DNA, 15 bp, Homo sapiens
gacatctcaggattt

SEQ ID NO: 3811120 - DNA, 14 bp, Homo sapiens
gacattgaaagctc

SEQ ID NO: 3811121 - DNA, 15 bp, Homo sapiens
gaccaagagagaaag

SEQ ID NO: 3811122 - DNA, 18 bp, Homo sapiens
gaccaagagagaaagaag

SEQ ID NO: 3811123 - DNA, 20 bp, Homo sapiens
gaccaccagccgccccagcc

SEQ ID NO: 3811124 - DNA, 21 bp, Homo sapiens
gaccaccagccgccccagccc

SEQ ID NO: 3811125 - DNA, 15 bp, Homo sapiens
gaccattgtcttcca

SEQ ID NO: 3811126 - DNA, 16 bp, Homo sapiens
gaccattgtcttccaa

SEQ ID NO: 3811127 - DNA, 18 bp, Homo sapiens
gaccattgtcttccaacc

SEQ ID NO: 3811128 - DNA, 20 bp, Homo sapiens
gaccattgtcttccaacccc

SEQ ID NO: 3811129 - DNA, 23 bp, Homo sapiens
gaccattgtcttccaaccccagc

SEQ ID NO: 3811130 - DNA, 14 bp, Homo sapiens
gaccccatctcatt

SEQ ID NO: 3811131 - DNA, 18 bp, Homo sapiens
gacccccactgccgcctc

SEQ ID NO: 3811132 - DNA, 22 bp, Homo sapiens
gacccggctgggtcggccctgc

SEQ ID NO: 3811133 - DNA, 19 bp, Homo sapiens
gaccctcatctttcttcca

SEQ ID NO: 3811134 - DNA, 14 bp, Homo sapiens
gacctaggcaagtt

SEQ ID NO: 3811135 - DNA, 19 bp, Homo sapiens
gacctcaggtgagaagcag

SEQ ID NO: 3811136 - DNA, 21 bp, Homo sapiens
gacctcaggtgagaagcagag

SEQ ID NO: 3811137 - DNA, 20 bp, Homo sapiens
gacctctgaatgtcccagag

SEQ ID NO: 3811138 - DNA, 16 bp, Homo sapiens
gacctgaaggcatctg

SEQ ID NO: 3811139 - DNA, 24 bp, Homo sapiens
gaccttctccagggacagaagcag

SEQ ID NO: 3811140 - DNA, 19 bp, Homo sapiens
gacgtttgactagccatct

SEQ ID NO: 3811141 - DNA, 16 bp, Homo sapiens
gactactactctgcca

SEQ ID NO: 3811142 - DNA, 17 bp, Homo sapiens
gactactactctgccaa

SEQ ID NO: 3811143 - DNA, 13 bp, Homo sapiens
gactatttatgaa

SEQ ID NO: 3811144 - DNA, 12 bp, Homo sapiens
gactgagggaga

SEQ ID NO: 3811145 - DNA, 15 bp, Homo sapiens
gactgcccggcaggg

SEQ ID NO: 3811146 - DNA, 16 bp, Homo sapiens
gactggcagtaaccta

SEQ ID NO: 3811147 - DNA, 20 bp, Homo sapiens
gactgggatgggaacactgg

SEQ ID NO: 3811148 - DNA, 16 bp, Homo sapiens
gactgttttctcttga

SEQ ID NO: 3811149 - DNA, 18 bp, Homo sapiens
gactgttttctcttgaga

SEQ ID NO: 3811150 - DNA, 24 bp, Homo sapiens
gacttcaggagctgacagagccag

SEQ ID NO: 3811151 - DNA, 18 bp, Homo sapiens
gacttgtcccgggacacc

SEQ ID NO: 3811152 - DNA, 16 bp, Homo sapiens
gacttttctaaagctc

SEQ ID NO: 3811153 - DNA, 23 bp, Homo sapiens
gacttttctgtccgagctttgaa

SEQ ID NO: 3811154 - DNA, 16 bp, Homo sapiens
gagaaaatgcaggaga

SEQ ID NO: 3811155 - DNA, 13 bp, Homo sapiens
gagaaacagagac

SEQ ID NO: 3811156 - DNA, 14 bp, Homo sapiens
gagaaacagagaca

SEQ ID NO: 3811157 - DNA, 18 bp, Homo sapiens
gagaaacaggctctgaga

SEQ ID NO: 3811158 - DNA, 18 bp, Homo sapiens
gagaaagaagtaggcatg

SEQ ID NO: 3811159 - DNA, 21 bp, Homo sapiens
gagaaattttactgacagaaa

SEQ ID NO: 3811160 - DNA, 22 bp, Homo sapiens
gagaatctatatttaacaagat

SEQ ID NO: 3811161 - DNA, 17 bp, Homo sapiens
gagaatgtcagtatgtg

SEQ ID NO: 3811162 - DNA, 22 bp, Homo sapiens
gagacaaacacctcccaggaga

SEQ ID NO: 3811163 - DNA, 14 bp, Homo sapiens
gagacacagagatg

SEQ ID NO: 3811164 - DNA, 14 bp, Homo sapiens
gagacagaaacaga

SEQ ID NO: 3811165 - DNA, 18 bp, Homo sapiens
gagacagaaacagagaga

SEQ ID NO: 3811166 - DNA, 18 bp, Homo sapiens
gagacagtagaggcatga

SEQ ID NO: 3811167 - DNA, 18 bp, Homo sapiens
gagacagttcaagaaagc

SEQ ID NO: 3811168 - DNA, 16 bp, Homo sapiens
gagacgggccctggtg

SEQ ID NO: 3811169 - DNA, 20 bp, Homo sapiens
gagactaatagagacacaga

SEQ ID NO: 3811170 - DNA, 15 bp, Homo sapiens
gagactgagggagag

SEQ ID NO: 3811171 - DNA, 16 bp, Homo sapiens
gagactgagggagaga

SEQ ID NO: 3811172 - DNA, 21 bp, Homo sapiens
gagagacagagacagagagag

SEQ ID NO: 3811173 - DNA, 11 bp, Homo sapiens
gagagagactg

SEQ ID NO: 3811174 - DNA, 12 bp, Homo sapiens
gagagaggggaa

SEQ ID NO: 3811175 - DNA, 21 bp, Homo sapiens
gagagctagcagcagggaggg

SEQ ID NO: 3811176 - DNA, 18 bp, Homo sapiens
gagatcaaatggaaagga

SEQ ID NO: 3811177 - DNA, 14 bp, Homo sapiens
gagatcagcctggg

SEQ ID NO: 3811178 - DNA, 16 bp, Homo sapiens
gagatcagcctgggca

SEQ ID NO: 3811179 - DNA, 12 bp, Homo sapiens
gagcaagactct

SEQ ID NO: 3811180 - DNA, 22 bp, Homo sapiens
gagcaccgcctgtgaaatacca

SEQ ID NO: 3811181 - DNA, 21 bp, Homo sapiens
gagcagatggatccacgtgct

SEQ ID NO: 3811182 - DNA, 14 bp, Homo sapiens
gagcagcactgggg

SEQ ID NO: 3811183 - DNA, 11 bp, Homo sapiens
gagccaaggcc

SEQ ID NO: 3811184 - DNA, 14 bp, Homo sapiens
gagccaaggccacc

SEQ ID NO: 3811185 - DNA, 23 bp, Homo sapiens
gagccactacctttgtccaggcc

SEQ ID NO: 3811186 - DNA, 12 bp, Homo sapiens
gagccactctgt

SEQ ID NO: 3811187 - DNA, 14 bp, Homo sapiens
gagccagccaggac

SEQ ID NO: 3811188 - DNA, 14 bp, Homo sapiens
gagccccacacgga

SEQ ID NO: 3811189 - DNA, 16 bp, Homo sapiens
gagccccacacggagg

SEQ ID NO: 3811190 - DNA, 23 bp, Homo sapiens
gagcctggctccgtccaggagcc

SEQ ID NO: 3811191 - DNA, 21 bp, Homo sapiens
gagcctgggaggtcaaggctg

SEQ ID NO: 3811192 - DNA, 19 bp, Homo sapiens
gagcctgtgcctcctcacc

SEQ ID NO: 3811193 - DNA, 14 bp, Homo sapiens
gagctccagtggaa

SEQ ID NO: 3811194 - DNA, 17 bp, Homo sapiens
gagctcctgtccctacc

SEQ ID NO: 3811195 - DNA, 20 bp, Homo sapiens
gagctccttaaggctctttt

SEQ ID NO: 3811196 - DNA, 15 bp, Homo sapiens
gagctgagtggggga

SEQ ID NO: 3811197 - DNA, 13 bp, Homo sapiens
gagctgcagcccc

SEQ ID NO: 3811198 - DNA, 23 bp, Homo sapiens
ggaaaatcagcctgctccagctg

SEQ ID NO: 3811199 - DNA, 14 bp, Homo sapiens
ggaaaatgaataat

SEQ ID NO: 3811200 - DNA, 13 bp, Homo sapiens
ggaaccatgaagc

SEQ ID NO: 3811201 - DNA, 20 bp, Homo sapiens
ggaactgctgggcttggcag

SEQ ID NO: 3811202 - DNA, 14 bp, Homo sapiens
ggaagacaatgtga

SEQ ID NO: 3811203 - DNA, 23 bp, Homo sapiens
ggaagggacaccaagccttggct

SEQ ID NO: 3811204 - DNA, 19 bp, Homo sapiens
ggaagggggctccatgctg

SEQ ID NO: 3811205 - DNA, 21 bp, Homo sapiens
ggaattttctttcatacatta

SEQ ID NO: 3811206 - DNA, 10 bp, Homo sapiens
ggacacctgc

SEQ ID NO: 3811207 - DNA, 12 bp, Homo sapiens
ggacacctgccc

SEQ ID NO: 3811208 - DNA, 14 bp, Homo sapiens
ggacacctgccctg

SEQ ID NO: 3811209 - DNA, 15 bp, Homo sapiens
ggacatggagagaga

SEQ ID NO: 3811210 - DNA, 13 bp, Homo sapiens
ggaccacacctcc

SEQ ID NO: 3811211 - DNA, 21 bp, Homo sapiens
ggaccacacctccctgaacca

SEQ ID NO: 3811212 - DNA, 18 bp, Homo sapiens
ggacttcacttaaaaaaa

SEQ ID NO: 3811213 - DNA, 16 bp, Homo sapiens
ggagaaacagagacag

SEQ ID NO: 3811214 - DNA, 19 bp, Homo sapiens
ggagacaggttagctgctc

SEQ ID NO: 3811215 - DNA, 12 bp, Homo sapiens
ggagaggaaaga

SEQ ID NO: 3811216 - DNA, 21 bp, Homo sapiens
ggagaggtggggagggagaca

SEQ ID NO: 3811217 - DNA, 21 bp, Homo sapiens
ggagataaaagaaccccagac

SEQ ID NO: 3811218 - DNA, 14 bp, Homo sapiens
ggagccagccagga

SEQ ID NO: 3811219 - DNA, 21 bp, Homo sapiens
ggagctcaggaaccgaggcag

SEQ ID NO: 3811220 - DNA, 14 bp, Homo sapiens
ggagctgacagagc

SEQ ID NO: 3811221 - DNA, 17 bp, Homo sapiens
ggagctgacagagccag

SEQ ID NO: 3811222 - DNA, 22 bp, Homo sapiens
ggagctgacagagccagaggca

SEQ ID NO: 3811223 - DNA, 16 bp, Homo sapiens
ggagctgagtggggga

SEQ ID NO: 3811224 - DNA, 18 bp, Homo sapiens
ggagctggttagaaatgc

SEQ ID NO: 3811225 - DNA, 12 bp, Homo sapiens
ggaggacagagc

SEQ ID NO: 3811226 - DNA, 13 bp, Homo sapiens
ggaggagaatgag

SEQ ID NO: 3811227 - DNA, 20 bp, Homo sapiens
ggaggagggcaggcatcggg

SEQ ID NO: 3811228 - DNA, 23 bp, Homo sapiens
ggaggatcacttgagtccagaag

SEQ ID NO: 3811229 - DNA, 23 bp, Homo sapiens
ggaggcaggatatccccagggaa

SEQ ID NO: 3811230 - DNA, 20 bp, Homo sapiens
ggaggccaaggtgggaggat

SEQ ID NO: 3811231 - DNA, 17 bp, Homo sapiens
ggaggctgaggcaccag

SEQ ID NO: 3811232 - DNA, 20 bp, Homo sapiens
ggaggggactatttatgaag

SEQ ID NO: 3811233 - DNA, 21 bp, Homo sapiens
ggagtcccttagaagatctgc

SEQ ID NO: 3811234 - DNA, 15 bp, Homo sapiens
ggatagatgtgtgga

SEQ ID NO: 3811235 - DNA, 13 bp, Homo sapiens
ggatcacagggcc

SEQ ID NO: 3811236 - DNA, 21 bp, Homo sapiens
ggatccacgtgctcgcctctg

SEQ ID NO: 3811237 - DNA, 16 bp, Homo sapiens
ggatggagagagggga

SEQ ID NO: 3811238 - DNA, 18 bp, Homo sapiens
ggatgggaacactggtgg

SEQ ID NO: 3811239 - DNA, 22 bp, Homo sapiens
ggatggtcttgatctcctgagc

SEQ ID NO: 3811240 - DNA, 13 bp, Homo sapiens
ggatgtctgggcc

SEQ ID NO: 3811241 - DNA, 14 bp, Homo sapiens
ggattcccagagag

SEQ ID NO: 3811242 - DNA, 23 bp, Homo sapiens
ggatttcaccgtattagccagga

SEQ ID NO: 3811243 - DNA, 15 bp, Homo sapiens
ggcaaaaaggcagga

SEQ ID NO: 3811244 - DNA, 16 bp, Homo sapiens
ggcaaaatccttgctt

SEQ ID NO: 3811245 - DNA, 18 bp, Homo sapiens
ggcaaagaactgccccat

SEQ ID NO: 3811246 - DNA, 13 bp, Homo sapiens
ggcaaccctcagc

SEQ ID NO: 3811247 - DNA, 19 bp, Homo sapiens
ggcaagaatgaaatactct

SEQ ID NO: 3811248 - DNA, 14 bp, Homo sapiens
ggcacatggaggag

SEQ ID NO: 3811249 - DNA, 23 bp, Homo sapiens
ggcaccactagggtcctggccct

SEQ ID NO: 3811250 - DNA, 24 bp, Homo sapiens
ggcaccactagggtcctggccctc

SEQ ID NO: 3811251 - DNA, 12 bp, Homo sapiens
ggcacctaaact

SEQ ID NO: 3811252 - DNA, 15 bp, Homo sapiens
ggcactggggcaggg

SEQ ID NO: 3811253 - DNA, 14 bp, Homo sapiens
ggcagctccagctg

SEQ ID NO: 3811254 - DNA, 12 bp, Homo sapiens
ggcaggggccgg

SEQ ID NO: 3811255 - DNA, 24 bp, Homo sapiens
ggcagtgaacacactcagcagccc

SEQ ID NO: 3811256 - DNA, 23 bp, Homo sapiens
ggcatcggggagccgggagcctg

SEQ ID NO: 3811257 - DNA, 11 bp, Homo sapiens
ggccactgtga

SEQ ID NO: 3811258 - DNA, 20 bp, Homo sapiens
ggccactgtgaagagaacca

SEQ ID NO: 3811259 - DNA, 20 bp, Homo sapiens
ggccagatgcacatccctgg

SEQ ID NO: 3811260 - DNA, 15 bp, Homo sapiens
ggccagtcctagagc

SEQ ID NO: 3811261 - DNA, 24 bp, Homo sapiens
ggccagtcctagagctcctgtccc

SEQ ID NO: 3811262 - DNA, 17 bp, Homo sapiens
ggccatgaactttgtcc

SEQ ID NO: 3811263 - DNA, 14 bp, Homo sapiens
ggcccgggccttat

SEQ ID NO: 3811264 - DNA, 21 bp, Homo sapiens
ggccctaggattcctccccca

SEQ ID NO: 3811265 - DNA, 15 bp, Homo sapiens
ggcctaacctgccga

SEQ ID NO: 3811266 - DNA, 22 bp, Homo sapiens
ggcctaacctgccgagagtcca

SEQ ID NO: 3811267 - DNA, 17 bp, Homo sapiens
ggcctcagcctccaggc

SEQ ID NO: 3811268 - DNA, 20 bp, Homo sapiens
ggcctccagccctctcactg

SEQ ID NO: 3811269 - DNA, 22 bp, Homo sapiens
ggcctctagaacacccactggc

SEQ ID NO: 3811270 - DNA, 16 bp, Homo sapiens
ggcctgactctcagca

SEQ ID NO: 3811271 - DNA, 15 bp, Homo sapiens
ggcctgggcaggagg

SEQ ID NO: 3811272 - DNA, 13 bp, Homo sapiens
ggcctttggcttc

SEQ ID NO: 3811273 - DNA, 14 bp, Homo sapiens
ggcgacagagcaag

SEQ ID NO: 3811274 - DNA, 18 bp, Homo sapiens
ggcgagcccttagccttg

SEQ ID NO: 3811275 - DNA, 15 bp, Homo sapiens
ggcgcggtggctcac

SEQ ID NO: 3811276 - DNA, 19 bp, Homo sapiens
ggctaagatactgctgatg

SEQ ID NO: 3811277 - DNA, 23 bp, Homo sapiens
ggctacccctcgactcagcacca

SEQ ID NO: 3811278 - DNA, 23 bp, Homo sapiens
ggctcagcaaaagatgcttctca

SEQ ID NO: 3811279 - DNA, 16 bp, Homo sapiens
ggctccatgctggtgt

SEQ ID NO: 3811280 - DNA, 20 bp, Homo sapiens
ggctcctcgagatcccaaca

SEQ ID NO: 3811281 - DNA, 22 bp, Homo sapiens
ggctggaaggagccagccagga

SEQ ID NO: 3811282 - DNA, 20 bp, Homo sapiens
ggctggagtgcagtggtgcg

SEQ ID NO: 3811283 - DNA, 16 bp, Homo sapiens
ggctgggtccagggga

SEQ ID NO: 3811284 - DNA, 18 bp, Homo sapiens
ggctgggtcggccctgcc

SEQ ID NO: 3811285 - DNA, 23 bp, Homo sapiens
ggctgtggcatccagagtccctg

SEQ ID NO: 3811286 - DNA, 11 bp, Homo sapiens
ggcttccctgg

SEQ ID NO: 3811287 - DNA, 23 bp, Homo sapiens
gggacaattcttctcgacttcag

SEQ ID NO: 3811288 - DNA, 20 bp, Homo sapiens
gggacaccaagccttggctc

SEQ ID NO: 3811289 - DNA, 14 bp, Homo sapiens
gggacacctaggct

SEQ ID NO: 3811290 - DNA, 22 bp, Homo sapiens
gggacacctaggctagggtggg

SEQ ID NO: 3811291 - DNA, 13 bp, Homo sapiens
gggaccagggcat

SEQ ID NO: 3811292 - DNA, 13 bp, Homo sapiens
gggagccgggagc

SEQ ID NO: 3811293 - DNA, 12 bp, Homo sapiens
gggagctcagga

SEQ ID NO: 3811294 - DNA, 22 bp, Homo sapiens
gggagctcaggaaccgaggcag

SEQ ID NO: 3811295 - DNA, 19 bp, Homo sapiens
gggaggccaaggtgggagg

SEQ ID NO: 3811296 - DNA, 18 bp, Homo sapiens
gggagggaaaagctaaga

SEQ ID NO: 3811297 - DNA, 18 bp, Homo sapiens
gggaggtcaaggctgcag

SEQ ID NO: 3811298 - DNA, 17 bp, Homo sapiens
gggaggtcgaggcagga

SEQ ID NO: 3811299 - DNA, 18 bp, Homo sapiens
gggaggtcgaggcaggag

SEQ ID NO: 3811300 - DNA, 18 bp, Homo sapiens
gggaggtgagaccacctc

SEQ ID NO: 3811301 - DNA, 23 bp, Homo sapiens
gggaggtgcttctagttctgcca

SEQ ID NO: 3811302 - DNA, 19 bp, Homo sapiens
gggatgactaaaatattta

SEQ ID NO: 3811303 - DNA, 23 bp, Homo sapiens
gggatgactagaggcagggaggg

SEQ ID NO: 3811304 - DNA, 16 bp, Homo sapiens
gggcacagggtctcta

SEQ ID NO: 3811305 - DNA, 21 bp, Homo sapiens
gggcaccctccaaacactggg

SEQ ID NO: 3811306 - DNA, 14 bp, Homo sapiens
tattggaattttct

SEQ ID NO: 3811307 - DNA, 15 bp, Homo sapiens
tattgtatttatgtg

SEQ ID NO: 3811308 - DNA, 21 bp, Homo sapiens
tatttaaacctgcccttgttt

SEQ ID NO: 3811309 - DNA, 13 bp, Homo sapiens
tatttagaatata

SEQ ID NO: 3811310 - DNA, 21 bp, Homo sapiens
tatttatgtaggatctgtcaa

SEQ ID NO: 3811311 - DNA, 13 bp, Homo sapiens
tattttaatttac

SEQ ID NO: 3811312 - DNA, 16 bp, Homo sapiens
tattttacaaattgtt

SEQ ID NO: 3811313 - DNA, 18 bp, Homo sapiens
tattttatttctgaagag

SEQ ID NO: 3811314 - DNA, 22 bp, Homo sapiens
tattttccctattagagaagag

SEQ ID NO: 3811315 - DNA, 23 bp, Homo sapiens
tatttttgttggagccactctgt

SEQ ID NO: 3811316 - DNA, 17 bp, Homo sapiens
tattttttttaagtatt

SEQ ID NO: 3811317 - DNA, 16 bp, Homo sapiens
tcaaaagctgggcagg

SEQ ID NO: 3811318 - DNA, 19 bp, Homo sapiens
tcaaattatttttaagttt

SEQ ID NO: 3811319 - DNA, 16 bp, Homo sapiens
tcaaccgcttgccata

SEQ ID NO: 3811320 - DNA, 15 bp, Homo sapiens
tcaacctgtgtctta

SEQ ID NO: 3811321 - DNA, 22 bp, Homo sapiens
tcaagaaactgaggaattttct

SEQ ID NO: 3811322 - DNA, 21 bp, Homo sapiens
tcaagaaagcttcaaactgca

SEQ ID NO: 3811323 - DNA, 21 bp, Homo sapiens
tcaaggggactggtgatggga

SEQ ID NO: 3811324 - DNA, 15 bp, Homo sapiens
tcaagtgaaaaagga

SEQ ID NO: 3811325 - DNA, 23 bp, Homo sapiens
tcaagtgaaaaaggaggaagaga

SEQ ID NO: 3811326 - DNA, 13 bp, Homo sapiens
tcaataaagcaga

SEQ ID NO: 3811327 - DNA, 16 bp, Homo sapiens
tcaataaagcagagcc

SEQ ID NO: 3811328 - DNA, 23 bp, Homo sapiens
tcaataaagcagagccaaggcca

SEQ ID NO: 3811329 - DNA, 16 bp, Homo sapiens
tcaatattcaataaag

SEQ ID NO: 3811330 - DNA, 16 bp, Homo sapiens
tcaatgatcatctcac

SEQ ID NO: 3811331 - DNA, 12 bp, Homo sapiens
tcacacagagat

SEQ ID NO: 3811332 - DNA, 17 bp, Homo sapiens
tcacaccattctcctgc

SEQ ID NO: 3811333 - DNA, 14 bp, Homo sapiens
tcacagcctctccc

SEQ ID NO: 3811334 - DNA, 16 bp, Homo sapiens
tcacagcctctccctt

SEQ ID NO: 3811335 - DNA, 13 bp, Homo sapiens
tcacagcctctga

SEQ ID NO: 3811336 - DNA, 14 bp, Homo sapiens
tcacagcgcctcct

SEQ ID NO: 3811337 - DNA, 17 bp, Homo sapiens
tcacagggccccagaag

SEQ ID NO: 3811338 - DNA, 23 bp, Homo sapiens
tcacagggccccagaaggcaggg

SEQ ID NO: 3811339 - DNA, 23 bp, Homo sapiens
tcaccacaacctccacctcctgg

SEQ ID NO: 3811340 - DNA, 21 bp, Homo sapiens
tcaccagatttgctaatttat

SEQ ID NO: 3811341 - DNA, 15 bp, Homo sapiens
tcaccctacctgtgc

SEQ ID NO: 3811342 - DNA, 16 bp, Homo sapiens
tcacccttggtagagt

SEQ ID NO: 3811343 - DNA, 14 bp, Homo sapiens
tcaccggagctttc

SEQ ID NO: 3811344 - DNA, 19 bp, Homo sapiens
tcacctgagtcaccctacc

SEQ ID NO: 3811345 - DNA, 13 bp, Homo sapiens
tcaccttcctagt

SEQ ID NO: 3811346 - DNA, 17 bp, Homo sapiens
tcacggaagagccttgc

SEQ ID NO: 3811347 - DNA, 21 bp, Homo sapiens
tcactgcaagctctgcctccc

SEQ ID NO: 3811348 - DNA, 18 bp, Homo sapiens
tcactggaccactgggca

SEQ ID NO: 3811349 - DNA, 19 bp, Homo sapiens
tcactggtagaccaaaata

SEQ ID NO: 3811350 - DNA, 16 bp, Homo sapiens
tcacttaaaaaaatgc

SEQ ID NO: 3811351 - DNA, 13 bp, Homo sapiens
tcacttgtacaaa

SEQ ID NO: 3811352 - DNA, 14 bp, Homo sapiens
tcacttgtacaaaa

SEQ ID NO: 3811353 - DNA, 18 bp, Homo sapiens
tcacttttcctccctcag

SEQ ID NO: 3811354 - DNA, 19 bp, Homo sapiens
tcagaatataacatgtaaa

SEQ ID NO: 3811355 - DNA, 22 bp, Homo sapiens
tcagatttgccttattggcagc

SEQ ID NO: 3811356 - DNA, 19 bp, Homo sapiens
tcagcaccacattgcctca

SEQ ID NO: 3811357 - DNA, 17 bp, Homo sapiens
tcagcagccccctgccc

SEQ ID NO: 3811358 - DNA, 18 bp, Homo sapiens
tcagcatcctcagttcct

SEQ ID NO: 3811359 - DNA, 16 bp, Homo sapiens
tcagccccgcgtggaa

SEQ ID NO: 3811360 - DNA, 13 bp, Homo sapiens
tcagcctcctgag

SEQ ID NO: 3811361 - DNA, 16 bp, Homo sapiens
tcagcctgctccagct

SEQ ID NO: 3811362 - DNA, 19 bp, Homo sapiens
tcagcctgctccagctgtt

SEQ ID NO: 3811363 - DNA, 12 bp, Homo sapiens
tcagctgcctca

SEQ ID NO: 3811364 - DNA, 21 bp, Homo sapiens
tcaggagctgacagagccaga

SEQ ID NO: 3811365 - DNA, 21 bp, Homo sapiens
tcaggatgtcctttgtgtcca

SEQ ID NO: 3811366 - DNA, 21 bp, Homo sapiens
tcaggatttcaccagaagtta

SEQ ID NO: 3811367 - DNA, 19 bp, Homo sapiens
tcaggcccttattttcaag

SEQ ID NO: 3811368 - DNA, 21 bp, Homo sapiens
tcaggctgggttgtcactgag

SEQ ID NO: 3811369 - DNA, 23 bp, Homo sapiens
tcaggctggtctcgaactcctga

SEQ ID NO: 3811370 - DNA, 17 bp, Homo sapiens
tcaggctttgtctgctc

SEQ ID NO: 3811371 - DNA, 23 bp, Homo sapiens
tcaggggtcgtcaccacctctcc

SEQ ID NO: 3811372 - DNA, 12 bp, Homo sapiens
tcaggggtgtgc

SEQ ID NO: 3811373 - DNA, 19 bp, Homo sapiens
tcaggtagggagctaagga

SEQ ID NO: 3811374 - DNA, 16 bp, Homo sapiens
tcaggtcctcagagaa

SEQ ID NO: 3811375 - DNA, 21 bp, Homo sapiens
tcaggtgagaagcagaggaag

SEQ ID NO: 3811376 - DNA, 12 bp, Homo sapiens
tcagtatgtgga

SEQ ID NO: 3811377 - DNA, 16 bp, Homo sapiens
tcagtatgtggaagtg

SEQ ID NO: 3811378 - DNA, 14 bp, Homo sapiens
tcagtcatgtgtaa

SEQ ID NO: 3811379 - DNA, 19 bp, Homo sapiens
tcagtgcacacggatgcac

SEQ ID NO: 3811380 - DNA, 16 bp, Homo sapiens
tcagtggcaagaatga

SEQ ID NO: 3811381 - DNA, 19 bp, Homo sapiens
tcagttcattgtggtcctt

SEQ ID NO: 3811382 - DNA, 12 bp, Homo sapiens
tcatacattata

SEQ ID NO: 3811383 - DNA, 14 bp, Homo sapiens
tcatacattatatt

SEQ ID NO: 3811384 - DNA, 20 bp, Homo sapiens
tcatagatgagaaaactgag

SEQ ID NO: 3811385 - DNA, 16 bp, Homo sapiens
tcatatattatcaaaa

SEQ ID NO: 3811386 - DNA, 23 bp, Homo sapiens
tcatcacatttctatgccaaaca

SEQ ID NO: 3811387 - DNA, 13 bp, Homo sapiens
tcatgggaagaac

SEQ ID NO: 3811388 - DNA, 16 bp, Homo sapiens
tcatgtcgtaggtaaa

SEQ ID NO: 3811389 - DNA, 13 bp, Homo sapiens
tcatgtcttttta

SEQ ID NO: 3811390 - DNA, 14 bp, Homo sapiens
tcatgtgactcttt

SEQ ID NO: 3811391 - DNA, 17 bp, Homo sapiens
tcatgtttacagaggac

SEQ ID NO: 3811392 - DNA, 15 bp, Homo sapiens
tcattaaatggggct

SEQ ID NO: 3811393 - DNA, 16 bp, Homo sapiens
tcattcaggtgttctc

SEQ ID NO: 3811394 - DNA, 19 bp, Homo sapiens
tcattctaattacaaagtt

SEQ ID NO: 3811395 - DNA, 17 bp, Homo sapiens
tcatttcttcctctgca

SEQ ID NO: 3811396 - DNA, 18 bp, Homo sapiens
tcatttgttcattaaacg

SEQ ID NO: 3811397 - DNA, 15 bp, Homo sapiens
tcatttgttggaatg

SEQ ID NO: 3811398 - DNA, 12 bp, Homo sapiens
tccaaccccagc

SEQ ID NO: 3811399 - DNA, 18 bp, Homo sapiens
tccaaccccagctggcct

SEQ ID NO: 3811400 - DNA, 20 bp, Homo sapiens
tccaaccccagctggcctct

SEQ ID NO: 3811401 - DNA, 19 bp, Homo sapiens
tccaaggagaaacagagac

SEQ ID NO: 3811402 - DNA, 22 bp, Homo sapiens
tccaaggagaaacagagacagg

SEQ ID NO: 3811403 - DNA, 17 bp, Homo sapiens
tccaagtctctctgtga

SEQ ID NO: 3811404 - DNA, 18 bp, Homo sapiens
tccaagtctctctgtgaa

SEQ ID NO: 3811405 - DNA, 19 bp, Homo sapiens
tccaagtctctctgtgaat

SEQ ID NO: 3811406 - DNA, 18 bp, Homo sapiens
tccaattttctggaatac

SEQ ID NO: 3811407 - DNA, 22 bp, Homo sapiens
tccaattttctggaatacatga

SEQ ID NO: 3811408 - DNA, 15 bp, Homo sapiens
tccacaaatgctatt

SEQ ID NO: 3811409 - DNA, 12 bp, Homo sapiens
tccacacacaga

SEQ ID NO: 3811410 - DNA, 14 bp, Homo sapiens
tccacacacagagg

SEQ ID NO: 3811411 - DNA, 19 bp, Homo sapiens
tccacacacagaggaagag

SEQ ID NO: 3811412 - DNA, 14 bp, Homo sapiens
tccactcatgtgac

SEQ ID NO: 3811413 - DNA, 21 bp, Homo sapiens
tccactcatgtgactctttcc

SEQ ID NO: 3811414 - DNA, 16 bp, Homo sapiens
tgggaaccatgaagct

SEQ ID NO: 3811415 - DNA, 23 bp, Homo sapiens
tgggaataagtgccaggatggaa

SEQ ID NO: 3811416 - DNA, 21 bp, Homo sapiens
tgggacaccccgacttttgtt

SEQ ID NO: 3811417 - DNA, 14 bp, Homo sapiens
tgggaccagggcat

SEQ ID NO: 3811418 - DNA, 16 bp, Homo sapiens
tgggaggacagagccg

SEQ ID NO: 3811419 - DNA, 17 bp, Homo sapiens
tgggaggagggcaggca

SEQ ID NO: 3811420 - DNA, 18 bp, Homo sapiens
tgggaggatctcttgagc

SEQ ID NO: 3811421 - DNA, 22 bp, Homo sapiens
tgggaggatctcttgagcctgg

SEQ ID NO: 3811422 - DNA, 22 bp, Homo sapiens
tgggaggattgcttgagctcag

SEQ ID NO: 3811423 - DNA, 18 bp, Homo sapiens
tgggaggtcaaggctgca

SEQ ID NO: 3811424 - DNA, 23 bp, Homo sapiens
tgggaggtcaaggctgcagtgag

SEQ ID NO: 3811425 - DNA, 21 bp, Homo sapiens
tgggagtgaggatgtctgggc

SEQ ID NO: 3811426 - DNA, 22 bp, Homo sapiens
tgggagtgaggatgtctgggcc

SEQ ID NO: 3811427 - DNA, 19 bp, Homo sapiens
tgggcaatgatggcaattt

SEQ ID NO: 3811428 - DNA, 13 bp, Homo sapiens
tgggcagctgagg

SEQ ID NO: 3811429 - DNA, 13 bp, Homo sapiens
tgggcaggaggga

SEQ ID NO: 3811430 - DNA, 18 bp, Homo sapiens
tgggcaggagggaggtgc

SEQ ID NO: 3811431 - DNA, 12 bp, Homo sapiens
tgggcagtgccc

SEQ ID NO: 3811432 - DNA, 20 bp, Homo sapiens
tgggctttctcagtgtcagc

SEQ ID NO: 3811433 - DNA, 22 bp, Homo sapiens
tggggagggatttggggctcag

SEQ ID NO: 3811434 - DNA, 18 bp, Homo sapiens
tggggagtttagggtggg

SEQ ID NO: 3811435 - DNA, 19 bp, Homo sapiens
tggggagtttagggtgggg

SEQ ID NO: 3811436 - DNA, 21 bp, Homo sapiens
tgggggatcacagcctctgaa

SEQ ID NO: 3811437 - DNA, 20 bp, Homo sapiens
tgggggatgactagaggcag

SEQ ID NO: 3811438 - DNA, 11 bp, Homo sapiens
tgggggatgta

SEQ ID NO: 3811439 - DNA, 14 bp, Homo sapiens
tgggggtctgtgtg

SEQ ID NO: 3811440 - DNA, 18 bp, Homo sapiens
tgggggtctgtgtgttta

SEQ ID NO: 3811441 - DNA, 13 bp, Homo sapiens
tgggtccagggga

SEQ ID NO: 3811442 - DNA, 15 bp, Homo sapiens
tgggtctgtgtgtgt

SEQ ID NO: 3811443 - DNA, 13 bp, Homo sapiens
tggtaattgttgc

SEQ ID NO: 3811444 - DNA, 18 bp, Homo sapiens
tggtattttaagagaaaa

SEQ ID NO: 3811445 - DNA, 23 bp, Homo sapiens
tggtcccaagtagtagtgtcttc

SEQ ID NO: 3811446 - DNA, 17 bp, Homo sapiens
tggtctcgaactcctga

SEQ ID NO: 3811447 - DNA, 17 bp, Homo sapiens
tggtcttgatctcctga

SEQ ID NO: 3811448 - DNA, 16 bp, Homo sapiens
tggtgttactaaagtc

SEQ ID NO: 3811449 - DNA, 13 bp, Homo sapiens
tggttagaaatgc

SEQ ID NO: 3811450 - DNA, 14 bp, Homo sapiens
tggttagaaatgca

SEQ ID NO: 3811451 - DNA, 16 bp, Homo sapiens
tgtaaagtaagacatc

SEQ ID NO: 3811452 - DNA, 18 bp, Homo sapiens
tgtaaatatttatttatg

SEQ ID NO: 3811453 - DNA, 12 bp, Homo sapiens
tgtaaatgtaag

SEQ ID NO: 3811454 - DNA, 20 bp, Homo sapiens
tgtaatcccagcactttggg

SEQ ID NO: 3811455 - DNA, 17 bp, Homo sapiens
tgtaattacttattgta

SEQ ID NO: 3811456 - DNA, 18 bp, Homo sapiens
tgtaatttaaaattgtga

SEQ ID NO: 3811457 - DNA, 14 bp, Homo sapiens
tgtacctctgcctc

SEQ ID NO: 3811458 - DNA, 16 bp, Homo sapiens
tgtagaatgatttcat

SEQ ID NO: 3811459 - DNA, 11 bp, Homo sapiens
tgtagagactt

SEQ ID NO: 3811460 - DNA, 12 bp, Homo sapiens
tgtatatagttt

SEQ ID NO: 3811461 - DNA, 16 bp, Homo sapiens
tgtatatgtatatcta

SEQ ID NO: 3811462 - DNA, 22 bp, Homo sapiens
tgtatcactcactgccaaaaat

SEQ ID NO: 3811463 - DNA, 16 bp, Homo sapiens
tgtatcatagaaatgt

SEQ ID NO: 3811464 - DNA, 17 bp, Homo sapiens
tgtatcatagaaatgta

SEQ ID NO: 3811465 - DNA, 14 bp, Homo sapiens
tgtcacgccagact

SEQ ID NO: 3811466 - DNA, 21 bp, Homo sapiens
tgtcactggtagaccaaaata

SEQ ID NO: 3811467 - DNA, 23 bp, Homo sapiens
tgtcactggtagaccaaaataaa

SEQ ID NO: 3811468 - DNA, 18 bp, Homo sapiens
tgtccccctcccctccca

SEQ ID NO: 3811469 - DNA, 14 bp, Homo sapiens
tgtccctacccact

SEQ ID NO: 3811470 - DNA, 18 bp, Homo sapiens
tgtccctacccactcttt

SEQ ID NO: 3811471 - DNA, 13 bp, Homo sapiens
tgtcctcagcccc

SEQ ID NO: 3811472 - DNA, 18 bp, Homo sapiens
tgtcctgcaccggggcct

SEQ ID NO: 3811473 - DNA, 23 bp, Homo sapiens
tgtctggctgaggatttcaagcc

SEQ ID NO: 3811474 - DNA, 14 bp, Homo sapiens
tgtctgtctgtccc

SEQ ID NO: 3811475 - DNA, 16 bp, Homo sapiens
tgtctgtctgtctgtc

SEQ ID NO: 3811476 - DNA, 19 bp, Homo sapiens
tgtcttataggtttccact

SEQ ID NO: 3811477 - DNA, 15 bp, Homo sapiens
tgtcttccaacccca

SEQ ID NO: 3811478 - DNA, 16 bp, Homo sapiens
tgtcttccaaccccag

SEQ ID NO: 3811479 - DNA, 18 bp, Homo sapiens
tgtcttccaaccccagct

SEQ ID NO: 3811480 - DNA, 20 bp, Homo sapiens
tgtcttcctagtatattagt

SEQ ID NO: 3811481 - DNA, 14 bp, Homo sapiens
tgtcttttgaagaa

SEQ ID NO: 3811482 - DNA, 15 bp, Homo sapiens
tgtcttttgaagaag

SEQ ID NO: 3811483 - DNA, 14 bp, Homo sapiens
tgtgaagagaacca

SEQ ID NO: 3811484 - DNA, 19 bp, Homo sapiens
tgtgaatacaattaaaggt

SEQ ID NO: 3811485 - DNA, 20 bp, Homo sapiens
tgtgaatacaattaaaggtc

SEQ ID NO: 3811486 - DNA, 12 bp, Homo sapiens
tgtgacaacatt

SEQ ID NO: 3811487 - DNA, 18 bp, Homo sapiens
tgtgaggggctctctcat

SEQ ID NO: 3811488 - DNA, 11 bp, Homo sapiens
tgtgatgtgtc

SEQ ID NO: 3811489 - DNA, 19 bp, Homo sapiens
tgtgattcctttgaagagg

SEQ ID NO: 3811490 - DNA, 21 bp, Homo sapiens
tgtgattcctttgaagaggaa

SEQ ID NO: 3811491 - DNA, 16 bp, Homo sapiens
tgtgcctcctcacccc

SEQ ID NO: 3811492 - DNA, 19 bp, Homo sapiens
tgtgccttgtcacgccaga

SEQ ID NO: 3811493 - DNA, 17 bp, Homo sapiens
tgtgctcccaccaggca

SEQ ID NO: 3811494 - DNA, 20 bp, Homo sapiens
tgtgctctcggcttcaccag

SEQ ID NO: 3811495 - DNA, 15 bp, Homo sapiens
tgtggaagtgtgggt

SEQ ID NO: 3811496 - DNA, 23 bp, Homo sapiens
tgtggcaataaaggagaagagat

SEQ ID NO: 3811497 - DNA, 14 bp, Homo sapiens
tgtgggtctgtgtg

SEQ ID NO: 3811498 - DNA, 16 bp, Homo sapiens
tgtgggtctgtgtgtg

SEQ ID NO: 3811499 - DNA, 18 bp, Homo sapiens
tgtgtaatttaaaattgt

SEQ ID NO: 3811500 - DNA, 18 bp, Homo sapiens
tgtgtatattttaatgaa

SEQ ID NO: 3811501 - DNA, 11 bp, Homo sapiens
tgtgtatgtgg

SEQ ID NO: 3811502 - DNA, 17 bp, Homo sapiens
tgtgtcagaaacatgaa

SEQ ID NO: 3811503 - DNA, 21 bp, Homo sapiens
tgtgtcagaaacatgaaatgc

SEQ ID NO: 3811504 - DNA, 15 bp, Homo sapiens
tgtgtccctctctct

SEQ ID NO: 3811505 - DNA, 16 bp, Homo sapiens
tgtgtcttgtgttttt

SEQ ID NO: 3811506 - DNA, 14 bp, Homo sapiens
tgtgtgggagtgtg

SEQ ID NO: 3811507 - DNA, 23 bp, Homo sapiens
tgtgttgtgtgtgggagtgtgta

SEQ ID NO: 3811508 - DNA, 13 bp, Homo sapiens
tgttactaaagtc

SEQ ID NO: 3811509 - DNA, 22 bp, Homo sapiens
tgttactaaagtcacatataaa

SEQ ID NO: 3811510 - DNA, 17 bp, Homo sapiens
tgttattggaattttct

SEQ ID NO: 3811511 - DNA, 23 bp, Homo sapiens
tgttattggaattttctttcata

SEQ ID NO: 3811512 - DNA, 21 bp, Homo sapiens
tgttcacaccattctcctgcc

SEQ ID NO: 3811513 - DNA, 19 bp, Homo sapiens
tgttccataataaacttct

SEQ ID NO: 3811514 - DNA, 23 bp, Homo sapiens
tgttcgccgtctggcgagccctt

SEQ ID NO: 3811515 - DNA, 16 bp, Homo sapiens
tgttctctttaaaata

SEQ ID NO: 3811516 - DNA, 16 bp, Homo sapiens
tgttcttttgtcccag

SEQ ID NO: 3811517 - DNA, 18 bp, Homo sapiens
tgttgggagtgaggatgt

SEQ ID NO: 3811518 - DNA, 15 bp, Homo sapiens
tgttgtgtgtgggag

SEQ ID NO: 3811519 - DNA, 22 bp, Homo sapiens
tgtttaaaactcagaatataac

SEQ ID NO: 3811520 - DNA, 14 bp, Homo sapiens
tgtttacagaggac

SEQ ID NO: 3811521 - DNA, 19 bp, Homo sapiens
tgtttagaagaagtgtgtc

SEQ ID NO: 3811522 - DNA, 20 bp, Homo sapiens
aatatgcctagtaacacata

SEQ ID NO: 3811523 - DNA, 16 bp, Homo sapiens
aatattcaataaagct

SEQ ID NO: 3811524 - DNA, 13 bp, Homo sapiens
aatccagaaagaa

SEQ ID NO: 3811525 - DNA, 20 bp, Homo sapiens
aatcccagctattcaggagg

SEQ ID NO: 3811526 - DNA, 21 bp, Homo sapiens
aatccttaaactagctaaaac

SEQ ID NO: 3811527 - DNA, 13 bp, Homo sapiens
aatccttgcttat

SEQ ID NO: 3811528 - DNA, 21 bp, Homo sapiens
aatctcttctaaaaaaaaaca

SEQ ID NO: 3811529 - DNA, 18 bp, Homo sapiens
aatctgcattttaacaag

SEQ ID NO: 3811530 - DNA, 21 bp, Homo sapiens
aatgaaatcctgcttcagtgt

SEQ ID NO: 3811531 - DNA, 11 bp, Homo sapiens
aatgagcctgg

SEQ ID NO: 3811532 - DNA, 14 bp, Homo sapiens
aatgagcctggcaa

SEQ ID NO: 3811533 - DNA, 17 bp, Homo sapiens
aatgatggcaattttgt

SEQ ID NO: 3811534 - DNA, 24 bp, Homo sapiens
aatgcacacacacagagatatgca

SEQ ID NO: 3811535 - DNA, 11 bp, Homo sapiens
aatgcaggaga

SEQ ID NO: 3811536 - DNA, 16 bp, Homo sapiens
aatggcacgatctcag

SEQ ID NO: 3811537 - DNA, 19 bp, Homo sapiens
aatggcacgatctcagctc

SEQ ID NO: 3811538 - DNA, 17 bp, Homo sapiens
aatggtgttactaaagt

SEQ ID NO: 3811539 - DNA, 16 bp, Homo sapiens
aatgtaacttttgtaa

SEQ ID NO: 3811540 - DNA, 23 bp, Homo sapiens
aatgtagcgactgtcaacagcgt

SEQ ID NO: 3811541 - DNA, 18 bp, Homo sapiens
aatgtatcatagaaatgt

SEQ ID NO: 3811542 - DNA, 23 bp, Homo sapiens
aatgtcagaaactcgatgaatgt

SEQ ID NO: 3811543 - DNA, 13 bp, Homo sapiens
aatgtcagtatgt

SEQ ID NO: 3811544 - DNA, 15 bp, Homo sapiens
aatgtcagtatgtgg

SEQ ID NO: 3811545 - DNA, 22 bp, Homo sapiens
aatgtctagttgtaacaccatg

SEQ ID NO: 3811546 - DNA, 16 bp, Homo sapiens
aatgtggcagctgtct

SEQ ID NO: 3811547 - DNA, 22 bp, Homo sapiens
aatgtgttgatttgagaaattt

SEQ ID NO: 3811548 - DNA, 20 bp, Homo sapiens
aatgttatgtgctctgattt

SEQ ID NO: 3811549 - DNA, 13 bp, Homo sapiens
aattacaaagttc

SEQ ID NO: 3811550 - DNA, 14 bp, Homo sapiens
aattacacccaaag

SEQ ID NO: 3811551 - DNA, 14 bp, Homo sapiens
aattactgtatata

SEQ ID NO: 3811552 - DNA, 15 bp, Homo sapiens
aattagccaagtgtg

SEQ ID NO: 3811553 - DNA, 20 bp, Homo sapiens
aattatttatttatggagga

SEQ ID NO: 3811554 - DNA, 18 bp, Homo sapiens
aattcaacctgtgtctta

SEQ ID NO: 3811555 - DNA, 14 bp, Homo sapiens
aattccccaccctg

SEQ ID NO: 3811556 - DNA, 19 bp, Homo sapiens
aattgcttgaacccaggag

SEQ ID NO: 3811557 - DNA, 20 bp, Homo sapiens
aattggaagctgccctgccc

SEQ ID NO: 3811558 - DNA, 21 bp, Homo sapiens
aattgggagcttgggaatgga

SEQ ID NO: 3811559 - DNA, 15 bp, Homo sapiens
aattgtgatgtgtcc

SEQ ID NO: 3811560 - DNA, 19 bp, Homo sapiens
aatttatcctgaaatttca

SEQ ID NO: 3811561 - DNA, 18 bp, Homo sapiens
aatttctaccatttcaga

SEQ ID NO: 3811562 - DNA, 20 bp, Homo sapiens
aatttgcattgtgtcagaaa

SEQ ID NO: 3811563 - DNA, 17 bp, Homo sapiens
aattttatttataaact

SEQ ID NO: 3811564 - DNA, 13 bp, Homo sapiens
acaaaaacatggc

SEQ ID NO: 3811565 - DNA, 13 bp, Homo sapiens
acaaaattttgtt

SEQ ID NO: 3811566 - DNA, 23 bp, Homo sapiens
acaaaattttgtttaaaactcag

SEQ ID NO: 3811567 - DNA, 15 bp, Homo sapiens
acaaacacctcccag

SEQ ID NO: 3811568 - DNA, 16 bp, Homo sapiens
acaaataacaatgtgc

SEQ ID NO: 3811569 - DNA, 14 bp, Homo sapiens
acaaatctatgcca

SEQ ID NO: 3811570 - DNA, 15 bp, Homo sapiens
acaaatctatgccac

SEQ ID NO: 3811571 - DNA, 21 bp, Homo sapiens
acaacatttttgtacattatg

SEQ ID NO: 3811572 - DNA, 17 bp, Homo sapiens
acaacctccacctcctg

SEQ ID NO: 3811573 - DNA, 18 bp, Homo sapiens
acaacctccacctcctgg

SEQ ID NO: 3811574 - DNA, 15 bp, Homo sapiens
acaacctgcccctcc

SEQ ID NO: 3811575 - DNA, 16 bp, Homo sapiens
acaacctgcccctccc

SEQ ID NO: 3811576 - DNA, 18 bp, Homo sapiens
acaacctgcccctcccca

SEQ ID NO: 3811577 - DNA, 17 bp, Homo sapiens
acaacttttaaagaaaa

SEQ ID NO: 3811578 - DNA, 21 bp, Homo sapiens
acaagctgcaccctcaggcag

SEQ ID NO: 3811579 - DNA, 20 bp, Homo sapiens
acaaggctgaccaagagaga

SEQ ID NO: 3811580 - DNA, 22 bp, Homo sapiens
acaaggctgaccaagagagaaa

SEQ ID NO: 3811581 - DNA, 15 bp, Homo sapiens
acaagtaagaaaaat

SEQ ID NO: 3811582 - DNA, 18 bp, Homo sapiens
acaagttgcttttacctg

SEQ ID NO: 3811583 - DNA, 20 bp, Homo sapiens
acaatgcttctttcctgtat

SEQ ID NO: 3811584 - DNA, 21 bp, Homo sapiens
acaatttctattatttttcaa

SEQ ID NO: 3811585 - DNA, 22 bp, Homo sapiens
acaatttctattatttttcaag

SEQ ID NO: 3811586 - DNA, 13 bp, Homo sapiens
acacacacagaga

SEQ ID NO: 3811587 - DNA, 13 bp, Homo sapiens
acacacagaggaa

SEQ ID NO: 3811588 - DNA, 14 bp, Homo sapiens
acacacagatatgc

SEQ ID NO: 3811589 - DNA, 14 bp, Homo sapiens
acacacagatgcac

SEQ ID NO: 3811590 - DNA, 14 bp, Homo sapiens
acacacggatgcac

SEQ ID NO: 3811591 - DNA, 14 bp, Homo sapiens
acacagaaaccaat

SEQ ID NO: 3811592 - DNA, 13 bp, Homo sapiens
acacagaggaaga

SEQ ID NO: 3811593 - DNA, 19 bp, Homo sapiens
acacagatatacacatgga

SEQ ID NO: 3811594 - DNA, 21 bp, Homo sapiens
acacagatggtcacacagaga

SEQ ID NO: 3811595 - DNA, 22 bp, Homo sapiens
acacagtgctgaccagacagcc

SEQ ID NO: 3811596 - DNA, 17 bp, Homo sapiens
acacagtgtttcctgag

SEQ ID NO: 3811597 - DNA, 19 bp, Homo sapiens
acaccagccctgctgcttc

SEQ ID NO: 3811598 - DNA, 22 bp, Homo sapiens
acaccagccctgctgcttccta

SEQ ID NO: 3811599 - DNA, 17 bp, Homo sapiens
acaccattctcctgcct

SEQ ID NO: 3811600 - DNA, 19 bp, Homo sapiens
acaccattctcctgcctca

SEQ ID NO: 3811601 - DNA, 19 bp, Homo sapiens
acaccccacaccccagccc

SEQ ID NO: 3811602 - DNA, 18 bp, Homo sapiens
acaccgttcattcaggca

SEQ ID NO: 3811603 - DNA, 20 bp, Homo sapiens
acacctaggctagggtgggg

SEQ ID NO: 3811604 - DNA, 12 bp, Homo sapiens
acacctcccagg

SEQ ID NO: 3811605 - DNA, 13 bp, Homo sapiens
acacctccctgaa

SEQ ID NO: 3811606 - DNA, 16 bp, Homo sapiens
acacctccctgaacca

SEQ ID NO: 3811607 - DNA, 19 bp, Homo sapiens
acacctctgcacaagctgc

SEQ ID NO: 3811608 - DNA, 23 bp, Homo sapiens
acacctgccctgccctgccacct

SEQ ID NO: 3811609 - DNA, 14 bp, Homo sapiens
acacggaggcatct

SEQ ID NO: 3811610 - DNA, 17 bp, Homo sapiens
acacggaggcatctgca

SEQ ID NO: 3811611 - DNA, 22 bp, Homo sapiens
acacggctgcctgacactgagc

SEQ ID NO: 3811612 - DNA, 21 bp, Homo sapiens
acactcaaaagctgggcaggt

SEQ ID NO: 3811613 - DNA, 18 bp, Homo sapiens
acactcaaggaaaagatg

SEQ ID NO: 3811614 - DNA, 14 bp, Homo sapiens
acactcagcagccc

SEQ ID NO: 3811615 - DNA, 21 bp, Homo sapiens
acactgagccccacctctcca

SEQ ID NO: 3811616 - DNA, 22 bp, Homo sapiens
acactggcatctccctgacctt

SEQ ID NO: 3811617 - DNA, 17 bp, Homo sapiens
acagaaacaaaaacact

SEQ ID NO: 3811618 - DNA, 15 bp, Homo sapiens
acagaaacagagaga

SEQ ID NO: 3811619 - DNA, 17 bp, Homo sapiens
acagaaacagagagaga

SEQ ID NO: 3811620 - DNA, 17 bp, Homo sapiens
acagaaaggccactcag

SEQ ID NO: 3811621 - DNA, 15 bp, Homo sapiens
acagacactacatat

SEQ ID NO: 3811622 - DNA, 20 bp, Homo sapiens
acagacactacatatctaaa

SEQ ID NO: 3811623 - DNA, 23 bp, Homo sapiens
acagagacagaaacagagagaga

SEQ ID NO: 3811624 - DNA, 21 bp, Homo sapiens
acagagacaggcccaagagat

SEQ ID NO: 3811625 - DNA, 14 bp, Homo sapiens
acagagagagactg

SEQ ID NO: 3811626 - DNA, 15 bp, Homo sapiens
acagagagagactga

SEQ ID NO: 3811627 - DNA, 15 bp, Homo sapiens
acagagcaagactct

SEQ ID NO: 3811628 - DNA, 17 bp, Homo sapiens
acagaggaagagcaggc

SEQ ID NO: 3811629 - DNA, 17 bp, Homo sapiens
acagagttggtgttcat

SEQ ID NO: 3811630 - DNA, 16 bp, Homo sapiens
catgggcgaccagggc

SEQ ID NO: 3811631 - DNA, 12 bp, Homo sapiens
catggtgtatgt

SEQ ID NO: 3811632 - DNA, 19 bp, Homo sapiens
catggtgtatgtggttttt

SEQ ID NO: 3811633 - DNA, 15 bp, Homo sapiens
catgttttgtttacg

SEQ ID NO: 3811634 - DNA, 17 bp, Homo sapiens
cattaccacttccctgc

SEQ ID NO: 3811635 - DNA, 22 bp, Homo sapiens
cattagatattaggggggaaag

SEQ ID NO: 3811636 - DNA, 23 bp, Homo sapiens
cattatgttattggaattttctt

SEQ ID NO: 3811637 - DNA, 14 bp, Homo sapiens
cattcaaaaacccc

SEQ ID NO: 3811638 - DNA, 18 bp, Homo sapiens
cattcacagcgcctcctg

SEQ ID NO: 3811639 - DNA, 22 bp, Homo sapiens
cattcacagcgcctcctggacc

SEQ ID NO: 3811640 - DNA, 19 bp, Homo sapiens
cattcaggtgttctcttct

SEQ ID NO: 3811641 - DNA, 23 bp, Homo sapiens
cattccaacagctcaagtcttcc

SEQ ID NO: 3811642 - DNA, 13 bp, Homo sapiens
cattccagaggaa

SEQ ID NO: 3811643 - DNA, 15 bp, Homo sapiens
cattctaattacaaa

SEQ ID NO: 3811644 - DNA, 14 bp, Homo sapiens
cattgtcaagtgga

SEQ ID NO: 3811645 - DNA, 13 bp, Homo sapiens
cattgtcttccaa

SEQ ID NO: 3811646 - DNA, 18 bp, Homo sapiens
cattgtcttccaacccca

SEQ ID NO: 3811647 - DNA, 21 bp, Homo sapiens
cattgtcttccaaccccagct

SEQ ID NO: 3811648 - DNA, 22 bp, Homo sapiens
cattgtcttccaaccccagctg

SEQ ID NO: 3811649 - DNA, 17 bp, Homo sapiens
catttagtgctaaacaa

SEQ ID NO: 3811650 - DNA, 15 bp, Homo sapiens
catttcttcctctgc

SEQ ID NO: 3811651 - DNA, 13 bp, Homo sapiens
catttgctgaata

SEQ ID NO: 3811652 - DNA, 16 bp, Homo sapiens
catttgctttttcacc

SEQ ID NO: 3811653 - DNA, 19 bp, Homo sapiens
cattttgcattagacagat

SEQ ID NO: 3811654 - DNA, 16 bp, Homo sapiens
catttttgtacattat

SEQ ID NO: 3811655 - DNA, 16 bp, Homo sapiens
ccaaacaggctcagag

SEQ ID NO: 3811656 - DNA, 22 bp, Homo sapiens
ccaaagcctcctccagccgcca

SEQ ID NO: 3811657 - DNA, 14 bp, Homo sapiens
ccaacactgccagc

SEQ ID NO: 3811658 - DNA, 16 bp, Homo sapiens
ccaacactgccagcat

SEQ ID NO: 3811659 - DNA, 13 bp, Homo sapiens
ccaacccagcctg

SEQ ID NO: 3811660 - DNA, 13 bp, Homo sapiens
ccaaccccagctg

SEQ ID NO: 3811661 - DNA, 14 bp, Homo sapiens
ccaaccccagctgg

SEQ ID NO: 3811662 - DNA, 15 bp, Homo sapiens
ccaaccccagctggc

SEQ ID NO: 3811663 - DNA, 19 bp, Homo sapiens
ccaaccccagctggcctct

SEQ ID NO: 3811664 - DNA, 15 bp, Homo sapiens
ccaacgaaaagcaca

SEQ ID NO: 3811665 - DNA, 19 bp, Homo sapiens
ccaacgaaaagcacatcca

SEQ ID NO: 3811666 - DNA, 14 bp, Homo sapiens
ccaactcacctgag

SEQ ID NO: 3811667 - DNA, 12 bp, Homo sapiens
ccaagagagaaa

SEQ ID NO: 3811668 - DNA, 13 bp, Homo sapiens
ccaagagagaaag

SEQ ID NO: 3811669 - DNA, 16 bp, Homo sapiens
ccaagatgagctgcag

SEQ ID NO: 3811670 - DNA, 17 bp, Homo sapiens
ccaagattcaaagagac

SEQ ID NO: 3811671 - DNA, 21 bp, Homo sapiens
ccaaggaccttacaggccctc

SEQ ID NO: 3811672 - DNA, 21 bp, Homo sapiens
ccaaggagaaacagagacagg

SEQ ID NO: 3811673 - DNA, 11 bp, Homo sapiens
ccaaggccacc

SEQ ID NO: 3811674 - DNA, 19 bp, Homo sapiens
ccaagggcctcccaccaga

SEQ ID NO: 3811675 - DNA, 22 bp, Homo sapiens
ccaagggcctcccaccagagac

SEQ ID NO: 3811676 - DNA, 23 bp, Homo sapiens
ccaattcctcatttgttcattaa

SEQ ID NO: 3811677 - DNA, 18 bp, Homo sapiens
ccacaaaggagagctagc

SEQ ID NO: 3811678 - DNA, 22 bp, Homo sapiens
ccacacacagaggaagagcagg

SEQ ID NO: 3811679 - DNA, 13 bp, Homo sapiens
ccacaccccagcc

SEQ ID NO: 3811680 - DNA, 15 bp, Homo sapiens
ccaccagagactggg

SEQ ID NO: 3811681 - DNA, 19 bp, Homo sapiens
ccacccctcaacacctctg

SEQ ID NO: 3811682 - DNA, 19 bp, Homo sapiens
ccaccctcgtggacacctg

SEQ ID NO: 3811683 - DNA, 22 bp, Homo sapiens
ccaccctcgtggacacctgccc

SEQ ID NO: 3811684 - DNA, 13 bp, Homo sapiens
ccaccctgctcct

SEQ ID NO: 3811685 - DNA, 15 bp, Homo sapiens
ccaccctgctcctcc

SEQ ID NO: 3811686 - DNA, 23 bp, Homo sapiens
ccacctctcaatattcaataaag

SEQ ID NO: 3811687 - DNA, 16 bp, Homo sapiens
ccacctctccaagtct

SEQ ID NO: 3811688 - DNA, 21 bp, Homo sapiens
ccacctctccaagtctctctg

SEQ ID NO: 3811689 - DNA, 14 bp, Homo sapiens
ccacctgtctgtct

SEQ ID NO: 3811690 - DNA, 14 bp, Homo sapiens
ccacggcactccag

SEQ ID NO: 3811691 - DNA, 15 bp, Homo sapiens
ccacgtgctcgcctc

SEQ ID NO: 3811692 - DNA, 17 bp, Homo sapiens
ccactaagctttctcct

SEQ ID NO: 3811693 - DNA, 19 bp, Homo sapiens
ccactaagctttctccttt

SEQ ID NO: 3811694 - DNA, 14 bp, Homo sapiens
ccactacctttgtc

SEQ ID NO: 3811695 - DNA, 22 bp, Homo sapiens
ccactagggtcctggccctctt

SEQ ID NO: 3811696 - DNA, 19 bp, Homo sapiens
ccactcatgtgactctttc

SEQ ID NO: 3811697 - DNA, 12 bp, Homo sapiens
ccactctttgct

SEQ ID NO: 3811698 - DNA, 13 bp, Homo sapiens
ccactctttgcta

SEQ ID NO: 3811699 - DNA, 23 bp, Homo sapiens
ccactctttgctacaataaatgc

SEQ ID NO: 3811700 - DNA, 11 bp, Homo sapiens
ccactggccag

SEQ ID NO: 3811701 - DNA, 22 bp, Homo sapiens
ccactggccagtcctagagctc

SEQ ID NO: 3811702 - DNA, 24 bp, Homo sapiens
ccactggccagtcctagagctcct

SEQ ID NO: 3811703 - DNA, 14 bp, Homo sapiens
ccactgtgaagaga

SEQ ID NO: 3811704 - DNA, 14 bp, Homo sapiens
ccacttcagctgac

SEQ ID NO: 3811705 - DNA, 12 bp, Homo sapiens
ccagaaagaaaa

SEQ ID NO: 3811706 - DNA, 12 bp, Homo sapiens
ccagaaggcagg

SEQ ID NO: 3811707 - DNA, 14 bp, Homo sapiens
ccagaccattgtct

SEQ ID NO: 3811708 - DNA, 22 bp, Homo sapiens
ccagacctctgaatgtcccaga

SEQ ID NO: 3811709 - DNA, 13 bp, Homo sapiens
ccagagccactac

SEQ ID NO: 3811710 - DNA, 15 bp, Homo sapiens
ccagagccttaataa

SEQ ID NO: 3811711 - DNA, 18 bp, Homo sapiens
ccagagtccctgcctgga

SEQ ID NO: 3811712 - DNA, 22 bp, Homo sapiens
ccagagtccctgcctggaccag

SEQ ID NO: 3811713 - DNA, 18 bp, Homo sapiens
ccagatgcacatccctgg

SEQ ID NO: 3811714 - DNA, 19 bp, Homo sapiens
ccagattgttctgtccagt

SEQ ID NO: 3811715 - DNA, 12 bp, Homo sapiens
ccagcagcctgg

SEQ ID NO: 3811716 - DNA, 13 bp, Homo sapiens
ccagcagcctgga

SEQ ID NO: 3811717 - DNA, 15 bp, Homo sapiens
ccagcagcctggacc

SEQ ID NO: 3811718 - DNA, 21 bp, Homo sapiens
ccagcatttcccttccttcct

SEQ ID NO: 3811719 - DNA, 17 bp, Homo sapiens
ccagccaggactcctta

SEQ ID NO: 3811720 - DNA, 15 bp, Homo sapiens
ccagcccaccctgct

SEQ ID NO: 3811721 - DNA, 22 bp, Homo sapiens
ccagcccaccctgctcctcctg

SEQ ID NO: 3811722 - DNA, 15 bp, Homo sapiens
ccagccccttctccc

SEQ ID NO: 3811723 - DNA, 16 bp, Homo sapiens
ccagccccttctccca

SEQ ID NO: 3811724 - DNA, 17 bp, Homo sapiens
ccagccccttctcccag

SEQ ID NO: 3811725 - DNA, 20 bp, Homo sapiens
ccagccctctcactgtgtcc

SEQ ID NO: 3811726 - DNA, 14 bp, Homo sapiens
ccagccgccatgct

SEQ ID NO: 3811727 - DNA, 18 bp, Homo sapiens
ccagccgccatgctcctg

SEQ ID NO: 3811728 - DNA, 19 bp, Homo sapiens
ccagccgccatgctcctgg

SEQ ID NO: 3811729 - DNA, 15 bp, Homo sapiens
ccagccgccccagcc

SEQ ID NO: 3811730 - DNA, 16 bp, Homo sapiens
ccagccgccccagccc

SEQ ID NO: 3811731 - DNA, 19 bp, Homo sapiens
ccagcctccaggcccccaa

SEQ ID NO: 3811732 - DNA, 17 bp, Homo sapiens
ccagcctctccccgctc

SEQ ID NO: 3811733 - DNA, 23 bp, Homo sapiens
ccagcctgccccagcctcccagc

SEQ ID NO: 3811734 - DNA, 23 bp, Homo sapiens
ccagctattcaggaggctgaggc

SEQ ID NO: 3811735 - DNA, 16 bp, Homo sapiens
ccagctccccccaaga

SEQ ID NO: 3811736 - DNA, 19 bp, Homo sapiens
ccagctgccgaccagagcc

SEQ ID NO: 3811737 - DNA, 20 bp, Homo sapiens
ccagctgccgaccagagccc

SEQ ID NO: 3811738 - DNA, 13 bp, Homo sapiens
ccagctggcctct

SEQ ID NO: 3811739 - DNA, 12 bp, Homo sapiens
ctacacatatat

SEQ ID NO: 3811740 - DNA, 10 bp, Homo sapiens
ctacatgaaa

SEQ ID NO: 3811741 - DNA, 15 bp, Homo sapiens
ctacatgaaacagaa

SEQ ID NO: 3811742 - DNA, 12 bp, Homo sapiens
ctaccatttcag

SEQ ID NO: 3811743 - DNA, 12 bp, Homo sapiens
ctacccactctt

SEQ ID NO: 3811744 - DNA, 16 bp, Homo sapiens
ctacccactctttgct

SEQ ID NO: 3811745 - DNA, 21 bp, Homo sapiens
ctacccctcgactcagcacca

SEQ ID NO: 3811746 - DNA, 23 bp, Homo sapiens
ctacccctcgactcagcaccaca

SEQ ID NO: 3811747 - DNA, 13 bp, Homo sapiens
ctacctgtgcctg

SEQ ID NO: 3811748 - DNA, 14 bp, Homo sapiens
ctactactctgcca

SEQ ID NO: 3811749 - DNA, 13 bp, Homo sapiens
ctactcaacaaaa

SEQ ID NO: 3811750 - DNA, 13 bp, Homo sapiens
ctactctgccaat

SEQ ID NO: 3811751 - DNA, 22 bp, Homo sapiens
ctactctggaggtttgtttaga

SEQ ID NO: 3811752 - DNA, 22 bp, Homo sapiens
ctacttcttttgctcttagctg

SEQ ID NO: 3811753 - DNA, 17 bp, Homo sapiens
ctacttgagaaaatgca

SEQ ID NO: 3811754 - DNA, 19 bp, Homo sapiens
ctagaacacccactggcca

SEQ ID NO: 3811755 - DNA, 20 bp, Homo sapiens
ctagaacacccactggccag

SEQ ID NO: 3811756 - DNA, 21 bp, Homo sapiens
ctagaacacccactggccagt

SEQ ID NO: 3811757 - DNA, 13 bp, Homo sapiens
ctagacactgcca

SEQ ID NO: 3811758 - DNA, 19 bp, Homo sapiens
ctagagagggaattctctt

SEQ ID NO: 3811759 - DNA, 13 bp, Homo sapiens
ctagagctcctgt

SEQ ID NO: 3811760 - DNA, 17 bp, Homo sapiens
ctagagctcctgtccct

SEQ ID NO: 3811761 - DNA, 19 bp, Homo sapiens
ctagagctcctgtccctac

SEQ ID NO: 3811762 - DNA, 15 bp, Homo sapiens
ctagagtgacaggca

SEQ ID NO: 3811763 - DNA, 14 bp, Homo sapiens
ctagagtgcagtgg

SEQ ID NO: 3811764 - DNA, 17 bp, Homo sapiens
ctagatccacacacaga

SEQ ID NO: 3811765 - DNA, 17 bp, Homo sapiens
ctagcactttgggaggc

SEQ ID NO: 3811766 - DNA, 22 bp, Homo sapiens
ctagcagcagggagggcttctg

SEQ ID NO: 3811767 - DNA, 23 bp, Homo sapiens
ctagcagcagggagggcttctgc

SEQ ID NO: 3811768 - DNA, 18 bp, Homo sapiens
ctagcatggcccgggcct

SEQ ID NO: 3811769 - DNA, 21 bp, Homo sapiens
ctagccatctcaagcaagttt

SEQ ID NO: 3811770 - DNA, 22 bp, Homo sapiens
ctaggattacaggcatgagcca

SEQ ID NO: 3811771 - DNA, 14 bp, Homo sapiens
ctaggattcctccc

SEQ ID NO: 3811772 - DNA, 15 bp, Homo sapiens
ctaggattcctcccc

SEQ ID NO: 3811773 - DNA, 22 bp, Homo sapiens
ctaggattcctcccccagagcc

SEQ ID NO: 3811774 - DNA, 23 bp, Homo sapiens
ctaggattcctcccccagagcca

SEQ ID NO: 3811775 - DNA, 19 bp, Homo sapiens
ctagggaaaaaccagcgtg

SEQ ID NO: 3811776 - DNA, 14 bp, Homo sapiens
ctagggaagataat

SEQ ID NO: 3811777 - DNA, 17 bp, Homo sapiens
ctagggtcctggccctc

SEQ ID NO: 3811778 - DNA, 15 bp, Homo sapiens
ctagggtggggagag

SEQ ID NO: 3811779 - DNA, 19 bp, Homo sapiens
ctagggttttggcctgcct

SEQ ID NO: 3811780 - DNA, 15 bp, Homo sapiens
ctaggtaaaatttgt

SEQ ID NO: 3811781 - DNA, 11 bp, Homo sapiens
ctagtatatta

SEQ ID NO: 3811782 - DNA, 19 bp, Homo sapiens
ctagtgaatttctgaaaga

SEQ ID NO: 3811783 - DNA, 19 bp, Homo sapiens
ctagttttctcctcccagg

SEQ ID NO: 3811784 - DNA, 21 bp, Homo sapiens
ctataaagaaaagagggagag

SEQ ID NO: 3811785 - DNA, 20 bp, Homo sapiens
ctatacctgggcatactaat

SEQ ID NO: 3811786 - DNA, 14 bp, Homo sapiens
ctatatctctaaac

SEQ ID NO: 3811787 - DNA, 13 bp, Homo sapiens
ctatatttattta

SEQ ID NO: 3811788 - DNA, 17 bp, Homo sapiens
ctatctctgtgtgcaca

SEQ ID NO: 3811789 - DNA, 15 bp, Homo sapiens
ctatgaagagaagga

SEQ ID NO: 3811790 - DNA, 20 bp, Homo sapiens
ctatggggatagatgtgtgg

SEQ ID NO: 3811791 - DNA, 21 bp, Homo sapiens
ctatggggatagatgtgtgga

SEQ ID NO: 3811792 - DNA, 12 bp, Homo sapiens
ctattccttggt

SEQ ID NO: 3811793 - DNA, 18 bp, Homo sapiens
ctcaaacctccaaaagcc

SEQ ID NO: 3811794 - DNA, 13 bp, Homo sapiens
ctcaaggaaaaga

SEQ ID NO: 3811795 - DNA, 16 bp, Homo sapiens
ctcaagtcttccctga

SEQ ID NO: 3811796 - DNA, 17 bp, Homo sapiens
ctcaagtcttccctgat

SEQ ID NO: 3811797 - DNA, 16 bp, Homo sapiens
ctcaatattcaataaa

SEQ ID NO: 3811798 - DNA, 23 bp, Homo sapiens
ctcacacggacactcaaaagctg

SEQ ID NO: 3811799 - DNA, 17 bp, Homo sapiens
ctcacactacttgagaa

SEQ ID NO: 3811800 - DNA, 15 bp, Homo sapiens
ctcacagcctctccc

SEQ ID NO: 3811801 - DNA, 12 bp, Homo sapiens
ctcacagggagc

SEQ ID NO: 3811802 - DNA, 14 bp, Homo sapiens
ctcacccccagctt

SEQ ID NO: 3811803 - DNA, 18 bp, Homo sapiens
ctcacccccagctttgct

SEQ ID NO: 3811804 - DNA, 19 bp, Homo sapiens
ctcacgctgatcattggat

SEQ ID NO: 3811805 - DNA, 19 bp, Homo sapiens
ctcactgccatgccagctt

SEQ ID NO: 3811806 - DNA, 22 bp, Homo sapiens
ctcactgccatgccagcttatc

SEQ ID NO: 3811807 - DNA, 16 bp, Homo sapiens
ctcagagcagcactgg

SEQ ID NO: 3811808 - DNA, 17 bp, Homo sapiens
ctcagagcagcactggg

SEQ ID NO: 3811809 - DNA, 19 bp, Homo sapiens
ctcagcaaaagatgcttct

SEQ ID NO: 3811810 - DNA, 20 bp, Homo sapiens
ctcagcaaaagatgcttctc

SEQ ID NO: 3811811 - DNA, 22 bp, Homo sapiens
ctcagcaccacattgcctcatt

SEQ ID NO: 3811812 - DNA, 17 bp, Homo sapiens
ctcagccccgcgtggaa

SEQ ID NO: 3811813 - DNA, 12 bp, Homo sapiens
ctcagcctccag

SEQ ID NO: 3811814 - DNA, 12 bp, Homo sapiens
ctcagcctcctg

SEQ ID NO: 3811815 - DNA, 12 bp, Homo sapiens
ctcagctgcctc

SEQ ID NO: 3811816 - DNA, 20 bp, Homo sapiens
ctcagcttcccaagtagctg

SEQ ID NO: 3811817 - DNA, 17 bp, Homo sapiens
ctcaggaaccgaggcag

SEQ ID NO: 3811818 - DNA, 22 bp, Homo sapiens
ctcaggatgtcctttgtgtcca

SEQ ID NO: 3811819 - DNA, 23 bp, Homo sapiens
ctcaggccgaaggaggagtcagg

SEQ ID NO: 3811820 - DNA, 14 bp, Homo sapiens
ctcagggcctggtc

SEQ ID NO: 3811821 - DNA, 19 bp, Homo sapiens
ctcaggtagggagctaagg

SEQ ID NO: 3811822 - DNA, 16 bp, Homo sapiens
ctcaggtgagaagcag

SEQ ID NO: 3811823 - DNA, 20 bp, Homo sapiens
ctcaggtgagaagcagagga

SEQ ID NO: 3811824 - DNA, 17 bp, Homo sapiens
ctcagtggcaagaatga

SEQ ID NO: 3811825 - DNA, 18 bp, Homo sapiens
ctcagtgtcagcactcag

SEQ ID NO: 3811826 - DNA, 20 bp, Homo sapiens
ctcagtgtcagcactcaggt

SEQ ID NO: 3811827 - DNA, 14 bp, Homo sapiens
ctcatagggtgctc

SEQ ID NO: 3811828 - DNA, 16 bp, Homo sapiens
ctcatctttcttccaa

SEQ ID NO: 3811829 - DNA, 21 bp, Homo sapiens
ctcattagcattttgctaaat

SEQ ID NO: 3811830 - DNA, 15 bp, Homo sapiens
ctcattccagaggaa

SEQ ID NO: 3811831 - DNA, 17 bp, Homo sapiens
ctcattccagaggaagg

SEQ ID NO: 3811832 - DNA, 18 bp, Homo sapiens
ctcatttcttcctctgca

SEQ ID NO: 3811833 - DNA, 17 bp, Homo sapiens
ctcatttgttcattaaa

SEQ ID NO: 3811834 - DNA, 16 bp, Homo sapiens
ctccaaacactgggct

SEQ ID NO: 3811835 - DNA, 19 bp, Homo sapiens
ctccaagtctctctgtgaa

SEQ ID NO: 3811836 - DNA, 13 bp, Homo sapiens
ctccacctcctgg

SEQ ID NO: 3811837 - DNA, 22 bp, Homo sapiens
ctccactcatgtgactctttcc

SEQ ID NO: 3811838 - DNA, 21 bp, Homo sapiens
ctccagcctgggcgacagagc

SEQ ID NO: 3811839 - DNA, 14 bp, Homo sapiens
ctccagctgttacc

SEQ ID NO: 3811840 - DNA, 18 bp, Homo sapiens
ctccagctgttcagctgg

SEQ ID NO: 3811841 - DNA, 17 bp, Homo sapiens
ctccagtgggaggacag

SEQ ID NO: 3811842 - DNA, 18 bp, Homo sapiens
ctccagtgggaggacaga

SEQ ID NO: 3811843 - DNA, 20 bp, Homo sapiens
ctccagtgggaggacagagc

SEQ ID NO: 3811844 - DNA, 20 bp, Homo sapiens
ctccatcctaccccctgtgc

SEQ ID NO: 3811845 - DNA, 19 bp, Homo sapiens
ctccatgctggtgtggcca

SEQ ID NO: 3811846 - DNA, 14 bp, Homo sapiens
ctccattctgacca

SEQ ID NO: 3811847 - DNA, 16 bp, Homo sapiens
cttgtcacgccagact

SEQ ID NO: 3811848 - DNA, 18 bp, Homo sapiens
cttgtcacgccagacttc

SEQ ID NO: 3811849 - DNA, 22 bp, Homo sapiens
cttgtcactggtagaccaaaat

SEQ ID NO: 3811850 - DNA, 15 bp, Homo sapiens
cttgtgtctctgtgc

SEQ ID NO: 3811851 - DNA, 18 bp, Homo sapiens
cttgtgtctctgtgcttt

SEQ ID NO: 3811852 - DNA, 21 bp, Homo sapiens
cttgtgtctctgtgcttttaa

SEQ ID NO: 3811853 - DNA, 15 bp, Homo sapiens
cttgtgtttttgtct

SEQ ID NO: 3811854 - DNA, 21 bp, Homo sapiens
ctttaaaaaaaatagaagcta

SEQ ID NO: 3811855 - DNA, 23 bp, Homo sapiens
ctttaaaggtcgcacctccttgg

SEQ ID NO: 3811856 - DNA, 14 bp, Homo sapiens
ctttacttttaaac

SEQ ID NO: 3811857 - DNA, 15 bp, Homo sapiens
ctttcaaagaaggaa

SEQ ID NO: 3811858 - DNA, 18 bp, Homo sapiens
ctttcaaagaaggaattc

SEQ ID NO: 3811859 - DNA, 13 bp, Homo sapiens
ctttcatacatta

SEQ ID NO: 3811860 - DNA, 14 bp, Homo sapiens
ctttcatacattat

SEQ ID NO: 3811861 - DNA, 22 bp, Homo sapiens
ctttcatacattatattcctct

SEQ ID NO: 3811862 - DNA, 19 bp, Homo sapiens
ctttccaaatgcccagctt

SEQ ID NO: 3811863 - DNA, 22 bp, Homo sapiens
ctttccaaatgcccagcttaaa

SEQ ID NO: 3811864 - DNA, 12 bp, Homo sapiens
ctttctcctttg

SEQ ID NO: 3811865 - DNA, 20 bp, Homo sapiens
ctttgaagaggaaaatgaat

SEQ ID NO: 3811866 - DNA, 15 bp, Homo sapiens
ctttgctacaataaa

SEQ ID NO: 3811867 - DNA, 14 bp, Homo sapiens
ctttgcttgaaaga

SEQ ID NO: 3811868 - DNA, 12 bp, Homo sapiens
ctttggacttgt

SEQ ID NO: 3811869 - DNA, 20 bp, Homo sapiens
ctttgggttggagctgttcc

SEQ ID NO: 3811870 - DNA, 14 bp, Homo sapiens
ctttggtccttcaa

SEQ ID NO: 3811871 - DNA, 16 bp, Homo sapiens
ctttgtctgctcccaa

SEQ ID NO: 3811872 - DNA, 14 bp, Homo sapiens
ctttgtggcactgg

SEQ ID NO: 3811873 - DNA, 18 bp, Homo sapiens
ctttgtttgttgtcagct

SEQ ID NO: 3811874 - DNA, 16 bp, Homo sapiens
cttttctcccagaagg

SEQ ID NO: 3811875 - DNA, 18 bp, Homo sapiens
cttttctgtccgagcttt

SEQ ID NO: 3811876 - DNA, 18 bp, Homo sapiens
cttttgcaacaagacaaa

SEQ ID NO: 3811877 - DNA, 13 bp, Homo sapiens
cttttgtaagaca

SEQ ID NO: 3811878 - DNA, 16 bp, Homo sapiens
cttttgtcctgttatt

SEQ ID NO: 3811879 - DNA, 19 bp, Homo sapiens
ctttttaccctttaaaaaa

SEQ ID NO: 3811880 - DNA, 13 bp, Homo sapiens
ctttttccagagg

SEQ ID NO: 3811881 - DNA, 18 bp, Homo sapiens
ctttttgaaaaaagtata

SEQ ID NO: 3811882 - DNA, 19 bp, Homo sapiens
gaaaagacattgaaagctc

SEQ ID NO: 3811883 - DNA, 22 bp, Homo sapiens
gaaaagacattgaaagctctat

SEQ ID NO: 3811884 - DNA, 16 bp, Homo sapiens
gaaaagatgagaggca

SEQ ID NO: 3811885 - DNA, 18 bp, Homo sapiens
gaaaagatgttgtgtctt

SEQ ID NO: 3811886 - DNA, 19 bp, Homo sapiens
gaaaatacctattttatat

SEQ ID NO: 3811887 - DNA, 12 bp, Homo sapiens
gaaaatgaataa

SEQ ID NO: 3811888 - DNA, 17 bp, Homo sapiens
gaaacaaatttttttct

SEQ ID NO: 3811889 - DNA, 14 bp, Homo sapiens
gaaacagagacagg

SEQ ID NO: 3811890 - DNA, 14 bp, Homo sapiens
gaaacagagagaga

SEQ ID NO: 3811891 - DNA, 16 bp, Homo sapiens
gaaacagagagagaca

SEQ ID NO: 3811892 - DNA, 16 bp, Homo sapiens
gaaacaggctctgaga

SEQ ID NO: 3811893 - DNA, 18 bp, Homo sapiens
gaaacctgtccataaagt

SEQ ID NO: 3811894 - DNA, 20 bp, Homo sapiens
gaaacctgtccataaagtaa

SEQ ID NO: 3811895 - DNA, 17 bp, Homo sapiens
gaaagcttcaaactgca

SEQ ID NO: 3811896 - DNA, 17 bp, Homo sapiens
gaaaggagaggaaagaa

SEQ ID NO: 3811897 - DNA, 15 bp, Homo sapiens
gaaaggctctgaaag

SEQ ID NO: 3811898 - DNA, 13 bp, Homo sapiens
gaaataaactagg

SEQ ID NO: 3811899 - DNA, 18 bp, Homo sapiens
gaaataaactagggtttt

SEQ ID NO: 3811900 - DNA, 23 bp, Homo sapiens
gaaataaactagggttttggcct

SEQ ID NO: 3811901 - DNA, 20 bp, Homo sapiens
gaaatacgccagaactgctt

SEQ ID NO: 3811902 - DNA, 14 bp, Homo sapiens
gaaatcagagctgg

SEQ ID NO: 3811903 - DNA, 20 bp, Homo sapiens
gaaattcaacctgtgtctta

SEQ ID NO: 3811904 - DNA, 21 bp, Homo sapiens
gaaattcaacctgtgtcttat

SEQ ID NO: 3811905 - DNA, 11 bp, Homo sapiens
gaaatttcaga

SEQ ID NO: 3811906 - DNA, 13 bp, Homo sapiens
gaacaaagaaaag

SEQ ID NO: 3811907 - DNA, 14 bp, Homo sapiens
gaacaaagaaaaga

SEQ ID NO: 3811908 - DNA, 14 bp, Homo sapiens
gaacacactcagca

SEQ ID NO: 3811909 - DNA, 15 bp, Homo sapiens
gaacacactcagcag

SEQ ID NO: 3811910 - DNA, 20 bp, Homo sapiens
gaacacactcagcagccccc

SEQ ID NO: 3811911 - DNA, 17 bp, Homo sapiens
gaacacaggcaaaatcc

SEQ ID NO: 3811912 - DNA, 12 bp, Homo sapiens
gaacacccactg

SEQ ID NO: 3811913 - DNA, 14 bp, Homo sapiens
gaacacccactggc

SEQ ID NO: 3811914 - DNA, 15 bp, Homo sapiens
gaacacccactggcc

SEQ ID NO: 3811915 - DNA, 18 bp, Homo sapiens
gaacagataatccctgta

SEQ ID NO: 3811916 - DNA, 21 bp, Homo sapiens
gaactaggagtcttcactgct

SEQ ID NO: 3811917 - DNA, 13 bp, Homo sapiens
gaactattagagc

SEQ ID NO: 3811918 - DNA, 13 bp, Homo sapiens
gaactcctgacct

SEQ ID NO: 3811919 - DNA, 19 bp, Homo sapiens
gaacttgaggacacatgtc

SEQ ID NO: 3811920 - DNA, 16 bp, Homo sapiens
gaagaacatccaagga

SEQ ID NO: 3811921 - DNA, 18 bp, Homo sapiens
gaagagcaggcacatgga

SEQ ID NO: 3811922 - DNA, 23 bp, Homo sapiens
gaagagcaggcacatggaggagc

SEQ ID NO: 3811923 - DNA, 14 bp, Homo sapiens
gaagaggaaaatga

SEQ ID NO: 3811924 - DNA, 14 bp, Homo sapiens
gaagcaagccggca

SEQ ID NO: 3811925 - DNA, 16 bp, Homo sapiens
gaagcaccataacttt

SEQ ID NO: 3811926 - DNA, 11 bp, Homo sapiens
gaagcaggagt

SEQ ID NO: 3811927 - DNA, 18 bp, Homo sapiens
gaagcccaataaacctct

SEQ ID NO: 3811928 - DNA, 18 bp, Homo sapiens
gaaggaagcaagccggca

SEQ ID NO: 3811929 - DNA, 23 bp, Homo sapiens
gaaggagccagccaggactcctt

SEQ ID NO: 3811930 - DNA, 21 bp, Homo sapiens
gaaggatcccatgagctcctt

SEQ ID NO: 3811931 - DNA, 13 bp, Homo sapiens
gaaggcagggaaa

SEQ ID NO: 3811932 - DNA, 23 bp, Homo sapiens
gaaggctttcagggcctccagcc

SEQ ID NO: 3811933 - DNA, 13 bp, Homo sapiens
gaagggaaggaag

SEQ ID NO: 3811934 - DNA, 14 bp, Homo sapiens
gaagtgcagctcag

SEQ ID NO: 3811935 - DNA, 16 bp, Homo sapiens
gaagtgcagctcagga

SEQ ID NO: 3811936 - DNA, 18 bp, Homo sapiens
gaagtgcttgatatgtaa

SEQ ID NO: 3811937 - DNA, 19 bp, Homo sapiens
gaagtgtgggtctgtgtgt

SEQ ID NO: 3811938 - DNA, 14 bp, Homo sapiens
gaataaaatactct

SEQ ID NO: 3811939 - DNA, 17 bp, Homo sapiens
gaataatacagtatctc

SEQ ID NO: 3811940 - DNA, 12 bp, Homo sapiens
gaataatagaag

SEQ ID NO: 3811941 - DNA, 21 bp, Homo sapiens
gaatacagaggcaactgcatt

SEQ ID NO: 3811942 - DNA, 11 bp, Homo sapiens
gaatgagcctc

SEQ ID NO: 3811943 - DNA, 13 bp, Homo sapiens
gaatgtcagtatg

SEQ ID NO: 3811944 - DNA, 22 bp, Homo sapiens
gaatgtggcccctgaacaagaa

SEQ ID NO: 3811945 - DNA, 12 bp, Homo sapiens
gaattaaataaa

SEQ ID NO: 3811946 - DNA, 20 bp, Homo sapiens
gaattaaataaacccttcct

SEQ ID NO: 3811947 - DNA, 20 bp, Homo sapiens
gaattgaaggagaaaatgca

SEQ ID NO: 3811948 - DNA, 23 bp, Homo sapiens
gaattgccttaaggccacactgg

SEQ ID NO: 3811949 - DNA, 20 bp, Homo sapiens
gaattgcttgaacccaggag

SEQ ID NO: 3811950 - DNA, 17 bp, Homo sapiens
gaattgggagcttggga

SEQ ID NO: 3811951 - DNA, 13 bp, Homo sapiens
gaattttctttca

SEQ ID NO: 3811952 - DNA, 21 bp, Homo sapiens
gaattttctttcatacattat

SEQ ID NO: 3811953 - DNA, 22 bp, Homo sapiens
gaattttctttcatacattata

SEQ ID NO: 3811954 - DNA, 21 bp, Homo sapiens
gaattttctttgtgtagcttt

SEQ ID NO: 3811955 - DNA, 15 bp, Homo sapiens
gaattttgttgctgt

SEQ ID NO: 3811956 - DNA, 15 bp, Homo sapiens
gcctgttctccagat

SEQ ID NO: 3811957 - DNA, 18 bp, Homo sapiens
gccttaaggccacactgg

SEQ ID NO: 3811958 - DNA, 13 bp, Homo sapiens
gcctttggcttca

SEQ ID NO: 3811959 - DNA, 13 bp, Homo sapiens
gcgagaattttca

SEQ ID NO: 3811960 - DNA, 14 bp, Homo sapiens
gcgagcccttagcc

SEQ ID NO: 3811961 - DNA, 12 bp, Homo sapiens
gcgcggctggga

SEQ ID NO: 3811962 - DNA, 16 bp, Homo sapiens
gcggcctttggcttca

SEQ ID NO: 3811963 - DNA, 19 bp, Homo sapiens
gcggctgggaggagggcag

SEQ ID NO: 3811964 - DNA, 21 bp, Homo sapiens
gcgtggaactcgtgtctggca

SEQ ID NO: 3811965 - DNA, 13 bp, Homo sapiens
gctaaatgtgaat

SEQ ID NO: 3811966 - DNA, 16 bp, Homo sapiens
gctaaatgtgaatgat

SEQ ID NO: 3811967 - DNA, 20 bp, Homo sapiens
gctaagagggtgaacaaaga

SEQ ID NO: 3811968 - DNA, 16 bp, Homo sapiens
gctaaggaagacacag

SEQ ID NO: 3811969 - DNA, 22 bp, Homo sapiens
gctaaggaagacacagcccaga

SEQ ID NO: 3811970 - DNA, 23 bp, Homo sapiens
gctaaggaagacacagcccagac

SEQ ID NO: 3811971 - DNA, 23 bp, Homo sapiens
gctagaagaaaacaaactgtcac

SEQ ID NO: 3811972 - DNA, 18 bp, Homo sapiens
gctagtctcttctcagag

SEQ ID NO: 3811973 - DNA, 23 bp, Homo sapiens
gctatacctgggcatactaataa

SEQ ID NO: 3811974 - DNA, 13 bp, Homo sapiens
gctatctctgtgt

SEQ ID NO: 3811975 - DNA, 21 bp, Homo sapiens
gctattattttcactgtagaa

SEQ ID NO: 3811976 - DNA, 17 bp, Homo sapiens
gctattcagataaggca

SEQ ID NO: 3811977 - DNA, 20 bp, Homo sapiens
gctattcaggaggctgaggc

SEQ ID NO: 3811978 - DNA, 17 bp, Homo sapiens
gctcaagtcttccctga

SEQ ID NO: 3811979 - DNA, 20 bp, Homo sapiens
gctcaagtcttccctgatca

SEQ ID NO: 3811980 - DNA, 19 bp, Homo sapiens
gctcactgcaagctctgcc

SEQ ID NO: 3811981 - DNA, 20 bp, Homo sapiens
gctcagcaaaagatgcttct

SEQ ID NO: 3811982 - DNA, 22 bp, Homo sapiens
gctcagcaaaagatgcttctca

SEQ ID NO: 3811983 - DNA, 16 bp, Homo sapiens
gctcagtaatttgagg

SEQ ID NO: 3811984 - DNA, 21 bp, Homo sapiens
gctcagtaatttgaggacaac

SEQ ID NO: 3811985 - DNA, 19 bp, Homo sapiens
gctcataagctgtagaact

SEQ ID NO: 3811986 - DNA, 21 bp, Homo sapiens
gctccagctgttcagctggtt

SEQ ID NO: 3811987 - DNA, 23 bp, Homo sapiens
gctccgtccaggagcctgtgcct

SEQ ID NO: 3811988 - DNA, 16 bp, Homo sapiens
gctcctcctgccctgt

SEQ ID NO: 3811989 - DNA, 19 bp, Homo sapiens
gctcctggcccactgcatc

SEQ ID NO: 3811990 - DNA, 12 bp, Homo sapiens
gctcctgtccct

SEQ ID NO: 3811991 - DNA, 17 bp, Homo sapiens
gctcctgtccctaccca

SEQ ID NO: 3811992 - DNA, 17 bp, Homo sapiens
gctccttaaggctcttt

SEQ ID NO: 3811993 - DNA, 21 bp, Homo sapiens
gctccttaaggctcttttgta

SEQ ID NO: 3811994 - DNA, 18 bp, Homo sapiens
gctcgcctctgcccagcc

SEQ ID NO: 3811995 - DNA, 21 bp, Homo sapiens
gctctactggtcttgtggaat

SEQ ID NO: 3811996 - DNA, 18 bp, Homo sapiens
gctctcaagttatcaggg

SEQ ID NO: 3811997 - DNA, 19 bp, Homo sapiens
gctctcggcttcaccaggg

SEQ ID NO: 3811998 - DNA, 17 bp, Homo sapiens
gctctgaggtcaataaa

SEQ ID NO: 3811999 - DNA, 20 bp, Homo sapiens
gctctgaggtcaataaagca

SEQ ID NO: 3812000 - DNA, 23 bp, Homo sapiens
gctctgaggtcaataaagcagag

SEQ ID NO: 3812001 - DNA, 20 bp, Homo sapiens
gctgaaataaactagggttt

SEQ ID NO: 3812002 - DNA, 17 bp, Homo sapiens
gctgaaatctattaaac

SEQ ID NO: 3812003 - DNA, 16 bp, Homo sapiens
gctgaacaatgaatgc

SEQ ID NO: 3812004 - DNA, 18 bp, Homo sapiens
gctgacagagccagaggc

SEQ ID NO: 3812005 - DNA, 12 bp, Homo sapiens
gctgaccagaca

SEQ ID NO: 3812006 - DNA, 19 bp, Homo sapiens
gctgactactactctgcca

SEQ ID NO: 3812007 - DNA, 22 bp, Homo sapiens
gctgactgttttctcttgagag

SEQ ID NO: 3812008 - DNA, 23 bp, Homo sapiens
gctgagtgggggatcacagcctc

SEQ ID NO: 3812009 - DNA, 13 bp, Homo sapiens
gctgatcattgga

SEQ ID NO: 3812010 - DNA, 22 bp, Homo sapiens
gctgatgcattcccggtgcaga

SEQ ID NO: 3812011 - DNA, 16 bp, Homo sapiens
gctgatgctgaaataa

SEQ ID NO: 3812012 - DNA, 20 bp, Homo sapiens
gctgcccctggtgcactggc

SEQ ID NO: 3812013 - DNA, 19 bp, Homo sapiens
gctgcctaataaagagact

SEQ ID NO: 3812014 - DNA, 22 bp, Homo sapiens
gctgcctgacactgagccccac

SEQ ID NO: 3812015 - DNA, 22 bp, Homo sapiens
gctgctccccacgtcagctggg

SEQ ID NO: 3812016 - DNA, 12 bp, Homo sapiens
gctgcttcctaa

SEQ ID NO: 3812017 - DNA, 16 bp, Homo sapiens
gctgcttcctaactta

SEQ ID NO: 3812018 - DNA, 17 bp, Homo sapiens
gctggacagaggggcag

SEQ ID NO: 3812019 - DNA, 18 bp, Homo sapiens
gctggagttcagcagtga

SEQ ID NO: 3812020 - DNA, 21 bp, Homo sapiens
gctggatgagcaactcctgtt

SEQ ID NO: 3812021 - DNA, 14 bp, Homo sapiens
gctggcagcctcca

SEQ ID NO: 3812022 - DNA, 15 bp, Homo sapiens
gctggcagcctccag

SEQ ID NO: 3812023 - DNA, 17 bp, Homo sapiens
gctggcagcctccagtg

SEQ ID NO: 3812024 - DNA, 13 bp, Homo sapiens
gctggcctctaga

SEQ ID NO: 3812025 - DNA, 23 bp, Homo sapiens
gctggcctctagaacacccactg

SEQ ID NO: 3812026 - DNA, 17 bp, Homo sapiens
gctggctcccagggcca

SEQ ID NO: 3812027 - DNA, 23 bp, Homo sapiens
gctgggacaccccgacttttgtt

SEQ ID NO: 3812028 - DNA, 14 bp, Homo sapiens
gctgggcaggttgg

SEQ ID NO: 3812029 - DNA, 22 bp, Homo sapiens
gctgggctaccccccctcctgc

SEQ ID NO: 3812030 - DNA, 24 bp, Homo sapiens
gctggggaagggggctccatgctg

SEQ ID NO: 3812031 - DNA, 23 bp, Homo sapiens
gctgggggaagaagctctctcct

SEQ ID NO: 3812032 - DNA, 17 bp, Homo sapiens
gctgggtccaggggagg

SEQ ID NO: 3812033 - DNA, 22 bp, Homo sapiens
gctgggtggcaccagcagcctg

SEQ ID NO: 3812034 - DNA, 17 bp, Homo sapiens
gctgggttgtcactgag

SEQ ID NO: 3812035 - DNA, 13 bp, Homo sapiens
gctggtgtggcca

SEQ ID NO: 3812036 - DNA, 15 bp, Homo sapiens
gctgtagaactctgc

SEQ ID NO: 3812037 - DNA, 22 bp, Homo sapiens
gctgtagaactctgcaggcaga

SEQ ID NO: 3812038 - DNA, 20 bp, Homo sapiens
gctgtagacatttgctatga

SEQ ID NO: 3812039 - DNA, 18 bp, Homo sapiens
gctgtgattggcaggagg

SEQ ID NO: 3812040 - DNA, 19 bp, Homo sapiens
gctgtggcctaacctgccg

SEQ ID NO: 3812041 - DNA, 14 bp, Homo sapiens
gctgttacctgaga

SEQ ID NO: 3812042 - DNA, 13 bp, Homo sapiens
gctgtttgcgtga

SEQ ID NO: 3812043 - DNA, 14 bp, Homo sapiens
gcttaaaaatcatt

SEQ ID NO: 3812044 - DNA, 16 bp, Homo sapiens
gcttccctgggcctca

SEQ ID NO: 3812045 - DNA, 13 bp, Homo sapiens
gcttccctggggc

SEQ ID NO: 3812046 - DNA, 16 bp, Homo sapiens
gcttccgtattttaat

SEQ ID NO: 3812047 - DNA, 13 bp, Homo sapiens
gcttcctaactta

SEQ ID NO: 3812048 - DNA, 16 bp, Homo sapiens
gcttctagttctgcca

SEQ ID NO: 3812049 - DNA, 21 bp, Homo sapiens
gcttctagttctgccaggaga

SEQ ID NO: 3812050 - DNA, 22 bp, Homo sapiens
gcttctcactgccatgccagct

SEQ ID NO: 3812051 - DNA, 20 bp, Homo sapiens
gcttgaacccaggaggtgga

SEQ ID NO: 3812052 - DNA, 22 bp, Homo sapiens
gcttggtgtttgtaagaaaatg

SEQ ID NO: 3812053 - DNA, 14 bp, Homo sapiens
gctttcagggcctc

SEQ ID NO: 3812054 - DNA, 21 bp, Homo sapiens
gctttgtttgttgtcagctga

SEQ ID NO: 3812055 - DNA, 14 bp, Homo sapiens
gcttttacttaaac

SEQ ID NO: 3812056 - DNA, 22 bp, Homo sapiens
gcttttcctcaaagggagagag

SEQ ID NO: 3812057 - DNA, 17 bp, Homo sapiens
gcttttctcccagaagg

SEQ ID NO: 3812058 - DNA, 15 bp, Homo sapiens
ggaaaatgccaatct

SEQ ID NO: 3812059 - DNA, 14 bp, Homo sapiens
ggaaatcagagctg

SEQ ID NO: 3812060 - DNA, 17 bp, Homo sapiens
ggaaattggaagagcac

SEQ ID NO: 3812061 - DNA, 13 bp, Homo sapiens
ggaacacctcctc

SEQ ID NO: 3812062 - DNA, 23 bp, Homo sapiens
ggaacactggtgggcagctgagg

SEQ ID NO: 3812063 - DNA, 21 bp, Homo sapiens
gtcaacatatgtgattgttcc

SEQ ID NO: 3812064 - DNA, 18 bp, Homo sapiens
gtcaagtgaaaaaggagg

SEQ ID NO: 3812065 - DNA, 18 bp, Homo sapiens
gtcaataaagcagagcca

SEQ ID NO: 3812066 - DNA, 21 bp, Homo sapiens
gtcaataaagcagagccaagg

SEQ ID NO: 3812067 - DNA, 22 bp, Homo sapiens
gtcaataaagcagagccaaggc

SEQ ID NO: 3812068 - DNA, 15 bp, Homo sapiens
gtcatgtgacaggta

SEQ ID NO: 3812069 - DNA, 18 bp, Homo sapiens
gtccagaccattgtcttc

SEQ ID NO: 3812070 - DNA, 20 bp, Homo sapiens
gtccagaccattgtcttcca

SEQ ID NO: 3812071 - DNA, 21 bp, Homo sapiens
gtccagaccattgtcttccaa

SEQ ID NO: 3812072 - DNA, 20 bp, Homo sapiens
gtccaggggagggaaaagct

SEQ ID NO: 3812073 - DNA, 11 bp, Homo sapiens
gtccataaagt

SEQ ID NO: 3812074 - DNA, 17 bp, Homo sapiens
gtcccagatacttgggg

SEQ ID NO: 3812075 - DNA, 21 bp, Homo sapiens
gtcccaggagcaaatgctgga

SEQ ID NO: 3812076 - DNA, 14 bp, Homo sapiens
gtccctctctctgg

SEQ ID NO: 3812077 - DNA, 20 bp, Homo sapiens
gtccctgcctggaccagcct

SEQ ID NO: 3812078 - DNA, 21 bp, Homo sapiens
gtcccttagaagatctgcttc

SEQ ID NO: 3812079 - DNA, 13 bp, Homo sapiens
gtccgagctttga

SEQ ID NO: 3812080 - DNA, 15 bp, Homo sapiens
gtcctcacagcctct

SEQ ID NO: 3812081 - DNA, 20 bp, Homo sapiens
gtcctcagagaatttctacc

SEQ ID NO: 3812082 - DNA, 17 bp, Homo sapiens
gtcctccagaccaccag

SEQ ID NO: 3812083 - DNA, 15 bp, Homo sapiens
gtcctgcaccggggc

SEQ ID NO: 3812084 - DNA, 19 bp, Homo sapiens
gtcctgcaccggggcctgg

SEQ ID NO: 3812085 - DNA, 14 bp, Homo sapiens
gtcggccctgccca

SEQ ID NO: 3812086 - DNA, 19 bp, Homo sapiens
gtctcaaaaaaagaaaaag

SEQ ID NO: 3812087 - DNA, 20 bp, Homo sapiens
gtctcaaacctccaaaagcc

SEQ ID NO: 3812088 - DNA, 16 bp, Homo sapiens
gtctccctcctctgcc

SEQ ID NO: 3812089 - DNA, 15 bp, Homo sapiens
gtctcgaactcctga

SEQ ID NO: 3812090 - DNA, 19 bp, Homo sapiens
gtctcgaactcctgacctc

SEQ ID NO: 3812091 - DNA, 15 bp, Homo sapiens
gtctctctctctcta

SEQ ID NO: 3812092 - DNA, 19 bp, Homo sapiens
gtctctctctctctacaaa

SEQ ID NO: 3812093 - DNA, 11 bp, Homo sapiens
gtctctctgtg

SEQ ID NO: 3812094 - DNA, 21 bp, Homo sapiens
gtctctctgtgaatacaatta

SEQ ID NO: 3812095 - DNA, 22 bp, Homo sapiens
gtctctctgtgaatacaattaa

SEQ ID NO: 3812096 - DNA, 15 bp, Homo sapiens
gtctcttctcagagc

SEQ ID NO: 3812097 - DNA, 14 bp, Homo sapiens
gtctgagagaggcc

SEQ ID NO: 3812098 - DNA, 18 bp, Homo sapiens
gtctgagagaggccattc

SEQ ID NO: 3812099 - DNA, 20 bp, Homo sapiens
gtctggcgagcccttagcct

SEQ ID NO: 3812100 - DNA, 21 bp, Homo sapiens
gtctggcgagcccttagcctt

SEQ ID NO: 3812101 - DNA, 22 bp, Homo sapiens
gtctggctgcacccctttttcc

SEQ ID NO: 3812102 - DNA, 12 bp, Homo sapiens
gtctgtgtgtgt

SEQ ID NO: 3812103 - DNA, 20 bp, Homo sapiens
gtctgtgtgtgtgtatgtgg

SEQ ID NO: 3812104 - DNA, 17 bp, Homo sapiens
gtctgttcacttttcct

SEQ ID NO: 3812105 - DNA, 18 bp, Homo sapiens
gtcttataggtttccact

SEQ ID NO: 3812106 - DNA, 13 bp, Homo sapiens
gtcttccaacccc

SEQ ID NO: 3812107 - DNA, 16 bp, Homo sapiens
gtcttccaaccccagc

SEQ ID NO: 3812108 - DNA, 20 bp, Homo sapiens
gtcttccaaccccagctggc

SEQ ID NO: 3812109 - DNA, 14 bp, Homo sapiens
gtcttgatctcctg

SEQ ID NO: 3812110 - DNA, 14 bp, Homo sapiens
gtgaaaagaaaaat

SEQ ID NO: 3812111 - DNA, 22 bp, Homo sapiens
gtgaaataccaacctgaagaca

SEQ ID NO: 3812112 - DNA, 22 bp, Homo sapiens
gtgaaattcaacctgtgtctta

SEQ ID NO: 3812113 - DNA, 13 bp, Homo sapiens
gtgaatacaatta

SEQ ID NO: 3812114 - DNA, 19 bp, Homo sapiens
gtgaatacaattaaaggtc

SEQ ID NO: 3812115 - DNA, 15 bp, Homo sapiens
gtgaatgggaaaaga

SEQ ID NO: 3812116 - DNA, 20 bp, Homo sapiens
gtgacaacatttttgtacat

SEQ ID NO: 3812117 - DNA, 22 bp, Homo sapiens
gtgacaacatttttgtacatta

SEQ ID NO: 3812118 - DNA, 17 bp, Homo sapiens
gtgacttgcctggggcc

SEQ ID NO: 3812119 - DNA, 23 bp, Homo sapiens
gtgagagggcatgcgcacaaggc

SEQ ID NO: 3812120 - DNA, 15 bp, Homo sapiens
gtgaggatgtctggg

SEQ ID NO: 3812121 - DNA, 10 bp, Homo sapiens
gtgatgtgtc

SEQ ID NO: 3812122 - DNA, 16 bp, Homo sapiens
gtgatttttatgccac

SEQ ID NO: 3812123 - DNA, 19 bp, Homo sapiens
gtgatttttatgccacctg

SEQ ID NO: 3812124 - DNA, 17 bp, Homo sapiens
gtgcactggccccaccc

SEQ ID NO: 3812125 - DNA, 18 bp, Homo sapiens
gtgcactggccccaccct

SEQ ID NO: 3812126 - DNA, 15 bp, Homo sapiens
gtgcagctcaggaga

SEQ ID NO: 3812127 - DNA, 15 bp, Homo sapiens
gtgcccaccatgcac

SEQ ID NO: 3812128 - DNA, 22 bp, Homo sapiens
gtgccgagaaggaagcctccca

SEQ ID NO: 3812129 - DNA, 23 bp, Homo sapiens
gtgctattgtagagccagaggtc

SEQ ID NO: 3812130 - DNA, 23 bp, Homo sapiens
gtgctctgaggtcaataaagcag

SEQ ID NO: 3812131 - DNA, 20 bp, Homo sapiens
gtgcttctagttctgccagg

SEQ ID NO: 3812132 - DNA, 14 bp, Homo sapiens
gtggaagtgtgggt

SEQ ID NO: 3812133 - DNA, 15 bp, Homo sapiens
gtggaagtgtgggtc

SEQ ID NO: 3812134 - DNA, 21 bp, Homo sapiens
gtggaagtgtgggtctgtgtg

SEQ ID NO: 3812135 - DNA, 16 bp, Homo sapiens
gtggacacctgccctg

SEQ ID NO: 3812136 - DNA, 23 bp, Homo sapiens
gtggactgaaccgacttttctaa

SEQ ID NO: 3812137 - DNA, 14 bp, Homo sapiens
gtggcaccagcagc

SEQ ID NO: 3812138 - DNA, 14 bp, Homo sapiens
gtggcactggggca

SEQ ID NO: 3812139 - DNA, 17 bp, Homo sapiens
gtggcactggggcaggg

SEQ ID NO: 3812140 - DNA, 18 bp, Homo sapiens
gtggcagccgcctccctt

SEQ ID NO: 3812141 - DNA, 21 bp, Homo sapiens
gtggcctaacctgccgagagt

SEQ ID NO: 3812142 - DNA, 14 bp, Homo sapiens
gtggctcacgcctg

SEQ ID NO: 3812143 - DNA, 17 bp, Homo sapiens
gtggctggatctgtgag

SEQ ID NO: 3812144 - DNA, 12 bp, Homo sapiens
gtgggagctgag

SEQ ID NO: 3812145 - DNA, 12 bp, Homo sapiens
gtgggaggacag

SEQ ID NO: 3812146 - DNA, 17 bp, Homo sapiens
gtgggaggtgagaccac

SEQ ID NO: 3812147 - DNA, 14 bp, Homo sapiens
gtgggagtgtgtaa

SEQ ID NO: 3812148 - DNA, 15 bp, Homo sapiens
gtgggccatggcaat

SEQ ID NO: 3812149 - DNA, 13 bp, Homo sapiens
gtggggagggaga

SEQ ID NO: 3812150 - DNA, 20 bp, Homo sapiens
gtgggggatcacagcctctg

SEQ ID NO: 3812151 - DNA, 23 bp, Homo sapiens
gtggggggggggcgcggctggga

SEQ ID NO: 3812152 - DNA, 13 bp, Homo sapiens
gtgggtctgtgtg

SEQ ID NO: 3812153 - DNA, 16 bp, Homo sapiens
gtggtttttgagccat

SEQ ID NO: 3812154 - DNA, 16 bp, Homo sapiens
gtgtcagcatagaagt

SEQ ID NO: 3812155 - DNA, 20 bp, Homo sapiens
gtgtccagaccattgtcttc

SEQ ID NO: 3812156 - DNA, 23 bp, Homo sapiens
gtgtccagaccattgtcttccaa

SEQ ID NO: 3812157 - DNA, 14 bp, Homo sapiens
gtgtccggtccctg

SEQ ID NO: 3812158 - DNA, 12 bp, Homo sapiens
gtgtgctgtcct

SEQ ID NO: 3812159 - DNA, 17 bp, Homo sapiens
gtgtgggagtgtgtaat

SEQ ID NO: 3812160 - DNA, 14 bp, Homo sapiens
gtgtgggtctgtgt

SEQ ID NO: 3812161 - DNA, 13 bp, Homo sapiens
gtgtgtatgtggg

SEQ ID NO: 3812162 - DNA, 13 bp, Homo sapiens
gtgtgtgtatgtg

SEQ ID NO: 3812163 - DNA, 17 bp, Homo sapiens
gtgtgtgttgtgtgtgg

SEQ ID NO: 3812164 - DNA, 17 bp, Homo sapiens
gtgtgttgtgtgtggga

SEQ ID NO: 3812165 - DNA, 18 bp, Homo sapiens
gtgttgatttgagaaatt

SEQ ID NO: 3812166 - DNA, 16 bp, Homo sapiens
gtgtttatgtgtgtgt

SEQ ID NO: 3812167 - DNA, 14 bp, Homo sapiens
gttacctacttttt

SEQ ID NO: 3812168 - DNA, 21 bp, Homo sapiens
gttagaattgccttaaggcca

SEQ ID NO: 3812169 - DNA, 20 bp, Homo sapiens
gttcacaccattctcctgcc

SEQ ID NO: 3812170 - DNA, 22 bp, Homo sapiens
gttcagctaagctaggaatgaa

SEQ ID NO: 3812171 - DNA, 11 bp, Homo sapiens
tccctgggcct

SEQ ID NO: 3812172 - DNA, 13 bp, Homo sapiens
tccctgggcctca

SEQ ID NO: 3812173 - DNA, 14 bp, Homo sapiens
tccctgtccccctc

SEQ ID NO: 3812174 - DNA, 16 bp, Homo sapiens
tccgctttcatgaaca

SEQ ID NO: 3812175 - DNA, 14 bp, Homo sapiens
tccgggtgccattc

SEQ ID NO: 3812176 - DNA, 17 bp, Homo sapiens
tccggtccctgtcccag

SEQ ID NO: 3812177 - DNA, 22 bp, Homo sapiens
tccgtcacccttggtagagttt

SEQ ID NO: 3812178 - DNA, 20 bp, Homo sapiens
tccgtggcaaccctcagctg

SEQ ID NO: 3812179 - DNA, 14 bp, Homo sapiens
tcctaccaacctct

SEQ ID NO: 3812180 - DNA, 15 bp, Homo sapiens
tcctaccccctgtgc

SEQ ID NO: 3812181 - DNA, 16 bp, Homo sapiens
tcctagaaattcccca

SEQ ID NO: 3812182 - DNA, 13 bp, Homo sapiens
tcctagagctcct

SEQ ID NO: 3812183 - DNA, 16 bp, Homo sapiens
tcctagagctcctgtc

SEQ ID NO: 3812184 - DNA, 18 bp, Homo sapiens
tcctagagctcctgtccc

SEQ ID NO: 3812185 - DNA, 19 bp, Homo sapiens
tcctagagctcctgtccct

SEQ ID NO: 3812186 - DNA, 22 bp, Homo sapiens
tcctaggctccaccccatccag

SEQ ID NO: 3812187 - DNA, 13 bp, Homo sapiens
tcctagttttctc

SEQ ID NO: 3812188 - DNA, 20 bp, Homo sapiens
tcctataatacaaatacaca

SEQ ID NO: 3812189 - DNA, 15 bp, Homo sapiens
tcctcacagcctctc

SEQ ID NO: 3812190 - DNA, 17 bp, Homo sapiens
tcctcagagaatttcta

SEQ ID NO: 3812191 - DNA, 17 bp, Homo sapiens
tcctcattagcattttg

SEQ ID NO: 3812192 - DNA, 14 bp, Homo sapiens
tcctccaagaattt

SEQ ID NO: 3812193 - DNA, 13 bp, Homo sapiens
tcctccagaccac

SEQ ID NO: 3812194 - DNA, 15 bp, Homo sapiens
tcctccctcagtgcc

SEQ ID NO: 3812195 - DNA, 16 bp, Homo sapiens
tcctcgagatcccaac

SEQ ID NO: 3812196 - DNA, 13 bp, Homo sapiens
tcctctcctgtct

SEQ ID NO: 3812197 - DNA, 16 bp, Homo sapiens
tcctctgcccgggagc

SEQ ID NO: 3812198 - DNA, 22 bp, Homo sapiens
tcctctgcccgggagctcagga

SEQ ID NO: 3812199 - DNA, 15 bp, Homo sapiens
tcctgcagcagagcc

SEQ ID NO: 3812200 - DNA, 14 bp, Homo sapiens
tcctgccaggcatg

SEQ ID NO: 3812201 - DNA, 21 bp, Homo sapiens
tcctgccctgtccctgtcccc

SEQ ID NO: 3812202 - DNA, 21 bp, Homo sapiens
tcctgcctcagcctcctgagt

SEQ ID NO: 3812203 - DNA, 12 bp, Homo sapiens
tcctggccctct

SEQ ID NO: 3812204 - DNA, 13 bp, Homo sapiens
tcctggctcagcc

SEQ ID NO: 3812205 - DNA, 17 bp, Homo sapiens
tcctgtccctacccact

SEQ ID NO: 3812206 - DNA, 24 bp, Homo sapiens
tcctgttattttttatttccacat

SEQ ID NO: 3812207 - DNA, 13 bp, Homo sapiens
tccttgtcactgg

SEQ ID NO: 3812208 - DNA, 10 bp, Homo sapiens
tcctttgttc

SEQ ID NO: 3812209 - DNA, 24 bp, Homo sapiens
tcctttgttcttacctgtatgtct

SEQ ID NO: 3812210 - DNA, 21 bp, Homo sapiens
tccttttgcaacaagacaaag

SEQ ID NO: 3812211 - DNA, 21 bp, Homo sapiens
tcgaaacctgtccataaagta

SEQ ID NO: 3812212 - DNA, 13 bp, Homo sapiens
tcgactcagcacc

SEQ ID NO: 3812213 - DNA, 15 bp, Homo sapiens
tcgactctgctgctc

SEQ ID NO: 3812214 - DNA, 23 bp, Homo sapiens
tcgatgaatgtgttgatttgaga

SEQ ID NO: 3812215 - DNA, 12 bp, Homo sapiens
tcgcacctcctt

SEQ ID NO: 3812216 - DNA, 21 bp, Homo sapiens
tcgctggggaagggggctcca

SEQ ID NO: 3812217 - DNA, 18 bp, Homo sapiens
tcgtgatttgcctgcctg

SEQ ID NO: 3812218 - DNA, 17 bp, Homo sapiens
tcgtggacacctgccct

SEQ ID NO: 3812219 - DNA, 14 bp, Homo sapiens
tcgtgtctggcaca

SEQ ID NO: 3812220 - DNA, 20 bp, Homo sapiens
tcgttactctcacctcgtga

SEQ ID NO: 3812221 - DNA, 17 bp, Homo sapiens
tctaatttgcattgtgt

SEQ ID NO: 3812222 - DNA, 15 bp, Homo sapiens
tctaccatttcagag

SEQ ID NO: 3812223 - DNA, 18 bp, Homo sapiens
tctaccatttcagagagg

SEQ ID NO: 3812224 - DNA, 15 bp, Homo sapiens
tctacctcttggctg

SEQ ID NO: 3812225 - DNA, 21 bp, Homo sapiens
tctacctttttttctctccta

SEQ ID NO: 3812226 - DNA, 15 bp, Homo sapiens
tctactcctcacagc

SEQ ID NO: 3812227 - DNA, 18 bp, Homo sapiens
tctactctagggaaaaac

SEQ ID NO: 3812228 - DNA, 16 bp, Homo sapiens
tctactggtcttgtgg

SEQ ID NO: 3812229 - DNA, 20 bp, Homo sapiens
tctactggtcttgtggaatt

SEQ ID NO: 3812230 - DNA, 16 bp, Homo sapiens
tctagaacacccactg

SEQ ID NO: 3812231 - DNA, 22 bp, Homo sapiens
tctagaacacccactggccagt

SEQ ID NO: 3812232 - DNA, 14 bp, Homo sapiens
tctagagagggaat

SEQ ID NO: 3812233 - DNA, 23 bp, Homo sapiens
tctagagagggaattctcttggc

SEQ ID NO: 3812234 - DNA, 16 bp, Homo sapiens
tctagcagcacctcct

SEQ ID NO: 3812235 - DNA, 18 bp, Homo sapiens
tctaggcatcccagggga

SEQ ID NO: 3812236 - DNA, 17 bp, Homo sapiens
tctagttacctactttt

SEQ ID NO: 3812237 - DNA, 16 bp, Homo sapiens
tctagttctgccagga

SEQ ID NO: 3812238 - DNA, 17 bp, Homo sapiens
tctagttctgccaggag

SEQ ID NO: 3812239 - DNA, 22 bp, Homo sapiens
tctatattccgggtgccattcc

SEQ ID NO: 3812240 - DNA, 16 bp, Homo sapiens
tctcaaaaaaagaaaa

SEQ ID NO: 3812241 - DNA, 13 bp, Homo sapiens
tctcaaacctcca

SEQ ID NO: 3812242 - DNA, 20 bp, Homo sapiens
tctcactgccatgccagctt

SEQ ID NO: 3812243 - DNA, 13 bp, Homo sapiens
tctcactgtgtcc

SEQ ID NO: 3812244 - DNA, 14 bp, Homo sapiens
tctcactgtgtccc

SEQ ID NO: 3812245 - DNA, 21 bp, Homo sapiens
tctcactgtgtccctctctct

SEQ ID NO: 3812246 - DNA, 20 bp, Homo sapiens
tctcagagcagcactggggt

SEQ ID NO: 3812247 - DNA, 21 bp, Homo sapiens
tctcattcaggtgttctcttc

SEQ ID NO: 3812248 - DNA, 17 bp, Homo sapiens
tctccaacaagttgcct

SEQ ID NO: 3812249 - DNA, 16 bp, Homo sapiens
tctccaagtctctctg

SEQ ID NO: 3812250 - DNA, 18 bp, Homo sapiens
tctccagatggagaaaca

SEQ ID NO: 3812251 - DNA, 19 bp, Homo sapiens
tctccagtatccactttgc

SEQ ID NO: 3812252 - DNA, 16 bp, Homo sapiens
tctccccgctctggat

SEQ ID NO: 3812253 - DNA, 22 bp, Homo sapiens
tctccccgctctggatcctgca

SEQ ID NO: 3812254 - DNA, 21 bp, Homo sapiens
tctccctgaccttctccaggg

SEQ ID NO: 3812255 - DNA, 11 bp, Homo sapiens
tctcctcccac

SEQ ID NO: 3812256 - DNA, 18 bp, Homo sapiens
tctcctcccatggccttc

SEQ ID NO: 3812257 - DNA, 21 bp, Homo sapiens
tctcctcccatggccttccct

SEQ ID NO: 3812258 - DNA, 23 bp, Homo sapiens
tctcctgcctcagcctcctgagt

SEQ ID NO: 3812259 - DNA, 15 bp, Homo sapiens
tctcgaactcctgac

SEQ ID NO: 3812260 - DNA, 14 bp, Homo sapiens
tctcgacttcagga

SEQ ID NO: 3812261 - DNA, 16 bp, Homo sapiens
tctcgacttcaggagc

SEQ ID NO: 3812262 - DNA, 12 bp, Homo sapiens
tctcgctctgct

SEQ ID NO: 3812263 - DNA, 15 bp, Homo sapiens
tctctacaaaaagca

SEQ ID NO: 3812264 - DNA, 13 bp, Homo sapiens
tctctctctacaa

SEQ ID NO: 3812265 - DNA, 14 bp, Homo sapiens
tctctctctacaaa

SEQ ID NO: 3812266 - DNA, 13 bp, Homo sapiens
tctctctgtgaat

SEQ ID NO: 3812267 - DNA, 14 bp, Homo sapiens
tctctctgtgaata

SEQ ID NO: 3812268 - DNA, 14 bp, Homo sapiens
tctctgtgaataca

SEQ ID NO: 3812269 - DNA, 18 bp, Homo sapiens
tctctgtgaatacaatta

SEQ ID NO: 3812270 - DNA, 20 bp, Homo sapiens
tctctgtgaatacaattaaa

SEQ ID NO: 3812271 - DNA, 22 bp, Homo sapiens
tctctgtgaatacaattaaagg

SEQ ID NO: 3812272 - DNA, 11 bp, Homo sapiens
tctctgtgctt

SEQ ID NO: 3812273 - DNA, 14 bp, Homo sapiens
tctcttgagagggt

SEQ ID NO: 3812274 - DNA, 13 bp, Homo sapiens
tctcttgagcctg

SEQ ID NO: 3812275 - DNA, 18 bp, Homo sapiens
tctcttggctggcttcct

SEQ ID NO: 3812276 - DNA, 15 bp, Homo sapiens
tctgaacaaaagctt

SEQ ID NO: 3812277 - DNA, 13 bp, Homo sapiens
tctgaagtactta

SEQ ID NO: 3812278 - DNA, 16 bp, Homo sapiens
tctgaatgtcccagag

SEQ ID NO: 3812279 - DNA, 18 bp, Homo sapiens
tctgaatgtcccagaggc

SEQ ID NO: 3812280 - DNA, 18 bp, Homo sapiens
tgctaatttatcctgaaa

SEQ ID NO: 3812281 - DNA, 14 bp, Homo sapiens
tgctacaataaatg

SEQ ID NO: 3812282 - DNA, 15 bp, Homo sapiens
tgctacaataaatgc

SEQ ID NO: 3812283 - DNA, 16 bp, Homo sapiens
tgctacaataaatgct

SEQ ID NO: 3812284 - DNA, 19 bp, Homo sapiens
tgctacaataaatgctgaa

SEQ ID NO: 3812285 - DNA, 13 bp, Homo sapiens
tgctaccaaagca

SEQ ID NO: 3812286 - DNA, 15 bp, Homo sapiens
tgctagaagaaaaca

SEQ ID NO: 3812287 - DNA, 16 bp, Homo sapiens
tgctatctctgtgtgc

SEQ ID NO: 3812288 - DNA, 20 bp, Homo sapiens
tgctatgagctggggatgtc

SEQ ID NO: 3812289 - DNA, 15 bp, Homo sapiens
tgctcatgggaagaa

SEQ ID NO: 3812290 - DNA, 13 bp, Homo sapiens
tgctccccacgtc

SEQ ID NO: 3812291 - DNA, 19 bp, Homo sapiens
tgctcctggcccactgcat

SEQ ID NO: 3812292 - DNA, 21 bp, Homo sapiens
tgctctgaggtcaataaagca

SEQ ID NO: 3812293 - DNA, 12 bp, Homo sapiens
tgctgaaatcta

SEQ ID NO: 3812294 - DNA, 21 bp, Homo sapiens
tgctgactgttttctcttgag

SEQ ID NO: 3812295 - DNA, 24 bp, Homo sapiens
tgctgactgttttctcttgagagg

SEQ ID NO: 3812296 - DNA, 14 bp, Homo sapiens
tgctgcctaataaa

SEQ ID NO: 3812297 - DNA, 17 bp, Homo sapiens
tgctggccacagaaagg

SEQ ID NO: 3812298 - DNA, 18 bp, Homo sapiens
tgctggctcccagggcca

SEQ ID NO: 3812299 - DNA, 23 bp, Homo sapiens
tgctgggattacaggtgtgagcc

SEQ ID NO: 3812300 - DNA, 15 bp, Homo sapiens
tgctgtagacatttg

SEQ ID NO: 3812301 - DNA, 15 bp, Homo sapiens
tgctgtagagacttc

SEQ ID NO: 3812302 - DNA, 22 bp, Homo sapiens
tgctgtatatggaattctttta

SEQ ID NO: 3812303 - DNA, 22 bp, Homo sapiens
tgctgtgcattagatattaggg

SEQ ID NO: 3812304 - DNA, 16 bp, Homo sapiens
tgcttcatgaaaatcc

SEQ ID NO: 3812305 - DNA, 14 bp, Homo sapiens
tgcttccctggggc

SEQ ID NO: 3812306 - DNA, 14 bp, Homo sapiens
tgcttcctaactta

SEQ ID NO: 3812307 - DNA, 19 bp, Homo sapiens
tgcttctagttctgccagg

SEQ ID NO: 3812308 - DNA, 19 bp, Homo sapiens
tgcttctgcattcacagcg

SEQ ID NO: 3812309 - DNA, 17 bp, Homo sapiens
tgcttctgcctcagctt

SEQ ID NO: 3812310 - DNA, 17 bp, Homo sapiens
tgcttgaacccaggagg

SEQ ID NO: 3812311 - DNA, 15 bp, Homo sapiens
tgcttgagctcagga

SEQ ID NO: 3812312 - DNA, 13 bp, Homo sapiens
tgcttttctccca

SEQ ID NO: 3812313 - DNA, 18 bp, Homo sapiens
tggaactcgtgtctggca

SEQ ID NO: 3812314 - DNA, 14 bp, Homo sapiens
tggaagtgtgggtc

SEQ ID NO: 3812315 - DNA, 21 bp, Homo sapiens
tggaagtgtgggtctgtgtgt

SEQ ID NO: 3812316 - DNA, 14 bp, Homo sapiens
tggaatacatgaaa

SEQ ID NO: 3812317 - DNA, 18 bp, Homo sapiens
tggaatgaattaaataaa

SEQ ID NO: 3812318 - DNA, 23 bp, Homo sapiens
tggaattttctttcatacattat

SEQ ID NO: 3812319 - DNA, 11 bp, Homo sapiens
tggacacctgc

SEQ ID NO: 3812320 - DNA, 23 bp, Homo sapiens
tggacacctgccctgccctgcca

SEQ ID NO: 3812321 - DNA, 14 bp, Homo sapiens
tggacagaggggca

SEQ ID NO: 3812322 - DNA, 16 bp, Homo sapiens
tggaccagcctctcca

SEQ ID NO: 3812323 - DNA, 20 bp, Homo sapiens
tggagaaacaggctctgaga

SEQ ID NO: 3812324 - DNA, 12 bp, Homo sapiens
tggagagagggg

SEQ ID NO: 3812325 - DNA, 15 bp, Homo sapiens
tggagccactctgtt

SEQ ID NO: 3812326 - DNA, 16 bp, Homo sapiens
tggagccactctgttc

SEQ ID NO: 3812327 - DNA, 17 bp, Homo sapiens
tggattatccactgcaa

SEQ ID NO: 3812328 - DNA, 12 bp, Homo sapiens
tggcaaaaaggc

SEQ ID NO: 3812329 - DNA, 16 bp, Homo sapiens
tggcaaaaaggcagga

SEQ ID NO: 3812330 - DNA, 20 bp, Homo sapiens
tggcaataaaggagaagaga

SEQ ID NO: 3812331 - DNA, 14 bp, Homo sapiens
tggcaattttgtaa

SEQ ID NO: 3812332 - DNA, 15 bp, Homo sapiens
tggcaattttgtaac

SEQ ID NO: 3812333 - DNA, 20 bp, Homo sapiens
tggcacgatctcagctcacc

SEQ ID NO: 3812334 - DNA, 15 bp, Homo sapiens
tggccagtggctgga

SEQ ID NO: 3812335 - DNA, 23 bp, Homo sapiens
tggccagtggctggatctgtgag

SEQ ID NO: 3812336 - DNA, 23 bp, Homo sapiens
tggccgggcgcggtggctcacgc

SEQ ID NO: 3812337 - DNA, 20 bp, Homo sapiens
tggcctctagaacacccact

SEQ ID NO: 3812338 - DNA, 21 bp, Homo sapiens
tggcctctagaacacccactg

SEQ ID NO: 3812339 - DNA, 24 bp, Homo sapiens
tggcctctagaacacccactggcc

SEQ ID NO: 3812340 - DNA, 14 bp, Homo sapiens
tggcctgagaagag

SEQ ID NO: 3812341 - DNA, 16 bp, Homo sapiens
tggcgtgatctcggct

SEQ ID NO: 3812342 - DNA, 20 bp, Homo sapiens
tggctgaggatttcaagcct

SEQ ID NO: 3812343 - DNA, 22 bp, Homo sapiens
tggcttcacggaagagccttgc

SEQ ID NO: 3812344 - DNA, 17 bp, Homo sapiens
tgggaaccatgaagctg

SEQ ID NO: 3812345 - DNA, 18 bp, Homo sapiens
tgggaagaacagaattgc

SEQ ID NO: 3812346 - DNA, 14 bp, Homo sapiens
tgggactacaggca

SEQ ID NO: 3812347 - DNA, 17 bp, Homo sapiens
tgggactgtgcctttgg

SEQ ID NO: 3812348 - DNA, 18 bp, Homo sapiens
tgggagctggttagaaat

SEQ ID NO: 3812349 - DNA, 18 bp, Homo sapiens
tgggaggattgcttgagc

SEQ ID NO: 3812350 - DNA, 19 bp, Homo sapiens
tgggaggccaaggtgggag

SEQ ID NO: 3812351 - DNA, 16 bp, Homo sapiens
tgggagggagggagag

SEQ ID NO: 3812352 - DNA, 18 bp, Homo sapiens
tgggagggagggagaggt

SEQ ID NO: 3812353 - DNA, 19 bp, Homo sapiens
tgggaggtcaaggctgcag

SEQ ID NO: 3812354 - DNA, 20 bp, Homo sapiens
tgggaggtcaaggctgcagt

SEQ ID NO: 3812355 - DNA, 16 bp, Homo sapiens
tgggcaggagggaggt

SEQ ID NO: 3812356 - DNA, 21 bp, Homo sapiens
tgggcatactaataaagtatg

SEQ ID NO: 3812357 - DNA, 16 bp, Homo sapiens
tgggccaactcacctg

SEQ ID NO: 3812358 - DNA, 17 bp, Homo sapiens
tgggcctcagcctccag

SEQ ID NO: 3812359 - DNA, 18 bp, Homo sapiens
tgggcctcagcctccagg

SEQ ID NO: 3812360 - DNA, 14 bp, Homo sapiens
tgggcgaccagggc

SEQ ID NO: 3812361 - DNA, 23 bp, Homo sapiens
tgggctaccccccctcctgctgc

SEQ ID NO: 3812362 - DNA, 19 bp, Homo sapiens
tgggctcacattcccaagg

SEQ ID NO: 3812363 - DNA, 13 bp, Homo sapiens
tgggctctgagga

SEQ ID NO: 3812364 - DNA, 17 bp, Homo sapiens
tggggaagggggctcca

SEQ ID NO: 3812365 - DNA, 19 bp, Homo sapiens
tggggagggagacagagac

SEQ ID NO: 3812366 - DNA, 20 bp, Homo sapiens
tggggagtttagggtggggg

SEQ ID NO: 3812367 - DNA, 14 bp, Homo sapiens
tgggggcttccctg

SEQ ID NO: 3812368 - DNA, 16 bp, Homo sapiens
tgggggcttccctggg

SEQ ID NO: 3812369 - DNA, 14 bp, Homo sapiens
tggggtcaggtgcc

SEQ ID NO: 3812370 - DNA, 22 bp, Homo sapiens
tgggtccaggggagggaaaagc

SEQ ID NO: 3812371 - DNA, 17 bp, Homo sapiens
tgggtcggccctgccca

SEQ ID NO: 3812372 - DNA, 20 bp, Homo sapiens
tgggtggcaccagcagcctg

SEQ ID NO: 3812373 - DNA, 21 bp, Homo sapiens
tgggtggcaccagcagcctgg

SEQ ID NO: 3812374 - DNA, 14 bp, Homo sapiens
tgggtggggaggga

SEQ ID NO: 3812375 - DNA, 17 bp, Homo sapiens
tggtagaccaaaataaa

SEQ ID NO: 3812376 - DNA, 20 bp, Homo sapiens
tggtagagtgtgcctgaagt

SEQ ID NO: 3812377 - DNA, 13 bp, Homo sapiens
tggtaggaactgc

SEQ ID NO: 3812378 - DNA, 20 bp, Homo sapiens
tggtaggaactgctgggctt

SEQ ID NO: 3812379 - DNA, 22 bp, Homo sapiens
tggtatatctggccacactggg

SEQ ID NO: 3812380 - DNA, 21 bp, Homo sapiens
tggtatgaacttgaggacaca

SEQ ID NO: 3812381 - DNA, 18 bp, Homo sapiens
tggtctcgaactcctgac

SEQ ID NO: 3812382 - DNA, 16 bp, Homo sapiens
tggtcttgtggaattg

SEQ ID NO: 3812383 - DNA, 12 bp, Homo sapiens
tggtggggacca

SEQ ID NO: 3812384 - DNA, 16 bp, Homo sapiens
tggtgggggcctcggt

SEQ ID NO: 3812385 - DNA, 20 bp, Homo sapiens
tggtgttcataatttcagtt

SEQ ID NO: 3812386 - DNA, 14 bp, Homo sapiens
tggttatggagagg

SEQ ID NO: 3812387 - DNA, 20 bp, Homo sapiens
tgtaaaagtctagttaccta

SEQ ID NO: 3812388 - DNA, 15 bp, Homo sapiens
aaaatgcattatgtg

SEQ ID NO: 3812389 - DNA, 15 bp, Homo sapiens
aaaatgccaatctct

SEQ ID NO: 3812390 - DNA, 15 bp, Homo sapiens
aaaatgggaagactg

SEQ ID NO: 3812391 - DNA, 17 bp, Homo sapiens
aaacactgggctctgag

SEQ ID NO: 3812392 - DNA, 16 bp, Homo sapiens
aaacagagacaggccc

SEQ ID NO: 3812393 - DNA, 22 bp, Homo sapiens
aaacagagacaggcccaagaga

SEQ ID NO: 3812394 - DNA, 13 bp, Homo sapiens
aaacagagagaga

SEQ ID NO: 3812395 - DNA, 18 bp, Homo sapiens
aaacagagagagacagag

SEQ ID NO: 3812396 - DNA, 23 bp, Homo sapiens
aaacataaaaaaattagtcaggt

SEQ ID NO: 3812397 - DNA, 14 bp, Homo sapiens
aaacataaataaaa

SEQ ID NO: 3812398 - DNA, 19 bp, Homo sapiens
aaacatgcttgaataactg

SEQ ID NO: 3812399 - DNA, 23 bp, Homo sapiens
aaaccaagtcaagtgaaaaagga

SEQ ID NO: 3812400 - DNA, 17 bp, Homo sapiens
aaaccccatctctacaa

SEQ ID NO: 3812401 - DNA, 15 bp, Homo sapiens
aaaccgccaaggctg

SEQ ID NO: 3812402 - DNA, 20 bp, Homo sapiens
aaacgttttatgtgaatgtg

SEQ ID NO: 3812403 - DNA, 18 bp, Homo sapiens
aaactagggttttggcct

SEQ ID NO: 3812404 - DNA, 19 bp, Homo sapiens
aaactagggttttggcctg

SEQ ID NO: 3812405 - DNA, 16 bp, Homo sapiens
aaactatcttggtgaa

SEQ ID NO: 3812406 - DNA, 13 bp, Homo sapiens
aaactcaaaatat

SEQ ID NO: 3812407 - DNA, 20 bp, Homo sapiens
aaactgaggccattatttca

SEQ ID NO: 3812408 - DNA, 13 bp, Homo sapiens
aaacttagaggaa

SEQ ID NO: 3812409 - DNA, 16 bp, Homo sapiens
aaagacattgaaagct

SEQ ID NO: 3812410 - DNA, 18 bp, Homo sapiens
aaagagatggcctgagaa

SEQ ID NO: 3812411 - DNA, 15 bp, Homo sapiens
aaagagggagagatg

SEQ ID NO: 3812412 - DNA, 11 bp, Homo sapiens
aaagaggtttt

SEQ ID NO: 3812413 - DNA, 12 bp, Homo sapiens
aaagattatata

SEQ ID NO: 3812414 - DNA, 13 bp, Homo sapiens
aaagatttctgct

SEQ ID NO: 3812415 - DNA, 16 bp, Homo sapiens
aaagcagagccaaggc

SEQ ID NO: 3812416 - DNA, 17 bp, Homo sapiens
aaagcagagccaaggcc

SEQ ID NO: 3812417 - DNA, 18 bp, Homo sapiens
aaagcagagccaaggcca

SEQ ID NO: 3812418 - DNA, 20 bp, Homo sapiens
aaagcagagccaaggccacc

SEQ ID NO: 3812419 - DNA, 15 bp, Homo sapiens
aaagccacattttgc

SEQ ID NO: 3812420 - DNA, 15 bp, Homo sapiens
aaagctcactttact

SEQ ID NO: 3812421 - DNA, 20 bp, Homo sapiens
aaagctctatggattatcca

SEQ ID NO: 3812422 - DNA, 13 bp, Homo sapiens
aaaggagaagaga

SEQ ID NO: 3812423 - DNA, 15 bp, Homo sapiens
aaagggcagtaaagt

SEQ ID NO: 3812424 - DNA, 13 bp, Homo sapiens
aaaggtatttaga

SEQ ID NO: 3812425 - DNA, 14 bp, Homo sapiens
aaaggtcctgccct

SEQ ID NO: 3812426 - DNA, 15 bp, Homo sapiens
aaaggtcctgccctc

SEQ ID NO: 3812427 - DNA, 14 bp, Homo sapiens
aaagtatatattct

SEQ ID NO: 3812428 - DNA, 21 bp, Homo sapiens
aaagtatgccttcctgtttaa

SEQ ID NO: 3812429 - DNA, 19 bp, Homo sapiens
aaagtatggtattgaaact

SEQ ID NO: 3812430 - DNA, 14 bp, Homo sapiens
aaataaaatgacca

SEQ ID NO: 3812431 - DNA, 18 bp, Homo sapiens
aaataaacaaataacaat

SEQ ID NO: 3812432 - DNA, 16 bp, Homo sapiens
aaataaatgtatcata

SEQ ID NO: 3812433 - DNA, 14 bp, Homo sapiens
aaataacaatgtgc

SEQ ID NO: 3812434 - DNA, 19 bp, Homo sapiens
aaatatttgtctttaaaca

SEQ ID NO: 3812435 - DNA, 22 bp, Homo sapiens
aaatcagagctggcagcctcca

SEQ ID NO: 3812436 - DNA, 12 bp, Homo sapiens
aaatcagcctgc

SEQ ID NO: 3812437 - DNA, 18 bp, Homo sapiens
aaatcagcctgctccagc

SEQ ID NO: 3812438 - DNA, 16 bp, Homo sapiens
aaatcagttatgtcaa

SEQ ID NO: 3812439 - DNA, 17 bp, Homo sapiens
aaatcctaccaacctct

SEQ ID NO: 3812440 - DNA, 13 bp, Homo sapiens
aaatctatgccac

SEQ ID NO: 3812441 - DNA, 17 bp, Homo sapiens
aaatctggcaaagttat

SEQ ID NO: 3812442 - DNA, 13 bp, Homo sapiens
aaatgcccagctt

SEQ ID NO: 3812443 - DNA, 13 bp, Homo sapiens
aaatgctattcag

SEQ ID NO: 3812444 - DNA, 21 bp, Homo sapiens
aaatggaaaggagaggaaaga

SEQ ID NO: 3812445 - DNA, 17 bp, Homo sapiens
aaatgtaacttttgtaa

SEQ ID NO: 3812446 - DNA, 13 bp, Homo sapiens
aaatgtaagaaag

SEQ ID NO: 3812447 - DNA, 20 bp, Homo sapiens
aaatgtatcatagaaatgta

SEQ ID NO: 3812448 - DNA, 12 bp, Homo sapiens
aaatttatgtga

SEQ ID NO: 3812449 - DNA, 12 bp, Homo sapiens
aacaagaattgg

SEQ ID NO: 3812450 - DNA, 17 bp, Homo sapiens
aacaagaggggaaaaca

SEQ ID NO: 3812451 - DNA, 14 bp, Homo sapiens
aacaagtaagaaaa

SEQ ID NO: 3812452 - DNA, 23 bp, Homo sapiens
aacaatgtttttcatactgaata

SEQ ID NO: 3812453 - DNA, 13 bp, Homo sapiens
aacaattatgttt

SEQ ID NO: 3812454 - DNA, 15 bp, Homo sapiens
aacaattatgtttct

SEQ ID NO: 3812455 - DNA, 15 bp, Homo sapiens
aacacaccgatgcac

SEQ ID NO: 3812456 - DNA, 17 bp, Homo sapiens
aacacccactggccagt

SEQ ID NO: 3812457 - DNA, 23 bp, Homo sapiens
aacacctcccaggagacagttca

SEQ ID NO: 3812458 - DNA, 22 bp, Homo sapiens
aacactgccagcatttcccttc

SEQ ID NO: 3812459 - DNA, 14 bp, Homo sapiens
aacaggctcagagg

SEQ ID NO: 3812460 - DNA, 17 bp, Homo sapiens
aacataaataaaatgac

SEQ ID NO: 3812461 - DNA, 18 bp, Homo sapiens
aacatgtatcactcactg

SEQ ID NO: 3812462 - DNA, 17 bp, Homo sapiens
aaccaattcctcatttg

SEQ ID NO: 3812463 - DNA, 18 bp, Homo sapiens
aaccaggccccagcctcc

SEQ ID NO: 3812464 - DNA, 22 bp, Homo sapiens
aaccaggccccagcctccaggc

SEQ ID NO: 3812465 - DNA, 20 bp, Homo sapiens
aacccaaatatatcaaaacg

SEQ ID NO: 3812466 - DNA, 16 bp, Homo sapiens
aacccagcctgagtgc

SEQ ID NO: 3812467 - DNA, 20 bp, Homo sapiens
aacctactttcatactgaag

SEQ ID NO: 3812468 - DNA, 16 bp, Homo sapiens
aacctcatttaccata

SEQ ID NO: 3812469 - DNA, 16 bp, Homo sapiens
aacctgtccataaagt

SEQ ID NO: 3812470 - DNA, 18 bp, Homo sapiens
aacgtcattcagtactta

SEQ ID NO: 3812471 - DNA, 11 bp, Homo sapiens
aactatcttgg

SEQ ID NO: 3812472 - DNA, 16 bp, Homo sapiens
aactcagaatataaca

SEQ ID NO: 3812473 - DNA, 13 bp, Homo sapiens
aactcccggaggt

SEQ ID NO: 3812474 - DNA, 16 bp, Homo sapiens
aactccgcccagcctc

SEQ ID NO: 3812475 - DNA, 17 bp, Homo sapiens
aactccgcccagcctct

SEQ ID NO: 3812476 - DNA, 19 bp, Homo sapiens
aactccgcccagcctctcc

SEQ ID NO: 3812477 - DNA, 12 bp, Homo sapiens
aactctgcagga

SEQ ID NO: 3812478 - DNA, 13 bp, Homo sapiens
aactctgcaggaa

SEQ ID NO: 3812479 - DNA, 16 bp, Homo sapiens
aactctgcaggaaatc

SEQ ID NO: 3812480 - DNA, 19 bp, Homo sapiens
aactcttggccagagctga

SEQ ID NO: 3812481 - DNA, 22 bp, Homo sapiens
aactgcactcatagggtgctct

SEQ ID NO: 3812482 - DNA, 20 bp, Homo sapiens
aactgctgttaattgattaa

SEQ ID NO: 3812483 - DNA, 16 bp, Homo sapiens
aacttagaggaaaagg

SEQ ID NO: 3812484 - DNA, 19 bp, Homo sapiens
aacttattttaaatatgcc

SEQ ID NO: 3812485 - DNA, 20 bp, Homo sapiens
aacttcatatatgaggactt

SEQ ID NO: 3812486 - DNA, 13 bp, Homo sapiens
aacttgaggacac

SEQ ID NO: 3812487 - DNA, 17 bp, Homo sapiens
aacttgaggacacatgt

SEQ ID NO: 3812488 - DNA, 18 bp, Homo sapiens
aacttgaggacacatgtc

SEQ ID NO: 3812489 - DNA, 19 bp, Homo sapiens
aacttgaggacacatgtcc

SEQ ID NO: 3812490 - DNA, 20 bp, Homo sapiens
aacttgaggacacatgtcca

SEQ ID NO: 3812491 - DNA, 19 bp, Homo sapiens
aagaaaaaatattttccct

SEQ ID NO: 3812492 - DNA, 14 bp, Homo sapiens
aagaaaaatatgat

SEQ ID NO: 3812493 - DNA, 14 bp, Homo sapiens
aagaaaacttccaa

SEQ ID NO: 3812494 - DNA, 21 bp, Homo sapiens
aagaaactgaggaattttctt

SEQ ID NO: 3812495 - DNA, 18 bp, Homo sapiens
aagaacagaattgctcct

SEQ ID NO: 3812496 - DNA, 13 bp, Homo sapiens
aagaactgcccca

SEQ ID NO: 3812497 - DNA, 16 bp, Homo sapiens
agagccactacctttg

SEQ ID NO: 3812498 - DNA, 12 bp, Homo sapiens
agagccagaggc

SEQ ID NO: 3812499 - DNA, 17 bp, Homo sapiens
agagccccacacggagg

SEQ ID NO: 3812500 - DNA, 14 bp, Homo sapiens
agagccttaataaa

SEQ ID NO: 3812501 - DNA, 11 bp, Homo sapiens
agagccttgcg

SEQ ID NO: 3812502 - DNA, 20 bp, Homo sapiens
agagctagcagcagggaggg

SEQ ID NO: 3812503 - DNA, 14 bp, Homo sapiens
agagctcctgtccc

SEQ ID NO: 3812504 - DNA, 16 bp, Homo sapiens
agagctcctgtcccta

SEQ ID NO: 3812505 - DNA, 19 bp, Homo sapiens
agagctcctgtccctaccc

SEQ ID NO: 3812506 - DNA, 20 bp, Homo sapiens
agagctcctgtccctaccca

SEQ ID NO: 3812507 - DNA, 12 bp, Homo sapiens
agagctgagtgg

SEQ ID NO: 3812508 - DNA, 20 bp, Homo sapiens
agagcttcccccaaggctga

SEQ ID NO: 3812509 - DNA, 13 bp, Homo sapiens
agaggagaggggc

SEQ ID NO: 3812510 - DNA, 17 bp, Homo sapiens
agaggcagggaggggac

SEQ ID NO: 3812511 - DNA, 21 bp, Homo sapiens
agaggccattctttcccaaca

SEQ ID NO: 3812512 - DNA, 16 bp, Homo sapiens
agagggagagatgagt

SEQ ID NO: 3812513 - DNA, 23 bp, Homo sapiens
agagggcatgcgcacaaggctga

SEQ ID NO: 3812514 - DNA, 10 bp, Homo sapiens
agagggctgc

SEQ ID NO: 3812515 - DNA, 19 bp, Homo sapiens
agaggggaataatagaaga

SEQ ID NO: 3812516 - DNA, 12 bp, Homo sapiens
agaggggcaggg

SEQ ID NO: 3812517 - DNA, 17 bp, Homo sapiens
agaggggcaggggagtg

SEQ ID NO: 3812518 - DNA, 21 bp, Homo sapiens
agaggtggggagggagacaga

SEQ ID NO: 3812519 - DNA, 23 bp, Homo sapiens
agagtccatcagcctccatccta

SEQ ID NO: 3812520 - DNA, 14 bp, Homo sapiens
agagtccctgcctg

SEQ ID NO: 3812521 - DNA, 13 bp, Homo sapiens
agagtgacaggca

SEQ ID NO: 3812522 - DNA, 21 bp, Homo sapiens
agagtgagagggcatgcgcac

SEQ ID NO: 3812523 - DNA, 16 bp, Homo sapiens
agataatctagaacac

SEQ ID NO: 3812524 - DNA, 23 bp, Homo sapiens
agataatctagaacacaggcaaa

SEQ ID NO: 3812525 - DNA, 16 bp, Homo sapiens
agatactgctgatgct

SEQ ID NO: 3812526 - DNA, 22 bp, Homo sapiens
agatacttggggggctgaggtg

SEQ ID NO: 3812527 - DNA, 19 bp, Homo sapiens
agatatgcacacacagatg

SEQ ID NO: 3812528 - DNA, 22 bp, Homo sapiens
agatatgcacacacagatgcac

SEQ ID NO: 3812529 - DNA, 19 bp, Homo sapiens
agatatgctaagcagtagt

SEQ ID NO: 3812530 - DNA, 22 bp, Homo sapiens
agatattaggggggaaagtcat

SEQ ID NO: 3812531 - DNA, 17 bp, Homo sapiens
agatccacacacagagg

SEQ ID NO: 3812532 - DNA, 21 bp, Homo sapiens
agatctgcagggggtgtgtct

SEQ ID NO: 3812533 - DNA, 15 bp, Homo sapiens
agatctttttgtgaa

SEQ ID NO: 3812534 - DNA, 20 bp, Homo sapiens
agatctttttgtgaaattca

SEQ ID NO: 3812535 - DNA, 19 bp, Homo sapiens
agatgagaaaactgagagg

SEQ ID NO: 3812536 - DNA, 22 bp, Homo sapiens
agatgagtgggttagctacctg

SEQ ID NO: 3812537 - DNA, 22 bp, Homo sapiens
agatgcacacacagatgcacac

SEQ ID NO: 3812538 - DNA, 15 bp, Homo sapiens
agatggagtctcgct

SEQ ID NO: 3812539 - DNA, 20 bp, Homo sapiens
agatggagtctcgctctgct

SEQ ID NO: 3812540 - DNA, 19 bp, Homo sapiens
agatggcctgagaagagag

SEQ ID NO: 3812541 - DNA, 20 bp, Homo sapiens
agatggcttatttgtataat

SEQ ID NO: 3812542 - DNA, 16 bp, Homo sapiens
agatgtggatttggca

SEQ ID NO: 3812543 - DNA, 18 bp, Homo sapiens
agattacaggcgcacacc

SEQ ID NO: 3812544 - DNA, 20 bp, Homo sapiens
agattatatatcataaagta

SEQ ID NO: 3812545 - DNA, 16 bp, Homo sapiens
agattcccagagcaaa

SEQ ID NO: 3812546 - DNA, 19 bp, Homo sapiens
agattgagagaagagacaa

SEQ ID NO: 3812547 - DNA, 18 bp, Homo sapiens
agattgctttaagaaact

SEQ ID NO: 3812548 - DNA, 13 bp, Homo sapiens
agatttattaatt

SEQ ID NO: 3812549 - DNA, 18 bp, Homo sapiens
agatttcacaggtcttgc

SEQ ID NO: 3812550 - DNA, 14 bp, Homo sapiens
agattttcctattc

SEQ ID NO: 3812551 - DNA, 21 bp, Homo sapiens
agcaaaataattttaaacaaa

SEQ ID NO: 3812552 - DNA, 14 bp, Homo sapiens
agcaaaatgtgaat

SEQ ID NO: 3812553 - DNA, 15 bp, Homo sapiens
agcaacatgcttcat

SEQ ID NO: 3812554 - DNA, 23 bp, Homo sapiens
agcaagaccaaatcattgtatca

SEQ ID NO: 3812555 - DNA, 22 bp, Homo sapiens
agcaagccggcagaaatagcta

SEQ ID NO: 3812556 - DNA, 16 bp, Homo sapiens
agcaatctgcatttta

SEQ ID NO: 3812557 - DNA, 14 bp, Homo sapiens
agcacatccaggca

SEQ ID NO: 3812558 - DNA, 14 bp, Homo sapiens
agcagagccaaggc

SEQ ID NO: 3812559 - DNA, 14 bp, Homo sapiens
agcaggcacatgga

SEQ ID NO: 3812560 - DNA, 16 bp, Homo sapiens
agcaggcacatggagg

SEQ ID NO: 3812561 - DNA, 15 bp, Homo sapiens
agcatcctcagttcc

SEQ ID NO: 3812562 - DNA, 21 bp, Homo sapiens
agcatgacaacttttaaagaa

SEQ ID NO: 3812563 - DNA, 18 bp, Homo sapiens
agcatttagtcttgccag

SEQ ID NO: 3812564 - DNA, 15 bp, Homo sapiens
agcattttgctaaat

SEQ ID NO: 3812565 - DNA, 13 bp, Homo sapiens
agccaaggccacc

SEQ ID NO: 3812566 - DNA, 23 bp, Homo sapiens
agccaagtgtggtagagtgtgcc

SEQ ID NO: 3812567 - DNA, 16 bp, Homo sapiens
agccactacctttgtc

SEQ ID NO: 3812568 - DNA, 16 bp, Homo sapiens
agccagctgccgacca

SEQ ID NO: 3812569 - DNA, 16 bp, Homo sapiens
agccaggactccttag

SEQ ID NO: 3812570 - DNA, 15 bp, Homo sapiens
agccatctcaagcaa

SEQ ID NO: 3812571 - DNA, 16 bp, Homo sapiens
agcccaaagctgttgg

SEQ ID NO: 3812572 - DNA, 16 bp, Homo sapiens
agcccaataaacctct

SEQ ID NO: 3812573 - DNA, 23 bp, Homo sapiens
agccccgcgtggaactcgtgtct

SEQ ID NO: 3812574 - DNA, 14 bp, Homo sapiens
agccccttctccca

SEQ ID NO: 3812575 - DNA, 23 bp, Homo sapiens
agccccttctcccagcacacggc

SEQ ID NO: 3812576 - DNA, 19 bp, Homo sapiens
agccctctcactgtgtccc

SEQ ID NO: 3812577 - DNA, 12 bp, Homo sapiens
agccctgctgct

SEQ ID NO: 3812578 - DNA, 17 bp, Homo sapiens
agccctgctgcttccta

SEQ ID NO: 3812579 - DNA, 19 bp, Homo sapiens
agccctgctgcttcctaac

SEQ ID NO: 3812580 - DNA, 16 bp, Homo sapiens
agcccttagccttgct

SEQ ID NO: 3812581 - DNA, 22 bp, Homo sapiens
agcccttagccttgctgtagag

SEQ ID NO: 3812582 - DNA, 15 bp, Homo sapiens
agccgccccagcccc

SEQ ID NO: 3812583 - DNA, 20 bp, Homo sapiens
agcctccaggcccccaactc

SEQ ID NO: 3812584 - DNA, 22 bp, Homo sapiens
agcctcccacgactgcccggca

SEQ ID NO: 3812585 - DNA, 14 bp, Homo sapiens
agcctcctccagcc

SEQ ID NO: 3812586 - DNA, 20 bp, Homo sapiens
agcctgaattttgttgctgt

SEQ ID NO: 3812587 - DNA, 21 bp, Homo sapiens
agcctgccccagcctcccagc

SEQ ID NO: 3812588 - DNA, 16 bp, Homo sapiens
agcctgcctcttctct

SEQ ID NO: 3812589 - DNA, 19 bp, Homo sapiens
agcctgcctcttctctact

SEQ ID NO: 3812590 - DNA, 16 bp, Homo sapiens
agcctgctccagctgt

SEQ ID NO: 3812591 - DNA, 17 bp, Homo sapiens
agcctgggaccagggca

SEQ ID NO: 3812592 - DNA, 20 bp, Homo sapiens
agcctgggaggtcaaggctg

SEQ ID NO: 3812593 - DNA, 18 bp, Homo sapiens
agcctgggcaatgtgata

SEQ ID NO: 3812594 - DNA, 22 bp, Homo sapiens
agcctgggtgacagagcaagtg

SEQ ID NO: 3812595 - DNA, 12 bp, Homo sapiens
agccttaataaa

SEQ ID NO: 3812596 - DNA, 19 bp, Homo sapiens
agccttgctgtagagactt

SEQ ID NO: 3812597 - DNA, 13 bp, Homo sapiens
agcgcctcctgga

SEQ ID NO: 3812598 - DNA, 18 bp, Homo sapiens
agctaagctaggaatgaa

SEQ ID NO: 3812599 - DNA, 12 bp, Homo sapiens
agctaggaatga

SEQ ID NO: 3812600 - DNA, 14 bp, Homo sapiens
agctattcaggagg

SEQ ID NO: 3812601 - DNA, 22 bp, Homo sapiens
agctcataagctgtagaactct

SEQ ID NO: 3812602 - DNA, 23 bp, Homo sapiens
agctccagtggaagaagaaaaca

SEQ ID NO: 3812603 - DNA, 13 bp, Homo sapiens
agctcctgtccct

SEQ ID NO: 3812604 - DNA, 15 bp, Homo sapiens
agctcctgtccctac

SEQ ID NO: 3812605 - DNA, 18 bp, Homo sapiens
attttactgacagaaatg

SEQ ID NO: 3812606 - DNA, 13 bp, Homo sapiens
attttatatgatg

SEQ ID NO: 3812607 - DNA, 20 bp, Homo sapiens
attttcaataaatttctgct

SEQ ID NO: 3812608 - DNA, 19 bp, Homo sapiens
attttccctattagagaag

SEQ ID NO: 3812609 - DNA, 18 bp, Homo sapiens
attttctggaatacatga

SEQ ID NO: 3812610 - DNA, 20 bp, Homo sapiens
attttctttagcttttacca

SEQ ID NO: 3812611 - DNA, 17 bp, Homo sapiens
attttctttcatacatt

SEQ ID NO: 3812612 - DNA, 21 bp, Homo sapiens
attttctttcatacattatat

SEQ ID NO: 3812613 - DNA, 19 bp, Homo sapiens
attttgggtgccattaaat

SEQ ID NO: 3812614 - DNA, 20 bp, Homo sapiens
attttgtaaactcaaaatat

SEQ ID NO: 3812615 - DNA, 18 bp, Homo sapiens
attttgtaacgaagacac

SEQ ID NO: 3812616 - DNA, 17 bp, Homo sapiens
attttgtacaaagatat

SEQ ID NO: 3812617 - DNA, 21 bp, Homo sapiens
attttgtttttgtcttaaaaa

SEQ ID NO: 3812618 - DNA, 22 bp, Homo sapiens
attttgtttttgtcttaaaaag

SEQ ID NO: 3812619 - DNA, 17 bp, Homo sapiens
atttttatgccacctga

SEQ ID NO: 3812620 - DNA, 15 bp, Homo sapiens
atttttgtacattat

SEQ ID NO: 3812621 - DNA, 16 bp, Homo sapiens
atttttgtacattatg

SEQ ID NO: 3812622 - DNA, 18 bp, Homo sapiens
atttttttgatggctaag

SEQ ID NO: 3812623 - DNA, 18 bp, Homo sapiens
attttttttaagtattta

SEQ ID NO: 3812624 - DNA, 20 bp, Homo sapiens
attttttttatcatgtcgta

SEQ ID NO: 3812625 - DNA, 17 bp, Homo sapiens
atttttttttcctagcc

SEQ ID NO: 3812626 - DNA, 20 bp, Homo sapiens
caaaaacatggcctttgctt

SEQ ID NO: 3812627 - DNA, 15 bp, Homo sapiens
caaaacggttttact

SEQ ID NO: 3812628 - DNA, 21 bp, Homo sapiens
caaaacggttttactgcagct

SEQ ID NO: 3812629 - DNA, 19 bp, Homo sapiens
caaaacgttttatgtgaat

SEQ ID NO: 3812630 - DNA, 16 bp, Homo sapiens
caaaatatttgtacat

SEQ ID NO: 3812631 - DNA, 18 bp, Homo sapiens
caaaattactggacatat

SEQ ID NO: 3812632 - DNA, 14 bp, Homo sapiens
caaacactgggctc

SEQ ID NO: 3812633 - DNA, 14 bp, Homo sapiens
caaacaggctcaga

SEQ ID NO: 3812634 - DNA, 20 bp, Homo sapiens
caaagaactgccccatctcc

SEQ ID NO: 3812635 - DNA, 17 bp, Homo sapiens
caaagaaggaattctag

SEQ ID NO: 3812636 - DNA, 21 bp, Homo sapiens
caaagaggttttaaaaaaatc

SEQ ID NO: 3812637 - DNA, 17 bp, Homo sapiens
caaagcctcctccagcc

SEQ ID NO: 3812638 - DNA, 16 bp, Homo sapiens
caaagggcagtaaagt

SEQ ID NO: 3812639 - DNA, 18 bp, Homo sapiens
caaagggcagtaaagttt

SEQ ID NO: 3812640 - DNA, 19 bp, Homo sapiens
caaaggttttcctcttcta

SEQ ID NO: 3812641 - DNA, 15 bp, Homo sapiens
caaagtgtcagtgtt

SEQ ID NO: 3812642 - DNA, 16 bp, Homo sapiens
caaagtgtcagtgttg

SEQ ID NO: 3812643 - DNA, 13 bp, Homo sapiens
caaagttatattt

SEQ ID NO: 3812644 - DNA, 17 bp, Homo sapiens
caaagttcactgtttat

SEQ ID NO: 3812645 - DNA, 12 bp, Homo sapiens
caaatatttatt

SEQ ID NO: 3812646 - DNA, 20 bp, Homo sapiens
caaatatttattttctttct

SEQ ID NO: 3812647 - DNA, 16 bp, Homo sapiens
caaatcattgtatcaa

SEQ ID NO: 3812648 - DNA, 21 bp, Homo sapiens
caaatggaaaggagaggaaag

SEQ ID NO: 3812649 - DNA, 20 bp, Homo sapiens
caacacctctgcacaagctg

SEQ ID NO: 3812650 - DNA, 18 bp, Homo sapiens
caacacctcttggggagt

SEQ ID NO: 3812651 - DNA, 12 bp, Homo sapiens
caacactgccag

SEQ ID NO: 3812652 - DNA, 22 bp, Homo sapiens
caacagctcaagtcttccctga

SEQ ID NO: 3812653 - DNA, 19 bp, Homo sapiens
caacatttttgtacattat

SEQ ID NO: 3812654 - DNA, 23 bp, Homo sapiens
caacatttttgtacattatgtta

SEQ ID NO: 3812655 - DNA, 16 bp, Homo sapiens
caaccattccagactg

SEQ ID NO: 3812656 - DNA, 18 bp, Homo sapiens
caaccccaaacccaagtg

SEQ ID NO: 3812657 - DNA, 18 bp, Homo sapiens
caaccccagctggcctct

SEQ ID NO: 3812658 - DNA, 22 bp, Homo sapiens
caaccccagctggcctctagaa

SEQ ID NO: 3812659 - DNA, 16 bp, Homo sapiens
caaccctcagctgcct

SEQ ID NO: 3812660 - DNA, 13 bp, Homo sapiens
caaccctggtgtg

SEQ ID NO: 3812661 - DNA, 16 bp, Homo sapiens
caacctccacctcctg

SEQ ID NO: 3812662 - DNA, 17 bp, Homo sapiens
caacctccacctcctgg

SEQ ID NO: 3812663 - DNA, 22 bp, Homo sapiens
caacctgcccctccccagccct

SEQ ID NO: 3812664 - DNA, 14 bp, Homo sapiens
caacctgtgtctta

SEQ ID NO: 3812665 - DNA, 19 bp, Homo sapiens
caagaaactgaggaatttt

SEQ ID NO: 3812666 - DNA, 21 bp, Homo sapiens
caagaattggaagctgccctg

SEQ ID NO: 3812667 - DNA, 14 bp, Homo sapiens
caagacaaagcaaa

SEQ ID NO: 3812668 - DNA, 21 bp, Homo sapiens
caagaccaaatcattgtatca

SEQ ID NO: 3812669 - DNA, 13 bp, Homo sapiens
caagagagaaaga

SEQ ID NO: 3812670 - DNA, 14 bp, Homo sapiens
caagagagaaagaa

SEQ ID NO: 3812671 - DNA, 17 bp, Homo sapiens
caagagagaaagaagta

SEQ ID NO: 3812672 - DNA, 18 bp, Homo sapiens
caagattcaaagagacta

SEQ ID NO: 3812673 - DNA, 20 bp, Homo sapiens
caagctgcaccctcaggcag

SEQ ID NO: 3812674 - DNA, 16 bp, Homo sapiens
caagctgttttcttct

SEQ ID NO: 3812675 - DNA, 17 bp, Homo sapiens
caaggacaacctgcccc

SEQ ID NO: 3812676 - DNA, 18 bp, Homo sapiens
caaggacaacctgcccct

SEQ ID NO: 3812677 - DNA, 14 bp, Homo sapiens
caaggagaaacaga

SEQ ID NO: 3812678 - DNA, 16 bp, Homo sapiens
caaggagaaacagaga

SEQ ID NO: 3812679 - DNA, 23 bp, Homo sapiens
caaggctgaccaagagagaaaga

SEQ ID NO: 3812680 - DNA, 15 bp, Homo sapiens
caaggctgagagctc

SEQ ID NO: 3812681 - DNA, 12 bp, Homo sapiens
caaggctgcagt

SEQ ID NO: 3812682 - DNA, 17 bp, Homo sapiens
caaggctgcagtgagcc

SEQ ID NO: 3812683 - DNA, 21 bp, Homo sapiens
caaggctgggggaagaagctc

SEQ ID NO: 3812684 - DNA, 12 bp, Homo sapiens
caaggtgggagg

SEQ ID NO: 3812685 - DNA, 23 bp, Homo sapiens
caagtaaatagcaacatgcttca

SEQ ID NO: 3812686 - DNA, 15 bp, Homo sapiens
caagtaataaaacaa

SEQ ID NO: 3812687 - DNA, 15 bp, Homo sapiens
caagtctctctgtga

SEQ ID NO: 3812688 - DNA, 22 bp, Homo sapiens
caagtctctctgtgaatacaat

SEQ ID NO: 3812689 - DNA, 15 bp, Homo sapiens
caagtcttccctgat

SEQ ID NO: 3812690 - DNA, 15 bp, Homo sapiens
caagtgagaccctgt

SEQ ID NO: 3812691 - DNA, 16 bp, Homo sapiens
caagtgataattttat

SEQ ID NO: 3812692 - DNA, 13 bp, Homo sapiens
caataaagcagag

SEQ ID NO: 3812693 - DNA, 14 bp, Homo sapiens
caataaagcagagc

SEQ ID NO: 3812694 - DNA, 22 bp, Homo sapiens
caataaagctgctgagaatcta

SEQ ID NO: 3812695 - DNA, 17 bp, Homo sapiens
caataaaggagaagaga

SEQ ID NO: 3812696 - DNA, 14 bp, Homo sapiens
caataaatgctgaa

SEQ ID NO: 3812697 - DNA, 15 bp, Homo sapiens
caataaatgctgaat

SEQ ID NO: 3812698 - DNA, 13 bp, Homo sapiens
caatgatggcaat

SEQ ID NO: 3812699 - DNA, 16 bp, Homo sapiens
caatgcacacacacag

SEQ ID NO: 3812700 - DNA, 17 bp, Homo sapiens
caatgcacacacacaga

SEQ ID NO: 3812701 - DNA, 18 bp, Homo sapiens
caatgcacacacacagag

SEQ ID NO: 3812702 - DNA, 21 bp, Homo sapiens
caatgcccgtaagatggctta

SEQ ID NO: 3812703 - DNA, 17 bp, Homo sapiens
caatgccctacctgcct

SEQ ID NO: 3812704 - DNA, 19 bp, Homo sapiens
caatgcttctgcctcagct

SEQ ID NO: 3812705 - DNA, 20 bp, Homo sapiens
caatgcttctgcctcagctt

SEQ ID NO: 3812706 - DNA, 18 bp, Homo sapiens
caatggcacgatctcagc

SEQ ID NO: 3812707 - DNA, 14 bp, Homo sapiens
caatgtcagaaact

SEQ ID NO: 3812708 - DNA, 13 bp, Homo sapiens
caatgtgctctcg

SEQ ID NO: 3812709 - DNA, 13 bp, Homo sapiens
caattaaaggtcc

SEQ ID NO: 3812710 - DNA, 20 bp, Homo sapiens
caattaaaggtcctgccctc

SEQ ID NO: 3812711 - DNA, 21 bp, Homo sapiens
caattagcaattgactgtcac

SEQ ID NO: 3812712 - DNA, 16 bp, Homo sapiens
caattagggcctagcc

SEQ ID NO: 3812713 - DNA, 12 bp, Homo sapiens
ccaaccccagct

SEQ ID NO: 3812714 - DNA, 17 bp, Homo sapiens
ccaaccccagctggcct

SEQ ID NO: 3812715 - DNA, 18 bp, Homo sapiens
ccaaccccagctggcctc

SEQ ID NO: 3812716 - DNA, 14 bp, Homo sapiens
ccaacgaaaagcac

SEQ ID NO: 3812717 - DNA, 19 bp, Homo sapiens
ccaactccgcccagcctct

SEQ ID NO: 3812718 - DNA, 20 bp, Homo sapiens
ccaactccgcccagcctctc

SEQ ID NO: 3812719 - DNA, 14 bp, Homo sapiens
ccaagagagaaaga

SEQ ID NO: 3812720 - DNA, 14 bp, Homo sapiens
ccaagagatgaaga

SEQ ID NO: 3812721 - DNA, 19 bp, Homo sapiens
ccaagatgagctgcagccc

SEQ ID NO: 3812722 - DNA, 14 bp, Homo sapiens
ccaagctgttttct

SEQ ID NO: 3812723 - DNA, 19 bp, Homo sapiens
ccaaggagaaacagagaca

SEQ ID NO: 3812724 - DNA, 17 bp, Homo sapiens
ccaagggcctcccacca

SEQ ID NO: 3812725 - DNA, 20 bp, Homo sapiens
ccaagggtaactcttggcca

SEQ ID NO: 3812726 - DNA, 13 bp, Homo sapiens
ccaaggtgggagg

SEQ ID NO: 3812727 - DNA, 17 bp, Homo sapiens
ccaagtaaatagcaaca

SEQ ID NO: 3812728 - DNA, 20 bp, Homo sapiens
ccaagtagctgagattacag

SEQ ID NO: 3812729 - DNA, 14 bp, Homo sapiens
ccaagtctctctgt

SEQ ID NO: 3812730 - DNA, 16 bp, Homo sapiens
ccaagtctctctgtga

SEQ ID NO: 3812731 - DNA, 21 bp, Homo sapiens
ccaagtctctctgtgaataca

SEQ ID NO: 3812732 - DNA, 18 bp, Homo sapiens
ccaatcggctacccctcg

SEQ ID NO: 3812733 - DNA, 14 bp, Homo sapiens
ccaattcctcattt

SEQ ID NO: 3812734 - DNA, 16 bp, Homo sapiens
ccacacacagaggaag

SEQ ID NO: 3812735 - DNA, 20 bp, Homo sapiens
ccacaccccagcccaccctg

SEQ ID NO: 3812736 - DNA, 17 bp, Homo sapiens
ccacacctccctgaacc

SEQ ID NO: 3812737 - DNA, 11 bp, Homo sapiens
ccacactgggc

SEQ ID NO: 3812738 - DNA, 13 bp, Homo sapiens
ccacagagtataa

SEQ ID NO: 3812739 - DNA, 15 bp, Homo sapiens
ccacagtcctcacag

SEQ ID NO: 3812740 - DNA, 14 bp, Homo sapiens
ccacattgcctcat

SEQ ID NO: 3812741 - DNA, 15 bp, Homo sapiens
ccacattgcctcatt

SEQ ID NO: 3812742 - DNA, 17 bp, Homo sapiens
ccaccagccgccccagc

SEQ ID NO: 3812743 - DNA, 18 bp, Homo sapiens
ccaccatcaccagacagg

SEQ ID NO: 3812744 - DNA, 21 bp, Homo sapiens
ccaccatgcacccctgatgtt

SEQ ID NO: 3812745 - DNA, 18 bp, Homo sapiens
ccaccctcgtggacacct

SEQ ID NO: 3812746 - DNA, 18 bp, Homo sapiens
ccaccctgaaagccctga

SEQ ID NO: 3812747 - DNA, 17 bp, Homo sapiens
ccaccctgctcctcctg

SEQ ID NO: 3812748 - DNA, 14 bp, Homo sapiens
ccacctctcaatat

SEQ ID NO: 3812749 - DNA, 20 bp, Homo sapiens
ccacctgaataaagaatgaa

SEQ ID NO: 3812750 - DNA, 12 bp, Homo sapiens
ccacctgtctgt

SEQ ID NO: 3812751 - DNA, 22 bp, Homo sapiens
ccacctgtctgtctgtctgtcc

SEQ ID NO: 3812752 - DNA, 20 bp, Homo sapiens
ccacggcactccagcctggg

SEQ ID NO: 3812753 - DNA, 18 bp, Homo sapiens
ccactaagctttctcctt

SEQ ID NO: 3812754 - DNA, 21 bp, Homo sapiens
ccactaagctttctcctttga

SEQ ID NO: 3812755 - DNA, 22 bp, Homo sapiens
ccactcatgtgactctttccaa

SEQ ID NO: 3812756 - DNA, 22 bp, Homo sapiens
ccactctttgctacaataaatg

SEQ ID NO: 3812757 - DNA, 23 bp, Homo sapiens
ccactgaccgggatccagttcca

SEQ ID NO: 3812758 - DNA, 19 bp, Homo sapiens
ccactgcactccagcctgg

SEQ ID NO: 3812759 - DNA, 23 bp, Homo sapiens
ccactgcactccagcctgggtga

SEQ ID NO: 3812760 - DNA, 15 bp, Homo sapiens
ccactgccgcctcct

SEQ ID NO: 3812761 - DNA, 16 bp, Homo sapiens
ccactgccgcctcctt

SEQ ID NO: 3812762 - DNA, 17 bp, Homo sapiens
ccactgccgcctccttc

SEQ ID NO: 3812763 - DNA, 12 bp, Homo sapiens
ccactggccagt

SEQ ID NO: 3812764 - DNA, 20 bp, Homo sapiens
ccactggccagtcctagagc

SEQ ID NO: 3812765 - DNA, 22 bp, Homo sapiens
ccacttattccccattcttcct

SEQ ID NO: 3812766 - DNA, 13 bp, Homo sapiens
ccacttcagctga

SEQ ID NO: 3812767 - DNA, 16 bp, Homo sapiens
ccacttccctgctttt

SEQ ID NO: 3812768 - DNA, 19 bp, Homo sapiens
ccagaaggctgggtccagg

SEQ ID NO: 3812769 - DNA, 22 bp, Homo sapiens
ccagaagtttgagatcagcctg

SEQ ID NO: 3812770 - DNA, 23 bp, Homo sapiens
ccagaagtttgagatcagcctgg

SEQ ID NO: 3812771 - DNA, 20 bp, Homo sapiens
ccagaattgcttgaacccag

SEQ ID NO: 3812772 - DNA, 15 bp, Homo sapiens
ccagaccattgtctt

SEQ ID NO: 3812773 - DNA, 19 bp, Homo sapiens
ccagaccattgtcttccaa

SEQ ID NO: 3812774 - DNA, 22 bp, Homo sapiens
ccagaccattgtcttccaaccc

SEQ ID NO: 3812775 - DNA, 21 bp, Homo sapiens
ccagacctctgaatgtcccag

SEQ ID NO: 3812776 - DNA, 18 bp, Homo sapiens
ccagagactgggatggga

SEQ ID NO: 3812777 - DNA, 13 bp, Homo sapiens
ccagagcaaaata

SEQ ID NO: 3812778 - DNA, 14 bp, Homo sapiens
ccagagccccacac

SEQ ID NO: 3812779 - DNA, 12 bp, Homo sapiens
ccagagctgagt

SEQ ID NO: 3812780 - DNA, 19 bp, Homo sapiens
ccagaggctattattttca

SEQ ID NO: 3812781 - DNA, 17 bp, Homo sapiens
ccagagtccctgcctgg

SEQ ID NO: 3812782 - DNA, 19 bp, Homo sapiens
ccagagtccctgcctggac

SEQ ID NO: 3812783 - DNA, 16 bp, Homo sapiens
ccagatggagaaacag

SEQ ID NO: 3812784 - DNA, 21 bp, Homo sapiens
ccagattgataagtaatgaaa

SEQ ID NO: 3812785 - DNA, 16 bp, Homo sapiens
ccagcagacttgagtc

SEQ ID NO: 3812786 - DNA, 19 bp, Homo sapiens
ccagcagcctggaccctgt

SEQ ID NO: 3812787 - DNA, 16 bp, Homo sapiens
ccagcatttcccttcc

SEQ ID NO: 3812788 - DNA, 15 bp, Homo sapiens
ccagccaaagcctcc

SEQ ID NO: 3812789 - DNA, 18 bp, Homo sapiens
ccagccaaagcctcctcc

SEQ ID NO: 3812790 - DNA, 21 bp, Homo sapiens
ccagccccttctcccagcaca

SEQ ID NO: 3812791 - DNA, 19 bp, Homo sapiens
ccagccctgctgcttccta

SEQ ID NO: 3812792 - DNA, 13 bp, Homo sapiens
ccagcctcccagc

SEQ ID NO: 3812793 - DNA, 16 bp, Homo sapiens
ccagcctgggcgacag

SEQ ID NO: 3812794 - DNA, 16 bp, Homo sapiens
ccagctgttcagctgg

SEQ ID NO: 3812795 - DNA, 17 bp, Homo sapiens
ccaggacatctctgccc

SEQ ID NO: 3812796 - DNA, 17 bp, Homo sapiens
ccaggagcctgtgcctc

SEQ ID NO: 3812797 - DNA, 16 bp, Homo sapiens
ccaggattcccagaga

SEQ ID NO: 3812798 - DNA, 23 bp, Homo sapiens
ccaggattcccagagagacgctg

SEQ ID NO: 3812799 - DNA, 18 bp, Homo sapiens
ccaggatttgctgggaga

SEQ ID NO: 3812800 - DNA, 17 bp, Homo sapiens
ccaggcagctccagctg

SEQ ID NO: 3812801 - DNA, 18 bp, Homo sapiens
ccaggccccagcctccag

SEQ ID NO: 3812802 - DNA, 16 bp, Homo sapiens
ccaggctagagtgcag

SEQ ID NO: 3812803 - DNA, 16 bp, Homo sapiens
ccaggctggagtgcaa

SEQ ID NO: 3812804 - DNA, 14 bp, Homo sapiens
ccaggctgggctct

SEQ ID NO: 3812805 - DNA, 16 bp, Homo sapiens
ccagggacagaagcag

SEQ ID NO: 3812806 - DNA, 18 bp, Homo sapiens
ccagggacagaagcagga

SEQ ID NO: 3812807 - DNA, 19 bp, Homo sapiens
ccagggcatattaaaggct

SEQ ID NO: 3812808 - DNA, 19 bp, Homo sapiens
ccagggccatctcctccca

SEQ ID NO: 3812809 - DNA, 19 bp, Homo sapiens
ccaggggagggaaaagcta

SEQ ID NO: 3812810 - DNA, 17 bp, Homo sapiens
ccaggtgcctggccctt

SEQ ID NO: 3812811 - DNA, 19 bp, Homo sapiens
ccagtcctagagctcctgt

SEQ ID NO: 3812812 - DNA, 20 bp, Homo sapiens
ccagtcctagagctcctgtc

SEQ ID NO: 3812813 - DNA, 22 bp, Homo sapiens
ccagtcctagagctcctgtccc

SEQ ID NO: 3812814 - DNA, 24 bp, Homo sapiens
ccagtcctagagctcctgtcccta

SEQ ID NO: 3812815 - DNA, 16 bp, Homo sapiens
ccagtcctccagacca

SEQ ID NO: 3812816 - DNA, 19 bp, Homo sapiens
ccagtggcccccactcaca

SEQ ID NO: 3812817 - DNA, 15 bp, Homo sapiens
ccagtgggaggacag

SEQ ID NO: 3812818 - DNA, 22 bp, Homo sapiens
ccagttcccatggtgtatgtgg

SEQ ID NO: 3812819 - DNA, 22 bp, Homo sapiens
ccatcccctgtagagtgggagc

SEQ ID NO: 3812820 - DNA, 18 bp, Homo sapiens
ccatcctaccccctgtgc

SEQ ID NO: 3812821 - DNA, 13 bp, Homo sapiens
ctacatgaaacag

SEQ ID NO: 3812822 - DNA, 18 bp, Homo sapiens
ctacatgaaacagaaaca

SEQ ID NO: 3812823 - DNA, 14 bp, Homo sapiens
ctaccaaagcacct

SEQ ID NO: 3812824 - DNA, 15 bp, Homo sapiens
ctaccaaagcacctt

SEQ ID NO: 3812825 - DNA, 18 bp, Homo sapiens
ctaccatcccctgtagag

SEQ ID NO: 3812826 - DNA, 14 bp, Homo sapiens
ctacccactctttg

SEQ ID NO: 3812827 - DNA, 19 bp, Homo sapiens
ctacccctcgactcagcac

SEQ ID NO: 3812828 - DNA, 17 bp, Homo sapiens
ctaccctcttagaaaaa

SEQ ID NO: 3812829 - DNA, 20 bp, Homo sapiens
ctacctttttttctctccta

SEQ ID NO: 3812830 - DNA, 16 bp, Homo sapiens
ctactactctgccaat

SEQ ID NO: 3812831 - DNA, 12 bp, Homo sapiens
ctactctgccaa

SEQ ID NO: 3812832 - DNA, 14 bp, Homo sapiens
ctactctgccaatc

SEQ ID NO: 3812833 - DNA, 15 bp, Homo sapiens
ctactttttctttga

SEQ ID NO: 3812834 - DNA, 19 bp, Homo sapiens
ctagaaattccccaccctg

SEQ ID NO: 3812835 - DNA, 16 bp, Homo sapiens
ctagaacacccactgg

SEQ ID NO: 3812836 - DNA, 17 bp, Homo sapiens
ctagaacacccactggc

SEQ ID NO: 3812837 - DNA, 18 bp, Homo sapiens
ctagaacacccactggcc

SEQ ID NO: 3812838 - DNA, 14 bp, Homo sapiens
ctagaggcagggag

SEQ ID NO: 3812839 - DNA, 17 bp, Homo sapiens
ctagagtgaacttgggc

SEQ ID NO: 3812840 - DNA, 21 bp, Homo sapiens
ctagagtgaacttgggccact

SEQ ID NO: 3812841 - DNA, 12 bp, Homo sapiens
ctagagtgacag

SEQ ID NO: 3812842 - DNA, 15 bp, Homo sapiens
ctagagtgcagtggc

SEQ ID NO: 3812843 - DNA, 21 bp, Homo sapiens
ctagatccacacacagaggaa

SEQ ID NO: 3812844 - DNA, 16 bp, Homo sapiens
ctagattctcacctgc

SEQ ID NO: 3812845 - DNA, 24 bp, Homo sapiens
ctagattgagagaagagacaaaca

SEQ ID NO: 3812846 - DNA, 12 bp, Homo sapiens
ctagcagcaggg

SEQ ID NO: 3812847 - DNA, 19 bp, Homo sapiens
ctagccctctcacatttat

SEQ ID NO: 3812848 - DNA, 15 bp, Homo sapiens
ctaggaattcccagc

SEQ ID NO: 3812849 - DNA, 17 bp, Homo sapiens
ctaggattcctccccca

SEQ ID NO: 3812850 - DNA, 18 bp, Homo sapiens
ctaggcaagtgtatattt

SEQ ID NO: 3812851 - DNA, 19 bp, Homo sapiens
ctaggcatcccaggggacc

SEQ ID NO: 3812852 - DNA, 12 bp, Homo sapiens
ctaggcctgggg

SEQ ID NO: 3812853 - DNA, 21 bp, Homo sapiens
ctagggaaaaaccagcgtgtg

SEQ ID NO: 3812854 - DNA, 16 bp, Homo sapiens
ctagggttttggcctg

SEQ ID NO: 3812855 - DNA, 21 bp, Homo sapiens
ctagtatattagtttgattta

SEQ ID NO: 3812856 - DNA, 12 bp, Homo sapiens
ctagtccttgtt

SEQ ID NO: 3812857 - DNA, 15 bp, Homo sapiens
ctagtctcttctcag

SEQ ID NO: 3812858 - DNA, 18 bp, Homo sapiens
ctagtctcttctcagagc

SEQ ID NO: 3812859 - DNA, 20 bp, Homo sapiens
ctagtctcttctcagagcag

SEQ ID NO: 3812860 - DNA, 16 bp, Homo sapiens
ctagttacctactttt

SEQ ID NO: 3812861 - DNA, 16 bp, Homo sapiens
ctagttctgccaggag

SEQ ID NO: 3812862 - DNA, 21 bp, Homo sapiens
ctagttgattgcgagaatttt

SEQ ID NO: 3812863 - DNA, 23 bp, Homo sapiens
ctagttgattgcgagaattttca

SEQ ID NO: 3812864 - DNA, 21 bp, Homo sapiens
ctatgacctcgccctccacaa

SEQ ID NO: 3812865 - DNA, 20 bp, Homo sapiens
ctatggattatccactgcaa

SEQ ID NO: 3812866 - DNA, 19 bp, Homo sapiens
ctatggggatagatgtgtg

SEQ ID NO: 3812867 - DNA, 14 bp, Homo sapiens
ctattagcaactgt

SEQ ID NO: 3812868 - DNA, 20 bp, Homo sapiens
ctattattttcactgtagaa

SEQ ID NO: 3812869 - DNA, 22 bp, Homo sapiens
ctattattttcactgtagaatg

SEQ ID NO: 3812870 - DNA, 18 bp, Homo sapiens
ctcaaaaaaagaaaaaga

SEQ ID NO: 3812871 - DNA, 18 bp, Homo sapiens
ctcaaaatatttgtacat

SEQ ID NO: 3812872 - DNA, 14 bp, Homo sapiens
ctcaaagagactcc

SEQ ID NO: 3812873 - DNA, 21 bp, Homo sapiens
ctcaacacctctgcacaagct

SEQ ID NO: 3812874 - DNA, 18 bp, Homo sapiens
ctcaagcaagtttaatca

SEQ ID NO: 3812875 - DNA, 22 bp, Homo sapiens
ctcacaaaccatgcaaatgcta

SEQ ID NO: 3812876 - DNA, 14 bp, Homo sapiens
ctcacagcctctcc

SEQ ID NO: 3812877 - DNA, 12 bp, Homo sapiens
ctcacatttatg

SEQ ID NO: 3812878 - DNA, 19 bp, Homo sapiens
ctcactgcaagctctgcct

SEQ ID NO: 3812879 - DNA, 23 bp, Homo sapiens
ctcactgcaagctctgcctcccg

SEQ ID NO: 3812880 - DNA, 18 bp, Homo sapiens
ctcagagcagcactgggg

SEQ ID NO: 3812881 - DNA, 11 bp, Homo sapiens
ctcagcagccc

SEQ ID NO: 3812882 - DNA, 18 bp, Homo sapiens
ctcagcagccccctgccc

SEQ ID NO: 3812883 - DNA, 14 bp, Homo sapiens
ctcagcctcctgag

SEQ ID NO: 3812884 - DNA, 15 bp, Homo sapiens
ctcagcctcctgagt

SEQ ID NO: 3812885 - DNA, 23 bp, Homo sapiens
ctcagcctcctgagtagctggga

SEQ ID NO: 3812886 - DNA, 13 bp, Homo sapiens
ctcagctgcctca

SEQ ID NO: 3812887 - DNA, 19 bp, Homo sapiens
ctcagctgcctcatcgtgg

SEQ ID NO: 3812888 - DNA, 18 bp, Homo sapiens
ctcaggagtttgagacca

SEQ ID NO: 3812889 - DNA, 15 bp, Homo sapiens
ctcaggcaggtggga

SEQ ID NO: 3812890 - DNA, 18 bp, Homo sapiens
ctcaggcaggtgggatgg

SEQ ID NO: 3812891 - DNA, 21 bp, Homo sapiens
ctcaggtagggagctaaggaa

SEQ ID NO: 3812892 - DNA, 19 bp, Homo sapiens
ctcaggtgagaagcagagg

SEQ ID NO: 3812893 - DNA, 24 bp, Homo sapiens
ctcagtctggtgctccagttccag

SEQ ID NO: 3812894 - DNA, 17 bp, Homo sapiens
ctcagtgtcagcactca

SEQ ID NO: 3812895 - DNA, 21 bp, Homo sapiens
ctcagttcctgcagcagagcc

SEQ ID NO: 3812896 - DNA, 13 bp, Homo sapiens
ctcatagggtgct

SEQ ID NO: 3812897 - DNA, 18 bp, Homo sapiens
ctcatgtgactctttcca

SEQ ID NO: 3812898 - DNA, 20 bp, Homo sapiens
ctcattataaaatgggaaga

SEQ ID NO: 3812899 - DNA, 13 bp, Homo sapiens
ctccaagtctctc

SEQ ID NO: 3812900 - DNA, 16 bp, Homo sapiens
ctccaagtctctctgt

SEQ ID NO: 3812901 - DNA, 12 bp, Homo sapiens
ctccacctcctg

SEQ ID NO: 3812902 - DNA, 16 bp, Homo sapiens
ctccacctcctgggtt

SEQ ID NO: 3812903 - DNA, 16 bp, Homo sapiens
ctccactcatgtgact

SEQ ID NO: 3812904 - DNA, 18 bp, Homo sapiens
ctccagatggagaaacag

SEQ ID NO: 3812905 - DNA, 18 bp, Homo sapiens
ctccagcctgggcgacag

SEQ ID NO: 3812906 - DNA, 13 bp, Homo sapiens
ctccagctgttca

SEQ ID NO: 3812907 - DNA, 16 bp, Homo sapiens
ctccaggcccccaact

SEQ ID NO: 3812908 - DNA, 19 bp, Homo sapiens
ctccagtggaagaagaaaa

SEQ ID NO: 3812909 - DNA, 23 bp, Homo sapiens
ctccagtgggaggacagagccgg

SEQ ID NO: 3812910 - DNA, 22 bp, Homo sapiens
ctcccaattcacctcgttactc

SEQ ID NO: 3812911 - DNA, 15 bp, Homo sapiens
ctcccacaaaggaga

SEQ ID NO: 3812912 - DNA, 16 bp, Homo sapiens
ctcccagaaggctggg

SEQ ID NO: 3812913 - DNA, 18 bp, Homo sapiens
ctcccaggaactgggcca

SEQ ID NO: 3812914 - DNA, 14 bp, Homo sapiens
ctcccagggccatg

SEQ ID NO: 3812915 - DNA, 14 bp, Homo sapiens
ctcccagtcctcca

SEQ ID NO: 3812916 - DNA, 16 bp, Homo sapiens
ctcccagtcctccaga

SEQ ID NO: 3812917 - DNA, 19 bp, Homo sapiens
ctcccagtcctccagacca

SEQ ID NO: 3812918 - DNA, 13 bp, Homo sapiens
ctccccacagtcc

SEQ ID NO: 3812919 - DNA, 19 bp, Homo sapiens
ctccccacagtcctcacag

SEQ ID NO: 3812920 - DNA, 22 bp, Homo sapiens
ctccccacagtcctcacagcct

SEQ ID NO: 3812921 - DNA, 14 bp, Homo sapiens
ctccccagcccttt

SEQ ID NO: 3812922 - DNA, 14 bp, Homo sapiens
ctcccccagagcca

SEQ ID NO: 3812923 - DNA, 22 bp, Homo sapiens
ctcccctcccagtcctccagac

SEQ ID NO: 3812924 - DNA, 22 bp, Homo sapiens
ctcccggaggtgtcaccttcct

SEQ ID NO: 3812925 - DNA, 13 bp, Homo sapiens
ctccctcctctgc

SEQ ID NO: 3812926 - DNA, 14 bp, Homo sapiens
ctccctcctctgcc

SEQ ID NO: 3812927 - DNA, 19 bp, Homo sapiens
ctccctgaaccatccctga

SEQ ID NO: 3812928 - DNA, 16 bp, Homo sapiens
ctccgcccagcctctc

SEQ ID NO: 3812929 - DNA, 15 bp, Homo sapiens
ctcctcacccccagc

SEQ ID NO: 3812930 - DNA, 22 bp, Homo sapiens
cttggtatatctggccacactg

SEQ ID NO: 3812931 - DNA, 23 bp, Homo sapiens
cttggtatatctggccacactgg

SEQ ID NO: 3812932 - DNA, 22 bp, Homo sapiens
cttggtctaacttttgtgtgaa

SEQ ID NO: 3812933 - DNA, 20 bp, Homo sapiens
cttggtgaatttttttttcc

SEQ ID NO: 3812934 - DNA, 23 bp, Homo sapiens
cttgtcacgccagacttcccacg

SEQ ID NO: 3812935 - DNA, 15 bp, Homo sapiens
cttgtcactggtaga

SEQ ID NO: 3812936 - DNA, 14 bp, Homo sapiens
cttgtcatgtgaca

SEQ ID NO: 3812937 - DNA, 13 bp, Homo sapiens
cttgtctggctgc

SEQ ID NO: 3812938 - DNA, 13 bp, Homo sapiens
cttgtctgtagat

SEQ ID NO: 3812939 - DNA, 23 bp, Homo sapiens
cttgtgtatattttaatgaatat

SEQ ID NO: 3812940 - DNA, 17 bp, Homo sapiens
cttgtgtctctgtgctt

SEQ ID NO: 3812941 - DNA, 15 bp, Homo sapiens
ctttaaaataaaata

SEQ ID NO: 3812942 - DNA, 21 bp, Homo sapiens
ctttcaaagaaggaattctag

SEQ ID NO: 3812943 - DNA, 15 bp, Homo sapiens
ctttcatacattata

SEQ ID NO: 3812944 - DNA, 17 bp, Homo sapiens
ctttcatactgaagatg

SEQ ID NO: 3812945 - DNA, 18 bp, Homo sapiens
ctttcatgaacacagcct

SEQ ID NO: 3812946 - DNA, 17 bp, Homo sapiens
ctttcccaacacctctt

SEQ ID NO: 3812947 - DNA, 20 bp, Homo sapiens
ctttctcttttcctctacca

SEQ ID NO: 3812948 - DNA, 16 bp, Homo sapiens
ctttctgtaaccataa

SEQ ID NO: 3812949 - DNA, 15 bp, Homo sapiens
ctttctgtgtgcaca

SEQ ID NO: 3812950 - DNA, 22 bp, Homo sapiens
ctttgaagaggaaaatgaataa

SEQ ID NO: 3812951 - DNA, 20 bp, Homo sapiens
ctttgccccggcttgcctgt

SEQ ID NO: 3812952 - DNA, 14 bp, Homo sapiens
ctttggtagaaaag

SEQ ID NO: 3812953 - DNA, 14 bp, Homo sapiens
ctttggttcagcta

SEQ ID NO: 3812954 - DNA, 16 bp, Homo sapiens
ctttgtgtagctttgc

SEQ ID NO: 3812955 - DNA, 21 bp, Homo sapiens
ctttgtttgttgtcagctgaa

SEQ ID NO: 3812956 - DNA, 20 bp, Homo sapiens
cttttaaagaaaaatatgat

SEQ ID NO: 3812957 - DNA, 16 bp, Homo sapiens
cttttaccaacccaaa

SEQ ID NO: 3812958 - DNA, 13 bp, Homo sapiens
cttttctcccaga

SEQ ID NO: 3812959 - DNA, 17 bp, Homo sapiens
cttttctcccagaaggc

SEQ ID NO: 3812960 - DNA, 23 bp, Homo sapiens
cttttctgtccgagctttgaaaa

SEQ ID NO: 3812961 - DNA, 23 bp, Homo sapiens
cttttgaagaagttcttaaatac

SEQ ID NO: 3812962 - DNA, 10 bp, Homo sapiens
cttttgtaag

SEQ ID NO: 3812963 - DNA, 14 bp, Homo sapiens
cttttgtcccagaa

SEQ ID NO: 3812964 - DNA, 16 bp, Homo sapiens
cttttgttttcttcat

SEQ ID NO: 3812965 - DNA, 20 bp, Homo sapiens
cttttgttttcttcatttct

SEQ ID NO: 3812966 - DNA, 17 bp, Homo sapiens
ctttttcccctttctgt

SEQ ID NO: 3812967 - DNA, 22 bp, Homo sapiens
ctttttgtgaaattcaacctgt

SEQ ID NO: 3812968 - DNA, 21 bp, Homo sapiens
gaaaaaataattgatttcaag

SEQ ID NO: 3812969 - DNA, 16 bp, Homo sapiens
gaaaaatgagcctggc

SEQ ID NO: 3812970 - DNA, 13 bp, Homo sapiens
gaaaactgagagg

SEQ ID NO: 3812971 - DNA, 18 bp, Homo sapiens
gaaaagaaaaatgagcct

SEQ ID NO: 3812972 - DNA, 18 bp, Homo sapiens
gaaaagacattgaaagct

SEQ ID NO: 3812973 - DNA, 18 bp, Homo sapiens
gaaaagatgagaggcaga

SEQ ID NO: 3812974 - DNA, 22 bp, Homo sapiens
gaaaatcagcctgctccagctg

SEQ ID NO: 3812975 - DNA, 16 bp, Homo sapiens
gaaaatgcaggagagc

SEQ ID NO: 3812976 - DNA, 18 bp, Homo sapiens
gaaaatgcaggagagctt

SEQ ID NO: 3812977 - DNA, 22 bp, Homo sapiens
gaaacagaaacaaaaacactaa

SEQ ID NO: 3812978 - DNA, 18 bp, Homo sapiens
gaaacagagagagacaga

SEQ ID NO: 3812979 - DNA, 15 bp, Homo sapiens
gaaacataaataaaa

SEQ ID NO: 3812980 - DNA, 17 bp, Homo sapiens
gaaacataaataaaatg

SEQ ID NO: 3812981 - DNA, 22 bp, Homo sapiens
gaaacataaataaaatgaccag

SEQ ID NO: 3812982 - DNA, 21 bp, Homo sapiens
gaaagaaaataccaaggaaca

SEQ ID NO: 3812983 - DNA, 16 bp, Homo sapiens
gaaagagatacagagg

SEQ ID NO: 3812984 - DNA, 22 bp, Homo sapiens
gaaagccctgagctttctgcta

SEQ ID NO: 3812985 - DNA, 18 bp, Homo sapiens
gaaagtgcactgcagtga

SEQ ID NO: 3812986 - DNA, 21 bp, Homo sapiens
gaaataaatgtatcatagaaa

SEQ ID NO: 3812987 - DNA, 16 bp, Homo sapiens
gaaataatagggaaaa

SEQ ID NO: 3812988 - DNA, 19 bp, Homo sapiens
gaaatacgccagaactgct

SEQ ID NO: 3812989 - DNA, 23 bp, Homo sapiens
gaaatcagagctggcagcctcca

SEQ ID NO: 3812990 - DNA, 21 bp, Homo sapiens
gaaatttcagattcccagagc

SEQ ID NO: 3812991 - DNA, 18 bp, Homo sapiens
gaaattttactgacagaa

SEQ ID NO: 3812992 - DNA, 19 bp, Homo sapiens
gaaattttactgacagaaa

SEQ ID NO: 3812993 - DNA, 22 bp, Homo sapiens
gaaattttactgacagaaatgc

SEQ ID NO: 3812994 - DNA, 13 bp, Homo sapiens
gaacaatgaatgc

SEQ ID NO: 3812995 - DNA, 15 bp, Homo sapiens
gaacaatgtcagaaa

SEQ ID NO: 3812996 - DNA, 17 bp, Homo sapiens
gaacacactcagcagcc

SEQ ID NO: 3812997 - DNA, 16 bp, Homo sapiens
gaacacccactggcca

SEQ ID NO: 3812998 - DNA, 19 bp, Homo sapiens
gaacatctaacccactaga

SEQ ID NO: 3812999 - DNA, 21 bp, Homo sapiens
gaacccctacatgaaacagaa

SEQ ID NO: 3813000 - DNA, 11 bp, Homo sapiens
gaactcctgac

SEQ ID NO: 3813001 - DNA, 15 bp, Homo sapiens
gaactctgcaggcag

SEQ ID NO: 3813002 - DNA, 12 bp, Homo sapiens
gaactgagactg

SEQ ID NO: 3813003 - DNA, 17 bp, Homo sapiens
gaactgctgggcttggc

SEQ ID NO: 3813004 - DNA, 17 bp, Homo sapiens
gaacttgggccactgtg

SEQ ID NO: 3813005 - DNA, 13 bp, Homo sapiens
gaagaagaaaaca

SEQ ID NO: 3813006 - DNA, 13 bp, Homo sapiens
gaagaagtgtgtc

SEQ ID NO: 3813007 - DNA, 23 bp, Homo sapiens
gaagacaatgtgaaaagaaaaat

SEQ ID NO: 3813008 - DNA, 14 bp, Homo sapiens
gaagaccctccccg

SEQ ID NO: 3813009 - DNA, 15 bp, Homo sapiens
gaagagcaggcacat

SEQ ID NO: 3813010 - DNA, 18 bp, Homo sapiens
gaagaggaaaatgaataa

SEQ ID NO: 3813011 - DNA, 17 bp, Homo sapiens
gaagaggggtcttttat

SEQ ID NO: 3813012 - DNA, 14 bp, Homo sapiens
gaagagtgagaggg

SEQ ID NO: 3813013 - DNA, 14 bp, Homo sapiens
gaagcactgctgtg

SEQ ID NO: 3813014 - DNA, 15 bp, Homo sapiens
gaagcagaggaagga

SEQ ID NO: 3813015 - DNA, 17 bp, Homo sapiens
gaagctataaagaaaag

SEQ ID NO: 3813016 - DNA, 24 bp, Homo sapiens
gaaggctttcagggcctccagccc

SEQ ID NO: 3813017 - DNA, 10 bp, Homo sapiens
gaagtggaag

SEQ ID NO: 3813018 - DNA, 18 bp, Homo sapiens
gaagtgtgggtctgtgtg

SEQ ID NO: 3813019 - DNA, 20 bp, Homo sapiens
gaagtttgagatcagcctgg

SEQ ID NO: 3813020 - DNA, 20 bp, Homo sapiens
gaataagtgccaggatggaa

SEQ ID NO: 3813021 - DNA, 17 bp, Homo sapiens
gaatacaattaaaggtc

SEQ ID NO: 3813022 - DNA, 15 bp, Homo sapiens
gaatataacatgtaa

SEQ ID NO: 3813023 - DNA, 17 bp, Homo sapiens
gaatataacatgtaaaa

SEQ ID NO: 3813024 - DNA, 20 bp, Homo sapiens
gaatcctaggctccacccca

SEQ ID NO: 3813025 - DNA, 17 bp, Homo sapiens
gaatctatatttaacaa

SEQ ID NO: 3813026 - DNA, 23 bp, Homo sapiens
gaatgaaatcctgcttcagtgta

SEQ ID NO: 3813027 - DNA, 14 bp, Homo sapiens
gaatgaattaaata

SEQ ID NO: 3813028 - DNA, 16 bp, Homo sapiens
gaatgaattaaataaa

SEQ ID NO: 3813029 - DNA, 13 bp, Homo sapiens
gaatgagcctcgg

SEQ ID NO: 3813030 - DNA, 13 bp, Homo sapiens
gaatgggaaaaga

SEQ ID NO: 3813031 - DNA, 19 bp, Homo sapiens
gaatgtcagtatgtggaag

SEQ ID NO: 3813032 - DNA, 13 bp, Homo sapiens
gaatgtcccagag

SEQ ID NO: 3813033 - DNA, 22 bp, Homo sapiens
gaatgttatgggatgtaaacaa

SEQ ID NO: 3813034 - DNA, 20 bp, Homo sapiens
gaattacactcaaggaaaag

SEQ ID NO: 3813035 - DNA, 18 bp, Homo sapiens
gaattactgtatataaac

SEQ ID NO: 3813036 - DNA, 23 bp, Homo sapiens
gaattctaggcatcccaggggac

SEQ ID NO: 3813037 - DNA, 12 bp, Homo sapiens
gaattcttctgg

SEQ ID NO: 3813038 - DNA, 20 bp, Homo sapiens
gcctcctgagtagctgggac

SEQ ID NO: 3813039 - DNA, 21 bp, Homo sapiens
gcctcctgagtagctgggact

SEQ ID NO: 3813040 - DNA, 21 bp, Homo sapiens
gcctccttcttaactctgcag

SEQ ID NO: 3813041 - DNA, 15 bp, Homo sapiens
gcctctagaacaccc

SEQ ID NO: 3813042 - DNA, 19 bp, Homo sapiens
gcctctccccgctctggat

SEQ ID NO: 3813043 - DNA, 12 bp, Homo sapiens
gcctctccctta

SEQ ID NO: 3813044 - DNA, 12 bp, Homo sapiens
gcctcttctcta

SEQ ID NO: 3813045 - DNA, 20 bp, Homo sapiens
gcctgacactgagccccacc

SEQ ID NO: 3813046 - DNA, 19 bp, Homo sapiens
gcctgccccagcctcccag

SEQ ID NO: 3813047 - DNA, 16 bp, Homo sapiens
gcctgctccagctgtt

SEQ ID NO: 3813048 - DNA, 17 bp, Homo sapiens
gcctggaccagcctctc

SEQ ID NO: 3813049 - DNA, 16 bp, Homo sapiens
gcctgggaccagggca

SEQ ID NO: 3813050 - DNA, 21 bp, Homo sapiens
gcctgggaggtcaaggctgca

SEQ ID NO: 3813051 - DNA, 22 bp, Homo sapiens
gcctgggaggtcaaggctgcag

SEQ ID NO: 3813052 - DNA, 15 bp, Homo sapiens
gcctgtaatcctagc

SEQ ID NO: 3813053 - DNA, 20 bp, Homo sapiens
gcctgtaatcctagcacttt

SEQ ID NO: 3813054 - DNA, 19 bp, Homo sapiens
gccttaaggccacactggc

SEQ ID NO: 3813055 - DNA, 16 bp, Homo sapiens
gccttccctccccaca

SEQ ID NO: 3813056 - DNA, 13 bp, Homo sapiens
gccttgctgtaga

SEQ ID NO: 3813057 - DNA, 15 bp, Homo sapiens
gccttgctgtagaga

SEQ ID NO: 3813058 - DNA, 18 bp, Homo sapiens
gccttgctgtagagactt

SEQ ID NO: 3813059 - DNA, 23 bp, Homo sapiens
gcgaaaccccgtctctactaaac

SEQ ID NO: 3813060 - DNA, 12 bp, Homo sapiens
gcgacagagcaa

SEQ ID NO: 3813061 - DNA, 16 bp, Homo sapiens
gcgaccagggccatct

SEQ ID NO: 3813062 - DNA, 18 bp, Homo sapiens
gcgcacaaggctgaccaa

SEQ ID NO: 3813063 - DNA, 18 bp, Homo sapiens
gcgcggctgggaggaggg

SEQ ID NO: 3813064 - DNA, 13 bp, Homo sapiens
gcggctgggagga

SEQ ID NO: 3813065 - DNA, 14 bp, Homo sapiens
gcggctgggaggag

SEQ ID NO: 3813066 - DNA, 17 bp, Homo sapiens
gcggctgggaggagggc

SEQ ID NO: 3813067 - DNA, 14 bp, Homo sapiens
gcgtgctacctgca

SEQ ID NO: 3813068 - DNA, 17 bp, Homo sapiens
gctaagatactgctgat

SEQ ID NO: 3813069 - DNA, 15 bp, Homo sapiens
gctaagctaggaatg

SEQ ID NO: 3813070 - DNA, 20 bp, Homo sapiens
gctaatttatcctgaaattt

SEQ ID NO: 3813071 - DNA, 12 bp, Homo sapiens
gctacaataaat

SEQ ID NO: 3813072 - DNA, 13 bp, Homo sapiens
gctacaataaatg

SEQ ID NO: 3813073 - DNA, 14 bp, Homo sapiens
gctacaataaatgc

SEQ ID NO: 3813074 - DNA, 20 bp, Homo sapiens
gctacccctcgactcagcac

SEQ ID NO: 3813075 - DNA, 23 bp, Homo sapiens
gctacccctcgactcagcaccac

SEQ ID NO: 3813076 - DNA, 22 bp, Homo sapiens
gctagcagcagggagggcttct

SEQ ID NO: 3813077 - DNA, 22 bp, Homo sapiens
gctagcattaccacttccctgc

SEQ ID NO: 3813078 - DNA, 12 bp, Homo sapiens
gctaggaatgaa

SEQ ID NO: 3813079 - DNA, 16 bp, Homo sapiens
gctagtctcttctcag

SEQ ID NO: 3813080 - DNA, 19 bp, Homo sapiens
gctagtctcttctcagagc

SEQ ID NO: 3813081 - DNA, 20 bp, Homo sapiens
gctagtctcttctcagagca

SEQ ID NO: 3813082 - DNA, 15 bp, Homo sapiens
gctataaagaaaaga

SEQ ID NO: 3813083 - DNA, 19 bp, Homo sapiens
gctatggggatagatgtgt

SEQ ID NO: 3813084 - DNA, 17 bp, Homo sapiens
gctattattttcactgt

SEQ ID NO: 3813085 - DNA, 18 bp, Homo sapiens
gctcactgcaagctctgc

SEQ ID NO: 3813086 - DNA, 17 bp, Homo sapiens
gctcagcaaaagatgct

SEQ ID NO: 3813087 - DNA, 13 bp, Homo sapiens
gctcaggagtttg

SEQ ID NO: 3813088 - DNA, 12 bp, Homo sapiens
gctccatgctgg

SEQ ID NO: 3813089 - DNA, 13 bp, Homo sapiens
gctccatgctggt

SEQ ID NO: 3813090 - DNA, 22 bp, Homo sapiens
gctccatgctggtgtggccaag

SEQ ID NO: 3813091 - DNA, 13 bp, Homo sapiens
gctcctgcatgca

SEQ ID NO: 3813092 - DNA, 15 bp, Homo sapiens
gctcctggcccactg

SEQ ID NO: 3813093 - DNA, 20 bp, Homo sapiens
gctcctggcccactgcatcg

SEQ ID NO: 3813094 - DNA, 14 bp, Homo sapiens
gctcctgtccctac

SEQ ID NO: 3813095 - DNA, 21 bp, Homo sapiens
gctcctgtccctacccactct

SEQ ID NO: 3813096 - DNA, 23 bp, Homo sapiens
gctctagattgagagaagagaca

SEQ ID NO: 3813097 - DNA, 19 bp, Homo sapiens
gctctcgggttgtgtgtct

SEQ ID NO: 3813098 - DNA, 22 bp, Homo sapiens
gctctgaggtcaataaagcaga

SEQ ID NO: 3813099 - DNA, 23 bp, Homo sapiens
gctctgcccccaactcccggagg

SEQ ID NO: 3813100 - DNA, 16 bp, Homo sapiens
gctctgcctcccgtgt

SEQ ID NO: 3813101 - DNA, 15 bp, Homo sapiens
gctctggatcctgca

SEQ ID NO: 3813102 - DNA, 14 bp, Homo sapiens
gctctgggattctg

SEQ ID NO: 3813103 - DNA, 18 bp, Homo sapiens
gctctttggtagaaaagg

SEQ ID NO: 3813104 - DNA, 22 bp, Homo sapiens
gctgaatacagaggcaactgca

SEQ ID NO: 3813105 - DNA, 15 bp, Homo sapiens
gctgacagagccaga

SEQ ID NO: 3813106 - DNA, 14 bp, Homo sapiens
gctgaccaagagag

SEQ ID NO: 3813107 - DNA, 20 bp, Homo sapiens
gctgaccaagagagaaagaa

SEQ ID NO: 3813108 - DNA, 20 bp, Homo sapiens
gctgaggatttcaagcctgc

SEQ ID NO: 3813109 - DNA, 14 bp, Homo sapiens
gctgaggcaccaga

SEQ ID NO: 3813110 - DNA, 15 bp, Homo sapiens
gctgaggtgggagga

SEQ ID NO: 3813111 - DNA, 17 bp, Homo sapiens
gctgatgcattcccggt

SEQ ID NO: 3813112 - DNA, 13 bp, Homo sapiens
gctgcaccctcag

SEQ ID NO: 3813113 - DNA, 18 bp, Homo sapiens
gctgcaccctcaggcagg

SEQ ID NO: 3813114 - DNA, 18 bp, Homo sapiens
gctgccctgtaccccagc

SEQ ID NO: 3813115 - DNA, 21 bp, Homo sapiens
gctgcctgacactgagcccca

SEQ ID NO: 3813116 - DNA, 14 bp, Homo sapiens
gctgccttgccatg

SEQ ID NO: 3813117 - DNA, 18 bp, Homo sapiens
gctggaagcactgctgtg

SEQ ID NO: 3813118 - DNA, 15 bp, Homo sapiens
gctggagtgcagtgg

SEQ ID NO: 3813119 - DNA, 20 bp, Homo sapiens
gctggagtgcagtggtgcga

SEQ ID NO: 3813120 - DNA, 20 bp, Homo sapiens
gctggcaatgccctacctgc

SEQ ID NO: 3813121 - DNA, 13 bp, Homo sapiens
gctggccacagaa

SEQ ID NO: 3813122 - DNA, 22 bp, Homo sapiens
gctgggcttggcagcccgggtc

SEQ ID NO: 3813123 - DNA, 15 bp, Homo sapiens
gctgggtgagctgag

SEQ ID NO: 3813124 - DNA, 16 bp, Homo sapiens
gctggtctcgaactcc

SEQ ID NO: 3813125 - DNA, 18 bp, Homo sapiens
gctggtctcgaactcctg

SEQ ID NO: 3813126 - DNA, 14 bp, Homo sapiens
gctggttagaaatg

SEQ ID NO: 3813127 - DNA, 21 bp, Homo sapiens
gctgtagaactctgcaggcag

SEQ ID NO: 3813128 - DNA, 12 bp, Homo sapiens
gctgtagagact

SEQ ID NO: 3813129 - DNA, 20 bp, Homo sapiens
gctgtggcctaacctgccga

SEQ ID NO: 3813130 - DNA, 21 bp, Homo sapiens
gctgttacctgagatactgaa

SEQ ID NO: 3813131 - DNA, 13 bp, Homo sapiens
gctgttcagctgg

SEQ ID NO: 3813132 - DNA, 22 bp, Homo sapiens
gcttatgacatcacttgtacaa

SEQ ID NO: 3813133 - DNA, 15 bp, Homo sapiens
gcttcacggaagagc

SEQ ID NO: 3813134 - DNA, 20 bp, Homo sapiens
gcttcacggaagagccttgc

SEQ ID NO: 3813135 - DNA, 18 bp, Homo sapiens
gcttcatgaaaatcctac

SEQ ID NO: 3813136 - DNA, 12 bp, Homo sapiens
gcttccaatttt

SEQ ID NO: 3813137 - DNA, 14 bp, Homo sapiens
gcttccctgggcct

SEQ ID NO: 3813138 - DNA, 18 bp, Homo sapiens
gcttccctggggccccat

SEQ ID NO: 3813139 - DNA, 14 bp, Homo sapiens
gcttccgtatttta

SEQ ID NO: 3813140 - DNA, 17 bp, Homo sapiens
gcttctagttctgccag

SEQ ID NO: 3813141 - DNA, 20 bp, Homo sapiens
gcttctagttctgccaggag

SEQ ID NO: 3813142 - DNA, 14 bp, Homo sapiens
gcttgagctcagga

SEQ ID NO: 3813143 - DNA, 18 bp, Homo sapiens
gctttcagggcctccagc

SEQ ID NO: 3813144 - DNA, 12 bp, Homo sapiens
gctttctcagtg

SEQ ID NO: 3813145 - DNA, 12 bp, Homo sapiens
gctttctccttt

SEQ ID NO: 3813146 - DNA, 12 bp, Homo sapiens
ggaaaaccagac

SEQ ID NO: 3813147 - DNA, 23 bp, Homo sapiens
gttctggtatgaacttgaggaca

SEQ ID NO: 3813148 - DNA, 18 bp, Homo sapiens
gttgcagtgaactgagac

SEQ ID NO: 3813149 - DNA, 22 bp, Homo sapiens
gttgctgactactactctgcca

SEQ ID NO: 3813150 - DNA, 19 bp, Homo sapiens
gttggagccactctgttcc

SEQ ID NO: 3813151 - DNA, 14 bp, Homo sapiens
gttggcaaaaaggc

SEQ ID NO: 3813152 - DNA, 18 bp, Homo sapiens
gttggcaaaaaggcagga

SEQ ID NO: 3813153 - DNA, 16 bp, Homo sapiens
gttgggcgtgctacct

SEQ ID NO: 3813154 - DNA, 12 bp, Homo sapiens
gttgtcagctga

SEQ ID NO: 3813155 - DNA, 19 bp, Homo sapiens
gtttaaaaaaagtatatat

SEQ ID NO: 3813156 - DNA, 19 bp, Homo sapiens
gtttaaaagtccactttta

SEQ ID NO: 3813157 - DNA, 16 bp, Homo sapiens
gtttagaagaagtgtg

SEQ ID NO: 3813158 - DNA, 21 bp, Homo sapiens
gtttccaaagggcagtaaagt

SEQ ID NO: 3813159 - DNA, 18 bp, Homo sapiens
gtttccattttttgttcc

SEQ ID NO: 3813160 - DNA, 22 bp, Homo sapiens
gtttccgtggcaaccctcagct

SEQ ID NO: 3813161 - DNA, 15 bp, Homo sapiens
gtttctgaagtactt

SEQ ID NO: 3813162 - DNA, 17 bp, Homo sapiens
gtttgagatcagcctgg

SEQ ID NO: 3813163 - DNA, 18 bp, Homo sapiens
gtttgagatcagcctggg

SEQ ID NO: 3813164 - DNA, 13 bp, Homo sapiens
gtttgtaagaaaa

SEQ ID NO: 3813165 - DNA, 16 bp, Homo sapiens
gttttactgcagcttt

SEQ ID NO: 3813166 - DNA, 18 bp, Homo sapiens
gttttactgcagctttgt

SEQ ID NO: 3813167 - DNA, 20 bp, Homo sapiens
gttttccaggtttaagctgt

SEQ ID NO: 3813168 - DNA, 16 bp, Homo sapiens
gttttctcctcccagg

SEQ ID NO: 3813169 - DNA, 19 bp, Homo sapiens
gttttctcttgagagggtg

SEQ ID NO: 3813170 - DNA, 18 bp, Homo sapiens
gtttttctaggcctgggg

SEQ ID NO: 3813171 - DNA, 15 bp, Homo sapiens
taaaaagtggaaaaa

SEQ ID NO: 3813172 - DNA, 13 bp, Homo sapiens
taaaacccaagtg

SEQ ID NO: 3813173 - DNA, 21 bp, Homo sapiens
taaaatatttgtctttaaaca

SEQ ID NO: 3813174 - DNA, 19 bp, Homo sapiens
taaaatctggcaaagttat

SEQ ID NO: 3813175 - DNA, 21 bp, Homo sapiens
taaaatctggcaaagttatat

SEQ ID NO: 3813176 - DNA, 21 bp, Homo sapiens
taaaatgaccagtaattgtga

SEQ ID NO: 3813177 - DNA, 17 bp, Homo sapiens
taaaattcttgggagtg

SEQ ID NO: 3813178 - DNA, 18 bp, Homo sapiens
taaacagcaactacagaa

SEQ ID NO: 3813179 - DNA, 23 bp, Homo sapiens
taaacagtgagcctgaattttgt

SEQ ID NO: 3813180 - DNA, 14 bp, Homo sapiens
taaactcaaaatat

SEQ ID NO: 3813181 - DNA, 22 bp, Homo sapiens
taaactcaaaatatttgtacat

SEQ ID NO: 3813182 - DNA, 23 bp, Homo sapiens
taaactcaaaatatttgtacata

SEQ ID NO: 3813183 - DNA, 13 bp, Homo sapiens
taaagcagagcca

SEQ ID NO: 3813184 - DNA, 19 bp, Homo sapiens
taaagcagagccaaggcca

SEQ ID NO: 3813185 - DNA, 22 bp, Homo sapiens
taaaggcttttggcagcaaagt

SEQ ID NO: 3813186 - DNA, 14 bp, Homo sapiens
taaagtcctgttta

SEQ ID NO: 3813187 - DNA, 23 bp, Homo sapiens
taaataaccaattcctcatttgt

SEQ ID NO: 3813188 - DNA, 16 bp, Homo sapiens
taaatacgttgttaaa

SEQ ID NO: 3813189 - DNA, 13 bp, Homo sapiens
taaatagggaaaa

SEQ ID NO: 3813190 - DNA, 19 bp, Homo sapiens
taaatagggaaaaaacatg

SEQ ID NO: 3813191 - DNA, 19 bp, Homo sapiens
taaatcagccgtgtaacca

SEQ ID NO: 3813192 - DNA, 16 bp, Homo sapiens
taaatgcataaatgca

SEQ ID NO: 3813193 - DNA, 14 bp, Homo sapiens
taaatgcattatag

SEQ ID NO: 3813194 - DNA, 14 bp, Homo sapiens
taaattacattaaa

SEQ ID NO: 3813195 - DNA, 13 bp, Homo sapiens
taaatttatgtga

SEQ ID NO: 3813196 - DNA, 15 bp, Homo sapiens
taacaagaggggaaa

SEQ ID NO: 3813197 - DNA, 21 bp, Homo sapiens
taacactcgactctgctgctc

SEQ ID NO: 3813198 - DNA, 13 bp, Homo sapiens
taacatgtaaaat

SEQ ID NO: 3813199 - DNA, 17 bp, Homo sapiens
taaccaattcctcattt

SEQ ID NO: 3813200 - DNA, 15 bp, Homo sapiens
taactctgcaggaaa

SEQ ID NO: 3813201 - DNA, 22 bp, Homo sapiens
taacttaaaagaacatgtatat

SEQ ID NO: 3813202 - DNA, 16 bp, Homo sapiens
taactttctgaaataa

SEQ ID NO: 3813203 - DNA, 23 bp, Homo sapiens
taagaaaatgctagaagaaaaca

SEQ ID NO: 3813204 - DNA, 22 bp, Homo sapiens
taagatggcttatttgtataat

SEQ ID NO: 3813205 - DNA, 14 bp, Homo sapiens
taagattgctttaa

SEQ ID NO: 3813206 - DNA, 14 bp, Homo sapiens
taagctgtagaact

SEQ ID NO: 3813207 - DNA, 14 bp, Homo sapiens
taagctttctcctt

SEQ ID NO: 3813208 - DNA, 15 bp, Homo sapiens
taagctttctccttt

SEQ ID NO: 3813209 - DNA, 20 bp, Homo sapiens
taaggaagaggggtctttta

SEQ ID NO: 3813210 - DNA, 15 bp, Homo sapiens
taagtttctcatccc

SEQ ID NO: 3813211 - DNA, 16 bp, Homo sapiens
taataagtgctacttt

SEQ ID NO: 3813212 - DNA, 21 bp, Homo sapiens
taatatctgagaagtgtatat

SEQ ID NO: 3813213 - DNA, 19 bp, Homo sapiens
taatcaggtcctcagagaa

SEQ ID NO: 3813214 - DNA, 22 bp, Homo sapiens
taatctagaacacaggcaaaat

SEQ ID NO: 3813215 - DNA, 21 bp, Homo sapiens
taatctctttattaaaacagt

SEQ ID NO: 3813216 - DNA, 15 bp, Homo sapiens
taatctttaaactgg

SEQ ID NO: 3813217 - DNA, 17 bp, Homo sapiens
taatgaggtccctctag

SEQ ID NO: 3813218 - DNA, 17 bp, Homo sapiens
taatgatcaaaacatgc

SEQ ID NO: 3813219 - DNA, 15 bp, Homo sapiens
taattcagctcttga

SEQ ID NO: 3813220 - DNA, 19 bp, Homo sapiens
taattgatttcaagacctt

SEQ ID NO: 3813221 - DNA, 16 bp, Homo sapiens
taattgttgctaatct

SEQ ID NO: 3813222 - DNA, 16 bp, Homo sapiens
taatttaaaattgtga

SEQ ID NO: 3813223 - DNA, 20 bp, Homo sapiens
taatttaaaattgtgatgtg

SEQ ID NO: 3813224 - DNA, 20 bp, Homo sapiens
taatttactgattccagcaa

SEQ ID NO: 3813225 - DNA, 22 bp, Homo sapiens
taatttcagttctagttgattg

SEQ ID NO: 3813226 - DNA, 18 bp, Homo sapiens
taatttgaggacaaccat

SEQ ID NO: 3813227 - DNA, 22 bp, Homo sapiens
taatttgaggacaaccattcca

SEQ ID NO: 3813228 - DNA, 14 bp, Homo sapiens
taattttaaacaaa

SEQ ID NO: 3813229 - DNA, 17 bp, Homo sapiens
taattttatttataaac

SEQ ID NO: 3813230 - DNA, 18 bp, Homo sapiens
taattttatttataaact

SEQ ID NO: 3813231 - DNA, 16 bp, Homo sapiens
tacaaaaacatggcct

SEQ ID NO: 3813232 - DNA, 20 bp, Homo sapiens
tacaaaaagcataaaaatta

SEQ ID NO: 3813233 - DNA, 12 bp, Homo sapiens
tacaattaaagg

SEQ ID NO: 3813234 - DNA, 15 bp, Homo sapiens
tacacagctctagac

SEQ ID NO: 3813235 - DNA, 15 bp, Homo sapiens
tacacatatatgtat

SEQ ID NO: 3813236 - DNA, 14 bp, Homo sapiens
tacagaggacagta

SEQ ID NO: 3813237 - DNA, 15 bp, Homo sapiens
tacaggtgtgagcca

SEQ ID NO: 3813238 - DNA, 17 bp, Homo sapiens
tacagttgaaaaacagc

SEQ ID NO: 3813239 - DNA, 19 bp, Homo sapiens
tacagttgaaaaacagctg

SEQ ID NO: 3813240 - DNA, 20 bp, Homo sapiens
tacagttgaaaaacagctga

SEQ ID NO: 3813241 - DNA, 12 bp, Homo sapiens
tacatgaaacag

SEQ ID NO: 3813242 - DNA, 13 bp, Homo sapiens
tacatgaaacaga

SEQ ID NO: 3813243 - DNA, 14 bp, Homo sapiens
tacatgaaacagaa

SEQ ID NO: 3813244 - DNA, 21 bp, Homo sapiens
tacattaaaatagcacatgat

SEQ ID NO: 3813245 - DNA, 18 bp, Homo sapiens
tacattaaagatttctgc

SEQ ID NO: 3813246 - DNA, 19 bp, Homo sapiens
tacattaaagatttctgct

SEQ ID NO: 3813247 - DNA, 13 bp, Homo sapiens
tacattatgttat

SEQ ID NO: 3813248 - DNA, 14 bp, Homo sapiens
tacattatgttatt

SEQ ID NO: 3813249 - DNA, 15 bp, Homo sapiens
tacattatgttattg

SEQ ID NO: 3813250 - DNA, 22 bp, Homo sapiens
tacattctaatttgcattgtgt

SEQ ID NO: 3813251 - DNA, 13 bp, Homo sapiens
taccacttccctg

SEQ ID NO: 3813252 - DNA, 17 bp, Homo sapiens
taccacttccctgcttt

SEQ ID NO: 3813253 - DNA, 21 bp, Homo sapiens
taccagggtgagttaaagaga

SEQ ID NO: 3813254 - DNA, 17 bp, Homo sapiens
taccatcccctgtagag

SEQ ID NO: 3813255 - DNA, 22 bp, Homo sapiens
tgaacttgaggacacatgtcca

SEQ ID NO: 3813256 - DNA, 22 bp, Homo sapiens
tgaagaactggcatcttaaatc

SEQ ID NO: 3813257 - DNA, 16 bp, Homo sapiens
tgaagaggaaaatgaa

SEQ ID NO: 3813258 - DNA, 16 bp, Homo sapiens
tgaagagtgagagggc

SEQ ID NO: 3813259 - DNA, 15 bp, Homo sapiens
tgaagctggaagcac

SEQ ID NO: 3813260 - DNA, 20 bp, Homo sapiens
tgaagtacttaaacttccac

SEQ ID NO: 3813261 - DNA, 23 bp, Homo sapiens
tgaatgatgatcctaggcatttg

SEQ ID NO: 3813262 - DNA, 14 bp, Homo sapiens
tgaatgggaaaaga

SEQ ID NO: 3813263 - DNA, 18 bp, Homo sapiens
tgaatgggaaaagagatg

SEQ ID NO: 3813264 - DNA, 18 bp, Homo sapiens
tgacaacttttaaagaaa

SEQ ID NO: 3813265 - DNA, 16 bp, Homo sapiens
tgacacggccatgacc

SEQ ID NO: 3813266 - DNA, 13 bp, Homo sapiens
tgacactgagccc

SEQ ID NO: 3813267 - DNA, 15 bp, Homo sapiens
tgacactgagcccca

SEQ ID NO: 3813268 - DNA, 15 bp, Homo sapiens
tgacagagccagagg

SEQ ID NO: 3813269 - DNA, 16 bp, Homo sapiens
tgacatcacttgtaca

SEQ ID NO: 3813270 - DNA, 23 bp, Homo sapiens
tgacatcacttgtacaaaataaa

SEQ ID NO: 3813271 - DNA, 15 bp, Homo sapiens
tgaccaagagagaaa

SEQ ID NO: 3813272 - DNA, 17 bp, Homo sapiens
tgaccaagagagaaaga

SEQ ID NO: 3813273 - DNA, 20 bp, Homo sapiens
tgaccagggcagtgaaaatg

SEQ ID NO: 3813274 - DNA, 22 bp, Homo sapiens
tgacccggctgggtcggccctg

SEQ ID NO: 3813275 - DNA, 19 bp, Homo sapiens
tgacctaggcaagtttgtt

SEQ ID NO: 3813276 - DNA, 24 bp, Homo sapiens
tgacctcgtgatttgcctgcctgg

SEQ ID NO: 3813277 - DNA, 15 bp, Homo sapiens
tgacctctataaact

SEQ ID NO: 3813278 - DNA, 15 bp, Homo sapiens
tgaccttctccaggg

SEQ ID NO: 3813279 - DNA, 14 bp, Homo sapiens
tgactaaaatattt

SEQ ID NO: 3813280 - DNA, 18 bp, Homo sapiens
tgactactactctgccaa

SEQ ID NO: 3813281 - DNA, 20 bp, Homo sapiens
tgactatggctctggcacca

SEQ ID NO: 3813282 - DNA, 22 bp, Homo sapiens
tgactccatgtgtgctgtcctc

SEQ ID NO: 3813283 - DNA, 19 bp, Homo sapiens
tgactctttccaaccggct

SEQ ID NO: 3813284 - DNA, 11 bp, Homo sapiens
tgacttgcctg

SEQ ID NO: 3813285 - DNA, 22 bp, Homo sapiens
tgacttttctgtccgagctttg

SEQ ID NO: 3813286 - DNA, 20 bp, Homo sapiens
tgagaagcagaggaaggaga

SEQ ID NO: 3813287 - DNA, 14 bp, Homo sapiens
tgagaccaacctgg

SEQ ID NO: 3813288 - DNA, 20 bp, Homo sapiens
tgagactagattctcacctg

SEQ ID NO: 3813289 - DNA, 14 bp, Homo sapiens
tgagagttccagat

SEQ ID NO: 3813290 - DNA, 23 bp, Homo sapiens
tgagatggagtctcgctctgctg

SEQ ID NO: 3813291 - DNA, 19 bp, Homo sapiens
tgagccccacctctccaag

SEQ ID NO: 3813292 - DNA, 14 bp, Homo sapiens
tgagcctgggaggt

SEQ ID NO: 3813293 - DNA, 19 bp, Homo sapiens
tgagcctgggaggtcaagg

SEQ ID NO: 3813294 - DNA, 11 bp, Homo sapiens
tgagctcagga

SEQ ID NO: 3813295 - DNA, 13 bp, Homo sapiens
tgaggaattttct

SEQ ID NO: 3813296 - DNA, 18 bp, Homo sapiens
tgaggaattttctttgtg

SEQ ID NO: 3813297 - DNA, 13 bp, Homo sapiens
tgaggacacatgt

SEQ ID NO: 3813298 - DNA, 14 bp, Homo sapiens
tgaggacacatgtc

SEQ ID NO: 3813299 - DNA, 17 bp, Homo sapiens
tgaggacatggagagag

SEQ ID NO: 3813300 - DNA, 19 bp, Homo sapiens
tgaggacatggagagagac

SEQ ID NO: 3813301 - DNA, 21 bp, Homo sapiens
tgaggacatggagagagactc

SEQ ID NO: 3813302 - DNA, 13 bp, Homo sapiens
tgaggatttcaag

SEQ ID NO: 3813303 - DNA, 16 bp, Homo sapiens
tgaggatttcaagcct

SEQ ID NO: 3813304 - DNA, 15 bp, Homo sapiens
tgaggccattatttc

SEQ ID NO: 3813305 - DNA, 19 bp, Homo sapiens
tgagggcagtggggagcat

SEQ ID NO: 3813306 - DNA, 20 bp, Homo sapiens
tgaggtgacttgcctggggc

SEQ ID NO: 3813307 - DNA, 22 bp, Homo sapiens
tgagtcaccctacctgtgcctg

SEQ ID NO: 3813308 - DNA, 14 bp, Homo sapiens
tgagtccagctccc

SEQ ID NO: 3813309 - DNA, 15 bp, Homo sapiens
tgagtccagctcccc

SEQ ID NO: 3813310 - DNA, 21 bp, Homo sapiens
tgagtgggggatcacagcctc

SEQ ID NO: 3813311 - DNA, 23 bp, Homo sapiens
tgagtgggggatcacagcctctg

SEQ ID NO: 3813312 - DNA, 21 bp, Homo sapiens
tgagtgggtgaataatacagt

SEQ ID NO: 3813313 - DNA, 13 bp, Homo sapiens
tgagttaaagaga

SEQ ID NO: 3813314 - DNA, 21 bp, Homo sapiens
tgagttaaagagaggccccgg

SEQ ID NO: 3813315 - DNA, 18 bp, Homo sapiens
tgataaaagattttccta

SEQ ID NO: 3813316 - DNA, 15 bp, Homo sapiens
tgataagtaatgaaa

SEQ ID NO: 3813317 - DNA, 21 bp, Homo sapiens
tgatagaaggctatggggata

SEQ ID NO: 3813318 - DNA, 18 bp, Homo sapiens
tgatatagataacagatt

SEQ ID NO: 3813319 - DNA, 19 bp, Homo sapiens
tgatctcggctcactgcaa

SEQ ID NO: 3813320 - DNA, 15 bp, Homo sapiens
tgatctggacttcct

SEQ ID NO: 3813321 - DNA, 17 bp, Homo sapiens
tgatggcaattttgtaa

SEQ ID NO: 3813322 - DNA, 10 bp, Homo sapiens
tgatggctaa

SEQ ID NO: 3813323 - DNA, 20 bp, Homo sapiens
tgattaaccacttcagctga

SEQ ID NO: 3813324 - DNA, 19 bp, Homo sapiens
tgattcatgccaattagca

SEQ ID NO: 3813325 - DNA, 18 bp, Homo sapiens
tgattgcgagaattttca

SEQ ID NO: 3813326 - DNA, 15 bp, Homo sapiens
tgattttcattgctg

SEQ ID NO: 3813327 - DNA, 18 bp, Homo sapiens
tgatttttatgccacctg

SEQ ID NO: 3813328 - DNA, 21 bp, Homo sapiens
tgcaaatgctatgagatgcat

SEQ ID NO: 3813329 - DNA, 23 bp, Homo sapiens
tgcaaccctggtgtgctgggcga

SEQ ID NO: 3813330 - DNA, 16 bp, Homo sapiens
tgcaaggtctttggtt

SEQ ID NO: 3813331 - DNA, 22 bp, Homo sapiens
tgcaatggcacgatctcagctc

SEQ ID NO: 3813332 - DNA, 21 bp, Homo sapiens
tgcacaaatatttattttctt

SEQ ID NO: 3813333 - DNA, 18 bp, Homo sapiens
tgcacaagctgcaccctc

SEQ ID NO: 3813334 - DNA, 21 bp, Homo sapiens
tgcacaagctgcaccctcagg

SEQ ID NO: 3813335 - DNA, 16 bp, Homo sapiens
tgcacacacacagaga

SEQ ID NO: 3813336 - DNA, 18 bp, Homo sapiens
tgcacacacagatgcaca

SEQ ID NO: 3813337 - DNA, 21 bp, Homo sapiens
tgcacacacatggatgagcac

SEQ ID NO: 3813338 - DNA, 15 bp, Homo sapiens
tgcacacggatgcac

SEQ ID NO: 3813339 - DNA, 16 bp, Homo sapiens
tgcacacggatgcaca

SEQ ID NO: 3813340 - DNA, 12 bp, Homo sapiens
tgcacatccctg

SEQ ID NO: 3813341 - DNA, 16 bp, Homo sapiens
tgcaccctcaggcagg

SEQ ID NO: 3813342 - DNA, 22 bp, Homo sapiens
tgcaccggggcctgggcaggag

SEQ ID NO: 3813343 - DNA, 19 bp, Homo sapiens
tgcactggtcccaagtagt

SEQ ID NO: 3813344 - DNA, 22 bp, Homo sapiens
tgcacttatttatgaacctgcc

SEQ ID NO: 3813345 - DNA, 19 bp, Homo sapiens
tgcaggaaatcagagctgg

SEQ ID NO: 3813346 - DNA, 14 bp, Homo sapiens
tgcagtgagccgag

SEQ ID NO: 3813347 - DNA, 19 bp, Homo sapiens
tgcagttaatggggtagag

SEQ ID NO: 3813348 - DNA, 14 bp, Homo sapiens
tgcatgcaactaat

SEQ ID NO: 3813349 - DNA, 23 bp, Homo sapiens
tgcatgcaactaattcaataaaa

SEQ ID NO: 3813350 - DNA, 21 bp, Homo sapiens
tgcattcacagcgcctcctgg

SEQ ID NO: 3813351 - DNA, 23 bp, Homo sapiens
tgcattgtgtcagaaacatgaaa

SEQ ID NO: 3813352 - DNA, 11 bp, Homo sapiens
tgccacctgtc

SEQ ID NO: 3813353 - DNA, 14 bp, Homo sapiens
tgccacctgtctgt

SEQ ID NO: 3813354 - DNA, 23 bp, Homo sapiens
tgccactgaccgggatccagttc

SEQ ID NO: 3813355 - DNA, 21 bp, Homo sapiens
tgccattaaatagggaaaaaa

SEQ ID NO: 3813356 - DNA, 18 bp, Homo sapiens
tgccattgtatttcttca

SEQ ID NO: 3813357 - DNA, 18 bp, Homo sapiens
tgcccaagggcctcccac

SEQ ID NO: 3813358 - DNA, 22 bp, Homo sapiens
tgcccaagggcctcccaccaga

SEQ ID NO: 3813359 - DNA, 14 bp, Homo sapiens
tgcccagcctgccc

SEQ ID NO: 3813360 - DNA, 20 bp, Homo sapiens
tgcccaggctagagtgcagt

SEQ ID NO: 3813361 - DNA, 20 bp, Homo sapiens
tgcccaggctggagtgcaat

SEQ ID NO: 3813362 - DNA, 20 bp, Homo sapiens
tgcccaggctggagtgcagt

SEQ ID NO: 3813363 - DNA, 20 bp, Homo sapiens
ttgcccaggctggagtgcag

SEQ ID NO: 3813364 - DNA, 20 bp, Homo sapiens
ttgcctgcctgggcctccca

SEQ ID NO: 3813365 - DNA, 12 bp, Homo sapiens
ttgcctggggcc

SEQ ID NO: 3813366 - DNA, 20 bp, Homo sapiens
ttgcctggggccacatagct

SEQ ID NO: 3813367 - DNA, 14 bp, Homo sapiens
ttgctacaataaat

SEQ ID NO: 3813368 - DNA, 17 bp, Homo sapiens
ttgctacaataaatgct

SEQ ID NO: 3813369 - DNA, 20 bp, Homo sapiens
ttgctcacactacttgagaa

SEQ ID NO: 3813370 - DNA, 15 bp, Homo sapiens
ttgctctaatgatca

SEQ ID NO: 3813371 - DNA, 12 bp, Homo sapiens
ttgctcttctgt

SEQ ID NO: 3813372 - DNA, 19 bp, Homo sapiens
ttgctgaatacagaggcaa

SEQ ID NO: 3813373 - DNA, 20 bp, Homo sapiens
ttgctgactactactctgcc

SEQ ID NO: 3813374 - DNA, 14 bp, Homo sapiens
ttgctgcttgaggc

SEQ ID NO: 3813375 - DNA, 16 bp, Homo sapiens
ttgctgcttgaggcaa

SEQ ID NO: 3813376 - DNA, 12 bp, Homo sapiens
ttgctgtagaga

SEQ ID NO: 3813377 - DNA, 14 bp, Homo sapiens
ttgctgtagagact

SEQ ID NO: 3813378 - DNA, 13 bp, Homo sapiens
ttgctgttttgat

SEQ ID NO: 3813379 - DNA, 13 bp, Homo sapiens
ttgcttatgacat

SEQ ID NO: 3813380 - DNA, 16 bp, Homo sapiens
ttggcagctctactct

SEQ ID NO: 3813381 - DNA, 14 bp, Homo sapiens
ttggccagagctga

SEQ ID NO: 3813382 - DNA, 11 bp, Homo sapiens
ttggcctgcct

SEQ ID NO: 3813383 - DNA, 19 bp, Homo sapiens
ttgggagcttgggaatgga

SEQ ID NO: 3813384 - DNA, 12 bp, Homo sapiens
ttggtagagttt

SEQ ID NO: 3813385 - DNA, 18 bp, Homo sapiens
ttgtaaaagtctagttac

SEQ ID NO: 3813386 - DNA, 16 bp, Homo sapiens
ttgtaaactcaaaata

SEQ ID NO: 3813387 - DNA, 22 bp, Homo sapiens
ttgtaaactcaaaatatttgta

SEQ ID NO: 3813388 - DNA, 16 bp, Homo sapiens
ttgtacaaagatatgc

SEQ ID NO: 3813389 - DNA, 16 bp, Homo sapiens
ttgtacatagttattt

SEQ ID NO: 3813390 - DNA, 11 bp, Homo sapiens
ttgtacattat

SEQ ID NO: 3813391 - DNA, 20 bp, Homo sapiens
ttgtacattatgttattgga

SEQ ID NO: 3813392 - DNA, 18 bp, Homo sapiens
ttgtccctgaagagaagg

SEQ ID NO: 3813393 - DNA, 15 bp, Homo sapiens
ttgtcttaaaaagtg

SEQ ID NO: 3813394 - DNA, 17 bp, Homo sapiens
ttgtcttccaaccccag

SEQ ID NO: 3813395 - DNA, 19 bp, Homo sapiens
ttgtcttccaaccccagct

SEQ ID NO: 3813396 - DNA, 14 bp, Homo sapiens
ttgtctttaaacag

SEQ ID NO: 3813397 - DNA, 20 bp, Homo sapiens
ttgtgaaattcaacctgtgt

SEQ ID NO: 3813398 - DNA, 13 bp, Homo sapiens
ttgtgtgtgggag

SEQ ID NO: 3813399 - DNA, 13 bp, Homo sapiens
ttgttggaatgaa

SEQ ID NO: 3813400 - DNA, 23 bp, Homo sapiens
ttgtttaaaactcagaatataac

SEQ ID NO: 3813401 - DNA, 18 bp, Homo sapiens
ttgtttagaagaagtgtg

SEQ ID NO: 3813402 - DNA, 14 bp, Homo sapiens
tttaaaagtccact

SEQ ID NO: 3813403 - DNA, 14 bp, Homo sapiens
tttaaaatatttgt

SEQ ID NO: 3813404 - DNA, 16 bp, Homo sapiens
tttaaaattgtgatgt

SEQ ID NO: 3813405 - DNA, 14 bp, Homo sapiens
tttaagggggaaaa

SEQ ID NO: 3813406 - DNA, 15 bp, Homo sapiens
tttactgacagaaat

SEQ ID NO: 3813407 - DNA, 18 bp, Homo sapiens
tttacttttaaacagtga

SEQ ID NO: 3813408 - DNA, 22 bp, Homo sapiens
tttagttttaaaagtctatgat

SEQ ID NO: 3813409 - DNA, 15 bp, Homo sapiens
tttatgatgctattt

SEQ ID NO: 3813410 - DNA, 12 bp, Homo sapiens
tttatgtgatgg

SEQ ID NO: 3813411 - DNA, 13 bp, Homo sapiens
tttatgtgtgtgt

SEQ ID NO: 3813412 - DNA, 13 bp, Homo sapiens
tttattgaagaac

SEQ ID NO: 3813413 - DNA, 19 bp, Homo sapiens
tttatttagttccttgagt

SEQ ID NO: 3813414 - DNA, 18 bp, Homo sapiens
tttatttccacataaagg

SEQ ID NO: 3813415 - DNA, 13 bp, Homo sapiens
tttatttctgaag

SEQ ID NO: 3813416 - DNA, 20 bp, Homo sapiens
tttatttttttgatggctaa

SEQ ID NO: 3813417 - DNA, 17 bp, Homo sapiens
tttcaaagctttttcca

SEQ ID NO: 3813418 - DNA, 18 bp, Homo sapiens
tttcaaccgcttgccata

SEQ ID NO: 3813419 - DNA, 16 bp, Homo sapiens
tttcaagtaataaaac

SEQ ID NO: 3813420 - DNA, 18 bp, Homo sapiens
tttcaagtaataaaacaa

SEQ ID NO: 3813421 - DNA, 18 bp, Homo sapiens
tttcaataaatttctgct

SEQ ID NO: 3813422 - DNA, 23 bp, Homo sapiens
tttcagaattgaaggagaaaatg

SEQ ID NO: 3813423 - DNA, 23 bp, Homo sapiens
tttcagctattagcaactgtgct

SEQ ID NO: 3813424 - DNA, 21 bp, Homo sapiens
tttcaggggtcgtcaccacct

SEQ ID NO: 3813425 - DNA, 19 bp, Homo sapiens
tttcatgctatctctgtgt

SEQ ID NO: 3813426 - DNA, 19 bp, Homo sapiens
tttccagaggctattattt

SEQ ID NO: 3813427 - DNA, 19 bp, Homo sapiens
tttccaggtttaagctgtt

SEQ ID NO: 3813428 - DNA, 23 bp, Homo sapiens
tttccatgcaccctcatacacag

SEQ ID NO: 3813429 - DNA, 22 bp, Homo sapiens
tttcctcttctattttgtaaac

SEQ ID NO: 3813430 - DNA, 16 bp, Homo sapiens
tttccttttttgttat

SEQ ID NO: 3813431 - DNA, 19 bp, Homo sapiens
tttctaaagctctgaacaa

SEQ ID NO: 3813432 - DNA, 15 bp, Homo sapiens
tttctcctcccagga

SEQ ID NO: 3813433 - DNA, 14 bp, Homo sapiens
tttctgaaataaca

SEQ ID NO: 3813434 - DNA, 20 bp, Homo sapiens
tttctggaatacatgaaata

SEQ ID NO: 3813435 - DNA, 17 bp, Homo sapiens
tttctttcatacattat

SEQ ID NO: 3813436 - DNA, 23 bp, Homo sapiens
tttgacctgttgggagtgaggat

SEQ ID NO: 3813437 - DNA, 17 bp, Homo sapiens
tttgagatcagcctggg

SEQ ID NO: 3813438 - DNA, 22 bp, Homo sapiens
tttgcaacaagacaaagcaaag

SEQ ID NO: 3813439 - DNA, 18 bp, Homo sapiens
tttgcaggcccagcagac

SEQ ID NO: 3813440 - DNA, 22 bp, Homo sapiens
tttgcctgcctgggcctcccaa

SEQ ID NO: 3813441 - DNA, 17 bp, Homo sapiens
tttgctacaataaatgc

SEQ ID NO: 3813442 - DNA, 22 bp, Homo sapiens
tttgctacaataaatgctgaat

SEQ ID NO: 3813443 - DNA, 19 bp, Homo sapiens
tttgctcttctgtatgtga

SEQ ID NO: 3813444 - DNA, 19 bp, Homo sapiens
tttgctggggccgaaagaa

SEQ ID NO: 3813445 - DNA, 22 bp, Homo sapiens
tttgctggggccgaaagaacag

SEQ ID NO: 3813446 - DNA, 16 bp, Homo sapiens
tttgcttgaaagaaaa

SEQ ID NO: 3813447 - DNA, 11 bp, Homo sapiens
tttggaatgtg

SEQ ID NO: 3813448 - DNA, 17 bp, Homo sapiens
tttgggggcttccctgg

SEQ ID NO: 3813449 - DNA, 18 bp, Homo sapiens
tttgggtgccattaaata

SEQ ID NO: 3813450 - DNA, 16 bp, Homo sapiens
tttgtaaactcaaaat

SEQ ID NO: 3813451 - DNA, 22 bp, Homo sapiens
tttgtaaactcaaaatatttgt

SEQ ID NO: 3813452 - DNA, 18 bp, Homo sapiens
tttgtaaattatttatgt

SEQ ID NO: 3813453 - DNA, 13 bp, Homo sapiens
tttgtacattatg

SEQ ID NO: 3813454 - DNA, 18 bp, Homo sapiens
tttgtacattatgttatt

SEQ ID NO: 3813455 - DNA, 12 bp, Homo sapiens
tttgtcccaggt

SEQ ID NO: 3813456 - DNA, 15 bp, Homo sapiens
tttgtctttaaacag

SEQ ID NO: 3813457 - DNA, 14 bp, Homo sapiens
tttgttcattaaac

SEQ ID NO: 3813458 - DNA, 21 bp, Homo sapiens
ttttaaaaaactgctgactgt

SEQ ID NO: 3813459 - DNA, 14 bp, Homo sapiens
ttttacaaattgtt

SEQ ID NO: 3813460 - DNA, 15 bp, Homo sapiens
ttttactgacagaaa

SEQ ID NO: 3813461 - DNA, 21 bp, Homo sapiens
ttttagaccctattgctgctt

SEQ ID NO: 3813462 - DNA, 17 bp, Homo sapiens
ttttatatgatggggga

SEQ ID NO: 3813463 - DNA, 19 bp, Homo sapiens
ttttatgtgaatgtggcaa

SEQ ID NO: 3813464 - DNA, 16 bp, Homo sapiens
ttttatttataaacta

SEQ ID NO: 3813465 - DNA, 17 bp, Homo sapiens
ttttatttccacataaa

SEQ ID NO: 3813466 - DNA, 21 bp, Homo sapiens
ttttatttttctcatgatgag

SEQ ID NO: 3813467 - DNA, 12 bp, Homo sapiens
ttttcaataaat

SEQ ID NO: 3813468 - DNA, 20 bp, Homo sapiens
ttttcaataaatttctgctt

SEQ ID NO: 3813469 - DNA, 19 bp, Homo sapiens
ttttcaccagatttgctaa

SEQ ID NO: 3813470 - DNA, 19 bp, Homo sapiens
ttttccaggtttaagctgt

SEQ ID NO: 3813471 - DNA, 18 bp, Homo sapiens
ttttccctattagagaag

SEQ ID NO: 3813472 - DNA, 15 bp, Homo sapiens
aaagaactgccccat

SEQ ID NO: 3813473 - DNA, 17 bp, Homo sapiens
aaagacattgaaagctc

SEQ ID NO: 3813474 - DNA, 14 bp, Homo sapiens
aaagagatacagag

SEQ ID NO: 3813475 - DNA, 14 bp, Homo sapiens
aaagatgcttctca

SEQ ID NO: 3813476 - DNA, 22 bp, Homo sapiens
aaagatgtgctcccaccaggca

SEQ ID NO: 3813477 - DNA, 15 bp, Homo sapiens
aaagattatatatca

SEQ ID NO: 3813478 - DNA, 16 bp, Homo sapiens
aaagctttggacaagt

SEQ ID NO: 3813479 - DNA, 19 bp, Homo sapiens
aaaggctaggtacacagct

SEQ ID NO: 3813480 - DNA, 13 bp, Homo sapiens
aaagtaagacatc

SEQ ID NO: 3813481 - DNA, 16 bp, Homo sapiens
aaagtaattttgtgaa

SEQ ID NO: 3813482 - DNA, 20 bp, Homo sapiens
aaagtcacatataaaagtta

SEQ ID NO: 3813483 - DNA, 15 bp, Homo sapiens
aaagtctagttacct

SEQ ID NO: 3813484 - DNA, 22 bp, Homo sapiens
aaagtctagttacctacttttt

SEQ ID NO: 3813485 - DNA, 13 bp, Homo sapiens
aaagtggaaaaat

SEQ ID NO: 3813486 - DNA, 20 bp, Homo sapiens
aaagttaaactacttgtaaa

SEQ ID NO: 3813487 - DNA, 21 bp, Homo sapiens
aaagttcccactccttcagga

SEQ ID NO: 3813488 - DNA, 15 bp, Homo sapiens
aaataaaatgaccag

SEQ ID NO: 3813489 - DNA, 21 bp, Homo sapiens
aaataaactagggttttggcc

SEQ ID NO: 3813490 - DNA, 17 bp, Homo sapiens
aaataacaatgtgctct

SEQ ID NO: 3813491 - DNA, 17 bp, Homo sapiens
aaataattgatttcaag

SEQ ID NO: 3813492 - DNA, 21 bp, Homo sapiens
aaatacgccagaactgcttta

SEQ ID NO: 3813493 - DNA, 15 bp, Homo sapiens
aaatagcaacatgct

SEQ ID NO: 3813494 - DNA, 16 bp, Homo sapiens
aaatagggaaaaaaca

SEQ ID NO: 3813495 - DNA, 22 bp, Homo sapiens
aaatatgatactctcagatttt

SEQ ID NO: 3813496 - DNA, 20 bp, Homo sapiens
aaatattcatatattatcaa

SEQ ID NO: 3813497 - DNA, 22 bp, Homo sapiens
aaatatttgtacatagttattt

SEQ ID NO: 3813498 - DNA, 15 bp, Homo sapiens
aaatcagagctggca

SEQ ID NO: 3813499 - DNA, 19 bp, Homo sapiens
aaatcagccgtgtaaccat

SEQ ID NO: 3813500 - DNA, 14 bp, Homo sapiens
aaatcagtcttgga

SEQ ID NO: 3813501 - DNA, 14 bp, Homo sapiens
aaatccagaaagaa

SEQ ID NO: 3813502 - DNA, 14 bp, Homo sapiens
aaatctatgccact

SEQ ID NO: 3813503 - DNA, 20 bp, Homo sapiens
aaatctatgccactcagaat

SEQ ID NO: 3813504 - DNA, 22 bp, Homo sapiens
aaatctggcaaagttatattta

SEQ ID NO: 3813505 - DNA, 19 bp, Homo sapiens
aaatgaccagtaattgtga

SEQ ID NO: 3813506 - DNA, 21 bp, Homo sapiens
aaatgaccagtaattgtgaaa

SEQ ID NO: 3813507 - DNA, 22 bp, Homo sapiens
aaatgagcattagctacttttc

SEQ ID NO: 3813508 - DNA, 13 bp, Homo sapiens
aaatgctgaatga

SEQ ID NO: 3813509 - DNA, 24 bp, Homo sapiens
aaatgctggatgagcaactcctgt

SEQ ID NO: 3813510 - DNA, 13 bp, Homo sapiens
aaatggccatttg

SEQ ID NO: 3813511 - DNA, 16 bp, Homo sapiens
aaatggccatttgctt

SEQ ID NO: 3813512 - DNA, 19 bp, Homo sapiens
aaatgtctagttgtaacac

SEQ ID NO: 3813513 - DNA, 19 bp, Homo sapiens
aaatgtgaatgggaaaaga

SEQ ID NO: 3813514 - DNA, 21 bp, Homo sapiens
aaatgttcagaaggttgctct

SEQ ID NO: 3813515 - DNA, 17 bp, Homo sapiens
aaatgttggaatgttat

SEQ ID NO: 3813516 - DNA, 22 bp, Homo sapiens
aaattacacccaaagaggtatt

SEQ ID NO: 3813517 - DNA, 15 bp, Homo sapiens
aaattgtgatgtgtc

SEQ ID NO: 3813518 - DNA, 13 bp, Homo sapiens
aacaaagaaaaga

SEQ ID NO: 3813519 - DNA, 16 bp, Homo sapiens
aacaagtaagaaaaat

SEQ ID NO: 3813520 - DNA, 12 bp, Homo sapiens
aacaagttgcct

SEQ ID NO: 3813521 - DNA, 11 bp, Homo sapiens
aacaatgaatg

SEQ ID NO: 3813522 - DNA, 14 bp, Homo sapiens
aacaatgtaaagta

SEQ ID NO: 3813523 - DNA, 18 bp, Homo sapiens
aacacagcaattcctcag

SEQ ID NO: 3813524 - DNA, 22 bp, Homo sapiens
aacacaggcaaaatccttgctt

SEQ ID NO: 3813525 - DNA, 13 bp, Homo sapiens
aacacccactggc

SEQ ID NO: 3813526 - DNA, 14 bp, Homo sapiens
aacactaaaaataa

SEQ ID NO: 3813527 - DNA, 14 bp, Homo sapiens
aacactaaaaccat

SEQ ID NO: 3813528 - DNA, 16 bp, Homo sapiens
aacagaaacaaaaaca

SEQ ID NO: 3813529 - DNA, 18 bp, Homo sapiens
aacagctcaagtcttccc

SEQ ID NO: 3813530 - DNA, 17 bp, Homo sapiens
aacagcttaaagagaaa

SEQ ID NO: 3813531 - DNA, 13 bp, Homo sapiens
aacaggctctgag

SEQ ID NO: 3813532 - DNA, 18 bp, Homo sapiens
aacataaataaaatgacc

SEQ ID NO: 3813533 - DNA, 13 bp, Homo sapiens
aacatgtaaaatc

SEQ ID NO: 3813534 - DNA, 17 bp, Homo sapiens
aacatttttgtacatta

SEQ ID NO: 3813535 - DNA, 15 bp, Homo sapiens
aaccacttcagctga

SEQ ID NO: 3813536 - DNA, 17 bp, Homo sapiens
aaccaggccccagcctc

SEQ ID NO: 3813537 - DNA, 12 bp, Homo sapiens
aaccccagctgg

SEQ ID NO: 3813538 - DNA, 13 bp, Homo sapiens
aaccccagctggc

SEQ ID NO: 3813539 - DNA, 15 bp, Homo sapiens
aaccccagctggcct

SEQ ID NO: 3813540 - DNA, 23 bp, Homo sapiens
aaccccagctggcctctagaaca

SEQ ID NO: 3813541 - DNA, 21 bp, Homo sapiens
aacccctacatgaaacagaaa

SEQ ID NO: 3813542 - DNA, 12 bp, Homo sapiens
aaccctcagctg

SEQ ID NO: 3813543 - DNA, 14 bp, Homo sapiens
aaccgcttgccata

SEQ ID NO: 3813544 - DNA, 22 bp, Homo sapiens
aacctactttcatactgaagat

SEQ ID NO: 3813545 - DNA, 22 bp, Homo sapiens
aacctgcccctccccagccctt

SEQ ID NO: 3813546 - DNA, 12 bp, Homo sapiens
aacgtcattcag

SEQ ID NO: 3813547 - DNA, 20 bp, Homo sapiens
aacgttttatgtgaatgtgg

SEQ ID NO: 3813548 - DNA, 18 bp, Homo sapiens
aactagggttttggcctg

SEQ ID NO: 3813549 - DNA, 16 bp, Homo sapiens
aactcaaaatatttgt

SEQ ID NO: 3813550 - DNA, 23 bp, Homo sapiens
aactcgatgaatgtgttgatttg

SEQ ID NO: 3813551 - DNA, 15 bp, Homo sapiens
aactgagaggtgagg

SEQ ID NO: 3813552 - DNA, 18 bp, Homo sapiens
aactgaggaattttcttt

SEQ ID NO: 3813553 - DNA, 20 bp, Homo sapiens
aactgaggaattttctttgt

SEQ ID NO: 3813554 - DNA, 19 bp, Homo sapiens
aactgttctctttaaaata

SEQ ID NO: 3813555 - DNA, 14 bp, Homo sapiens
aacttagaggaaaa

SEQ ID NO: 3813556 - DNA, 19 bp, Homo sapiens
aacttattgcctgggcagt

SEQ ID NO: 3813557 - DNA, 22 bp, Homo sapiens
aacttattgcctgggcagtgcc

SEQ ID NO: 3813558 - DNA, 23 bp, Homo sapiens
aacttattgcctgggcagtgccc

SEQ ID NO: 3813559 - DNA, 15 bp, Homo sapiens
aacttccacaagagt

SEQ ID NO: 3813560 - DNA, 12 bp, Homo sapiens
aacttgaggaca

SEQ ID NO: 3813561 - DNA, 15 bp, Homo sapiens
aacttgaggacacat

SEQ ID NO: 3813562 - DNA, 16 bp, Homo sapiens
aacttgaggacacatg

SEQ ID NO: 3813563 - DNA, 23 bp, Homo sapiens
aacttggaaaaatccagaaagaa

SEQ ID NO: 3813564 - DNA, 14 bp, Homo sapiens
aacttttaaagaaa

SEQ ID NO: 3813565 - DNA, 18 bp, Homo sapiens
aagaaaaagaaaaagaaa

SEQ ID NO: 3813566 - DNA, 23 bp, Homo sapiens
aagaaaagacattgaaagctcta

SEQ ID NO: 3813567 - DNA, 16 bp, Homo sapiens
aagaaaataccaagga

SEQ ID NO: 3813568 - DNA, 20 bp, Homo sapiens
aagaaactgaggaattttct

SEQ ID NO: 3813569 - DNA, 15 bp, Homo sapiens
aagaagctctctcct

SEQ ID NO: 3813570 - DNA, 14 bp, Homo sapiens
aagaataaaatact

SEQ ID NO: 3813571 - DNA, 14 bp, Homo sapiens
aagaatgaaatact

SEQ ID NO: 3813572 - DNA, 16 bp, Homo sapiens
aagaattgaagcagga

SEQ ID NO: 3813573 - DNA, 17 bp, Homo sapiens
aagacaaaggttttcct

SEQ ID NO: 3813574 - DNA, 20 bp, Homo sapiens
aagacaatgtgaaaagaaaa

SEQ ID NO: 3813575 - DNA, 23 bp, Homo sapiens
aagacagatactcctccaaggtt

SEQ ID NO: 3813576 - DNA, 20 bp, Homo sapiens
aagaccttctccccattctg

SEQ ID NO: 3813577 - DNA, 19 bp, Homo sapiens
aagagactaatagagacac

SEQ ID NO: 3813578 - DNA, 21 bp, Homo sapiens
aagagagaaagaagtaggcat

SEQ ID NO: 3813579 - DNA, 20 bp, Homo sapiens
aagagaggccccggctgggt

SEQ ID NO: 3813580 - DNA, 13 bp, Homo sapiens
aatgccaatctct

SEQ ID NO: 3813581 - DNA, 18 bp, Homo sapiens
acatgaaatgcttccaag

SEQ ID NO: 3813582 - DNA, 12 bp, Homo sapiens
acatgattttct

SEQ ID NO: 3813583 - DNA, 14 bp, Homo sapiens
acatgcttgaataa

SEQ ID NO: 3813584 - DNA, 20 bp, Homo sapiens
acattaaaatagcacatgat

SEQ ID NO: 3813585 - DNA, 20 bp, Homo sapiens
acattatgttattggaattt

SEQ ID NO: 3813586 - DNA, 14 bp, Homo sapiens
acattgaattagaa

SEQ ID NO: 3813587 - DNA, 12 bp, Homo sapiens
acattgcctcat

SEQ ID NO: 3813588 - DNA, 15 bp, Homo sapiens
acatttttgtacatt

SEQ ID NO: 3813589 - DNA, 21 bp, Homo sapiens
acatttttgtacattatgtta

SEQ ID NO: 3813590 - DNA, 21 bp, Homo sapiens
accaaatgagcattagctact

SEQ ID NO: 3813591 - DNA, 17 bp, Homo sapiens
accaattcctcatttgt

SEQ ID NO: 3813592 - DNA, 20 bp, Homo sapiens
accacaacctccacctcctg

SEQ ID NO: 3813593 - DNA, 21 bp, Homo sapiens
accacaacctccacctcctgg

SEQ ID NO: 3813594 - DNA, 15 bp, Homo sapiens
accacacctccctga

SEQ ID NO: 3813595 - DNA, 15 bp, Homo sapiens
accacttcagctgac

SEQ ID NO: 3813596 - DNA, 22 bp, Homo sapiens
accacttccctgcttttctccc

SEQ ID NO: 3813597 - DNA, 20 bp, Homo sapiens
accagaacaattatgtttct

SEQ ID NO: 3813598 - DNA, 11 bp, Homo sapiens
accagacaggt

SEQ ID NO: 3813599 - DNA, 21 bp, Homo sapiens
accagactacttgggagcacc

SEQ ID NO: 3813600 - DNA, 23 bp, Homo sapiens
accagactacttgggagcaccgc

SEQ ID NO: 3813601 - DNA, 15 bp, Homo sapiens
accagccctgctgct

SEQ ID NO: 3813602 - DNA, 16 bp, Homo sapiens
accagccctgctgctt

SEQ ID NO: 3813603 - DNA, 22 bp, Homo sapiens
accagccctgctgcttcctaac

SEQ ID NO: 3813604 - DNA, 16 bp, Homo sapiens
accagccgccccagcc

SEQ ID NO: 3813605 - DNA, 16 bp, Homo sapiens
accaggcagctccagc

SEQ ID NO: 3813606 - DNA, 17 bp, Homo sapiens
accaggccccagcctcc

SEQ ID NO: 3813607 - DNA, 21 bp, Homo sapiens
accattctcctgcctcagcct

SEQ ID NO: 3813608 - DNA, 12 bp, Homo sapiens
accattgtcttc

SEQ ID NO: 3813609 - DNA, 15 bp, Homo sapiens
accattgtcttccaa

SEQ ID NO: 3813610 - DNA, 16 bp, Homo sapiens
accattgtcttccaac

SEQ ID NO: 3813611 - DNA, 11 bp, Homo sapiens
accatttcaga

SEQ ID NO: 3813612 - DNA, 14 bp, Homo sapiens
accatttcagagag

SEQ ID NO: 3813613 - DNA, 13 bp, Homo sapiens
acccactggccag

SEQ ID NO: 3813614 - DNA, 19 bp, Homo sapiens
acccatcttcacgcctggg

SEQ ID NO: 3813615 - DNA, 21 bp, Homo sapiens
acccatcttcacgcctgggtg

SEQ ID NO: 3813616 - DNA, 15 bp, Homo sapiens
accccacaccccagc

SEQ ID NO: 3813617 - DNA, 19 bp, Homo sapiens
accccacaccccagcccac

SEQ ID NO: 3813618 - DNA, 20 bp, Homo sapiens
accccacaccccagcccacc

SEQ ID NO: 3813619 - DNA, 11 bp, Homo sapiens
accccagccca

SEQ ID NO: 3813620 - DNA, 13 bp, Homo sapiens
accccagctggcc

SEQ ID NO: 3813621 - DNA, 23 bp, Homo sapiens
accccagctggcctctagaacac

SEQ ID NO: 3813622 - DNA, 17 bp, Homo sapiens
accccatccagttcatg

SEQ ID NO: 3813623 - DNA, 21 bp, Homo sapiens
acccccaggattcccagagag

SEQ ID NO: 3813624 - DNA, 14 bp, Homo sapiens
accccccaagctgt

SEQ ID NO: 3813625 - DNA, 20 bp, Homo sapiens
accccccctcctgctgccta

SEQ ID NO: 3813626 - DNA, 18 bp, Homo sapiens
acccctcgactcagcacc

SEQ ID NO: 3813627 - DNA, 13 bp, Homo sapiens
accctacctgtgc

SEQ ID NO: 3813628 - DNA, 14 bp, Homo sapiens
accctacttctttt

SEQ ID NO: 3813629 - DNA, 17 bp, Homo sapiens
accctcagctgcctcat

SEQ ID NO: 3813630 - DNA, 13 bp, Homo sapiens
accctcaggcagg

SEQ ID NO: 3813631 - DNA, 14 bp, Homo sapiens
accctcaggcaggt

SEQ ID NO: 3813632 - DNA, 18 bp, Homo sapiens
accctcatacacagaaac

SEQ ID NO: 3813633 - DNA, 23 bp, Homo sapiens
accctccccgcaccccccaagct

SEQ ID NO: 3813634 - DNA, 18 bp, Homo sapiens
accctcgtggacacctgc

SEQ ID NO: 3813635 - DNA, 20 bp, Homo sapiens
accctcgtggacacctgccc

SEQ ID NO: 3813636 - DNA, 14 bp, Homo sapiens
accctgctcctcct

SEQ ID NO: 3813637 - DNA, 15 bp, Homo sapiens
accctgctcctcctg

SEQ ID NO: 3813638 - DNA, 19 bp, Homo sapiens
acccttggtagagtttatt

SEQ ID NO: 3813639 - DNA, 21 bp, Homo sapiens
acccttggtagagtttatttt

SEQ ID NO: 3813640 - DNA, 13 bp, Homo sapiens
accgaggcaggga

SEQ ID NO: 3813641 - DNA, 14 bp, Homo sapiens
accgggtctgcttc

SEQ ID NO: 3813642 - DNA, 20 bp, Homo sapiens
acctaataagtgctactttg

SEQ ID NO: 3813643 - DNA, 21 bp, Homo sapiens
acctaataagtgctactttgc

SEQ ID NO: 3813644 - DNA, 19 bp, Homo sapiens
acctccaaaagccctgagt

SEQ ID NO: 3813645 - DNA, 15 bp, Homo sapiens
acctccacctcctgg

SEQ ID NO: 3813646 - DNA, 15 bp, Homo sapiens
acctccctgaaccat

SEQ ID NO: 3813647 - DNA, 23 bp, Homo sapiens
acctcctgggtttaagcaatgct

SEQ ID NO: 3813648 - DNA, 17 bp, Homo sapiens
acctctgaatgtcccag

SEQ ID NO: 3813649 - DNA, 18 bp, Homo sapiens
acctctgaatgtcccaga

SEQ ID NO: 3813650 - DNA, 21 bp, Homo sapiens
acctctgaatgtcccagaggc

SEQ ID NO: 3813651 - DNA, 12 bp, Homo sapiens
acctctgcacaa

SEQ ID NO: 3813652 - DNA, 16 bp, Homo sapiens
acctctgcacaagctg

SEQ ID NO: 3813653 - DNA, 22 bp, Homo sapiens
acctgaaaagatgttgtgtctt

SEQ ID NO: 3813654 - DNA, 18 bp, Homo sapiens
acctgaataaagaatgaa

SEQ ID NO: 3813655 - DNA, 22 bp, Homo sapiens
acctgagatactgaagtgcagc

SEQ ID NO: 3813656 - DNA, 14 bp, Homo sapiens
acctgcccctcccc

SEQ ID NO: 3813657 - DNA, 13 bp, Homo sapiens
acctgccctgccc

SEQ ID NO: 3813658 - DNA, 16 bp, Homo sapiens
acctgccctgccctgc

SEQ ID NO: 3813659 - DNA, 22 bp, Homo sapiens
acctgccctgccctgccacctg

SEQ ID NO: 3813660 - DNA, 15 bp, Homo sapiens
accttcagatcctac

SEQ ID NO: 3813661 - DNA, 17 bp, Homo sapiens
accttctccccattctg

SEQ ID NO: 3813662 - DNA, 20 bp, Homo sapiens
accttttttatgatgctatt

SEQ ID NO: 3813663 - DNA, 13 bp, Homo sapiens
acgatctcagctc

SEQ ID NO: 3813664 - DNA, 22 bp, Homo sapiens
acgccagacttcccacggctcc

SEQ ID NO: 3813665 - DNA, 18 bp, Homo sapiens
acgccaggggaaaatcag

SEQ ID NO: 3813666 - DNA, 14 bp, Homo sapiens
acgctgatcattgg

SEQ ID NO: 3813667 - DNA, 15 bp, Homo sapiens
acggaagagccttgc

SEQ ID NO: 3813668 - DNA, 16 bp, Homo sapiens
acggaagagccttgcg

SEQ ID NO: 3813669 - DNA, 16 bp, Homo sapiens
acggcactgtggcctt

SEQ ID NO: 3813670 - DNA, 17 bp, Homo sapiens
acggttttactgcagct

SEQ ID NO: 3813671 - DNA, 22 bp, Homo sapiens
acgtagatttttgctcttctgt

SEQ ID NO: 3813672 - DNA, 21 bp, Homo sapiens
acgtgctcgcctctgcccagc

SEQ ID NO: 3813673 - DNA, 14 bp, Homo sapiens
actaaaatatttat

SEQ ID NO: 3813674 - DNA, 21 bp, Homo sapiens
actaacctggtattttaagag

SEQ ID NO: 3813675 - DNA, 21 bp, Homo sapiens
actaatagagacacagagatg

SEQ ID NO: 3813676 - DNA, 21 bp, Homo sapiens
actagaggaaaccagtttggt

SEQ ID NO: 3813677 - DNA, 14 bp, Homo sapiens
actagaggcaggga

SEQ ID NO: 3813678 - DNA, 13 bp, Homo sapiens
actaggtaaaatt

SEQ ID NO: 3813679 - DNA, 16 bp, Homo sapiens
actatcttggtgaatt

SEQ ID NO: 3813680 - DNA, 16 bp, Homo sapiens
actcaaactcttaaaa

SEQ ID NO: 3813681 - DNA, 22 bp, Homo sapiens
actcagaatataacatgtaaaa

SEQ ID NO: 3813682 - DNA, 23 bp, Homo sapiens
actcagaatataacatgtaaaat

SEQ ID NO: 3813683 - DNA, 21 bp, Homo sapiens
actcagcaccacattgcctca

SEQ ID NO: 3813684 - DNA, 22 bp, Homo sapiens
actcagcaccacattgcctcat

SEQ ID NO: 3813685 - DNA, 13 bp, Homo sapiens
actcagtctttaa

SEQ ID NO: 3813686 - DNA, 16 bp, Homo sapiens
actcatagggtgctct

SEQ ID NO: 3813687 - DNA, 14 bp, Homo sapiens
actccagcctgggc

SEQ ID NO: 3813688 - DNA, 16 bp, Homo sapiens
actccccccttccaaa

SEQ ID NO: 3813689 - DNA, 21 bp, Homo sapiens
agacaggcgctggacagaggg

SEQ ID NO: 3813690 - DNA, 14 bp, Homo sapiens
agacagttcaagaa

SEQ ID NO: 3813691 - DNA, 17 bp, Homo sapiens
agacattgaaagctcta

SEQ ID NO: 3813692 - DNA, 21 bp, Homo sapiens
agacatttgctatgagctggg

SEQ ID NO: 3813693 - DNA, 17 bp, Homo sapiens
agaccacctctcaatat

SEQ ID NO: 3813694 - DNA, 12 bp, Homo sapiens
agaccagcctgg

SEQ ID NO: 3813695 - DNA, 18 bp, Homo sapiens
agacggggtttccccatg

SEQ ID NO: 3813696 - DNA, 17 bp, Homo sapiens
agactagattctcacct

SEQ ID NO: 3813697 - DNA, 17 bp, Homo sapiens
ataagctcgagtgaatt

SEQ ID NO: 3813698 - DNA, 12 bp, Homo sapiens
ataagtaatgaa

SEQ ID NO: 3813699 - DNA, 19 bp, Homo sapiens
ataatacagtatctcaggg

SEQ ID NO: 3813700 - DNA, 12 bp, Homo sapiens
ataatagaagaa

SEQ ID NO: 3813701 - DNA, 21 bp, Homo sapiens
ataattttatttataaactag

SEQ ID NO: 3813702 - DNA, 13 bp, Homo sapiens
atacaattaaagg

SEQ ID NO: 3813703 - DNA, 22 bp, Homo sapiens
atacaattaaaggtcctgccct

SEQ ID NO: 3813704 - DNA, 22 bp, Homo sapiens
atacaatttctattatttttca

SEQ ID NO: 3813705 - DNA, 16 bp, Homo sapiens
atacagaggcaactgc

SEQ ID NO: 3813706 - DNA, 20 bp, Homo sapiens
atacgccagaactgctttat

SEQ ID NO: 3813707 - DNA, 15 bp, Homo sapiens
atagaaaagatgaga

SEQ ID NO: 3813708 - DNA, 20 bp, Homo sapiens
atagaagctataaagaaaag

SEQ ID NO: 3813709 - DNA, 19 bp, Homo sapiens
atagaaggctatggggata

SEQ ID NO: 3813710 - DNA, 14 bp, Homo sapiens
atagatgtgtggac

SEQ ID NO: 3813711 - DNA, 20 bp, Homo sapiens
atagctatattttatttctg

SEQ ID NO: 3813712 - DNA, 23 bp, Homo sapiens
atagctggtcttatttgtaaagc

SEQ ID NO: 3813713 - DNA, 17 bp, Homo sapiens
ataggataaattacatt

SEQ ID NO: 3813714 - DNA, 19 bp, Homo sapiens
ataggataaattacattaa

SEQ ID NO: 3813715 - DNA, 12 bp, Homo sapiens
ataggtttccac

SEQ ID NO: 3813716 - DNA, 14 bp, Homo sapiens
atatagagaataag

SEQ ID NO: 3813717 - DNA, 15 bp, Homo sapiens
atatagataacagat

SEQ ID NO: 3813718 - DNA, 23 bp, Homo sapiens
atatagatcagttataagtagca

SEQ ID NO: 3813719 - DNA, 15 bp, Homo sapiens
atatatcaaaacgtt

SEQ ID NO: 3813720 - DNA, 13 bp, Homo sapiens
atatatcataaag

SEQ ID NO: 3813721 - DNA, 14 bp, Homo sapiens
atatatcataaagt

SEQ ID NO: 3813722 - DNA, 13 bp, Homo sapiens
atatatgaggact

SEQ ID NO: 3813723 - DNA, 15 bp, Homo sapiens
atatatgtatatgta

SEQ ID NO: 3813724 - DNA, 20 bp, Homo sapiens
atatatgtatatgtatatct

SEQ ID NO: 3813725 - DNA, 23 bp, Homo sapiens
atatatgtatatgtatatctata

SEQ ID NO: 3813726 - DNA, 19 bp, Homo sapiens
atatattctacacatatat

SEQ ID NO: 3813727 - DNA, 13 bp, Homo sapiens
atatctatatctc

SEQ ID NO: 3813728 - DNA, 17 bp, Homo sapiens
atatctgagaagtgtat

SEQ ID NO: 3813729 - DNA, 20 bp, Homo sapiens
atatgatttaaatcagccgt

SEQ ID NO: 3813730 - DNA, 14 bp, Homo sapiens
atatgtatatctat

SEQ ID NO: 3813731 - DNA, 22 bp, Homo sapiens
atatgtatatctatatctctaa

SEQ ID NO: 3813732 - DNA, 16 bp, Homo sapiens
atatgtatatgtatat

SEQ ID NO: 3813733 - DNA, 19 bp, Homo sapiens
atattaggggggaaagtca

SEQ ID NO: 3813734 - DNA, 17 bp, Homo sapiens
atattcatatattatca

SEQ ID NO: 3813735 - DNA, 14 bp, Homo sapiens
atatttatttatgt

SEQ ID NO: 3813736 - DNA, 19 bp, Homo sapiens
atatttattttttttaagt

SEQ ID NO: 3813737 - DNA, 14 bp, Homo sapiens
atcaaaattctgtt

SEQ ID NO: 3813738 - DNA, 19 bp, Homo sapiens
atcaaagaggttttaaaaa

SEQ ID NO: 3813739 - DNA, 14 bp, Homo sapiens
atcacatttctatg

SEQ ID NO: 3813740 - DNA, 18 bp, Homo sapiens
atcacgatccagtctgca

SEQ ID NO: 3813741 - DNA, 14 bp, Homo sapiens
atcacttgtacaaa

SEQ ID NO: 3813742 - DNA, 18 bp, Homo sapiens
atcacttgtacaaaataa

SEQ ID NO: 3813743 - DNA, 22 bp, Homo sapiens
atcagagctggcagcctccagt

SEQ ID NO: 3813744 - DNA, 19 bp, Homo sapiens
atcagcctgctccagctgt

SEQ ID NO: 3813745 - DNA, 20 bp, Homo sapiens
atcagcctgctccagctgtt

SEQ ID NO: 3813746 - DNA, 14 bp, Homo sapiens
atcagcctgtgcca

SEQ ID NO: 3813747 - DNA, 13 bp, Homo sapiens
atcaggccattgt

SEQ ID NO: 3813748 - DNA, 12 bp, Homo sapiens
atcataaagtat

SEQ ID NO: 3813749 - DNA, 20 bp, Homo sapiens
atccaaagttgccacagatg

SEQ ID NO: 3813750 - DNA, 14 bp, Homo sapiens
atccaaggagaaac

SEQ ID NO: 3813751 - DNA, 16 bp, Homo sapiens
atccacacacagagga

SEQ ID NO: 3813752 - DNA, 20 bp, Homo sapiens
atccacacacagaggaagag

SEQ ID NO: 3813753 - DNA, 14 bp, Homo sapiens
atccagaaagaaaa

SEQ ID NO: 3813754 - DNA, 16 bp, Homo sapiens
atccagttcatgagaa

SEQ ID NO: 3813755 - DNA, 17 bp, Homo sapiens
atccagttccagttccc

SEQ ID NO: 3813756 - DNA, 23 bp, Homo sapiens
atcccacggaaaatgccaatctc

SEQ ID NO: 3813757 - DNA, 19 bp, Homo sapiens
atcccaggggaccacacct

SEQ ID NO: 3813758 - DNA, 14 bp, Homo sapiens
atcctgcttcagtg

SEQ ID NO: 3813759 - DNA, 17 bp, Homo sapiens
atcgctgccttgccatg

SEQ ID NO: 3813760 - DNA, 23 bp, Homo sapiens
atcggctacccctcgactcagca

SEQ ID NO: 3813761 - DNA, 21 bp, Homo sapiens
atctagaacacaggcaaaatc

SEQ ID NO: 3813762 - DNA, 21 bp, Homo sapiens
atctatatctctaaactgctg

SEQ ID NO: 3813763 - DNA, 20 bp, Homo sapiens
atctcacgctgatcattgga

SEQ ID NO: 3813764 - DNA, 16 bp, Homo sapiens
atctcagggcctggtc

SEQ ID NO: 3813765 - DNA, 20 bp, Homo sapiens
atctcctcccatggccttcc

SEQ ID NO: 3813766 - DNA, 22 bp, Homo sapiens
atctcctcccatggccttccct

SEQ ID NO: 3813767 - DNA, 16 bp, Homo sapiens
atctctaaactgctgt

SEQ ID NO: 3813768 - DNA, 17 bp, Homo sapiens
atctctgtgtgcacaaa

SEQ ID NO: 3813769 - DNA, 19 bp, Homo sapiens
atctctgtgtgcacaaata

SEQ ID NO: 3813770 - DNA, 19 bp, Homo sapiens
atctgagaagtgtatatag

SEQ ID NO: 3813771 - DNA, 17 bp, Homo sapiens
atctgagtccagctccc

SEQ ID NO: 3813772 - DNA, 21 bp, Homo sapiens
atctgagtccagctcccccca

SEQ ID NO: 3813773 - DNA, 21 bp, Homo sapiens
atctgcaccctcgatgaagcc

SEQ ID NO: 3813774 - DNA, 21 bp, Homo sapiens
atctgcccgcctcggcctccc

SEQ ID NO: 3813775 - DNA, 18 bp, Homo sapiens
atctgcttccctggggcc

SEQ ID NO: 3813776 - DNA, 21 bp, Homo sapiens
atctgcttccctggggcccca

SEQ ID NO: 3813777 - DNA, 19 bp, Homo sapiens
atcttccaactcaaactct

SEQ ID NO: 3813778 - DNA, 17 bp, Homo sapiens
atcttcttatgcaattt

SEQ ID NO: 3813779 - DNA, 19 bp, Homo sapiens
atgaaaatcctaccaacct

SEQ ID NO: 3813780 - DNA, 13 bp, Homo sapiens
atgaacttgagga

SEQ ID NO: 3813781 - DNA, 18 bp, Homo sapiens
atgaacttgaggacacat

SEQ ID NO: 3813782 - DNA, 16 bp, Homo sapiens
atgaaggcaaaaaaat

SEQ ID NO: 3813783 - DNA, 14 bp, Homo sapiens
atgaagtgtttcct

SEQ ID NO: 3813784 - DNA, 21 bp, Homo sapiens
atgaattactgtatataaact

SEQ ID NO: 3813785 - DNA, 14 bp, Homo sapiens
atgacatcacttgt

SEQ ID NO: 3813786 - DNA, 19 bp, Homo sapiens
atgaccagtaattgtgaaa

SEQ ID NO: 3813787 - DNA, 12 bp, Homo sapiens
atgagcctggca

SEQ ID NO: 3813788 - DNA, 19 bp, Homo sapiens
atgatggcaattttgtaac

SEQ ID NO: 3813789 - DNA, 20 bp, Homo sapiens
atgatttcatgctatctctg

SEQ ID NO: 3813790 - DNA, 21 bp, Homo sapiens
atgatttcatgctatctctgt

SEQ ID NO: 3813791 - DNA, 15 bp, Homo sapiens
atgattttcttttgt

SEQ ID NO: 3813792 - DNA, 19 bp, Homo sapiens
atgcacacacacagagata

SEQ ID NO: 3813793 - DNA, 12 bp, Homo sapiens
atgcacacacag

SEQ ID NO: 3813794 - DNA, 21 bp, Homo sapiens
atgcacacgcacatagagata

SEQ ID NO: 3813795 - DNA, 17 bp, Homo sapiens
atgcaggagagcttccc

SEQ ID NO: 3813796 - DNA, 23 bp, Homo sapiens
atgcatggagggctgccctgtac

SEQ ID NO: 3813797 - DNA, 21 bp, Homo sapiens
atgctatttttattaatataa

SEQ ID NO: 3813798 - DNA, 19 bp, Homo sapiens
atgctcctggcccactgca

SEQ ID NO: 3813799 - DNA, 14 bp, Homo sapiens
atgctgaatgaatc

SEQ ID NO: 3813800 - DNA, 14 bp, Homo sapiens
atgctgctcatcca

SEQ ID NO: 3813801 - DNA, 22 bp, Homo sapiens
atgctggatgagcaactcctgt

SEQ ID NO: 3813802 - DNA, 15 bp, Homo sapiens
atgcttcatgaaaat

SEQ ID NO: 3813803 - DNA, 21 bp, Homo sapiens
atgcttcatgaaaatcctacc

SEQ ID NO: 3813804 - DNA, 16 bp, Homo sapiens
atgcttctcactgcca

SEQ ID NO: 3813805 - DNA, 13 bp, Homo sapiens
atgcttctgcctc

SEQ ID NO: 3813806 - DNA, 12 bp, Homo sapiens
agccaaggccac

SEQ ID NO: 3813807 - DNA, 13 bp, Homo sapiens
agccactctgttc

SEQ ID NO: 3813808 - DNA, 13 bp, Homo sapiens
agccagaggtctg

SEQ ID NO: 3813809 - DNA, 12 bp, Homo sapiens
agccagccagga

SEQ ID NO: 3813810 - DNA, 13 bp, Homo sapiens
agccagccaggac

SEQ ID NO: 3813811 - DNA, 20 bp, Homo sapiens
agccagctgccgaccagagc

SEQ ID NO: 3813812 - DNA, 15 bp, Homo sapiens
agccataccagggtg

SEQ ID NO: 3813813 - DNA, 15 bp, Homo sapiens
agcccacccctcaac

SEQ ID NO: 3813814 - DNA, 23 bp, Homo sapiens
agcccacccctcaacacctctgc

SEQ ID NO: 3813815 - DNA, 19 bp, Homo sapiens
agccccacctctccaagtc

SEQ ID NO: 3813816 - DNA, 22 bp, Homo sapiens
agccccccagagagagctctgc

SEQ ID NO: 3813817 - DNA, 23 bp, Homo sapiens
agccctgagtttcaagtatcctt

SEQ ID NO: 3813818 - DNA, 10 bp, Homo sapiens
agcccttagc

SEQ ID NO: 3813819 - DNA, 12 bp, Homo sapiens
agcccttagcct

SEQ ID NO: 3813820 - DNA, 20 bp, Homo sapiens
agccctttgcaggcccagca

SEQ ID NO: 3813821 - DNA, 21 bp, Homo sapiens
agccctttgcaggcccagcag

SEQ ID NO: 3813822 - DNA, 19 bp, Homo sapiens
agccgagattgcaccactg

SEQ ID NO: 3813823 - DNA, 20 bp, Homo sapiens
agccgagattgcaccactgc

SEQ ID NO: 3813824 - DNA, 14 bp, Homo sapiens
agccgccccagccc

SEQ ID NO: 3813825 - DNA, 13 bp, Homo sapiens
agccgcctccctt

SEQ ID NO: 3813826 - DNA, 11 bp, Homo sapiens
agcctatggca

SEQ ID NO: 3813827 - DNA, 20 bp, Homo sapiens
agcctccagtgggaggacag

SEQ ID NO: 3813828 - DNA, 22 bp, Homo sapiens
agcctcccagctttctgtgtgc

SEQ ID NO: 3813829 - DNA, 11 bp, Homo sapiens
agcctcctgag

SEQ ID NO: 3813830 - DNA, 16 bp, Homo sapiens
agcctctccactcatg

SEQ ID NO: 3813831 - DNA, 20 bp, Homo sapiens
agcctctccccgctctggat

SEQ ID NO: 3813832 - DNA, 18 bp, Homo sapiens
agcctgaccctcatcttt

SEQ ID NO: 3813833 - DNA, 14 bp, Homo sapiens
agcctgctccagct

SEQ ID NO: 3813834 - DNA, 17 bp, Homo sapiens
agcctgctccagctgtt

SEQ ID NO: 3813835 - DNA, 22 bp, Homo sapiens
agcctgctccagctgttcagct

SEQ ID NO: 3813836 - DNA, 14 bp, Homo sapiens
agcctggaccctgt

SEQ ID NO: 3813837 - DNA, 16 bp, Homo sapiens
agcctgggaccagggc

SEQ ID NO: 3813838 - DNA, 18 bp, Homo sapiens
agcctgggaccagggcat

SEQ ID NO: 3813839 - DNA, 12 bp, Homo sapiens
agcctgggaggt

SEQ ID NO: 3813840 - DNA, 19 bp, Homo sapiens
agccttgcggaaggttcta

SEQ ID NO: 3813841 - DNA, 17 bp, Homo sapiens
agccttgctgtagagac

SEQ ID NO: 3813842 - DNA, 11 bp, Homo sapiens
agcgcctcctg

SEQ ID NO: 3813843 - DNA, 22 bp, Homo sapiens
agcgcctcctggacctgaaggc

SEQ ID NO: 3813844 - DNA, 20 bp, Homo sapiens
agcggatgctggccacagaa

SEQ ID NO: 3813845 - DNA, 13 bp, Homo sapiens
agcggctggcagc

SEQ ID NO: 3813846 - DNA, 19 bp, Homo sapiens
agctaattctttgacctgt

SEQ ID NO: 3813847 - DNA, 20 bp, Homo sapiens
agctattagcaactgtgcta

SEQ ID NO: 3813848 - DNA, 15 bp, Homo sapiens
agctattcaggaggc

SEQ ID NO: 3813849 - DNA, 22 bp, Homo sapiens
agctcaggaaccgaggcaggga

SEQ ID NO: 3813850 - DNA, 20 bp, Homo sapiens
agctcataagctgtagaact

SEQ ID NO: 3813851 - DNA, 20 bp, Homo sapiens
agctccagtggaagaagaaa

SEQ ID NO: 3813852 - DNA, 16 bp, Homo sapiens
agctcctgtccctacc

SEQ ID NO: 3813853 - DNA, 20 bp, Homo sapiens
agctcctgtccctacccact

SEQ ID NO: 3813854 - DNA, 22 bp, Homo sapiens
agctcctgtccctacccactct

SEQ ID NO: 3813855 - DNA, 18 bp, Homo sapiens
agctccttaaggctcttt

SEQ ID NO: 3813856 - DNA, 22 bp, Homo sapiens
agctccttaaggctcttttgta

SEQ ID NO: 3813857 - DNA, 18 bp, Homo sapiens
agctgacagagccagagg

SEQ ID NO: 3813858 - DNA, 20 bp, Homo sapiens
agctgacagagccagaggca

SEQ ID NO: 3813859 - DNA, 17 bp, Homo sapiens
agctgagatggagtcct

SEQ ID NO: 3813860 - DNA, 14 bp, Homo sapiens
agctgagcaggtgt

SEQ ID NO: 3813861 - DNA, 19 bp, Homo sapiens
agctgcaccctcaggcagg

SEQ ID NO: 3813862 - DNA, 16 bp, Homo sapiens
agctggaagcactgct

SEQ ID NO: 3813863 - DNA, 15 bp, Homo sapiens
agctggagaagaccc

SEQ ID NO: 3813864 - DNA, 21 bp, Homo sapiens
agctggcattacagctggaga

SEQ ID NO: 3813865 - DNA, 11 bp, Homo sapiens
agctggcctct

SEQ ID NO: 3813866 - DNA, 20 bp, Homo sapiens
agctggcctctagaacaccc

SEQ ID NO: 3813867 - DNA, 23 bp, Homo sapiens
agctggcctctagaacacccact

SEQ ID NO: 3813868 - DNA, 21 bp, Homo sapiens
agctgggacaccccgactttt

SEQ ID NO: 3813869 - DNA, 17 bp, Homo sapiens
agctgggactacaggca

SEQ ID NO: 3813870 - DNA, 15 bp, Homo sapiens
agctggggatgtctc

SEQ ID NO: 3813871 - DNA, 16 bp, Homo sapiens
agctggttgaggtttc

SEQ ID NO: 3813872 - DNA, 15 bp, Homo sapiens
agctgtagaactctg

SEQ ID NO: 3813873 - DNA, 16 bp, Homo sapiens
agctgtagaactctgc

SEQ ID NO: 3813874 - DNA, 19 bp, Homo sapiens
agctgtctcaaacctccaa

SEQ ID NO: 3813875 - DNA, 17 bp, Homo sapiens
agctgtctgctcagaca

SEQ ID NO: 3813876 - DNA, 20 bp, Homo sapiens
agcttaaaggggctagagtg

SEQ ID NO: 3813877 - DNA, 17 bp, Homo sapiens
agcttcccaagtagctg

SEQ ID NO: 3813878 - DNA, 10 bp, Homo sapiens
agctttgcta

SEQ ID NO: 3813879 - DNA, 16 bp, Homo sapiens
agctttgctaccaaag

SEQ ID NO: 3813880 - DNA, 21 bp, Homo sapiens
agctttgtttgttgtcagctg

SEQ ID NO: 3813881 - DNA, 22 bp, Homo sapiens
agctttgtttgttgtcagctga

SEQ ID NO: 3813882 - DNA, 23 bp, Homo sapiens
agctttgtttgttgtcagctgaa

SEQ ID NO: 3813883 - DNA, 14 bp, Homo sapiens
aggaaaatgaataa

SEQ ID NO: 3813884 - DNA, 16 bp, Homo sapiens
aggaaccgaggcaggg

SEQ ID NO: 3813885 - DNA, 14 bp, Homo sapiens
aggaacctgaacct

SEQ ID NO: 3813886 - DNA, 23 bp, Homo sapiens
aggaagagcaggcacatggagga

SEQ ID NO: 3813887 - DNA, 19 bp, Homo sapiens
aggaagaggggtcttttat

SEQ ID NO: 3813888 - DNA, 22 bp, Homo sapiens
aggaattctaggcatcccaggg

SEQ ID NO: 3813889 - DNA, 14 bp, Homo sapiens
aggacaaccattcc

SEQ ID NO: 3813890 - DNA, 22 bp, Homo sapiens
aggacacaccccacaccccagc

SEQ ID NO: 3813891 - DNA, 11 bp, Homo sapiens
aggacacatgt

SEQ ID NO: 3813892 - DNA, 19 bp, Homo sapiens
aggacagtatttgtgggga

SEQ ID NO: 3813893 - DNA, 13 bp, Homo sapiens
aggacctcaggtg

SEQ ID NO: 3813894 - DNA, 14 bp, Homo sapiens
aggacctcaggtga

SEQ ID NO: 3813895 - DNA, 20 bp, Homo sapiens
aggacctcaggtgagaagca

SEQ ID NO: 3813896 - DNA, 13 bp, Homo sapiens
aggacttgtgtct

SEQ ID NO: 3813897 - DNA, 22 bp, Homo sapiens
aggagatccagggcaaggccat

SEQ ID NO: 3813898 - DNA, 14 bp, Homo sapiens
aggagcaaatgctg

SEQ ID NO: 3813899 - DNA, 17 bp, Homo sapiens
aggagcctatggcatct

SEQ ID NO: 3813900 - DNA, 22 bp, Homo sapiens
aggagctgacagagccagaggc

SEQ ID NO: 3813901 - DNA, 15 bp, Homo sapiens
aggagggcaggcatc

SEQ ID NO: 3813902 - DNA, 20 bp, Homo sapiens
aggaggtggaggttgcagtg

SEQ ID NO: 3813903 - DNA, 21 bp, Homo sapiens
aggagtccctgccatcatgtt

SEQ ID NO: 3813904 - DNA, 21 bp, Homo sapiens
aggagtcccttagaagatctg

SEQ ID NO: 3813905 - DNA, 20 bp, Homo sapiens
aggatcatttgttggaatga

SEQ ID NO: 3813906 - DNA, 17 bp, Homo sapiens
aggatctcttgagcctg

SEQ ID NO: 3813907 - DNA, 21 bp, Homo sapiens
aggatctcttgagcctgggag

SEQ ID NO: 3813908 - DNA, 13 bp, Homo sapiens
aggatggagagag

SEQ ID NO: 3813909 - DNA, 15 bp, Homo sapiens
aggatggagagaggg

SEQ ID NO: 3813910 - DNA, 23 bp, Homo sapiens
aggatggtcttgatctcctgagc

SEQ ID NO: 3813911 - DNA, 14 bp, Homo sapiens
aggatttcaagcct

SEQ ID NO: 3813912 - DNA, 17 bp, Homo sapiens
aggcaactcatcttagg

SEQ ID NO: 3813913 - DNA, 19 bp, Homo sapiens
aggcaactgcattggcttt

SEQ ID NO: 3813914 - DNA, 17 bp, Homo sapiens
catctgtacctctgcct

SEQ ID NO: 3813915 - DNA, 19 bp, Homo sapiens
catctgtttaatttacaca

SEQ ID NO: 3813916 - DNA, 18 bp, Homo sapiens
catcttcacgcctgggtg

SEQ ID NO: 3813917 - DNA, 23 bp, Homo sapiens
catcttccccaacgaaaagcaca

SEQ ID NO: 3813918 - DNA, 19 bp, Homo sapiens
catgaaacagaaacaaaaa

SEQ ID NO: 3813919 - DNA, 18 bp, Homo sapiens
catgaacacacatggatg

SEQ ID NO: 3813920 - DNA, 12 bp, Homo sapiens
catgaagctgga

SEQ ID NO: 3813921 - DNA, 23 bp, Homo sapiens
catgacaacttttaaagaaaaat

SEQ ID NO: 3813922 - DNA, 23 bp, Homo sapiens
catgagctccttaaggctctttt

SEQ ID NO: 3813923 - DNA, 17 bp, Homo sapiens
catgagggatcacaggg

SEQ ID NO: 3813924 - DNA, 18 bp, Homo sapiens
catgagggatcacagggc

SEQ ID NO: 3813925 - DNA, 19 bp, Homo sapiens
catgagggatcacagggcc

SEQ ID NO: 3813926 - DNA, 22 bp, Homo sapiens
catgattaaccacttcagctga

SEQ ID NO: 3813927 - DNA, 12 bp, Homo sapiens
catgattttctt

SEQ ID NO: 3813928 - DNA, 20 bp, Homo sapiens
catgcaccctcatacacaga

SEQ ID NO: 3813929 - DNA, 23 bp, Homo sapiens
catgctatctctgtgtgcacaaa

SEQ ID NO: 3813930 - DNA, 14 bp, Homo sapiens
catgctcctggccc

SEQ ID NO: 3813931 - DNA, 17 bp, Homo sapiens
catgctcctggcccact

SEQ ID NO: 3813932 - DNA, 19 bp, Homo sapiens
catgctggctcccagggcc

SEQ ID NO: 3813933 - DNA, 20 bp, Homo sapiens
catgctggtgtggccaaggc

SEQ ID NO: 3813934 - DNA, 23 bp, Homo sapiens
catgctggtgtggccaaggctga

SEQ ID NO: 3813935 - DNA, 17 bp, Homo sapiens
catgctttctccttttt

SEQ ID NO: 3813936 - DNA, 14 bp, Homo sapiens
catggaggagcttg

SEQ ID NO: 3813937 - DNA, 13 bp, Homo sapiens
catggatgagcac

SEQ ID NO: 3813938 - DNA, 20 bp, Homo sapiens
catggatgcacgcacatgcc

SEQ ID NO: 3813939 - DNA, 15 bp, Homo sapiens
catggcccgggcctt

SEQ ID NO: 3813940 - DNA, 22 bp, Homo sapiens
catggcctttgcttgaaagaaa

SEQ ID NO: 3813941 - DNA, 15 bp, Homo sapiens
catgggactgtgcct

SEQ ID NO: 3813942 - DNA, 17 bp, Homo sapiens
catgggactgtgccttt

SEQ ID NO: 3813943 - DNA, 17 bp, Homo sapiens
catgtgactctttccaa

SEQ ID NO: 3813944 - DNA, 20 bp, Homo sapiens
cattaaaatagcacatgatt

SEQ ID NO: 3813945 - DNA, 21 bp, Homo sapiens
cattacctcagtgagaagcca

SEQ ID NO: 3813946 - DNA, 23 bp, Homo sapiens
cattagtgaattacactcaagga

SEQ ID NO: 3813947 - DNA, 20 bp, Homo sapiens
cattatattcctctaaaact

SEQ ID NO: 3813948 - DNA, 22 bp, Homo sapiens
cattatgttattggaattttct

SEQ ID NO: 3813949 - DNA, 23 bp, Homo sapiens
cattatttcaaccgcttgccata

SEQ ID NO: 3813950 - DNA, 19 bp, Homo sapiens
cattcacagcgcctcctgg

SEQ ID NO: 3813951 - DNA, 12 bp, Homo sapiens
cattctcctgcc

SEQ ID NO: 3813952 - DNA, 20 bp, Homo sapiens
aggcccaagagatgaagagt

SEQ ID NO: 3813953 - DNA, 13 bp, Homo sapiens
aggcccagcagac

SEQ ID NO: 3813954 - DNA, 14 bp, Homo sapiens
aggccccagcctcc

SEQ ID NO: 3813955 - DNA, 18 bp, Homo sapiens
aggccccagcctccaggc

SEQ ID NO: 3813956 - DNA, 16 bp, Homo sapiens
aggctagggtggggag

SEQ ID NO: 3813957 - DNA, 18 bp, Homo sapiens
aggctgaccaagagagaa

SEQ ID NO: 3813958 - DNA, 15 bp, Homo sapiens
aggctgaggcaccag

SEQ ID NO: 3813959 - DNA, 16 bp, Homo sapiens
aggctgggtccagggg

SEQ ID NO: 3813960 - DNA, 18 bp, Homo sapiens
aggctttggtaactgcgg

SEQ ID NO: 3813961 - DNA, 19 bp, Homo sapiens
aggctttgtctgctcccaa

SEQ ID NO: 3813962 - DNA, 17 bp, Homo sapiens
agggaaaaaacatgtaa

SEQ ID NO: 3813963 - DNA, 15 bp, Homo sapiens
agggaaggatcccat

SEQ ID NO: 3813964 - DNA, 22 bp, Homo sapiens
agggagataaaagaaccccaga

SEQ ID NO: 3813965 - DNA, 13 bp, Homo sapiens
agggagctaagga

SEQ ID NO: 3813966 - DNA, 13 bp, Homo sapiens
agggagggagagg

SEQ ID NO: 3813967 - DNA, 15 bp, Homo sapiens
agggagggcttctgc

SEQ ID NO: 3813968 - DNA, 12 bp, Homo sapiens
agggaggggact

SEQ ID NO: 3813969 - DNA, 17 bp, Homo sapiens
agggcatgcgcacaagg

SEQ ID NO: 3813970 - DNA, 16 bp, Homo sapiens
agggcatgggagggag

SEQ ID NO: 3813971 - DNA, 18 bp, Homo sapiens
agggccccagaaggcagg

SEQ ID NO: 3813972 - DNA, 19 bp, Homo sapiens
agggcctcccaccagagac

SEQ ID NO: 3813973 - DNA, 23 bp, Homo sapiens
agggcttctgccatttctgagat

SEQ ID NO: 3813974 - DNA, 22 bp, Homo sapiens
aggggaaaatcagcctgctcca

SEQ ID NO: 3813975 - DNA, 18 bp, Homo sapiens
aggggaataatagaagaa

SEQ ID NO: 3813976 - DNA, 20 bp, Homo sapiens
aggggcaccctccaaacact

SEQ ID NO: 3813977 - DNA, 13 bp, Homo sapiens
agggtattccaga

SEQ ID NO: 3813978 - DNA, 17 bp, Homo sapiens
agggtgagttaaagaga

SEQ ID NO: 3813979 - DNA, 19 bp, Homo sapiens
agggtgctctgaggtcaat

SEQ ID NO: 3813980 - DNA, 14 bp, Homo sapiens
agggttgtgcccac

SEQ ID NO: 3813981 - DNA, 14 bp, Homo sapiens
agggttttggcctg

SEQ ID NO: 3813982 - DNA, 16 bp, Homo sapiens
agggttttggcctgcc

SEQ ID NO: 3813983 - DNA, 19 bp, Homo sapiens
aggtcaataaagcagagcc

SEQ ID NO: 3813984 - DNA, 21 bp, Homo sapiens
aggtcaataaagcagagccaa

SEQ ID NO: 3813985 - DNA, 22 bp, Homo sapiens
aggtcaataaagcagagccaag

SEQ ID NO: 3813986 - DNA, 23 bp, Homo sapiens
aggtcaataaagcagagccaagg

SEQ ID NO: 3813987 - DNA, 15 bp, Homo sapiens
aggtcctcagagaat

SEQ ID NO: 3813988 - DNA, 14 bp, Homo sapiens
aggtgacttgcctg

SEQ ID NO: 3813989 - DNA, 23 bp, Homo sapiens
aggtgagaagcagaggaaggaga

SEQ ID NO: 3813990 - DNA, 14 bp, Homo sapiens
aggtgccactgacc

SEQ ID NO: 3813991 - DNA, 20 bp, Homo sapiens
aggtggaggttgcagtgaac

SEQ ID NO: 3813992 - DNA, 23 bp, Homo sapiens
aggttgggagaatgtcagtatgt

SEQ ID NO: 3813993 - DNA, 23 bp, Homo sapiens
aggtttgtttagaagaagtgtgt

SEQ ID NO: 3813994 - DNA, 16 bp, Homo sapiens
agtaacctagtgaatt

SEQ ID NO: 3813995 - DNA, 13 bp, Homo sapiens
agtaattgtgaaa

SEQ ID NO: 3813996 - DNA, 15 bp, Homo sapiens
agtagtagtgtcttc

SEQ ID NO: 3813997 - DNA, 12 bp, Homo sapiens
agtagtattttg

SEQ ID NO: 3813998 - DNA, 21 bp, Homo sapiens
agtagtgtcttcctagtatat

SEQ ID NO: 3813999 - DNA, 15 bp, Homo sapiens
agtagttaattctgt

SEQ ID NO: 3814000 - DNA, 13 bp, Homo sapiens
agtatatattcta

SEQ ID NO: 3814001 - DNA, 21 bp, Homo sapiens
agtatatattctacacatata

SEQ ID NO: 3814002 - DNA, 14 bp, Homo sapiens
agtatccactttgc

SEQ ID NO: 3814003 - DNA, 20 bp, Homo sapiens
agtatgtctactcctcacag

SEQ ID NO: 3814004 - DNA, 15 bp, Homo sapiens
agtatgtggaagtgt

SEQ ID NO: 3814005 - DNA, 19 bp, Homo sapiens
agtcactaggatgcagatg

SEQ ID NO: 3814006 - DNA, 13 bp, Homo sapiens
agtccctgcctgg

SEQ ID NO: 3814007 - DNA, 22 bp, Homo sapiens
agtccctgcctggaccagcctc

SEQ ID NO: 3814008 - DNA, 16 bp, Homo sapiens
agtcctcacagcctct

SEQ ID NO: 3814009 - DNA, 19 bp, Homo sapiens
agtcctcacagcctctccc

SEQ ID NO: 3814010 - DNA, 13 bp, Homo sapiens
agtctcgctctgc

SEQ ID NO: 3814011 - DNA, 15 bp, Homo sapiens
agtctctctgtgaat

SEQ ID NO: 3814012 - DNA, 16 bp, Homo sapiens
agtctctctgtgaata

SEQ ID NO: 3814013 - DNA, 19 bp, Homo sapiens
agtctcttctcagagcagc

SEQ ID NO: 3814014 - DNA, 23 bp, Homo sapiens
agtctgagagaggccattctttc

SEQ ID NO: 3814015 - DNA, 20 bp, Homo sapiens
agtctgaggccccaggccct

SEQ ID NO: 3814016 - DNA, 11 bp, Homo sapiens
agtgaaaaagg

SEQ ID NO: 3814017 - DNA, 17 bp, Homo sapiens
agtgaaaaaggaggaag

SEQ ID NO: 3814018 - DNA, 15 bp, Homo sapiens
agtgaattacactca

SEQ ID NO: 3814019 - DNA, 17 bp, Homo sapiens
agtgaattacactcaag

SEQ ID NO: 3814020 - DNA, 22 bp, Homo sapiens
agtgaattacactcaaggaaaa

SEQ ID NO: 3814021 - DNA, 17 bp, Homo sapiens
agtgagaccctgtctca

SEQ ID NO: 3814022 - DNA, 13 bp, Homo sapiens
agtgagagggcat

SEQ ID NO: 3814023 - DNA, 11 bp, Homo sapiens
agtgagcctga

SEQ ID NO: 3814024 - DNA, 23 bp, Homo sapiens
agtgattgttatgccttgctatt

SEQ ID NO: 3814025 - DNA, 21 bp, Homo sapiens
agtgatttttatgccacctga

SEQ ID NO: 3814026 - DNA, 17 bp, Homo sapiens
agtgcagctcaggagac

SEQ ID NO: 3814027 - DNA, 20 bp, Homo sapiens
agtgctaggattacaggcat

SEQ ID NO: 3814028 - DNA, 16 bp, Homo sapiens
agtggcagccgcctcc

SEQ ID NO: 3814029 - DNA, 16 bp, Homo sapiens
agtgtatggaaataaa

SEQ ID NO: 3814030 - DNA, 23 bp, Homo sapiens
agtgtccagaccattgtcttcca

SEQ ID NO: 3814031 - DNA, 18 bp, Homo sapiens
agtgtccccaaagactac

SEQ ID NO: 3814032 - DNA, 9 bp, Homo sapiens
agtgtgtaa

SEQ ID NO: 3814033 - DNA, 14 bp, Homo sapiens
agtgtttcctgagt

SEQ ID NO: 3814034 - DNA, 20 bp, Homo sapiens
agttaatggggtagaggagg

SEQ ID NO: 3814035 - DNA, 18 bp, Homo sapiens
agttaggaagttacctgg

SEQ ID NO: 3814036 - DNA, 19 bp, Homo sapiens
agttatatttactttaaaa

SEQ ID NO: 3814037 - DNA, 14 bp, Homo sapiens
agttattttacaaa

SEQ ID NO: 3814038 - DNA, 19 bp, Homo sapiens
agttattttacaaattgtt

SEQ ID NO: 3814039 - DNA, 18 bp, Homo sapiens
agttcataaatttatggt

SEQ ID NO: 3814040 - DNA, 12 bp, Homo sapiens
agttctctgttc

SEQ ID NO: 3814041 - DNA, 20 bp, Homo sapiens
agttctctgttctagagtga

SEQ ID NO: 3814042 - DNA, 19 bp, Homo sapiens
agttgaccagggcagtgaa

SEQ ID NO: 3814043 - DNA, 15 bp, Homo sapiens
agttgattcagctct

SEQ ID NO: 3814044 - DNA, 12 bp, Homo sapiens
cacacacagagg

SEQ ID NO: 3814045 - DNA, 19 bp, Homo sapiens
cacacagatggtcacacag

SEQ ID NO: 3814046 - DNA, 23 bp, Homo sapiens
cacacagggtctgcaaggtcttt

SEQ ID NO: 3814047 - DNA, 17 bp, Homo sapiens
cacacatggatgagcac

SEQ ID NO: 3814048 - DNA, 15 bp, Homo sapiens
cacaccaatgcgcac

SEQ ID NO: 3814049 - DNA, 14 bp, Homo sapiens
cacaccattctcct

SEQ ID NO: 3814050 - DNA, 22 bp, Homo sapiens
cacaccattctcctgcctcagc

SEQ ID NO: 3814051 - DNA, 14 bp, Homo sapiens
cacaccccacaccc

SEQ ID NO: 3814052 - DNA, 13 bp, Homo sapiens
cacaccccagccc

SEQ ID NO: 3814053 - DNA, 14 bp, Homo sapiens
cacaccccagccca

SEQ ID NO: 3814054 - DNA, 21 bp, Homo sapiens
cacaccccagcccaccctgct

SEQ ID NO: 3814055 - DNA, 15 bp, Homo sapiens
cacaccgatgtgcgc

SEQ ID NO: 3814056 - DNA, 20 bp, Homo sapiens
cacacggaggcatctgcacc

SEQ ID NO: 3814057 - DNA, 15 bp, Homo sapiens
cacacggatgcacag

SEQ ID NO: 3814058 - DNA, 12 bp, Homo sapiens
cacactcagcag

SEQ ID NO: 3814059 - DNA, 15 bp, Homo sapiens
cacactcagcagccc

SEQ ID NO: 3814060 - DNA, 16 bp, Homo sapiens
cacagaaaccaatttt

SEQ ID NO: 3814061 - DNA, 20 bp, Homo sapiens
cacagaaaggccactcagga

SEQ ID NO: 3814062 - DNA, 12 bp, Homo sapiens
cacagagatatg

SEQ ID NO: 3814063 - DNA, 20 bp, Homo sapiens
cacagagatatgcacacaca

SEQ ID NO: 3814064 - DNA, 13 bp, Homo sapiens
cacagaggaagag

SEQ ID NO: 3814065 - DNA, 16 bp, Homo sapiens
cacagagtataaataa

SEQ ID NO: 3814066 - DNA, 16 bp, Homo sapiens
cacagatgcacacaca

SEQ ID NO: 3814067 - DNA, 15 bp, Homo sapiens
cacagcctctccctt

SEQ ID NO: 3814068 - DNA, 16 bp, Homo sapiens
cacagcgcctcctgga

SEQ ID NO: 3814069 - DNA, 20 bp, Homo sapiens
cacagctctccggtctctct

SEQ ID NO: 3814070 - DNA, 15 bp, Homo sapiens
cacagggagctggca

SEQ ID NO: 3814071 - DNA, 20 bp, Homo sapiens
cacagtcctcacagcctctc

SEQ ID NO: 3814072 - DNA, 20 bp, Homo sapiens
cacataaaggtatttagaat

SEQ ID NO: 3814073 - DNA, 14 bp, Homo sapiens
cacatagagatatg

SEQ ID NO: 3814074 - DNA, 12 bp, Homo sapiens
cacatatatgta

SEQ ID NO: 3814075 - DNA, 21 bp, Homo sapiens
cacatccaggcaatggcctaa

SEQ ID NO: 3814076 - DNA, 13 bp, Homo sapiens
cacatgattttct

SEQ ID NO: 3814077 - DNA, 15 bp, Homo sapiens
cacatggatgagcac

SEQ ID NO: 3814078 - DNA, 13 bp, Homo sapiens
cacattgcctcat

SEQ ID NO: 3814079 - DNA, 23 bp, Homo sapiens
caccaagttggaacatccttgga

SEQ ID NO: 3814080 - DNA, 15 bp, Homo sapiens
caccacaacctccac

SEQ ID NO: 3814081 - DNA, 13 bp, Homo sapiens
caccactagggtc

SEQ ID NO: 3814082 - DNA, 21 bp, Homo sapiens
caccactagggtcctggccct

SEQ ID NO: 3814083 - DNA, 13 bp, Homo sapiens
caccagaagttac

SEQ ID NO: 3814084 - DNA, 23 bp, Homo sapiens
caccagccctgctgcttcctaac

SEQ ID NO: 3814085 - DNA, 16 bp, Homo sapiens
caccaggcagctccag

SEQ ID NO: 3814086 - DNA, 14 bp, Homo sapiens
caccattctcctgc

SEQ ID NO: 3814087 - DNA, 15 bp, Homo sapiens
caccattctcctgcc

SEQ ID NO: 3814088 - DNA, 11 bp, Homo sapiens
cacccactggc

SEQ ID NO: 3814089 - DNA, 14 bp, Homo sapiens
cacccactggccag

SEQ ID NO: 3814090 - DNA, 15 bp, Homo sapiens
cacccactggccagt

SEQ ID NO: 3814091 - DNA, 16 bp, Homo sapiens
cacccactggccagtc

SEQ ID NO: 3814092 - DNA, 17 bp, Homo sapiens
cacccactggccagtcc

SEQ ID NO: 3814093 - DNA, 14 bp, Homo sapiens
caccccagcccacc

SEQ ID NO: 3814094 - DNA, 18 bp, Homo sapiens
caccccagcccaccctgc

SEQ ID NO: 3814095 - DNA, 20 bp, Homo sapiens
cacccctcaacacctctgca

SEQ ID NO: 3814096 - DNA, 17 bp, Homo sapiens
caccctcgtggacacct

SEQ ID NO: 3814097 - DNA, 18 bp, Homo sapiens
caccctcgtggacacctg

SEQ ID NO: 3814098 - DNA, 21 bp, Homo sapiens
caccctcgtggacacctgccc

SEQ ID NO: 3814099 - DNA, 21 bp, Homo sapiens
caccctgctcctcctgccctg

SEQ ID NO: 3814100 - DNA, 14 bp, Homo sapiens
caccggggcctggg

SEQ ID NO: 3814101 - DNA, 21 bp, Homo sapiens
caccggggcctgggcaggagg

SEQ ID NO: 3814102 - DNA, 17 bp, Homo sapiens
caccgtattagccagga

SEQ ID NO: 3814103 - DNA, 14 bp, Homo sapiens
caccgttcattcag

SEQ ID NO: 3814104 - DNA, 19 bp, Homo sapiens
cacctaggctagggtgggg

SEQ ID NO: 3814105 - DNA, 10 bp, Homo sapiens
cacctcccag

SEQ ID NO: 3814106 - DNA, 12 bp, Homo sapiens
cacctcccagga

SEQ ID NO: 3814107 - DNA, 23 bp, Homo sapiens
cacctcgttactctcacctcgtg

SEQ ID NO: 3814108 - DNA, 13 bp, Homo sapiens
cacctctcaatat

SEQ ID NO: 3814109 - DNA, 21 bp, Homo sapiens
cacctctcaatattcaataaa

SEQ ID NO: 3814110 - DNA, 15 bp, Homo sapiens
cacctctccaagtct

SEQ ID NO: 3814111 - DNA, 23 bp, Homo sapiens
cacctctccaagtctctctgtga

SEQ ID NO: 3814112 - DNA, 23 bp, Homo sapiens
cacctgagtcaccctacctgtgc

SEQ ID NO: 3814113 - DNA, 16 bp, Homo sapiens
cacctgccctgccctg

SEQ ID NO: 3814114 - DNA, 18 bp, Homo sapiens
cacctgccctgccctgcc

SEQ ID NO: 3814115 - DNA, 11 bp, Homo sapiens
cacctgtctgt

SEQ ID NO: 3814116 - DNA, 16 bp, Homo sapiens
cacctgtctgtctgtc

SEQ ID NO: 3814117 - DNA, 17 bp, Homo sapiens
cacgactgcccggcagg

SEQ ID NO: 3814118 - DNA, 14 bp, Homo sapiens
cacgatctcagctc

SEQ ID NO: 3814119 - DNA, 17 bp, Homo sapiens
cacgcacttcgggaggt

SEQ ID NO: 3814120 - DNA, 17 bp, Homo sapiens
cacgcttattgcccagg

SEQ ID NO: 3814121 - DNA, 22 bp, Homo sapiens
cacggaagagccttgcggaagg

SEQ ID NO: 3814122 - DNA, 16 bp, Homo sapiens
cagcctgctccagctg

SEQ ID NO: 3814123 - DNA, 17 bp, Homo sapiens
cagcctgctccagctgt

SEQ ID NO: 3814124 - DNA, 20 bp, Homo sapiens
cagcctgctccagctgttca

SEQ ID NO: 3814125 - DNA, 19 bp, Homo sapiens
cagcctggaccctgtggat

SEQ ID NO: 3814126 - DNA, 18 bp, Homo sapiens
cagcctgggaccagggca

SEQ ID NO: 3814127 - DNA, 19 bp, Homo sapiens
cagcgcctcctggacctga

SEQ ID NO: 3814128 - DNA, 23 bp, Homo sapiens
cagcgcctcctggacctgaaggc

SEQ ID NO: 3814129 - DNA, 18 bp, Homo sapiens
cagctaagctaggaatga

SEQ ID NO: 3814130 - DNA, 13 bp, Homo sapiens
cagctcaagtctt

SEQ ID NO: 3814131 - DNA, 20 bp, Homo sapiens
cagctctagacactgccaca

SEQ ID NO: 3814132 - DNA, 21 bp, Homo sapiens
cagctgacttttctgtccgag

SEQ ID NO: 3814133 - DNA, 22 bp, Homo sapiens
cagctgaggacacaccccacac

SEQ ID NO: 3814134 - DNA, 19 bp, Homo sapiens
cagctgccgaccagagccc

SEQ ID NO: 3814135 - DNA, 15 bp, Homo sapiens
cagctggcctctaga

SEQ ID NO: 3814136 - DNA, 23 bp, Homo sapiens
cagctggcctctagaacacccac

SEQ ID NO: 3814137 - DNA, 18 bp, Homo sapiens
cagctgttacctgagata

SEQ ID NO: 3814138 - DNA, 14 bp, Homo sapiens
cagcttctcttgaa

SEQ ID NO: 3814139 - DNA, 22 bp, Homo sapiens
cagctttgctaccaaagcacct

SEQ ID NO: 3814140 - DNA, 12 bp, Homo sapiens
cagctttgtttg

SEQ ID NO: 3814141 - DNA, 16 bp, Homo sapiens
caggacctcaggtgag

SEQ ID NO: 3814142 - DNA, 23 bp, Homo sapiens
caggacctcaggtgagaagcaga

SEQ ID NO: 3814143 - DNA, 11 bp, Homo sapiens
caggagcctgg

SEQ ID NO: 3814144 - DNA, 15 bp, Homo sapiens
caggagctgacagag

SEQ ID NO: 3814145 - DNA, 22 bp, Homo sapiens
caggagctgacagagccagagg

SEQ ID NO: 3814146 - DNA, 24 bp, Homo sapiens
caggagctgacagagccagaggca

SEQ ID NO: 3814147 - DNA, 19 bp, Homo sapiens
caggaggatcacttgagtc

SEQ ID NO: 3814148 - DNA, 15 bp, Homo sapiens
caggaggcaggatat

SEQ ID NO: 3814149 - DNA, 15 bp, Homo sapiens
caggagtccctgcca

SEQ ID NO: 3814150 - DNA, 21 bp, Homo sapiens
caggagtccctgccatcatgt

SEQ ID NO: 3814151 - DNA, 23 bp, Homo sapiens
caggagtttgagaccaacctggg

SEQ ID NO: 3814152 - DNA, 22 bp, Homo sapiens
caggatggtcttgatctcctga

SEQ ID NO: 3814153 - DNA, 20 bp, Homo sapiens
caggatgtcctttgtgtcca

SEQ ID NO: 3814154 - DNA, 13 bp, Homo sapiens
caggattcccaga

SEQ ID NO: 3814155 - DNA, 17 bp, Homo sapiens
caggattcccagagaga

SEQ ID NO: 3814156 - DNA, 17 bp, Homo sapiens
caggatttgctgggaga

SEQ ID NO: 3814157 - DNA, 14 bp, Homo sapiens
atggaatagaaaag

SEQ ID NO: 3814158 - DNA, 23 bp, Homo sapiens
atggaatagaaaagatgagaggc

SEQ ID NO: 3814159 - DNA, 21 bp, Homo sapiens
atggacccaatatttaccaga

SEQ ID NO: 3814160 - DNA, 16 bp, Homo sapiens
atggatcctggaggat

SEQ ID NO: 3814161 - DNA, 15 bp, Homo sapiens
atggatttccagcca

SEQ ID NO: 3814162 - DNA, 18 bp, Homo sapiens
atggatttccagccaaag

SEQ ID NO: 3814163 - DNA, 16 bp, Homo sapiens
atggcaattttgtaac

SEQ ID NO: 3814164 - DNA, 17 bp, Homo sapiens
atggcctgagaagagag

SEQ ID NO: 3814165 - DNA, 16 bp, Homo sapiens
atggcctgggggatgt

SEQ ID NO: 3814166 - DNA, 18 bp, Homo sapiens
atggccttccctccccac

SEQ ID NO: 3814167 - DNA, 18 bp, Homo sapiens
atggctggaaggagccag

SEQ ID NO: 3814168 - DNA, 20 bp, Homo sapiens
atgggagctggttagaaatg

SEQ ID NO: 3814169 - DNA, 21 bp, Homo sapiens
atgggagctggttagaaatgc

SEQ ID NO: 3814170 - DNA, 14 bp, Homo sapiens
atggtgtatgtggt

SEQ ID NO: 3814171 - DNA, 21 bp, Homo sapiens
atgtaaaaggtattaaattga

SEQ ID NO: 3814172 - DNA, 19 bp, Homo sapiens
atgtaaaatggagaccaat

SEQ ID NO: 3814173 - DNA, 16 bp, Homo sapiens
atgtaacttttgtaag

SEQ ID NO: 3814174 - DNA, 17 bp, Homo sapiens
atgtatataaacatgct

SEQ ID NO: 3814175 - DNA, 13 bp, Homo sapiens
atgtatatctata

SEQ ID NO: 3814176 - DNA, 15 bp, Homo sapiens
atgtatatctatatc

SEQ ID NO: 3814177 - DNA, 19 bp, Homo sapiens
atgtatatctatatctcta

SEQ ID NO: 3814178 - DNA, 16 bp, Homo sapiens
atgtcagtatgtggaa

SEQ ID NO: 3814179 - DNA, 16 bp, Homo sapiens
atgtcctttgtgtcca

SEQ ID NO: 3814180 - DNA, 16 bp, Homo sapiens
atgtgaatgggaaaag

SEQ ID NO: 3814181 - DNA, 12 bp, Homo sapiens
atgtgaatgtgg

SEQ ID NO: 3814182 - DNA, 20 bp, Homo sapiens
atgtgattcctttgaagagg

SEQ ID NO: 3814183 - DNA, 21 bp, Homo sapiens
atgtgattgttccataataaa

SEQ ID NO: 3814184 - DNA, 16 bp, Homo sapiens
atgtgctcccaccagg

SEQ ID NO: 3814185 - DNA, 17 bp, Homo sapiens
atgtgctcccaccaggc

SEQ ID NO: 3814186 - DNA, 15 bp, Homo sapiens
atgtggaagtgtggg

SEQ ID NO: 3814187 - DNA, 19 bp, Homo sapiens
atgtggcaataaaggagaa

SEQ ID NO: 3814188 - DNA, 20 bp, Homo sapiens
atgtggcccctgaacaagaa

SEQ ID NO: 3814189 - DNA, 22 bp, Homo sapiens
atgtggcccctgaacaagaatt

SEQ ID NO: 3814190 - DNA, 10 bp, Homo sapiens
atgtgtgtgt

SEQ ID NO: 3814191 - DNA, 18 bp, Homo sapiens
atgtgtgtgtgttgtgtg

SEQ ID NO: 3814192 - DNA, 19 bp, Homo sapiens
atgttatgggatgtaaaca

SEQ ID NO: 3814193 - DNA, 21 bp, Homo sapiens
atgttatgggatgtaaacaat

SEQ ID NO: 3814194 - DNA, 12 bp, Homo sapiens
atgttattggaa

SEQ ID NO: 3814195 - DNA, 16 bp, Homo sapiens
atgttctctcttctcc

SEQ ID NO: 3814196 - DNA, 19 bp, Homo sapiens
atgttgctggactgtcata

SEQ ID NO: 3814197 - DNA, 15 bp, Homo sapiens
attaaaacagtgtat

SEQ ID NO: 3814198 - DNA, 23 bp, Homo sapiens
attaaaatctggcaaagttatat

SEQ ID NO: 3814199 - DNA, 17 bp, Homo sapiens
attaaaggtcctgccct

SEQ ID NO: 3814200 - DNA, 17 bp, Homo sapiens
attaaatagggaaaaaa

SEQ ID NO: 3814201 - DNA, 19 bp, Homo sapiens
attaaattagacttcctgt

SEQ ID NO: 3814202 - DNA, 18 bp, Homo sapiens
attaaccacttcagctga

SEQ ID NO: 3814203 - DNA, 23 bp, Homo sapiens
attaattaaaataaaaaacagct

SEQ ID NO: 3814204 - DNA, 15 bp, Homo sapiens
attacagctggagaa

SEQ ID NO: 3814205 - DNA, 16 bp, Homo sapiens
attacttatttttgac

SEQ ID NO: 3814206 - DNA, 13 bp, Homo sapiens
attagagaagaga

SEQ ID NO: 3814207 - DNA, 19 bp, Homo sapiens
attagagggaggagaatga

SEQ ID NO: 3814208 - DNA, 22 bp, Homo sapiens
attagcaattgactgtcactgt

SEQ ID NO: 3814209 - DNA, 19 bp, Homo sapiens
attagcaggtgcaccttct

SEQ ID NO: 3814210 - DNA, 13 bp, Homo sapiens
attatatatcata

SEQ ID NO: 3814211 - DNA, 17 bp, Homo sapiens
attatatatcataaagt

SEQ ID NO: 3814212 - DNA, 23 bp, Homo sapiens
attatattcctctaaaactctca

SEQ ID NO: 3814213 - DNA, 13 bp, Homo sapiens
attatgttattgg

SEQ ID NO: 3814214 - DNA, 14 bp, Homo sapiens
attatgttattgga

SEQ ID NO: 3814215 - DNA, 17 bp, Homo sapiens
attatgttattggaatt

SEQ ID NO: 3814216 - DNA, 14 bp, Homo sapiens
attcaaagagacta

SEQ ID NO: 3814217 - DNA, 14 bp, Homo sapiens
attcagctctgcaa

SEQ ID NO: 3814218 - DNA, 19 bp, Homo sapiens
attcatgctttctcctttt

SEQ ID NO: 3814219 - DNA, 20 bp, Homo sapiens
attccaacagctcaagtctt

SEQ ID NO: 3814220 - DNA, 12 bp, Homo sapiens
attccagaggaa

SEQ ID NO: 3814221 - DNA, 19 bp, Homo sapiens
attcccactaagctttctc

SEQ ID NO: 3814222 - DNA, 12 bp, Homo sapiens
attcccagagag

SEQ ID NO: 3814223 - DNA, 17 bp, Homo sapiens
attcccagagcaaaata

SEQ ID NO: 3814224 - DNA, 15 bp, Homo sapiens
attccccattcttcc

SEQ ID NO: 3814225 - DNA, 13 bp, Homo sapiens
attcctcatttgt

SEQ ID NO: 3814226 - DNA, 18 bp, Homo sapiens
attcctcatttgttcatt

SEQ ID NO: 3814227 - DNA, 14 bp, Homo sapiens
attcctctaaaact

SEQ ID NO: 3814228 - DNA, 24 bp, Homo sapiens
attctacacatatatgtatatgta

SEQ ID NO: 3814229 - DNA, 20 bp, Homo sapiens
attctaggcatcccagggga

SEQ ID NO: 3814230 - DNA, 14 bp, Homo sapiens
attctcacctgcct

SEQ ID NO: 3814231 - DNA, 14 bp, Homo sapiens
attctcctgcctca

SEQ ID NO: 3814232 - DNA, 23 bp, Homo sapiens
attctcctgcctcagcctcctga

SEQ ID NO: 3814233 - DNA, 18 bp, Homo sapiens
attctgttttgtaaatgt

SEQ ID NO: 3814234 - DNA, 12 bp, Homo sapiens
attcttcctagt

SEQ ID NO: 3814235 - DNA, 23 bp, Homo sapiens
attcttctcgacttcaggagctg

SEQ ID NO: 3814236 - DNA, 13 bp, Homo sapiens
attctttcccaac

SEQ ID NO: 3814237 - DNA, 16 bp, Homo sapiens
attgaaggagaaaatg

SEQ ID NO: 3814238 - DNA, 14 bp, Homo sapiens
attgattaaaatct

SEQ ID NO: 3814239 - DNA, 16 bp, Homo sapiens
attgatttcaagacct

SEQ ID NO: 3814240 - DNA, 12 bp, Homo sapiens
attgcaccactg

SEQ ID NO: 3814241 - DNA, 22 bp, Homo sapiens
attgcctcatttcttcctctgc

SEQ ID NO: 3814242 - DNA, 15 bp, Homo sapiens
attgcgagaattttc

SEQ ID NO: 3814243 - DNA, 12 bp, Homo sapiens
attgctgcttga

SEQ ID NO: 3814244 - DNA, 23 bp, Homo sapiens
attgctggagacagtagaggcat

SEQ ID NO: 3814245 - DNA, 12 bp, Homo sapiens
attggaattttc

SEQ ID NO: 3814246 - DNA, 17 bp, Homo sapiens
attggaattttctttca

SEQ ID NO: 3814247 - DNA, 21 bp, Homo sapiens
attggtccaacccagcctgag

SEQ ID NO: 3814248 - DNA, 12 bp, Homo sapiens
attggtgttgac

SEQ ID NO: 3814249 - DNA, 22 bp, Homo sapiens
attgtaaaaaaggttttctata

SEQ ID NO: 3814250 - DNA, 21 bp, Homo sapiens
attgtcttccaaccccagctg

SEQ ID NO: 3814251 - DNA, 16 bp, Homo sapiens
attgttccataataaa

SEQ ID NO: 3814252 - DNA, 13 bp, Homo sapiens
atttagaatatat

SEQ ID NO: 3814253 - DNA, 19 bp, Homo sapiens
atttagtgctaaacaagta

SEQ ID NO: 3814254 - DNA, 18 bp, Homo sapiens
atttataaactaggtaaa

SEQ ID NO: 3814255 - DNA, 18 bp, Homo sapiens
atttatcctgaaatttca

SEQ ID NO: 3814256 - DNA, 22 bp, Homo sapiens
atttatctttacttttaaacag

SEQ ID NO: 3814257 - DNA, 14 bp, Homo sapiens
atttatttatgtgt

SEQ ID NO: 3814258 - DNA, 15 bp, Homo sapiens
atttcaagaccttct

SEQ ID NO: 3814259 - DNA, 12 bp, Homo sapiens
atttcatgcatt

SEQ ID NO: 3814260 - DNA, 16 bp, Homo sapiens
atttcccttccttcct

SEQ ID NO: 3814261 - DNA, 21 bp, Homo sapiens
atttctactttttgcacctta

SEQ ID NO: 3814262 - DNA, 20 bp, Homo sapiens
atttctattatttttcaagt

SEQ ID NO: 3814263 - DNA, 14 bp, Homo sapiens
atttcttcctctgc

SEQ ID NO: 3814264 - DNA, 21 bp, Homo sapiens
atttgtacatagttatttatt

SEQ ID NO: 3814265 - DNA, 23 bp, Homo sapiens
atttgtactgaaaaatggtaatt

SEQ ID NO: 3814266 - DNA, 13 bp, Homo sapiens
attttaaacaaag

SEQ ID NO: 3814267 - DNA, 20 bp, Homo sapiens
attttaataaagattctatt

SEQ ID NO: 3814268 - DNA, 14 bp, Homo sapiens
attttacaaattgt

SEQ ID NO: 3814269 - DNA, 21 bp, Homo sapiens
attttactgacagaaatgcaa

SEQ ID NO: 3814270 - DNA, 14 bp, Homo sapiens
attttatatacaat

SEQ ID NO: 3814271 - DNA, 13 bp, Homo sapiens
attttcaagaaac

SEQ ID NO: 3814272 - DNA, 17 bp, Homo sapiens
attttcaagaaactgag

SEQ ID NO: 3814273 - DNA, 13 bp, Homo sapiens
attttcactgtag

SEQ ID NO: 3814274 - DNA, 16 bp, Homo sapiens
attttcctgccaggca

SEQ ID NO: 3814275 - DNA, 16 bp, Homo sapiens
attttctttcatacat

SEQ ID NO: 3814276 - DNA, 18 bp, Homo sapiens
attttctttcatacatta

SEQ ID NO: 3814277 - DNA, 20 bp, Homo sapiens
attttcttttgttttcttca

SEQ ID NO: 3814278 - DNA, 18 bp, Homo sapiens
attttgcattagacagat

SEQ ID NO: 3814279 - DNA, 19 bp, Homo sapiens
attttgtaacgaagacaca

SEQ ID NO: 3814280 - DNA, 19 bp, Homo sapiens
attttgtatccccctgtag

SEQ ID NO: 3814281 - DNA, 19 bp, Homo sapiens
attttgtgaaagaaggagc

SEQ ID NO: 3814282 - DNA, 23 bp, Homo sapiens
atttttgctcttctgtatgtgac

SEQ ID NO: 3814283 - DNA, 13 bp, Homo sapiens
atttttgtacatt

SEQ ID NO: 3814284 - DNA, 14 bp, Homo sapiens
atttttgtacatta

SEQ ID NO: 3814285 - DNA, 17 bp, Homo sapiens
atttttgtacattatgt

SEQ ID NO: 3814286 - DNA, 18 bp, Homo sapiens
atttttgtacattatgtt

SEQ ID NO: 3814287 - DNA, 22 bp, Homo sapiens
atttttgttggagccactctgt

SEQ ID NO: 3814288 - DNA, 16 bp, Homo sapiens
attttttatttccaca

SEQ ID NO: 3814289 - DNA, 14 bp, Homo sapiens
caaaaaaattaaat

SEQ ID NO: 3814290 - DNA, 13 bp, Homo sapiens
caaaaaggcagga

SEQ ID NO: 3814291 - DNA, 11 bp, Homo sapiens
caaaacaatgc

SEQ ID NO: 3814292 - DNA, 16 bp, Homo sapiens
caaaagatgcttctca

SEQ ID NO: 3814293 - DNA, 17 bp, Homo sapiens
caaaatatttgtacata

SEQ ID NO: 3814294 - DNA, 20 bp, Homo sapiens
caaaatccttgcttatgaca

SEQ ID NO: 3814295 - DNA, 13 bp, Homo sapiens
caaaatgtccagc

SEQ ID NO: 3814296 - DNA, 15 bp, Homo sapiens
caaaattactggaca

SEQ ID NO: 3814297 - DNA, 14 bp, Homo sapiens
caaaattctgtttt

SEQ ID NO: 3814298 - DNA, 15 bp, Homo sapiens
caaaattctgttttg

SEQ ID NO: 3814299 - DNA, 19 bp, Homo sapiens
caaaattctgttttgtaaa

SEQ ID NO: 3814300 - DNA, 14 bp, Homo sapiens
caaacacctcccag

SEQ ID NO: 3814301 - DNA, 11 bp, Homo sapiens
caaacactggg

SEQ ID NO: 3814302 - DNA, 21 bp, Homo sapiens
caaacactgggctctgaggag

SEQ ID NO: 3814303 - DNA, 15 bp, Homo sapiens
caaacaggctcagag

SEQ ID NO: 3814304 - DNA, 22 bp, Homo sapiens
caaagaaaagacattgaaagct

SEQ ID NO: 3814305 - DNA, 15 bp, Homo sapiens
caaagaactgcccca

SEQ ID NO: 3814306 - DNA, 22 bp, Homo sapiens
caaagaactgccccatctcctc

SEQ ID NO: 3814307 - DNA, 14 bp, Homo sapiens
caaagaggttttaa

SEQ ID NO: 3814308 - DNA, 18 bp, Homo sapiens
caaagcctcctccagccg

SEQ ID NO: 3814309 - DNA, 15 bp, Homo sapiens
caaaggttgagatgt

SEQ ID NO: 3814310 - DNA, 19 bp, Homo sapiens
caaagtgctaggattacag

SEQ ID NO: 3814311 - DNA, 14 bp, Homo sapiens
caaagttatattta

SEQ ID NO: 3814312 - DNA, 17 bp, Homo sapiens
caaagttatatttactt

SEQ ID NO: 3814313 - DNA, 14 bp, Homo sapiens
caaatatttatttt

SEQ ID NO: 3814314 - DNA, 15 bp, Homo sapiens
caaatatttattttc

SEQ ID NO: 3814315 - DNA, 16 bp, Homo sapiens
caaatgagcattagct

SEQ ID NO: 3814316 - DNA, 20 bp, Homo sapiens
caaatgagcattagctactt

SEQ ID NO: 3814317 - DNA, 13 bp, Homo sapiens
caaatggaaagga

SEQ ID NO: 3814318 - DNA, 13 bp, Homo sapiens
caacaagttgcct

SEQ ID NO: 3814319 - DNA, 15 bp, Homo sapiens
caacagctcaagtct

SEQ ID NO: 3814320 - DNA, 17 bp, Homo sapiens
caacatttttgtacatt

SEQ ID NO: 3814321 - DNA, 18 bp, Homo sapiens
caacatttttgtacatta

SEQ ID NO: 3814322 - DNA, 13 bp, Homo sapiens
caacccagcctga

SEQ ID NO: 3814323 - DNA, 14 bp, Homo sapiens
caaccccagctggc

SEQ ID NO: 3814324 - DNA, 17 bp, Homo sapiens
caaccccagctggcctc

SEQ ID NO: 3814325 - DNA, 16 bp, Homo sapiens
caaccgcttgccatat

SEQ ID NO: 3814326 - DNA, 22 bp, Homo sapiens
caaccggctttgtggcactggg

SEQ ID NO: 3814327 - DNA, 20 bp, Homo sapiens
caacctccacctcctgggtt

SEQ ID NO: 3814328 - DNA, 17 bp, Homo sapiens
caactaattcaataaaa

SEQ ID NO: 3814329 - DNA, 19 bp, Homo sapiens
caactccgcccagcctctc

SEQ ID NO: 3814330 - DNA, 16 bp, Homo sapiens
caactgcattggcttt

SEQ ID NO: 3814331 - DNA, 18 bp, Homo sapiens
caagaaactgaggaattt

SEQ ID NO: 3814332 - DNA, 22 bp, Homo sapiens
caagaattgaagcaggactaaa

SEQ ID NO: 3814333 - DNA, 20 bp, Homo sapiens
caagaatttgacttggaaaa

SEQ ID NO: 3814334 - DNA, 14 bp, Homo sapiens
caagaccagcctgg

SEQ ID NO: 3814335 - DNA, 16 bp, Homo sapiens
caagactctgtctcaa

SEQ ID NO: 3814336 - DNA, 12 bp, Homo sapiens
caagagaacatt

SEQ ID NO: 3814337 - DNA, 14 bp, Homo sapiens
caagaggagatcca

SEQ ID NO: 3814338 - DNA, 18 bp, Homo sapiens
caagatggctggaaggag

SEQ ID NO: 3814339 - DNA, 17 bp, Homo sapiens
caagccggcagaaatag

SEQ ID NO: 3814340 - DNA, 13 bp, Homo sapiens
caagctgcaccct

SEQ ID NO: 3814341 - DNA, 14 bp, Homo sapiens
caagctgcaccctc

SEQ ID NO: 3814342 - DNA, 21 bp, Homo sapiens
caagctgcaccctcaggcagg

SEQ ID NO: 3814343 - DNA, 13 bp, Homo sapiens
caaggaaaagatg

SEQ ID NO: 3814344 - DNA, 18 bp, Homo sapiens
caaggctgaccaagagag

SEQ ID NO: 3814345 - DNA, 19 bp, Homo sapiens
caaggctgaccaagagaga

SEQ ID NO: 3814346 - DNA, 20 bp, Homo sapiens
caagtaaccaggccccagcc

SEQ ID NO: 3814347 - DNA, 13 bp, Homo sapiens
caagtagctgaga

SEQ ID NO: 3814348 - DNA, 13 bp, Homo sapiens
caagtcaagtgaa

SEQ ID NO: 3814349 - DNA, 21 bp, Homo sapiens
caagtccttgacctctataaa

SEQ ID NO: 3814350 - DNA, 14 bp, Homo sapiens
caagtcttccctga

SEQ ID NO: 3814351 - DNA, 22 bp, Homo sapiens
caagtgaaaaaggaggaagaga

SEQ ID NO: 3814352 - DNA, 21 bp, Homo sapiens
caataaagcagagccaaggcc

SEQ ID NO: 3814353 - DNA, 23 bp, Homo sapiens
caataaagcagagccaaggccac

SEQ ID NO: 3814354 - DNA, 17 bp, Homo sapiens
caataaagctgctgaga

SEQ ID NO: 3814355 - DNA, 13 bp, Homo sapiens
caataaatgctga

SEQ ID NO: 3814356 - DNA, 17 bp, Homo sapiens
caataaatgctgaatga

SEQ ID NO: 3814357 - DNA, 17 bp, Homo sapiens
caatattcaataaagct

SEQ ID NO: 3814358 - DNA, 16 bp, Homo sapiens
caatatttgttactgt

SEQ ID NO: 3814359 - DNA, 17 bp, Homo sapiens
caatctgcattttaaca

SEQ ID NO: 3814360 - DNA, 16 bp, Homo sapiens
caatgatggcaatttt

SEQ ID NO: 3814361 - DNA, 24 bp, Homo sapiens
caatgatggcaattttgtaacgaa

SEQ ID NO: 3814362 - DNA, 16 bp, Homo sapiens
caatgccctacctgcc

SEQ ID NO: 3814363 - DNA, 23 bp, Homo sapiens
caatgccctacctgcctgttctc

SEQ ID NO: 3814364 - DNA, 13 bp, Homo sapiens
caatgcttctgcc

SEQ ID NO: 3814365 - DNA, 15 bp, Homo sapiens
caatggcctaaactt

SEQ ID NO: 3814366 - DNA, 22 bp, Homo sapiens
caatgtgaaaagaaaaatgagc

SEQ ID NO: 3814367 - DNA, 17 bp, Homo sapiens
caattaaaggtcctgcc

SEQ ID NO: 3814368 - DNA, 14 bp, Homo sapiens
caattatgtttctt

SEQ ID NO: 3814369 - DNA, 21 bp, Homo sapiens
caattcctcatttgttcatta

SEQ ID NO: 3814370 - DNA, 22 bp, Homo sapiens
caattcctcatttgttcattaa

SEQ ID NO: 3814371 - DNA, 22 bp, Homo sapiens
caatttttacacaaacctgaaa

SEQ ID NO: 3814372 - DNA, 23 bp, Homo sapiens
cacaaatatttattttctttctg

SEQ ID NO: 3814373 - DNA, 22 bp, Homo sapiens
cacaacctccacctcctgggtt

SEQ ID NO: 3814374 - DNA, 14 bp, Homo sapiens
cacaagagtgaatt

SEQ ID NO: 3814375 - DNA, 17 bp, Homo sapiens
cacaagctgcaccctca

SEQ ID NO: 3814376 - DNA, 19 bp, Homo sapiens
cacaaggctgaccaagaga

SEQ ID NO: 3814377 - DNA, 13 bp, Homo sapiens
ccaggctgggctc

SEQ ID NO: 3814378 - DNA, 13 bp, Homo sapiens
ccagggacagaag

SEQ ID NO: 3814379 - DNA, 18 bp, Homo sapiens
ccagggccatgaactttg

SEQ ID NO: 3814380 - DNA, 21 bp, Homo sapiens
ccaggggaaaatcagcctgct

SEQ ID NO: 3814381 - DNA, 13 bp, Homo sapiens
ccaggtttaagct

SEQ ID NO: 3814382 - DNA, 16 bp, Homo sapiens
ccagtcctagagctcc

SEQ ID NO: 3814383 - DNA, 18 bp, Homo sapiens
ccagtcctagagctcctg

SEQ ID NO: 3814384 - DNA, 20 bp, Homo sapiens
ccagtgccgagaaggaagcc

SEQ ID NO: 3814385 - DNA, 20 bp, Homo sapiens
ccagtgggaggacagagccg

SEQ ID NO: 3814386 - DNA, 20 bp, Homo sapiens
ccagtgggaggtgagaccac

SEQ ID NO: 3814387 - DNA, 16 bp, Homo sapiens
ccagttccagttccca

SEQ ID NO: 3814388 - DNA, 21 bp, Homo sapiens
ccagttcccatggtgtatgtg

SEQ ID NO: 3814389 - DNA, 13 bp, Homo sapiens
ccatcagcctcca

SEQ ID NO: 3814390 - DNA, 14 bp, Homo sapiens
ccatctcaagcaag

SEQ ID NO: 3814391 - DNA, 13 bp, Homo sapiens
ccatctcctccca

SEQ ID NO: 3814392 - DNA, 18 bp, Homo sapiens
ccatctcctcccatggcc

SEQ ID NO: 3814393 - DNA, 15 bp, Homo sapiens
ccatgaactttgtcc

SEQ ID NO: 3814394 - DNA, 12 bp, Homo sapiens
ccatgagctcct

SEQ ID NO: 3814395 - DNA, 21 bp, Homo sapiens
ccatgagctccttaaggctct

SEQ ID NO: 3814396 - DNA, 17 bp, Homo sapiens
ccatgcacccctgatgt

SEQ ID NO: 3814397 - DNA, 15 bp, Homo sapiens
ccatgctcctggccc

SEQ ID NO: 3814398 - DNA, 21 bp, Homo sapiens
ccatggccttccctccccaca

SEQ ID NO: 3814399 - DNA, 17 bp, Homo sapiens
ccatggtgtatgtggtt

SEQ ID NO: 3814400 - DNA, 12 bp, Homo sapiens
ccatgtgtgctg

SEQ ID NO: 3814401 - DNA, 12 bp, Homo sapiens
ccattctcctgc

SEQ ID NO: 3814402 - DNA, 14 bp, Homo sapiens
ccattctcctgcct

SEQ ID NO: 3814403 - DNA, 17 bp, Homo sapiens
ccattctcctgcctcag

SEQ ID NO: 3814404 - DNA, 22 bp, Homo sapiens
ccattctcctgcctcagcctcc

SEQ ID NO: 3814405 - DNA, 14 bp, Homo sapiens
ccattcttcctagt

SEQ ID NO: 3814406 - DNA, 21 bp, Homo sapiens
ccattgctcacactacttgag

SEQ ID NO: 3814407 - DNA, 17 bp, Homo sapiens
ccattgtcttccaaccc

SEQ ID NO: 3814408 - DNA, 21 bp, Homo sapiens
ccattgtcttccaaccccagc

SEQ ID NO: 3814409 - DNA, 16 bp, Homo sapiens
cccaacgaaaagcaca

SEQ ID NO: 3814410 - DNA, 18 bp, Homo sapiens
cccaactccgcccagcct

SEQ ID NO: 3814411 - DNA, 15 bp, Homo sapiens
cccaagagatgaaga

SEQ ID NO: 3814412 - DNA, 19 bp, Homo sapiens
cccaagatgagctgcagcc

SEQ ID NO: 3814413 - DNA, 19 bp, Homo sapiens
cccaagtagtagtgtcttc

SEQ ID NO: 3814414 - DNA, 13 bp, Homo sapiens
cccacaccccagc

SEQ ID NO: 3814415 - DNA, 14 bp, Homo sapiens
cccacaccccagcc

SEQ ID NO: 3814416 - DNA, 22 bp, Homo sapiens
cccacacggaggcatctgcacc

SEQ ID NO: 3814417 - DNA, 22 bp, Homo sapiens
cccacagtcctcacagcctctc

SEQ ID NO: 3814418 - DNA, 20 bp, Homo sapiens
cccaccctcgtggacacctg

SEQ ID NO: 3814419 - DNA, 22 bp, Homo sapiens
cccaccctcgtggacacctgcc

SEQ ID NO: 3814420 - DNA, 21 bp, Homo sapiens
cccaccctgctcctcctgccc

SEQ ID NO: 3814421 - DNA, 15 bp, Homo sapiens
cccacgtcagctggg

SEQ ID NO: 3814422 - DNA, 20 bp, Homo sapiens
cccactaagctttctccttt

SEQ ID NO: 3814423 - DNA, 22 bp, Homo sapiens
cccactctttgctacaataaat

SEQ ID NO: 3814424 - DNA, 17 bp, Homo sapiens
cccactgccgcctcctt

SEQ ID NO: 3814425 - DNA, 12 bp, Homo sapiens
cccactggccag

SEQ ID NO: 3814426 - DNA, 14 bp, Homo sapiens
cccactggccagtc

SEQ ID NO: 3814427 - DNA, 14 bp, Homo sapiens
cccagacctctgaa

SEQ ID NO: 3814428 - DNA, 11 bp, Homo sapiens
cccagcccacc

SEQ ID NO: 3814429 - DNA, 15 bp, Homo sapiens
cccagcccaccctgc

SEQ ID NO: 3814430 - DNA, 17 bp, Homo sapiens
cccagccccttctccca

SEQ ID NO: 3814431 - DNA, 20 bp, Homo sapiens
cccagccccttctcccagca

SEQ ID NO: 3814432 - DNA, 14 bp, Homo sapiens
cccagcctccaggc

SEQ ID NO: 3814433 - DNA, 22 bp, Homo sapiens
cccagcctctccccgctctgga

SEQ ID NO: 3814434 - DNA, 23 bp, Homo sapiens
cccagcctctccccgctctggat

SEQ ID NO: 3814435 - DNA, 22 bp, Homo sapiens
cccagcctgccccagcctccca

SEQ ID NO: 3814436 - DNA, 13 bp, Homo sapiens
cccagctggcctc

SEQ ID NO: 3814437 - DNA, 18 bp, Homo sapiens
cccagctggcctctagaa

SEQ ID NO: 3814438 - DNA, 22 bp, Homo sapiens
cccagcttaaaggggctagagt

SEQ ID NO: 3814439 - DNA, 17 bp, Homo sapiens
cccaggagcaaatgctg

SEQ ID NO: 3814440 - DNA, 17 bp, Homo sapiens
cccaggattcccagaga

SEQ ID NO: 3814441 - DNA, 12 bp, Homo sapiens
cttgagcctggg

SEQ ID NO: 3814442 - DNA, 13 bp, Homo sapiens
cttgaggacacat

SEQ ID NO: 3814443 - DNA, 16 bp, Homo sapiens
cttgaggacacatgtc

SEQ ID NO: 3814444 - DNA, 18 bp, Homo sapiens
cttgagttgattcagctc

SEQ ID NO: 3814445 - DNA, 12 bp, Homo sapiens
cttgcctggggc

SEQ ID NO: 3814446 - DNA, 17 bp, Homo sapiens
cttgctgtagagacttc

SEQ ID NO: 3814447 - DNA, 18 bp, Homo sapiens
cttgctgtagagacttcc

SEQ ID NO: 3814448 - DNA, 12 bp, Homo sapiens
cttggagggcat

SEQ ID NO: 3814449 - DNA, 17 bp, Homo sapiens
cttggccagagctgagt

SEQ ID NO: 3814450 - DNA, 23 bp, Homo sapiens
cttggccagagctgagtggcagc

SEQ ID NO: 3814451 - DNA, 14 bp, Homo sapiens
cttgggccactgtg

SEQ ID NO: 3814452 - DNA, 18 bp, Homo sapiens
cttgggccactgtgaaga

SEQ ID NO: 3814453 - DNA, 20 bp, Homo sapiens
cttggggagtttagggtggg

SEQ ID NO: 3814454 - DNA, 21 bp, Homo sapiens
cttggggagtttagggtgggg

SEQ ID NO: 3814455 - DNA, 15 bp, Homo sapiens
cttggggggctgagg

SEQ ID NO: 3814456 - DNA, 22 bp, Homo sapiens
cttggggggctgaggtgggagg

SEQ ID NO: 3814457 - DNA, 13 bp, Homo sapiens
cttggtagagttt

SEQ ID NO: 3814458 - DNA, 15 bp, Homo sapiens
cttggtagagtttat

SEQ ID NO: 3814459 - DNA, 12 bp, Homo sapiens
cttgtctggctg

SEQ ID NO: 3814460 - DNA, 13 bp, Homo sapiens
cttgttgtggagg

SEQ ID NO: 3814461 - DNA, 21 bp, Homo sapiens
ctttaaaggtcgcacctcctt

SEQ ID NO: 3814462 - DNA, 24 bp, Homo sapiens
ctttaaaggtcgcacctccttgga

SEQ ID NO: 3814463 - DNA, 20 bp, Homo sapiens
ctttacccctcatccaaagt

SEQ ID NO: 3814464 - DNA, 16 bp, Homo sapiens
ctttccaaatgcccag

SEQ ID NO: 3814465 - DNA, 13 bp, Homo sapiens
ctttctgaaataa

SEQ ID NO: 3814466 - DNA, 16 bp, Homo sapiens
ctttctgtgtgcacag

SEQ ID NO: 3814467 - DNA, 19 bp, Homo sapiens
ctttcttccaaacaggctc

SEQ ID NO: 3814468 - DNA, 22 bp, Homo sapiens
ctttcttccaaacaggctcaga

SEQ ID NO: 3814469 - DNA, 18 bp, Homo sapiens
ctttgaagaggaaaatga

SEQ ID NO: 3814470 - DNA, 14 bp, Homo sapiens
ctttgacctgttgg

SEQ ID NO: 3814471 - DNA, 20 bp, Homo sapiens
ctttgcaggcccagcagact

SEQ ID NO: 3814472 - DNA, 19 bp, Homo sapiens
ctttgccccggcttgcctg

SEQ ID NO: 3814473 - DNA, 13 bp, Homo sapiens
ctttgctacaata

SEQ ID NO: 3814474 - DNA, 16 bp, Homo sapiens
ctttgctacaataaat

SEQ ID NO: 3814475 - DNA, 18 bp, Homo sapiens
ctttgctacaataaatgc

SEQ ID NO: 3814476 - DNA, 16 bp, Homo sapiens
ctttgggagagttcat

SEQ ID NO: 3814477 - DNA, 13 bp, Homo sapiens
ctttgggaggcca

SEQ ID NO: 3814478 - DNA, 23 bp, Homo sapiens
ctttgggaggccaaggtgggagg

SEQ ID NO: 3814479 - DNA, 19 bp, Homo sapiens
cttttaaaactatatttat

SEQ ID NO: 3814480 - DNA, 23 bp, Homo sapiens
ctgaaagccctgagctttctgct

SEQ ID NO: 3814481 - DNA, 13 bp, Homo sapiens
ctgaacaaaagct

SEQ ID NO: 3814482 - DNA, 14 bp, Homo sapiens
ctgaaccatccctg

SEQ ID NO: 3814483 - DNA, 16 bp, Homo sapiens
ctgaaccatccctgat

SEQ ID NO: 3814484 - DNA, 22 bp, Homo sapiens
ctgaagatgcagcaaaatgtga

SEQ ID NO: 3814485 - DNA, 13 bp, Homo sapiens
ctgaaggctttca

SEQ ID NO: 3814486 - DNA, 23 bp, Homo sapiens
ctgaaggctttcagggcctccag

SEQ ID NO: 3814487 - DNA, 14 bp, Homo sapiens
ctgaatgtcccaga

SEQ ID NO: 3814488 - DNA, 15 bp, Homo sapiens
ctgaatgtcccagag

SEQ ID NO: 3814489 - DNA, 18 bp, Homo sapiens
ctgaatgtcccagaggct

SEQ ID NO: 3814490 - DNA, 15 bp, Homo sapiens
ctgacagagccagag

SEQ ID NO: 3814491 - DNA, 21 bp, Homo sapiens
ctgaccgggtctgcttctgca

SEQ ID NO: 3814492 - DNA, 16 bp, Homo sapiens
ctgactgttttctctt

SEQ ID NO: 3814493 - DNA, 17 bp, Homo sapiens
ctgagaagtgtatatag

SEQ ID NO: 3814494 - DNA, 21 bp, Homo sapiens
ctgagactagattctcacctg

SEQ ID NO: 3814495 - DNA, 22 bp, Homo sapiens
ctgagagctctctcttctctgt

SEQ ID NO: 3814496 - DNA, 12 bp, Homo sapiens
ctgagaggccac

SEQ ID NO: 3814497 - DNA, 23 bp, Homo sapiens
ctgagatactgaagtgcagctca

SEQ ID NO: 3814498 - DNA, 23 bp, Homo sapiens
ctgagctcgtgatctgcccgcct

SEQ ID NO: 3814499 - DNA, 17 bp, Homo sapiens
ctgaggacacaccccac

SEQ ID NO: 3814500 - DNA, 21 bp, Homo sapiens
ctgaggacatggagagagact

SEQ ID NO: 3814501 - DNA, 23 bp, Homo sapiens
ctgaggacatggagagagactca

SEQ ID NO: 3814502 - DNA, 20 bp, Homo sapiens
ctgaggtcaataaagcagag

SEQ ID NO: 3814503 - DNA, 23 bp, Homo sapiens
ctgaggtcaataaagcagagcca

SEQ ID NO: 3814504 - DNA, 13 bp, Homo sapiens
ctgagtagctggg

SEQ ID NO: 3814505 - DNA, 23 bp, Homo sapiens
ctgagtcaccctacctgtgcctg

SEQ ID NO: 3814506 - DNA, 15 bp, Homo sapiens
ctgagtccagctccc

SEQ ID NO: 3814507 - DNA, 18 bp, Homo sapiens
ctgatcaagtcaccggag

SEQ ID NO: 3814508 - DNA, 15 bp, Homo sapiens
ctgatgctgaaataa

SEQ ID NO: 3814509 - DNA, 23 bp, Homo sapiens
ctgcaaccctggtgtgctgggcg

SEQ ID NO: 3814510 - DNA, 20 bp, Homo sapiens
ctgcaagctctgcctcccgt

SEQ ID NO: 3814511 - DNA, 17 bp, Homo sapiens
ctgcaaggtctttggtt

SEQ ID NO: 3814512 - DNA, 15 bp, Homo sapiens
ctgcacaagctgcac

SEQ ID NO: 3814513 - DNA, 18 bp, Homo sapiens
ctgcacaagctgcaccct

SEQ ID NO: 3814514 - DNA, 17 bp, Homo sapiens
ctgcacccctttttccc

SEQ ID NO: 3814515 - DNA, 14 bp, Homo sapiens
ctgcaccggggcct

SEQ ID NO: 3814516 - DNA, 15 bp, Homo sapiens
ctgcactccagcctg

SEQ ID NO: 3814517 - DNA, 19 bp, Homo sapiens
ctgcactccagcctgggtg

SEQ ID NO: 3814518 - DNA, 16 bp, Homo sapiens
ctgcactgttgctgac

SEQ ID NO: 3814519 - DNA, 17 bp, Homo sapiens
ctgcactgttgctgact

SEQ ID NO: 3814520 - DNA, 19 bp, Homo sapiens
ctgcactgttgctgactac

SEQ ID NO: 3814521 - DNA, 15 bp, Homo sapiens
ctgcagccccccaga

SEQ ID NO: 3814522 - DNA, 22 bp, Homo sapiens
ctgcattcacagcgcctcctgg

SEQ ID NO: 3814523 - DNA, 13 bp, Homo sapiens
ctgcattggcttt

SEQ ID NO: 3814524 - DNA, 12 bp, Homo sapiens
ctgccacacagg

SEQ ID NO: 3814525 - DNA, 12 bp, Homo sapiens
ctgccacctgtc

SEQ ID NO: 3814526 - DNA, 13 bp, Homo sapiens
ctgccacctgtct

SEQ ID NO: 3814527 - DNA, 11 bp, Homo sapiens
ggcgagccctt

SEQ ID NO: 3814528 - DNA, 18 bp, Homo sapiens
ggcgctgccacctgcccc

SEQ ID NO: 3814529 - DNA, 21 bp, Homo sapiens
ggctaagatactgctgatgct

SEQ ID NO: 3814530 - DNA, 22 bp, Homo sapiens
ggctacccctcgactcagcacc

SEQ ID NO: 3814531 - DNA, 14 bp, Homo sapiens
ggctagagtgcagt

SEQ ID NO: 3814532 - DNA, 16 bp, Homo sapiens
ggctagggtggggaga

SEQ ID NO: 3814533 - DNA, 20 bp, Homo sapiens
ggctagtctcttctcagagc

SEQ ID NO: 3814534 - DNA, 19 bp, Homo sapiens
ggctcactgcaagctctgc

SEQ ID NO: 3814535 - DNA, 20 bp, Homo sapiens
ggctcagagggtgtcctgca

SEQ ID NO: 3814536 - DNA, 14 bp, Homo sapiens
ggctcagagtgggg

SEQ ID NO: 3814537 - DNA, 19 bp, Homo sapiens
ggctcagcaaaagatgctt

SEQ ID NO: 3814538 - DNA, 14 bp, Homo sapiens
ggctctgaaagcca

SEQ ID NO: 3814539 - DNA, 13 bp, Homo sapiens
ggctgaaagacag

SEQ ID NO: 3814540 - DNA, 12 bp, Homo sapiens
ggctgagagctc

SEQ ID NO: 3814541 - DNA, 21 bp, Homo sapiens
ggctgcgtcgaactgtcctgg

SEQ ID NO: 3814542 - DNA, 20 bp, Homo sapiens
ggctgggaggagggcaggca

SEQ ID NO: 3814543 - DNA, 16 bp, Homo sapiens
ggctgggggaagaagc

SEQ ID NO: 3814544 - DNA, 19 bp, Homo sapiens
ggctgggtggcaccagcag

SEQ ID NO: 3814545 - DNA, 20 bp, Homo sapiens
ggcttcacggaagagccttg

SEQ ID NO: 3814546 - DNA, 12 bp, Homo sapiens
ggcttccctggg

SEQ ID NO: 3814547 - DNA, 13 bp, Homo sapiens
ggcttccctgggc

SEQ ID NO: 3814548 - DNA, 15 bp, Homo sapiens
ggcttccctgggcct

SEQ ID NO: 3814549 - DNA, 19 bp, Homo sapiens
gggaaccatgaagctggaa

SEQ ID NO: 3814550 - DNA, 23 bp, Homo sapiens
gggaaccatgaagctggaagcac

SEQ ID NO: 3814551 - DNA, 18 bp, Homo sapiens
gggaagaagctctctcct

SEQ ID NO: 3814552 - DNA, 15 bp, Homo sapiens
gggactgtgcctttg

SEQ ID NO: 3814553 - DNA, 21 bp, Homo sapiens
gggagataaaagaaccccaga

SEQ ID NO: 3814554 - DNA, 23 bp, Homo sapiens
gggagctggcaatgccctacctg

SEQ ID NO: 3814555 - DNA, 16 bp, Homo sapiens
gggaggacagagccgg

SEQ ID NO: 3814556 - DNA, 16 bp, Homo sapiens
gggaggagggcaggca

SEQ ID NO: 3814557 - DNA, 15 bp, Homo sapiens
gggaggtcgaggcag

SEQ ID NO: 3814558 - DNA, 19 bp, Homo sapiens
gggaggtcgaggcaggagg

SEQ ID NO: 3814559 - DNA, 21 bp, Homo sapiens
gggatatgatttaaatcagcc

SEQ ID NO: 3814560 - DNA, 20 bp, Homo sapiens
gggatgactaaaatatttat

SEQ ID NO: 3814561 - DNA, 17 bp, Homo sapiens
gggatgactagaggcag

SEQ ID NO: 3814562 - DNA, 14 bp, Homo sapiens
gggatgtctctcat

SEQ ID NO: 3814563 - DNA, 13 bp, Homo sapiens
gggcacagggtct

SEQ ID NO: 3814564 - DNA, 12 bp, Homo sapiens
gggcagctgagg

SEQ ID NO: 3814565 - DNA, 14 bp, Homo sapiens
gggcagctgaggac

SEQ ID NO: 3814566 - DNA, 15 bp, Homo sapiens
gggcagtggggagca

SEQ ID NO: 3814567 - DNA, 21 bp, Homo sapiens
gggcatctgagtccagctccc

SEQ ID NO: 3814568 - DNA, 20 bp, Homo sapiens
gggcatgggagggagggaga

SEQ ID NO: 3814569 - DNA, 18 bp, Homo sapiens
gggccccagaaggcaggg

SEQ ID NO: 3814570 - DNA, 22 bp, Homo sapiens
gggcctcggtgtggagaagcgg

SEQ ID NO: 3814571 - DNA, 16 bp, Homo sapiens
gggcctgggcaggagg

SEQ ID NO: 3814572 - DNA, 14 bp, Homo sapiens
gggcgcggctggga

SEQ ID NO: 3814573 - DNA, 16 bp, Homo sapiens
gggctgaggtgggagg

SEQ ID NO: 3814574 - DNA, 17 bp, Homo sapiens
ggggatcacagcctctg

SEQ ID NO: 3814575 - DNA, 21 bp, Homo sapiens
ggggatgactagaggcaggga

SEQ ID NO: 3814576 - DNA, 19 bp, Homo sapiens
ggggcagtctgagagaggc

SEQ ID NO: 3814577 - DNA, 17 bp, Homo sapiens
ggggccgggggcagtct

SEQ ID NO: 3814578 - DNA, 12 bp, Homo sapiens
ggggcctgggca

SEQ ID NO: 3814579 - DNA, 15 bp, Homo sapiens
ggggcctgggcagga

SEQ ID NO: 3814580 - DNA, 16 bp, Homo sapiens
ggggcgcggctgggag

SEQ ID NO: 3814581 - DNA, 17 bp, Homo sapiens
ggggctgaggtgggagg

SEQ ID NO: 3814582 - DNA, 15 bp, Homo sapiens
gggggagagggctgc

SEQ ID NO: 3814583 - DNA, 22 bp, Homo sapiens
gggggcagtctgagagaggcca

SEQ ID NO: 3814584 - DNA, 18 bp, Homo sapiens
gggggcgcggctgggagg

SEQ ID NO: 3814585 - DNA, 21 bp, Homo sapiens
gggtcatctgtacctctgcct

SEQ ID NO: 3814586 - DNA, 18 bp, Homo sapiens
gggtgctctgaggtcaat

SEQ ID NO: 3814587 - DNA, 23 bp, Homo sapiens
gggtgtcctgcaccggggcctgg

SEQ ID NO: 3814588 - DNA, 15 bp, Homo sapiens
gggttgtgtgtctgt

SEQ ID NO: 3814589 - DNA, 12 bp, Homo sapiens
gggttttggcct

SEQ ID NO: 3814590 - DNA, 23 bp, Homo sapiens
ggtaaaaagattatatatcataa

SEQ ID NO: 3814591 - DNA, 16 bp, Homo sapiens
ggtactgcacattttg

SEQ ID NO: 3814592 - DNA, 19 bp, Homo sapiens
ggtatgaacttgaggacac

SEQ ID NO: 3814593 - DNA, 21 bp, Homo sapiens
ggtatgaacttgaggacacat

SEQ ID NO: 3814594 - DNA, 22 bp, Homo sapiens
ggtatgaacttgaggacacatg

SEQ ID NO: 3814595 - DNA, 13 bp, Homo sapiens
ggtcaataaagca

SEQ ID NO: 3814596 - DNA, 15 bp, Homo sapiens
ggtcaataaagcaga

SEQ ID NO: 3814597 - DNA, 21 bp, Homo sapiens
ggtcctcagagaatttctacc

SEQ ID NO: 3814598 - DNA, 19 bp, Homo sapiens
ggtctcgaactcctgacct

SEQ ID NO: 3814599 - DNA, 20 bp, Homo sapiens
ggtctcgaactcctgacctc

SEQ ID NO: 3814600 - DNA, 19 bp, Homo sapiens
ggtctctctctctctacaa

SEQ ID NO: 3814601 - DNA, 13 bp, Homo sapiens
ggtctgcttctgc

SEQ ID NO: 3814602 - DNA, 11 bp, Homo sapiens
ggtctgtgtgt

SEQ ID NO: 3814603 - DNA, 17 bp, Homo sapiens
ggtctgtgtgtgtgtat

SEQ ID NO: 3814604 - DNA, 20 bp, Homo sapiens
ggtctgtgtgtgtgtatgtg

SEQ ID NO: 3814605 - DNA, 16 bp, Homo sapiens
ggtcttgatctcctga

SEQ ID NO: 3814606 - DNA, 19 bp, Homo sapiens
ggtcttgatctcctgagct

SEQ ID NO: 3814607 - DNA, 14 bp, Homo sapiens
ggtgagaccacctc

SEQ ID NO: 3814608 - DNA, 17 bp, Homo sapiens
ggtgcactggccccacc

SEQ ID NO: 3814609 - DNA, 16 bp, Homo sapiens
ggtgcagaacaggggc

SEQ ID NO: 3814610 - DNA, 13 bp, Homo sapiens
ggtgccactgacc

SEQ ID NO: 3814611 - DNA, 14 bp, Homo sapiens
ggtgcctggccctt

SEQ ID NO: 3814612 - DNA, 16 bp, Homo sapiens
ggtgctctgaggtcaa

SEQ ID NO: 3814613 - DNA, 20 bp, Homo sapiens
ggtgggaggatctcttgagc

SEQ ID NO: 3814614 - DNA, 20 bp, Homo sapiens
ggtgggaggattgcttgagc

SEQ ID NO: 3814615 - DNA, 21 bp, Homo sapiens
ggtggggagagacgggccctg

SEQ ID NO: 3814616 - DNA, 22 bp, Homo sapiens
ggtggggggggggcgcggctgg

SEQ ID NO: 3814617 - DNA, 21 bp, Homo sapiens
ggtgtgcggcctttggcttca

SEQ ID NO: 3814618 - DNA, 12 bp, Homo sapiens
ggtgtggagaag

SEQ ID NO: 3814619 - DNA, 23 bp, Homo sapiens
ggtgtggagaagcggctggcagc

SEQ ID NO: 3814620 - DNA, 12 bp, Homo sapiens
ggtgtgtctgct

SEQ ID NO: 3814621 - DNA, 16 bp, Homo sapiens
ggtgttcataatttca

SEQ ID NO: 3814622 - DNA, 13 bp, Homo sapiens
ggttggtgggggc

SEQ ID NO: 3814623 - DNA, 13 bp, Homo sapiens
ggtttaagctgtt

SEQ ID NO: 3814624 - DNA, 17 bp, Homo sapiens
gtaaaaggtattaaatt

SEQ ID NO: 3814625 - DNA, 18 bp, Homo sapiens
gtaaaagtctagttacct

SEQ ID NO: 3814626 - DNA, 22 bp, Homo sapiens
gtaaaatcccatctgctagaag

SEQ ID NO: 3814627 - DNA, 16 bp, Homo sapiens
gtaaactcaaaatatt

SEQ ID NO: 3814628 - DNA, 16 bp, Homo sapiens
gtaaatttatgtgatg

SEQ ID NO: 3814629 - DNA, 20 bp, Homo sapiens
gtaaccaggccccagcctcc

SEQ ID NO: 3814630 - DNA, 14 bp, Homo sapiens
gtaacttttgtaag

SEQ ID NO: 3814631 - DNA, 19 bp, Homo sapiens
gtaagatggcttatttgta

SEQ ID NO: 3814632 - DNA, 12 bp, Homo sapiens
gtaataaaacaa

SEQ ID NO: 3814633 - DNA, 23 bp, Homo sapiens
gtaatgaaagtgcactgcagtga

SEQ ID NO: 3814634 - DNA, 23 bp, Homo sapiens
gtaatttaaaattgtgatgtgtc

SEQ ID NO: 3814635 - DNA, 14 bp, Homo sapiens
gtacaaaataaaca

SEQ ID NO: 3814636 - DNA, 17 bp, Homo sapiens
gtacatcttgtaagaca

SEQ ID NO: 3814637 - DNA, 19 bp, Homo sapiens
gaggggaataatagaagaa

SEQ ID NO: 3814638 - DNA, 17 bp, Homo sapiens
gaggggcaggggagtgc

SEQ ID NO: 3814639 - DNA, 23 bp, Homo sapiens
gagggttgggcgtgctacctgca

SEQ ID NO: 3814640 - DNA, 15 bp, Homo sapiens
gaggtcaataaagca

SEQ ID NO: 3814641 - DNA, 20 bp, Homo sapiens
gaggtcaataaagcagagcc

SEQ ID NO: 3814642 - DNA, 21 bp, Homo sapiens
gaggtcaataaagcagagcca

SEQ ID NO: 3814643 - DNA, 20 bp, Homo sapiens
gaggtgacttgcctggggcc

SEQ ID NO: 3814644 - DNA, 23 bp, Homo sapiens
gaggtgcttctagttctgccagg

SEQ ID NO: 3814645 - DNA, 19 bp, Homo sapiens
gaggtggaggttgcagtga

SEQ ID NO: 3814646 - DNA, 13 bp, Homo sapiens
gaggttgcagtga

SEQ ID NO: 3814647 - DNA, 22 bp, Homo sapiens
gaggtttgtttagaagaagtgt

SEQ ID NO: 3814648 - DNA, 19 bp, Homo sapiens
gagtatacctcctatatgt

SEQ ID NO: 3814649 - DNA, 14 bp, Homo sapiens
gagtccagctcccc

SEQ ID NO: 3814650 - DNA, 16 bp, Homo sapiens
gagtccagctcccccc

SEQ ID NO: 3814651 - DNA, 14 bp, Homo sapiens
gagtccctgccatc

SEQ ID NO: 3814652 - DNA, 15 bp, Homo sapiens
gagtccctgcctgga

SEQ ID NO: 3814653 - DNA, 20 bp, Homo sapiens
gagtcttccaggtgcctggc

SEQ ID NO: 3814654 - DNA, 18 bp, Homo sapiens
gagtgaggatgtctgggc

SEQ ID NO: 3814655 - DNA, 13 bp, Homo sapiens
gagtgggtgaata

SEQ ID NO: 3814656 - DNA, 17 bp, Homo sapiens
gagtgtgcctgaagtcc

SEQ ID NO: 3814657 - DNA, 22 bp, Homo sapiens
gagtgtgtaatttaaaattgtg

SEQ ID NO: 3814658 - DNA, 19 bp, Homo sapiens
gagttcaagaccagcctgg

SEQ ID NO: 3814659 - DNA, 23 bp, Homo sapiens
gagtttcacgcttattgcccagg

SEQ ID NO: 3814660 - DNA, 18 bp, Homo sapiens
gataaaagaaccccagac

SEQ ID NO: 3814661 - DNA, 15 bp, Homo sapiens
gataaattacattaa

SEQ ID NO: 3814662 - DNA, 22 bp, Homo sapiens
gataattttatttataaactag

SEQ ID NO: 3814663 - DNA, 22 bp, Homo sapiens
gatactgctgatgctgaaataa

SEQ ID NO: 3814664 - DNA, 13 bp, Homo sapiens
gatagatgtgtgg

SEQ ID NO: 3814665 - DNA, 14 bp, Homo sapiens
gatagatgtgtgga

SEQ ID NO: 3814666 - DNA, 19 bp, Homo sapiens
gatatccacaaatgctatt

SEQ ID NO: 3814667 - DNA, 14 bp, Homo sapiens
gatcacagcctctg

SEQ ID NO: 3814668 - DNA, 12 bp, Homo sapiens
gatcagcctggg

SEQ ID NO: 3814669 - DNA, 19 bp, Homo sapiens
gatccacacacagaggaag

SEQ ID NO: 3814670 - DNA, 12 bp, Homo sapiens
gatccagtctgc

SEQ ID NO: 3814671 - DNA, 22 bp, Homo sapiens
gctaccccccctcctgctgcct

SEQ ID NO: 3814672 - DNA, 18 bp, Homo sapiens
gctagggtggggagagac

SEQ ID NO: 3814673 - DNA, 22 bp, Homo sapiens
gctagtctcttctcagagcagc

SEQ ID NO: 3814674 - DNA, 16 bp, Homo sapiens
gctatctctgtgtgca

SEQ ID NO: 3814675 - DNA, 18 bp, Homo sapiens
gctattattttcactgta

SEQ ID NO: 3814676 - DNA, 15 bp, Homo sapiens
gctattttaataaag

SEQ ID NO: 3814677 - DNA, 15 bp, Homo sapiens
gctcacattcccaag

SEQ ID NO: 3814678 - DNA, 18 bp, Homo sapiens
gctcaccacaacctccac

SEQ ID NO: 3814679 - DNA, 18 bp, Homo sapiens
gctcagagggtgtcctgc

SEQ ID NO: 3814680 - DNA, 23 bp, Homo sapiens
gctcagcaaaagatgcttctcac

SEQ ID NO: 3814681 - DNA, 19 bp, Homo sapiens
gctcaggaaccgaggcagg

SEQ ID NO: 3814682 - DNA, 21 bp, Homo sapiens
gctcaggaaccgaggcaggga

SEQ ID NO: 3814683 - DNA, 20 bp, Homo sapiens
gctccagctgttcagctggt

SEQ ID NO: 3814684 - DNA, 12 bp, Homo sapiens
gctccagtggaa

SEQ ID NO: 3814685 - DNA, 21 bp, Homo sapiens
gctccagtggaagaagaaaac

SEQ ID NO: 3814686 - DNA, 16 bp, Homo sapiens
gctcccaattcacctc

SEQ ID NO: 3814687 - DNA, 13 bp, Homo sapiens
gctcccacagaac

SEQ ID NO: 3814688 - DNA, 19 bp, Homo sapiens
gctcccacagaacacagca

SEQ ID NO: 3814689 - DNA, 13 bp, Homo sapiens
gctcccaccaggc

SEQ ID NO: 3814690 - DNA, 23 bp, Homo sapiens
gctcccaccaggcagctccagct

SEQ ID NO: 3814691 - DNA, 14 bp, Homo sapiens
gctcccagggccat

SEQ ID NO: 3814692 - DNA, 18 bp, Homo sapiens
gctcctcgagatcccaac

SEQ ID NO: 3814693 - DNA, 14 bp, Homo sapiens
gctcctggcccact

SEQ ID NO: 3814694 - DNA, 13 bp, Homo sapiens
gctcctgtcccta

SEQ ID NO: 3814695 - DNA, 23 bp, Homo sapiens
gctcctgtccctacccactcttt

SEQ ID NO: 3814696 - DNA, 15 bp, Homo sapiens
gctccttaaggctct

SEQ ID NO: 3814697 - DNA, 15 bp, Homo sapiens
gctctgaaagccagc

SEQ ID NO: 3814698 - DNA, 15 bp, Homo sapiens
gctctgaggagtgga

SEQ ID NO: 3814699 - DNA, 23 bp, Homo sapiens
gctctgcaagaattgaagcagga

SEQ ID NO: 3814700 - DNA, 15 bp, Homo sapiens
gctctgcctcccgtg

SEQ ID NO: 3814701 - DNA, 17 bp, Homo sapiens
gctgaatacagaggcaa

SEQ ID NO: 3814702 - DNA, 14 bp, Homo sapiens
gctgacagagccag

SEQ ID NO: 3814703 - DNA, 13 bp, Homo sapiens
gctgaccaagaga

SEQ ID NO: 3814704 - DNA, 21 bp, Homo sapiens
gctgactactactctgccaat

SEQ ID NO: 3814705 - DNA, 18 bp, Homo sapiens
gctgaggatttcaagcct

SEQ ID NO: 3814706 - DNA, 14 bp, Homo sapiens
gctgaggcctctca

SEQ ID NO: 3814707 - DNA, 18 bp, Homo sapiens
gctgagggtgagtgggtg

SEQ ID NO: 3814708 - DNA, 14 bp, Homo sapiens
gctgaggtgggagg

SEQ ID NO: 3814709 - DNA, 22 bp, Homo sapiens
gctgagtgggggatcacagcct

SEQ ID NO: 3814710 - DNA, 19 bp, Homo sapiens
gctgatgctgaaataaact

SEQ ID NO: 3814711 - DNA, 14 bp, Homo sapiens
gctgattgtattta

SEQ ID NO: 3814712 - DNA, 19 bp, Homo sapiens
gctgcaccctcaggcaggt

SEQ ID NO: 3814713 - DNA, 16 bp, Homo sapiens
gctgccgaccagagcc

SEQ ID NO: 3814714 - DNA, 14 bp, Homo sapiens
gctgcctaataaag

SEQ ID NO: 3814715 - DNA, 15 bp, Homo sapiens
gctgcctaataaaga

SEQ ID NO: 3814716 - DNA, 19 bp, Homo sapiens
gctgcctgacactgagccc

SEQ ID NO: 3814717 - DNA, 15 bp, Homo sapiens
gctgcctttggactt

SEQ ID NO: 3814718 - DNA, 20 bp, Homo sapiens
gctgcctttggacttgtccc

SEQ ID NO: 3814719 - DNA, 17 bp, Homo sapiens
gctgctcatgggaagaa

SEQ ID NO: 3814720 - DNA, 14 bp, Homo sapiens
gctgcttcctaact

SEQ ID NO: 3814721 - DNA, 13 bp, Homo sapiens
gctggatctgtga

SEQ ID NO: 3814722 - DNA, 12 bp, Homo sapiens
gctggatgagca

SEQ ID NO: 3814723 - DNA, 19 bp, Homo sapiens
gctggcagcctccagtggg

SEQ ID NO: 3814724 - DNA, 16 bp, Homo sapiens
gctggcctcaggctgc

SEQ ID NO: 3814725 - DNA, 22 bp, Homo sapiens
gctggcctctagaacacccact

SEQ ID NO: 3814726 - DNA, 19 bp, Homo sapiens
gctgggaagggaaggaagc

SEQ ID NO: 3814727 - DNA, 23 bp, Homo sapiens
gctgggaggaacctgaacctggg

SEQ ID NO: 3814728 - DNA, 17 bp, Homo sapiens
gctgggaggagggcagg

SEQ ID NO: 3814729 - DNA, 19 bp, Homo sapiens
gctgggaggagggcaggca

SEQ ID NO: 3814730 - DNA, 14 bp, Homo sapiens
gctgggtccagggg

SEQ ID NO: 3814731 - DNA, 17 bp, Homo sapiens
gctgggtcggccctgcc

SEQ ID NO: 3814732 - DNA, 19 bp, Homo sapiens
gctgggtcggccctgccca

SEQ ID NO: 3814733 - DNA, 16 bp, Homo sapiens
gctgggtgagctgaga

SEQ ID NO: 3814734 - DNA, 21 bp, Homo sapiens
gctgggtggcaccagcagcct

SEQ ID NO: 3814735 - DNA, 20 bp, Homo sapiens
gctggtctcgaactcctgac

SEQ ID NO: 3814736 - DNA, 15 bp, Homo sapiens
gctgtcctctgaagg

SEQ ID NO: 3814737 - DNA, 21 bp, Homo sapiens
gctgtgtccgctttcatgaac

SEQ ID NO: 3814738 - DNA, 20 bp, Homo sapiens
gcttaaaaatcattctaatt

SEQ ID NO: 3814739 - DNA, 13 bp, Homo sapiens
gcttatctcaggg

SEQ ID NO: 3814740 - DNA, 19 bp, Homo sapiens
gcttatctcaggggtgtgc

SEQ ID NO: 3814741 - DNA, 23 bp, Homo sapiens
gcttatgacatcacttgtacaaa

SEQ ID NO: 3814742 - DNA, 17 bp, Homo sapiens
gcttcacggaagagcct

SEQ ID NO: 3814743 - DNA, 18 bp, Homo sapiens
gcttcacggaagagcctt

SEQ ID NO: 3814744 - DNA, 19 bp, Homo sapiens
gcttcacggaagagccttg

SEQ ID NO: 3814745 - DNA, 16 bp, Homo sapiens
gcttcccaagtagctg

SEQ ID NO: 3814746 - DNA, 14 bp, Homo sapiens
gcttccctggggcc

SEQ ID NO: 3814747 - DNA, 17 bp, Homo sapiens
gcttccctggggcccca

SEQ ID NO: 3814748 - DNA, 19 bp, Homo sapiens
gcttctagttctgccagga

SEQ ID NO: 3814749 - DNA, 17 bp, Homo sapiens
gcttctcactgccatgc

SEQ ID NO: 3814750 - DNA, 15 bp, Homo sapiens
ttagctgtctgctca

SEQ ID NO: 3814751 - DNA, 20 bp, Homo sapiens
ttagcttttaccaacccaaa

SEQ ID NO: 3814752 - DNA, 23 bp, Homo sapiens
ttagtgaattacactcaaggaaa

SEQ ID NO: 3814753 - DNA, 14 bp, Homo sapiens
ttatatatcataaa

SEQ ID NO: 3814754 - DNA, 20 bp, Homo sapiens
ttatatatcataaagtatgc

SEQ ID NO: 3814755 - DNA, 22 bp, Homo sapiens
ttatcccacggaaaatgccaat

SEQ ID NO: 3814756 - DNA, 16 bp, Homo sapiens
ttatctttacttttaa

SEQ ID NO: 3814757 - DNA, 23 bp, Homo sapiens
ttatgacatcacttgtacaaaat

SEQ ID NO: 3814758 - DNA, 13 bp, Homo sapiens
ttatgatgctatt

SEQ ID NO: 3814759 - DNA, 18 bp, Homo sapiens
ttatgggatgtaaacaat

SEQ ID NO: 3814760 - DNA, 10 bp, Homo sapiens
ttatgtgtgt

SEQ ID NO: 3814761 - DNA, 12 bp, Homo sapiens
ttatgtgtgtgt

SEQ ID NO: 3814762 - DNA, 12 bp, Homo sapiens
ttattaaaacag

SEQ ID NO: 3814763 - DNA, 21 bp, Homo sapiens
ttattcatgctttctcctttt

SEQ ID NO: 3814764 - DNA, 19 bp, Homo sapiens
ttattgcctgggcagtgcc

SEQ ID NO: 3814765 - DNA, 14 bp, Homo sapiens
ttattggaattttc

SEQ ID NO: 3814766 - DNA, 12 bp, Homo sapiens
ttatttataaac

SEQ ID NO: 3814767 - DNA, 12 bp, Homo sapiens
ttattttacaaa

SEQ ID NO: 3814768 - DNA, 13 bp, Homo sapiens
ttcaaagagacta

SEQ ID NO: 3814769 - DNA, 18 bp, Homo sapiens
ttcaaatgctgtaacttt

SEQ ID NO: 3814770 - DNA, 18 bp, Homo sapiens
ttcaaccgcttgccatat

SEQ ID NO: 3814771 - DNA, 13 bp, Homo sapiens
ttcaagaaactga

SEQ ID NO: 3814772 - DNA, 16 bp, Homo sapiens
ttcaagtaataaaaca

SEQ ID NO: 3814773 - DNA, 12 bp, Homo sapiens
ttcaataaagct

SEQ ID NO: 3814774 - DNA, 16 bp, Homo sapiens
ttcacagcgcctcctg

SEQ ID NO: 3814775 - DNA, 18 bp, Homo sapiens
ttcaccagggttctgacc

SEQ ID NO: 3814776 - DNA, 23 bp, Homo sapiens
ttcacttcgatgactggatacag

SEQ ID NO: 3814777 - DNA, 14 bp, Homo sapiens
ttcagaagcatcac

SEQ ID NO: 3814778 - DNA, 15 bp, Homo sapiens
ttcagagaggccttt

SEQ ID NO: 3814779 - DNA, 22 bp, Homo sapiens
ttcagaggataaatatcaatgg

SEQ ID NO: 3814780 - DNA, 14 bp, Homo sapiens
ttcagatcctaccc

SEQ ID NO: 3814781 - DNA, 15 bp, Homo sapiens
ttcagatcctacccc

SEQ ID NO: 3814782 - DNA, 14 bp, Homo sapiens
ttcagattcccaga

SEQ ID NO: 3814783 - DNA, 16 bp, Homo sapiens
ttcagatttgccttat

SEQ ID NO: 3814784 - DNA, 19 bp, Homo sapiens
ttcagcagtcagtccccca

SEQ ID NO: 3814785 - DNA, 24 bp, Homo sapiens
ttcagctctgcaagaattgaagca

SEQ ID NO: 3814786 - DNA, 12 bp, Homo sapiens
ttcaggagctga

SEQ ID NO: 3814787 - DNA, 13 bp, Homo sapiens
ttcaggaggctga

SEQ ID NO: 3814788 - DNA, 12 bp, Homo sapiens
ttcatacattat

SEQ ID NO: 3814789 - DNA, 19 bp, Homo sapiens
ttcatagatgagaaaactg

SEQ ID NO: 3814790 - DNA, 21 bp, Homo sapiens
ttcatatatgaggacttgtgt

SEQ ID NO: 3814791 - DNA, 18 bp, Homo sapiens
ttcatgaaaatcctacca

SEQ ID NO: 3814792 - DNA, 18 bp, Homo sapiens
ttcatgatgaattacttc

SEQ ID NO: 3814793 - DNA, 22 bp, Homo sapiens
ttcatgcattctagtgcagaag

SEQ ID NO: 3814794 - DNA, 17 bp, Homo sapiens
ttcatgctatctctgtg

SEQ ID NO: 3814795 - DNA, 14 bp, Homo sapiens
ttcatgctttctcc

SEQ ID NO: 3814796 - DNA, 16 bp, Homo sapiens
ttcatgctttctcctt

SEQ ID NO: 3814797 - DNA, 23 bp, Homo sapiens
ttccaacagctcaagtcttccct

SEQ ID NO: 3814798 - DNA, 16 bp, Homo sapiens
ttccaaccccagctgg

SEQ ID NO: 3814799 - DNA, 19 bp, Homo sapiens
ttccactgccaaaacaatg

SEQ ID NO: 3814800 - DNA, 14 bp, Homo sapiens
ttcccactccttca

SEQ ID NO: 3814801 - DNA, 17 bp, Homo sapiens
ttcccagagagacgctg

SEQ ID NO: 3814802 - DNA, 16 bp, Homo sapiens
ttcccatggtgtatgt

SEQ ID NO: 3814803 - DNA, 16 bp, Homo sapiens
ttccccaacgaaaagc

SEQ ID NO: 3814804 - DNA, 22 bp, Homo sapiens
ttccccatgttggtcaggctgg

SEQ ID NO: 3814805 - DNA, 15 bp, Homo sapiens
ttccctattagagaa

SEQ ID NO: 3814806 - DNA, 15 bp, Homo sapiens
ttccctcccaacaga

SEQ ID NO: 3814807 - DNA, 18 bp, Homo sapiens
ttccctgcttttctccca

SEQ ID NO: 3814808 - DNA, 19 bp, Homo sapiens
ttccctgcttttctcccag

SEQ ID NO: 3814809 - DNA, 13 bp, Homo sapiens
ttccctgggcctc

SEQ ID NO: 3814810 - DNA, 15 bp, Homo sapiens
ttccctggggcccca

SEQ ID NO: 3814811 - DNA, 15 bp, Homo sapiens
ttccgtcacccttgg

SEQ ID NO: 3814812 - DNA, 23 bp, Homo sapiens
ttccgtcacccttggtagagttt

SEQ ID NO: 3814813 - DNA, 13 bp, Homo sapiens
ttcctcatttgtt

SEQ ID NO: 3814814 - DNA, 21 bp, Homo sapiens
ttcctgcagcagagcctggaa

SEQ ID NO: 3814815 - DNA, 21 bp, Homo sapiens
ttcgaaacctgtccataaagt

SEQ ID NO: 3814816 - DNA, 19 bp, Homo sapiens
ttcgccgtctggcgagccc

SEQ ID NO: 3814817 - DNA, 16 bp, Homo sapiens
ttctaatctctttatt

SEQ ID NO: 3814818 - DNA, 21 bp, Homo sapiens
ttctaatctctttattaaaac

SEQ ID NO: 3814819 - DNA, 21 bp, Homo sapiens
ttctacctttttttctctcct

SEQ ID NO: 3814820 - DNA, 21 bp, Homo sapiens
ttctagaaacaaacatctaat

SEQ ID NO: 3814821 - DNA, 13 bp, Homo sapiens
ttctattttgtaa

SEQ ID NO: 3814822 - DNA, 18 bp, Homo sapiens
ttctcacctgccttcaaa

SEQ ID NO: 3814823 - DNA, 17 bp, Homo sapiens
ttctcccagaaggctgg

SEQ ID NO: 3814824 - DNA, 12 bp, Homo sapiens
ttctcccagcac

SEQ ID NO: 3814825 - DNA, 12 bp, Homo sapiens
ttctcttctagg

SEQ ID NO: 3814826 - DNA, 23 bp, Homo sapiens
ttctgaagagtaaggagtagtat

SEQ ID NO: 3814827 - DNA, 13 bp, Homo sapiens
ttctgaagtactt

SEQ ID NO: 3814828 - DNA, 13 bp, Homo sapiens
ttctgccaggaga

SEQ ID NO: 3814829 - DNA, 14 bp, Homo sapiens
ttctgcctcagctt

SEQ ID NO: 3814830 - DNA, 19 bp, Homo sapiens
ttctggaatacatgaaata

SEQ ID NO: 3814831 - DNA, 21 bp, Homo sapiens
ttctggtatgaacttgaggac

SEQ ID NO: 3814832 - DNA, 22 bp, Homo sapiens
ttctggtatgaacttgaggaca

SEQ ID NO: 3814833 - DNA, 15 bp, Homo sapiens
ttctgtatgtgacaa

SEQ ID NO: 3814834 - DNA, 20 bp, Homo sapiens
ttctgtatgtgacaacattt

SEQ ID NO: 3814835 - DNA, 14 bp, Homo sapiens
ttctgtgtgcacag

SEQ ID NO: 3814836 - DNA, 17 bp, Homo sapiens
ttctgttttgtaaatgt

SEQ ID NO: 3814837 - DNA, 20 bp, Homo sapiens
ttctgtttttctaggcctgg

SEQ ID NO: 3814838 - DNA, 21 bp, Homo sapiens
ttgaagaggaaaatgaataat

SEQ ID NO: 3814839 - DNA, 11 bp, Homo sapiens
ttgaggacaca

SEQ ID NO: 3814840 - DNA, 18 bp, Homo sapiens
ttgataaaagattttcct

SEQ ID NO: 3814841 - DNA, 13 bp, Homo sapiens
ttgatgttaacaa

SEQ ID NO: 3814842 - DNA, 14 bp, Homo sapiens
ttgatttaatatct

SEQ ID NO: 3814843 - DNA, 14 bp, Homo sapiens
ttgcaccactgcac

SEQ ID NO: 3814844 - DNA, 17 bp, Homo sapiens
ttgcaggcccagcagac

SEQ ID NO: 3814845 - DNA, 18 bp, Homo sapiens
ttgcatgaattactgtat

SEQ ID NO: 3814846 - DNA, 15 bp, Homo sapiens
ttgccagagccttaa

SEQ ID NO: 3814847 - DNA, 19 bp, Homo sapiens
ttgcctgcctgggcctccc

SEQ ID NO: 3814848 - DNA, 18 bp, Homo sapiens
ttgcctgggcagtgccca

SEQ ID NO: 3814849 - DNA, 15 bp, Homo sapiens
ttgcgagaattttca

SEQ ID NO: 3814850 - DNA, 18 bp, Homo sapiens
ttgctacaataaatgctg

SEQ ID NO: 3814851 - DNA, 19 bp, Homo sapiens
ttgctcctgcatgcaacta

SEQ ID NO: 3814852 - DNA, 19 bp, Homo sapiens
ttgctgactactactctgc

SEQ ID NO: 3814853 - DNA, 23 bp, Homo sapiens
ttgctggactgtcatagaaatta

SEQ ID NO: 3814854 - DNA, 20 bp, Homo sapiens
ttgctggggccgaaagaaca

SEQ ID NO: 3814855 - DNA, 14 bp, Homo sapiens
ttgcttgaaagaaa

SEQ ID NO: 3814856 - DNA, 23 bp, Homo sapiens
ttgctttaagaaactgttactgt

SEQ ID NO: 3814857 - DNA, 12 bp, Homo sapiens
ggacacatgtcc

SEQ ID NO: 3814858 - DNA, 13 bp, Homo sapiens
ggacacatgtcca

SEQ ID NO: 3814859 - DNA, 19 bp, Homo sapiens
ggacacatgtccagtggga

SEQ ID NO: 3814860 - DNA, 16 bp, Homo sapiens
ggacaccccgactttt

SEQ ID NO: 3814861 - DNA, 16 bp, Homo sapiens
ggacacctaggctagg

SEQ ID NO: 3814862 - DNA, 15 bp, Homo sapiens
ggacacctgccctgc

SEQ ID NO: 3814863 - DNA, 17 bp, Homo sapiens
ggacacctgccctgccc

SEQ ID NO: 3814864 - DNA, 17 bp, Homo sapiens
ggacactcaaaagctgg

SEQ ID NO: 3814865 - DNA, 14 bp, Homo sapiens
ggacagaagcagga

SEQ ID NO: 3814866 - DNA, 14 bp, Homo sapiens
ggacatcatgaagc

SEQ ID NO: 3814867 - DNA, 12 bp, Homo sapiens
ggaccagcctct

SEQ ID NO: 3814868 - DNA, 14 bp, Homo sapiens
ggactccttagact

SEQ ID NO: 3814869 - DNA, 17 bp, Homo sapiens
ggactggtgatgggaca

SEQ ID NO: 3814870 - DNA, 15 bp, Homo sapiens
ggactgtcatagaaa

SEQ ID NO: 3814871 - DNA, 16 bp, Homo sapiens
ggacttgtgtctctgt

SEQ ID NO: 3814872 - DNA, 15 bp, Homo sapiens
ggagaaacagagaca

SEQ ID NO: 3814873 - DNA, 17 bp, Homo sapiens
ggagaagcggctggcag

SEQ ID NO: 3814874 - DNA, 22 bp, Homo sapiens
ggagaatgtcagtatgtggaag

SEQ ID NO: 3814875 - DNA, 14 bp, Homo sapiens
ggagacagagacag

SEQ ID NO: 3814876 - DNA, 15 bp, Homo sapiens
ggagacagagacaga

SEQ ID NO: 3814877 - DNA, 15 bp, Homo sapiens
ggagagacgggccct

SEQ ID NO: 3814878 - DNA, 21 bp, Homo sapiens
ggagagaggggaataatagaa

SEQ ID NO: 3814879 - DNA, 21 bp, Homo sapiens
ggagagctagcagcagggagg

SEQ ID NO: 3814880 - DNA, 15 bp, Homo sapiens
ggagccactctgttc

SEQ ID NO: 3814881 - DNA, 16 bp, Homo sapiens
ggagccgggagcctga

SEQ ID NO: 3814882 - DNA, 22 bp, Homo sapiens
ggagctggcaatgccctacctg

SEQ ID NO: 3814883 - DNA, 20 bp, Homo sapiens
ggagctttcaaagaaggaat

SEQ ID NO: 3814884 - DNA, 22 bp, Homo sapiens
ggaggaaggagcctatggcatc

SEQ ID NO: 3814885 - DNA, 14 bp, Homo sapiens
ggaggacagagccg

SEQ ID NO: 3814886 - DNA, 17 bp, Homo sapiens
ggaggagcttgggggat

SEQ ID NO: 3814887 - DNA, 17 bp, Homo sapiens
ggaggatctcttgagcc

SEQ ID NO: 3814888 - DNA, 12 bp, Homo sapiens
ggaggatggaga

SEQ ID NO: 3814889 - DNA, 13 bp, Homo sapiens
ggaggatggagag

SEQ ID NO: 3814890 - DNA, 13 bp, Homo sapiens
ggagggcaggcat

SEQ ID NO: 3814891 - DNA, 14 bp, Homo sapiens
ggagggggagaggg

SEQ ID NO: 3814892 - DNA, 20 bp, Homo sapiens
ggaggtcaaggctgcagtga

SEQ ID NO: 3814893 - DNA, 16 bp, Homo sapiens
ggaggtcgaggcagga

SEQ ID NO: 3814894 - DNA, 13 bp, Homo sapiens
ggagtcttcactg

SEQ ID NO: 3814895 - DNA, 11 bp, Homo sapiens
ggagtgtgtaa

SEQ ID NO: 3814896 - DNA, 22 bp, Homo sapiens
ggagtgtgtaatttaaaattgt

SEQ ID NO: 3814897 - DNA, 18 bp, Homo sapiens
ggagttcaagaccagcct

SEQ ID NO: 3814898 - DNA, 18 bp, Homo sapiens
ggatgactagaggcaggg

SEQ ID NO: 3814899 - DNA, 17 bp, Homo sapiens
ggatggaatgatgggtc

SEQ ID NO: 3814900 - DNA, 18 bp, Homo sapiens
ggatggatttccagccaa

SEQ ID NO: 3814901 - DNA, 13 bp, Homo sapiens
ggattcccagaga

SEQ ID NO: 3814902 - DNA, 15 bp, Homo sapiens
ggcaaaaaaattaaa

SEQ ID NO: 3814903 - DNA, 14 bp, Homo sapiens
ggcaaccctcagct

SEQ ID NO: 3814904 - DNA, 18 bp, Homo sapiens
ggcaactgcattggcttt

SEQ ID NO: 3814905 - DNA, 14 bp, Homo sapiens
ggcaataaaggaga

SEQ ID NO: 3814906 - DNA, 14 bp, Homo sapiens
ggcaattttgtaac

SEQ ID NO: 3814907 - DNA, 17 bp, Homo sapiens
ggcaccagcagcctgga

SEQ ID NO: 3814908 - DNA, 23 bp, Homo sapiens
ggcagatttactgtcccaggagc

SEQ ID NO: 3814909 - DNA, 16 bp, Homo sapiens
ggcagcaaagtgtcag

SEQ ID NO: 3814910 - DNA, 14 bp, Homo sapiens
ggcagcctccagtg

SEQ ID NO: 3814911 - DNA, 13 bp, Homo sapiens
ggcagctccagct

SEQ ID NO: 3814912 - DNA, 18 bp, Homo sapiens
ggcaggaggatcacttga

SEQ ID NO: 3814913 - DNA, 16 bp, Homo sapiens
ggcaggatatccccag

SEQ ID NO: 3814914 - DNA, 23 bp, Homo sapiens
ggcaggcatcggggagccgggag

SEQ ID NO: 3814915 - DNA, 15 bp, Homo sapiens
ggcaggttggtgggg

SEQ ID NO: 3814916 - DNA, 14 bp, Homo sapiens
ggcagtgcccacca

SEQ ID NO: 3814917 - DNA, 19 bp, Homo sapiens
ggcagtgcccaccatgcac

SEQ ID NO: 3814918 - DNA, 15 bp, Homo sapiens
ggcatcccaggggac

SEQ ID NO: 3814919 - DNA, 22 bp, Homo sapiens
ggcatcggggagccgggagcct

SEQ ID NO: 3814920 - DNA, 23 bp, Homo sapiens
ggcatctccctgaccttctccag

SEQ ID NO: 3814921 - DNA, 15 bp, Homo sapiens
ggcatgaagacagat

SEQ ID NO: 3814922 - DNA, 14 bp, Homo sapiens
ggcatttgctgaat

SEQ ID NO: 3814923 - DNA, 13 bp, Homo sapiens
ggccaaggtggga

SEQ ID NO: 3814924 - DNA, 11 bp, Homo sapiens
ggccacactgg

SEQ ID NO: 3814925 - DNA, 14 bp, Homo sapiens
ggccacagaaaggc

SEQ ID NO: 3814926 - DNA, 23 bp, Homo sapiens
ggccagatgcacatccctggaag

SEQ ID NO: 3814927 - DNA, 16 bp, Homo sapiens
ggccagtcctagagct

SEQ ID NO: 3814928 - DNA, 17 bp, Homo sapiens
ggccagtcctagagctc

SEQ ID NO: 3814929 - DNA, 21 bp, Homo sapiens
ggccagtcctagagctcctgt

SEQ ID NO: 3814930 - DNA, 15 bp, Homo sapiens
ggccatgaactttgt

SEQ ID NO: 3814931 - DNA, 23 bp, Homo sapiens
ggccatgaccactttccccgtgg

SEQ ID NO: 3814932 - DNA, 20 bp, Homo sapiens
ggcccagagtttacattcta

SEQ ID NO: 3814933 - DNA, 19 bp, Homo sapiens
ggccctcttcttattcatg

SEQ ID NO: 3814934 - DNA, 17 bp, Homo sapiens
ggccctgtgccttggtg

SEQ ID NO: 3814935 - DNA, 14 bp, Homo sapiens
ggcctaaacttcag

SEQ ID NO: 3814936 - DNA, 21 bp, Homo sapiens
ggcctaacctgccgagagtcc

SEQ ID NO: 3814937 - DNA, 21 bp, Homo sapiens
ggcctccgtccaggagcctgg

SEQ ID NO: 3814938 - DNA, 20 bp, Homo sapiens
ggcctcggtgtggagaagcg

SEQ ID NO: 3814939 - DNA, 23 bp, Homo sapiens
ggcctctagaacacccactggcc

SEQ ID NO: 3814940 - DNA, 22 bp, Homo sapiens
ttggagctgttccattgggtcc

SEQ ID NO: 3814941 - DNA, 15 bp, Homo sapiens
ttggcaggaggcagg

SEQ ID NO: 3814942 - DNA, 13 bp, Homo sapiens
ttggcttaaaaat

SEQ ID NO: 3814943 - DNA, 23 bp, Homo sapiens
ttggcttcacggaagagccttgc

SEQ ID NO: 3814944 - DNA, 18 bp, Homo sapiens
ttgggaatggatcctgga

SEQ ID NO: 3814945 - DNA, 22 bp, Homo sapiens
ttggggggctgaggtgggagga

SEQ ID NO: 3814946 - DNA, 13 bp, Homo sapiens
ttggtagagttta

SEQ ID NO: 3814947 - DNA, 21 bp, Homo sapiens
ttgtaagacaaaggttttcct

SEQ ID NO: 3814948 - DNA, 22 bp, Homo sapiens
ttgtaagacaaaggttttcctc

SEQ ID NO: 3814949 - DNA, 14 bp, Homo sapiens
ttgtacaaaataaa

SEQ ID NO: 3814950 - DNA, 23 bp, Homo sapiens
ttgtacaaaataaacaaataaca

SEQ ID NO: 3814951 - DNA, 15 bp, Homo sapiens
ttgtacaaagatatg

SEQ ID NO: 3814952 - DNA, 21 bp, Homo sapiens
ttgtacattatgttattggaa

SEQ ID NO: 3814953 - DNA, 18 bp, Homo sapiens
ttgtatcaaattattttt

SEQ ID NO: 3814954 - DNA, 16 bp, Homo sapiens
ttgtatttatgtgtat

SEQ ID NO: 3814955 - DNA, 13 bp, Homo sapiens
ttgtcacgccaga

SEQ ID NO: 3814956 - DNA, 21 bp, Homo sapiens
ttgtccggtggaaggccttct

SEQ ID NO: 3814957 - DNA, 22 bp, Homo sapiens
ttgtcctcagccccgcgtggaa

SEQ ID NO: 3814958 - DNA, 12 bp, Homo sapiens
ttgtcttccaac

SEQ ID NO: 3814959 - DNA, 12 bp, Homo sapiens
ttgtgatgtgtc

SEQ ID NO: 3814960 - DNA, 11 bp, Homo sapiens
ttgtgcagaga

SEQ ID NO: 3814961 - DNA, 14 bp, Homo sapiens
ttgtggtaaaaaga

SEQ ID NO: 3814962 - DNA, 18 bp, Homo sapiens
tttaaaaaaagtatatat

SEQ ID NO: 3814963 - DNA, 13 bp, Homo sapiens
tttaaaactatat

SEQ ID NO: 3814964 - DNA, 20 bp, Homo sapiens
tttaaaatatttgtctttaa

SEQ ID NO: 3814965 - DNA, 21 bp, Homo sapiens
tttaaaggtcgcacctccttg

SEQ ID NO: 3814966 - DNA, 13 bp, Homo sapiens
tttaagtatttag

SEQ ID NO: 3814967 - DNA, 18 bp, Homo sapiens
tttaagtatttaggtttt

SEQ ID NO: 3814968 - DNA, 19 bp, Homo sapiens
tttacatataaaatgtaat

SEQ ID NO: 3814969 - DNA, 16 bp, Homo sapiens
tttactgcagctttgt

SEQ ID NO: 3814970 - DNA, 15 bp, Homo sapiens
tttacttttaaacag

SEQ ID NO: 3814971 - DNA, 17 bp, Homo sapiens
tttagaagaagtgtgtc

SEQ ID NO: 3814972 - DNA, 10 bp, Homo sapiens
tttagccata

SEQ ID NO: 3814973 - DNA, 22 bp, Homo sapiens
tttatcatgtcgtaggtaaact

SEQ ID NO: 3814974 - DNA, 17 bp, Homo sapiens
tttatcccacggaaaat

SEQ ID NO: 3814975 - DNA, 17 bp, Homo sapiens
tttatgaaggcaaaaaa

SEQ ID NO: 3814976 - DNA, 14 bp, Homo sapiens
tttatgatgctatt

SEQ ID NO: 3814977 - DNA, 23 bp, Homo sapiens
tttatggaggatggagagagggg

SEQ ID NO: 3814978 - DNA, 17 bp, Homo sapiens
tttcaagaaactgagga

SEQ ID NO: 3814979 - DNA, 15 bp, Homo sapiens
tttcaccagaagtta

SEQ ID NO: 3814980 - DNA, 24 bp, Homo sapiens
tttcactgtagaatgatttcatgc

SEQ ID NO: 3814981 - DNA, 15 bp, Homo sapiens
tttcatacattatat

SEQ ID NO: 3814982 - DNA, 17 bp, Homo sapiens
tttcatacattatattc

SEQ ID NO: 3814983 - DNA, 22 bp, Homo sapiens
tttcattgctgggcttgtctgt

SEQ ID NO: 3814984 - DNA, 15 bp, Homo sapiens
tttccactgccaaaa

SEQ ID NO: 3814985 - DNA, 23 bp, Homo sapiens
tttcctagccctctcacatttat

SEQ ID NO: 3814986 - DNA, 21 bp, Homo sapiens
tttcctcttctattttgtaaa

SEQ ID NO: 3814987 - DNA, 17 bp, Homo sapiens
tttccttttttgttatt

SEQ ID NO: 3814988 - DNA, 21 bp, Homo sapiens
tttctaaatgttggaatgtta

SEQ ID NO: 3814989 - DNA, 17 bp, Homo sapiens
tttctcccagaaggctg

SEQ ID NO: 3814990 - DNA, 18 bp, Homo sapiens
tttctggaatacatgaaa

SEQ ID NO: 3814991 - DNA, 14 bp, Homo sapiens
tttctttcatacat

SEQ ID NO: 3814992 - DNA, 14 bp, Homo sapiens
tttctttgattttc

SEQ ID NO: 3814993 - DNA, 15 bp, Homo sapiens
tttctttgtgtagct

SEQ ID NO: 3814994 - DNA, 20 bp, Homo sapiens
tttcttttgttttcttcatt

SEQ ID NO: 3814995 - DNA, 15 bp, Homo sapiens
tttgaacaaatgtat

SEQ ID NO: 3814996 - DNA, 18 bp, Homo sapiens
tttgacagtgttgaaaat

SEQ ID NO: 3814997 - DNA, 20 bp, Homo sapiens
tttgcctgcctgggcctccc

SEQ ID NO: 3814998 - DNA, 14 bp, Homo sapiens
tttgctacaataaa

SEQ ID NO: 3814999 - DNA, 15 bp, Homo sapiens
tttggaatgaagaaa

SEQ ID NO: 3815000 - DNA, 16 bp, Homo sapiens
tttggctagtccttgt

SEQ ID NO: 3815001 - DNA, 17 bp, Homo sapiens
tttgtaaactcaaaata

SEQ ID NO: 3815002 - DNA, 18 bp, Homo sapiens
tttgtaaggtttttgtag

SEQ ID NO: 3815003 - DNA, 19 bp, Homo sapiens
tttgtacatagttatttat

SEQ ID NO: 3815004 - DNA, 12 bp, Homo sapiens
tttgtacattat

SEQ ID NO: 3815005 - DNA, 16 bp, Homo sapiens
tttgtacattatgtta

SEQ ID NO: 3815006 - DNA, 22 bp, Homo sapiens
tttgtacattatgttattggaa

SEQ ID NO: 3815007 - DNA, 14 bp, Homo sapiens
tttgtactgaaaaa

SEQ ID NO: 3815008 - DNA, 23 bp, Homo sapiens
tttgtcttaaaaagtggaaaaat

SEQ ID NO: 3815009 - DNA, 11 bp, Homo sapiens
tttgtggggag

SEQ ID NO: 3815010 - DNA, 19 bp, Homo sapiens
tttgtggtaaaaagattat

SEQ ID NO: 3815011 - DNA, 15 bp, Homo sapiens
tttgttgtcagctga

SEQ ID NO: 3815012 - DNA, 15 bp, Homo sapiens
tttgtttcctttgtt

SEQ ID NO: 3815013 - DNA, 13 bp, Homo sapiens
ttttaaacagtga

SEQ ID NO: 3815014 - DNA, 16 bp, Homo sapiens
ttttaactgcactcat

SEQ ID NO: 3815015 - DNA, 19 bp, Homo sapiens
ttttaagagaaaactgcag

SEQ ID NO: 3815016 - DNA, 15 bp, Homo sapiens
ttttaagtatttagg

SEQ ID NO: 3815017 - DNA, 18 bp, Homo sapiens
ttttacaaattgttttta

SEQ ID NO: 3815018 - DNA, 18 bp, Homo sapiens
ttttactgacagaaatgc

SEQ ID NO: 3815019 - DNA, 24 bp, Homo sapiens
ttttcagaattgaaggagaaaatg

SEQ ID NO: 3815020 - DNA, 20 bp, Homo sapiens
ttttcagctattagcaactg

SEQ ID NO: 3815021 - DNA, 23 bp, Homo sapiens
ttttctacctttttttctctcct

SEQ ID NO: 3815022 - DNA, 13 bp, Homo sapiens
ttttctcccagaa

SEQ ID NO: 3815023 - DNA, 12 bp, Homo sapiens
ttttctttgtgt

SEQ ID NO: 3815024 - DNA, 19 bp, Homo sapiens
ttttctttgtgtagctttg

SEQ ID NO: 3815025 - DNA, 21 bp, Homo sapiens
ttttcttttgttttcttcatt

SEQ ID NO: 3815026 - DNA, 23 bp, Homo sapiens
ttttgacagagttggtgttcata

SEQ ID NO: 3815027 - DNA, 20 bp, Homo sapiens
ttttgatttgtactgaaaaa

SEQ ID NO: 3815028 - DNA, 21 bp, Homo sapiens
ttttgatttgtactgaaaaat

SEQ ID NO: 3815029 - DNA, 15 bp, Homo sapiens
ttttgtcctgttatt

SEQ ID NO: 3815030 - DNA, 15 bp, Homo sapiens
tttttatttccacat

SEQ ID NO: 3815031 - DNA, 14 bp, Homo sapiens
tttttgatggctaa

SEQ ID NO: 3815032 - DNA, 19 bp, Homo sapiens
tttttgctcttctgtatgt

SEQ ID NO: 3815033 - DNA, 13 bp, Homo sapiens
tttttgtacatta

SEQ ID NO: 3815034 - DNA, 17 bp, Homo sapiens
tttttgttgtgttctgt

SEQ ID NO: 3815035 - DNA, 15 bp, Homo sapiens
ttttttgatggctaa

SEQ ID NO: 3815036 - DNA, 18 bp, Homo sapiens
tcctcagttcctgcagca

SEQ ID NO: 3815037 - DNA, 16 bp, Homo sapiens
tcctcattataaaatg

SEQ ID NO: 3815038 - DNA, 12 bp, Homo sapiens
tcctcatttgtt

SEQ ID NO: 3815039 - DNA, 18 bp, Homo sapiens
tcctcatttgttcattaa

SEQ ID NO: 3815040 - DNA, 16 bp, Homo sapiens
tcctccagaccaccag

SEQ ID NO: 3815041 - DNA, 17 bp, Homo sapiens
tcctccagaccaccagc

SEQ ID NO: 3815042 - DNA, 16 bp, Homo sapiens
tcctcccaccagtggc

SEQ ID NO: 3815043 - DNA, 21 bp, Homo sapiens
tcctcccaccagtggccccca

SEQ ID NO: 3815044 - DNA, 14 bp, Homo sapiens
tcctcccatggcct

SEQ ID NO: 3815045 - DNA, 15 bp, Homo sapiens
tcctcccatggcctt

SEQ ID NO: 3815046 - DNA, 20 bp, Homo sapiens
tcctcccatggccttccctc

SEQ ID NO: 3815047 - DNA, 14 bp, Homo sapiens
tcctcccccagagc

SEQ ID NO: 3815048 - DNA, 15 bp, Homo sapiens
tcctcccccagagcc

SEQ ID NO: 3815049 - DNA, 15 bp, Homo sapiens
tcctcctgccctgtc

SEQ ID NO: 3815050 - DNA, 16 bp, Homo sapiens
tcctcctgccctgtcc

SEQ ID NO: 3815051 - DNA, 21 bp, Homo sapiens
tcctcgacttatcaccacacc

SEQ ID NO: 3815052 - DNA, 23 bp, Homo sapiens
tcctcgagatcccaacactgcca

SEQ ID NO: 3815053 - DNA, 15 bp, Homo sapiens
tcctgaaatttcaga

SEQ ID NO: 3815054 - DNA, 14 bp, Homo sapiens
tcctgacctcgtga

SEQ ID NO: 3815055 - DNA, 16 bp, Homo sapiens
tcctgcagcagagcct

SEQ ID NO: 3815056 - DNA, 16 bp, Homo sapiens
tcctgctgcctaataa

SEQ ID NO: 3815057 - DNA, 23 bp, Homo sapiens
tcctgtatattctcttgtctggc

SEQ ID NO: 3815058 - DNA, 16 bp, Homo sapiens
tcctgtccctacccac

SEQ ID NO: 3815059 - DNA, 18 bp, Homo sapiens
tcctgtccctacccactc

SEQ ID NO: 3815060 - DNA, 19 bp, Homo sapiens
tcctgtccctcatccatag

SEQ ID NO: 3815061 - DNA, 15 bp, Homo sapiens
tcctgtctccctcct

SEQ ID NO: 3815062 - DNA, 18 bp, Homo sapiens
tcctgttctttgggctca

SEQ ID NO: 3815063 - DNA, 14 bp, Homo sapiens
tcctgttttctaat

SEQ ID NO: 3815064 - DNA, 22 bp, Homo sapiens
tccttaccgtgggcactgaagg

SEQ ID NO: 3815065 - DNA, 22 bp, Homo sapiens
tccttgcttatgacatcacttg

SEQ ID NO: 3815066 - DNA, 20 bp, Homo sapiens
tcctttgaagaggaaaatga

SEQ ID NO: 3815067 - DNA, 14 bp, Homo sapiens
tcctttgagggcag

SEQ ID NO: 3815068 - DNA, 16 bp, Homo sapiens
tcctttgttcttacct

SEQ ID NO: 3815069 - DNA, 19 bp, Homo sapiens
tccttttgcaacaagacaa

SEQ ID NO: 3815070 - DNA, 20 bp, Homo sapiens
tcgaaacctgtccataaagt

SEQ ID NO: 3815071 - DNA, 14 bp, Homo sapiens
tcgactcagcacca

SEQ ID NO: 3815072 - DNA, 23 bp, Homo sapiens
tcgctgtgtcagcatagaagtaa

SEQ ID NO: 3815073 - DNA, 23 bp, Homo sapiens
tcggctacccctcgactcagcac

SEQ ID NO: 3815074 - DNA, 21 bp, Homo sapiens
tcgggaggtcgaggcaggagg

SEQ ID NO: 3815075 - DNA, 21 bp, Homo sapiens
tcgggagttcaagaccagcct

SEQ ID NO: 3815076 - DNA, 12 bp, Homo sapiens
tcgtggacacct

SEQ ID NO: 3815077 - DNA, 13 bp, Homo sapiens
tcgtggacacctg

SEQ ID NO: 3815078 - DNA, 15 bp, Homo sapiens
tcgtggacacctgcc

SEQ ID NO: 3815079 - DNA, 16 bp, Homo sapiens
tcgtggacacctgccc

SEQ ID NO: 3815080 - DNA, 18 bp, Homo sapiens
tcgtggacacctgccctg

SEQ ID NO: 3815081 - DNA, 18 bp, Homo sapiens
tcgttagaggagcaacag

SEQ ID NO: 3815082 - DNA, 23 bp, Homo sapiens
tctaacactcgactctgctgctc

SEQ ID NO: 3815083 - DNA, 14 bp, Homo sapiens
tctaatctctttat

SEQ ID NO: 3815084 - DNA, 18 bp, Homo sapiens
tctaatgatcaaaacatg

SEQ ID NO: 3815085 - DNA, 21 bp, Homo sapiens
tctaattacaaagttcactgt

SEQ ID NO: 3815086 - DNA, 16 bp, Homo sapiens
tctacaatgacacaca

SEQ ID NO: 3815087 - DNA, 19 bp, Homo sapiens
tctacacatatatgtatat

SEQ ID NO: 3815088 - DNA, 19 bp, Homo sapiens
tctacctttttttctctcc

SEQ ID NO: 3815089 - DNA, 17 bp, Homo sapiens
tctactgagacatgact

SEQ ID NO: 3815090 - DNA, 17 bp, Homo sapiens
tctagaacacaggcaaa

SEQ ID NO: 3815091 - DNA, 15 bp, Homo sapiens
tctagaacacccact

SEQ ID NO: 3815092 - DNA, 14 bp, Homo sapiens
tctagacactgcca

SEQ ID NO: 3815093 - DNA, 19 bp, Homo sapiens
tctagggaaaaaccagcgt

SEQ ID NO: 3815094 - DNA, 22 bp, Homo sapiens
tctagggaaaaaccagcgtgtg

SEQ ID NO: 3815095 - DNA, 14 bp, Homo sapiens
tctagttctgccag

SEQ ID NO: 3815096 - DNA, 22 bp, Homo sapiens
tctagttgattgcgagaatttt

SEQ ID NO: 3815097 - DNA, 18 bp, Homo sapiens
tctatggattatccactg

SEQ ID NO: 3815098 - DNA, 19 bp, Homo sapiens
tctcagattttaaggggga

SEQ ID NO: 3815099 - DNA, 14 bp, Homo sapiens
tctcagggcctggt

SEQ ID NO: 3815100 - DNA, 16 bp, Homo sapiens
tctcattccagaggaa

SEQ ID NO: 3815101 - DNA, 18 bp, Homo sapiens
tctccaagtctctctgtg

SEQ ID NO: 3815102 - DNA, 19 bp, Homo sapiens
tctccagggacagaagcag

SEQ ID NO: 3815103 - DNA, 12 bp, Homo sapiens
tctcccagcaca

SEQ ID NO: 3815104 - DNA, 12 bp, Homo sapiens
tctccccgctct

SEQ ID NO: 3815105 - DNA, 15 bp, Homo sapiens
tctcggcttcaccag

SEQ ID NO: 3815106 - DNA, 12 bp, Homo sapiens
tctctctgtgaa

SEQ ID NO: 3815107 - DNA, 20 bp, Homo sapiens
tctctctgtgaatacaatta

SEQ ID NO: 3815108 - DNA, 19 bp, Homo sapiens
tctctgattttcaaagctt

SEQ ID NO: 3815109 - DNA, 15 bp, Homo sapiens
tctctgtgaatacaa

SEQ ID NO: 3815110 - DNA, 14 bp, Homo sapiens
tctcttgagcctgg

SEQ ID NO: 3815111 - DNA, 15 bp, Homo sapiens
tctcttgagcctggg

SEQ ID NO: 3815112 - DNA, 17 bp, Homo sapiens
tctcttgagcctgggag

SEQ ID NO: 3815113 - DNA, 18 bp, Homo sapiens
tctcttgagcctgggagg

SEQ ID NO: 3815114 - DNA, 14 bp, Homo sapiens
tctcttgtctggct

SEQ ID NO: 3815115 - DNA, 14 bp, Homo sapiens
tctgaatgtcccag

SEQ ID NO: 3815116 - DNA, 15 bp, Homo sapiens
tctgaatgtcccaga

SEQ ID NO: 3815117 - DNA, 17 bp, Homo sapiens
tctgaatgtcccagagg

SEQ ID NO: 3815118 - DNA, 20 bp, Homo sapiens
tctgaggacatggagagaga

SEQ ID NO: 3815119 - DNA, 12 bp, Homo sapiens
tctgaggtcaat

SEQ ID NO: 3815120 - DNA, 17 bp, Homo sapiens
tctgaggtcaataaagc

SEQ ID NO: 3815121 - DNA, 20 bp, Homo sapiens
tctgaggtcaataaagcaga

SEQ ID NO: 3815122 - DNA, 16 bp, Homo sapiens
tctgagtccagctccc

SEQ ID NO: 3815123 - DNA, 17 bp, Homo sapiens
tctgagtccagctcccc

SEQ ID NO: 3815124 - DNA, 21 bp, Homo sapiens
tctgcaagaattgaagcagga

SEQ ID NO: 3815125 - DNA, 11 bp, Homo sapiens
tctgcaggaaa

SEQ ID NO: 3815126 - DNA, 12 bp, Homo sapiens
tctgcaggaaat

SEQ ID NO: 3815127 - DNA, 22 bp, Homo sapiens
tctgcattcacagcgcctcctg

SEQ ID NO: 3815128 - DNA, 20 bp, Homo sapiens
tctgccaatcggctacccct

SEQ ID NO: 3815129 - DNA, 22 bp, Homo sapiens
tctgccaatcggctacccctcg

SEQ ID NO: 3815130 - DNA, 15 bp, Homo sapiens
tctgccaggagacag

SEQ ID NO: 3815131 - DNA, 14 bp, Homo sapiens
tctgcccagcctgc

SEQ ID NO: 3815132 - DNA, 19 bp, Homo sapiens
tctgcccagcctgccccag

SEQ ID NO: 3815133 - DNA, 19 bp, Homo sapiens
tctgcctcagcttcccaag

SEQ ID NO: 3815134 - DNA, 22 bp, Homo sapiens
tctgctcagtaatttgaggaca

SEQ ID NO: 3815135 - DNA, 17 bp, Homo sapiens
tctgcttccgtatttta

SEQ ID NO: 3815136 - DNA, 15 bp, Homo sapiens
tctggatcctgcact

SEQ ID NO: 3815137 - DNA, 20 bp, Homo sapiens
tctggcaccactagggtcct

SEQ ID NO: 3815138 - DNA, 14 bp, Homo sapiens
tctggccacactgg

SEQ ID NO: 3815139 - DNA, 11 bp, Homo sapiens
tctggccctat

SEQ ID NO: 3815140 - DNA, 14 bp, Homo sapiens
tctggcgagccctt

SEQ ID NO: 3815141 - DNA, 23 bp, Homo sapiens
tctggtatgaacttgaggacaca

SEQ ID NO: 3815142 - DNA, 19 bp, Homo sapiens
tctgtatgtgacaacattt

SEQ ID NO: 3815143 - DNA, 15 bp, Homo sapiens
tctgtccagtttcca

SEQ ID NO: 3815144 - DNA, 16 bp, Homo sapiens
tctgtgaatacaatta

SEQ ID NO: 3815145 - DNA, 15 bp, Homo sapiens
tgctggctcccaggg

SEQ ID NO: 3815146 - DNA, 16 bp, Homo sapiens
tgctgggcctctgcct

SEQ ID NO: 3815147 - DNA, 13 bp, Homo sapiens
tgctgtagagact

SEQ ID NO: 3815148 - DNA, 14 bp, Homo sapiens
tgctgtagagactt

SEQ ID NO: 3815149 - DNA, 23 bp, Homo sapiens
tgctgtatccatccatggggctg

SEQ ID NO: 3815150 - DNA, 18 bp, Homo sapiens
tgctgttttgatttgtac

SEQ ID NO: 3815151 - DNA, 18 bp, Homo sapiens
tgcttcatgaaaatccta

SEQ ID NO: 3815152 - DNA, 13 bp, Homo sapiens
tgcttcctaactt

SEQ ID NO: 3815153 - DNA, 14 bp, Homo sapiens
tgcttctgcctcag

SEQ ID NO: 3815154 - DNA, 12 bp, Homo sapiens
tgcttctttcct

SEQ ID NO: 3815155 - DNA, 21 bp, Homo sapiens
tgcttgaggcaactcatctta

SEQ ID NO: 3815156 - DNA, 21 bp, Homo sapiens
tgcttgatatgtaagtacttc

SEQ ID NO: 3815157 - DNA, 23 bp, Homo sapiens
tgctttaagaaactgttactgtc

SEQ ID NO: 3815158 - DNA, 17 bp, Homo sapiens
tgcttttctcccagaag

SEQ ID NO: 3815159 - DNA, 15 bp, Homo sapiens
tgctttttcaccaga

SEQ ID NO: 3815160 - DNA, 20 bp, Homo sapiens
tggaaaaatagcctgcctct

SEQ ID NO: 3815161 - DNA, 18 bp, Homo sapiens
tggaaaaatccagaaaga

SEQ ID NO: 3815162 - DNA, 13 bp, Homo sapiens
tggaaataaatgt

SEQ ID NO: 3815163 - DNA, 23 bp, Homo sapiens
tggaaataaatgtatcatagaaa

SEQ ID NO: 3815164 - DNA, 16 bp, Homo sapiens
tggaaattggaagagc

SEQ ID NO: 3815165 - DNA, 14 bp, Homo sapiens
tggaacatccttgg

SEQ ID NO: 3815166 - DNA, 16 bp, Homo sapiens
tggaagcactgctgtg

SEQ ID NO: 3815167 - DNA, 13 bp, Homo sapiens
tggaagtgtgggt

SEQ ID NO: 3815168 - DNA, 20 bp, Homo sapiens
tggaagtgtgggtctgtgtg

SEQ ID NO: 3815169 - DNA, 17 bp, Homo sapiens
tggaatgaattaaataa

SEQ ID NO: 3815170 - DNA, 21 bp, Homo sapiens
tggaatgtggcccctgaacaa

SEQ ID NO: 3815171 - DNA, 23 bp, Homo sapiens
tggaatgtggcccctgaacaaga

SEQ ID NO: 3815172 - DNA, 17 bp, Homo sapiens
tggaattgggagcttgg

SEQ ID NO: 3815173 - DNA, 11 bp, Homo sapiens
tggaattttct

SEQ ID NO: 3815174 - DNA, 15 bp, Homo sapiens
tggacaccggaaaca

SEQ ID NO: 3815175 - DNA, 12 bp, Homo sapiens
tggacacctgcc

SEQ ID NO: 3815176 - DNA, 22 bp, Homo sapiens
tggacctttcctgaggaagagg

SEQ ID NO: 3815177 - DNA, 21 bp, Homo sapiens
tggagaaacaggctctgagat

SEQ ID NO: 3815178 - DNA, 13 bp, Homo sapiens
tggagaagcggct

SEQ ID NO: 3815179 - DNA, 15 bp, Homo sapiens
tggaggatggagaga

SEQ ID NO: 3815180 - DNA, 12 bp, Homo sapiens
tggaggctggca

SEQ ID NO: 3815181 - DNA, 15 bp, Homo sapiens
tggatccacgtgctc

SEQ ID NO: 3815182 - DNA, 18 bp, Homo sapiens
tggatgagcaactcctgt

SEQ ID NO: 3815183 - DNA, 16 bp, Homo sapiens
tggcaaccctcagctg

SEQ ID NO: 3815184 - DNA, 23 bp, Homo sapiens
tggcaaccctcagctgcctcatc

SEQ ID NO: 3815185 - DNA, 13 bp, Homo sapiens
tggcaattttgta

SEQ ID NO: 3815186 - DNA, 18 bp, Homo sapiens
tggcaccagcagcctgga

SEQ ID NO: 3815187 - DNA, 13 bp, Homo sapiens
tggcagcctccag

SEQ ID NO: 3815188 - DNA, 15 bp, Homo sapiens
tggcaggaggcagga

SEQ ID NO: 3815189 - DNA, 21 bp, Homo sapiens
tggcatccagagtccctgcct

SEQ ID NO: 3815190 - DNA, 18 bp, Homo sapiens
tggccaaggctgagagct

SEQ ID NO: 3815191 - DNA, 12 bp, Homo sapiens
tggccacactgg

SEQ ID NO: 3815192 - DNA, 16 bp, Homo sapiens
tggccacactgggctc

SEQ ID NO: 3815193 - DNA, 19 bp, Homo sapiens
tggccagtcctagagctcc

SEQ ID NO: 3815194 - DNA, 20 bp, Homo sapiens
tggccagtcctagagctcct

SEQ ID NO: 3815195 - DNA, 21 bp, Homo sapiens
tggccagtcctagagctcctg

SEQ ID NO: 3815196 - DNA, 22 bp, Homo sapiens
tggccagtcctagagctcctgt

SEQ ID NO: 3815197 - DNA, 14 bp, Homo sapiens
tggccagtggctgg

SEQ ID NO: 3815198 - DNA, 14 bp, Homo sapiens
tggccatttgcttt

SEQ ID NO: 3815199 - DNA, 15 bp, Homo sapiens
tggccatttgctttt

SEQ ID NO: 3815200 - DNA, 22 bp, Homo sapiens
tggccccaccctcgtggacacc

SEQ ID NO: 3815201 - DNA, 13 bp, Homo sapiens
tggcctctagaac

SEQ ID NO: 3815202 - DNA, 21 bp, Homo sapiens
tggcctgttcttctatgggtt

SEQ ID NO: 3815203 - DNA, 11 bp, Homo sapiens
tggccttccct

SEQ ID NO: 3815204 - DNA, 22 bp, Homo sapiens
tggcgaaaccccgtctctacta

SEQ ID NO: 3815205 - DNA, 12 bp, Homo sapiens
tggcgagccctt

SEQ ID NO: 3815206 - DNA, 18 bp, Homo sapiens
tggcggtgcgtgcctgta

SEQ ID NO: 3815207 - DNA, 13 bp, Homo sapiens
tggctcacgcctg

SEQ ID NO: 3815208 - DNA, 17 bp, Homo sapiens
tggctcccagggccatg

SEQ ID NO: 3815209 - DNA, 17 bp, Homo sapiens
tggctgtggcatccaga

SEQ ID NO: 3815210 - DNA, 14 bp, Homo sapiens
tggcttcacggaag

SEQ ID NO: 3815211 - DNA, 19 bp, Homo sapiens
tgggagaatgtcagtatgt

SEQ ID NO: 3815212 - DNA, 20 bp, Homo sapiens
tgggagaatgtcagtatgtg

SEQ ID NO: 3815213 - DNA, 19 bp, Homo sapiens
tgggagctggttagaaatg

SEQ ID NO: 3815214 - DNA, 20 bp, Homo sapiens
tgggagctggttagaaatgc

SEQ ID NO: 3815215 - DNA, 16 bp, Homo sapiens
tgggagcttgggaatg

SEQ ID NO: 3815216 - DNA, 21 bp, Homo sapiens
tgggaggatctcttgagcctg

SEQ ID NO: 3815217 - DNA, 13 bp, Homo sapiens
tgggaggcagcat

SEQ ID NO: 3815218 - DNA, 17 bp, Homo sapiens
tgggaggtcaaggctgc

SEQ ID NO: 3815219 - DNA, 19 bp, Homo sapiens
tgggaggtgagaccacctc

SEQ ID NO: 3815220 - DNA, 11 bp, Homo sapiens
tgggagtgtgt

SEQ ID NO: 3815221 - DNA, 13 bp, Homo sapiens
tgggagtgtgtaa

SEQ ID NO: 3815222 - DNA, 15 bp, Homo sapiens
tgggcaggagggagg

SEQ ID NO: 3815223 - DNA, 16 bp, Homo sapiens
tgggcatactaataaa

SEQ ID NO: 3815224 - DNA, 16 bp, Homo sapiens
tggggatagatgtgtg

SEQ ID NO: 3815225 - DNA, 17 bp, Homo sapiens
tggggatagatgtgtgg

SEQ ID NO: 3815226 - DNA, 18 bp, Homo sapiens
tggggcaggggccggggg

SEQ ID NO: 3815227 - DNA, 15 bp, Homo sapiens
tggggccacatagct

SEQ ID NO: 3815228 - DNA, 15 bp, Homo sapiens
tggggctcagagtgg

SEQ ID NO: 3815229 - DNA, 14 bp, Homo sapiens
tggggctgattgta

SEQ ID NO: 3815230 - DNA, 15 bp, Homo sapiens
tgggggaaaaaaagt

SEQ ID NO: 3815231 - DNA, 15 bp, Homo sapiens
tgggggtctgtgtgt

SEQ ID NO: 3815232 - DNA, 15 bp, Homo sapiens
tggggtaggttggga

SEQ ID NO: 3815233 - DNA, 21 bp, Homo sapiens
tggggtcaggtgccactgacc

SEQ ID NO: 3815234 - DNA, 16 bp, Homo sapiens
tgggtaactagggaag

SEQ ID NO: 3815235 - DNA, 16 bp, Homo sapiens
tgggtcggccctgccc

SEQ ID NO: 3815236 - DNA, 18 bp, Homo sapiens
tgggtcggccctgcccaa

SEQ ID NO: 3815237 - DNA, 13 bp, Homo sapiens
tgggtctgtgtgt

SEQ ID NO: 3815238 - DNA, 22 bp, Homo sapiens
tgggtggcaccagcagcctgga

SEQ ID NO: 3815239 - DNA, 16 bp, Homo sapiens
tgggttgtcactgaga

SEQ ID NO: 3815240 - DNA, 18 bp, Homo sapiens
tggtaaaaagattatata

SEQ ID NO: 3815241 - DNA, 11 bp, Homo sapiens
tggtagagttt

SEQ ID NO: 3815242 - DNA, 14 bp, Homo sapiens
tggtagagtttatt

SEQ ID NO: 3815243 - DNA, 22 bp, Homo sapiens
tggtatgaacttgaggacacat

SEQ ID NO: 3815244 - DNA, 23 bp, Homo sapiens
tggtatgaacttgaggacacatg

SEQ ID NO: 3815245 - DNA, 18 bp, Homo sapiens
tggtcttgatctcctgag

SEQ ID NO: 3815246 - DNA, 21 bp, Homo sapiens
tggtcttgatctcctgagctc

SEQ ID NO: 3815247 - DNA, 20 bp, Homo sapiens
tggtgggcagctgaggacac

SEQ ID NO: 3815248 - DNA, 18 bp, Homo sapiens
gtacatcttgtaagacac

SEQ ID NO: 3815249 - DNA, 19 bp, Homo sapiens
gtaccttcagatcctaccc

SEQ ID NO: 3815250 - DNA, 15 bp, Homo sapiens
gtagagtgggagctg

SEQ ID NO: 3815251 - DNA, 16 bp, Homo sapiens
gtaggaactgctgggc

SEQ ID NO: 3815252 - DNA, 16 bp, Homo sapiens
gtatatctatatctct

SEQ ID NO: 3815253 - DNA, 15 bp, Homo sapiens
gtatatgtatatcta

SEQ ID NO: 3815254 - DNA, 17 bp, Homo sapiens
gtatattttaatgaata

SEQ ID NO: 3815255 - DNA, 23 bp, Homo sapiens
gtatgaacttgaggacacatgtc

SEQ ID NO: 3815256 - DNA, 13 bp, Homo sapiens
gtatggaaataaa

SEQ ID NO: 3815257 - DNA, 20 bp, Homo sapiens
gtatgtgggggtctgtgtgt

SEQ ID NO: 3815258 - DNA, 21 bp, Homo sapiens
gtatttggaaaatgttatgtg

SEQ ID NO: 3815259 - DNA, 18 bp, Homo sapiens
gtcaaagcggatgctggc

SEQ ID NO: 3815260 - DNA, 15 bp, Homo sapiens
gtcaagtgaaaaagg

SEQ ID NO: 3815261 - DNA, 13 bp, Homo sapiens
gtcaataaagcag

SEQ ID NO: 3815262 - DNA, 14 bp, Homo sapiens
gtcaataaagcaga

SEQ ID NO: 3815263 - DNA, 15 bp, Homo sapiens
gtcaataaagcagag

SEQ ID NO: 3815264 - DNA, 17 bp, Homo sapiens
gtcaataaagcagagcc

SEQ ID NO: 3815265 - DNA, 14 bp, Homo sapiens
gtcacgccagactt

SEQ ID NO: 3815266 - DNA, 13 bp, Homo sapiens
gtcagcactcagg

SEQ ID NO: 3815267 - DNA, 22 bp, Homo sapiens
gtcaggcccttattttcaagaa

SEQ ID NO: 3815268 - DNA, 16 bp, Homo sapiens
taggcatcccagggga

SEQ ID NO: 3815269 - DNA, 21 bp, Homo sapiens
taggcatgagggatcacaggg

SEQ ID NO: 3815270 - DNA, 20 bp, Homo sapiens
taggcatttgctgaatacag

SEQ ID NO: 3815271 - DNA, 17 bp, Homo sapiens
tagggtcctggccctct

SEQ ID NO: 3815272 - DNA, 13 bp, Homo sapiens
taggtgtggggga

SEQ ID NO: 3815273 - DNA, 15 bp, Homo sapiens
taggtttttgtttgt

SEQ ID NO: 3815274 - DNA, 20 bp, Homo sapiens
tagtatattagtttgattta

SEQ ID NO: 3815275 - DNA, 18 bp, Homo sapiens
tagtgaatttctgaaaga

SEQ ID NO: 3815276 - DNA, 22 bp, Homo sapiens
tagtgatttttatgccacctga

SEQ ID NO: 3815277 - DNA, 22 bp, Homo sapiens
tagttacctactttttctttga

SEQ ID NO: 3815278 - DNA, 20 bp, Homo sapiens
tagttcctcattagcatttt

SEQ ID NO: 3815279 - DNA, 13 bp, Homo sapiens
tagttctgccagg

SEQ ID NO: 3815280 - DNA, 21 bp, Homo sapiens
tagttgattgcgagaattttc

SEQ ID NO: 3815281 - DNA, 13 bp, Homo sapiens
tataacatgtaaa

SEQ ID NO: 3815282 - DNA, 16 bp, Homo sapiens
tataagtagcaggcca

SEQ ID NO: 3815283 - DNA, 14 bp, Homo sapiens
tataggataaatta

SEQ ID NO: 3815284 - DNA, 16 bp, Homo sapiens
tatatacaatttctat

SEQ ID NO: 3815285 - DNA, 12 bp, Homo sapiens
tatatatcataa

SEQ ID NO: 3815286 - DNA, 22 bp, Homo sapiens
tatatattctacacatatatgt

SEQ ID NO: 3815287 - DNA, 13 bp, Homo sapiens
tatatcataaagt

SEQ ID NO: 3815288 - DNA, 14 bp, Homo sapiens
tatatcataaagta

SEQ ID NO: 3815289 - DNA, 13 bp, Homo sapiens
tatatgtatatct

SEQ ID NO: 3815290 - DNA, 15 bp, Homo sapiens
tatatgtatatgtat

SEQ ID NO: 3815291 - DNA, 17 bp, Homo sapiens
tatatgtatatgtatat

SEQ ID NO: 3815292 - DNA, 12 bp, Homo sapiens
tatcactcactg

SEQ ID NO: 3815293 - DNA, 14 bp, Homo sapiens
tatcagcacgtgtg

SEQ ID NO: 3815294 - DNA, 15 bp, Homo sapiens
tatcagcacgtgtgg

SEQ ID NO: 3815295 - DNA, 11 bp, Homo sapiens
tatcataaagt

SEQ ID NO: 3815296 - DNA, 14 bp, Homo sapiens
tatcataaagtatg

SEQ ID NO: 3815297 - DNA, 15 bp, Homo sapiens
tatcatagaaatgta

SEQ ID NO: 3815298 - DNA, 23 bp, Homo sapiens
tatcatagaaatgtaacttttgt

SEQ ID NO: 3815299 - DNA, 19 bp, Homo sapiens
tatcatgtcgtaggtaaac

SEQ ID NO: 3815300 - DNA, 18 bp, Homo sapiens
tatccactttgcacagct

SEQ ID NO: 3815301 - DNA, 14 bp, Homo sapiens
tatctatatctcta

SEQ ID NO: 3815302 - DNA, 23 bp, Homo sapiens
tatctatatctctaaactgctgt

SEQ ID NO: 3815303 - DNA, 16 bp, Homo sapiens
tatctggccacactgg

SEQ ID NO: 3815304 - DNA, 19 bp, Homo sapiens
tatctggccacactgggct

SEQ ID NO: 3815305 - DNA, 23 bp, Homo sapiens
tatcttggtgaatttttttttcc

SEQ ID NO: 3815306 - DNA, 16 bp, Homo sapiens
tatgaacttgaggaca

SEQ ID NO: 3815307 - DNA, 21 bp, Homo sapiens
tatgaacttgaggacacatgt

SEQ ID NO: 3815308 - DNA, 22 bp, Homo sapiens
tatgaacttgaggacacatgtc

SEQ ID NO: 3815309 - DNA, 19 bp, Homo sapiens
tatgacatcacttgtacaa

SEQ ID NO: 3815310 - DNA, 24 bp, Homo sapiens
tatgacatcacttgtacaaaataa

SEQ ID NO: 3815311 - DNA, 15 bp, Homo sapiens
tatgatgggggaaaa

SEQ ID NO: 3815312 - DNA, 19 bp, Homo sapiens
tatggggatagatgtgtgg

SEQ ID NO: 3815313 - DNA, 16 bp, Homo sapiens
tatgtgacaacatttt

SEQ ID NO: 3815314 - DNA, 22 bp, Homo sapiens
tatgtgattgttccataataaa

SEQ ID NO: 3815315 - DNA, 19 bp, Homo sapiens
tatgtgggggtctgtgtgt

SEQ ID NO: 3815316 - DNA, 11 bp, Homo sapiens
tatgtgtgtgt

SEQ ID NO: 3815317 - DNA, 14 bp, Homo sapiens
tatgtgtgtgtgtt

SEQ ID NO: 3815318 - DNA, 21 bp, Homo sapiens
tatgtttcttgctgtattata

SEQ ID NO: 3815319 - DNA, 15 bp, Homo sapiens
tattaggttgtcacg

SEQ ID NO: 3815320 - DNA, 16 bp, Homo sapiens
tattatcaaaattctg

SEQ ID NO: 3815321 - DNA, 12 bp, Homo sapiens
tattcaataaag

SEQ ID NO: 3815322 - DNA, 14 bp, Homo sapiens
tattcaataaagct

SEQ ID NO: 3815323 - DNA, 18 bp, Homo sapiens
tattcatgctttctcctt

SEQ ID NO: 3815324 - DNA, 19 bp, Homo sapiens
tattcatgctttctccttt

SEQ ID NO: 3815325 - DNA, 20 bp, Homo sapiens
tattcatgctttctcctttt

SEQ ID NO: 3815326 - DNA, 16 bp, Homo sapiens
tattctacacatatat

SEQ ID NO: 3815327 - DNA, 15 bp, Homo sapiens
tattgatgttaacaa

SEQ ID NO: 3815328 - DNA, 15 bp, Homo sapiens
tattggaattttctt

SEQ ID NO: 3815329 - DNA, 15 bp, Homo sapiens
tatttaacaagatct

SEQ ID NO: 3815330 - DNA, 19 bp, Homo sapiens
tatttataaactaggtaaa

SEQ ID NO: 3815331 - DNA, 14 bp, Homo sapiens
tatttatttatgga

SEQ ID NO: 3815332 - DNA, 16 bp, Homo sapiens
tatttccacataaagg

SEQ ID NO: 3815333 - DNA, 19 bp, Homo sapiens
tatttccacataaaggtat

SEQ ID NO: 3815334 - DNA, 15 bp, Homo sapiens
tatttggaaaatgtt

SEQ ID NO: 3815335 - DNA, 17 bp, Homo sapiens
tatttgtaaatttatgt

SEQ ID NO: 3815336 - DNA, 13 bp, Homo sapiens
tattttacaaatt

SEQ ID NO: 3815337 - DNA, 17 bp, Homo sapiens
tattttatatacaattt

SEQ ID NO: 3815338 - DNA, 13 bp, Homo sapiens
tattttcaagaaa

SEQ ID NO: 3815339 - DNA, 16 bp, Homo sapiens
tattttcaagaaactg

SEQ ID NO: 3815340 - DNA, 20 bp, Homo sapiens
tattttgtaaactcaaaata

SEQ ID NO: 3815341 - DNA, 21 bp, Homo sapiens
tattttgtaaactcaaaatat

SEQ ID NO: 3815342 - DNA, 21 bp, Homo sapiens
tattttgttttgtgcagagat

SEQ ID NO: 3815343 - DNA, 19 bp, Homo sapiens
tatttttgttgtgttctgt

SEQ ID NO: 3815344 - DNA, 15 bp, Homo sapiens
tattttttatttcca

SEQ ID NO: 3815345 - DNA, 18 bp, Homo sapiens
tattttttatttccacat

SEQ ID NO: 3815346 - DNA, 15 bp, Homo sapiens
tcaaaaaaagaaaaa

SEQ ID NO: 3815347 - DNA, 22 bp, Homo sapiens
tcaaaacggttttactgcagct

SEQ ID NO: 3815348 - DNA, 16 bp, Homo sapiens
tcaaaatatttgtaca

SEQ ID NO: 3815349 - DNA, 17 bp, Homo sapiens
tcaaaatatttgtacat

SEQ ID NO: 3815350 - DNA, 14 bp, Homo sapiens
tcaaactcttaaaa

SEQ ID NO: 3815351 - DNA, 23 bp, Homo sapiens
tcaaagaggttttaaaaaaatcc

SEQ ID NO: 3815352 - DNA, 19 bp, Homo sapiens
tcaaagcggatgctggcca

SEQ ID NO: 3815353 - DNA, 15 bp, Homo sapiens
tcaaatggaaaggag

SEQ ID NO: 3815354 - DNA, 16 bp, Homo sapiens
tcaagaccttctcccc

SEQ ID NO: 3815355 - DNA, 22 bp, Homo sapiens
tcaagcagacgtgagtgtgact

SEQ ID NO: 3815356 - DNA, 17 bp, Homo sapiens
tcaagtaataaaacaat

SEQ ID NO: 3815357 - DNA, 14 bp, Homo sapiens
tcaataaagcagag

SEQ ID NO: 3815358 - DNA, 15 bp, Homo sapiens
tcaatattcaataaa

SEQ ID NO: 3815359 - DNA, 19 bp, Homo sapiens
tcacaccattctcctgcct

SEQ ID NO: 3815360 - DNA, 20 bp, Homo sapiens
tcacactacttgagaaaatg

SEQ ID NO: 3815361 - DNA, 16 bp, Homo sapiens
accttcagatcctacc

SEQ ID NO: 3815362 - DNA, 17 bp, Homo sapiens
accttcagatcctaccc

SEQ ID NO: 3815363 - DNA, 18 bp, Homo sapiens
accttcagatcctacccc

SEQ ID NO: 3815364 - DNA, 14 bp, Homo sapiens
accttcctcctccc

SEQ ID NO: 3815365 - DNA, 23 bp, Homo sapiens
accttctccagggacagaagcag

SEQ ID NO: 3815366 - DNA, 17 bp, Homo sapiens
acctttttttctctcct

SEQ ID NO: 3815367 - DNA, 18 bp, Homo sapiens
acctttttttctctccta

SEQ ID NO: 3815368 - DNA, 15 bp, Homo sapiens
acgactgcccggcag

SEQ ID NO: 3815369 - DNA, 15 bp, Homo sapiens
acgatctcagctcac

SEQ ID NO: 3815370 - DNA, 21 bp, Homo sapiens
acgcacatagagatatgcaca

SEQ ID NO: 3815371 - DNA, 21 bp, Homo sapiens
acgctgtgattggcaggaggc

SEQ ID NO: 3815372 - DNA, 16 bp, Homo sapiens
acgcttattgcccagg

SEQ ID NO: 3815373 - DNA, 15 bp, Homo sapiens
acggcactgtggcct

SEQ ID NO: 3815374 - DNA, 20 bp, Homo sapiens
acgtccacagagtataaata

SEQ ID NO: 3815375 - DNA, 18 bp, Homo sapiens
actaagctttctcctttg

SEQ ID NO: 3815376 - DNA, 14 bp, Homo sapiens
actaatagagacac

SEQ ID NO: 3815377 - DNA, 17 bp, Homo sapiens
actactcccccaggtgg

SEQ ID NO: 3815378 - DNA, 17 bp, Homo sapiens
actacttgggagcaccg

SEQ ID NO: 3815379 - DNA, 15 bp, Homo sapiens
actagaggcagggag

SEQ ID NO: 3815380 - DNA, 16 bp, Homo sapiens
actagaggcagggagg

SEQ ID NO: 3815381 - DNA, 16 bp, Homo sapiens
actagattctcacctg

SEQ ID NO: 3815382 - DNA, 19 bp, Homo sapiens
actagccatctcaagcaag

SEQ ID NO: 3815383 - DNA, 22 bp, Homo sapiens
actagggtcctggccctcttct

SEQ ID NO: 3815384 - DNA, 16 bp, Homo sapiens
actagggttttggcct

SEQ ID NO: 3815385 - DNA, 23 bp, Homo sapiens
actagggttttggcctgcctgcg

SEQ ID NO: 3815386 - DNA, 23 bp, Homo sapiens
actagtaccttcagatcctaccc

SEQ ID NO: 3815387 - DNA, 16 bp, Homo sapiens
actatatttatttatg

SEQ ID NO: 3815388 - DNA, 18 bp, Homo sapiens
actatatttatttatgta

SEQ ID NO: 3815389 - DNA, 20 bp, Homo sapiens
actcaaaatatttgtacata

SEQ ID NO: 3815390 - DNA, 17 bp, Homo sapiens
actcaaactcttaaaac

SEQ ID NO: 3815391 - DNA, 20 bp, Homo sapiens
actcagaatataacatgtaa

SEQ ID NO: 3815392 - DNA, 21 bp, Homo sapiens
actcaggtagggagctaagga

SEQ ID NO: 3815393 - DNA, 20 bp, Homo sapiens
actcatagggtgctctgagg

SEQ ID NO: 3815394 - DNA, 17 bp, Homo sapiens
actcatgtgactctttc

SEQ ID NO: 3815395 - DNA, 18 bp, Homo sapiens
actcatgtgactctttcc

SEQ ID NO: 3815396 - DNA, 21 bp, Homo sapiens
actccagcctgggcgacagag

SEQ ID NO: 3815397 - DNA, 23 bp, Homo sapiens
actcccggaggtgtcaccttcct

SEQ ID NO: 3815398 - DNA, 14 bp, Homo sapiens
actcctcacagcat

SEQ ID NO: 3815399 - DNA, 21 bp, Homo sapiens
actcctcacagcatctctatg

SEQ ID NO: 3815400 - DNA, 20 bp, Homo sapiens
actcctgttctttgggctca

SEQ ID NO: 3815401 - DNA, 23 bp, Homo sapiens
actctgatggttcttcacctcct

SEQ ID NO: 3815402 - DNA, 14 bp, Homo sapiens
actctgcaggaaat

SEQ ID NO: 3815403 - DNA, 15 bp, Homo sapiens
actcttggccagagc

SEQ ID NO: 3815404 - DNA, 16 bp, Homo sapiens
actctttgctacaata

SEQ ID NO: 3815405 - DNA, 21 bp, Homo sapiens
actgaaccgacttttctaaag

SEQ ID NO: 3815406 - DNA, 13 bp, Homo sapiens
actgaagtgcagc

SEQ ID NO: 3815407 - DNA, 13 bp, Homo sapiens
actgagggagaga

SEQ ID NO: 3815408 - DNA, 18 bp, Homo sapiens
actgcaagctctgcctcc

SEQ ID NO: 3815409 - DNA, 16 bp, Homo sapiens
actgccaaaacaatgc

SEQ ID NO: 3815410 - DNA, 15 bp, Homo sapiens
actgcccggcagggt

SEQ ID NO: 3815411 - DNA, 22 bp, Homo sapiens
actgcccggcagggtcctagaa

SEQ ID NO: 3815412 - DNA, 14 bp, Homo sapiens
actgccgcctcctt

SEQ ID NO: 3815413 - DNA, 18 bp, Homo sapiens
actgctgatgctgaaata

SEQ ID NO: 3815414 - DNA, 18 bp, Homo sapiens
actggccagtcctagagc

SEQ ID NO: 3815415 - DNA, 20 bp, Homo sapiens
actggccagtcctagagctc

SEQ ID NO: 3815416 - DNA, 12 bp, Homo sapiens
actggccccacc

SEQ ID NO: 3815417 - DNA, 13 bp, Homo sapiens
actggccccaccc

SEQ ID NO: 3815418 - DNA, 14 bp, Homo sapiens
actgggctctgagg

SEQ ID NO: 3815419 - DNA, 14 bp, Homo sapiens
actggggcaggggc

SEQ ID NO: 3815420 - DNA, 18 bp, Homo sapiens
actgtagaatgatttcat

SEQ ID NO: 3815421 - DNA, 19 bp, Homo sapiens
actgtagaatgatttcatg

SEQ ID NO: 3815422 - DNA, 20 bp, Homo sapiens
actgtagaatgatttcatgc

SEQ ID NO: 3815423 - DNA, 13 bp, Homo sapiens
actgtcatagaaa

SEQ ID NO: 3815424 - DNA, 18 bp, Homo sapiens
actgtgtccctctctctg

SEQ ID NO: 3815425 - DNA, 19 bp, Homo sapiens
actgttgctgactactact

SEQ ID NO: 3815426 - DNA, 15 bp, Homo sapiens
acttagaggaaaagg

SEQ ID NO: 3815427 - DNA, 15 bp, Homo sapiens
acttattgcctgggc

SEQ ID NO: 3815428 - DNA, 22 bp, Homo sapiens
acttattgcctgggcagtgccc

SEQ ID NO: 3815429 - DNA, 22 bp, Homo sapiens
acttatttttgacagtgttgaa

SEQ ID NO: 3815430 - DNA, 20 bp, Homo sapiens
acttcagagtcctcattata

SEQ ID NO: 3815431 - DNA, 11 bp, Homo sapiens
acttcagctga

SEQ ID NO: 3815432 - DNA, 18 bp, Homo sapiens
acttcaggagctgacaga

SEQ ID NO: 3815433 - DNA, 22 bp, Homo sapiens
acttccctgcttttctcccaga

SEQ ID NO: 3815434 - DNA, 23 bp, Homo sapiens
acttccctgcttttctcccagaa

SEQ ID NO: 3815435 - DNA, 16 bp, Homo sapiens
acttccgtcacccttg

SEQ ID NO: 3815436 - DNA, 12 bp, Homo sapiens
acttgaggacac

SEQ ID NO: 3815437 - DNA, 17 bp, Homo sapiens
acttgaggacacatgtc

SEQ ID NO: 3815438 - DNA, 19 bp, Homo sapiens
acttgaggacacatgtcca

SEQ ID NO: 3815439 - DNA, 20 bp, Homo sapiens
acttgcatgaattactgtat

SEQ ID NO: 3815440 - DNA, 21 bp, Homo sapiens
acttgcatgaattactgtata

SEQ ID NO: 3815441 - DNA, 14 bp, Homo sapiens
acttgcctggggcc

SEQ ID NO: 3815442 - DNA, 17 bp, Homo sapiens
acttgcctggggccaca

SEQ ID NO: 3815443 - DNA, 21 bp, Homo sapiens
acttggaaaaatccagaaaga

SEQ ID NO: 3815444 - DNA, 22 bp, Homo sapiens
acttggaaaaatccagaaagaa

SEQ ID NO: 3815445 - DNA, 14 bp, Homo sapiens
acttgggccactgt

SEQ ID NO: 3815446 - DNA, 16 bp, Homo sapiens
acttgggtacatcttg

SEQ ID NO: 3815447 - DNA, 20 bp, Homo sapiens
acttgtacaaaataaacaaa

SEQ ID NO: 3815448 - DNA, 23 bp, Homo sapiens
acttgtcccgggacacctaggct

SEQ ID NO: 3815449 - DNA, 12 bp, Homo sapiens
acttgtgtatat

SEQ ID NO: 3815450 - DNA, 22 bp, Homo sapiens
acttgtgtatattttaatgaat

SEQ ID NO: 3815451 - DNA, 22 bp, Homo sapiens
actttccccgtgggccatggca

SEQ ID NO: 3815452 - DNA, 14 bp, Homo sapiens
actttctgaaataa

SEQ ID NO: 3815453 - DNA, 13 bp, Homo sapiens
actttttctttga

SEQ ID NO: 3815454 - DNA, 23 bp, Homo sapiens
agaaaaaatattttcctgccagg

SEQ ID NO: 3815455 - DNA, 23 bp, Homo sapiens
agaaaaataagctcgagtgaatt

SEQ ID NO: 3815456 - DNA, 12 bp, Homo sapiens
agaaaaatatga

SEQ ID NO: 3815457 - DNA, 17 bp, Homo sapiens
agaaaaatgagcctggc

SEQ ID NO: 3815458 - DNA, 18 bp, Homo sapiens
agaaaaatgagcctggca

SEQ ID NO: 3815459 - DNA, 16 bp, Homo sapiens
agaaaaatggcctgca

SEQ ID NO: 3815460 - DNA, 15 bp, Homo sapiens
agaaaataccaagga

SEQ ID NO: 3815461 - DNA, 14 bp, Homo sapiens
agaaaatgcaggag

SEQ ID NO: 3815462 - DNA, 15 bp, Homo sapiens
agaaaatgcaggaga

SEQ ID NO: 3815463 - DNA, 20 bp, Homo sapiens
agaaacaccacccatttcta

SEQ ID NO: 3815464 - DNA, 23 bp, Homo sapiens
agaaacataaataaaatgaccag

SEQ ID NO: 3815465 - DNA, 18 bp, Homo sapiens
agaaacatgaaatgcttc

SEQ ID NO: 3815466 - DNA, 15 bp, Homo sapiens
agaaaggccactcag

SEQ ID NO: 3815467 - DNA, 12 bp, Homo sapiens
agaaatgcagaa

SEQ ID NO: 3815468 - DNA, 17 bp, Homo sapiens
agaacaattatgtttct

SEQ ID NO: 3815469 - DNA, 16 bp, Homo sapiens
agcaagtgagaccctg

SEQ ID NO: 3815470 - DNA, 20 bp, Homo sapiens
agcaagtgagaccctgtctc

SEQ ID NO: 3815471 - DNA, 14 bp, Homo sapiens
agcaagtttaatca

SEQ ID NO: 3815472 - DNA, 22 bp, Homo sapiens
agcaatgcttctgcctcagctt

SEQ ID NO: 3815473 - DNA, 22 bp, Homo sapiens
agcacatccaggcaatggccta

SEQ ID NO: 3815474 - DNA, 16 bp, Homo sapiens
agcacatgattttctt

SEQ ID NO: 3815475 - DNA, 22 bp, Homo sapiens
agcactttgggaggccaaggtg

SEQ ID NO: 3815476 - DNA, 23 bp, Homo sapiens
agcactttgggaggccaaggtgg

SEQ ID NO: 3815477 - DNA, 13 bp, Homo sapiens
agcagcacctcct

SEQ ID NO: 3815478 - DNA, 16 bp, Homo sapiens
agcagcagggagggct

SEQ ID NO: 3815479 - DNA, 23 bp, Homo sapiens
agcataaaaattagccaagtgtg

SEQ ID NO: 3815480 - DNA, 13 bp, Homo sapiens
agcatctcccagt

SEQ ID NO: 3815481 - DNA, 15 bp, Homo sapiens
agcatgacaactttt

SEQ ID NO: 3815482 - DNA, 15 bp, Homo sapiens
agccccacacggagg

SEQ ID NO: 3815483 - DNA, 23 bp, Homo sapiens
agccccacctctccaagtctctc

SEQ ID NO: 3815484 - DNA, 16 bp, Homo sapiens
agccctctcactgtgt

SEQ ID NO: 3815485 - DNA, 18 bp, Homo sapiens
agccctctcactgtgtcc

SEQ ID NO: 3815486 - DNA, 15 bp, Homo sapiens
agccctgagctttct

SEQ ID NO: 3815487 - DNA, 20 bp, Homo sapiens
agccctgctgcttcctaact

SEQ ID NO: 3815488 - DNA, 21 bp, Homo sapiens
agccctgctgcttcctaactt

SEQ ID NO: 3815489 - DNA, 22 bp, Homo sapiens
agccctgctgcttcctaactta

SEQ ID NO: 3815490 - DNA, 23 bp, Homo sapiens
agcccttagccttgctgtagaga

SEQ ID NO: 3815491 - DNA, 21 bp, Homo sapiens
agccgccatgctcctggccca

SEQ ID NO: 3815492 - DNA, 17 bp, Homo sapiens
agccggcagaaatagct

SEQ ID NO: 3815493 - DNA, 14 bp, Homo sapiens
agccgggagcctga

SEQ ID NO: 3815494 - DNA, 14 bp, Homo sapiens
agcctccagtggga

SEQ ID NO: 3815495 - DNA, 19 bp, Homo sapiens
agcctcctgagtagctggg

SEQ ID NO: 3815496 - DNA, 10 bp, Homo sapiens
agcctctccc

SEQ ID NO: 3815497 - DNA, 19 bp, Homo sapiens
agcctgaccctcatctttc

SEQ ID NO: 3815498 - DNA, 18 bp, Homo sapiens
agcctgactttctctcca

SEQ ID NO: 3815499 - DNA, 15 bp, Homo sapiens
agcctgctccagctg

SEQ ID NO: 3815500 - DNA, 19 bp, Homo sapiens
agcctgctccagctgttca

SEQ ID NO: 3815501 - DNA, 15 bp, Homo sapiens
agcctgggaccaggg

SEQ ID NO: 3815502 - DNA, 20 bp, Homo sapiens
agcctgggcgacagagcaag

SEQ ID NO: 3815503 - DNA, 18 bp, Homo sapiens
agccttaatcaggtcctc

SEQ ID NO: 3815504 - DNA, 15 bp, Homo sapiens
agccttgctgtagag

SEQ ID NO: 3815505 - DNA, 22 bp, Homo sapiens
agccttgctgtagagacttccg

SEQ ID NO: 3815506 - DNA, 16 bp, Homo sapiens
agctaaggaagacaca

SEQ ID NO: 3815507 - DNA, 18 bp, Homo sapiens
agctatggaaggtcttgc

SEQ ID NO: 3815508 - DNA, 15 bp, Homo sapiens
agctattagcaactg

SEQ ID NO: 3815509 - DNA, 18 bp, Homo sapiens
agctattagcaactgtgc

SEQ ID NO: 3815510 - DNA, 20 bp, Homo sapiens
agctattcaggaggctgagg

SEQ ID NO: 3815511 - DNA, 18 bp, Homo sapiens
agctcaagtcttccctga

SEQ ID NO: 3815512 - DNA, 23 bp, Homo sapiens
agctcaagtcttccctgatcaag

SEQ ID NO: 3815513 - DNA, 20 bp, Homo sapiens
agctcaggaaccgaggcagg

SEQ ID NO: 3815514 - DNA, 13 bp, Homo sapiens
agctcagtggcaa

SEQ ID NO: 3815515 - DNA, 14 bp, Homo sapiens
agctccagtggaag

SEQ ID NO: 3815516 - DNA, 19 bp, Homo sapiens
agctccagtggaagaagaa

SEQ ID NO: 3815517 - DNA, 17 bp, Homo sapiens
agctcctgtccctaccc

SEQ ID NO: 3815518 - DNA, 16 bp, Homo sapiens
agctccttaaggctct

SEQ ID NO: 3815519 - DNA, 17 bp, Homo sapiens
agctccttaaggctctt

SEQ ID NO: 3815520 - DNA, 18 bp, Homo sapiens
agctctccggtctctctc

SEQ ID NO: 3815521 - DNA, 13 bp, Homo sapiens
agctgagtggcag

SEQ ID NO: 3815522 - DNA, 13 bp, Homo sapiens
agctgcaccctca

SEQ ID NO: 3815523 - DNA, 20 bp, Homo sapiens
agctgcaccctcaggcaggt

SEQ ID NO: 3815524 - DNA, 22 bp, Homo sapiens
agctgcaccctcaggcaggtgg

SEQ ID NO: 3815525 - DNA, 17 bp, Homo sapiens
agctgccgaccagagcc

SEQ ID NO: 3815526 - DNA, 18 bp, Homo sapiens
agctgccgaccagagccc

SEQ ID NO: 3815527 - DNA, 16 bp, Homo sapiens
agctggcagcctccag

SEQ ID NO: 3815528 - DNA, 18 bp, Homo sapiens
agctggcagcctccagtg

SEQ ID NO: 3815529 - DNA, 23 bp, Homo sapiens
agctggcagcctccagtgggagg

SEQ ID NO: 3815530 - DNA, 14 bp, Homo sapiens
agctgggcaggttg

SEQ ID NO: 3815531 - DNA, 19 bp, Homo sapiens
agctgtagaactctgcagg

SEQ ID NO: 3815532 - DNA, 21 bp, Homo sapiens
agctgtagaactctgcaggca

SEQ ID NO: 3815533 - DNA, 11 bp, Homo sapiens
agctgtctgct

SEQ ID NO: 3815534 - DNA, 18 bp, Homo sapiens
agctgttactgtcttcag

SEQ ID NO: 3815535 - DNA, 19 bp, Homo sapiens
agctgttactgtcttcagt

SEQ ID NO: 3815536 - DNA, 14 bp, Homo sapiens
agctgttttcttct

SEQ ID NO: 3815537 - DNA, 16 bp, Homo sapiens
agcttaaagagaaaaa

SEQ ID NO: 3815538 - DNA, 15 bp, Homo sapiens
agcttatctcagggg

SEQ ID NO: 3815539 - DNA, 21 bp, Homo sapiens
agcttgggggatgactagagg

SEQ ID NO: 3815540 - DNA, 12 bp, Homo sapiens
agctttgaaaat

SEQ ID NO: 3815541 - DNA, 18 bp, Homo sapiens
agctttgaaaattcagtg

SEQ ID NO: 3815542 - DNA, 23 bp, Homo sapiens
agctttgctctttggtagaaaag

SEQ ID NO: 3815543 - DNA, 16 bp, Homo sapiens
aggaaatcagagctgg

SEQ ID NO: 3815544 - DNA, 16 bp, Homo sapiens
aggaactgctgggctt

SEQ ID NO: 3815545 - DNA, 18 bp, Homo sapiens
aggaagacacagcccaga

SEQ ID NO: 3815546 - DNA, 17 bp, Homo sapiens
aggaagagcaggcacat

SEQ ID NO: 3815547 - DNA, 22 bp, Homo sapiens
aggaattcccagcccaaagctg

SEQ ID NO: 3815548 - DNA, 16 bp, Homo sapiens
aggaattttctttgtg

SEQ ID NO: 3815549 - DNA, 18 bp, Homo sapiens
aggacaacctgcccctcc

SEQ ID NO: 3815550 - DNA, 20 bp, Homo sapiens
aggacacaccccacacccca

SEQ ID NO: 3815551 - DNA, 23 bp, Homo sapiens
aggacacaccccacaccccagcc

SEQ ID NO: 3815552 - DNA, 12 bp, Homo sapiens
aggacagtattt

SEQ ID NO: 3815553 - DNA, 17 bp, Homo sapiens
aggacatggagagagac

SEQ ID NO: 3815554 - DNA, 16 bp, Homo sapiens
aggacttgtgtctctg

SEQ ID NO: 3815555 - DNA, 14 bp, Homo sapiens
aggagaaaatgcat

SEQ ID NO: 3815556 - DNA, 16 bp, Homo sapiens
aggagaaacagagaca

SEQ ID NO: 3815557 - DNA, 18 bp, Homo sapiens
aggagaaacagagacagg

SEQ ID NO: 3815558 - DNA, 18 bp, Homo sapiens
aggagacagttcaagaaa

SEQ ID NO: 3815559 - DNA, 12 bp, Homo sapiens
aggagaggaaag

SEQ ID NO: 3815560 - DNA, 14 bp, Homo sapiens
aggagaggggcaca

SEQ ID NO: 3815561 - DNA, 15 bp, Homo sapiens
aggagccagccagga

SEQ ID NO: 3815562 - DNA, 11 bp, Homo sapiens
aggagcctggc

SEQ ID NO: 3815563 - DNA, 21 bp, Homo sapiens
aggaggcaggatatccccagg

SEQ ID NO: 3815564 - DNA, 12 bp, Homo sapiens
aggaggctgagg

SEQ ID NO: 3815565 - DNA, 16 bp, Homo sapiens
aggagggcatgggagg

SEQ ID NO: 3815566 - DNA, 21 bp, Homo sapiens
aggagtcttcactgctctgcc

SEQ ID NO: 3815567 - DNA, 22 bp, Homo sapiens
aggagtggagttctctgttcta

SEQ ID NO: 3815568 - DNA, 16 bp, Homo sapiens
aggatatccccaggga

SEQ ID NO: 3815569 - DNA, 17 bp, Homo sapiens
aggatatccccagggaa

SEQ ID NO: 3815570 - DNA, 19 bp, Homo sapiens
aggatgtcctttgtgtcca

SEQ ID NO: 3815571 - DNA, 13 bp, Homo sapiens
aggatgtctgggc

SEQ ID NO: 3815572 - DNA, 14 bp, Homo sapiens
aggattcccagaga

SEQ ID NO: 3815573 - DNA, 15 bp, Homo sapiens
aggattcccagagag

SEQ ID NO: 3815574 - DNA, 18 bp, Homo sapiens
aggatttcaccagaagtt

SEQ ID NO: 3815575 - DNA, 16 bp, Homo sapiens
aggatttgctgggaga

SEQ ID NO: 3815576 - DNA, 14 bp, Homo sapiens
aggcacatggagga

SEQ ID NO: 3815577 - DNA, 16 bp, Homo sapiens
agtgttgaaaatgttc

SEQ ID NO: 3815578 - DNA, 17 bp, Homo sapiens
agtgttgaaaatgttca

SEQ ID NO: 3815579 - DNA, 22 bp, Homo sapiens
agtgtttcctgagtagcagtga

SEQ ID NO: 3815580 - DNA, 22 bp, Homo sapiens
agttaaagagaggccccggctg

SEQ ID NO: 3815581 - DNA, 18 bp, Homo sapiens
agttacctggatgccatt

SEQ ID NO: 3815582 - DNA, 21 bp, Homo sapiens
agttataagtagcaggccaag

SEQ ID NO: 3815583 - DNA, 13 bp, Homo sapiens
agttcatgagaat

SEQ ID NO: 3815584 - DNA, 21 bp, Homo sapiens
agttcatgagaatctatattt

SEQ ID NO: 3815585 - DNA, 21 bp, Homo sapiens
agttcattcaaaatgtccagc

SEQ ID NO: 3815586 - DNA, 23 bp, Homo sapiens
agttcccatggtgtatgtggttt

SEQ ID NO: 3815587 - DNA, 23 bp, Homo sapiens
agttcctcattagcattttgcta

SEQ ID NO: 3815588 - DNA, 17 bp, Homo sapiens
agttctagttgattgcg

SEQ ID NO: 3815589 - DNA, 12 bp, Homo sapiens
agttctgccagg

SEQ ID NO: 3815590 - DNA, 14 bp, Homo sapiens
agttctgccaggag

SEQ ID NO: 3815591 - DNA, 13 bp, Homo sapiens
agttgattcagct

SEQ ID NO: 3815592 - DNA, 14 bp, Homo sapiens
agttgattcagctc

SEQ ID NO: 3815593 - DNA, 17 bp, Homo sapiens
agttgattcagctctgc

SEQ ID NO: 3815594 - DNA, 19 bp, Homo sapiens
agttgattgcgagaatttt

SEQ ID NO: 3815595 - DNA, 17 bp, Homo sapiens
agttggtgttcataatt

SEQ ID NO: 3815596 - DNA, 23 bp, Homo sapiens
agttgtatcagcacgtgtggcct

SEQ ID NO: 3815597 - DNA, 14 bp, Homo sapiens
agtttacattctaa

SEQ ID NO: 3815598 - DNA, 12 bp, Homo sapiens
agtttagggtgg

SEQ ID NO: 3815599 - DNA, 14 bp, Homo sapiens
agtttagggtgggg

SEQ ID NO: 3815600 - DNA, 22 bp, Homo sapiens
agtttccaaagggcagtaaagt

SEQ ID NO: 3815601 - DNA, 20 bp, Homo sapiens
agtttctgggtcttctggga

SEQ ID NO: 3815602 - DNA, 16 bp, Homo sapiens
agtttgatttaatatc

SEQ ID NO: 3815603 - DNA, 15 bp, Homo sapiens
agtttggaatgaaga

SEQ ID NO: 3815604 - DNA, 17 bp, Homo sapiens
agttttgacagagttgg

SEQ ID NO: 3815605 - DNA, 16 bp, Homo sapiens
ataaaataattttatt

SEQ ID NO: 3815606 - DNA, 15 bp, Homo sapiens
ataaagcagagccaa

SEQ ID NO: 3815607 - DNA, 20 bp, Homo sapiens
ataaagcagagccaaggcca

SEQ ID NO: 3815608 - DNA, 15 bp, Homo sapiens
ataaaggagaagaga

SEQ ID NO: 3815609 - DNA, 21 bp, Homo sapiens
ataaaggtatttagaatatat

SEQ ID NO: 3815610 - DNA, 21 bp, Homo sapiens
ataaatgtatcatagaaatgt

SEQ ID NO: 3815611 - DNA, 16 bp, Homo sapiens
ataacaatgtgctctc

SEQ ID NO: 3815612 - DNA, 19 bp, Homo sapiens
ataagctgtagaactctgc

SEQ ID NO: 3815613 - DNA, 15 bp, Homo sapiens
ataagtgctactttg

SEQ ID NO: 3815614 - DNA, 14 bp, Homo sapiens
ataatagggaaaat

SEQ ID NO: 3815615 - DNA, 20 bp, Homo sapiens
ataatcctgtgaaaatatga

SEQ ID NO: 3815616 - DNA, 19 bp, Homo sapiens
ataatggtgttactaaagt

SEQ ID NO: 3815617 - DNA, 21 bp, Homo sapiens
ataatggtgttactaaagtca

SEQ ID NO: 3815618 - DNA, 14 bp, Homo sapiens
atacaattaaaggt

SEQ ID NO: 3815619 - DNA, 15 bp, Homo sapiens
atacaattaaaggtc

SEQ ID NO: 3815620 - DNA, 15 bp, Homo sapiens
atacacaatcctcca

SEQ ID NO: 3815621 - DNA, 20 bp, Homo sapiens
atacattatattcctctaaa

SEQ ID NO: 3815622 - DNA, 17 bp, Homo sapiens
atacattgaattagaaa

SEQ ID NO: 3815623 - DNA, 17 bp, Homo sapiens
atactcctccaaggtta

SEQ ID NO: 3815624 - DNA, 11 bp, Homo sapiens
atactgaagat

SEQ ID NO: 3815625 - DNA, 13 bp, Homo sapiens
atactgaagatgc

SEQ ID NO: 3815626 - DNA, 13 bp, Homo sapiens
atagatgtgtgga

SEQ ID NO: 3815627 - DNA, 14 bp, Homo sapiens
atagcaaatgacat

SEQ ID NO: 3815628 - DNA, 16 bp, Homo sapiens
atagcacatgattttc

SEQ ID NO: 3815629 - DNA, 17 bp, Homo sapiens
atagcacatgattttct

SEQ ID NO: 3815630 - DNA, 18 bp, Homo sapiens
atagcctgcctcttctct

SEQ ID NO: 3815631 - DNA, 18 bp, Homo sapiens
ataggataaattacatta

SEQ ID NO: 3815632 - DNA, 23 bp, Homo sapiens
ataggatcatttgttggaatgaa

SEQ ID NO: 3815633 - DNA, 23 bp, Homo sapiens
atagggtgctctgaggtcaataa

SEQ ID NO: 3815634 - DNA, 14 bp, Homo sapiens
atatacaatttcta

SEQ ID NO: 3815635 - DNA, 16 bp, Homo sapiens
atatatcataaagtat

SEQ ID NO: 3815636 - DNA, 12 bp, Homo sapiens
atatatgtatat

SEQ ID NO: 3815637 - DNA, 14 bp, Homo sapiens
atatatgtatatgt

SEQ ID NO: 3815638 - DNA, 16 bp, Homo sapiens
atatatgtatatgtat

SEQ ID NO: 3815639 - DNA, 23 bp, Homo sapiens
atatattctacacatatatgtat

SEQ ID NO: 3815640 - DNA, 13 bp, Homo sapiens
atatcataaagta

SEQ ID NO: 3815641 - DNA, 16 bp, Homo sapiens
atatccccagggaaac

SEQ ID NO: 3815642 - DNA, 19 bp, Homo sapiens
atatctgagaagtgtatat

SEQ ID NO: 3815643 - DNA, 23 bp, Homo sapiens
atatctggccacactgggctcac

SEQ ID NO: 3815644 - DNA, 13 bp, Homo sapiens
atatgtatatcta

SEQ ID NO: 3815645 - DNA, 12 bp, Homo sapiens
atatgtatatgt

SEQ ID NO: 3815646 - DNA, 22 bp, Homo sapiens
atattagtttgatttaatatct

SEQ ID NO: 3815647 - DNA, 20 bp, Homo sapiens
atattcaataaagctgctga

SEQ ID NO: 3815648 - DNA, 21 bp, Homo sapiens
atattcctctaaaactctcaa

SEQ ID NO: 3815649 - DNA, 21 bp, Homo sapiens
atattctcttgtctggctgca

SEQ ID NO: 3815650 - DNA, 13 bp, Homo sapiens
atatttactttaa

SEQ ID NO: 3815651 - DNA, 20 bp, Homo sapiens
atatttgtaaatttatgtga

SEQ ID NO: 3815652 - DNA, 13 bp, Homo sapiens
atatttgtacata

SEQ ID NO: 3815653 - DNA, 12 bp, Homo sapiens
atcaaaacatgc

SEQ ID NO: 3815654 - DNA, 15 bp, Homo sapiens
atcaaaattctgttt

SEQ ID NO: 3815655 - DNA, 23 bp, Homo sapiens
atcaaagaggttttaaaaaaatc

SEQ ID NO: 3815656 - DNA, 23 bp, Homo sapiens
atcagccctgcccttcagcatcc

SEQ ID NO: 3815657 - DNA, 24 bp, Homo sapiens
atcagccctgcccttcagcatcct

SEQ ID NO: 3815658 - DNA, 11 bp, Homo sapiens
atcagcctggg

SEQ ID NO: 3815659 - DNA, 16 bp, Homo sapiens
atcaggccattgtccc

SEQ ID NO: 3815660 - DNA, 20 bp, Homo sapiens
atcaggtcctcagagaattt

SEQ ID NO: 3815661 - DNA, 12 bp, Homo sapiens
atcatagaaatg

SEQ ID NO: 3815662 - DNA, 17 bp, Homo sapiens
atcatgtcgtaggtaaa

SEQ ID NO: 3815663 - DNA, 20 bp, Homo sapiens
atcattctgcttccgtattt

SEQ ID NO: 3815664 - DNA, 22 bp, Homo sapiens
atcattggatcctactcaacaa

SEQ ID NO: 3815665 - DNA, 18 bp, Homo sapiens
atcatttgttggaatgaa

SEQ ID NO: 3815666 - DNA, 19 bp, Homo sapiens
atccaaggagaaacagaga

SEQ ID NO: 3815667 - DNA, 22 bp, Homo sapiens
atccaaggagaaacagagacag

SEQ ID NO: 3815668 - DNA, 15 bp, Homo sapiens
atccacacacagagg

SEQ ID NO: 3815669 - DNA, 23 bp, Homo sapiens
atccacacacagaggaagagcag

SEQ ID NO: 3815670 - DNA, 13 bp, Homo sapiens
atccagaaagaaa

SEQ ID NO: 3815671 - DNA, 15 bp, Homo sapiens
atccagaaagaaaaa

SEQ ID NO: 3815672 - DNA, 19 bp, Homo sapiens
atccagagtccctgcctgg

SEQ ID NO: 3815673 - DNA, 20 bp, Homo sapiens
atccagagtccctgcctgga

SEQ ID NO: 3815674 - DNA, 15 bp, Homo sapiens
atccaggcaatggcc

SEQ ID NO: 3815675 - DNA, 20 bp, Homo sapiens
atccatggggctgattgtat

SEQ ID NO: 3815676 - DNA, 16 bp, Homo sapiens
atcccaacactgccag

SEQ ID NO: 3815677 - DNA, 14 bp, Homo sapiens
atcctaccaacctc

SEQ ID NO: 3815678 - DNA, 21 bp, Homo sapiens
atcctaggcatttgctgaata

SEQ ID NO: 3815679 - DNA, 17 bp, Homo sapiens
atcctgaaatttcagat

SEQ ID NO: 3815680 - DNA, 18 bp, Homo sapiens
atcctgtgccagaggaag

SEQ ID NO: 3815681 - DNA, 23 bp, Homo sapiens
atcctgtgccagaggaaggaaaa

SEQ ID NO: 3815682 - DNA, 18 bp, Homo sapiens
atcggggagccgggagcc

SEQ ID NO: 3815683 - DNA, 20 bp, Homo sapiens
atctaaagctttggacaagt

SEQ ID NO: 3815684 - DNA, 20 bp, Homo sapiens
atctcaagcaagtttaatca

SEQ ID NO: 3815685 - DNA, 14 bp, Homo sapiens
attctaattacaaa

SEQ ID NO: 3815686 - DNA, 20 bp, Homo sapiens
attctacacatatatgtata

SEQ ID NO: 3815687 - DNA, 15 bp, Homo sapiens
attctcacctgcctt

SEQ ID NO: 3815688 - DNA, 13 bp, Homo sapiens
attctcctgcctc

SEQ ID NO: 3815689 - DNA, 20 bp, Homo sapiens
attctcttggctggcttcct

SEQ ID NO: 3815690 - DNA, 14 bp, Homo sapiens
attctcttgtctgg

SEQ ID NO: 3815691 - DNA, 18 bp, Homo sapiens
attctcttgtctggctgc

SEQ ID NO: 3815692 - DNA, 17 bp, Homo sapiens
attctgttttgtaaatg

SEQ ID NO: 3815693 - DNA, 19 bp, Homo sapiens
attcttcctagttttctcc

SEQ ID NO: 3815694 - DNA, 13 bp, Homo sapiens
attcttctgcagt

SEQ ID NO: 3815695 - DNA, 19 bp, Homo sapiens
attctttgacctgttggga

SEQ ID NO: 3815696 - DNA, 17 bp, Homo sapiens
attgaaggagaaaatgc

SEQ ID NO: 3815697 - DNA, 19 bp, Homo sapiens
attgaaggagaaaatgcat

SEQ ID NO: 3815698 - DNA, 16 bp, Homo sapiens
attgataagtaatgaa

SEQ ID NO: 3815699 - DNA, 16 bp, Homo sapiens
attgatgttaacaaga

SEQ ID NO: 3815700 - DNA, 18 bp, Homo sapiens
attgcctgggcagtgccc

SEQ ID NO: 3815701 - DNA, 22 bp, Homo sapiens
attgctcctgcatgcaactaat

SEQ ID NO: 3815702 - DNA, 14 bp, Homo sapiens
attggaattttctt

SEQ ID NO: 3815703 - DNA, 21 bp, Homo sapiens
attgggagcttgggaatggat

SEQ ID NO: 3815704 - DNA, 15 bp, Homo sapiens
attgtatttatgtgt

SEQ ID NO: 3815705 - DNA, 11 bp, Homo sapiens
attgtcttcca

SEQ ID NO: 3815706 - DNA, 16 bp, Homo sapiens
attgtcttccaacccc

SEQ ID NO: 3815707 - DNA, 18 bp, Homo sapiens
attgtcttccaaccccag

SEQ ID NO: 3815708 - DNA, 20 bp, Homo sapiens
attgtcttccaaccccagct

SEQ ID NO: 3815709 - DNA, 15 bp, Homo sapiens
attgtgatgtgtcct

SEQ ID NO: 3815710 - DNA, 13 bp, Homo sapiens
atttaatatctga

SEQ ID NO: 3815711 - DNA, 14 bp, Homo sapiens
atttagaatatatt

SEQ ID NO: 3815712 - DNA, 20 bp, Homo sapiens
atttagaatatattaaatcg

SEQ ID NO: 3815713 - DNA, 20 bp, Homo sapiens
atttatcctgaaatttcaga

SEQ ID NO: 3815714 - DNA, 21 bp, Homo sapiens
atttatcctgaaatttcagat

SEQ ID NO: 3815715 - DNA, 13 bp, Homo sapiens
atttatttatgta

SEQ ID NO: 3815716 - DNA, 16 bp, Homo sapiens
atttcagagaggcctt

SEQ ID NO: 3815717 - DNA, 22 bp, Homo sapiens
atttcagagaggccttttggaa

SEQ ID NO: 3815718 - DNA, 18 bp, Homo sapiens
atttcatgctatctctgt

SEQ ID NO: 3815719 - DNA, 17 bp, Homo sapiens
atttccacataaaggta

SEQ ID NO: 3815720 - DNA, 21 bp, Homo sapiens
atttccacataaaggtattta

SEQ ID NO: 3815721 - DNA, 17 bp, Homo sapiens
atttctaccatttcaga

SEQ ID NO: 3815722 - DNA, 18 bp, Homo sapiens
atttctaccatttcagag

SEQ ID NO: 3815723 - DNA, 17 bp, Homo sapiens
atttctattatttttca

SEQ ID NO: 3815724 - DNA, 13 bp, Homo sapiens
atttctgaagagt

SEQ ID NO: 3815725 - DNA, 12 bp, Homo sapiens
atttgcctgcct

SEQ ID NO: 3815726 - DNA, 21 bp, Homo sapiens
atttgcctgcctgggcctccc

SEQ ID NO: 3815727 - DNA, 19 bp, Homo sapiens
atttgtaaatttatgtgat

SEQ ID NO: 3815728 - DNA, 15 bp, Homo sapiens
atttgtctttaaaca

SEQ ID NO: 3815729 - DNA, 13 bp, Homo sapiens
atttgttggaatg

SEQ ID NO: 3815730 - DNA, 22 bp, Homo sapiens
attttaaacaaaggttgagatg

SEQ ID NO: 3815731 - DNA, 19 bp, Homo sapiens
attttaatgaatattgatg

SEQ ID NO: 3815732 - DNA, 16 bp, Homo sapiens
attttactgacagaaa

SEQ ID NO: 3815733 - DNA, 19 bp, Homo sapiens
attttactgacagaaatgc

SEQ ID NO: 3815734 - DNA, 22 bp, Homo sapiens
attttcaaagctttttccagag

SEQ ID NO: 3815735 - DNA, 14 bp, Homo sapiens
attttcaagaaact

SEQ ID NO: 3815736 - DNA, 16 bp, Homo sapiens
attttcaagaaactga

SEQ ID NO: 3815737 - DNA, 22 bp, Homo sapiens
attttcaagaaactgaggaatt

SEQ ID NO: 3815738 - DNA, 22 bp, Homo sapiens
attttctggaatacatgaaata

SEQ ID NO: 3815739 - DNA, 20 bp, Homo sapiens
attttctttcatacattata

SEQ ID NO: 3815740 - DNA, 16 bp, Homo sapiens
attttctttctgtaac

SEQ ID NO: 3815741 - DNA, 21 bp, Homo sapiens
attttcttttgttttcttcat

SEQ ID NO: 3815742 - DNA, 19 bp, Homo sapiens
attttgtaaactcaaaata

SEQ ID NO: 3815743 - DNA, 22 bp, Homo sapiens
atttttcaagtaataaaacaat

SEQ ID NO: 3815744 - DNA, 12 bp, Homo sapiens
atttttctcatg

SEQ ID NO: 3815745 - DNA, 11 bp, Homo sapiens
atttttcttcc

SEQ ID NO: 3815746 - DNA, 16 bp, Homo sapiens
atttttgctcttctgt

SEQ ID NO: 3815747 - DNA, 20 bp, Homo sapiens
atttttgtacattatgttat

SEQ ID NO: 3815748 - DNA, 14 bp, Homo sapiens
atttttttgatggc

SEQ ID NO: 3815749 - DNA, 22 bp, Homo sapiens
caaaacgttttatgtgaatgtg

SEQ ID NO: 3815750 - DNA, 15 bp, Homo sapiens
caaaagctgggcagg

SEQ ID NO: 3815751 - DNA, 19 bp, Homo sapiens
caaaagctgggcaggttgg

SEQ ID NO: 3815752 - DNA, 16 bp, Homo sapiens
caaaatccttgcttat

SEQ ID NO: 3815753 - DNA, 17 bp, Homo sapiens
caaacacaccgatgcac

SEQ ID NO: 3815754 - DNA, 15 bp, Homo sapiens
caaacacctcccagg

SEQ ID NO: 3815755 - DNA, 15 bp, Homo sapiens
caaacaggaacaatc

SEQ ID NO: 3815756 - DNA, 18 bp, Homo sapiens
caaacctccaaaagccct

SEQ ID NO: 3815757 - DNA, 13 bp, Homo sapiens
caaagaggtattt

SEQ ID NO: 3815758 - DNA, 20 bp, Homo sapiens
caaagatatgctaagcagta

SEQ ID NO: 3815759 - DNA, 22 bp, Homo sapiens
caaagttgccacagatgatact

SEQ ID NO: 3815760 - DNA, 23 bp, Homo sapiens
caaattagcaggtgcaccttctg

SEQ ID NO: 3815761 - DNA, 14 bp, Homo sapiens
caacaagttgcctc

SEQ ID NO: 3815762 - DNA, 22 bp, Homo sapiens
caacacctctgcacaagctgca

SEQ ID NO: 3815763 - DNA, 13 bp, Homo sapiens
caacactgccagc

SEQ ID NO: 3815764 - DNA, 14 bp, Homo sapiens
caacactgccagca

SEQ ID NO: 3815765 - DNA, 22 bp, Homo sapiens
caacatgcttcatgaaaatcct

SEQ ID NO: 3815766 - DNA, 18 bp, Homo sapiens
caacatggcgaaaccccg

SEQ ID NO: 3815767 - DNA, 21 bp, Homo sapiens
caacatttttgtacattatgt

SEQ ID NO: 3815768 - DNA, 13 bp, Homo sapiens
caaccattccaga

SEQ ID NO: 3815769 - DNA, 22 bp, Homo sapiens
caaccattccagactgcttcca

SEQ ID NO: 3815770 - DNA, 13 bp, Homo sapiens
caaccccagctgg

SEQ ID NO: 3815771 - DNA, 16 bp, Homo sapiens
caaccccagctggcct

SEQ ID NO: 3815772 - DNA, 23 bp, Homo sapiens
caaccccagctggcctctagaac

SEQ ID NO: 3815773 - DNA, 13 bp, Homo sapiens
caaccggctttgt

SEQ ID NO: 3815774 - DNA, 14 bp, Homo sapiens
caacctgcccctcc

SEQ ID NO: 3815775 - DNA, 13 bp, Homo sapiens
caacgaaaagcac

SEQ ID NO: 3815776 - DNA, 23 bp, Homo sapiens
caactcccggaggtgtcaccttc

SEQ ID NO: 3815777 - DNA, 15 bp, Homo sapiens
caactccgcccagcc

SEQ ID NO: 3815778 - DNA, 18 bp, Homo sapiens
caactccgcccagcctct

SEQ ID NO: 3815779 - DNA, 14 bp, Homo sapiens
caactcctgttctt

SEQ ID NO: 3815780 - DNA, 22 bp, Homo sapiens
caactcctgttctttgggctca

SEQ ID NO: 3815781 - DNA, 23 bp, Homo sapiens
caagagatgaagagtgagagggc

SEQ ID NO: 3815782 - DNA, 15 bp, Homo sapiens
caagattcaaagaga

SEQ ID NO: 3815783 - DNA, 23 bp, Homo sapiens
caagcagacgtgagtgtgacttt

SEQ ID NO: 3815784 - DNA, 19 bp, Homo sapiens
caagcatgacaacttttaa

SEQ ID NO: 3815785 - DNA, 14 bp, Homo sapiens
caagcctgcctagg

SEQ ID NO: 3815786 - DNA, 14 bp, Homo sapiens
caagctctgcctcc

SEQ ID NO: 3815787 - DNA, 22 bp, Homo sapiens
caagctgcaccctcaggcaggt

SEQ ID NO: 3815788 - DNA, 14 bp, Homo sapiens
caagctgttttctt

SEQ ID NO: 3815789 - DNA, 23 bp, Homo sapiens
caaggacaacctgcccctcccca

SEQ ID NO: 3815790 - DNA, 20 bp, Homo sapiens
caaggaccttacaggccctc

SEQ ID NO: 3815791 - DNA, 19 bp, Homo sapiens
caaggagaaacagagacag

SEQ ID NO: 3815792 - DNA, 20 bp, Homo sapiens
caaggagaaacagagacagg

SEQ ID NO: 3815793 - DNA, 14 bp, Homo sapiens
aaaaacatggcctt

SEQ ID NO: 3815794 - DNA, 13 bp, Homo sapiens
aaaaagtatatat

SEQ ID NO: 3815795 - DNA, 11 bp, Homo sapiens
aaaaatagaag

SEQ ID NO: 3815796 - DNA, 21 bp, Homo sapiens
aaaacactaaaaataaaaatg

SEQ ID NO: 3815797 - DNA, 21 bp, Homo sapiens
aaaacagcttaaagagaaaaa

SEQ ID NO: 3815798 - DNA, 21 bp, Homo sapiens
aaaacatgcttgaataactga

SEQ ID NO: 3815799 - DNA, 12 bp, Homo sapiens
aaaacccaagtg

SEQ ID NO: 3815800 - DNA, 23 bp, Homo sapiens
aaaacgttttatgtgaatgtggc

SEQ ID NO: 3815801 - DNA, 23 bp, Homo sapiens
aaaagaatgacgtttacatataa

SEQ ID NO: 3815802 - DNA, 20 bp, Homo sapiens
aaaaggctaggtacacagct

SEQ ID NO: 3815803 - DNA, 16 bp, Homo sapiens
aaaagtccacttttaa

SEQ ID NO: 3815804 - DNA, 14 bp, Homo sapiens
aaaataccaaggaa

SEQ ID NO: 3815805 - DNA, 12 bp, Homo sapiens
aaaatagcctgc

SEQ ID NO: 3815806 - DNA, 13 bp, Homo sapiens
aaaatatgatact

SEQ ID NO: 3815807 - DNA, 13 bp, Homo sapiens
aaaatccttgctt

SEQ ID NO: 3815808 - DNA, 20 bp, Homo sapiens
aaaatccttgcttatgacat

SEQ ID NO: 3815809 - DNA, 21 bp, Homo sapiens
aaaatgagcctggcaagaatg

SEQ ID NO: 3815810 - DNA, 15 bp, Homo sapiens
aaaattagccaagtg

SEQ ID NO: 3815811 - DNA, 17 bp, Homo sapiens
aaacaaaggttgagatg

SEQ ID NO: 3815812 - DNA, 15 bp, Homo sapiens
aaacagagacaggcc

SEQ ID NO: 3815813 - DNA, 13 bp, Homo sapiens
aaacataaataaa

SEQ ID NO: 3815814 - DNA, 21 bp, Homo sapiens
aaacatgcttgaataactgag

SEQ ID NO: 3815815 - DNA, 23 bp, Homo sapiens
aaacatgcttgaataactgagct

SEQ ID NO: 3815816 - DNA, 15 bp, Homo sapiens
aaaccatgcaaatgc

SEQ ID NO: 3815817 - DNA, 17 bp, Homo sapiens
aaacctgtccataaagt

SEQ ID NO: 3815818 - DNA, 15 bp, Homo sapiens
aaacgggctcagcaa

SEQ ID NO: 3815819 - DNA, 15 bp, Homo sapiens
aaactaggtaaaatt

SEQ ID NO: 3815820 - DNA, 23 bp, Homo sapiens
aaactatatttatttatgtagga

SEQ ID NO: 3815821 - DNA, 23 bp, Homo sapiens
aaactcccacttgtcatgtgaca

SEQ ID NO: 3815822 - DNA, 18 bp, Homo sapiens
aaactgaggaattttctt

SEQ ID NO: 3815823 - DNA, 21 bp, Homo sapiens
aaactggctggcccagagttt

SEQ ID NO: 3815824 - DNA, 23 bp, Homo sapiens
aaactgttactgtcctgttttct

SEQ ID NO: 3815825 - DNA, 15 bp, Homo sapiens
aaacttagaggaaaa

SEQ ID NO: 3815826 - DNA, 17 bp, Homo sapiens
aaacttagaggaaaagg

SEQ ID NO: 3815827 - DNA, 18 bp, Homo sapiens
aaagaaaaaataattgat

SEQ ID NO: 3815828 - DNA, 13 bp, Homo sapiens
aaagaactgcccc

SEQ ID NO: 3815829 - DNA, 14 bp, Homo sapiens
aaagaactgcccca

SEQ ID NO: 3815830 - DNA, 19 bp, Homo sapiens
aaagatgcttctcactgcc

SEQ ID NO: 3815831 - DNA, 17 bp, Homo sapiens
aaagattatatatcata

SEQ ID NO: 3815832 - DNA, 12 bp, Homo sapiens
aaagcacatcca

SEQ ID NO: 3815833 - DNA, 19 bp, Homo sapiens
aaagcagagccaaggccac

SEQ ID NO: 3815834 - DNA, 13 bp, Homo sapiens
aaagccacatttt

SEQ ID NO: 3815835 - DNA, 18 bp, Homo sapiens
aaagctctgaacaaaagc

SEQ ID NO: 3815836 - DNA, 23 bp, Homo sapiens
aaagctgctgagaatctagcctc

SEQ ID NO: 3815837 - DNA, 17 bp, Homo sapiens
aaaggagagctagcagc

SEQ ID NO: 3815838 - DNA, 14 bp, Homo sapiens
aaaggttttcctct

SEQ ID NO: 3815839 - DNA, 15 bp, Homo sapiens
aaagtatatattcta

SEQ ID NO: 3815840 - DNA, 14 bp, Homo sapiens
aaataaaaccagct

SEQ ID NO: 3815841 - DNA, 12 bp, Homo sapiens
aaataaaataat

SEQ ID NO: 3815842 - DNA, 11 bp, Homo sapiens
aaataaactag

SEQ ID NO: 3815843 - DNA, 15 bp, Homo sapiens
aaataaatgtatcat

SEQ ID NO: 3815844 - DNA, 18 bp, Homo sapiens
aaataagctcgagtgaat

SEQ ID NO: 3815845 - DNA, 12 bp, Homo sapiens
aaataattttaa

SEQ ID NO: 3815846 - DNA, 14 bp, Homo sapiens
aaataattttaaac

SEQ ID NO: 3815847 - DNA, 18 bp, Homo sapiens
aaataattttaaacaaag

SEQ ID NO: 3815848 - DNA, 20 bp, Homo sapiens
aaataattttaaacaaaggt

SEQ ID NO: 3815849 - DNA, 15 bp, Homo sapiens
aaatacgttgttaaa

SEQ ID NO: 3815850 - DNA, 18 bp, Homo sapiens
aaatagaagctataaaga

SEQ ID NO: 3815851 - DNA, 12 bp, Homo sapiens
aaatatgatact

SEQ ID NO: 3815852 - DNA, 13 bp, Homo sapiens
aaatatttatttt

SEQ ID NO: 3815853 - DNA, 14 bp, Homo sapiens
aaatatttgtacat

SEQ ID NO: 3815854 - DNA, 20 bp, Homo sapiens
aaatatttgtctttaaacag

SEQ ID NO: 3815855 - DNA, 19 bp, Homo sapiens
aaatcagcctgctccagct

SEQ ID NO: 3815856 - DNA, 23 bp, Homo sapiens
aaatcagcctgctccagctgttc

SEQ ID NO: 3815857 - DNA, 15 bp, Homo sapiens
aaatgagcattagct

SEQ ID NO: 3815858 - DNA, 19 bp, Homo sapiens
aaatgagcctggcaagaat

SEQ ID NO: 3815859 - DNA, 15 bp, Homo sapiens
aaatgcataaatgca

SEQ ID NO: 3815860 - DNA, 20 bp, Homo sapiens
aaatgcattataggatcatt

SEQ ID NO: 3815861 - DNA, 13 bp, Homo sapiens
aaatgcattatgt

SEQ ID NO: 3815862 - DNA, 19 bp, Homo sapiens
aaatgctgtaactttctga

SEQ ID NO: 3815863 - DNA, 22 bp, Homo sapiens
aaatggccatttgctttttcac

SEQ ID NO: 3815864 - DNA, 23 bp, Homo sapiens
aaatggccatttgctttttcacc

SEQ ID NO: 3815865 - DNA, 15 bp, Homo sapiens
aaatgtaagaaagca

SEQ ID NO: 3815866 - DNA, 24 bp, Homo sapiens
aaatgtctagttgtaacaccatga

SEQ ID NO: 3815867 - DNA, 15 bp, Homo sapiens
aaatgttcagaaggt

SEQ ID NO: 3815868 - DNA, 18 bp, Homo sapiens
aaatgttggaatgttatg

SEQ ID NO: 3815869 - DNA, 16 bp, Homo sapiens
aaattacacccaaaga

SEQ ID NO: 3815870 - DNA, 19 bp, Homo sapiens
aaattcaacctgtgtctta

SEQ ID NO: 3815871 - DNA, 12 bp, Homo sapiens
aaattgtgatgt

SEQ ID NO: 3815872 - DNA, 15 bp, Homo sapiens
aaatttatgtgatgg

SEQ ID NO: 3815873 - DNA, 12 bp, Homo sapiens
aaatttcagatt

SEQ ID NO: 3815874 - DNA, 16 bp, Homo sapiens
aacaaaggttgagatg

SEQ ID NO: 3815875 - DNA, 19 bp, Homo sapiens
aacaaatgtatcagtgatg

SEQ ID NO: 3815876 - DNA, 17 bp, Homo sapiens
aacaagtaagaaaaata

SEQ ID NO: 3815877 - DNA, 16 bp, Homo sapiens
aacaatgtcagaaact

SEQ ID NO: 3815878 - DNA, 15 bp, Homo sapiens
aacaatgtttttcat

SEQ ID NO: 3815879 - DNA, 22 bp, Homo sapiens
aacaattatgtttcttgctgta

SEQ ID NO: 3815880 - DNA, 15 bp, Homo sapiens
aacacaggcaaaatc

SEQ ID NO: 3815881 - DNA, 11 bp, Homo sapiens
aacacccactg

SEQ ID NO: 3815882 - DNA, 12 bp, Homo sapiens
aacacccactgg

SEQ ID NO: 3815883 - DNA, 15 bp, Homo sapiens
aacacccactggcca

SEQ ID NO: 3815884 - DNA, 16 bp, Homo sapiens
aacacccactggccag

SEQ ID NO: 3815885 - DNA, 13 bp, Homo sapiens
aacacctcccagg

SEQ ID NO: 3815886 - DNA, 19 bp, Homo sapiens
aacacctctgcacaagctg

SEQ ID NO: 3815887 - DNA, 12 bp, Homo sapiens
aacactgccagc

SEQ ID NO: 3815888 - DNA, 18 bp, Homo sapiens
aacactgggctctgagga

SEQ ID NO: 3815889 - DNA, 13 bp, Homo sapiens
aacagaaacaaaa

SEQ ID NO: 3815890 - DNA, 13 bp, Homo sapiens
aacagcaactaca

SEQ ID NO: 3815891 - DNA, 18 bp, Homo sapiens
aacagtccattgaaaggg

SEQ ID NO: 3815892 - DNA, 13 bp, Homo sapiens
aacagtgagcctg

SEQ ID NO: 3815893 - DNA, 21 bp, Homo sapiens
aacagtgagcctgaattttgt

SEQ ID NO: 3815894 - DNA, 17 bp, Homo sapiens
cacgcctgggtgacccc

SEQ ID NO: 3815895 - DNA, 20 bp, Homo sapiens
cacgcctgtaatcctagcac

SEQ ID NO: 3815896 - DNA, 16 bp, Homo sapiens
cacggaagagccttgc

SEQ ID NO: 3815897 - DNA, 20 bp, Homo sapiens
cacggcactccagcctgggc

SEQ ID NO: 3815898 - DNA, 17 bp, Homo sapiens
cacgtgctcgcctctgc

SEQ ID NO: 3815899 - DNA, 17 bp, Homo sapiens
cactacatatctaaagc

SEQ ID NO: 3815900 - DNA, 15 bp, Homo sapiens
cactcaaaagctggg

SEQ ID NO: 3815901 - DNA, 17 bp, Homo sapiens
cactcacagggagctgg

SEQ ID NO: 3815902 - DNA, 16 bp, Homo sapiens
cactcatagggtgctc

SEQ ID NO: 3815903 - DNA, 12 bp, Homo sapiens
cactctttgcta

SEQ ID NO: 3815904 - DNA, 14 bp, Homo sapiens
cactctttgctaca

SEQ ID NO: 3815905 - DNA, 22 bp, Homo sapiens
cactgaaggctttcagggcctc

SEQ ID NO: 3815906 - DNA, 22 bp, Homo sapiens
cactgagactagattctcacct

SEQ ID NO: 3815907 - DNA, 16 bp, Homo sapiens
cactgcaagctctgcc

SEQ ID NO: 3815908 - DNA, 17 bp, Homo sapiens
cactgcaagctctgcct

SEQ ID NO: 3815909 - DNA, 20 bp, Homo sapiens
cactgcaagctctgcctccc

SEQ ID NO: 3815910 - DNA, 22 bp, Homo sapiens
cactgccaaaaatagaaagtga

SEQ ID NO: 3815911 - DNA, 18 bp, Homo sapiens
cactgccagcatttccct

SEQ ID NO: 3815912 - DNA, 14 bp, Homo sapiens
cactgccgcctcct

SEQ ID NO: 3815913 - DNA, 12 bp, Homo sapiens
cactgctctgcc

SEQ ID NO: 3815914 - DNA, 21 bp, Homo sapiens
cactggccagtcctagagctc

SEQ ID NO: 3815915 - DNA, 13 bp, Homo sapiens
cactggccccacc

SEQ ID NO: 3815916 - DNA, 12 bp, Homo sapiens
cactgggctctg

SEQ ID NO: 3815917 - DNA, 16 bp, Homo sapiens
cactgggctctgagga

SEQ ID NO: 3815918 - DNA, 15 bp, Homo sapiens
cactggggcaggggc

SEQ ID NO: 3815919 - DNA, 13 bp, Homo sapiens
cactgtgaagaga

SEQ ID NO: 3815920 - DNA, 20 bp, Homo sapiens
cacttatttatgaacctgcc

SEQ ID NO: 3815921 - DNA, 21 bp, Homo sapiens
cacttcagctgacttttctgt

SEQ ID NO: 3815922 - DNA, 16 bp, Homo sapiens
cacttcatagatgaga

SEQ ID NO: 3815923 - DNA, 12 bp, Homo sapiens
cacttgtacaaa

SEQ ID NO: 3815924 - DNA, 16 bp, Homo sapiens
cactttgagaaacacc

SEQ ID NO: 3815925 - DNA, 13 bp, Homo sapiens
cacttttaaaact

SEQ ID NO: 3815926 - DNA, 18 bp, Homo sapiens
cagaaacaaaaacactaa

SEQ ID NO: 3815927 - DNA, 16 bp, Homo sapiens
cagaaacagagagaga

SEQ ID NO: 3815928 - DNA, 14 bp, Homo sapiens
cagaaatagctatg

SEQ ID NO: 3815929 - DNA, 13 bp, Homo sapiens
cagaactgcttta

SEQ ID NO: 3815930 - DNA, 18 bp, Homo sapiens
cagaagcaggagtaagtt

SEQ ID NO: 3815931 - DNA, 20 bp, Homo sapiens
cagaagccccaactgtgatc

SEQ ID NO: 3815932 - DNA, 19 bp, Homo sapiens
cagaaggctgggtccaggg

SEQ ID NO: 3815933 - DNA, 22 bp, Homo sapiens
cagaagtttgagatcagcctgg

SEQ ID NO: 3815934 - DNA, 14 bp, Homo sapiens
cagaatattaaatt

SEQ ID NO: 3815935 - DNA, 11 bp, Homo sapiens
cagaatgaatc

SEQ ID NO: 3815936 - DNA, 16 bp, Homo sapiens
cagaccaccagccgcc

SEQ ID NO: 3815937 - DNA, 23 bp, Homo sapiens
cagaccaccagccgccccagccc

SEQ ID NO: 3815938 - DNA, 22 bp, Homo sapiens
cagaccattgtcttccaacccc

SEQ ID NO: 3815939 - DNA, 19 bp, Homo sapiens
cagacctctgaatgtccca

SEQ ID NO: 3815940 - DNA, 18 bp, Homo sapiens
cagagaaaaagggagggg

SEQ ID NO: 3815941 - DNA, 16 bp, Homo sapiens
cagagaatttctacca

SEQ ID NO: 3815942 - DNA, 16 bp, Homo sapiens
cagagacagagagaga

SEQ ID NO: 3815943 - DNA, 20 bp, Homo sapiens
cagagatatgcacacaccga

SEQ ID NO: 3815944 - DNA, 13 bp, Homo sapiens
cagagccagaggc

SEQ ID NO: 3815945 - DNA, 13 bp, Homo sapiens
cagagccccacac

SEQ ID NO: 3815946 - DNA, 18 bp, Homo sapiens
cagagccggtttccgtgg

SEQ ID NO: 3815947 - DNA, 11 bp, Homo sapiens
cagagctgagt

SEQ ID NO: 3815948 - DNA, 11 bp, Homo sapiens
cagagctgggc

SEQ ID NO: 3815949 - DNA, 13 bp, Homo sapiens
cagaggaaggaga

SEQ ID NO: 3815950 - DNA, 22 bp, Homo sapiens
cagaggacagtatttgtgggga

SEQ ID NO: 3815951 - DNA, 13 bp, Homo sapiens
cagaggcagacag

SEQ ID NO: 3815952 - DNA, 12 bp, Homo sapiens
cagaggggcagg

SEQ ID NO: 3815953 - DNA, 18 bp, Homo sapiens
cagaggggcaggggagtg

SEQ ID NO: 3815954 - DNA, 17 bp, Homo sapiens
cagagggtgtcctgcac

SEQ ID NO: 3815955 - DNA, 14 bp, Homo sapiens
cagagtccctgcct

SEQ ID NO: 3815956 - DNA, 17 bp, Homo sapiens
cagagttggtgttcata

SEQ ID NO: 3815957 - DNA, 18 bp, Homo sapiens
cagatatgcacacacatg

SEQ ID NO: 3815958 - DNA, 19 bp, Homo sapiens
cagatggatccacgtgctc

SEQ ID NO: 3815959 - DNA, 20 bp, Homo sapiens
cagatgggatgggctttctc

SEQ ID NO: 3815960 - DNA, 20 bp, Homo sapiens
cagatttgctaatttatcct

SEQ ID NO: 3815961 - DNA, 22 bp, Homo sapiens
cagattttaagggggaaaactg

SEQ ID NO: 3815962 - DNA, 19 bp, Homo sapiens
cagcaaagtgtcagtgttg

SEQ ID NO: 3815963 - DNA, 16 bp, Homo sapiens
cagcaccacattgcct

SEQ ID NO: 3815964 - DNA, 18 bp, Homo sapiens
cagcaccacattgcctca

SEQ ID NO: 3815965 - DNA, 19 bp, Homo sapiens
cagcaccacattgcctcat

SEQ ID NO: 3815966 - DNA, 17 bp, Homo sapiens
cagcagccccctgcccg

SEQ ID NO: 3815967 - DNA, 12 bp, Homo sapiens
cagcagcctgga

SEQ ID NO: 3815968 - DNA, 15 bp, Homo sapiens
cagcagcctggaccc

SEQ ID NO: 3815969 - DNA, 19 bp, Homo sapiens
cagcagcctggaccctgtg

SEQ ID NO: 3815970 - DNA, 20 bp, Homo sapiens
cagcagggagggcttctgcc

SEQ ID NO: 3815971 - DNA, 11 bp, Homo sapiens
cagcccaccct

SEQ ID NO: 3815972 - DNA, 13 bp, Homo sapiens
cagccccttctcc

SEQ ID NO: 3815973 - DNA, 15 bp, Homo sapiens
cagccctctcactgt

SEQ ID NO: 3815974 - DNA, 19 bp, Homo sapiens
cagccctgctgcttcctaa

SEQ ID NO: 3815975 - DNA, 21 bp, Homo sapiens
cagcctacactattctagcag

SEQ ID NO: 3815976 - DNA, 13 bp, Homo sapiens
cagcctccaggca

SEQ ID NO: 3815977 - DNA, 18 bp, Homo sapiens
cagcctcccagctttctg

SEQ ID NO: 3815978 - DNA, 23 bp, Homo sapiens
cagcctccccctgtcccctctat

SEQ ID NO: 3815979 - DNA, 10 bp, Homo sapiens
cagcctcctg

SEQ ID NO: 3815980 - DNA, 24 bp, Homo sapiens
cagcctctccactcatgtgactct

SEQ ID NO: 3815981 - DNA, 18 bp, Homo sapiens
cagcctgagtgcaccacc

SEQ ID NO: 3815982 - DNA, 23 bp, Homo sapiens
cagcctgccccagcctcccagct

SEQ ID NO: 3815983 - DNA, 15 bp, Homo sapiens
cagcctgctccagct

SEQ ID NO: 3815984 - DNA, 19 bp, Homo sapiens
cagcctgctccagctgttc

SEQ ID NO: 3815985 - DNA, 19 bp, Homo sapiens
cagcctgggaccagggcat

SEQ ID NO: 3815986 - DNA, 20 bp, Homo sapiens
cagcctgggaccagggcata

SEQ ID NO: 3815987 - DNA, 17 bp, Homo sapiens
cagcctgggcgacagag

SEQ ID NO: 3815988 - DNA, 12 bp, Homo sapiens
cagcgcctcctg

SEQ ID NO: 3815989 - DNA, 13 bp, Homo sapiens
cagcgcctcctgg

SEQ ID NO: 3815990 - DNA, 18 bp, Homo sapiens
cagcggtccaaagttatc

SEQ ID NO: 3815991 - DNA, 16 bp, Homo sapiens
cagctattcaggaggc

SEQ ID NO: 3815992 - DNA, 23 bp, Homo sapiens
cagctattcaggaggctgaggca

SEQ ID NO: 3815993 - DNA, 15 bp, Homo sapiens
cagctctgcaagaat

SEQ ID NO: 3815994 - DNA, 16 bp, Homo sapiens
cagctctgcaagaatt

SEQ ID NO: 3815995 - DNA, 21 bp, Homo sapiens
cagctctgcaagaattgaagc

SEQ ID NO: 3815996 - DNA, 19 bp, Homo sapiens
cagctgaggacacacccca

SEQ ID NO: 3815997 - DNA, 20 bp, Homo sapiens
cagctgaggacacaccccac

SEQ ID NO: 3815998 - DNA, 19 bp, Homo sapiens
cagctgagggtgagtgggt

SEQ ID NO: 3815999 - DNA, 16 bp, Homo sapiens
cagctggagaagaccc

SEQ ID NO: 3816000 - DNA, 10 bp, Homo sapiens
cagctggcct

SEQ ID NO: 3816001 - DNA, 12 bp, Homo sapiens
cagctggcctct

SEQ ID NO: 3816002 - DNA, 19 bp, Homo sapiens
cagctggcctctagaacac

SEQ ID NO: 3816003 - DNA, 23 bp, Homo sapiens
ccctcgtggacacctgccctgcc

SEQ ID NO: 3816004 - DNA, 11 bp, Homo sapiens
ccctctctctg

SEQ ID NO: 3816005 - DNA, 16 bp, Homo sapiens
ccctgaaagccctgag

SEQ ID NO: 3816006 - DNA, 14 bp, Homo sapiens
ccctgaacaagaat

SEQ ID NO: 3816007 - DNA, 13 bp, Homo sapiens
ccctgaaccatcc

SEQ ID NO: 3816008 - DNA, 12 bp, Homo sapiens
ccctgcctggac

SEQ ID NO: 3816009 - DNA, 13 bp, Homo sapiens
ccctgcctggacc

SEQ ID NO: 3816010 - DNA, 18 bp, Homo sapiens
ccctgcctggaccagcct

SEQ ID NO: 3816011 - DNA, 21 bp, Homo sapiens
ccctgggcctcagcctccagg

SEQ ID NO: 3816012 - DNA, 16 bp, Homo sapiens
ccctgtccctgtcccc

SEQ ID NO: 3816013 - DNA, 15 bp, Homo sapiens
ccctgtgccttgtca

SEQ ID NO: 3816014 - DNA, 18 bp, Homo sapiens
cccttagaagatctgctt

SEQ ID NO: 3816015 - DNA, 15 bp, Homo sapiens
cccttctcccagcac

SEQ ID NO: 3816016 - DNA, 23 bp, Homo sapiens
ccctttaaaggtcgcacctcctt

SEQ ID NO: 3816017 - DNA, 17 bp, Homo sapiens
ccgagaaggaagcctcc

SEQ ID NO: 3816018 - DNA, 19 bp, Homo sapiens
ccgagattgcaccactgca

SEQ ID NO: 3816019 - DNA, 15 bp, Homo sapiens
ccgaggcagggaagg

SEQ ID NO: 3816020 - DNA, 19 bp, Homo sapiens
ccgctctggatcctgcact

SEQ ID NO: 3816021 - DNA, 21 bp, Homo sapiens
ccgctttcatgaacacagcct

SEQ ID NO: 3816022 - DNA, 20 bp, Homo sapiens
ccggctgggtcggccctgcc

SEQ ID NO: 3816023 - DNA, 20 bp, Homo sapiens
ccgggcgcggtggctcacgc

SEQ ID NO: 3816024 - DNA, 19 bp, Homo sapiens
ccggggcctgggcaggagg

SEQ ID NO: 3816025 - DNA, 20 bp, Homo sapiens
ccggggcctgggcaggaggg

SEQ ID NO: 3816026 - DNA, 22 bp, Homo sapiens
ccgggtcatctgtacctctgcc

SEQ ID NO: 3816027 - DNA, 14 bp, Homo sapiens
ccgggtgccattcc

SEQ ID NO: 3816028 - DNA, 11 bp, Homo sapiens
ccggtgcagaa

SEQ ID NO: 3816029 - DNA, 16 bp, Homo sapiens
ccgtccaggagcctgg

SEQ ID NO: 3816030 - DNA, 18 bp, Homo sapiens
ccgtccaggagcctgtgc

SEQ ID NO: 3816031 - DNA, 19 bp, Homo sapiens
ccgtgggcactgaaggctt

SEQ ID NO: 3816032 - DNA, 12 bp, Homo sapiens
cctaacctgccg

SEQ ID NO: 3816033 - DNA, 13 bp, Homo sapiens
cctaacctgccga

SEQ ID NO: 3816034 - DNA, 18 bp, Homo sapiens
cctaatgtggcagctgtc

SEQ ID NO: 3816035 - DNA, 21 bp, Homo sapiens
cctacagttgaaaaacagctg

SEQ ID NO: 3816036 - DNA, 19 bp, Homo sapiens
cctacatgaaacagaaaca

SEQ ID NO: 3816037 - DNA, 15 bp, Homo sapiens
cctaccaacctctga

SEQ ID NO: 3816038 - DNA, 12 bp, Homo sapiens
cctacccactct

SEQ ID NO: 3816039 - DNA, 16 bp, Homo sapiens
cctacccactctttgc

SEQ ID NO: 3816040 - DNA, 17 bp, Homo sapiens
cctagatccacacacag

SEQ ID NO: 3816041 - DNA, 16 bp, Homo sapiens
cctaggaattcccagc

SEQ ID NO: 3816042 - DNA, 17 bp, Homo sapiens
cctaggaattcccagcc

SEQ ID NO: 3816043 - DNA, 17 bp, Homo sapiens
cctaggctccaccccat

SEQ ID NO: 3816044 - DNA, 18 bp, Homo sapiens
cctaggctccaccccatc

SEQ ID NO: 3816045 - DNA, 16 bp, Homo sapiens
cctattagagaagaga

SEQ ID NO: 3816046 - DNA, 19 bp, Homo sapiens
cctcacagcctctccctta

SEQ ID NO: 3816047 - DNA, 18 bp, Homo sapiens
cctcagccccgcgtggaa

SEQ ID NO: 3816048 - DNA, 22 bp, Homo sapiens
cctcagcctcctgagtagctgg

SEQ ID NO: 3816049 - DNA, 12 bp, Homo sapiens
cctcagcttccc

SEQ ID NO: 3816050 - DNA, 21 bp, Homo sapiens
cctcagcttcccaagtagctg

SEQ ID NO: 3816051 - DNA, 11 bp, Homo sapiens
cctcaggcagg

SEQ ID NO: 3816052 - DNA, 18 bp, Homo sapiens
cctcaggcaggtgggatg

SEQ ID NO: 3816053 - DNA, 18 bp, Homo sapiens
cctcaggtgagaagcaga

SEQ ID NO: 3816054 - DNA, 20 bp, Homo sapiens
cctcatttcttcctctgcat

SEQ ID NO: 3816055 - DNA, 15 bp, Homo sapiens
cctccaaacactggg

SEQ ID NO: 3816056 - DNA, 13 bp, Homo sapiens
cctccacctcctg

SEQ ID NO: 3816057 - DNA, 14 bp, Homo sapiens
cctccacctcctgg

SEQ ID NO: 3816058 - DNA, 15 bp, Homo sapiens
cctccacctcctggg

SEQ ID NO: 3816059 - DNA, 15 bp, Homo sapiens
cctccagaccaccag

SEQ ID NO: 3816060 - DNA, 17 bp, Homo sapiens
cctccagaccaccagcc

SEQ ID NO: 3816061 - DNA, 20 bp, Homo sapiens
cctccagtgggaggacagag

SEQ ID NO: 3816062 - DNA, 14 bp, Homo sapiens
cctcccagctttct

SEQ ID NO: 3816063 - DNA, 23 bp, Homo sapiens
cctccccacagtcctcacagcct

SEQ ID NO: 3816064 - DNA, 17 bp, Homo sapiens
cctcccccagagccact

SEQ ID NO: 3816065 - DNA, 21 bp, Homo sapiens
cctccccgcaccccccaagct

SEQ ID NO: 3816066 - DNA, 20 bp, Homo sapiens
cctccctgaaccatccctga

SEQ ID NO: 3816067 - DNA, 20 bp, Homo sapiens
cctccctgttaataaacagc

SEQ ID NO: 3816068 - DNA, 19 bp, Homo sapiens
cctccgctgggaggaacct

SEQ ID NO: 3816069 - DNA, 13 bp, Homo sapiens
cctcctcaccccc

SEQ ID NO: 3816070 - DNA, 14 bp, Homo sapiens
cctcctcaccccca

SEQ ID NO: 3816071 - DNA, 17 bp, Homo sapiens
cctcctgagtagctggg

SEQ ID NO: 3816072 - DNA, 16 bp, Homo sapiens
cctcctgccctgtccc

SEQ ID NO: 3816073 - DNA, 17 bp, Homo sapiens
cctcctgccctgtccct

SEQ ID NO: 3816074 - DNA, 21 bp, Homo sapiens
cctcctgggtttaagcaatgc

SEQ ID NO: 3816075 - DNA, 14 bp, Homo sapiens
cctcgactcagcac

SEQ ID NO: 3816076 - DNA, 14 bp, Homo sapiens
cctcggcctcccaa

SEQ ID NO: 3816077 - DNA, 15 bp, Homo sapiens
cctcgtggacacctg

SEQ ID NO: 3816078 - DNA, 12 bp, Homo sapiens
cctctagaacac

SEQ ID NO: 3816079 - DNA, 20 bp, Homo sapiens
cctctagaacacccactggc

SEQ ID NO: 3816080 - DNA, 23 bp, Homo sapiens
cctctagaacacccactggccag

SEQ ID NO: 3816081 - DNA, 18 bp, Homo sapiens
cctctcaatattcaataa

SEQ ID NO: 3816082 - DNA, 22 bp, Homo sapiens
cctctcaatattcaataaagct

SEQ ID NO: 3816083 - DNA, 18 bp, Homo sapiens
cctctccactcatgtgac

SEQ ID NO: 3816084 - DNA, 15 bp, Homo sapiens
cctctctctggaaag

SEQ ID NO: 3816085 - DNA, 23 bp, Homo sapiens
cctctgaaaaccaatgttctctc

SEQ ID NO: 3816086 - DNA, 15 bp, Homo sapiens
cctctgcacaagctg

SEQ ID NO: 3816087 - DNA, 20 bp, Homo sapiens
cctctgcccagcctgcccca

SEQ ID NO: 3816088 - DNA, 21 bp, Homo sapiens
cctctgcccgggagctcagga

SEQ ID NO: 3816089 - DNA, 22 bp, Homo sapiens
cctctgcccgggagctcaggaa

SEQ ID NO: 3816090 - DNA, 18 bp, Homo sapiens
cctcttctattttgtaaa

SEQ ID NO: 3816091 - DNA, 15 bp, Homo sapiens
cctcttggctgcctt

SEQ ID NO: 3816092 - DNA, 18 bp, Homo sapiens
cctgaaagccctgagctt

SEQ ID NO: 3816093 - DNA, 15 bp, Homo sapiens
cctgaaatttcagat

SEQ ID NO: 3816094 - DNA, 13 bp, Homo sapiens
cctgaacaagaat

SEQ ID NO: 3816095 - DNA, 15 bp, Homo sapiens
cctgaacaagaattg

SEQ ID NO: 3816096 - DNA, 17 bp, Homo sapiens
cctgaacaagaattgga

SEQ ID NO: 3816097 - DNA, 16 bp, Homo sapiens
cctgaaggcatctgag

SEQ ID NO: 3816098 - DNA, 21 bp, Homo sapiens
cctgacctcgtgatttgcctg

SEQ ID NO: 3816099 - DNA, 14 bp, Homo sapiens
cctgaccttctcca

SEQ ID NO: 3816100 - DNA, 15 bp, Homo sapiens
cctgaccttctccag

SEQ ID NO: 3816101 - DNA, 14 bp, Homo sapiens
cctgactctcagca

SEQ ID NO: 3816102 - DNA, 13 bp, Homo sapiens
cctgagaagagag

SEQ ID NO: 3816103 - DNA, 19 bp, Homo sapiens
cctgaggaagagggactgt

SEQ ID NO: 3816104 - DNA, 15 bp, Homo sapiens
cctgagtagcagtga

SEQ ID NO: 3816105 - DNA, 23 bp, Homo sapiens
cctgagtcaccctacctgtgcct

SEQ ID NO: 3816106 - DNA, 20 bp, Homo sapiens
cctgatcaagtcaccggagc

SEQ ID NO: 3816107 - DNA, 18 bp, Homo sapiens
cctgccccagcctcccag

SEQ ID NO: 3816108 - DNA, 19 bp, Homo sapiens
cctgccccagcctcccagc

SEQ ID NO: 3816109 - DNA, 11 bp, Homo sapiens
cctgccctgcc

SEQ ID NO: 3816110 - DNA, 15 bp, Homo sapiens
cctgccctgccctgc

SEQ ID NO: 3816111 - DNA, 21 bp, Homo sapiens
cctgccctgtccctgtccccc

SEQ ID NO: 3816112 - DNA, 22 bp, Homo sapiens
ctgagtgggggatcacagcctc

SEQ ID NO: 3816113 - DNA, 22 bp, Homo sapiens
ctgagtgtgagaccctgttcta

SEQ ID NO: 3816114 - DNA, 23 bp, Homo sapiens
ctgatgctgaaataaactagggt

SEQ ID NO: 3816115 - DNA, 15 bp, Homo sapiens
ctgattccagcaaga

SEQ ID NO: 3816116 - DNA, 18 bp, Homo sapiens
ctgattttcaaagctttt

SEQ ID NO: 3816117 - DNA, 21 bp, Homo sapiens
ctgattttcaaagctttttcc

SEQ ID NO: 3816118 - DNA, 18 bp, Homo sapiens
ctgcaagaattgaagcag

SEQ ID NO: 3816119 - DNA, 14 bp, Homo sapiens
ctgcaagctctgcc

SEQ ID NO: 3816120 - DNA, 14 bp, Homo sapiens
ctgcacaagctgca

SEQ ID NO: 3816121 - DNA, 13 bp, Homo sapiens
ctgcaccctcagg

SEQ ID NO: 3816122 - DNA, 16 bp, Homo sapiens
ctgcaccctcaggcag

SEQ ID NO: 3816123 - DNA, 17 bp, Homo sapiens
ctgcaccctcaggcagg

SEQ ID NO: 3816124 - DNA, 18 bp, Homo sapiens
ctgcaccctcaggcaggt

SEQ ID NO: 3816125 - DNA, 19 bp, Homo sapiens
ctgcaccggggcctgggca

SEQ ID NO: 3816126 - DNA, 16 bp, Homo sapiens
ctgcactccagcctgg

SEQ ID NO: 3816127 - DNA, 15 bp, Homo sapiens
ctgcagcagagcctg

SEQ ID NO: 3816128 - DNA, 12 bp, Homo sapiens
ctgcagctttgt

SEQ ID NO: 3816129 - DNA, 21 bp, Homo sapiens
ctgcaggtcagtttggaatga

SEQ ID NO: 3816130 - DNA, 24 bp, Homo sapiens
ctgcattcacagcgcctcctggac

SEQ ID NO: 3816131 - DNA, 18 bp, Homo sapiens
ctgccaatcggctacccc

SEQ ID NO: 3816132 - DNA, 15 bp, Homo sapiens
ctgccacctgtctgt

SEQ ID NO: 3816133 - DNA, 16 bp, Homo sapiens
ctgccacctgtctgtc

SEQ ID NO: 3816134 - DNA, 17 bp, Homo sapiens
ctgccacctgtctgtct

SEQ ID NO: 3816135 - DNA, 18 bp, Homo sapiens
ctgccacctgtctgtctg

SEQ ID NO: 3816136 - DNA, 20 bp, Homo sapiens
ctgccagcatttcccttcct

SEQ ID NO: 3816137 - DNA, 15 bp, Homo sapiens
ctgccatgccagctt

SEQ ID NO: 3816138 - DNA, 16 bp, Homo sapiens
ctgccatttctgagat

SEQ ID NO: 3816139 - DNA, 19 bp, Homo sapiens
ctgcccaagggcctcccac

SEQ ID NO: 3816140 - DNA, 15 bp, Homo sapiens
ctgcccagcctgccc

SEQ ID NO: 3816141 - DNA, 17 bp, Homo sapiens
ctgccccagcctcccag

SEQ ID NO: 3816142 - DNA, 16 bp, Homo sapiens
ctgccccatctcctcc

SEQ ID NO: 3816143 - DNA, 13 bp, Homo sapiens
ctgcccggcaggg

SEQ ID NO: 3816144 - DNA, 14 bp, Homo sapiens
ctgccctgccacct

SEQ ID NO: 3816145 - DNA, 16 bp, Homo sapiens
ctgccctgccacctgt

SEQ ID NO: 3816146 - DNA, 17 bp, Homo sapiens
ctgccctgccacctgtc

SEQ ID NO: 3816147 - DNA, 15 bp, Homo sapiens
ctgccctgccctgcc

SEQ ID NO: 3816148 - DNA, 15 bp, Homo sapiens
ctgccctgtccctgt

SEQ ID NO: 3816149 - DNA, 11 bp, Homo sapiens
ctgcctaataa

SEQ ID NO: 3816150 - DNA, 16 bp, Homo sapiens
ctgcctaataaagaga

SEQ ID NO: 3816151 - DNA, 16 bp, Homo sapiens
ctgcctcagcctcctg

SEQ ID NO: 3816152 - DNA, 15 bp, Homo sapiens
ctgcctcttctctac

SEQ ID NO: 3816153 - DNA, 20 bp, Homo sapiens
ctgcctgacactgagcccca

SEQ ID NO: 3816154 - DNA, 17 bp, Homo sapiens
ctgcctggaccagcctc

SEQ ID NO: 3816155 - DNA, 15 bp, Homo sapiens
ctgcctgttctccag

SEQ ID NO: 3816156 - DNA, 20 bp, Homo sapiens
ctgcctgttctccagatgga

SEQ ID NO: 3816157 - DNA, 16 bp, Homo sapiens
ctgcgccacggcactc

SEQ ID NO: 3816158 - DNA, 21 bp, Homo sapiens
ctgcgccacggcactccagcc

SEQ ID NO: 3816159 - DNA, 19 bp, Homo sapiens
ctgcgtcgaactgtcctgg

SEQ ID NO: 3816160 - DNA, 18 bp, Homo sapiens
ctgctcccaattcacctc

SEQ ID NO: 3816161 - DNA, 15 bp, Homo sapiens
ctgctcctcctgccc

SEQ ID NO: 3816162 - DNA, 14 bp, Homo sapiens
ctgctcgaagaaca

SEQ ID NO: 3816163 - DNA, 18 bp, Homo sapiens
ctgctgactgttttctct

SEQ ID NO: 3816164 - DNA, 22 bp, Homo sapiens
ctgctgtgtccgctttcatgaa

SEQ ID NO: 3816165 - DNA, 16 bp, Homo sapiens
ctgcttccctggggcc

SEQ ID NO: 3816166 - DNA, 19 bp, Homo sapiens
ctgcttccctggggcccca

SEQ ID NO: 3816167 - DNA, 15 bp, Homo sapiens
ctgcttttctcccag

SEQ ID NO: 3816168 - DNA, 17 bp, Homo sapiens
ctgcttttctcccagaa

SEQ ID NO: 3816169 - DNA, 20 bp, Homo sapiens
ctgcttttctcccagaaggc

SEQ ID NO: 3816170 - DNA, 15 bp, Homo sapiens
ctggaagcactgctg

SEQ ID NO: 3816171 - DNA, 15 bp, Homo sapiens
ctggaccactgggca

SEQ ID NO: 3816172 - DNA, 20 bp, Homo sapiens
ctggactgtcatagaaatta

SEQ ID NO: 3816173 - DNA, 14 bp, Homo sapiens
ctggaggcagacag

SEQ ID NO: 3816174 - DNA, 12 bp, Homo sapiens
ctggagggagat

SEQ ID NO: 3816175 - DNA, 19 bp, Homo sapiens
ctggcaaagttatatttac

SEQ ID NO: 3816176 - DNA, 22 bp, Homo sapiens
ctggcaatgccctacctgcctg

SEQ ID NO: 3816177 - DNA, 15 bp, Homo sapiens
ctggcacagcctggc

SEQ ID NO: 3816178 - DNA, 14 bp, Homo sapiens
ctggcagcctccag

SEQ ID NO: 3816179 - DNA, 15 bp, Homo sapiens
ctggcatctccctga

SEQ ID NO: 3816180 - DNA, 16 bp, Homo sapiens
ctggcatctccctgac

SEQ ID NO: 3816181 - DNA, 16 bp, Homo sapiens
ctggcattacagctgg

SEQ ID NO: 3816182 - DNA, 19 bp, Homo sapiens
ctggccagtcctagagctc

SEQ ID NO: 3816183 - DNA, 21 bp, Homo sapiens
ctggccagtcctagagctcct

SEQ ID NO: 3816184 - DNA, 15 bp, Homo sapiens
ctggcccactgcatc

SEQ ID NO: 3816185 - DNA, 12 bp, Homo sapiens
ctggccccaccc

SEQ ID NO: 3816186 - DNA, 23 bp, Homo sapiens
ctggccctatgcttccggcctcc

SEQ ID NO: 3816187 - DNA, 13 bp, Homo sapiens
ctggccctgtgcc

SEQ ID NO: 3816188 - DNA, 22 bp, Homo sapiens
ctggcctctagaacacccactg

SEQ ID NO: 3816189 - DNA, 14 bp, Homo sapiens
ctggcgagccctta

SEQ ID NO: 3816190 - DNA, 16 bp, Homo sapiens
ctggcgagcccttagc

SEQ ID NO: 3816191 - DNA, 18 bp, Homo sapiens
ctggcgagcccttagcct

SEQ ID NO: 3816192 - DNA, 21 bp, Homo sapiens
ctggctcagcctcaaatgcag

SEQ ID NO: 3816193 - DNA, 22 bp, Homo sapiens
ctggctgggtggcaccagcagc

SEQ ID NO: 3816194 - DNA, 16 bp, Homo sapiens
ctgggaagggaaggaa

SEQ ID NO: 3816195 - DNA, 18 bp, Homo sapiens
ctgggaataagtgccagg

SEQ ID NO: 3816196 - DNA, 14 bp, Homo sapiens
ctgggaccagggca

SEQ ID NO: 3816197 - DNA, 15 bp, Homo sapiens
ctgggaccagggcat

SEQ ID NO: 3816198 - DNA, 18 bp, Homo sapiens
ctgggaggaacctgaacc

SEQ ID NO: 3816199 - DNA, 21 bp, Homo sapiens
ctgggaggtcaaggctgcagt

SEQ ID NO: 3816200 - DNA, 20 bp, Homo sapiens
ctgggcaatgtgataaaacc

SEQ ID NO: 3816201 - DNA, 13 bp, Homo sapiens
ctgggcagacctt

SEQ ID NO: 3816202 - DNA, 19 bp, Homo sapiens
ctgggcagtgcccaccatg

SEQ ID NO: 3816203 - DNA, 14 bp, Homo sapiens
ctgggcctcagcct

SEQ ID NO: 3816204 - DNA, 17 bp, Homo sapiens
ctgggcctcagcctcca

SEQ ID NO: 3816205 - DNA, 14 bp, Homo sapiens
ctgggctctgagga

SEQ ID NO: 3816206 - DNA, 17 bp, Homo sapiens
ctggggccacatagctc

SEQ ID NO: 3816207 - DNA, 23 bp, Homo sapiens
ctggggtttgggggcttccctgg

SEQ ID NO: 3816208 - DNA, 22 bp, Homo sapiens
ctgggtaactagggaagataat

SEQ ID NO: 3816209 - DNA, 22 bp, Homo sapiens
ctgggtggcaccagcagcctgg

SEQ ID NO: 3816210 - DNA, 23 bp, Homo sapiens
ctgggtggcaccagcagcctgga

SEQ ID NO: 3816211 - DNA, 17 bp, Homo sapiens
ctgggttgtcactgaga

SEQ ID NO: 3816212 - DNA, 18 bp, Homo sapiens
ctggtatgaacttgagga

SEQ ID NO: 3816213 - DNA, 21 bp, Homo sapiens
ctggtatgaacttgaggacac

SEQ ID NO: 3816214 - DNA, 22 bp, Homo sapiens
ctggtatgaacttgaggacaca

SEQ ID NO: 3816215 - DNA, 23 bp, Homo sapiens
ctggtatgaacttgaggacacat

SEQ ID NO: 3816216 - DNA, 15 bp, Homo sapiens
ctggtgatgggacaa

SEQ ID NO: 3816217 - DNA, 18 bp, Homo sapiens
ctggtgggcagctgagga

SEQ ID NO: 3816218 - DNA, 14 bp, Homo sapiens
ctggtggtggctcg

SEQ ID NO: 3816219 - DNA, 14 bp, Homo sapiens
ctggttagaaatgc

SEQ ID NO: 3816220 - DNA, 19 bp, Homo sapiens
gagggaagaaaaaaaatct

SEQ ID NO: 3816221 - DNA, 20 bp, Homo sapiens
gagggagacagagacagaaa

SEQ ID NO: 3816222 - DNA, 14 bp, Homo sapiens
gagggagagactct

SEQ ID NO: 3816223 - DNA, 18 bp, Homo sapiens
gagggcatgcgcacaagg

SEQ ID NO: 3816224 - DNA, 22 bp, Homo sapiens
gaggggactatttatgaaggca

SEQ ID NO: 3816225 - DNA, 14 bp, Homo sapiens
gagggggagagggc

SEQ ID NO: 3816226 - DNA, 12 bp, Homo sapiens
gagggtggaata

SEQ ID NO: 3816227 - DNA, 13 bp, Homo sapiens
gagggtgtcctgc

SEQ ID NO: 3816228 - DNA, 20 bp, Homo sapiens
gagggttgtgcccacttcat

SEQ ID NO: 3816229 - DNA, 17 bp, Homo sapiens
gaggtcaaggctgcagt

SEQ ID NO: 3816230 - DNA, 21 bp, Homo sapiens
gaggtgacttgcctggggcca

SEQ ID NO: 3816231 - DNA, 20 bp, Homo sapiens
gaggtggaggttgcagtgaa

SEQ ID NO: 3816232 - DNA, 16 bp, Homo sapiens
gaggtggtggggacca

SEQ ID NO: 3816233 - DNA, 19 bp, Homo sapiens
gaggttttaaaaaaatccc

SEQ ID NO: 3816234 - DNA, 13 bp, Homo sapiens
gagtagcagtgat

SEQ ID NO: 3816235 - DNA, 14 bp, Homo sapiens
gagtccatcagcct

SEQ ID NO: 3816236 - DNA, 14 bp, Homo sapiens
gagtccctgcctgg

SEQ ID NO: 3816237 - DNA, 16 bp, Homo sapiens
gagtccctgcctggac

SEQ ID NO: 3816238 - DNA, 16 bp, Homo sapiens
gagtctcgctctgctg

SEQ ID NO: 3816239 - DNA, 21 bp, Homo sapiens
gagtctcgctctgctgcccag

SEQ ID NO: 3816240 - DNA, 23 bp, Homo sapiens
gagtgggggatcacagcctctga

SEQ ID NO: 3816241 - DNA, 20 bp, Homo sapiens
gagtgtgcctgaagtcccag

SEQ ID NO: 3816242 - DNA, 13 bp, Homo sapiens
gagtgtgtaattt

SEQ ID NO: 3816243 - DNA, 21 bp, Homo sapiens
gagtgtgtaatttaaaattgt

SEQ ID NO: 3816244 - DNA, 18 bp, Homo sapiens
gagttcaagaccagcctg

SEQ ID NO: 3816245 - DNA, 15 bp, Homo sapiens
gagttgattcagctc

SEQ ID NO: 3816246 - DNA, 17 bp, Homo sapiens
gagttgattcagctctg

SEQ ID NO: 3816247 - DNA, 18 bp, Homo sapiens
gagttgattcagctctgc

SEQ ID NO: 3816248 - DNA, 14 bp, Homo sapiens
gagtttagggtggg

SEQ ID NO: 3816249 - DNA, 14 bp, Homo sapiens
gataaattacatta

SEQ ID NO: 3816250 - DNA, 12 bp, Homo sapiens
gataagtaatga

SEQ ID NO: 3816251 - DNA, 18 bp, Homo sapiens
gataatcttagctgccaa

SEQ ID NO: 3816252 - DNA, 12 bp, Homo sapiens
gatacagaatga

SEQ ID NO: 3816253 - DNA, 15 bp, Homo sapiens
gatactctcagattt

SEQ ID NO: 3816254 - DNA, 15 bp, Homo sapiens
gatcagcctgggcaa

SEQ ID NO: 3816255 - DNA, 18 bp, Homo sapiens
gatcatttgttggaatga

SEQ ID NO: 3816256 - DNA, 15 bp, Homo sapiens
gatccacacacagag

SEQ ID NO: 3816257 - DNA, 17 bp, Homo sapiens
gatccacacacagagga

SEQ ID NO: 3816258 - DNA, 12 bp, Homo sapiens
gatcccaacact

SEQ ID NO: 3816259 - DNA, 16 bp, Homo sapiens
gatcccaacactgcca

SEQ ID NO: 3816260 - DNA, 19 bp, Homo sapiens
gatcccaacactgccagca

SEQ ID NO: 3816261 - DNA, 14 bp, Homo sapiens
gatcctacccctga

SEQ ID NO: 3816262 - DNA, 15 bp, Homo sapiens
gatctcggctcactg

SEQ ID NO: 3816263 - DNA, 18 bp, Homo sapiens
gatctcttgagcctggga

SEQ ID NO: 3816264 - DNA, 15 bp, Homo sapiens
gatctgcttccctgg

SEQ ID NO: 3816265 - DNA, 18 bp, Homo sapiens
gatgagaaaactgagagg

SEQ ID NO: 3816266 - DNA, 18 bp, Homo sapiens
gatgatttggtcagattg

SEQ ID NO: 3816267 - DNA, 15 bp, Homo sapiens
gatgcacatccctgg

SEQ ID NO: 3816268 - DNA, 23 bp, Homo sapiens
gatgcattcccggtgcagaacag

SEQ ID NO: 3816269 - DNA, 13 bp, Homo sapiens
gatgctgaaataa

SEQ ID NO: 3816270 - DNA, 19 bp, Homo sapiens
gatgctgaaataaactagg

SEQ ID NO: 3816271 - DNA, 23 bp, Homo sapiens
gatgcttctcactgccatgccag

SEQ ID NO: 3816272 - DNA, 13 bp, Homo sapiens
gatggaatgatgg

SEQ ID NO: 3816273 - DNA, 15 bp, Homo sapiens
gatggagagagggga

SEQ ID NO: 3816274 - DNA, 18 bp, Homo sapiens
gatggagtctcgctctgc

SEQ ID NO: 3816275 - DNA, 24 bp, Homo sapiens
gatggagtctcgctctgctgccca

SEQ ID NO: 3816276 - DNA, 22 bp, Homo sapiens
gatggatttccagccaaagcct

SEQ ID NO: 3816277 - DNA, 20 bp, Homo sapiens
gatggcaaagaaggagagca

SEQ ID NO: 3816278 - DNA, 15 bp, Homo sapiens
gatgggatttcaccg

SEQ ID NO: 3816279 - DNA, 21 bp, Homo sapiens
gatgggctttctcagtgtcag

SEQ ID NO: 3816280 - DNA, 14 bp, Homo sapiens
gatgggggaaaaaa

SEQ ID NO: 3816281 - DNA, 21 bp, Homo sapiens
gatgtgctcccaccaggcagc

SEQ ID NO: 3816282 - DNA, 21 bp, Homo sapiens
gatgtgtcctgataagctgag

SEQ ID NO: 3816283 - DNA, 22 bp, Homo sapiens
gattatatatcataaagtatgc

SEQ ID NO: 3816284 - DNA, 19 bp, Homo sapiens
gattatttaaacctgccct

SEQ ID NO: 3816285 - DNA, 15 bp, Homo sapiens
gattcagctctgcaa

SEQ ID NO: 3816286 - DNA, 21 bp, Homo sapiens
gattcatgccaattagcaatt

SEQ ID NO: 3816287 - DNA, 19 bp, Homo sapiens
gattcccagagcaaaataa

SEQ ID NO: 3816288 - DNA, 23 bp, Homo sapiens
gattgcaccactgcactccagcc

SEQ ID NO: 3816289 - DNA, 18 bp, Homo sapiens
gattgcttgagctcagga

SEQ ID NO: 3816290 - DNA, 15 bp, Homo sapiens
gatttcaagcctgcc

SEQ ID NO: 3816291 - DNA, 17 bp, Homo sapiens
gatttgcctgcctgggc

SEQ ID NO: 3816292 - DNA, 17 bp, Homo sapiens
gcaaaagatgcttctca

SEQ ID NO: 3816293 - DNA, 13 bp, Homo sapiens
gcaaaatgtgaat

SEQ ID NO: 3816294 - DNA, 21 bp, Homo sapiens
gcaaggacaacctgcccctcc

SEQ ID NO: 3816295 - DNA, 14 bp, Homo sapiens
gcaatgtgataaaa

SEQ ID NO: 3816296 - DNA, 18 bp, Homo sapiens
gcaatttccttttttgtt

SEQ ID NO: 3816297 - DNA, 14 bp, Homo sapiens
gcacaaatatttat

SEQ ID NO: 3816298 - DNA, 15 bp, Homo sapiens
gcacaaatatttatt

SEQ ID NO: 3816299 - DNA, 16 bp, Homo sapiens
gcacaaatatttattt

SEQ ID NO: 3816300 - DNA, 14 bp, Homo sapiens
gcacaagctgcacc

SEQ ID NO: 3816301 - DNA, 23 bp, Homo sapiens
gcacacacagatatacacatgga

SEQ ID NO: 3816302 - DNA, 20 bp, Homo sapiens
gcacacacagatatgcacac

SEQ ID NO: 3816303 - DNA, 15 bp, Homo sapiens
gcacacacagatgca

SEQ ID NO: 3816304 - DNA, 18 bp, Homo sapiens
gcacacacagatgcacac

SEQ ID NO: 3816305 - DNA, 21 bp, Homo sapiens
gcacacacatggatgagcaca

SEQ ID NO: 3816306 - DNA, 13 bp, Homo sapiens
gcacacctgtggt

SEQ ID NO: 3816307 - DNA, 18 bp, Homo sapiens
gcacagttggcccgggtg

SEQ ID NO: 3816308 - DNA, 18 bp, Homo sapiens
gcacatgattttcttttg

SEQ ID NO: 3816309 - DNA, 19 bp, Homo sapiens
gcacatgattttcttttgt

SEQ ID NO: 3816310 - DNA, 20 bp, Homo sapiens
gcacatgccaatgcacgcac

SEQ ID NO: 3816311 - DNA, 19 bp, Homo sapiens
gcaccaccctttgaacaaa

SEQ ID NO: 3816312 - DNA, 19 bp, Homo sapiens
gcaccactgcactccagcc

SEQ ID NO: 3816313 - DNA, 20 bp, Homo sapiens
gcacccccaggattcccaga

SEQ ID NO: 3816314 - DNA, 15 bp, Homo sapiens
gcaccctcaggcagg

SEQ ID NO: 3816315 - DNA, 18 bp, Homo sapiens
gcactcatagggtgctct

SEQ ID NO: 3816316 - DNA, 14 bp, Homo sapiens
gcactccagcctgg

SEQ ID NO: 3816317 - DNA, 18 bp, Homo sapiens
gcactccagcctgggcga

SEQ ID NO: 3816318 - DNA, 19 bp, Homo sapiens
gcactccagcctgggcgac

SEQ ID NO: 3816319 - DNA, 17 bp, Homo sapiens
gcactccagcctgggtg

SEQ ID NO: 3816320 - DNA, 21 bp, Homo sapiens
gcactgaaggctttcagggcc

SEQ ID NO: 3816321 - DNA, 13 bp, Homo sapiens
gcactgctgtgtc

SEQ ID NO: 3816322 - DNA, 22 bp, Homo sapiens
gcacttcgggaggtcgaggcag

SEQ ID NO: 3816323 - DNA, 11 bp, Homo sapiens
gcagagccaag

SEQ ID NO: 3816324 - DNA, 14 bp, Homo sapiens
gcagagccaaggcc

SEQ ID NO: 3816325 - DNA, 16 bp, Homo sapiens
gcagagccaaggccac

SEQ ID NO: 3816326 - DNA, 22 bp, Homo sapiens
gcagatttactgtcccaggagc

SEQ ID NO: 3816327 - DNA, 13 bp, Homo sapiens
gcagcactggggt

SEQ ID NO: 3816328 - DNA, 14 bp, Homo sapiens
ggaaccatgaagct

SEQ ID NO: 3816329 - DNA, 17 bp, Homo sapiens
ggaaccatgaagctgga

SEQ ID NO: 3816330 - DNA, 15 bp, Homo sapiens
ggaaccgaggcaggg

SEQ ID NO: 3816331 - DNA, 16 bp, Homo sapiens
ggaaccgaggcaggga

SEQ ID NO: 3816332 - DNA, 20 bp, Homo sapiens
ggaaccgaggcagggaagga

SEQ ID NO: 3816333 - DNA, 17 bp, Homo sapiens
ggaactcgtgtctggca

SEQ ID NO: 3816334 - DNA, 18 bp, Homo sapiens
ggaagacacagcccagac

SEQ ID NO: 3816335 - DNA, 15 bp, Homo sapiens
ggaagagcaggcaca

SEQ ID NO: 3816336 - DNA, 21 bp, Homo sapiens
ggaagagcaggcacatggagg

SEQ ID NO: 3816337 - DNA, 13 bp, Homo sapiens
ggaagagccttgc

SEQ ID NO: 3816338 - DNA, 13 bp, Homo sapiens
ggaagcactgctg

SEQ ID NO: 3816339 - DNA, 19 bp, Homo sapiens
ggaaggaagcaagccggca

SEQ ID NO: 3816340 - DNA, 15 bp, Homo sapiens
ggaataatagaagaa

SEQ ID NO: 3816341 - DNA, 23 bp, Homo sapiens
ggaattttctttcatacattata

SEQ ID NO: 3816342 - DNA, 20 bp, Homo sapiens
ggacaacctgcccctcccca

SEQ ID NO: 3816343 - DNA, 22 bp, Homo sapiens
ggacacaccccacaccccagcc

SEQ ID NO: 3816344 - DNA, 22 bp, Homo sapiens
ggacactcaaaagctgggcagg

SEQ ID NO: 3816345 - DNA, 17 bp, Homo sapiens
ggacagaagcaggagta

SEQ ID NO: 3816346 - DNA, 16 bp, Homo sapiens
ggacagaggggcaggg

SEQ ID NO: 3816347 - DNA, 18 bp, Homo sapiens
ggacagtatttgtgggga

SEQ ID NO: 3816348 - DNA, 19 bp, Homo sapiens
ggacatggagagagactca

SEQ ID NO: 3816349 - DNA, 19 bp, Homo sapiens
ggacctcaggtgagaagca

SEQ ID NO: 3816350 - DNA, 23 bp, Homo sapiens
ggacctcaggtgagaagcagagg

SEQ ID NO: 3816351 - DNA, 15 bp, Homo sapiens
ggactggtgatggga

SEQ ID NO: 3816352 - DNA, 14 bp, Homo sapiens
ggagacagtagagg

SEQ ID NO: 3816353 - DNA, 17 bp, Homo sapiens
ggagagacgggccctgg

SEQ ID NO: 3816354 - DNA, 22 bp, Homo sapiens
ggagagactctgaggacatgga

SEQ ID NO: 3816355 - DNA, 13 bp, Homo sapiens
ggagagagactca

SEQ ID NO: 3816356 - DNA, 15 bp, Homo sapiens
ggagagctagcagca

SEQ ID NO: 3816357 - DNA, 17 bp, Homo sapiens
ggagagctagcagcagg

SEQ ID NO: 3816358 - DNA, 15 bp, Homo sapiens
ggagaggggcacagg

SEQ ID NO: 3816359 - DNA, 21 bp, Homo sapiens
ggagctgacagagccagaggc

SEQ ID NO: 3816360 - DNA, 23 bp, Homo sapiens
ggagctggttagaaatgcagaat

SEQ ID NO: 3816361 - DNA, 14 bp, Homo sapiens
ggaggagggcaggc

SEQ ID NO: 3816362 - DNA, 15 bp, Homo sapiens
ggaggagggcaggca

SEQ ID NO: 3816363 - DNA, 21 bp, Homo sapiens
ggaggatctcttgagcctggg

SEQ ID NO: 3816364 - DNA, 21 bp, Homo sapiens
ggaggatggagagaggggaat

SEQ ID NO: 3816365 - DNA, 18 bp, Homo sapiens
ggaggccaaggtgggagg

SEQ ID NO: 3816366 - DNA, 22 bp, Homo sapiens
ggaggctcctgcctgagcttcc

SEQ ID NO: 3816367 - DNA, 14 bp, Homo sapiens
ggagggcaggcatc

SEQ ID NO: 3816368 - DNA, 21 bp, Homo sapiens
ggaggggactatttatgaagg

SEQ ID NO: 3816369 - DNA, 14 bp, Homo sapiens
ggaggtcgaggcag

SEQ ID NO: 3816370 - DNA, 15 bp, Homo sapiens
ggaggtcgaggcagg

SEQ ID NO: 3816371 - DNA, 18 bp, Homo sapiens
ggaggtcgaggcaggagg

SEQ ID NO: 3816372 - DNA, 15 bp, Homo sapiens
ggagtctcgctctgc

SEQ ID NO: 3816373 - DNA, 19 bp, Homo sapiens
ggagtcttcactgctctgc

SEQ ID NO: 3816374 - DNA, 20 bp, Homo sapiens
ggagtcttcactgctctgcc

SEQ ID NO: 3816375 - DNA, 12 bp, Homo sapiens
ggagtgcagtgg

SEQ ID NO: 3816376 - DNA, 14 bp, Homo sapiens
ggataaattacatt

SEQ ID NO: 3816377 - DNA, 15 bp, Homo sapiens
ggataaattacatta

SEQ ID NO: 3816378 - DNA, 14 bp, Homo sapiens
ggatagatgtgtgg

SEQ ID NO: 3816379 - DNA, 22 bp, Homo sapiens
ggatccacgtgctcgcctctgc

SEQ ID NO: 3816380 - DNA, 18 bp, Homo sapiens
ggatctcttgagcctggg

SEQ ID NO: 3816381 - DNA, 21 bp, Homo sapiens
ggatggtcttgatctcctgag

SEQ ID NO: 3816382 - DNA, 19 bp, Homo sapiens
ggcaactgcattggctttg

SEQ ID NO: 3816383 - DNA, 15 bp, Homo sapiens
ggcaatgatggcaat

SEQ ID NO: 3816384 - DNA, 12 bp, Homo sapiens
ggcacagcctgg

SEQ ID NO: 3816385 - DNA, 13 bp, Homo sapiens
ggcacagcctggc

SEQ ID NO: 3816386 - DNA, 16 bp, Homo sapiens
ggcaccagcagcctgg

SEQ ID NO: 3816387 - DNA, 23 bp, Homo sapiens
ggcaccctccaaacactgggctc

SEQ ID NO: 3816388 - DNA, 23 bp, Homo sapiens
ggcagacaggcgctggacagagg

SEQ ID NO: 3816389 - DNA, 14 bp, Homo sapiens
ggcagaggcagaca

SEQ ID NO: 3816390 - DNA, 19 bp, Homo sapiens
ggcagatttactgtcccag

SEQ ID NO: 3816391 - DNA, 13 bp, Homo sapiens
ggcagcctccagt

SEQ ID NO: 3816392 - DNA, 14 bp, Homo sapiens
ggcaggagggaggt

SEQ ID NO: 3816393 - DNA, 18 bp, Homo sapiens
ggcagggaaaggctctga

SEQ ID NO: 3816394 - DNA, 13 bp, Homo sapiens
ggcagggagggga

SEQ ID NO: 3816395 - DNA, 15 bp, Homo sapiens
ggcagggctgaggcc

SEQ ID NO: 3816396 - DNA, 17 bp, Homo sapiens
ggcaggttggtgggggc

SEQ ID NO: 3816397 - DNA, 23 bp, Homo sapiens
ggcagtgaacacactcagcagcc

SEQ ID NO: 3816398 - DNA, 15 bp, Homo sapiens
ggcagtgcccaccat

SEQ ID NO: 3816399 - DNA, 16 bp, Homo sapiens
ggcagtgcccaccatg

SEQ ID NO: 3816400 - DNA, 22 bp, Homo sapiens
ggcagtgcccaccatgcacccc

SEQ ID NO: 3816401 - DNA, 14 bp, Homo sapiens
ggcatactaataaa

SEQ ID NO: 3816402 - DNA, 19 bp, Homo sapiens
ggcatctgagtccagctcc

SEQ ID NO: 3816403 - DNA, 14 bp, Homo sapiens
ggcatgagggatca

SEQ ID NO: 3816404 - DNA, 22 bp, Homo sapiens
ggcatgctggctcccagggcca

SEQ ID NO: 3816405 - DNA, 16 bp, Homo sapiens
ggccaaggctgagagc

SEQ ID NO: 3816406 - DNA, 22 bp, Homo sapiens
ggccacagaaaggccactcagg

SEQ ID NO: 3816407 - DNA, 18 bp, Homo sapiens
ggccagagctgagtggca

SEQ ID NO: 3816408 - DNA, 21 bp, Homo sapiens
ggccagatgcacatccctgga

SEQ ID NO: 3816409 - DNA, 18 bp, Homo sapiens
ggccagcaccatctcttt

SEQ ID NO: 3816410 - DNA, 14 bp, Homo sapiens
ggccagtcctagag

SEQ ID NO: 3816411 - DNA, 20 bp, Homo sapiens
ggccagtcctagagctcctg

SEQ ID NO: 3816412 - DNA, 22 bp, Homo sapiens
ggccagtcctagagctcctgtc

SEQ ID NO: 3816413 - DNA, 20 bp, Homo sapiens
ggccattctttcccaacacc

SEQ ID NO: 3816414 - DNA, 19 bp, Homo sapiens
ggcccaagagatgaagagt

SEQ ID NO: 3816415 - DNA, 20 bp, Homo sapiens
ggcccacacccgacaccagc

SEQ ID NO: 3816416 - DNA, 19 bp, Homo sapiens
ggccccagaaggcagggaa

SEQ ID NO: 3816417 - DNA, 13 bp, Homo sapiens
ggccccagcctcc

SEQ ID NO: 3816418 - DNA, 11 bp, Homo sapiens
ggccctgccca

SEQ ID NO: 3816419 - DNA, 16 bp, Homo sapiens
ggcctaacctgccgag

SEQ ID NO: 3816420 - DNA, 17 bp, Homo sapiens
ggcctagatccacacac

SEQ ID NO: 3816421 - DNA, 23 bp, Homo sapiens
ggcctagatccacacacagagga

SEQ ID NO: 3816422 - DNA, 13 bp, Homo sapiens
ggcctcccaccag

SEQ ID NO: 3816423 - DNA, 13 bp, Homo sapiens
ggcctctagaaca

SEQ ID NO: 3816424 - DNA, 17 bp, Homo sapiens
ggcctctagaacaccca

SEQ ID NO: 3816425 - DNA, 18 bp, Homo sapiens
ggcctctagaacacccac

SEQ ID NO: 3816426 - DNA, 20 bp, Homo sapiens
ggcctctagaacacccactg

SEQ ID NO: 3816427 - DNA, 21 bp, Homo sapiens
ggcctctagaacacccactgg

SEQ ID NO: 3816428 - DNA, 20 bp, Homo sapiens
ggcctctcattccagaggaa

SEQ ID NO: 3816429 - DNA, 13 bp, Homo sapiens
ggcctgggcagga

SEQ ID NO: 3816430 - DNA, 15 bp, Homo sapiens
ggccttccctcccca

SEQ ID NO: 3816431 - DNA, 14 bp, Homo sapiens
ggcctttggcttca

SEQ ID NO: 3816432 - DNA, 22 bp, Homo sapiens
ggcgaagcgttgtcctcagccc

SEQ ID NO: 3816433 - DNA, 11 bp, Homo sapiens
ggcgacagagc

SEQ ID NO: 3816434 - DNA, 13 bp, Homo sapiens
ggcgacagagcaa

SEQ ID NO: 3816435 - DNA, 15 bp, Homo sapiens
ggcgagcccttagcc

SEQ ID NO: 3816436 - DNA, 23 bp, Homo sapiens
tagaccacggctgccccttccac

SEQ ID NO: 3816437 - DNA, 15 bp, Homo sapiens
tagagctcctgtccc

SEQ ID NO: 3816438 - DNA, 17 bp, Homo sapiens
tagagctcctgtcccta

SEQ ID NO: 3816439 - DNA, 23 bp, Homo sapiens
tagagctcctgtccctacccact

SEQ ID NO: 3816440 - DNA, 14 bp, Homo sapiens
tagagtgcagtggc

SEQ ID NO: 3816441 - DNA, 15 bp, Homo sapiens
tagatcctgagatga

SEQ ID NO: 3816442 - DNA, 18 bp, Homo sapiens
tagattctcacctgcctt

SEQ ID NO: 3816443 - DNA, 12 bp, Homo sapiens
tagcagcattac

SEQ ID NO: 3816444 - DNA, 15 bp, Homo sapiens
tagcagcattacaga

SEQ ID NO: 3816445 - DNA, 16 bp, Homo sapiens
tagcattttgctaaat

SEQ ID NO: 3816446 - DNA, 13 bp, Homo sapiens
tagccatctcaag

SEQ ID NO: 3816447 - DNA, 17 bp, Homo sapiens
tagctaaaaccaaagga

SEQ ID NO: 3816448 - DNA, 17 bp, Homo sapiens
tagctgaacaatgaatg

SEQ ID NO: 3816449 - DNA, 22 bp, Homo sapiens
tagctggtcttatttgtaaagc

SEQ ID NO: 3816450 - DNA, 21 bp, Homo sapiens
tagctgtctgctcagacagaa

SEQ ID NO: 3816451 - DNA, 21 bp, Homo sapiens
taggaattcccagcccaaagc

SEQ ID NO: 3816452 - DNA, 20 bp, Homo sapiens
taggatcatttgttggaatg

SEQ ID NO: 3816453 - DNA, 16 bp, Homo sapiens
taggcatttgctgaat

SEQ ID NO: 3816454 - DNA, 15 bp, Homo sapiens
taggctagggtgggg

SEQ ID NO: 3816455 - DNA, 19 bp, Homo sapiens
tagggaaaaaccagcgtgt

SEQ ID NO: 3816456 - DNA, 15 bp, Homo sapiens
tagggttttggcctg

SEQ ID NO: 3816457 - DNA, 17 bp, Homo sapiens
taggtaaactaacctgg

SEQ ID NO: 3816458 - DNA, 20 bp, Homo sapiens
tagtaccttcagatcctacc

SEQ ID NO: 3816459 - DNA, 16 bp, Homo sapiens
tagtctcttctcagag

SEQ ID NO: 3816460 - DNA, 13 bp, Homo sapiens
tagttaattctgt

SEQ ID NO: 3816461 - DNA, 20 bp, Homo sapiens
tagttattttacaaattgtt

SEQ ID NO: 3816462 - DNA, 22 bp, Homo sapiens
tagttgaccagggcagtgaaaa

SEQ ID NO: 3816463 - DNA, 20 bp, Homo sapiens
tagtttgatttaatatctga

SEQ ID NO: 3816464 - DNA, 17 bp, Homo sapiens
tataaactaggtaaaat

SEQ ID NO: 3816465 - DNA, 14 bp, Homo sapiens
tataacatgtaaaa

SEQ ID NO: 3816466 - DNA, 23 bp, Homo sapiens
tatacaatttctattatttttca

SEQ ID NO: 3816467 - DNA, 13 bp, Homo sapiens
tataggataaatt

SEQ ID NO: 3816468 - DNA, 19 bp, Homo sapiens
tataggataaattacatta

SEQ ID NO: 3816469 - DNA, 22 bp, Homo sapiens
tataggataaattacattaaaa

SEQ ID NO: 3816470 - DNA, 13 bp, Homo sapiens
tatagttttgaca

SEQ ID NO: 3816471 - DNA, 15 bp, Homo sapiens
tatatatcataaagt

SEQ ID NO: 3816472 - DNA, 17 bp, Homo sapiens
tatatctatatctctaa

SEQ ID NO: 3816473 - DNA, 18 bp, Homo sapiens
tatatctatatctctaaa

SEQ ID NO: 3816474 - DNA, 19 bp, Homo sapiens
tatatgaggacttgtgtct

SEQ ID NO: 3816475 - DNA, 20 bp, Homo sapiens
tatatttgtaaatttatgtg

SEQ ID NO: 3816476 - DNA, 14 bp, Homo sapiens
tatcatagaaatgt

SEQ ID NO: 3816477 - DNA, 15 bp, Homo sapiens
tatccactttgcaca

SEQ ID NO: 3816478 - DNA, 16 bp, Homo sapiens
tatcctgaaatttcag

SEQ ID NO: 3816479 - DNA, 15 bp, Homo sapiens
tatctatatctctaa

SEQ ID NO: 3816480 - DNA, 17 bp, Homo sapiens
tatctatatctctaaac

SEQ ID NO: 3816481 - DNA, 15 bp, Homo sapiens
tatctcagggcctgg

SEQ ID NO: 3816482 - DNA, 16 bp, Homo sapiens
tatctctaaactgctg

SEQ ID NO: 3816483 - DNA, 19 bp, Homo sapiens
tatctgagaagtgtatata

SEQ ID NO: 3816484 - DNA, 19 bp, Homo sapiens
tatgaacttgaggacacat

SEQ ID NO: 3816485 - DNA, 20 bp, Homo sapiens
tatgaacttgaggacacatg

SEQ ID NO: 3816486 - DNA, 17 bp, Homo sapiens
tatgaggacttgtgtct

SEQ ID NO: 3816487 - DNA, 15 bp, Homo sapiens
tatggaggatggaga

SEQ ID NO: 3816488 - DNA, 14 bp, Homo sapiens
tatgggatgtaaac

SEQ ID NO: 3816489 - DNA, 19 bp, Homo sapiens
tatgggatgtaaacaatgt

SEQ ID NO: 3816490 - DNA, 20 bp, Homo sapiens
tatggggatagatgtgtgga

SEQ ID NO: 3816491 - DNA, 16 bp, Homo sapiens
tatgtaggatctgtca

SEQ ID NO: 3816492 - DNA, 19 bp, Homo sapiens
tatgtatatgtatatctat

SEQ ID NO: 3816493 - DNA, 14 bp, Homo sapiens
tatgtgacaacatt

SEQ ID NO: 3816494 - DNA, 22 bp, Homo sapiens
tatgtgacaacatttttgtaca

SEQ ID NO: 3816495 - DNA, 22 bp, Homo sapiens
tatgtgtgtgtgttgtgtgtgg

SEQ ID NO: 3816496 - DNA, 20 bp, Homo sapiens
tatgttattggaattttctt

SEQ ID NO: 3816497 - DNA, 12 bp, Homo sapiens
tattaaaggctt

SEQ ID NO: 3816498 - DNA, 23 bp, Homo sapiens
tattacttatttttgacagtgtt

SEQ ID NO: 3816499 - DNA, 19 bp, Homo sapiens
tattattacttatttttga

SEQ ID NO: 3816500 - DNA, 11 bp, Homo sapiens
tattcaataaa

SEQ ID NO: 3816501 - DNA, 21 bp, Homo sapiens
tattcatatattatcaaaatt

SEQ ID NO: 3816502 - DNA, 20 bp, Homo sapiens
tattctacacatatatgtat

SEQ ID NO: 3816503 - DNA, 16 bp, Homo sapiens
tattgatgttaacaag

SEQ ID NO: 3816504 - DNA, 23 bp, Homo sapiens
tattgatgttaacaagaggggaa

SEQ ID NO: 3816505 - DNA, 12 bp, Homo sapiens
tattggaatttt

SEQ ID NO: 3816506 - DNA, 20 bp, Homo sapiens
tatttagaatatattaaatc

SEQ ID NO: 3816507 - DNA, 12 bp, Homo sapiens
tatttatcttta

SEQ ID NO: 3816508 - DNA, 13 bp, Homo sapiens
tatttatttatgg

SEQ ID NO: 3816509 - DNA, 13 bp, Homo sapiens
tatttatttatgt

SEQ ID NO: 3816510 - DNA, 14 bp, Homo sapiens
tatttatttatgta

SEQ ID NO: 3816511 - DNA, 16 bp, Homo sapiens
tatttgtaaatttatg

SEQ ID NO: 3816512 - DNA, 22 bp, Homo sapiens
tatttgtaaatttatgtgatgg

SEQ ID NO: 3816513 - DNA, 15 bp, Homo sapiens
tattttaatgaatat

SEQ ID NO: 3816514 - DNA, 21 bp, Homo sapiens
tattttaatttactgattcca

SEQ ID NO: 3816515 - DNA, 13 bp, Homo sapiens
tattttgtaaact

SEQ ID NO: 3816516 - DNA, 18 bp, Homo sapiens
tatttttttgatggctaa

SEQ ID NO: 3816517 - DNA, 14 bp, Homo sapiens
tcaaaaaaagaaaa

SEQ ID NO: 3816518 - DNA, 12 bp, Homo sapiens
tcaaagagactc

SEQ ID NO: 3816519 - DNA, 12 bp, Homo sapiens
tcaaagaggttt

SEQ ID NO: 3816520 - DNA, 23 bp, Homo sapiens
tcaaatggaaaggagaggaaaga

SEQ ID NO: 3816521 - DNA, 20 bp, Homo sapiens
tcaacctactttcatactga

SEQ ID NO: 3816522 - DNA, 17 bp, Homo sapiens
tcaagaaactgaggaat

SEQ ID NO: 3816523 - DNA, 18 bp, Homo sapiens
tcaagaaactgaggaatt

SEQ ID NO: 3816524 - DNA, 20 bp, Homo sapiens
tcaagaaactgaggaatttt

SEQ ID NO: 3816525 - DNA, 15 bp, Homo sapiens
tcaagaccagcctgg

SEQ ID NO: 3816526 - DNA, 18 bp, Homo sapiens
tcaagcaagtttaatcaa

SEQ ID NO: 3816527 - DNA, 16 bp, Homo sapiens
tcaagtaataaaacaa

SEQ ID NO: 3816528 - DNA, 15 bp, Homo sapiens
tcaagtatccttgtt

SEQ ID NO: 3816529 - DNA, 12 bp, Homo sapiens
tcaagtcttccc

SEQ ID NO: 3816530 - DNA, 12 bp, Homo sapiens
tcaataaagcag

SEQ ID NO: 3816531 - DNA, 15 bp, Homo sapiens
tcaataaagcagagc

SEQ ID NO: 3816532 - DNA, 17 bp, Homo sapiens
tcaataaagcagagcca

SEQ ID NO: 3816533 - DNA, 21 bp, Homo sapiens
tcacaccattctcctgcctca

SEQ ID NO: 3816534 - DNA, 22 bp, Homo sapiens
tcacactacttgagaaaatgca

SEQ ID NO: 3816535 - DNA, 23 bp, Homo sapiens
tcacagcaagtcactggccagtg

SEQ ID NO: 3816536 - DNA, 13 bp, Homo sapiens
tcacagcctctcc

SEQ ID NO: 3816537 - DNA, 15 bp, Homo sapiens
tcacagcctctccct

SEQ ID NO: 3816538 - DNA, 15 bp, Homo sapiens
tcacagggagctggc

SEQ ID NO: 3816539 - DNA, 21 bp, Homo sapiens
tcacatataaaagttaaacta

SEQ ID NO: 3816540 - DNA, 15 bp, Homo sapiens
tcaccagatttgcta

SEQ ID NO: 3816541 - DNA, 18 bp, Homo sapiens
tcacccccagctttgcta

SEQ ID NO: 3816542 - DNA, 20 bp, Homo sapiens
tcacctaacagaatattaaa

SEQ ID NO: 3816543 - DNA, 17 bp, Homo sapiens
tcaccttcctagttctt

SEQ ID NO: 3816544 - DNA, 14 bp, Homo sapiens
tcacggaagagcct

SEQ ID NO: 3816545 - DNA, 20 bp, Homo sapiens
tgaccgggtctgcttctgca

SEQ ID NO: 3816546 - DNA, 21 bp, Homo sapiens
tgactgttttctcttgagagg

SEQ ID NO: 3816547 - DNA, 14 bp, Homo sapiens
tgactttagaaaca

SEQ ID NO: 3816548 - DNA, 14 bp, Homo sapiens
tgagaaaactgaga

SEQ ID NO: 3816549 - DNA, 17 bp, Homo sapiens
tgagaaaatgcaggaga

SEQ ID NO: 3816550 - DNA, 12 bp, Homo sapiens
tgagaccacctc

SEQ ID NO: 3816551 - DNA, 15 bp, Homo sapiens
tgagaccctgttcta

SEQ ID NO: 3816552 - DNA, 16 bp, Homo sapiens
tgagaggcagaggcag

SEQ ID NO: 3816553 - DNA, 15 bp, Homo sapiens
tgagatcagcctggg

SEQ ID NO: 3816554 - DNA, 18 bp, Homo sapiens
tgagcaactcctgttctt

SEQ ID NO: 3816555 - DNA, 20 bp, Homo sapiens
tgagccccacctctccaagt

SEQ ID NO: 3816556 - DNA, 11 bp, Homo sapiens
tgagcctggca

SEQ ID NO: 3816557 - DNA, 19 bp, Homo sapiens
tgagctcaggagtttgaga

SEQ ID NO: 3816558 - DNA, 14 bp, Homo sapiens
tgaggaattttctt

SEQ ID NO: 3816559 - DNA, 16 bp, Homo sapiens
tgaggacacatgtcca

SEQ ID NO: 3816560 - DNA, 15 bp, Homo sapiens
tgaggccccaggccc

SEQ ID NO: 3816561 - DNA, 16 bp, Homo sapiens
tgaggccccaggccct

SEQ ID NO: 3816562 - DNA, 22 bp, Homo sapiens
tgagggtgactatggagctgag

SEQ ID NO: 3816563 - DNA, 17 bp, Homo sapiens
tgaggtcaataaagcag

SEQ ID NO: 3816564 - DNA, 19 bp, Homo sapiens
tgaggtcaataaagcagag

SEQ ID NO: 3816565 - DNA, 12 bp, Homo sapiens
tgaggtgggagg

SEQ ID NO: 3816566 - DNA, 13 bp, Homo sapiens
tgagtccagaagt

SEQ ID NO: 3816567 - DNA, 19 bp, Homo sapiens
tgagtccagaagtttgaga

SEQ ID NO: 3816568 - DNA, 15 bp, Homo sapiens
tgagtctgaggcccc

SEQ ID NO: 3816569 - DNA, 17 bp, Homo sapiens
tgagtggcagccgcctc

SEQ ID NO: 3816570 - DNA, 16 bp, Homo sapiens
tgagttggctgggaat

SEQ ID NO: 3816571 - DNA, 14 bp, Homo sapiens
tgataagtaatgaa

SEQ ID NO: 3816572 - DNA, 18 bp, Homo sapiens
tgataagtaatgaaagtg

SEQ ID NO: 3816573 - DNA, 14 bp, Homo sapiens
tgatctcctgagct

SEQ ID NO: 3816574 - DNA, 18 bp, Homo sapiens
tgatctcggctcactgca

SEQ ID NO: 3816575 - DNA, 23 bp, Homo sapiens
tgatctgcccgcctcggcctccc

SEQ ID NO: 3816576 - DNA, 20 bp, Homo sapiens
tgatgatcctaggcatttgc

SEQ ID NO: 3816577 - DNA, 14 bp, Homo sapiens
tgattcagctctgc

SEQ ID NO: 3816578 - DNA, 21 bp, Homo sapiens
tgattcctttgaagaggaaaa

SEQ ID NO: 3816579 - DNA, 17 bp, Homo sapiens
tgattgcgagaattttc

SEQ ID NO: 3816580 - DNA, 15 bp, Homo sapiens
tgatttgtactgaaa

SEQ ID NO: 3816581 - DNA, 18 bp, Homo sapiens
tgatttgtactgaaaaat

SEQ ID NO: 3816582 - DNA, 20 bp, Homo sapiens
tgcaaccctggtgtgctggg

SEQ ID NO: 3816583 - DNA, 17 bp, Homo sapiens
tgcaagctctgcctccc

SEQ ID NO: 3816584 - DNA, 14 bp, Homo sapiens
tgcacaagctgcac

SEQ ID NO: 3816585 - DNA, 13 bp, Homo sapiens
tgcacacacacag

SEQ ID NO: 3816586 - DNA, 14 bp, Homo sapiens
tgcacacacatgga

SEQ ID NO: 3816587 - DNA, 20 bp, Homo sapiens
tgcacacgcacatagagata

SEQ ID NO: 3816588 - DNA, 18 bp, Homo sapiens
tgcacagagatatgcaca

SEQ ID NO: 3816589 - DNA, 19 bp, Homo sapiens
tgcacagagatatgcacac

SEQ ID NO: 3816590 - DNA, 19 bp, Homo sapiens
tgcacattttgtacaaaga

SEQ ID NO: 3816591 - DNA, 15 bp, Homo sapiens
tgcaccactgcactc

SEQ ID NO: 3816592 - DNA, 21 bp, Homo sapiens
tgcaccactgcactccagcct

SEQ ID NO: 3816593 - DNA, 16 bp, Homo sapiens
tgcacccatgccatag

SEQ ID NO: 3816594 - DNA, 16 bp, Homo sapiens
tgcacgcacacatcag

SEQ ID NO: 3816595 - DNA, 18 bp, Homo sapiens
tgcactcatagggtgctc

SEQ ID NO: 3816596 - DNA, 16 bp, Homo sapiens
tgcactccagcctggg

SEQ ID NO: 3816597 - DNA, 15 bp, Homo sapiens
tgcactggccccacc

SEQ ID NO: 3816598 - DNA, 18 bp, Homo sapiens
tgcagaacaggggcaccc

SEQ ID NO: 3816599 - DNA, 13 bp, Homo sapiens
tgcagcagagcct

SEQ ID NO: 3816600 - DNA, 14 bp, Homo sapiens
tgcaggacctcagg

SEQ ID NO: 3816601 - DNA, 16 bp, Homo sapiens
tgcaggacctcaggtg

SEQ ID NO: 3816602 - DNA, 18 bp, Homo sapiens
tgcaggacctcaggtgag

SEQ ID NO: 3816603 - DNA, 14 bp, Homo sapiens
tgcaggcccagcag

SEQ ID NO: 3816604 - DNA, 19 bp, Homo sapiens
tgcagggggtgtgtctgct

SEQ ID NO: 3816605 - DNA, 22 bp, Homo sapiens
tgcagggggtgtgtctgctcag

SEQ ID NO: 3816606 - DNA, 14 bp, Homo sapiens
tgcaggttttctgt

SEQ ID NO: 3816607 - DNA, 16 bp, Homo sapiens
tgcattagacagatga

SEQ ID NO: 3816608 - DNA, 21 bp, Homo sapiens
tgcattatatttgtaaattta

SEQ ID NO: 3816609 - DNA, 16 bp, Homo sapiens
tgcattcccggtgcag

SEQ ID NO: 3816610 - DNA, 10 bp, Homo sapiens
tgccacctgt

SEQ ID NO: 3816611 - DNA, 12 bp, Homo sapiens
tgccacctgtct

SEQ ID NO: 3816612 - DNA, 15 bp, Homo sapiens
tgccagattgcccca

SEQ ID NO: 3816613 - DNA, 16 bp, Homo sapiens
tgccatcatgtttaca

SEQ ID NO: 3816614 - DNA, 22 bp, Homo sapiens
tgccatcatgtttacagaggac

SEQ ID NO: 3816615 - DNA, 13 bp, Homo sapiens
tgccattaaatag

SEQ ID NO: 3816616 - DNA, 18 bp, Homo sapiens
tgccattaaatagggaaa

SEQ ID NO: 3816617 - DNA, 17 bp, Homo sapiens
tgcccaagggcctccca

SEQ ID NO: 3816618 - DNA, 13 bp, Homo sapiens
tgcccaggctgga

SEQ ID NO: 3816619 - DNA, 18 bp, Homo sapiens
tgccccggcttgcctgta

SEQ ID NO: 3816620 - DNA, 17 bp, Homo sapiens
tgcccctccccagccct

SEQ ID NO: 3816621 - DNA, 19 bp, Homo sapiens
tgcccgcctcggcctccca

SEQ ID NO: 3816622 - DNA, 18 bp, Homo sapiens
tgcccgggagctcaggaa

SEQ ID NO: 3816623 - DNA, 22 bp, Homo sapiens
tgccctacctgcctgttctcca

SEQ ID NO: 3816624 - DNA, 17 bp, Homo sapiens
tgccctgccacctgtct

SEQ ID NO: 3816625 - DNA, 21 bp, Homo sapiens
tgccctgccacctgtctgtct

SEQ ID NO: 3816626 - DNA, 12 bp, Homo sapiens
tgccctgtccct

SEQ ID NO: 3816627 - DNA, 21 bp, Homo sapiens
tgccgaccagagccccacacg

SEQ ID NO: 3816628 - DNA, 22 bp, Homo sapiens
tgccgaccagagccccacacgg

SEQ ID NO: 3816629 - DNA, 17 bp, Homo sapiens
tgcctaataaagagact

SEQ ID NO: 3816630 - DNA, 17 bp, Homo sapiens
tgcctcagcctcctgag

SEQ ID NO: 3816631 - DNA, 23 bp, Homo sapiens
tgcctcagcttcccaagtagctg

SEQ ID NO: 3816632 - DNA, 21 bp, Homo sapiens
tgcctcatttcttcctctgca

SEQ ID NO: 3816633 - DNA, 22 bp, Homo sapiens
tgcctcatttcttcctctgcat

SEQ ID NO: 3816634 - DNA, 19 bp, Homo sapiens
tgcctcctcacccccagct

SEQ ID NO: 3816635 - DNA, 13 bp, Homo sapiens
tgcctgcctgggc

SEQ ID NO: 3816636 - DNA, 21 bp, Homo sapiens
tgcctgcgagagaccctacag

SEQ ID NO: 3816637 - DNA, 13 bp, Homo sapiens
tgcctgggcagtg

SEQ ID NO: 3816638 - DNA, 23 bp, Homo sapiens
tgcctgggcagtgcccaccatgc

SEQ ID NO: 3816639 - DNA, 14 bp, Homo sapiens
tgcctgggcctccc

SEQ ID NO: 3816640 - DNA, 16 bp, Homo sapiens
tgcctgggcctcccaa

SEQ ID NO: 3816641 - DNA, 17 bp, Homo sapiens
tgcctgggcctcccaaa

SEQ ID NO: 3816642 - DNA, 17 bp, Homo sapiens
tgcctgtaatcccagca

SEQ ID NO: 3816643 - DNA, 18 bp, Homo sapiens
tgcctgttctccagatgg

SEQ ID NO: 3816644 - DNA, 16 bp, Homo sapiens
tgccttggtgtgctgt

SEQ ID NO: 3816645 - DNA, 17 bp, Homo sapiens
tgccttgtcacgccaga

SEQ ID NO: 3816646 - DNA, 13 bp, Homo sapiens
tgcgagaattttc

SEQ ID NO: 3816647 - DNA, 15 bp, Homo sapiens
tgcgagaattttcaa

SEQ ID NO: 3816648 - DNA, 22 bp, Homo sapiens
tgcgcacaaggctgaccaagag

SEQ ID NO: 3816649 - DNA, 18 bp, Homo sapiens
tgctaaacaagtaagaaa

SEQ ID NO: 3816650 - DNA, 21 bp, Homo sapiens
tgctaaacaagtaagaaaaat

SEQ ID NO: 3816651 - DNA, 15 bp, Homo sapiens
tgctaaatgtgaatg

SEQ ID NO: 3816652 - DNA, 20 bp, Homo sapiens
tgctaatcttcttatgcaat

SEQ ID NO: 3816653 - DNA, 22 bp, Homo sapiens
tgctaatcttcttatgcaattt

SEQ ID NO: 3816654 - DNA, 17 bp, Homo sapiens
ttaaaggtcctgccctc

SEQ ID NO: 3816655 - DNA, 19 bp, Homo sapiens
ttaacaagaggggaaaaca

SEQ ID NO: 3816656 - DNA, 12 bp, Homo sapiens
ttaactcagtct

SEQ ID NO: 3816657 - DNA, 14 bp, Homo sapiens
ttaactctgcagga

SEQ ID NO: 3816658 - DNA, 22 bp, Homo sapiens
ttaactgcactcatagggtgct

SEQ ID NO: 3816659 - DNA, 18 bp, Homo sapiens
ttaagaaactgttactgt

SEQ ID NO: 3816660 - DNA, 17 bp, Homo sapiens
ttaagctgttactgtct

SEQ ID NO: 3816661 - DNA, 21 bp, Homo sapiens
ttaaggaagacaatgtgaaaa

SEQ ID NO: 3816662 - DNA, 15 bp, Homo sapiens
ttaagggggaaaact

SEQ ID NO: 3816663 - DNA, 20 bp, Homo sapiens
ttaatcaggtcctcagagaa

SEQ ID NO: 3816664 - DNA, 21 bp, Homo sapiens
ttaatgaatattgatgttaac

SEQ ID NO: 3816665 - DNA, 23 bp, Homo sapiens
ttaatttactgattccagcaaga

SEQ ID NO: 3816666 - DNA, 24 bp, Homo sapiens
ttacattaaaatagcacatgattt

SEQ ID NO: 3816667 - DNA, 23 bp, Homo sapiens
ttaccagaacaattatgtttctt

SEQ ID NO: 3816668 - DNA, 12 bp, Homo sapiens
ttactaaagtca

SEQ ID NO: 3816669 - DNA, 15 bp, Homo sapiens
ttactgacagaaatg

SEQ ID NO: 3816670 - DNA, 16 bp, Homo sapiens
ttactgtatataaact

SEQ ID NO: 3816671 - DNA, 21 bp, Homo sapiens
ttacttaaaccgccaaggctg

SEQ ID NO: 3816672 - DNA, 23 bp, Homo sapiens
ttagaaacaaatttttttcttgt

SEQ ID NO: 3816673 - DNA, 15 bp, Homo sapiens
ttagaagaagtgtgt

SEQ ID NO: 3816674 - DNA, 18 bp, Homo sapiens
ttagagggaggagaatga

SEQ ID NO: 3816675 - DNA, 20 bp, Homo sapiens
ttagagtatacctcctatat

SEQ ID NO: 3816676 - DNA, 18 bp, Homo sapiens
ttagcaaattctgttttt

SEQ ID NO: 3816677 - DNA, 16 bp, Homo sapiens
ttagcctttgtcccag

SEQ ID NO: 3816678 - DNA, 17 bp, Homo sapiens
ttagctgtctgctcaga

SEQ ID NO: 3816679 - DNA, 15 bp, Homo sapiens
ttaggaagttacctg

SEQ ID NO: 3816680 - DNA, 15 bp, Homo sapiens
ttaggggggaaagtc

SEQ ID NO: 3816681 - DNA, 15 bp, Homo sapiens
ttagtgctaaacaag

SEQ ID NO: 3816682 - DNA, 16 bp, Homo sapiens
ttagttcctcattagc

SEQ ID NO: 3816683 - DNA, 14 bp, Homo sapiens
ttagttccttgagt

SEQ ID NO: 3816684 - DNA, 19 bp, Homo sapiens
ttagtttgatttaatatct

SEQ ID NO: 3816685 - DNA, 21 bp, Homo sapiens
ttataaaatgggaagactgag

SEQ ID NO: 3816686 - DNA, 21 bp, Homo sapiens
ttataagaggatagctatatt

SEQ ID NO: 3816687 - DNA, 20 bp, Homo sapiens
ttatatacaatttctattat

SEQ ID NO: 3816688 - DNA, 21 bp, Homo sapiens
ttatattcctctaaaactctc

SEQ ID NO: 3816689 - DNA, 16 bp, Homo sapiens
ttatcctgaaatttca

SEQ ID NO: 3816690 - DNA, 18 bp, Homo sapiens
ttatgacatcacttgtac

SEQ ID NO: 3816691 - DNA, 13 bp, Homo sapiens
ttatgccacctga

SEQ ID NO: 3816692 - DNA, 15 bp, Homo sapiens
ttatgggatgtaaac

SEQ ID NO: 3816693 - DNA, 16 bp, Homo sapiens
ttatgggatgtaaaca

SEQ ID NO: 3816694 - DNA, 18 bp, Homo sapiens
ttatgtgatataaaatat

SEQ ID NO: 3816695 - DNA, 14 bp, Homo sapiens
ttatgtgtgtgtgt

SEQ ID NO: 3816696 - DNA, 16 bp, Homo sapiens
ttatgttattggaatt

SEQ ID NO: 3816697 - DNA, 20 bp, Homo sapiens
ttattccccattcttcctag

SEQ ID NO: 3816698 - DNA, 18 bp, Homo sapiens
ttattgcctgggcagtgc

SEQ ID NO: 3816699 - DNA, 19 bp, Homo sapiens
ttattggaattttctttca

SEQ ID NO: 3816700 - DNA, 14 bp, Homo sapiens
ttattgtatttatg

SEQ ID NO: 3816701 - DNA, 16 bp, Homo sapiens
ttatttagttccttga

SEQ ID NO: 3816702 - DNA, 13 bp, Homo sapiens
ttatttgtataat

SEQ ID NO: 3816703 - DNA, 18 bp, Homo sapiens
ttattttcaagaaactga

SEQ ID NO: 3816704 - DNA, 12 bp, Homo sapiens
ttattttcactg

SEQ ID NO: 3816705 - DNA, 23 bp, Homo sapiens
ttcaaagagactaatagagacac

SEQ ID NO: 3816706 - DNA, 20 bp, Homo sapiens
ttcaagaaactgaggaattt

SEQ ID NO: 3816707 - DNA, 17 bp, Homo sapiens
ttcacagcgcctcctgg

SEQ ID NO: 3816708 - DNA, 14 bp, Homo sapiens
ttcactaccaaatg

SEQ ID NO: 3816709 - DNA, 15 bp, Homo sapiens
ttcagataaggcaga

SEQ ID NO: 3816710 - DNA, 20 bp, Homo sapiens
ttcagctaagctaggaatga

SEQ ID NO: 3816711 - DNA, 16 bp, Homo sapiens
ttcaggaggctgaggc

SEQ ID NO: 3816712 - DNA, 13 bp, Homo sapiens
ttcagggcctcca

SEQ ID NO: 3816713 - DNA, 14 bp, Homo sapiens
ttcagtaagccgtg

SEQ ID NO: 3816714 - DNA, 12 bp, Homo sapiens
ttcataatttca

SEQ ID NO: 3816715 - DNA, 22 bp, Homo sapiens
ttcatatattatcaaaattctg

SEQ ID NO: 3816716 - DNA, 21 bp, Homo sapiens
ttcatgcattctagtgcagaa

SEQ ID NO: 3816717 - DNA, 18 bp, Homo sapiens
ttcatgctatctctgtgt

SEQ ID NO: 3816718 - DNA, 12 bp, Homo sapiens
ttccaaccccag

SEQ ID NO: 3816719 - DNA, 18 bp, Homo sapiens
ttccaaccccagctggcc

SEQ ID NO: 3816720 - DNA, 13 bp, Homo sapiens
ttccacataaagg

SEQ ID NO: 3816721 - DNA, 18 bp, Homo sapiens
ttccactgccaaaacaat

SEQ ID NO: 3816722 - DNA, 23 bp, Homo sapiens
ttccagactgcttccaattttct

SEQ ID NO: 3816723 - DNA, 20 bp, Homo sapiens
ttccagaggctattattttc

SEQ ID NO: 3816724 - DNA, 12 bp, Homo sapiens
ttccataataaa

SEQ ID NO: 3816725 - DNA, 18 bp, Homo sapiens
ttcccagagcaaaataat

SEQ ID NO: 3816726 - DNA, 19 bp, Homo sapiens
ttccccagctttgctgcct

SEQ ID NO: 3816727 - DNA, 21 bp, Homo sapiens
ttccctgcttttctcccagaa

SEQ ID NO: 3816728 - DNA, 14 bp, Homo sapiens
ttccctgggcctca

SEQ ID NO: 3816729 - DNA, 12 bp, Homo sapiens
ttccctggggcc

SEQ ID NO: 3816730 - DNA, 14 bp, Homo sapiens
ttcctagccctctc

SEQ ID NO: 3816731 - DNA, 18 bp, Homo sapiens
ttcctagccctctcacat

SEQ ID NO: 3816732 - DNA, 18 bp, Homo sapiens
ttcctagttttctcctcc

SEQ ID NO: 3816733 - DNA, 12 bp, Homo sapiens
ttcctcatttgt

SEQ ID NO: 3816734 - DNA, 17 bp, Homo sapiens
ttcctcatttgttcatt

SEQ ID NO: 3816735 - DNA, 23 bp, Homo sapiens
ttcctcatttgttcattaaacgt

SEQ ID NO: 3816736 - DNA, 20 bp, Homo sapiens
ttcctcttctattttgtaaa

SEQ ID NO: 3816737 - DNA, 21 bp, Homo sapiens
ttcctgaggaagagggactgt

SEQ ID NO: 3816738 - DNA, 20 bp, Homo sapiens
ttccttgagttgattcagct

SEQ ID NO: 3816739 - DNA, 14 bp, Homo sapiens
ttcctttgaagagg

SEQ ID NO: 3816740 - DNA, 15 bp, Homo sapiens
ttcctttgaagagga

SEQ ID NO: 3816741 - DNA, 22 bp, Homo sapiens
ttcgaaacctgtccataaagta

SEQ ID NO: 3816742 - DNA, 14 bp, Homo sapiens
ttctaactcttaga

SEQ ID NO: 3816743 - DNA, 15 bp, Homo sapiens
ttctaactcttagaa

SEQ ID NO: 3816744 - DNA, 18 bp, Homo sapiens
ttctaccatttcagagag

SEQ ID NO: 3816745 - DNA, 13 bp, Homo sapiens
ttctaggcctggg

SEQ ID NO: 3816746 - DNA, 23 bp, Homo sapiens
ttctattatttttcaagtaataa

SEQ ID NO: 3816747 - DNA, 13 bp, Homo sapiens
ttctcagagcagc

SEQ ID NO: 3816748 - DNA, 21 bp, Homo sapiens
ttctccagggacagaagcagg

SEQ ID NO: 3816749 - DNA, 21 bp, Homo sapiens
ttctcctgcctcagcctcctg

SEQ ID NO: 3816750 - DNA, 22 bp, Homo sapiens
ttctcctgcctcagcctcctga

SEQ ID NO: 3816751 - DNA, 12 bp, Homo sapiens
ttctctgttcta

SEQ ID NO: 3816752 - DNA, 14 bp, Homo sapiens
ttctgcattcacag

SEQ ID NO: 3816753 - DNA, 12 bp, Homo sapiens
ttctgcctcagc

SEQ ID NO: 3816754 - DNA, 19 bp, Homo sapiens
ttctgctccaaattttcaa

SEQ ID NO: 3816755 - DNA, 19 bp, Homo sapiens
ttctgcttccgtattttaa

SEQ ID NO: 3816756 - DNA, 14 bp, Homo sapiens
ttctgggtcttctg

SEQ ID NO: 3816757 - DNA, 16 bp, Homo sapiens
ttctgtccagtttcca

SEQ ID NO: 3816758 - DNA, 17 bp, Homo sapiens
ttctgtccgagctttga

SEQ ID NO: 3816759 - DNA, 21 bp, Homo sapiens
ttctgtccgagctttgaaaat

SEQ ID NO: 3816760 - DNA, 22 bp, Homo sapiens
ttcttattcatgctttctcctt

SEQ ID NO: 3816761 - DNA, 22 bp, Homo sapiens
ttcttcatcccttgcttaagaa

SEQ ID NO: 3816762 - DNA, 22 bp, Homo sapiens
aagaataaacacagtgtttcct

SEQ ID NO: 3816763 - DNA, 18 bp, Homo sapiens
aagacaccgttcattcag

SEQ ID NO: 3816764 - DNA, 21 bp, Homo sapiens
aagagactaatagagacacag

SEQ ID NO: 3816765 - DNA, 23 bp, Homo sapiens
aagagactccaagattcaaagag

SEQ ID NO: 3816766 - DNA, 17 bp, Homo sapiens
aagagatggcctgagaa

SEQ ID NO: 3816767 - DNA, 19 bp, Homo sapiens
aagagattgtggtttcatt

SEQ ID NO: 3816768 - DNA, 14 bp, Homo sapiens
aagaggggaaaaca

SEQ ID NO: 3816769 - DNA, 21 bp, Homo sapiens
aagataatattaaggaagaca

SEQ ID NO: 3816770 - DNA, 23 bp, Homo sapiens
aagatctgcagggggtgtgtctg

SEQ ID NO: 3816771 - DNA, 18 bp, Homo sapiens
aagatctgcttccctggg

SEQ ID NO: 3816772 - DNA, 16 bp, Homo sapiens
aagatgcttctcactg

SEQ ID NO: 3816773 - DNA, 17 bp, Homo sapiens
aagatgcttctcactgc

SEQ ID NO: 3816774 - DNA, 16 bp, Homo sapiens
aagattatatatcata

SEQ ID NO: 3816775 - DNA, 20 bp, Homo sapiens
aagattatatatcataaagt

SEQ ID NO: 3816776 - DNA, 14 bp, Homo sapiens
aagattcaaagaga

SEQ ID NO: 3816777 - DNA, 19 bp, Homo sapiens
aagatttctgctccaaatt

SEQ ID NO: 3816778 - DNA, 18 bp, Homo sapiens
aagcaatctgtaactgct

SEQ ID NO: 3816779 - DNA, 23 bp, Homo sapiens
aagcaatgcttctgcctcagctt

SEQ ID NO: 3816780 - DNA, 18 bp, Homo sapiens
aagcaccccagtcactag

SEQ ID NO: 3816781 - DNA, 16 bp, Homo sapiens
aagcaccttagctggc

SEQ ID NO: 3816782 - DNA, 19 bp, Homo sapiens
aagcaccttagctggcatt

SEQ ID NO: 3816783 - DNA, 22 bp, Homo sapiens
aagcagacgtgagtgtgacttt

SEQ ID NO: 3816784 - DNA, 15 bp, Homo sapiens
aagcagagccaaggc

SEQ ID NO: 3816785 - DNA, 16 bp, Homo sapiens
aagcagagccaaggcc

SEQ ID NO: 3816786 - DNA, 17 bp, Homo sapiens
aagcagagccaaggcca

SEQ ID NO: 3816787 - DNA, 18 bp, Homo sapiens
aagcagagccaaggccac

SEQ ID NO: 3816788 - DNA, 21 bp, Homo sapiens
aagccagctgccgaccagagc

SEQ ID NO: 3816789 - DNA, 15 bp, Homo sapiens
aagcctcctccagcc

SEQ ID NO: 3816790 - DNA, 23 bp, Homo sapiens
aagcctgcctaggaattcccagc

SEQ ID NO: 3816791 - DNA, 14 bp, Homo sapiens
aagcggctggcagc

SEQ ID NO: 3816792 - DNA, 14 bp, Homo sapiens
aagctaggaatgaa

SEQ ID NO: 3816793 - DNA, 22 bp, Homo sapiens
aagctctatggattatccactg

SEQ ID NO: 3816794 - DNA, 13 bp, Homo sapiens
aagctgcaccctc

SEQ ID NO: 3816795 - DNA, 22 bp, Homo sapiens
aagctgcaccctcaggcaggtg

SEQ ID NO: 3816796 - DNA, 12 bp, Homo sapiens
aaggagaagaga

SEQ ID NO: 3816797 - DNA, 18 bp, Homo sapiens
aaggcagggaaaggctct

SEQ ID NO: 3816798 - DNA, 13 bp, Homo sapiens
aaggccacactgg

SEQ ID NO: 3816799 - DNA, 16 bp, Homo sapiens
aaggctgaccaagaga

SEQ ID NO: 3816800 - DNA, 18 bp, Homo sapiens
aaggctgggtccagggga

SEQ ID NO: 3816801 - DNA, 16 bp, Homo sapiens
aaggctttcagggcct

SEQ ID NO: 3816802 - DNA, 13 bp, Homo sapiens
aagggagggggag

SEQ ID NO: 3816803 - DNA, 21 bp, Homo sapiens
aagggcacagacactacatat

SEQ ID NO: 3816804 - DNA, 16 bp, Homo sapiens
aagggcagtaaagttt

SEQ ID NO: 3816805 - DNA, 20 bp, Homo sapiens
aaggtatttagaatatatta

SEQ ID NO: 3816806 - DNA, 19 bp, Homo sapiens
aaggtctttggttcagcta

SEQ ID NO: 3816807 - DNA, 13 bp, Homo sapiens
aagtacttaaact

SEQ ID NO: 3816808 - DNA, 12 bp, Homo sapiens
aagtagctgaga

SEQ ID NO: 3816809 - DNA, 10 bp, Homo sapiens
aagtatttag

SEQ ID NO: 3816810 - DNA, 21 bp, Homo sapiens
aagtcatctgtttaatttaca

SEQ ID NO: 3816811 - DNA, 18 bp, Homo sapiens
aagtctctctgtgaatac

SEQ ID NO: 3816812 - DNA, 15 bp, Homo sapiens
aagtgcactgcagtg

SEQ ID NO: 3816813 - DNA, 19 bp, Homo sapiens
aagtggaaaaatagcctgc

SEQ ID NO: 3816814 - DNA, 21 bp, Homo sapiens
aagtggaaaaatagcctgcct

SEQ ID NO: 3816815 - DNA, 10 bp, Homo sapiens
aagtgtgggt

SEQ ID NO: 3816816 - DNA, 17 bp, Homo sapiens
aagtgtgggtctgtgtg

SEQ ID NO: 3816817 - DNA, 10 bp, Homo sapiens
aataaaaaac

SEQ ID NO: 3816818 - DNA, 12 bp, Homo sapiens
aataaagcagag

SEQ ID NO: 3816819 - DNA, 14 bp, Homo sapiens
aataaagcagagcc

SEQ ID NO: 3816820 - DNA, 23 bp, Homo sapiens
aataaagcagagccaaggccacc

SEQ ID NO: 3816821 - DNA, 14 bp, Homo sapiens
aataaagctgctga

SEQ ID NO: 3816822 - DNA, 13 bp, Homo sapiens
aataacaatgtgc

SEQ ID NO: 3816823 - DNA, 17 bp, Homo sapiens
aataagtgccaggatgg

SEQ ID NO: 3816824 - DNA, 14 bp, Homo sapiens
aataatagggaaaa

SEQ ID NO: 3816825 - DNA, 16 bp, Homo sapiens
aataattttaaacaaa

SEQ ID NO: 3816826 - DNA, 22 bp, Homo sapiens
aatacaattaaaggtcctgccc

SEQ ID NO: 3816827 - DNA, 13 bp, Homo sapiens
aatacagaggcaa

SEQ ID NO: 3816828 - DNA, 12 bp, Homo sapiens
aataccaaggaa

SEQ ID NO: 3816829 - DNA, 22 bp, Homo sapiens
aatactctaccctcttagaaaa

SEQ ID NO: 3816830 - DNA, 15 bp, Homo sapiens
aatagaagaacatcc

SEQ ID NO: 3816831 - DNA, 20 bp, Homo sapiens
aatagcctgcctcttctcta

SEQ ID NO: 3816832 - DNA, 12 bp, Homo sapiens
aatataacatgt

SEQ ID NO: 3816833 - DNA, 21 bp, Homo sapiens
aatatagatcagttataagta

SEQ ID NO: 3816834 - DNA, 21 bp, Homo sapiens
aatattgatgttaacaagagg

SEQ ID NO: 3816835 - DNA, 17 bp, Homo sapiens
aatcccatttaaaaaaa

SEQ ID NO: 3816836 - DNA, 18 bp, Homo sapiens
aatccttgcttatgacat

SEQ ID NO: 3816837 - DNA, 21 bp, Homo sapiens
aatcggctacccctcgactca

SEQ ID NO: 3816838 - DNA, 19 bp, Homo sapiens
aatgaccagtaattgtgaa

SEQ ID NO: 3816839 - DNA, 14 bp, Homo sapiens
aatgacgtttacat

SEQ ID NO: 3816840 - DNA, 12 bp, Homo sapiens
aatgagcctggc

SEQ ID NO: 3816841 - DNA, 14 bp, Homo sapiens
aatgatcaaaacat

SEQ ID NO: 3816842 - DNA, 14 bp, Homo sapiens
aatgatggcaattt

SEQ ID NO: 3816843 - DNA, 19 bp, Homo sapiens
aatgatggcaattttgtaa

SEQ ID NO: 3816844 - DNA, 13 bp, Homo sapiens
aatgatttcatgc

SEQ ID NO: 3816845 - DNA, 17 bp, Homo sapiens
aatgcaggagagcttcc

SEQ ID NO: 3816846 - DNA, 22 bp, Homo sapiens
aatgctattcagataaggcaga

SEQ ID NO: 3816847 - DNA, 13 bp, Homo sapiens
aatggaaaggaga

SEQ ID NO: 3816848 - DNA, 14 bp, Homo sapiens
aatgggaaaagaga

SEQ ID NO: 3816849 - DNA, 21 bp, Homo sapiens
aatggggtagaggagggcatg

SEQ ID NO: 3816850 - DNA, 18 bp, Homo sapiens
aatggtgttactaaagtc

SEQ ID NO: 3816851 - DNA, 16 bp, Homo sapiens
aatgtatcatagaaat

SEQ ID NO: 3816852 - DNA, 22 bp, Homo sapiens
aatgtatcatagaaatgtaact

SEQ ID NO: 3816853 - DNA, 19 bp, Homo sapiens
aatgtgaaaagaaaaatga

SEQ ID NO: 3816854 - DNA, 22 bp, Homo sapiens
aatgtgattcctttgaagagga

SEQ ID NO: 3816855 - DNA, 17 bp, Homo sapiens
aatgtgttgatttgaga

SEQ ID NO: 3816856 - DNA, 21 bp, Homo sapiens
aatgttatgggatgtaaacaa

SEQ ID NO: 3816857 - DNA, 22 bp, Homo sapiens
aatgttatgggatgtaaacaat

SEQ ID NO: 3816858 - DNA, 18 bp, Homo sapiens
aattaaaggtcctgccct

SEQ ID NO: 3816859 - DNA, 15 bp, Homo sapiens
aattaattaaaataa

SEQ ID NO: 3816860 - DNA, 20 bp, Homo sapiens
aattactgtatataaactcc

SEQ ID NO: 3816861 - DNA, 12 bp, Homo sapiens
aattagcaattg

SEQ ID NO: 3816862 - DNA, 18 bp, Homo sapiens
aattagtggcacttgctt

SEQ ID NO: 3816863 - DNA, 16 bp, Homo sapiens
aattcagaagcatcac

SEQ ID NO: 3816864 - DNA, 23 bp, Homo sapiens
aattctaggcatcccaggggacc

SEQ ID NO: 3816865 - DNA, 18 bp, Homo sapiens
aattctgtttttctaggc

SEQ ID NO: 3816866 - DNA, 18 bp, Homo sapiens
aattctttgacctgttgg

SEQ ID NO: 3816867 - DNA, 22 bp, Homo sapiens
aattctttgacctgttgggagt

SEQ ID NO: 3816868 - DNA, 20 bp, Homo sapiens
aattgcttgaacccaggagg

SEQ ID NO: 3816869 - DNA, 14 bp, Homo sapiens
aattgtgatgtgtc

SEQ ID NO: 3816870 - DNA, 22 bp, Homo sapiens
accattgtcttccaaccccagc

SEQ ID NO: 3816871 - DNA, 23 bp, Homo sapiens
accattgtcttccaaccccagct

SEQ ID NO: 3816872 - DNA, 14 bp, Homo sapiens
acccactctttgct

SEQ ID NO: 3816873 - DNA, 23 bp, Homo sapiens
acccactctttgctacaataaat

SEQ ID NO: 3816874 - DNA, 12 bp, Homo sapiens
acccactggcca

SEQ ID NO: 3816875 - DNA, 23 bp, Homo sapiens
acccaggaggtggaggttgcagt

SEQ ID NO: 3816876 - DNA, 20 bp, Homo sapiens
acccaggatttgctgggaga

SEQ ID NO: 3816877 - DNA, 13 bp, Homo sapiens
acccatgccatag

SEQ ID NO: 3816878 - DNA, 17 bp, Homo sapiens
accccacaccccagccc

SEQ ID NO: 3816879 - DNA, 20 bp, Homo sapiens
accccagcccaccctgctcc

SEQ ID NO: 3816880 - DNA, 21 bp, Homo sapiens
accccagcccaccctgctcct

SEQ ID NO: 3816881 - DNA, 11 bp, Homo sapiens
accccagctgg

SEQ ID NO: 3816882 - DNA, 15 bp, Homo sapiens
accccagctggcctc

SEQ ID NO: 3816883 - DNA, 16 bp, Homo sapiens
accccagctggcctct

SEQ ID NO: 3816884 - DNA, 19 bp, Homo sapiens
acccccactgccgcctcct

SEQ ID NO: 3816885 - DNA, 18 bp, Homo sapiens
acccccaggattcccaga

SEQ ID NO: 3816886 - DNA, 15 bp, Homo sapiens
accccgacttttgtt

SEQ ID NO: 3816887 - DNA, 16 bp, Homo sapiens
acccctcgactcagca

SEQ ID NO: 3816888 - DNA, 17 bp, Homo sapiens
acccctcgactcagcac

SEQ ID NO: 3816889 - DNA, 23 bp, Homo sapiens
acccggctgggtcggccctgccc

SEQ ID NO: 3816890 - DNA, 16 bp, Homo sapiens
accctacctgtgcctg

SEQ ID NO: 3816891 - DNA, 17 bp, Homo sapiens
accctacctgtgcctga

SEQ ID NO: 3816892 - DNA, 18 bp, Homo sapiens
accctacttcttttgctc

SEQ ID NO: 3816893 - DNA, 14 bp, Homo sapiens
accctattgctgct

SEQ ID NO: 3816894 - DNA, 11 bp, Homo sapiens
accctcagctg

SEQ ID NO: 3816895 - DNA, 16 bp, Homo sapiens
accctcagctgcctca

SEQ ID NO: 3816896 - DNA, 20 bp, Homo sapiens
accctcagctgcctcatcgt

SEQ ID NO: 3816897 - DNA, 16 bp, Homo sapiens
accctcaggcaggtgg

SEQ ID NO: 3816898 - DNA, 14 bp, Homo sapiens
accctcatctttct

SEQ ID NO: 3816899 - DNA, 16 bp, Homo sapiens
accctcatctttcttc

SEQ ID NO: 3816900 - DNA, 19 bp, Homo sapiens
accctcatctttcttccaa

SEQ ID NO: 3816901 - DNA, 15 bp, Homo sapiens
accctcgtggacacc

SEQ ID NO: 3816902 - DNA, 17 bp, Homo sapiens
accctcgtggacacctg

SEQ ID NO: 3816903 - DNA, 19 bp, Homo sapiens
accctcgtggacacctgcc

SEQ ID NO: 3816904 - DNA, 23 bp, Homo sapiens
accctcgtggacacctgccctgc

SEQ ID NO: 3816905 - DNA, 18 bp, Homo sapiens
accctgaaagccctgagc

SEQ ID NO: 3816906 - DNA, 19 bp, Homo sapiens
accctgctcctcctgccct

SEQ ID NO: 3816907 - DNA, 18 bp, Homo sapiens
accgatgtacacacacag

SEQ ID NO: 3816908 - DNA, 13 bp, Homo sapiens
accgcgcccagcc

SEQ ID NO: 3816909 - DNA, 17 bp, Homo sapiens
accgcgcccagccaaga

SEQ ID NO: 3816910 - DNA, 23 bp, Homo sapiens
accggagctttcaaagaaggaat

SEQ ID NO: 3816911 - DNA, 16 bp, Homo sapiens
accgtattagccagga

SEQ ID NO: 3816912 - DNA, 17 bp, Homo sapiens
accgtattagccaggat

SEQ ID NO: 3816913 - DNA, 18 bp, Homo sapiens
acctcaggtgagaagcag

SEQ ID NO: 3816914 - DNA, 9 bp, Homo sapiens
acctcctgg

SEQ ID NO: 3816915 - DNA, 12 bp, Homo sapiens
acctcctgggtt

SEQ ID NO: 3816916 - DNA, 23 bp, Homo sapiens
acctcgtgatatccacaaatgct

SEQ ID NO: 3816917 - DNA, 20 bp, Homo sapiens
acctctcaatattcaataaa

SEQ ID NO: 3816918 - DNA, 21 bp, Homo sapiens
acctctcaatattcaataaag

SEQ ID NO: 3816919 - DNA, 23 bp, Homo sapiens
acctctcaatattcaataaagct

SEQ ID NO: 3816920 - DNA, 23 bp, Homo sapiens
acctctccaagtctctctgtgaa

SEQ ID NO: 3816921 - DNA, 15 bp, Homo sapiens
acctctgaagtctct

SEQ ID NO: 3816922 - DNA, 20 bp, Homo sapiens
acctctgaatgtcccagagg

SEQ ID NO: 3816923 - DNA, 13 bp, Homo sapiens
acctgaacctggg

SEQ ID NO: 3816924 - DNA, 21 bp, Homo sapiens
acctgagatactgaagtgcag

SEQ ID NO: 3816925 - DNA, 22 bp, Homo sapiens
acctgagtcaccctacctgtgc

SEQ ID NO: 3816926 - DNA, 12 bp, Homo sapiens
acctgccctgcc

SEQ ID NO: 3816927 - DNA, 23 bp, Homo sapiens
acctgccgagagtccatcagcct

SEQ ID NO: 3816928 - DNA, 18 bp, Homo sapiens
acctgcctgttctccaga

SEQ ID NO: 3816929 - DNA, 16 bp, Homo sapiens
acctgggaaccatgaa

SEQ ID NO: 3816930 - DNA, 20 bp, Homo sapiens
acctgggaaccatgaagctg

SEQ ID NO: 3816931 - DNA, 16 bp, Homo sapiens
acctgtccataaagta

SEQ ID NO: 3816932 - DNA, 11 bp, Homo sapiens
acctgtctgtc

SEQ ID NO: 3816933 - DNA, 14 bp, Homo sapiens
acctgtctgtctgt

SEQ ID NO: 3816934 - DNA, 20 bp, Homo sapiens
accttctccagggacagaag

SEQ ID NO: 3816935 - DNA, 17 bp, Homo sapiens
acctttgtccaggcctg

SEQ ID NO: 3816936 - DNA, 15 bp, Homo sapiens
acctttttttctctc

SEQ ID NO: 3816937 - DNA, 19 bp, Homo sapiens
acctttttttctctcctaa

SEQ ID NO: 3816938 - DNA, 15 bp, Homo sapiens
acgcacacatcagtg

SEQ ID NO: 3816939 - DNA, 18 bp, Homo sapiens
acgcacatagagatatgc

SEQ ID NO: 3816940 - DNA, 16 bp, Homo sapiens
acgccagacttcccac

SEQ ID NO: 3816941 - DNA, 23 bp, Homo sapiens
acgccaggggaaaatcagcctgc

SEQ ID NO: 3816942 - DNA, 20 bp, Homo sapiens
acgctgtgattggcaggagg

SEQ ID NO: 3816943 - DNA, 15 bp, Homo sapiens
acggaaaatgccaat

SEQ ID NO: 3816944 - DNA, 18 bp, Homo sapiens
acggaaaatgccaatctc

SEQ ID NO: 3816945 - DNA, 17 bp, Homo sapiens
acggacactcaaaagct

SEQ ID NO: 3816946 - DNA, 15 bp, Homo sapiens
acggatgcacagaga

SEQ ID NO: 3816947 - DNA, 14 bp, Homo sapiens
acggcactgtggcc

SEQ ID NO: 3816948 - DNA, 15 bp, Homo sapiens
acggttttactgcag

SEQ ID NO: 3816949 - DNA, 11 bp, Homo sapiens
acgtcattcag

SEQ ID NO: 3816950 - DNA, 17 bp, Homo sapiens
acgtgtctttagaactc

SEQ ID NO: 3816951 - DNA, 14 bp, Homo sapiens
acgttttatgtgaa

SEQ ID NO: 3816952 - DNA, 17 bp, Homo sapiens
actaagctttctccttt

SEQ ID NO: 3816953 - DNA, 15 bp, Homo sapiens
actacagaagtggaa

SEQ ID NO: 3816954 - DNA, 19 bp, Homo sapiens
actacctttgtccaggcct

SEQ ID NO: 3816955 - DNA, 16 bp, Homo sapiens
actactactctgccaa

SEQ ID NO: 3816956 - DNA, 12 bp, Homo sapiens
actactctgcca

SEQ ID NO: 3816957 - DNA, 13 bp, Homo sapiens
actactctgccaa

SEQ ID NO: 3816958 - DNA, 15 bp, Homo sapiens
actacttgagaaaat

SEQ ID NO: 3816959 - DNA, 17 bp, Homo sapiens
actagattctcacctgc

SEQ ID NO: 3816960 - DNA, 22 bp, Homo sapiens
actagattctcacctgccttca

SEQ ID NO: 3816961 - DNA, 18 bp, Homo sapiens
actagccatctcaagcaa

SEQ ID NO: 3816962 - DNA, 20 bp, Homo sapiens
actagggttttggcctgcct

SEQ ID NO: 3816963 - DNA, 13 bp, Homo sapiens
actcaaaagctgg

SEQ ID NO: 3816964 - DNA, 15 bp, Homo sapiens
actcaaaatatttgt

SEQ ID NO: 3816965 - DNA, 17 bp, Homo sapiens
actcagaatataacatg

SEQ ID NO: 3816966 - DNA, 12 bp, Homo sapiens
actcatcttagg

SEQ ID NO: 3816967 - DNA, 15 bp, Homo sapiens
actcatgtgactctt

SEQ ID NO: 3816968 - DNA, 19 bp, Homo sapiens
actcatgtgactctttcca

SEQ ID NO: 3816969 - DNA, 12 bp, Homo sapiens
actccagcctgg

SEQ ID NO: 3816970 - DNA, 13 bp, Homo sapiens
actccagcctggg

SEQ ID NO: 3816971 - DNA, 15 bp, Homo sapiens
actccagcctgggcg

SEQ ID NO: 3816972 - DNA, 14 bp, Homo sapiens
actcccccaggtgg

SEQ ID NO: 3816973 - DNA, 15 bp, Homo sapiens
actcctgacctcgtg

SEQ ID NO: 3816974 - DNA, 16 bp, Homo sapiens
actcgactctgctgct

SEQ ID NO: 3816975 - DNA, 23 bp, Homo sapiens
actcgtgtctggcacagcctggc

SEQ ID NO: 3816976 - DNA, 13 bp, Homo sapiens
actctaccctctt

SEQ ID NO: 3816977 - DNA, 17 bp, Homo sapiens
actctagggaaaaacca

SEQ ID NO: 3816978 - DNA, 20 bp, Homo sapiens
actctgccaatcggctaccc

SEQ ID NO: 3816979 - DNA, 20 bp, Homo sapiens
aggttggcaaaaaggcagga

SEQ ID NO: 3816980 - DNA, 14 bp, Homo sapiens
aggttggtgggggc

SEQ ID NO: 3816981 - DNA, 22 bp, Homo sapiens
aggttttcctcttctattttgt

SEQ ID NO: 3816982 - DNA, 19 bp, Homo sapiens
aggtttttgtttgtttcct

SEQ ID NO: 3816983 - DNA, 11 bp, Homo sapiens
agtaaagtttt

SEQ ID NO: 3816984 - DNA, 22 bp, Homo sapiens
agtaacaaaagtatagttttga

SEQ ID NO: 3816985 - DNA, 20 bp, Homo sapiens
agtaagccgtgattttcatt

SEQ ID NO: 3816986 - DNA, 15 bp, Homo sapiens
agtaatctttaaact

SEQ ID NO: 3816987 - DNA, 16 bp, Homo sapiens
agtaccttcagatcct

SEQ ID NO: 3816988 - DNA, 20 bp, Homo sapiens
agtaccttcagatcctaccc

SEQ ID NO: 3816989 - DNA, 21 bp, Homo sapiens
agtagctgagattacaggcgc

SEQ ID NO: 3816990 - DNA, 20 bp, Homo sapiens
agtataggataaattacatt

SEQ ID NO: 3816991 - DNA, 15 bp, Homo sapiens
agtatatattctaca

SEQ ID NO: 3816992 - DNA, 19 bp, Homo sapiens
agtatattagtttgattta

SEQ ID NO: 3816993 - DNA, 15 bp, Homo sapiens
agtatctcagggcct

SEQ ID NO: 3816994 - DNA, 19 bp, Homo sapiens
agtatgtggaagtgtgggt

SEQ ID NO: 3816995 - DNA, 19 bp, Homo sapiens
agtcaaagcggatgctggc

SEQ ID NO: 3816996 - DNA, 16 bp, Homo sapiens
agtcaagtgaaaaagg

SEQ ID NO: 3816997 - DNA, 19 bp, Homo sapiens
agtcaccctacctgtgcct

SEQ ID NO: 3816998 - DNA, 20 bp, Homo sapiens
agtcaccctacctgtgcctg

SEQ ID NO: 3816999 - DNA, 14 bp, Homo sapiens
agtcatctgtttaa

SEQ ID NO: 3817000 - DNA, 17 bp, Homo sapiens
agtccacttttaaaact

SEQ ID NO: 3817001 - DNA, 13 bp, Homo sapiens
agtccagctcccc

SEQ ID NO: 3817002 - DNA, 14 bp, Homo sapiens
agtccatcagcctc

SEQ ID NO: 3817003 - DNA, 16 bp, Homo sapiens
agtccatcagcctcca

SEQ ID NO: 3817004 - DNA, 15 bp, Homo sapiens
agtccctgcctggac

SEQ ID NO: 3817005 - DNA, 23 bp, Homo sapiens
agtccctgcctggaccagcctct

SEQ ID NO: 3817006 - DNA, 14 bp, Homo sapiens
agtcctagagctcc

SEQ ID NO: 3817007 - DNA, 16 bp, Homo sapiens
agtcctagagctcctg

SEQ ID NO: 3817008 - DNA, 19 bp, Homo sapiens
agtcctagagctcctgtcc

SEQ ID NO: 3817009 - DNA, 20 bp, Homo sapiens
agtcctagagctcctgtccc

SEQ ID NO: 3817010 - DNA, 22 bp, Homo sapiens
agtcctagagctcctgtcccta

SEQ ID NO: 3817011 - DNA, 19 bp, Homo sapiens
agtctagttacctactttt

SEQ ID NO: 3817012 - DNA, 20 bp, Homo sapiens
agtctagttacctacttttt

SEQ ID NO: 3817013 - DNA, 12 bp, Homo sapiens
agtctctctgtg

SEQ ID NO: 3817014 - DNA, 14 bp, Homo sapiens
agtctctctgtgaa

SEQ ID NO: 3817015 - DNA, 23 bp, Homo sapiens
agtctctctgtgaatacaattaa

SEQ ID NO: 3817016 - DNA, 13 bp, Homo sapiens
agtcttccctgat

SEQ ID NO: 3817017 - DNA, 16 bp, Homo sapiens
agtcttggaatacttg

SEQ ID NO: 3817018 - DNA, 23 bp, Homo sapiens
agtgaaaaaggaggaagagaaaa

SEQ ID NO: 3817019 - DNA, 22 bp, Homo sapiens
agtgacaggcaccagatgggat

SEQ ID NO: 3817020 - DNA, 22 bp, Homo sapiens
agtgagagggcatgcgcacaag

SEQ ID NO: 3817021 - DNA, 21 bp, Homo sapiens
agtgagcctgaattttgttgc

SEQ ID NO: 3817022 - DNA, 14 bp, Homo sapiens
agtgaggatgtctg

SEQ ID NO: 3817023 - DNA, 19 bp, Homo sapiens
agtgataattttatttata

SEQ ID NO: 3817024 - DNA, 23 bp, Homo sapiens
agtgataattttatttataaact

SEQ ID NO: 3817025 - DNA, 22 bp, Homo sapiens
agtgatgcttttagttttaaaa

SEQ ID NO: 3817026 - DNA, 21 bp, Homo sapiens
agtgattgttatgccttgcta

SEQ ID NO: 3817027 - DNA, 20 bp, Homo sapiens
agtgatttttatgccacctg

SEQ ID NO: 3817028 - DNA, 18 bp, Homo sapiens
agtgccaggatggaatga

SEQ ID NO: 3817029 - DNA, 20 bp, Homo sapiens
agtgctgggattacaggtgt

SEQ ID NO: 3817030 - DNA, 11 bp, Homo sapiens
agtggaaaaat

SEQ ID NO: 3817031 - DNA, 21 bp, Homo sapiens
agtggaagtgcttgatatgta

SEQ ID NO: 3817032 - DNA, 14 bp, Homo sapiens
agtggcagccgcct

SEQ ID NO: 3817033 - DNA, 16 bp, Homo sapiens
agtggctggatctgtg

SEQ ID NO: 3817034 - DNA, 18 bp, Homo sapiens
agtgggtgaataatacag

SEQ ID NO: 3817035 - DNA, 21 bp, Homo sapiens
agtgtatggaaataaatgtat

SEQ ID NO: 3817036 - DNA, 14 bp, Homo sapiens
agtgtatttggaaa

SEQ ID NO: 3817037 - DNA, 21 bp, Homo sapiens
agtgtccagaccattgtcttc

SEQ ID NO: 3817038 - DNA, 19 bp, Homo sapiens
agtgtcttcctagtatatt

SEQ ID NO: 3817039 - DNA, 21 bp, Homo sapiens
agtgtgcctgaagtcccagat

SEQ ID NO: 3817040 - DNA, 15 bp, Homo sapiens
agtgtgggtctgtgt

SEQ ID NO: 3817041 - DNA, 17 bp, Homo sapiens
agtgtgggtctgtgtgt

SEQ ID NO: 3817042 - DNA, 23 bp, Homo sapiens
agtgtgggtctgtgtgtgtgtat

SEQ ID NO: 3817043 - DNA, 20 bp, Homo sapiens
agttacatggtaattatgtg

SEQ ID NO: 3817044 - DNA, 21 bp, Homo sapiens
agttacctactttttctttga

SEQ ID NO: 3817045 - DNA, 21 bp, Homo sapiens
agttatttatttattggagat

SEQ ID NO: 3817046 - DNA, 14 bp, Homo sapiens
agttcaagaccagc

SEQ ID NO: 3817047 - DNA, 20 bp, Homo sapiens
agttcaagaccagcctggcc

SEQ ID NO: 3817048 - DNA, 18 bp, Homo sapiens
agttcccatggtgtatgt

SEQ ID NO: 3817049 - DNA, 19 bp, Homo sapiens
agttcccatggtgtatgtg

SEQ ID NO: 3817050 - DNA, 20 bp, Homo sapiens
agttcccatggtgtatgtgg

SEQ ID NO: 3817051 - DNA, 21 bp, Homo sapiens
agttcccatggtgtatgtggt

SEQ ID NO: 3817052 - DNA, 13 bp, Homo sapiens
agttctgccagga

SEQ ID NO: 3817053 - DNA, 20 bp, Homo sapiens
agttctgccaggagacaggt

SEQ ID NO: 3817054 - DNA, 18 bp, Homo sapiens
agttgaaaaacagctgag

SEQ ID NO: 3817055 - DNA, 13 bp, Homo sapiens
agtttagggtggg

SEQ ID NO: 3817056 - DNA, 20 bp, Homo sapiens
agtttatttttttgatggct

SEQ ID NO: 3817057 - DNA, 22 bp, Homo sapiens
agtttatttttttgatggctaa

SEQ ID NO: 3817058 - DNA, 14 bp, Homo sapiens
agttttaaaagtct

SEQ ID NO: 3817059 - DNA, 14 bp, Homo sapiens
ataaaataatttta

SEQ ID NO: 3817060 - DNA, 16 bp, Homo sapiens
ataaaatattcatata

SEQ ID NO: 3817061 - DNA, 15 bp, Homo sapiens
ataaaatgaccagta

SEQ ID NO: 3817062 - DNA, 18 bp, Homo sapiens
ataaactccttaacttca

SEQ ID NO: 3817063 - DNA, 14 bp, Homo sapiens
ataaagcagagcca

SEQ ID NO: 3817064 - DNA, 19 bp, Homo sapiens
ataaagcagagccaaggcc

SEQ ID NO: 3817065 - DNA, 15 bp, Homo sapiens
ataaagtatgccttc

SEQ ID NO: 3817066 - DNA, 14 bp, Homo sapiens
ataaatgctgaatg

SEQ ID NO: 3817067 - DNA, 18 bp, Homo sapiens
ataaatgctgaatgaatc

SEQ ID NO: 3817068 - DNA, 13 bp, Homo sapiens
ataaatgtatcat

SEQ ID NO: 3817069 - DNA, 17 bp, Homo sapiens
ataaatgtatcatagaa

SEQ ID NO: 3817070 - DNA, 13 bp, Homo sapiens
ataaatttctgct

SEQ ID NO: 3817071 - DNA, 20 bp, Homo sapiens
ataacatgtatcactcactg

SEQ ID NO: 3817072 - DNA, 13 bp, Homo sapiens
ataagtaatgaaa

SEQ ID NO: 3817073 - DNA, 14 bp, Homo sapiens
ataataaacttctg

SEQ ID NO: 3817074 - DNA, 12 bp, Homo sapiens
ataatagggaaa

SEQ ID NO: 3817075 - DNA, 18 bp, Homo sapiens
ataatcacaacccttcag

SEQ ID NO: 3817076 - DNA, 18 bp, Homo sapiens
ataatgaggagtttatga

SEQ ID NO: 3817077 - DNA, 11 bp, Homo sapiens
atacaattaaa

SEQ ID NO: 3817078 - DNA, 16 bp, Homo sapiens
atacaattaaaggtcc

SEQ ID NO: 3817079 - DNA, 16 bp, Homo sapiens
atacacatggatgcac

SEQ ID NO: 3817080 - DNA, 17 bp, Homo sapiens
atacagaggcaactgca

SEQ ID NO: 3817081 - DNA, 15 bp, Homo sapiens
atacattgaattaga

SEQ ID NO: 3817082 - DNA, 19 bp, Homo sapiens
atacattgaattagaaaca

SEQ ID NO: 3817083 - DNA, 20 bp, Homo sapiens
atagaaaagatgagaggcag

SEQ ID NO: 3817084 - DNA, 14 bp, Homo sapiens
atagagaataaggc

SEQ ID NO: 3817085 - DNA, 17 bp, Homo sapiens
atagatgagaaaactga

SEQ ID NO: 3817086 - DNA, 11 bp, Homo sapiens
atagatgtgtg

SEQ ID NO: 3817087 - DNA, 13 bp, Homo sapiens
caattatgtttct

SEQ ID NO: 3817088 - DNA, 18 bp, Homo sapiens
caattcatgtagtttctg

SEQ ID NO: 3817089 - DNA, 19 bp, Homo sapiens
caattgactgtcactgttc

SEQ ID NO: 3817090 - DNA, 23 bp, Homo sapiens
caatttctattatttttcaagta

SEQ ID NO: 3817091 - DNA, 20 bp, Homo sapiens
caattttctggaatacatga

SEQ ID NO: 3817092 - DNA, 15 bp, Homo sapiens
cacaaaccatgcaaa

SEQ ID NO: 3817093 - DNA, 13 bp, Homo sapiens
cacaaatatttat

SEQ ID NO: 3817094 - DNA, 23 bp, Homo sapiens
cacaagctgcaccctcaggcagg

SEQ ID NO: 3817095 - DNA, 18 bp, Homo sapiens
cacaaggctgaccaagag

SEQ ID NO: 3817096 - DNA, 21 bp, Homo sapiens
cacaatcctccaagaatttga

SEQ ID NO: 3817097 - DNA, 14 bp, Homo sapiens
cacacacagaggaa

SEQ ID NO: 3817098 - DNA, 23 bp, Homo sapiens
cacacacagaggaagagcaggca

SEQ ID NO: 3817099 - DNA, 14 bp, Homo sapiens
cacacacagatatg

SEQ ID NO: 3817100 - DNA, 19 bp, Homo sapiens
cacacacagatatgcacac

SEQ ID NO: 3817101 - DNA, 16 bp, Homo sapiens
cacacagagatatgca

SEQ ID NO: 3817102 - DNA, 22 bp, Homo sapiens
cacacagaggaagagcaggcac

SEQ ID NO: 3817103 - DNA, 18 bp, Homo sapiens
cacacagatgcacacaca

SEQ ID NO: 3817104 - DNA, 18 bp, Homo sapiens
cacacagatggtcacaca

SEQ ID NO: 3817105 - DNA, 15 bp, Homo sapiens
cacacatggatgcac

SEQ ID NO: 3817106 - DNA, 17 bp, Homo sapiens
cacaccattctcctgcc

SEQ ID NO: 3817107 - DNA, 18 bp, Homo sapiens
cacaccattctcctgcct

SEQ ID NO: 3817108 - DNA, 17 bp, Homo sapiens
cacacctccctgaacca

SEQ ID NO: 3817109 - DNA, 16 bp, Homo sapiens
cacagagatatgcaca

SEQ ID NO: 3817110 - DNA, 15 bp, Homo sapiens
cacagaggaagagca

SEQ ID NO: 3817111 - DNA, 16 bp, Homo sapiens
cacagaggaagagcag

SEQ ID NO: 3817112 - DNA, 14 bp, Homo sapiens
cacagatatgcaca

SEQ ID NO: 3817113 - DNA, 22 bp, Homo sapiens
cacagatatgcacacacatgga

SEQ ID NO: 3817114 - DNA, 20 bp, Homo sapiens
cacagatgcacacacagatg

SEQ ID NO: 3817115 - DNA, 16 bp, Homo sapiens
cacagatggtcacaca

SEQ ID NO: 3817116 - DNA, 20 bp, Homo sapiens
cacagatggtcacacagaga

SEQ ID NO: 3817117 - DNA, 16 bp, Homo sapiens
cacagcaattcctcag

SEQ ID NO: 3817118 - DNA, 17 bp, Homo sapiens
cacagcatctctatgaa

SEQ ID NO: 3817119 - DNA, 13 bp, Homo sapiens
cacagcctctccc

SEQ ID NO: 3817120 - DNA, 21 bp, Homo sapiens
cacagcctgggaccagggcat

SEQ ID NO: 3817121 - DNA, 14 bp, Homo sapiens
cacagcgcctcctg

SEQ ID NO: 3817122 - DNA, 15 bp, Homo sapiens
cacagcgcctcctgg

SEQ ID NO: 3817123 - DNA, 21 bp, Homo sapiens
cacagctctccggtctctctc

SEQ ID NO: 3817124 - DNA, 13 bp, Homo sapiens
cacagggagctgg

SEQ ID NO: 3817125 - DNA, 22 bp, Homo sapiens
cacagggccccagaaggcaggg

SEQ ID NO: 3817126 - DNA, 23 bp, Homo sapiens
cacaggggcaaagaactgcccca

SEQ ID NO: 3817127 - DNA, 15 bp, Homo sapiens
cacaggtcttgccca

SEQ ID NO: 3817128 - DNA, 16 bp, Homo sapiens
cacagtcctcacagcc

SEQ ID NO: 3817129 - DNA, 17 bp, Homo sapiens
cacagtgtttcctgagt

SEQ ID NO: 3817130 - DNA, 10 bp, Homo sapiens
cacataaagg

SEQ ID NO: 3817131 - DNA, 18 bp, Homo sapiens
cacatagagatatgcaca

SEQ ID NO: 3817132 - DNA, 20 bp, Homo sapiens
cacatataaaagttaaacta

SEQ ID NO: 3817133 - DNA, 15 bp, Homo sapiens
cacatatatgtatat

SEQ ID NO: 3817134 - DNA, 14 bp, Homo sapiens
cacatgattttctt

SEQ ID NO: 3817135 - DNA, 12 bp, Homo sapiens
cacatgtccagt

SEQ ID NO: 3817136 - DNA, 14 bp, Homo sapiens
cacattgcctcatt

SEQ ID NO: 3817137 - DNA, 21 bp, Homo sapiens
caccagatgggatgggctttc

SEQ ID NO: 3817138 - DNA, 20 bp, Homo sapiens
caccagccctgctgcttcct

SEQ ID NO: 3817139 - DNA, 18 bp, Homo sapiens
caccagccgccccagccc

SEQ ID NO: 3817140 - DNA, 22 bp, Homo sapiens
cacccaaagaggtatttatctt

SEQ ID NO: 3817141 - DNA, 15 bp, Homo sapiens
caccccccaagctgt

SEQ ID NO: 3817142 - DNA, 22 bp, Homo sapiens
cacccgacaccagccctgctgc

SEQ ID NO: 3817143 - DNA, 14 bp, Homo sapiens
caccctcaggcagg

SEQ ID NO: 3817144 - DNA, 19 bp, Homo sapiens
caccgcgcccagccaagaa

SEQ ID NO: 3817145 - DNA, 22 bp, Homo sapiens
caccggagctttcaaagaagga

SEQ ID NO: 3817146 - DNA, 18 bp, Homo sapiens
cacctaggctagggtggg

SEQ ID NO: 3817147 - DNA, 11 bp, Homo sapiens
cacctcccagg

SEQ ID NO: 3817148 - DNA, 19 bp, Homo sapiens
cacctccctgaaccatccc

SEQ ID NO: 3817149 - DNA, 19 bp, Homo sapiens
cacctcgttactctcacct

SEQ ID NO: 3817150 - DNA, 22 bp, Homo sapiens
cacctctcaatattcaataaag

SEQ ID NO: 3817151 - DNA, 18 bp, Homo sapiens
cacctctccaagtctctc

SEQ ID NO: 3817152 - DNA, 12 bp, Homo sapiens
cacctgccctgc

SEQ ID NO: 3817153 - DNA, 13 bp, Homo sapiens
cacctgccctgcc

SEQ ID NO: 3817154 - DNA, 22 bp, Homo sapiens
cacctgccctgccctgccacct

SEQ ID NO: 3817155 - DNA, 20 bp, Homo sapiens
cacctggtactgcacatttt

SEQ ID NO: 3817156 - DNA, 13 bp, Homo sapiens
cacctgtctgtct

SEQ ID NO: 3817157 - DNA, 17 bp, Homo sapiens
cacctgtggtgcctgcc

SEQ ID NO: 3817158 - DNA, 16 bp, Homo sapiens
cacgactgcccggcag

SEQ ID NO: 3817159 - DNA, 13 bp, Homo sapiens
cacgatctcagct

SEQ ID NO: 3817160 - DNA, 16 bp, Homo sapiens
cacgatctcagctcac

SEQ ID NO: 3817161 - DNA, 22 bp, Homo sapiens
cacgcacatgccaatgcacgca

SEQ ID NO: 3817162 - DNA, 20 bp, Homo sapiens
cacggaaaatgccaatctct

SEQ ID NO: 3817163 - DNA, 21 bp, Homo sapiens
cacggaggcatctgcaccctc

SEQ ID NO: 3817164 - DNA, 16 bp, Homo sapiens
cacggatgcacagaga

SEQ ID NO: 3817165 - DNA, 20 bp, Homo sapiens
cacggctgcctgacactgag

SEQ ID NO: 3817166 - DNA, 23 bp, Homo sapiens
cacggctgcctgacactgagccc

SEQ ID NO: 3817167 - DNA, 18 bp, Homo sapiens
cactaagctttctccttt

SEQ ID NO: 3817168 - DNA, 19 bp, Homo sapiens
cactaagctttctcctttg

SEQ ID NO: 3817169 - DNA, 17 bp, Homo sapiens
cactcaaaagctgggca

SEQ ID NO: 3817170 - DNA, 21 bp, Homo sapiens
cactcaaggaaaagatgtgct

SEQ ID NO: 3817171 - DNA, 14 bp, Homo sapiens
cactcagcagcccc

SEQ ID NO: 3817172 - DNA, 20 bp, Homo sapiens
cactcagcagccccctgccc

SEQ ID NO: 3817173 - DNA, 23 bp, Homo sapiens
cactcaggatgtcctttgtgtcc

SEQ ID NO: 3817174 - DNA, 16 bp, Homo sapiens
cactcatgtgactctt

SEQ ID NO: 3817175 - DNA, 16 bp, Homo sapiens
cactccagcctgggcg

SEQ ID NO: 3817176 - DNA, 12 bp, Homo sapiens
cactctgttcct

SEQ ID NO: 3817177 - DNA, 17 bp, Homo sapiens
cactctttgctacaata

SEQ ID NO: 3817178 - DNA, 19 bp, Homo sapiens
cactctttgctacaataaa

SEQ ID NO: 3817179 - DNA, 22 bp, Homo sapiens
cactctttgctacaataaatgc

SEQ ID NO: 3817180 - DNA, 15 bp, Homo sapiens
cactgcactccagcc

SEQ ID NO: 3817181 - DNA, 16 bp, Homo sapiens
cactgcactccagcct

SEQ ID NO: 3817182 - DNA, 19 bp, Homo sapiens
cactgcactccagcctggg

SEQ ID NO: 3817183 - DNA, 15 bp, Homo sapiens
cactgccgcctcctt

SEQ ID NO: 3817184 - DNA, 14 bp, Homo sapiens
cactggccagtcct

SEQ ID NO: 3817185 - DNA, 15 bp, Homo sapiens
cactggccagtccta

SEQ ID NO: 3817186 - DNA, 14 bp, Homo sapiens
cactggccccaccc

SEQ ID NO: 3817187 - DNA, 16 bp, Homo sapiens
cactggccccaccctc

SEQ ID NO: 3817188 - DNA, 19 bp, Homo sapiens
cactggggcaggggccggg

SEQ ID NO: 3817189 - DNA, 19 bp, Homo sapiens
cactggtgggcagctgagg

SEQ ID NO: 3817190 - DNA, 18 bp, Homo sapiens
cactgtagaatgatttca

SEQ ID NO: 3817191 - DNA, 20 bp, Homo sapiens
cacttattccccattcttcc

SEQ ID NO: 3817192 - DNA, 23 bp, Homo sapiens
cacttccctgcttttctcccaga

SEQ ID NO: 3817193 - DNA, 22 bp, Homo sapiens
cactttccccgtgggccatggc

SEQ ID NO: 3817194 - DNA, 13 bp, Homo sapiens
cactttgggaggc

SEQ ID NO: 3817195 - DNA, 21 bp, Homo sapiens
ccatctcctcccaccagtggc

SEQ ID NO: 3817196 - DNA, 12 bp, Homo sapiens
ccatgaagctgg

SEQ ID NO: 3817197 - DNA, 18 bp, Homo sapiens
ccatgaagctggaagcac

SEQ ID NO: 3817198 - DNA, 21 bp, Homo sapiens
ccatgcaccctcatacacaga

SEQ ID NO: 3817199 - DNA, 18 bp, Homo sapiens
ccatgctcctggcccact

SEQ ID NO: 3817200 - DNA, 17 bp, Homo sapiens
ccatgggcgaccagggc

SEQ ID NO: 3817201 - DNA, 20 bp, Homo sapiens
ccattctgcctccattctga

SEQ ID NO: 3817202 - DNA, 12 bp, Homo sapiens
ccattctttccc

SEQ ID NO: 3817203 - DNA, 17 bp, Homo sapiens
ccattgctcacactact

SEQ ID NO: 3817204 - DNA, 15 bp, Homo sapiens
ccattgtcttccaac

SEQ ID NO: 3817205 - DNA, 20 bp, Homo sapiens
ccattgtcttccaaccccag

SEQ ID NO: 3817206 - DNA, 16 bp, Homo sapiens
ccatttgctttttcac

SEQ ID NO: 3817207 - DNA, 19 bp, Homo sapiens
cccaaacccaagtgccttc

SEQ ID NO: 3817208 - DNA, 15 bp, Homo sapiens
cccaacactgccagc

SEQ ID NO: 3817209 - DNA, 19 bp, Homo sapiens
cccaacgaaaagcacatcc

SEQ ID NO: 3817210 - DNA, 16 bp, Homo sapiens
cccaactccgcccagc

SEQ ID NO: 3817211 - DNA, 17 bp, Homo sapiens
cccaagagatgaagagt

SEQ ID NO: 3817212 - DNA, 19 bp, Homo sapiens
cccaagctgttttcttcta

SEQ ID NO: 3817213 - DNA, 14 bp, Homo sapiens
cccaagtagctgag

SEQ ID NO: 3817214 - DNA, 22 bp, Homo sapiens
cccaagtagtagtgtcttccta

SEQ ID NO: 3817215 - DNA, 21 bp, Homo sapiens
cccacaaaggagagctagcag

SEQ ID NO: 3817216 - DNA, 22 bp, Homo sapiens
cccacaccccagcccaccctgc

SEQ ID NO: 3817217 - DNA, 23 bp, Homo sapiens
cccacacggaggcatctgcaccc

SEQ ID NO: 3817218 - DNA, 19 bp, Homo sapiens
cccaccatgcacccctgat

SEQ ID NO: 3817219 - DNA, 18 bp, Homo sapiens
cccaccctgaaagccctg

SEQ ID NO: 3817220 - DNA, 16 bp, Homo sapiens
cccacctccgctggga

SEQ ID NO: 3817221 - DNA, 15 bp, Homo sapiens
cccacggctcctcga

SEQ ID NO: 3817222 - DNA, 19 bp, Homo sapiens
cccactaagctttctcctt

SEQ ID NO: 3817223 - DNA, 22 bp, Homo sapiens
cccactaagctttctcctttga

SEQ ID NO: 3817224 - DNA, 23 bp, Homo sapiens
cccactctttgctacaataaatg

SEQ ID NO: 3817225 - DNA, 13 bp, Homo sapiens
cccactggccagt

SEQ ID NO: 3817226 - DNA, 21 bp, Homo sapiens
cccactggccagtcctagagc

SEQ ID NO: 3817227 - DNA, 13 bp, Homo sapiens
cccagaaggctgg

SEQ ID NO: 3817228 - DNA, 19 bp, Homo sapiens
cccagagagacgctgtgat

SEQ ID NO: 3817229 - DNA, 18 bp, Homo sapiens
cccagagagagctctgca

SEQ ID NO: 3817230 - DNA, 18 bp, Homo sapiens
cccagagccactaccttt

SEQ ID NO: 3817231 - DNA, 22 bp, Homo sapiens
cccagattgataagtaatgaaa

SEQ ID NO: 3817232 - DNA, 16 bp, Homo sapiens
cccagcccaaagctgt

SEQ ID NO: 3817233 - DNA, 16 bp, Homo sapiens
cccagcccaccctgct

SEQ ID NO: 3817234 - DNA, 20 bp, Homo sapiens
cccagcccaccctgctcctc

SEQ ID NO: 3817235 - DNA, 23 bp, Homo sapiens
cccagcccaccctgctcctcctg

SEQ ID NO: 3817236 - DNA, 22 bp, Homo sapiens
cccagccccttctcccagcaca

SEQ ID NO: 3817237 - DNA, 14 bp, Homo sapiens
cccagcctcccagc

SEQ ID NO: 3817238 - DNA, 12 bp, Homo sapiens
cccagcctgccc

SEQ ID NO: 3817239 - DNA, 20 bp, Homo sapiens
cccagcctgccccagcctcc

SEQ ID NO: 3817240 - DNA, 14 bp, Homo sapiens
cccagctggcctct

SEQ ID NO: 3817241 - DNA, 15 bp, Homo sapiens
cccaggaactgggcc

SEQ ID NO: 3817242 - DNA, 16 bp, Homo sapiens
cccaggattcccagag

SEQ ID NO: 3817243 - DNA, 13 bp, Homo sapiens
cccaggtcctcac

SEQ ID NO: 3817244 - DNA, 15 bp, Homo sapiens
cccagtgccgagaag

SEQ ID NO: 3817245 - DNA, 14 bp, Homo sapiens
cccagttagctctc

SEQ ID NO: 3817246 - DNA, 13 bp, Homo sapiens
cccatctcctccc

SEQ ID NO: 3817247 - DNA, 16 bp, Homo sapiens
cccatggtgtatgtgg

SEQ ID NO: 3817248 - DNA, 20 bp, Homo sapiens
cccattcttcctagttttct

SEQ ID NO: 3817249 - DNA, 21 bp, Homo sapiens
ccccaagatgagctgcagccc

SEQ ID NO: 3817250 - DNA, 15 bp, Homo sapiens
ccccacaccccagcc

SEQ ID NO: 3817251 - DNA, 12 bp, Homo sapiens
ccccacagtcct

SEQ ID NO: 3817252 - DNA, 22 bp, Homo sapiens
ccccaccctcgtggacacctgc

SEQ ID NO: 3817253 - DNA, 23 bp, Homo sapiens
ccccaccctcgtggacacctgcc

SEQ ID NO: 3817254 - DNA, 14 bp, Homo sapiens
ccccacctctccaa

SEQ ID NO: 3817255 - DNA, 16 bp, Homo sapiens
ccccactcacagggag

SEQ ID NO: 3817256 - DNA, 21 bp, Homo sapiens
ccccagagccactacctttgt

SEQ ID NO: 3817257 - DNA, 23 bp, Homo sapiens
ccccattcttcctagttttctcc

SEQ ID NO: 3817258 - DNA, 18 bp, Homo sapiens
cccccaggattcccagag

SEQ ID NO: 3817259 - DNA, 19 bp, Homo sapiens
cccccaggattcccagaga

SEQ ID NO: 3817260 - DNA, 20 bp, Homo sapiens
ccccctgtagcagcattaca

SEQ ID NO: 3817261 - DNA, 14 bp, Homo sapiens
ccccggcttgcctg

SEQ ID NO: 3817262 - DNA, 14 bp, Homo sapiens
cccctgtgccttgt

SEQ ID NO: 3817263 - DNA, 15 bp, Homo sapiens
cccgacaccagccct

SEQ ID NO: 3817264 - DNA, 23 bp, Homo sapiens
cccggcttgcctgtaatcccagc

SEQ ID NO: 3817265 - DNA, 12 bp, Homo sapiens
ccctacccactc

SEQ ID NO: 3817266 - DNA, 18 bp, Homo sapiens
ccctacccactctttgct

SEQ ID NO: 3817267 - DNA, 19 bp, Homo sapiens
ccctccaaacactgggctc

SEQ ID NO: 3817268 - DNA, 23 bp, Homo sapiens
ccctcccaacagagctgggctac

SEQ ID NO: 3817269 - DNA, 18 bp, Homo sapiens
ccctccccacagtcctca

SEQ ID NO: 3817270 - DNA, 13 bp, Homo sapiens
ccctccccagccc

SEQ ID NO: 3817271 - DNA, 18 bp, Homo sapiens
ccctcccctcccagtcct

SEQ ID NO: 3817272 - DNA, 21 bp, Homo sapiens
ccctcctgctgcctaataaag

SEQ ID NO: 3817273 - DNA, 17 bp, Homo sapiens
ccctcgtggacacctgc

SEQ ID NO: 3817274 - DNA, 19 bp, Homo sapiens
ccctcgtggacacctgccc

SEQ ID NO: 3817275 - DNA, 15 bp, Homo sapiens
ccctgaaagccctga

SEQ ID NO: 3817276 - DNA, 17 bp, Homo sapiens
ccctgaccttctccagg

SEQ ID NO: 3817277 - DNA, 15 bp, Homo sapiens
ccctgccacctgtct

SEQ ID NO: 3817278 - DNA, 16 bp, Homo sapiens
ccctgccacctgtctg

SEQ ID NO: 3817279 - DNA, 17 bp, Homo sapiens
ccctgccacctgtctgt

SEQ ID NO: 3817280 - DNA, 16 bp, Homo sapiens
ccctgcccaagggcct

SEQ ID NO: 3817281 - DNA, 22 bp, Homo sapiens
ccctgcccaagggcctcccacc

SEQ ID NO: 3817282 - DNA, 18 bp, Homo sapiens
ccctgccctgccacctgt

SEQ ID NO: 3817283 - DNA, 17 bp, Homo sapiens
ccctgctcccacagaac

SEQ ID NO: 3817284 - DNA, 14 bp, Homo sapiens
ccctgctcctcctg

SEQ ID NO: 3817285 - DNA, 19 bp, Homo sapiens
ccctgctcctcctgccctg

SEQ ID NO: 3817286 - DNA, 15 bp, Homo sapiens
ccctggcctgtggag

SEQ ID NO: 3817287 - DNA, 22 bp, Homo sapiens
ccctggcctgtggagagaaagc

SEQ ID NO: 3817288 - DNA, 12 bp, Homo sapiens
ccctgggcctca

SEQ ID NO: 3817289 - DNA, 23 bp, Homo sapiens
ccctgggcctcagcctccaggca

SEQ ID NO: 3817290 - DNA, 13 bp, Homo sapiens
ccctggggcccca

SEQ ID NO: 3817291 - DNA, 21 bp, Homo sapiens
ccctggtgcactggccccacc

SEQ ID NO: 3817292 - DNA, 21 bp, Homo sapiens
ccctgtccccctcccctccca

SEQ ID NO: 3817293 - DNA, 22 bp, Homo sapiens
ccctgtccccctcccctcccag

SEQ ID NO: 3817294 - DNA, 23 bp, Homo sapiens
ccctgtctcaaaaaaagaaaaag

SEQ ID NO: 3817295 - DNA, 18 bp, Homo sapiens
ccctgtgactatggctct

SEQ ID NO: 3817296 - DNA, 22 bp, Homo sapiens
ccctgtgccttgtcacgccaga

SEQ ID NO: 3817297 - DNA, 12 bp, Homo sapiens
cccttattttca

SEQ ID NO: 3817298 - DNA, 13 bp, Homo sapiens
ccgacttttctaa

SEQ ID NO: 3817299 - DNA, 19 bp, Homo sapiens
ccgagctttgaaaattcag

SEQ ID NO: 3817300 - DNA, 13 bp, Homo sapiens
ccgcccagcctct

SEQ ID NO: 3817301 - DNA, 15 bp, Homo sapiens
ccggagctttcaaag

SEQ ID NO: 3817302 - DNA, 23 bp, Homo sapiens
ccggctgggtcggccctgcccaa

SEQ ID NO: 3817303 - DNA, 16 bp, Homo sapiens
ctggtgggcagctgag

SEQ ID NO: 3817304 - DNA, 19 bp, Homo sapiens
ctggtggtaccattattat

SEQ ID NO: 3817305 - DNA, 22 bp, Homo sapiens
ctggtggtggctcgggaggcga

SEQ ID NO: 3817306 - DNA, 18 bp, Homo sapiens
ctgtagagacttccgtca

SEQ ID NO: 3817307 - DNA, 12 bp, Homo sapiens
ctgtatattctc

SEQ ID NO: 3817308 - DNA, 20 bp, Homo sapiens
ctgtcaaagaaaacttccaa

SEQ ID NO: 3817309 - DNA, 14 bp, Homo sapiens
ctgtccagtttcca

SEQ ID NO: 3817310 - DNA, 14 bp, Homo sapiens
ctgtccctacccac

SEQ ID NO: 3817311 - DNA, 15 bp, Homo sapiens
ctgtccctacccact

SEQ ID NO: 3817312 - DNA, 17 bp, Homo sapiens
ctgtccctacccactct

SEQ ID NO: 3817313 - DNA, 18 bp, Homo sapiens
ctgtccctacccactctt

SEQ ID NO: 3817314 - DNA, 23 bp, Homo sapiens
ctgtccctacccactctttgcta

SEQ ID NO: 3817315 - DNA, 18 bp, Homo sapiens
ctgtccctgtccccctcc

SEQ ID NO: 3817316 - DNA, 15 bp, Homo sapiens
ctgtccgagctttga

SEQ ID NO: 3817317 - DNA, 14 bp, Homo sapiens
ctgtctgtctgtct

SEQ ID NO: 3817318 - DNA, 16 bp, Homo sapiens
ctgtcttttgaagaag

SEQ ID NO: 3817319 - DNA, 18 bp, Homo sapiens
ctgtgaatacaattaaag

SEQ ID NO: 3817320 - DNA, 21 bp, Homo sapiens
ctgtgaatacaattaaaggtc

SEQ ID NO: 3817321 - DNA, 18 bp, Homo sapiens
ctgtgcctttgggaggca

SEQ ID NO: 3817322 - DNA, 14 bp, Homo sapiens
ctgtggagagaaag

SEQ ID NO: 3817323 - DNA, 15 bp, Homo sapiens
ctgtgtccctctctc

SEQ ID NO: 3817324 - DNA, 16 bp, Homo sapiens
ctgtgtccctctctct

SEQ ID NO: 3817325 - DNA, 19 bp, Homo sapiens
ctgtgtccctctctctgga

SEQ ID NO: 3817326 - DNA, 20 bp, Homo sapiens
ctgtgtccctctctctggaa

SEQ ID NO: 3817327 - DNA, 14 bp, Homo sapiens
ctgtgtgtgtgtat

SEQ ID NO: 3817328 - DNA, 16 bp, Homo sapiens
ctgtgtgtgtgtatgt

SEQ ID NO: 3817329 - DNA, 16 bp, Homo sapiens
ctgtgtgtttatgtgt

SEQ ID NO: 3817330 - DNA, 15 bp, Homo sapiens
ctgttaataaacagc

SEQ ID NO: 3817331 - DNA, 17 bp, Homo sapiens
ctgttactgtcttcagt

SEQ ID NO: 3817332 - DNA, 21 bp, Homo sapiens
ctgttcagctggttgaggttt

SEQ ID NO: 3817333 - DNA, 21 bp, Homo sapiens
ctgttcctggctcagcctcaa

SEQ ID NO: 3817334 - DNA, 17 bp, Homo sapiens
ctgttctaactcttaga

SEQ ID NO: 3817335 - DNA, 13 bp, Homo sapiens
ctgttctccagat

SEQ ID NO: 3817336 - DNA, 18 bp, Homo sapiens
ctgtttaaaaaaagtata

SEQ ID NO: 3817337 - DNA, 19 bp, Homo sapiens
ctgtttaaaaaaagtatat

SEQ ID NO: 3817338 - DNA, 22 bp, Homo sapiens
ctgtttaaaaaaagtatatatt

SEQ ID NO: 3817339 - DNA, 23 bp, Homo sapiens
ctgtttaaaaaaagtatatattc

SEQ ID NO: 3817340 - DNA, 13 bp, Homo sapiens
ctgttttctcttg

SEQ ID NO: 3817341 - DNA, 17 bp, Homo sapiens
ctgttttctcttgagag

SEQ ID NO: 3817342 - DNA, 12 bp, Homo sapiens
ctgttttcttct

SEQ ID NO: 3817343 - DNA, 18 bp, Homo sapiens
ctgttttcttctattcca

SEQ ID NO: 3817344 - DNA, 16 bp, Homo sapiens
cttaactctgcaggaa

SEQ ID NO: 3817345 - DNA, 22 bp, Homo sapiens
cttaatcaggtcctcagagaat

SEQ ID NO: 3817346 - DNA, 13 bp, Homo sapiens
cttacctcggtgc

SEQ ID NO: 3817347 - DNA, 20 bp, Homo sapiens
cttagaaaaaccaccaccat

SEQ ID NO: 3817348 - DNA, 14 bp, Homo sapiens
cttagccttgctgt

SEQ ID NO: 3817349 - DNA, 20 bp, Homo sapiens
cttagctgaacaatgaatgc

SEQ ID NO: 3817350 - DNA, 17 bp, Homo sapiens
cttagctgtctgctcag

SEQ ID NO: 3817351 - DNA, 23 bp, Homo sapiens
cttaggttggcaaaaaggcagga

SEQ ID NO: 3817352 - DNA, 21 bp, Homo sapiens
cttatgacatcacttgtacaa

SEQ ID NO: 3817353 - DNA, 13 bp, Homo sapiens
cttattgcccagg

SEQ ID NO: 3817354 - DNA, 14 bp, Homo sapiens
cttattttcaagaa

SEQ ID NO: 3817355 - DNA, 15 bp, Homo sapiens
cttattttcaagaaa

SEQ ID NO: 3817356 - DNA, 14 bp, Homo sapiens
cttcacgcctgggt

SEQ ID NO: 3817357 - DNA, 19 bp, Homo sapiens
cttcacgcctgggtgaccc

SEQ ID NO: 3817358 - DNA, 15 bp, Homo sapiens
cttcagcatcctcag

SEQ ID NO: 3817359 - DNA, 15 bp, Homo sapiens
cttcagctgactttt

SEQ ID NO: 3817360 - DNA, 16 bp, Homo sapiens
cttcaggagctgacag

SEQ ID NO: 3817361 - DNA, 15 bp, Homo sapiens
cttcagtaagccgtg

SEQ ID NO: 3817362 - DNA, 23 bp, Homo sapiens
cttcagtaagccgtgattttcat

SEQ ID NO: 3817363 - DNA, 20 bp, Homo sapiens
cttcagtgtatggaaataaa

SEQ ID NO: 3817364 - DNA, 21 bp, Homo sapiens
cttccaaaaagatttattaat

SEQ ID NO: 3817365 - DNA, 18 bp, Homo sapiens
cttccaaccccagctggc

SEQ ID NO: 3817366 - DNA, 19 bp, Homo sapiens
cttccaaccccagctggcc

SEQ ID NO: 3817367 - DNA, 16 bp, Homo sapiens
cttccaagcatgacaa

SEQ ID NO: 3817368 - DNA, 18 bp, Homo sapiens
cttcccaagtagctgaga

SEQ ID NO: 3817369 - DNA, 19 bp, Homo sapiens
cttccctccccacagtcct

SEQ ID NO: 3817370 - DNA, 20 bp, Homo sapiens
cttccctccccacagtcctc

SEQ ID NO: 3817371 - DNA, 21 bp, Homo sapiens
cttccctgcttttctcccaga

SEQ ID NO: 3817372 - DNA, 22 bp, Homo sapiens
cttccctgcttttctcccagaa

SEQ ID NO: 3817373 - DNA, 14 bp, Homo sapiens
cttccctgggcctc

SEQ ID NO: 3817374 - DNA, 15 bp, Homo sapiens
cttccctgggcctca

SEQ ID NO: 3817375 - DNA, 12 bp, Homo sapiens
cttccctggggc

SEQ ID NO: 3817376 - DNA, 15 bp, Homo sapiens
cttccgtattttaat

SEQ ID NO: 3817377 - DNA, 23 bp, Homo sapiens
cttcctaacttattgcctgggca

SEQ ID NO: 3817378 - DNA, 15 bp, Homo sapiens
cttcctagttttctc

SEQ ID NO: 3817379 - DNA, 12 bp, Homo sapiens
cttcctctgcat

SEQ ID NO: 3817380 - DNA, 14 bp, Homo sapiens
cttccttcctctcc

SEQ ID NO: 3817381 - DNA, 19 bp, Homo sapiens
cttctaaaaaaaaacaaaa

SEQ ID NO: 3817382 - DNA, 17 bp, Homo sapiens
cttctacctcttggctg

SEQ ID NO: 3817383 - DNA, 14 bp, Homo sapiens
cttctattttgtaa

SEQ ID NO: 3817384 - DNA, 19 bp, Homo sapiens
cttctcagagcagcactgg

SEQ ID NO: 3817385 - DNA, 23 bp, Homo sapiens
cttctcagagcagcactggggtt

SEQ ID NO: 3817386 - DNA, 19 bp, Homo sapiens
cttctccaacaagttgcct

SEQ ID NO: 3817387 - DNA, 21 bp, Homo sapiens
cttctccaacaagttgcctcc

SEQ ID NO: 3817388 - DNA, 21 bp, Homo sapiens
cttctccagggacagaagcag

SEQ ID NO: 3817389 - DNA, 13 bp, Homo sapiens
cttctcccagcac

SEQ ID NO: 3817390 - DNA, 15 bp, Homo sapiens
cttctcccagcacac

SEQ ID NO: 3817391 - DNA, 14 bp, Homo sapiens
cttctcgacttcag

SEQ ID NO: 3817392 - DNA, 20 bp, Homo sapiens
cttctcgacttcaggagctg

SEQ ID NO: 3817393 - DNA, 20 bp, Homo sapiens
cttctgccatttctgagatc

SEQ ID NO: 3817394 - DNA, 15 bp, Homo sapiens
cttctgcctcagctt

SEQ ID NO: 3817395 - DNA, 18 bp, Homo sapiens
cttctggggtcaggtgcc

SEQ ID NO: 3817396 - DNA, 16 bp, Homo sapiens
cttcttctcggggaca

SEQ ID NO: 3817397 - DNA, 14 bp, Homo sapiens
cttcttttgctctt

SEQ ID NO: 3817398 - DNA, 15 bp, Homo sapiens
cttgagcctgggagg

SEQ ID NO: 3817399 - DNA, 16 bp, Homo sapiens
cttgagcctgggaggt

SEQ ID NO: 3817400 - DNA, 19 bp, Homo sapiens
cttgagttgattcagctct

SEQ ID NO: 3817401 - DNA, 14 bp, Homo sapiens
cttgatatgtaagt

SEQ ID NO: 3817402 - DNA, 14 bp, Homo sapiens
cttgatctcctgag

SEQ ID NO: 3817403 - DNA, 13 bp, Homo sapiens
cttgcctggggcc

SEQ ID NO: 3817404 - DNA, 13 bp, Homo sapiens
cttgctgtagaga

SEQ ID NO: 3817405 - DNA, 16 bp, Homo sapiens
cttgctgtagagactt

SEQ ID NO: 3817406 - DNA, 17 bp, Homo sapiens
cttgctgtattataaga

SEQ ID NO: 3817407 - DNA, 17 bp, Homo sapiens
cttggaaccacagtcat

SEQ ID NO: 3817408 - DNA, 10 bp, Homo sapiens
cttgggaatg

SEQ ID NO: 3817409 - DNA, 18 bp, Homo sapiens
cttgggaatggatcctgg

SEQ ID NO: 3817410 - DNA, 20 bp, Homo sapiens
cttgggccactgtgaagaga

SEQ ID NO: 3817411 - DNA, 16 bp, Homo sapiens
cttggggggctgaggt

SEQ ID NO: 3817412 - DNA, 17 bp, Homo sapiens
gcaatctgtaactgctt

SEQ ID NO: 3817413 - DNA, 13 bp, Homo sapiens
gcacacacacaga

SEQ ID NO: 3817414 - DNA, 21 bp, Homo sapiens
gcacacacaccgatgctgact

SEQ ID NO: 3817415 - DNA, 17 bp, Homo sapiens
gcacacctgtggtgcct

SEQ ID NO: 3817416 - DNA, 13 bp, Homo sapiens
gcacacggatgca

SEQ ID NO: 3817417 - DNA, 19 bp, Homo sapiens
gcacatccaggcaatggcc

SEQ ID NO: 3817418 - DNA, 13 bp, Homo sapiens
gcacatccctgga

SEQ ID NO: 3817419 - DNA, 15 bp, Homo sapiens
gcaccacattgcctc

SEQ ID NO: 3817420 - DNA, 17 bp, Homo sapiens
gcaccacattgcctcat

SEQ ID NO: 3817421 - DNA, 22 bp, Homo sapiens
gcaccactgcactccagcctgg

SEQ ID NO: 3817422 - DNA, 15 bp, Homo sapiens
gcaccagcagcctgg

SEQ ID NO: 3817423 - DNA, 17 bp, Homo sapiens
gcaccctcatacacaga

SEQ ID NO: 3817424 - DNA, 19 bp, Homo sapiens
gcaccggggcctgggcagg

SEQ ID NO: 3817425 - DNA, 17 bp, Homo sapiens
gcacgatctcagctcac

SEQ ID NO: 3817426 - DNA, 19 bp, Homo sapiens
gcacgtgatctgctggcct

SEQ ID NO: 3817427 - DNA, 16 bp, Homo sapiens
gcactccagcctgggc

SEQ ID NO: 3817428 - DNA, 17 bp, Homo sapiens
gcactccagcctgggcg

SEQ ID NO: 3817429 - DNA, 15 bp, Homo sapiens
gcactggccccaccc

SEQ ID NO: 3817430 - DNA, 23 bp, Homo sapiens
gcactggggcaggggccgggggc

SEQ ID NO: 3817431 - DNA, 13 bp, Homo sapiens
gcactgtggcctt

SEQ ID NO: 3817432 - DNA, 21 bp, Homo sapiens
gcagaagccccaactgtgatc

SEQ ID NO: 3817433 - DNA, 17 bp, Homo sapiens
gcagagccaaggccacc

SEQ ID NO: 3817434 - DNA, 20 bp, Homo sapiens
gcagatggatccacgtgctc

SEQ ID NO: 3817435 - DNA, 18 bp, Homo sapiens
gcagatttactgtcccag

SEQ ID NO: 3817436 - DNA, 18 bp, Homo sapiens
gcagcagagcctggaaga

SEQ ID NO: 3817437 - DNA, 19 bp, Homo sapiens
gcagcagggagggcttctg

SEQ ID NO: 3817438 - DNA, 18 bp, Homo sapiens
gcagcccacccctcaaca

SEQ ID NO: 3817439 - DNA, 21 bp, Homo sapiens
gcagccctggcctgtggagag

SEQ ID NO: 3817440 - DNA, 19 bp, Homo sapiens
gcagccgcctcccttatgc

SEQ ID NO: 3817441 - DNA, 16 bp, Homo sapiens
gcagctcaggagacga

SEQ ID NO: 3817442 - DNA, 22 bp, Homo sapiens
gcaggaaatcagagctggcagc

SEQ ID NO: 3817443 - DNA, 12 bp, Homo sapiens
gcaggaggcagg

SEQ ID NO: 3817444 - DNA, 13 bp, Homo sapiens
gcagggaggggac

SEQ ID NO: 3817445 - DNA, 20 bp, Homo sapiens
gcaggggccgggggcagtct

SEQ ID NO: 3817446 - DNA, 23 bp, Homo sapiens
gcagtgaacacactcagcagccc

SEQ ID NO: 3817447 - DNA, 16 bp, Homo sapiens
gcagtgaactgagact

SEQ ID NO: 3817448 - DNA, 13 bp, Homo sapiens
gcatattaaaggc

SEQ ID NO: 3817449 - DNA, 16 bp, Homo sapiens
gcatcaccatgcatgg

SEQ ID NO: 3817450 - DNA, 14 bp, Homo sapiens
gcatcccaggggac

SEQ ID NO: 3817451 - DNA, 15 bp, Homo sapiens
gcatcctcagttcct

SEQ ID NO: 3817452 - DNA, 21 bp, Homo sapiens
gcatcctcagttcctgcagca

SEQ ID NO: 3817453 - DNA, 17 bp, Homo sapiens
gcatcggggagccggga

SEQ ID NO: 3817454 - DNA, 16 bp, Homo sapiens
gcatctccctgacctt

SEQ ID NO: 3817455 - DNA, 17 bp, Homo sapiens
gcatctgagtccagctc

SEQ ID NO: 3817456 - DNA, 19 bp, Homo sapiens
gcatctgagtccagctccc

SEQ ID NO: 3817457 - DNA, 18 bp, Homo sapiens
gcatgggagggagggaga

SEQ ID NO: 3817458 - DNA, 19 bp, Homo sapiens
gcatgggagggagggagag

SEQ ID NO: 3817459 - DNA, 19 bp, Homo sapiens
gcattcacagcgcctcctg

SEQ ID NO: 3817460 - DNA, 20 bp, Homo sapiens
gcattcacagcgcctcctgg

SEQ ID NO: 3817461 - DNA, 17 bp, Homo sapiens
gcattcccggtgcagaa

SEQ ID NO: 3817462 - DNA, 14 bp, Homo sapiens
gcattctagtgcag

SEQ ID NO: 3817463 - DNA, 15 bp, Homo sapiens
gcattctagtgcaga

SEQ ID NO: 3817464 - DNA, 13 bp, Homo sapiens
gcatttgctgaat

SEQ ID NO: 3817465 - DNA, 21 bp, Homo sapiens
gccaaaacaatgcccgtaaga

SEQ ID NO: 3817466 - DNA, 16 bp, Homo sapiens
gccaaagcctcctcca

SEQ ID NO: 3817467 - DNA, 11 bp, Homo sapiens
gccaaggccac

SEQ ID NO: 3817468 - DNA, 12 bp, Homo sapiens
gccaaggccacc

SEQ ID NO: 3817469 - DNA, 15 bp, Homo sapiens
gccaaggctgagagc

SEQ ID NO: 3817470 - DNA, 16 bp, Homo sapiens
gccaaggctgagagct

SEQ ID NO: 3817471 - DNA, 21 bp, Homo sapiens
gccaaggctgggggaagaagc

SEQ ID NO: 3817472 - DNA, 11 bp, Homo sapiens
gccacactggg

SEQ ID NO: 3817473 - DNA, 12 bp, Homo sapiens
gccacactgggc

SEQ ID NO: 3817474 - DNA, 20 bp, Homo sapiens
gccacatagctcataagctg

SEQ ID NO: 3817475 - DNA, 16 bp, Homo sapiens
gccaccgcgcccagcc

SEQ ID NO: 3817476 - DNA, 14 bp, Homo sapiens
gccacctgtctgtc

SEQ ID NO: 3817477 - DNA, 17 bp, Homo sapiens
gccacggcactccagcc

SEQ ID NO: 3817478 - DNA, 16 bp, Homo sapiens
gccactacctttgtcc

SEQ ID NO: 3817479 - DNA, 23 bp, Homo sapiens
gccactctgttcctggctcagcc

SEQ ID NO: 3817480 - DNA, 23 bp, Homo sapiens
gccactgaccgggatccagttcc

SEQ ID NO: 3817481 - DNA, 19 bp, Homo sapiens
gccactgtgaagagaacca

SEQ ID NO: 3817482 - DNA, 17 bp, Homo sapiens
gccagagccttaataaa

SEQ ID NO: 3817483 - DNA, 16 bp, Homo sapiens
gccagaggaaggaaaa

SEQ ID NO: 3817484 - DNA, 22 bp, Homo sapiens
gccagatgcacatccctggaag

SEQ ID NO: 3817485 - DNA, 17 bp, Homo sapiens
gccagccaggactcctt

SEQ ID NO: 3817486 - DNA, 17 bp, Homo sapiens
gccaggactccttagac

SEQ ID NO: 3817487 - DNA, 14 bp, Homo sapiens
gccagtcctagagc

SEQ ID NO: 3817488 - DNA, 14 bp, Homo sapiens
gccagtggctggat

SEQ ID NO: 3817489 - DNA, 15 bp, Homo sapiens
gccatgtcttgttca

SEQ ID NO: 3817490 - DNA, 21 bp, Homo sapiens
gccattgtatttcttcatccc

SEQ ID NO: 3817491 - DNA, 23 bp, Homo sapiens
gcccaccctgctcctcctgccct

SEQ ID NO: 3817492 - DNA, 22 bp, Homo sapiens
gcccagcctctccccgctctgg

SEQ ID NO: 3817493 - DNA, 20 bp, Homo sapiens
gccccaccctcgtggacacc

SEQ ID NO: 3817494 - DNA, 16 bp, Homo sapiens
gccccagccccttctc

SEQ ID NO: 3817495 - DNA, 23 bp, Homo sapiens
gcccccaactccgcccagcctct

SEQ ID NO: 3817496 - DNA, 16 bp, Homo sapiens
gccccggcttgcctgt

SEQ ID NO: 3817497 - DNA, 16 bp, Homo sapiens
gcccctgaacaagaat

SEQ ID NO: 3817498 - DNA, 19 bp, Homo sapiens
gcccgaccccatctcattc

SEQ ID NO: 3817499 - DNA, 20 bp, Homo sapiens
gcccggcccacacccgacac

SEQ ID NO: 3817500 - DNA, 17 bp, Homo sapiens
gcccgggagctcaggaa

SEQ ID NO: 3817501 - DNA, 13 bp, Homo sapiens
gccctgccacctg

SEQ ID NO: 3817502 - DNA, 14 bp, Homo sapiens
gccctgccacctgt

SEQ ID NO: 3817503 - DNA, 16 bp, Homo sapiens
gccctgccacctgtct

SEQ ID NO: 3817504 - DNA, 20 bp, Homo sapiens
gccctgccacctgtctgtct

SEQ ID NO: 3817505 - DNA, 17 bp, Homo sapiens
gccctgccctgccacct

SEQ ID NO: 3817506 - DNA, 15 bp, Homo sapiens
gccctgcccttcagc

SEQ ID NO: 3817507 - DNA, 20 bp, Homo sapiens
gccctgtccctgtccccctc

SEQ ID NO: 3817508 - DNA, 17 bp, Homo sapiens
gcccttagccttgctgt

SEQ ID NO: 3817509 - DNA, 21 bp, Homo sapiens
gcccttcagcatcctcagttc

SEQ ID NO: 3817510 - DNA, 14 bp, Homo sapiens
gccgccccagcccc

SEQ ID NO: 3817511 - DNA, 15 bp, Homo sapiens
gccgccccagcccct

SEQ ID NO: 3817512 - DNA, 17 bp, Homo sapiens
gcctaacctgccgagag

SEQ ID NO: 3817513 - DNA, 12 bp, Homo sapiens
gcctaataaaga

SEQ ID NO: 3817514 - DNA, 17 bp, Homo sapiens
gcctagatccacacaca

SEQ ID NO: 3817515 - DNA, 23 bp, Homo sapiens
gcctagatccacacacagaggaa

SEQ ID NO: 3817516 - DNA, 15 bp, Homo sapiens
gcctcagcctccagg

SEQ ID NO: 3817517 - DNA, 13 bp, Homo sapiens
gcctcagcctcct

SEQ ID NO: 3817518 - DNA, 17 bp, Homo sapiens
gcctcctcacccccagc

SEQ ID NO: 3817519 - DNA, 18 bp, Homo sapiens
gcctcctcacccccagct

SEQ ID NO: 3817520 - DNA, 19 bp, Homo sapiens
gcctcctcacccccagctt

SEQ ID NO: 3817521 - DNA, 17 bp, Homo sapiens
gggcaggttggtggggg

SEQ ID NO: 3817522 - DNA, 17 bp, Homo sapiens
gggcagtctgagagagg

SEQ ID NO: 3817523 - DNA, 20 bp, Homo sapiens
gggcagtctgagagaggcca

SEQ ID NO: 3817524 - DNA, 15 bp, Homo sapiens
gggccatgaactttg

SEQ ID NO: 3817525 - DNA, 22 bp, Homo sapiens
gggccctggtggtggctcggga

SEQ ID NO: 3817526 - DNA, 22 bp, Homo sapiens
gggcctagatccacacacagag

SEQ ID NO: 3817527 - DNA, 12 bp, Homo sapiens
gggcctcagcct

SEQ ID NO: 3817528 - DNA, 16 bp, Homo sapiens
gggcctcccaccagag

SEQ ID NO: 3817529 - DNA, 13 bp, Homo sapiens
gggcctgggcagg

SEQ ID NO: 3817530 - DNA, 15 bp, Homo sapiens
gggcctgggcaggag

SEQ ID NO: 3817531 - DNA, 16 bp, Homo sapiens
gggcgcggtggctcac

SEQ ID NO: 3817532 - DNA, 18 bp, Homo sapiens
gggctcagcaaaagatgc

SEQ ID NO: 3817533 - DNA, 17 bp, Homo sapiens
gggcttccctgggcctc

SEQ ID NO: 3817534 - DNA, 18 bp, Homo sapiens
ggggcagtctgagagagg

SEQ ID NO: 3817535 - DNA, 22 bp, Homo sapiens
ggggcatctgagtccagctccc

SEQ ID NO: 3817536 - DNA, 17 bp, Homo sapiens
gggggatcacagcctct

SEQ ID NO: 3817537 - DNA, 23 bp, Homo sapiens
gggggcatctgagtccagctccc

SEQ ID NO: 3817538 - DNA, 20 bp, Homo sapiens
ggggtcaggtgccactgacc

SEQ ID NO: 3817539 - DNA, 22 bp, Homo sapiens
gggtaactcttggccagagctg

SEQ ID NO: 3817540 - DNA, 23 bp, Homo sapiens
gggtaactcttggccagagctga

SEQ ID NO: 3817541 - DNA, 15 bp, Homo sapiens
gggtagaggagggca

SEQ ID NO: 3817542 - DNA, 21 bp, Homo sapiens
gggtccaggggagggaaaagc

SEQ ID NO: 3817543 - DNA, 16 bp, Homo sapiens
gggtcggccctgccca

SEQ ID NO: 3817544 - DNA, 17 bp, Homo sapiens
gggtgttaaggcagtga

SEQ ID NO: 3817545 - DNA, 21 bp, Homo sapiens
ggtaactcttggccagagctg

SEQ ID NO: 3817546 - DNA, 16 bp, Homo sapiens
ggtaggaactgctggg

SEQ ID NO: 3817547 - DNA, 16 bp, Homo sapiens
ggtagggagctaagga

SEQ ID NO: 3817548 - DNA, 23 bp, Homo sapiens
ggtatgaacttgaggacacatgt

SEQ ID NO: 3817549 - DNA, 13 bp, Homo sapiens
ggtccaacccagc

SEQ ID NO: 3817550 - DNA, 17 bp, Homo sapiens
ggtccaacccagcctga

SEQ ID NO: 3817551 - DNA, 19 bp, Homo sapiens
ggtccaacccagcctgagt

SEQ ID NO: 3817552 - DNA, 18 bp, Homo sapiens
ggtccaggggagggaaaa

SEQ ID NO: 3817553 - DNA, 14 bp, Homo sapiens
ggtcctcagagaat

SEQ ID NO: 3817554 - DNA, 14 bp, Homo sapiens
ggtcctggccctct

SEQ ID NO: 3817555 - DNA, 16 bp, Homo sapiens
ggtctcgaactcctga

SEQ ID NO: 3817556 - DNA, 17 bp, Homo sapiens
ggtctcgaactcctgac

SEQ ID NO: 3817557 - DNA, 21 bp, Homo sapiens
ggtctgtgtgtgtgtatgtgg

SEQ ID NO: 3817558 - DNA, 17 bp, Homo sapiens
ggtcttgatctcctgag

SEQ ID NO: 3817559 - DNA, 17 bp, Homo sapiens
ggtgcagaacaggggca

SEQ ID NO: 3817560 - DNA, 22 bp, Homo sapiens
ggtgcttctagttctgccagga

SEQ ID NO: 3817561 - DNA, 15 bp, Homo sapiens
ggtggaacaagcaca

SEQ ID NO: 3817562 - DNA, 15 bp, Homo sapiens
ggtggtggggaccag

SEQ ID NO: 3817563 - DNA, 21 bp, Homo sapiens
ggtggttatggagagggtgtc

SEQ ID NO: 3817564 - DNA, 21 bp, Homo sapiens
ggttacccagttagctctcaa

SEQ ID NO: 3817565 - DNA, 18 bp, Homo sapiens
ggttggcaaaaaggcagg

SEQ ID NO: 3817566 - DNA, 19 bp, Homo sapiens
ggttgggagaatgtcagta

SEQ ID NO: 3817567 - DNA, 21 bp, Homo sapiens
ggtttgggggcttccctgggc

SEQ ID NO: 3817568 - DNA, 22 bp, Homo sapiens
ggtttgtttagaagaagtgtgt

SEQ ID NO: 3817569 - DNA, 14 bp, Homo sapiens
ggttttggcctgcc

SEQ ID NO: 3817570 - DNA, 23 bp, Homo sapiens
ggtttttgtttgtttcctttgtt

SEQ ID NO: 3817571 - DNA, 15 bp, Homo sapiens
gtaaaaagattatat

SEQ ID NO: 3817572 - DNA, 22 bp, Homo sapiens
gtaaactatcttggtgaatttt

SEQ ID NO: 3817573 - DNA, 18 bp, Homo sapiens
gtaaatagcaacatgctt

SEQ ID NO: 3817574 - DNA, 15 bp, Homo sapiens
gtaactcttggccag

SEQ ID NO: 3817575 - DNA, 16 bp, Homo sapiens
gtaactcttggccaga

SEQ ID NO: 3817576 - DNA, 19 bp, Homo sapiens
gtaactcttggccagagct

SEQ ID NO: 3817577 - DNA, 17 bp, Homo sapiens
gtaacttttgtaagaca

SEQ ID NO: 3817578 - DNA, 13 bp, Homo sapiens
gtaagacatctca

SEQ ID NO: 3817579 - DNA, 23 bp, Homo sapiens
gtaatcccagctattcaggaggc

SEQ ID NO: 3817580 - DNA, 23 bp, Homo sapiens
gtaatcctagcactttgggaggc

SEQ ID NO: 3817581 - DNA, 13 bp, Homo sapiens
gtaatctttaaac

SEQ ID NO: 3817582 - DNA, 22 bp, Homo sapiens
gtaatgaaagtgcactgcagtg

SEQ ID NO: 3817583 - DNA, 19 bp, Homo sapiens
gtaatttaaaattgtgatg

SEQ ID NO: 3817584 - DNA, 12 bp, Homo sapiens
gtacaaaataaa

SEQ ID NO: 3817585 - DNA, 13 bp, Homo sapiens
gtacacacacaga

SEQ ID NO: 3817586 - DNA, 18 bp, Homo sapiens
gtacatagttatttattt

SEQ ID NO: 3817587 - DNA, 18 bp, Homo sapiens
gtactcttgctttttcaa

SEQ ID NO: 3817588 - DNA, 15 bp, Homo sapiens
gtagagtgtgcctga

SEQ ID NO: 3817589 - DNA, 19 bp, Homo sapiens
gtagatttttgctcttctg

SEQ ID NO: 3817590 - DNA, 13 bp, Homo sapiens
gtagcagcattac

SEQ ID NO: 3817591 - DNA, 22 bp, Homo sapiens
gtaggcatgagggatcacaggg

SEQ ID NO: 3817592 - DNA, 17 bp, Homo sapiens
gtagtcgtcaagttgca

SEQ ID NO: 3817593 - DNA, 11 bp, Homo sapiens
gtagtgtcttc

SEQ ID NO: 3817594 - DNA, 21 bp, Homo sapiens
gtagtgtcttcctagtatatt

SEQ ID NO: 3817595 - DNA, 15 bp, Homo sapiens
gtatacctcctatat

SEQ ID NO: 3817596 - DNA, 21 bp, Homo sapiens
gtatatattctacacatatat

SEQ ID NO: 3817597 - DNA, 16 bp, Homo sapiens
gtatatgtatatctat

SEQ ID NO: 3817598 - DNA, 18 bp, Homo sapiens
gtatcaaattatttttaa

SEQ ID NO: 3817599 - DNA, 18 bp, Homo sapiens
gtatcgctgccttgccat

SEQ ID NO: 3817600 - DNA, 15 bp, Homo sapiens
gtatgaacttgagga

SEQ ID NO: 3817601 - DNA, 18 bp, Homo sapiens
gtatgccttcctgtttaa

SEQ ID NO: 3817602 - DNA, 17 bp, Homo sapiens
gtatgtggaagtgtggg

SEQ ID NO: 3817603 - DNA, 21 bp, Homo sapiens
gtattttaagagaaaactgca

SEQ ID NO: 3817604 - DNA, 12 bp, Homo sapiens
gtcaacagtgaa

SEQ ID NO: 3817605 - DNA, 19 bp, Homo sapiens
gtcaagtgaaaaaggagga

SEQ ID NO: 3817606 - DNA, 16 bp, Homo sapiens
gtcaataaagcagagc

SEQ ID NO: 3817607 - DNA, 19 bp, Homo sapiens
gtcaataaagcagagccaa

SEQ ID NO: 3817608 - DNA, 23 bp, Homo sapiens
gtcaataaagcagagccaaggcc

SEQ ID NO: 3817609 - DNA, 13 bp, Homo sapiens
gtcaccacctctc

SEQ ID NO: 3817610 - DNA, 21 bp, Homo sapiens
gtcactggtagaccaaaataa

SEQ ID NO: 3817611 - DNA, 17 bp, Homo sapiens
gtcactgttccttgtca

SEQ ID NO: 3817612 - DNA, 22 bp, Homo sapiens
gtcagctgggacaccccgactt

SEQ ID NO: 3817613 - DNA, 21 bp, Homo sapiens
gtcaggcccttattttcaaga

SEQ ID NO: 3817614 - DNA, 17 bp, Homo sapiens
gtcaggtgccactgacc

SEQ ID NO: 3817615 - DNA, 22 bp, Homo sapiens
gtcatagaaattacacccaaag

SEQ ID NO: 3817616 - DNA, 14 bp, Homo sapiens
gtccaacccagcct

SEQ ID NO: 3817617 - DNA, 16 bp, Homo sapiens
gtccaacccagcctga

SEQ ID NO: 3817618 - DNA, 13 bp, Homo sapiens
gtccaggagcctg

SEQ ID NO: 3817619 - DNA, 21 bp, Homo sapiens
gtcccaagtagtagtgtcttc

SEQ ID NO: 3817620 - DNA, 20 bp, Homo sapiens
gtcccagaatgcctcctgca

SEQ ID NO: 3817621 - DNA, 12 bp, Homo sapiens
gtcccagtgccg

SEQ ID NO: 3817622 - DNA, 20 bp, Homo sapiens
gtccccctcccctcccagtc

SEQ ID NO: 3817623 - DNA, 23 bp, Homo sapiens
gtccccctcccctcccagtcctc

SEQ ID NO: 3817624 - DNA, 22 bp, Homo sapiens
gtcccgggacacctaggctagg

SEQ ID NO: 3817625 - DNA, 23 bp, Homo sapiens
gtccctacccactctttgctaca

SEQ ID NO: 3817626 - DNA, 13 bp, Homo sapiens
gtccctgcctgga

SEQ ID NO: 3817627 - DNA, 14 bp, Homo sapiens
gtccctgcctggac

SEQ ID NO: 3817628 - DNA, 21 bp, Homo sapiens
gtccctgcctggaccagcctc

SEQ ID NO: 3817629 - DNA, 23 bp, Homo sapiens
tccactgcaaagttttctttcca

SEQ ID NO: 3817630 - DNA, 18 bp, Homo sapiens
tccactgccaaaacaatg

SEQ ID NO: 3817631 - DNA, 15 bp, Homo sapiens
tccacttttaaaact

SEQ ID NO: 3817632 - DNA, 22 bp, Homo sapiens
tccagaagtttgagatcagcct

SEQ ID NO: 3817633 - DNA, 15 bp, Homo sapiens
tccagaccattgtct

SEQ ID NO: 3817634 - DNA, 22 bp, Homo sapiens
tccagactgcttccaattttct

SEQ ID NO: 3817635 - DNA, 18 bp, Homo sapiens
tccagagtccctgcctgg

SEQ ID NO: 3817636 - DNA, 23 bp, Homo sapiens
tccagccaaagcctcctccagcc

SEQ ID NO: 3817637 - DNA, 23 bp, Homo sapiens
tccagcctgggcgacagagcaag

SEQ ID NO: 3817638 - DNA, 18 bp, Homo sapiens
tccagctgttacctgaga

SEQ ID NO: 3817639 - DNA, 15 bp, Homo sapiens
tccagcttctcttga

SEQ ID NO: 3817640 - DNA, 14 bp, Homo sapiens
tccaggagcctggc

SEQ ID NO: 3817641 - DNA, 23 bp, Homo sapiens
tccaggagcctggctccgtccag

SEQ ID NO: 3817642 - DNA, 15 bp, Homo sapiens
tccaggagcctgtgc

SEQ ID NO: 3817643 - DNA, 19 bp, Homo sapiens
tccaggtgcctggcccttg

SEQ ID NO: 3817644 - DNA, 23 bp, Homo sapiens
tccagtgggaggtgagaccacct

SEQ ID NO: 3817645 - DNA, 22 bp, Homo sapiens
tccagttcccatggtgtatgtg

SEQ ID NO: 3817646 - DNA, 21 bp, Homo sapiens
tccataaagtaattttgtgaa

SEQ ID NO: 3817647 - DNA, 21 bp, Homo sapiens
tccatgcaccctcatacacag

SEQ ID NO: 3817648 - DNA, 15 bp, Homo sapiens
tcccaacactgccag

SEQ ID NO: 3817649 - DNA, 20 bp, Homo sapiens
tcccacggaaaatgccaatc

SEQ ID NO: 3817650 - DNA, 23 bp, Homo sapiens
tcccacggaaaatgccaatctct

SEQ ID NO: 3817651 - DNA, 20 bp, Homo sapiens
tcccactaagctttctcctt

SEQ ID NO: 3817652 - DNA, 22 bp, Homo sapiens
tcccactaagctttctcctttg

SEQ ID NO: 3817653 - DNA, 12 bp, Homo sapiens
tcccacttgtca

SEQ ID NO: 3817654 - DNA, 16 bp, Homo sapiens
tcccagagcaaaataa

SEQ ID NO: 3817655 - DNA, 15 bp, Homo sapiens
tcccagcccaaagct

SEQ ID NO: 3817656 - DNA, 18 bp, Homo sapiens
tcccagctattcaggagg

SEQ ID NO: 3817657 - DNA, 11 bp, Homo sapiens
tcccaggaact

SEQ ID NO: 3817658 - DNA, 16 bp, Homo sapiens
tcccaggaactgggcc

SEQ ID NO: 3817659 - DNA, 16 bp, Homo sapiens
tcccaggagacagttc

SEQ ID NO: 3817660 - DNA, 17 bp, Homo sapiens
tcccaggggaccacacc

SEQ ID NO: 3817661 - DNA, 15 bp, Homo sapiens
tcccagtcctccaga

SEQ ID NO: 3817662 - DNA, 23 bp, Homo sapiens
tcccatgagctccttaaggctct

SEQ ID NO: 3817663 - DNA, 14 bp, Homo sapiens
tcccatggccttcc

SEQ ID NO: 3817664 - DNA, 16 bp, Homo sapiens
tcccatggccttccct

SEQ ID NO: 3817665 - DNA, 23 bp, Homo sapiens
tccccacagtcctcacagcctct

SEQ ID NO: 3817666 - DNA, 23 bp, Homo sapiens
tccccaccctgaaagccctgagc

SEQ ID NO: 3817667 - DNA, 17 bp, Homo sapiens
tccccattcttcctagt

SEQ ID NO: 3817668 - DNA, 21 bp, Homo sapiens
tccccgcaccccccaagctgt

SEQ ID NO: 3817669 - DNA, 14 bp, Homo sapiens
tccccgctctggat

SEQ ID NO: 3817670 - DNA, 13 bp, Homo sapiens
tcccctcccagtc

SEQ ID NO: 3817671 - DNA, 21 bp, Homo sapiens
tcccggtgcagaacaggggca

SEQ ID NO: 3817672 - DNA, 16 bp, Homo sapiens
tccctattagagaaga

SEQ ID NO: 3817673 - DNA, 16 bp, Homo sapiens
tccctcctctgcccgg

SEQ ID NO: 3817674 - DNA, 12 bp, Homo sapiens
tccctctctctg

SEQ ID NO: 3817675 - DNA, 14 bp, Homo sapiens
tccctctctctgga

SEQ ID NO: 3817676 - DNA, 16 bp, Homo sapiens
tccctctctctggaaa

SEQ ID NO: 3817677 - DNA, 18 bp, Homo sapiens
tccctgaccttctccagg

SEQ ID NO: 3817678 - DNA, 19 bp, Homo sapiens
tccctgcttttctcccaga

SEQ ID NO: 3817679 - DNA, 23 bp, Homo sapiens
tccctgcttttctcccagaaggc

SEQ ID NO: 3817680 - DNA, 19 bp, Homo sapiens
tcccttccttcctctcctg

SEQ ID NO: 3817681 - DNA, 13 bp, Homo sapiens
tccgcccagcctc

SEQ ID NO: 3817682 - DNA, 14 bp, Homo sapiens
tccgcccagcctct

SEQ ID NO: 3817683 - DNA, 15 bp, Homo sapiens
tccgcccagcctctc

SEQ ID NO: 3817684 - DNA, 16 bp, Homo sapiens
tccgcccagcctctcc

SEQ ID NO: 3817685 - DNA, 19 bp, Homo sapiens
tccgcccagcctctccccg

SEQ ID NO: 3817686 - DNA, 16 bp, Homo sapiens
tccgggtgccattccc

SEQ ID NO: 3817687 - DNA, 18 bp, Homo sapiens
tccggtggaaggccttct

SEQ ID NO: 3817688 - DNA, 23 bp, Homo sapiens
tccgtggcaaccctcagctgcct

SEQ ID NO: 3817689 - DNA, 17 bp, Homo sapiens
tcctaccccctgtgcct

SEQ ID NO: 3817690 - DNA, 14 bp, Homo sapiens
tcctagagctcctg

SEQ ID NO: 3817691 - DNA, 20 bp, Homo sapiens
tcctagcactttgggaggcc

SEQ ID NO: 3817692 - DNA, 14 bp, Homo sapiens
tcctaggcatttgc

SEQ ID NO: 3817693 - DNA, 19 bp, Homo sapiens
tcctaggcatttgctgaat

SEQ ID NO: 3817694 - DNA, 13 bp, Homo sapiens
tcctagtatatta

SEQ ID NO: 3817695 - DNA, 20 bp, Homo sapiens
tcctagttttctcctcccag

SEQ ID NO: 3817696 - DNA, 16 bp, Homo sapiens
tcctcacagcctctcc

SEQ ID NO: 3817697 - DNA, 13 bp, Homo sapiens
tcctcacccccag

SEQ ID NO: 3817698 - DNA, 20 bp, Homo sapiens
tcctcattataaaatgggaa

SEQ ID NO: 3817699 - DNA, 18 bp, Homo sapiens
tcctcccatggccttccc

SEQ ID NO: 3817700 - DNA, 12 bp, Homo sapiens
tcctcctgccct

SEQ ID NO: 3817701 - DNA, 13 bp, Homo sapiens
tcctcctgccctg

SEQ ID NO: 3817702 - DNA, 19 bp, Homo sapiens
tcctcctgccctgtccctg

SEQ ID NO: 3817703 - DNA, 19 bp, Homo sapiens
tcctcttctattttgtaaa

SEQ ID NO: 3817704 - DNA, 19 bp, Homo sapiens
tcctcttgtcctacaatga

SEQ ID NO: 3817705 - DNA, 14 bp, Homo sapiens
tcctgaaatttcag

SEQ ID NO: 3817706 - DNA, 16 bp, Homo sapiens
tcctgagtagctggga

SEQ ID NO: 3817707 - DNA, 18 bp, Homo sapiens
tcctgcaccggggcctgg

SEQ ID NO: 3817708 - DNA, 20 bp, Homo sapiens
tcctgcaccggggcctgggc

SEQ ID NO: 3817709 - DNA, 21 bp, Homo sapiens
tcctgcaccggggcctgggca

SEQ ID NO: 3817710 - DNA, 13 bp, Homo sapiens
tcctgccaggcat

SEQ ID NO: 3817711 - DNA, 14 bp, Homo sapiens
tcctgcctcagcct

SEQ ID NO: 3817712 - DNA, 17 bp, Homo sapiens
tcctgcctcagcctcct

SEQ ID NO: 3817713 - DNA, 15 bp, Homo sapiens
tcctgctgcctaata

SEQ ID NO: 3817714 - DNA, 13 bp, Homo sapiens
tcctggacctgaa

SEQ ID NO: 3817715 - DNA, 13 bp, Homo sapiens
tcctggaggcaga

SEQ ID NO: 3817716 - DNA, 17 bp, Homo sapiens
tcctggcccactgcatc

SEQ ID NO: 3817717 - DNA, 15 bp, Homo sapiens
tcctgtccctaccca

SEQ ID NO: 3817718 - DNA, 21 bp, Homo sapiens
tcctgtccctacccactcttt

SEQ ID NO: 3817719 - DNA, 23 bp, Homo sapiens
tcctgtctccctcctctgcccgg

SEQ ID NO: 3817720 - DNA, 16 bp, Homo sapiens
tccttaaggctctttt

SEQ ID NO: 3817721 - DNA, 20 bp, Homo sapiens
tccttcttaactctgcagga

SEQ ID NO: 3817722 - DNA, 19 bp, Homo sapiens
tccttgacctctataaact

SEQ ID NO: 3817723 - DNA, 14 bp, Homo sapiens
tcctttgaagagga

SEQ ID NO: 3817724 - DNA, 15 bp, Homo sapiens
tcctttgaagaggaa

SEQ ID NO: 3817725 - DNA, 13 bp, Homo sapiens
tcgaactcctgac

SEQ ID NO: 3817726 - DNA, 23 bp, Homo sapiens
tcgaagaacaatgtcagaaactc

SEQ ID NO: 3817727 - DNA, 20 bp, Homo sapiens
tcgacgtttgactagccatc

SEQ ID NO: 3817728 - DNA, 15 bp, Homo sapiens
tcgactcagcaccac

SEQ ID NO: 3817729 - DNA, 18 bp, Homo sapiens
tcgagatcccaacactgc

SEQ ID NO: 3817730 - DNA, 23 bp, Homo sapiens
tcgagatcccaacactgccagca

SEQ ID NO: 3817731 - DNA, 19 bp, Homo sapiens
tcgatgaagcccaataaac

SEQ ID NO: 3817732 - DNA, 20 bp, Homo sapiens
tcgatgaatgtgttgatttg

SEQ ID NO: 3817733 - DNA, 16 bp, Homo sapiens
tcgctgccttgccatg

SEQ ID NO: 3817734 - DNA, 23 bp, Homo sapiens
tcgctgggtgccgggctgcacag

SEQ ID NO: 3817735 - DNA, 17 bp, Homo sapiens
tcgggaggtcgaggcag

SEQ ID NO: 3817736 - DNA, 23 bp, Homo sapiens
tcgtgatctgcccgcctcggcct

SEQ ID NO: 3817737 - DNA, 16 bp, Homo sapiens
tgtttgttgtcagctg

SEQ ID NO: 3817738 - DNA, 17 bp, Homo sapiens
tgtttgtttcctttgtt

SEQ ID NO: 3817739 - DNA, 13 bp, Homo sapiens
tgtttttactgtc

SEQ ID NO: 3817740 - DNA, 15 bp, Homo sapiens
ttaaaactatattta

SEQ ID NO: 3817741 - DNA, 13 bp, Homo sapiens
ttaaagatttctg

SEQ ID NO: 3817742 - DNA, 16 bp, Homo sapiens
ttaacctgaattattc

SEQ ID NO: 3817743 - DNA, 14 bp, Homo sapiens
ttaactgcactcat

SEQ ID NO: 3817744 - DNA, 23 bp, Homo sapiens
ttaatagtcatcacatttctatg

SEQ ID NO: 3817745 - DNA, 22 bp, Homo sapiens
ttaatatctgagaagtgtatat

SEQ ID NO: 3817746 - DNA, 22 bp, Homo sapiens
ttaatgaatattgatgttaaca

SEQ ID NO: 3817747 - DNA, 20 bp, Homo sapiens
ttacaaagttcactgtttat

SEQ ID NO: 3817748 - DNA, 22 bp, Homo sapiens
ttacattaaaatagcacatgat

SEQ ID NO: 3817749 - DNA, 20 bp, Homo sapiens
ttacggttttccaggtttaa

SEQ ID NO: 3817750 - DNA, 18 bp, Homo sapiens
ttactgacagaaatgcaa

SEQ ID NO: 3817751 - DNA, 13 bp, Homo sapiens
ttactgtcccagg

SEQ ID NO: 3817752 - DNA, 16 bp, Homo sapiens
ttagaaatgcagaatc

SEQ ID NO: 3817753 - DNA, 14 bp, Homo sapiens
ttagaagaagtgtg

SEQ ID NO: 3817754 - DNA, 18 bp, Homo sapiens
ttagccttgctgtagaga

SEQ ID NO: 3817755 - DNA, 19 bp, Homo sapiens
ttagcttttaccaacccaa

SEQ ID NO: 3817756 - DNA, 19 bp, Homo sapiens
ttaggtgtgggggaagcac

SEQ ID NO: 3817757 - DNA, 18 bp, Homo sapiens
ttataagtagcaggccaa

SEQ ID NO: 3817758 - DNA, 16 bp, Homo sapiens
ttataggatcatttgt

SEQ ID NO: 3817759 - DNA, 12 bp, Homo sapiens
ttatatatcata

SEQ ID NO: 3817760 - DNA, 13 bp, Homo sapiens
ttatatatcataa

SEQ ID NO: 3817761 - DNA, 16 bp, Homo sapiens
ttatatatcataaagt

SEQ ID NO: 3817762 - DNA, 17 bp, Homo sapiens
ttatatatcataaagta

SEQ ID NO: 3817763 - DNA, 14 bp, Homo sapiens
ttatcaacatttgt

SEQ ID NO: 3817764 - DNA, 16 bp, Homo sapiens
ttatgacatcacttgt

SEQ ID NO: 3817765 - DNA, 21 bp, Homo sapiens
ttatgacatcacttgtacaaa

SEQ ID NO: 3817766 - DNA, 21 bp, Homo sapiens
ttatgactccccccttccaaa

SEQ ID NO: 3817767 - DNA, 20 bp, Homo sapiens
ttattgcctgggcagtgccc

SEQ ID NO: 3817768 - DNA, 15 bp, Homo sapiens
ttatttattggagat

SEQ ID NO: 3817769 - DNA, 22 bp, Homo sapiens
ttatttcaaccgcttgccatat

SEQ ID NO: 3817770 - DNA, 17 bp, Homo sapiens
ttatttccacataaagg

SEQ ID NO: 3817771 - DNA, 17 bp, Homo sapiens
ttatttttttgatggct

SEQ ID NO: 3817772 - DNA, 15 bp, Homo sapiens
ttcaaaatgtccagc

SEQ ID NO: 3817773 - DNA, 22 bp, Homo sapiens
ttcaaagctttttccagaggct

SEQ ID NO: 3817774 - DNA, 16 bp, Homo sapiens
ttcaacctgtgtctta

SEQ ID NO: 3817775 - DNA, 22 bp, Homo sapiens
ttcaagaaagcttcaaactgca

SEQ ID NO: 3817776 - DNA, 16 bp, Homo sapiens
ttcaagaccagcctgg

SEQ ID NO: 3817777 - DNA, 21 bp, Homo sapiens
ttcaagaccagcctggccaac

SEQ ID NO: 3817778 - DNA, 18 bp, Homo sapiens
ttcaagaccttctcccca

SEQ ID NO: 3817779 - DNA, 13 bp, Homo sapiens
ttcaataaagctg

SEQ ID NO: 3817780 - DNA, 18 bp, Homo sapiens
ttcacaccattctcctgc

SEQ ID NO: 3817781 - DNA, 18 bp, Homo sapiens
ttcacggaagagccttgc

SEQ ID NO: 3817782 - DNA, 22 bp, Homo sapiens
ttcactgtagaatgatttcatg

SEQ ID NO: 3817783 - DNA, 18 bp, Homo sapiens
ttcacttaaaaaaatgcc

SEQ ID NO: 3817784 - DNA, 13 bp, Homo sapiens
ttcagatcctacc

SEQ ID NO: 3817785 - DNA, 21 bp, Homo sapiens
ttcagattcccagagcaaaat

SEQ ID NO: 3817786 - DNA, 18 bp, Homo sapiens
ttcagctgcatacagttt

SEQ ID NO: 3817787 - DNA, 21 bp, Homo sapiens
ttcagctggttgaggtttcaa

SEQ ID NO: 3817788 - DNA, 20 bp, Homo sapiens
ttcagtgtatggaaataaat

SEQ ID NO: 3817789 - DNA, 13 bp, Homo sapiens
ttcatacattata

SEQ ID NO: 3817790 - DNA, 17 bp, Homo sapiens
ttcatgaaaatcctacc

SEQ ID NO: 3817791 - DNA, 21 bp, Homo sapiens
ttcatgccaattagcaattga

SEQ ID NO: 3817792 - DNA, 16 bp, Homo sapiens
ttcattgctggagaca

SEQ ID NO: 3817793 - DNA, 21 bp, Homo sapiens
ttccaaagggcagtaaagttt

SEQ ID NO: 3817794 - DNA, 17 bp, Homo sapiens
ttccaaatcaggctggg

SEQ ID NO: 3817795 - DNA, 21 bp, Homo sapiens
ttccaaccccagctggcctct

SEQ ID NO: 3817796 - DNA, 15 bp, Homo sapiens
ttccaagcatgacaa

SEQ ID NO: 3817797 - DNA, 19 bp, Homo sapiens
ttccaggtgcctggccctt

SEQ ID NO: 3817798 - DNA, 17 bp, Homo sapiens
ttccaggtttaagctgt

SEQ ID NO: 3817799 - DNA, 20 bp, Homo sapiens
ttcccactaagctttctcct

SEQ ID NO: 3817800 - DNA, 19 bp, Homo sapiens
ttcccagagagacgctgtg

SEQ ID NO: 3817801 - DNA, 17 bp, Homo sapiens
ttcccatggtgtatgtg

SEQ ID NO: 3817802 - DNA, 20 bp, Homo sapiens
ttcccatggtgtatgtggtt

SEQ ID NO: 3817803 - DNA, 22 bp, Homo sapiens
ttccctcccaacagagctgggc

SEQ ID NO: 3817804 - DNA, 20 bp, Homo sapiens
ttccctccccacagtcctca

SEQ ID NO: 3817805 - DNA, 20 bp, Homo sapiens
ttccctgcttttctcccaga

SEQ ID NO: 3817806 - DNA, 19 bp, Homo sapiens
ttccgtggcaaccctcagc

SEQ ID NO: 3817807 - DNA, 16 bp, Homo sapiens
ttcctcccccagagcc

SEQ ID NO: 3817808 - DNA, 22 bp, Homo sapiens
ttcctctttttatttagttcct

SEQ ID NO: 3817809 - DNA, 17 bp, Homo sapiens
ttcctgccaggcatggt

SEQ ID NO: 3817810 - DNA, 21 bp, Homo sapiens
ttccttgagttgattcagctc

SEQ ID NO: 3817811 - DNA, 16 bp, Homo sapiens
ttccttgtcactggta

SEQ ID NO: 3817812 - DNA, 15 bp, Homo sapiens
ttcggaacactaaaa

SEQ ID NO: 3817813 - DNA, 20 bp, Homo sapiens
ttcgggaggtcgaggcagga

SEQ ID NO: 3817814 - DNA, 14 bp, Homo sapiens
ttctaatctcttta

SEQ ID NO: 3817815 - DNA, 17 bp, Homo sapiens
ttctacacatatatgta

SEQ ID NO: 3817816 - DNA, 18 bp, Homo sapiens
ttctacacatatatgtat

SEQ ID NO: 3817817 - DNA, 16 bp, Homo sapiens
ttctagttctgccagg

SEQ ID NO: 3817818 - DNA, 17 bp, Homo sapiens
ttctagttctgccagga

SEQ ID NO: 3817819 - DNA, 16 bp, Homo sapiens
ttctattttgtaaact

SEQ ID NO: 3817820 - DNA, 13 bp, Homo sapiens
ttctcctcccagg

SEQ ID NO: 3817821 - DNA, 12 bp, Homo sapiens
ttctcctgcctc

SEQ ID NO: 3817822 - DNA, 13 bp, Homo sapiens
ttctcctttttct

SEQ ID NO: 3817823 - DNA, 15 bp, Homo sapiens
ttctcttttcctttg

SEQ ID NO: 3817824 - DNA, 23 bp, Homo sapiens
ttctgcattcacagcgcctcctg

SEQ ID NO: 3817825 - DNA, 12 bp, Homo sapiens
ttctgccaggag

SEQ ID NO: 3817826 - DNA, 21 bp, Homo sapiens
ttctggggtcaggtgccactg

SEQ ID NO: 3817827 - DNA, 18 bp, Homo sapiens
ttctgtattttgtttttg

SEQ ID NO: 3817828 - DNA, 17 bp, Homo sapiens
ttcttaactctgcagga

SEQ ID NO: 3817829 - DNA, 13 bp, Homo sapiens
ttctttgattttc

SEQ ID NO: 3817830 - DNA, 14 bp, Homo sapiens
ttgaattagaaaca

SEQ ID NO: 3817831 - DNA, 21 bp, Homo sapiens
ttgaccagggcagtgaaaatg

SEQ ID NO: 3817832 - DNA, 22 bp, Homo sapiens
ttgaccagggcagtgaaaatga

SEQ ID NO: 3817833 - DNA, 17 bp, Homo sapiens
ttgagagaagagacaaa

SEQ ID NO: 3817834 - DNA, 14 bp, Homo sapiens
ttgaggacacatgt

SEQ ID NO: 3817835 - DNA, 17 bp, Homo sapiens
ttgataagtaatgaaag

SEQ ID NO: 3817836 - DNA, 18 bp, Homo sapiens
ttgataagtaatgaaagt

SEQ ID NO: 3817837 - DNA, 17 bp, Homo sapiens
ttgatatgtaagtactt

SEQ ID NO: 3817838 - DNA, 13 bp, Homo sapiens
ttgatctcctgag

SEQ ID NO: 3817839 - DNA, 11 bp, Homo sapiens
ttgatggctaa

SEQ ID NO: 3817840 - DNA, 23 bp, Homo sapiens
ttgatgttaacaagaggggaaaa

SEQ ID NO: 3817841 - DNA, 15 bp, Homo sapiens
ttgattgcgagaatt

SEQ ID NO: 3817842 - DNA, 21 bp, Homo sapiens
ttgcaccactgcactccagcc

SEQ ID NO: 3817843 - DNA, 14 bp, Homo sapiens
ttgcagtgaactga

SEQ ID NO: 3817844 - DNA, 17 bp, Homo sapiens
ttgcagtgaactgagac

SEQ ID NO: 3817845 - DNA, 12 bp, Homo sapiens
aaaaaaataata

SEQ ID NO: 3817846 - DNA, 15 bp, Homo sapiens
aaaaaatattttcct

SEQ ID NO: 3817847 - DNA, 14 bp, Homo sapiens
aaaaaggaggaaga

SEQ ID NO: 3817848 - DNA, 12 bp, Homo sapiens
aaaaaggcagga

SEQ ID NO: 3817849 - DNA, 14 bp, Homo sapiens
aaaaagtatatatt

SEQ ID NO: 3817850 - DNA, 13 bp, Homo sapiens
aaaacgagataag

SEQ ID NO: 3817851 - DNA, 14 bp, Homo sapiens
aaaactcagaatat

SEQ ID NO: 3817852 - DNA, 11 bp, Homo sapiens
aaaagaaaaag

SEQ ID NO: 3817853 - DNA, 13 bp, Homo sapiens
aaaagaataaaca

SEQ ID NO: 3817854 - DNA, 13 bp, Homo sapiens
aaaagatgcttct

SEQ ID NO: 3817855 - DNA, 13 bp, Homo sapiens
aaaagattatata

SEQ ID NO: 3817856 - DNA, 14 bp, Homo sapiens
aaaagctgggcagg

SEQ ID NO: 3817857 - DNA, 20 bp, Homo sapiens
aaaaggcgcatctaacgcgt

SEQ ID NO: 3817858 - DNA, 15 bp, Homo sapiens
aaaaggtattaaatt

SEQ ID NO: 3817859 - DNA, 17 bp, Homo sapiens
aaaagtaatctttaaac

SEQ ID NO: 3817860 - DNA, 22 bp, Homo sapiens
aaaagtaatctttaaactggct

SEQ ID NO: 3817861 - DNA, 12 bp, Homo sapiens
aaaataaacaaa

SEQ ID NO: 3817862 - DNA, 19 bp, Homo sapiens
aaaatatttgtctttaaac

SEQ ID NO: 3817863 - DNA, 19 bp, Homo sapiens
aaaatgggaagactgagct

SEQ ID NO: 3817864 - DNA, 16 bp, Homo sapiens
aaaatgttcagaaggt

SEQ ID NO: 3817865 - DNA, 22 bp, Homo sapiens
aaaattctgttttgtaaatgta

SEQ ID NO: 3817866 - DNA, 16 bp, Homo sapiens
aaaattgtgatgtgtc

SEQ ID NO: 3817867 - DNA, 13 bp, Homo sapiens
aaacaaaaacact

SEQ ID NO: 3817868 - DNA, 13 bp, Homo sapiens
aaacaatgtaaag

SEQ ID NO: 3817869 - DNA, 15 bp, Homo sapiens
aaacaatgtttttca

SEQ ID NO: 3817870 - DNA, 23 bp, Homo sapiens
aaacactagtaccttcagatcct

SEQ ID NO: 3817871 - DNA, 20 bp, Homo sapiens
aaacactgggctctgaggag

SEQ ID NO: 3817872 - DNA, 13 bp, Homo sapiens
aaacagaaacaaa

SEQ ID NO: 3817873 - DNA, 19 bp, Homo sapiens
aaacagaaacaaaaacact

SEQ ID NO: 3817874 - DNA, 21 bp, Homo sapiens
aaacagaaacaaaaacactaa

SEQ ID NO: 3817875 - DNA, 14 bp, Homo sapiens
aaacagtgagcctg

SEQ ID NO: 3817876 - DNA, 17 bp, Homo sapiens
aaacatggcctttgctt

SEQ ID NO: 3817877 - DNA, 18 bp, Homo sapiens
aaacctgtccataaagta

SEQ ID NO: 3817878 - DNA, 22 bp, Homo sapiens
aaaccttttttatgatgctatt

SEQ ID NO: 3817879 - DNA, 21 bp, Homo sapiens
aaactcaaaatatttgtacat

SEQ ID NO: 3817880 - DNA, 19 bp, Homo sapiens
aaactcagaatataacatg

SEQ ID NO: 3817881 - DNA, 12 bp, Homo sapiens
aaactcttaaaa

SEQ ID NO: 3817882 - DNA, 23 bp, Homo sapiens
aaactcttaaaacccaagtgcct

SEQ ID NO: 3817883 - DNA, 19 bp, Homo sapiens
aaactgaggccattatttc

SEQ ID NO: 3817884 - DNA, 14 bp, Homo sapiens
aaactgctgttaat

SEQ ID NO: 3817885 - DNA, 20 bp, Homo sapiens
cacggctcctcgagatccca

SEQ ID NO: 3817886 - DNA, 19 bp, Homo sapiens
cacgtgtggcctgttcttc

SEQ ID NO: 3817887 - DNA, 17 bp, Homo sapiens
cactaagctttctcctt

SEQ ID NO: 3817888 - DNA, 14 bp, Homo sapiens
cactacctttgtcc

SEQ ID NO: 3817889 - DNA, 19 bp, Homo sapiens
cactcaaaagctgggcagg

SEQ ID NO: 3817890 - DNA, 20 bp, Homo sapiens
cactcaaaagctgggcaggt

SEQ ID NO: 3817891 - DNA, 15 bp, Homo sapiens
cactcaaggaaaaga

SEQ ID NO: 3817892 - DNA, 13 bp, Homo sapiens
cactcactgccaa

SEQ ID NO: 3817893 - DNA, 15 bp, Homo sapiens
cactcagcagccccc

SEQ ID NO: 3817894 - DNA, 23 bp, Homo sapiens
cactcaggtagggagctaaggaa

SEQ ID NO: 3817895 - DNA, 22 bp, Homo sapiens
cactcatgtgactctttccaac

SEQ ID NO: 3817896 - DNA, 13 bp, Homo sapiens
cactccagcctgg

SEQ ID NO: 3817897 - DNA, 16 bp, Homo sapiens
cactctttgctacaat

SEQ ID NO: 3817898 - DNA, 21 bp, Homo sapiens
cactctttgctacaataaatg

SEQ ID NO: 3817899 - DNA, 20 bp, Homo sapiens
cactgaaggctttcagggcc

SEQ ID NO: 3817900 - DNA, 14 bp, Homo sapiens
cactgagccccacc

SEQ ID NO: 3817901 - DNA, 18 bp, Homo sapiens
cactgcactccagcctgg

SEQ ID NO: 3817902 - DNA, 18 bp, Homo sapiens
cactgccgcctccttctt

SEQ ID NO: 3817903 - DNA, 20 bp, Homo sapiens
cactggcatctccctgacct

SEQ ID NO: 3817904 - DNA, 18 bp, Homo sapiens
cactggccagtcctagag

SEQ ID NO: 3817905 - DNA, 19 bp, Homo sapiens
cactggccagtcctagagc

SEQ ID NO: 3817906 - DNA, 20 bp, Homo sapiens
cactgggctctgaggagtgg

SEQ ID NO: 3817907 - DNA, 20 bp, Homo sapiens
cactggtagaccaaaataaa

SEQ ID NO: 3817908 - DNA, 15 bp, Homo sapiens
cactggtgggcagct

SEQ ID NO: 3817909 - DNA, 21 bp, Homo sapiens
cactgttgctgactactactc

SEQ ID NO: 3817910 - DNA, 19 bp, Homo sapiens
cactgtttaactgggagtg

SEQ ID NO: 3817911 - DNA, 12 bp, Homo sapiens
cacttcagctga

SEQ ID NO: 3817912 - DNA, 14 bp, Homo sapiens
cacttccctgcttt

SEQ ID NO: 3817913 - DNA, 21 bp, Homo sapiens
cacttcgggaggtcgaggcag

SEQ ID NO: 3817914 - DNA, 17 bp, Homo sapiens
cacttgtacaaaataaa

SEQ ID NO: 3817915 - DNA, 14 bp, Homo sapiens
cactttgcacagct

SEQ ID NO: 3817916 - DNA, 16 bp, Homo sapiens
cactttgggaggccaa

SEQ ID NO: 3817917 - DNA, 14 bp, Homo sapiens
caggcaaaatcctt

SEQ ID NO: 3817918 - DNA, 22 bp, Homo sapiens
caggcagatttactgtcccagg

SEQ ID NO: 3817919 - DNA, 14 bp, Homo sapiens
caggcagctccagc

SEQ ID NO: 3817920 - DNA, 15 bp, Homo sapiens
caggcaggtgggatg

SEQ ID NO: 3817921 - DNA, 24 bp, Homo sapiens
caggcatgctggctcccagggcca

SEQ ID NO: 3817922 - DNA, 19 bp, Homo sapiens
caggcccaagagatgaaga

SEQ ID NO: 3817923 - DNA, 17 bp, Homo sapiens
caggcgctggacagagg

SEQ ID NO: 3817924 - DNA, 23 bp, Homo sapiens
caggcgctggacagaggggcagg

SEQ ID NO: 3817925 - DNA, 14 bp, Homo sapiens
caggctagagtgca

SEQ ID NO: 3817926 - DNA, 20 bp, Homo sapiens
caggctctgagatttcacag

SEQ ID NO: 3817927 - DNA, 13 bp, Homo sapiens
caggctgcaaccc

SEQ ID NO: 3817928 - DNA, 18 bp, Homo sapiens
caggctgggttgtcactg

SEQ ID NO: 3817929 - DNA, 20 bp, Homo sapiens
caggctgggttgtcactgag

SEQ ID NO: 3817930 - DNA, 17 bp, Homo sapiens
cagggacagaagcagga

SEQ ID NO: 3817931 - DNA, 13 bp, Homo sapiens
cagggaggggact

SEQ ID NO: 3817932 - DNA, 15 bp, Homo sapiens
cagggcaaggccatt

SEQ ID NO: 3817933 - DNA, 18 bp, Homo sapiens
cagggccatctcctccca

SEQ ID NO: 3817934 - DNA, 15 bp, Homo sapiens
cagggccccagaagg

SEQ ID NO: 3817935 - DNA, 21 bp, Homo sapiens
cagggccccagaaggcaggga

SEQ ID NO: 3817936 - DNA, 20 bp, Homo sapiens
caggggaaaatcagcctgct

SEQ ID NO: 3817937 - DNA, 20 bp, Homo sapiens
caggggcaaagaactgcccc

SEQ ID NO: 3817938 - DNA, 16 bp, Homo sapiens
cagggggtgtgtctgc

SEQ ID NO: 3817939 - DNA, 21 bp, Homo sapiens
caggtagggagctaaggaaga

SEQ ID NO: 3817940 - DNA, 21 bp, Homo sapiens
caggtgagaagcagaggaagg

SEQ ID NO: 3817941 - DNA, 12 bp, Homo sapiens
caggtgccactg

SEQ ID NO: 3817942 - DNA, 16 bp, Homo sapiens
caggtgcctggccctt

SEQ ID NO: 3817943 - DNA, 14 bp, Homo sapiens
caggtgcgaaagga

SEQ ID NO: 3817944 - DNA, 21 bp, Homo sapiens
caggttggtgggggcctcggt

SEQ ID NO: 3817945 - DNA, 18 bp, Homo sapiens
caggtttaagctgttact

SEQ ID NO: 3817946 - DNA, 14 bp, Homo sapiens
cagtaattgtgaaa

SEQ ID NO: 3817947 - DNA, 15 bp, Homo sapiens
cagtatttgtgggga

SEQ ID NO: 3817948 - DNA, 14 bp, Homo sapiens
cagtcctagagctc

SEQ ID NO: 3817949 - DNA, 16 bp, Homo sapiens
cagtcctagagctcct

SEQ ID NO: 3817950 - DNA, 17 bp, Homo sapiens
cagtcctagagctcctg

SEQ ID NO: 3817951 - DNA, 19 bp, Homo sapiens
cagtcctagagctcctgtc

SEQ ID NO: 3817952 - DNA, 22 bp, Homo sapiens
cagtcctagagctcctgtccct

SEQ ID NO: 3817953 - DNA, 18 bp, Homo sapiens
cagtcctccagaccacca

SEQ ID NO: 3817954 - DNA, 20 bp, Homo sapiens
cagtcctccagaccaccagc

SEQ ID NO: 3817955 - DNA, 17 bp, Homo sapiens
cagtctgagagaggcca

SEQ ID NO: 3817956 - DNA, 14 bp, Homo sapiens
cagtgaactgagac

SEQ ID NO: 3817957 - DNA, 22 bp, Homo sapiens
cagtgatgcttttagttttaaa

SEQ ID NO: 3817958 - DNA, 18 bp, Homo sapiens
cagtgcacacggatgcac

SEQ ID NO: 3817959 - DNA, 19 bp, Homo sapiens
cagtgccctcattttatgt

SEQ ID NO: 3817960 - DNA, 20 bp, Homo sapiens
cagtggctggatctgtgagg

SEQ ID NO: 3817961 - DNA, 14 bp, Homo sapiens
cagtgtatttggaa

SEQ ID NO: 3817962 - DNA, 17 bp, Homo sapiens
cagtgtcagcactcagg

SEQ ID NO: 3817963 - DNA, 20 bp, Homo sapiens
cagttcccatggtgtatgtg

SEQ ID NO: 3817964 - DNA, 22 bp, Homo sapiens
cagttcccatggtgtatgtggt

SEQ ID NO: 3817965 - DNA, 16 bp, Homo sapiens
cagttcctgcagcaga

SEQ ID NO: 3817966 - DNA, 21 bp, Homo sapiens
cagttcctgcagcagagcctg

SEQ ID NO: 3817967 - DNA, 19 bp, Homo sapiens
cagttgaaaaacagctgag

SEQ ID NO: 3817968 - DNA, 20 bp, Homo sapiens
cataaaaaaattagtcaggt

SEQ ID NO: 3817969 - DNA, 16 bp, Homo sapiens
cataaaggtatttaga

SEQ ID NO: 3817970 - DNA, 20 bp, Homo sapiens
cataaagtatgccttcctgt

SEQ ID NO: 3817971 - DNA, 11 bp, Homo sapiens
catacattata

SEQ ID NO: 3817972 - DNA, 15 bp, Homo sapiens
catacctggccctgt

SEQ ID NO: 3817973 - DNA, 16 bp, Homo sapiens
catagagatatgcaca

SEQ ID NO: 3817974 - DNA, 17 bp, Homo sapiens
catagatgagaaaactg

SEQ ID NO: 3817975 - DNA, 19 bp, Homo sapiens
catagatgagaaaactgag

SEQ ID NO: 3817976 - DNA, 16 bp, Homo sapiens
catagctcataagctg

SEQ ID NO: 3817977 - DNA, 18 bp, Homo sapiens
catattaaaggcttttgg

SEQ ID NO: 3817978 - DNA, 21 bp, Homo sapiens
catcatgtttacagaggacag

SEQ ID NO: 3817979 - DNA, 23 bp, Homo sapiens
catccaaggagaaacagagacag

SEQ ID NO: 3817980 - DNA, 19 bp, Homo sapiens
catcccaggggaccacacc

SEQ ID NO: 3817981 - DNA, 15 bp, Homo sapiens
catcctaccccctgt

SEQ ID NO: 3817982 - DNA, 18 bp, Homo sapiens
catcctaccccctgtgcc

SEQ ID NO: 3817983 - DNA, 19 bp, Homo sapiens
catcctaccccctgtgcct

SEQ ID NO: 3817984 - DNA, 21 bp, Homo sapiens
catctcaagcaagtttaatca

SEQ ID NO: 3817985 - DNA, 21 bp, Homo sapiens
catctccctgaccttctccag

SEQ ID NO: 3817986 - DNA, 18 bp, Homo sapiens
catctgagtccagctccc

SEQ ID NO: 3817987 - DNA, 20 bp, Homo sapiens
ccacggaaaatgccaatctc

SEQ ID NO: 3817988 - DNA, 21 bp, Homo sapiens
ccacgtcagctgggacacccc

SEQ ID NO: 3817989 - DNA, 22 bp, Homo sapiens
ccactacctttgtccaggcctg

SEQ ID NO: 3817990 - DNA, 20 bp, Homo sapiens
ccactagggtcctggccctc

SEQ ID NO: 3817991 - DNA, 18 bp, Homo sapiens
ccactgcactccagcctg

SEQ ID NO: 3817992 - DNA, 21 bp, Homo sapiens
ccactgcatcgtttcatcttc

SEQ ID NO: 3817993 - DNA, 23 bp, Homo sapiens
ccactgcatcgtttcatcttcca

SEQ ID NO: 3817994 - DNA, 15 bp, Homo sapiens
ccactggccagtcct

SEQ ID NO: 3817995 - DNA, 18 bp, Homo sapiens
ccagaccattgtcttcca

SEQ ID NO: 3817996 - DNA, 23 bp, Homo sapiens
ccagacctctgaatgtcccagag

SEQ ID NO: 3817997 - DNA, 22 bp, Homo sapiens
ccagactgcttccaattttctg

SEQ ID NO: 3817998 - DNA, 23 bp, Homo sapiens
ccagacttcccacggctcctcga

SEQ ID NO: 3817999 - DNA, 18 bp, Homo sapiens
ccagagaaaaagggaggg

SEQ ID NO: 3818000 - DNA, 17 bp, Homo sapiens
ccagagccactaccttt

SEQ ID NO: 3818001 - DNA, 18 bp, Homo sapiens
ccagaggaaggaaaagga

SEQ ID NO: 3818002 - DNA, 16 bp, Homo sapiens
ccagagtccctgcctg

SEQ ID NO: 3818003 - DNA, 21 bp, Homo sapiens
ccagcaagaccaaatcattgt

SEQ ID NO: 3818004 - DNA, 21 bp, Homo sapiens
ccagcagccctggcctgtgga

SEQ ID NO: 3818005 - DNA, 14 bp, Homo sapiens
ccagcagcctggac

SEQ ID NO: 3818006 - DNA, 19 bp, Homo sapiens
ccagccaaagcctcctcca

SEQ ID NO: 3818007 - DNA, 16 bp, Homo sapiens
ccagcccaccctgctc

SEQ ID NO: 3818008 - DNA, 21 bp, Homo sapiens
ccagcccaccctgctcctcct

SEQ ID NO: 3818009 - DNA, 23 bp, Homo sapiens
ccagccctttgcaggcccagcag

SEQ ID NO: 3818010 - DNA, 13 bp, Homo sapiens
ccagcctccaggc

SEQ ID NO: 3818011 - DNA, 16 bp, Homo sapiens
ccagcctccaggcccc

SEQ ID NO: 3818012 - DNA, 13 bp, Homo sapiens
ccagcctgggtga

SEQ ID NO: 3818013 - DNA, 16 bp, Homo sapiens
ccagctaattggtcca

SEQ ID NO: 3818014 - DNA, 12 bp, Homo sapiens
ccagctggcctc

SEQ ID NO: 3818015 - DNA, 20 bp, Homo sapiens
ccagctggcctctagaacac

SEQ ID NO: 3818016 - DNA, 16 bp, Homo sapiens
ccagctgttacctgag

SEQ ID NO: 3818017 - DNA, 17 bp, Homo sapiens
ccagctttctgtgtgca

SEQ ID NO: 3818018 - DNA, 20 bp, Homo sapiens
ccagctttgctaccaaagca

SEQ ID NO: 3818019 - DNA, 13 bp, Homo sapiens
ccaggagacaggt

SEQ ID NO: 3818020 - DNA, 17 bp, Homo sapiens
ccaggagcaaatgctgg

SEQ ID NO: 3818021 - DNA, 16 bp, Homo sapiens
ccaggagcctgtgcct

SEQ ID NO: 3818022 - DNA, 15 bp, Homo sapiens
ccaggcagctccagc

SEQ ID NO: 3818023 - DNA, 13 bp, Homo sapiens
ccaggcatggtgg

SEQ ID NO: 3818024 - DNA, 13 bp, Homo sapiens
ccaggccccagcc

SEQ ID NO: 3818025 - DNA, 16 bp, Homo sapiens
ccaggccccagcctcc

SEQ ID NO: 3818026 - DNA, 20 bp, Homo sapiens
ccaggccccagcctccaggc

SEQ ID NO: 3818027 - DNA, 22 bp, Homo sapiens
ccaggccctaggattcctcccc

SEQ ID NO: 3818028 - DNA, 17 bp, Homo sapiens
ccaggctagagtgcagt

SEQ ID NO: 3818029 - DNA, 23 bp, Homo sapiens
cagaacccctacatgaaacagaa

SEQ ID NO: 3818030 - DNA, 20 bp, Homo sapiens
cagaaggctgggtccagggg

SEQ ID NO: 3818031 - DNA, 20 bp, Homo sapiens
cagaagtttgagatcagcct

SEQ ID NO: 3818032 - DNA, 20 bp, Homo sapiens
cagaatataacatgtaaaat

SEQ ID NO: 3818033 - DNA, 16 bp, Homo sapiens
cagaattgaaggagaa

SEQ ID NO: 3818034 - DNA, 23 bp, Homo sapiens
cagaattgcttgaacccaggagg

SEQ ID NO: 3818035 - DNA, 19 bp, Homo sapiens
cagacaagatggctggaag

SEQ ID NO: 3818036 - DNA, 21 bp, Homo sapiens
cagacaattcagaagcatcac

SEQ ID NO: 3818037 - DNA, 19 bp, Homo sapiens
cagacactacatatctaaa

SEQ ID NO: 3818038 - DNA, 14 bp, Homo sapiens
cagaccacaaaact

SEQ ID NO: 3818039 - DNA, 17 bp, Homo sapiens
cagaccaccagccgccc

SEQ ID NO: 3818040 - DNA, 19 bp, Homo sapiens
cagaccaccagccgcccca

SEQ ID NO: 3818041 - DNA, 15 bp, Homo sapiens
cagaccattgtcttc

SEQ ID NO: 3818042 - DNA, 21 bp, Homo sapiens
cagaccattgtcttccaaccc

SEQ ID NO: 3818043 - DNA, 22 bp, Homo sapiens
cagacctctgaatgtcccagag

SEQ ID NO: 3818044 - DNA, 22 bp, Homo sapiens
cagacttcccacggctcctcga

SEQ ID NO: 3818045 - DNA, 13 bp, Homo sapiens
cagagaatttcta

SEQ ID NO: 3818046 - DNA, 21 bp, Homo sapiens
cagagacagaaacagagagag

SEQ ID NO: 3818047 - DNA, 13 bp, Homo sapiens
cagagacagagag

SEQ ID NO: 3818048 - DNA, 15 bp, Homo sapiens
cagagacagagagag

SEQ ID NO: 3818049 - DNA, 14 bp, Homo sapiens
cagagagagacaga

SEQ ID NO: 3818050 - DNA, 17 bp, Homo sapiens
cagagagagacagagac

SEQ ID NO: 3818051 - DNA, 13 bp, Homo sapiens
cagagagagactg

SEQ ID NO: 3818052 - DNA, 20 bp, Homo sapiens
cagagaggccttttggaatg

SEQ ID NO: 3818053 - DNA, 16 bp, Homo sapiens
cagagataaagacctt

SEQ ID NO: 3818054 - DNA, 16 bp, Homo sapiens
cagagcaaaataattt

SEQ ID NO: 3818055 - DNA, 13 bp, Homo sapiens
cagagccaaggcc

SEQ ID NO: 3818056 - DNA, 20 bp, Homo sapiens
cagagccccacacggaggca

SEQ ID NO: 3818057 - DNA, 17 bp, Homo sapiens
cagagctggcagcctcc

SEQ ID NO: 3818058 - DNA, 22 bp, Homo sapiens
cagagctggcagcctccagtgg

SEQ ID NO: 3818059 - DNA, 20 bp, Homo sapiens
cagaggctattattttcact

SEQ ID NO: 3818060 - DNA, 18 bp, Homo sapiens
cagagtccctgcctggac

SEQ ID NO: 3818061 - DNA, 16 bp, Homo sapiens
cagagtttacattcta

SEQ ID NO: 3818062 - DNA, 17 bp, Homo sapiens
cagagtttacattctaa

SEQ ID NO: 3818063 - DNA, 23 bp, Homo sapiens
cagagtttacattctaatttgca

SEQ ID NO: 3818064 - DNA, 14 bp, Homo sapiens
cagatatacacatg

SEQ ID NO: 3818065 - DNA, 15 bp, Homo sapiens
cagatatacacatgg

SEQ ID NO: 3818066 - DNA, 19 bp, Homo sapiens
cagatatacacatggatgc

SEQ ID NO: 3818067 - DNA, 22 bp, Homo sapiens
cagatatgcacacacatggatg

SEQ ID NO: 3818068 - DNA, 13 bp, Homo sapiens
cagatctttttgt

SEQ ID NO: 3818069 - DNA, 15 bp, Homo sapiens
cagatctttttgtga

SEQ ID NO: 3818070 - DNA, 23 bp, Homo sapiens
cagatggagaaacaggctctgag

SEQ ID NO: 3818071 - DNA, 15 bp, Homo sapiens
cagatggtcacacag

SEQ ID NO: 3818072 - DNA, 18 bp, Homo sapiens
cagatggtcacacagaga

SEQ ID NO: 3818073 - DNA, 19 bp, Homo sapiens
cagattcccagagcaaaat

SEQ ID NO: 3818074 - DNA, 20 bp, Homo sapiens
cagattgataagtaatgaaa

SEQ ID NO: 3818075 - DNA, 12 bp, Homo sapiens
cagattgcccca

SEQ ID NO: 3818076 - DNA, 17 bp, Homo sapiens
cagatttactgtcccag

SEQ ID NO: 3818077 - DNA, 21 bp, Homo sapiens
cagatttactgtcccaggagc

SEQ ID NO: 3818078 - DNA, 22 bp, Homo sapiens
cagatttactgtcccaggagca

SEQ ID NO: 3818079 - DNA, 19 bp, Homo sapiens
cagattttaagggggaaaa

SEQ ID NO: 3818080 - DNA, 18 bp, Homo sapiens
cagcaaaagatgcttctc

SEQ ID NO: 3818081 - DNA, 12 bp, Homo sapiens
cagcaatctgca

SEQ ID NO: 3818082 - DNA, 21 bp, Homo sapiens
cagcaatctgcattttaacaa

SEQ ID NO: 3818083 - DNA, 19 bp, Homo sapiens
cagcagccctggcctgtgg

SEQ ID NO: 3818084 - DNA, 18 bp, Homo sapiens
cagcagcctggaccctgt

SEQ ID NO: 3818085 - DNA, 17 bp, Homo sapiens
cagcatagaagtaactt

SEQ ID NO: 3818086 - DNA, 14 bp, Homo sapiens
cagcatctctatga

SEQ ID NO: 3818087 - DNA, 17 bp, Homo sapiens
cagcccaccctgctcct

SEQ ID NO: 3818088 - DNA, 17 bp, Homo sapiens
cagccccttctcccagc

SEQ ID NO: 3818089 - DNA, 18 bp, Homo sapiens
cagccccttctcccagca

SEQ ID NO: 3818090 - DNA, 18 bp, Homo sapiens
cagccctctcactgtgtc

SEQ ID NO: 3818091 - DNA, 13 bp, Homo sapiens
cagccctgccctt

SEQ ID NO: 3818092 - DNA, 18 bp, Homo sapiens
cagccctgctgcttccta

SEQ ID NO: 3818093 - DNA, 17 bp, Homo sapiens
cagccctttgcaggccc

SEQ ID NO: 3818094 - DNA, 23 bp, Homo sapiens
cagccgccatgctcctggcccac

SEQ ID NO: 3818095 - DNA, 13 bp, Homo sapiens
cagccgccccagc

SEQ ID NO: 3818096 - DNA, 13 bp, Homo sapiens
cagccgcctccct

SEQ ID NO: 3818097 - DNA, 21 bp, Homo sapiens
cagccgtgtaaccatggaccc

SEQ ID NO: 3818098 - DNA, 12 bp, Homo sapiens
cagcctccaggc

SEQ ID NO: 3818099 - DNA, 20 bp, Homo sapiens
cagcctcctgagtagctggg

SEQ ID NO: 3818100 - DNA, 19 bp, Homo sapiens
cagcctgccccagcctccc

SEQ ID NO: 3818101 - DNA, 20 bp, Homo sapiens
cagcctgccccagcctccca

SEQ ID NO: 3818102 - DNA, 20 bp, Homo sapiens
ctagagctcctgtccctacc

SEQ ID NO: 3818103 - DNA, 21 bp, Homo sapiens
ctagagctcctgtccctaccc

SEQ ID NO: 3818104 - DNA, 22 bp, Homo sapiens
ctagagctcctgtccctaccca

SEQ ID NO: 3818105 - DNA, 23 bp, Homo sapiens
ctagagctcctgtccctacccac

SEQ ID NO: 3818106 - DNA, 24 bp, Homo sapiens
ctagagctcctgtccctacccact

SEQ ID NO: 3818107 - DNA, 15 bp, Homo sapiens
ctagaggcagggagg

SEQ ID NO: 3818108 - DNA, 19 bp, Homo sapiens
ctagaggcagggaggggac

SEQ ID NO: 3818109 - DNA, 13 bp, Homo sapiens
ctagatccacaca

SEQ ID NO: 3818110 - DNA, 18 bp, Homo sapiens
ctagatccacacacagag

SEQ ID NO: 3818111 - DNA, 14 bp, Homo sapiens
ctaggcatcccagg

SEQ ID NO: 3818112 - DNA, 18 bp, Homo sapiens
ctaggcatcccaggggac

SEQ ID NO: 3818113 - DNA, 21 bp, Homo sapiens
ctaggcatttgctgaatacag

SEQ ID NO: 3818114 - DNA, 13 bp, Homo sapiens
ctaggctccaccc

SEQ ID NO: 3818115 - DNA, 18 bp, Homo sapiens
ctagggttttggcctgcc

SEQ ID NO: 3818116 - DNA, 17 bp, Homo sapiens
ctagtctcttctcagag

SEQ ID NO: 3818117 - DNA, 21 bp, Homo sapiens
ctagtgcagaagccccaactg

SEQ ID NO: 3818118 - DNA, 13 bp, Homo sapiens
ctagttctgccag

SEQ ID NO: 3818119 - DNA, 20 bp, Homo sapiens
ctagttttctcctcccagga

SEQ ID NO: 3818120 - DNA, 21 bp, Homo sapiens
ctatacctgggcatactaata

SEQ ID NO: 3818121 - DNA, 16 bp, Homo sapiens
ctatatgtccatttaa

SEQ ID NO: 3818122 - DNA, 19 bp, Homo sapiens
ctatattccgggtgccatt

SEQ ID NO: 3818123 - DNA, 16 bp, Homo sapiens
ctatatttatttatgt

SEQ ID NO: 3818124 - DNA, 18 bp, Homo sapiens
ctatattttatttctgaa

SEQ ID NO: 3818125 - DNA, 21 bp, Homo sapiens
ctatctctgtgtgcacaaata

SEQ ID NO: 3818126 - DNA, 20 bp, Homo sapiens
ctattaaaccatctttgttt

SEQ ID NO: 3818127 - DNA, 15 bp, Homo sapiens
ctattagagaagaga

SEQ ID NO: 3818128 - DNA, 16 bp, Homo sapiens
ctattgctgcttgagg

SEQ ID NO: 3818129 - DNA, 11 bp, Homo sapiens
ctatttatgaa

SEQ ID NO: 3818130 - DNA, 15 bp, Homo sapiens
ctattttaataaaga

SEQ ID NO: 3818131 - DNA, 12 bp, Homo sapiens
ctattttgtaaa

SEQ ID NO: 3818132 - DNA, 19 bp, Homo sapiens
ctattttgtaaactcaaaa

SEQ ID NO: 3818133 - DNA, 17 bp, Homo sapiens
ctcaaaaaaagaaaaag

SEQ ID NO: 3818134 - DNA, 18 bp, Homo sapiens
ctcaaaagctgggcaggt

SEQ ID NO: 3818135 - DNA, 13 bp, Homo sapiens
ctcaaaatatttg

SEQ ID NO: 3818136 - DNA, 22 bp, Homo sapiens
ctcaaagagactccaagattca

SEQ ID NO: 3818137 - DNA, 13 bp, Homo sapiens
ctcaagcaagttt

SEQ ID NO: 3818138 - DNA, 15 bp, Homo sapiens
ctcaaggaaaagatg

SEQ ID NO: 3818139 - DNA, 18 bp, Homo sapiens
ctcaagtcttccctgatc

SEQ ID NO: 3818140 - DNA, 17 bp, Homo sapiens
ctcaatattcaataaag

SEQ ID NO: 3818141 - DNA, 22 bp, Homo sapiens
ctcacactacttgagaaaatgc

SEQ ID NO: 3818142 - DNA, 13 bp, Homo sapiens
ctcacagcctctc

SEQ ID NO: 3818143 - DNA, 17 bp, Homo sapiens
ctcacagcctctccctt

SEQ ID NO: 3818144 - DNA, 20 bp, Homo sapiens
ctcacagcctctcccttaat

SEQ ID NO: 3818145 - DNA, 14 bp, Homo sapiens
ctcacattcccaag

SEQ ID NO: 3818146 - DNA, 20 bp, Homo sapiens
ctcaccactacatcacttga

SEQ ID NO: 3818147 - DNA, 19 bp, Homo sapiens
ctcacctgagtcaccctac

SEQ ID NO: 3818148 - DNA, 21 bp, Homo sapiens
ctcagcaaaagatgcttctca

SEQ ID NO: 3818149 - DNA, 17 bp, Homo sapiens
ctcagcaccacattgcc

SEQ ID NO: 3818150 - DNA, 20 bp, Homo sapiens
ctcagcaccacattgcctca

SEQ ID NO: 3818151 - DNA, 13 bp, Homo sapiens
ctcagcagccccc

SEQ ID NO: 3818152 - DNA, 19 bp, Homo sapiens
ctcagcagccccctgcccg

SEQ ID NO: 3818153 - DNA, 13 bp, Homo sapiens
ctcagcctccagg

SEQ ID NO: 3818154 - DNA, 20 bp, Homo sapiens
ctcagcctcctgagtagctg

SEQ ID NO: 3818155 - DNA, 18 bp, Homo sapiens
ctcaggaaccgaggcagg

SEQ ID NO: 3818156 - DNA, 19 bp, Homo sapiens
ctcaggaaccgaggcaggg

SEQ ID NO: 3818157 - DNA, 18 bp, Homo sapiens
ccttattttcaagaaact

SEQ ID NO: 3818158 - DNA, 17 bp, Homo sapiens
ccttcaaagaagggcca

SEQ ID NO: 3818159 - DNA, 21 bp, Homo sapiens
ccttcagcatcctcagttcct

SEQ ID NO: 3818160 - DNA, 22 bp, Homo sapiens
ccttccccagctttgctgcctg

SEQ ID NO: 3818161 - DNA, 22 bp, Homo sapiens
ccttctccagggacagaagcag

SEQ ID NO: 3818162 - DNA, 14 bp, Homo sapiens
ccttgctgtagaga

SEQ ID NO: 3818163 - DNA, 18 bp, Homo sapiens
ccttgcttatgacatcac

SEQ ID NO: 3818164 - DNA, 15 bp, Homo sapiens
ccttgtcacgccaga

SEQ ID NO: 3818165 - DNA, 12 bp, Homo sapiens
ccttgtggcttc

SEQ ID NO: 3818166 - DNA, 14 bp, Homo sapiens
cctttgaagaggaa

SEQ ID NO: 3818167 - DNA, 22 bp, Homo sapiens
cctttgagggcagtggggagca

SEQ ID NO: 3818168 - DNA, 18 bp, Homo sapiens
cctttgcaggcccagcag

SEQ ID NO: 3818169 - DNA, 20 bp, Homo sapiens
cctttgcaggcccagcagac

SEQ ID NO: 3818170 - DNA, 14 bp, Homo sapiens
cctttgtcccagaa

SEQ ID NO: 3818171 - DNA, 20 bp, Homo sapiens
cgaaacctgtccataaagta

SEQ ID NO: 3818172 - DNA, 12 bp, Homo sapiens
cgaaagaacagt

SEQ ID NO: 3818173 - DNA, 20 bp, Homo sapiens
cgaaaggatgaaagtgacca

SEQ ID NO: 3818174 - DNA, 13 bp, Homo sapiens
cgaactgtcctgg

SEQ ID NO: 3818175 - DNA, 12 bp, Homo sapiens
cgactcagcacc

SEQ ID NO: 3818176 - DNA, 13 bp, Homo sapiens
cgactcagcacca

SEQ ID NO: 3818177 - DNA, 17 bp, Homo sapiens
cgactgcccggcagggt

SEQ ID NO: 3818178 - DNA, 12 bp, Homo sapiens
cgagaattttca

SEQ ID NO: 3818179 - DNA, 23 bp, Homo sapiens
cgagagaccctacagacagtatg

SEQ ID NO: 3818180 - DNA, 13 bp, Homo sapiens
cgagatcccaaca

SEQ ID NO: 3818181 - DNA, 14 bp, Homo sapiens
cgagcccttagcct

SEQ ID NO: 3818182 - DNA, 22 bp, Homo sapiens
cgaggtgggcggatcacttgag

SEQ ID NO: 3818183 - DNA, 21 bp, Homo sapiens
cgattgcaggagtccctgcca

SEQ ID NO: 3818184 - DNA, 16 bp, Homo sapiens
cgcacaaggctgacca

SEQ ID NO: 3818185 - DNA, 21 bp, Homo sapiens
cgcacaaggctgaccaagaga

SEQ ID NO: 3818186 - DNA, 19 bp, Homo sapiens
cgcacatgccaatgcacgc

SEQ ID NO: 3818187 - DNA, 13 bp, Homo sapiens
cgcacctccttgg

SEQ ID NO: 3818188 - DNA, 17 bp, Homo sapiens
cgccacggcactccagc

SEQ ID NO: 3818189 - DNA, 23 bp, Homo sapiens
cgccaggggaaaatcagcctgct

SEQ ID NO: 3818190 - DNA, 23 bp, Homo sapiens
cgcctcccttatgcaggacatgt

SEQ ID NO: 3818191 - DNA, 15 bp, Homo sapiens
cgctgccttgccatg

SEQ ID NO: 3818192 - DNA, 23 bp, Homo sapiens
cgctggggaagggggctccatgc

SEQ ID NO: 3818193 - DNA, 20 bp, Homo sapiens
cgctgtgattggcaggaggc

SEQ ID NO: 3818194 - DNA, 15 bp, Homo sapiens
cgcttattgcccagg

SEQ ID NO: 3818195 - DNA, 18 bp, Homo sapiens
cggaaaatgccaatctct

SEQ ID NO: 3818196 - DNA, 13 bp, Homo sapiens
cggccctgcccaa

SEQ ID NO: 3818197 - DNA, 22 bp, Homo sapiens
cggcctccgtccaggagcctgg

SEQ ID NO: 3818198 - DNA, 15 bp, Homo sapiens
cggcctttggcttca

SEQ ID NO: 3818199 - DNA, 17 bp, Homo sapiens
cggctacccctcgactc

SEQ ID NO: 3818200 - DNA, 23 bp, Homo sapiens
cggctcctcgagatcccaacact

SEQ ID NO: 3818201 - DNA, 19 bp, Homo sapiens
cggctgcctgacactgagc

SEQ ID NO: 3818202 - DNA, 12 bp, Homo sapiens
cggctgggagga

SEQ ID NO: 3818203 - DNA, 22 bp, Homo sapiens
cggctgggaggagggcaggcat

SEQ ID NO: 3818204 - DNA, 22 bp, Homo sapiens
cggcttgcctgtaatcccagca

SEQ ID NO: 3818205 - DNA, 18 bp, Homo sapiens
cgggacacctaggctagg

SEQ ID NO: 3818206 - DNA, 19 bp, Homo sapiens
cggggcctgggcaggaggg

SEQ ID NO: 3818207 - DNA, 21 bp, Homo sapiens
cgggggcagtctgagagaggc

SEQ ID NO: 3818208 - DNA, 23 bp, Homo sapiens
ctcaggagtttgagaccaacctg

SEQ ID NO: 3818209 - DNA, 18 bp, Homo sapiens
ctcaggatgtcctttgtg

SEQ ID NO: 3818210 - DNA, 21 bp, Homo sapiens
ctcaggatgtcctttgtgtcc

SEQ ID NO: 3818211 - DNA, 20 bp, Homo sapiens
ctcaggtagggagctaagga

SEQ ID NO: 3818212 - DNA, 16 bp, Homo sapiens
ctcagtgtcagcactc

SEQ ID NO: 3818213 - DNA, 19 bp, Homo sapiens
ctcatttcttcctctgcat

SEQ ID NO: 3818214 - DNA, 17 bp, Homo sapiens
ctccaagtctctctgtg

SEQ ID NO: 3818215 - DNA, 18 bp, Homo sapiens
ctccaagtctctctgtga

SEQ ID NO: 3818216 - DNA, 20 bp, Homo sapiens
ctccaagtctctctgtgaat

SEQ ID NO: 3818217 - DNA, 15 bp, Homo sapiens
ctccacctcctgggt

SEQ ID NO: 3818218 - DNA, 19 bp, Homo sapiens
ctccagctgttcagctggt

SEQ ID NO: 3818219 - DNA, 14 bp, Homo sapiens
ctccagggacagaa

SEQ ID NO: 3818220 - DNA, 17 bp, Homo sapiens
ctccattggtgttgaca

SEQ ID NO: 3818221 - DNA, 18 bp, Homo sapiens
ctcccaaagtgctgggat

SEQ ID NO: 3818222 - DNA, 14 bp, Homo sapiens
ctcccagaaggctg

SEQ ID NO: 3818223 - DNA, 19 bp, Homo sapiens
ctcccagaaggctgggtcc

SEQ ID NO: 3818224 - DNA, 16 bp, Homo sapiens
ctcccaggagacagtt

SEQ ID NO: 3818225 - DNA, 19 bp, Homo sapiens
ctcccaggagacagttcaa

SEQ ID NO: 3818226 - DNA, 21 bp, Homo sapiens
ctcccagggccatgaactttg

SEQ ID NO: 3818227 - DNA, 14 bp, Homo sapiens
ctcccatggccttc

SEQ ID NO: 3818228 - DNA, 12 bp, Homo sapiens
ctccccagccct

SEQ ID NO: 3818229 - DNA, 12 bp, Homo sapiens
ctcccctcccag

SEQ ID NO: 3818230 - DNA, 14 bp, Homo sapiens
ctccctcagtgccc

SEQ ID NO: 3818231 - DNA, 18 bp, Homo sapiens
ctccctgaccttctccag

SEQ ID NO: 3818232 - DNA, 17 bp, Homo sapiens
ctccctttcttccctac

SEQ ID NO: 3818233 - DNA, 17 bp, Homo sapiens
ctccgcccagcctctcc

SEQ ID NO: 3818234 - DNA, 18 bp, Homo sapiens
ctccgctgggaggaacct

SEQ ID NO: 3818235 - DNA, 23 bp, Homo sapiens
ctccgctgggaggaacctgaacc

SEQ ID NO: 3818236 - DNA, 18 bp, Homo sapiens
ctccgtccaggagcctgg

SEQ ID NO: 3818237 - DNA, 19 bp, Homo sapiens
ctccgtccaggagcctggc

SEQ ID NO: 3818238 - DNA, 17 bp, Homo sapiens
ctcctcacccccagctt

SEQ ID NO: 3818239 - DNA, 21 bp, Homo sapiens
ctcctcacccccagctttgct

SEQ ID NO: 3818240 - DNA, 12 bp, Homo sapiens
ctcctcccagga

SEQ ID NO: 3818241 - DNA, 14 bp, Homo sapiens
ctcctcccatggcc

SEQ ID NO: 3818242 - DNA, 13 bp, Homo sapiens
ctcctcctgccct

SEQ ID NO: 3818243 - DNA, 17 bp, Homo sapiens
ctcctcgagatcccaac

SEQ ID NO: 3818244 - DNA, 21 bp, Homo sapiens
ctcctcgagatcccaacactg

SEQ ID NO: 3818245 - DNA, 15 bp, Homo sapiens
ctcctgacctcgtga

SEQ ID NO: 3818246 - DNA, 16 bp, Homo sapiens
ctcctgagtagctggg

SEQ ID NO: 3818247 - DNA, 12 bp, Homo sapiens
ctcctgcctcag

SEQ ID NO: 3818248 - DNA, 20 bp, Homo sapiens
ctcctgcctcagcctcctga

SEQ ID NO: 3818249 - DNA, 21 bp, Homo sapiens
ctcctgcctcagcctcctgag

SEQ ID NO: 3818250 - DNA, 18 bp, Homo sapiens
ctcctgctgcctaataaa

SEQ ID NO: 3818251 - DNA, 21 bp, Homo sapiens
ctcctgctgcctaataaagag

SEQ ID NO: 3818252 - DNA, 13 bp, Homo sapiens
ctcctgtccctac

SEQ ID NO: 3818253 - DNA, 14 bp, Homo sapiens
ctcctgtccctacc

SEQ ID NO: 3818254 - DNA, 22 bp, Homo sapiens
ctcctgtccctacccactcttt

SEQ ID NO: 3818255 - DNA, 13 bp, Homo sapiens
ctccttaaggctc

SEQ ID NO: 3818256 - DNA, 22 bp, Homo sapiens
ctccttcttaactctgcaggaa

SEQ ID NO: 3818257 - DNA, 13 bp, Homo sapiens
ctcgaactcctga

SEQ ID NO: 3818258 - DNA, 23 bp, Homo sapiens
ctcgaagaacaatgtcagaaact

SEQ ID NO: 3818259 - DNA, 12 bp, Homo sapiens
ctcgactcagca

SEQ ID NO: 3818260 - DNA, 16 bp, Homo sapiens
ctcgactctgctgctc

SEQ ID NO: 3818261 - DNA, 22 bp, Homo sapiens
ctcgagtgaatttctaaatgtt

SEQ ID NO: 3818262 - DNA, 18 bp, Homo sapiens
ctcgctctgctgcccagg

SEQ ID NO: 3818263 - DNA, 11 bp, Homo sapiens
ctcggtgcctt

SEQ ID NO: 3818264 - DNA, 18 bp, Homo sapiens
ctcgtgatttgcctgcct

SEQ ID NO: 3818265 - DNA, 14 bp, Homo sapiens
ctcgtggacacctg

SEQ ID NO: 3818266 - DNA, 15 bp, Homo sapiens
ctcgtggacacctgc

SEQ ID NO: 3818267 - DNA, 20 bp, Homo sapiens
ctcgtggacacctgccctgc

SEQ ID NO: 3818268 - DNA, 13 bp, Homo sapiens
ctctacaaaaagc

SEQ ID NO: 3818269 - DNA, 17 bp, Homo sapiens
ctctagaacacccactg

SEQ ID NO: 3818270 - DNA, 20 bp, Homo sapiens
ctctagaacacccactggcc

SEQ ID NO: 3818271 - DNA, 21 bp, Homo sapiens
ctctagaacacccactggcca

SEQ ID NO: 3818272 - DNA, 22 bp, Homo sapiens
ctctagaacacccactggccag

SEQ ID NO: 3818273 - DNA, 16 bp, Homo sapiens
ctctagacactgccac

SEQ ID NO: 3818274 - DNA, 19 bp, Homo sapiens
ctctagctttagctggagg

SEQ ID NO: 3818275 - DNA, 18 bp, Homo sapiens
ctctcaatattcaataaa

SEQ ID NO: 3818276 - DNA, 15 bp, Homo sapiens
ctctcactgtgtccc

SEQ ID NO: 3818277 - DNA, 17 bp, Homo sapiens
ctctccaagtctctctg

SEQ ID NO: 3818278 - DNA, 19 bp, Homo sapiens
ctctccactcatgtgactc

SEQ ID NO: 3818279 - DNA, 21 bp, Homo sapiens
ctctccactcatgtgactctt

SEQ ID NO: 3818280 - DNA, 22 bp, Homo sapiens
ctctccactcatgtgactcttt

SEQ ID NO: 3818281 - DNA, 15 bp, Homo sapiens
ctctccggtctctct

SEQ ID NO: 3818282 - DNA, 19 bp, Homo sapiens
ctctcgggttgtgtgtctg

SEQ ID NO: 3818283 - DNA, 19 bp, Homo sapiens
ctctctacaaactcccact

SEQ ID NO: 3818284 - DNA, 15 bp, Homo sapiens
ctctctgtgaataca

SEQ ID NO: 3818285 - DNA, 19 bp, Homo sapiens
ctctgaatgtcccagaggc

SEQ ID NO: 3818286 - DNA, 23 bp, Homo sapiens
ctctgaggagtggagttctctgt

SEQ ID NO: 3818287 - DNA, 15 bp, Homo sapiens
ctctgaggtcaataa

SEQ ID NO: 3818288 - DNA, 21 bp, Homo sapiens
ctctgaggtcaataaagcaga

SEQ ID NO: 3818289 - DNA, 22 bp, Homo sapiens
ctctgatggttcttcacctcct

SEQ ID NO: 3818290 - DNA, 20 bp, Homo sapiens
ctctgattttcaaagctttt

SEQ ID NO: 3818291 - DNA, 22 bp, Homo sapiens
ctctgattttcaaagctttttc

SEQ ID NO: 3818292 - DNA, 10 bp, Homo sapiens
ctctgcacaa

SEQ ID NO: 3818293 - DNA, 14 bp, Homo sapiens
ctctgcacaagctg

SEQ ID NO: 3818294 - DNA, 13 bp, Homo sapiens
ctctgcaggcaga

SEQ ID NO: 3818295 - DNA, 17 bp, Homo sapiens
ctctgcccagcctgccc

SEQ ID NO: 3818296 - DNA, 23 bp, Homo sapiens
ctctgcccagcctgccccagcct

SEQ ID NO: 3818297 - DNA, 20 bp, Homo sapiens
ctctgcccgggagctcagga

SEQ ID NO: 3818298 - DNA, 16 bp, Homo sapiens
ctctgcttcagtccac

SEQ ID NO: 3818299 - DNA, 20 bp, Homo sapiens
ctctgtgaatacaattaaag

SEQ ID NO: 3818300 - DNA, 22 bp, Homo sapiens
ctctgtgaatacaattaaaggt

SEQ ID NO: 3818301 - DNA, 20 bp, Homo sapiens
ctctgtgcacttatttatga

SEQ ID NO: 3818302 - DNA, 15 bp, Homo sapiens
ctctgtgtgcacaaa

SEQ ID NO: 3818303 - DNA, 19 bp, Homo sapiens
ctctgttcctgagccccca

SEQ ID NO: 3818304 - DNA, 22 bp, Homo sapiens
ctctgttgcccaggctggagtg

SEQ ID NO: 3818305 - DNA, 22 bp, Homo sapiens
ctcttcttattcatgctttctc

SEQ ID NO: 3818306 - DNA, 13 bp, Homo sapiens
ctcttgagcctgg

SEQ ID NO: 3818307 - DNA, 13 bp, Homo sapiens
ctcttggccagag

SEQ ID NO: 3818308 - DNA, 21 bp, Homo sapiens
ctcttggggagtttagggtgg

SEQ ID NO: 3818309 - DNA, 13 bp, Homo sapiens
ctcttgtctggct

SEQ ID NO: 3818310 - DNA, 14 bp, Homo sapiens
ctcttgtctggctg

SEQ ID NO: 3818311 - DNA, 13 bp, Homo sapiens
ctctttaaaatat

SEQ ID NO: 3818312 - DNA, 15 bp, Homo sapiens
ctctttggacactca

SEQ ID NO: 3818313 - DNA, 18 bp, Homo sapiens
ctctttggacactcacac

SEQ ID NO: 3818314 - DNA, 22 bp, Homo sapiens
ctcttttcctttggtccttcaa

SEQ ID NO: 3818315 - DNA, 14 bp, Homo sapiens
ctgaaagccagctg

SEQ ID NO: 3818316 - DNA, 15 bp, Homo sapiens
ctgaaagccctgagc

SEQ ID NO: 3818317 - DNA, 13 bp, Homo sapiens
ctgggcaggaggg

SEQ ID NO: 3818318 - DNA, 12 bp, Homo sapiens
ctgggcagtgcc

SEQ ID NO: 3818319 - DNA, 13 bp, Homo sapiens
ctgggcagtgccc

SEQ ID NO: 3818320 - DNA, 19 bp, Homo sapiens
ctgggccaactcacctgag

SEQ ID NO: 3818321 - DNA, 19 bp, Homo sapiens
ctgggcctcagcctccagg

SEQ ID NO: 3818322 - DNA, 15 bp, Homo sapiens
ctgggcgacagagca

SEQ ID NO: 3818323 - DNA, 16 bp, Homo sapiens
ctgggcgacagagcaa

SEQ ID NO: 3818324 - DNA, 18 bp, Homo sapiens
ctgggcgacagagcaaga

SEQ ID NO: 3818325 - DNA, 18 bp, Homo sapiens
ctgggcttgtctgtagat

SEQ ID NO: 3818326 - DNA, 17 bp, Homo sapiens
ctggggatgtctctcat

SEQ ID NO: 3818327 - DNA, 20 bp, Homo sapiens
ctgggtgacccccactgccg

SEQ ID NO: 3818328 - DNA, 23 bp, Homo sapiens
ctgggtgagctgagatggagtcc

SEQ ID NO: 3818329 - DNA, 21 bp, Homo sapiens
ctgggtggcaccagcagcctg

SEQ ID NO: 3818330 - DNA, 19 bp, Homo sapiens
ctgggttgtcactgagact

SEQ ID NO: 3818331 - DNA, 20 bp, Homo sapiens
ctggtatgaacttgaggaca

SEQ ID NO: 3818332 - DNA, 22 bp, Homo sapiens
ctggtattttaagagaaaactg

SEQ ID NO: 3818333 - DNA, 22 bp, Homo sapiens
ctggtctcgaactcctgacctc

SEQ ID NO: 3818334 - DNA, 18 bp, Homo sapiens
ctggtcttgtggaattgg

SEQ ID NO: 3818335 - DNA, 20 bp, Homo sapiens
ctggtcttgtggaattggga

SEQ ID NO: 3818336 - DNA, 17 bp, Homo sapiens
ctggtgggcagctgagg

SEQ ID NO: 3818337 - DNA, 14 bp, Homo sapiens
ctgtacctctgcct

SEQ ID NO: 3818338 - DNA, 19 bp, Homo sapiens
ctgtagaactctgcaggca

SEQ ID NO: 3818339 - DNA, 21 bp, Homo sapiens
ctgtagaactctgcaggcaga

SEQ ID NO: 3818340 - DNA, 15 bp, Homo sapiens
ctgtagagtgggagc

SEQ ID NO: 3818341 - DNA, 16 bp, Homo sapiens
ctgtcatagaaattac

SEQ ID NO: 3818342 - DNA, 22 bp, Homo sapiens
ctgtcccaggagcaaatgctgg

SEQ ID NO: 3818343 - DNA, 20 bp, Homo sapiens
ctgtccccctcccctcccag

SEQ ID NO: 3818344 - DNA, 19 bp, Homo sapiens
ctgtccctacccactcttt

SEQ ID NO: 3818345 - DNA, 16 bp, Homo sapiens
ctgtctcaaaaaaaga

SEQ ID NO: 3818346 - DNA, 21 bp, Homo sapiens
ctgtctccctcctctgcccgg

SEQ ID NO: 3818347 - DNA, 16 bp, Homo sapiens
ctgtctgtctgtccca

SEQ ID NO: 3818348 - DNA, 17 bp, Homo sapiens
ctgtctgtctgtcccaa

SEQ ID NO: 3818349 - DNA, 20 bp, Homo sapiens
ctgtcttttgaagaagttct

SEQ ID NO: 3818350 - DNA, 14 bp, Homo sapiens
ctgtgaatacaatt

SEQ ID NO: 3818351 - DNA, 15 bp, Homo sapiens
ctgtgaatacaatta

SEQ ID NO: 3818352 - DNA, 16 bp, Homo sapiens
ctgtgaatacaattaa

SEQ ID NO: 3818353 - DNA, 22 bp, Homo sapiens
ctgtgaatacaattaaaggtcc

SEQ ID NO: 3818354 - DNA, 17 bp, Homo sapiens
ctgtgattggcaggagg

SEQ ID NO: 3818355 - DNA, 22 bp, Homo sapiens
ctgtgccagaggaaggaaaagg

SEQ ID NO: 3818356 - DNA, 16 bp, Homo sapiens
ctgtgccttttgccat

SEQ ID NO: 3818357 - DNA, 17 bp, Homo sapiens
ctgtgcttttaaatgca

SEQ ID NO: 3818358 - DNA, 18 bp, Homo sapiens
ctgtggcctaacctgccg

SEQ ID NO: 3818359 - DNA, 15 bp, Homo sapiens
ctgtggccttggtct

SEQ ID NO: 3818360 - DNA, 14 bp, Homo sapiens
ctgtggctctgcat

SEQ ID NO: 3818361 - DNA, 19 bp, Homo sapiens
ctgtgtcagcatagaagta

SEQ ID NO: 3818362 - DNA, 20 bp, Homo sapiens
ctgtgtgtttatgtgtgtgt

SEQ ID NO: 3818363 - DNA, 21 bp, Homo sapiens
ctgttattttttatttccaca

SEQ ID NO: 3818364 - DNA, 16 bp, Homo sapiens
ctgttcacttttcctc

SEQ ID NO: 3818365 - DNA, 18 bp, Homo sapiens
ctgttcagctggttgagg

SEQ ID NO: 3818366 - DNA, 18 bp, Homo sapiens
ctgttctagagtgacagg

SEQ ID NO: 3818367 - DNA, 17 bp, Homo sapiens
ctgttgaatttcccaca

SEQ ID NO: 3818368 - DNA, 23 bp, Homo sapiens
ctgttgttgaggtggtggtagtg

SEQ ID NO: 3818369 - DNA, 14 bp, Homo sapiens
ctgtttaatttaca

SEQ ID NO: 3818370 - DNA, 13 bp, Homo sapiens
ctgttttctaatc

SEQ ID NO: 3818371 - DNA, 14 bp, Homo sapiens
ctgttttctcttga

SEQ ID NO: 3818372 - DNA, 16 bp, Homo sapiens
cttaaaaagtggaaaa

SEQ ID NO: 3818373 - DNA, 17 bp, Homo sapiens
cttaaaaagtggaaaaa

SEQ ID NO: 3818374 - DNA, 18 bp, Homo sapiens
cttaaatacgttgttaaa

SEQ ID NO: 3818375 - DNA, 16 bp, Homo sapiens
cttaaggccacactgg

SEQ ID NO: 3818376 - DNA, 17 bp, Homo sapiens
cttaaggccacactggc

SEQ ID NO: 3818377 - DNA, 22 bp, Homo sapiens
cttaaggccacactggcatctc

SEQ ID NO: 3818378 - DNA, 15 bp, Homo sapiens
cttaaggctcttttg

SEQ ID NO: 3818379 - DNA, 19 bp, Homo sapiens
cttagaattagtggcactt

SEQ ID NO: 3818380 - DNA, 17 bp, Homo sapiens
cttagccttgctgtaga

SEQ ID NO: 3818381 - DNA, 21 bp, Homo sapiens
cttaggttggcaaaaaggcag

SEQ ID NO: 3818382 - DNA, 23 bp, Homo sapiens
cttatatacaatgcttctttcct

SEQ ID NO: 3818383 - DNA, 20 bp, Homo sapiens
cttatgcaggacatgtgctc

SEQ ID NO: 3818384 - DNA, 22 bp, Homo sapiens
cttattcatgctttctcctttt

SEQ ID NO: 3818385 - DNA, 23 bp, Homo sapiens
cttattcatgctttctccttttt

SEQ ID NO: 3818386 - DNA, 16 bp, Homo sapiens
cttattgcccaggctg

SEQ ID NO: 3818387 - DNA, 21 bp, Homo sapiens
cttattgcctgggcagtgccc

SEQ ID NO: 3818388 - DNA, 18 bp, Homo sapiens
cttattggcagctctact

SEQ ID NO: 3818389 - DNA, 18 bp, Homo sapiens
cttattttcaagaaactg

SEQ ID NO: 3818390 - DNA, 19 bp, Homo sapiens
cttattttcaagaaactga

SEQ ID NO: 3818391 - DNA, 15 bp, Homo sapiens
cttcacggaagagcc

SEQ ID NO: 3818392 - DNA, 19 bp, Homo sapiens
cttcacggaagagccttgc

SEQ ID NO: 3818393 - DNA, 15 bp, Homo sapiens
cttcactgctctgcc

SEQ ID NO: 3818394 - DNA, 19 bp, Homo sapiens
cttcactgctctgccccca

SEQ ID NO: 3818395 - DNA, 14 bp, Homo sapiens
cttcagatcctacc

SEQ ID NO: 3818396 - DNA, 19 bp, Homo sapiens
cttcaggagctgacagagc

SEQ ID NO: 3818397 - DNA, 16 bp, Homo sapiens
cttcagtaagccgtga

SEQ ID NO: 3818398 - DNA, 17 bp, Homo sapiens
cttcatgaaaatcctac

SEQ ID NO: 3818399 - DNA, 18 bp, Homo sapiens
cttcatgaaaatcctacc

SEQ ID NO: 3818400 - DNA, 18 bp, Homo sapiens
cttccaaatcaggctggg

SEQ ID NO: 3818401 - DNA, 14 bp, Homo sapiens
cttccaaccccagc

SEQ ID NO: 3818402 - DNA, 16 bp, Homo sapiens
cttccaaccccagctg

SEQ ID NO: 3818403 - DNA, 23 bp, Homo sapiens
cttccaccaagttggaacatcct

SEQ ID NO: 3818404 - DNA, 20 bp, Homo sapiens
cttccaggtgcctggccctt

SEQ ID NO: 3818405 - DNA, 17 bp, Homo sapiens
cttccctacagttgaaa

SEQ ID NO: 3818406 - DNA, 13 bp, Homo sapiens
cttccctgctttt

SEQ ID NO: 3818407 - DNA, 17 bp, Homo sapiens
cttccctgggcctcagc

SEQ ID NO: 3818408 - DNA, 21 bp, Homo sapiens
cttccctgggcctcagcctcc

SEQ ID NO: 3818409 - DNA, 15 bp, Homo sapiens
cttccctggggcccc

SEQ ID NO: 3818410 - DNA, 23 bp, Homo sapiens
cttccgtcacccttggtagagtt

SEQ ID NO: 3818411 - DNA, 15 bp, Homo sapiens
cttcctaacttattg

SEQ ID NO: 3818412 - DNA, 21 bp, Homo sapiens
cttcctaacttattgcctggg

SEQ ID NO: 3818413 - DNA, 22 bp, Homo sapiens
cttcctagttttctcctcccag

SEQ ID NO: 3818414 - DNA, 23 bp, Homo sapiens
cttcctagttttctcctcccagg

SEQ ID NO: 3818415 - DNA, 19 bp, Homo sapiens
cttcctctcctgtctccct

SEQ ID NO: 3818416 - DNA, 16 bp, Homo sapiens
cttccttaccgtgggc

SEQ ID NO: 3818417 - DNA, 20 bp, Homo sapiens
cttcgggaggtcgaggcagg

SEQ ID NO: 3818418 - DNA, 21 bp, Homo sapiens
cttcgggaggtcgaggcagga

SEQ ID NO: 3818419 - DNA, 16 bp, Homo sapiens
cttctagttctgccag

SEQ ID NO: 3818420 - DNA, 19 bp, Homo sapiens
cttctagttctgccaggag

SEQ ID NO: 3818421 - DNA, 16 bp, Homo sapiens
cttctcactgccatgc

SEQ ID NO: 3818422 - DNA, 21 bp, Homo sapiens
cttctcactgccatgccagct

SEQ ID NO: 3818423 - DNA, 22 bp, Homo sapiens
cttctcagagcagcactggggt

SEQ ID NO: 3818424 - DNA, 12 bp, Homo sapiens
cttctgcctcag

SEQ ID NO: 3818425 - DNA, 16 bp, Homo sapiens
tgaggtgacttgcctg

SEQ ID NO: 3818426 - DNA, 19 bp, Homo sapiens
tgaggtttcaaacctccct

SEQ ID NO: 3818427 - DNA, 13 bp, Homo sapiens
tgagtccagctcc

SEQ ID NO: 3818428 - DNA, 14 bp, Homo sapiens
tgagtgtgactttt

SEQ ID NO: 3818429 - DNA, 17 bp, Homo sapiens
tgagtgtgactttttga

SEQ ID NO: 3818430 - DNA, 16 bp, Homo sapiens
tgagttgattcagctc

SEQ ID NO: 3818431 - DNA, 17 bp, Homo sapiens
tgagttggctgggaata

SEQ ID NO: 3818432 - DNA, 24 bp, Homo sapiens
tgataagcagtcatcctcagatca

SEQ ID NO: 3818433 - DNA, 12 bp, Homo sapiens
tgataagtaatg

SEQ ID NO: 3818434 - DNA, 19 bp, Homo sapiens
tgatacttccaagtgataa

SEQ ID NO: 3818435 - DNA, 14 bp, Homo sapiens
tgatatccacaaat

SEQ ID NO: 3818436 - DNA, 20 bp, Homo sapiens
tgatatccacaaatgctatt

SEQ ID NO: 3818437 - DNA, 21 bp, Homo sapiens
tgatctaatgaagtgtttcct

SEQ ID NO: 3818438 - DNA, 12 bp, Homo sapiens
tgatctcctgag

SEQ ID NO: 3818439 - DNA, 13 bp, Homo sapiens
tgatctcctgagc

SEQ ID NO: 3818440 - DNA, 16 bp, Homo sapiens
tgatctcggctcactg

SEQ ID NO: 3818441 - DNA, 14 bp, Homo sapiens
tgatgatcctaggc

SEQ ID NO: 3818442 - DNA, 24 bp, Homo sapiens
tgatgcattcccggtgcagaacag

SEQ ID NO: 3818443 - DNA, 13 bp, Homo sapiens
tgatgctgaaata

SEQ ID NO: 3818444 - DNA, 14 bp, Homo sapiens
tgatggaaccttaa

SEQ ID NO: 3818445 - DNA, 15 bp, Homo sapiens
tgatggcaattttgt

SEQ ID NO: 3818446 - DNA, 15 bp, Homo sapiens
tgatgggtcagttgt

SEQ ID NO: 3818447 - DNA, 19 bp, Homo sapiens
tgatggttcttcacctcct

SEQ ID NO: 3818448 - DNA, 16 bp, Homo sapiens
tgatgtttaaaagtcc

SEQ ID NO: 3818449 - DNA, 19 bp, Homo sapiens
tgattaaccacttcagctg

SEQ ID NO: 3818450 - DNA, 13 bp, Homo sapiens
tgattcagctctg

SEQ ID NO: 3818451 - DNA, 14 bp, Homo sapiens
tgattccagcaaga

SEQ ID NO: 3818452 - DNA, 17 bp, Homo sapiens
tgattcctttgaagagg

SEQ ID NO: 3818453 - DNA, 13 bp, Homo sapiens
tgatttaatatct

SEQ ID NO: 3818454 - DNA, 19 bp, Homo sapiens
tgcacacacacggatgcac

SEQ ID NO: 3818455 - DNA, 20 bp, Homo sapiens
tgcacacacacggatgcaca

SEQ ID NO: 3818456 - DNA, 21 bp, Homo sapiens
tgcacacacacggatgcacac

SEQ ID NO: 3818457 - DNA, 23 bp, Homo sapiens
tgcacacacagatgcacacacag

SEQ ID NO: 3818458 - DNA, 23 bp, Homo sapiens
tgcacattttgtacaaagatatg

SEQ ID NO: 3818459 - DNA, 14 bp, Homo sapiens
tgcaccactgcact

SEQ ID NO: 3818460 - DNA, 19 bp, Homo sapiens
tgcacccctttttcccgcc

SEQ ID NO: 3818461 - DNA, 16 bp, Homo sapiens
tgcaccggggcctggg

SEQ ID NO: 3818462 - DNA, 14 bp, Homo sapiens
tgcactccagcctg

SEQ ID NO: 3818463 - DNA, 15 bp, Homo sapiens
tgcactccagcctgg

SEQ ID NO: 3818464 - DNA, 17 bp, Homo sapiens
tgcactggccccaccct

SEQ ID NO: 3818465 - DNA, 21 bp, Homo sapiens
tgcagatctttttgtgaaatt

SEQ ID NO: 3818466 - DNA, 18 bp, Homo sapiens
tgcaggaaatcagagctg

SEQ ID NO: 3818467 - DNA, 20 bp, Homo sapiens
tgcaggaaatcagagctggc

SEQ ID NO: 3818468 - DNA, 23 bp, Homo sapiens
tgcaggcagatttactgtcccag

SEQ ID NO: 3818469 - DNA, 17 bp, Homo sapiens
tgcaggcccagcagact

SEQ ID NO: 3818470 - DNA, 13 bp, Homo sapiens
tgcatgcaactaa

SEQ ID NO: 3818471 - DNA, 22 bp, Homo sapiens
tgcattcacagcgcctcctgga

SEQ ID NO: 3818472 - DNA, 16 bp, Homo sapiens
tgcattctagtgcaga

SEQ ID NO: 3818473 - DNA, 19 bp, Homo sapiens
tgccaatcggctacccctc

SEQ ID NO: 3818474 - DNA, 20 bp, Homo sapiens
tgccaatcggctacccctcg

SEQ ID NO: 3818475 - DNA, 23 bp, Homo sapiens
tgccaatcggctacccctcgact

SEQ ID NO: 3818476 - DNA, 13 bp, Homo sapiens
tgccacctgtctg

SEQ ID NO: 3818477 - DNA, 15 bp, Homo sapiens
tgccacctgtctgtc

SEQ ID NO: 3818478 - DNA, 16 bp, Homo sapiens
tgccacctgtctgtct

SEQ ID NO: 3818479 - DNA, 17 bp, Homo sapiens
tgccagagccttaataa

SEQ ID NO: 3818480 - DNA, 18 bp, Homo sapiens
tgccagcttatctcaggg

SEQ ID NO: 3818481 - DNA, 14 bp, Homo sapiens
tgccaggcatggtg

SEQ ID NO: 3818482 - DNA, 11 bp, Homo sapiens
tgccattccca

SEQ ID NO: 3818483 - DNA, 12 bp, Homo sapiens
tgccattcccac

SEQ ID NO: 3818484 - DNA, 19 bp, Homo sapiens
tgcccaagggcctcccacc

SEQ ID NO: 3818485 - DNA, 21 bp, Homo sapiens
tgcccaagggcctcccaccag

SEQ ID NO: 3818486 - DNA, 16 bp, Homo sapiens
tgcccagcctgcccca

SEQ ID NO: 3818487 - DNA, 12 bp, Homo sapiens
tgcccaggctgg

SEQ ID NO: 3818488 - DNA, 17 bp, Homo sapiens
tgccccagcctcccagc

SEQ ID NO: 3818489 - DNA, 21 bp, Homo sapiens
tgccccatctcctcccatggc

SEQ ID NO: 3818490 - DNA, 19 bp, Homo sapiens
tgcccccaactcccggagg

SEQ ID NO: 3818491 - DNA, 18 bp, Homo sapiens
tgcccgcctcggcctccc

SEQ ID NO: 3818492 - DNA, 15 bp, Homo sapiens
tgccctgccacctgt

SEQ ID NO: 3818493 - DNA, 22 bp, Homo sapiens
tgccctgccacctgtctgtctg

SEQ ID NO: 3818494 - DNA, 12 bp, Homo sapiens
tgccgcctcctt

SEQ ID NO: 3818495 - DNA, 15 bp, Homo sapiens
tgcctaataaagaga

SEQ ID NO: 3818496 - DNA, 15 bp, Homo sapiens
tgcctcagcctcctg

SEQ ID NO: 3818497 - DNA, 24 bp, Homo sapiens
tgcctcctcacccccagctttgct

SEQ ID NO: 3818498 - DNA, 17 bp, Homo sapiens
tgcctgacactgagccc

SEQ ID NO: 3818499 - DNA, 18 bp, Homo sapiens
tgcctgacactgagcccc

SEQ ID NO: 3818500 - DNA, 23 bp, Homo sapiens
tgcctgaccctacttcttttgct

SEQ ID NO: 3818501 - DNA, 14 bp, Homo sapiens
tgcctgcctgggcc

SEQ ID NO: 3818502 - DNA, 16 bp, Homo sapiens
tgcctgggcagtgccc

SEQ ID NO: 3818503 - DNA, 16 bp, Homo sapiens
tgccttcctgtttaaa

SEQ ID NO: 3818504 - DNA, 21 bp, Homo sapiens
tgccttcctgtttaaaaaaag

SEQ ID NO: 3818505 - DNA, 13 bp, Homo sapiens
tgcgaaaggatga

SEQ ID NO: 3818506 - DNA, 19 bp, Homo sapiens
tgcgaaaggatgaaagtga

SEQ ID NO: 3818507 - DNA, 22 bp, Homo sapiens
tgcgcacacacaccgatgtaca

SEQ ID NO: 3818508 - DNA, 22 bp, Homo sapiens
tgcgcacacacagatatgcaca

SEQ ID NO: 3818509 - DNA, 17 bp, Homo sapiens
tgcggcctttggcttca

SEQ ID NO: 3818510 - DNA, 19 bp, Homo sapiens
tgcggcctttggcttcacg

SEQ ID NO: 3818511 - DNA, 21 bp, Homo sapiens
tgcgtgggtggggagggaggt

SEQ ID NO: 3818512 - DNA, 12 bp, Homo sapiens
tgctacaataaa

SEQ ID NO: 3818513 - DNA, 20 bp, Homo sapiens
tgctatctctgtgtgcacaa

SEQ ID NO: 3818514 - DNA, 18 bp, Homo sapiens
tgctattgtagagccaga

SEQ ID NO: 3818515 - DNA, 22 bp, Homo sapiens
tgctattgtagagccagaggtc

SEQ ID NO: 3818516 - DNA, 16 bp, Homo sapiens
tgctccagctgttcag

SEQ ID NO: 3818517 - DNA, 20 bp, Homo sapiens
tgctccagctgttcagctgg

SEQ ID NO: 3818518 - DNA, 21 bp, Homo sapiens
tgctccagctgttcagctggt

SEQ ID NO: 3818519 - DNA, 15 bp, Homo sapiens
tgctcctcctgccct

SEQ ID NO: 3818520 - DNA, 16 bp, Homo sapiens
tgctcctcctgccctg

SEQ ID NO: 3818521 - DNA, 18 bp, Homo sapiens
tgctcgcctctgcccagc

SEQ ID NO: 3818522 - DNA, 23 bp, Homo sapiens
tgctctgaggtcaataaagcaga

SEQ ID NO: 3818523 - DNA, 18 bp, Homo sapiens
tgctgaatacagaggcaa

SEQ ID NO: 3818524 - DNA, 23 bp, Homo sapiens
tgctgaatacagaggcaactgca

SEQ ID NO: 3818525 - DNA, 21 bp, Homo sapiens
tgctgactactactctgccaa

SEQ ID NO: 3818526 - DNA, 16 bp, Homo sapiens
tgctgatgctgaaata

SEQ ID NO: 3818527 - DNA, 13 bp, Homo sapiens
tgctgcctaataa

SEQ ID NO: 3818528 - DNA, 17 bp, Homo sapiens
tgctgcctaataaagag

SEQ ID NO: 3818529 - DNA, 14 bp, Homo sapiens
tgctgcttcctaac

SEQ ID NO: 3818530 - DNA, 14 bp, Homo sapiens
tgctggactgtcat

SEQ ID NO: 3818531 - DNA, 22 bp, Homo sapiens
tgctggagacagtagaggcatg

SEQ ID NO: 3818532 - DNA, 16 bp, Homo sapiens
tgctggcctcaggctg

SEQ ID NO: 3818533 - DNA, 15 bp, Homo sapiens
tgtaaactcaaaata

SEQ ID NO: 3818534 - DNA, 16 bp, Homo sapiens
tgtaaatttatgtgat

SEQ ID NO: 3818535 - DNA, 17 bp, Homo sapiens
tgtaactttctgaaata

SEQ ID NO: 3818536 - DNA, 16 bp, Homo sapiens
tgtaacttttgtaaga

SEQ ID NO: 3818537 - DNA, 21 bp, Homo sapiens
tgtaagacaaaggttttcctc

SEQ ID NO: 3818538 - DNA, 23 bp, Homo sapiens
tgtaatcccagctattcaggagg

SEQ ID NO: 3818539 - DNA, 13 bp, Homo sapiens
tgtacaaaataaa

SEQ ID NO: 3818540 - DNA, 22 bp, Homo sapiens
tgtacaaaataaacaaataaca

SEQ ID NO: 3818541 - DNA, 12 bp, Homo sapiens
tgtacattatgt

SEQ ID NO: 3818542 - DNA, 20 bp, Homo sapiens
tgtagtgatttttatgccac

SEQ ID NO: 3818543 - DNA, 22 bp, Homo sapiens
tgtatattctcttgtctggctg

SEQ ID NO: 3818544 - DNA, 17 bp, Homo sapiens
tgtatattttaatgaat

SEQ ID NO: 3818545 - DNA, 23 bp, Homo sapiens
tgtatggaaataaatgtatcata

SEQ ID NO: 3818546 - DNA, 17 bp, Homo sapiens
tgtatgtgacaacattt

SEQ ID NO: 3818547 - DNA, 12 bp, Homo sapiens
tgtatgtggggg

SEQ ID NO: 3818548 - DNA, 11 bp, Homo sapiens
tgtatgtggtt

SEQ ID NO: 3818549 - DNA, 22 bp, Homo sapiens
tgtcacccttaggccagcacca

SEQ ID NO: 3818550 - DNA, 15 bp, Homo sapiens
tgtcaccttcctagt

SEQ ID NO: 3818551 - DNA, 13 bp, Homo sapiens
tgtcactgagact

SEQ ID NO: 3818552 - DNA, 19 bp, Homo sapiens
tgtcagtatgtggaagtgt

SEQ ID NO: 3818553 - DNA, 20 bp, Homo sapiens
tgtcagtatgtggaagtgtg

SEQ ID NO: 3818554 - DNA, 16 bp, Homo sapiens
tgtcatagaaattaca

SEQ ID NO: 3818555 - DNA, 23 bp, Homo sapiens
tgtcattaaatggggctcacaaa

SEQ ID NO: 3818556 - DNA, 20 bp, Homo sapiens
tgtccagaccattgtcttcc

SEQ ID NO: 3818557 - DNA, 21 bp, Homo sapiens
tgtccagaccattgtcttcca

SEQ ID NO: 3818558 - DNA, 22 bp, Homo sapiens
tgtccagcttctcttgaaaact

SEQ ID NO: 3818559 - DNA, 14 bp, Homo sapiens
tgtccagtttccaa

SEQ ID NO: 3818560 - DNA, 14 bp, Homo sapiens
tgtcccaggtcctc

SEQ ID NO: 3818561 - DNA, 16 bp, Homo sapiens
tgtccctacccactct

SEQ ID NO: 3818562 - DNA, 21 bp, Homo sapiens
tgtcctcagccccgcgtggaa

SEQ ID NO: 3818563 - DNA, 23 bp, Homo sapiens
tgtcctgttattttttatttcca

SEQ ID NO: 3818564 - DNA, 18 bp, Homo sapiens
tgtctactcctcacagca

SEQ ID NO: 3818565 - DNA, 17 bp, Homo sapiens
tgtctggcacagcctgg

SEQ ID NO: 3818566 - DNA, 21 bp, Homo sapiens
tgtctggtggtggcaccatct

SEQ ID NO: 3818567 - DNA, 15 bp, Homo sapiens
tgtgaaaagaaaaat

SEQ ID NO: 3818568 - DNA, 23 bp, Homo sapiens
tgtgaaaagaaaaatgagcctgg

SEQ ID NO: 3818569 - DNA, 23 bp, Homo sapiens
tgtgaaattcaacctgtgtctta

SEQ ID NO: 3818570 - DNA, 11 bp, Homo sapiens
tgtgaatacaa

SEQ ID NO: 3818571 - DNA, 17 bp, Homo sapiens
tgtgaatacaattaaag

SEQ ID NO: 3818572 - DNA, 12 bp, Homo sapiens
tgtgactctttc

SEQ ID NO: 3818573 - DNA, 14 bp, Homo sapiens
tgtgactctttcca

SEQ ID NO: 3818574 - DNA, 15 bp, Homo sapiens
tgtgactctttccaa

SEQ ID NO: 3818575 - DNA, 17 bp, Homo sapiens
tgtgcacttatttatga

SEQ ID NO: 3818576 - DNA, 15 bp, Homo sapiens
tgtgcctcctcaccc

SEQ ID NO: 3818577 - DNA, 15 bp, Homo sapiens
tgtgcctgaccctac

SEQ ID NO: 3818578 - DNA, 17 bp, Homo sapiens
tgtgccttggtgtgctg

SEQ ID NO: 3818579 - DNA, 20 bp, Homo sapiens
tgtgccttgtcacgccagac

SEQ ID NO: 3818580 - DNA, 23 bp, Homo sapiens
tgtgcctttgggaggcagcatca

SEQ ID NO: 3818581 - DNA, 16 bp, Homo sapiens
tgtgccttttgccatc

SEQ ID NO: 3818582 - DNA, 13 bp, Homo sapiens
tgtgctctcggct

SEQ ID NO: 3818583 - DNA, 12 bp, Homo sapiens
tgtggagaagcg

SEQ ID NO: 3818584 - DNA, 19 bp, Homo sapiens
tgtggcactggggcagggg

SEQ ID NO: 3818585 - DNA, 19 bp, Homo sapiens
tgtggcatccagagtccct

SEQ ID NO: 3818586 - DNA, 21 bp, Homo sapiens
tgtggcatccagagtccctgc

SEQ ID NO: 3818587 - DNA, 14 bp, Homo sapiens
tgtgggagtgtgta

SEQ ID NO: 3818588 - DNA, 12 bp, Homo sapiens
tgtggtttcatt

SEQ ID NO: 3818589 - DNA, 19 bp, Homo sapiens
tgtgtaatttaaaattgtg

SEQ ID NO: 3818590 - DNA, 20 bp, Homo sapiens
tgtgtagggcttttttttga

SEQ ID NO: 3818591 - DNA, 16 bp, Homo sapiens
tgtgtccctctctctg

SEQ ID NO: 3818592 - DNA, 15 bp, Homo sapiens
tgtgtgggagtgtgt

SEQ ID NO: 3818593 - DNA, 13 bp, Homo sapiens
tgtgtgtgtgtat

SEQ ID NO: 3818594 - DNA, 14 bp, Homo sapiens
tgtgttgtgtgtgg

SEQ ID NO: 3818595 - DNA, 13 bp, Homo sapiens
tgtgtttatgtgt

SEQ ID NO: 3818596 - DNA, 16 bp, Homo sapiens
tgttacctgagatact

SEQ ID NO: 3818597 - DNA, 15 bp, Homo sapiens
tgttactgtcttcag

SEQ ID NO: 3818598 - DNA, 20 bp, Homo sapiens
tgttatgggatgtaaacaat

SEQ ID NO: 3818599 - DNA, 16 bp, Homo sapiens
tgttcacttttcctcc

SEQ ID NO: 3818600 - DNA, 11 bp, Homo sapiens
tgttcagctgg

SEQ ID NO: 3818601 - DNA, 14 bp, Homo sapiens
tgttccataataaa

SEQ ID NO: 3818602 - DNA, 16 bp, Homo sapiens
tgttctaactcttaga

SEQ ID NO: 3818603 - DNA, 16 bp, Homo sapiens
tgttctctcttctcca

SEQ ID NO: 3818604 - DNA, 20 bp, Homo sapiens
tgttctgtccagtttccaaa

SEQ ID NO: 3818605 - DNA, 17 bp, Homo sapiens
tgttcttacctgtatgt

SEQ ID NO: 3818606 - DNA, 20 bp, Homo sapiens
tgttctttggaaatacacag

SEQ ID NO: 3818607 - DNA, 14 bp, Homo sapiens
tgttgaaaatgttc

SEQ ID NO: 3818608 - DNA, 17 bp, Homo sapiens
tgttgaaaatgttcaga

SEQ ID NO: 3818609 - DNA, 17 bp, Homo sapiens
tgttgatttgagaaatt

SEQ ID NO: 3818610 - DNA, 14 bp, Homo sapiens
tgttgtgtgtggga

SEQ ID NO: 3818611 - DNA, 21 bp, Homo sapiens
tgtttacagaggacagtattt

SEQ ID NO: 3818612 - DNA, 16 bp, Homo sapiens
tgtttatgtgtgtgtg

SEQ ID NO: 3818613 - DNA, 14 bp, Homo sapiens
tgtttggacttcac

SEQ ID NO: 3818614 - DNA, 17 bp, Homo sapiens
tgtttgttgtcagctga

SEQ ID NO: 3818615 - DNA, 15 bp, Homo sapiens
tgttttctcttgaga

SEQ ID NO: 3818616 - DNA, 13 bp, Homo sapiens
tgtttttgtctta

SEQ ID NO: 3818617 - DNA, 22 bp, Homo sapiens
ttaaaaaaagtatatattctac

SEQ ID NO: 3818618 - DNA, 21 bp, Homo sapiens
ttaaaacagtgtatttggaaa

SEQ ID NO: 3818619 - DNA, 18 bp, Homo sapiens
ttaaaatagcacatgatt

SEQ ID NO: 3818620 - DNA, 13 bp, Homo sapiens
ttaaagaaaaata

SEQ ID NO: 3818621 - DNA, 21 bp, Homo sapiens
ttaaagagaaaaatggcctgc

SEQ ID NO: 3818622 - DNA, 16 bp, Homo sapiens
ttaaaggtcctgccct

SEQ ID NO: 3818623 - DNA, 20 bp, Homo sapiens
ttaaatagggaaaaaacatg

SEQ ID NO: 3818624 - DNA, 18 bp, Homo sapiens
ttaaattagacttcctgt

SEQ ID NO: 3818625 - DNA, 17 bp, Homo sapiens
ttaaccacttcagctga

SEQ ID NO: 3818626 - DNA, 18 bp, Homo sapiens
ttaacctgaattattcca

SEQ ID NO: 3818627 - DNA, 10 bp, Homo sapiens
ttaactctgc

SEQ ID NO: 3818628 - DNA, 14 bp, Homo sapiens
ttaagctcagtggc

SEQ ID NO: 3818629 - DNA, 19 bp, Homo sapiens
ttaagggggaaaactgttc

SEQ ID NO: 3818630 - DNA, 16 bp, Homo sapiens
ttacaaattgttttta

SEQ ID NO: 3818631 - DNA, 15 bp, Homo sapiens
ttacagaggacagta

SEQ ID NO: 3818632 - DNA, 14 bp, Homo sapiens
ttacaggcatgagc

SEQ ID NO: 3818633 - DNA, 17 bp, Homo sapiens
ttactgacagaaatgca

SEQ ID NO: 3818634 - DNA, 15 bp, Homo sapiens
ttactgcagctttgt

SEQ ID NO: 3818635 - DNA, 17 bp, Homo sapiens
ttacttttaaacagtga

SEQ ID NO: 3818636 - DNA, 16 bp, Homo sapiens
ttagaaacataaataa

SEQ ID NO: 3818637 - DNA, 14 bp, Homo sapiens
ttagaatatattaa

SEQ ID NO: 3818638 - DNA, 18 bp, Homo sapiens
ttagccaagtgtggtaga

SEQ ID NO: 3818639 - DNA, 23 bp, Homo sapiens
ttagccttgctgtagagacttcc

SEQ ID NO: 3818640 - DNA, 15 bp, Homo sapiens
tcacagcgcctcctg

SEQ ID NO: 3818641 - DNA, 22 bp, Homo sapiens
tcacagcgcctcctggacctga

SEQ ID NO: 3818642 - DNA, 14 bp, Homo sapiens
tcacagggagctgg

SEQ ID NO: 3818643 - DNA, 14 bp, Homo sapiens
tcacatctctgcct

SEQ ID NO: 3818644 - DNA, 19 bp, Homo sapiens
tcaccacaacctccacctc

SEQ ID NO: 3818645 - DNA, 22 bp, Homo sapiens
tcaccacaacctccacctcctg

SEQ ID NO: 3818646 - DNA, 13 bp, Homo sapiens
tcacccccagctt

SEQ ID NO: 3818647 - DNA, 17 bp, Homo sapiens
tcaccctacctgtgcct

SEQ ID NO: 3818648 - DNA, 16 bp, Homo sapiens
tcacctaacagaatat

SEQ ID NO: 3818649 - DNA, 20 bp, Homo sapiens
tcacctcgttactctcacct

SEQ ID NO: 3818650 - DNA, 18 bp, Homo sapiens
tcacgcttattgcccagg

SEQ ID NO: 3818651 - DNA, 16 bp, Homo sapiens
tcacggaagagccttg

SEQ ID NO: 3818652 - DNA, 13 bp, Homo sapiens
tcactgagactag

SEQ ID NO: 3818653 - DNA, 18 bp, Homo sapiens
tcactgccatgccagctt

SEQ ID NO: 3818654 - DNA, 21 bp, Homo sapiens
tctgtgtgcacaaatatttat

SEQ ID NO: 3818655 - DNA, 18 bp, Homo sapiens
tctgtgtgtgtgtatgtg

SEQ ID NO: 3818656 - DNA, 16 bp, Homo sapiens
tctgtgtgtttatgtg

SEQ ID NO: 3818657 - DNA, 22 bp, Homo sapiens
tctgttcacttttcctccctca

SEQ ID NO: 3818658 - DNA, 13 bp, Homo sapiens
tctgttcctggct

SEQ ID NO: 3818659 - DNA, 14 bp, Homo sapiens
tcttagctgccaag

SEQ ID NO: 3818660 - DNA, 15 bp, Homo sapiens
tcttagctgtctgct

SEQ ID NO: 3818661 - DNA, 23 bp, Homo sapiens
tcttagctgtctgctcagacaga

SEQ ID NO: 3818662 - DNA, 15 bp, Homo sapiens
tcttcagtaagccgt

SEQ ID NO: 3818663 - DNA, 13 bp, Homo sapiens
tcttcatttctct

SEQ ID NO: 3818664 - DNA, 12 bp, Homo sapiens
tcttccaacccc

SEQ ID NO: 3818665 - DNA, 20 bp, Homo sapiens
tcttccaaccccagctggcc

SEQ ID NO: 3818666 - DNA, 22 bp, Homo sapiens
tcttccaaccccagctggcctc

SEQ ID NO: 3818667 - DNA, 21 bp, Homo sapiens
tcttccaggtgcctggccctt

SEQ ID NO: 3818668 - DNA, 19 bp, Homo sapiens
tcttcctagttttctcctc

SEQ ID NO: 3818669 - DNA, 21 bp, Homo sapiens
tcttcctagttttctcctccc

SEQ ID NO: 3818670 - DNA, 23 bp, Homo sapiens
tcttcctagttttctcctcccag

SEQ ID NO: 3818671 - DNA, 15 bp, Homo sapiens
tcttccttaaactcc

SEQ ID NO: 3818672 - DNA, 16 bp, Homo sapiens
tcttctaaaaaaaaac

SEQ ID NO: 3818673 - DNA, 15 bp, Homo sapiens
tcttctcagagcagc

SEQ ID NO: 3818674 - DNA, 17 bp, Homo sapiens
tcttctcgacttcagga

SEQ ID NO: 3818675 - DNA, 12 bp, Homo sapiens
tcttcttatgca

SEQ ID NO: 3818676 - DNA, 15 bp, Homo sapiens
tcttgatctcctgag

SEQ ID NO: 3818677 - DNA, 16 bp, Homo sapiens
tcttggctggcttcct

SEQ ID NO: 3818678 - DNA, 16 bp, Homo sapiens
tctttattaaaacagt

SEQ ID NO: 3818679 - DNA, 16 bp, Homo sapiens
tctttcatacattata

SEQ ID NO: 3818680 - DNA, 17 bp, Homo sapiens
tctttcatacattatat

SEQ ID NO: 3818681 - DNA, 19 bp, Homo sapiens
tctttccaaccggctttgt

SEQ ID NO: 3818682 - DNA, 18 bp, Homo sapiens
tctttgctacaataaatg

SEQ ID NO: 3818683 - DNA, 13 bp, Homo sapiens
tctttgtgtagct

SEQ ID NO: 3818684 - DNA, 19 bp, Homo sapiens
tcttttgaagaagttctta

SEQ ID NO: 3818685 - DNA, 22 bp, Homo sapiens
tgaaaaaagtataggataaatt

SEQ ID NO: 3818686 - DNA, 14 bp, Homo sapiens
tgaaagaaggagca

SEQ ID NO: 3818687 - DNA, 23 bp, Homo sapiens
tgaaagccagctgccgaccagag

SEQ ID NO: 3818688 - DNA, 16 bp, Homo sapiens
tgaaataacatggcct

SEQ ID NO: 3818689 - DNA, 17 bp, Homo sapiens
tgaaataacatggcctt

SEQ ID NO: 3818690 - DNA, 12 bp, Homo sapiens
tgaacaaaagct

SEQ ID NO: 3818691 - DNA, 17 bp, Homo sapiens
tgaacaaaagcttttct

SEQ ID NO: 3818692 - DNA, 16 bp, Homo sapiens
tgaacacactcagcag

SEQ ID NO: 3818693 - DNA, 15 bp, Homo sapiens
tgaacacagcctggg

SEQ ID NO: 3818694 - DNA, 14 bp, Homo sapiens
tgaaccgacttttc

SEQ ID NO: 3818695 - DNA, 17 bp, Homo sapiens
tgaacttgaggacacat

SEQ ID NO: 3818696 - DNA, 20 bp, Homo sapiens
tgaagagaagggcagggctg

SEQ ID NO: 3818697 - DNA, 22 bp, Homo sapiens
tgaagagaagggcagggctgag

SEQ ID NO: 3818698 - DNA, 20 bp, Homo sapiens
tgaagaggaaaatgaataat

SEQ ID NO: 3818699 - DNA, 21 bp, Homo sapiens
tgaagatgcagcaaaatgtga

SEQ ID NO: 3818700 - DNA, 15 bp, Homo sapiens
tgaagcccaataaac

SEQ ID NO: 3818701 - DNA, 19 bp, Homo sapiens
tgaagcccaataaacctct

SEQ ID NO: 3818702 - DNA, 13 bp, Homo sapiens
tgaaggagaaaat

SEQ ID NO: 3818703 - DNA, 19 bp, Homo sapiens
tgaaggctttcagggcctc

SEQ ID NO: 3818704 - DNA, 18 bp, Homo sapiens
tgaatacaattaaaggtc

SEQ ID NO: 3818705 - DNA, 15 bp, Homo sapiens
tgaatgtcccagagg

SEQ ID NO: 3818706 - DNA, 16 bp, Homo sapiens
tgaatgtgttgatttg

SEQ ID NO: 3818707 - DNA, 14 bp, Homo sapiens
tgaattttgttgct

SEQ ID NO: 3818708 - DNA, 20 bp, Homo sapiens
tgacaacatttttgtacatt

SEQ ID NO: 3818709 - DNA, 15 bp, Homo sapiens
tgacaggtaaactat

SEQ ID NO: 3818710 - DNA, 13 bp, Homo sapiens
tgacatcacttgt

SEQ ID NO: 3818711 - DNA, 17 bp, Homo sapiens
tgacatcacttgtacaa

SEQ ID NO: 3818712 - DNA, 19 bp, Homo sapiens
tgacatcacttgtacaaaa

SEQ ID NO: 3818713 - DNA, 20 bp, Homo sapiens
tgacatcacttgtacaaaat

SEQ ID NO: 3818714 - DNA, 21 bp, Homo sapiens
tgacatcacttgtacaaaata

SEQ ID NO: 3818715 - DNA, 22 bp, Homo sapiens
tgacatcacttgtacaaaataa

SEQ ID NO: 3818716 - DNA, 18 bp, Homo sapiens
tgaccaagagagaaagaa

SEQ ID NO: 3818717 - DNA, 17 bp, Homo sapiens
tgaccagggcagtgaaa

SEQ ID NO: 3818718 - DNA, 16 bp, Homo sapiens
tgaccttctccaggga

SEQ ID NO: 3818719 - DNA, 19 bp, Homo sapiens
tgaccttctccagggacag

SEQ ID NO: 3818720 - DNA, 17 bp, Homo sapiens
tgactagaggcagggag

SEQ ID NO: 3818721 - DNA, 17 bp, Homo sapiens
tgactaggaagaaaaca

SEQ ID NO: 3818722 - DNA, 14 bp, Homo sapiens
tgactctttccaac

SEQ ID NO: 3818723 - DNA, 22 bp, Homo sapiens
tgactgcactgttgctgactac

SEQ ID NO: 3818724 - DNA, 17 bp, Homo sapiens
tgactgtcactgttcct

SEQ ID NO: 3818725 - DNA, 15 bp, Homo sapiens
tgacttgcctggggc

SEQ ID NO: 3818726 - DNA, 16 bp, Homo sapiens
tgacttgcctggggcc

SEQ ID NO: 3818727 - DNA, 18 bp, Homo sapiens
tgagaagtgtatatagtt

SEQ ID NO: 3818728 - DNA, 18 bp, Homo sapiens
tgagaatctatatttaac

SEQ ID NO: 3818729 - DNA, 23 bp, Homo sapiens
tgagaatctatatttaacaagat

SEQ ID NO: 3818730 - DNA, 19 bp, Homo sapiens
tgagaccacctctcaatat

SEQ ID NO: 3818731 - DNA, 12 bp, Homo sapiens
tgagaccctgtc

SEQ ID NO: 3818732 - DNA, 22 bp, Homo sapiens
tgagaccctttaaatgcctgcg

SEQ ID NO: 3818733 - DNA, 19 bp, Homo sapiens
tgagactagattctcacct

SEQ ID NO: 3818734 - DNA, 23 bp, Homo sapiens
tgagactgcgccacggcactcca

SEQ ID NO: 3818735 - DNA, 13 bp, Homo sapiens
tgagagaggccat

SEQ ID NO: 3818736 - DNA, 16 bp, Homo sapiens
tgagagctctctcttc

SEQ ID NO: 3818737 - DNA, 17 bp, Homo sapiens
tgagagggcatgcgcac

SEQ ID NO: 3818738 - DNA, 15 bp, Homo sapiens
tgagatcaaaacggt

SEQ ID NO: 3818739 - DNA, 20 bp, Homo sapiens
tgagcaaggacaacctgccc

SEQ ID NO: 3818740 - DNA, 23 bp, Homo sapiens
tgagccaccgcgcccagccaaga

SEQ ID NO: 3818741 - DNA, 11 bp, Homo sapiens
tgagccccacc

SEQ ID NO: 3818742 - DNA, 10 bp, Homo sapiens
tgagcctggc

SEQ ID NO: 3818743 - DNA, 16 bp, Homo sapiens
tgagcctggcaagaat

SEQ ID NO: 3818744 - DNA, 22 bp, Homo sapiens
tgagcctgggaggtcaaggctg

SEQ ID NO: 3818745 - DNA, 19 bp, Homo sapiens
tgagctccttaaggctctt

SEQ ID NO: 3818746 - DNA, 20 bp, Homo sapiens
tgagctggggatgtctctca

SEQ ID NO: 3818747 - DNA, 17 bp, Homo sapiens
tgaggaagagggactgt

SEQ ID NO: 3818748 - DNA, 19 bp, Homo sapiens
tgaggacaaccattccaga

SEQ ID NO: 3818749 - DNA, 20 bp, Homo sapiens
tgaggacaaccattccagac

SEQ ID NO: 3818750 - DNA, 12 bp, Homo sapiens
tgaggacacatg

SEQ ID NO: 3818751 - DNA, 17 bp, Homo sapiens
gactactcccccaggtg

SEQ ID NO: 3818752 - DNA, 16 bp, Homo sapiens
gactagaggcagggag

SEQ ID NO: 3818753 - DNA, 17 bp, Homo sapiens
gactagaggcagggagg

SEQ ID NO: 3818754 - DNA, 20 bp, Homo sapiens
gactagccatctcaagcaag

SEQ ID NO: 3818755 - DNA, 12 bp, Homo sapiens
gactcagcacca

SEQ ID NO: 3818756 - DNA, 17 bp, Homo sapiens
gactcagcaccacattg

SEQ ID NO: 3818757 - DNA, 22 bp, Homo sapiens
gactcagcaccacattgcctca

SEQ ID NO: 3818758 - DNA, 12 bp, Homo sapiens
gactccttagac

SEQ ID NO: 3818759 - DNA, 13 bp, Homo sapiens
gactctgctgctc

SEQ ID NO: 3818760 - DNA, 15 bp, Homo sapiens
gactgtcatagaaat

SEQ ID NO: 3818761 - DNA, 15 bp, Homo sapiens
gacttcaggagctga

SEQ ID NO: 3818762 - DNA, 15 bp, Homo sapiens
gacttgcctggggcc

SEQ ID NO: 3818763 - DNA, 21 bp, Homo sapiens
gacttttctgtccgagctttg

SEQ ID NO: 3818764 - DNA, 17 bp, Homo sapiens
gagaaaaatggcctgca

SEQ ID NO: 3818765 - DNA, 19 bp, Homo sapiens
gagaaacagagacaggccc

SEQ ID NO: 3818766 - DNA, 14 bp, Homo sapiens
gagaaacaggctct

SEQ ID NO: 3818767 - DNA, 15 bp, Homo sapiens
gagaaacaggctctg

SEQ ID NO: 3818768 - DNA, 22 bp, Homo sapiens
gagaagccagctttcctcatca

SEQ ID NO: 3818769 - DNA, 13 bp, Homo sapiens
gagaagcggctgg

SEQ ID NO: 3818770 - DNA, 16 bp, Homo sapiens
gagaagcggctggcag

SEQ ID NO: 3818771 - DNA, 17 bp, Homo sapiens
gagaagcggctggcagc

SEQ ID NO: 3818772 - DNA, 12 bp, Homo sapiens
gagaaggaagcc

SEQ ID NO: 3818773 - DNA, 15 bp, Homo sapiens
gagaatctatattta

SEQ ID NO: 3818774 - DNA, 16 bp, Homo sapiens
gagacacagagatgga

SEQ ID NO: 3818775 - DNA, 17 bp, Homo sapiens
gagacagaaacagagag

SEQ ID NO: 3818776 - DNA, 16 bp, Homo sapiens
gagacagttcaagaaa

SEQ ID NO: 3818777 - DNA, 13 bp, Homo sapiens
gagacgctgtgat

SEQ ID NO: 3818778 - DNA, 18 bp, Homo sapiens
gagactagattctcacct

SEQ ID NO: 3818779 - DNA, 19 bp, Homo sapiens
gagactagattctcacctg

SEQ ID NO: 3818780 - DNA, 18 bp, Homo sapiens
gagactcaaagagactcc

SEQ ID NO: 3818781 - DNA, 18 bp, Homo sapiens
gagactgagggagagact

SEQ ID NO: 3818782 - DNA, 14 bp, Homo sapiens
gagacttccgtcac

SEQ ID NO: 3818783 - DNA, 11 bp, Homo sapiens
gagagaaagaa

SEQ ID NO: 3818784 - DNA, 16 bp, Homo sapiens
gagagactcaaagaga

SEQ ID NO: 3818785 - DNA, 22 bp, Homo sapiens
gagagagactgagggagagact

SEQ ID NO: 3818786 - DNA, 15 bp, Homo sapiens
gagagctagcagcag

SEQ ID NO: 3818787 - DNA, 14 bp, Homo sapiens
gagaggcagaggca

SEQ ID NO: 3818788 - DNA, 15 bp, Homo sapiens
gagaggccttttgga

SEQ ID NO: 3818789 - DNA, 12 bp, Homo sapiens
gagatatgcaca

SEQ ID NO: 3818790 - DNA, 23 bp, Homo sapiens
gagatcaaatggaaaggagagga

SEQ ID NO: 3818791 - DNA, 18 bp, Homo sapiens
gagatcccaacactgcca

SEQ ID NO: 3818792 - DNA, 19 bp, Homo sapiens
gagatcccaacactgccag

SEQ ID NO: 3818793 - DNA, 12 bp, Homo sapiens
gagcaaaataat

SEQ ID NO: 3818794 - DNA, 15 bp, Homo sapiens
gagcaggcacatgga

SEQ ID NO: 3818795 - DNA, 17 bp, Homo sapiens
gagccactacctttgtc

SEQ ID NO: 3818796 - DNA, 22 bp, Homo sapiens
gagcccttagccttgctgtaga

SEQ ID NO: 3818797 - DNA, 19 bp, Homo sapiens
gagcctgaattttgttgct

SEQ ID NO: 3818798 - DNA, 21 bp, Homo sapiens
gagcctgaccctcatctttct

SEQ ID NO: 3818799 - DNA, 10 bp, Homo sapiens
gagcctggca

SEQ ID NO: 3818800 - DNA, 18 bp, Homo sapiens
gagctaaggaagacacag

SEQ ID NO: 3818801 - DNA, 15 bp, Homo sapiens
gagctagcagcaggg

SEQ ID NO: 3818802 - DNA, 17 bp, Homo sapiens
gagctagcagcagggag

SEQ ID NO: 3818803 - DNA, 21 bp, Homo sapiens
gagctcaggaaccgaggcagg

SEQ ID NO: 3818804 - DNA, 22 bp, Homo sapiens
gagctcaggaaccgaggcaggg

SEQ ID NO: 3818805 - DNA, 21 bp, Homo sapiens
gagctcctgtccctacccact

SEQ ID NO: 3818806 - DNA, 20 bp, Homo sapiens
gagctgacagagccagaggc

SEQ ID NO: 3818807 - DNA, 20 bp, Homo sapiens
gagctttgaaaattcagtgg

SEQ ID NO: 3818808 - DNA, 11 bp, Homo sapiens
gaggacacatg

SEQ ID NO: 3818809 - DNA, 12 bp, Homo sapiens
gaggacacatgt

SEQ ID NO: 3818810 - DNA, 13 bp, Homo sapiens
gaggacacatgtc

SEQ ID NO: 3818811 - DNA, 16 bp, Homo sapiens
gaggacttgtgtctct

SEQ ID NO: 3818812 - DNA, 17 bp, Homo sapiens
gaggacttgtgtctctg

SEQ ID NO: 3818813 - DNA, 22 bp, Homo sapiens
gaggacttgtgtctctgtgctt

SEQ ID NO: 3818814 - DNA, 14 bp, Homo sapiens
gaggagggcaggca

SEQ ID NO: 3818815 - DNA, 13 bp, Homo sapiens
gaggatctcttga

SEQ ID NO: 3818816 - DNA, 22 bp, Homo sapiens
gaggatctcttgagcctgggag

SEQ ID NO: 3818817 - DNA, 15 bp, Homo sapiens
gaggatggagagagg

SEQ ID NO: 3818818 - DNA, 16 bp, Homo sapiens
gaggattgcttgagct

SEQ ID NO: 3818819 - DNA, 18 bp, Homo sapiens
gaggcagaggcagacagg

SEQ ID NO: 3818820 - DNA, 17 bp, Homo sapiens
gaggcagggaggggact

SEQ ID NO: 3818821 - DNA, 16 bp, Homo sapiens
gaggccccaggcccta

SEQ ID NO: 3818822 - DNA, 21 bp, Homo sapiens
gaggctagtctcttctcagag

SEQ ID NO: 3818823 - DNA, 18 bp, Homo sapiens
gagggagagactctgagg

SEQ ID NO: 3818824 - DNA, 17 bp, Homo sapiens
aggcacatggaggagct

SEQ ID NO: 3818825 - DNA, 20 bp, Homo sapiens
aggcagatttactgtcccag

SEQ ID NO: 3818826 - DNA, 14 bp, Homo sapiens
aggcaggatatccc

SEQ ID NO: 3818827 - DNA, 12 bp, Homo sapiens
aggcaggatggc

SEQ ID NO: 3818828 - DNA, 16 bp, Homo sapiens
aggcatcccaggggac

SEQ ID NO: 3818829 - DNA, 19 bp, Homo sapiens
aggcatcggggagccggga

SEQ ID NO: 3818830 - DNA, 19 bp, Homo sapiens
aggcatgaacacacatgga

SEQ ID NO: 3818831 - DNA, 19 bp, Homo sapiens
aggccattctttcccaaca

SEQ ID NO: 3818832 - DNA, 16 bp, Homo sapiens
aggcccttattttcaa

SEQ ID NO: 3818833 - DNA, 21 bp, Homo sapiens
aggcctctcattccagaggaa

SEQ ID NO: 3818834 - DNA, 16 bp, Homo sapiens
aggcctgactctcagc

SEQ ID NO: 3818835 - DNA, 16 bp, Homo sapiens
aggccttttggaatgt

SEQ ID NO: 3818836 - DNA, 14 bp, Homo sapiens
aggctaagctgccg

SEQ ID NO: 3818837 - DNA, 17 bp, Homo sapiens
aggctagagtgcagtgg

SEQ ID NO: 3818838 - DNA, 20 bp, Homo sapiens
aggctagagtgcagtggcgt

SEQ ID NO: 3818839 - DNA, 15 bp, Homo sapiens
aggctagggtgggga

SEQ ID NO: 3818840 - DNA, 19 bp, Homo sapiens
aggctagggtggggagaga

SEQ ID NO: 3818841 - DNA, 20 bp, Homo sapiens
aggctagtctcttctcagag

SEQ ID NO: 3818842 - DNA, 21 bp, Homo sapiens
aggctagtctcttctcagagc

SEQ ID NO: 3818843 - DNA, 19 bp, Homo sapiens
aggctatggggatagatgt

SEQ ID NO: 3818844 - DNA, 21 bp, Homo sapiens
aggctatggggatagatgtgt

SEQ ID NO: 3818845 - DNA, 22 bp, Homo sapiens
aggctatggggatagatgtgtg

SEQ ID NO: 3818846 - DNA, 19 bp, Homo sapiens
aggctattattttcactgt

SEQ ID NO: 3818847 - DNA, 18 bp, Homo sapiens
aggctcagagggtgtcct

SEQ ID NO: 3818848 - DNA, 14 bp, Homo sapiens
aggctgaccaagag

SEQ ID NO: 3818849 - DNA, 17 bp, Homo sapiens
aggctgaccaagagaga

SEQ ID NO: 3818850 - DNA, 15 bp, Homo sapiens
aggctgagagctctc

SEQ ID NO: 3818851 - DNA, 19 bp, Homo sapiens
aggctgatgcattcccggt

SEQ ID NO: 3818852 - DNA, 18 bp, Homo sapiens
aggctgcaaccctggtgt

SEQ ID NO: 3818853 - DNA, 19 bp, Homo sapiens
aggctgcagtgagccgaga

SEQ ID NO: 3818854 - DNA, 13 bp, Homo sapiens
aggctgggtccag

SEQ ID NO: 3818855 - DNA, 22 bp, Homo sapiens
aggctggtctcgaactcctgac

SEQ ID NO: 3818856 - DNA, 21 bp, Homo sapiens
agggaaataatagggaaaata

SEQ ID NO: 3818857 - DNA, 22 bp, Homo sapiens
agggaaggatcccatgagctcc

SEQ ID NO: 3818858 - DNA, 14 bp, Homo sapiens
agggacagaagcag

SEQ ID NO: 3818859 - DNA, 16 bp, Homo sapiens
agggacagaagcagga

SEQ ID NO: 3818860 - DNA, 12 bp, Homo sapiens
agggagacagag

SEQ ID NO: 3818861 - DNA, 23 bp, Homo sapiens
agggagataaaagaaccccagac

SEQ ID NO: 3818862 - DNA, 15 bp, Homo sapiens
agggagctggcaatg

SEQ ID NO: 3818863 - DNA, 17 bp, Homo sapiens
agggatcacagggcccc

SEQ ID NO: 3818864 - DNA, 22 bp, Homo sapiens
agggatgactaaaatatttatt

SEQ ID NO: 3818865 - DNA, 18 bp, Homo sapiens
agggcagtgaaaatgaaa

SEQ ID NO: 3818866 - DNA, 18 bp, Homo sapiens
aggggaaaatcagcctgc

SEQ ID NO: 3818867 - DNA, 14 bp, Homo sapiens
aggggagggaaaag

SEQ ID NO: 3818868 - DNA, 18 bp, Homo sapiens
aggggcaaagaactgccc

SEQ ID NO: 3818869 - DNA, 19 bp, Homo sapiens
aggggcaaagaactgcccc

SEQ ID NO: 3818870 - DNA, 17 bp, Homo sapiens
aggggcaccctccaaac

SEQ ID NO: 3818871 - DNA, 16 bp, Homo sapiens
agggggagagggctgc

SEQ ID NO: 3818872 - DNA, 20 bp, Homo sapiens
agggggcccatccctgccca

SEQ ID NO: 3818873 - DNA, 17 bp, Homo sapiens
agggtgaacaaagaaaa

SEQ ID NO: 3818874 - DNA, 15 bp, Homo sapiens
agggttttggcctgc

SEQ ID NO: 3818875 - DNA, 16 bp, Homo sapiens
aggtacacagctctag

SEQ ID NO: 3818876 - DNA, 14 bp, Homo sapiens
aggtcaataaagca

SEQ ID NO: 3818877 - DNA, 16 bp, Homo sapiens
aggtcaataaagcaga

SEQ ID NO: 3818878 - DNA, 17 bp, Homo sapiens
aggtcaataaagcagag

SEQ ID NO: 3818879 - DNA, 14 bp, Homo sapiens
aggtcgaggcagga

SEQ ID NO: 3818880 - DNA, 15 bp, Homo sapiens
aggtcgcacctcctt

SEQ ID NO: 3818881 - DNA, 14 bp, Homo sapiens
aggtgagaccacct

SEQ ID NO: 3818882 - DNA, 15 bp, Homo sapiens
aggtgagaccacctc

SEQ ID NO: 3818883 - DNA, 19 bp, Homo sapiens
aggtgccgatttcatgcat

SEQ ID NO: 3818884 - DNA, 12 bp, Homo sapiens
aggtgggaggat

SEQ ID NO: 3818885 - DNA, 17 bp, Homo sapiens
aggtggttatggagagg

SEQ ID NO: 3818886 - DNA, 23 bp, Homo sapiens
aggtgtttaacggcactgtggcc

SEQ ID NO: 3818887 - DNA, 19 bp, Homo sapiens
aggtttttgtagtgatttt

SEQ ID NO: 3818888 - DNA, 20 bp, Homo sapiens
agtaaccaggccccagcctc

SEQ ID NO: 3818889 - DNA, 23 bp, Homo sapiens
agtaagtttctcatcccatgggc

SEQ ID NO: 3818890 - DNA, 15 bp, Homo sapiens
agtaatttgaggaca

SEQ ID NO: 3818891 - DNA, 20 bp, Homo sapiens
agtacatcacctaacagaat

SEQ ID NO: 3818892 - DNA, 23 bp, Homo sapiens
agtagcagtgattgttatgcctt

SEQ ID NO: 3818893 - DNA, 12 bp, Homo sapiens
agtagctgagat

SEQ ID NO: 3818894 - DNA, 22 bp, Homo sapiens
agtagtgtcttcctagtatatt

SEQ ID NO: 3818895 - DNA, 14 bp, Homo sapiens
agtagttaattctg

SEQ ID NO: 3818896 - DNA, 21 bp, Homo sapiens
agtatgccttcctgtttaaaa

SEQ ID NO: 3818897 - DNA, 17 bp, Homo sapiens
agtatgtggaagtgtgg

SEQ ID NO: 3818898 - DNA, 14 bp, Homo sapiens
agtatttgtgggga

SEQ ID NO: 3818899 - DNA, 20 bp, Homo sapiens
agtcaagtgaaaaaggagga

SEQ ID NO: 3818900 - DNA, 11 bp, Homo sapiens
agtccagctcc

SEQ ID NO: 3818901 - DNA, 19 bp, Homo sapiens
agtcccttagaagatctgc

SEQ ID NO: 3818902 - DNA, 22 bp, Homo sapiens
agtcccttagaagatctgcttc

SEQ ID NO: 3818903 - DNA, 15 bp, Homo sapiens
agtcctagagctcct

SEQ ID NO: 3818904 - DNA, 18 bp, Homo sapiens
agtcctagagctcctgtc

SEQ ID NO: 3818905 - DNA, 13 bp, Homo sapiens
agtcctcacagcc

SEQ ID NO: 3818906 - DNA, 20 bp, Homo sapiens
agtcctcacagcctctccct

SEQ ID NO: 3818907 - DNA, 14 bp, Homo sapiens
agtcctcattataa

SEQ ID NO: 3818908 - DNA, 13 bp, Homo sapiens
agtcgtcaagttg

SEQ ID NO: 3818909 - DNA, 22 bp, Homo sapiens
agtctctctgtgaatacaatta

SEQ ID NO: 3818910 - DNA, 18 bp, Homo sapiens
agtctcttctcagagcag

SEQ ID NO: 3818911 - DNA, 16 bp, Homo sapiens
agtctgagagaggcca

SEQ ID NO: 3818912 - DNA, 22 bp, Homo sapiens
agtctgaggccccaggccctag

SEQ ID NO: 3818913 - DNA, 23 bp, Homo sapiens
agtcttccaggtgcctggccctt

SEQ ID NO: 3818914 - DNA, 20 bp, Homo sapiens
agtgaaaaaggaggaagaga

SEQ ID NO: 3818915 - DNA, 20 bp, Homo sapiens
agtgaacttgggccactgtg

SEQ ID NO: 3818916 - DNA, 18 bp, Homo sapiens
agtgaatttctaaatgtt

SEQ ID NO: 3818917 - DNA, 21 bp, Homo sapiens
agtgagaccctgtctcaaaaa

SEQ ID NO: 3818918 - DNA, 14 bp, Homo sapiens
agtgagagggcatg

SEQ ID NO: 3818919 - DNA, 22 bp, Homo sapiens
agtgatgaaaatttgcctttgc

SEQ ID NO: 3818920 - DNA, 16 bp, Homo sapiens
agtgatttttatgcca

SEQ ID NO: 3818921 - DNA, 17 bp, Homo sapiens
agtgcaccaccctttga

SEQ ID NO: 3818922 - DNA, 13 bp, Homo sapiens
agtgctactttgc

SEQ ID NO: 3818923 - DNA, 16 bp, Homo sapiens
agtggaagaagaaaac

SEQ ID NO: 3818924 - DNA, 13 bp, Homo sapiens
agtgggtgaataa

SEQ ID NO: 3818925 - DNA, 19 bp, Homo sapiens
agtgggtgaataatacagt

SEQ ID NO: 3818926 - DNA, 20 bp, Homo sapiens
agtgtatggaaataaatgta

SEQ ID NO: 3818927 - DNA, 22 bp, Homo sapiens
agtgtatggaaataaatgtatc

SEQ ID NO: 3818928 - DNA, 20 bp, Homo sapiens
agtgtatttggaaaatgtta

SEQ ID NO: 3818929 - DNA, 12 bp, Homo sapiens
agtgtcagtgtt

SEQ ID NO: 3818930 - DNA, 16 bp, Homo sapiens
agtgtgggtctgtgtg

SEQ ID NO: 3818931 - DNA, 19 bp, Homo sapiens
agtgtgggtctgtgtgtgt

SEQ ID NO: 3818932 - DNA, 20 bp, Homo sapiens
caaggctgaccaagagagaa

SEQ ID NO: 3818933 - DNA, 21 bp, Homo sapiens
caaggctgaccaagagagaaa

SEQ ID NO: 3818934 - DNA, 22 bp, Homo sapiens
caaggctgcagtgagccgagat

SEQ ID NO: 3818935 - DNA, 18 bp, Homo sapiens
caaggctgggggaagaag

SEQ ID NO: 3818936 - DNA, 23 bp, Homo sapiens
caagtaaccaggccccagcctcc

SEQ ID NO: 3818937 - DNA, 18 bp, Homo sapiens
caagtaagaaaaataagc

SEQ ID NO: 3818938 - DNA, 16 bp, Homo sapiens
caagtaataaaacaat

SEQ ID NO: 3818939 - DNA, 17 bp, Homo sapiens
caagtagtagtgtcttc

SEQ ID NO: 3818940 - DNA, 17 bp, Homo sapiens
caagtcaagtgaaaaag

SEQ ID NO: 3818941 - DNA, 19 bp, Homo sapiens
caagtcaggcccttatttt

SEQ ID NO: 3818942 - DNA, 18 bp, Homo sapiens
caagtccttgacctctat

SEQ ID NO: 3818943 - DNA, 19 bp, Homo sapiens
caagtgaaaaaggaggaag

SEQ ID NO: 3818944 - DNA, 14 bp, Homo sapiens
caagtgagaccctg

SEQ ID NO: 3818945 - DNA, 19 bp, Homo sapiens
caagtggaaacatgctgaa

SEQ ID NO: 3818946 - DNA, 17 bp, Homo sapiens
caataaacctcttttct

SEQ ID NO: 3818947 - DNA, 15 bp, Homo sapiens
caataaagcagagcc

SEQ ID NO: 3818948 - DNA, 19 bp, Homo sapiens
caataaagcagagccaagg

SEQ ID NO: 3818949 - DNA, 15 bp, Homo sapiens
caataaagctgctga

SEQ ID NO: 3818950 - DNA, 11 bp, Homo sapiens
caataaatgct

SEQ ID NO: 3818951 - DNA, 20 bp, Homo sapiens
caataaatgctgaatgaatc

SEQ ID NO: 3818952 - DNA, 15 bp, Homo sapiens
caatattcaataaag

SEQ ID NO: 3818953 - DNA, 16 bp, Homo sapiens
caatattcaataaagc

SEQ ID NO: 3818954 - DNA, 15 bp, Homo sapiens
caatcggctacccct

SEQ ID NO: 3818955 - DNA, 18 bp, Homo sapiens
caatgccctacctgcctg

SEQ ID NO: 3818956 - DNA, 16 bp, Homo sapiens
caatgcttctgcctca

SEQ ID NO: 3818957 - DNA, 19 bp, Homo sapiens
caatggcacgatctcagct

SEQ ID NO: 3818958 - DNA, 15 bp, Homo sapiens
caatgtcagaaactc

SEQ ID NO: 3818959 - DNA, 15 bp, Homo sapiens
caatgtgataaaacc

SEQ ID NO: 3818960 - DNA, 14 bp, Homo sapiens
caatgttctctctt

SEQ ID NO: 3818961 - DNA, 13 bp, Homo sapiens
caattgctgccaa

SEQ ID NO: 3818962 - DNA, 15 bp, Homo sapiens
caatttctattattt

SEQ ID NO: 3818963 - DNA, 12 bp, Homo sapiens
caattttgtaac

SEQ ID NO: 3818964 - DNA, 13 bp, Homo sapiens
cacaaaggagagc

SEQ ID NO: 3818965 - DNA, 21 bp, Homo sapiens
cacaaatatttattttctttc

SEQ ID NO: 3818966 - DNA, 14 bp, Homo sapiens
cacaaggctgacca

SEQ ID NO: 3818967 - DNA, 21 bp, Homo sapiens
cacaaggctgaccaagagaga

SEQ ID NO: 3818968 - DNA, 13 bp, Homo sapiens
cacacacagagat

SEQ ID NO: 3818969 - DNA, 17 bp, Homo sapiens
cacacacagatgcacac

SEQ ID NO: 3818970 - DNA, 18 bp, Homo sapiens
cacacagaggaagagcag

SEQ ID NO: 3818971 - DNA, 13 bp, Homo sapiens
cacacagatgcac

SEQ ID NO: 3818972 - DNA, 19 bp, Homo sapiens
cacacagatgcacacacag

SEQ ID NO: 3818973 - DNA, 15 bp, Homo sapiens
cacacatcagtgcac

SEQ ID NO: 3818974 - DNA, 14 bp, Homo sapiens
cacacatggatgca

SEQ ID NO: 3818975 - DNA, 15 bp, Homo sapiens
cacaccccagcccac

SEQ ID NO: 3818976 - DNA, 20 bp, Homo sapiens
cacaccccagcccaccctgc

SEQ ID NO: 3818977 - DNA, 23 bp, Homo sapiens
cacacccgacaccagccctgctg

SEQ ID NO: 3818978 - DNA, 15 bp, Homo sapiens
cacaccgatgcacac

SEQ ID NO: 3818979 - DNA, 14 bp, Homo sapiens
cacacgcacataga

SEQ ID NO: 3818980 - DNA, 14 bp, Homo sapiens
cacacgccaatgca

SEQ ID NO: 3818981 - DNA, 18 bp, Homo sapiens
cacacggaggcatctgca

SEQ ID NO: 3818982 - DNA, 21 bp, Homo sapiens
cacacggaggcatctgcaccc

SEQ ID NO: 3818983 - DNA, 13 bp, Homo sapiens
cacactcagcagc

SEQ ID NO: 3818984 - DNA, 19 bp, Homo sapiens
cacactggcatctccctga

SEQ ID NO: 3818985 - DNA, 13 bp, Homo sapiens
cacactgggctca

SEQ ID NO: 3818986 - DNA, 17 bp, Homo sapiens
cacagaggaagagcagg

SEQ ID NO: 3818987 - DNA, 22 bp, Homo sapiens
cacagatatacacatggatgca

SEQ ID NO: 3818988 - DNA, 18 bp, Homo sapiens
cacagatgcacacacaga

SEQ ID NO: 3818989 - DNA, 18 bp, Homo sapiens
cacagcaattcctcaggc

SEQ ID NO: 3818990 - DNA, 12 bp, Homo sapiens
cacagcccagac

SEQ ID NO: 3818991 - DNA, 12 bp, Homo sapiens
cacagcctctcc

SEQ ID NO: 3818992 - DNA, 14 bp, Homo sapiens
cacagcctctccct

SEQ ID NO: 3818993 - DNA, 11 bp, Homo sapiens
cacagcctctg

SEQ ID NO: 3818994 - DNA, 17 bp, Homo sapiens
cacagcctgggaccagg

SEQ ID NO: 3818995 - DNA, 18 bp, Homo sapiens
cacagcctgggaccaggg

SEQ ID NO: 3818996 - DNA, 20 bp, Homo sapiens
cacagcctgggaccagggca

SEQ ID NO: 3818997 - DNA, 20 bp, Homo sapiens
cacaggcaaaatccttgctt

SEQ ID NO: 3818998 - DNA, 14 bp, Homo sapiens
cacagggccccaga

SEQ ID NO: 3818999 - DNA, 19 bp, Homo sapiens
cacagggccccagaaggca

SEQ ID NO: 3819000 - DNA, 13 bp, Homo sapiens
cacagtcctcaca

SEQ ID NO: 3819001 - DNA, 14 bp, Homo sapiens
cacagtcctcacag

SEQ ID NO: 3819002 - DNA, 17 bp, Homo sapiens
cacagtcctcacagcct

SEQ ID NO: 3819003 - DNA, 13 bp, Homo sapiens
cacagtgtttcct

SEQ ID NO: 3819004 - DNA, 23 bp, Homo sapiens
cacagtgtttcctgagtagcagt

SEQ ID NO: 3819005 - DNA, 16 bp, Homo sapiens
cacatagagatatgca

SEQ ID NO: 3819006 - DNA, 18 bp, Homo sapiens
cacatgattttcttttgt

SEQ ID NO: 3819007 - DNA, 12 bp, Homo sapiens
caccacctctcc

SEQ ID NO: 3819008 - DNA, 23 bp, Homo sapiens
caccactagggtcctggccctct

SEQ ID NO: 3819009 - DNA, 12 bp, Homo sapiens
caccagcagcct

SEQ ID NO: 3819010 - DNA, 14 bp, Homo sapiens
caccagcagcctgg

SEQ ID NO: 3819011 - DNA, 15 bp, Homo sapiens
caccagccgccccag

SEQ ID NO: 3819012 - DNA, 19 bp, Homo sapiens
caccagccgccccagcccc

SEQ ID NO: 3819013 - DNA, 19 bp, Homo sapiens
caccaggcagctccagctg

SEQ ID NO: 3819014 - DNA, 16 bp, Homo sapiens
caccattctcctgcct

SEQ ID NO: 3819015 - DNA, 13 bp, Homo sapiens
cacccactggcca

SEQ ID NO: 3819016 - DNA, 14 bp, Homo sapiens
cacccatgccatag

SEQ ID NO: 3819017 - DNA, 18 bp, Homo sapiens
caccccacaccccagccc

SEQ ID NO: 3819018 - DNA, 11 bp, Homo sapiens
caccccagccc

SEQ ID NO: 3819019 - DNA, 12 bp, Homo sapiens
caccccagccca

SEQ ID NO: 3819020 - DNA, 14 bp, Homo sapiens
caccccccaagctg

SEQ ID NO: 3819021 - DNA, 16 bp, Homo sapiens
caccccgacttttgtt

SEQ ID NO: 3819022 - DNA, 14 bp, Homo sapiens
cacccgacaccagc

SEQ ID NO: 3819023 - DNA, 20 bp, Homo sapiens
cacccgacaccagccctgct

SEQ ID NO: 3819024 - DNA, 20 bp, Homo sapiens
caccctaatgtggcagctgt

SEQ ID NO: 3819025 - DNA, 19 bp, Homo sapiens
caccctcgtggacacctgc

SEQ ID NO: 3819026 - DNA, 17 bp, Homo sapiens
caccctgaaagccctga

SEQ ID NO: 3819027 - DNA, 16 bp, Homo sapiens
caccctgctcctcctg

SEQ ID NO: 3819028 - DNA, 20 bp, Homo sapiens
cacccttggtagagtttatt

SEQ ID NO: 3819029 - DNA, 19 bp, Homo sapiens
caccgccccttctccaaca

SEQ ID NO: 3819030 - DNA, 22 bp, Homo sapiens
caccggggcctgggcaggaggg

SEQ ID NO: 3819031 - DNA, 17 bp, Homo sapiens
cacctaggctagggtgg

SEQ ID NO: 3819032 - DNA, 21 bp, Homo sapiens
cacctccgctgggaggaacct

SEQ ID NO: 3819033 - DNA, 18 bp, Homo sapiens
cacctctgcacaagctgc

SEQ ID NO: 3819034 - DNA, 19 bp, Homo sapiens
cacctgagtcaccctacct

SEQ ID NO: 3819035 - DNA, 19 bp, Homo sapiens
cacctgcacgtgatctgct

SEQ ID NO: 3819036 - DNA, 17 bp, Homo sapiens
cacctgccctgccctgc

SEQ ID NO: 3819037 - DNA, 19 bp, Homo sapiens
cacctgccctgccctgcca

SEQ ID NO: 3819038 - DNA, 12 bp, Homo sapiens
cacctgtctgtc

SEQ ID NO: 3819039 - DNA, 14 bp, Homo sapiens
cacctgtctgtctg

SEQ ID NO: 3819040 - DNA, 22 bp, Homo sapiens
cacctgtctgtctgtctgtccc

SEQ ID NO: 3819041 - DNA, 12 bp, Homo sapiens
aaaaaaaacaaa

SEQ ID NO: 3819042 - DNA, 11 bp, Homo sapiens
aaaaaagtata

SEQ ID NO: 3819043 - DNA, 10 bp, Homo sapiens
aaaaacagct

SEQ ID NO: 3819044 - DNA, 13 bp, Homo sapiens
aaaaagattatat

SEQ ID NO: 3819045 - DNA, 15 bp, Homo sapiens
aaaaagggaggggga

SEQ ID NO: 3819046 - DNA, 11 bp, Homo sapiens
aaaaagtatat

SEQ ID NO: 3819047 - DNA, 17 bp, Homo sapiens
aaaaagtatatattcta

SEQ ID NO: 3819048 - DNA, 14 bp, Homo sapiens
aaaaatgtaaaatg

SEQ ID NO: 3819049 - DNA, 10 bp, Homo sapiens
aaaacaaaat

SEQ ID NO: 3819050 - DNA, 22 bp, Homo sapiens
aaaacgttttatgtgaatgtgg

SEQ ID NO: 3819051 - DNA, 23 bp, Homo sapiens
aaaactgctgactgttttctctt

SEQ ID NO: 3819052 - DNA, 21 bp, Homo sapiens
aaaagacattgaaagctctat

SEQ ID NO: 3819053 - DNA, 19 bp, Homo sapiens
aaaagagatggcctgagaa

SEQ ID NO: 3819054 - DNA, 17 bp, Homo sapiens
aaaagattatatatcat

SEQ ID NO: 3819055 - DNA, 20 bp, Homo sapiens
aaaagattatatatcataaa

SEQ ID NO: 3819056 - DNA, 22 bp, Homo sapiens
aaaagattatatatcataaagt

SEQ ID NO: 3819057 - DNA, 23 bp, Homo sapiens
aaaagattatatatcataaagta

SEQ ID NO: 3819058 - DNA, 13 bp, Homo sapiens
aaaagattttcct

SEQ ID NO: 3819059 - DNA, 13 bp, Homo sapiens
aaaaggaggaaat

SEQ ID NO: 3819060 - DNA, 16 bp, Homo sapiens
aaaataattgatttca

SEQ ID NO: 3819061 - DNA, 22 bp, Homo sapiens
aaaataattgatttcaagacct

SEQ ID NO: 3819062 - DNA, 20 bp, Homo sapiens
aaaataattttaaacaaagg

SEQ ID NO: 3819063 - DNA, 16 bp, Homo sapiens
aaaatagcacatgatt

SEQ ID NO: 3819064 - DNA, 14 bp, Homo sapiens
aaaatattcatata

SEQ ID NO: 3819065 - DNA, 15 bp, Homo sapiens
aaaatatttgtacat

SEQ ID NO: 3819066 - DNA, 13 bp, Homo sapiens
aaaatcagcctgc

SEQ ID NO: 3819067 - DNA, 12 bp, Homo sapiens
aaaatcctacca

SEQ ID NO: 3819068 - DNA, 14 bp, Homo sapiens
aaaatgagcctggc

SEQ ID NO: 3819069 - DNA, 23 bp, Homo sapiens
actctgctgctcatgggaagaac

SEQ ID NO: 3819070 - DNA, 21 bp, Homo sapiens
actctggaggtttgtttagaa

SEQ ID NO: 3819071 - DNA, 15 bp, Homo sapiens
actctgttcctggct

SEQ ID NO: 3819072 - DNA, 16 bp, Homo sapiens
actctgttcctggctc

SEQ ID NO: 3819073 - DNA, 11 bp, Homo sapiens
actcttaaaac

SEQ ID NO: 3819074 - DNA, 18 bp, Homo sapiens
actcttaaaacccaagtg

SEQ ID NO: 3819075 - DNA, 17 bp, Homo sapiens
actcttagaagtgacat

SEQ ID NO: 3819076 - DNA, 20 bp, Homo sapiens
actctttgctacaataaatg

SEQ ID NO: 3819077 - DNA, 21 bp, Homo sapiens
actctttgctacaataaatgc

SEQ ID NO: 3819078 - DNA, 16 bp, Homo sapiens
actgaagtgcagctca

SEQ ID NO: 3819079 - DNA, 20 bp, Homo sapiens
actgaccgggatccagttcc

SEQ ID NO: 3819080 - DNA, 13 bp, Homo sapiens
actgagccccacc

SEQ ID NO: 3819081 - DNA, 19 bp, Homo sapiens
actgcaacttctacctccg

SEQ ID NO: 3819082 - DNA, 17 bp, Homo sapiens
actgcactccagcctgg

SEQ ID NO: 3819083 - DNA, 19 bp, Homo sapiens
actgcactccagcctgggt

SEQ ID NO: 3819084 - DNA, 12 bp, Homo sapiens
actgccagcatt

SEQ ID NO: 3819085 - DNA, 14 bp, Homo sapiens
actgccatgccagc

SEQ ID NO: 3819086 - DNA, 14 bp, Homo sapiens
actgccccatctcc

SEQ ID NO: 3819087 - DNA, 21 bp, Homo sapiens
actgcgccacggcactccagc

SEQ ID NO: 3819088 - DNA, 23 bp, Homo sapiens
actgctgatgctgaaataaacta

SEQ ID NO: 3819089 - DNA, 22 bp, Homo sapiens
actgctgtgtccgctttcatga

SEQ ID NO: 3819090 - DNA, 22 bp, Homo sapiens
actgctgttaattgattaaaat

SEQ ID NO: 3819091 - DNA, 15 bp, Homo sapiens
actggcatctccctg

SEQ ID NO: 3819092 - DNA, 17 bp, Homo sapiens
actggcatctccctgac

SEQ ID NO: 3819093 - DNA, 23 bp, Homo sapiens
actggcatctccctgaccttctc

SEQ ID NO: 3819094 - DNA, 13 bp, Homo sapiens
actggccagtcct

SEQ ID NO: 3819095 - DNA, 22 bp, Homo sapiens
actggccagtcctagagctcct

SEQ ID NO: 3819096 - DNA, 23 bp, Homo sapiens
actggccagtggctggatctgtg

SEQ ID NO: 3819097 - DNA, 13 bp, Homo sapiens
actgggcaatgat

SEQ ID NO: 3819098 - DNA, 18 bp, Homo sapiens
actgggcaatgatggcaa

SEQ ID NO: 3819099 - DNA, 17 bp, Homo sapiens
actgtcttttgaagaag

SEQ ID NO: 3819100 - DNA, 22 bp, Homo sapiens
actgtggccttggtctaacttt

SEQ ID NO: 3819101 - DNA, 19 bp, Homo sapiens
actgtgtccctctctctgg

SEQ ID NO: 3819102 - DNA, 15 bp, Homo sapiens
acttaggtgtggggg

SEQ ID NO: 3819103 - DNA, 19 bp, Homo sapiens
acttattgcctgggcagtg

SEQ ID NO: 3819104 - DNA, 14 bp, Homo sapiens
acttatttttgaca

SEQ ID NO: 3819105 - DNA, 16 bp, Homo sapiens
acttcactaccaaatg

SEQ ID NO: 3819106 - DNA, 18 bp, Homo sapiens
acttcatatatgaggact

SEQ ID NO: 3819107 - DNA, 20 bp, Homo sapiens
acttcttttgctcttagctg

SEQ ID NO: 3819108 - DNA, 11 bp, Homo sapiens
acttgaggaca

SEQ ID NO: 3819109 - DNA, 18 bp, Homo sapiens
acttgaggacacatgtcc

SEQ ID NO: 3819110 - DNA, 22 bp, Homo sapiens
acttgcatgaattactgtatat

SEQ ID NO: 3819111 - DNA, 15 bp, Homo sapiens
acttgggccactgtg

SEQ ID NO: 3819112 - DNA, 23 bp, Homo sapiens
acttggggggctgaggtgggagg

SEQ ID NO: 3819113 - DNA, 16 bp, Homo sapiens
acttggtttttaaaaa

SEQ ID NO: 3819114 - DNA, 14 bp, Homo sapiens
acttgtacaaaata

SEQ ID NO: 3819115 - DNA, 16 bp, Homo sapiens
acttgtgtctctgtgc

SEQ ID NO: 3819116 - DNA, 21 bp, Homo sapiens
acttgtgtctctgtgctttta

SEQ ID NO: 3819117 - DNA, 22 bp, Homo sapiens
acttgtgtctctgtgcttttaa

SEQ ID NO: 3819118 - DNA, 16 bp, Homo sapiens
acttttaaaactatat

SEQ ID NO: 3819119 - DNA, 15 bp, Homo sapiens
acttttaaacagtga

SEQ ID NO: 3819120 - DNA, 22 bp, Homo sapiens
acttttaaagaaaaatatgata

SEQ ID NO: 3819121 - DNA, 21 bp, Homo sapiens
acttttcagaattgaaggaga

SEQ ID NO: 3819122 - DNA, 15 bp, Homo sapiens
acttttctaaagctc

SEQ ID NO: 3819123 - DNA, 19 bp, Homo sapiens
agaaaaaatattttcccta

SEQ ID NO: 3819124 - DNA, 17 bp, Homo sapiens
agaaaaaatattttcct

SEQ ID NO: 3819125 - DNA, 16 bp, Homo sapiens
agaaaactgagaggtg

SEQ ID NO: 3819126 - DNA, 13 bp, Homo sapiens
agaaaacttccaa

SEQ ID NO: 3819127 - DNA, 14 bp, Homo sapiens
agaaacagagacag

SEQ ID NO: 3819128 - DNA, 15 bp, Homo sapiens
agaaacagagacagg

SEQ ID NO: 3819129 - DNA, 19 bp, Homo sapiens
agaaacagagacaggccca

SEQ ID NO: 3819130 - DNA, 15 bp, Homo sapiens
agaaacagagagaga

SEQ ID NO: 3819131 - DNA, 15 bp, Homo sapiens
agaaacaggctctga

SEQ ID NO: 3819132 - DNA, 16 bp, Homo sapiens
agaaacaggctctgag

SEQ ID NO: 3819133 - DNA, 15 bp, Homo sapiens
agaaacataaataaa

SEQ ID NO: 3819134 - DNA, 11 bp, Homo sapiens
agaaacatgaa

SEQ ID NO: 3819135 - DNA, 19 bp, Homo sapiens
agaaactcgatgaatgtgt

SEQ ID NO: 3819136 - DNA, 17 bp, Homo sapiens
agaaacttagaggaaaa

SEQ ID NO: 3819137 - DNA, 14 bp, Homo sapiens
agaaagtgaccatg

SEQ ID NO: 3819138 - DNA, 22 bp, Homo sapiens
agaaattttactgacagaaatg

SEQ ID NO: 3819139 - DNA, 16 bp, Homo sapiens
agaacaattatgtttc

SEQ ID NO: 3819140 - DNA, 15 bp, Homo sapiens
agaacatccaaggag

SEQ ID NO: 3819141 - DNA, 20 bp, Homo sapiens
agaactaggagtcttcactg

SEQ ID NO: 3819142 - DNA, 17 bp, Homo sapiens
agaagcatcaccatgca

SEQ ID NO: 3819143 - DNA, 16 bp, Homo sapiens
agaaggagcaagagaa

SEQ ID NO: 3819144 - DNA, 19 bp, Homo sapiens
agaaggagggttgtgccca

SEQ ID NO: 3819145 - DNA, 14 bp, Homo sapiens
agaagtaacttact

SEQ ID NO: 3819146 - DNA, 12 bp, Homo sapiens
agaatgagcctc

SEQ ID NO: 3819147 - DNA, 21 bp, Homo sapiens
agaatgtgtttaaacttggtt

SEQ ID NO: 3819148 - DNA, 19 bp, Homo sapiens
agaattagtggcacttgct

SEQ ID NO: 3819149 - DNA, 19 bp, Homo sapiens
agaattgaaggagaaaatg

SEQ ID NO: 3819150 - DNA, 12 bp, Homo sapiens
agacacagactg

SEQ ID NO: 3819151 - DNA, 17 bp, Homo sapiens
agacacagcccagacaa

SEQ ID NO: 3819152 - DNA, 23 bp, Homo sapiens
agacagaaacagagagagacaga

SEQ ID NO: 3819153 - DNA, 13 bp, Homo sapiens
agacagagagaga

SEQ ID NO: 3819154 - DNA, 15 bp, Homo sapiens
agacaggcccaagag

SEQ ID NO: 3819155 - DNA, 21 bp, Homo sapiens
agaccaccagccgccccagcc

SEQ ID NO: 3819156 - DNA, 22 bp, Homo sapiens
agaccaccagccgccccagccc

SEQ ID NO: 3819157 - DNA, 12 bp, Homo sapiens
agaccacctctc

SEQ ID NO: 3819158 - DNA, 20 bp, Homo sapiens
agaccattgtcttccaaccc

SEQ ID NO: 3819159 - DNA, 21 bp, Homo sapiens
agaccattgtcttccaacccc

SEQ ID NO: 3819160 - DNA, 19 bp, Homo sapiens
agactaatagagacacaga

SEQ ID NO: 3819161 - DNA, 20 bp, Homo sapiens
agactaatagagacacagag

SEQ ID NO: 3819162 - DNA, 15 bp, Homo sapiens
agactgagggagaga

SEQ ID NO: 3819163 - DNA, 16 bp, Homo sapiens
agactgagggagagac

SEQ ID NO: 3819164 - DNA, 14 bp, Homo sapiens
agacttatcaacat

SEQ ID NO: 3819165 - DNA, 21 bp, Homo sapiens
agagacaaacacctcccagga

SEQ ID NO: 3819166 - DNA, 18 bp, Homo sapiens
agagacagaaacagagag

SEQ ID NO: 3819167 - DNA, 15 bp, Homo sapiens
agagacaggcccaag

SEQ ID NO: 3819168 - DNA, 17 bp, Homo sapiens
agagacgggccctggtg

SEQ ID NO: 3819169 - DNA, 18 bp, Homo sapiens
agagagactcaaagagac

SEQ ID NO: 3819170 - DNA, 12 bp, Homo sapiens
agagagagactg

SEQ ID NO: 3819171 - DNA, 12 bp, Homo sapiens
agagaggccatt

SEQ ID NO: 3819172 - DNA, 20 bp, Homo sapiens
agagaggccttttggaatgt

SEQ ID NO: 3819173 - DNA, 18 bp, Homo sapiens
agagcaaaataattttaa

SEQ ID NO: 3819174 - DNA, 12 bp, Homo sapiens
agagcaggcaca

SEQ ID NO: 3819175 - DNA, 19 bp, Homo sapiens
agagcaggcacatggagga

SEQ ID NO: 3819176 - DNA, 15 bp, Homo sapiens
agagccaaggccacc

SEQ ID NO: 3819177 - DNA, 12 bp, Homo sapiens
atagatgtgtgg

SEQ ID NO: 3819178 - DNA, 18 bp, Homo sapiens
atagcacatgattttctt

SEQ ID NO: 3819179 - DNA, 22 bp, Homo sapiens
atagctggtcttatttgtaaag

SEQ ID NO: 3819180 - DNA, 18 bp, Homo sapiens
atatacacatggatgcac

SEQ ID NO: 3819181 - DNA, 16 bp, Homo sapiens
atatagataacagatt

SEQ ID NO: 3819182 - DNA, 24 bp, Homo sapiens
atatagtttgtggtaaaaagatta

SEQ ID NO: 3819183 - DNA, 17 bp, Homo sapiens
atatataatgttgccag

SEQ ID NO: 3819184 - DNA, 15 bp, Homo sapiens
atatatcataaagta

SEQ ID NO: 3819185 - DNA, 12 bp, Homo sapiens
atatcataaagt

SEQ ID NO: 3819186 - DNA, 16 bp, Homo sapiens
atatccacaaatgcta

SEQ ID NO: 3819187 - DNA, 22 bp, Homo sapiens
atatctaaagctttggacaagt

SEQ ID NO: 3819188 - DNA, 18 bp, Homo sapiens
atatctatatctctaaac

SEQ ID NO: 3819189 - DNA, 17 bp, Homo sapiens
atatgatgggggaaaaa

SEQ ID NO: 3819190 - DNA, 19 bp, Homo sapiens
atatgcacacacagatgca

SEQ ID NO: 3819191 - DNA, 14 bp, Homo sapiens
atattaaaggcttt

SEQ ID NO: 3819192 - DNA, 17 bp, Homo sapiens
atattaggggggaaagt

SEQ ID NO: 3819193 - DNA, 13 bp, Homo sapiens
atattcaataaag

SEQ ID NO: 3819194 - DNA, 16 bp, Homo sapiens
atattgatgttaacaa

SEQ ID NO: 3819195 - DNA, 14 bp, Homo sapiens
atatttactttaaa

SEQ ID NO: 3819196 - DNA, 15 bp, Homo sapiens
atatttatttatgta

SEQ ID NO: 3819197 - DNA, 21 bp, Homo sapiens
atatttattttctttctgtaa

SEQ ID NO: 3819198 - DNA, 12 bp, Homo sapiens
atatttgtacat

SEQ ID NO: 3819199 - DNA, 15 bp, Homo sapiens
atattttaatgaata

SEQ ID NO: 3819200 - DNA, 15 bp, Homo sapiens
atattttatttctga

SEQ ID NO: 3819201 - DNA, 20 bp, Homo sapiens
atcaaagaggttttaaaaaa

SEQ ID NO: 3819202 - DNA, 13 bp, Homo sapiens
atcacagcctctg

SEQ ID NO: 3819203 - DNA, 21 bp, Homo sapiens
atcacagggccccagaaggca

SEQ ID NO: 3819204 - DNA, 22 bp, Homo sapiens
atcacagggccccagaaggcag

SEQ ID NO: 3819205 - DNA, 13 bp, Homo sapiens
atcaccagacagg

SEQ ID NO: 3819206 - DNA, 19 bp, Homo sapiens
atcacttgagacaaatcta

SEQ ID NO: 3819207 - DNA, 16 bp, Homo sapiens
atcacttgtacaaaat

SEQ ID NO: 3819208 - DNA, 18 bp, Homo sapiens
atcagcctgctccagctg

SEQ ID NO: 3819209 - DNA, 21 bp, Homo sapiens
atcagcctgggcaatgtgata

SEQ ID NO: 3819210 - DNA, 16 bp, Homo sapiens
atcaggtcctcagaga

SEQ ID NO: 3819211 - DNA, 11 bp, Homo sapiens
atcataaagta

SEQ ID NO: 3819212 - DNA, 23 bp, Homo sapiens
atcatgtttacagaggacagtat

SEQ ID NO: 3819213 - DNA, 20 bp, Homo sapiens
atcattatcagcctgtgcca

SEQ ID NO: 3819214 - DNA, 23 bp, Homo sapiens
atcattgtatcaaattattttta

SEQ ID NO: 3819215 - DNA, 12 bp, Homo sapiens
atccactttgca

SEQ ID NO: 3819216 - DNA, 11 bp, Homo sapiens
atcccaacact

SEQ ID NO: 3819217 - DNA, 23 bp, Homo sapiens
atcccaggggaccacacctccct

SEQ ID NO: 3819218 - DNA, 15 bp, Homo sapiens
atcccatctgctaga

SEQ ID NO: 3819219 - DNA, 15 bp, Homo sapiens
atcctaccaacctct

SEQ ID NO: 3819220 - DNA, 14 bp, Homo sapiens
atcctaccccctgt

SEQ ID NO: 3819221 - DNA, 14 bp, Homo sapiens
atcctcagttcctg

SEQ ID NO: 3819222 - DNA, 14 bp, Homo sapiens
atcctgaaatttca

SEQ ID NO: 3819223 - DNA, 11 bp, Homo sapiens
atcctgcactc

SEQ ID NO: 3819224 - DNA, 13 bp, Homo sapiens
atcctgctaagtt

SEQ ID NO: 3819225 - DNA, 16 bp, Homo sapiens
atcggggagccgggag

SEQ ID NO: 3819226 - DNA, 18 bp, Homo sapiens
atctatatctctaaactg

SEQ ID NO: 3819227 - DNA, 14 bp, Homo sapiens
atctcagggcctgg

SEQ ID NO: 3819228 - DNA, 22 bp, Homo sapiens
atctcattcaggtgttctcttc

SEQ ID NO: 3819229 - DNA, 17 bp, Homo sapiens
atctcctcccatggcct

SEQ ID NO: 3819230 - DNA, 15 bp, Homo sapiens
atctctaaactgctg

SEQ ID NO: 3819231 - DNA, 16 bp, Homo sapiens
atctgagtccagctcc

SEQ ID NO: 3819232 - DNA, 23 bp, Homo sapiens
atctgcccgcctcggcctcccaa

SEQ ID NO: 3819233 - DNA, 14 bp, Homo sapiens
atctgcttccctgg

SEQ ID NO: 3819234 - DNA, 21 bp, Homo sapiens
atctgtcaaagaaaacttcca

SEQ ID NO: 3819235 - DNA, 15 bp, Homo sapiens
atcttaaaattcttg

SEQ ID NO: 3819236 - DNA, 15 bp, Homo sapiens
atcttagctgccaag

SEQ ID NO: 3819237 - DNA, 15 bp, Homo sapiens
atcttcacgcctggg

SEQ ID NO: 3819238 - DNA, 17 bp, Homo sapiens
atcttcacgcctgggtg

SEQ ID NO: 3819239 - DNA, 17 bp, Homo sapiens
atgaaaatcctaccaac

SEQ ID NO: 3819240 - DNA, 15 bp, Homo sapiens
atgaacttgaggaca

SEQ ID NO: 3819241 - DNA, 20 bp, Homo sapiens
atgaacttgaggacacatgt

SEQ ID NO: 3819242 - DNA, 19 bp, Homo sapiens
atgaagagtgagagggcat

SEQ ID NO: 3819243 - DNA, 16 bp, Homo sapiens
atgaagcccaataaac

SEQ ID NO: 3819244 - DNA, 19 bp, Homo sapiens
atgaagctggaagcactgc

SEQ ID NO: 3819245 - DNA, 22 bp, Homo sapiens
atgaagctggaagcactgctgt

SEQ ID NO: 3819246 - DNA, 13 bp, Homo sapiens
atgaatattgatg

SEQ ID NO: 3819247 - DNA, 13 bp, Homo sapiens
atgaatgctgacc

SEQ ID NO: 3819248 - DNA, 22 bp, Homo sapiens
atgacaacttttaaagaaaaat

SEQ ID NO: 3819249 - DNA, 18 bp, Homo sapiens
atgacatcacttgtacaa

SEQ ID NO: 3819250 - DNA, 19 bp, Homo sapiens
atgacatcacttgtacaaa

SEQ ID NO: 3819251 - DNA, 20 bp, Homo sapiens
atgacatcacttgtacaaaa

SEQ ID NO: 3819252 - DNA, 15 bp, Homo sapiens
atgactagaggcagg

SEQ ID NO: 3819253 - DNA, 22 bp, Homo sapiens
atgactagaggcagggagggga

SEQ ID NO: 3819254 - DNA, 22 bp, Homo sapiens
atgactggatacagaatgaatc

SEQ ID NO: 3819255 - DNA, 16 bp, Homo sapiens
atgagaaaactgagag

SEQ ID NO: 3819256 - DNA, 13 bp, Homo sapiens
atgagcctggcaa

SEQ ID NO: 3819257 - DNA, 16 bp, Homo sapiens
atgaggtccctctagc

SEQ ID NO: 3819258 - DNA, 18 bp, Homo sapiens
atgagttggctgggaata

SEQ ID NO: 3819259 - DNA, 15 bp, Homo sapiens
atgataaaacacaaa

SEQ ID NO: 3819260 - DNA, 16 bp, Homo sapiens
atgatcaaaacatgct

SEQ ID NO: 3819261 - DNA, 16 bp, Homo sapiens
atgatcctaggcattt

SEQ ID NO: 3819262 - DNA, 18 bp, Homo sapiens
atgatctggacttcctat

SEQ ID NO: 3819263 - DNA, 16 bp, Homo sapiens
atgatgggtcagttgt

SEQ ID NO: 3819264 - DNA, 20 bp, Homo sapiens
atgattaaccacttcagctg

SEQ ID NO: 3819265 - DNA, 21 bp, Homo sapiens
atgattaaccacttcagctga

SEQ ID NO: 3819266 - DNA, 17 bp, Homo sapiens
atgcaatttcctttttt

SEQ ID NO: 3819267 - DNA, 17 bp, Homo sapiens
atgcacacacacagaga

SEQ ID NO: 3819268 - DNA, 19 bp, Homo sapiens
atgcacagagatatgcaca

SEQ ID NO: 3819269 - DNA, 14 bp, Homo sapiens
atgcacatccctgg

SEQ ID NO: 3819270 - DNA, 14 bp, Homo sapiens
atgcaggagagctt

SEQ ID NO: 3819271 - DNA, 22 bp, Homo sapiens
atgcattataggatcatttgtt

SEQ ID NO: 3819272 - DNA, 18 bp, Homo sapiens
atgcattctagtgcagaa

SEQ ID NO: 3819273 - DNA, 22 bp, Homo sapiens
atgccaattagcaattgactgt

SEQ ID NO: 3819274 - DNA, 16 bp, Homo sapiens
atgccctacctgcctg

SEQ ID NO: 3819275 - DNA, 21 bp, Homo sapiens
atgctggtgtggccaaggctg

SEQ ID NO: 3819276 - DNA, 22 bp, Homo sapiens
atgctggtgtggccaaggctga

SEQ ID NO: 3819277 - DNA, 18 bp, Homo sapiens
atgcttcatgaaaatcct

SEQ ID NO: 3819278 - DNA, 22 bp, Homo sapiens
atgcttcatgaaaatcctacca

SEQ ID NO: 3819279 - DNA, 15 bp, Homo sapiens
atgctttctcctttt

SEQ ID NO: 3819280 - DNA, 16 bp, Homo sapiens
atgctttctccttttt

SEQ ID NO: 3819281 - DNA, 20 bp, Homo sapiens
atgcttttagttttaaaagt

SEQ ID NO: 3819282 - DNA, 22 bp, Homo sapiens
atggaatagaaaagatgagagg

SEQ ID NO: 3819283 - DNA, 11 bp, Homo sapiens
atggagagaga

SEQ ID NO: 3819284 - DNA, 14 bp, Homo sapiens
atggagagagactc

SEQ ID NO: 3819285 - DNA, 14 bp, Homo sapiens
atggagagagggga

SEQ ID NO: 3819286 - DNA, 14 bp, Homo sapiens
caggggagggaaaa

SEQ ID NO: 3819287 - DNA, 21 bp, Homo sapiens
caggggagggaaaagctaaga

SEQ ID NO: 3819288 - DNA, 16 bp, Homo sapiens
caggggcaccctccaa

SEQ ID NO: 3819289 - DNA, 21 bp, Homo sapiens
caggggcaccctccaaacact

SEQ ID NO: 3819290 - DNA, 18 bp, Homo sapiens
caggggtcgtcaccacct

SEQ ID NO: 3819291 - DNA, 21 bp, Homo sapiens
caggggtcgtcaccacctctc

SEQ ID NO: 3819292 - DNA, 18 bp, Homo sapiens
cagggttctgaccgggtc

SEQ ID NO: 3819293 - DNA, 15 bp, Homo sapiens
caggtcctcagagaa

SEQ ID NO: 3819294 - DNA, 20 bp, Homo sapiens
caggtggttatggagagggt

SEQ ID NO: 3819295 - DNA, 12 bp, Homo sapiens
cagtaacacgct

SEQ ID NO: 3819296 - DNA, 17 bp, Homo sapiens
cagtaacctagtgaatt

SEQ ID NO: 3819297 - DNA, 16 bp, Homo sapiens
cagtaattgtgaaaat

SEQ ID NO: 3819298 - DNA, 16 bp, Homo sapiens
cagtagaggcatgaac

SEQ ID NO: 3819299 - DNA, 15 bp, Homo sapiens
cagtatctcagggcc

SEQ ID NO: 3819300 - DNA, 18 bp, Homo sapiens
cagtatgtctactcctca

SEQ ID NO: 3819301 - DNA, 14 bp, Homo sapiens
cagtccattgaaag

SEQ ID NO: 3819302 - DNA, 21 bp, Homo sapiens
cagtcctagagctcctgtccc

SEQ ID NO: 3819303 - DNA, 23 bp, Homo sapiens
cagtcctagagctcctgtcccta

SEQ ID NO: 3819304 - DNA, 17 bp, Homo sapiens
cagtcctcacagcctct

SEQ ID NO: 3819305 - DNA, 19 bp, Homo sapiens
cagtcctcacagcctctcc

SEQ ID NO: 3819306 - DNA, 22 bp, Homo sapiens
cagtcctcacagcctctccctt

SEQ ID NO: 3819307 - DNA, 18 bp, Homo sapiens
cagtctgagagaggccat

SEQ ID NO: 3819308 - DNA, 22 bp, Homo sapiens
cagtctttaatctgagaggcca

SEQ ID NO: 3819309 - DNA, 13 bp, Homo sapiens
cagtgaaaatgaa

SEQ ID NO: 3819310 - DNA, 15 bp, Homo sapiens
cagtgaactgagact

SEQ ID NO: 3819311 - DNA, 24 bp, Homo sapiens
cagtgagccgagattgcaccactg

SEQ ID NO: 3819312 - DNA, 21 bp, Homo sapiens
cagtgcacacggatgcacaga

SEQ ID NO: 3819313 - DNA, 15 bp, Homo sapiens
cagtgccgagaagga

SEQ ID NO: 3819314 - DNA, 18 bp, Homo sapiens
cagtgccgagaaggaagc

SEQ ID NO: 3819315 - DNA, 16 bp, Homo sapiens
cagtggctggatctgt

SEQ ID NO: 3819316 - DNA, 18 bp, Homo sapiens
cagtggctggatctgtga

SEQ ID NO: 3819317 - DNA, 16 bp, Homo sapiens
cagtgggaggacagag

SEQ ID NO: 3819318 - DNA, 17 bp, Homo sapiens
cagtgtatggaaataaa

SEQ ID NO: 3819319 - DNA, 11 bp, Homo sapiens
cagtgtttcct

SEQ ID NO: 3819320 - DNA, 15 bp, Homo sapiens
cagtgtttcctgagt

SEQ ID NO: 3819321 - DNA, 23 bp, Homo sapiens
cagtgtttcctgagtagcagtga

SEQ ID NO: 3819322 - DNA, 14 bp, Homo sapiens
cagttcaagaaagc

SEQ ID NO: 3819323 - DNA, 13 bp, Homo sapiens
cagttctagttga

SEQ ID NO: 3819324 - DNA, 23 bp, Homo sapiens
cataaaggtatttagaatatatt

SEQ ID NO: 3819325 - DNA, 16 bp, Homo sapiens
cataaagtatgccttc

SEQ ID NO: 3819326 - DNA, 18 bp, Homo sapiens
cataaataaaatgaccag

SEQ ID NO: 3819327 - DNA, 19 bp, Homo sapiens
cataataaacttctggtgt

SEQ ID NO: 3819328 - DNA, 14 bp, Homo sapiens
catacattatattc

SEQ ID NO: 3819329 - DNA, 24 bp, Homo sapiens
catagagatatgcacacacagatg

SEQ ID NO: 3819330 - DNA, 13 bp, Homo sapiens
catagggtgctct

SEQ ID NO: 3819331 - DNA, 17 bp, Homo sapiens
catatatgaggacttgt

SEQ ID NO: 3819332 - DNA, 21 bp, Homo sapiens
catatatgtatatgtatatct

SEQ ID NO: 3819333 - DNA, 14 bp, Homo sapiens
catatattatcaaa

SEQ ID NO: 3819334 - DNA, 19 bp, Homo sapiens
catatattatcaaaattct

SEQ ID NO: 3819335 - DNA, 14 bp, Homo sapiens
catcacttgtacaa

SEQ ID NO: 3819336 - DNA, 19 bp, Homo sapiens
catcatgtttacagaggac

SEQ ID NO: 3819337 - DNA, 14 bp, Homo sapiens
catccaaggagaaa

SEQ ID NO: 3819338 - DNA, 21 bp, Homo sapiens
catccaaggagaaacagagac

SEQ ID NO: 3819339 - DNA, 18 bp, Homo sapiens
catccagagtccctgcct

SEQ ID NO: 3819340 - DNA, 18 bp, Homo sapiens
catccatgttccgagaag

SEQ ID NO: 3819341 - DNA, 19 bp, Homo sapiens
catcccttgcttaagaatc

SEQ ID NO: 3819342 - DNA, 16 bp, Homo sapiens
catctccctgaccttc

SEQ ID NO: 3819343 - DNA, 15 bp, Homo sapiens
catgaaacagaaaca

SEQ ID NO: 3819344 - DNA, 12 bp, Homo sapiens
catgaagacaga

SEQ ID NO: 3819345 - DNA, 12 bp, Homo sapiens
catgagaatcta

SEQ ID NO: 3819346 - DNA, 20 bp, Homo sapiens
catgagggatcacagggccc

SEQ ID NO: 3819347 - DNA, 23 bp, Homo sapiens
catgattaaccacttcagctgac

SEQ ID NO: 3819348 - DNA, 21 bp, Homo sapiens
catgattcatgccaattagca

SEQ ID NO: 3819349 - DNA, 18 bp, Homo sapiens
catgcattctagtgcaga

SEQ ID NO: 3819350 - DNA, 19 bp, Homo sapiens
catgccagcttatctcagg

SEQ ID NO: 3819351 - DNA, 22 bp, Homo sapiens
catgcgtgggtggggagggagg

SEQ ID NO: 3819352 - DNA, 20 bp, Homo sapiens
catgctcctggcccactgca

SEQ ID NO: 3819353 - DNA, 19 bp, Homo sapiens
catgctgaaggctgaaaga

SEQ ID NO: 3819354 - DNA, 20 bp, Homo sapiens
catgctggctcccagggcca

SEQ ID NO: 3819355 - DNA, 23 bp, Homo sapiens
catgcttcatgaaaatcctacca

SEQ ID NO: 3819356 - DNA, 15 bp, Homo sapiens
catgctttctccttt

SEQ ID NO: 3819357 - DNA, 16 bp, Homo sapiens
catgctttctcctttt

SEQ ID NO: 3819358 - DNA, 23 bp, Homo sapiens
catggagagagactcaaagagac

SEQ ID NO: 3819359 - DNA, 13 bp, Homo sapiens
catggccttccct

SEQ ID NO: 3819360 - DNA, 14 bp, Homo sapiens
catggccttccctc

SEQ ID NO: 3819361 - DNA, 19 bp, Homo sapiens
catggcctttgcttgaaag

SEQ ID NO: 3819362 - DNA, 21 bp, Homo sapiens
catgggcgaccagggccatct

SEQ ID NO: 3819363 - DNA, 19 bp, Homo sapiens
catggggctgattgtattt

SEQ ID NO: 3819364 - DNA, 22 bp, Homo sapiens
catggtaattatgtgatataaa

SEQ ID NO: 3819365 - DNA, 17 bp, Homo sapiens
catggtgtatgtggttt

SEQ ID NO: 3819366 - DNA, 16 bp, Homo sapiens
catgtatcactcactg

SEQ ID NO: 3819367 - DNA, 17 bp, Homo sapiens
cattaaacgtcattcag

SEQ ID NO: 3819368 - DNA, 17 bp, Homo sapiens
cattaaagatttctgct

SEQ ID NO: 3819369 - DNA, 19 bp, Homo sapiens
cattagctacttttcagaa

SEQ ID NO: 3819370 - DNA, 19 bp, Homo sapiens
cattatgttattggaattt

SEQ ID NO: 3819371 - DNA, 20 bp, Homo sapiens
cattatgttattggaatttt

SEQ ID NO: 3819372 - DNA, 21 bp, Homo sapiens
cattatgttattggaattttc

SEQ ID NO: 3819373 - DNA, 17 bp, Homo sapiens
cattcacagcgcctcct

SEQ ID NO: 3819374 - DNA, 18 bp, Homo sapiens
cattcaggtgttctcttc

SEQ ID NO: 3819375 - DNA, 13 bp, Homo sapiens
cattcagtactta

SEQ ID NO: 3819376 - DNA, 14 bp, Homo sapiens
cattctaatttgca

SEQ ID NO: 3819377 - DNA, 13 bp, Homo sapiens
cattctcctgcct

SEQ ID NO: 3819378 - DNA, 17 bp, Homo sapiens
cattctgaccatttcag

SEQ ID NO: 3819379 - DNA, 14 bp, Homo sapiens
cattctttcccaac

SEQ ID NO: 3819380 - DNA, 14 bp, Homo sapiens
cattgaattagaaa

SEQ ID NO: 3819381 - DNA, 20 bp, Homo sapiens
cattgtcttccaaccccagc

SEQ ID NO: 3819382 - DNA, 17 bp, Homo sapiens
cattgtgtcagaaacat

SEQ ID NO: 3819383 - DNA, 20 bp, Homo sapiens
catttctagcgcatggcctg

SEQ ID NO: 3819384 - DNA, 16 bp, Homo sapiens
catttcttcctctgca

SEQ ID NO: 3819385 - DNA, 17 bp, Homo sapiens
catttgttcattaaacg

SEQ ID NO: 3819386 - DNA, 24 bp, Homo sapiens
cattttgctaaatgtgaatgatga

SEQ ID NO: 3819387 - DNA, 23 bp, Homo sapiens
cattttgtacaaagatatgctaa

SEQ ID NO: 3819388 - DNA, 15 bp, Homo sapiens
catttttgtacatta

SEQ ID NO: 3819389 - DNA, 20 bp, Homo sapiens
catttttgtacattatgtta

SEQ ID NO: 3819390 - DNA, 23 bp, Homo sapiens
catttttgtacattatgttattg

SEQ ID NO: 3819391 - DNA, 16 bp, Homo sapiens
ccaaaagtacttaccc

SEQ ID NO: 3819392 - DNA, 17 bp, Homo sapiens
ccaaagcctcctccagc

SEQ ID NO: 3819393 - DNA, 14 bp, Homo sapiens
ccaaatattctcct

SEQ ID NO: 3819394 - DNA, 20 bp, Homo sapiens
cctgtctgtctgtctgtccc

SEQ ID NO: 3819395 - DNA, 21 bp, Homo sapiens
cctgtctgtctgtctgtccca

SEQ ID NO: 3819396 - DNA, 22 bp, Homo sapiens
cctgtctgtctgtctgtcccaa

SEQ ID NO: 3819397 - DNA, 17 bp, Homo sapiens
cctgtgccttttgccat

SEQ ID NO: 3819398 - DNA, 20 bp, Homo sapiens
cctgtggatgataaaacaca

SEQ ID NO: 3819399 - DNA, 11 bp, Homo sapiens
cctgtgtctta

SEQ ID NO: 3819400 - DNA, 13 bp, Homo sapiens
cctgttctccaga

SEQ ID NO: 3819401 - DNA, 14 bp, Homo sapiens
cctgttctccagat

SEQ ID NO: 3819402 - DNA, 17 bp, Homo sapiens
ccttaaggccacactgg

SEQ ID NO: 3819403 - DNA, 13 bp, Homo sapiens
ccttaaggctctt

SEQ ID NO: 3819404 - DNA, 23 bp, Homo sapiens
ccttaatcaggtcctcagagaat

SEQ ID NO: 3819405 - DNA, 20 bp, Homo sapiens
ccttacctcggtgccttcct

SEQ ID NO: 3819406 - DNA, 19 bp, Homo sapiens
ccttagccttgctgtagag

SEQ ID NO: 3819407 - DNA, 14 bp, Homo sapiens
ccttagttgttatc

SEQ ID NO: 3819408 - DNA, 16 bp, Homo sapiens
ccttcagatcctaccc

SEQ ID NO: 3819409 - DNA, 21 bp, Homo sapiens
ccttccaaatcaggctgggtt

SEQ ID NO: 3819410 - DNA, 13 bp, Homo sapiens
ccttctcccagca

SEQ ID NO: 3819411 - DNA, 20 bp, Homo sapiens
ccttctttctagagagggaa

SEQ ID NO: 3819412 - DNA, 23 bp, Homo sapiens
ccttgagttgattcagctctgca

SEQ ID NO: 3819413 - DNA, 19 bp, Homo sapiens
ccttgctgtagagacttcc

SEQ ID NO: 3819414 - DNA, 23 bp, Homo sapiens
ccttggtctaacttttgtgtgaa

SEQ ID NO: 3819415 - DNA, 18 bp, Homo sapiens
ccttgtcacgccagactt

SEQ ID NO: 3819416 - DNA, 16 bp, Homo sapiens
ccttgtcactggtaga

SEQ ID NO: 3819417 - DNA, 22 bp, Homo sapiens
cctttaaaggtcgcacctcctt

SEQ ID NO: 3819418 - DNA, 12 bp, Homo sapiens
cctttgaagagg

SEQ ID NO: 3819419 - DNA, 13 bp, Homo sapiens
cctttgaagagga

SEQ ID NO: 3819420 - DNA, 15 bp, Homo sapiens
cctttggccattcca

SEQ ID NO: 3819421 - DNA, 12 bp, Homo sapiens
ccttttccatgc

SEQ ID NO: 3819422 - DNA, 14 bp, Homo sapiens
cctttttctacctt

SEQ ID NO: 3819423 - DNA, 16 bp, Homo sapiens
cctttttctacctttt

SEQ ID NO: 3819424 - DNA, 16 bp, Homo sapiens
cctttttttctctcct

SEQ ID NO: 3819425 - DNA, 21 bp, Homo sapiens
cgaaagaacagtccattgaaa

SEQ ID NO: 3819426 - DNA, 21 bp, Homo sapiens
cgaagaacaatgtcagaaact

SEQ ID NO: 3819427 - DNA, 14 bp, Homo sapiens
cgacaccagccctg

SEQ ID NO: 3819428 - DNA, 17 bp, Homo sapiens
cgacaccagccctgctg

SEQ ID NO: 3819429 - DNA, 10 bp, Homo sapiens
cgactctgct

SEQ ID NO: 3819430 - DNA, 20 bp, Homo sapiens
cgactctgctgctcatggga

SEQ ID NO: 3819431 - DNA, 22 bp, Homo sapiens
cgacttttctaaagctctgaac

SEQ ID NO: 3819432 - DNA, 16 bp, Homo sapiens
cgagcccttagccttg

SEQ ID NO: 3819433 - DNA, 14 bp, Homo sapiens
cgagtgaatttcta

SEQ ID NO: 3819434 - DNA, 19 bp, Homo sapiens
cgatgtacacacacagatg

SEQ ID NO: 3819435 - DNA, 18 bp, Homo sapiens
cgatgtgcgcacacacag

SEQ ID NO: 3819436 - DNA, 23 bp, Homo sapiens
cgattgcaggagtccctgccatc

SEQ ID NO: 3819437 - DNA, 14 bp, Homo sapiens
cgatttgtcccagg

SEQ ID NO: 3819438 - DNA, 23 bp, Homo sapiens
cgcattttgggtgccattaaata

SEQ ID NO: 3819439 - DNA, 16 bp, Homo sapiens
cgccaaggctggggga

SEQ ID NO: 3819440 - DNA, 23 bp, Homo sapiens
cgccaaggctgggggaagaagct

SEQ ID NO: 3819441 - DNA, 17 bp, Homo sapiens
cgccatgctcctggccc

SEQ ID NO: 3819442 - DNA, 19 bp, Homo sapiens
cgccgtctggcgagccctt

SEQ ID NO: 3819443 - DNA, 20 bp, Homo sapiens
cgcctcggcctcccaaagtg

SEQ ID NO: 3819444 - DNA, 16 bp, Homo sapiens
cgcggctgggaggagg

SEQ ID NO: 3819445 - DNA, 16 bp, Homo sapiens
cgctctggatcctgca

SEQ ID NO: 3819446 - DNA, 19 bp, Homo sapiens
cgctgtgattggcaggagg

SEQ ID NO: 3819447 - DNA, 13 bp, Homo sapiens
cgctttcatgaac

SEQ ID NO: 3819448 - DNA, 18 bp, Homo sapiens
cggatgcacacacagatg

SEQ ID NO: 3819449 - DNA, 16 bp, Homo sapiens
cggcactccagcctgg

SEQ ID NO: 3819450 - DNA, 17 bp, Homo sapiens
cggcactccagcctggg

SEQ ID NO: 3819451 - DNA, 15 bp, Homo sapiens
cggcactgtggcctt

SEQ ID NO: 3819452 - DNA, 18 bp, Homo sapiens
cggcagcatcccagccag

SEQ ID NO: 3819453 - DNA, 21 bp, Homo sapiens
cggcctccgtccaggagcctg

SEQ ID NO: 3819454 - DNA, 21 bp, Homo sapiens
cggctgcctgacactgagccc

SEQ ID NO: 3819455 - DNA, 23 bp, Homo sapiens
cggctggcagcccacccctcaac

SEQ ID NO: 3819456 - DNA, 23 bp, Homo sapiens
cggctgggaggagggcaggcatc

SEQ ID NO: 3819457 - DNA, 20 bp, Homo sapiens
cggctgggtcggccctgccc

SEQ ID NO: 3819458 - DNA, 17 bp, Homo sapiens
cgggagcctgaccctca

SEQ ID NO: 3819459 - DNA, 16 bp, Homo sapiens
cgggagctcaggaacc

SEQ ID NO: 3819460 - DNA, 17 bp, Homo sapiens
cgggaggtcgaggcagg

SEQ ID NO: 3819461 - DNA, 18 bp, Homo sapiens
cgggaggtcgaggcagga

SEQ ID NO: 3819462 - DNA, 20 bp, Homo sapiens
cgggaggtcgaggcaggagg

SEQ ID NO: 3819463 - DNA, 15 bp, Homo sapiens
cgggctcagcaaaag

SEQ ID NO: 3819464 - DNA, 17 bp, Homo sapiens
cgggggcagtctgagag

SEQ ID NO: 3819465 - DNA, 17 bp, Homo sapiens
cgggttgtgtgtctgtt

SEQ ID NO: 3819466 - DNA, 13 bp, Homo sapiens
cggtgtggagaag

SEQ ID NO: 3819467 - DNA, 17 bp, Homo sapiens
cgtaagatggcttattt

SEQ ID NO: 3819468 - DNA, 19 bp, Homo sapiens
cgtaagatggcttatttgt

SEQ ID NO: 3819469 - DNA, 12 bp, Homo sapiens
cgtagatttttg

SEQ ID NO: 3819470 - DNA, 14 bp, Homo sapiens
cgtcaccacctctc

SEQ ID NO: 3819471 - DNA, 16 bp, Homo sapiens
cgtctggcgagccctt

SEQ ID NO: 3819472 - DNA, 18 bp, Homo sapiens
cgtctggcgagcccttag

SEQ ID NO: 3819473 - DNA, 15 bp, Homo sapiens
cgtgagtgtgacttt

SEQ ID NO: 3819474 - DNA, 22 bp, Homo sapiens
cgtgatatccacaaatgctatt

SEQ ID NO: 3819475 - DNA, 20 bp, Homo sapiens
cgtgatctcggctcactgca

SEQ ID NO: 3819476 - DNA, 19 bp, Homo sapiens
cgtgctcgcctctgcccag

SEQ ID NO: 3819477 - DNA, 12 bp, Homo sapiens
cgtggacacctg

SEQ ID NO: 3819478 - DNA, 14 bp, Homo sapiens
cgtggacacctgcc

SEQ ID NO: 3819479 - DNA, 14 bp, Homo sapiens
cgtgtctggcacag

SEQ ID NO: 3819480 - DNA, 21 bp, Homo sapiens
cgtgttttgtttggacttcac

SEQ ID NO: 3819481 - DNA, 15 bp, Homo sapiens
cgttactctcacctc

SEQ ID NO: 3819482 - DNA, 11 bp, Homo sapiens
ctaaaaataaa

SEQ ID NO: 3819483 - DNA, 14 bp, Homo sapiens
ctaaaatatttatt

SEQ ID NO: 3819484 - DNA, 21 bp, Homo sapiens
ctaaagctctgaacaaaagct

SEQ ID NO: 3819485 - DNA, 22 bp, Homo sapiens
ctaaatgtggacatcatgaagc

SEQ ID NO: 3819486 - DNA, 13 bp, Homo sapiens
ctaacttttgtgt

SEQ ID NO: 3819487 - DNA, 22 bp, Homo sapiens
ctaagctaggaatgaaatcctg

SEQ ID NO: 3819488 - DNA, 16 bp, Homo sapiens
ctaagctttctccttt

SEQ ID NO: 3819489 - DNA, 17 bp, Homo sapiens
ctaagctttctcctttg

SEQ ID NO: 3819490 - DNA, 19 bp, Homo sapiens
ctaaggaagacacagccca

SEQ ID NO: 3819491 - DNA, 18 bp, Homo sapiens
ctaatctctttattaaaa

SEQ ID NO: 3819492 - DNA, 16 bp, Homo sapiens
ctaatgagaagtcaac

SEQ ID NO: 3819493 - DNA, 22 bp, Homo sapiens
ctaattctttgacctgttggga

SEQ ID NO: 3819494 - DNA, 21 bp, Homo sapiens
ctaattggtccaacccagcct

SEQ ID NO: 3819495 - DNA, 15 bp, Homo sapiens
ctacaataaatgctg

SEQ ID NO: 3819496 - DNA, 19 bp, Homo sapiens
ctacaataaatgctgaatg

SEQ ID NO: 3819497 - DNA, 14 bp, Homo sapiens
ctacacatatatgt

SEQ ID NO: 3819498 - DNA, 18 bp, Homo sapiens
ctacacatatatgtatat

SEQ ID NO: 3819499 - DNA, 14 bp, Homo sapiens
ctacagaagtggaa

SEQ ID NO: 3819500 - DNA, 21 bp, Homo sapiens
ctacagttgaaaaacagctga

SEQ ID NO: 3819501 - DNA, 22 bp, Homo sapiens
ctacagttgaaaaacagctgag

SEQ ID NO: 3819502 - DNA, 15 bp, Homo sapiens
ctcctccagccgcca

SEQ ID NO: 3819503 - DNA, 12 bp, Homo sapiens
ctcctcctgccc

SEQ ID NO: 3819504 - DNA, 15 bp, Homo sapiens
ctcctcctgccctgt

SEQ ID NO: 3819505 - DNA, 22 bp, Homo sapiens
ctcctctgcccgggagctcagg

SEQ ID NO: 3819506 - DNA, 16 bp, Homo sapiens
ctcctgagctcgtgat

SEQ ID NO: 3819507 - DNA, 18 bp, Homo sapiens
ctcctgcctcagcctcct

SEQ ID NO: 3819508 - DNA, 23 bp, Homo sapiens
ctcctgcctcagcctcctgagta

SEQ ID NO: 3819509 - DNA, 17 bp, Homo sapiens
ctcctgctgcctaataa

SEQ ID NO: 3819510 - DNA, 16 bp, Homo sapiens
ctcctgtccctaccca

SEQ ID NO: 3819511 - DNA, 19 bp, Homo sapiens
ctcctgtccctacccactc

SEQ ID NO: 3819512 - DNA, 13 bp, Homo sapiens
ctcgactcagcac

SEQ ID NO: 3819513 - DNA, 15 bp, Homo sapiens
ctcgactcagcacca

SEQ ID NO: 3819514 - DNA, 16 bp, Homo sapiens
ctcgactcagcaccac

SEQ ID NO: 3819515 - DNA, 22 bp, Homo sapiens
ctcgactctgctgctcatggga

SEQ ID NO: 3819516 - DNA, 12 bp, Homo sapiens
ctcggctcactg

SEQ ID NO: 3819517 - DNA, 16 bp, Homo sapiens
ctcggtgtggagaagc

SEQ ID NO: 3819518 - DNA, 17 bp, Homo sapiens
ctcggtgtggagaagcg

SEQ ID NO: 3819519 - DNA, 23 bp, Homo sapiens
ctcggtgtggagaagcggctggc

SEQ ID NO: 3819520 - DNA, 18 bp, Homo sapiens
ctcgtgatctgcccgcct

SEQ ID NO: 3819521 - DNA, 19 bp, Homo sapiens
ctcgtgatttgcctgcctg

SEQ ID NO: 3819522 - DNA, 12 bp, Homo sapiens
ctcgtggacacc

SEQ ID NO: 3819523 - DNA, 19 bp, Homo sapiens
ctcgtggacacctgccctg

SEQ ID NO: 3819524 - DNA, 21 bp, Homo sapiens
ctcgtggacacctgccctgcc

SEQ ID NO: 3819525 - DNA, 15 bp, Homo sapiens
ctctaaaactctcaa

SEQ ID NO: 3819526 - DNA, 17 bp, Homo sapiens
ctctacaaactcccact

SEQ ID NO: 3819527 - DNA, 15 bp, Homo sapiens
ctctagaacacccac

SEQ ID NO: 3819528 - DNA, 21 bp, Homo sapiens
ctctagacactgccacacagg

SEQ ID NO: 3819529 - DNA, 17 bp, Homo sapiens
ctctagcagcacctcct

SEQ ID NO: 3819530 - DNA, 23 bp, Homo sapiens
ctctagggaaaaaccagcgtgtg

SEQ ID NO: 3819531 - DNA, 19 bp, Homo sapiens
ctctcaatattcaataaag

SEQ ID NO: 3819532 - DNA, 21 bp, Homo sapiens
ctctccaagtctctctgtgaa

SEQ ID NO: 3819533 - DNA, 17 bp, Homo sapiens
ctctccccgctctggat

SEQ ID NO: 3819534 - DNA, 21 bp, Homo sapiens
ctctctgtgaatacaattaaa

SEQ ID NO: 3819535 - DNA, 17 bp, Homo sapiens
ctctgaatgtcccagag

SEQ ID NO: 3819536 - DNA, 18 bp, Homo sapiens
ctctgaatgtcccagagg

SEQ ID NO: 3819537 - DNA, 16 bp, Homo sapiens
ctctgagatttcacag

SEQ ID NO: 3819538 - DNA, 16 bp, Homo sapiens
ctctgaggagtggagt

SEQ ID NO: 3819539 - DNA, 16 bp, Homo sapiens
ctctgaggtcaataaa

SEQ ID NO: 3819540 - DNA, 18 bp, Homo sapiens
ctctgaggtcaataaagc

SEQ ID NO: 3819541 - DNA, 20 bp, Homo sapiens
ctctgaggtcaataaagcag

SEQ ID NO: 3819542 - DNA, 23 bp, Homo sapiens
ctctgaggtcaataaagcagagc

SEQ ID NO: 3819543 - DNA, 15 bp, Homo sapiens
ctctgattttcaaag

SEQ ID NO: 3819544 - DNA, 18 bp, Homo sapiens
ctctgattttcaaagctt

SEQ ID NO: 3819545 - DNA, 19 bp, Homo sapiens
ctctgattttcaaagcttt

SEQ ID NO: 3819546 - DNA, 18 bp, Homo sapiens
ctctgcacaagctgcacc

SEQ ID NO: 3819547 - DNA, 20 bp, Homo sapiens
ctctgcacaagctgcaccct

SEQ ID NO: 3819548 - DNA, 21 bp, Homo sapiens
ctctgcacaagctgcaccctc

SEQ ID NO: 3819549 - DNA, 13 bp, Homo sapiens
ctctgctgcccag

SEQ ID NO: 3819550 - DNA, 23 bp, Homo sapiens
ctctggaaaggaggaaggagcct

SEQ ID NO: 3819551 - DNA, 14 bp, Homo sapiens
ctctgtgaatacaa

SEQ ID NO: 3819552 - DNA, 19 bp, Homo sapiens
ctctgtgaatacaattaaa

SEQ ID NO: 3819553 - DNA, 17 bp, Homo sapiens
ctctgtgtgcacaaata

SEQ ID NO: 3819554 - DNA, 22 bp, Homo sapiens
ctctgttcctggctcagcctca

SEQ ID NO: 3819555 - DNA, 13 bp, Homo sapiens
ctcttaaaaccca

SEQ ID NO: 3819556 - DNA, 24 bp, Homo sapiens
ctcttaaaacccaagtgccttagc

SEQ ID NO: 3819557 - DNA, 13 bp, Homo sapiens
ctcttagaaaaac

SEQ ID NO: 3819558 - DNA, 22 bp, Homo sapiens
ctcttctcagagcagcactggg

SEQ ID NO: 3819559 - DNA, 13 bp, Homo sapiens
ctcttctctgtta

SEQ ID NO: 3819560 - DNA, 15 bp, Homo sapiens
ctcttgagcctggga

SEQ ID NO: 3819561 - DNA, 16 bp, Homo sapiens
ctcttggccagagctg

SEQ ID NO: 3819562 - DNA, 17 bp, Homo sapiens
ctcttggccagagctga

SEQ ID NO: 3819563 - DNA, 23 bp, Homo sapiens
ctcttggggagtttagggtgggg

SEQ ID NO: 3819564 - DNA, 23 bp, Homo sapiens
ctctttaaaaaaaatagaagcta

SEQ ID NO: 3819565 - DNA, 14 bp, Homo sapiens
ctctttgctacaat

SEQ ID NO: 3819566 - DNA, 15 bp, Homo sapiens
ctctttgctacaata

SEQ ID NO: 3819567 - DNA, 19 bp, Homo sapiens
ctctttgctacaataaatg

SEQ ID NO: 3819568 - DNA, 20 bp, Homo sapiens
ctctttgctacaataaatgc

SEQ ID NO: 3819569 - DNA, 21 bp, Homo sapiens
ctctttgctacaataaatgct

SEQ ID NO: 3819570 - DNA, 23 bp, Homo sapiens
ctgaaagccagctgccgaccaga

SEQ ID NO: 3819571 - DNA, 16 bp, Homo sapiens
ctgaaagccctgagct

SEQ ID NO: 3819572 - DNA, 17 bp, Homo sapiens
ctgaaagccctgagctt

SEQ ID NO: 3819573 - DNA, 18 bp, Homo sapiens
ctgaaagccctgagcttt

SEQ ID NO: 3819574 - DNA, 19 bp, Homo sapiens
ctgaaagccctgagctttc

SEQ ID NO: 3819575 - DNA, 12 bp, Homo sapiens
ctgaaataaact

SEQ ID NO: 3819576 - DNA, 14 bp, Homo sapiens
ctgaaatttcagat

SEQ ID NO: 3819577 - DNA, 13 bp, Homo sapiens
ctgaacaagaatt

SEQ ID NO: 3819578 - DNA, 14 bp, Homo sapiens
ctgaacaagaattg

SEQ ID NO: 3819579 - DNA, 14 bp, Homo sapiens
ctgaacaatgaatg

SEQ ID NO: 3819580 - DNA, 18 bp, Homo sapiens
ctgaaggctttcagggcc

SEQ ID NO: 3819581 - DNA, 20 bp, Homo sapiens
ctgaagtgcagctcaggaga

SEQ ID NO: 3819582 - DNA, 17 bp, Homo sapiens
ctgaagttcagctgcat

SEQ ID NO: 3819583 - DNA, 16 bp, Homo sapiens
ctgaatacagaggcaa

SEQ ID NO: 3819584 - DNA, 13 bp, Homo sapiens
ctgaatgtcccag

SEQ ID NO: 3819585 - DNA, 17 bp, Homo sapiens
ctgaatgtcccagaggc

SEQ ID NO: 3819586 - DNA, 14 bp, Homo sapiens
ctgacactgagccc

SEQ ID NO: 3819587 - DNA, 16 bp, Homo sapiens
ctgacactgagcccca

SEQ ID NO: 3819588 - DNA, 19 bp, Homo sapiens
ctgacactgagccccacct

SEQ ID NO: 3819589 - DNA, 13 bp, Homo sapiens
ctgacagaaatgc

SEQ ID NO: 3819590 - DNA, 16 bp, Homo sapiens
ctgacagagccagagg

SEQ ID NO: 3819591 - DNA, 18 bp, Homo sapiens
ctgacagagccagaggca

SEQ ID NO: 3819592 - DNA, 17 bp, Homo sapiens
ctgaccaagagagaaag

SEQ ID NO: 3819593 - DNA, 24 bp, Homo sapiens
ctgacctcgtgatttgcctgcctg

SEQ ID NO: 3819594 - DNA, 16 bp, Homo sapiens
ctgaccttctccaggg

SEQ ID NO: 3819595 - DNA, 19 bp, Homo sapiens
ctgaccttctccagggaca

SEQ ID NO: 3819596 - DNA, 21 bp, Homo sapiens
ctgaccttctccagggacaga

SEQ ID NO: 3819597 - DNA, 19 bp, Homo sapiens
ctgactactactctgccaa

SEQ ID NO: 3819598 - DNA, 20 bp, Homo sapiens
ctgactactactctgccaat

SEQ ID NO: 3819599 - DNA, 23 bp, Homo sapiens
ctgactgcactgttgctgactac

SEQ ID NO: 3819600 - DNA, 18 bp, Homo sapiens
ctgactgttttctcttga

SEQ ID NO: 3819601 - DNA, 13 bp, Homo sapiens
ctgagagaggcca

SEQ ID NO: 3819602 - DNA, 14 bp, Homo sapiens
ctgagagaggccat

SEQ ID NO: 3819603 - DNA, 12 bp, Homo sapiens
ctgagcaggtgt

SEQ ID NO: 3819604 - DNA, 15 bp, Homo sapiens
ctgagccccacctct

SEQ ID NO: 3819605 - DNA, 17 bp, Homo sapiens
ctgagccccacctctcc

SEQ ID NO: 3819606 - DNA, 23 bp, Homo sapiens
ctgagccccacctctccaagtct

SEQ ID NO: 3819607 - DNA, 15 bp, Homo sapiens
ctgagctttctgcta

SEQ ID NO: 3819608 - DNA, 18 bp, Homo sapiens
ctgaggaagagggactgt

SEQ ID NO: 3819609 - DNA, 23 bp, Homo sapiens
ctgaggaagagggactgttcttt

SEQ ID NO: 3819610 - DNA, 14 bp, Homo sapiens
gagctgcagccccc

SEQ ID NO: 3819611 - DNA, 16 bp, Homo sapiens
gagctggcagcctcca

SEQ ID NO: 3819612 - DNA, 15 bp, Homo sapiens
gagctttcaaagaag

SEQ ID NO: 3819613 - DNA, 18 bp, Homo sapiens
gagctttcaaagaaggaa

SEQ ID NO: 3819614 - DNA, 22 bp, Homo sapiens
gagctttctgctatcaaagagg

SEQ ID NO: 3819615 - DNA, 17 bp, Homo sapiens
gaggaagagaaaaaata

SEQ ID NO: 3819616 - DNA, 17 bp, Homo sapiens
gaggaagagcaggcaca

SEQ ID NO: 3819617 - DNA, 19 bp, Homo sapiens
gaggaagagcaggcacatg

SEQ ID NO: 3819618 - DNA, 22 bp, Homo sapiens
gaggaaggaaaaggaggaaatt

SEQ ID NO: 3819619 - DNA, 22 bp, Homo sapiens
gaggaattttctttgtgtagct

SEQ ID NO: 3819620 - DNA, 14 bp, Homo sapiens
gaggacacatgtcc

SEQ ID NO: 3819621 - DNA, 22 bp, Homo sapiens
gaggacagtatttgtggggagg

SEQ ID NO: 3819622 - DNA, 16 bp, Homo sapiens
gaggacatggagagag

SEQ ID NO: 3819623 - DNA, 18 bp, Homo sapiens
gaggacttgtgtctctgt

SEQ ID NO: 3819624 - DNA, 13 bp, Homo sapiens
gaggagggcaggc

SEQ ID NO: 3819625 - DNA, 20 bp, Homo sapiens
gaggattgcttgagctcagg

SEQ ID NO: 3819626 - DNA, 22 bp, Homo sapiens
gaggcaggatatccccagggaa

SEQ ID NO: 3819627 - DNA, 24 bp, Homo sapiens
gaggcaggatatccccagggaaac

SEQ ID NO: 3819628 - DNA, 15 bp, Homo sapiens
gaggcagggagggga

SEQ ID NO: 3819629 - DNA, 16 bp, Homo sapiens
gaggcagggaggggac

SEQ ID NO: 3819630 - DNA, 22 bp, Homo sapiens
gaggccaaggtgggaggattgc

SEQ ID NO: 3819631 - DNA, 14 bp, Homo sapiens
gaggccccaggccc

SEQ ID NO: 3819632 - DNA, 20 bp, Homo sapiens
gaggcgaagcgttgtcctca

SEQ ID NO: 3819633 - DNA, 12 bp, Homo sapiens
gagggaaaagct

SEQ ID NO: 3819634 - DNA, 14 bp, Homo sapiens
gagggagggagagg

SEQ ID NO: 3819635 - DNA, 14 bp, Homo sapiens
gagggatcacaggg

SEQ ID NO: 3819636 - DNA, 23 bp, Homo sapiens
gagggatcacagggccccagaag

SEQ ID NO: 3819637 - DNA, 17 bp, Homo sapiens
gagggcagtggggagca

SEQ ID NO: 3819638 - DNA, 22 bp, Homo sapiens
gagggcatgcgcacaaggctga

SEQ ID NO: 3819639 - DNA, 17 bp, Homo sapiens
gagggcatgggagggag

SEQ ID NO: 3819640 - DNA, 18 bp, Homo sapiens
gagggcatgggagggagg

SEQ ID NO: 3819641 - DNA, 13 bp, Homo sapiens
gagggctgccctg

SEQ ID NO: 3819642 - DNA, 19 bp, Homo sapiens
gaggtatttatctttactt

SEQ ID NO: 3819643 - DNA, 19 bp, Homo sapiens
gaggtcaataaagcagagc

SEQ ID NO: 3819644 - DNA, 16 bp, Homo sapiens
gaggtgagaccacctc

SEQ ID NO: 3819645 - DNA, 16 bp, Homo sapiens
gaggtttcaaacctcc

SEQ ID NO: 3819646 - DNA, 18 bp, Homo sapiens
gagtcagggagagctgaa

SEQ ID NO: 3819647 - DNA, 13 bp, Homo sapiens
gagtccagctccc

SEQ ID NO: 3819648 - DNA, 15 bp, Homo sapiens
gagtccagctccccc

SEQ ID NO: 3819649 - DNA, 21 bp, Homo sapiens
gagtccagctccccccaagat

SEQ ID NO: 3819650 - DNA, 13 bp, Homo sapiens
gagtccatcagcc

SEQ ID NO: 3819651 - DNA, 16 bp, Homo sapiens
gagtccatcagcctcc

SEQ ID NO: 3819652 - DNA, 17 bp, Homo sapiens
gagtccatcagcctcca

SEQ ID NO: 3819653 - DNA, 21 bp, Homo sapiens
gagtccctgcctggaccagcc

SEQ ID NO: 3819654 - DNA, 15 bp, Homo sapiens
gagtgtgactttttg

SEQ ID NO: 3819655 - DNA, 14 bp, Homo sapiens
gagttcaagaccag

SEQ ID NO: 3819656 - DNA, 23 bp, Homo sapiens
gagttcattcaaaatgtccagct

SEQ ID NO: 3819657 - DNA, 16 bp, Homo sapiens
gagttgattcagctct

SEQ ID NO: 3819658 - DNA, 22 bp, Homo sapiens
gagtttatttttttgatggcta

SEQ ID NO: 3819659 - DNA, 23 bp, Homo sapiens
gagtttatttttttgatggctaa

SEQ ID NO: 3819660 - DNA, 17 bp, Homo sapiens
gataaaagaaccccaga

SEQ ID NO: 3819661 - DNA, 13 bp, Homo sapiens
gataaattacatt

SEQ ID NO: 3819662 - DNA, 22 bp, Homo sapiens
gataacatgtatcactcactgc

SEQ ID NO: 3819663 - DNA, 16 bp, Homo sapiens
gataagtaatgaaagt

SEQ ID NO: 3819664 - DNA, 15 bp, Homo sapiens
gatactgaagtgcag

SEQ ID NO: 3819665 - DNA, 22 bp, Homo sapiens
gatagctatattttatttctga

SEQ ID NO: 3819666 - DNA, 15 bp, Homo sapiens
gatatccccagggaa

SEQ ID NO: 3819667 - DNA, 17 bp, Homo sapiens
gatatccccagggaaac

SEQ ID NO: 3819668 - DNA, 13 bp, Homo sapiens
gatcacagggccc

SEQ ID NO: 3819669 - DNA, 20 bp, Homo sapiens
gatcacagggccccagaagg

SEQ ID NO: 3819670 - DNA, 16 bp, Homo sapiens
gatccacacacagagg

SEQ ID NO: 3819671 - DNA, 16 bp, Homo sapiens
gatccagtctgcagac

SEQ ID NO: 3819672 - DNA, 18 bp, Homo sapiens
gatcccaacactgccagc

SEQ ID NO: 3819673 - DNA, 11 bp, Homo sapiens
gatctcctgag

SEQ ID NO: 3819674 - DNA, 13 bp, Homo sapiens
gatctcctgagct

SEQ ID NO: 3819675 - DNA, 12 bp, Homo sapiens
gatctcttgagc

SEQ ID NO: 3819676 - DNA, 19 bp, Homo sapiens
gatctcttgagcctgggag

SEQ ID NO: 3819677 - DNA, 19 bp, Homo sapiens
gatctgcccgcctcggcct

SEQ ID NO: 3819678 - DNA, 22 bp, Homo sapiens
gatctgcttccctggggcccca

SEQ ID NO: 3819679 - DNA, 14 bp, Homo sapiens
gatgaagagtgaga

SEQ ID NO: 3819680 - DNA, 16 bp, Homo sapiens
gatgcacatccctgga

SEQ ID NO: 3819681 - DNA, 17 bp, Homo sapiens
gatgcagcaaaatgtga

SEQ ID NO: 3819682 - DNA, 16 bp, Homo sapiens
gatgctggccacagaa

SEQ ID NO: 3819683 - DNA, 16 bp, Homo sapiens
gatggagagaggggaa

SEQ ID NO: 3819684 - DNA, 23 bp, Homo sapiens
gatgggatttcaccgtattagcc

SEQ ID NO: 3819685 - DNA, 21 bp, Homo sapiens
gatgggtcagttgtatcagca

SEQ ID NO: 3819686 - DNA, 18 bp, Homo sapiens
gatggtcacacagagata

SEQ ID NO: 3819687 - DNA, 13 bp, Homo sapiens
gatgtaaacaatg

SEQ ID NO: 3819688 - DNA, 18 bp, Homo sapiens
gatgtcattcagcagtca

SEQ ID NO: 3819689 - DNA, 13 bp, Homo sapiens
gattcagctctgc

SEQ ID NO: 3819690 - DNA, 12 bp, Homo sapiens
gattcccagaga

SEQ ID NO: 3819691 - DNA, 18 bp, Homo sapiens
gattcctcccccagagcc

SEQ ID NO: 3819692 - DNA, 21 bp, Homo sapiens
gattcctttgaagaggaaaat

SEQ ID NO: 3819693 - DNA, 15 bp, Homo sapiens
gattctcacctgcct

SEQ ID NO: 3819694 - DNA, 16 bp, Homo sapiens
gattgcaccactgcac

SEQ ID NO: 3819695 - DNA, 16 bp, Homo sapiens
gattgcgagaattttc

SEQ ID NO: 3819696 - DNA, 13 bp, Homo sapiens
gattggcaggagg

SEQ ID NO: 3819697 - DNA, 14 bp, Homo sapiens
gattggcaggaggc

SEQ ID NO: 3819698 - DNA, 21 bp, Homo sapiens
gattgttctgtccagtttcca

SEQ ID NO: 3819699 - DNA, 17 bp, Homo sapiens
gatttactgtcccagga

SEQ ID NO: 3819700 - DNA, 22 bp, Homo sapiens
gatttcaccgtattagccagga

SEQ ID NO: 3819701 - DNA, 13 bp, Homo sapiens
gatttcatgcatt

SEQ ID NO: 3819702 - DNA, 23 bp, Homo sapiens
gatttcatgcattctagtgcaga

SEQ ID NO: 3819703 - DNA, 14 bp, Homo sapiens
gatttgcctgcctg

SEQ ID NO: 3819704 - DNA, 14 bp, Homo sapiens
gatttgtactgaaa

SEQ ID NO: 3819705 - DNA, 13 bp, Homo sapiens
gcaaaataatttt

SEQ ID NO: 3819706 - DNA, 15 bp, Homo sapiens
gcaaaataattttaa

SEQ ID NO: 3819707 - DNA, 13 bp, Homo sapiens
gcaaagttatatt

SEQ ID NO: 3819708 - DNA, 14 bp, Homo sapiens
gcaaagttatattt

SEQ ID NO: 3819709 - DNA, 14 bp, Homo sapiens
gcaaccctcagctg

SEQ ID NO: 3819710 - DNA, 14 bp, Homo sapiens
gcaactcatcttag

SEQ ID NO: 3819711 - DNA, 15 bp, Homo sapiens
gcaactcctgttctt

SEQ ID NO: 3819712 - DNA, 15 bp, Homo sapiens
gcaagactctgtctc

SEQ ID NO: 3819713 - DNA, 23 bp, Homo sapiens
gcaagactctgtctcaataaata

SEQ ID NO: 3819714 - DNA, 19 bp, Homo sapiens
gcaaggacaacctgcccct

SEQ ID NO: 3819715 - DNA, 20 bp, Homo sapiens
gcaagtgttagaattgcctt

SEQ ID NO: 3819716 - DNA, 18 bp, Homo sapiens
gcaataaaggagaagaga

SEQ ID NO: 3819717 - DNA, 19 bp, Homo sapiens
gcaataaaggagaagagat

SEQ ID NO: 3819718 - DNA, 21 bp, Homo sapiens
gcaataaagtgtagcaccctg

SEQ ID NO: 3819719 - DNA, 22 bp, Homo sapiens
gtccctgcctggaccagcctct

SEQ ID NO: 3819720 - DNA, 14 bp, Homo sapiens
gtcctagagctcct

SEQ ID NO: 3819721 - DNA, 16 bp, Homo sapiens
gtcctcacagcctctc

SEQ ID NO: 3819722 - DNA, 17 bp, Homo sapiens
gtcctcacagcctctcc

SEQ ID NO: 3819723 - DNA, 18 bp, Homo sapiens
gtcctcacagcctctccc

SEQ ID NO: 3819724 - DNA, 12 bp, Homo sapiens
gtcgaggcagga

SEQ ID NO: 3819725 - DNA, 19 bp, Homo sapiens
gtctccctcctctgcccgg

SEQ ID NO: 3819726 - DNA, 16 bp, Homo sapiens
gtctcgaactcctgac

SEQ ID NO: 3819727 - DNA, 13 bp, Homo sapiens
gtctcgctctgct

SEQ ID NO: 3819728 - DNA, 16 bp, Homo sapiens
gtctcgctctgctgcc

SEQ ID NO: 3819729 - DNA, 16 bp, Homo sapiens
gtctctctgtgaatac

SEQ ID NO: 3819730 - DNA, 16 bp, Homo sapiens
gtctcttctcagagca

SEQ ID NO: 3819731 - DNA, 19 bp, Homo sapiens
gtctgaggccccaggccct

SEQ ID NO: 3819732 - DNA, 13 bp, Homo sapiens
gtctgcttctgca

SEQ ID NO: 3819733 - DNA, 19 bp, Homo sapiens
gtctggcacagcctggctg

SEQ ID NO: 3819734 - DNA, 15 bp, Homo sapiens
gtctggcgagccctt

SEQ ID NO: 3819735 - DNA, 14 bp, Homo sapiens
gtctgtctgtctgt

SEQ ID NO: 3819736 - DNA, 11 bp, Homo sapiens
gtctgtgtgtg

SEQ ID NO: 3819737 - DNA, 16 bp, Homo sapiens
gtctgtgtgtgtgtat

SEQ ID NO: 3819738 - DNA, 11 bp, Homo sapiens
gtctgtgtgtt

SEQ ID NO: 3819739 - DNA, 21 bp, Homo sapiens
gtcttaaaaagtggaaaaata

SEQ ID NO: 3819740 - DNA, 15 bp, Homo sapiens
gtcttccaaccccag

SEQ ID NO: 3819741 - DNA, 17 bp, Homo sapiens
gtcttccaaccccagct

SEQ ID NO: 3819742 - DNA, 19 bp, Homo sapiens
gtcttccaaccccagctgg

SEQ ID NO: 3819743 - DNA, 22 bp, Homo sapiens
gtcttccaaccccagctggcct

SEQ ID NO: 3819744 - DNA, 22 bp, Homo sapiens
gtcttccaggtgcctggccctt

SEQ ID NO: 3819745 - DNA, 15 bp, Homo sapiens
gtcttgatctcctga

SEQ ID NO: 3819746 - DNA, 15 bp, Homo sapiens
gtctttggttcagct

SEQ ID NO: 3819747 - DNA, 23 bp, Homo sapiens
gtgaaaagaaaaatgagcctggc

SEQ ID NO: 3819748 - DNA, 15 bp, Homo sapiens
gtgaacaaagaaaag

SEQ ID NO: 3819749 - DNA, 17 bp, Homo sapiens
gtgaacttgggccactg

SEQ ID NO: 3819750 - DNA, 14 bp, Homo sapiens
gtgaatacaattaa

SEQ ID NO: 3819751 - DNA, 17 bp, Homo sapiens
gtgaatacaattaaagg

SEQ ID NO: 3819752 - DNA, 15 bp, Homo sapiens
gtgaattacactcaa

SEQ ID NO: 3819753 - DNA, 17 bp, Homo sapiens
gtgaattacactcaagg

SEQ ID NO: 3819754 - DNA, 16 bp, Homo sapiens
gtgaatttctaaatgt

SEQ ID NO: 3819755 - DNA, 23 bp, Homo sapiens
gtgacccccactgccgcctcctt

SEQ ID NO: 3819756 - DNA, 13 bp, Homo sapiens
gtgagaccacctc

SEQ ID NO: 3819757 - DNA, 16 bp, Homo sapiens
gtgagaccctgttcta

SEQ ID NO: 3819758 - DNA, 17 bp, Homo sapiens
gtgaggtgacttgcctg

SEQ ID NO: 3819759 - DNA, 22 bp, Homo sapiens
gtgattagagggaggagaatga

SEQ ID NO: 3819760 - DNA, 19 bp, Homo sapiens
gtgattcctttgaagagga

SEQ ID NO: 3819761 - DNA, 21 bp, Homo sapiens
gtgattcctttgaagaggaaa

SEQ ID NO: 3819762 - DNA, 20 bp, Homo sapiens
gtgattggcaggaggcagga

SEQ ID NO: 3819763 - DNA, 19 bp, Homo sapiens
gtgattgttccataataaa

SEQ ID NO: 3819764 - DNA, 16 bp, Homo sapiens
gtgatttgcctgcctg

SEQ ID NO: 3819765 - DNA, 12 bp, Homo sapiens
gtgattttcatt

SEQ ID NO: 3819766 - DNA, 17 bp, Homo sapiens
gtgatttttatgccacc

SEQ ID NO: 3819767 - DNA, 20 bp, Homo sapiens
gtgatttttatgccacctga

SEQ ID NO: 3819768 - DNA, 20 bp, Homo sapiens
gtgcagaacaggggcaccct

SEQ ID NO: 3819769 - DNA, 16 bp, Homo sapiens
gtgccaaggttgtcct

SEQ ID NO: 3819770 - DNA, 13 bp, Homo sapiens
gtgccactgaccg

SEQ ID NO: 3819771 - DNA, 21 bp, Homo sapiens
gtgctcgcctctgcccagcct

SEQ ID NO: 3819772 - DNA, 17 bp, Homo sapiens
gtgctctgaggtcaata

SEQ ID NO: 3819773 - DNA, 22 bp, Homo sapiens
gtgcttctagttctgccaggag

SEQ ID NO: 3819774 - DNA, 12 bp, Homo sapiens
gtggacacctgc

SEQ ID NO: 3819775 - DNA, 13 bp, Homo sapiens
gtggacacctgcc

SEQ ID NO: 3819776 - DNA, 17 bp, Homo sapiens
gtggacacctgccctgc

SEQ ID NO: 3819777 - DNA, 17 bp, Homo sapiens
gtggaggttgcagtgaa

SEQ ID NO: 3819778 - DNA, 18 bp, Homo sapiens
gtggagttctctgttcta

SEQ ID NO: 3819779 - DNA, 21 bp, Homo sapiens
gtggagttctctgttctagag

SEQ ID NO: 3819780 - DNA, 18 bp, Homo sapiens
gtggcaaccctcagctgc

SEQ ID NO: 3819781 - DNA, 21 bp, Homo sapiens
gtggcaataaaggagaagaga

SEQ ID NO: 3819782 - DNA, 18 bp, Homo sapiens
gtggcactggggcagggg

SEQ ID NO: 3819783 - DNA, 16 bp, Homo sapiens
gtggctcgggaggcga

SEQ ID NO: 3819784 - DNA, 17 bp, Homo sapiens
gtggctgggaagggaag

SEQ ID NO: 3819785 - DNA, 22 bp, Homo sapiens
gtggctgggaagggaaggaagc

SEQ ID NO: 3819786 - DNA, 18 bp, Homo sapiens
gtgggaggacagagccgg

SEQ ID NO: 3819787 - DNA, 21 bp, Homo sapiens
gtggggagagacgggccctgg

SEQ ID NO: 3819788 - DNA, 14 bp, Homo sapiens
gtgggggtctgtgt

SEQ ID NO: 3819789 - DNA, 17 bp, Homo sapiens
gtggtagagtgtgcctg

SEQ ID NO: 3819790 - DNA, 20 bp, Homo sapiens
gtggtggggaccagctaatt

SEQ ID NO: 3819791 - DNA, 18 bp, Homo sapiens
gtggttatggagagggtg

SEQ ID NO: 3819792 - DNA, 20 bp, Homo sapiens
gtgtaatttaaaattgtgat

SEQ ID NO: 3819793 - DNA, 22 bp, Homo sapiens
gtgtaatttaaaattgtgatgt

SEQ ID NO: 3819794 - DNA, 21 bp, Homo sapiens
gtgtatgtgggggtctgtgtg

SEQ ID NO: 3819795 - DNA, 13 bp, Homo sapiens
gtgtatgtggttt

SEQ ID NO: 3819796 - DNA, 22 bp, Homo sapiens
gtgtccagaccattgtcttcca

SEQ ID NO: 3819797 - DNA, 21 bp, Homo sapiens
gtgtcctgcaccggggcctgg

SEQ ID NO: 3819798 - DNA, 17 bp, Homo sapiens
gtgtctggcacagcctg

SEQ ID NO: 3819799 - DNA, 15 bp, Homo sapiens
gtgtcttgtgttttt

SEQ ID NO: 3819800 - DNA, 17 bp, Homo sapiens
gtgtgactactccccca

SEQ ID NO: 3819801 - DNA, 13 bp, Homo sapiens
gtgtggagaagcg

SEQ ID NO: 3819802 - DNA, 20 bp, Homo sapiens
gtgtggccaaggctgagagc

SEQ ID NO: 3819803 - DNA, 16 bp, Homo sapiens
gtgtggtagagtgtgc

SEQ ID NO: 3819804 - DNA, 12 bp, Homo sapiens
gtgtgtatgtgg

SEQ ID NO: 3819805 - DNA, 15 bp, Homo sapiens
gtgtgtctgctcagt

SEQ ID NO: 3819806 - DNA, 16 bp, Homo sapiens
gtgtgtctgctcagta

SEQ ID NO: 3819807 - DNA, 15 bp, Homo sapiens
gtgtgtctgttcact

SEQ ID NO: 3819808 - DNA, 22 bp, Homo sapiens
gtgtgtctgttcacttttcctc

SEQ ID NO: 3819809 - DNA, 14 bp, Homo sapiens
gtgtgtgtatgtgg

SEQ ID NO: 3819810 - DNA, 15 bp, Homo sapiens
gtgtgtttatgtgtg

SEQ ID NO: 3819811 - DNA, 16 bp, Homo sapiens
gtgttactaaagtcac

SEQ ID NO: 3819812 - DNA, 14 bp, Homo sapiens
gtgttctgttgttt

SEQ ID NO: 3819813 - DNA, 19 bp, Homo sapiens
gttaattgattaaaatctg

SEQ ID NO: 3819814 - DNA, 19 bp, Homo sapiens
gttagaaatgcagaatcct

SEQ ID NO: 3819815 - DNA, 16 bp, Homo sapiens
gttattggaattttct

SEQ ID NO: 3819816 - DNA, 22 bp, Homo sapiens
gttatttttctctttaaaaaaa

SEQ ID NO: 3819817 - DNA, 22 bp, Homo sapiens
gttcacaccattctcctgcctc

SEQ ID NO: 3819818 - DNA, 14 bp, Homo sapiens
gttcataatttcag

SEQ ID NO: 3819819 - DNA, 19 bp, Homo sapiens
gttcatgagaatctatatt

SEQ ID NO: 3819820 - DNA, 22 bp, Homo sapiens
gttcattcaaaatgtccagctt

SEQ ID NO: 3819821 - DNA, 19 bp, Homo sapiens
gttcccatggtgtatgtgg

SEQ ID NO: 3819822 - DNA, 15 bp, Homo sapiens
gttcctggctcagcc

SEQ ID NO: 3819823 - DNA, 16 bp, Homo sapiens
gttcctggctcagcct

SEQ ID NO: 3819824 - DNA, 11 bp, Homo sapiens
gttctccagat

SEQ ID NO: 3819825 - DNA, 15 bp, Homo sapiens
gttctctcttctcca

SEQ ID NO: 3819826 - DNA, 20 bp, Homo sapiens
gttctgaccgggtctgcttc

SEQ ID NO: 3819827 - DNA, 12 bp, Homo sapiens
gttctgccagga

SEQ ID NO: 3819828 - DNA, 13 bp, Homo sapiens
tacccactctttg

SEQ ID NO: 3819829 - DNA, 14 bp, Homo sapiens
tacccactctttgc

SEQ ID NO: 3819830 - DNA, 15 bp, Homo sapiens
taccccctgtgcctt

SEQ ID NO: 3819831 - DNA, 18 bp, Homo sapiens
tacccctcgactcagcac

SEQ ID NO: 3819832 - DNA, 20 bp, Homo sapiens
tacccctcgactcagcacca

SEQ ID NO: 3819833 - DNA, 17 bp, Homo sapiens
tacctattttatatgat

SEQ ID NO: 3819834 - DNA, 15 bp, Homo sapiens
tacctgcctgttctc

SEQ ID NO: 3819835 - DNA, 13 bp, Homo sapiens
tactactctgcca

SEQ ID NO: 3819836 - DNA, 14 bp, Homo sapiens
tactactctgccaa

SEQ ID NO: 3819837 - DNA, 16 bp, Homo sapiens
tactctcacctcgtga

SEQ ID NO: 3819838 - DNA, 14 bp, Homo sapiens
tactgacagaaatg

SEQ ID NO: 3819839 - DNA, 14 bp, Homo sapiens
tactgattccagca

SEQ ID NO: 3819840 - DNA, 15 bp, Homo sapiens
tactgattccagcaa

SEQ ID NO: 3819841 - DNA, 13 bp, Homo sapiens
tactgcacatttt

SEQ ID NO: 3819842 - DNA, 15 bp, Homo sapiens
tactgcacattttgt

SEQ ID NO: 3819843 - DNA, 23 bp, Homo sapiens
tactgctgatgctgaaataaact

SEQ ID NO: 3819844 - DNA, 18 bp, Homo sapiens
tactggtcttgtggaatt

SEQ ID NO: 3819845 - DNA, 13 bp, Homo sapiens
tactgtcccagga

SEQ ID NO: 3819846 - DNA, 19 bp, Homo sapiens
tagaaatgtaacttttgta

SEQ ID NO: 3819847 - DNA, 19 bp, Homo sapiens
tagaaattacacccaaaga

SEQ ID NO: 3819848 - DNA, 15 bp, Homo sapiens
tagaacacaggcaaa

SEQ ID NO: 3819849 - DNA, 17 bp, Homo sapiens
tagaacacccactggcc

SEQ ID NO: 3819850 - DNA, 14 bp, Homo sapiens
tagaagaagtgtgt

SEQ ID NO: 3819851 - DNA, 16 bp, Homo sapiens
tagaatgatttcatgc

SEQ ID NO: 3819852 - DNA, 14 bp, Homo sapiens
tagagctcctgtcc

SEQ ID NO: 3819853 - DNA, 12 bp, Homo sapiens
tagaggaaaagg

SEQ ID NO: 3819854 - DNA, 19 bp, Homo sapiens
tagaggcagggaggggact

SEQ ID NO: 3819855 - DNA, 12 bp, Homo sapiens
tagagtgggagc

SEQ ID NO: 3819856 - DNA, 23 bp, Homo sapiens
tagagtttatttttttgatggct

SEQ ID NO: 3819857 - DNA, 18 bp, Homo sapiens
tagatccacacacagagg

SEQ ID NO: 3819858 - DNA, 11 bp, Homo sapiens
tagatgtgtgg

SEQ ID NO: 3819859 - DNA, 20 bp, Homo sapiens
tagattctcacctgccttca

SEQ ID NO: 3819860 - DNA, 12 bp, Homo sapiens
tagcaactgtgc

SEQ ID NO: 3819861 - DNA, 14 bp, Homo sapiens
tagcagcacctcct

SEQ ID NO: 3819862 - DNA, 17 bp, Homo sapiens
tagcctgcctcttctct

SEQ ID NO: 3819863 - DNA, 15 bp, Homo sapiens
tagccttgctgtaga

SEQ ID NO: 3819864 - DNA, 16 bp, Homo sapiens
tagccttgctgtagag

SEQ ID NO: 3819865 - DNA, 16 bp, Homo sapiens
tagctatattttattt

SEQ ID NO: 3819866 - DNA, 21 bp, Homo sapiens
tagctcataagctgtagaact

SEQ ID NO: 3819867 - DNA, 15 bp, Homo sapiens
tagctttgctctttg

SEQ ID NO: 3819868 - DNA, 15 bp, Homo sapiens
taggaactgctgggc

SEQ ID NO: 3819869 - DNA, 22 bp, Homo sapiens
taggagagggggcgatatagag

SEQ ID NO: 3819870 - DNA, 12 bp, Homo sapiens
taggataaatta

SEQ ID NO: 3819871 - DNA, 18 bp, Homo sapiens
taggataaattacattaa

SEQ ID NO: 3819872 - DNA, 19 bp, Homo sapiens
taggataaattacattaaa

SEQ ID NO: 3819873 - DNA, 14 bp, Homo sapiens
taggcatcccaggg

SEQ ID NO: 3819874 - DNA, 13 bp, Homo sapiens
tagggaaaaaaca

SEQ ID NO: 3819875 - DNA, 11 bp, Homo sapiens
tagggaaaaac

SEQ ID NO: 3819876 - DNA, 20 bp, Homo sapiens
tagggaaaaaccagcgtgtg

SEQ ID NO: 3819877 - DNA, 21 bp, Homo sapiens
tagggaaaaaccagcgtgtga

SEQ ID NO: 3819878 - DNA, 23 bp, Homo sapiens
tagggtgctctgaggtcaataaa

SEQ ID NO: 3819879 - DNA, 16 bp, Homo sapiens
tagggttttggcctgc

SEQ ID NO: 3819880 - DNA, 14 bp, Homo sapiens
taggtacacagctc

SEQ ID NO: 3819881 - DNA, 17 bp, Homo sapiens
taggtgtgggggaagca

SEQ ID NO: 3819882 - DNA, 21 bp, Homo sapiens
taggttggcaaaaaggcagga

SEQ ID NO: 3819883 - DNA, 13 bp, Homo sapiens
tagtagtgtcttc

SEQ ID NO: 3819884 - DNA, 20 bp, Homo sapiens
tagtgatttttatgccacct

SEQ ID NO: 3819885 - DNA, 20 bp, Homo sapiens
tagtgtcttcctagtatatt

SEQ ID NO: 3819886 - DNA, 15 bp, Homo sapiens
tagttacctactttt

SEQ ID NO: 3819887 - DNA, 14 bp, Homo sapiens
tagttctgccagga

SEQ ID NO: 3819888 - DNA, 20 bp, Homo sapiens
tagttgattgcgagaatttt

SEQ ID NO: 3819889 - DNA, 22 bp, Homo sapiens
tagttgattgcgagaattttca

SEQ ID NO: 3819890 - DNA, 19 bp, Homo sapiens
tataaaatattcatatatt

SEQ ID NO: 3819891 - DNA, 14 bp, Homo sapiens
tataaaatgggaag

SEQ ID NO: 3819892 - DNA, 18 bp, Homo sapiens
tatacaatttctattatt

SEQ ID NO: 3819893 - DNA, 20 bp, Homo sapiens
tataggataaattacattaa

SEQ ID NO: 3819894 - DNA, 14 bp, Homo sapiens
tatatatcataaag

SEQ ID NO: 3819895 - DNA, 17 bp, Homo sapiens
tatatatcataaagtat

SEQ ID NO: 3819896 - DNA, 21 bp, Homo sapiens
tatatattctacacatatatg

SEQ ID NO: 3819897 - DNA, 18 bp, Homo sapiens
tatatgagactttatgtg

SEQ ID NO: 3819898 - DNA, 14 bp, Homo sapiens
tatatgtatatcta

SEQ ID NO: 3819899 - DNA, 19 bp, Homo sapiens
tatatgtatatctatatct

SEQ ID NO: 3819900 - DNA, 22 bp, Homo sapiens
tatattccgggtgccattccca

SEQ ID NO: 3819901 - DNA, 15 bp, Homo sapiens
tatattttatttctg

SEQ ID NO: 3819902 - DNA, 20 bp, Homo sapiens
tatattttatttctgaagag

SEQ ID NO: 3819903 - DNA, 21 bp, Homo sapiens
tatcaaattatttttaagttt

SEQ ID NO: 3819904 - DNA, 12 bp, Homo sapiens
tatcataaagta

SEQ ID NO: 3819905 - DNA, 13 bp, Homo sapiens
tatcataaagtat

SEQ ID NO: 3819906 - DNA, 18 bp, Homo sapiens
tatcatagaaatgtaact

SEQ ID NO: 3819907 - DNA, 16 bp, Homo sapiens
tatcccacggaaaatg

SEQ ID NO: 3819908 - DNA, 19 bp, Homo sapiens
tatcccacggaaaatgcca

SEQ ID NO: 3819909 - DNA, 14 bp, Homo sapiens
tatcctgaaatttc

SEQ ID NO: 3819910 - DNA, 13 bp, Homo sapiens
tatctcagggcct

SEQ ID NO: 3819911 - DNA, 21 bp, Homo sapiens
tatctctaaactgctgttaat

SEQ ID NO: 3819912 - DNA, 16 bp, Homo sapiens
tatctctgtgtgcaca

SEQ ID NO: 3819913 - DNA, 17 bp, Homo sapiens
tatctctgtgtgcacaa

SEQ ID NO: 3819914 - DNA, 18 bp, Homo sapiens
tatctctgtgtgcacaaa

SEQ ID NO: 3819915 - DNA, 16 bp, Homo sapiens
tatctgagaagtgtat

SEQ ID NO: 3819916 - DNA, 23 bp, Homo sapiens
tatgacatcacttgtacaaaata

SEQ ID NO: 3819917 - DNA, 15 bp, Homo sapiens
tatgagactttatgt

SEQ ID NO: 3819918 - DNA, 23 bp, Homo sapiens
tatgagctggggatgtctctcat

SEQ ID NO: 3819919 - DNA, 12 bp, Homo sapiens
tatgatgctatt

SEQ ID NO: 3819920 - DNA, 13 bp, Homo sapiens
tatgatgctattt

SEQ ID NO: 3819921 - DNA, 16 bp, Homo sapiens
tatgcaatttcctttt

SEQ ID NO: 3819922 - DNA, 15 bp, Homo sapiens
tatgcacacacatgg

SEQ ID NO: 3819923 - DNA, 14 bp, Homo sapiens
tatgccttgctatt

SEQ ID NO: 3819924 - DNA, 15 bp, Homo sapiens
tatgggatgtaaaca

SEQ ID NO: 3819925 - DNA, 17 bp, Homo sapiens
tatggggatagatgtgt

SEQ ID NO: 3819926 - DNA, 21 bp, Homo sapiens
tatggtaggaactgctgggct

SEQ ID NO: 3819927 - DNA, 16 bp, Homo sapiens
tatgtatatgtatatc

SEQ ID NO: 3819928 - DNA, 17 bp, Homo sapiens
tatgtatatgtatatct

SEQ ID NO: 3819929 - DNA, 18 bp, Homo sapiens
tatgtatatgtatatcta

SEQ ID NO: 3819930 - DNA, 18 bp, Homo sapiens
tatgtgggggtctgtgtg

SEQ ID NO: 3819931 - DNA, 13 bp, Homo sapiens
tattaaaggcttt

SEQ ID NO: 3819932 - DNA, 14 bp, Homo sapiens
tattaaggaagaca

SEQ ID NO: 3819933 - DNA, 15 bp, Homo sapiens
tattagcaactgtgc

SEQ ID NO: 3819934 - DNA, 21 bp, Homo sapiens
tattagtttgatttaatatct

SEQ ID NO: 3819935 - DNA, 12 bp, Homo sapiens
tattcccatgag

SEQ ID NO: 3819936 - DNA, 18 bp, Homo sapiens
tattctacacatatatgt

SEQ ID NO: 3819937 - DNA, 19 bp, Homo sapiens
tattgcctgggcagtgccc

SEQ ID NO: 3819938 - DNA, 16 bp, Homo sapiens
tcgtgatttgcctgcc

SEQ ID NO: 3819939 - DNA, 14 bp, Homo sapiens
tcgtggacacctgc

SEQ ID NO: 3819940 - DNA, 18 bp, Homo sapiens
tctaaagctttggacaag

SEQ ID NO: 3819941 - DNA, 18 bp, Homo sapiens
tctaaatgttggaatgtt

SEQ ID NO: 3819942 - DNA, 17 bp, Homo sapiens
tctacacatatatgtat

SEQ ID NO: 3819943 - DNA, 21 bp, Homo sapiens
tctacacatatatgtatatgt

SEQ ID NO: 3819944 - DNA, 14 bp, Homo sapiens
tctaccatttcaga

SEQ ID NO: 3819945 - DNA, 13 bp, Homo sapiens
tctagaacacagg

SEQ ID NO: 3819946 - DNA, 16 bp, Homo sapiens
tctagaacacaggcaa

SEQ ID NO: 3819947 - DNA, 18 bp, Homo sapiens
tctagaacacccactggc

SEQ ID NO: 3819948 - DNA, 19 bp, Homo sapiens
tctagaacacccactggcc

SEQ ID NO: 3819949 - DNA, 20 bp, Homo sapiens
tctagaacacccactggcca

SEQ ID NO: 3819950 - DNA, 21 bp, Homo sapiens
tctagaacacccactggccag

SEQ ID NO: 3819951 - DNA, 22 bp, Homo sapiens
tctagagagggaattctcttgg

SEQ ID NO: 3819952 - DNA, 23 bp, Homo sapiens
tctaggagaaacttagaggaaaa

SEQ ID NO: 3819953 - DNA, 15 bp, Homo sapiens
tctatgaagagaagg

SEQ ID NO: 3819954 - DNA, 18 bp, Homo sapiens
tctcaaacctccaaaagc

SEQ ID NO: 3819955 - DNA, 15 bp, Homo sapiens
tctcaagcaagttta

SEQ ID NO: 3819956 - DNA, 17 bp, Homo sapiens
tctcaatattcaataaa

SEQ ID NO: 3819957 - DNA, 22 bp, Homo sapiens
tctcaggatttcaccagaagtt

SEQ ID NO: 3819958 - DNA, 15 bp, Homo sapiens
tctcagggcctggtc

SEQ ID NO: 3819959 - DNA, 19 bp, Homo sapiens
tctcagggcctggtcgttt

SEQ ID NO: 3819960 - DNA, 19 bp, Homo sapiens
tctccaagtctctctgtga

SEQ ID NO: 3819961 - DNA, 20 bp, Homo sapiens
tctccaagtctctctgtgaa

SEQ ID NO: 3819962 - DNA, 16 bp, Homo sapiens
tctcccagaaggctgg

SEQ ID NO: 3819963 - DNA, 19 bp, Homo sapiens
tctcctcccaccagtggcc

SEQ ID NO: 3819964 - DNA, 16 bp, Homo sapiens
tctcctcccatggcct

SEQ ID NO: 3819965 - DNA, 23 bp, Homo sapiens
tctctctgtgaatacaattaaag

SEQ ID NO: 3819966 - DNA, 23 bp, Homo sapiens
tctctgagctccagtggaagaag

SEQ ID NO: 3819967 - DNA, 20 bp, Homo sapiens
tctctgattttcaaagcttt

SEQ ID NO: 3819968 - DNA, 16 bp, Homo sapiens
tctctggaaaggagga

SEQ ID NO: 3819969 - DNA, 19 bp, Homo sapiens
tctctgtgaatacaattaa

SEQ ID NO: 3819970 - DNA, 18 bp, Homo sapiens
tctctgtgtgcacaaata

SEQ ID NO: 3819971 - DNA, 14 bp, Homo sapiens
tctcttctctgtta

SEQ ID NO: 3819972 - DNA, 18 bp, Homo sapiens
tctctttttttctggagg

SEQ ID NO: 3819973 - DNA, 18 bp, Homo sapiens
tctgaccgggtctgcttc

SEQ ID NO: 3819974 - DNA, 14 bp, Homo sapiens
tctgagaagtgtat

SEQ ID NO: 3819975 - DNA, 15 bp, Homo sapiens
tctgaggtcaataaa

SEQ ID NO: 3819976 - DNA, 18 bp, Homo sapiens
tctgaggtcaataaagca

SEQ ID NO: 3819977 - DNA, 14 bp, Homo sapiens
tctgcacaagctgc

SEQ ID NO: 3819978 - DNA, 19 bp, Homo sapiens
tctgcagggggtgtgtctg

SEQ ID NO: 3819979 - DNA, 23 bp, Homo sapiens
tctgcattcacagcgcctcctgg

SEQ ID NO: 3819980 - DNA, 19 bp, Homo sapiens
tctgccaatcggctacccc

SEQ ID NO: 3819981 - DNA, 16 bp, Homo sapiens
tctgcccagcctgccc

SEQ ID NO: 3819982 - DNA, 19 bp, Homo sapiens
tctgcccccaactcccgga

SEQ ID NO: 3819983 - DNA, 14 bp, Homo sapiens
tctgcctcagcttc

SEQ ID NO: 3819984 - DNA, 17 bp, Homo sapiens
tctgctccaaattttca

SEQ ID NO: 3819985 - DNA, 12 bp, Homo sapiens
tctgctgcccag

SEQ ID NO: 3819986 - DNA, 17 bp, Homo sapiens
tctgcttccctggggcc

SEQ ID NO: 3819987 - DNA, 12 bp, Homo sapiens
tctgcttctgca

SEQ ID NO: 3819988 - DNA, 14 bp, Homo sapiens
tctggaaaggagga

SEQ ID NO: 3819989 - DNA, 14 bp, Homo sapiens
tctggaatacatga

SEQ ID NO: 3819990 - DNA, 18 bp, Homo sapiens
tctggcaaagttatattt

SEQ ID NO: 3819991 - DNA, 15 bp, Homo sapiens
tctggccacactggg

SEQ ID NO: 3819992 - DNA, 22 bp, Homo sapiens
tctggtatgaacttgaggacac

SEQ ID NO: 3819993 - DNA, 14 bp, Homo sapiens
tctgtctgtcccaa

SEQ ID NO: 3819994 - DNA, 21 bp, Homo sapiens
tctgtgaatacaattaaaggt

SEQ ID NO: 3819995 - DNA, 22 bp, Homo sapiens
tctgtgaatacaattaaaggtc

SEQ ID NO: 3819996 - DNA, 13 bp, Homo sapiens
tctgtgtgtgtgt

SEQ ID NO: 3819997 - DNA, 15 bp, Homo sapiens
tctgtgtgtgtgtat

SEQ ID NO: 3819998 - DNA, 22 bp, Homo sapiens
tctgtgtgtgtgtatgtggggg

SEQ ID NO: 3819999 - DNA, 15 bp, Homo sapiens
tctgtgtgtttatgt

SEQ ID NO: 3820000 - DNA, 19 bp, Homo sapiens
tctgtgtgtttatgtgtgt

SEQ ID NO: 3820001 - DNA, 20 bp, Homo sapiens
tctgtgtgtttatgtgtgtg

SEQ ID NO: 3820002 - DNA, 21 bp, Homo sapiens
tctgttcacttttcctccctc

SEQ ID NO: 3820003 - DNA, 22 bp, Homo sapiens
tctgttcctggctcagcctcaa

SEQ ID NO: 3820004 - DNA, 18 bp, Homo sapiens
tcttaaaaagtggaaaaa

SEQ ID NO: 3820005 - DNA, 13 bp, Homo sapiens
tcttaactctgca

SEQ ID NO: 3820006 - DNA, 18 bp, Homo sapiens
tcttagctgtctgctcag

SEQ ID NO: 3820007 - DNA, 20 bp, Homo sapiens
tcttaggttggcaaaaaggc

SEQ ID NO: 3820008 - DNA, 17 bp, Homo sapiens
tcttataggtttccact

SEQ ID NO: 3820009 - DNA, 21 bp, Homo sapiens
tcttattcatgctttctcctt

SEQ ID NO: 3820010 - DNA, 23 bp, Homo sapiens
tcttattcatgctttctcctttt

SEQ ID NO: 3820011 - DNA, 15 bp, Homo sapiens
tcttccaaccccagc

SEQ ID NO: 3820012 - DNA, 22 bp, Homo sapiens
tcttccctacagttgaaaaaca

SEQ ID NO: 3820013 - DNA, 19 bp, Homo sapiens
tcttcctagtatattagtt

SEQ ID NO: 3820014 - DNA, 12 bp, Homo sapiens
tcttcctctgca

SEQ ID NO: 3820015 - DNA, 13 bp, Homo sapiens
tcttctattttgt

SEQ ID NO: 3820016 - DNA, 13 bp, Homo sapiens
tcttctcggggac

SEQ ID NO: 3820017 - DNA, 16 bp, Homo sapiens
tcttgatctcctgagc

SEQ ID NO: 3820018 - DNA, 22 bp, Homo sapiens
tcttggggagtttagggtgggg

SEQ ID NO: 3820019 - DNA, 23 bp, Homo sapiens
tcttggggagtttagggtggggg

SEQ ID NO: 3820020 - DNA, 13 bp, Homo sapiens
tcttgtctggctg

SEQ ID NO: 3820021 - DNA, 20 bp, Homo sapiens
tcttgtttctgaagtactta

SEQ ID NO: 3820022 - DNA, 15 bp, Homo sapiens
tctttcatacattat

SEQ ID NO: 3820023 - DNA, 16 bp, Homo sapiens
tctttgctacaataaa

SEQ ID NO: 3820024 - DNA, 22 bp, Homo sapiens
tctttgctacaataaatgctga

SEQ ID NO: 3820025 - DNA, 23 bp, Homo sapiens
tctttgctacaataaatgctgaa

SEQ ID NO: 3820026 - DNA, 17 bp, Homo sapiens
tctttggacactcacac

SEQ ID NO: 3820027 - DNA, 16 bp, Homo sapiens
tcttttgttttcttca

SEQ ID NO: 3820028 - DNA, 17 bp, Homo sapiens
tctttttaagctcagtg

SEQ ID NO: 3820029 - DNA, 16 bp, Homo sapiens
tgaaaaaggaggaaga

SEQ ID NO: 3820030 - DNA, 20 bp, Homo sapiens
tgaaaaaggaggaagagaaa

SEQ ID NO: 3820031 - DNA, 19 bp, Homo sapiens
tgaaaagaaaaatgagcct

SEQ ID NO: 3820032 - DNA, 20 bp, Homo sapiens
tgaaaagaaaaatgagcctg

SEQ ID NO: 3820033 - DNA, 13 bp, Homo sapiens
tgaaaatcctacc

SEQ ID NO: 3820034 - DNA, 16 bp, Homo sapiens
tgaaacagaaacaaaa

SEQ ID NO: 3820035 - DNA, 23 bp, Homo sapiens
tgaaagggagtattacaaaaaca

SEQ ID NO: 3820036 - DNA, 14 bp, Homo sapiens
tgaaatcctgcttc

SEQ ID NO: 3820037 - DNA, 17 bp, Homo sapiens
tgaaattcaacctgtgt

SEQ ID NO: 3820038 - DNA, 21 bp, Homo sapiens
tgaaattcaacctgtgtctta

SEQ ID NO: 3820039 - DNA, 11 bp, Homo sapiens
tgaacaagaat

SEQ ID NO: 3820040 - DNA, 17 bp, Homo sapiens
tgaacccaggaggtgga

SEQ ID NO: 3820041 - DNA, 22 bp, Homo sapiens
tgaaccgacttttctaaagctc

SEQ ID NO: 3820042 - DNA, 12 bp, Homo sapiens
tgaacctgccct

SEQ ID NO: 3820043 - DNA, 21 bp, Homo sapiens
tgaacctgggaaccatgaagc

SEQ ID NO: 3820044 - DNA, 22 bp, Homo sapiens
tgaacctgggaaccatgaagct

SEQ ID NO: 3820045 - DNA, 16 bp, Homo sapiens
tgaacttgaggacaca

SEQ ID NO: 3820046 - DNA, 14 bp, Homo sapiens
tgccccagcctccc

SEQ ID NO: 3820047 - DNA, 22 bp, Homo sapiens
tgccccatctcctcccatggcc

SEQ ID NO: 3820048 - DNA, 19 bp, Homo sapiens
tgccctcccacctccgctg

SEQ ID NO: 3820049 - DNA, 14 bp, Homo sapiens
tgccctgccacctg

SEQ ID NO: 3820050 - DNA, 15 bp, Homo sapiens
tgccctgccctgcca

SEQ ID NO: 3820051 - DNA, 18 bp, Homo sapiens
tgccctgccctgccacct

SEQ ID NO: 3820052 - DNA, 18 bp, Homo sapiens
tgccctgtccctgtcccc

SEQ ID NO: 3820053 - DNA, 23 bp, Homo sapiens
tgcccttcagcatcctcagttcc

SEQ ID NO: 3820054 - DNA, 22 bp, Homo sapiens
tgccgagagtccatcagcctcc

SEQ ID NO: 3820055 - DNA, 17 bp, Homo sapiens
tgcctaggaattcccag

SEQ ID NO: 3820056 - DNA, 11 bp, Homo sapiens
tgcctcagcct

SEQ ID NO: 3820057 - DNA, 22 bp, Homo sapiens
tgcctgacactgagccccacct

SEQ ID NO: 3820058 - DNA, 19 bp, Homo sapiens
tgcctggcccttggcttta

SEQ ID NO: 3820059 - DNA, 15 bp, Homo sapiens
tgcctgttctccaga

SEQ ID NO: 3820060 - DNA, 20 bp, Homo sapiens
tgcgccacggcactccagcc

SEQ ID NO: 3820061 - DNA, 23 bp, Homo sapiens
tgctaaacaagtaagaaaaataa

SEQ ID NO: 3820062 - DNA, 13 bp, Homo sapiens
tgctaatcttctt

SEQ ID NO: 3820063 - DNA, 13 bp, Homo sapiens
tgctacaataaat

SEQ ID NO: 3820064 - DNA, 18 bp, Homo sapiens
tgctacaataaatgctga

SEQ ID NO: 3820065 - DNA, 11 bp, Homo sapiens
tgctactttgc

SEQ ID NO: 3820066 - DNA, 15 bp, Homo sapiens
tgctagaagctgtaa

SEQ ID NO: 3820067 - DNA, 22 bp, Homo sapiens
tgctagcattaccacttccctg

SEQ ID NO: 3820068 - DNA, 18 bp, Homo sapiens
tgctattcagataaggca

SEQ ID NO: 3820069 - DNA, 22 bp, Homo sapiens
tgctattttaataaagattcta

SEQ ID NO: 3820070 - DNA, 13 bp, Homo sapiens
tgctcagacagaa

SEQ ID NO: 3820071 - DNA, 16 bp, Homo sapiens
tgctcatgggaagaac

SEQ ID NO: 3820072 - DNA, 19 bp, Homo sapiens
tgctccagctgttcagctg

SEQ ID NO: 3820073 - DNA, 11 bp, Homo sapiens
tgctcctcctg

SEQ ID NO: 3820074 - DNA, 13 bp, Homo sapiens
tgctcctcctgcc

SEQ ID NO: 3820075 - DNA, 19 bp, Homo sapiens
tgctcctcctgccctgtcc

SEQ ID NO: 3820076 - DNA, 14 bp, Homo sapiens
tgctcctgcatgca

SEQ ID NO: 3820077 - DNA, 14 bp, Homo sapiens
tgctcgaagaacaa

SEQ ID NO: 3820078 - DNA, 21 bp, Homo sapiens
tgctctaatgatcaaaacatg

SEQ ID NO: 3820079 - DNA, 22 bp, Homo sapiens
tgctctgcccccaactcccgga

SEQ ID NO: 3820080 - DNA, 18 bp, Homo sapiens
tgctcttagctgtctgct

SEQ ID NO: 3820081 - DNA, 13 bp, Homo sapiens
tgctcttctgtat

SEQ ID NO: 3820082 - DNA, 13 bp, Homo sapiens
tgctgaaatctat

SEQ ID NO: 3820083 - DNA, 13 bp, Homo sapiens
tgctgaatgaatc

SEQ ID NO: 3820084 - DNA, 16 bp, Homo sapiens
tgctgactgttttctc

SEQ ID NO: 3820085 - DNA, 17 bp, Homo sapiens
tgctgactgttttctct

SEQ ID NO: 3820086 - DNA, 12 bp, Homo sapiens
tgctgcttccta

SEQ ID NO: 3820087 - DNA, 13 bp, Homo sapiens
tgctgcttcctaa

SEQ ID NO: 3820088 - DNA, 17 bp, Homo sapiens
tgctgcttcctaactta

SEQ ID NO: 3820089 - DNA, 19 bp, Homo sapiens
tgctgcttgaggcaactca

SEQ ID NO: 3820090 - DNA, 15 bp, Homo sapiens
tgctggactgtcata

SEQ ID NO: 3820091 - DNA, 16 bp, Homo sapiens
tgctggctcccagggc

SEQ ID NO: 3820092 - DNA, 24 bp, Homo sapiens
tgctgggcgaaaacccttatgact

SEQ ID NO: 3820093 - DNA, 17 bp, Homo sapiens
tgctgggcttgtctgta

SEQ ID NO: 3820094 - DNA, 18 bp, Homo sapiens
tgctgtaactttctgaaa

SEQ ID NO: 3820095 - DNA, 16 bp, Homo sapiens
tgctgtagagacttcc

SEQ ID NO: 3820096 - DNA, 21 bp, Homo sapiens
tgcttatgacatcacttgtac

SEQ ID NO: 3820097 - DNA, 21 bp, Homo sapiens
tgcttcatgaaaatcctacca

SEQ ID NO: 3820098 - DNA, 18 bp, Homo sapiens
tgcttctagttctgccag

SEQ ID NO: 3820099 - DNA, 20 bp, Homo sapiens
tgcttctagttctgccagga

SEQ ID NO: 3820100 - DNA, 12 bp, Homo sapiens
tgcttctcactg

SEQ ID NO: 3820101 - DNA, 20 bp, Homo sapiens
tgcttgaacccaggaggtgg

SEQ ID NO: 3820102 - DNA, 14 bp, Homo sapiens
tgctttttcttgtt

SEQ ID NO: 3820103 - DNA, 22 bp, Homo sapiens
tgctttttcttgtttgtttaaa

SEQ ID NO: 3820104 - DNA, 19 bp, Homo sapiens
tggaaaaatccagaaagaa

SEQ ID NO: 3820105 - DNA, 15 bp, Homo sapiens
tggaaaggagaggaa

SEQ ID NO: 3820106 - DNA, 16 bp, Homo sapiens
tggaaaggagaggaaa

SEQ ID NO: 3820107 - DNA, 19 bp, Homo sapiens
tggaaaggagaggaaagaa

SEQ ID NO: 3820108 - DNA, 23 bp, Homo sapiens
tggaaaggagaggaaagaactca

SEQ ID NO: 3820109 - DNA, 14 bp, Homo sapiens
tggaaatacacagt

SEQ ID NO: 3820110 - DNA, 17 bp, Homo sapiens
tggaagctgccctgccc

SEQ ID NO: 3820111 - DNA, 18 bp, Homo sapiens
tggaagctgccctgccca

SEQ ID NO: 3820112 - DNA, 23 bp, Homo sapiens
tggaagtgtgggtctgtgtgtgt

SEQ ID NO: 3820113 - DNA, 15 bp, Homo sapiens
tggaatacatgaaat

SEQ ID NO: 3820114 - DNA, 16 bp, Homo sapiens
tggaatgaagaaattg

SEQ ID NO: 3820115 - DNA, 12 bp, Homo sapiens
tggaattttctt

SEQ ID NO: 3820116 - DNA, 22 bp, Homo sapiens
tggaattttctttcatacatta

SEQ ID NO: 3820117 - DNA, 10 bp, Homo sapiens
tggacacctg

SEQ ID NO: 3820118 - DNA, 13 bp, Homo sapiens
tggacacctgccc

SEQ ID NO: 3820119 - DNA, 15 bp, Homo sapiens
tggacacctgccctg

SEQ ID NO: 3820120 - DNA, 23 bp, Homo sapiens
tggaccctgtggatgataaaaca

SEQ ID NO: 3820121 - DNA, 15 bp, Homo sapiens
tggactgtcatagaa

SEQ ID NO: 3820122 - DNA, 17 bp, Homo sapiens
tggagaagaccctcccc

SEQ ID NO: 3820123 - DNA, 22 bp, Homo sapiens
tggagaagcggctggcagccca

SEQ ID NO: 3820124 - DNA, 19 bp, Homo sapiens
tggagacagtagaggcatg

SEQ ID NO: 3820125 - DNA, 13 bp, Homo sapiens
tggagagagggga

SEQ ID NO: 3820126 - DNA, 14 bp, Homo sapiens
tggagctgttccat

SEQ ID NO: 3820127 - DNA, 13 bp, Homo sapiens
tggagtctcgctc

SEQ ID NO: 3820128 - DNA, 22 bp, Homo sapiens
tggatccacgtgctcgcctctg

SEQ ID NO: 3820129 - DNA, 19 bp, Homo sapiens
tggatctgtgaggggctct

SEQ ID NO: 3820130 - DNA, 21 bp, Homo sapiens
tggcaatgccctacctgcctg

SEQ ID NO: 3820131 - DNA, 22 bp, Homo sapiens
tggcaatgccctacctgcctgt

SEQ ID NO: 3820132 - DNA, 23 bp, Homo sapiens
tggcaatgccctacctgcctgtt

SEQ ID NO: 3820133 - DNA, 22 bp, Homo sapiens
tggcacagcctggctgtggcct

SEQ ID NO: 3820134 - DNA, 15 bp, Homo sapiens
tggcagccgcctccc

SEQ ID NO: 3820135 - DNA, 18 bp, Homo sapiens
tggcagccgcctccctta

SEQ ID NO: 3820136 - DNA, 22 bp, Homo sapiens
tggcatccagagtccctgcctg

SEQ ID NO: 3820137 - DNA, 19 bp, Homo sapiens
tggcattacagctggagaa

SEQ ID NO: 3820138 - DNA, 13 bp, Homo sapiens
tggccagagctga

SEQ ID NO: 3820139 - DNA, 18 bp, Homo sapiens
tggccagtcctagagctc

SEQ ID NO: 3820140 - DNA, 16 bp, Homo sapiens
tggccagtggctggat

SEQ ID NO: 3820141 - DNA, 13 bp, Homo sapiens
tggcccacgcact

SEQ ID NO: 3820142 - DNA, 20 bp, Homo sapiens
tggcccctgaacaagaattg

SEQ ID NO: 3820143 - DNA, 13 bp, Homo sapiens
tggccctcttctt

SEQ ID NO: 3820144 - DNA, 23 bp, Homo sapiens
tggcctaacctgccgagagtcca

SEQ ID NO: 3820145 - DNA, 22 bp, Homo sapiens
tggcctctagaacacccactgg

SEQ ID NO: 3820146 - DNA, 23 bp, Homo sapiens
tggcctctagaacacccactggc

SEQ ID NO: 3820147 - DNA, 18 bp, Homo sapiens
tggccttccctccccaca

SEQ ID NO: 3820148 - DNA, 15 bp, Homo sapiens
tggctagtccttgtt

SEQ ID NO: 3820149 - DNA, 20 bp, Homo sapiens
tggctccattggtgttgaca

SEQ ID NO: 3820150 - DNA, 15 bp, Homo sapiens
tggctcccagggcca

SEQ ID NO: 3820151 - DNA, 16 bp, Homo sapiens
tggcttatttgtataa

SEQ ID NO: 3820152 - DNA, 17 bp, Homo sapiens
tggcttcacggaagagc

SEQ ID NO: 3820153 - DNA, 20 bp, Homo sapiens
tggcttcacggaagagcctt

SEQ ID NO: 3820154 - DNA, 22 bp, Homo sapiens
ttttccctattagagaagagat

SEQ ID NO: 3820155 - DNA, 17 bp, Homo sapiens
ttttcctagccctctca

SEQ ID NO: 3820156 - DNA, 18 bp, Homo sapiens
ttttcctcttctattttg

SEQ ID NO: 3820157 - DNA, 12 bp, Homo sapiens
ttttctcccaga

SEQ ID NO: 3820158 - DNA, 19 bp, Homo sapiens
ttttctcctcccaggaact

SEQ ID NO: 3820159 - DNA, 21 bp, Homo sapiens
ttttctggaatacatgaaata

SEQ ID NO: 3820160 - DNA, 16 bp, Homo sapiens
ttttcttcatttctct

SEQ ID NO: 3820161 - DNA, 24 bp, Homo sapiens
ttttgacagtgttgaaaatgttca

SEQ ID NO: 3820162 - DNA, 20 bp, Homo sapiens
ttttgctcttctgtatgtga

SEQ ID NO: 3820163 - DNA, 13 bp, Homo sapiens
ttttggcctgcct

SEQ ID NO: 3820164 - DNA, 18 bp, Homo sapiens
ttttgtaaactcaaaata

SEQ ID NO: 3820165 - DNA, 14 bp, Homo sapiens
ttttgtaagacaaa

SEQ ID NO: 3820166 - DNA, 15 bp, Homo sapiens
ttttgtacattatgt

SEQ ID NO: 3820167 - DNA, 16 bp, Homo sapiens
ttttgtttttgtctta

SEQ ID NO: 3820168 - DNA, 21 bp, Homo sapiens
tttttccccccaattgctgcc

SEQ ID NO: 3820169 - DNA, 18 bp, Homo sapiens
tttttcctagccctctca

SEQ ID NO: 3820170 - DNA, 14 bp, Homo sapiens
tttttgtgaaattc

SEQ ID NO: 3820171 - DNA, 16 bp, Homo sapiens
ttttttgatggctaag

SEQ ID NO: 3820172 - DNA, 12 bp, Homo sapiens
aacataaaaaaa

SEQ ID NO: 3820173 - DNA, 19 bp, Homo sapiens
aacatccaaggagaaacag

SEQ ID NO: 3820174 - DNA, 22 bp, Homo sapiens
aacatccaaggagaaacagaga

SEQ ID NO: 3820175 - DNA, 16 bp, Homo sapiens
aacatgcttcatgaaa

SEQ ID NO: 3820176 - DNA, 23 bp, Homo sapiens
aacatggcctttgcttgaaagaa

SEQ ID NO: 3820177 - DNA, 15 bp, Homo sapiens
aaccaagtcaagtga

SEQ ID NO: 3820178 - DNA, 18 bp, Homo sapiens
aaccataacaacttcata

SEQ ID NO: 3820179 - DNA, 19 bp, Homo sapiens
aaccatgcaaatgctatga

SEQ ID NO: 3820180 - DNA, 11 bp, Homo sapiens
aaccccagctg

SEQ ID NO: 3820181 - DNA, 16 bp, Homo sapiens
aaccccagctggcctc

SEQ ID NO: 3820182 - DNA, 17 bp, Homo sapiens
aaccccagctggcctct

SEQ ID NO: 3820183 - DNA, 12 bp, Homo sapiens
aaccgacttttc

SEQ ID NO: 3820184 - DNA, 16 bp, Homo sapiens
aacctccacctcctgg

SEQ ID NO: 3820185 - DNA, 18 bp, Homo sapiens
aacctccacctcctgggt

SEQ ID NO: 3820186 - DNA, 21 bp, Homo sapiens
aacctgaaaagatgttgtgtc

SEQ ID NO: 3820187 - DNA, 22 bp, Homo sapiens
aacctgaaaagatgttgtgtct

SEQ ID NO: 3820188 - DNA, 14 bp, Homo sapiens
aacctgaattattc

SEQ ID NO: 3820189 - DNA, 17 bp, Homo sapiens
aacctgaattattccaa

SEQ ID NO: 3820190 - DNA, 21 bp, Homo sapiens
aacctggtattttaagagaaa

SEQ ID NO: 3820191 - DNA, 21 bp, Homo sapiens
aacctgtccataaagtaattt

SEQ ID NO: 3820192 - DNA, 13 bp, Homo sapiens
aacctgtgtctta

SEQ ID NO: 3820193 - DNA, 12 bp, Homo sapiens
aacgaaaagcac

SEQ ID NO: 3820194 - DNA, 18 bp, Homo sapiens
aactaacctggtatttta

SEQ ID NO: 3820195 - DNA, 16 bp, Homo sapiens
aactaattcaataaaa

SEQ ID NO: 3820196 - DNA, 17 bp, Homo sapiens
aactagggttttggcct

SEQ ID NO: 3820197 - DNA, 19 bp, Homo sapiens
aactagggttttggcctgc

SEQ ID NO: 3820198 - DNA, 18 bp, Homo sapiens
aactatcttggtgaattt

SEQ ID NO: 3820199 - DNA, 17 bp, Homo sapiens
aactcctgacctcgtga

SEQ ID NO: 3820200 - DNA, 12 bp, Homo sapiens
aactcctgttct

SEQ ID NO: 3820201 - DNA, 19 bp, Homo sapiens
aactcgtgtctggcacagc

SEQ ID NO: 3820202 - DNA, 13 bp, Homo sapiens
aactctaattcta

SEQ ID NO: 3820203 - DNA, 13 bp, Homo sapiens
aactgaggaattt

SEQ ID NO: 3820204 - DNA, 16 bp, Homo sapiens
aactgcattggctttg

SEQ ID NO: 3820205 - DNA, 20 bp, Homo sapiens
aactgctgactgttttctct

SEQ ID NO: 3820206 - DNA, 23 bp, Homo sapiens
aactgctgactgttttctcttga

SEQ ID NO: 3820207 - DNA, 20 bp, Homo sapiens
aactgctttatcccacggaa

SEQ ID NO: 3820208 - DNA, 11 bp, Homo sapiens
aacttttgtaa

SEQ ID NO: 3820209 - DNA, 13 bp, Homo sapiens
aagaaaaagaaaa

SEQ ID NO: 3820210 - DNA, 17 bp, Homo sapiens
aagaaaaatgagcctgg

SEQ ID NO: 3820211 - DNA, 18 bp, Homo sapiens
aagaaaaatgagcctggc

SEQ ID NO: 3820212 - DNA, 22 bp, Homo sapiens
aagaaagcttcaaactgcatga

SEQ ID NO: 3820213 - DNA, 18 bp, Homo sapiens
aagaacatccaaggagaa

SEQ ID NO: 3820214 - DNA, 13 bp, Homo sapiens
aagaagaaaacac

SEQ ID NO: 3820215 - DNA, 14 bp, Homo sapiens
aagaagctctctcc

SEQ ID NO: 3820216 - DNA, 15 bp, Homo sapiens
aagaagtaggcatga

SEQ ID NO: 3820217 - DNA, 19 bp, Homo sapiens
aagaagtgtgtcaccctta

SEQ ID NO: 3820218 - DNA, 13 bp, Homo sapiens
aagaccctccccg

SEQ ID NO: 3820219 - DNA, 22 bp, Homo sapiens
aagactctgtctcaataaataa

SEQ ID NO: 3820220 - DNA, 13 bp, Homo sapiens
aagagaaaaaata

SEQ ID NO: 3820221 - DNA, 18 bp, Homo sapiens
aagagaagggcagggctg

SEQ ID NO: 3820222 - DNA, 21 bp, Homo sapiens
aagagacaaacacctcccagg

SEQ ID NO: 3820223 - DNA, 14 bp, Homo sapiens
aagagagaaagaag

SEQ ID NO: 3820224 - DNA, 22 bp, Homo sapiens
aagatggctggaaggagccagc

SEQ ID NO: 3820225 - DNA, 21 bp, Homo sapiens
aagatggcttatttgtataat

SEQ ID NO: 3820226 - DNA, 15 bp, Homo sapiens
aagatgttgtgtctt

SEQ ID NO: 3820227 - DNA, 15 bp, Homo sapiens
aagattcaaagagac

SEQ ID NO: 3820228 - DNA, 17 bp, Homo sapiens
aagcaaagccacatttt

SEQ ID NO: 3820229 - DNA, 21 bp, Homo sapiens
aagcatgacaacttttaaaga

SEQ ID NO: 3820230 - DNA, 23 bp, Homo sapiens
aagccagctgccgaccagagccc

SEQ ID NO: 3820231 - DNA, 19 bp, Homo sapiens
aagcctcctccagccgcca

SEQ ID NO: 3820232 - DNA, 20 bp, Homo sapiens
aagcctgagtttgctttcaa

SEQ ID NO: 3820233 - DNA, 22 bp, Homo sapiens
aagctcagtggcaagaatgaaa

SEQ ID NO: 3820234 - DNA, 20 bp, Homo sapiens
aagctgcaccctcaggcagg

SEQ ID NO: 3820235 - DNA, 21 bp, Homo sapiens
aagctgcaccctcaggcaggt

SEQ ID NO: 3820236 - DNA, 13 bp, Homo sapiens
aagctgggcaggt

SEQ ID NO: 3820237 - DNA, 12 bp, Homo sapiens
aagctttctcct

SEQ ID NO: 3820238 - DNA, 18 bp, Homo sapiens
aaggaaaaactgatgttt

SEQ ID NO: 3820239 - DNA, 22 bp, Homo sapiens
aaggaagcaagccggcagaaat

SEQ ID NO: 3820240 - DNA, 14 bp, Homo sapiens
aaggccacactggc

SEQ ID NO: 3820241 - DNA, 14 bp, Homo sapiens
aaggccactcagga

SEQ ID NO: 3820242 - DNA, 17 bp, Homo sapiens
aaggctctgaaagccag

SEQ ID NO: 3820243 - DNA, 14 bp, Homo sapiens
aaggctcttttgta

SEQ ID NO: 3820244 - DNA, 14 bp, Homo sapiens
aaggctgggggaag

SEQ ID NO: 3820245 - DNA, 17 bp, Homo sapiens
aaggctttcagggcctc

SEQ ID NO: 3820246 - DNA, 14 bp, Homo sapiens
aaggtcgcacctcc

SEQ ID NO: 3820247 - DNA, 21 bp, Homo sapiens
aaggtgccgatttcatgcatt

SEQ ID NO: 3820248 - DNA, 16 bp, Homo sapiens
aagtaatctttaaact

SEQ ID NO: 3820249 - DNA, 20 bp, Homo sapiens
aagtacttaaacttccacaa

SEQ ID NO: 3820250 - DNA, 23 bp, Homo sapiens
aagtacttccacttgtgtatatt

SEQ ID NO: 3820251 - DNA, 15 bp, Homo sapiens
aagtaggcatgaggg

SEQ ID NO: 3820252 - DNA, 14 bp, Homo sapiens
aagtagtagtgtct

SEQ ID NO: 3820253 - DNA, 20 bp, Homo sapiens
aagtataggataaattacat

SEQ ID NO: 3820254 - DNA, 23 bp, Homo sapiens
aagtatatattctacacatatat

SEQ ID NO: 3820255 - DNA, 16 bp, Homo sapiens
aagtctctctgtgaat

SEQ ID NO: 3820256 - DNA, 20 bp, Homo sapiens
aagtctctctgtgaatacaa

SEQ ID NO: 3820257 - DNA, 14 bp, Homo sapiens
aagtgcagctcagg

SEQ ID NO: 3820258 - DNA, 20 bp, Homo sapiens
aagtgctaggattacaggca

SEQ ID NO: 3820259 - DNA, 18 bp, Homo sapiens
aagtgtgggtctgtgtgt

SEQ ID NO: 3820260 - DNA, 13 bp, Homo sapiens
aagtgtggtagag

SEQ ID NO: 3820261 - DNA, 12 bp, Homo sapiens
aagttatattta

SEQ ID NO: 3820262 - DNA, 23 bp, Homo sapiens
aagttcactgtttattgaagaac

SEQ ID NO: 3820263 - DNA, 13 bp, Homo sapiens
aataaacaaataa

SEQ ID NO: 3820264 - DNA, 22 bp, Homo sapiens
aataaacacagtgtttcctgag

SEQ ID NO: 3820265 - DNA, 14 bp, Homo sapiens
aataaactagggtt

SEQ ID NO: 3820266 - DNA, 20 bp, Homo sapiens
aataaactagggttttggcc

SEQ ID NO: 3820267 - DNA, 12 bp, Homo sapiens
aataaatgctga

SEQ ID NO: 3820268 - DNA, 13 bp, Homo sapiens
aataaatgctgaa

SEQ ID NO: 3820269 - DNA, 19 bp, Homo sapiens
aataacaatgtgctctcgg

SEQ ID NO: 3820270 - DNA, 18 bp, Homo sapiens
aataatagggaaaatacc

SEQ ID NO: 3820271 - DNA, 20 bp, Homo sapiens
aataattgatttcaagacct

SEQ ID NO: 3820272 - DNA, 19 bp, Homo sapiens
aatacataggcttatatac

SEQ ID NO: 3820273 - DNA, 18 bp, Homo sapiens
aatacattgaattagaaa

SEQ ID NO: 3820274 - DNA, 13 bp, Homo sapiens
aatagcacatgat

SEQ ID NO: 3820275 - DNA, 14 bp, Homo sapiens
aatagcacatgatt

SEQ ID NO: 3820276 - DNA, 22 bp, Homo sapiens
aatagggaaaatacctatttta

SEQ ID NO: 3820277 - DNA, 18 bp, Homo sapiens
aatatctgagaagtgtat

SEQ ID NO: 3820278 - DNA, 20 bp, Homo sapiens
aatatctgagaagtgtatat

SEQ ID NO: 3820279 - DNA, 23 bp, Homo sapiens
aatatctgagaagtgtatatagt

SEQ ID NO: 3820280 - DNA, 20 bp, Homo sapiens
cagctggcctctagaacacc

SEQ ID NO: 3820281 - DNA, 11 bp, Homo sapiens
cagctttgcta

SEQ ID NO: 3820282 - DNA, 17 bp, Homo sapiens
caggaaccgaggcaggg

SEQ ID NO: 3820283 - DNA, 18 bp, Homo sapiens
caggaaccgaggcaggga

SEQ ID NO: 3820284 - DNA, 23 bp, Homo sapiens
caggagacaggttagctgctccc

SEQ ID NO: 3820285 - DNA, 14 bp, Homo sapiens
caggagagcttccc

SEQ ID NO: 3820286 - DNA, 14 bp, Homo sapiens
caggagcaaatgct

SEQ ID NO: 3820287 - DNA, 15 bp, Homo sapiens
caggagcctgtgcct

SEQ ID NO: 3820288 - DNA, 16 bp, Homo sapiens
caggagcctgtgcctc

SEQ ID NO: 3820289 - DNA, 23 bp, Homo sapiens
caggaggtggaggttgcagtgaa

SEQ ID NO: 3820290 - DNA, 14 bp, Homo sapiens
caggagtccctgcc

SEQ ID NO: 3820291 - DNA, 21 bp, Homo sapiens
caggagtttgagaccaacctg

SEQ ID NO: 3820292 - DNA, 22 bp, Homo sapiens
caggatttcaccagaagttaca

SEQ ID NO: 3820293 - DNA, 18 bp, Homo sapiens
caggcaaaatccttgctt

SEQ ID NO: 3820294 - DNA, 15 bp, Homo sapiens
caggcaatggcctaa

SEQ ID NO: 3820295 - DNA, 16 bp, Homo sapiens
caggcagctccagctg

SEQ ID NO: 3820296 - DNA, 21 bp, Homo sapiens
caggcatcggggagccgggag

SEQ ID NO: 3820297 - DNA, 17 bp, Homo sapiens
caggcatggtggcccac

SEQ ID NO: 3820298 - DNA, 12 bp, Homo sapiens
caggccagaaaa

SEQ ID NO: 3820299 - DNA, 19 bp, Homo sapiens
caggccccagcctccaggc

SEQ ID NO: 3820300 - DNA, 11 bp, Homo sapiens
caggctcagag

SEQ ID NO: 3820301 - DNA, 13 bp, Homo sapiens
caggctctgagat

SEQ ID NO: 3820302 - DNA, 22 bp, Homo sapiens
caggctggtctcgaactcctga

SEQ ID NO: 3820303 - DNA, 13 bp, Homo sapiens
cagggaaggatcc

SEQ ID NO: 3820304 - DNA, 18 bp, Homo sapiens
cagggacagaagcaggag

SEQ ID NO: 3820305 - DNA, 19 bp, Homo sapiens
cagggaggggactatttat

SEQ ID NO: 3820306 - DNA, 18 bp, Homo sapiens
cagggcatattaaaggct

SEQ ID NO: 3820307 - DNA, 23 bp, Homo sapiens
cagggcctccagccctctcactg

SEQ ID NO: 3820308 - DNA, 18 bp, Homo sapiens
cagggctgaggcctctca

SEQ ID NO: 3820309 - DNA, 17 bp, Homo sapiens
caggggaccacacctcc

SEQ ID NO: 3820310 - DNA, 17 bp, Homo sapiens
caggggagggaaaagct

SEQ ID NO: 3820311 - DNA, 18 bp, Homo sapiens
caggggagggaaaagcta

SEQ ID NO: 3820312 - DNA, 18 bp, Homo sapiens
caggggcaccctccaaac

SEQ ID NO: 3820313 - DNA, 21 bp, Homo sapiens
cagggtctctaccatcccctg

SEQ ID NO: 3820314 - DNA, 16 bp, Homo sapiens
caggtagggaaataat

SEQ ID NO: 3820315 - DNA, 16 bp, Homo sapiens
caggtagggagctaag

SEQ ID NO: 3820316 - DNA, 20 bp, Homo sapiens
caggtgagaagcagaggaag

SEQ ID NO: 3820317 - DNA, 21 bp, Homo sapiens
caggtgcctggcccttggctt

SEQ ID NO: 3820318 - DNA, 18 bp, Homo sapiens
caggtggttatggagagg

SEQ ID NO: 3820319 - DNA, 14 bp, Homo sapiens
caggtttaagctgt

SEQ ID NO: 3820320 - DNA, 23 bp, Homo sapiens
cagtagaggcatgaacacacatg

SEQ ID NO: 3820321 - DNA, 16 bp, Homo sapiens
cagtagtcgtcaagtt

SEQ ID NO: 3820322 - DNA, 16 bp, Homo sapiens
cagtatccactttgca

SEQ ID NO: 3820323 - DNA, 12 bp, Homo sapiens
cagtatgtggaa

SEQ ID NO: 3820324 - DNA, 13 bp, Homo sapiens
cagtcctagagct

SEQ ID NO: 3820325 - DNA, 15 bp, Homo sapiens
cagtcctagagctcc

SEQ ID NO: 3820326 - DNA, 20 bp, Homo sapiens
cagtcctcacagcctctccc

SEQ ID NO: 3820327 - DNA, 21 bp, Homo sapiens
cagtcctccagaccaccagcc

SEQ ID NO: 3820328 - DNA, 22 bp, Homo sapiens
cagtcctccagaccaccagccg

SEQ ID NO: 3820329 - DNA, 19 bp, Homo sapiens
cagtgaacacactcagcag

SEQ ID NO: 3820330 - DNA, 18 bp, Homo sapiens
cagtgaactgagactgcg

SEQ ID NO: 3820331 - DNA, 12 bp, Homo sapiens
cagtgagcctga

SEQ ID NO: 3820332 - DNA, 17 bp, Homo sapiens
cagtgccctcattttat

SEQ ID NO: 3820333 - DNA, 20 bp, Homo sapiens
cagtggcccccactcacagg

SEQ ID NO: 3820334 - DNA, 22 bp, Homo sapiens
cagtggcccccactcacaggga

SEQ ID NO: 3820335 - DNA, 19 bp, Homo sapiens
cagtggcgtgatctcggct

SEQ ID NO: 3820336 - DNA, 19 bp, Homo sapiens
cagtgggaggacagagccg

SEQ ID NO: 3820337 - DNA, 21 bp, Homo sapiens
cagtgggaggtgagaccacct

SEQ ID NO: 3820338 - DNA, 22 bp, Homo sapiens
cagtgggaggtgagaccacctc

SEQ ID NO: 3820339 - DNA, 21 bp, Homo sapiens
cagttcccatggtgtatgtgg

SEQ ID NO: 3820340 - DNA, 19 bp, Homo sapiens
cagttcctgcagcagagcc

SEQ ID NO: 3820341 - DNA, 16 bp, Homo sapiens
cagttctagttgattg

SEQ ID NO: 3820342 - DNA, 12 bp, Homo sapiens
cagttgaaaaac

SEQ ID NO: 3820343 - DNA, 19 bp, Homo sapiens
cagttggcccgggtgcagg

SEQ ID NO: 3820344 - DNA, 21 bp, Homo sapiens
cataaaaattagccaagtgtg

SEQ ID NO: 3820345 - DNA, 15 bp, Homo sapiens
cataacaacttcata

SEQ ID NO: 3820346 - DNA, 15 bp, Homo sapiens
cataataaacttctg

SEQ ID NO: 3820347 - DNA, 18 bp, Homo sapiens
cataataaacttctggtg

SEQ ID NO: 3820348 - DNA, 18 bp, Homo sapiens
cataatcacaacccttca

SEQ ID NO: 3820349 - DNA, 13 bp, Homo sapiens
catacattatatt

SEQ ID NO: 3820350 - DNA, 23 bp, Homo sapiens
catagaaatgtaacttttgtaag

SEQ ID NO: 3820351 - DNA, 16 bp, Homo sapiens
cataggcttatataca

SEQ ID NO: 3820352 - DNA, 22 bp, Homo sapiens
catagggtgctctgaggtcaat

SEQ ID NO: 3820353 - DNA, 20 bp, Homo sapiens
catatatgtatatgtatatc

SEQ ID NO: 3820354 - DNA, 15 bp, Homo sapiens
catcacttgtacaaa

SEQ ID NO: 3820355 - DNA, 13 bp, Homo sapiens
catccaaagttcc

SEQ ID NO: 3820356 - DNA, 14 bp, Homo sapiens
catccaaagttgcc

SEQ ID NO: 3820357 - DNA, 13 bp, Homo sapiens
catccagttcatg

SEQ ID NO: 3820358 - DNA, 19 bp, Homo sapiens
catccatggggctgattgt

SEQ ID NO: 3820359 - DNA, 14 bp, Homo sapiens
catcccaggggacc

SEQ ID NO: 3820360 - DNA, 15 bp, Homo sapiens
catcgtggctgggaa

SEQ ID NO: 3820361 - DNA, 22 bp, Homo sapiens
catctcaagcaagtttaatcaa

SEQ ID NO: 3820362 - DNA, 18 bp, Homo sapiens
catctcctcccaccagtg

SEQ ID NO: 3820363 - DNA, 16 bp, Homo sapiens
catctgagtccagctc

SEQ ID NO: 3820364 - DNA, 17 bp, Homo sapiens
catctgagtccagctcc

SEQ ID NO: 3820365 - DNA, 23 bp, Homo sapiens
catctgcaccctcgatgaagccc

SEQ ID NO: 3820366 - DNA, 21 bp, Homo sapiens
catcttaggttggcaaaaagg

SEQ ID NO: 3820367 - DNA, 22 bp, Homo sapiens
catcttaggttggcaaaaaggc

SEQ ID NO: 3820368 - DNA, 19 bp, Homo sapiens
catctttgggagagttcat

SEQ ID NO: 3820369 - DNA, 22 bp, Homo sapiens
catgaaaatcctaccaacctct

SEQ ID NO: 3820370 - DNA, 13 bp, Homo sapiens
catgaaacagaaa

SEQ ID NO: 3820371 - DNA, 22 bp, Homo sapiens
catgaaatatagatcagttata

SEQ ID NO: 3820372 - DNA, 18 bp, Homo sapiens
catgaacacagcctggga

SEQ ID NO: 3820373 - DNA, 16 bp, Homo sapiens
catgaagctggaagca

SEQ ID NO: 3820374 - DNA, 18 bp, Homo sapiens
catgaattactgtatata

SEQ ID NO: 3820375 - DNA, 20 bp, Homo sapiens
catgaattactgtatataaa

SEQ ID NO: 3820376 - DNA, 19 bp, Homo sapiens
catgagaatctatatttaa

SEQ ID NO: 3820377 - DNA, 19 bp, Homo sapiens
catgagttggctgggaata

SEQ ID NO: 3820378 - DNA, 17 bp, Homo sapiens
catgcacccctgatgtt

SEQ ID NO: 3820379 - DNA, 16 bp, Homo sapiens
catgcaccctcataca

SEQ ID NO: 3820380 - DNA, 13 bp, Homo sapiens
catgcgcacaagg

SEQ ID NO: 3820381 - DNA, 13 bp, Homo sapiens
catgctcctggcc

SEQ ID NO: 3820382 - DNA, 13 bp, Homo sapiens
catgctttctcct

SEQ ID NO: 3820383 - DNA, 14 bp, Homo sapiens
catgctttctcctt

SEQ ID NO: 3820384 - DNA, 12 bp, Homo sapiens
catggagagaga

SEQ ID NO: 3820385 - DNA, 16 bp, Homo sapiens
catggagagagactca

SEQ ID NO: 3820386 - DNA, 14 bp, Homo sapiens
catggctaactggc

SEQ ID NO: 3820387 - DNA, 13 bp, Homo sapiens
catgggagggagg

SEQ ID NO: 3820388 - DNA, 21 bp, Homo sapiens
cctgcctaggaattcccagcc

SEQ ID NO: 3820389 - DNA, 15 bp, Homo sapiens
cctgcctcttctcta

SEQ ID NO: 3820390 - DNA, 19 bp, Homo sapiens
cctgcctggaccagcctct

SEQ ID NO: 3820391 - DNA, 14 bp, Homo sapiens
cctgcctgggcctc

SEQ ID NO: 3820392 - DNA, 15 bp, Homo sapiens
cctgcctgttctcca

SEQ ID NO: 3820393 - DNA, 18 bp, Homo sapiens
cctgcctgttctccagat

SEQ ID NO: 3820394 - DNA, 12 bp, Homo sapiens
cctgctcctcct

SEQ ID NO: 3820395 - DNA, 15 bp, Homo sapiens
cctggccctcttctt

SEQ ID NO: 3820396 - DNA, 21 bp, Homo sapiens
cctggctccgtccaggagcct

SEQ ID NO: 3820397 - DNA, 22 bp, Homo sapiens
cctgggaggtcaaggctgcagt

SEQ ID NO: 3820398 - DNA, 18 bp, Homo sapiens
cctgggcctcagcctcca

SEQ ID NO: 3820399 - DNA, 12 bp, Homo sapiens
cctgggcctccc

SEQ ID NO: 3820400 - DNA, 18 bp, Homo sapiens
cctggtactgcacatttt

SEQ ID NO: 3820401 - DNA, 17 bp, Homo sapiens
cctggtgcactggcccc

SEQ ID NO: 3820402 - DNA, 20 bp, Homo sapiens
cctggtgcactggccccacc

SEQ ID NO: 3820403 - DNA, 21 bp, Homo sapiens
cctggtggtggctcgggaggc

SEQ ID NO: 3820404 - DNA, 14 bp, Homo sapiens
cctgtaatcccagc

SEQ ID NO: 3820405 - DNA, 17 bp, Homo sapiens
cctgtaatcccagctat

SEQ ID NO: 3820406 - DNA, 17 bp, Homo sapiens
cctgtaccccagcactt

SEQ ID NO: 3820407 - DNA, 16 bp, Homo sapiens
cctgtagagtgggagc

SEQ ID NO: 3820408 - DNA, 21 bp, Homo sapiens
cctgtagagtgggagctgagt

SEQ ID NO: 3820409 - DNA, 16 bp, Homo sapiens
cctgtatgtctccagt

SEQ ID NO: 3820410 - DNA, 21 bp, Homo sapiens
cctgtccccctcccctcccag

SEQ ID NO: 3820411 - DNA, 20 bp, Homo sapiens
cctgtccctacccactcttt

SEQ ID NO: 3820412 - DNA, 15 bp, Homo sapiens
cctgtcccttgacct

SEQ ID NO: 3820413 - DNA, 15 bp, Homo sapiens
cctgtgactatggct

SEQ ID NO: 3820414 - DNA, 15 bp, Homo sapiens
cctgtgcctcctcac

SEQ ID NO: 3820415 - DNA, 21 bp, Homo sapiens
cctgtgcctcctcacccccag

SEQ ID NO: 3820416 - DNA, 19 bp, Homo sapiens
cctgttctaactcttagaa

SEQ ID NO: 3820417 - DNA, 22 bp, Homo sapiens
cctgttctaactcttagaagtg

SEQ ID NO: 3820418 - DNA, 17 bp, Homo sapiens
cctgtttaaaaaaagta

SEQ ID NO: 3820419 - DNA, 19 bp, Homo sapiens
ccttagaagatctgcttcc

SEQ ID NO: 3820420 - DNA, 16 bp, Homo sapiens
ccttagcaaattctgt

SEQ ID NO: 3820421 - DNA, 19 bp, Homo sapiens
ccttagctggcattacagc

SEQ ID NO: 3820422 - DNA, 13 bp, Homo sapiens
ccttcagatccta

SEQ ID NO: 3820423 - DNA, 20 bp, Homo sapiens
ccttcagatcctacccctga

SEQ ID NO: 3820424 - DNA, 18 bp, Homo sapiens
ccttccctccccacagtc

SEQ ID NO: 3820425 - DNA, 19 bp, Homo sapiens
ccttcctggggcatctggc

SEQ ID NO: 3820426 - DNA, 15 bp, Homo sapiens
ccttctcccagcaca

SEQ ID NO: 3820427 - DNA, 17 bp, Homo sapiens
ccttcttaactctgcag

SEQ ID NO: 3820428 - DNA, 19 bp, Homo sapiens
ccttcttaactctgcagga

SEQ ID NO: 3820429 - DNA, 20 bp, Homo sapiens
ccttgctgtagagacttccg

SEQ ID NO: 3820430 - DNA, 14 bp, Homo sapiens
ccttggtctaactt

SEQ ID NO: 3820431 - DNA, 23 bp, Homo sapiens
cctttaaaggtcgcacctccttg

SEQ ID NO: 3820432 - DNA, 15 bp, Homo sapiens
cctttgcaggcccag

SEQ ID NO: 3820433 - DNA, 16 bp, Homo sapiens
cctttgccccggcttg

SEQ ID NO: 3820434 - DNA, 16 bp, Homo sapiens
cctttgcttgaaagaa

SEQ ID NO: 3820435 - DNA, 19 bp, Homo sapiens
ccttttttatgatgctatt

SEQ ID NO: 3820436 - DNA, 20 bp, Homo sapiens
ccttttttatgatgctattt

SEQ ID NO: 3820437 - DNA, 13 bp, Homo sapiens
cgaagacacagac

SEQ ID NO: 3820438 - DNA, 16 bp, Homo sapiens
cgaagcgttgtcctca

SEQ ID NO: 3820439 - DNA, 17 bp, Homo sapiens
cgaagcgttgtcctcag

SEQ ID NO: 3820440 - DNA, 21 bp, Homo sapiens
cgaagcgttgtcctcagcccc

SEQ ID NO: 3820441 - DNA, 15 bp, Homo sapiens
cgaccagagccccac

SEQ ID NO: 3820442 - DNA, 20 bp, Homo sapiens
cgatcttggctcactgcaac

SEQ ID NO: 3820443 - DNA, 12 bp, Homo sapiens
cgccaaggctgg

SEQ ID NO: 3820444 - DNA, 23 bp, Homo sapiens
cgccagaactgctttatcccacg

SEQ ID NO: 3820445 - DNA, 21 bp, Homo sapiens
cgcctccttcttaactctgca

SEQ ID NO: 3820446 - DNA, 14 bp, Homo sapiens
cgcctctgcccagc

SEQ ID NO: 3820447 - DNA, 11 bp, Homo sapiens
cgcggctggga

SEQ ID NO: 3820448 - DNA, 12 bp, Homo sapiens
cgcggctgggag

SEQ ID NO: 3820449 - DNA, 16 bp, Homo sapiens
cgctctgctgcccagg

SEQ ID NO: 3820450 - DNA, 14 bp, Homo sapiens
cgctgatcattgga

SEQ ID NO: 3820451 - DNA, 20 bp, Homo sapiens
cgctggggaagggggctcca

SEQ ID NO: 3820452 - DNA, 19 bp, Homo sapiens
cgcttattgcccaggctgg

SEQ ID NO: 3820453 - DNA, 20 bp, Homo sapiens
cgctttcatgaacacagcct

SEQ ID NO: 3820454 - DNA, 13 bp, Homo sapiens
cggaagagccttg

SEQ ID NO: 3820455 - DNA, 13 bp, Homo sapiens
cggatgcacagag

SEQ ID NO: 3820456 - DNA, 13 bp, Homo sapiens
cggcactccagcc

SEQ ID NO: 3820457 - DNA, 22 bp, Homo sapiens
cggccatgaccactttccccgt

SEQ ID NO: 3820458 - DNA, 23 bp, Homo sapiens
cggctacccctcgactcagcacc

SEQ ID NO: 3820459 - DNA, 18 bp, Homo sapiens
cggctgggaggagggcag

SEQ ID NO: 3820460 - DNA, 19 bp, Homo sapiens
cgggacacctaggctaggg

SEQ ID NO: 3820461 - DNA, 16 bp, Homo sapiens
cgggaggtcgaggcag

SEQ ID NO: 3820462 - DNA, 19 bp, Homo sapiens
cgggctcagcaaaagatgc

SEQ ID NO: 3820463 - DNA, 13 bp, Homo sapiens
cggggacacaggc

SEQ ID NO: 3820464 - DNA, 18 bp, Homo sapiens
cgggggcagtctgagaga

SEQ ID NO: 3820465 - DNA, 22 bp, Homo sapiens
cgggggcatctgagtccagctc

SEQ ID NO: 3820466 - DNA, 15 bp, Homo sapiens
cgggtcatctgtacc

SEQ ID NO: 3820467 - DNA, 16 bp, Homo sapiens
cgggtctgcttctgca

SEQ ID NO: 3820468 - DNA, 16 bp, Homo sapiens
cgggttgtgtgtctgt

SEQ ID NO: 3820469 - DNA, 13 bp, Homo sapiens
cggtccaaagtta

SEQ ID NO: 3820470 - DNA, 20 bp, Homo sapiens
cggtggctcacgcctgtaat

SEQ ID NO: 3820471 - DNA, 16 bp, Homo sapiens
cggttttactgcagct

SEQ ID NO: 3820472 - DNA, 23 bp, Homo sapiens
cggttttcagctattagcaactg

SEQ ID NO: 3820473 - DNA, 18 bp, Homo sapiens
cgtcacccttggtagagt

SEQ ID NO: 3820474 - DNA, 17 bp, Homo sapiens
cgtctggcgagccctta

SEQ ID NO: 3820475 - DNA, 21 bp, Homo sapiens
cgtctggcgagcccttagcct

SEQ ID NO: 3820476 - DNA, 17 bp, Homo sapiens
cgtgagtgtgacttttt

SEQ ID NO: 3820477 - DNA, 15 bp, Homo sapiens
cgtggacacctgccc

SEQ ID NO: 3820478 - DNA, 18 bp, Homo sapiens
cgtggacacctgccctgc

SEQ ID NO: 3820479 - DNA, 15 bp, Homo sapiens
cgtggcaaccctcag

SEQ ID NO: 3820480 - DNA, 18 bp, Homo sapiens
cgtggcaaccctcagctg

SEQ ID NO: 3820481 - DNA, 23 bp, Homo sapiens
cgtgttcacaccattctcctgcc

SEQ ID NO: 3820482 - DNA, 16 bp, Homo sapiens
cgttgtcctcagcccc

SEQ ID NO: 3820483 - DNA, 18 bp, Homo sapiens
cgttttatgtgaatgtgg

SEQ ID NO: 3820484 - DNA, 22 bp, Homo sapiens
ctaaagctctgaacaaaagctt

SEQ ID NO: 3820485 - DNA, 19 bp, Homo sapiens
ctaacctgccgagagtcca

SEQ ID NO: 3820486 - DNA, 23 bp, Homo sapiens
ctaacttattgcctgggcagtgc

SEQ ID NO: 3820487 - DNA, 17 bp, Homo sapiens
ctaacttttgtgtgaaa

SEQ ID NO: 3820488 - DNA, 21 bp, Homo sapiens
ctaaggaagacacagcccaga

SEQ ID NO: 3820489 - DNA, 15 bp, Homo sapiens
ctaataaagagactg

SEQ ID NO: 3820490 - DNA, 23 bp, Homo sapiens
ctaattggtccaacccagcctga

SEQ ID NO: 3820491 - DNA, 23 bp, Homo sapiens
ctaatttatcctgaaatttcaga

SEQ ID NO: 3820492 - DNA, 13 bp, Homo sapiens
ctacaataaatgc

SEQ ID NO: 3820493 - DNA, 14 bp, Homo sapiens
ctacaataaatgct

SEQ ID NO: 3820494 - DNA, 18 bp, Homo sapiens
ctacaataaatgctgaat

SEQ ID NO: 3820495 - DNA, 20 bp, Homo sapiens
ctacaataaatgctgaatga

SEQ ID NO: 3820496 - DNA, 23 bp, Homo sapiens
ctggttagaaatgcagaatccta

SEQ ID NO: 3820497 - DNA, 19 bp, Homo sapiens
ctgtaagattgctttaaga

SEQ ID NO: 3820498 - DNA, 19 bp, Homo sapiens
ctgtaatcctagcactttg

SEQ ID NO: 3820499 - DNA, 12 bp, Homo sapiens
ctgtagagactt

SEQ ID NO: 3820500 - DNA, 13 bp, Homo sapiens
ctgtagagacttc

SEQ ID NO: 3820501 - DNA, 14 bp, Homo sapiens
ctgtagagacttcc

SEQ ID NO: 3820502 - DNA, 19 bp, Homo sapiens
ctgtatgtgacaacatttt

SEQ ID NO: 3820503 - DNA, 20 bp, Homo sapiens
ctgtattttgtttttgtctt

SEQ ID NO: 3820504 - DNA, 14 bp, Homo sapiens
ctgtcatagaaatt

SEQ ID NO: 3820505 - DNA, 16 bp, Homo sapiens
ctgtccagtttccaaa

SEQ ID NO: 3820506 - DNA, 13 bp, Homo sapiens
ctgtccataaagt

SEQ ID NO: 3820507 - DNA, 13 bp, Homo sapiens
ctgtcccaggagc

SEQ ID NO: 3820508 - DNA, 12 bp, Homo sapiens
ctgtccctaccc

SEQ ID NO: 3820509 - DNA, 22 bp, Homo sapiens
ctgtccctacccactctttgct

SEQ ID NO: 3820510 - DNA, 14 bp, Homo sapiens
ctgtccctgtcccc

SEQ ID NO: 3820511 - DNA, 18 bp, Homo sapiens
ctgtctcaaaaaaagaaa

SEQ ID NO: 3820512 - DNA, 15 bp, Homo sapiens
ctgtctgtctgtctg

SEQ ID NO: 3820513 - DNA, 18 bp, Homo sapiens
ctgtcttcagtaagccgt

SEQ ID NO: 3820514 - DNA, 12 bp, Homo sapiens
ctgtgaatacaa

SEQ ID NO: 3820515 - DNA, 13 bp, Homo sapiens
ctgtgaatacaat

SEQ ID NO: 3820516 - DNA, 17 bp, Homo sapiens
ctgtgaatacaattaaa

SEQ ID NO: 3820517 - DNA, 19 bp, Homo sapiens
ctgtgaggggctctctcat

SEQ ID NO: 3820518 - DNA, 16 bp, Homo sapiens
ctgtgcctcctcaccc

SEQ ID NO: 3820519 - DNA, 11 bp, Homo sapiens
ctgtgcctttg

SEQ ID NO: 3820520 - DNA, 12 bp, Homo sapiens
ctgtgcctttgg

SEQ ID NO: 3820521 - DNA, 20 bp, Homo sapiens
ctgtgtcagcatagaagtaa

SEQ ID NO: 3820522 - DNA, 16 bp, Homo sapiens
ctgtgtgcacaaatat

SEQ ID NO: 3820523 - DNA, 18 bp, Homo sapiens
ctgtgtgtgtgtatgtgg

SEQ ID NO: 3820524 - DNA, 21 bp, Homo sapiens
ctgtgtgtgtgtatgtggggg

SEQ ID NO: 3820525 - DNA, 18 bp, Homo sapiens
ctgtgtgtttatgtgtgt

SEQ ID NO: 3820526 - DNA, 13 bp, Homo sapiens
ctgttactgtctt

SEQ ID NO: 3820527 - DNA, 19 bp, Homo sapiens
ctgttattttttatttcca

SEQ ID NO: 3820528 - DNA, 12 bp, Homo sapiens
ctgttcagctgg

SEQ ID NO: 3820529 - DNA, 19 bp, Homo sapiens
ctgttcagctggttgaggt

SEQ ID NO: 3820530 - DNA, 12 bp, Homo sapiens
ctgttctccaga

SEQ ID NO: 3820531 - DNA, 21 bp, Homo sapiens
ctgtttaaaaaaagtatatat

SEQ ID NO: 3820532 - DNA, 15 bp, Homo sapiens
cttaaagttgtcact

SEQ ID NO: 3820533 - DNA, 17 bp, Homo sapiens
cttaactctgcaggaaa

SEQ ID NO: 3820534 - DNA, 19 bp, Homo sapiens
cttacctcggtgccttcct

SEQ ID NO: 3820535 - DNA, 20 bp, Homo sapiens
cttacctgtatgtctccagt

SEQ ID NO: 3820536 - DNA, 21 bp, Homo sapiens
cttagaagatctgcttccctg

SEQ ID NO: 3820537 - DNA, 22 bp, Homo sapiens
cttagaagatctgcttccctgg

SEQ ID NO: 3820538 - DNA, 19 bp, Homo sapiens
cttagccttgctgtagaga

SEQ ID NO: 3820539 - DNA, 21 bp, Homo sapiens
cttagccttgctgtagagact

SEQ ID NO: 3820540 - DNA, 23 bp, Homo sapiens
cttagccttgctgtagagacttc

SEQ ID NO: 3820541 - DNA, 19 bp, Homo sapiens
cttagctgaacaatgaatg

SEQ ID NO: 3820542 - DNA, 14 bp, Homo sapiens
cttagctgccaagt

SEQ ID NO: 3820543 - DNA, 17 bp, Homo sapiens
cttagctgccaagtaaa

SEQ ID NO: 3820544 - DNA, 14 bp, Homo sapiens
cttagctgtctgct

SEQ ID NO: 3820545 - DNA, 15 bp, Homo sapiens
cttaggccagcacca

SEQ ID NO: 3820546 - DNA, 14 bp, Homo sapiens
cttataggtttcca

SEQ ID NO: 3820547 - DNA, 22 bp, Homo sapiens
cttatgacatcacttgtacaaa

SEQ ID NO: 3820548 - DNA, 20 bp, Homo sapiens
cttattcatgctttctcctt

SEQ ID NO: 3820549 - DNA, 21 bp, Homo sapiens
cttattcatgctttctccttt

SEQ ID NO: 3820550 - DNA, 19 bp, Homo sapiens
cttattgcctgggcagtgc

SEQ ID NO: 3820551 - DNA, 14 bp, Homo sapiens
cttatttgtataat

SEQ ID NO: 3820552 - DNA, 17 bp, Homo sapiens
cttatttttgacagtgt

SEQ ID NO: 3820553 - DNA, 15 bp, Homo sapiens
cttcacgcctgggtg

SEQ ID NO: 3820554 - DNA, 15 bp, Homo sapiens
cttcagatcctaccc

SEQ ID NO: 3820555 - DNA, 16 bp, Homo sapiens
cttcagatcctacccc

SEQ ID NO: 3820556 - DNA, 11 bp, Homo sapiens
cttcagctgac

SEQ ID NO: 3820557 - DNA, 19 bp, Homo sapiens
cttcagctgacttttctgt

SEQ ID NO: 3820558 - DNA, 14 bp, Homo sapiens
cttcagtaagccgt

SEQ ID NO: 3820559 - DNA, 22 bp, Homo sapiens
cttcatcccttgcttaagaatc

SEQ ID NO: 3820560 - DNA, 16 bp, Homo sapiens
cttcatgaaaatccta

SEQ ID NO: 3820561 - DNA, 19 bp, Homo sapiens
cttccaaacaggctcagag

SEQ ID NO: 3820562 - DNA, 17 bp, Homo sapiens
cttccaaatcaggctgg

SEQ ID NO: 3820563 - DNA, 13 bp, Homo sapiens
cttccaaccccag

SEQ ID NO: 3820564 - DNA, 15 bp, Homo sapiens
cttccaaccccagct

SEQ ID NO: 3820565 - DNA, 17 bp, Homo sapiens
cttccaaccccagctgg

SEQ ID NO: 3820566 - DNA, 22 bp, Homo sapiens
cttccaaccccagctggcctct

SEQ ID NO: 3820567 - DNA, 18 bp, Homo sapiens
cttccacaagagtgaatt

SEQ ID NO: 3820568 - DNA, 16 bp, Homo sapiens
cttccaggtgcctggc

SEQ ID NO: 3820569 - DNA, 12 bp, Homo sapiens
cttcccccaagg

SEQ ID NO: 3820570 - DNA, 13 bp, Homo sapiens
cttcccccaaggc

SEQ ID NO: 3820571 - DNA, 16 bp, Homo sapiens
cttcccccaaggctga

SEQ ID NO: 3820572 - DNA, 20 bp, Homo sapiens
cttccctgcttttctcccag

SEQ ID NO: 3820573 - DNA, 23 bp, Homo sapiens
cttccctgcttttctcccagaag

SEQ ID NO: 3820574 - DNA, 12 bp, Homo sapiens
cttccctgggcc

SEQ ID NO: 3820575 - DNA, 13 bp, Homo sapiens
cttccctggggcc

SEQ ID NO: 3820576 - DNA, 16 bp, Homo sapiens
cttccctggggcccca

SEQ ID NO: 3820577 - DNA, 18 bp, Homo sapiens
cttccgtcacccttggta

SEQ ID NO: 3820578 - DNA, 13 bp, Homo sapiens
cttcctaacttat

SEQ ID NO: 3820579 - DNA, 17 bp, Homo sapiens
cttcctagttttctcct

SEQ ID NO: 3820580 - DNA, 12 bp, Homo sapiens
cttcctataata

SEQ ID NO: 3820581 - DNA, 20 bp, Homo sapiens
cttcctggggcatctggcga

SEQ ID NO: 3820582 - DNA, 19 bp, Homo sapiens
cttcgggaggtcgaggcag

SEQ ID NO: 3820583 - DNA, 17 bp, Homo sapiens
cttctagttctgccagg

SEQ ID NO: 3820584 - DNA, 18 bp, Homo sapiens
cttctagttctgccagga

SEQ ID NO: 3820585 - DNA, 15 bp, Homo sapiens
cttctattttgtaaa

SEQ ID NO: 3820586 - DNA, 17 bp, Homo sapiens
cttctattttgtaaact

SEQ ID NO: 3820587 - DNA, 13 bp, Homo sapiens
cttctcagagcag

SEQ ID NO: 3820588 - DNA, 15 bp, Homo sapiens
cttctgcattcacag

SEQ ID NO: 3820589 - DNA, 22 bp, Homo sapiens
cttctggggtcaggtgccactg

SEQ ID NO: 3820590 - DNA, 19 bp, Homo sapiens
cttgaaaacctcatttacc

SEQ ID NO: 3820591 - DNA, 15 bp, Homo sapiens
cttgacctctataaa

SEQ ID NO: 3820592 - DNA, 13 bp, Homo sapiens
cttgagctcagga

SEQ ID NO: 3820593 - DNA, 14 bp, Homo sapiens
cttgaggacacatg

SEQ ID NO: 3820594 - DNA, 15 bp, Homo sapiens
cttgaggacacatgt

SEQ ID NO: 3820595 - DNA, 17 bp, Homo sapiens
cttgaggacacatgtcc

SEQ ID NO: 3820596 - DNA, 21 bp, Homo sapiens
cttgagttgattcagctctgc

SEQ ID NO: 3820597 - DNA, 13 bp, Homo sapiens
cttgctttttcaa

SEQ ID NO: 3820598 - DNA, 22 bp, Homo sapiens
cttggaaaaatccagaaagaaa

SEQ ID NO: 3820599 - DNA, 16 bp, Homo sapiens
cttggaaccacagtca

SEQ ID NO: 3820600 - DNA, 13 bp, Homo sapiens
cttggccagagct

SEQ ID NO: 3820601 - DNA, 16 bp, Homo sapiens
cttggccagagctgag

SEQ ID NO: 3820602 - DNA, 23 bp, Homo sapiens
cttggggggctgaggtgggagga

SEQ ID NO: 3820603 - DNA, 17 bp, Homo sapiens
cttggtagagtttattt

SEQ ID NO: 3820604 - DNA, 15 bp, Homo sapiens
cttggtgtcgtttcc

SEQ ID NO: 3820605 - DNA, 13 bp, Homo sapiens
gcagcagagcctg

SEQ ID NO: 3820606 - DNA, 22 bp, Homo sapiens
gcagccgcctcccttatgcagg

SEQ ID NO: 3820607 - DNA, 23 bp, Homo sapiens
gcagcctccagtgggaggacaga

SEQ ID NO: 3820608 - DNA, 13 bp, Homo sapiens
gcagctccagctg

SEQ ID NO: 3820609 - DNA, 18 bp, Homo sapiens
gcaggaaatcagagctgg

SEQ ID NO: 3820610 - DNA, 20 bp, Homo sapiens
gcaggaaatcagagctggca

SEQ ID NO: 3820611 - DNA, 23 bp, Homo sapiens
gcaggaggatcacttgagtccag

SEQ ID NO: 3820612 - DNA, 15 bp, Homo sapiens
gcaggagggaggtgc

SEQ ID NO: 3820613 - DNA, 15 bp, Homo sapiens
gcaggcccagcagac

SEQ ID NO: 3820614 - DNA, 15 bp, Homo sapiens
gcagggaggggacta

SEQ ID NO: 3820615 - DNA, 13 bp, Homo sapiens
gcaggggagtgcc

SEQ ID NO: 3820616 - DNA, 19 bp, Homo sapiens
gcaggggccgggggcagtc

SEQ ID NO: 3820617 - DNA, 19 bp, Homo sapiens
gcagggtcctagaaattcc

SEQ ID NO: 3820618 - DNA, 14 bp, Homo sapiens
gcagtgaaaatgaa

SEQ ID NO: 3820619 - DNA, 21 bp, Homo sapiens
gcagtgaacacactcagcagc

SEQ ID NO: 3820620 - DNA, 22 bp, Homo sapiens
gcagtgattgttatgccttgct

SEQ ID NO: 3820621 - DNA, 14 bp, Homo sapiens
gcagtgcccaccat

SEQ ID NO: 3820622 - DNA, 18 bp, Homo sapiens
gcagttaatggggtagag

SEQ ID NO: 3820623 - DNA, 15 bp, Homo sapiens
gcataaaaattagcc

SEQ ID NO: 3820624 - DNA, 12 bp, Homo sapiens
gcatattaaagg

SEQ ID NO: 3820625 - DNA, 15 bp, Homo sapiens
gcatattaaaggctt

SEQ ID NO: 3820626 - DNA, 22 bp, Homo sapiens
gcatccagagtccctgcctgga

SEQ ID NO: 3820627 - DNA, 23 bp, Homo sapiens
gcatccagagtccctgcctggac

SEQ ID NO: 3820628 - DNA, 17 bp, Homo sapiens
gcatctccctgaccttc

SEQ ID NO: 3820629 - DNA, 22 bp, Homo sapiens
gcatctccctgaccttctccag

SEQ ID NO: 3820630 - DNA, 19 bp, Homo sapiens
gcatgagggatcacagggc

SEQ ID NO: 3820631 - DNA, 21 bp, Homo sapiens
gcatgagggatcacagggccc

SEQ ID NO: 3820632 - DNA, 12 bp, Homo sapiens
gcatgcaactaa

SEQ ID NO: 3820633 - DNA, 21 bp, Homo sapiens
gcatgggagggagggagaggt

SEQ ID NO: 3820634 - DNA, 16 bp, Homo sapiens
gcattctagtgcagaa

SEQ ID NO: 3820635 - DNA, 18 bp, Homo sapiens
gcatttcccttccttcct

SEQ ID NO: 3820636 - DNA, 13 bp, Homo sapiens
gccaagaataaaa

SEQ ID NO: 3820637 - DNA, 15 bp, Homo sapiens
gccaaggttgtcctg

SEQ ID NO: 3820638 - DNA, 18 bp, Homo sapiens
gccaaggttgtcctggag

SEQ ID NO: 3820639 - DNA, 12 bp, Homo sapiens
gccacctgtctg

SEQ ID NO: 3820640 - DNA, 15 bp, Homo sapiens
gccactacctttgtc

SEQ ID NO: 3820641 - DNA, 22 bp, Homo sapiens
gccactacctttgtccaggcct

SEQ ID NO: 3820642 - DNA, 21 bp, Homo sapiens
gccagacttcccacggctcct

SEQ ID NO: 3820643 - DNA, 17 bp, Homo sapiens
gccagagctgagtggca

SEQ ID NO: 3820644 - DNA, 21 bp, Homo sapiens
gccagatgcacatccctggaa

SEQ ID NO: 3820645 - DNA, 21 bp, Homo sapiens
gccaggggaaaatcagcctgc

SEQ ID NO: 3820646 - DNA, 23 bp, Homo sapiens
gccaggggaaaatcagcctgctc

SEQ ID NO: 3820647 - DNA, 15 bp, Homo sapiens
gccagtcctagagct

SEQ ID NO: 3820648 - DNA, 18 bp, Homo sapiens
gccagtcctagagctcct

SEQ ID NO: 3820649 - DNA, 19 bp, Homo sapiens
gccagtcctagagctcctg

SEQ ID NO: 3820650 - DNA, 23 bp, Homo sapiens
gccagtcctagagctcctgtccc

SEQ ID NO: 3820651 - DNA, 23 bp, Homo sapiens
gccatctcaagcaagtttaatca

SEQ ID NO: 3820652 - DNA, 11 bp, Homo sapiens
gccatctcctc

SEQ ID NO: 3820653 - DNA, 13 bp, Homo sapiens
gccatgccagctt

SEQ ID NO: 3820654 - DNA, 19 bp, Homo sapiens
gccattctttcccaacacc

SEQ ID NO: 3820655 - DNA, 22 bp, Homo sapiens
gcccaagggcctcccaccagag

SEQ ID NO: 3820656 - DNA, 21 bp, Homo sapiens
gcccacacccgacaccagccc

SEQ ID NO: 3820657 - DNA, 23 bp, Homo sapiens
gcccacacccgacaccagccctg

SEQ ID NO: 3820658 - DNA, 18 bp, Homo sapiens
gcccaccatgcacccctg

SEQ ID NO: 3820659 - DNA, 16 bp, Homo sapiens
gcccacctgcacgtga

SEQ ID NO: 3820660 - DNA, 21 bp, Homo sapiens
gcccagcctgccccagcctgc

SEQ ID NO: 3820661 - DNA, 20 bp, Homo sapiens
gcccaggctggagtgcagtg

SEQ ID NO: 3820662 - DNA, 20 bp, Homo sapiens
gccccacacggaggcatctg

SEQ ID NO: 3820663 - DNA, 22 bp, Homo sapiens
gccccaccctcgtggacacctg

SEQ ID NO: 3820664 - DNA, 16 bp, Homo sapiens
gccccatctcctccca

SEQ ID NO: 3820665 - DNA, 13 bp, Homo sapiens
gccccgcgtggaa

SEQ ID NO: 3820666 - DNA, 17 bp, Homo sapiens
gcccctccccagccctt

SEQ ID NO: 3820667 - DNA, 19 bp, Homo sapiens
gcccgggagctcaggaacc

SEQ ID NO: 3820668 - DNA, 15 bp, Homo sapiens
gccctacctgcctgt

SEQ ID NO: 3820669 - DNA, 22 bp, Homo sapiens
gccctacctgcctgttctccag

SEQ ID NO: 3820670 - DNA, 18 bp, Homo sapiens
gccctaggattcctcccc

SEQ ID NO: 3820671 - DNA, 18 bp, Homo sapiens
gccctgccacctgtctgt

SEQ ID NO: 3820672 - DNA, 13 bp, Homo sapiens
gccctgccctgcc

SEQ ID NO: 3820673 - DNA, 17 bp, Homo sapiens
gcccttattttcaagaa

SEQ ID NO: 3820674 - DNA, 20 bp, Homo sapiens
gcccttattttcaagaaact

SEQ ID NO: 3820675 - DNA, 15 bp, Homo sapiens
gccctttgcaggccc

SEQ ID NO: 3820676 - DNA, 21 bp, Homo sapiens
gccgagagtccatcagcctcc

SEQ ID NO: 3820677 - DNA, 18 bp, Homo sapiens
gccgagattgcaccactg

SEQ ID NO: 3820678 - DNA, 15 bp, Homo sapiens
gccgccatgctcctg

SEQ ID NO: 3820679 - DNA, 16 bp, Homo sapiens
gccggcagaaatagct

SEQ ID NO: 3820680 - DNA, 19 bp, Homo sapiens
gccgggagcctgaccctca

SEQ ID NO: 3820681 - DNA, 23 bp, Homo sapiens
gccgtctggcgagcccttagcct

SEQ ID NO: 3820682 - DNA, 14 bp, Homo sapiens
gcctcagcctccag

SEQ ID NO: 3820683 - DNA, 16 bp, Homo sapiens
gcctcagcctccaggc

SEQ ID NO: 3820684 - DNA, 14 bp, Homo sapiens
gcctcagcctcctg

SEQ ID NO: 3820685 - DNA, 19 bp, Homo sapiens
gcctcatttcttcctctgc

SEQ ID NO: 3820686 - DNA, 14 bp, Homo sapiens
gcctccagccctct

SEQ ID NO: 3820687 - DNA, 21 bp, Homo sapiens
gcctccagccctctcactgtg

SEQ ID NO: 3820688 - DNA, 16 bp, Homo sapiens
gcctcccaaagtgcta

SEQ ID NO: 3820689 - DNA, 21 bp, Homo sapiens
gcctcccacgactgcccggca

SEQ ID NO: 3820690 - DNA, 19 bp, Homo sapiens
gcctcccagctttctgtgt

SEQ ID NO: 3820691 - DNA, 18 bp, Homo sapiens
gcctcccttatgcaggac

SEQ ID NO: 3820692 - DNA, 16 bp, Homo sapiens
gcctcctcacccccag

SEQ ID NO: 3820693 - DNA, 16 bp, Homo sapiens
gcctcctgagtagctg

SEQ ID NO: 3820694 - DNA, 19 bp, Homo sapiens
gcctctagaacacccactg

SEQ ID NO: 3820695 - DNA, 23 bp, Homo sapiens
gcctctagaacacccactggcca

SEQ ID NO: 3820696 - DNA, 19 bp, Homo sapiens
gcctctcattccagaggaa

SEQ ID NO: 3820697 - DNA, 20 bp, Homo sapiens
gcctctcattccagaggaag

SEQ ID NO: 3820698 - DNA, 24 bp, Homo sapiens
gcctctccactcatgtgactcttt

SEQ ID NO: 3820699 - DNA, 23 bp, Homo sapiens
gcctcttctctactctagggaaa

SEQ ID NO: 3820700 - DNA, 21 bp, Homo sapiens
gcctgacactgagccccacct

SEQ ID NO: 3820701 - DNA, 23 bp, Homo sapiens
gcctgaccctacttcttttgctc

SEQ ID NO: 3820702 - DNA, 17 bp, Homo sapiens
gcctgaccctcatcttt

SEQ ID NO: 3820703 - DNA, 23 bp, Homo sapiens
gcctgagtgcaccaccctttgaa

SEQ ID NO: 3820704 - DNA, 12 bp, Homo sapiens
gcctgcgagaga

SEQ ID NO: 3820705 - DNA, 13 bp, Homo sapiens
gcctgctccagct

SEQ ID NO: 3820706 - DNA, 14 bp, Homo sapiens
gcctggaccctgtg

SEQ ID NO: 3820707 - DNA, 17 bp, Homo sapiens
gcctgggaccagggcat

SEQ ID NO: 3820708 - DNA, 13 bp, Homo sapiens
gcctgggcagtgc

SEQ ID NO: 3820709 - DNA, 14 bp, Homo sapiens
gcctgggcctccca

SEQ ID NO: 3820710 - DNA, 19 bp, Homo sapiens
gcctgtgcctcctcacccc

SEQ ID NO: 3820711 - DNA, 13 bp, Homo sapiens
gcctgttctccag

SEQ ID NO: 3820712 - DNA, 14 bp, Homo sapiens
gttcatgagaatct

SEQ ID NO: 3820713 - DNA, 20 bp, Homo sapiens
gttcattaaacgtcattcag

SEQ ID NO: 3820714 - DNA, 19 bp, Homo sapiens
gttcattcaaaatgtccag

SEQ ID NO: 3820715 - DNA, 23 bp, Homo sapiens
gttccagttcccatggtgtatgt

SEQ ID NO: 3820716 - DNA, 22 bp, Homo sapiens
gttcctcattagcattttgcta

SEQ ID NO: 3820717 - DNA, 12 bp, Homo sapiens
gttcctgcagca

SEQ ID NO: 3820718 - DNA, 18 bp, Homo sapiens
gttcctgcagcagagcct

SEQ ID NO: 3820719 - DNA, 20 bp, Homo sapiens
gttctaactcttagaagtga

SEQ ID NO: 3820720 - DNA, 22 bp, Homo sapiens
gttctgaccgggtctgcttctg

SEQ ID NO: 3820721 - DNA, 14 bp, Homo sapiens
gttctgccaggaga

SEQ ID NO: 3820722 - DNA, 17 bp, Homo sapiens
gttgaaaaacagctgag

SEQ ID NO: 3820723 - DNA, 22 bp, Homo sapiens
gttgaccagggcagtgaaaatg

SEQ ID NO: 3820724 - DNA, 18 bp, Homo sapiens
gttgattgcgagaatttt

SEQ ID NO: 3820725 - DNA, 15 bp, Homo sapiens
gttgcaggacctcag

SEQ ID NO: 3820726 - DNA, 18 bp, Homo sapiens
gttgtatcagcacgtgtg

SEQ ID NO: 3820727 - DNA, 14 bp, Homo sapiens
gttgtgtgtgggag

SEQ ID NO: 3820728 - DNA, 18 bp, Homo sapiens
gtttaaaaaaagtatata

SEQ ID NO: 3820729 - DNA, 20 bp, Homo sapiens
gtttaaaaaaagtatatatt

SEQ ID NO: 3820730 - DNA, 19 bp, Homo sapiens
gtttaagcaatgcttctgc

SEQ ID NO: 3820731 - DNA, 16 bp, Homo sapiens
gtttatgtgtgtgtgt

SEQ ID NO: 3820732 - DNA, 19 bp, Homo sapiens
gtttatttttttgatggct

SEQ ID NO: 3820733 - DNA, 19 bp, Homo sapiens
gtttctgaagtacttaaac

SEQ ID NO: 3820734 - DNA, 18 bp, Homo sapiens
gtttgactagccatctca

SEQ ID NO: 3820735 - DNA, 20 bp, Homo sapiens
gtttgactagccatctcaag

SEQ ID NO: 3820736 - DNA, 15 bp, Homo sapiens
gttttactgcagctt

SEQ ID NO: 3820737 - DNA, 12 bp, Homo sapiens
gttttctcttga

SEQ ID NO: 3820738 - DNA, 18 bp, Homo sapiens
taaaaaaagtatatattc

SEQ ID NO: 3820739 - DNA, 20 bp, Homo sapiens
taaaaaactgctgactgttt

SEQ ID NO: 3820740 - DNA, 21 bp, Homo sapiens
taaaacaatgtttttcatact

SEQ ID NO: 3820741 - DNA, 22 bp, Homo sapiens
taaaacaatgtttttcatactg

SEQ ID NO: 3820742 - DNA, 22 bp, Homo sapiens
taaaactcagaatataacatgt

SEQ ID NO: 3820743 - DNA, 14 bp, Homo sapiens
taaaagattttcct

SEQ ID NO: 3820744 - DNA, 22 bp, Homo sapiens
taaaagtctagttacctacttt

SEQ ID NO: 3820745 - DNA, 23 bp, Homo sapiens
taaaatattcatatattatcaaa

SEQ ID NO: 3820746 - DNA, 15 bp, Homo sapiens
taaacaagtaagaaa

SEQ ID NO: 3820747 - DNA, 17 bp, Homo sapiens
taaactagggttttggc

SEQ ID NO: 3820748 - DNA, 19 bp, Homo sapiens
taaactcaaaatatttgta

SEQ ID NO: 3820749 - DNA, 22 bp, Homo sapiens
taaacttggtttttaaaaaact

SEQ ID NO: 3820750 - DNA, 14 bp, Homo sapiens
taaagcagagccaa

SEQ ID NO: 3820751 - DNA, 20 bp, Homo sapiens
taaagcagagccaaggccac

SEQ ID NO: 3820752 - DNA, 21 bp, Homo sapiens
taaagcagagccaaggccacc

SEQ ID NO: 3820753 - DNA, 15 bp, Homo sapiens
taaataaaatgacca

SEQ ID NO: 3820754 - DNA, 12 bp, Homo sapiens
taaattacatta

SEQ ID NO: 3820755 - DNA, 13 bp, Homo sapiens
taaattatttatg

SEQ ID NO: 3820756 - DNA, 18 bp, Homo sapiens
taacaccatgattaacca

SEQ ID NO: 3820757 - DNA, 12 bp, Homo sapiens
taacatgtaaaa

SEQ ID NO: 3820758 - DNA, 16 bp, Homo sapiens
taaccacttcagctga

SEQ ID NO: 3820759 - DNA, 16 bp, Homo sapiens
taactctgcaggaaat

SEQ ID NO: 3820760 - DNA, 21 bp, Homo sapiens
taacttattgcctgggcagtg

SEQ ID NO: 3820761 - DNA, 18 bp, Homo sapiens
taagattgctttaagaaa

SEQ ID NO: 3820762 - DNA, 16 bp, Homo sapiens
taaggcagaactagga

SEQ ID NO: 3820763 - DNA, 14 bp, Homo sapiens
taaggccacactgg

SEQ ID NO: 3820764 - DNA, 18 bp, Homo sapiens
taagggggaaaactgttc

SEQ ID NO: 3820765 - DNA, 22 bp, Homo sapiens
taagtacttccacttgtgtata

SEQ ID NO: 3820766 - DNA, 22 bp, Homo sapiens
taatatctgagaagtgtatata

SEQ ID NO: 3820767 - DNA, 21 bp, Homo sapiens
taatgaaagtgcactgcagtg

SEQ ID NO: 3820768 - DNA, 19 bp, Homo sapiens
taatggtgttactaaagtc

SEQ ID NO: 3820769 - DNA, 22 bp, Homo sapiens
taattaaaccagactctgttgc

SEQ ID NO: 3820770 - DNA, 22 bp, Homo sapiens
taattacttattgtatttatgt

SEQ ID NO: 3820771 - DNA, 23 bp, Homo sapiens
taattagttcctcattagcattt

SEQ ID NO: 3820772 - DNA, 19 bp, Homo sapiens
taattatgtgatataaaat

SEQ ID NO: 3820773 - DNA, 22 bp, Homo sapiens
taattatgtgatataaaatatt

SEQ ID NO: 3820774 - DNA, 19 bp, Homo sapiens
taattctttgacctgttgg

SEQ ID NO: 3820775 - DNA, 20 bp, Homo sapiens
tacaaaataaacaaataaca

SEQ ID NO: 3820776 - DNA, 19 bp, Homo sapiens
tacaaactcccacttgtca

SEQ ID NO: 3820777 - DNA, 10 bp, Homo sapiens
tacaataaat

SEQ ID NO: 3820778 - DNA, 11 bp, Homo sapiens
tacaataaatg

SEQ ID NO: 3820779 - DNA, 12 bp, Homo sapiens
tacaataaatgc

SEQ ID NO: 3820780 - DNA, 15 bp, Homo sapiens
tacaataaatgctga

SEQ ID NO: 3820781 - DNA, 16 bp, Homo sapiens
tacaataaatgctgaa

SEQ ID NO: 3820782 - DNA, 17 bp, Homo sapiens
tacaataaatgctgaat

SEQ ID NO: 3820783 - DNA, 21 bp, Homo sapiens
tacaattaaaggtcctgccct

SEQ ID NO: 3820784 - DNA, 14 bp, Homo sapiens
tacacccaaagagg

SEQ ID NO: 3820785 - DNA, 20 bp, Homo sapiens
tacatataaaatgtaattac

SEQ ID NO: 3820786 - DNA, 15 bp, Homo sapiens
tacatgaaacagaaa

SEQ ID NO: 3820787 - DNA, 21 bp, Homo sapiens
tacatgaaacagaaacaaaaa

SEQ ID NO: 3820788 - DNA, 19 bp, Homo sapiens
taccagagaaaaagggagg

SEQ ID NO: 3820789 - DNA, 23 bp, Homo sapiens
taccattgtgattattgttacta

SEQ ID NO: 3820790 - DNA, 18 bp, Homo sapiens
tacccactctttgctaca

SEQ ID NO: 3820791 - DNA, 21 bp, Homo sapiens
tacccactctttgctacaata

SEQ ID NO: 3820792 - DNA, 22 bp, Homo sapiens
tacccactctttgctacaataa

SEQ ID NO: 3820793 - DNA, 18 bp, Homo sapiens
tacctcggtgccttcctc

SEQ ID NO: 3820794 - DNA, 13 bp, Homo sapiens
tacctcttggctg

SEQ ID NO: 3820795 - DNA, 23 bp, Homo sapiens
tacctgagatactgaagtgcagc

SEQ ID NO: 3820796 - DNA, 20 bp, Homo sapiens
tacctgcctgttctccagat

SEQ ID NO: 3820797 - DNA, 18 bp, Homo sapiens
taccttcagatcctaccc

SEQ ID NO: 3820798 - DNA, 22 bp, Homo sapiens
tacgccaggggaaaatcagcct

SEQ ID NO: 3820799 - DNA, 15 bp, Homo sapiens
tacgttgttaaatgg

SEQ ID NO: 3820800 - DNA, 22 bp, Homo sapiens
tactctaccctcttagaaaaac

SEQ ID NO: 3820801 - DNA, 20 bp, Homo sapiens
tactgaagtgcagctcagga

SEQ ID NO: 3820802 - DNA, 21 bp, Homo sapiens
tactgctgatgctgaaataaa

SEQ ID NO: 3820803 - DNA, 15 bp, Homo sapiens
tactgtatataaact

SEQ ID NO: 3820804 - DNA, 15 bp, Homo sapiens
tactgtcccaggagc

SEQ ID NO: 3820805 - DNA, 17 bp, Homo sapiens
tactgtcctgttttcta

SEQ ID NO: 3820806 - DNA, 16 bp, Homo sapiens
tactgttatctatctg

SEQ ID NO: 3820807 - DNA, 19 bp, Homo sapiens
tacttatttttgacagtgt

SEQ ID NO: 3820808 - DNA, 16 bp, Homo sapiens
tagaaaagatgagagg

SEQ ID NO: 3820809 - DNA, 18 bp, Homo sapiens
tagaaaagatgagaggca

SEQ ID NO: 3820810 - DNA, 18 bp, Homo sapiens
tagaaacataaataaaat

SEQ ID NO: 3820811 - DNA, 14 bp, Homo sapiens
tagaacacccactg

SEQ ID NO: 3820812 - DNA, 15 bp, Homo sapiens
tagaacacccactgg

SEQ ID NO: 3820813 - DNA, 18 bp, Homo sapiens
tagaagaacatccaagga

SEQ ID NO: 3820814 - DNA, 15 bp, Homo sapiens
tagaagatctgcttc

SEQ ID NO: 3820815 - DNA, 23 bp, Homo sapiens
tagaagatctgcttccctggggc

SEQ ID NO: 3820816 - DNA, 21 bp, Homo sapiens
tagaatgatttcatgctatct

SEQ ID NO: 3820817 - DNA, 23 bp, Homo sapiens
tagaattagtggcacttgctttt

SEQ ID NO: 3820818 - DNA, 14 bp, Homo sapiens
tagaccaaaataaa

SEQ ID NO: 3820819 - DNA, 14 bp, Homo sapiens
tctgagagaggcca

SEQ ID NO: 3820820 - DNA, 20 bp, Homo sapiens
tctgagagaggccattcttt

SEQ ID NO: 3820821 - DNA, 15 bp, Homo sapiens
tctgagatttcacag

SEQ ID NO: 3820822 - DNA, 23 bp, Homo sapiens
tctgaggacatggagagagactc

SEQ ID NO: 3820823 - DNA, 13 bp, Homo sapiens
tctgaggagtgga

SEQ ID NO: 3820824 - DNA, 22 bp, Homo sapiens
tctgaggagtggagttctctgt

SEQ ID NO: 3820825 - DNA, 19 bp, Homo sapiens
tctgaggtcaataaagcag

SEQ ID NO: 3820826 - DNA, 15 bp, Homo sapiens
tctgagtccagctcc

SEQ ID NO: 3820827 - DNA, 17 bp, Homo sapiens
tctgcaaggtctttggt

SEQ ID NO: 3820828 - DNA, 21 bp, Homo sapiens
tctgcattcacagcgcctcct

SEQ ID NO: 3820829 - DNA, 21 bp, Homo sapiens
tctgcccccaactcccggagg

SEQ ID NO: 3820830 - DNA, 20 bp, Homo sapiens
tctgcccgcctcggcctccc

SEQ ID NO: 3820831 - DNA, 13 bp, Homo sapiens
tctgcctcagctt

SEQ ID NO: 3820832 - DNA, 16 bp, Homo sapiens
tctgcctcagcttccc

SEQ ID NO: 3820833 - DNA, 22 bp, Homo sapiens
tctgctcagacagaacccctac

SEQ ID NO: 3820834 - DNA, 14 bp, Homo sapiens
tctgcttccctggg

SEQ ID NO: 3820835 - DNA, 19 bp, Homo sapiens
tctgcttccgtattttaat

SEQ ID NO: 3820836 - DNA, 16 bp, Homo sapiens
tctggaaaggaggaag

SEQ ID NO: 3820837 - DNA, 14 bp, Homo sapiens
tctggaggctggca

SEQ ID NO: 3820838 - DNA, 19 bp, Homo sapiens
tctggcgagcccttagcct

SEQ ID NO: 3820839 - DNA, 17 bp, Homo sapiens
tctggggtcaggtgcca

SEQ ID NO: 3820840 - DNA, 23 bp, Homo sapiens
tctggggtcaggtgccactgacc

SEQ ID NO: 3820841 - DNA, 19 bp, Homo sapiens
tctgtccgagctttgaaaa

SEQ ID NO: 3820842 - DNA, 15 bp, Homo sapiens
tctgtctgtcccaaa

SEQ ID NO: 3820843 - DNA, 16 bp, Homo sapiens
tctgtctgtcccaaag

SEQ ID NO: 3820844 - DNA, 12 bp, Homo sapiens
tctgtgaataca

SEQ ID NO: 3820845 - DNA, 13 bp, Homo sapiens
tctgtgaatacaa

SEQ ID NO: 3820846 - DNA, 19 bp, Homo sapiens
tctgtgaatacaattaaag

SEQ ID NO: 3820847 - DNA, 20 bp, Homo sapiens
tctgtgaatacaattaaagg

SEQ ID NO: 3820848 - DNA, 22 bp, Homo sapiens
tctgtgatcaccctctcggcct

SEQ ID NO: 3820849 - DNA, 14 bp, Homo sapiens
tctgtgtgcacaaa

SEQ ID NO: 3820850 - DNA, 11 bp, Homo sapiens
tctgtgtgtgt

SEQ ID NO: 3820851 - DNA, 19 bp, Homo sapiens
tctgtgtgtgtgtatgtgg

SEQ ID NO: 3820852 - DNA, 21 bp, Homo sapiens
tctgtgtgtgtgtatgtgggg

SEQ ID NO: 3820853 - DNA, 19 bp, Homo sapiens
tctgttcacttttcctccc

SEQ ID NO: 3820854 - DNA, 14 bp, Homo sapiens
tctgttttgtaaat

SEQ ID NO: 3820855 - DNA, 15 bp, Homo sapiens
tctgttttgtaaatg

SEQ ID NO: 3820856 - DNA, 18 bp, Homo sapiens
tctgttttgtaaatgtaa

SEQ ID NO: 3820857 - DNA, 13 bp, Homo sapiens
tcttaaaaagtgg

SEQ ID NO: 3820858 - DNA, 16 bp, Homo sapiens
tcttaactctgcagga

SEQ ID NO: 3820859 - DNA, 21 bp, Homo sapiens
tcttacctgtatgtctccagt

SEQ ID NO: 3820860 - DNA, 14 bp, Homo sapiens
tcttatgcaatttc

SEQ ID NO: 3820861 - DNA, 18 bp, Homo sapiens
tcttcacctcctgccagc

SEQ ID NO: 3820862 - DNA, 15 bp, Homo sapiens
tcttcacgcctgggt

SEQ ID NO: 3820863 - DNA, 16 bp, Homo sapiens
tcttcagtaagccgtg

SEQ ID NO: 3820864 - DNA, 22 bp, Homo sapiens
tcttcattacctcagtgagaag

SEQ ID NO: 3820865 - DNA, 17 bp, Homo sapiens
tcttccaaccccagctg

SEQ ID NO: 3820866 - DNA, 19 bp, Homo sapiens
tcttccaaccccagctggc

SEQ ID NO: 3820867 - DNA, 19 bp, Homo sapiens
tcttccctacagttgaaaa

SEQ ID NO: 3820868 - DNA, 23 bp, Homo sapiens
tcttctcagagcagcactggggt

SEQ ID NO: 3820869 - DNA, 21 bp, Homo sapiens
tcttctgtatgtgacaacatt

SEQ ID NO: 3820870 - DNA, 13 bp, Homo sapiens
tcttgagcctggg

SEQ ID NO: 3820871 - DNA, 16 bp, Homo sapiens
tcttgagcctgggagg

SEQ ID NO: 3820872 - DNA, 17 bp, Homo sapiens
tcttgatctcctgagct

SEQ ID NO: 3820873 - DNA, 16 bp, Homo sapiens
tctttaaaatatttgt

SEQ ID NO: 3820874 - DNA, 11 bp, Homo sapiens
tctttaaacag

SEQ ID NO: 3820875 - DNA, 23 bp, Homo sapiens
tctttaaacagcaactacagaag

SEQ ID NO: 3820876 - DNA, 12 bp, Homo sapiens
tctttactttta

SEQ ID NO: 3820877 - DNA, 16 bp, Homo sapiens
tctttagcttttacca

SEQ ID NO: 3820878 - DNA, 12 bp, Homo sapiens
tctttcatacat

SEQ ID NO: 3820879 - DNA, 19 bp, Homo sapiens
tctttcatacattatattc

SEQ ID NO: 3820880 - DNA, 13 bp, Homo sapiens
tctttcttccaaa

SEQ ID NO: 3820881 - DNA, 14 bp, Homo sapiens
tctttgctacaata

SEQ ID NO: 3820882 - DNA, 17 bp, Homo sapiens
tctttgctacaataaat

SEQ ID NO: 3820883 - DNA, 19 bp, Homo sapiens
tctttgctacaataaatgc

SEQ ID NO: 3820884 - DNA, 21 bp, Homo sapiens
tctttgctacaataaatgctg

SEQ ID NO: 3820885 - DNA, 18 bp, Homo sapiens
tctttgtgtagctttgct

SEQ ID NO: 3820886 - DNA, 13 bp, Homo sapiens
tcttttgaagaag

SEQ ID NO: 3820887 - DNA, 22 bp, Homo sapiens
tcttttgaagaagttcttaaat

SEQ ID NO: 3820888 - DNA, 22 bp, Homo sapiens
tgaaaaaggaggaagagaaaaa

SEQ ID NO: 3820889 - DNA, 15 bp, Homo sapiens
tgaaaagaaaaatga

SEQ ID NO: 3820890 - DNA, 22 bp, Homo sapiens
tgaaaagaaaaatgagcctggc

SEQ ID NO: 3820891 - DNA, 16 bp, Homo sapiens
tgaaaagatgttgtgt

SEQ ID NO: 3820892 - DNA, 16 bp, Homo sapiens
tgaaaatttgcctttg

SEQ ID NO: 3820893 - DNA, 22 bp, Homo sapiens
tgaaagaaaataccaaggaaca

SEQ ID NO: 3820894 - DNA, 17 bp, Homo sapiens
tgaaataaactagggtt

SEQ ID NO: 3820895 - DNA, 21 bp, Homo sapiens
tgaaataccaacctgaagaca

SEQ ID NO: 3820896 - DNA, 22 bp, Homo sapiens
tgaaatttcagattcccagagc

SEQ ID NO: 3820897 - DNA, 12 bp, Homo sapiens
tgaacaagaatt

SEQ ID NO: 3820898 - DNA, 18 bp, Homo sapiens
tgaacaagaattggaagc

SEQ ID NO: 3820899 - DNA, 19 bp, Homo sapiens
tgaacttgaggacacatgt

SEQ ID NO: 3820900 - DNA, 20 bp, Homo sapiens
tgaacttgaggacacatgtc

SEQ ID NO: 3820901 - DNA, 21 bp, Homo sapiens
tgaacttgaggacacatgtcc

SEQ ID NO: 3820902 - DNA, 17 bp, Homo sapiens
tgaagagtgagagggca

SEQ ID NO: 3820903 - DNA, 19 bp, Homo sapiens
tgaagctggaagcactgct

SEQ ID NO: 3820904 - DNA, 13 bp, Homo sapiens
tgaataatacagt

SEQ ID NO: 3820905 - DNA, 15 bp, Homo sapiens
tgaatacaattaaag

SEQ ID NO: 3820906 - DNA, 17 bp, Homo sapiens
tgaatacaattaaaggt

SEQ ID NO: 3820907 - DNA, 14 bp, Homo sapiens
tgaatgtcccagag

SEQ ID NO: 3820908 - DNA, 19 bp, Homo sapiens
tgaattacactcaaggaaa

SEQ ID NO: 3820909 - DNA, 16 bp, Homo sapiens
tgaattactgtatata

SEQ ID NO: 3820910 - DNA, 20 bp, Homo sapiens
tgaattactgtatataaact

SEQ ID NO: 3820911 - DNA, 19 bp, Homo sapiens
tgaattagaaacataaata

SEQ ID NO: 3820912 - DNA, 23 bp, Homo sapiens
tgaattagaaacataaataaaat

SEQ ID NO: 3820913 - DNA, 13 bp, Homo sapiens
tgaatttctaaat

SEQ ID NO: 3820914 - DNA, 16 bp, Homo sapiens
tgaattttgttgctgt

SEQ ID NO: 3820915 - DNA, 16 bp, Homo sapiens
tgaatttttttttcct

SEQ ID NO: 3820916 - DNA, 20 bp, Homo sapiens
tgaatttttttttcctagcc

SEQ ID NO: 3820917 - DNA, 19 bp, Homo sapiens
tgacaacatttttgtacat

SEQ ID NO: 3820918 - DNA, 23 bp, Homo sapiens
tgacaacatttttgtacattatg

SEQ ID NO: 3820919 - DNA, 22 bp, Homo sapiens
tgacagagcaagtgagaccctg

SEQ ID NO: 3820920 - DNA, 13 bp, Homo sapiens
tgacagagccaga

SEQ ID NO: 3820921 - DNA, 16 bp, Homo sapiens
tgacagagccagaggc

SEQ ID NO: 3820922 - DNA, 19 bp, Homo sapiens
tgacagagttggtgttcat

SEQ ID NO: 3820923 - DNA, 19 bp, Homo sapiens
tgacagtgttgaaaatgtt

SEQ ID NO: 3820924 - DNA, 17 bp, Homo sapiens
tgacatacatccaacat

SEQ ID NO: 3820925 - DNA, 21 bp, Homo sapiens
tgacccggctgggtcggccct

SEQ ID NO: 3820926 - DNA, 21 bp, Homo sapiens
tgaccctcatctttcttccaa

SEQ ID NO: 3820927 - DNA, 12 bp, Homo sapiens
ttcttcctctgc

SEQ ID NO: 3820928 - DNA, 13 bp, Homo sapiens
ttcttcctctgca

SEQ ID NO: 3820929 - DNA, 18 bp, Homo sapiens
ttcttccttaaactcctg

SEQ ID NO: 3820930 - DNA, 16 bp, Homo sapiens
ttctttcatacattat

SEQ ID NO: 3820931 - DNA, 17 bp, Homo sapiens
ttctttcatacattata

SEQ ID NO: 3820932 - DNA, 13 bp, Homo sapiens
ttgaagaggaaaa

SEQ ID NO: 3820933 - DNA, 18 bp, Homo sapiens
ttgaaggagaaaatgcat

SEQ ID NO: 3820934 - DNA, 23 bp, Homo sapiens
ttgaattagaaacataaataaaa

SEQ ID NO: 3820935 - DNA, 21 bp, Homo sapiens
ttgacagagttggtgttcata

SEQ ID NO: 3820936 - DNA, 19 bp, Homo sapiens
ttgacagtgttgaaaatgt

SEQ ID NO: 3820937 - DNA, 17 bp, Homo sapiens
ttgactagccatctcaa

SEQ ID NO: 3820938 - DNA, 17 bp, Homo sapiens
ttgagaaaatgcaggag

SEQ ID NO: 3820939 - DNA, 15 bp, Homo sapiens
ttgagatcagcctgg

SEQ ID NO: 3820940 - DNA, 16 bp, Homo sapiens
ttgagatcagcctggg

SEQ ID NO: 3820941 - DNA, 11 bp, Homo sapiens
ttgagcctggg

SEQ ID NO: 3820942 - DNA, 13 bp, Homo sapiens
ttgaggacacatg

SEQ ID NO: 3820943 - DNA, 15 bp, Homo sapiens
ttgaggacacatgtc

SEQ ID NO: 3820944 - DNA, 20 bp, Homo sapiens
ttgagttgattcagctctgc

SEQ ID NO: 3820945 - DNA, 18 bp, Homo sapiens
ttgatggctaagatactg

SEQ ID NO: 3820946 - DNA, 16 bp, Homo sapiens
ttgattcagctctgca

SEQ ID NO: 3820947 - DNA, 15 bp, Homo sapiens
ttgatttgagaaatt

SEQ ID NO: 3820948 - DNA, 16 bp, Homo sapiens
ttgcaccactgcactc

SEQ ID NO: 3820949 - DNA, 22 bp, Homo sapiens
ttgcatgaattactgtatataa

SEQ ID NO: 3820950 - DNA, 22 bp, Homo sapiens
ttgccacagatgatacttccaa

SEQ ID NO: 3820951 - DNA, 17 bp, Homo sapiens
ttgccccggcttgcctg

SEQ ID NO: 3820952 - DNA, 21 bp, Homo sapiens
ttgcctcatttcttcctctgc

SEQ ID NO: 3820953 - DNA, 17 bp, Homo sapiens
ttgcctgcctgggcctc

SEQ ID NO: 3820954 - DNA, 23 bp, Homo sapiens
ttgcctgcctgggcctcccaaag

SEQ ID NO: 3820955 - DNA, 17 bp, Homo sapiens
ttgcctgggcagtgccc

SEQ ID NO: 3820956 - DNA, 13 bp, Homo sapiens
ttgctacaataaa

SEQ ID NO: 3820957 - DNA, 16 bp, Homo sapiens
ttgctacaataaatgc

SEQ ID NO: 3820958 - DNA, 20 bp, Homo sapiens
ttgctatgagctggggatgt

SEQ ID NO: 3820959 - DNA, 14 bp, Homo sapiens
ttgctctacaatga

SEQ ID NO: 3820960 - DNA, 23 bp, Homo sapiens
ttgctgactactactctgccaat

SEQ ID NO: 3820961 - DNA, 15 bp, Homo sapiens
ttgctgtagagactt

SEQ ID NO: 3820962 - DNA, 14 bp, Homo sapiens
ttgctttaagaaac

SEQ ID NO: 3820963 - DNA, 11 bp, Homo sapiens
ttggaatgtta

SEQ ID NO: 3820964 - DNA, 14 bp, Homo sapiens
ttggaattttcttt

SEQ ID NO: 3820965 - DNA, 22 bp, Homo sapiens
ttggaattttctttcatacatt

SEQ ID NO: 3820966 - DNA, 16 bp, Homo sapiens
ttggacttgtcccggg

SEQ ID NO: 3820967 - DNA, 16 bp, Homo sapiens
ttggcaggaggcagga

SEQ ID NO: 3820968 - DNA, 17 bp, Homo sapiens
ttgggagcttgggaatg

SEQ ID NO: 3820969 - DNA, 23 bp, Homo sapiens
ttgggtagaaagagatacagagg

SEQ ID NO: 3820970 - DNA, 15 bp, Homo sapiens
ttggtagagtttatt

SEQ ID NO: 3820971 - DNA, 12 bp, Homo sapiens
ttgtaaatgtaa

SEQ ID NO: 3820972 - DNA, 19 bp, Homo sapiens
ttgtaaatttatgtgatgg

SEQ ID NO: 3820973 - DNA, 18 bp, Homo sapiens
ttgtaagacaaaggtttt

SEQ ID NO: 3820974 - DNA, 18 bp, Homo sapiens
ttgtacaaagatatgcta

SEQ ID NO: 3820975 - DNA, 12 bp, Homo sapiens
ttgtacattatg

SEQ ID NO: 3820976 - DNA, 15 bp, Homo sapiens
ttgtacattatgtta

SEQ ID NO: 3820977 - DNA, 17 bp, Homo sapiens
ttgtacattatgttatt

SEQ ID NO: 3820978 - DNA, 19 bp, Homo sapiens
ttgtactcttgctttttca

SEQ ID NO: 3820979 - DNA, 20 bp, Homo sapiens
ttgtcacgccagacttccca

SEQ ID NO: 3820980 - DNA, 11 bp, Homo sapiens
ttgtcttccaa

SEQ ID NO: 3820981 - DNA, 22 bp, Homo sapiens
ttgtcttccaaccccagctggc

SEQ ID NO: 3820982 - DNA, 13 bp, Homo sapiens
ttgtgaaagaagg

SEQ ID NO: 3820983 - DNA, 19 bp, Homo sapiens
ttgtgaaattcaacctgtg

SEQ ID NO: 3820984 - DNA, 10 bp, Homo sapiens
ttgtgcccac

SEQ ID NO: 3820985 - DNA, 20 bp, Homo sapiens
ttgtgtcagaaacatgaaat

SEQ ID NO: 3820986 - DNA, 18 bp, Homo sapiens
ttgttatgccttgctatt

SEQ ID NO: 3820987 - DNA, 23 bp, Homo sapiens
ttgttccataataaacttctggt

SEQ ID NO: 3820988 - DNA, 15 bp, Homo sapiens
ttgtttagaagaagt

SEQ ID NO: 3820989 - DNA, 14 bp, Homo sapiens
ttgttttcttcatt

SEQ ID NO: 3820990 - DNA, 13 bp, Homo sapiens
ttgtttttactgt

SEQ ID NO: 3820991 - DNA, 20 bp, Homo sapiens
tttaaaaaaaatagaagcta

SEQ ID NO: 3820992 - DNA, 18 bp, Homo sapiens
tttaaatgcataaatgca

SEQ ID NO: 3820993 - DNA, 23 bp, Homo sapiens
tttaactgcactcatagggtgct

SEQ ID NO: 3820994 - DNA, 14 bp, Homo sapiens
tttaagcaatgctt

SEQ ID NO: 3820995 - DNA, 21 bp, Homo sapiens
tttaagctgttactgtcttca

SEQ ID NO: 3820996 - DNA, 23 bp, Homo sapiens
tttaatatctgagaagtgtatat

SEQ ID NO: 3820997 - DNA, 19 bp, Homo sapiens
tttacacacttgcatgaat

SEQ ID NO: 3820998 - DNA, 20 bp, Homo sapiens
tttacagaggacagtatttg

SEQ ID NO: 3820999 - DNA, 14 bp, Homo sapiens
tttactgacagaaa

SEQ ID NO: 3821000 - DNA, 19 bp, Homo sapiens
tttagaagaagtgtgtcac

SEQ ID NO: 3821001 - DNA, 14 bp, Homo sapiens
tttagaatatatta

SEQ ID NO: 3821002 - DNA, 22 bp, Homo sapiens
tttagaccctattgctgcttga

SEQ ID NO: 3821003 - DNA, 22 bp, Homo sapiens
tttaggtttttgtttgtttcct

SEQ ID NO: 3821004 - DNA, 19 bp, Homo sapiens
tttataaactaggtaaaat

SEQ ID NO: 3821005 - DNA, 23 bp, Homo sapiens
tttatcatgtcgtaggtaaacta

SEQ ID NO: 3821006 - DNA, 13 bp, Homo sapiens
tttatcattctgc

SEQ ID NO: 3821007 - DNA, 19 bp, Homo sapiens
tttatcctgaaatttcaga

SEQ ID NO: 3821008 - DNA, 14 bp, Homo sapiens
tttatgccacctga

SEQ ID NO: 3821009 - DNA, 13 bp, Homo sapiens
tttattaaaacag

SEQ ID NO: 3821010 - DNA, 15 bp, Homo sapiens
tttatttataaacta

SEQ ID NO: 3821011 - DNA, 22 bp, Homo sapiens
tttcaagcctgcctaggaattc

SEQ ID NO: 3821012 - DNA, 17 bp, Homo sapiens
tttcaccagatttgcta

SEQ ID NO: 3821013 - DNA, 21 bp, Homo sapiens
tttcatacattatattcctct

SEQ ID NO: 3821014 - DNA, 16 bp, Homo sapiens
tttcatgaacacagcc

SEQ ID NO: 3821015 - DNA, 16 bp, Homo sapiens
tttcatgctatctctg

SEQ ID NO: 3821016 - DNA, 20 bp, Homo sapiens
tttcatttagtgctaaacaa

SEQ ID NO: 3821017 - DNA, 16 bp, Homo sapiens
tttccctattagagaa

SEQ ID NO: 3821018 - DNA, 22 bp, Homo sapiens
tttccgtggcaaccctcagctg

SEQ ID NO: 3821019 - DNA, 17 bp, Homo sapiens
tttcctagccctctcac

SEQ ID NO: 3821020 - DNA, 13 bp, Homo sapiens
tttcctccctcag

SEQ ID NO: 3821021 - DNA, 21 bp, Homo sapiens
tttccttttgcaacaagacaa

SEQ ID NO: 3821022 - DNA, 23 bp, Homo sapiens
tttctgaaagatgagtaatttct

SEQ ID NO: 3821023 - DNA, 21 bp, Homo sapiens
tttctggaatacatgaaatat

SEQ ID NO: 3821024 - DNA, 21 bp, Homo sapiens
tttcttgctgtattataagag

SEQ ID NO: 3821025 - DNA, 19 bp, Homo sapiens
tttctttagcttttaccaa

SEQ ID NO: 3821026 - DNA, 16 bp, Homo sapiens
tttctttcatacatta

SEQ ID NO: 3821027 - DNA, 15 bp, Homo sapiens
tttgaagaggaaaat

SEQ ID NO: 3821028 - DNA, 22 bp, Homo sapiens
tttgacagagttggtgttcata

SEQ ID NO: 3821029 - DNA, 22 bp, Homo sapiens
tttgactagccatctcaagcaa

SEQ ID NO: 3821030 - DNA, 12 bp, Homo sapiens
tttgcacagctc

SEQ ID NO: 3821031 - DNA, 16 bp, Homo sapiens
tttgcacagctctccg

SEQ ID NO: 3821032 - DNA, 15 bp, Homo sapiens
tttgctacaataaat

SEQ ID NO: 3821033 - DNA, 18 bp, Homo sapiens
tttgctacaataaatgct

SEQ ID NO: 3821034 - DNA, 19 bp, Homo sapiens
tttgctgcactttttactt

SEQ ID NO: 3821035 - DNA, 19 bp, Homo sapiens
ccaggggctggcttcagga

SEQ ID NO: 3821036 - DNA, 21 bp, Homo sapiens
ccaggggctggcttcaggagg

SEQ ID NO: 3821037 - DNA, 22 bp, Homo sapiens
ccagggtggacttagaaagcag

SEQ ID NO: 3821038 - DNA, 23 bp, Homo sapiens
ccaggtaccagctgcgcttgctt

SEQ ID NO: 3821039 - DNA, 17 bp, Homo sapiens
ccagtaataaaaagcca

SEQ ID NO: 3821040 - DNA, 16 bp, Homo sapiens
ccagtcccaccctgct

SEQ ID NO: 3821041 - DNA, 15 bp, Homo sapiens
ccagtccccacccct

SEQ ID NO: 3821042 - DNA, 20 bp, Homo sapiens
ccagtctgctctcagcttgt

SEQ ID NO: 3821043 - DNA, 13 bp, Homo sapiens
ccagttaaatatg

SEQ ID NO: 3821044 - DNA, 19 bp, Homo sapiens
ccagttcccgggccctcct

SEQ ID NO: 3821045 - DNA, 18 bp, Homo sapiens
ccatagaatggcacatgt

SEQ ID NO: 3821046 - DNA, 22 bp, Homo sapiens
ccatccctcgtggtccccaaca

SEQ ID NO: 3821047 - DNA, 12 bp, Homo sapiens
ccatccctgcct

SEQ ID NO: 3821048 - DNA, 14 bp, Homo sapiens
ccatccctgcctgg

SEQ ID NO: 3821049 - DNA, 15 bp, Homo sapiens
ccatccctgcctggt

SEQ ID NO: 3821050 - DNA, 16 bp, Homo sapiens
ccatccctgcctggtc

SEQ ID NO: 3821051 - DNA, 13 bp, Homo sapiens
ccatcccttcccc

SEQ ID NO: 3821052 - DNA, 15 bp, Homo sapiens
ccatcctgctagcac

SEQ ID NO: 3821053 - DNA, 14 bp, Homo sapiens
ccatcctttgcatt

SEQ ID NO: 3821054 - DNA, 15 bp, Homo sapiens
ccatcctttgcattt

SEQ ID NO: 3821055 - DNA, 18 bp, Homo sapiens
ccatcctttgcatttctc

SEQ ID NO: 3821056 - DNA, 17 bp, Homo sapiens
ccatcgccagctgatga

SEQ ID NO: 3821057 - DNA, 23 bp, Homo sapiens
ccatcgccagctgatgactcaag

SEQ ID NO: 3821058 - DNA, 12 bp, Homo sapiens
ccatctgcaccc

SEQ ID NO: 3821059 - DNA, 13 bp, Homo sapiens
ccatctggcccag

SEQ ID NO: 3821060 - DNA, 16 bp, Homo sapiens
ccatctggcccaggct

SEQ ID NO: 3821061 - DNA, 18 bp, Homo sapiens
ccatctggcccaggctgg

SEQ ID NO: 3821062 - DNA, 21 bp, Homo sapiens
ccatctggctgtgacagcctc

SEQ ID NO: 3821063 - DNA, 22 bp, Homo sapiens
ccatcttgggggtcacccatgg

SEQ ID NO: 3821064 - DNA, 19 bp, Homo sapiens
ccatgcagtgaccgcttcc

SEQ ID NO: 3821065 - DNA, 20 bp, Homo sapiens
ccatgcccccgccacctccc

SEQ ID NO: 3821066 - DNA, 16 bp, Homo sapiens
ccatgctggagcctgt

SEQ ID NO: 3821067 - DNA, 17 bp, Homo sapiens
ccatgctggagcctgtg

SEQ ID NO: 3821068 - DNA, 14 bp, Homo sapiens
ccatggggcagcct

SEQ ID NO: 3821069 - DNA, 17 bp, Homo sapiens
ccatggggcagcctcca

SEQ ID NO: 3821070 - DNA, 24 bp, Homo sapiens
ccatggggcagcctccagtctgct

SEQ ID NO: 3821071 - DNA, 18 bp, Homo sapiens
ccatggtgattcctggga

SEQ ID NO: 3821072 - DNA, 15 bp, Homo sapiens
ccatgtccaatggag

SEQ ID NO: 3821073 - DNA, 21 bp, Homo sapiens
ccatgtcccagcctggcctgt

SEQ ID NO: 3821074 - DNA, 17 bp, Homo sapiens
ccatgttccaataaaca

SEQ ID NO: 3821075 - DNA, 12 bp, Homo sapiens
ccattctacttg

SEQ ID NO: 3821076 - DNA, 19 bp, Homo sapiens
ccattctacttgctctgga

SEQ ID NO: 3821077 - DNA, 20 bp, Homo sapiens
ccattctacttgctctggac

SEQ ID NO: 3821078 - DNA, 22 bp, Homo sapiens
ccattctcccaggtaccagctg

SEQ ID NO: 3821079 - DNA, 14 bp, Homo sapiens
ccatttcccatctg

SEQ ID NO: 3821080 - DNA, 15 bp, Homo sapiens
ccatttcccatctgc

SEQ ID NO: 3821081 - DNA, 17 bp, Homo sapiens
ccatttcccatctgcac

SEQ ID NO: 3821082 - DNA, 18 bp, Homo sapiens
ccatttctttatatggaa

SEQ ID NO: 3821083 - DNA, 13 bp, Homo sapiens
cccaaagctctaa

SEQ ID NO: 3821084 - DNA, 13 bp, Homo sapiens
cccaaagggaggg

SEQ ID NO: 3821085 - DNA, 19 bp, Homo sapiens
cccaaattatcaagctaat

SEQ ID NO: 3821086 - DNA, 23 bp, Homo sapiens
cccaacagcgacatagcccatcc

SEQ ID NO: 3821087 - DNA, 20 bp, Homo sapiens
cccaaggacctgcctccccg

SEQ ID NO: 3821088 - DNA, 20 bp, Homo sapiens
cccacaccatctggcccagg

SEQ ID NO: 3821089 - DNA, 23 bp, Homo sapiens
cccacacccactccacaccagta

SEQ ID NO: 3821090 - DNA, 12 bp, Homo sapiens
cccacccacctt

SEQ ID NO: 3821091 - DNA, 16 bp, Homo sapiens
cccacccccagccagg

SEQ ID NO: 3821092 - DNA, 13 bp, Homo sapiens
cccaccccctgcc

SEQ ID NO: 3821093 - DNA, 14 bp, Homo sapiens
cccaccccctgccc

SEQ ID NO: 3821094 - DNA, 19 bp, Homo sapiens
cccaccccctgccctgcac

SEQ ID NO: 3821095 - DNA, 22 bp, Homo sapiens
cccaccccgggctctcctgccc

SEQ ID NO: 3821096 - DNA, 22 bp, Homo sapiens
cccaccccgtccatggtgctaa

SEQ ID NO: 3821097 - DNA, 18 bp, Homo sapiens
cccaccgccctgcctctt

SEQ ID NO: 3821098 - DNA, 14 bp, Homo sapiens
cccacctccccacg

SEQ ID NO: 3821099 - DNA, 17 bp, Homo sapiens
cccacctccccacgccc

SEQ ID NO: 3821100 - DNA, 15 bp, Homo sapiens
cccacctctgtgacc

SEQ ID NO: 3821101 - DNA, 17 bp, Homo sapiens
cccacctctgtgacctc

SEQ ID NO: 3821102 - DNA, 22 bp, Homo sapiens
cccaccttccttgcgaccacca

SEQ ID NO: 3821103 - DNA, 16 bp, Homo sapiens
cccacgcccccatgca

SEQ ID NO: 3821104 - DNA, 15 bp, Homo sapiens
cccacggggtccccg

SEQ ID NO: 3821105 - DNA, 13 bp, Homo sapiens
cccactccagcag

SEQ ID NO: 3821106 - DNA, 22 bp, Homo sapiens
cccactgggagagtccttagcc

SEQ ID NO: 3821107 - DNA, 23 bp, Homo sapiens
cccactgggagagtccttagcct

SEQ ID NO: 3821108 - DNA, 13 bp, Homo sapiens
cccagacagggct

SEQ ID NO: 3821109 - DNA, 14 bp, Homo sapiens
cccagacagggctc

SEQ ID NO: 3821110 - DNA, 16 bp, Homo sapiens
cccagagatggctcct

SEQ ID NO: 3821111 - DNA, 17 bp, Homo sapiens
cccagaggtcacacagc

SEQ ID NO: 3821112 - DNA, 14 bp, Homo sapiens
cccagatctgtcct

SEQ ID NO: 3821113 - DNA, 18 bp, Homo sapiens
cccagatctgtcctgggg

SEQ ID NO: 3821114 - DNA, 14 bp, Homo sapiens
cccagcaccctctg

SEQ ID NO: 3821115 - DNA, 13 bp, Homo sapiens
cccagcccaggcc

SEQ ID NO: 3821116 - DNA, 16 bp, Homo sapiens
cccagcccaggcctgg

SEQ ID NO: 3821117 - DNA, 17 bp, Homo sapiens
cccagcccaggcctggt

SEQ ID NO: 3821118 - DNA, 18 bp, Homo sapiens
cccagcccaggcctggtg

SEQ ID NO: 3821119 - DNA, 15 bp, Homo sapiens
cccagccccggggtg

SEQ ID NO: 3821120 - DNA, 14 bp, Homo sapiens
cccagcccctagcc

SEQ ID NO: 3821121 - DNA, 17 bp, Homo sapiens
cccagcccctagcccag

SEQ ID NO: 3821122 - DNA, 20 bp, Homo sapiens
cccagcccctagcccaggag

SEQ ID NO: 3821123 - DNA, 22 bp, Homo sapiens
cccagcccctagcccaggagag

SEQ ID NO: 3821124 - DNA, 22 bp, Homo sapiens
cccagcctcagtcctcccctca

SEQ ID NO: 3821125 - DNA, 13 bp, Homo sapiens
cccagctgccagg

SEQ ID NO: 3821126 - DNA, 14 bp, Homo sapiens
cccagctgccaggg

SEQ ID NO: 3821127 - DNA, 17 bp, Homo sapiens
cccagctgtgagccttg

SEQ ID NO: 3821128 - DNA, 22 bp, Homo sapiens
cccaggacaccacacccagcct

SEQ ID NO: 3821129 - DNA, 16 bp, Homo sapiens
cccaggacctgagcct

SEQ ID NO: 3821130 - DNA, 24 bp, Homo sapiens
cccaggagaattaggaaggccatg

SEQ ID NO: 3821131 - DNA, 14 bp, Homo sapiens
cccaggagttctgc

SEQ ID NO: 3821132 - DNA, 17 bp, Homo sapiens
cccaggcagctcctgtt

SEQ ID NO: 3821133 - DNA, 13 bp, Homo sapiens
cccaggcgggagc

SEQ ID NO: 3821134 - DNA, 17 bp, Homo sapiens
cccaggctggcccccac

SEQ ID NO: 3821135 - DNA, 20 bp, Homo sapiens
cccagggagactccgctgtg

SEQ ID NO: 3821136 - DNA, 22 bp, Homo sapiens
cccagggtggacttagaaagca

SEQ ID NO: 3821137 - DNA, 14 bp, Homo sapiens
cccaggtaccagct

SEQ ID NO: 3821138 - DNA, 15 bp, Homo sapiens
cccaggtaccagctg

SEQ ID NO: 3821139 - DNA, 19 bp, Homo sapiens
cccaggtaccagctgcgct

SEQ ID NO: 3821140 - DNA, 14 bp, Homo sapiens
cccagtccccaccc

SEQ ID NO: 3821141 - DNA, 19 bp, Homo sapiens
cccagtccccacccctgcc

SEQ ID NO: 3821142 - DNA, 21 bp, Homo sapiens
cccagtccccacccctgcccc

SEQ ID NO: 3821143 - DNA, 13 bp, Homo sapiens
cccatctgcaccc

SEQ ID NO: 3821144 - DNA, 15 bp, Homo sapiens
cccatgctggagcct

SEQ ID NO: 3821145 - DNA, 20 bp, Homo sapiens
cccatgctggagcctgtgta

SEQ ID NO: 3821146 - DNA, 20 bp, Homo sapiens
cccatggctttgtgctgctg

SEQ ID NO: 3821147 - DNA, 12 bp, Homo sapiens
cccattcaccct

SEQ ID NO: 3821148 - DNA, 13 bp, Homo sapiens
cccattctacttg

SEQ ID NO: 3821149 - DNA, 17 bp, Homo sapiens
cccattctacttgctct

SEQ ID NO: 3821150 - DNA, 15 bp, Homo sapiens
cccatttatccacct

SEQ ID NO: 3821151 - DNA, 14 bp, Homo sapiens
cccatttcccatct

SEQ ID NO: 3821152 - DNA, 22 bp, Homo sapiens
ccccaacagcgacatagcccat

SEQ ID NO: 3821153 - DNA, 21 bp, Homo sapiens
ccccaacccaataaaactgat

SEQ ID NO: 3821154 - DNA, 19 bp, Homo sapiens
ccccaatttcccagactag

SEQ ID NO: 3821155 - DNA, 21 bp, Homo sapiens
ccaacatcatatacctcttga

SEQ ID NO: 3821156 - DNA, 20 bp, Homo sapiens
ccaacccaataaaactgatg

SEQ ID NO: 3821157 - DNA, 18 bp, Homo sapiens
ccaacctgtaataaatat

SEQ ID NO: 3821158 - DNA, 22 bp, Homo sapiens
ccaacctgtaataaatatgagt

SEQ ID NO: 3821159 - DNA, 19 bp, Homo sapiens
ccaactccagctgagtcct

SEQ ID NO: 3821160 - DNA, 20 bp, Homo sapiens
ccaactccagctgagtcctg

SEQ ID NO: 3821161 - DNA, 16 bp, Homo sapiens
ccaacttgtctctgta

SEQ ID NO: 3821162 - DNA, 20 bp, Homo sapiens
ccaacttgtctctgtagaag

SEQ ID NO: 3821163 - DNA, 23 bp, Homo sapiens
ccaagactccctcgtcgagctgg

SEQ ID NO: 3821164 - DNA, 15 bp, Homo sapiens
ccaagccctttgctg

SEQ ID NO: 3821165 - DNA, 13 bp, Homo sapiens
ccaagccggccca

SEQ ID NO: 3821166 - DNA, 23 bp, Homo sapiens
ccaagccggcccaacccaaccac

SEQ ID NO: 3821167 - DNA, 21 bp, Homo sapiens
ccaagctggggcaaggggcag

SEQ ID NO: 3821168 - DNA, 13 bp, Homo sapiens
ccaagggacacag

SEQ ID NO: 3821169 - DNA, 22 bp, Homo sapiens
ccaagggacacaggagaccacc

SEQ ID NO: 3821170 - DNA, 15 bp, Homo sapiens
ccaagtaagacatct

SEQ ID NO: 3821171 - DNA, 15 bp, Homo sapiens
ccaagtggggtgctg

SEQ ID NO: 3821172 - DNA, 15 bp, Homo sapiens
ccaataaaactgatg

SEQ ID NO: 3821173 - DNA, 17 bp, Homo sapiens
ccaatgggtttgccaag

SEQ ID NO: 3821174 - DNA, 22 bp, Homo sapiens
ccaatgtttattgggcaataaa

SEQ ID NO: 3821175 - DNA, 23 bp, Homo sapiens
ccacaaaattatgctgcatttgg

SEQ ID NO: 3821176 - DNA, 16 bp, Homo sapiens
ccacacagcccagaag

SEQ ID NO: 3821177 - DNA, 22 bp, Homo sapiens
ccacacagcccagaaggccaga

SEQ ID NO: 3821178 - DNA, 13 bp, Homo sapiens
ccacaccatctgg

SEQ ID NO: 3821179 - DNA, 22 bp, Homo sapiens
ccacaccatctggcccaggctg

SEQ ID NO: 3821180 - DNA, 15 bp, Homo sapiens
ccacacccagcctca

SEQ ID NO: 3821181 - DNA, 16 bp, Homo sapiens
ccacacccagcctcag

SEQ ID NO: 3821182 - DNA, 18 bp, Homo sapiens
ccacagagggctgtgtct

SEQ ID NO: 3821183 - DNA, 22 bp, Homo sapiens
ccacaggccctttcctcaggca

SEQ ID NO: 3821184 - DNA, 19 bp, Homo sapiens
ccacagggctcctgaagga

SEQ ID NO: 3821185 - DNA, 20 bp, Homo sapiens
ccacatatctagatttttct

SEQ ID NO: 3821186 - DNA, 13 bp, Homo sapiens
ccacatctgcctt

SEQ ID NO: 3821187 - DNA, 22 bp, Homo sapiens
ccacatctgccttaaaaccaaa

SEQ ID NO: 3821188 - DNA, 15 bp, Homo sapiens
ccaccaacacacagg

SEQ ID NO: 3821189 - DNA, 13 bp, Homo sapiens
ccaccacacactg

SEQ ID NO: 3821190 - DNA, 13 bp, Homo sapiens
ccaccacaccaaa

SEQ ID NO: 3821191 - DNA, 16 bp, Homo sapiens
ccaccactcctgcctg

SEQ ID NO: 3821192 - DNA, 14 bp, Homo sapiens
ccacccccagccag

SEQ ID NO: 3821193 - DNA, 20 bp, Homo sapiens
ccacccccgagcttgcctca

SEQ ID NO: 3821194 - DNA, 18 bp, Homo sapiens
ccaccccgggctctcctg

SEQ ID NO: 3821195 - DNA, 19 bp, Homo sapiens
ccaccccggggaccctgtg

SEQ ID NO: 3821196 - DNA, 21 bp, Homo sapiens
ccaccccggggaccctgtgac

SEQ ID NO: 3821197 - DNA, 17 bp, Homo sapiens
ccaccgacccttcctgg

SEQ ID NO: 3821198 - DNA, 15 bp, Homo sapiens
ccaccgccctgcctc

SEQ ID NO: 3821199 - DNA, 18 bp, Homo sapiens
ccacctccccacgccctc

SEQ ID NO: 3821200 - DNA, 23 bp, Homo sapiens
ccacctccccacgccctcccctc

SEQ ID NO: 3821201 - DNA, 20 bp, Homo sapiens
ccacctctgcggaccccagc

SEQ ID NO: 3821202 - DNA, 17 bp, Homo sapiens
ccacctctgtgacctca

SEQ ID NO: 3821203 - DNA, 17 bp, Homo sapiens
ccacgatttagatttaa

SEQ ID NO: 3821204 - DNA, 14 bp, Homo sapiens
ccacggtgttctgt

SEQ ID NO: 3821205 - DNA, 14 bp, Homo sapiens
ccactacacctggc

SEQ ID NO: 3821206 - DNA, 15 bp, Homo sapiens
ccactacacctggct

SEQ ID NO: 3821207 - DNA, 16 bp, Homo sapiens
ccactcggggccccca

SEQ ID NO: 3821208 - DNA, 15 bp, Homo sapiens
ccactgatttagcca

SEQ ID NO: 3821209 - DNA, 14 bp, Homo sapiens
ccactgctggtgtt

SEQ ID NO: 3821210 - DNA, 22 bp, Homo sapiens
ccactgctggtgtttatgtgaa

SEQ ID NO: 3821211 - DNA, 13 bp, Homo sapiens
ccacttctgtgta

SEQ ID NO: 3821212 - DNA, 17 bp, Homo sapiens
ccacttctgtgtagaca

SEQ ID NO: 3821213 - DNA, 18 bp, Homo sapiens
ccacttctgtgtagacat

SEQ ID NO: 3821214 - DNA, 19 bp, Homo sapiens
ccacttctgtgtagacatg

SEQ ID NO: 3821215 - DNA, 17 bp, Homo sapiens
ccacttggccaagcagg

SEQ ID NO: 3821216 - DNA, 17 bp, Homo sapiens
ccagaaaaggcagccag

SEQ ID NO: 3821217 - DNA, 20 bp, Homo sapiens
ccagaaaaggcagccagatc

SEQ ID NO: 3821218 - DNA, 22 bp, Homo sapiens
ccagaaaggtgattccaggagg

SEQ ID NO: 3821219 - DNA, 13 bp, Homo sapiens
ccagaaggccaga

SEQ ID NO: 3821220 - DNA, 14 bp, Homo sapiens
ccagaaggccagaa

SEQ ID NO: 3821221 - DNA, 20 bp, Homo sapiens
ccagaagtcaagcccagcca

SEQ ID NO: 3821222 - DNA, 13 bp, Homo sapiens
ccagacagggctc

SEQ ID NO: 3821223 - DNA, 14 bp, Homo sapiens
ccagacagggctcc

SEQ ID NO: 3821224 - DNA, 13 bp, Homo sapiens
ccagactccaggc

SEQ ID NO: 3821225 - DNA, 21 bp, Homo sapiens
ccagactccgcctgaggccag

SEQ ID NO: 3821226 - DNA, 16 bp, Homo sapiens
ccagagatggctcctt

SEQ ID NO: 3821227 - DNA, 12 bp, Homo sapiens
ccagagctcctg

SEQ ID NO: 3821228 - DNA, 16 bp, Homo sapiens
ccagagctgcctatgc

SEQ ID NO: 3821229 - DNA, 16 bp, Homo sapiens
ccagaggccaggatgc

SEQ ID NO: 3821230 - DNA, 23 bp, Homo sapiens
ccagaggtcacacagcctgtgtg

SEQ ID NO: 3821231 - DNA, 15 bp, Homo sapiens
ccagagttgggggct

SEQ ID NO: 3821232 - DNA, 23 bp, Homo sapiens
ccagagttgggggctaggggagg

SEQ ID NO: 3821233 - DNA, 15 bp, Homo sapiens
ccagatccccagggc

SEQ ID NO: 3821234 - DNA, 17 bp, Homo sapiens
ccagatccccagggcag

SEQ ID NO: 3821235 - DNA, 16 bp, Homo sapiens
ccagatctgtcctggg

SEQ ID NO: 3821236 - DNA, 22 bp, Homo sapiens
ccagatttatgcatattatttt

SEQ ID NO: 3821237 - DNA, 15 bp, Homo sapiens
ccagcacagctgagg

SEQ ID NO: 3821238 - DNA, 20 bp, Homo sapiens
ccagcacgcgacttctcagg

SEQ ID NO: 3821239 - DNA, 17 bp, Homo sapiens
ccagcagataaggccga

SEQ ID NO: 3821240 - DNA, 19 bp, Homo sapiens
ccagcattttgagaggctg

SEQ ID NO: 3821241 - DNA, 18 bp, Homo sapiens
ccagccaccccgcagtca

SEQ ID NO: 3821242 - DNA, 14 bp, Homo sapiens
ccagcccaggcctg

SEQ ID NO: 3821243 - DNA, 23 bp, Homo sapiens
ccagcccctagcccaggagagag

SEQ ID NO: 3821244 - DNA, 12 bp, Homo sapiens
ccagccctggct

SEQ ID NO: 3821245 - DNA, 15 bp, Homo sapiens
ccagccctggcttcc

SEQ ID NO: 3821246 - DNA, 11 bp, Homo sapiens
ccagcctcagt

SEQ ID NO: 3821247 - DNA, 21 bp, Homo sapiens
ccagcctcagtcctcccctca

SEQ ID NO: 3821248 - DNA, 11 bp, Homo sapiens
ccagcctcctc

SEQ ID NO: 3821249 - DNA, 17 bp, Homo sapiens
ccagctatttttactag

SEQ ID NO: 3821250 - DNA, 21 bp, Homo sapiens
ccagctatttttactagaaca

SEQ ID NO: 3821251 - DNA, 20 bp, Homo sapiens
ccagctcctccgtgcttcct

SEQ ID NO: 3821252 - DNA, 22 bp, Homo sapiens
ccagctcctcgtctttgaactg

SEQ ID NO: 3821253 - DNA, 15 bp, Homo sapiens
ccagctgagtcctgg

SEQ ID NO: 3821254 - DNA, 16 bp, Homo sapiens
ccagctgagtcctggg

SEQ ID NO: 3821255 - DNA, 22 bp, Homo sapiens
ccagctgatgactcaagattcc

SEQ ID NO: 3821256 - DNA, 12 bp, Homo sapiens
ccagctgccagg

SEQ ID NO: 3821257 - DNA, 15 bp, Homo sapiens
ccagctgccagggaa

SEQ ID NO: 3821258 - DNA, 22 bp, Homo sapiens
ccagctgccagggaagacagag

SEQ ID NO: 3821259 - DNA, 23 bp, Homo sapiens
ccagctgccagggaagacagagc

SEQ ID NO: 3821260 - DNA, 23 bp, Homo sapiens
ccagctgggctagaggctgagca

SEQ ID NO: 3821261 - DNA, 14 bp, Homo sapiens
ccagctgtgagcct

SEQ ID NO: 3821262 - DNA, 20 bp, Homo sapiens
ccagctgtgagccttggctg

SEQ ID NO: 3821263 - DNA, 20 bp, Homo sapiens
ccaggaaaatgtgaggggaa

SEQ ID NO: 3821264 - DNA, 19 bp, Homo sapiens
ccaggaaactccacatctg

SEQ ID NO: 3821265 - DNA, 20 bp, Homo sapiens
ccaggacaccacacccagcc

SEQ ID NO: 3821266 - DNA, 21 bp, Homo sapiens
ccaggacaccacacccagcct

SEQ ID NO: 3821267 - DNA, 22 bp, Homo sapiens
ccaggacaccacacccagcctc

SEQ ID NO: 3821268 - DNA, 13 bp, Homo sapiens
ccaggacctgagc

SEQ ID NO: 3821269 - DNA, 13 bp, Homo sapiens
ccaggactgagcc

SEQ ID NO: 3821270 - DNA, 21 bp, Homo sapiens
ccaggagagagaaagccaggc

SEQ ID NO: 3821271 - DNA, 17 bp, Homo sapiens
ccaggagctgctcacta

SEQ ID NO: 3821272 - DNA, 19 bp, Homo sapiens
ccaggaggagttagccaaa

SEQ ID NO: 3821273 - DNA, 20 bp, Homo sapiens
ccaggatgcctgagccccct

SEQ ID NO: 3821274 - DNA, 22 bp, Homo sapiens
ccaggcaggggtgggggtggag

SEQ ID NO: 3821275 - DNA, 13 bp, Homo sapiens
ccaggccagcctc

SEQ ID NO: 3821276 - DNA, 20 bp, Homo sapiens
ccaggccgggcacagtggct

SEQ ID NO: 3821277 - DNA, 21 bp, Homo sapiens
ccaggccgtttgctttttcag

SEQ ID NO: 3821278 - DNA, 21 bp, Homo sapiens
ccaggcgggagcggtggccct

SEQ ID NO: 3821279 - DNA, 19 bp, Homo sapiens
ccaggctatggttgccacc

SEQ ID NO: 3821280 - DNA, 23 bp, Homo sapiens
ccaggctatggttgccaccccaa

SEQ ID NO: 3821281 - DNA, 21 bp, Homo sapiens
ccaggctggagtgcagtggct

SEQ ID NO: 3821282 - DNA, 17 bp, Homo sapiens
ccaggctggcccccacc

SEQ ID NO: 3821283 - DNA, 21 bp, Homo sapiens
ccaggctggcccccacccacc

SEQ ID NO: 3821284 - DNA, 23 bp, Homo sapiens
ccaggctggcccccacccacctt

SEQ ID NO: 3821285 - DNA, 13 bp, Homo sapiens
ccaggctgggagg

SEQ ID NO: 3821286 - DNA, 17 bp, Homo sapiens
ccagggaaatgcctcga

SEQ ID NO: 3821287 - DNA, 17 bp, Homo sapiens
ccagggaagacagagca

SEQ ID NO: 3821288 - DNA, 18 bp, Homo sapiens
ccagggaagacagagcag

SEQ ID NO: 3821289 - DNA, 22 bp, Homo sapiens
ccagggagactccgctgtggga

SEQ ID NO: 3821290 - DNA, 17 bp, Homo sapiens
cataatatattgtgttt

SEQ ID NO: 3821291 - DNA, 22 bp, Homo sapiens
cataatatattgtgttttaaca

SEQ ID NO: 3821292 - DNA, 14 bp, Homo sapiens
ctgacacctttaaa

SEQ ID NO: 3821293 - DNA, 22 bp, Homo sapiens
ctgacagggcccagttaaatat

SEQ ID NO: 3821294 - DNA, 13 bp, Homo sapiens
ctgacccaataaa

SEQ ID NO: 3821295 - DNA, 19 bp, Homo sapiens
ctgaccttcacccagagct

SEQ ID NO: 3821296 - DNA, 22 bp, Homo sapiens
ctgaccttcacccagagctgcc

SEQ ID NO: 3821297 - DNA, 13 bp, Homo sapiens
ctgactttcattt

SEQ ID NO: 3821298 - DNA, 14 bp, Homo sapiens
ctgagaaatttata

SEQ ID NO: 3821299 - DNA, 13 bp, Homo sapiens
ctgagaggcaggc

SEQ ID NO: 3821300 - DNA, 15 bp, Homo sapiens
ctgagaggcaggcat

SEQ ID NO: 3821301 - DNA, 19 bp, Homo sapiens
ctgagatgaggttttggaa

SEQ ID NO: 3821302 - DNA, 13 bp, Homo sapiens
ctgagccccctga

SEQ ID NO: 3821303 - DNA, 18 bp, Homo sapiens
ctgagccccgcagacctc

SEQ ID NO: 3821304 - DNA, 19 bp, Homo sapiens
ctgagctagtgtcacctgc

SEQ ID NO: 3821305 - DNA, 13 bp, Homo sapiens
ctgagctggcctc

SEQ ID NO: 3821306 - DNA, 22 bp, Homo sapiens
ctgagcttcccccccaccacag

SEQ ID NO: 3821307 - DNA, 13 bp, Homo sapiens
ctgaggaataaag

SEQ ID NO: 3821308 - DNA, 20 bp, Homo sapiens
ctgaggaccctcagccccag

SEQ ID NO: 3821309 - DNA, 21 bp, Homo sapiens
ctgaggaccctcagccccagg

SEQ ID NO: 3821310 - DNA, 14 bp, Homo sapiens
ctgaggagggccct

SEQ ID NO: 3821311 - DNA, 21 bp, Homo sapiens
ctgaggagggccctgaggaat

SEQ ID NO: 3821312 - DNA, 20 bp, Homo sapiens
ctgaggctcagccctgagct

SEQ ID NO: 3821313 - DNA, 12 bp, Homo sapiens
ctgagggctgat

SEQ ID NO: 3821314 - DNA, 19 bp, Homo sapiens
ctgagggctgatctttaac

SEQ ID NO: 3821315 - DNA, 13 bp, Homo sapiens
ctgaggtctggct

SEQ ID NO: 3821316 - DNA, 14 bp, Homo sapiens
ctgaggtctggctg

SEQ ID NO: 3821317 - DNA, 14 bp, Homo sapiens
ctgaggttcctctg

SEQ ID NO: 3821318 - DNA, 18 bp, Homo sapiens
ctgaggttcctctgcctg

SEQ ID NO: 3821319 - DNA, 19 bp, Homo sapiens
ctgaggttcctctgcctgc

SEQ ID NO: 3821320 - DNA, 13 bp, Homo sapiens
ctgagtcctgggg

SEQ ID NO: 3821321 - DNA, 22 bp, Homo sapiens
ctgagttcccaaagggagggtg

SEQ ID NO: 3821322 - DNA, 19 bp, Homo sapiens
ctgagttggcatcacctgc

SEQ ID NO: 3821323 - DNA, 22 bp, Homo sapiens
ctgagttggcatcacctgcgca

SEQ ID NO: 3821324 - DNA, 23 bp, Homo sapiens
ctgatctttaactggaaggctgc

SEQ ID NO: 3821325 - DNA, 20 bp, Homo sapiens
ctgattcccgcatggttttt

SEQ ID NO: 3821326 - DNA, 12 bp, Homo sapiens
ctgcaagcctgc

SEQ ID NO: 3821327 - DNA, 13 bp, Homo sapiens
ctgcaagcctgcg

SEQ ID NO: 3821328 - DNA, 14 bp, Homo sapiens
ctgcaagcctgcgt

SEQ ID NO: 3821329 - DNA, 12 bp, Homo sapiens
ctgcacctctcc

SEQ ID NO: 3821330 - DNA, 17 bp, Homo sapiens
ctgcaggggctctggag

SEQ ID NO: 3821331 - DNA, 19 bp, Homo sapiens
ctgcaggggctctggagag

SEQ ID NO: 3821332 - DNA, 18 bp, Homo sapiens
ctgcagtaatctccaggg

SEQ ID NO: 3821333 - DNA, 21 bp, Homo sapiens
ctgcagtaatctccagggcct

SEQ ID NO: 3821334 - DNA, 14 bp, Homo sapiens
ctgcatttggctgg

SEQ ID NO: 3821335 - DNA, 17 bp, Homo sapiens
ctgcattttaagcataa

SEQ ID NO: 3821336 - DNA, 22 bp, Homo sapiens
ctgcattttcacaacatatcag

SEQ ID NO: 3821337 - DNA, 15 bp, Homo sapiens
ctgccaccagagacc

SEQ ID NO: 3821338 - DNA, 20 bp, Homo sapiens
ctgccaggccagcctccgag

SEQ ID NO: 3821339 - DNA, 22 bp, Homo sapiens
ctgccaggccagcctccgagag

SEQ ID NO: 3821340 - DNA, 23 bp, Homo sapiens
ctgccaggccagcctccgagagg

SEQ ID NO: 3821341 - DNA, 19 bp, Homo sapiens
ctgccagggaagacagagc

SEQ ID NO: 3821342 - DNA, 14 bp, Homo sapiens
ctgcccccacaccc

SEQ ID NO: 3821343 - DNA, 15 bp, Homo sapiens
ctgcccccaccccgg

SEQ ID NO: 3821344 - DNA, 22 bp, Homo sapiens
ctgcccccgcatcccctgcctc

SEQ ID NO: 3821345 - DNA, 23 bp, Homo sapiens
ctgcccccgcatcccctgcctcc

SEQ ID NO: 3821346 - DNA, 15 bp, Homo sapiens
ctgcccctgccctga

SEQ ID NO: 3821347 - DNA, 17 bp, Homo sapiens
ctgcccctgccctgagg

SEQ ID NO: 3821348 - DNA, 19 bp, Homo sapiens
ctgcccctgccctgaggag

SEQ ID NO: 3821349 - DNA, 21 bp, Homo sapiens
ctgccctccatcccttcccca

SEQ ID NO: 3821350 - DNA, 16 bp, Homo sapiens
ctgccctggctgctgc

SEQ ID NO: 3821351 - DNA, 17 bp, Homo sapiens
ctgcctactgcccctgc

SEQ ID NO: 3821352 - DNA, 23 bp, Homo sapiens
ctgcctactgcccctgccctgag

SEQ ID NO: 3821353 - DNA, 13 bp, Homo sapiens
ctgcctccatcct

SEQ ID NO: 3821354 - DNA, 14 bp, Homo sapiens
ctgcctcccaaagt

SEQ ID NO: 3821355 - DNA, 22 bp, Homo sapiens
ctgcctccccggaagtgcctta

SEQ ID NO: 3821356 - DNA, 23 bp, Homo sapiens
ctgcctcctcctgagagctgttc

SEQ ID NO: 3821357 - DNA, 14 bp, Homo sapiens
ctatttaacttgag

SEQ ID NO: 3821358 - DNA, 15 bp, Homo sapiens
ctatttctacctcac

SEQ ID NO: 3821359 - DNA, 16 bp, Homo sapiens
ctattttcattttctg

SEQ ID NO: 3821360 - DNA, 18 bp, Homo sapiens
ctatttttactagaacac

SEQ ID NO: 3821361 - DNA, 13 bp, Homo sapiens
ctcaaacgtggct

SEQ ID NO: 3821362 - DNA, 19 bp, Homo sapiens
ctcaaagcaagctcttctc

SEQ ID NO: 3821363 - DNA, 20 bp, Homo sapiens
ctcaaatacagtagtataat

SEQ ID NO: 3821364 - DNA, 16 bp, Homo sapiens
ctcaaccttgtaaatt

SEQ ID NO: 3821365 - DNA, 23 bp, Homo sapiens
ctcaaccttgtaaattccccttc

SEQ ID NO: 3821366 - DNA, 21 bp, Homo sapiens
ctcaagaccctcgagattaac

SEQ ID NO: 3821367 - DNA, 19 bp, Homo sapiens
ctcaatcctaatttctcct

SEQ ID NO: 3821368 - DNA, 23 bp, Homo sapiens
ctcaatcctaatttctcctccct

SEQ ID NO: 3821369 - DNA, 17 bp, Homo sapiens
ctcaatgggggggcggc

SEQ ID NO: 3821370 - DNA, 21 bp, Homo sapiens
ctcacagcctctgacccctcc

SEQ ID NO: 3821371 - DNA, 22 bp, Homo sapiens
ctcacagcctctgacccctcct

SEQ ID NO: 3821372 - DNA, 23 bp, Homo sapiens
ctcacattcccccggtgcctctc

SEQ ID NO: 3821373 - DNA, 15 bp, Homo sapiens
ctcacccctgtcctc

SEQ ID NO: 3821374 - DNA, 21 bp, Homo sapiens
ctcacccctgtcctcactgct

SEQ ID NO: 3821375 - DNA, 23 bp, Homo sapiens
ctcacctcatgcccaccccctgc

SEQ ID NO: 3821376 - DNA, 20 bp, Homo sapiens
ctcacctgggttccccaccc

SEQ ID NO: 3821377 - DNA, 14 bp, Homo sapiens
ctcactcttgccaa

SEQ ID NO: 3821378 - DNA, 18 bp, Homo sapiens
ctcactgccaggccagcc

SEQ ID NO: 3821379 - DNA, 20 bp, Homo sapiens
ctcactgccaggccagcctc

SEQ ID NO: 3821380 - DNA, 21 bp, Homo sapiens
ctcactgccaggccagcctcc

SEQ ID NO: 3821381 - DNA, 17 bp, Homo sapiens
ctcactgctccctgaag

SEQ ID NO: 3821382 - DNA, 21 bp, Homo sapiens
ctcactggccatccctcgtgg

SEQ ID NO: 3821383 - DNA, 15 bp, Homo sapiens
ctcactttggttttg

SEQ ID NO: 3821384 - DNA, 12 bp, Homo sapiens
ctcagagagtac

SEQ ID NO: 3821385 - DNA, 23 bp, Homo sapiens
ctcagatgatggggtcagcaggc

SEQ ID NO: 3821386 - DNA, 15 bp, Homo sapiens
ctcagatttaaaaca

SEQ ID NO: 3821387 - DNA, 16 bp, Homo sapiens
ctcagcatgtagggct

SEQ ID NO: 3821388 - DNA, 22 bp, Homo sapiens
ctcagcatgtagggcttctgtg

SEQ ID NO: 3821389 - DNA, 14 bp, Homo sapiens
ctcagccctgagct

SEQ ID NO: 3821390 - DNA, 15 bp, Homo sapiens
ctcagccctgagctg

SEQ ID NO: 3821391 - DNA, 22 bp, Homo sapiens
ctcagccctgagctggcgtcac

SEQ ID NO: 3821392 - DNA, 14 bp, Homo sapiens
ctcagccctggagg

SEQ ID NO: 3821393 - DNA, 18 bp, Homo sapiens
ctcagccctggaggtgcc

SEQ ID NO: 3821394 - DNA, 12 bp, Homo sapiens
ctcagctgcttc

SEQ ID NO: 3821395 - DNA, 14 bp, Homo sapiens
ctcagcttgtgcct

SEQ ID NO: 3821396 - DNA, 18 bp, Homo sapiens
ctcagcttgtgccttgta

SEQ ID NO: 3821397 - DNA, 17 bp, Homo sapiens
ctcaggctggtgggagg

SEQ ID NO: 3821398 - DNA, 16 bp, Homo sapiens
ctcagggccaagccgg

SEQ ID NO: 3821399 - DNA, 17 bp, Homo sapiens
ctcagggccaagccggc

SEQ ID NO: 3821400 - DNA, 18 bp, Homo sapiens
ctcagggccaagccggcc

SEQ ID NO: 3821401 - DNA, 21 bp, Homo sapiens
ctcagtcctcccctcacagcc

SEQ ID NO: 3821402 - DNA, 14 bp, Homo sapiens
ctcatctgacctta

SEQ ID NO: 3821403 - DNA, 14 bp, Homo sapiens
ctcatgaagccctt

SEQ ID NO: 3821404 - DNA, 16 bp, Homo sapiens
ctcatgcccaccccct

SEQ ID NO: 3821405 - DNA, 23 bp, Homo sapiens
ctcatgcccaccccctgccctgc

SEQ ID NO: 3821406 - DNA, 20 bp, Homo sapiens
ctcatggtgaaatctgctct

SEQ ID NO: 3821407 - DNA, 15 bp, Homo sapiens
ctcatgtctctttgg

SEQ ID NO: 3821408 - DNA, 14 bp, Homo sapiens
ctcattctaatgat

SEQ ID NO: 3821409 - DNA, 14 bp, Homo sapiens
ctcattttgttttt

SEQ ID NO: 3821410 - DNA, 16 bp, Homo sapiens
ctccaaagtctctgga

SEQ ID NO: 3821411 - DNA, 17 bp, Homo sapiens
ctccacatctgccttaa

SEQ ID NO: 3821412 - DNA, 23 bp, Homo sapiens
ctccagcacgcgacttctcagga

SEQ ID NO: 3821413 - DNA, 23 bp, Homo sapiens
ctccagctcctcccacggggtcc

SEQ ID NO: 3821414 - DNA, 15 bp, Homo sapiens
ctccagctgagtcct

SEQ ID NO: 3821415 - DNA, 10 bp, Homo sapiens
ctccaggccc

SEQ ID NO: 3821416 - DNA, 18 bp, Homo sapiens
ctccagtctgctctcagc

SEQ ID NO: 3821417 - DNA, 19 bp, Homo sapiens
ctccagtctgctctcagct

SEQ ID NO: 3821418 - DNA, 24 bp, Homo sapiens
ctccagtctgctctcagcttgtgc

SEQ ID NO: 3821419 - DNA, 16 bp, Homo sapiens
ctccatcccttcccca

SEQ ID NO: 3821420 - DNA, 17 bp, Homo sapiens
ctccatcccttccccag

SEQ ID NO: 3821421 - DNA, 21 bp, Homo sapiens
ctccatcctttctgcctctca

SEQ ID NO: 3821422 - DNA, 22 bp, Homo sapiens
ctccatcctttctgcctctcaa

SEQ ID NO: 3821423 - DNA, 18 bp, Homo sapiens
ctccatgcccccgccacc

SEQ ID NO: 3821424 - DNA, 20 bp, Homo sapiens
ctccatgcccccgccacctc

SEQ ID NO: 3821425 - DNA, 15 bp, Homo sapiens
ctcccacctctgtga

SEQ ID NO: 3821426 - DNA, 17 bp, Homo sapiens
ctcccacctctgtgacc

SEQ ID NO: 3821427 - DNA, 21 bp, Homo sapiens
ctcccacctctgtgacctcag

SEQ ID NO: 3821428 - DNA, 15 bp, Homo sapiens
ctcccacttggccaa

SEQ ID NO: 3821429 - DNA, 22 bp, Homo sapiens
ctcccacttggccaagcaggga

SEQ ID NO: 3821430 - DNA, 19 bp, Homo sapiens
ctcccaggggctggcttca

SEQ ID NO: 3821431 - DNA, 18 bp, Homo sapiens
ctcccaggtaccagctgc

SEQ ID NO: 3821432 - DNA, 19 bp, Homo sapiens
ctcccaggtaccagctgcg

SEQ ID NO: 3821433 - DNA, 22 bp, Homo sapiens
ctcccaggtaccagctgcgctt

SEQ ID NO: 3821434 - DNA, 19 bp, Homo sapiens
ctccccacgcccccatgca

SEQ ID NO: 3821435 - DNA, 15 bp, Homo sapiens
ctccccactccagca

SEQ ID NO: 3821436 - DNA, 11 bp, Homo sapiens
ctccccagagg

SEQ ID NO: 3821437 - DNA, 19 bp, Homo sapiens
ctccccagatctgtcctgg

SEQ ID NO: 3821438 - DNA, 20 bp, Homo sapiens
ctccccagatctgtcctggg

SEQ ID NO: 3821439 - DNA, 11 bp, Homo sapiens
ctccccagccc

SEQ ID NO: 3821440 - DNA, 21 bp, Homo sapiens
ctccccagcccctagcccagg

SEQ ID NO: 3821441 - DNA, 15 bp, Homo sapiens
ctccccagctcctcg

SEQ ID NO: 3821442 - DNA, 23 bp, Homo sapiens
ctccccatcgccagctgatgact

SEQ ID NO: 3821443 - DNA, 13 bp, Homo sapiens
ctcccctcacagc

SEQ ID NO: 3821444 - DNA, 14 bp, Homo sapiens
ctcccctcacagcc

SEQ ID NO: 3821445 - DNA, 16 bp, Homo sapiens
ctcccctcacagcctc

SEQ ID NO: 3821446 - DNA, 17 bp, Homo sapiens
ctcccctcccctgctgc

SEQ ID NO: 3821447 - DNA, 15 bp, Homo sapiens
ctcccctgctgcagg

SEQ ID NO: 3821448 - DNA, 18 bp, Homo sapiens
ctcccctgctgcaggggc

SEQ ID NO: 3821449 - DNA, 22 bp, Homo sapiens
ctcccgtactgtctgtgtcctt

SEQ ID NO: 3821450 - DNA, 15 bp, Homo sapiens
ctccctcctgcctgc

SEQ ID NO: 3821451 - DNA, 17 bp, Homo sapiens
ctccctcgtcgagctgg

SEQ ID NO: 3821452 - DNA, 18 bp, Homo sapiens
ctccctgaagccagcctt

SEQ ID NO: 3821453 - DNA, 19 bp, Homo sapiens
ctcccttccttttccctgc

SEQ ID NO: 3821454 - DNA, 14 bp, Homo sapiens
ctccgagagggaga

SEQ ID NO: 3821455 - DNA, 16 bp, Homo sapiens
ctccgagagggagaga

SEQ ID NO: 3821456 - DNA, 14 bp, Homo sapiens
ctccgccagcctcc

SEQ ID NO: 3821457 - DNA, 18 bp, Homo sapiens
ctccgccagcctcctctg

SEQ ID NO: 3821458 - DNA, 13 bp, Homo sapiens
ctccgcctgaggc

SEQ ID NO: 3821459 - DNA, 16 bp, Homo sapiens
ctccggcctgcactcc

SEQ ID NO: 3821460 - DNA, 15 bp, Homo sapiens
ctccggggctcagcc

SEQ ID NO: 3821461 - DNA, 19 bp, Homo sapiens
ctccgggtgtagattccct

SEQ ID NO: 3821462 - DNA, 21 bp, Homo sapiens
ctccgggtgtagattcccttg

SEQ ID NO: 3821463 - DNA, 23 bp, Homo sapiens
ctccgggtgtagattcccttgca

SEQ ID NO: 3821464 - DNA, 13 bp, Homo sapiens
ctcctagctggag

SEQ ID NO: 3821465 - DNA, 20 bp, Homo sapiens
ctcctcacctcatgcccacc

SEQ ID NO: 3821466 - DNA, 18 bp, Homo sapiens
ctcctcactggccatccc

SEQ ID NO: 3821467 - DNA, 14 bp, Homo sapiens
ctcctcagcttggg

SEQ ID NO: 3821468 - DNA, 22 bp, Homo sapiens
ctcctcagggatggccgttggc

SEQ ID NO: 3821469 - DNA, 13 bp, Homo sapiens
ctcctcccttcct

SEQ ID NO: 3821470 - DNA, 15 bp, Homo sapiens
ctcctcccttccttt

SEQ ID NO: 3821471 - DNA, 12 bp, Homo sapiens
ctcctcctagct

SEQ ID NO: 3821472 - DNA, 13 bp, Homo sapiens
ctcctgccctgcc

SEQ ID NO: 3821473 - DNA, 19 bp, Homo sapiens
ctcctgccctgccctcctg

SEQ ID NO: 3821474 - DNA, 16 bp, Homo sapiens
ctcctgcctcagcctc

SEQ ID NO: 3821475 - DNA, 20 bp, Homo sapiens
ctcctgcctgcccccacacc

SEQ ID NO: 3821476 - DNA, 21 bp, Homo sapiens
ctcctgcctgcgcagctcctt

SEQ ID NO: 3821477 - DNA, 14 bp, Homo sapiens
ctcctgggcacccc

SEQ ID NO: 3821478 - DNA, 21 bp, Homo sapiens
ctcctgggcaccccaggcagc

SEQ ID NO: 3821479 - DNA, 18 bp, Homo sapiens
ctcctgtttggaaatggg

SEQ ID NO: 3821480 - DNA, 14 bp, Homo sapiens
ctccttgggaggaa

SEQ ID NO: 3821481 - DNA, 22 bp, Homo sapiens
ctccttgggaggaagcagaata

SEQ ID NO: 3821482 - DNA, 18 bp, Homo sapiens
ctcctttttatgttgcca

SEQ ID NO: 3821483 - DNA, 14 bp, Homo sapiens
ctcgctctctgtct

SEQ ID NO: 3821484 - DNA, 18 bp, Homo sapiens
ctcggagtgtggcctgga

SEQ ID NO: 3821485 - DNA, 14 bp, Homo sapiens
ctcggccccgtctc

SEQ ID NO: 3821486 - DNA, 20 bp, Homo sapiens
ctcggccgccgactggacgc

SEQ ID NO: 3821487 - DNA, 12 bp, Homo sapiens
ctcggggccccc

SEQ ID NO: 3821488 - DNA, 19 bp, Homo sapiens
ctcggggcctgtgccgcac

SEQ ID NO: 3821489 - DNA, 14 bp, Homo sapiens
ctcggggctcccca

SEQ ID NO: 3821490 - DNA, 15 bp, Homo sapiens
ctcggggctccccac

SEQ ID NO: 3821491 - DNA, 14 bp, Homo sapiens
ctctaacaaatgat

SEQ ID NO: 3821492 - DNA, 13 bp, Homo sapiens
ctctaagatgaat

SEQ ID NO: 3821493 - DNA, 22 bp, Homo sapiens
cgctctaggcagaagaagctgg

SEQ ID NO: 3821494 - DNA, 16 bp, Homo sapiens
cgctctcatgaagccc

SEQ ID NO: 3821495 - DNA, 21 bp, Homo sapiens
cgctctctgtctccaggcagt

SEQ ID NO: 3821496 - DNA, 21 bp, Homo sapiens
cgctgattcctaaggcccagc

SEQ ID NO: 3821497 - DNA, 22 bp, Homo sapiens
cgctgattcctaaggcccagct

SEQ ID NO: 3821498 - DNA, 18 bp, Homo sapiens
cgctgctgcgccctgggc

SEQ ID NO: 3821499 - DNA, 14 bp, Homo sapiens
cgctggctgcactc

SEQ ID NO: 3821500 - DNA, 12 bp, Homo sapiens
cggaccccagct

SEQ ID NO: 3821501 - DNA, 20 bp, Homo sapiens
cggaccccagctgtgagcct

SEQ ID NO: 3821502 - DNA, 14 bp, Homo sapiens
cggagtgtggcctg

SEQ ID NO: 3821503 - DNA, 15 bp, Homo sapiens
cggagtgtggcctgg

SEQ ID NO: 3821504 - DNA, 13 bp, Homo sapiens
cggccacacccca

SEQ ID NO: 3821505 - DNA, 16 bp, Homo sapiens
cggccacaccccagac

SEQ ID NO: 3821506 - DNA, 22 bp, Homo sapiens
cggccacaccccagactccagg

SEQ ID NO: 3821507 - DNA, 14 bp, Homo sapiens
cggcccaacccaac

SEQ ID NO: 3821508 - DNA, 20 bp, Homo sapiens
cgggaacctcactcttgcca

SEQ ID NO: 3821509 - DNA, 14 bp, Homo sapiens
cgggcacagtggct

SEQ ID NO: 3821510 - DNA, 15 bp, Homo sapiens
cgggcccctgggctt

SEQ ID NO: 3821511 - DNA, 14 bp, Homo sapiens
cggggaccctgtga

SEQ ID NO: 3821512 - DNA, 14 bp, Homo sapiens
cggggctgaagcca

SEQ ID NO: 3821513 - DNA, 22 bp, Homo sapiens
cggggtcccaggacctgagcct

SEQ ID NO: 3821514 - DNA, 23 bp, Homo sapiens
cggggtcccaggacctgagcctg

SEQ ID NO: 3821515 - DNA, 23 bp, Homo sapiens
cggggtgagtccattctcccagg

SEQ ID NO: 3821516 - DNA, 15 bp, Homo sapiens
cgggtcccagctact

SEQ ID NO: 3821517 - DNA, 23 bp, Homo sapiens
cgggtgtagattcccttgcactg

SEQ ID NO: 3821518 - DNA, 14 bp, Homo sapiens
cggtcatgaaggag

SEQ ID NO: 3821519 - DNA, 11 bp, Homo sapiens
cggtctcaggc

SEQ ID NO: 3821520 - DNA, 14 bp, Homo sapiens
cggtgcttgcagta

SEQ ID NO: 3821521 - DNA, 19 bp, Homo sapiens
cggttccctccccagctcc

SEQ ID NO: 3821522 - DNA, 16 bp, Homo sapiens
cgtacattatgtgttt

SEQ ID NO: 3821523 - DNA, 18 bp, Homo sapiens
cgtctgctcctccctccc

SEQ ID NO: 3821524 - DNA, 21 bp, Homo sapiens
cgtggtccccaacagcgacat

SEQ ID NO: 3821525 - DNA, 17 bp, Homo sapiens
cgtgtgacctataattt

SEQ ID NO: 3821526 - DNA, 21 bp, Homo sapiens
cgtgtgtgggtggatataaat

SEQ ID NO: 3821527 - DNA, 23 bp, Homo sapiens
cgtgtgtgggtggatataaatat

SEQ ID NO: 3821528 - DNA, 12 bp, Homo sapiens
cgtgtgtgtgcg

SEQ ID NO: 3821529 - DNA, 18 bp, Homo sapiens
cgtgttgtgttctttata

SEQ ID NO: 3821530 - DNA, 19 bp, Homo sapiens
cgtgttgtgttctttataa

SEQ ID NO: 3821531 - DNA, 21 bp, Homo sapiens
cgttaggacaaggctgtgcca

SEQ ID NO: 3821532 - DNA, 23 bp, Homo sapiens
cgttaggacaaggctgtgccagg

SEQ ID NO: 3821533 - DNA, 22 bp, Homo sapiens
cgtttcagtgtcaaataaacac

SEQ ID NO: 3821534 - DNA, 12 bp, Homo sapiens
ctaaaaacaaaa

SEQ ID NO: 3821535 - DNA, 15 bp, Homo sapiens
ctaaaacattgtcta

SEQ ID NO: 3821536 - DNA, 20 bp, Homo sapiens
ctaaaagattttgtgaaatt

SEQ ID NO: 3821537 - DNA, 21 bp, Homo sapiens
ctaaaagattttgtgaaattt

SEQ ID NO: 3821538 - DNA, 15 bp, Homo sapiens
ctaaagaaaaaataa

SEQ ID NO: 3821539 - DNA, 22 bp, Homo sapiens
ctaaagacctgctgtaataaat

SEQ ID NO: 3821540 - DNA, 15 bp, Homo sapiens
ctaaagagcccttgc

SEQ ID NO: 3821541 - DNA, 17 bp, Homo sapiens
ctaaagagcccttgcct

SEQ ID NO: 3821542 - DNA, 19 bp, Homo sapiens
ctaaagagcccttgcctcc

SEQ ID NO: 3821543 - DNA, 21 bp, Homo sapiens
ctaaagagcccttgcctcccc

SEQ ID NO: 3821544 - DNA, 23 bp, Homo sapiens
ctaaagtaaaaacaaagaaatta

SEQ ID NO: 3821545 - DNA, 19 bp, Homo sapiens
ctaaagtgtgctttataaa

SEQ ID NO: 3821546 - DNA, 20 bp, Homo sapiens
ctaaatatattttaagacga

SEQ ID NO: 3821547 - DNA, 16 bp, Homo sapiens
ctaaattctttcatga

SEQ ID NO: 3821548 - DNA, 18 bp, Homo sapiens
ctaaattctttcatgagc

SEQ ID NO: 3821549 - DNA, 20 bp, Homo sapiens
ctaacagattataataaatt

SEQ ID NO: 3821550 - DNA, 13 bp, Homo sapiens
ctaaccccgtctg

SEQ ID NO: 3821551 - DNA, 18 bp, Homo sapiens
ctaagaaatcatgtgcat

SEQ ID NO: 3821552 - DNA, 13 bp, Homo sapiens
ctaagaagtttaa

SEQ ID NO: 3821553 - DNA, 11 bp, Homo sapiens
ctaagagaagt

SEQ ID NO: 3821554 - DNA, 15 bp, Homo sapiens
ctaagatgaatccaa

SEQ ID NO: 3821555 - DNA, 18 bp, Homo sapiens
ctaagatgaatccaaatg

SEQ ID NO: 3821556 - DNA, 22 bp, Homo sapiens
ctaagatgaatccaaatgtgaa

SEQ ID NO: 3821557 - DNA, 21 bp, Homo sapiens
ctaagcgggcccgggtcccac

SEQ ID NO: 3821558 - DNA, 16 bp, Homo sapiens
ctaaggcccagctgcc

SEQ ID NO: 3821559 - DNA, 20 bp, Homo sapiens
ctaaggcccagctgccaggg

SEQ ID NO: 3821560 - DNA, 15 bp, Homo sapiens
ctaaggtaacaaatt

SEQ ID NO: 3821561 - DNA, 13 bp, Homo sapiens
ctaataaaatatc

SEQ ID NO: 3821562 - DNA, 14 bp, Homo sapiens
ctaataaaatatca

SEQ ID NO: 3821563 - DNA, 18 bp, Homo sapiens
ctaataaaatatcattca

SEQ ID NO: 3821564 - DNA, 23 bp, Homo sapiens
ctaataaaatatcattcagcaac

SEQ ID NO: 3821565 - DNA, 13 bp, Homo sapiens
ctaatagaaagaa

SEQ ID NO: 3821566 - DNA, 16 bp, Homo sapiens
ctaatagcctaaaaga

SEQ ID NO: 3821567 - DNA, 17 bp, Homo sapiens
ctaatagcctaaaagat

SEQ ID NO: 3821568 - DNA, 21 bp, Homo sapiens
ctaatatggttttgttttcaa

SEQ ID NO: 3821569 - DNA, 18 bp, Homo sapiens
ctaatatttattgcttta

SEQ ID NO: 3821570 - DNA, 19 bp, Homo sapiens
ctaatatttgtctgtgtgc

SEQ ID NO: 3821571 - DNA, 20 bp, Homo sapiens
ctaatatttgtctgtgtgct

SEQ ID NO: 3821572 - DNA, 22 bp, Homo sapiens
ctaatatttgtctgtgtgctac

SEQ ID NO: 3821573 - DNA, 19 bp, Homo sapiens
ctaatcccttcctctccca

SEQ ID NO: 3821574 - DNA, 13 bp, Homo sapiens
ctaatgatggccc

SEQ ID NO: 3821575 - DNA, 22 bp, Homo sapiens
ctaatgatggcccattctactt

SEQ ID NO: 3821576 - DNA, 13 bp, Homo sapiens
ctaatgtgtctgt

SEQ ID NO: 3821577 - DNA, 13 bp, Homo sapiens
ctaatgttgtgtg

SEQ ID NO: 3821578 - DNA, 19 bp, Homo sapiens
ctaatttctcctcccttcc

SEQ ID NO: 3821579 - DNA, 17 bp, Homo sapiens
cctctgacccagactcc

SEQ ID NO: 3821580 - DNA, 17 bp, Homo sapiens
cctctgacccctcctca

SEQ ID NO: 3821581 - DNA, 20 bp, Homo sapiens
cctctgacccctcctcactg

SEQ ID NO: 3821582 - DNA, 22 bp, Homo sapiens
cctctgacccctcctcactggc

SEQ ID NO: 3821583 - DNA, 14 bp, Homo sapiens
cctctgaggctcag

SEQ ID NO: 3821584 - DNA, 12 bp, Homo sapiens
cctctgcctgcc

SEQ ID NO: 3821585 - DNA, 13 bp, Homo sapiens
cctctgcggaccc

SEQ ID NO: 3821586 - DNA, 16 bp, Homo sapiens
cctctgcggaccccag

SEQ ID NO: 3821587 - DNA, 20 bp, Homo sapiens
cctctgcggaccccagctgt

SEQ ID NO: 3821588 - DNA, 23 bp, Homo sapiens
cctctggacggcaggctcactgc

SEQ ID NO: 3821589 - DNA, 16 bp, Homo sapiens
cctctggagtttcatg

SEQ ID NO: 3821590 - DNA, 16 bp, Homo sapiens
cctctggggctcagcc

SEQ ID NO: 3821591 - DNA, 21 bp, Homo sapiens
cctctggggctcagccctgag

SEQ ID NO: 3821592 - DNA, 15 bp, Homo sapiens
cctctgtgacctcag

SEQ ID NO: 3821593 - DNA, 20 bp, Homo sapiens
cctctgtgctgcatcccacc

SEQ ID NO: 3821594 - DNA, 15 bp, Homo sapiens
cctgaagccagcctt

SEQ ID NO: 3821595 - DNA, 16 bp, Homo sapiens
cctgaagccagccttc

SEQ ID NO: 3821596 - DNA, 20 bp, Homo sapiens
cctgaagctatcgtaaaatt

SEQ ID NO: 3821597 - DNA, 14 bp, Homo sapiens
cctgaagctgctta

SEQ ID NO: 3821598 - DNA, 13 bp, Homo sapiens
cctgaagggtgct

SEQ ID NO: 3821599 - DNA, 14 bp, Homo sapiens
cctgacccaataaa

SEQ ID NO: 3821600 - DNA, 18 bp, Homo sapiens
cctgagaggcaggcatag

SEQ ID NO: 3821601 - DNA, 13 bp, Homo sapiens
cctgagccccctg

SEQ ID NO: 3821602 - DNA, 23 bp, Homo sapiens
cctgagctctggagcaagccctg

SEQ ID NO: 3821603 - DNA, 20 bp, Homo sapiens
cctgagctggcctcacctgg

SEQ ID NO: 3821604 - DNA, 20 bp, Homo sapiens
cctgagctggcgtcacctgt

SEQ ID NO: 3821605 - DNA, 15 bp, Homo sapiens
cctgaggaataaagc

SEQ ID NO: 3821606 - DNA, 16 bp, Homo sapiens
cctgaggaataaagct

SEQ ID NO: 3821607 - DNA, 20 bp, Homo sapiens
cctgaggccagcctgcggga

SEQ ID NO: 3821608 - DNA, 20 bp, Homo sapiens
cctgagttcccaaagggagg

SEQ ID NO: 3821609 - DNA, 14 bp, Homo sapiens
cctgatttacagtt

SEQ ID NO: 3821610 - DNA, 17 bp, Homo sapiens
cctgatttacagtttca

SEQ ID NO: 3821611 - DNA, 23 bp, Homo sapiens
cctgcacgtcatgggagggggct

SEQ ID NO: 3821612 - DNA, 18 bp, Homo sapiens
cctgcactcccccagttc

SEQ ID NO: 3821613 - DNA, 20 bp, Homo sapiens
cctgcagtaatctccagggc

SEQ ID NO: 3821614 - DNA, 22 bp, Homo sapiens
cctgcagtaatctccagggcct

SEQ ID NO: 3821615 - DNA, 14 bp, Homo sapiens
cctgccaggcaggg

SEQ ID NO: 3821616 - DNA, 15 bp, Homo sapiens
cctgccaggcagggg

SEQ ID NO: 3821617 - DNA, 14 bp, Homo sapiens
cctgcccccagccc

SEQ ID NO: 3821618 - DNA, 17 bp, Homo sapiens
cctgcccccagccccgg

SEQ ID NO: 3821619 - DNA, 22 bp, Homo sapiens
cctgcccccgcatcccctgcct

SEQ ID NO: 3821620 - DNA, 23 bp, Homo sapiens
cctgcccgaggtcgctgcagccc

SEQ ID NO: 3821621 - DNA, 23 bp, Homo sapiens
cctgcccgccctccctcctgcct

SEQ ID NO: 3821622 - DNA, 11 bp, Homo sapiens
cctgccctgca

SEQ ID NO: 3821623 - DNA, 17 bp, Homo sapiens
cctgcctccatcctagt

SEQ ID NO: 3821624 - DNA, 17 bp, Homo sapiens
cctgcctgcccccacac

SEQ ID NO: 3821625 - DNA, 19 bp, Homo sapiens
cctgcgcagggccctctgg

SEQ ID NO: 3821626 - DNA, 19 bp, Homo sapiens
cctgcgttcttgtgacaga

SEQ ID NO: 3821627 - DNA, 19 bp, Homo sapiens
cctgctagcacctccccag

SEQ ID NO: 3821628 - DNA, 20 bp, Homo sapiens
cctgctagcacctccccaga

SEQ ID NO: 3821629 - DNA, 21 bp, Homo sapiens
cctgctagcacctccccagac

SEQ ID NO: 3821630 - DNA, 10 bp, Homo sapiens
cctgctgctg

SEQ ID NO: 3821631 - DNA, 15 bp, Homo sapiens
cctgctgctgctcct

SEQ ID NO: 3821632 - DNA, 21 bp, Homo sapiens
cctgctgctgctcctccctct

SEQ ID NO: 3821633 - DNA, 17 bp, Homo sapiens
cctgctgtaataaatgt

SEQ ID NO: 3821634 - DNA, 14 bp, Homo sapiens
cctgcttccaggaa

SEQ ID NO: 3821635 - DNA, 16 bp, Homo sapiens
cctgctttgccccact

SEQ ID NO: 3821636 - DNA, 12 bp, Homo sapiens
cctggacgcagc

SEQ ID NO: 3821637 - DNA, 20 bp, Homo sapiens
cctggacgcagccacacagt

SEQ ID NO: 3821638 - DNA, 19 bp, Homo sapiens
cctggatccatcctgctag

SEQ ID NO: 3821639 - DNA, 16 bp, Homo sapiens
cctggctgaggttcct

SEQ ID NO: 3821640 - DNA, 13 bp, Homo sapiens
cctggctgctgcc

SEQ ID NO: 3821641 - DNA, 14 bp, Homo sapiens
cctggctgctgccc

SEQ ID NO: 3821642 - DNA, 22 bp, Homo sapiens
cctggctgctgcccccaccccg

SEQ ID NO: 3821643 - DNA, 15 bp, Homo sapiens
cctgggaaggaagct

SEQ ID NO: 3821644 - DNA, 15 bp, Homo sapiens
cctgggaggagtggc

SEQ ID NO: 3821645 - DNA, 23 bp, Homo sapiens
cctgggcaccccaggcagctcct

SEQ ID NO: 3821646 - DNA, 14 bp, Homo sapiens
cctgggcctcctcc

SEQ ID NO: 3821647 - DNA, 20 bp, Homo sapiens
cctgggcgcagctgaagcct

SEQ ID NO: 3821648 - DNA, 23 bp, Homo sapiens
cctgggcgcagctgaagcctgga

SEQ ID NO: 3821649 - DNA, 16 bp, Homo sapiens
cctgggctgcctcctc

SEQ ID NO: 3821650 - DNA, 13 bp, Homo sapiens
cctgggctgggcc

SEQ ID NO: 3821651 - DNA, 14 bp, Homo sapiens
cctgggcttggcct

SEQ ID NO: 3821652 - DNA, 17 bp, Homo sapiens
cctgggcttggcctgct

SEQ ID NO: 3821653 - DNA, 16 bp, Homo sapiens
cctggtattgtaatat

SEQ ID NO: 3821654 - DNA, 15 bp, Homo sapiens
cctggtggggcagaa

SEQ ID NO: 3821655 - DNA, 18 bp, Homo sapiens
cctggtggggcagaaagg

SEQ ID NO: 3821656 - DNA, 20 bp, Homo sapiens
cctggtggggcagaaaggct

SEQ ID NO: 3821657 - DNA, 13 bp, Homo sapiens
cctgtccctccca

SEQ ID NO: 3821658 - DNA, 14 bp, Homo sapiens
cctgtccctcccac

SEQ ID NO: 3821659 - DNA, 16 bp, Homo sapiens
cctgtccctcccacct

SEQ ID NO: 3821660 - DNA, 15 bp, Homo sapiens
cctgtcctcactgct

SEQ ID NO: 3821661 - DNA, 22 bp, Homo sapiens
cctgtcctcactgctccctgaa

SEQ ID NO: 3821662 - DNA, 24 bp, Homo sapiens
cctgtcggccacaccccagactcc

SEQ ID NO: 3821663 - DNA, 19 bp, Homo sapiens
cctgtgacatggtgcctga

SEQ ID NO: 3821664 - DNA, 19 bp, Homo sapiens
cctgtgcagggccctctgg

SEQ ID NO: 3821665 - DNA, 14 bp, Homo sapiens
cctgtggagactgg

SEQ ID NO: 3821666 - DNA, 18 bp, Homo sapiens
cctgtggatcaaatccag

SEQ ID NO: 3821667 - DNA, 15 bp, Homo sapiens
cctgtgtaacagctc

SEQ ID NO: 3821668 - DNA, 20 bp, Homo sapiens
cctgtgtctttttcgccaaa

SEQ ID NO: 3821669 - DNA, 13 bp, Homo sapiens
cctgtgtgcagtg

SEQ ID NO: 3821670 - DNA, 15 bp, Homo sapiens
cctgtgtgcagtgga

SEQ ID NO: 3821671 - DNA, 18 bp, Homo sapiens
cctgttgcaaaggaaata

SEQ ID NO: 3821672 - DNA, 14 bp, Homo sapiens
cctgttgcaggcaa

SEQ ID NO: 3821673 - DNA, 15 bp, Homo sapiens
cctgttgcaggcaaa

SEQ ID NO: 3821674 - DNA, 17 bp, Homo sapiens
ccttagagccaggcaca

SEQ ID NO: 3821675 - DNA, 19 bp, Homo sapiens
ccttcaccaaagatctgct

SEQ ID NO: 3821676 - DNA, 22 bp, Homo sapiens
ccttcagatgttctctcccagg

SEQ ID NO: 3821677 - DNA, 23 bp, Homo sapiens
ccttcagatgttctctcccaggg

SEQ ID NO: 3821678 - DNA, 15 bp, Homo sapiens
ccttccctagcttta

SEQ ID NO: 3821679 - DNA, 16 bp, Homo sapiens
ccttcctggcctaatc

SEQ ID NO: 3821680 - DNA, 17 bp, Homo sapiens
ccttccttttccctgct

SEQ ID NO: 3821681 - DNA, 18 bp, Homo sapiens
ccttccttttccctgctt

SEQ ID NO: 3821682 - DNA, 21 bp, Homo sapiens
ccttccttttccctgcttcca

SEQ ID NO: 3821683 - DNA, 15 bp, Homo sapiens
ccttctctcctcccc

SEQ ID NO: 3821684 - DNA, 16 bp, Homo sapiens
ccttctctcctcccca

SEQ ID NO: 3821685 - DNA, 17 bp, Homo sapiens
ccttctctcctccccaa

SEQ ID NO: 3821686 - DNA, 19 bp, Homo sapiens
ccttcttccatcccaggac

SEQ ID NO: 3821687 - DNA, 16 bp, Homo sapiens
ccttcttgccttcaga

SEQ ID NO: 3821688 - DNA, 20 bp, Homo sapiens
ccttgacataccaagtggtt

SEQ ID NO: 3821689 - DNA, 22 bp, Homo sapiens
ccttgcactgtatcatttcatg

SEQ ID NO: 3821690 - DNA, 17 bp, Homo sapiens
ccttgccctgggctgcc

SEQ ID NO: 3821691 - DNA, 14 bp, Homo sapiens
ccttgcgaccacca

SEQ ID NO: 3821692 - DNA, 16 bp, Homo sapiens
ccttgcgaccaccaac

SEQ ID NO: 3821693 - DNA, 22 bp, Homo sapiens
ccttgcgaccaccaacacacag

SEQ ID NO: 3821694 - DNA, 22 bp, Homo sapiens
ccttgcttgctgccttctggat

SEQ ID NO: 3821695 - DNA, 18 bp, Homo sapiens
ccttggccagaagtcaag

SEQ ID NO: 3821696 - DNA, 19 bp, Homo sapiens
ccttggccctacagccctg

SEQ ID NO: 3821697 - DNA, 15 bp, Homo sapiens
ccttgggaggaagca

SEQ ID NO: 3821698 - DNA, 20 bp, Homo sapiens
ccttgggaggaagcagaata

SEQ ID NO: 3821699 - DNA, 23 bp, Homo sapiens
ccttgggaggaagcagaataaag

SEQ ID NO: 3821700 - DNA, 19 bp, Homo sapiens
ccttgtaaattccccttcc

SEQ ID NO: 3821701 - DNA, 22 bp, Homo sapiens
ccttgtataaggagctttgctc

SEQ ID NO: 3821702 - DNA, 17 bp, Homo sapiens
ccttgtgtgtatgtgta

SEQ ID NO: 3821703 - DNA, 13 bp, Homo sapiens
cctttaaaaagca

SEQ ID NO: 3821704 - DNA, 15 bp, Homo sapiens
cctttaactgagggc

SEQ ID NO: 3821705 - DNA, 15 bp, Homo sapiens
cctttccccagccca

SEQ ID NO: 3821706 - DNA, 18 bp, Homo sapiens
cctttgctagtgtctttg

SEQ ID NO: 3821707 - DNA, 13 bp, Homo sapiens
cctttgctgttcg

SEQ ID NO: 3821708 - DNA, 12 bp, Homo sapiens
cctttggctctg

SEQ ID NO: 3821709 - DNA, 14 bp, Homo sapiens
cctttggctctgga

SEQ ID NO: 3821710 - DNA, 22 bp, Homo sapiens
cctttggggatagtctggaaag

SEQ ID NO: 3821711 - DNA, 13 bp, Homo sapiens
cagctgatgactc

SEQ ID NO: 3821712 - DNA, 21 bp, Homo sapiens
cagctgatgactcaagattcc

SEQ ID NO: 3821713 - DNA, 23 bp, Homo sapiens
cagctgatgactcaagattccca

SEQ ID NO: 3821714 - DNA, 20 bp, Homo sapiens
cagctgccagggaagacaga

SEQ ID NO: 3821715 - DNA, 21 bp, Homo sapiens
cagctgccagggaagacagag

SEQ ID NO: 3821716 - DNA, 15 bp, Homo sapiens
cagctgcttctccca

SEQ ID NO: 3821717 - DNA, 12 bp, Homo sapiens
cagctggactgc

SEQ ID NO: 3821718 - DNA, 16 bp, Homo sapiens
cagctggactgcattg

SEQ ID NO: 3821719 - DNA, 13 bp, Homo sapiens
cagctgtgagcct

SEQ ID NO: 3821720 - DNA, 16 bp, Homo sapiens
cagctgtgagccttgg

SEQ ID NO: 3821721 - DNA, 16 bp, Homo sapiens
cagcttgtgccttgta

SEQ ID NO: 3821722 - DNA, 22 bp, Homo sapiens
caggaaactccacatctgcctt

SEQ ID NO: 3821723 - DNA, 23 bp, Homo sapiens
caggaaactccacatctgcctta

SEQ ID NO: 3821724 - DNA, 18 bp, Homo sapiens
caggaactctgtgtgaga

SEQ ID NO: 3821725 - DNA, 22 bp, Homo sapiens
caggaactctgtgtgagagaga

SEQ ID NO: 3821726 - DNA, 20 bp, Homo sapiens
caggacaccacacccagcct

SEQ ID NO: 3821727 - DNA, 15 bp, Homo sapiens
caggacctgagcctg

SEQ ID NO: 3821728 - DNA, 19 bp, Homo sapiens
caggacctgagcctggcca

SEQ ID NO: 3821729 - DNA, 20 bp, Homo sapiens
caggacgacgaatcttctca

SEQ ID NO: 3821730 - DNA, 14 bp, Homo sapiens
caggactgagcccc

SEQ ID NO: 3821731 - DNA, 17 bp, Homo sapiens
caggactgagccccgca

SEQ ID NO: 3821732 - DNA, 15 bp, Homo sapiens
caggacttattatat

SEQ ID NO: 3821733 - DNA, 20 bp, Homo sapiens
caggacttattatatcagag

SEQ ID NO: 3821734 - DNA, 18 bp, Homo sapiens
caggagaattaggaaggc

SEQ ID NO: 3821735 - DNA, 20 bp, Homo sapiens
caggagaattaggaaggcca

SEQ ID NO: 3821736 - DNA, 22 bp, Homo sapiens
caggagaattaggaaggccatg

SEQ ID NO: 3821737 - DNA, 13 bp, Homo sapiens
caggagaccaccc

SEQ ID NO: 3821738 - DNA, 14 bp, Homo sapiens
caggagaccacccc

SEQ ID NO: 3821739 - DNA, 16 bp, Homo sapiens
caggagattgagaagg

SEQ ID NO: 3821740 - DNA, 19 bp, Homo sapiens
caggagattgagaaggaga

SEQ ID NO: 3821741 - DNA, 22 bp, Homo sapiens
caggagattgagaaggagagaa

SEQ ID NO: 3821742 - DNA, 23 bp, Homo sapiens
caggagattgagaaggagagaaa

SEQ ID NO: 3821743 - DNA, 15 bp, Homo sapiens
caggagcctggaggg

SEQ ID NO: 3821744 - DNA, 21 bp, Homo sapiens
caggagcctggagggaagttg

SEQ ID NO: 3821745 - DNA, 19 bp, Homo sapiens
caggaggagttagccaaac

SEQ ID NO: 3821746 - DNA, 15 bp, Homo sapiens
caggagggctttgtg

SEQ ID NO: 3821747 - DNA, 16 bp, Homo sapiens
caggagttctgctcat

SEQ ID NO: 3821748 - DNA, 15 bp, Homo sapiens
caggatcggcttcct

SEQ ID NO: 3821749 - DNA, 20 bp, Homo sapiens
caggatgatgactatggaaa

SEQ ID NO: 3821750 - DNA, 22 bp, Homo sapiens
caggatgatgactatggaaaga

SEQ ID NO: 3821751 - DNA, 16 bp, Homo sapiens
caggatgcctgagccc

SEQ ID NO: 3821752 - DNA, 17 bp, Homo sapiens
caggcaaggtctggcct

SEQ ID NO: 3821753 - DNA, 14 bp, Homo sapiens
caggcacaaaatgt

SEQ ID NO: 3821754 - DNA, 16 bp, Homo sapiens
caggcacaaaatgtga

SEQ ID NO: 3821755 - DNA, 14 bp, Homo sapiens
caggcacacactgt

SEQ ID NO: 3821756 - DNA, 15 bp, Homo sapiens
caggcacacactgtg

SEQ ID NO: 3821757 - DNA, 23 bp, Homo sapiens
caggcacacactgtgctttctat

SEQ ID NO: 3821758 - DNA, 15 bp, Homo sapiens
caggcagctcctgtt

SEQ ID NO: 3821759 - DNA, 18 bp, Homo sapiens
caggcagctcctgtttgg

SEQ ID NO: 3821760 - DNA, 17 bp, Homo sapiens
caggcatagaggcttct

SEQ ID NO: 3821761 - DNA, 19 bp, Homo sapiens
caggcatagaggcttctcc

SEQ ID NO: 3821762 - DNA, 21 bp, Homo sapiens
caggcatagaggcttctccgc

SEQ ID NO: 3821763 - DNA, 23 bp, Homo sapiens
caggcatagaggcttctccgcca

SEQ ID NO: 3821764 - DNA, 11 bp, Homo sapiens
caggccagcct

SEQ ID NO: 3821765 - DNA, 15 bp, Homo sapiens
caggccagcctccga

SEQ ID NO: 3821766 - DNA, 21 bp, Homo sapiens
caggccagcctccgagaggga

SEQ ID NO: 3821767 - DNA, 22 bp, Homo sapiens
caggcccccgttgaagccgctc

SEQ ID NO: 3821768 - DNA, 23 bp, Homo sapiens
caggcccccgttgaagccgctcc

SEQ ID NO: 3821769 - DNA, 16 bp, Homo sapiens
caggccttgcctggga

SEQ ID NO: 3821770 - DNA, 19 bp, Homo sapiens
caggctatggttgccaccc

SEQ ID NO: 3821771 - DNA, 15 bp, Homo sapiens
caggctcactgccag

SEQ ID NO: 3821772 - DNA, 22 bp, Homo sapiens
caggctcactgccaggccagcc

SEQ ID NO: 3821773 - DNA, 23 bp, Homo sapiens
caggctcactgccaggccagcct

SEQ ID NO: 3821774 - DNA, 17 bp, Homo sapiens
caggctggcccccaccc

SEQ ID NO: 3821775 - DNA, 20 bp, Homo sapiens
caggctggcccccacccacc

SEQ ID NO: 3821776 - DNA, 24 bp, Homo sapiens
caggctggctcctggggatggcca

SEQ ID NO: 3821777 - DNA, 12 bp, Homo sapiens
caggctgggagg

SEQ ID NO: 3821778 - DNA, 17 bp, Homo sapiens
caggctgggaggctcgg

SEQ ID NO: 3821779 - DNA, 16 bp, Homo sapiens
caggcttgcattaaaa

SEQ ID NO: 3821780 - DNA, 18 bp, Homo sapiens
caggctttgtgagagagg

SEQ ID NO: 3821781 - DNA, 20 bp, Homo sapiens
caggctttgtgagagaggac

SEQ ID NO: 3821782 - DNA, 21 bp, Homo sapiens
caggctttgtgagagaggacc

SEQ ID NO: 3821783 - DNA, 23 bp, Homo sapiens
caggctttgtgagagaggacctc

SEQ ID NO: 3821784 - DNA, 13 bp, Homo sapiens
cagggaagacaga

SEQ ID NO: 3821785 - DNA, 15 bp, Homo sapiens
cagggaagacagagc

SEQ ID NO: 3821786 - DNA, 23 bp, Homo sapiens
cagggaagacagagcaggctttg

SEQ ID NO: 3821787 - DNA, 12 bp, Homo sapiens
cagggcagcctc

SEQ ID NO: 3821788 - DNA, 21 bp, Homo sapiens
cagggcatgccccggccacct

SEQ ID NO: 3821789 - DNA, 15 bp, Homo sapiens
cagggccaagccggc

SEQ ID NO: 3821790 - DNA, 17 bp, Homo sapiens
cagggccaagccggccc

SEQ ID NO: 3821791 - DNA, 18 bp, Homo sapiens
cagggccaggactgagcc

SEQ ID NO: 3821792 - DNA, 18 bp, Homo sapiens
cagggccctctgaggctc

SEQ ID NO: 3821793 - DNA, 17 bp, Homo sapiens
cagggctccagcctgtc

SEQ ID NO: 3821794 - DNA, 20 bp, Homo sapiens
cagggctctctttccttctt

SEQ ID NO: 3821795 - DNA, 21 bp, Homo sapiens
cagggctctctttccttcttg

SEQ ID NO: 3821796 - DNA, 24 bp, Homo sapiens
cagggctctctttccttcttgcct

SEQ ID NO: 3821797 - DNA, 22 bp, Homo sapiens
caggggcacagacctctcccac

SEQ ID NO: 3821798 - DNA, 17 bp, Homo sapiens
caggggctacaagaggg

SEQ ID NO: 3821799 - DNA, 18 bp, Homo sapiens
caggggctacaagaggga

SEQ ID NO: 3821800 - DNA, 17 bp, Homo sapiens
caggggctctggagaga

SEQ ID NO: 3821801 - DNA, 18 bp, Homo sapiens
cagggggactagcccctg

SEQ ID NO: 3821802 - DNA, 20 bp, Homo sapiens
cagggggcccaccagagctg

SEQ ID NO: 3821803 - DNA, 20 bp, Homo sapiens
cagggtcctccggggctcag

SEQ ID NO: 3821804 - DNA, 22 bp, Homo sapiens
cagggtggacttagaaagcagg

SEQ ID NO: 3821805 - DNA, 15 bp, Homo sapiens
cagggtttaacaata

SEQ ID NO: 3821806 - DNA, 15 bp, Homo sapiens
caggtaccagctgcg

SEQ ID NO: 3821807 - DNA, 17 bp, Homo sapiens
caggtaccagctgcgct

SEQ ID NO: 3821808 - DNA, 18 bp, Homo sapiens
caggtgaggaatttgaag

SEQ ID NO: 3821809 - DNA, 20 bp, Homo sapiens
caggttaaatatataaacaa

SEQ ID NO: 3821810 - DNA, 16 bp, Homo sapiens
cagtaagagtttacaa

SEQ ID NO: 3821811 - DNA, 17 bp, Homo sapiens
cagtaagagtttacaag

SEQ ID NO: 3821812 - DNA, 19 bp, Homo sapiens
cagtagtataatgtatgaa

SEQ ID NO: 3821813 - DNA, 22 bp, Homo sapiens
cagtagtataatgtatgaattt

SEQ ID NO: 3821814 - DNA, 16 bp, Homo sapiens
cagtataaaagacaaa

SEQ ID NO: 3821815 - DNA, 14 bp, Homo sapiens
cagtcactggaggt

SEQ ID NO: 3821816 - DNA, 12 bp, Homo sapiens
cagtcaggatga

SEQ ID NO: 3821817 - DNA, 17 bp, Homo sapiens
cagtcagtgctggagaa

SEQ ID NO: 3821818 - DNA, 16 bp, Homo sapiens
cagtcatgacagatga

SEQ ID NO: 3821819 - DNA, 13 bp, Homo sapiens
cagtccccacccc

SEQ ID NO: 3821820 - DNA, 16 bp, Homo sapiens
cagtccccacccctgc

SEQ ID NO: 3821821 - DNA, 18 bp, Homo sapiens
cagtccccacccctgccc

SEQ ID NO: 3821822 - DNA, 19 bp, Homo sapiens
cagtccccacccctgcccc

SEQ ID NO: 3821823 - DNA, 13 bp, Homo sapiens
cagtcctgaagca

SEQ ID NO: 3821824 - DNA, 15 bp, Homo sapiens
cagtctgctctcagc

SEQ ID NO: 3821825 - DNA, 14 bp, Homo sapiens
cagtgatgttgaaa

SEQ ID NO: 3821826 - DNA, 17 bp, Homo sapiens
cagtgctggagaaatct

SEQ ID NO: 3821827 - DNA, 13 bp, Homo sapiens
cagtggagctggc

SEQ ID NO: 3821828 - DNA, 14 bp, Homo sapiens
cagtggagctggca

SEQ ID NO: 3821829 - DNA, 21 bp, Homo sapiens
cagtgggcactaagggtggag

SEQ ID NO: 3821830 - DNA, 14 bp, Homo sapiens
cagtggtttccctg

SEQ ID NO: 3821831 - DNA, 21 bp, Homo sapiens
cagtggttttatactgaagga

SEQ ID NO: 3821832 - DNA, 20 bp, Homo sapiens
cagtgtcaaataaacactgt

SEQ ID NO: 3821833 - DNA, 16 bp, Homo sapiens
cagtgtgcggagctga

SEQ ID NO: 3821834 - DNA, 12 bp, Homo sapiens
cagttaaatatg

SEQ ID NO: 3821835 - DNA, 17 bp, Homo sapiens
cagttaaatatgatttg

SEQ ID NO: 3821836 - DNA, 16 bp, Homo sapiens
cagttagccactgctg

SEQ ID NO: 3821837 - DNA, 11 bp, Homo sapiens
cagttataaag

SEQ ID NO: 3821838 - DNA, 18 bp, Homo sapiens
cagttctctcgaatactt

SEQ ID NO: 3821839 - DNA, 12 bp, Homo sapiens
cagtttctgagt

SEQ ID NO: 3821840 - DNA, 16 bp, Homo sapiens
cagtttgttgatcttt

SEQ ID NO: 3821841 - DNA, 18 bp, Homo sapiens
cagtttgtttacacacgt

SEQ ID NO: 3821842 - DNA, 11 bp, Homo sapiens
cagttttactg

SEQ ID NO: 3821843 - DNA, 18 bp, Homo sapiens
cagttttactgcattttc

SEQ ID NO: 3821844 - DNA, 16 bp, Homo sapiens
cagttttattttctaa

SEQ ID NO: 3821845 - DNA, 13 bp, Homo sapiens
cataaaaagctga

SEQ ID NO: 3821846 - DNA, 18 bp, Homo sapiens
cataatacataaagttct

SEQ ID NO: 3821847 - DNA, 13 bp, Homo sapiens
cagaataaagcaa

SEQ ID NO: 3821848 - DNA, 20 bp, Homo sapiens
cagaataaagcaattttcct

SEQ ID NO: 3821849 - DNA, 19 bp, Homo sapiens
cagaataaatgttttacaa

SEQ ID NO: 3821850 - DNA, 21 bp, Homo sapiens
cagaataaatgttttacaact

SEQ ID NO: 3821851 - DNA, 17 bp, Homo sapiens
cagaattgtgtctgcag

SEQ ID NO: 3821852 - DNA, 12 bp, Homo sapiens
cagacagggctc

SEQ ID NO: 3821853 - DNA, 16 bp, Homo sapiens
cagacagggctccagc

SEQ ID NO: 3821854 - DNA, 19 bp, Homo sapiens
cagacagggctccagcctg

SEQ ID NO: 3821855 - DNA, 21 bp, Homo sapiens
cagacatggaccttctctcca

SEQ ID NO: 3821856 - DNA, 16 bp, Homo sapiens
cagacctccccagccc

SEQ ID NO: 3821857 - DNA, 23 bp, Homo sapiens
cagacctccccagcccctagccc

SEQ ID NO: 3821858 - DNA, 12 bp, Homo sapiens
cagactccaggc

SEQ ID NO: 3821859 - DNA, 13 bp, Homo sapiens
cagactccaggcc

SEQ ID NO: 3821860 - DNA, 14 bp, Homo sapiens
cagactccaggccc

SEQ ID NO: 3821861 - DNA, 16 bp, Homo sapiens
cagactccaggccccc

SEQ ID NO: 3821862 - DNA, 15 bp, Homo sapiens
cagacttcaccaaat

SEQ ID NO: 3821863 - DNA, 18 bp, Homo sapiens
cagactttcagccgactc

SEQ ID NO: 3821864 - DNA, 16 bp, Homo sapiens
cagagaaaagcttgga

SEQ ID NO: 3821865 - DNA, 16 bp, Homo sapiens
cagagacagtgggcac

SEQ ID NO: 3821866 - DNA, 16 bp, Homo sapiens
cagagaccgtcctcac

SEQ ID NO: 3821867 - DNA, 18 bp, Homo sapiens
cagagaccgtcctcaccc

SEQ ID NO: 3821868 - DNA, 19 bp, Homo sapiens
cagagaccgtcctcacccc

SEQ ID NO: 3821869 - DNA, 20 bp, Homo sapiens
cagagaccgtcctcacccct

SEQ ID NO: 3821870 - DNA, 20 bp, Homo sapiens
cagagactggggcctggact

SEQ ID NO: 3821871 - DNA, 22 bp, Homo sapiens
cagagagcggtctcaggctggt

SEQ ID NO: 3821872 - DNA, 14 bp, Homo sapiens
cagagatggctcct

SEQ ID NO: 3821873 - DNA, 11 bp, Homo sapiens
cagagcaggct

SEQ ID NO: 3821874 - DNA, 16 bp, Homo sapiens
cagagcaggctttgtg

SEQ ID NO: 3821875 - DNA, 19 bp, Homo sapiens
cagagcaggctttgtgaga

SEQ ID NO: 3821876 - DNA, 20 bp, Homo sapiens
cagagctggggctgagggat

SEQ ID NO: 3821877 - DNA, 12 bp, Homo sapiens
cagaggcaagga

SEQ ID NO: 3821878 - DNA, 16 bp, Homo sapiens
cagaggcaaggatggt

SEQ ID NO: 3821879 - DNA, 11 bp, Homo sapiens
cagaggccagg

SEQ ID NO: 3821880 - DNA, 19 bp, Homo sapiens
cagaggccaggatgcctga

SEQ ID NO: 3821881 - DNA, 21 bp, Homo sapiens
cagaggccaggatgcctgagc

SEQ ID NO: 3821882 - DNA, 16 bp, Homo sapiens
cagagggctgtgtctt

SEQ ID NO: 3821883 - DNA, 18 bp, Homo sapiens
cagagtaacaaaaaataa

SEQ ID NO: 3821884 - DNA, 21 bp, Homo sapiens
cagagtcacctttccccactc

SEQ ID NO: 3821885 - DNA, 23 bp, Homo sapiens
cagataaggccgagcccacacca

SEQ ID NO: 3821886 - DNA, 14 bp, Homo sapiens
cagatccccagggc

SEQ ID NO: 3821887 - DNA, 15 bp, Homo sapiens
cagatccccagggca

SEQ ID NO: 3821888 - DNA, 14 bp, Homo sapiens
cagatctgtcctgg

SEQ ID NO: 3821889 - DNA, 17 bp, Homo sapiens
cagatctgtcctggggg

SEQ ID NO: 3821890 - DNA, 20 bp, Homo sapiens
cagatgatggggtcagcagg

SEQ ID NO: 3821891 - DNA, 21 bp, Homo sapiens
cagatgatggggtcagcaggc

SEQ ID NO: 3821892 - DNA, 23 bp, Homo sapiens
cagatgatggggtcagcaggccc

SEQ ID NO: 3821893 - DNA, 14 bp, Homo sapiens
cagatgtacatgtg

SEQ ID NO: 3821894 - DNA, 19 bp, Homo sapiens
cagatgttctctcccaggg

SEQ ID NO: 3821895 - DNA, 15 bp, Homo sapiens
cagattataataaat

SEQ ID NO: 3821896 - DNA, 21 bp, Homo sapiens
cagattataataaattgtcat

SEQ ID NO: 3821897 - DNA, 15 bp, Homo sapiens
cagcaactttccctt

SEQ ID NO: 3821898 - DNA, 22 bp, Homo sapiens
cagcaactttcccttgccctgg

SEQ ID NO: 3821899 - DNA, 13 bp, Homo sapiens
cagcaccctctgt

SEQ ID NO: 3821900 - DNA, 17 bp, Homo sapiens
cagcagatggaaagaaa

SEQ ID NO: 3821901 - DNA, 11 bp, Homo sapiens
cagcaggccca

SEQ ID NO: 3821902 - DNA, 18 bp, Homo sapiens
cagcataaaggccttttt

SEQ ID NO: 3821903 - DNA, 13 bp, Homo sapiens
cagcataatactt

SEQ ID NO: 3821904 - DNA, 21 bp, Homo sapiens
cagccagccctggcttccaag

SEQ ID NO: 3821905 - DNA, 20 bp, Homo sapiens
cagccattggcctctgtctc

SEQ ID NO: 3821906 - DNA, 14 bp, Homo sapiens
cagcccaggcctgg

SEQ ID NO: 3821907 - DNA, 15 bp, Homo sapiens
cagcccaggcctggt

SEQ ID NO: 3821908 - DNA, 18 bp, Homo sapiens
cagcccaggcctggtgga

SEQ ID NO: 3821909 - DNA, 20 bp, Homo sapiens
cagcccaggcctggtggagg

SEQ ID NO: 3821910 - DNA, 18 bp, Homo sapiens
cagccccacccccagcca

SEQ ID NO: 3821911 - DNA, 19 bp, Homo sapiens
cagccccacccccagccag

SEQ ID NO: 3821912 - DNA, 13 bp, Homo sapiens
cagccccaggaga

SEQ ID NO: 3821913 - DNA, 16 bp, Homo sapiens
cagccccgtgccagga

SEQ ID NO: 3821914 - DNA, 13 bp, Homo sapiens
cagcccctagccc

SEQ ID NO: 3821915 - DNA, 15 bp, Homo sapiens
cagcccctagcccag

SEQ ID NO: 3821916 - DNA, 17 bp, Homo sapiens
cagcccctagcccagga

SEQ ID NO: 3821917 - DNA, 24 bp, Homo sapiens
cagcccctagcccaggagagagaa

SEQ ID NO: 3821918 - DNA, 22 bp, Homo sapiens
cagccctgagctagtgtcacct

SEQ ID NO: 3821919 - DNA, 23 bp, Homo sapiens
cagccctgagctggcctcacctg

SEQ ID NO: 3821920 - DNA, 23 bp, Homo sapiens
cagccctgagttggcatcacctg

SEQ ID NO: 3821921 - DNA, 13 bp, Homo sapiens
cagccctgcagta

SEQ ID NO: 3821922 - DNA, 23 bp, Homo sapiens
cagccctgcagtaatctccaggg

SEQ ID NO: 3821923 - DNA, 12 bp, Homo sapiens
cagccctggagg

SEQ ID NO: 3821924 - DNA, 12 bp, Homo sapiens
cagcccttggcc

SEQ ID NO: 3821925 - DNA, 20 bp, Homo sapiens
cagcctccaactccagctga

SEQ ID NO: 3821926 - DNA, 19 bp, Homo sapiens
cagcctccagtctgctctc

SEQ ID NO: 3821927 - DNA, 22 bp, Homo sapiens
cagcctccagtctgctctcagc

SEQ ID NO: 3821928 - DNA, 23 bp, Homo sapiens
cagcctccagtctgctctcagct

SEQ ID NO: 3821929 - DNA, 20 bp, Homo sapiens
cagcctccgagagggagaga

SEQ ID NO: 3821930 - DNA, 17 bp, Homo sapiens
cagcctcctctggacgg

SEQ ID NO: 3821931 - DNA, 21 bp, Homo sapiens
cagcctcctctggacggcagg

SEQ ID NO: 3821932 - DNA, 23 bp, Homo sapiens
cagcctcctctggacggcaggct

SEQ ID NO: 3821933 - DNA, 22 bp, Homo sapiens
cagcctcgttaggacaaggctg

SEQ ID NO: 3821934 - DNA, 23 bp, Homo sapiens
cagcctcgttaggacaaggctgt

SEQ ID NO: 3821935 - DNA, 16 bp, Homo sapiens
cagcctctgacccctc

SEQ ID NO: 3821936 - DNA, 23 bp, Homo sapiens
cagcctctgacccctcctcactg

SEQ ID NO: 3821937 - DNA, 21 bp, Homo sapiens
cagcctctgcagtccgtgggc

SEQ ID NO: 3821938 - DNA, 22 bp, Homo sapiens
cagcctgagcaagacgccctct

SEQ ID NO: 3821939 - DNA, 22 bp, Homo sapiens
cagcctgcgggaagctgacctt

SEQ ID NO: 3821940 - DNA, 14 bp, Homo sapiens
cagcctggcctgtg

SEQ ID NO: 3821941 - DNA, 18 bp, Homo sapiens
cagcctgtcggccacacc

SEQ ID NO: 3821942 - DNA, 14 bp, Homo sapiens
cagcctgtgtgcag

SEQ ID NO: 3821943 - DNA, 15 bp, Homo sapiens
cagcgagcaccctca

SEQ ID NO: 3821944 - DNA, 13 bp, Homo sapiens
cagcgcattgttt

SEQ ID NO: 3821945 - DNA, 13 bp, Homo sapiens
cagctccagatgt

SEQ ID NO: 3821946 - DNA, 15 bp, Homo sapiens
cagctcctgtttgga

SEQ ID NO: 3821947 - DNA, 16 bp, Homo sapiens
cagctccttgggagga

SEQ ID NO: 3821948 - DNA, 17 bp, Homo sapiens
cagctccttgggaggaa

SEQ ID NO: 3821949 - DNA, 22 bp, Homo sapiens
cagctccttgggaggaagcaga

SEQ ID NO: 3821950 - DNA, 12 bp, Homo sapiens
cagctgaagcct

SEQ ID NO: 3821951 - DNA, 15 bp, Homo sapiens
cagctgaagcctgga

SEQ ID NO: 3821952 - DNA, 21 bp, Homo sapiens
cagctgaagcctggacgcagc

SEQ ID NO: 3821953 - DNA, 18 bp, Homo sapiens
cacacagtggccggggct

SEQ ID NO: 3821954 - DNA, 12 bp, Homo sapiens
cacaccatctgg

SEQ ID NO: 3821955 - DNA, 15 bp, Homo sapiens
cacaccatctggccc

SEQ ID NO: 3821956 - DNA, 19 bp, Homo sapiens
cacaccatctggcccaggc

SEQ ID NO: 3821957 - DNA, 21 bp, Homo sapiens
cacaccatctggcccaggctg

SEQ ID NO: 3821958 - DNA, 23 bp, Homo sapiens
cacaccatctggcccaggctggc

SEQ ID NO: 3821959 - DNA, 18 bp, Homo sapiens
cacacccagcctcagtcc

SEQ ID NO: 3821960 - DNA, 19 bp, Homo sapiens
cacaccccagactccaggc

SEQ ID NO: 3821961 - DNA, 20 bp, Homo sapiens
cacactgtgctttctattgt

SEQ ID NO: 3821962 - DNA, 12 bp, Homo sapiens
cacagaaagcct

SEQ ID NO: 3821963 - DNA, 17 bp, Homo sapiens
cacagacctctcccacc

SEQ ID NO: 3821964 - DNA, 17 bp, Homo sapiens
cacagagggctgtgtct

SEQ ID NO: 3821965 - DNA, 15 bp, Homo sapiens
cacagcccagaaggc

SEQ ID NO: 3821966 - DNA, 15 bp, Homo sapiens
cacaggaactctgtg

SEQ ID NO: 3821967 - DNA, 22 bp, Homo sapiens
cacaggaactctgtgtgagaga

SEQ ID NO: 3821968 - DNA, 20 bp, Homo sapiens
cacagggcatgccccggcca

SEQ ID NO: 3821969 - DNA, 16 bp, Homo sapiens
cacagtggccggggct

SEQ ID NO: 3821970 - DNA, 23 bp, Homo sapiens
cacagtggccggggctgaagcca

SEQ ID NO: 3821971 - DNA, 13 bp, Homo sapiens
cacatacacacac

SEQ ID NO: 3821972 - DNA, 14 bp, Homo sapiens
cacatacacacaca

SEQ ID NO: 3821973 - DNA, 16 bp, Homo sapiens
cacatcctaatagaaa

SEQ ID NO: 3821974 - DNA, 17 bp, Homo sapiens
cacatggcagatgattt

SEQ ID NO: 3821975 - DNA, 14 bp, Homo sapiens
cacatggcatgttt

SEQ ID NO: 3821976 - DNA, 17 bp, Homo sapiens
cacatggcatgttttgt

SEQ ID NO: 3821977 - DNA, 22 bp, Homo sapiens
cacatgtcattgcccacttctg

SEQ ID NO: 3821978 - DNA, 19 bp, Homo sapiens
cacattcccccggtgcctc

SEQ ID NO: 3821979 - DNA, 19 bp, Homo sapiens
caccaaagatctgctcctc

SEQ ID NO: 3821980 - DNA, 22 bp, Homo sapiens
caccaagtattaaactgtaaat

SEQ ID NO: 3821981 - DNA, 14 bp, Homo sapiens
caccacacccagcc

SEQ ID NO: 3821982 - DNA, 15 bp, Homo sapiens
caccacacccagcct

SEQ ID NO: 3821983 - DNA, 17 bp, Homo sapiens
caccacacccagcctca

SEQ ID NO: 3821984 - DNA, 16 bp, Homo sapiens
caccacactaaaacat

SEQ ID NO: 3821985 - DNA, 22 bp, Homo sapiens
caccacactaaaacattgtcta

SEQ ID NO: 3821986 - DNA, 21 bp, Homo sapiens
caccacttgtccattgcgtta

SEQ ID NO: 3821987 - DNA, 16 bp, Homo sapiens
caccagagaccgtcct

SEQ ID NO: 3821988 - DNA, 21 bp, Homo sapiens
caccagagaccgtcctcaccc

SEQ ID NO: 3821989 - DNA, 17 bp, Homo sapiens
caccagtaataaaaagc

SEQ ID NO: 3821990 - DNA, 16 bp, Homo sapiens
caccatctggcccagg

SEQ ID NO: 3821991 - DNA, 19 bp, Homo sapiens
caccatctggcccaggctg

SEQ ID NO: 3821992 - DNA, 20 bp, Homo sapiens
caccatctggcccaggctgg

SEQ ID NO: 3821993 - DNA, 20 bp, Homo sapiens
caccatgttggccaggctgg

SEQ ID NO: 3821994 - DNA, 15 bp, Homo sapiens
cacccaacttcccct

SEQ ID NO: 3821995 - DNA, 19 bp, Homo sapiens
cacccaccttccttgcgac

SEQ ID NO: 3821996 - DNA, 20 bp, Homo sapiens
cacccagagctgcctatgcc

SEQ ID NO: 3821997 - DNA, 19 bp, Homo sapiens
cacccagcctcagtcctcc

SEQ ID NO: 3821998 - DNA, 13 bp, Homo sapiens
caccccagactcc

SEQ ID NO: 3821999 - DNA, 22 bp, Homo sapiens
caccccaggcagctcctgtttg

SEQ ID NO: 3822000 - DNA, 12 bp, Homo sapiens
cacccccagcca

SEQ ID NO: 3822001 - DNA, 14 bp, Homo sapiens
cacccccagccagg

SEQ ID NO: 3822002 - DNA, 15 bp, Homo sapiens
cacccccagccaggc

SEQ ID NO: 3822003 - DNA, 18 bp, Homo sapiens
cacccccgagcttgcctc

SEQ ID NO: 3822004 - DNA, 21 bp, Homo sapiens
cacccccgagcttgcctcagg

SEQ ID NO: 3822005 - DNA, 14 bp, Homo sapiens
caccccctgccctg

SEQ ID NO: 3822006 - DNA, 16 bp, Homo sapiens
caccccctgccctgca

SEQ ID NO: 3822007 - DNA, 17 bp, Homo sapiens
caccccgggctctcctg

SEQ ID NO: 3822008 - DNA, 17 bp, Homo sapiens
caccccggggaccctgt

SEQ ID NO: 3822009 - DNA, 13 bp, Homo sapiens
cacccctgccccc

SEQ ID NO: 3822010 - DNA, 18 bp, Homo sapiens
cacccctgtcctcactgc

SEQ ID NO: 3822011 - DNA, 12 bp, Homo sapiens
caccccttctct

SEQ ID NO: 3822012 - DNA, 15 bp, Homo sapiens
cacccgcctccctct

SEQ ID NO: 3822013 - DNA, 22 bp, Homo sapiens
caccctctgttagtgccgcaat

SEQ ID NO: 3822014 - DNA, 21 bp, Homo sapiens
caccgcattagagctcgaaat

SEQ ID NO: 3822015 - DNA, 12 bp, Homo sapiens
caccgccctgcc

SEQ ID NO: 3822016 - DNA, 12 bp, Homo sapiens
cacctcatgccc

SEQ ID NO: 3822017 - DNA, 17 bp, Homo sapiens
cacctcatgcccacccc

SEQ ID NO: 3822018 - DNA, 19 bp, Homo sapiens
cacctcatgcccaccccct

SEQ ID NO: 3822019 - DNA, 22 bp, Homo sapiens
cacctcatgcccaccccctgcc

SEQ ID NO: 3822020 - DNA, 17 bp, Homo sapiens
cacctccccacgccctc

SEQ ID NO: 3822021 - DNA, 19 bp, Homo sapiens
cacctccccacgccctccc

SEQ ID NO: 3822022 - DNA, 15 bp, Homo sapiens
cacctccccactcca

SEQ ID NO: 3822023 - DNA, 16 bp, Homo sapiens
cacctccccactccag

SEQ ID NO: 3822024 - DNA, 18 bp, Homo sapiens
cacctccccagacagggc

SEQ ID NO: 3822025 - DNA, 20 bp, Homo sapiens
cacctccccagacagggctc

SEQ ID NO: 3822026 - DNA, 21 bp, Homo sapiens
cacctccccagacagggctcc

SEQ ID NO: 3822027 - DNA, 22 bp, Homo sapiens
cacctccccagacagggctcca

SEQ ID NO: 3822028 - DNA, 23 bp, Homo sapiens
cacctccccagacagggctccag

SEQ ID NO: 3822029 - DNA, 20 bp, Homo sapiens
cacctctccagctcctccca

SEQ ID NO: 3822030 - DNA, 18 bp, Homo sapiens
cacctctgcggaccccag

SEQ ID NO: 3822031 - DNA, 22 bp, Homo sapiens
cacctctgcggaccccagctgt

SEQ ID NO: 3822032 - DNA, 14 bp, Homo sapiens
cacctctgtgacct

SEQ ID NO: 3822033 - DNA, 15 bp, Homo sapiens
cacctctgtgacctc

SEQ ID NO: 3822034 - DNA, 19 bp, Homo sapiens
cacctctgtgacctcaggc

SEQ ID NO: 3822035 - DNA, 16 bp, Homo sapiens
cacctgcacagggccc

SEQ ID NO: 3822036 - DNA, 17 bp, Homo sapiens
cacctgcacagggccct

SEQ ID NO: 3822037 - DNA, 17 bp, Homo sapiens
cacctgcgcagggccct

SEQ ID NO: 3822038 - DNA, 21 bp, Homo sapiens
cacctggctgaggttcctctg

SEQ ID NO: 3822039 - DNA, 19 bp, Homo sapiens
cacgatttagatttaatga

SEQ ID NO: 3822040 - DNA, 16 bp, Homo sapiens
cacgccctcccctccc

SEQ ID NO: 3822041 - DNA, 24 bp, Homo sapiens
cacgccctcccctcccctgctgca

SEQ ID NO: 3822042 - DNA, 15 bp, Homo sapiens
cactacacctggctg

SEQ ID NO: 3822043 - DNA, 18 bp, Homo sapiens
cactagcctttggctctg

SEQ ID NO: 3822044 - DNA, 20 bp, Homo sapiens
cactagcctttggctctgga

SEQ ID NO: 3822045 - DNA, 21 bp, Homo sapiens
cactagcctttggctctggag

SEQ ID NO: 3822046 - DNA, 20 bp, Homo sapiens
cactcatcactaaacagaga

SEQ ID NO: 3822047 - DNA, 11 bp, Homo sapiens
cactccagcag

SEQ ID NO: 3822048 - DNA, 12 bp, Homo sapiens
cactccagcaga

SEQ ID NO: 3822049 - DNA, 23 bp, Homo sapiens
cactccagcagataaggccgagc

SEQ ID NO: 3822050 - DNA, 19 bp, Homo sapiens
cactccataaaaagaaagc

SEQ ID NO: 3822051 - DNA, 12 bp, Homo sapiens
cactgccaggcc

SEQ ID NO: 3822052 - DNA, 15 bp, Homo sapiens
atgtttttttttaaa

SEQ ID NO: 3822053 - DNA, 13 bp, Homo sapiens
attaaaatatttg

SEQ ID NO: 3822054 - DNA, 17 bp, Homo sapiens
attaaactgtaaatcat

SEQ ID NO: 3822055 - DNA, 15 bp, Homo sapiens
attaaatatatcttt

SEQ ID NO: 3822056 - DNA, 21 bp, Homo sapiens
attaacatgaatatttagtgt

SEQ ID NO: 3822057 - DNA, 16 bp, Homo sapiens
attaagaaagattaaa

SEQ ID NO: 3822058 - DNA, 17 bp, Homo sapiens
attaagaaagattaaat

SEQ ID NO: 3822059 - DNA, 22 bp, Homo sapiens
attaagcttaaaaaagaaagat

SEQ ID NO: 3822060 - DNA, 13 bp, Homo sapiens
attaagtgaaatt

SEQ ID NO: 3822061 - DNA, 14 bp, Homo sapiens
attaagtgaaattt

SEQ ID NO: 3822062 - DNA, 15 bp, Homo sapiens
attaatgctaagggc

SEQ ID NO: 3822063 - DNA, 14 bp, Homo sapiens
attaattaacatca

SEQ ID NO: 3822064 - DNA, 14 bp, Homo sapiens
attacatgaagatt

SEQ ID NO: 3822065 - DNA, 12 bp, Homo sapiens
attacccaaaag

SEQ ID NO: 3822066 - DNA, 19 bp, Homo sapiens
attacttctagtcagtcat

SEQ ID NO: 3822067 - DNA, 23 bp, Homo sapiens
attagacaggttaaatatataaa

SEQ ID NO: 3822068 - DNA, 22 bp, Homo sapiens
attagagctcgaaataaaggcg

SEQ ID NO: 3822069 - DNA, 23 bp, Homo sapiens
attaggaaggccatggggcagcc

SEQ ID NO: 3822070 - DNA, 12 bp, Homo sapiens
attatactgtag

SEQ ID NO: 3822071 - DNA, 19 bp, Homo sapiens
attatactgtagatttcag

SEQ ID NO: 3822072 - DNA, 15 bp, Homo sapiens
attatagtactgctt

SEQ ID NO: 3822073 - DNA, 21 bp, Homo sapiens
attatagtactgctttactgt

SEQ ID NO: 3822074 - DNA, 14 bp, Homo sapiens
attatcaagctaat

SEQ ID NO: 3822075 - DNA, 15 bp, Homo sapiens
attatcaagctaata

SEQ ID NO: 3822076 - DNA, 17 bp, Homo sapiens
attatcaagctaataaa

SEQ ID NO: 3822077 - DNA, 14 bp, Homo sapiens
attatgtaaagttt

SEQ ID NO: 3822078 - DNA, 12 bp, Homo sapiens
attatttggaaa

SEQ ID NO: 3822079 - DNA, 16 bp, Homo sapiens
attattttgaaacttt

SEQ ID NO: 3822080 - DNA, 17 bp, Homo sapiens
attatttttttaaactt

SEQ ID NO: 3822081 - DNA, 14 bp, Homo sapiens
attcaaatgttaca

SEQ ID NO: 3822082 - DNA, 19 bp, Homo sapiens
attcacatgctggctcctg

SEQ ID NO: 3822083 - DNA, 20 bp, Homo sapiens
attcacatgctggctcctga

SEQ ID NO: 3822084 - DNA, 15 bp, Homo sapiens
attcagcttcctgct

SEQ ID NO: 3822085 - DNA, 20 bp, Homo sapiens
attcaggcttgcattaaaag

SEQ ID NO: 3822086 - DNA, 21 bp, Homo sapiens
attcatacaacaaagaggatt

SEQ ID NO: 3822087 - DNA, 21 bp, Homo sapiens
attcatggttttaaagctaaa

SEQ ID NO: 3822088 - DNA, 15 bp, Homo sapiens
attcatttattaagt

SEQ ID NO: 3822089 - DNA, 15 bp, Homo sapiens
attccagctcctccg

SEQ ID NO: 3822090 - DNA, 12 bp, Homo sapiens
attcccaggagt

SEQ ID NO: 3822091 - DNA, 19 bp, Homo sapiens
attccctgcccccaatttc

SEQ ID NO: 3822092 - DNA, 17 bp, Homo sapiens
attcctaaaactctgcc

SEQ ID NO: 3822093 - DNA, 15 bp, Homo sapiens
attcctaaggcccag

SEQ ID NO: 3822094 - DNA, 23 bp, Homo sapiens
attcctaaggcccagctgccagg

SEQ ID NO: 3822095 - DNA, 16 bp, Homo sapiens
attcgacctgatttac

SEQ ID NO: 3822096 - DNA, 17 bp, Homo sapiens
attctaatgatggccca

SEQ ID NO: 3822097 - DNA, 12 bp, Homo sapiens
attctacttgct

SEQ ID NO: 3822098 - DNA, 16 bp, Homo sapiens
attctacttgctctgg

SEQ ID NO: 3822099 - DNA, 23 bp, Homo sapiens
attctacttgctctggacctgcc

SEQ ID NO: 3822100 - DNA, 18 bp, Homo sapiens
attctattttcattttct

SEQ ID NO: 3822101 - DNA, 24 bp, Homo sapiens
attctcccaggtaccagctgcgct

SEQ ID NO: 3822102 - DNA, 22 bp, Homo sapiens
attctcttactttttgtaaatg

SEQ ID NO: 3822103 - DNA, 22 bp, Homo sapiens
attctgaccttgtgaacatcag

SEQ ID NO: 3822104 - DNA, 13 bp, Homo sapiens
attcttgaaagta

SEQ ID NO: 3822105 - DNA, 22 bp, Homo sapiens
attcttggcccgcacagagctg

SEQ ID NO: 3822106 - DNA, 19 bp, Homo sapiens
attctttctttttccttca

SEQ ID NO: 3822107 - DNA, 17 bp, Homo sapiens
attgaaacaacattatt

SEQ ID NO: 3822108 - DNA, 15 bp, Homo sapiens
attgaactgcaggtg

SEQ ID NO: 3822109 - DNA, 20 bp, Homo sapiens
attgagagtaacttaagtta

SEQ ID NO: 3822110 - DNA, 13 bp, Homo sapiens
attgcccacttct

SEQ ID NO: 3822111 - DNA, 13 bp, Homo sapiens
attgctcaaaaaa

SEQ ID NO: 3822112 - DNA, 19 bp, Homo sapiens
attgctgcattttaagcat

SEQ ID NO: 3822113 - DNA, 21 bp, Homo sapiens
attgctgcattttaagcataa

SEQ ID NO: 3822114 - DNA, 15 bp, Homo sapiens
attgctttataaata

SEQ ID NO: 3822115 - DNA, 16 bp, Homo sapiens
attgctttataaataa

SEQ ID NO: 3822116 - DNA, 17 bp, Homo sapiens
attgctttataaataaa

SEQ ID NO: 3822117 - DNA, 16 bp, Homo sapiens
attggatttttttaaa

SEQ ID NO: 3822118 - DNA, 20 bp, Homo sapiens
attgggagcaatctggaaaa

SEQ ID NO: 3822119 - DNA, 13 bp, Homo sapiens
attgggcaataaa

SEQ ID NO: 3822120 - DNA, 17 bp, Homo sapiens
attgggcaataaaagat

SEQ ID NO: 3822121 - DNA, 19 bp, Homo sapiens
attgtaatattaaaaagaa

SEQ ID NO: 3822122 - DNA, 13 bp, Homo sapiens
attgtacaaaaaa

SEQ ID NO: 3822123 - DNA, 20 bp, Homo sapiens
attgtacaaaaaagttataa

SEQ ID NO: 3822124 - DNA, 21 bp, Homo sapiens
attgtacagtttgtttacaca

SEQ ID NO: 3822125 - DNA, 21 bp, Homo sapiens
attgtattatagtactgcttt

SEQ ID NO: 3822126 - DNA, 13 bp, Homo sapiens
attgtattcagag

SEQ ID NO: 3822127 - DNA, 20 bp, Homo sapiens
attgtgtttatgcatttcaa

SEQ ID NO: 3822128 - DNA, 14 bp, Homo sapiens
attgtgttttaaca

SEQ ID NO: 3822129 - DNA, 17 bp, Homo sapiens
attgttcataatacata

SEQ ID NO: 3822130 - DNA, 13 bp, Homo sapiens
attgttttgttaa

SEQ ID NO: 3822131 - DNA, 14 bp, Homo sapiens
attgttttgttaac

SEQ ID NO: 3822132 - DNA, 13 bp, Homo sapiens
atttaacttgagc

SEQ ID NO: 3822133 - DNA, 19 bp, Homo sapiens
atttaacttgagctttaaa

SEQ ID NO: 3822134 - DNA, 19 bp, Homo sapiens
atttaagggaatgtgagca

SEQ ID NO: 3822135 - DNA, 14 bp, Homo sapiens
atttaatcaggagg

SEQ ID NO: 3822136 - DNA, 16 bp, Homo sapiens
atttagacaagagatg

SEQ ID NO: 3822137 - DNA, 17 bp, Homo sapiens
atttagtgttcataaat

SEQ ID NO: 3822138 - DNA, 15 bp, Homo sapiens
atttataaacttttt

SEQ ID NO: 3822139 - DNA, 22 bp, Homo sapiens
atttataacagttataaagaaa

SEQ ID NO: 3822140 - DNA, 16 bp, Homo sapiens
atttataactaatatg

SEQ ID NO: 3822141 - DNA, 13 bp, Homo sapiens
atttatacaaaga

SEQ ID NO: 3822142 - DNA, 14 bp, Homo sapiens
atttatacaaagaa

SEQ ID NO: 3822143 - DNA, 17 bp, Homo sapiens
atttatacaaagaaact

SEQ ID NO: 3822144 - DNA, 20 bp, Homo sapiens
atttatacaaagaaactttt

SEQ ID NO: 3822145 - DNA, 22 bp, Homo sapiens
atttatgcatattattttatgt

SEQ ID NO: 3822146 - DNA, 22 bp, Homo sapiens
atttattaagtatatttgtaaa

SEQ ID NO: 3822147 - DNA, 21 bp, Homo sapiens
atttcaatggtgttggcttcc

SEQ ID NO: 3822148 - DNA, 14 bp, Homo sapiens
atttcataaattaa

SEQ ID NO: 3822149 - DNA, 21 bp, Homo sapiens
atttcataaattaacaaagtg

SEQ ID NO: 3822150 - DNA, 17 bp, Homo sapiens
atttcatatatctatat

SEQ ID NO: 3822151 - DNA, 13 bp, Homo sapiens
atttcccatctgc

SEQ ID NO: 3822152 - DNA, 18 bp, Homo sapiens
atttgaaacactttgcat

SEQ ID NO: 3822153 - DNA, 16 bp, Homo sapiens
atttgaacaaaaattg

SEQ ID NO: 3822154 - DNA, 21 bp, Homo sapiens
atttgctatctgaactaattc

SEQ ID NO: 3822155 - DNA, 23 bp, Homo sapiens
atttggcaggatcggcttcctca

SEQ ID NO: 3822156 - DNA, 17 bp, Homo sapiens
atttggggcatttgtaa

SEQ ID NO: 3822157 - DNA, 21 bp, Homo sapiens
atttggtttttgtcttgcatt

SEQ ID NO: 3822158 - DNA, 23 bp, Homo sapiens
atttggtttttgtcttgcatttt

SEQ ID NO: 3822159 - DNA, 23 bp, Homo sapiens
atttgtaaaaagtagattaaaat

SEQ ID NO: 3822160 - DNA, 12 bp, Homo sapiens
atttgtctgtgt

SEQ ID NO: 3822161 - DNA, 13 bp, Homo sapiens
atttgtctgtgtg

SEQ ID NO: 3822162 - DNA, 15 bp, Homo sapiens
atttgtctgtgtgct

SEQ ID NO: 3822163 - DNA, 16 bp, Homo sapiens
atttgtctgtgtgcta

SEQ ID NO: 3822164 - DNA, 23 bp, Homo sapiens
atttgtctgtgtgctactaacag

SEQ ID NO: 3822165 - DNA, 15 bp, Homo sapiens
atttgtttgtgcttc

SEQ ID NO: 3822166 - DNA, 17 bp, Homo sapiens
atttgtttgtgcttcta

SEQ ID NO: 3822167 - DNA, 22 bp, Homo sapiens
attttaaatgctgtatgtcatt

SEQ ID NO: 3822168 - DNA, 15 bp, Homo sapiens
attttaagcataatt

SEQ ID NO: 3822169 - DNA, 13 bp, Homo sapiens
attttatgtgctt

SEQ ID NO: 3822170 - DNA, 14 bp, Homo sapiens
attttatgttgcat

SEQ ID NO: 3822171 - DNA, 21 bp, Homo sapiens
attttatgttgcatagaataa

SEQ ID NO: 3822172 - DNA, 13 bp, Homo sapiens
attttattagaca

SEQ ID NO: 3822173 - DNA, 23 bp, Homo sapiens
attttatttctttttgattttta

SEQ ID NO: 3822174 - DNA, 19 bp, Homo sapiens
attttcaaaagaaaaccca

SEQ ID NO: 3822175 - DNA, 17 bp, Homo sapiens
attttcattttctgcaa

SEQ ID NO: 3822176 - DNA, 16 bp, Homo sapiens
attttcctaatggtct

SEQ ID NO: 3822177 - DNA, 13 bp, Homo sapiens
attttccttgaag

SEQ ID NO: 3822178 - DNA, 14 bp, Homo sapiens
attttctaaattct

SEQ ID NO: 3822179 - DNA, 12 bp, Homo sapiens
attttctgcaag

SEQ ID NO: 3822180 - DNA, 16 bp, Homo sapiens
attttctgcaagcctg

SEQ ID NO: 3822181 - DNA, 22 bp, Homo sapiens
attttctttttctgaagcctct

SEQ ID NO: 3822182 - DNA, 17 bp, Homo sapiens
attttgcaaatctgtta

SEQ ID NO: 3822183 - DNA, 13 bp, Homo sapiens
attttgtgaaatt

SEQ ID NO: 3822184 - DNA, 15 bp, Homo sapiens
attttgtgaaatttc

SEQ ID NO: 3822185 - DNA, 22 bp, Homo sapiens
attttgtgaaatttcatgaaaa

SEQ ID NO: 3822186 - DNA, 21 bp, Homo sapiens
attttgtgggcttaattgaaa

SEQ ID NO: 3822187 - DNA, 15 bp, Homo sapiens
attttgttttaatct

SEQ ID NO: 3822188 - DNA, 11 bp, Homo sapiens
atttttaaatc

SEQ ID NO: 3822189 - DNA, 17 bp, Homo sapiens
atttttggcattcctct

SEQ ID NO: 3822190 - DNA, 16 bp, Homo sapiens
atttttgtaaatagtt

SEQ ID NO: 3822191 - DNA, 15 bp, Homo sapiens
attttttaaaacaag

SEQ ID NO: 3822192 - DNA, 17 bp, Homo sapiens
attttttaaaacaagaa

SEQ ID NO: 3822193 - DNA, 19 bp, Homo sapiens
attttttaaatgttcatgt

SEQ ID NO: 3822194 - DNA, 21 bp, Homo sapiens
attttttaaatgttcatgtca

SEQ ID NO: 3822195 - DNA, 15 bp, Homo sapiens
atttttttttctaag

SEQ ID NO: 3822196 - DNA, 18 bp, Homo sapiens
atttttttttctaagaga

SEQ ID NO: 3822197 - DNA, 22 bp, Homo sapiens
caaaaaaaaaaaaaagcatcta

SEQ ID NO: 3822198 - DNA, 15 bp, Homo sapiens
caaaaaagttataag

SEQ ID NO: 3822199 - DNA, 20 bp, Homo sapiens
caaaaattgagagctttatt

SEQ ID NO: 3822200 - DNA, 16 bp, Homo sapiens
caaaacttcctgtttg

SEQ ID NO: 3822201 - DNA, 18 bp, Homo sapiens
caaaactttttaaatttt

SEQ ID NO: 3822202 - DNA, 22 bp, Homo sapiens
caaaaggtactggtgagggcaa

SEQ ID NO: 3822203 - DNA, 17 bp, Homo sapiens
caaaagttcgaaagaaa

SEQ ID NO: 3822204 - DNA, 21 bp, Homo sapiens
caaaatcccttaatctatgtg

SEQ ID NO: 3822205 - DNA, 21 bp, Homo sapiens
caaaatttagatttaatttac

SEQ ID NO: 3822206 - DNA, 21 bp, Homo sapiens
caaaattttgtcccatctcta

SEQ ID NO: 3822207 - DNA, 16 bp, Homo sapiens
caaacctctccttcct

SEQ ID NO: 3822208 - DNA, 20 bp, Homo sapiens
caaacctctccttcctcaga

SEQ ID NO: 3822209 - DNA, 21 bp, Homo sapiens
caaacgctaaagagcccttgc

SEQ ID NO: 3822210 - DNA, 22 bp, Homo sapiens
caaacgctaaagagcccttgcc

SEQ ID NO: 3822211 - DNA, 23 bp, Homo sapiens
caaagaaactttttaataaagta

SEQ ID NO: 3822212 - DNA, 15 bp, Homo sapiens
caaagaaattatgtg

SEQ ID NO: 3822213 - DNA, 18 bp, Homo sapiens
caaagaccttgtgtgtat

SEQ ID NO: 3822214 - DNA, 14 bp, Homo sapiens
caaagaggattaga

SEQ ID NO: 3822215 - DNA, 16 bp, Homo sapiens
caaagagggcttcctc

SEQ ID NO: 3822216 - DNA, 15 bp, Homo sapiens
caaagatctgctcct

SEQ ID NO: 3822217 - DNA, 17 bp, Homo sapiens
caaagcaagctcttctc

SEQ ID NO: 3822218 - DNA, 19 bp, Homo sapiens
caaagccccatgctggagc

SEQ ID NO: 3822219 - DNA, 20 bp, Homo sapiens
caaagccccatgctggagcc

SEQ ID NO: 3822220 - DNA, 21 bp, Homo sapiens
caaagccccatgctggagcct

SEQ ID NO: 3822221 - DNA, 16 bp, Homo sapiens
caaagctctaaggtaa

SEQ ID NO: 3822222 - DNA, 16 bp, Homo sapiens
caaagtgtcactccat

SEQ ID NO: 3822223 - DNA, 11 bp, Homo sapiens
caaataaacac

SEQ ID NO: 3822224 - DNA, 15 bp, Homo sapiens
caaataaacactgtg

SEQ ID NO: 3822225 - DNA, 14 bp, Homo sapiens
caaataaagcctgc

SEQ ID NO: 3822226 - DNA, 15 bp, Homo sapiens
caaataaagcctgct

SEQ ID NO: 3822227 - DNA, 20 bp, Homo sapiens
caaataaaggctctggaagc

SEQ ID NO: 3822228 - DNA, 15 bp, Homo sapiens
caaatcaatacacta

SEQ ID NO: 3822229 - DNA, 11 bp, Homo sapiens
caaatgactac

SEQ ID NO: 3822230 - DNA, 15 bp, Homo sapiens
caaatgtaaagtcta

SEQ ID NO: 3822231 - DNA, 13 bp, Homo sapiens
caaatgtgaaaga

SEQ ID NO: 3822232 - DNA, 20 bp, Homo sapiens
caaatgtgaaagatgcatgt

SEQ ID NO: 3822233 - DNA, 13 bp, Homo sapiens
caaattaccaaat

SEQ ID NO: 3822234 - DNA, 21 bp, Homo sapiens
caaattgattcaaatgttaca

SEQ ID NO: 3822235 - DNA, 13 bp, Homo sapiens
caacaaaaacaaa

SEQ ID NO: 3822236 - DNA, 14 bp, Homo sapiens
caacaacaaaaaca

SEQ ID NO: 3822237 - DNA, 12 bp, Homo sapiens
caacacacagga

SEQ ID NO: 3822238 - DNA, 20 bp, Homo sapiens
caacatcatatacctcttga

SEQ ID NO: 3822239 - DNA, 22 bp, Homo sapiens
caaccactcggggcccccatct

SEQ ID NO: 3822240 - DNA, 17 bp, Homo sapiens
caacctgtaataaatat

SEQ ID NO: 3822241 - DNA, 21 bp, Homo sapiens
caacctgtaataaatatgagt

SEQ ID NO: 3822242 - DNA, 23 bp, Homo sapiens
caaccttgtaaattccccttccc

SEQ ID NO: 3822243 - DNA, 21 bp, Homo sapiens
caacgcaaacctctccttcct

SEQ ID NO: 3822244 - DNA, 20 bp, Homo sapiens
caacgctgattcctaaggcc

SEQ ID NO: 3822245 - DNA, 20 bp, Homo sapiens
caactccagctgagtcctgg

SEQ ID NO: 3822246 - DNA, 22 bp, Homo sapiens
caactccagctgagtcctgggg

SEQ ID NO: 3822247 - DNA, 22 bp, Homo sapiens
caacttccccttagagtgctgt

SEQ ID NO: 3822248 - DNA, 23 bp, Homo sapiens
caacttctccatcctttctgcct

SEQ ID NO: 3822249 - DNA, 13 bp, Homo sapiens
caacttgtctctg

SEQ ID NO: 3822250 - DNA, 22 bp, Homo sapiens
caactttcccttgccctgggct

SEQ ID NO: 3822251 - DNA, 12 bp, Homo sapiens
caactttgtata

SEQ ID NO: 3822252 - DNA, 13 bp, Homo sapiens
caagaaagtttcc

SEQ ID NO: 3822253 - DNA, 14 bp, Homo sapiens
caagaggtgcctgg

SEQ ID NO: 3822254 - DNA, 20 bp, Homo sapiens
caagaggtgcctgggaggag

SEQ ID NO: 3822255 - DNA, 13 bp, Homo sapiens
caagattcccagg

SEQ ID NO: 3822256 - DNA, 15 bp, Homo sapiens
caagcaaatgtgaat

SEQ ID NO: 3822257 - DNA, 19 bp, Homo sapiens
caagcaaatgtgaatcatt

SEQ ID NO: 3822258 - DNA, 12 bp, Homo sapiens
caagcagaaaac

SEQ ID NO: 3822259 - DNA, 23 bp, Homo sapiens
caagctaataaaatatcattcag

SEQ ID NO: 3822260 - DNA, 14 bp, Homo sapiens
caagctaattttct

SEQ ID NO: 3822261 - DNA, 20 bp, Homo sapiens
caagctcttctcctcagctt

SEQ ID NO: 3822262 - DNA, 15 bp, Homo sapiens
caaggacagtcagca

SEQ ID NO: 3822263 - DNA, 16 bp, Homo sapiens
caaggatttttaaaac

SEQ ID NO: 3822264 - DNA, 13 bp, Homo sapiens
caaggctgtgcca

SEQ ID NO: 3822265 - DNA, 15 bp, Homo sapiens
caaggctgtgccagg

SEQ ID NO: 3822266 - DNA, 16 bp, Homo sapiens
caaggctgtgccaggc

SEQ ID NO: 3822267 - DNA, 17 bp, Homo sapiens
caaggctgtgccaggct

SEQ ID NO: 3822268 - DNA, 21 bp, Homo sapiens
caaggctgtgccaggctggga

SEQ ID NO: 3822269 - DNA, 14 bp, Homo sapiens
caagggaaaggggt

SEQ ID NO: 3822270 - DNA, 21 bp, Homo sapiens
caagggaaaggggtgctttta

SEQ ID NO: 3822271 - DNA, 16 bp, Homo sapiens
caaggggcagccagcc

SEQ ID NO: 3822272 - DNA, 17 bp, Homo sapiens
caagtaagacatctcaa

SEQ ID NO: 3822273 - DNA, 22 bp, Homo sapiens
caagtaagacatctcaaataca

SEQ ID NO: 3822274 - DNA, 17 bp, Homo sapiens
caagtaatcctgcacag

SEQ ID NO: 3822275 - DNA, 15 bp, Homo sapiens
caagtattaaactgt

SEQ ID NO: 3822276 - DNA, 19 bp, Homo sapiens
caagtattaaactgtaaat

SEQ ID NO: 3822277 - DNA, 16 bp, Homo sapiens
caagtgattctcctgc

SEQ ID NO: 3822278 - DNA, 15 bp, Homo sapiens
agaccgtcctcaccc

SEQ ID NO: 3822279 - DNA, 19 bp, Homo sapiens
agaccgtcctcacccctgt

SEQ ID NO: 3822280 - DNA, 20 bp, Homo sapiens
agaccgtcctcacccctgtc

SEQ ID NO: 3822281 - DNA, 17 bp, Homo sapiens
agacctccccagcccct

SEQ ID NO: 3822282 - DNA, 14 bp, Homo sapiens
agacctctcccacc

SEQ ID NO: 3822283 - DNA, 16 bp, Homo sapiens
agacctctcccaccca

SEQ ID NO: 3822284 - DNA, 21 bp, Homo sapiens
agacctgctgtaataaatgta

SEQ ID NO: 3822285 - DNA, 20 bp, Homo sapiens
agacctttgtctgaaggatt

SEQ ID NO: 3822286 - DNA, 16 bp, Homo sapiens
agactccgctgtggga

SEQ ID NO: 3822287 - DNA, 17 bp, Homo sapiens
agactgttttcagacct

SEQ ID NO: 3822288 - DNA, 19 bp, Homo sapiens
agacttcaccaaatatatg

SEQ ID NO: 3822289 - DNA, 22 bp, Homo sapiens
agagaaagccaggcaggtagcc

SEQ ID NO: 3822290 - DNA, 20 bp, Homo sapiens
agagaaatcaatagtgcaac

SEQ ID NO: 3822291 - DNA, 14 bp, Homo sapiens
agagagaaagccag

SEQ ID NO: 3822292 - DNA, 15 bp, Homo sapiens
agagagagagagaga

SEQ ID NO: 3822293 - DNA, 24 bp, Homo sapiens
agagagagggcgcccagcccaggc

SEQ ID NO: 3822294 - DNA, 16 bp, Homo sapiens
agagagcggtctcagg

SEQ ID NO: 3822295 - DNA, 15 bp, Homo sapiens
agagaggagaggaga

SEQ ID NO: 3822296 - DNA, 20 bp, Homo sapiens
agagagggcgcccagcccag

SEQ ID NO: 3822297 - DNA, 21 bp, Homo sapiens
agagagggcgcccagcccagg

SEQ ID NO: 3822298 - DNA, 24 bp, Homo sapiens
agagatggctccttgggatgaaga

SEQ ID NO: 3822299 - DNA, 16 bp, Homo sapiens
agagcaagtctgcagg

SEQ ID NO: 3822300 - DNA, 19 bp, Homo sapiens
agagcaggctttgtgagag

SEQ ID NO: 3822301 - DNA, 20 bp, Homo sapiens
agagccaggcacacactgtg

SEQ ID NO: 3822302 - DNA, 14 bp, Homo sapiens
agagcccttgcctc

SEQ ID NO: 3822303 - DNA, 23 bp, Homo sapiens
agagcctgaaatcatctttgttg

SEQ ID NO: 3822304 - DNA, 14 bp, Homo sapiens
agagctcctgagtg

SEQ ID NO: 3822305 - DNA, 16 bp, Homo sapiens
agagctcgaaataaag

SEQ ID NO: 3822306 - DNA, 16 bp, Homo sapiens
agagctgtggagaggg

SEQ ID NO: 3822307 - DNA, 20 bp, Homo sapiens
agagctgtggcacagacccc

SEQ ID NO: 3822308 - DNA, 15 bp, Homo sapiens
agagctttattgctg

SEQ ID NO: 3822309 - DNA, 21 bp, Homo sapiens
agagctttattgctgcatttt

SEQ ID NO: 3822310 - DNA, 18 bp, Homo sapiens
agaggaagccttcttaga

SEQ ID NO: 3822311 - DNA, 16 bp, Homo sapiens
agaggacctccatgcc

SEQ ID NO: 3822312 - DNA, 10 bp, Homo sapiens
agaggagaga

SEQ ID NO: 3822313 - DNA, 13 bp, Homo sapiens
agaggagagaggc

SEQ ID NO: 3822314 - DNA, 15 bp, Homo sapiens
agaggagagaggcag

SEQ ID NO: 3822315 - DNA, 17 bp, Homo sapiens
agaggagagaggcagag

SEQ ID NO: 3822316 - DNA, 19 bp, Homo sapiens
agaggattagacagtaaga

SEQ ID NO: 3822317 - DNA, 15 bp, Homo sapiens
agaggcagagagcgg

SEQ ID NO: 3822318 - DNA, 14 bp, Homo sapiens
agaggccaggatgc

SEQ ID NO: 3822319 - DNA, 22 bp, Homo sapiens
agaggccaggatgcctgagccc

SEQ ID NO: 3822320 - DNA, 16 bp, Homo sapiens
agaggctagcttctgc

SEQ ID NO: 3822321 - DNA, 19 bp, Homo sapiens
agaggctagcttctgcttt

SEQ ID NO: 3822322 - DNA, 14 bp, Homo sapiens
agagggcgcccagc

SEQ ID NO: 3822323 - DNA, 15 bp, Homo sapiens
agagggcgcccagcc

SEQ ID NO: 3822324 - DNA, 20 bp, Homo sapiens
agagggcgcccagcccaggc

SEQ ID NO: 3822325 - DNA, 13 bp, Homo sapiens
agagggcttcctc

SEQ ID NO: 3822326 - DNA, 13 bp, Homo sapiens
agaggtgcctggg

SEQ ID NO: 3822327 - DNA, 16 bp, Homo sapiens
agagtccttagcctgg

SEQ ID NO: 3822328 - DNA, 18 bp, Homo sapiens
agagtccttagcctgggc

SEQ ID NO: 3822329 - DNA, 19 bp, Homo sapiens
agagtccttagcctgggcc

SEQ ID NO: 3822330 - DNA, 20 bp, Homo sapiens
agagtccttagcctgggcct

SEQ ID NO: 3822331 - DNA, 21 bp, Homo sapiens
agagtccttagcctgggcctc

SEQ ID NO: 3822332 - DNA, 23 bp, Homo sapiens
agagtccttagcctgggcctcct

SEQ ID NO: 3822333 - DNA, 18 bp, Homo sapiens
agagtgagggcctgaggt

SEQ ID NO: 3822334 - DNA, 15 bp, Homo sapiens
agagtgcataaataa

SEQ ID NO: 3822335 - DNA, 16 bp, Homo sapiens
agagtgggttttgtcc

SEQ ID NO: 3822336 - DNA, 17 bp, Homo sapiens
agagttgggggccagca

SEQ ID NO: 3822337 - DNA, 18 bp, Homo sapiens
agagttgggggccagcac

SEQ ID NO: 3822338 - DNA, 20 bp, Homo sapiens
agagttgggggctaggggag

SEQ ID NO: 3822339 - DNA, 18 bp, Homo sapiens
agagtttacaagaaataa

SEQ ID NO: 3822340 - DNA, 18 bp, Homo sapiens
agataaggccgagcccac

SEQ ID NO: 3822341 - DNA, 19 bp, Homo sapiens
agataaggccgagcccaca

SEQ ID NO: 3822342 - DNA, 13 bp, Homo sapiens
agataagtgcagt

SEQ ID NO: 3822343 - DNA, 19 bp, Homo sapiens
agatacgaatttctataga

SEQ ID NO: 3822344 - DNA, 15 bp, Homo sapiens
agatcacaactgaag

SEQ ID NO: 3822345 - DNA, 18 bp, Homo sapiens
agatccccagggcagcct

SEQ ID NO: 3822346 - DNA, 12 bp, Homo sapiens
agatctgtcctg

SEQ ID NO: 3822347 - DNA, 15 bp, Homo sapiens
agatctgtcctgggg

SEQ ID NO: 3822348 - DNA, 13 bp, Homo sapiens
agatgaagaagga

SEQ ID NO: 3822349 - DNA, 18 bp, Homo sapiens
agatgaagaaggagcaga

SEQ ID NO: 3822350 - DNA, 18 bp, Homo sapiens
agatgaatccaaatgtga

SEQ ID NO: 3822351 - DNA, 20 bp, Homo sapiens
agatgaatccaaatgtgaaa

SEQ ID NO: 3822352 - DNA, 17 bp, Homo sapiens
agatgagtttttcatta

SEQ ID NO: 3822353 - DNA, 23 bp, Homo sapiens
agatgatggggtcagcaggccca

SEQ ID NO: 3822354 - DNA, 11 bp, Homo sapiens
agatgctggag

SEQ ID NO: 3822355 - DNA, 17 bp, Homo sapiens
agatgctggagaagaga

SEQ ID NO: 3822356 - DNA, 21 bp, Homo sapiens
agatgctggagaagagaggag

SEQ ID NO: 3822357 - DNA, 22 bp, Homo sapiens
agtataatgtatgaattttgta

SEQ ID NO: 3822358 - DNA, 15 bp, Homo sapiens
agtatataaatacta

SEQ ID NO: 3822359 - DNA, 14 bp, Homo sapiens
agtatattgaaagt

SEQ ID NO: 3822360 - DNA, 13 bp, Homo sapiens
agtatatttgtaa

SEQ ID NO: 3822361 - DNA, 15 bp, Homo sapiens
agtatatttgtaaaa

SEQ ID NO: 3822362 - DNA, 12 bp, Homo sapiens
agtatcataata

SEQ ID NO: 3822363 - DNA, 16 bp, Homo sapiens
agtattaagtgaaatt

SEQ ID NO: 3822364 - DNA, 19 bp, Homo sapiens
agtattaagtgaaatttta

SEQ ID NO: 3822365 - DNA, 22 bp, Homo sapiens
agtattaagtgaaattttaaat

SEQ ID NO: 3822366 - DNA, 20 bp, Homo sapiens
agtattgtgtttatgcattt

SEQ ID NO: 3822367 - DNA, 19 bp, Homo sapiens
agtcacaattttctgtgcc

SEQ ID NO: 3822368 - DNA, 23 bp, Homo sapiens
agtcactggaggttgaagccaag

SEQ ID NO: 3822369 - DNA, 22 bp, Homo sapiens
agtcagtccagctcatctgcca

SEQ ID NO: 3822370 - DNA, 12 bp, Homo sapiens
agtcatgacaga

SEQ ID NO: 3822371 - DNA, 13 bp, Homo sapiens
agtcatgacagat

SEQ ID NO: 3822372 - DNA, 15 bp, Homo sapiens
agtccattctcccag

SEQ ID NO: 3822373 - DNA, 17 bp, Homo sapiens
agtccattctcccaggt

SEQ ID NO: 3822374 - DNA, 17 bp, Homo sapiens
agtcccaccctgctgct

SEQ ID NO: 3822375 - DNA, 13 bp, Homo sapiens
agtccccacccct

SEQ ID NO: 3822376 - DNA, 20 bp, Homo sapiens
agtccccacccctgccccca

SEQ ID NO: 3822377 - DNA, 14 bp, Homo sapiens
agtcctcccctcac

SEQ ID NO: 3822378 - DNA, 22 bp, Homo sapiens
agtcctcccctcacagcctctg

SEQ ID NO: 3822379 - DNA, 13 bp, Homo sapiens
agtcctgaagcag

SEQ ID NO: 3822380 - DNA, 13 bp, Homo sapiens
agtctagaaaata

SEQ ID NO: 3822381 - DNA, 16 bp, Homo sapiens
agtctagaaaataatg

SEQ ID NO: 3822382 - DNA, 12 bp, Homo sapiens
agtctccttggt

SEQ ID NO: 3822383 - DNA, 15 bp, Homo sapiens
agtctgctctcagct

SEQ ID NO: 3822384 - DNA, 16 bp, Homo sapiens
agtctgctctcagctt

SEQ ID NO: 3822385 - DNA, 18 bp, Homo sapiens
agtctgctctcagcttgt

SEQ ID NO: 3822386 - DNA, 15 bp, Homo sapiens
agtctgtcataatat

SEQ ID NO: 3822387 - DNA, 21 bp, Homo sapiens
agtctgtcataatatttgaac

SEQ ID NO: 3822388 - DNA, 23 bp, Homo sapiens
agtctgtggcccaagagagagac

SEQ ID NO: 3822389 - DNA, 21 bp, Homo sapiens
agtcttgtgactagtgctgaa

SEQ ID NO: 3822390 - DNA, 23 bp, Homo sapiens
agtcttgtgactagtgctgaagc

SEQ ID NO: 3822391 - DNA, 21 bp, Homo sapiens
agtcttttccacatggcagat

SEQ ID NO: 3822392 - DNA, 14 bp, Homo sapiens
agtctttttgaagt

SEQ ID NO: 3822393 - DNA, 14 bp, Homo sapiens
agtgaaattttaaa

SEQ ID NO: 3822394 - DNA, 16 bp, Homo sapiens
agtgaaattttaaatg

SEQ ID NO: 3822395 - DNA, 13 bp, Homo sapiens
agtgagcctggct

SEQ ID NO: 3822396 - DNA, 15 bp, Homo sapiens
agtgagcctggctct

SEQ ID NO: 3822397 - DNA, 12 bp, Homo sapiens
agtgagggcctg

SEQ ID NO: 3822398 - DNA, 18 bp, Homo sapiens
agtgagtctgtcataata

SEQ ID NO: 3822399 - DNA, 13 bp, Homo sapiens
agtgagtgagcct

SEQ ID NO: 3822400 - DNA, 14 bp, Homo sapiens
agtgagtgagcctg

SEQ ID NO: 3822401 - DNA, 13 bp, Homo sapiens
agtgatgttgaaa

SEQ ID NO: 3822402 - DNA, 15 bp, Homo sapiens
agtgattctcctgcc

SEQ ID NO: 3822403 - DNA, 15 bp, Homo sapiens
agtgcaactgttttg

SEQ ID NO: 3822404 - DNA, 16 bp, Homo sapiens
agtgcaactgttttga

SEQ ID NO: 3822405 - DNA, 22 bp, Homo sapiens
agtgccccagatgtacatgtgt

SEQ ID NO: 3822406 - DNA, 15 bp, Homo sapiens
agtgctgaagcttat

SEQ ID NO: 3822407 - DNA, 21 bp, Homo sapiens
agtgctgaagcttattaatgc

SEQ ID NO: 3822408 - DNA, 23 bp, Homo sapiens
agtgctgaagcttattaatgcta

SEQ ID NO: 3822409 - DNA, 20 bp, Homo sapiens
agtgctgggattacaggtgt

SEQ ID NO: 3822410 - DNA, 12 bp, Homo sapiens
agtggagctggc

SEQ ID NO: 3822411 - DNA, 15 bp, Homo sapiens
agtggccctgatcca

SEQ ID NO: 3822412 - DNA, 16 bp, Homo sapiens
agtggccggggctgaa

SEQ ID NO: 3822413 - DNA, 19 bp, Homo sapiens
agtgggcactaagggtgga

SEQ ID NO: 3822414 - DNA, 20 bp, Homo sapiens
agtgggcactaagggtggag

SEQ ID NO: 3822415 - DNA, 14 bp, Homo sapiens
agtggggtgctggg

SEQ ID NO: 3822416 - DNA, 21 bp, Homo sapiens
agtgggtaaatcagggacagg

SEQ ID NO: 3822417 - DNA, 19 bp, Homo sapiens
agtgggtgagatgctggag

SEQ ID NO: 3822418 - DNA, 13 bp, Homo sapiens
agtgggttttgtc

SEQ ID NO: 3822419 - DNA, 20 bp, Homo sapiens
agtggttaagaatgtatatc

SEQ ID NO: 3822420 - DNA, 22 bp, Homo sapiens
agtggtttccctgcccgaggtc

SEQ ID NO: 3822421 - DNA, 18 bp, Homo sapiens
agtggttttatactgaag

SEQ ID NO: 3822422 - DNA, 23 bp, Homo sapiens
agtggttttatactgaaggaaaa

SEQ ID NO: 3822423 - DNA, 20 bp, Homo sapiens
agtgtcaaataaacactgtg

SEQ ID NO: 3822424 - DNA, 21 bp, Homo sapiens
agtgtcaaataaacactgtgt

SEQ ID NO: 3822425 - DNA, 13 bp, Homo sapiens
agtgtcacctgca

SEQ ID NO: 3822426 - DNA, 15 bp, Homo sapiens
agtgtcacctgcaca

SEQ ID NO: 3822427 - DNA, 16 bp, Homo sapiens
agtgtcactccataaa

SEQ ID NO: 3822428 - DNA, 17 bp, Homo sapiens
agtgtcactccataaaa

SEQ ID NO: 3822429 - DNA, 16 bp, Homo sapiens
agtgtgctttataaaa

SEQ ID NO: 3822430 - DNA, 17 bp, Homo sapiens
agtgtgctttataaaaa

SEQ ID NO: 3822431 - DNA, 13 bp, Homo sapiens
agtgtggcctgga

SEQ ID NO: 3822432 - DNA, 14 bp, Homo sapiens
agtgttttacaatg

SEQ ID NO: 3822433 - DNA, 23 bp, Homo sapiens
agttagccaaacaacaacaaaaa

SEQ ID NO: 3822434 - DNA, 13 bp, Homo sapiens
agttataaagaaa

SEQ ID NO: 3822435 - DNA, 12 bp, Homo sapiens
agttataagaaa

SEQ ID NO: 3822436 - DNA, 15 bp, Homo sapiens
agttatatagataaa

SEQ ID NO: 3822437 - DNA, 12 bp, Homo sapiens
agttcattcctg

SEQ ID NO: 3822438 - DNA, 16 bp, Homo sapiens
agttcccaaagggagg

SEQ ID NO: 3822439 - DNA, 17 bp, Homo sapiens
agttcccaaagggaggg

SEQ ID NO: 3822440 - DNA, 15 bp, Homo sapiens
agttctctgtaatta

SEQ ID NO: 3822441 - DNA, 21 bp, Homo sapiens
agttctctgtaattacaacta

SEQ ID NO: 3822442 - DNA, 16 bp, Homo sapiens
agttgctttggattct

SEQ ID NO: 3822443 - DNA, 24 bp, Homo sapiens
agttgctttggattctctaagatg

SEQ ID NO: 3822444 - DNA, 18 bp, Homo sapiens
agttggctaggggagcag

SEQ ID NO: 3822445 - DNA, 13 bp, Homo sapiens
agttgggggccag

SEQ ID NO: 3822446 - DNA, 17 bp, Homo sapiens
agttgggggccagcaca

SEQ ID NO: 3822447 - DNA, 20 bp, Homo sapiens
agttgtaatagagaatattt

SEQ ID NO: 3822448 - DNA, 21 bp, Homo sapiens
agtttaagtaagtaagtttca

SEQ ID NO: 3822449 - DNA, 17 bp, Homo sapiens
agtttaatttttgcttg

SEQ ID NO: 3822450 - DNA, 22 bp, Homo sapiens
agtttacaagaaataaatctat

SEQ ID NO: 3822451 - DNA, 18 bp, Homo sapiens
agtttcatgttatgcctg

SEQ ID NO: 3822452 - DNA, 18 bp, Homo sapiens
agtttccttccctaccca

SEQ ID NO: 3822453 - DNA, 17 bp, Homo sapiens
agtttctaagtctgtta

SEQ ID NO: 3822454 - DNA, 19 bp, Homo sapiens
agtttctaagtctgttatt

SEQ ID NO: 3822455 - DNA, 14 bp, Homo sapiens
agtttgagctgcct

SEQ ID NO: 3822456 - DNA, 11 bp, Homo sapiens
agttttactgc

SEQ ID NO: 3822457 - DNA, 18 bp, Homo sapiens
agttttactgcattttca

SEQ ID NO: 3822458 - DNA, 17 bp, Homo sapiens
agttttattttctaaat

SEQ ID NO: 3822459 - DNA, 20 bp, Homo sapiens
agttttattttctaaattct

SEQ ID NO: 3822460 - DNA, 22 bp, Homo sapiens
agttttcatttcatatatctat

SEQ ID NO: 3822461 - DNA, 15 bp, Homo sapiens
agttttgctccttct

SEQ ID NO: 3822462 - DNA, 19 bp, Homo sapiens
agtttttcattatttggaa

SEQ ID NO: 3822463 - DNA, 14 bp, Homo sapiens
agtttttgaaagac

SEQ ID NO: 3822464 - DNA, 19 bp, Homo sapiens
ataaaaaaaagttgtttat

SEQ ID NO: 3822465 - DNA, 18 bp, Homo sapiens
ataaaaagaaagctaata

SEQ ID NO: 3822466 - DNA, 13 bp, Homo sapiens
ataaaagcctgtt

SEQ ID NO: 3822467 - DNA, 17 bp, Homo sapiens
ataaaaggttgtgtaca

SEQ ID NO: 3822468 - DNA, 15 bp, Homo sapiens
ataaaatatcattca

SEQ ID NO: 3822469 - DNA, 20 bp, Homo sapiens
ataaaatttttaatctttaa

SEQ ID NO: 3822470 - DNA, 15 bp, Homo sapiens
ataaacaaacaaaca

SEQ ID NO: 3822471 - DNA, 12 bp, Homo sapiens
ataaacactgtg

SEQ ID NO: 3822472 - DNA, 14 bp, Homo sapiens
ataaacactgtgta

SEQ ID NO: 3822473 - DNA, 13 bp, Homo sapiens
ataaagaaagatt

SEQ ID NO: 3822474 - DNA, 17 bp, Homo sapiens
ataaagcaattttcctt

SEQ ID NO: 3822475 - DNA, 19 bp, Homo sapiens
ataaagcaattttccttga

SEQ ID NO: 3822476 - DNA, 20 bp, Homo sapiens
ataaagcaattttccttgaa

SEQ ID NO: 3822477 - DNA, 21 bp, Homo sapiens
ataaagcaattttccttgaag

SEQ ID NO: 3822478 - DNA, 15 bp, Homo sapiens
ataaagcaggcagaa

SEQ ID NO: 3822479 - DNA, 16 bp, Homo sapiens
ataaagcttctctctg

SEQ ID NO: 3822480 - DNA, 22 bp, Homo sapiens
ataaagttctctgtaattacaa

SEQ ID NO: 3822481 - DNA, 18 bp, Homo sapiens
ataaataaactttgggaa

SEQ ID NO: 3822482 - DNA, 14 bp, Homo sapiens
ataaatatgagtgc

SEQ ID NO: 3822483 - DNA, 15 bp, Homo sapiens
ataaatatgagtgcc

SEQ ID NO: 3822484 - DNA, 18 bp, Homo sapiens
ataaatgtacaggttgga

SEQ ID NO: 3822485 - DNA, 15 bp, Homo sapiens
ataaatgttttacaa

SEQ ID NO: 3822486 - DNA, 13 bp, Homo sapiens
ataacagttataa

SEQ ID NO: 3822487 - DNA, 17 bp, Homo sapiens
ataacagttataaagaa

SEQ ID NO: 3822488 - DNA, 18 bp, Homo sapiens
ataacagttataaagaaa

SEQ ID NO: 3822489 - DNA, 22 bp, Homo sapiens
ataacttgccatttctttatat

SEQ ID NO: 3822490 - DNA, 19 bp, Homo sapiens
atctgctcagccctggagg

SEQ ID NO: 3822491 - DNA, 22 bp, Homo sapiens
atctggaaaaacttgctcccag

SEQ ID NO: 3822492 - DNA, 12 bp, Homo sapiens
atctggcccagg

SEQ ID NO: 3822493 - DNA, 21 bp, Homo sapiens
atcttctttgcagcctgggtg

SEQ ID NO: 3822494 - DNA, 15 bp, Homo sapiens
atcttgatagctaaa

SEQ ID NO: 3822495 - DNA, 16 bp, Homo sapiens
atcttgatctgctcag

SEQ ID NO: 3822496 - DNA, 21 bp, Homo sapiens
atcttgatctgctcagccctg

SEQ ID NO: 3822497 - DNA, 22 bp, Homo sapiens
atcttgatctgctcagccctgg

SEQ ID NO: 3822498 - DNA, 16 bp, Homo sapiens
atctttaattttacat

SEQ ID NO: 3822499 - DNA, 15 bp, Homo sapiens
atctttgtaaattat

SEQ ID NO: 3822500 - DNA, 21 bp, Homo sapiens
atctttgttggctcagaaaat

SEQ ID NO: 3822501 - DNA, 15 bp, Homo sapiens
atgaaaactttttaa

SEQ ID NO: 3822502 - DNA, 12 bp, Homo sapiens
atgaaaagctac

SEQ ID NO: 3822503 - DNA, 18 bp, Homo sapiens
atgaaagtcttgtgacta

SEQ ID NO: 3822504 - DNA, 16 bp, Homo sapiens
atgaactgtgtttcca

SEQ ID NO: 3822505 - DNA, 17 bp, Homo sapiens
atgaagatttggttttt

SEQ ID NO: 3822506 - DNA, 16 bp, Homo sapiens
atgaagtgttttacaa

SEQ ID NO: 3822507 - DNA, 19 bp, Homo sapiens
atgaagtgttttacaatga

SEQ ID NO: 3822508 - DNA, 22 bp, Homo sapiens
atgaagtgttttacaatgattt

SEQ ID NO: 3822509 - DNA, 19 bp, Homo sapiens
atgaagttttttttataca

SEQ ID NO: 3822510 - DNA, 14 bp, Homo sapiens
atgaatccaaatgt

SEQ ID NO: 3822511 - DNA, 17 bp, Homo sapiens
atgaatccaaatgtgaa

SEQ ID NO: 3822512 - DNA, 21 bp, Homo sapiens
atgaatccaaatgtgaaagat

SEQ ID NO: 3822513 - DNA, 14 bp, Homo sapiens
atgaattttgtaag

SEQ ID NO: 3822514 - DNA, 17 bp, Homo sapiens
atgaattttgtaagtat

SEQ ID NO: 3822515 - DNA, 22 bp, Homo sapiens
atgactaaagacctgctgtaat

SEQ ID NO: 3822516 - DNA, 16 bp, Homo sapiens
atgactcaagattccc

SEQ ID NO: 3822517 - DNA, 22 bp, Homo sapiens
atgactcaagattcccaggagt

SEQ ID NO: 3822518 - DNA, 15 bp, Homo sapiens
atgactgaagacagg

SEQ ID NO: 3822519 - DNA, 23 bp, Homo sapiens
atgactgaagacaggcacaaaat

SEQ ID NO: 3822520 - DNA, 18 bp, Homo sapiens
atgagaaatctaaaaaac

SEQ ID NO: 3822521 - DNA, 23 bp, Homo sapiens
atgagaaatctaaaaaacgaaaa

SEQ ID NO: 3822522 - DNA, 13 bp, Homo sapiens
atgaggtgggagg

SEQ ID NO: 3822523 - DNA, 14 bp, Homo sapiens
atgaggtgggaggt

SEQ ID NO: 3822524 - DNA, 21 bp, Homo sapiens
atgatacttgaaaattaacat

SEQ ID NO: 3822525 - DNA, 21 bp, Homo sapiens
atgatggggtcagcaggccca

SEQ ID NO: 3822526 - DNA, 22 bp, Homo sapiens
atgatggggtcagcaggcccag

SEQ ID NO: 3822527 - DNA, 13 bp, Homo sapiens
atgattgttcata

SEQ ID NO: 3822528 - DNA, 16 bp, Homo sapiens
atgattgttcataata

SEQ ID NO: 3822529 - DNA, 11 bp, Homo sapiens
atgatttgtaa

SEQ ID NO: 3822530 - DNA, 12 bp, Homo sapiens
atgatttgtaaa

SEQ ID NO: 3822531 - DNA, 22 bp, Homo sapiens
atgcaaactttattttgtgttt

SEQ ID NO: 3822532 - DNA, 15 bp, Homo sapiens
atgcaaataaagcct

SEQ ID NO: 3822533 - DNA, 23 bp, Homo sapiens
atgcaaataaagcctgctctccc

SEQ ID NO: 3822534 - DNA, 15 bp, Homo sapiens
atgcaattgtacaaa

SEQ ID NO: 3822535 - DNA, 16 bp, Homo sapiens
atgcataatgtcttta

SEQ ID NO: 3822536 - DNA, 22 bp, Homo sapiens
atgccatggaatgactgaagac

SEQ ID NO: 3822537 - DNA, 15 bp, Homo sapiens
atgcccaccccctgc

SEQ ID NO: 3822538 - DNA, 18 bp, Homo sapiens
atgcccaccccctgccct

SEQ ID NO: 3822539 - DNA, 14 bp, Homo sapiens
atgcccagcctcca

SEQ ID NO: 3822540 - DNA, 17 bp, Homo sapiens
atgcccccgccacctcc

SEQ ID NO: 3822541 - DNA, 19 bp, Homo sapiens
atgcccccgccacctcccc

SEQ ID NO: 3822542 - DNA, 18 bp, Homo sapiens
atgccccggccacctctg

SEQ ID NO: 3822543 - DNA, 20 bp, Homo sapiens
atgccccggccacctctgcg

SEQ ID NO: 3822544 - DNA, 16 bp, Homo sapiens
atgcctgagccccctg

SEQ ID NO: 3822545 - DNA, 12 bp, Homo sapiens
atgcctgctgct

SEQ ID NO: 3822546 - DNA, 13 bp, Homo sapiens
atgcctgctgctg

SEQ ID NO: 3822547 - DNA, 16 bp, Homo sapiens
atgcctgttgcaggca

SEQ ID NO: 3822548 - DNA, 18 bp, Homo sapiens
atgcctgttgcaggcaaa

SEQ ID NO: 3822549 - DNA, 22 bp, Homo sapiens
atgcctgttgcaggcaaatgta

SEQ ID NO: 3822550 - DNA, 21 bp, Homo sapiens
atgctaatataagtttctttg

SEQ ID NO: 3822551 - DNA, 16 bp, Homo sapiens
atgctcaaatgaaaac

SEQ ID NO: 3822552 - DNA, 20 bp, Homo sapiens
atgctcaatcatgtgccaga

SEQ ID NO: 3822553 - DNA, 18 bp, Homo sapiens
atgctgcatttggctgga

SEQ ID NO: 3822554 - DNA, 12 bp, Homo sapiens
atgctggagaag

SEQ ID NO: 3822555 - DNA, 15 bp, Homo sapiens
atgctggagaagaga

SEQ ID NO: 3822556 - DNA, 16 bp, Homo sapiens
atgctggagaagagag

SEQ ID NO: 3822557 - DNA, 17 bp, Homo sapiens
atgctggagaagagagg

SEQ ID NO: 3822558 - DNA, 19 bp, Homo sapiens
atgctggagaagagaggag

SEQ ID NO: 3822559 - DNA, 23 bp, Homo sapiens
atgctggagaagagaggagagga

SEQ ID NO: 3822560 - DNA, 12 bp, Homo sapiens
atgctggagcct

SEQ ID NO: 3822561 - DNA, 18 bp, Homo sapiens
atgctggagcctgtgtaa

SEQ ID NO: 3822562 - DNA, 23 bp, Homo sapiens
atgctggagcctgtgtaacagct

SEQ ID NO: 3822563 - DNA, 22 bp, Homo sapiens
atgctggctcctgaagggtgct

SEQ ID NO: 3822564 - DNA, 18 bp, Homo sapiens
atgctgtaaatatttcat

SEQ ID NO: 3822565 - DNA, 19 bp, Homo sapiens
atgctgtaaatatttcata

SEQ ID NO: 3822566 - DNA, 22 bp, Homo sapiens
atgctgtaaatatttcataaat

SEQ ID NO: 3822567 - DNA, 16 bp, Homo sapiens
atgcttcagtggaaat

SEQ ID NO: 3822568 - DNA, 17 bp, Homo sapiens
atggataggcacaggaa

SEQ ID NO: 3822569 - DNA, 12 bp, Homo sapiens
atggcagatgat

SEQ ID NO: 3822570 - DNA, 16 bp, Homo sapiens
atggcaggttttacac

SEQ ID NO: 3822571 - DNA, 23 bp, Homo sapiens
atggcatgttttgtcattgtttt

SEQ ID NO: 3822572 - DNA, 15 bp, Homo sapiens
tttctcctcccttcc

SEQ ID NO: 3822573 - DNA, 15 bp, Homo sapiens
tttctcctttcacca

SEQ ID NO: 3822574 - DNA, 14 bp, Homo sapiens
tttctgaagcctct

SEQ ID NO: 3822575 - DNA, 19 bp, Homo sapiens
tttctgggtttgaagctgc

SEQ ID NO: 3822576 - DNA, 13 bp, Homo sapiens
tttcttctctgct

SEQ ID NO: 3822577 - DNA, 22 bp, Homo sapiens
tttctttttgatttttaaatca

SEQ ID NO: 3822578 - DNA, 15 bp, Homo sapiens
tttctttttttgcat

SEQ ID NO: 3822579 - DNA, 19 bp, Homo sapiens
tttgaaacactttgcataa

SEQ ID NO: 3822580 - DNA, 16 bp, Homo sapiens
tttgaagctcagaaag

SEQ ID NO: 3822581 - DNA, 13 bp, Homo sapiens
tttgaagctgctg

SEQ ID NO: 3822582 - DNA, 18 bp, Homo sapiens
tttgacaaaggtaaatca

SEQ ID NO: 3822583 - DNA, 12 bp, Homo sapiens
tttgagctgcct

SEQ ID NO: 3822584 - DNA, 19 bp, Homo sapiens
tttgaggcagcgcattgtt

SEQ ID NO: 3822585 - DNA, 18 bp, Homo sapiens
tttgcataacgtataaaa

SEQ ID NO: 3822586 - DNA, 23 bp, Homo sapiens
tttgcataacgtataaaagcctg

SEQ ID NO: 3822587 - DNA, 13 bp, Homo sapiens
tttgccccactgg

SEQ ID NO: 3822588 - DNA, 13 bp, Homo sapiens
tttgctatctgaa

SEQ ID NO: 3822589 - DNA, 18 bp, Homo sapiens
tttgctgttcgcagcctc

SEQ ID NO: 3822590 - DNA, 20 bp, Homo sapiens
tttgctttgggtttgtggca

SEQ ID NO: 3822591 - DNA, 19 bp, Homo sapiens
tttggattctctaagatga

SEQ ID NO: 3822592 - DNA, 13 bp, Homo sapiens
tttggcattcctc

SEQ ID NO: 3822593 - DNA, 22 bp, Homo sapiens
tttggggagagctggcagtgtg

SEQ ID NO: 3822594 - DNA, 18 bp, Homo sapiens
tttggggatagtctggaa

SEQ ID NO: 3822595 - DNA, 15 bp, Homo sapiens
tttggttggttttat

SEQ ID NO: 3822596 - DNA, 15 bp, Homo sapiens
tttggtttttgtctt

SEQ ID NO: 3822597 - DNA, 19 bp, Homo sapiens
tttggtttttgttgctttt

SEQ ID NO: 3822598 - DNA, 14 bp, Homo sapiens
tttgtaaaagctaa

SEQ ID NO: 3822599 - DNA, 16 bp, Homo sapiens
tttgtaaatagtttaa

SEQ ID NO: 3822600 - DNA, 16 bp, Homo sapiens
tttgtaaatgctgtaa

SEQ ID NO: 3822601 - DNA, 21 bp, Homo sapiens
tttgtaaatgctgtaaatatt

SEQ ID NO: 3822602 - DNA, 13 bp, Homo sapiens
tttgtaaattatt

SEQ ID NO: 3822603 - DNA, 21 bp, Homo sapiens
tttgtaagtaagtaagaaaga

SEQ ID NO: 3822604 - DNA, 15 bp, Homo sapiens
tttgtagcaaccatt

SEQ ID NO: 3822605 - DNA, 17 bp, Homo sapiens
tttgtagtttgcccaga

SEQ ID NO: 3822606 - DNA, 22 bp, Homo sapiens
tttgtcccatctctaccccctc

SEQ ID NO: 3822607 - DNA, 18 bp, Homo sapiens
tttgtctgtgtgctacta

SEQ ID NO: 3822608 - DNA, 15 bp, Homo sapiens
tttgtcttgcatttt

SEQ ID NO: 3822609 - DNA, 19 bp, Homo sapiens
tttgtgaaatttcatgaaa

SEQ ID NO: 3822610 - DNA, 20 bp, Homo sapiens
tttgtgccatgttcaaaaga

SEQ ID NO: 3822611 - DNA, 21 bp, Homo sapiens
tttgtgccatgttcaaaagaa

SEQ ID NO: 3822612 - DNA, 19 bp, Homo sapiens
tttgttgcttttttagatt

SEQ ID NO: 3822613 - DNA, 18 bp, Homo sapiens
tttgttggctcagaaaat

SEQ ID NO: 3822614 - DNA, 12 bp, Homo sapiens
tttgtttacaca

SEQ ID NO: 3822615 - DNA, 15 bp, Homo sapiens
ttttaaaatgagaaa

SEQ ID NO: 3822616 - DNA, 21 bp, Homo sapiens
ttttaaaccataaaaagctga

SEQ ID NO: 3822617 - DNA, 14 bp, Homo sapiens
ttttaaacttcagt

SEQ ID NO: 3822618 - DNA, 15 bp, Homo sapiens
ttttaaacttcagtt

SEQ ID NO: 3822619 - DNA, 18 bp, Homo sapiens
ttttaaagacttttatga

SEQ ID NO: 3822620 - DNA, 15 bp, Homo sapiens
ttttaaatcattcat

SEQ ID NO: 3822621 - DNA, 20 bp, Homo sapiens
ttttaaatgctgtatgtcat

SEQ ID NO: 3822622 - DNA, 12 bp, Homo sapiens
ttttaaatttgc

SEQ ID NO: 3822623 - DNA, 17 bp, Homo sapiens
ttttaagcataattaat

SEQ ID NO: 3822624 - DNA, 16 bp, Homo sapiens
ttttaagtaaggaatt

SEQ ID NO: 3822625 - DNA, 18 bp, Homo sapiens
ttttacaatgatttgtaa

SEQ ID NO: 3822626 - DNA, 19 bp, Homo sapiens
ttttacaatgatttgtaaa

SEQ ID NO: 3822627 - DNA, 23 bp, Homo sapiens
ttttactgcattttcacaacata

SEQ ID NO: 3822628 - DNA, 24 bp, Homo sapiens
ttttagttaagcatgactttagat

SEQ ID NO: 3822629 - DNA, 22 bp, Homo sapiens
ttttatagtattaagtgaaatt

SEQ ID NO: 3822630 - DNA, 16 bp, Homo sapiens
ttttatgatacttgaa

SEQ ID NO: 3822631 - DNA, 22 bp, Homo sapiens
ttttatgttgcatagaataaaa

SEQ ID NO: 3822632 - DNA, 13 bp, Homo sapiens
ttttattttctaa

SEQ ID NO: 3822633 - DNA, 14 bp, Homo sapiens
ttttcaaaagaaaa

SEQ ID NO: 3822634 - DNA, 12 bp, Homo sapiens
ttttcattccct

SEQ ID NO: 3822635 - DNA, 22 bp, Homo sapiens
ttttccacatggcagatgattt

SEQ ID NO: 3822636 - DNA, 21 bp, Homo sapiens
ttttcccaatattgagcagtt

SEQ ID NO: 3822637 - DNA, 14 bp, Homo sapiens
ttttccttcataat

SEQ ID NO: 3822638 - DNA, 13 bp, Homo sapiens
ttttcctttataa

SEQ ID NO: 3822639 - DNA, 13 bp, Homo sapiens
ttttctaagagaa

SEQ ID NO: 3822640 - DNA, 20 bp, Homo sapiens
ttttgcatattaaagataag

SEQ ID NO: 3822641 - DNA, 15 bp, Homo sapiens
ttttggcattcctct

SEQ ID NO: 3822642 - DNA, 21 bp, Homo sapiens
ttttgggttgtttaaaaattt

SEQ ID NO: 3822643 - DNA, 21 bp, Homo sapiens
ttttgtaaatgctgtaaatat

SEQ ID NO: 3822644 - DNA, 17 bp, Homo sapiens
ttttgtgggcttaattg

SEQ ID NO: 3822645 - DNA, 13 bp, Homo sapiens
ttttgttttcaat

SEQ ID NO: 3822646 - DNA, 22 bp, Homo sapiens
tttttaaaactcagatttaaaa

SEQ ID NO: 3822647 - DNA, 15 bp, Homo sapiens
tttttaaatttgcca

SEQ ID NO: 3822648 - DNA, 24 bp, Homo sapiens
tttttaatggcaataatgactaaa

SEQ ID NO: 3822649 - DNA, 17 bp, Homo sapiens
tttttccttcataattt

SEQ ID NO: 3822650 - DNA, 22 bp, Homo sapiens
tttttgccactgatttagccat

SEQ ID NO: 3822651 - DNA, 22 bp, Homo sapiens
tttttggcattcctctaatgtt

SEQ ID NO: 3822652 - DNA, 17 bp, Homo sapiens
tttttgtgtgtgctgga

SEQ ID NO: 3822653 - DNA, 15 bp, Homo sapiens
tttttgttgttttgt

SEQ ID NO: 3822654 - DNA, 19 bp, Homo sapiens
tttttgttgttttgtagca

SEQ ID NO: 3822655 - DNA, 19 bp, Homo sapiens
ttttttcccttttagttaa

SEQ ID NO: 3822656 - DNA, 22 bp, Homo sapiens
tgtattttatttagacaagaga

SEQ ID NO: 3822657 - DNA, 22 bp, Homo sapiens
tgtatttttttttctaagagaa

SEQ ID NO: 3822658 - DNA, 18 bp, Homo sapiens
tgtcacatcctaatagaa

SEQ ID NO: 3822659 - DNA, 20 bp, Homo sapiens
tgtcataatatttgaacaaa

SEQ ID NO: 3822660 - DNA, 18 bp, Homo sapiens
tgtcattgcccacttctg

SEQ ID NO: 3822661 - DNA, 23 bp, Homo sapiens
tgtccattgcgttattttctttt

SEQ ID NO: 3822662 - DNA, 12 bp, Homo sapiens
tgtcccatctct

SEQ ID NO: 3822663 - DNA, 14 bp, Homo sapiens
tgtccccatagctg

SEQ ID NO: 3822664 - DNA, 13 bp, Homo sapiens
tgtcccccacacc

SEQ ID NO: 3822665 - DNA, 14 bp, Homo sapiens
tgtccctcccacct

SEQ ID NO: 3822666 - DNA, 16 bp, Homo sapiens
tgtccctcccacctct

SEQ ID NO: 3822667 - DNA, 17 bp, Homo sapiens
tgtccctcccacctctg

SEQ ID NO: 3822668 - DNA, 18 bp, Homo sapiens
tgtccctcccacctctgt

SEQ ID NO: 3822669 - DNA, 14 bp, Homo sapiens
tgtcctccccaccc

SEQ ID NO: 3822670 - DNA, 19 bp, Homo sapiens
tgtcggccacaccccagac

SEQ ID NO: 3822671 - DNA, 22 bp, Homo sapiens
tgtcggccacaccccagactcc

SEQ ID NO: 3822672 - DNA, 16 bp, Homo sapiens
ttgatttttaaatcat

SEQ ID NO: 3822673 - DNA, 18 bp, Homo sapiens
ttgcaactttgtataaaa

SEQ ID NO: 3822674 - DNA, 12 bp, Homo sapiens
ttgcaggcaaat

SEQ ID NO: 3822675 - DNA, 20 bp, Homo sapiens
ttgcaggcaaatgtaaagtc

SEQ ID NO: 3822676 - DNA, 16 bp, Homo sapiens
ttgcataacgtataaa

SEQ ID NO: 3822677 - DNA, 18 bp, Homo sapiens
ttgccaacctgtaataaa

SEQ ID NO: 3822678 - DNA, 21 bp, Homo sapiens
ttgccaacctgtaataaatat

SEQ ID NO: 3822679 - DNA, 20 bp, Homo sapiens
ttgccaagccctttgctgtt

SEQ ID NO: 3822680 - DNA, 14 bp, Homo sapiens
ttgccaccccaacc

SEQ ID NO: 3822681 - DNA, 16 bp, Homo sapiens
ttgccatttctttata

SEQ ID NO: 3822682 - DNA, 17 bp, Homo sapiens
ttgcctcatgaacactg

SEQ ID NO: 3822683 - DNA, 17 bp, Homo sapiens
ttgcctccccatttccc

SEQ ID NO: 3822684 - DNA, 20 bp, Homo sapiens
ttgcctccccatttcccatc

SEQ ID NO: 3822685 - DNA, 21 bp, Homo sapiens
ttgcctccccatttcccatct

SEQ ID NO: 3822686 - DNA, 22 bp, Homo sapiens
ttgcctccccatttcccatctg

SEQ ID NO: 3822687 - DNA, 12 bp, Homo sapiens
ttgcgaccacca

SEQ ID NO: 3822688 - DNA, 13 bp, Homo sapiens
ttgctagtgtctt

SEQ ID NO: 3822689 - DNA, 15 bp, Homo sapiens
ttgctagtgtctttg

SEQ ID NO: 3822690 - DNA, 14 bp, Homo sapiens
ttgctctggacctg

SEQ ID NO: 3822691 - DNA, 15 bp, Homo sapiens
ttgctctggacctgc

SEQ ID NO: 3822692 - DNA, 12 bp, Homo sapiens
ttgctgcatttt

SEQ ID NO: 3822693 - DNA, 20 bp, Homo sapiens
ttgctgcattttaagcataa

SEQ ID NO: 3822694 - DNA, 21 bp, Homo sapiens
ttgcttttttagatttattgt

SEQ ID NO: 3822695 - DNA, 23 bp, Homo sapiens
ttggaatgggagaggcaataaat

SEQ ID NO: 3822696 - DNA, 20 bp, Homo sapiens
ttggatgattgttcataata

SEQ ID NO: 3822697 - DNA, 21 bp, Homo sapiens
ttggatgcatgagctattgct

SEQ ID NO: 3822698 - DNA, 22 bp, Homo sapiens
ttggcaggatcggcttcctcag

SEQ ID NO: 3822699 - DNA, 12 bp, Homo sapiens
ttggcattcctc

SEQ ID NO: 3822700 - DNA, 14 bp, Homo sapiens
ttggcattcctcta

SEQ ID NO: 3822701 - DNA, 16 bp, Homo sapiens
ttggccaagcagggag

SEQ ID NO: 3822702 - DNA, 12 bp, Homo sapiens
ttggcctgctgt

SEQ ID NO: 3822703 - DNA, 17 bp, Homo sapiens
ttggctctggagacagc

SEQ ID NO: 3822704 - DNA, 23 bp, Homo sapiens
ttggctctggagacagccccaga

SEQ ID NO: 3822705 - DNA, 12 bp, Homo sapiens
ttggctggagcc

SEQ ID NO: 3822706 - DNA, 21 bp, Homo sapiens
ttgggaaaaggtgtaaaacag

SEQ ID NO: 3822707 - DNA, 13 bp, Homo sapiens
ttgggaaaccaag

SEQ ID NO: 3822708 - DNA, 23 bp, Homo sapiens
ttgggactagatcacaactgaag

SEQ ID NO: 3822709 - DNA, 20 bp, Homo sapiens
ttgggaggaagcagaataaa

SEQ ID NO: 3822710 - DNA, 23 bp, Homo sapiens
ttgggaggaagcagaataaagca

SEQ ID NO: 3822711 - DNA, 23 bp, Homo sapiens
ttgggatttgcaaataaaggctc

SEQ ID NO: 3822712 - DNA, 13 bp, Homo sapiens
ttgggggccagca

SEQ ID NO: 3822713 - DNA, 20 bp, Homo sapiens
ttgggggtcacccatggcct

SEQ ID NO: 3822714 - DNA, 21 bp, Homo sapiens
ttggtgattaaggtcctgctt

SEQ ID NO: 3822715 - DNA, 18 bp, Homo sapiens
ttgtaaaggactatttat

SEQ ID NO: 3822716 - DNA, 12 bp, Homo sapiens
ttgtaaattatt

SEQ ID NO: 3822717 - DNA, 16 bp, Homo sapiens
ttgtaaattccccttc

SEQ ID NO: 3822718 - DNA, 17 bp, Homo sapiens
ttgtaaattccccttcc

SEQ ID NO: 3822719 - DNA, 17 bp, Homo sapiens
ttgtaacttggatgtag

SEQ ID NO: 3822720 - DNA, 15 bp, Homo sapiens
ttgtaagtaagtaag

SEQ ID NO: 3822721 - DNA, 19 bp, Homo sapiens
ttgtacaaaaaagttataa

SEQ ID NO: 3822722 - DNA, 18 bp, Homo sapiens
ttgtacagtttgtttaca

SEQ ID NO: 3822723 - DNA, 20 bp, Homo sapiens
ttgtattatagtactgcttt

SEQ ID NO: 3822724 - DNA, 14 bp, Homo sapiens
ttgtccattgcgtt

SEQ ID NO: 3822725 - DNA, 13 bp, Homo sapiens
ttgtcccatctct

SEQ ID NO: 3822726 - DNA, 12 bp, Homo sapiens
ttgtctctgtag

SEQ ID NO: 3822727 - DNA, 13 bp, Homo sapiens
ttgtctctgtaga

SEQ ID NO: 3822728 - DNA, 14 bp, Homo sapiens
ttgtctgtgtgcta

SEQ ID NO: 3822729 - DNA, 21 bp, Homo sapiens
ttgtctgtgtgctactaacag

SEQ ID NO: 3822730 - DNA, 12 bp, Homo sapiens
ttgtgaacatca

SEQ ID NO: 3822731 - DNA, 13 bp, Homo sapiens
ttgtgactagtgc

SEQ ID NO: 3822732 - DNA, 16 bp, Homo sapiens
ttgtgactagtgctga

SEQ ID NO: 3822733 - DNA, 21 bp, Homo sapiens
ttgtgagagaggacctccatg

SEQ ID NO: 3822734 - DNA, 11 bp, Homo sapiens
ttgtgctgctg

SEQ ID NO: 3822735 - DNA, 15 bp, Homo sapiens
ttgtggaacaaaagt

SEQ ID NO: 3822736 - DNA, 21 bp, Homo sapiens
ttgtggatgggaggctcctgg

SEQ ID NO: 3822737 - DNA, 18 bp, Homo sapiens
ttgtgtttatgcatttca

SEQ ID NO: 3822738 - DNA, 20 bp, Homo sapiens
ttgttaacaatggcaggttt

SEQ ID NO: 3822739 - DNA, 15 bp, Homo sapiens
ttgttgatcttttaa

SEQ ID NO: 3822740 - DNA, 19 bp, Homo sapiens
ttgtttaaaaatttataac

SEQ ID NO: 3822741 - DNA, 13 bp, Homo sapiens
ttgtttataaaaa

SEQ ID NO: 3822742 - DNA, 15 bp, Homo sapiens
ttgttttgttaacaa

SEQ ID NO: 3822743 - DNA, 14 bp, Homo sapiens
tttaaaaagcatgt

SEQ ID NO: 3822744 - DNA, 19 bp, Homo sapiens
tttaaaaagcatgttgtga

SEQ ID NO: 3822745 - DNA, 20 bp, Homo sapiens
tttaaaaatcattgtatgga

SEQ ID NO: 3822746 - DNA, 16 bp, Homo sapiens
tttaaaaatttataac

SEQ ID NO: 3822747 - DNA, 14 bp, Homo sapiens
tttaaaataaataa

SEQ ID NO: 3822748 - DNA, 23 bp, Homo sapiens
tttaaaatgtttaggaaatttat

SEQ ID NO: 3822749 - DNA, 14 bp, Homo sapiens
tttaaatgtttttt

SEQ ID NO: 3822750 - DNA, 21 bp, Homo sapiens
tttaacaccaacactgtaaca

SEQ ID NO: 3822751 - DNA, 22 bp, Homo sapiens
tttaacaccaacactgtaacat

SEQ ID NO: 3822752 - DNA, 21 bp, Homo sapiens
tttaactggaaggctgctttc

SEQ ID NO: 3822753 - DNA, 14 bp, Homo sapiens
tttaagagacagcc

SEQ ID NO: 3822754 - DNA, 14 bp, Homo sapiens
tttaagcataatta

SEQ ID NO: 3822755 - DNA, 14 bp, Homo sapiens
tttaagtaagtaag

SEQ ID NO: 3822756 - DNA, 19 bp, Homo sapiens
tttaagtaagtaagtttca

SEQ ID NO: 3822757 - DNA, 14 bp, Homo sapiens
tttaagtaattgcc

SEQ ID NO: 3822758 - DNA, 12 bp, Homo sapiens
tttaatgtaaat

SEQ ID NO: 3822759 - DNA, 16 bp, Homo sapiens
tttaattttaaaatgt

SEQ ID NO: 3822760 - DNA, 16 bp, Homo sapiens
tttacaactcctgatt

SEQ ID NO: 3822761 - DNA, 21 bp, Homo sapiens
tttacacacgtgcaatttgtt

SEQ ID NO: 3822762 - DNA, 20 bp, Homo sapiens
tttactagaacacagaaagc

SEQ ID NO: 3822763 - DNA, 15 bp, Homo sapiens
tttagatttaattta

SEQ ID NO: 3822764 - DNA, 19 bp, Homo sapiens
tttaggggtagaaaatgtt

SEQ ID NO: 3822765 - DNA, 18 bp, Homo sapiens
tttagttgcaactttgta

SEQ ID NO: 3822766 - DNA, 15 bp, Homo sapiens
tttataaaaaaaagt

SEQ ID NO: 3822767 - DNA, 15 bp, Homo sapiens
tttataacagttata

SEQ ID NO: 3822768 - DNA, 23 bp, Homo sapiens
tttataacagttataaagaaaga

SEQ ID NO: 3822769 - DNA, 12 bp, Homo sapiens
tttatacaaaga

SEQ ID NO: 3822770 - DNA, 17 bp, Homo sapiens
tttatacaaagaaactt

SEQ ID NO: 3822771 - DNA, 19 bp, Homo sapiens
tttatacaccaattgattt

SEQ ID NO: 3822772 - DNA, 20 bp, Homo sapiens
tttatactatattaactttt

SEQ ID NO: 3822773 - DNA, 22 bp, Homo sapiens
tttatgatacttgaaaattaac

SEQ ID NO: 3822774 - DNA, 17 bp, Homo sapiens
tttatgtgaacattcct

SEQ ID NO: 3822775 - DNA, 15 bp, Homo sapiens
tttatgtgcttgaag

SEQ ID NO: 3822776 - DNA, 20 bp, Homo sapiens
tttatgtgcttgaagattca

SEQ ID NO: 3822777 - DNA, 20 bp, Homo sapiens
tttattaagtatatttgtaa

SEQ ID NO: 3822778 - DNA, 16 bp, Homo sapiens
tttattgctgcatttt

SEQ ID NO: 3822779 - DNA, 19 bp, Homo sapiens
tttattgggcaataaaaga

SEQ ID NO: 3822780 - DNA, 20 bp, Homo sapiens
tttcaatgaattaagaaaga

SEQ ID NO: 3822781 - DNA, 13 bp, Homo sapiens
tttcacaacatat

SEQ ID NO: 3822782 - DNA, 21 bp, Homo sapiens
tttcagacctttgtctgaagg

SEQ ID NO: 3822783 - DNA, 14 bp, Homo sapiens
tttcagtagtttct

SEQ ID NO: 3822784 - DNA, 12 bp, Homo sapiens
tttcataaagca

SEQ ID NO: 3822785 - DNA, 12 bp, Homo sapiens
tttcatgaaaac

SEQ ID NO: 3822786 - DNA, 22 bp, Homo sapiens
tttcattagaagttaccaaatt

SEQ ID NO: 3822787 - DNA, 15 bp, Homo sapiens
tttcattatttggaa

SEQ ID NO: 3822788 - DNA, 20 bp, Homo sapiens
tttcatttggggcatttgta

SEQ ID NO: 3822789 - DNA, 21 bp, Homo sapiens
tttcatttggggcatttgtaa

SEQ ID NO: 3822790 - DNA, 15 bp, Homo sapiens
tttcattttctgcaa

SEQ ID NO: 3822791 - DNA, 18 bp, Homo sapiens
tttcattttctgcaagcc

SEQ ID NO: 3822792 - DNA, 20 bp, Homo sapiens
tttccacagttgctgctcct

SEQ ID NO: 3822793 - DNA, 19 bp, Homo sapiens
tttccacatggcagatgat

SEQ ID NO: 3822794 - DNA, 18 bp, Homo sapiens
tttcccaatattgagcag

SEQ ID NO: 3822795 - DNA, 12 bp, Homo sapiens
tttcccatctgc

SEQ ID NO: 3822796 - DNA, 13 bp, Homo sapiens
tttcccatctgca

SEQ ID NO: 3822797 - DNA, 11 bp, Homo sapiens
tttccccagcc

SEQ ID NO: 3822798 - DNA, 13 bp, Homo sapiens
tttccccagccca

SEQ ID NO: 3822799 - DNA, 16 bp, Homo sapiens
tttccttccctaccca

SEQ ID NO: 3822800 - DNA, 13 bp, Homo sapiens
tttccttgaagcc

SEQ ID NO: 3822801 - DNA, 14 bp, Homo sapiens
tttccttgaagccg

SEQ ID NO: 3822802 - DNA, 13 bp, Homo sapiens
tttcgcaaatgtt

SEQ ID NO: 3822803 - DNA, 20 bp, Homo sapiens
tttcgtgttgtgttctttat

SEQ ID NO: 3822804 - DNA, 17 bp, Homo sapiens
tttctaaattctttcat

SEQ ID NO: 3822805 - DNA, 23 bp, Homo sapiens
tggcatgttttgtcattgttttc

SEQ ID NO: 3822806 - DNA, 13 bp, Homo sapiens
tggcattcctcta

SEQ ID NO: 3822807 - DNA, 18 bp, Homo sapiens
tggcattcctctaatgtt

SEQ ID NO: 3822808 - DNA, 14 bp, Homo sapiens
tggccaggtacaac

SEQ ID NO: 3822809 - DNA, 13 bp, Homo sapiens
tggccatggctgc

SEQ ID NO: 3822810 - DNA, 13 bp, Homo sapiens
tggccatgtcctc

SEQ ID NO: 3822811 - DNA, 13 bp, Homo sapiens
tggcccaagagag

SEQ ID NO: 3822812 - DNA, 17 bp, Homo sapiens
tggcccccacccacctt

SEQ ID NO: 3822813 - DNA, 14 bp, Homo sapiens
tggccctacagccc

SEQ ID NO: 3822814 - DNA, 17 bp, Homo sapiens
tggccctagtgacaggt

SEQ ID NO: 3822815 - DNA, 13 bp, Homo sapiens
tggccctgtccct

SEQ ID NO: 3822816 - DNA, 15 bp, Homo sapiens
tggcgtgatatccat

SEQ ID NO: 3822817 - DNA, 13 bp, Homo sapiens
tggctcagaaaat

SEQ ID NO: 3822818 - DNA, 22 bp, Homo sapiens
tggctcagaaaataccttagct

SEQ ID NO: 3822819 - DNA, 22 bp, Homo sapiens
tggctcctgaagggtgctcagt

SEQ ID NO: 3822820 - DNA, 22 bp, Homo sapiens
tggctgaggttcctctgcctgc

SEQ ID NO: 3822821 - DNA, 23 bp, Homo sapiens
tggctgaggttcctctgcctgcc

SEQ ID NO: 3822822 - DNA, 22 bp, Homo sapiens
tggctgcaagtggttaagaatg

SEQ ID NO: 3822823 - DNA, 23 bp, Homo sapiens
tggctgcaagtggttaagaatgt

SEQ ID NO: 3822824 - DNA, 22 bp, Homo sapiens
tggctgccagctatttttacta

SEQ ID NO: 3822825 - DNA, 15 bp, Homo sapiens
tggctgctgccccca

SEQ ID NO: 3822826 - DNA, 16 bp, Homo sapiens
tggctgctgcccccac

SEQ ID NO: 3822827 - DNA, 20 bp, Homo sapiens
tggctgctgcccccaccccg

SEQ ID NO: 3822828 - DNA, 23 bp, Homo sapiens
tggctgctttgtagtttgcccag

SEQ ID NO: 3822829 - DNA, 18 bp, Homo sapiens
tatatttttaaaaaactg

SEQ ID NO: 3822830 - DNA, 23 bp, Homo sapiens
tatcaagctaataaaatatcatt

SEQ ID NO: 3822831 - DNA, 20 bp, Homo sapiens
tatcagtcatgacagatgaa

SEQ ID NO: 3822832 - DNA, 14 bp, Homo sapiens
tatcatttcatgct

SEQ ID NO: 3822833 - DNA, 17 bp, Homo sapiens
tatccatatgaaattca

SEQ ID NO: 3822834 - DNA, 19 bp, Homo sapiens
tatctgaactaattcattt

SEQ ID NO: 3822835 - DNA, 13 bp, Homo sapiens
tatgaattttgta

SEQ ID NO: 3822836 - DNA, 17 bp, Homo sapiens
tatgaattttgtaagta

SEQ ID NO: 3822837 - DNA, 15 bp, Homo sapiens
tatgcagaatacttt

SEQ ID NO: 3822838 - DNA, 20 bp, Homo sapiens
tatgcatttcaatttcaatg

SEQ ID NO: 3822839 - DNA, 18 bp, Homo sapiens
tatgcctgttgcaggcaa

SEQ ID NO: 3822840 - DNA, 15 bp, Homo sapiens
tatggaacgcatttt

SEQ ID NO: 3822841 - DNA, 19 bp, Homo sapiens
tatggctcatgtctgaaaa

SEQ ID NO: 3822842 - DNA, 15 bp, Homo sapiens
tatggttgccacccc

SEQ ID NO: 3822843 - DNA, 15 bp, Homo sapiens
tatgtacaaaacttt

SEQ ID NO: 3822844 - DNA, 14 bp, Homo sapiens
tatgtcattaaagt

SEQ ID NO: 3822845 - DNA, 13 bp, Homo sapiens
tatgtgaacattc

SEQ ID NO: 3822846 - DNA, 16 bp, Homo sapiens
tatgtgaacattccta

SEQ ID NO: 3822847 - DNA, 23 bp, Homo sapiens
tatgtgccagatttatgcatatt

SEQ ID NO: 3822848 - DNA, 22 bp, Homo sapiens
tatgtgccttctagaatacata

SEQ ID NO: 3822849 - DNA, 23 bp, Homo sapiens
tatgtgccttctagaatacatat

SEQ ID NO: 3822850 - DNA, 16 bp, Homo sapiens
tatgttgcatagaata

SEQ ID NO: 3822851 - DNA, 19 bp, Homo sapiens
tattaaaccttcagattaa

SEQ ID NO: 3822852 - DNA, 18 bp, Homo sapiens
tattaaactgtaaatcat

SEQ ID NO: 3822853 - DNA, 15 bp, Homo sapiens
tattaagtgaaattt

SEQ ID NO: 3822854 - DNA, 20 bp, Homo sapiens
tattaagtgaaattttaaat

SEQ ID NO: 3822855 - DNA, 13 bp, Homo sapiens
tattaatgctaag

SEQ ID NO: 3822856 - DNA, 22 bp, Homo sapiens
tattacggtgatccttttgtgc

SEQ ID NO: 3822857 - DNA, 13 bp, Homo sapiens
tattatgcttctt

SEQ ID NO: 3822858 - DNA, 14 bp, Homo sapiens
tattatgcttcttg

SEQ ID NO: 3822859 - DNA, 20 bp, Homo sapiens
tattatggaggcaggagttt

SEQ ID NO: 3822860 - DNA, 21 bp, Homo sapiens
tattcagctcatggacttctg

SEQ ID NO: 3822861 - DNA, 12 bp, Homo sapiens
tattcagtaact

SEQ ID NO: 3822862 - DNA, 20 bp, Homo sapiens
tattcatacaacaaagagga

SEQ ID NO: 3822863 - DNA, 14 bp, Homo sapiens
tattctattttcat

SEQ ID NO: 3822864 - DNA, 16 bp, Homo sapiens
tattctgtgaaactaa

SEQ ID NO: 3822865 - DNA, 13 bp, Homo sapiens
tattcttgaaagt

SEQ ID NO: 3822866 - DNA, 14 bp, Homo sapiens
tattgctgcatttt

SEQ ID NO: 3822867 - DNA, 21 bp, Homo sapiens
tattgctgcattttaagcata

SEQ ID NO: 3822868 - DNA, 21 bp, Homo sapiens
tattgggagcaatctggaaaa

SEQ ID NO: 3822869 - DNA, 11 bp, Homo sapiens
tattgtacaga

SEQ ID NO: 3822870 - DNA, 17 bp, Homo sapiens
tattgtgtttatgcatt

SEQ ID NO: 3822871 - DNA, 13 bp, Homo sapiens
tattgtgttttaa

SEQ ID NO: 3822872 - DNA, 20 bp, Homo sapiens
tatttaacttgagctttaaa

SEQ ID NO: 3822873 - DNA, 15 bp, Homo sapiens
tatttagacaagaga

SEQ ID NO: 3822874 - DNA, 20 bp, Homo sapiens
tatttagacaagagatggga

SEQ ID NO: 3822875 - DNA, 19 bp, Homo sapiens
tatttagtgttcataaata

SEQ ID NO: 3822876 - DNA, 13 bp, Homo sapiens
tatttataactaa

SEQ ID NO: 3822877 - DNA, 15 bp, Homo sapiens
tatttataactaata

SEQ ID NO: 3822878 - DNA, 13 bp, Homo sapiens
tatttattgcttt

SEQ ID NO: 3822879 - DNA, 13 bp, Homo sapiens
tatttcataaatt

SEQ ID NO: 3822880 - DNA, 20 bp, Homo sapiens
tatttgtctgtgtgctacta

SEQ ID NO: 3822881 - DNA, 20 bp, Homo sapiens
tattttatgtcatagtttaa

SEQ ID NO: 3822882 - DNA, 15 bp, Homo sapiens
tattttatgttgcat

SEQ ID NO: 3822883 - DNA, 16 bp, Homo sapiens
tattttatgttgcata

SEQ ID NO: 3822884 - DNA, 17 bp, Homo sapiens
tattttatgttgcatag

SEQ ID NO: 3822885 - DNA, 17 bp, Homo sapiens
tattttatttagacaag

SEQ ID NO: 3822886 - DNA, 12 bp, Homo sapiens
tattttctaaat

SEQ ID NO: 3822887 - DNA, 13 bp, Homo sapiens
tattttctaaatt

SEQ ID NO: 3822888 - DNA, 20 bp, Homo sapiens
tattttgtgggcttaattga

SEQ ID NO: 3822889 - DNA, 17 bp, Homo sapiens
tatttttggcattcctc

SEQ ID NO: 3822890 - DNA, 20 bp, Homo sapiens
tatttttggcattcctctaa

SEQ ID NO: 3822891 - DNA, 23 bp, Homo sapiens
tatttttttaaacttcagtttta

SEQ ID NO: 3822892 - DNA, 22 bp, Homo sapiens
tatttttttctgaattattttc

SEQ ID NO: 3822893 - DNA, 19 bp, Homo sapiens
tatttttttttctaagaga

SEQ ID NO: 3822894 - DNA, 23 bp, Homo sapiens
tcaaaaaagaggagaaaagctca

SEQ ID NO: 3822895 - DNA, 13 bp, Homo sapiens
tcaaaagaagttc

SEQ ID NO: 3822896 - DNA, 14 bp, Homo sapiens
tcaaaccaggattt

SEQ ID NO: 3822897 - DNA, 17 bp, Homo sapiens
tcaaagaccttgtgtgt

SEQ ID NO: 3822898 - DNA, 15 bp, Homo sapiens
tcaaataaacactgt

SEQ ID NO: 3822899 - DNA, 21 bp, Homo sapiens
tcaaccttgtaaattcccctt

SEQ ID NO: 3822900 - DNA, 17 bp, Homo sapiens
tcaagaggaaaagctaa

SEQ ID NO: 3822901 - DNA, 15 bp, Homo sapiens
tgcgcttgagacctt

SEQ ID NO: 3822902 - DNA, 14 bp, Homo sapiens
tgcggaccccagct

SEQ ID NO: 3822903 - DNA, 23 bp, Homo sapiens
tgctaagcgggcccgggtcccac

SEQ ID NO: 3822904 - DNA, 16 bp, Homo sapiens
tgctagcacctcccca

SEQ ID NO: 3822905 - DNA, 21 bp, Homo sapiens
tgctagcacctccccagacag

SEQ ID NO: 3822906 - DNA, 22 bp, Homo sapiens
tgctagcacctccccagacagg

SEQ ID NO: 3822907 - DNA, 12 bp, Homo sapiens
tgctcaaaaaag

SEQ ID NO: 3822908 - DNA, 16 bp, Homo sapiens
tgctcaatcatgtgcc

SEQ ID NO: 3822909 - DNA, 21 bp, Homo sapiens
tgctcactacctcctcaggga

SEQ ID NO: 3822910 - DNA, 13 bp, Homo sapiens
tgctcagccctgg

SEQ ID NO: 3822911 - DNA, 14 bp, Homo sapiens
tgctcagccctgga

SEQ ID NO: 3822912 - DNA, 23 bp, Homo sapiens
tgctcagccctggaggtgccagc

SEQ ID NO: 3822913 - DNA, 14 bp, Homo sapiens
tgctcagtctcctt

SEQ ID NO: 3822914 - DNA, 16 bp, Homo sapiens
tgctcagtctccttgg

SEQ ID NO: 3822915 - DNA, 14 bp, Homo sapiens
tgctcagtttctga

SEQ ID NO: 3822916 - DNA, 20 bp, Homo sapiens
tgctcatttgagaactgtca

SEQ ID NO: 3822917 - DNA, 13 bp, Homo sapiens
tgctccctgaagc

SEQ ID NO: 3822918 - DNA, 17 bp, Homo sapiens
tgctccctgaagccagc

SEQ ID NO: 3822919 - DNA, 18 bp, Homo sapiens
tgctccctgaagccagcc

SEQ ID NO: 3822920 - DNA, 12 bp, Homo sapiens
tgctcctccctc

SEQ ID NO: 3822921 - DNA, 13 bp, Homo sapiens
tgctcctccctct

SEQ ID NO: 3822922 - DNA, 18 bp, Homo sapiens
tgctcctccctctgaccc

SEQ ID NO: 3822923 - DNA, 16 bp, Homo sapiens
tgctccttctgtgttt

SEQ ID NO: 3822924 - DNA, 12 bp, Homo sapiens
tgctctggacct

SEQ ID NO: 3822925 - DNA, 14 bp, Homo sapiens
tgctctggacctgc

SEQ ID NO: 3822926 - DNA, 13 bp, Homo sapiens
tgctgaagcttat

SEQ ID NO: 3822927 - DNA, 18 bp, Homo sapiens
tgctgaagcttattaatg

SEQ ID NO: 3822928 - DNA, 23 bp, Homo sapiens
tgctgaagcttattaatgctaag

SEQ ID NO: 3822929 - DNA, 13 bp, Homo sapiens
tgctgcaggggct

SEQ ID NO: 3822930 - DNA, 17 bp, Homo sapiens
tgctgcaggggctctgg

SEQ ID NO: 3822931 - DNA, 17 bp, Homo sapiens
tgctgcatttggctgga

SEQ ID NO: 3822932 - DNA, 22 bp, Homo sapiens
tgctgcattttaagcataatta

SEQ ID NO: 3822933 - DNA, 23 bp, Homo sapiens
tgctgcattttaagcataattaa

SEQ ID NO: 3822934 - DNA, 14 bp, Homo sapiens
tgctgcccccaccc

SEQ ID NO: 3822935 - DNA, 17 bp, Homo sapiens
tgctgcgccctgggctc

SEQ ID NO: 3822936 - DNA, 23 bp, Homo sapiens
tgctgctagcaatgccacgattt

SEQ ID NO: 3822937 - DNA, 12 bp, Homo sapiens
tgctggagaaat

SEQ ID NO: 3822938 - DNA, 16 bp, Homo sapiens
tgctggagcctgtgta

SEQ ID NO: 3822939 - DNA, 14 bp, Homo sapiens
tgctggaggtggga

SEQ ID NO: 3822940 - DNA, 19 bp, Homo sapiens
tgctggatggagcccaggc

SEQ ID NO: 3822941 - DNA, 18 bp, Homo sapiens
tgctgggaggagggagag

SEQ ID NO: 3822942 - DNA, 20 bp, Homo sapiens
tgctgtaaatatttcataaa

SEQ ID NO: 3822943 - DNA, 17 bp, Homo sapiens
tgcttaggggaatgttt

SEQ ID NO: 3822944 - DNA, 16 bp, Homo sapiens
tgcttcacttctccca

SEQ ID NO: 3822945 - DNA, 22 bp, Homo sapiens
tgcttctaatatttattgcttt

SEQ ID NO: 3822946 - DNA, 14 bp, Homo sapiens
tgcttcttggagtc

SEQ ID NO: 3822947 - DNA, 19 bp, Homo sapiens
tgcttgctgccttctggat

SEQ ID NO: 3822948 - DNA, 23 bp, Homo sapiens
tgcttggtctagaatggattttt

SEQ ID NO: 3822949 - DNA, 13 bp, Homo sapiens
tgcttggttcatt

SEQ ID NO: 3822950 - DNA, 13 bp, Homo sapiens
tgctttaaaaact

SEQ ID NO: 3822951 - DNA, 17 bp, Homo sapiens
tgctttataaaaaaaag

SEQ ID NO: 3822952 - DNA, 12 bp, Homo sapiens
tgctttctattg

SEQ ID NO: 3822953 - DNA, 23 bp, Homo sapiens
tgctttctcctttcaccaccccc

SEQ ID NO: 3822954 - DNA, 17 bp, Homo sapiens
tgctttggaaaacccag

SEQ ID NO: 3822955 - DNA, 18 bp, Homo sapiens
tgctttgtagtttgccca

SEQ ID NO: 3822956 - DNA, 17 bp, Homo sapiens
tgctttgtatcagtcag

SEQ ID NO: 3822957 - DNA, 17 bp, Homo sapiens
tgcttttctgtatttta

SEQ ID NO: 3822958 - DNA, 23 bp, Homo sapiens
tggaaaaacttgctcccaggagg

SEQ ID NO: 3822959 - DNA, 14 bp, Homo sapiens
tggaaagagtactc

SEQ ID NO: 3822960 - DNA, 22 bp, Homo sapiens
tggaaaggggagagcctgctgg

SEQ ID NO: 3822961 - DNA, 23 bp, Homo sapiens
tggaaaggggagagcctgctggc

SEQ ID NO: 3822962 - DNA, 16 bp, Homo sapiens
tggaaatcaatcagaa

SEQ ID NO: 3822963 - DNA, 21 bp, Homo sapiens
tggaacaaaagttcgaaagaa

SEQ ID NO: 3822964 - DNA, 18 bp, Homo sapiens
tggaacgctctaggcaga

SEQ ID NO: 3822965 - DNA, 21 bp, Homo sapiens
tggaagaagggagaagaaagg

SEQ ID NO: 3822966 - DNA, 21 bp, Homo sapiens
tggaatgactgaagacaggca

SEQ ID NO: 3822967 - DNA, 17 bp, Homo sapiens
tggaccttctctccaga

SEQ ID NO: 3822968 - DNA, 14 bp, Homo sapiens
tggaccttttcttt

SEQ ID NO: 3822969 - DNA, 15 bp, Homo sapiens
tggacggcaggctca

SEQ ID NO: 3822970 - DNA, 20 bp, Homo sapiens
tggacttagaaagcaggggc

SEQ ID NO: 3822971 - DNA, 17 bp, Homo sapiens
tggagaaacaagagacc

SEQ ID NO: 3822972 - DNA, 14 bp, Homo sapiens
tggagaagagagga

SEQ ID NO: 3822973 - DNA, 12 bp, Homo sapiens
tggagacagccc

SEQ ID NO: 3822974 - DNA, 17 bp, Homo sapiens
tggagacagccccagag

SEQ ID NO: 3822975 - DNA, 19 bp, Homo sapiens
tggagacagccccagagca

SEQ ID NO: 3822976 - DNA, 20 bp, Homo sapiens
tggagactggggggcttgaa

SEQ ID NO: 3822977 - DNA, 20 bp, Homo sapiens
tggagagtgggctgacatca

SEQ ID NO: 3822978 - DNA, 22 bp, Homo sapiens
tggagcagagcaagtctgcagg

SEQ ID NO: 3822979 - DNA, 18 bp, Homo sapiens
tggagcccaggcgggagc

SEQ ID NO: 3822980 - DNA, 22 bp, Homo sapiens
tggagcctagagtgagggcctg

SEQ ID NO: 3822981 - DNA, 16 bp, Homo sapiens
tggagcctgtgtaaca

SEQ ID NO: 3822982 - DNA, 21 bp, Homo sapiens
tggagcctgtgtaacagctcc

SEQ ID NO: 3822983 - DNA, 22 bp, Homo sapiens
tggagcctgtgtaacagctcct

SEQ ID NO: 3822984 - DNA, 14 bp, Homo sapiens
tggaggaggaaggc

SEQ ID NO: 3822985 - DNA, 15 bp, Homo sapiens
tggaggaggaaggca

SEQ ID NO: 3822986 - DNA, 19 bp, Homo sapiens
tggaggccgctgctgacca

SEQ ID NO: 3822987 - DNA, 22 bp, Homo sapiens
tggagggcaaggggtttccaca

SEQ ID NO: 3822988 - DNA, 21 bp, Homo sapiens
tggaggggagctgctggccat

SEQ ID NO: 3822989 - DNA, 14 bp, Homo sapiens
tggaggggtgtggc

SEQ ID NO: 3822990 - DNA, 19 bp, Homo sapiens
tggaggtgccagcaaagcc

SEQ ID NO: 3822991 - DNA, 12 bp, Homo sapiens
tggaggtgggag

SEQ ID NO: 3822992 - DNA, 13 bp, Homo sapiens
tggaggtgggagc

SEQ ID NO: 3822993 - DNA, 18 bp, Homo sapiens
tggaggtgggagcaggag

SEQ ID NO: 3822994 - DNA, 18 bp, Homo sapiens
tggaggttgcagtgagct

SEQ ID NO: 3822995 - DNA, 22 bp, Homo sapiens
tggagtccttagtatcagtcat

SEQ ID NO: 3822996 - DNA, 13 bp, Homo sapiens
tggagtgccatgg

SEQ ID NO: 3822997 - DNA, 13 bp, Homo sapiens
tggagttcagaga

SEQ ID NO: 3822998 - DNA, 24 bp, Homo sapiens
tggatccatcctgctagcacctcc

SEQ ID NO: 3822999 - DNA, 15 bp, Homo sapiens
tggattctctaagat

SEQ ID NO: 3823000 - DNA, 18 bp, Homo sapiens
tggcaaaccccaaagaga

SEQ ID NO: 3823001 - DNA, 19 bp, Homo sapiens
tggcagagacagtgggcac

SEQ ID NO: 3823002 - DNA, 21 bp, Homo sapiens
tggcagagacagtgggcacta

SEQ ID NO: 3823003 - DNA, 13 bp, Homo sapiens
tggcagatgattt

SEQ ID NO: 3823004 - DNA, 22 bp, Homo sapiens
tggcagatgatttgggcagagc

SEQ ID NO: 3823005 - DNA, 17 bp, Homo sapiens
tggcagtgagtgagcct

SEQ ID NO: 3823006 - DNA, 19 bp, Homo sapiens
tggcagtgtgcggagctga

SEQ ID NO: 3823007 - DNA, 23 bp, Homo sapiens
tacctgaagctatcgtaaaatta

SEQ ID NO: 3823008 - DNA, 20 bp, Homo sapiens
taccttagcttcactcagct

SEQ ID NO: 3823009 - DNA, 13 bp, Homo sapiens
tacgaatttctat

SEQ ID NO: 3823010 - DNA, 15 bp, Homo sapiens
tacgaatttctatag

SEQ ID NO: 3823011 - DNA, 16 bp, Homo sapiens
tacgtcttgagaaata

SEQ ID NO: 3823012 - DNA, 11 bp, Homo sapiens
tactaacagat

SEQ ID NO: 3823013 - DNA, 12 bp, Homo sapiens
tactagaacaca

SEQ ID NO: 3823014 - DNA, 17 bp, Homo sapiens
tactatagttatataga

SEQ ID NO: 3823015 - DNA, 15 bp, Homo sapiens
tactatatatacaat

SEQ ID NO: 3823016 - DNA, 23 bp, Homo sapiens
tactctatatacttttgcttggt

SEQ ID NO: 3823017 - DNA, 16 bp, Homo sapiens
tactgaaagtctgtgg

SEQ ID NO: 3823018 - DNA, 13 bp, Homo sapiens
tactgaaggaaaa

SEQ ID NO: 3823019 - DNA, 18 bp, Homo sapiens
tactgaaggaaaaacaca

SEQ ID NO: 3823020 - DNA, 13 bp, Homo sapiens
tactgagttctta

SEQ ID NO: 3823021 - DNA, 14 bp, Homo sapiens
tactgcagggccag

SEQ ID NO: 3823022 - DNA, 12 bp, Homo sapiens
tactgcattttc

SEQ ID NO: 3823023 - DNA, 13 bp, Homo sapiens
tactgcattttca

SEQ ID NO: 3823024 - DNA, 21 bp, Homo sapiens
tactgcattttcacaacatat

SEQ ID NO: 3823025 - DNA, 22 bp, Homo sapiens
tactgcattttcacaacatatc

SEQ ID NO: 3823026 - DNA, 17 bp, Homo sapiens
tactgcccctgccctga

SEQ ID NO: 3823027 - DNA, 15 bp, Homo sapiens
tactgtgtatctcaa

SEQ ID NO: 3823028 - DNA, 15 bp, Homo sapiens
tacttgaaaattaac

SEQ ID NO: 3823029 - DNA, 17 bp, Homo sapiens
tacttgagtatcataat

SEQ ID NO: 3823030 - DNA, 14 bp, Homo sapiens
tactttacatccta

SEQ ID NO: 3823031 - DNA, 20 bp, Homo sapiens
tactttcctttccccagccc

SEQ ID NO: 3823032 - DNA, 14 bp, Homo sapiens
tacttttgcttggt

SEQ ID NO: 3823033 - DNA, 14 bp, Homo sapiens
tactttttgtaaat

SEQ ID NO: 3823034 - DNA, 15 bp, Homo sapiens
tagaaagcaggggct

SEQ ID NO: 3823035 - DNA, 19 bp, Homo sapiens
tagaacttgaactaacata

SEQ ID NO: 3823036 - DNA, 16 bp, Homo sapiens
tagaagccaagggaaa

SEQ ID NO: 3823037 - DNA, 17 bp, Homo sapiens
tagaagtgccatctcaa

SEQ ID NO: 3823038 - DNA, 18 bp, Homo sapiens
tagaagtgccatctcaat

SEQ ID NO: 3823039 - DNA, 15 bp, Homo sapiens
tagaagttaccaaat

SEQ ID NO: 3823040 - DNA, 19 bp, Homo sapiens
tagacagtaagagtttaca

SEQ ID NO: 3823041 - DNA, 16 bp, Homo sapiens
tagaccctgggtgggc

SEQ ID NO: 3823042 - DNA, 16 bp, Homo sapiens
tagacttccacaaaat

SEQ ID NO: 3823043 - DNA, 14 bp, Homo sapiens
tagagaggaagcct

SEQ ID NO: 3823044 - DNA, 19 bp, Homo sapiens
tagagccaggcacacactg

SEQ ID NO: 3823045 - DNA, 18 bp, Homo sapiens
tagaggctgagcaccttt

SEQ ID NO: 3823046 - DNA, 20 bp, Homo sapiens
tagaggcttctccgccagcc

SEQ ID NO: 3823047 - DNA, 22 bp, Homo sapiens
tagaggcttctccgccagcctc

SEQ ID NO: 3823048 - DNA, 16 bp, Homo sapiens
tagagggtcggggagg

SEQ ID NO: 3823049 - DNA, 15 bp, Homo sapiens
tagagtgagggcctg

SEQ ID NO: 3823050 - DNA, 15 bp, Homo sapiens
tagatgctattcttt

SEQ ID NO: 3823051 - DNA, 13 bp, Homo sapiens
tagatgggaagcc

SEQ ID NO: 3823052 - DNA, 17 bp, Homo sapiens
tagattaggtcacatta

SEQ ID NO: 3823053 - DNA, 20 bp, Homo sapiens
tagatttaatgatgcttcag

SEQ ID NO: 3823054 - DNA, 14 bp, Homo sapiens
tagcacctccccag

SEQ ID NO: 3823055 - DNA, 18 bp, Homo sapiens
tagcacctccccagacag

SEQ ID NO: 3823056 - DNA, 19 bp, Homo sapiens
tagcacctccccagacagg

SEQ ID NO: 3823057 - DNA, 14 bp, Homo sapiens
tagccaaacaacaa

SEQ ID NO: 3823058 - DNA, 17 bp, Homo sapiens
tagccactgctggtgtt

SEQ ID NO: 3823059 - DNA, 22 bp, Homo sapiens
tagccagggggactagcccctg

SEQ ID NO: 3823060 - DNA, 18 bp, Homo sapiens
tagccatgtgaaactcat

SEQ ID NO: 3823061 - DNA, 22 bp, Homo sapiens
tagccatgtgaaactcatctca

SEQ ID NO: 3823062 - DNA, 12 bp, Homo sapiens
tagcccaggaga

SEQ ID NO: 3823063 - DNA, 16 bp, Homo sapiens
tagcccaggagagaga

SEQ ID NO: 3823064 - DNA, 22 bp, Homo sapiens
tagcccaggagagagaaagcca

SEQ ID NO: 3823065 - DNA, 20 bp, Homo sapiens
tagcccatccctgcctggtc

SEQ ID NO: 3823066 - DNA, 21 bp, Homo sapiens
tagcccatccctgcctggtca

SEQ ID NO: 3823067 - DNA, 19 bp, Homo sapiens
tagcctcattttgtttttg

SEQ ID NO: 3823068 - DNA, 12 bp, Homo sapiens
tagcctgggcct

SEQ ID NO: 3823069 - DNA, 15 bp, Homo sapiens
tagcctgggcctcct

SEQ ID NO: 3823070 - DNA, 12 bp, Homo sapiens
tagctaaataac

SEQ ID NO: 3823071 - DNA, 17 bp, Homo sapiens
tagctcaaacgtggctt

SEQ ID NO: 3823072 - DNA, 14 bp, Homo sapiens
tagctgactttcat

SEQ ID NO: 3823073 - DNA, 17 bp, Homo sapiens
tagctgactttcatttg

SEQ ID NO: 3823074 - DNA, 15 bp, Homo sapiens
tagcttctgcttttc

SEQ ID NO: 3823075 - DNA, 22 bp, Homo sapiens
tagcttctgcttttctgccctg

SEQ ID NO: 3823076 - DNA, 18 bp, Homo sapiens
tagctttagaccctgggt

SEQ ID NO: 3823077 - DNA, 18 bp, Homo sapiens
taggaaaaagctttactc

SEQ ID NO: 3823078 - DNA, 19 bp, Homo sapiens
taggaaatttatacaaaga

SEQ ID NO: 3823079 - DNA, 13 bp, Homo sapiens
taggacaaggctg

SEQ ID NO: 3823080 - DNA, 15 bp, Homo sapiens
taggactgtggaggg

SEQ ID NO: 3823081 - DNA, 18 bp, Homo sapiens
taggaggccgaggtagga

SEQ ID NO: 3823082 - DNA, 23 bp, Homo sapiens
taggagtcttatatcccaggtga

SEQ ID NO: 3823083 - DNA, 24 bp, Homo sapiens
taggagtcttatatcccaggtgag

SEQ ID NO: 3823084 - DNA, 12 bp, Homo sapiens
taggcagaagaa

SEQ ID NO: 3823085 - DNA, 16 bp, Homo sapiens
taggcagaagaagctg

SEQ ID NO: 3823086 - DNA, 22 bp, Homo sapiens
taaagaaagattgtaaactaaa

SEQ ID NO: 3823087 - DNA, 22 bp, Homo sapiens
taaagaatttaaaaaagttgta

SEQ ID NO: 3823088 - DNA, 19 bp, Homo sapiens
taaagagcccttgcctccc

SEQ ID NO: 3823089 - DNA, 13 bp, Homo sapiens
taaagcaattttc

SEQ ID NO: 3823090 - DNA, 15 bp, Homo sapiens
taaagcaattttcct

SEQ ID NO: 3823091 - DNA, 19 bp, Homo sapiens
taaagcaattttccttgaa

SEQ ID NO: 3823092 - DNA, 21 bp, Homo sapiens
taaagcaattttccttgaagc

SEQ ID NO: 3823093 - DNA, 16 bp, Homo sapiens
taaagcacgcagttat

SEQ ID NO: 3823094 - DNA, 14 bp, Homo sapiens
taaagcctgctctc

SEQ ID NO: 3823095 - DNA, 18 bp, Homo sapiens
taaagcttctctctgagc

SEQ ID NO: 3823096 - DNA, 19 bp, Homo sapiens
taaagcttctctctgagct

SEQ ID NO: 3823097 - DNA, 14 bp, Homo sapiens
taaaggactattta

SEQ ID NO: 3823098 - DNA, 21 bp, Homo sapiens
taaaggactatttataactaa

SEQ ID NO: 3823099 - DNA, 23 bp, Homo sapiens
taaaggcgatagctgactttcat

SEQ ID NO: 3823100 - DNA, 16 bp, Homo sapiens
taaaggctttgaaccc

SEQ ID NO: 3823101 - DNA, 16 bp, Homo sapiens
taaagtctagaaaata

SEQ ID NO: 3823102 - DNA, 20 bp, Homo sapiens
taaagtgtgctttataaaaa

SEQ ID NO: 3823103 - DNA, 20 bp, Homo sapiens
taaagtttaatttttgcttg

SEQ ID NO: 3823104 - DNA, 14 bp, Homo sapiens
taaataaatatata

SEQ ID NO: 3823105 - DNA, 19 bp, Homo sapiens
taaataacttgccatttct

SEQ ID NO: 3823106 - DNA, 20 bp, Homo sapiens
taaataacttgccatttctt

SEQ ID NO: 3823107 - DNA, 22 bp, Homo sapiens
taaataacttgccatttcttta

SEQ ID NO: 3823108 - DNA, 18 bp, Homo sapiens
taaataattttgttttaa

SEQ ID NO: 3823109 - DNA, 15 bp, Homo sapiens
taaatacatttcctt

SEQ ID NO: 3823110 - DNA, 17 bp, Homo sapiens
taaatatatataaatat

SEQ ID NO: 3823111 - DNA, 19 bp, Homo sapiens
taaatatatctttgtaaat

SEQ ID NO: 3823112 - DNA, 20 bp, Homo sapiens
taaatatatctttgtaaatt

SEQ ID NO: 3823113 - DNA, 22 bp, Homo sapiens
taaatatatctttgtaaattat

SEQ ID NO: 3823114 - DNA, 19 bp, Homo sapiens
taaatattctattttcatt

SEQ ID NO: 3823115 - DNA, 13 bp, Homo sapiens
taaatatttcata

SEQ ID NO: 3823116 - DNA, 20 bp, Homo sapiens
taaatcagactatgaagttt

SEQ ID NO: 3823117 - DNA, 17 bp, Homo sapiens
taaatcataatgtaact

SEQ ID NO: 3823118 - DNA, 23 bp, Homo sapiens
taaatgcacagttctatttgcta

SEQ ID NO: 3823119 - DNA, 18 bp, Homo sapiens
taaatgccacaagacata

SEQ ID NO: 3823120 - DNA, 18 bp, Homo sapiens
taaatgtggaatgatgta

SEQ ID NO: 3823121 - DNA, 21 bp, Homo sapiens
taaatgtggaatgatgtatat

SEQ ID NO: 3823122 - DNA, 14 bp, Homo sapiens
taaatgttcatgtc

SEQ ID NO: 3823123 - DNA, 13 bp, Homo sapiens
taaatgttttaca

SEQ ID NO: 3823124 - DNA, 13 bp, Homo sapiens
taaattattacat

SEQ ID NO: 3823125 - DNA, 14 bp, Homo sapiens
taaattattacata

SEQ ID NO: 3823126 - DNA, 18 bp, Homo sapiens
taaattattttatgtcat

SEQ ID NO: 3823127 - DNA, 22 bp, Homo sapiens
taacaatggcaggttttacacg

SEQ ID NO: 3823128 - DNA, 16 bp, Homo sapiens
taacaccaacactgta

SEQ ID NO: 3823129 - DNA, 17 bp, Homo sapiens
taacagattataataaa

SEQ ID NO: 3823130 - DNA, 18 bp, Homo sapiens
taacagattataataaat

SEQ ID NO: 3823131 - DNA, 17 bp, Homo sapiens
taacagctccttgggag

SEQ ID NO: 3823132 - DNA, 16 bp, Homo sapiens
taacagttagccactg

SEQ ID NO: 3823133 - DNA, 14 bp, Homo sapiens
taacagttgctttg

SEQ ID NO: 3823134 - DNA, 14 bp, Homo sapiens
taacatgaatattt

SEQ ID NO: 3823135 - DNA, 17 bp, Homo sapiens
taacatttacgaattat

SEQ ID NO: 3823136 - DNA, 22 bp, Homo sapiens
taactagtcctgcagaggattt

SEQ ID NO: 3823137 - DNA, 20 bp, Homo sapiens
taactgaagcataaacatca

SEQ ID NO: 3823138 - DNA, 13 bp, Homo sapiens
taacttgccattt

SEQ ID NO: 3823139 - DNA, 21 bp, Homo sapiens
taacttgccatttctttatat

SEQ ID NO: 3823140 - DNA, 14 bp, Homo sapiens
taagaaagattaaa

SEQ ID NO: 3823141 - DNA, 17 bp, Homo sapiens
taagaaagattaaatat

SEQ ID NO: 3823142 - DNA, 15 bp, Homo sapiens
taagatgaatccaaa

SEQ ID NO: 3823143 - DNA, 22 bp, Homo sapiens
taagcatgactttagatgggaa

SEQ ID NO: 3823144 - DNA, 15 bp, Homo sapiens
taaggagaaatagct

SEQ ID NO: 3823145 - DNA, 15 bp, Homo sapiens
taaggagctttgctc

SEQ ID NO: 3823146 - DNA, 20 bp, Homo sapiens
taaggcccagctgccaggga

SEQ ID NO: 3823147 - DNA, 15 bp, Homo sapiens
taaggccgagcccac

SEQ ID NO: 3823148 - DNA, 18 bp, Homo sapiens
taaggccgagcccacacc

SEQ ID NO: 3823149 - DNA, 19 bp, Homo sapiens
taaggccgagcccacacca

SEQ ID NO: 3823150 - DNA, 13 bp, Homo sapiens
taaggtcctgctt

SEQ ID NO: 3823151 - DNA, 19 bp, Homo sapiens
taagtataagaaattttat

SEQ ID NO: 3823152 - DNA, 15 bp, Homo sapiens
taagtatatttgtaa

SEQ ID NO: 3823153 - DNA, 16 bp, Homo sapiens
taagtatatttgtaaa

SEQ ID NO: 3823154 - DNA, 14 bp, Homo sapiens
taagtgaaatttta

SEQ ID NO: 3823155 - DNA, 12 bp, Homo sapiens
taagtttcattc

SEQ ID NO: 3823156 - DNA, 18 bp, Homo sapiens
taagtttcattctaaaat

SEQ ID NO: 3823157 - DNA, 20 bp, Homo sapiens
taataaaaagccaccacaca

SEQ ID NO: 3823158 - DNA, 23 bp, Homo sapiens
taataaaaagccaccacacactg

SEQ ID NO: 3823159 - DNA, 12 bp, Homo sapiens
taataaaatatc

SEQ ID NO: 3823160 - DNA, 16 bp, Homo sapiens
taataaaatatcattc

SEQ ID NO: 3823161 - DNA, 20 bp, Homo sapiens
taataaaatatcattcagca

SEQ ID NO: 3823162 - DNA, 12 bp, Homo sapiens
taataaatatga

SEQ ID NO: 3823163 - DNA, 22 bp, Homo sapiens
taatacataaagttctctgtaa

SEQ ID NO: 3823164 - DNA, 23 bp, Homo sapiens
taataccactgagaccttcaggc

SEQ ID NO: 3823165 - DNA, 12 bp, Homo sapiens
taatagaaagaa

SEQ ID NO: 3823166 - DNA, 19 bp, Homo sapiens
taatagaaagaaattactt

SEQ ID NO: 3823167 - DNA, 19 bp, Homo sapiens
taatagcctaaaagatttt

SEQ ID NO: 3823168 - DNA, 21 bp, Homo sapiens
taatagcctaaaagattttgt

SEQ ID NO: 3823169 - DNA, 20 bp, Homo sapiens
taatatggttttgttttcaa

SEQ ID NO: 3823170 - DNA, 15 bp, Homo sapiens
taatattcatacaac

SEQ ID NO: 3823171 - DNA, 18 bp, Homo sapiens
taatattcatacaacaaa

SEQ ID NO: 3823172 - DNA, 15 bp, Homo sapiens
ggcagccagccctgg

SEQ ID NO: 3823173 - DNA, 17 bp, Homo sapiens
ggcagccattggcctct

SEQ ID NO: 3823174 - DNA, 15 bp, Homo sapiens
ggcagcctccagtct

SEQ ID NO: 3823175 - DNA, 16 bp, Homo sapiens
ggcagcctccagtctg

SEQ ID NO: 3823176 - DNA, 15 bp, Homo sapiens
ggcaggctcactgcc

SEQ ID NO: 3823177 - DNA, 16 bp, Homo sapiens
ggcaggctcactgcca

SEQ ID NO: 3823178 - DNA, 19 bp, Homo sapiens
ggcaggctcactgccaggc

SEQ ID NO: 3823179 - DNA, 13 bp, Homo sapiens
ggcaggggtgggg

SEQ ID NO: 3823180 - DNA, 15 bp, Homo sapiens
ggcaggggtgtcctg

SEQ ID NO: 3823181 - DNA, 20 bp, Homo sapiens
ggcaggtagccagggggact

SEQ ID NO: 3823182 - DNA, 19 bp, Homo sapiens
ggcagtgagtgagcctggc

SEQ ID NO: 3823183 - DNA, 16 bp, Homo sapiens
ggcatagaggcttctc

SEQ ID NO: 3823184 - DNA, 12 bp, Homo sapiens
ggcatgttttgt

SEQ ID NO: 3823185 - DNA, 10 bp, Homo sapiens
ggcattcctc

SEQ ID NO: 3823186 - DNA, 18 bp, Homo sapiens
ggcattcctctaatgttg

SEQ ID NO: 3823187 - DNA, 11 bp, Homo sapiens
ggcatttgtaa

SEQ ID NO: 3823188 - DNA, 12 bp, Homo sapiens
ggcatttgtaaa

SEQ ID NO: 3823189 - DNA, 13 bp, Homo sapiens
ggcatttgtaaaa

SEQ ID NO: 3823190 - DNA, 15 bp, Homo sapiens
ggccaagccggccca

SEQ ID NO: 3823191 - DNA, 17 bp, Homo sapiens
ggccaagccggcccaac

SEQ ID NO: 3823192 - DNA, 19 bp, Homo sapiens
ggccagaaaaggcagccag

SEQ ID NO: 3823193 - DNA, 14 bp, Homo sapiens
ggccagcacagctg

SEQ ID NO: 3823194 - DNA, 22 bp, Homo sapiens
ggccagcctccgagagggagag

SEQ ID NO: 3823195 - DNA, 15 bp, Homo sapiens
ggccaggactgagcc

SEQ ID NO: 3823196 - DNA, 19 bp, Homo sapiens
ggccaggatgcctgagccc

SEQ ID NO: 3823197 - DNA, 13 bp, Homo sapiens
ggccatggctgct

SEQ ID NO: 3823198 - DNA, 19 bp, Homo sapiens
ggccatggggcagcctcca

SEQ ID NO: 3823199 - DNA, 13 bp, Homo sapiens
ggccatgttccaa

SEQ ID NO: 3823200 - DNA, 17 bp, Homo sapiens
ggcccaacccaaccact

SEQ ID NO: 3823201 - DNA, 14 bp, Homo sapiens
ggcccagctgccag

SEQ ID NO: 3823202 - DNA, 17 bp, Homo sapiens
ggcccagctgccaggga

SEQ ID NO: 3823203 - DNA, 13 bp, Homo sapiens
ggcccaggctggc

SEQ ID NO: 3823204 - DNA, 15 bp, Homo sapiens
ggcccaggctggccc

SEQ ID NO: 3823205 - DNA, 16 bp, Homo sapiens
ggcccagttaaatatg

SEQ ID NO: 3823206 - DNA, 18 bp, Homo sapiens
ggcccattctacttgctc

SEQ ID NO: 3823207 - DNA, 19 bp, Homo sapiens
ggcccattctacttgctct

SEQ ID NO: 3823208 - DNA, 21 bp, Homo sapiens
ggcccattctacttgctctgg

SEQ ID NO: 3823209 - DNA, 23 bp, Homo sapiens
ggcccattctacttgctctggac

SEQ ID NO: 3823210 - DNA, 22 bp, Homo sapiens
ggcccccacccaccttccttgc

SEQ ID NO: 3823211 - DNA, 14 bp, Homo sapiens
ggcccccatcttgg

SEQ ID NO: 3823212 - DNA, 17 bp, Homo sapiens
ggccccgtctcctgagg

SEQ ID NO: 3823213 - DNA, 15 bp, Homo sapiens
ggccctacagccctg

SEQ ID NO: 3823214 - DNA, 22 bp, Homo sapiens
ggccctctgaggctcagccctg

SEQ ID NO: 3823215 - DNA, 19 bp, Homo sapiens
ggccctgaggaataaagct

SEQ ID NO: 3823216 - DNA, 15 bp, Homo sapiens
ggccctgtccctccc

SEQ ID NO: 3823217 - DNA, 16 bp, Homo sapiens
ggccctgtccctccca

SEQ ID NO: 3823218 - DNA, 17 bp, Homo sapiens
ggccctgtccctcccac

SEQ ID NO: 3823219 - DNA, 15 bp, Homo sapiens
ggccgagcccacacc

SEQ ID NO: 3823220 - DNA, 19 bp, Homo sapiens
ggccgagcccacaccatct

SEQ ID NO: 3823221 - DNA, 17 bp, Homo sapiens
ggccgattgggagaaag

SEQ ID NO: 3823222 - DNA, 21 bp, Homo sapiens
ggccggggctgaagccacaca

SEQ ID NO: 3823223 - DNA, 13 bp, Homo sapiens
ggccgttggccac

SEQ ID NO: 3823224 - DNA, 14 bp, Homo sapiens
ggcctcctcctagc

SEQ ID NO: 3823225 - DNA, 18 bp, Homo sapiens
ggcctggatccatcctgc

SEQ ID NO: 3823226 - DNA, 16 bp, Homo sapiens
ggcctgtggctgccct

SEQ ID NO: 3823227 - DNA, 13 bp, Homo sapiens
ggcgaggctgccc

SEQ ID NO: 3823228 - DNA, 16 bp, Homo sapiens
ggcgcagctgaagcct

SEQ ID NO: 3823229 - DNA, 24 bp, Homo sapiens
ggcgcagctgaagcctggacgcag

SEQ ID NO: 3823230 - DNA, 19 bp, Homo sapiens
ggcgcccagcccaggcctg

SEQ ID NO: 3823231 - DNA, 23 bp, Homo sapiens
ggcgcccagcccaggcctggtgg

SEQ ID NO: 3823232 - DNA, 16 bp, Homo sapiens
ggcgctggctgcactc

SEQ ID NO: 3823233 - DNA, 23 bp, Homo sapiens
ggctaggactgtggaggggagct

SEQ ID NO: 3823234 - DNA, 17 bp, Homo sapiens
ggctaggggagggggga

SEQ ID NO: 3823235 - DNA, 20 bp, Homo sapiens
ggctcaatgcaacctctgcc

SEQ ID NO: 3823236 - DNA, 13 bp, Homo sapiens
ggctcactgccag

SEQ ID NO: 3823237 - DNA, 18 bp, Homo sapiens
ggctcactgccaggccag

SEQ ID NO: 3823238 - DNA, 19 bp, Homo sapiens
ggctcactgccaggccagc

SEQ ID NO: 3823239 - DNA, 21 bp, Homo sapiens
ggctcagaaaataccttagct

SEQ ID NO: 3823240 - DNA, 14 bp, Homo sapiens
ggctcagccctgag

SEQ ID NO: 3823241 - DNA, 13 bp, Homo sapiens
ggctccagcctgt

SEQ ID NO: 3823242 - DNA, 17 bp, Homo sapiens
ggctccagcctgtcggc

SEQ ID NO: 3823243 - DNA, 17 bp, Homo sapiens
ggctccgctgtgcccgc

SEQ ID NO: 3823244 - DNA, 16 bp, Homo sapiens
ggctcctgacctacct

SEQ ID NO: 3823245 - DNA, 19 bp, Homo sapiens
ggctcggggctccccacgc

SEQ ID NO: 3823246 - DNA, 22 bp, Homo sapiens
ggctcggggctccccacgcccc

SEQ ID NO: 3823247 - DNA, 15 bp, Homo sapiens
ggctctggagacagc

SEQ ID NO: 3823248 - DNA, 23 bp, Homo sapiens
ggctcttgtgctggatggagccc

SEQ ID NO: 3823249 - DNA, 21 bp, Homo sapiens
ggctgaagccacacagcccag

SEQ ID NO: 3823250 - DNA, 22 bp, Homo sapiens
ggctgaagccacacagcccaga

SEQ ID NO: 3823251 - DNA, 23 bp, Homo sapiens
ggctgaagccacacagcccagaa

SEQ ID NO: 3823252 - DNA, 18 bp, Homo sapiens
ggctgagctccagccacc

SEQ ID NO: 3823253 - DNA, 14 bp, Homo sapiens
ggctgaggttcctc

SEQ ID NO: 3823254 - DNA, 18 bp, Homo sapiens
ggctgaggttcctctgcc

SEQ ID NO: 3823255 - DNA, 21 bp, Homo sapiens
ggctgaggttcctctgcctgc

SEQ ID NO: 3823256 - DNA, 23 bp, Homo sapiens
ggctgattcctaaaactctgcca

SEQ ID NO: 3823257 - DNA, 21 bp, Homo sapiens
ggctgcctcctcctgagagct

SEQ ID NO: 3823258 - DNA, 22 bp, Homo sapiens
ggctgcctcctcctgagagctg

SEQ ID NO: 3823259 - DNA, 11 bp, Homo sapiens
ggctgctgccc

SEQ ID NO: 3823260 - DNA, 15 bp, Homo sapiens
ggctggcccccaccc

SEQ ID NO: 3823261 - DNA, 14 bp, Homo sapiens
ggctgtgccaggct

SEQ ID NO: 3823262 - DNA, 18 bp, Homo sapiens
ggctgtgccaggctggga

SEQ ID NO: 3823263 - DNA, 20 bp, Homo sapiens
ggctgtgccaggctgggagg

SEQ ID NO: 3823264 - DNA, 20 bp, Homo sapiens
ggcttcctgcgtcctcctca

SEQ ID NO: 3823265 - DNA, 16 bp, Homo sapiens
ggcttctccgccagcc

SEQ ID NO: 3823266 - DNA, 17 bp, Homo sapiens
ggcttctccgccagcct

SEQ ID NO: 3823267 - DNA, 15 bp, Homo sapiens
ggcttgaagccaaag

SEQ ID NO: 3823268 - DNA, 16 bp, Homo sapiens
ggcttgaagccaaaga

SEQ ID NO: 3823269 - DNA, 19 bp, Homo sapiens
ggcttgcattaaaagactg

SEQ ID NO: 3823270 - DNA, 14 bp, Homo sapiens
ggcttggcctgctg

SEQ ID NO: 3823271 - DNA, 15 bp, Homo sapiens
ggcttggcctgctgt

SEQ ID NO: 3823272 - DNA, 16 bp, Homo sapiens
ggctttgtgagagagg

SEQ ID NO: 3823273 - DNA, 18 bp, Homo sapiens
ggctttgtgagagaggac

SEQ ID NO: 3823274 - DNA, 15 bp, Homo sapiens
ggctttgtgctgctg

SEQ ID NO: 3823275 - DNA, 16 bp, Homo sapiens
ggctttgtgctgctga

SEQ ID NO: 3823276 - DNA, 21 bp, Homo sapiens
ggctttttctttttttgcata

SEQ ID NO: 3823277 - DNA, 12 bp, Homo sapiens
gggaacctcact

SEQ ID NO: 3823278 - DNA, 17 bp, Homo sapiens
gggaagacagagcaggc

SEQ ID NO: 3823279 - DNA, 19 bp, Homo sapiens
gggaagacagagcaggctt

SEQ ID NO: 3823280 - DNA, 11 bp, Homo sapiens
gggaatgtttt

SEQ ID NO: 3823281 - DNA, 20 bp, Homo sapiens
gggacaaaaggtactggtga

SEQ ID NO: 3823282 - DNA, 18 bp, Homo sapiens
gggacacaggagaccacc

SEQ ID NO: 3823283 - DNA, 20 bp, Homo sapiens
gggaccctaagactcctcgg

SEQ ID NO: 3823284 - DNA, 18 bp, Homo sapiens
gggacctgccaggcaggg

SEQ ID NO: 3823285 - DNA, 15 bp, Homo sapiens
gggactagcccctgt

SEQ ID NO: 3823286 - DNA, 22 bp, Homo sapiens
gggagaagaaaggtgagtttga

SEQ ID NO: 3823287 - DNA, 14 bp, Homo sapiens
gggagagagagaga

SEQ ID NO: 3823288 - DNA, 23 bp, Homo sapiens
gggagagcacctgttgtgtgcct

SEQ ID NO: 3823289 - DNA, 12 bp, Homo sapiens
gggagagctggc

SEQ ID NO: 3823290 - DNA, 17 bp, Homo sapiens
gtaaatagagtgcataa

SEQ ID NO: 3823291 - DNA, 20 bp, Homo sapiens
gtaaatagagtgcataaata

SEQ ID NO: 3823292 - DNA, 13 bp, Homo sapiens
gtaaatatttcat

SEQ ID NO: 3823293 - DNA, 15 bp, Homo sapiens
gtaaatatttcataa

SEQ ID NO: 3823294 - DNA, 16 bp, Homo sapiens
gtaaatgctgtaaata

SEQ ID NO: 3823295 - DNA, 12 bp, Homo sapiens
gtaaattatttt

SEQ ID NO: 3823296 - DNA, 17 bp, Homo sapiens
gtaaattccccttccca

SEQ ID NO: 3823297 - DNA, 16 bp, Homo sapiens
gtaacagctccttggg

SEQ ID NO: 3823298 - DNA, 23 bp, Homo sapiens
gtaacagctccttgggaggaagc

SEQ ID NO: 3823299 - DNA, 15 bp, Homo sapiens
gtaactgaagcataa

SEQ ID NO: 3823300 - DNA, 18 bp, Homo sapiens
gtaactgaagcataaaca

SEQ ID NO: 3823301 - DNA, 16 bp, Homo sapiens
gtaagacatctcaaat

SEQ ID NO: 3823302 - DNA, 14 bp, Homo sapiens
gtaagacctctgag

SEQ ID NO: 3823303 - DNA, 14 bp, Homo sapiens
gtaagagtttacaa

SEQ ID NO: 3823304 - DNA, 18 bp, Homo sapiens
gtaagagtttacaagaaa

SEQ ID NO: 3823305 - DNA, 20 bp, Homo sapiens
gtaagagtttacaagaaata

SEQ ID NO: 3823306 - DNA, 17 bp, Homo sapiens
gtaataaaaagccacca

SEQ ID NO: 3823307 - DNA, 16 bp, Homo sapiens
gtaataaatatgagtg

SEQ ID NO: 3823308 - DNA, 13 bp, Homo sapiens
gtaattacaacta

SEQ ID NO: 3823309 - DNA, 15 bp, Homo sapiens
gtacaaaaaagttat

SEQ ID NO: 3823310 - DNA, 22 bp, Homo sapiens
gtacaaaaaagttataagaaaa

SEQ ID NO: 3823311 - DNA, 16 bp, Homo sapiens
gtacaaccggatgcca

SEQ ID NO: 3823312 - DNA, 16 bp, Homo sapiens
gtaccaaatgctttaa

SEQ ID NO: 3823313 - DNA, 18 bp, Homo sapiens
gtaccaaatgctttaaaa

SEQ ID NO: 3823314 - DNA, 14 bp, Homo sapiens
gtaccaatcgtctc

SEQ ID NO: 3823315 - DNA, 18 bp, Homo sapiens
gtaccaatcgtctcagcc

SEQ ID NO: 3823316 - DNA, 16 bp, Homo sapiens
gtaccagctgcgcttg

SEQ ID NO: 3823317 - DNA, 15 bp, Homo sapiens
gtactgctttactgt

SEQ ID NO: 3823318 - DNA, 20 bp, Homo sapiens
gcaggggctctggagagaaa

SEQ ID NO: 3823319 - DNA, 21 bp, Homo sapiens
gcaggggtgggggtggaggct

SEQ ID NO: 3823320 - DNA, 16 bp, Homo sapiens
gcaggggtgtcctgat

SEQ ID NO: 3823321 - DNA, 16 bp, Homo sapiens
gcagtaatctccaggg

SEQ ID NO: 3823322 - DNA, 23 bp, Homo sapiens
gcagtcactggaggttgaagcca

SEQ ID NO: 3823323 - DNA, 19 bp, Homo sapiens
gcagtgagtgagcctggct

SEQ ID NO: 3823324 - DNA, 23 bp, Homo sapiens
gcagtggagctggcaccattcag

SEQ ID NO: 3823325 - DNA, 20 bp, Homo sapiens
gcagtttttgaaagacaaaa

SEQ ID NO: 3823326 - DNA, 14 bp, Homo sapiens
gcataatgtcttta

SEQ ID NO: 3823327 - DNA, 14 bp, Homo sapiens
gcatatcacttgat

SEQ ID NO: 3823328 - DNA, 23 bp, Homo sapiens
gcatattattttatgttgcatag

SEQ ID NO: 3823329 - DNA, 21 bp, Homo sapiens
gcatcctgccttagagccagg

SEQ ID NO: 3823330 - DNA, 23 bp, Homo sapiens
gcatcctgccttagagccaggca

SEQ ID NO: 3823331 - DNA, 14 bp, Homo sapiens
gcatcctgctgctt

SEQ ID NO: 3823332 - DNA, 22 bp, Homo sapiens
gcatcttggtccaggaaatgtg

SEQ ID NO: 3823333 - DNA, 20 bp, Homo sapiens
gcatgaaccccaggctggag

SEQ ID NO: 3823334 - DNA, 13 bp, Homo sapiens
gctaggggagggg

SEQ ID NO: 3823335 - DNA, 16 bp, Homo sapiens
gctaggggagggggga

SEQ ID NO: 3823336 - DNA, 16 bp, Homo sapiens
gctatcgtaaaattaa

SEQ ID NO: 3823337 - DNA, 21 bp, Homo sapiens
gctatctgaactaattcattt

SEQ ID NO: 3823338 - DNA, 16 bp, Homo sapiens
gctatggttgccaccc

SEQ ID NO: 3823339 - DNA, 18 bp, Homo sapiens
gctattctgtgaaactaa

SEQ ID NO: 3823340 - DNA, 21 bp, Homo sapiens
gctcactacctcctcagggat

SEQ ID NO: 3823341 - DNA, 15 bp, Homo sapiens
gctcactgccaggcc

SEQ ID NO: 3823342 - DNA, 17 bp, Homo sapiens
gctcactgccaggccag

SEQ ID NO: 3823343 - DNA, 20 bp, Homo sapiens
gctcactgccaggccagcct

SEQ ID NO: 3823344 - DNA, 23 bp, Homo sapiens
gctcactgccaggccagcctccg

SEQ ID NO: 3823345 - DNA, 14 bp, Homo sapiens
gctcagccctgagc

SEQ ID NO: 3823346 - DNA, 16 bp, Homo sapiens
gctcagccctgagcta

SEQ ID NO: 3823347 - DNA, 21 bp, Homo sapiens
gctcagccctgagctggcctc

SEQ ID NO: 3823348 - DNA, 18 bp, Homo sapiens
gctcattctaatgatggc

SEQ ID NO: 3823349 - DNA, 13 bp, Homo sapiens
gctccagatgttt

SEQ ID NO: 3823350 - DNA, 16 bp, Homo sapiens
gctccagcctgtcggc

SEQ ID NO: 3823351 - DNA, 15 bp, Homo sapiens
gctccccacgccccc

SEQ ID NO: 3823352 - DNA, 12 bp, Homo sapiens
gctccccagagg

SEQ ID NO: 3823353 - DNA, 20 bp, Homo sapiens
gctcccggttccctccccag

SEQ ID NO: 3823354 - DNA, 21 bp, Homo sapiens
gctcccggttccctccccagc

SEQ ID NO: 3823355 - DNA, 23 bp, Homo sapiens
gctcccggttccctccccagctc

SEQ ID NO: 3823356 - DNA, 24 bp, Homo sapiens
gctccctgaagccagccttcttcc

SEQ ID NO: 3823357 - DNA, 16 bp, Homo sapiens
gctccgctgtgcccgc

SEQ ID NO: 3823358 - DNA, 21 bp, Homo sapiens
gctcctacccaccgcccttgc

SEQ ID NO: 3823359 - DNA, 12 bp, Homo sapiens
gctcctccctcc

SEQ ID NO: 3823360 - DNA, 18 bp, Homo sapiens
gctcctccctctgaccca

SEQ ID NO: 3823361 - DNA, 20 bp, Homo sapiens
gctcctgacctacctggccc

SEQ ID NO: 3823362 - DNA, 21 bp, Homo sapiens
gctcctggtggggcagaaagg

SEQ ID NO: 3823363 - DNA, 21 bp, Homo sapiens
gctccttgggaggaagcagaa

SEQ ID NO: 3823364 - DNA, 18 bp, Homo sapiens
gctcggggctccccacgc

SEQ ID NO: 3823365 - DNA, 16 bp, Homo sapiens
gctctcagcttgtgcc

SEQ ID NO: 3823366 - DNA, 17 bp, Homo sapiens
gctctcagcttgtgcct

SEQ ID NO: 3823367 - DNA, 14 bp, Homo sapiens
gctctcatgaagcc

SEQ ID NO: 3823368 - DNA, 15 bp, Homo sapiens
gctctggacctgccc

SEQ ID NO: 3823369 - DNA, 17 bp, Homo sapiens
gctctggacctgccccc

SEQ ID NO: 3823370 - DNA, 14 bp, Homo sapiens
gctcttctcctcag

SEQ ID NO: 3823371 - DNA, 15 bp, Homo sapiens
gctgaagccacacag

SEQ ID NO: 3823372 - DNA, 22 bp, Homo sapiens
gctgaagccacacagcccagaa

SEQ ID NO: 3823373 - DNA, 15 bp, Homo sapiens
gctgaagcctggacg

SEQ ID NO: 3823374 - DNA, 16 bp, Homo sapiens
gctgaagcctggacgc

SEQ ID NO: 3823375 - DNA, 19 bp, Homo sapiens
gctgaccttcacccagagc

SEQ ID NO: 3823376 - DNA, 22 bp, Homo sapiens
gctgagcacctttggaaacaac

SEQ ID NO: 3823377 - DNA, 16 bp, Homo sapiens
gctgagctccagccac

SEQ ID NO: 3823378 - DNA, 19 bp, Homo sapiens
gctgaggttcctctgcctg

SEQ ID NO: 3823379 - DNA, 21 bp, Homo sapiens
gctgaggttcctctgcctgcc

SEQ ID NO: 3823380 - DNA, 23 bp, Homo sapiens
gctgaggttcctctgcctgcccc

SEQ ID NO: 3823381 - DNA, 14 bp, Homo sapiens
gctgagtcctgggg

SEQ ID NO: 3823382 - DNA, 19 bp, Homo sapiens
gctgatctttaactggaag

SEQ ID NO: 3823383 - DNA, 13 bp, Homo sapiens
gctgatgactcaa

SEQ ID NO: 3823384 - DNA, 22 bp, Homo sapiens
gctgatgactcaagattcccag

SEQ ID NO: 3823385 - DNA, 23 bp, Homo sapiens
gctgatgactcaagattcccagg

SEQ ID NO: 3823386 - DNA, 22 bp, Homo sapiens
gctgattcctaaaactctgcca

SEQ ID NO: 3823387 - DNA, 23 bp, Homo sapiens
gctgattcctaaaactctgccag

SEQ ID NO: 3823388 - DNA, 21 bp, Homo sapiens
gctgattcctaaggcccagct

SEQ ID NO: 3823389 - DNA, 23 bp, Homo sapiens
gctgcaagtggttaagaatgtat

SEQ ID NO: 3823390 - DNA, 15 bp, Homo sapiens
gctgcagccccatct

SEQ ID NO: 3823391 - DNA, 20 bp, Homo sapiens
gctgcaggggctctggagag

SEQ ID NO: 3823392 - DNA, 22 bp, Homo sapiens
gctgcatcccaccagcctgagc

SEQ ID NO: 3823393 - DNA, 21 bp, Homo sapiens
gctgccagggaagacagagca

SEQ ID NO: 3823394 - DNA, 22 bp, Homo sapiens
gctgccagggaagacagagcag

SEQ ID NO: 3823395 - DNA, 21 bp, Homo sapiens
gctgccatcagtctagtggtt

SEQ ID NO: 3823396 - DNA, 20 bp, Homo sapiens
gctgcccccaccccggggac

SEQ ID NO: 3823397 - DNA, 13 bp, Homo sapiens
gctgccttcccta

SEQ ID NO: 3823398 - DNA, 16 bp, Homo sapiens
gctgccttctggattc

SEQ ID NO: 3823399 - DNA, 15 bp, Homo sapiens
gctgcgcttgctttt

SEQ ID NO: 3823400 - DNA, 21 bp, Homo sapiens
gctgctcactacctcctcagg

SEQ ID NO: 3823401 - DNA, 23 bp, Homo sapiens
gctgctcactacctcctcaggga

SEQ ID NO: 3823402 - DNA, 22 bp, Homo sapiens
gctgctcactcggacgacgccc

SEQ ID NO: 3823403 - DNA, 19 bp, Homo sapiens
gctgctcctccctctgacc

SEQ ID NO: 3823404 - DNA, 22 bp, Homo sapiens
gctgctcctccctctgacccag

SEQ ID NO: 3823405 - DNA, 18 bp, Homo sapiens
gctgctgctcctccctct

SEQ ID NO: 3823406 - DNA, 12 bp, Homo sapiens
gctgctggccat

SEQ ID NO: 3823407 - DNA, 17 bp, Homo sapiens
gctgctggccatggctg

SEQ ID NO: 3823408 - DNA, 18 bp, Homo sapiens
gctgctggccatggctgc

SEQ ID NO: 3823409 - DNA, 19 bp, Homo sapiens
gctgctggccatggctgct

SEQ ID NO: 3823410 - DNA, 21 bp, Homo sapiens
gctgcttctcccacttggcca

SEQ ID NO: 3823411 - DNA, 22 bp, Homo sapiens
gctgcttgcccccatgctggcg

SEQ ID NO: 3823412 - DNA, 15 bp, Homo sapiens
gctggaccttttctt

SEQ ID NO: 3823413 - DNA, 16 bp, Homo sapiens
gctggagaagagagga

SEQ ID NO: 3823414 - DNA, 22 bp, Homo sapiens
gctggagcctgtgtaacagctc

SEQ ID NO: 3823415 - DNA, 16 bp, Homo sapiens
gctggaggtgggagca

SEQ ID NO: 3823416 - DNA, 12 bp, Homo sapiens
gctggagtgcca

SEQ ID NO: 3823417 - DNA, 16 bp, Homo sapiens
gctggagtgccatggc

SEQ ID NO: 3823418 - DNA, 19 bp, Homo sapiens
gctggagtgccatggctgg

SEQ ID NO: 3823419 - DNA, 18 bp, Homo sapiens
gctggatggagcccaggc

SEQ ID NO: 3823420 - DNA, 20 bp, Homo sapiens
gctggcacccaccgtggagg

SEQ ID NO: 3823421 - DNA, 21 bp, Homo sapiens
gctggcagtgtgcggagctga

SEQ ID NO: 3823422 - DNA, 15 bp, Homo sapiens
gctggcccccaccca

SEQ ID NO: 3823423 - DNA, 17 bp, Homo sapiens
gctggcccccacccacc

SEQ ID NO: 3823424 - DNA, 18 bp, Homo sapiens
gctggcccccacccacct

SEQ ID NO: 3823425 - DNA, 22 bp, Homo sapiens
gctggctcctggggatggccag

SEQ ID NO: 3823426 - DNA, 23 bp, Homo sapiens
gctggctcctggggatggccagg

SEQ ID NO: 3823427 - DNA, 16 bp, Homo sapiens
gctgggaggagggaga

SEQ ID NO: 3823428 - DNA, 17 bp, Homo sapiens
gctgggaggagggagag

SEQ ID NO: 3823429 - DNA, 21 bp, Homo sapiens
gctgggaggctcggggctccc

SEQ ID NO: 3823430 - DNA, 15 bp, Homo sapiens
gctgggagggagggg

SEQ ID NO: 3823431 - DNA, 16 bp, Homo sapiens
gctgggagggaggggg

SEQ ID NO: 3823432 - DNA, 18 bp, Homo sapiens
gctgggcccttcctggct

SEQ ID NO: 3823433 - DNA, 21 bp, Homo sapiens
gctgggcccttcctggctagg

SEQ ID NO: 3823434 - DNA, 22 bp, Homo sapiens
gctggggcaaggggcagccagc

SEQ ID NO: 3823435 - DNA, 23 bp, Homo sapiens
gctggtgtttatgtgaacattcc

SEQ ID NO: 3823436 - DNA, 16 bp, Homo sapiens
gctgtaataaatgtat

SEQ ID NO: 3823437 - DNA, 18 bp, Homo sapiens
gctgtatgtcattaaagt

SEQ ID NO: 3823438 - DNA, 18 bp, Homo sapiens
gctgtgacagcctctgca

SEQ ID NO: 3823439 - DNA, 14 bp, Homo sapiens
gctgtgagccttgg

SEQ ID NO: 3823440 - DNA, 17 bp, Homo sapiens
gctgtgagccttggctg

SEQ ID NO: 3823441 - DNA, 12 bp, Homo sapiens
gctgtgccaggc

SEQ ID NO: 3823442 - DNA, 13 bp, Homo sapiens
gctgtgccaggct

SEQ ID NO: 3823443 - DNA, 16 bp, Homo sapiens
gctgtgccaggctggg

SEQ ID NO: 3823444 - DNA, 19 bp, Homo sapiens
gctgtgccaggctgggagg

SEQ ID NO: 3823445 - DNA, 16 bp, Homo sapiens
gctgtgcccgccctgg

SEQ ID NO: 3823446 - DNA, 20 bp, Homo sapiens
gctgtgcccgccctgggctg

SEQ ID NO: 3823447 - DNA, 18 bp, Homo sapiens
gctgtgggaaacctcatt

SEQ ID NO: 3823448 - DNA, 14 bp, Homo sapiens
gctgttccccaccg

SEQ ID NO: 3823449 - DNA, 19 bp, Homo sapiens
gcttaaaaaagaaagattt

SEQ ID NO: 3823450 - DNA, 22 bp, Homo sapiens
gcttaaaatgtactctcctttt

SEQ ID NO: 3823451 - DNA, 17 bp, Homo sapiens
gcttcactcagctggac

SEQ ID NO: 3823452 - DNA, 19 bp, Homo sapiens
gcttccaggaaactccaca

SEQ ID NO: 3823453 - DNA, 13 bp, Homo sapiens
gcttcctcagggg

SEQ ID NO: 3823454 - DNA, 17 bp, Homo sapiens
gcttcctctagaagcca

SEQ ID NO: 3823455 - DNA, 23 bp, Homo sapiens
gcttcctctagaagccaagggaa

SEQ ID NO: 3823456 - DNA, 21 bp, Homo sapiens
gcttctaatatttattgcttt

SEQ ID NO: 3823457 - DNA, 20 bp, Homo sapiens
gcttctccgccagcctcctc

SEQ ID NO: 3823458 - DNA, 23 bp, Homo sapiens
gcttctccgccagcctcctctgg

SEQ ID NO: 3823459 - DNA, 23 bp, Homo sapiens
gcttctgcttttctgccctggct

SEQ ID NO: 3823460 - DNA, 15 bp, Homo sapiens
gcttgaactgctgcc

SEQ ID NO: 3823461 - DNA, 20 bp, Homo sapiens
gcttgagttttcatttcata

SEQ ID NO: 3823462 - DNA, 22 bp, Homo sapiens
gcttgattttcctaatggtctc

SEQ ID NO: 3823463 - DNA, 20 bp, Homo sapiens
gcttgcctcagggccaagcc

SEQ ID NO: 3823464 - DNA, 13 bp, Homo sapiens
gcttggcctgctg

SEQ ID NO: 3823465 - DNA, 15 bp, Homo sapiens
gcttggggcagccat

SEQ ID NO: 3823466 - DNA, 16 bp, Homo sapiens
gctttactctttcatg

SEQ ID NO: 3823467 - DNA, 16 bp, Homo sapiens
gagccagaggccagga

SEQ ID NO: 3823468 - DNA, 12 bp, Homo sapiens
gagccaggcaca

SEQ ID NO: 3823469 - DNA, 19 bp, Homo sapiens
gagcccacaccatctggcc

SEQ ID NO: 3823470 - DNA, 23 bp, Homo sapiens
gagcccacaccatctggcccagg

SEQ ID NO: 3823471 - DNA, 18 bp, Homo sapiens
gagccccgcagacctccc

SEQ ID NO: 3823472 - DNA, 22 bp, Homo sapiens
gagcccttgcctccccatttcc

SEQ ID NO: 3823473 - DNA, 13 bp, Homo sapiens
gagccgcctcgga

SEQ ID NO: 3823474 - DNA, 14 bp, Homo sapiens
gagccgcctcggag

SEQ ID NO: 3823475 - DNA, 24 bp, Homo sapiens
gagccgcctcggagtgtggcctgg

SEQ ID NO: 3823476 - DNA, 16 bp, Homo sapiens
gagccgggcccctggg

SEQ ID NO: 3823477 - DNA, 17 bp, Homo sapiens
gagcctgaaatcatctt

SEQ ID NO: 3823478 - DNA, 10 bp, Homo sapiens
gagcctgctg

SEQ ID NO: 3823479 - DNA, 12 bp, Homo sapiens
gagcctgctggc

SEQ ID NO: 3823480 - DNA, 21 bp, Homo sapiens
gagcctggctcttgtgctgga

SEQ ID NO: 3823481 - DNA, 14 bp, Homo sapiens
gagcctgtgtaaca

SEQ ID NO: 3823482 - DNA, 15 bp, Homo sapiens
gagcctgtgtaacag

SEQ ID NO: 3823483 - DNA, 17 bp, Homo sapiens
gagcggtctcaggctgg

SEQ ID NO: 3823484 - DNA, 22 bp, Homo sapiens
gagcggtctcaggctggtggga

SEQ ID NO: 3823485 - DNA, 14 bp, Homo sapiens
gagcggtggccctg

SEQ ID NO: 3823486 - DNA, 17 bp, Homo sapiens
gagcggtggccctgtcc

SEQ ID NO: 3823487 - DNA, 14 bp, Homo sapiens
gagctccagccacc

SEQ ID NO: 3823488 - DNA, 20 bp, Homo sapiens
gagctctggagcaagccctg

SEQ ID NO: 3823489 - DNA, 13 bp, Homo sapiens
gagctgctcacta

SEQ ID NO: 3823490 - DNA, 13 bp, Homo sapiens
gagctgctggcca

SEQ ID NO: 3823491 - DNA, 15 bp, Homo sapiens
gagctgctggccatg

SEQ ID NO: 3823492 - DNA, 22 bp, Homo sapiens
gagctggcagtgtgcggagctg

SEQ ID NO: 3823493 - DNA, 21 bp, Homo sapiens
gagctggcctaggtgggagcc

SEQ ID NO: 3823494 - DNA, 14 bp, Homo sapiens
gagctggcgtcacc

SEQ ID NO: 3823495 - DNA, 13 bp, Homo sapiens
gagcttgcctcag

SEQ ID NO: 3823496 - DNA, 15 bp, Homo sapiens
gagctttgctcttgg

SEQ ID NO: 3823497 - DNA, 15 bp, Homo sapiens
gaggaagcagaataa

SEQ ID NO: 3823498 - DNA, 22 bp, Homo sapiens
gaggaataaagcttctctctga

SEQ ID NO: 3823499 - DNA, 14 bp, Homo sapiens
gaggaatttgaagc

SEQ ID NO: 3823500 - DNA, 18 bp, Homo sapiens
gaggacagcttgagccgg

SEQ ID NO: 3823501 - DNA, 17 bp, Homo sapiens
gaggacctccatgcccc

SEQ ID NO: 3823502 - DNA, 13 bp, Homo sapiens
gaggagagaggca

SEQ ID NO: 3823503 - DNA, 17 bp, Homo sapiens
gaggagagaggcagaga

SEQ ID NO: 3823504 - DNA, 13 bp, Homo sapiens
gaggagaggagag

SEQ ID NO: 3823505 - DNA, 11 bp, Homo sapiens
gaggagggaga

SEQ ID NO: 3823506 - DNA, 17 bp, Homo sapiens
gaggagggccctgagga

SEQ ID NO: 3823507 - DNA, 21 bp, Homo sapiens
gaggagggccctgaggaataa

SEQ ID NO: 3823508 - DNA, 15 bp, Homo sapiens
gaggagttagccaaa

SEQ ID NO: 3823509 - DNA, 16 bp, Homo sapiens
gaggagttagccaaac

SEQ ID NO: 3823510 - DNA, 22 bp, Homo sapiens
gaggatcctggtattgtaatat

SEQ ID NO: 3823511 - DNA, 18 bp, Homo sapiens
gaggatttaactgtgaac

SEQ ID NO: 3823512 - DNA, 22 bp, Homo sapiens
gaggcagagagcggtctcaggc

SEQ ID NO: 3823513 - DNA, 23 bp, Homo sapiens
gaggccatgttccaataaacagg

SEQ ID NO: 3823514 - DNA, 22 bp, Homo sapiens
gaggctcggggctccccacgcc

SEQ ID NO: 3823515 - DNA, 16 bp, Homo sapiens
gaggctgccccttgga

SEQ ID NO: 3823516 - DNA, 17 bp, Homo sapiens
gaggctgccccttggat

SEQ ID NO: 3823517 - DNA, 13 bp, Homo sapiens
gaggcttcctgcg

SEQ ID NO: 3823518 - DNA, 15 bp, Homo sapiens
gaggcttcctgcgtc

SEQ ID NO: 3823519 - DNA, 19 bp, Homo sapiens
gaggcttctccgccagcct

SEQ ID NO: 3823520 - DNA, 21 bp, Homo sapiens
gaggcttctccgccagcctcc

SEQ ID NO: 3823521 - DNA, 16 bp, Homo sapiens
gagggagagagagaga

SEQ ID NO: 3823522 - DNA, 22 bp, Homo sapiens
gagggagagagagagagagagg

SEQ ID NO: 3823523 - DNA, 13 bp, Homo sapiens
gagggagagggag

SEQ ID NO: 3823524 - DNA, 24 bp, Homo sapiens
gagggagcatagaaggcaggtgag

SEQ ID NO: 3823525 - DNA, 21 bp, Homo sapiens
gagggagcgcccctggctgcc

SEQ ID NO: 3823526 - DNA, 16 bp, Homo sapiens
gagggcaagaggtgcc

SEQ ID NO: 3823527 - DNA, 19 bp, Homo sapiens
gagggcaagaggtgcctgg

SEQ ID NO: 3823528 - DNA, 14 bp, Homo sapiens
gagggccctgagga

SEQ ID NO: 3823529 - DNA, 16 bp, Homo sapiens
gagggccctgaggaat

SEQ ID NO: 3823530 - DNA, 15 bp, Homo sapiens
gagggcgcccagccc

SEQ ID NO: 3823531 - DNA, 16 bp, Homo sapiens
gagggctttgtgtctg

SEQ ID NO: 3823532 - DNA, 16 bp, Homo sapiens
gaggggcgcccacctc

SEQ ID NO: 3823533 - DNA, 17 bp, Homo sapiens
gaggggggagccagagg

SEQ ID NO: 3823534 - DNA, 22 bp, Homo sapiens
gaggggggagccagaggccagg

SEQ ID NO: 3823535 - DNA, 14 bp, Homo sapiens
gagggggtggaggg

SEQ ID NO: 3823536 - DNA, 17 bp, Homo sapiens
gaggggtgtggcagtgg

SEQ ID NO: 3823537 - DNA, 17 bp, Homo sapiens
gagggtcggggaggagg

SEQ ID NO: 3823538 - DNA, 13 bp, Homo sapiens
gagggtggcagag

SEQ ID NO: 3823539 - DNA, 14 bp, Homo sapiens
gagggtggcagaga

SEQ ID NO: 3823540 - DNA, 19 bp, Homo sapiens
gagggtggcagagacagtg

SEQ ID NO: 3823541 - DNA, 17 bp, Homo sapiens
gaggtcacacagcctgt

SEQ ID NO: 3823542 - DNA, 20 bp, Homo sapiens
gaggtcactggaaaggggag

SEQ ID NO: 3823543 - DNA, 19 bp, Homo sapiens
gaggtgaaaagggcagagg

SEQ ID NO: 3823544 - DNA, 21 bp, Homo sapiens
gaggtgaaaagggcagaggca

SEQ ID NO: 3823545 - DNA, 14 bp, Homo sapiens
gaggtgccagcaaa

SEQ ID NO: 3823546 - DNA, 15 bp, Homo sapiens
gaggtgcctgggagg

SEQ ID NO: 3823547 - DNA, 19 bp, Homo sapiens
gaggtggaggttgcagtga

SEQ ID NO: 3823548 - DNA, 17 bp, Homo sapiens
gaggttcctctgcctgc

SEQ ID NO: 3823549 - DNA, 15 bp, Homo sapiens
gaggttgaagccaag

SEQ ID NO: 3823550 - DNA, 22 bp, Homo sapiens
gagtaatccaagcaaatgtgaa

SEQ ID NO: 3823551 - DNA, 15 bp, Homo sapiens
gagtccattctccca

SEQ ID NO: 3823552 - DNA, 17 bp, Homo sapiens
gagtccttagcctgggc

SEQ ID NO: 3823553 - DNA, 15 bp, Homo sapiens
gagtctgtcataata

SEQ ID NO: 3823554 - DNA, 21 bp, Homo sapiens
gagtcttatatcccaggtgag

SEQ ID NO: 3823555 - DNA, 14 bp, Homo sapiens
gagtgcataaataa

SEQ ID NO: 3823556 - DNA, 12 bp, Homo sapiens
gagtggccctga

SEQ ID NO: 3823557 - DNA, 15 bp, Homo sapiens
gagtgtggcctggat

SEQ ID NO: 3823558 - DNA, 13 bp, Homo sapiens
gagttagccaaac

SEQ ID NO: 3823559 - DNA, 17 bp, Homo sapiens
gagttcccaaagggagg

SEQ ID NO: 3823560 - DNA, 22 bp, Homo sapiens
gagttcccaaagggagggtggc

SEQ ID NO: 3823561 - DNA, 16 bp, Homo sapiens
gagttctgctcattct

SEQ ID NO: 3823562 - DNA, 20 bp, Homo sapiens
gagttctgctcattctaatg

SEQ ID NO: 3823563 - DNA, 17 bp, Homo sapiens
gagtttgagctgccttc

SEQ ID NO: 3823564 - DNA, 19 bp, Homo sapiens
gataaagttggtaaacctt

SEQ ID NO: 3823565 - DNA, 12 bp, Homo sapiens
gataagtgcagt

SEQ ID NO: 3823566 - DNA, 15 bp, Homo sapiens
gatataaatatatat

SEQ ID NO: 3823567 - DNA, 17 bp, Homo sapiens
gatataaatatatataa

SEQ ID NO: 3823568 - DNA, 15 bp, Homo sapiens
gatataagtgtgtgt

SEQ ID NO: 3823569 - DNA, 15 bp, Homo sapiens
gatcaagcagaaaac

SEQ ID NO: 3823570 - DNA, 19 bp, Homo sapiens
gatcacaactgaagataac

SEQ ID NO: 3823571 - DNA, 13 bp, Homo sapiens
gatccatcctgct

SEQ ID NO: 3823572 - DNA, 21 bp, Homo sapiens
gatccatcctgctagcacctc

SEQ ID NO: 3823573 - DNA, 19 bp, Homo sapiens
gaatgttttcgcaaatgtt

SEQ ID NO: 3823574 - DNA, 15 bp, Homo sapiens
gaattaagaaagatt

SEQ ID NO: 3823575 - DNA, 19 bp, Homo sapiens
gaattatttttttaaactt

SEQ ID NO: 3823576 - DNA, 21 bp, Homo sapiens
gaattgcattttttaaaacaa

SEQ ID NO: 3823577 - DNA, 16 bp, Homo sapiens
gaattttgtaagtata

SEQ ID NO: 3823578 - DNA, 20 bp, Homo sapiens
gacaaaatttagatttaatt

SEQ ID NO: 3823579 - DNA, 15 bp, Homo sapiens
gacaacgaaagtaaa

SEQ ID NO: 3823580 - DNA, 14 bp, Homo sapiens
gacaagagatggga

SEQ ID NO: 3823581 - DNA, 20 bp, Homo sapiens
gacaagagatgggaatgagg

SEQ ID NO: 3823582 - DNA, 15 bp, Homo sapiens
gacaaggctgtgcca

SEQ ID NO: 3823583 - DNA, 20 bp, Homo sapiens
gacaaggctgtgccaggctg

SEQ ID NO: 3823584 - DNA, 18 bp, Homo sapiens
gacacaggagaccacccc

SEQ ID NO: 3823585 - DNA, 14 bp, Homo sapiens
gacaccacacccag

SEQ ID NO: 3823586 - DNA, 19 bp, Homo sapiens
gacaccacacccagcctca

SEQ ID NO: 3823587 - DNA, 22 bp, Homo sapiens
gacactggctgccagctatttt

SEQ ID NO: 3823588 - DNA, 15 bp, Homo sapiens
gacagagcaggcttt

SEQ ID NO: 3823589 - DNA, 22 bp, Homo sapiens
gacagccaactatggcctgtgg

SEQ ID NO: 3823590 - DNA, 14 bp, Homo sapiens
gacagccccagagc

SEQ ID NO: 3823591 - DNA, 18 bp, Homo sapiens
gacagccccagagcaggg

SEQ ID NO: 3823592 - DNA, 19 bp, Homo sapiens
gacagccccagagcagggt

SEQ ID NO: 3823593 - DNA, 13 bp, Homo sapiens
gacaggcacaaaa

SEQ ID NO: 3823594 - DNA, 17 bp, Homo sapiens
gacagggctccagcctg

SEQ ID NO: 3823595 - DNA, 17 bp, Homo sapiens
gacagggtttcaccatg

SEQ ID NO: 3823596 - DNA, 17 bp, Homo sapiens
gacagtaagagtttaca

SEQ ID NO: 3823597 - DNA, 19 bp, Homo sapiens
gacagtaagagtttacaag

SEQ ID NO: 3823598 - DNA, 22 bp, Homo sapiens
gacatagcccatccctgcctgg

SEQ ID NO: 3823599 - DNA, 18 bp, Homo sapiens
gacatcaagtgtaattag

SEQ ID NO: 3823600 - DNA, 18 bp, Homo sapiens
gacatggaccttctctcc

SEQ ID NO: 3823601 - DNA, 23 bp, Homo sapiens
gacatggaccttctctccagagc

SEQ ID NO: 3823602 - DNA, 22 bp, Homo sapiens
gacatggtgcctgagaggcagg

SEQ ID NO: 3823603 - DNA, 22 bp, Homo sapiens
gacattgttggcagcataaagg

SEQ ID NO: 3823604 - DNA, 15 bp, Homo sapiens
gaccaactttttcat

SEQ ID NO: 3823605 - DNA, 12 bp, Homo sapiens
gaccaatgcctt

SEQ ID NO: 3823606 - DNA, 12 bp, Homo sapiens
gaccaccaacac

SEQ ID NO: 3823607 - DNA, 17 bp, Homo sapiens
gaccaccaacacacagg

SEQ ID NO: 3823608 - DNA, 19 bp, Homo sapiens
gaccaccaacacacaggaa

SEQ ID NO: 3823609 - DNA, 18 bp, Homo sapiens
gaccagcactgaccccga

SEQ ID NO: 3823610 - DNA, 21 bp, Homo sapiens
gaccccagctgtgagccttgg

SEQ ID NO: 3823611 - DNA, 23 bp, Homo sapiens
gacccctcctcactggccatccc

SEQ ID NO: 3823612 - DNA, 19 bp, Homo sapiens
gacccctgctttgccccac

SEQ ID NO: 3823613 - DNA, 20 bp, Homo sapiens
gacccctgctttgccccact

SEQ ID NO: 3823614 - DNA, 21 bp, Homo sapiens
gacccctgctttgccccactg

SEQ ID NO: 3823615 - DNA, 22 bp, Homo sapiens
gacccctgctttgccccactgg

SEQ ID NO: 3823616 - DNA, 21 bp, Homo sapiens
gaccctgggtgggctctgtgc

SEQ ID NO: 3823617 - DNA, 17 bp, Homo sapiens
gacctcaggcactagcc

SEQ ID NO: 3823618 - DNA, 18 bp, Homo sapiens
gacctcaggcactagcct

SEQ ID NO: 3823619 - DNA, 15 bp, Homo sapiens
gacctccatgccccc

SEQ ID NO: 3823620 - DNA, 14 bp, Homo sapiens
gacctccccagccc

SEQ ID NO: 3823621 - DNA, 14 bp, Homo sapiens
gacctgagcctggc

SEQ ID NO: 3823622 - DNA, 15 bp, Homo sapiens
gacctgccaggcagg

SEQ ID NO: 3823623 - DNA, 19 bp, Homo sapiens
gacctgccaggcaggggtg

SEQ ID NO: 3823624 - DNA, 23 bp, Homo sapiens
gacctgcccccgcatcccctgcc

SEQ ID NO: 3823625 - DNA, 21 bp, Homo sapiens
gacctgctgtaataaatgtat

SEQ ID NO: 3823626 - DNA, 21 bp, Homo sapiens
gaccttcacccagagctgcct

SEQ ID NO: 3823627 - DNA, 17 bp, Homo sapiens
gaccttctctccagagc

SEQ ID NO: 3823628 - DNA, 15 bp, Homo sapiens
gacgacgaatcttct

SEQ ID NO: 3823629 - DNA, 18 bp, Homo sapiens
gacgcagccacacagtgg

SEQ ID NO: 3823630 - DNA, 21 bp, Homo sapiens
gacgcagccacacagtggccg

SEQ ID NO: 3823631 - DNA, 11 bp, Homo sapiens
gacggcaggct

SEQ ID NO: 3823632 - DNA, 15 bp, Homo sapiens
gactactacacactg

SEQ ID NO: 3823633 - DNA, 19 bp, Homo sapiens
gactagatttcaagctaat

SEQ ID NO: 3823634 - DNA, 15 bp, Homo sapiens
gactagtgctgaagc

SEQ ID NO: 3823635 - DNA, 16 bp, Homo sapiens
gactagtgctgaagct

SEQ ID NO: 3823636 - DNA, 17 bp, Homo sapiens
gactcaagattcccagg

SEQ ID NO: 3823637 - DNA, 16 bp, Homo sapiens
gactccctccccagat

SEQ ID NO: 3823638 - DNA, 18 bp, Homo sapiens
gactccgcctgaggccag

SEQ ID NO: 3823639 - DNA, 15 bp, Homo sapiens
gactcctcggcctgg

SEQ ID NO: 3823640 - DNA, 16 bp, Homo sapiens
gactcggccccgtctc

SEQ ID NO: 3823641 - DNA, 22 bp, Homo sapiens
gactgactttttccatttttta

SEQ ID NO: 3823642 - DNA, 14 bp, Homo sapiens
gactggggggcttg

SEQ ID NO: 3823643 - DNA, 19 bp, Homo sapiens
gacttagaaagcaggggct

SEQ ID NO: 3823644 - DNA, 13 bp, Homo sapiens
gacttcaccaaat

SEQ ID NO: 3823645 - DNA, 13 bp, Homo sapiens
gacttctcaggac

SEQ ID NO: 3823646 - DNA, 18 bp, Homo sapiens
gacttgggctccgctgtg

SEQ ID NO: 3823647 - DNA, 13 bp, Homo sapiens
gactttcatttgg

SEQ ID NO: 3823648 - DNA, 17 bp, Homo sapiens
gagaacttgaacaaagt

SEQ ID NO: 3823649 - DNA, 23 bp, Homo sapiens
gagaatatttttggcattcctct

SEQ ID NO: 3823650 - DNA, 17 bp, Homo sapiens
gagaatggcatgaaccc

SEQ ID NO: 3823651 - DNA, 17 bp, Homo sapiens
gagaattaggaaggcca

SEQ ID NO: 3823652 - DNA, 15 bp, Homo sapiens
gagacagccccagag

SEQ ID NO: 3823653 - DNA, 18 bp, Homo sapiens
gagacagccccagagcag

SEQ ID NO: 3823654 - DNA, 18 bp, Homo sapiens
gagaccaactttttcatt

SEQ ID NO: 3823655 - DNA, 14 bp, Homo sapiens
gagaccgtcctcac

SEQ ID NO: 3823656 - DNA, 14 bp, Homo sapiens
gagactggggggct

SEQ ID NO: 3823657 - DNA, 16 bp, Homo sapiens
gagactggggggcttg

SEQ ID NO: 3823658 - DNA, 18 bp, Homo sapiens
gagagaaagccaggcagg

SEQ ID NO: 3823659 - DNA, 19 bp, Homo sapiens
gagagaaagccaggcaggt

SEQ ID NO: 3823660 - DNA, 17 bp, Homo sapiens
gagagaaagtgggtgag

SEQ ID NO: 3823661 - DNA, 18 bp, Homo sapiens
gagagaaagtgggtgaga

SEQ ID NO: 3823662 - DNA, 19 bp, Homo sapiens
gagagacacaagtggcctt

SEQ ID NO: 3823663 - DNA, 13 bp, Homo sapiens
gagagagagagga

SEQ ID NO: 3823664 - DNA, 17 bp, Homo sapiens
gagagaggcagagagcg

SEQ ID NO: 3823665 - DNA, 16 bp, Homo sapiens
gagagagggcgcccag

SEQ ID NO: 3823666 - DNA, 19 bp, Homo sapiens
gagagagggcgcccagccc

SEQ ID NO: 3823667 - DNA, 22 bp, Homo sapiens
gagagagggcgcccagcccagg

SEQ ID NO: 3823668 - DNA, 22 bp, Homo sapiens
gagagcacctgttgtgtgcctg

SEQ ID NO: 3823669 - DNA, 14 bp, Homo sapiens
gagagccaaacaga

SEQ ID NO: 3823670 - DNA, 20 bp, Homo sapiens
cttttccctgcttccaggaa

SEQ ID NO: 3823671 - DNA, 14 bp, Homo sapiens
cttttctgccctgg

SEQ ID NO: 3823672 - DNA, 23 bp, Homo sapiens
cttttctgggtttgaagctgctg

SEQ ID NO: 3823673 - DNA, 13 bp, Homo sapiens
cttttctgtattt

SEQ ID NO: 3823674 - DNA, 15 bp, Homo sapiens
cttttggtgcctggc

SEQ ID NO: 3823675 - DNA, 22 bp, Homo sapiens
cttttgtgccatgttcaaaaga

SEQ ID NO: 3823676 - DNA, 12 bp, Homo sapiens
ctttttccttta

SEQ ID NO: 3823677 - DNA, 14 bp, Homo sapiens
ctttttcctttata

SEQ ID NO: 3823678 - DNA, 22 bp, Homo sapiens
ctttttcgccaaactgtctctg

SEQ ID NO: 3823679 - DNA, 23 bp, Homo sapiens
ctttttcgccaaactgtctctgc

SEQ ID NO: 3823680 - DNA, 12 bp, Homo sapiens
ctttttgtaaat

SEQ ID NO: 3823681 - DNA, 14 bp, Homo sapiens
cttttttctaaagt

SEQ ID NO: 3823682 - DNA, 23 bp, Homo sapiens
cttttttggctttagacactggc

SEQ ID NO: 3823683 - DNA, 17 bp, Homo sapiens
ctttttttgcatattaa

SEQ ID NO: 3823684 - DNA, 15 bp, Homo sapiens
gaaaaacacaagcaa

SEQ ID NO: 3823685 - DNA, 17 bp, Homo sapiens
gaaaaacacaagcaaaa

SEQ ID NO: 3823686 - DNA, 23 bp, Homo sapiens
gaaaaagtgatggagcagagcaa

SEQ ID NO: 3823687 - DNA, 14 bp, Homo sapiens
gaaaactaactcag

SEQ ID NO: 3823688 - DNA, 17 bp, Homo sapiens
gaaaactacatgtaaaa

SEQ ID NO: 3823689 - DNA, 21 bp, Homo sapiens
gaaaactacatgtaaaatctt

SEQ ID NO: 3823690 - DNA, 18 bp, Homo sapiens
gaaaacttgtattatgtg

SEQ ID NO: 3823691 - DNA, 20 bp, Homo sapiens
gaaaagcagcccttggccag

SEQ ID NO: 3823692 - DNA, 19 bp, Homo sapiens
gaaaagggcagaggcaagg

SEQ ID NO: 3823693 - DNA, 16 bp, Homo sapiens
gaaaaggtgtaaaaca

SEQ ID NO: 3823694 - DNA, 14 bp, Homo sapiens
gaaaatgtgagggg

SEQ ID NO: 3823695 - DNA, 17 bp, Homo sapiens
gaaacaagagaccaact

SEQ ID NO: 3823696 - DNA, 14 bp, Homo sapiens
gaaactacaccaca

SEQ ID NO: 3823697 - DNA, 20 bp, Homo sapiens
gaaactacaccacactaaaa

SEQ ID NO: 3823698 - DNA, 14 bp, Homo sapiens
gaaactcatctcat

SEQ ID NO: 3823699 - DNA, 15 bp, Homo sapiens
gaaactcatctcatt

SEQ ID NO: 3823700 - DNA, 20 bp, Homo sapiens
gaaactccacatctgcctta

SEQ ID NO: 3823701 - DNA, 16 bp, Homo sapiens
gaaagaaaaaacaaaa

SEQ ID NO: 3823702 - DNA, 12 bp, Homo sapiens
gaaagcaggggc

SEQ ID NO: 3823703 - DNA, 13 bp, Homo sapiens
gaaagcaggggct

SEQ ID NO: 3823704 - DNA, 14 bp, Homo sapiens
gaaagcaggggcta

SEQ ID NO: 3823705 - DNA, 11 bp, Homo sapiens
gaaagccaggc

SEQ ID NO: 3823706 - DNA, 22 bp, Homo sapiens
gaaaggctgcaacgctgattcc

SEQ ID NO: 3823707 - DNA, 18 bp, Homo sapiens
gaaaggggagagcctgct

SEQ ID NO: 3823708 - DNA, 22 bp, Homo sapiens
gaaagtattgtgtttatgcatt

SEQ ID NO: 3823709 - DNA, 22 bp, Homo sapiens
gaaagtcttgtgactagtgctg

SEQ ID NO: 3823710 - DNA, 23 bp, Homo sapiens
gaaagtgggtgagatgctggaga

SEQ ID NO: 3823711 - DNA, 12 bp, Homo sapiens
gaaataaatcta

SEQ ID NO: 3823712 - DNA, 17 bp, Homo sapiens
gaaatactatatataca

SEQ ID NO: 3823713 - DNA, 15 bp, Homo sapiens
gaaatatattttaaa

SEQ ID NO: 3823714 - DNA, 18 bp, Homo sapiens
gaaatatattttaaatgt

SEQ ID NO: 3823715 - DNA, 20 bp, Homo sapiens
gaaatatattttaaatgtgg

SEQ ID NO: 3823716 - DNA, 16 bp, Homo sapiens
gaaatcagtgccccag

SEQ ID NO: 3823717 - DNA, 18 bp, Homo sapiens
gaaatctgctctgtacat

SEQ ID NO: 3823718 - DNA, 14 bp, Homo sapiens
gaaatggggagctg

SEQ ID NO: 3823719 - DNA, 15 bp, Homo sapiens
gaaatggggagctgg

SEQ ID NO: 3823720 - DNA, 13 bp, Homo sapiens
gaaattacttcta

SEQ ID NO: 3823721 - DNA, 19 bp, Homo sapiens
gaaattcatggctttttct

SEQ ID NO: 3823722 - DNA, 23 bp, Homo sapiens
gaaatttaggggtagaaaatgtt

SEQ ID NO: 3823723 - DNA, 14 bp, Homo sapiens
gaaatttatacaaa

SEQ ID NO: 3823724 - DNA, 16 bp, Homo sapiens
gaaatttatacaaaga

SEQ ID NO: 3823725 - DNA, 11 bp, Homo sapiens
gaacattccta

SEQ ID NO: 3823726 - DNA, 21 bp, Homo sapiens
gaacctcactcttgccaacct

SEQ ID NO: 3823727 - DNA, 22 bp, Homo sapiens
gaacgcattttgggttgtttaa

SEQ ID NO: 3823728 - DNA, 14 bp, Homo sapiens
gaacgctctaggca

SEQ ID NO: 3823729 - DNA, 17 bp, Homo sapiens
gaacgctctaggcagaa

SEQ ID NO: 3823730 - DNA, 14 bp, Homo sapiens
gaactaacataatc

SEQ ID NO: 3823731 - DNA, 19 bp, Homo sapiens
gaactaacataatcttaaa

SEQ ID NO: 3823732 - DNA, 14 bp, Homo sapiens
gaactaattcattt

SEQ ID NO: 3823733 - DNA, 17 bp, Homo sapiens
gaactaattcatttatt

SEQ ID NO: 3823734 - DNA, 22 bp, Homo sapiens
gaactaattcatttattaagta

SEQ ID NO: 3823735 - DNA, 21 bp, Homo sapiens
gaactcatctaggtaaattac

SEQ ID NO: 3823736 - DNA, 12 bp, Homo sapiens
gaactcctccca

SEQ ID NO: 3823737 - DNA, 16 bp, Homo sapiens
gaactctgtgtgagag

SEQ ID NO: 3823738 - DNA, 18 bp, Homo sapiens
gaactgccgccgccgtgg

SEQ ID NO: 3823739 - DNA, 17 bp, Homo sapiens
gaacttgaacaaagtct

SEQ ID NO: 3823740 - DNA, 12 bp, Homo sapiens
gaagaagctggg

SEQ ID NO: 3823741 - DNA, 15 bp, Homo sapiens
gaagaagctgggagg

SEQ ID NO: 3823742 - DNA, 18 bp, Homo sapiens
gaagaaggagcagaataa

SEQ ID NO: 3823743 - DNA, 14 bp, Homo sapiens
gaagaagggagaag

SEQ ID NO: 3823744 - DNA, 18 bp, Homo sapiens
gaagaagggagaagaaag

SEQ ID NO: 3823745 - DNA, 14 bp, Homo sapiens
gaagacagagcagg

SEQ ID NO: 3823746 - DNA, 14 bp, Homo sapiens
gaagacaggcacaa

SEQ ID NO: 3823747 - DNA, 13 bp, Homo sapiens
gaagagaggagag

SEQ ID NO: 3823748 - DNA, 21 bp, Homo sapiens
gaagagaggagaggagagagg

SEQ ID NO: 3823749 - DNA, 17 bp, Homo sapiens
gaagattgagatgtgtt

SEQ ID NO: 3823750 - DNA, 22 bp, Homo sapiens
gaagattgagatgtgttcacaa

SEQ ID NO: 3823751 - DNA, 20 bp, Homo sapiens
gaagcagaataaagcaattt

SEQ ID NO: 3823752 - DNA, 15 bp, Homo sapiens
gaagcataaacatca

SEQ ID NO: 3823753 - DNA, 10 bp, Homo sapiens
gaagccaaag

SEQ ID NO: 3823754 - DNA, 14 bp, Homo sapiens
gaagccaagggaaa

SEQ ID NO: 3823755 - DNA, 17 bp, Homo sapiens
gaagccaagggaaaggg

SEQ ID NO: 3823756 - DNA, 14 bp, Homo sapiens
gaagccaagggaca

SEQ ID NO: 3823757 - DNA, 16 bp, Homo sapiens
gaagccacacagccca

SEQ ID NO: 3823758 - DNA, 23 bp, Homo sapiens
gaagccacacagcccagaaggcc

SEQ ID NO: 3823759 - DNA, 23 bp, Homo sapiens
gaagccgctcccggttccctccc

SEQ ID NO: 3823760 - DNA, 22 bp, Homo sapiens
cttcagaacaatctgagtccag

SEQ ID NO: 3823761 - DNA, 23 bp, Homo sapiens
cttcagattaatgactggctaca

SEQ ID NO: 3823762 - DNA, 19 bp, Homo sapiens
cttcaggccttgcctggga

SEQ ID NO: 3823763 - DNA, 21 bp, Homo sapiens
cttcagttttactgcattttc

SEQ ID NO: 3823764 - DNA, 17 bp, Homo sapiens
cttccaggaaactccac

SEQ ID NO: 3823765 - DNA, 17 bp, Homo sapiens
cttccctacccagtccc

SEQ ID NO: 3823766 - DNA, 23 bp, Homo sapiens
cttccctagctttagaccctggg

SEQ ID NO: 3823767 - DNA, 15 bp, Homo sapiens
cttccctgtgtcttt

SEQ ID NO: 3823768 - DNA, 18 bp, Homo sapiens
cttccgttgctgccatcg

SEQ ID NO: 3823769 - DNA, 17 bp, Homo sapiens
cttcctcagttacacaa

SEQ ID NO: 3823770 - DNA, 18 bp, Homo sapiens
cttcctctagaagccaag

SEQ ID NO: 3823771 - DNA, 20 bp, Homo sapiens
cttcctgcgtcctcctcacc

SEQ ID NO: 3823772 - DNA, 21 bp, Homo sapiens
cttcctgcgtcctcctcacct

SEQ ID NO: 3823773 - DNA, 14 bp, Homo sapiens
cttcctggctagga

SEQ ID NO: 3823774 - DNA, 14 bp, Homo sapiens
cttccttgcgacca

SEQ ID NO: 3823775 - DNA, 17 bp, Homo sapiens
cttccttttccctgctt

SEQ ID NO: 3823776 - DNA, 22 bp, Homo sapiens
cttccttttccctgcttccagg

SEQ ID NO: 3823777 - DNA, 20 bp, Homo sapiens
cttctaatatttattgcttt

SEQ ID NO: 3823778 - DNA, 13 bp, Homo sapiens
cttctagaataca

SEQ ID NO: 3823779 - DNA, 23 bp, Homo sapiens
cttctagaatacatattacaaga

SEQ ID NO: 3823780 - DNA, 15 bp, Homo sapiens
cttctcatgctattt

SEQ ID NO: 3823781 - DNA, 18 bp, Homo sapiens
cttctcatgctatttcta

SEQ ID NO: 3823782 - DNA, 18 bp, Homo sapiens
cttctccgccagcctcct

SEQ ID NO: 3823783 - DNA, 24 bp, Homo sapiens
cttctccgccagcctcctctggac

SEQ ID NO: 3823784 - DNA, 12 bp, Homo sapiens
cttctctgctgc

SEQ ID NO: 3823785 - DNA, 14 bp, Homo sapiens
cttctgcctgagct

SEQ ID NO: 3823786 - DNA, 15 bp, Homo sapiens
cttctgcctgagctt

SEQ ID NO: 3823787 - DNA, 14 bp, Homo sapiens
cttctgcttttctg

SEQ ID NO: 3823788 - DNA, 15 bp, Homo sapiens
cttctggattcttgg

SEQ ID NO: 3823789 - DNA, 17 bp, Homo sapiens
cttctgtggttgtggat

SEQ ID NO: 3823790 - DNA, 20 bp, Homo sapiens
cttctgtggttgtggatggg

SEQ ID NO: 3823791 - DNA, 14 bp, Homo sapiens
cttctgtgtagaca

SEQ ID NO: 3823792 - DNA, 18 bp, Homo sapiens
cttctttgcagcctgggt

SEQ ID NO: 3823793 - DNA, 13 bp, Homo sapiens
cttgaaaattaac

SEQ ID NO: 3823794 - DNA, 18 bp, Homo sapiens
cttgaactcctgacctca

SEQ ID NO: 3823795 - DNA, 18 bp, Homo sapiens
cttgaagattcaggcttg

SEQ ID NO: 3823796 - DNA, 13 bp, Homo sapiens
cttgaagccaaag

SEQ ID NO: 3823797 - DNA, 14 bp, Homo sapiens
cttgaagccaaaga

SEQ ID NO: 3823798 - DNA, 19 bp, Homo sapiens
cttgaagccaaagaaaaat

SEQ ID NO: 3823799 - DNA, 14 bp, Homo sapiens
cttgaatcctaggg

SEQ ID NO: 3823800 - DNA, 20 bp, Homo sapiens
cttgaattgcattttttaaa

SEQ ID NO: 3823801 - DNA, 17 bp, Homo sapiens
cttgagccgggcccctg

SEQ ID NO: 3823802 - DNA, 20 bp, Homo sapiens
cttgagccgggcccctgggc

SEQ ID NO: 3823803 - DNA, 21 bp, Homo sapiens
cttgagttttcatttcatata

SEQ ID NO: 3823804 - DNA, 22 bp, Homo sapiens
cttgagttttcatttcatatat

SEQ ID NO: 3823805 - DNA, 12 bp, Homo sapiens
cttgatagctaa

SEQ ID NO: 3823806 - DNA, 16 bp, Homo sapiens
cttgatagctaaataa

SEQ ID NO: 3823807 - DNA, 16 bp, Homo sapiens
cttgatctgctcagcc

SEQ ID NO: 3823808 - DNA, 23 bp, Homo sapiens
cttgatctgctcagccctggagg

SEQ ID NO: 3823809 - DNA, 17 bp, Homo sapiens
cttgcattaaaagactg

SEQ ID NO: 3823810 - DNA, 22 bp, Homo sapiens
cttgccaacctgtaataaatat

SEQ ID NO: 3823811 - DNA, 23 bp, Homo sapiens
cttgccaagtaatcctgcacaga

SEQ ID NO: 3823812 - DNA, 17 bp, Homo sapiens
cttgcctcagggccaag

SEQ ID NO: 3823813 - DNA, 14 bp, Homo sapiens
cttgcctccccatt

SEQ ID NO: 3823814 - DNA, 20 bp, Homo sapiens
cttgcctccccatttcccat

SEQ ID NO: 3823815 - DNA, 13 bp, Homo sapiens
cttgcgaccacca

SEQ ID NO: 3823816 - DNA, 14 bp, Homo sapiens
cttgcgaccaccaa

SEQ ID NO: 3823817 - DNA, 18 bp, Homo sapiens
cttgcgaccaccaacaca

SEQ ID NO: 3823818 - DNA, 17 bp, Homo sapiens
cttgctctggacctgcc

SEQ ID NO: 3823819 - DNA, 17 bp, Homo sapiens
cttggaattactgaaag

SEQ ID NO: 3823820 - DNA, 18 bp, Homo sapiens
cttggaattactgaaagt

SEQ ID NO: 3823821 - DNA, 15 bp, Homo sapiens
cttggatgcatgagc

SEQ ID NO: 3823822 - DNA, 16 bp, Homo sapiens
cttggcctgctgtgat

SEQ ID NO: 3823823 - DNA, 15 bp, Homo sapiens
cttggctgctcagtt

SEQ ID NO: 3823824 - DNA, 15 bp, Homo sapiens
cttgggaggaagcag

SEQ ID NO: 3823825 - DNA, 16 bp, Homo sapiens
cttgggaggaagcaga

SEQ ID NO: 3823826 - DNA, 18 bp, Homo sapiens
cttgggaggaagcagaat

SEQ ID NO: 3823827 - DNA, 21 bp, Homo sapiens
cttgggaggaagcagaataaa

SEQ ID NO: 3823828 - DNA, 19 bp, Homo sapiens
cttgggaggttgaagcaga

SEQ ID NO: 3823829 - DNA, 17 bp, Homo sapiens
cttgggggtcacccatg

SEQ ID NO: 3823830 - DNA, 16 bp, Homo sapiens
cttggtccaggaaatg

SEQ ID NO: 3823831 - DNA, 14 bp, Homo sapiens
cttggtggattaga

SEQ ID NO: 3823832 - DNA, 20 bp, Homo sapiens
cttgtaaattccccttccca

SEQ ID NO: 3823833 - DNA, 20 bp, Homo sapiens
cttgtgacagattatacaga

SEQ ID NO: 3823834 - DNA, 14 bp, Homo sapiens
cttgtgactagtgc

SEQ ID NO: 3823835 - DNA, 15 bp, Homo sapiens
cttgtgactagtgct

SEQ ID NO: 3823836 - DNA, 16 bp, Homo sapiens
cttgtgactagtgctg

SEQ ID NO: 3823837 - DNA, 21 bp, Homo sapiens
cttgtgctggatggagcccag

SEQ ID NO: 3823838 - DNA, 14 bp, Homo sapiens
ctttaaaaactatt

SEQ ID NO: 3823839 - DNA, 22 bp, Homo sapiens
ctttaaaaagcagtttttgaaa

SEQ ID NO: 3823840 - DNA, 13 bp, Homo sapiens
ctttactgtgtat

SEQ ID NO: 3823841 - DNA, 14 bp, Homo sapiens
acccaataaaactg

SEQ ID NO: 3823842 - DNA, 22 bp, Homo sapiens
acccaccgtggaggaggaaggc

SEQ ID NO: 3823843 - DNA, 15 bp, Homo sapiens
acccactccacacca

SEQ ID NO: 3823844 - DNA, 21 bp, Homo sapiens
acccactccacaccagtaata

SEQ ID NO: 3823845 - DNA, 23 bp, Homo sapiens
acccagcctcagtcctcccctca

SEQ ID NO: 3823846 - DNA, 14 bp, Homo sapiens
acccatggcctcag

SEQ ID NO: 3823847 - DNA, 15 bp, Homo sapiens
acccatggcctcaga

SEQ ID NO: 3823848 - DNA, 19 bp, Homo sapiens
accccaaagagagcactgt

SEQ ID NO: 3823849 - DNA, 13 bp, Homo sapiens
accccagactcca

SEQ ID NO: 3823850 - DNA, 15 bp, Homo sapiens
accccagactccagg

SEQ ID NO: 3823851 - DNA, 16 bp, Homo sapiens
accccagactccaggc

SEQ ID NO: 3823852 - DNA, 19 bp, Homo sapiens
accccagctgtgagccttg

SEQ ID NO: 3823853 - DNA, 22 bp, Homo sapiens
accccagctgtgagccttggct

SEQ ID NO: 3823854 - DNA, 18 bp, Homo sapiens
accccaggcagctcctgt

SEQ ID NO: 3823855 - DNA, 13 bp, Homo sapiens
acccccagccagg

SEQ ID NO: 3823856 - DNA, 15 bp, Homo sapiens
acccccgagcttgcc

SEQ ID NO: 3823857 - DNA, 15 bp, Homo sapiens
accccgtctgctcct

SEQ ID NO: 3823858 - DNA, 16 bp, Homo sapiens
acccctcctcactggc

SEQ ID NO: 3823859 - DNA, 12 bp, Homo sapiens
acccctgccccc

SEQ ID NO: 3823860 - DNA, 17 bp, Homo sapiens
acccctgcccccagccc

SEQ ID NO: 3823861 - DNA, 18 bp, Homo sapiens
acccctgtcctcactgct

SEQ ID NO: 3823862 - DNA, 19 bp, Homo sapiens
acccctgtcctcactgctc

SEQ ID NO: 3823863 - DNA, 21 bp, Homo sapiens
acccctgtcctcactgctccc

SEQ ID NO: 3823864 - DNA, 15 bp, Homo sapiens
accccttctctcctc

SEQ ID NO: 3823865 - DNA, 23 bp, Homo sapiens
accccttctctcctccccaaatc

SEQ ID NO: 3823866 - DNA, 16 bp, Homo sapiens
accctaagactcctcg

SEQ ID NO: 3823867 - DNA, 13 bp, Homo sapiens
accctcagcccca

SEQ ID NO: 3823868 - DNA, 14 bp, Homo sapiens
accctcagccccag

SEQ ID NO: 3823869 - DNA, 23 bp, Homo sapiens
accctcgctctctgtctccaggc

SEQ ID NO: 3823870 - DNA, 14 bp, Homo sapiens
accctctgccacca

SEQ ID NO: 3823871 - DNA, 19 bp, Homo sapiens
accctctgccaccagagac

SEQ ID NO: 3823872 - DNA, 20 bp, Homo sapiens
accctctgccaccagagacc

SEQ ID NO: 3823873 - DNA, 14 bp, Homo sapiens
accctgctgctgct

SEQ ID NO: 3823874 - DNA, 18 bp, Homo sapiens
accctgggtgggctctgt

SEQ ID NO: 3823875 - DNA, 12 bp, Homo sapiens
accctttggttt

SEQ ID NO: 3823876 - DNA, 23 bp, Homo sapiens
acccttttctgggtttgaagctg

SEQ ID NO: 3823877 - DNA, 14 bp, Homo sapiens
accgacccttcctg

SEQ ID NO: 3823878 - DNA, 13 bp, Homo sapiens
accgagagccaaa

SEQ ID NO: 3823879 - DNA, 14 bp, Homo sapiens
accgagagccaaac

SEQ ID NO: 3823880 - DNA, 20 bp, Homo sapiens
accgcttccccgatgtgagc

SEQ ID NO: 3823881 - DNA, 15 bp, Homo sapiens
acctcactcttgcca

SEQ ID NO: 3823882 - DNA, 16 bp, Homo sapiens
acctcactcttgccaa

SEQ ID NO: 3823883 - DNA, 18 bp, Homo sapiens
acctcactcttgccaacc

SEQ ID NO: 3823884 - DNA, 15 bp, Homo sapiens
acctcagctgcttct

SEQ ID NO: 3823885 - DNA, 21 bp, Homo sapiens
acctcatgcccaccccctgcc

SEQ ID NO: 3823886 - DNA, 12 bp, Homo sapiens
acctccatgccc

SEQ ID NO: 3823887 - DNA, 11 bp, Homo sapiens
acctccccacg

SEQ ID NO: 3823888 - DNA, 16 bp, Homo sapiens
acctccccactccagc

SEQ ID NO: 3823889 - DNA, 17 bp, Homo sapiens
acctccccactccagca

SEQ ID NO: 3823890 - DNA, 19 bp, Homo sapiens
acctccccactccagcaga

SEQ ID NO: 3823891 - DNA, 14 bp, Homo sapiens
acctccccagacag

SEQ ID NO: 3823892 - DNA, 18 bp, Homo sapiens
acctccccagacagggct

SEQ ID NO: 3823893 - DNA, 13 bp, Homo sapiens
acctccccagccc

SEQ ID NO: 3823894 - DNA, 15 bp, Homo sapiens
acctccccagcccct

SEQ ID NO: 3823895 - DNA, 16 bp, Homo sapiens
acctccccagccccta

SEQ ID NO: 3823896 - DNA, 23 bp, Homo sapiens
acctcctcagggatggccgttgg

SEQ ID NO: 3823897 - DNA, 12 bp, Homo sapiens
acctctccttcc

SEQ ID NO: 3823898 - DNA, 23 bp, Homo sapiens
acctctgacatcaagtgtaatta

SEQ ID NO: 3823899 - DNA, 20 bp, Homo sapiens
acctctgccccccaagttca

SEQ ID NO: 3823900 - DNA, 19 bp, Homo sapiens
acctctgtgacctcaggca

SEQ ID NO: 3823901 - DNA, 18 bp, Homo sapiens
acctctgtgctgcatccc

SEQ ID NO: 3823902 - DNA, 17 bp, Homo sapiens
acctgaaatatatttta

SEQ ID NO: 3823903 - DNA, 18 bp, Homo sapiens
acctgaaatatattttaa

SEQ ID NO: 3823904 - DNA, 18 bp, Homo sapiens
acctgccaggcaggggtg

SEQ ID NO: 3823905 - DNA, 20 bp, Homo sapiens
acctgccaggcaggggtggg

SEQ ID NO: 3823906 - DNA, 23 bp, Homo sapiens
acctgcccccgcatcccctgcct

SEQ ID NO: 3823907 - DNA, 22 bp, Homo sapiens
acctgcctccccggaagtgcct

SEQ ID NO: 3823908 - DNA, 15 bp, Homo sapiens
acctgcgcagggccc

SEQ ID NO: 3823909 - DNA, 21 bp, Homo sapiens
acctgctgtaataaatgtatt

SEQ ID NO: 3823910 - DNA, 23 bp, Homo sapiens
acctggctgaggttcctctgcct

SEQ ID NO: 3823911 - DNA, 16 bp, Homo sapiens
acctgggttccccacc

SEQ ID NO: 3823912 - DNA, 19 bp, Homo sapiens
acctgtaagcccagcattt

SEQ ID NO: 3823913 - DNA, 17 bp, Homo sapiens
acctgtaataaatatga

SEQ ID NO: 3823914 - DNA, 15 bp, Homo sapiens
acctgtgcagggccc

SEQ ID NO: 3823915 - DNA, 19 bp, Homo sapiens
acctgtgcagggccctctg

SEQ ID NO: 3823916 - DNA, 23 bp, Homo sapiens
acctgtgcagggccctctggggc

SEQ ID NO: 3823917 - DNA, 19 bp, Homo sapiens
accttgtaaattccccttc

SEQ ID NO: 3823918 - DNA, 19 bp, Homo sapiens
accttgtgaacatcagaag

SEQ ID NO: 3823919 - DNA, 22 bp, Homo sapiens
acctttaaaaagcagtttttga

SEQ ID NO: 3823920 - DNA, 17 bp, Homo sapiens
acctttggaaacaacat

SEQ ID NO: 3823921 - DNA, 14 bp, Homo sapiens
accttttctttacc

SEQ ID NO: 3823922 - DNA, 19 bp, Homo sapiens
acgaattatttttttaaac

SEQ ID NO: 3823923 - DNA, 21 bp, Homo sapiens
acgaattatttttttaaactt

SEQ ID NO: 3823924 - DNA, 22 bp, Homo sapiens
acgcattttgggttgtttaaaa

SEQ ID NO: 3823925 - DNA, 14 bp, Homo sapiens
acgccctcccctcc

SEQ ID NO: 3823926 - DNA, 19 bp, Homo sapiens
acgccctcccctcccctgc

SEQ ID NO: 3823927 - DNA, 14 bp, Homo sapiens
acgcgacttctcag

SEQ ID NO: 3823928 - DNA, 16 bp, Homo sapiens
acgcgacttctcagga

SEQ ID NO: 3823929 - DNA, 20 bp, Homo sapiens
acgcgacttctcaggacgac

SEQ ID NO: 3823930 - DNA, 18 bp, Homo sapiens
acgctaaagagcccttgc

SEQ ID NO: 3823931 - DNA, 18 bp, Homo sapiens
acatatcagacttcacca

SEQ ID NO: 3823932 - DNA, 19 bp, Homo sapiens
acatattacaagaaaacta

SEQ ID NO: 3823933 - DNA, 14 bp, Homo sapiens
acatcaagtgtaat

SEQ ID NO: 3823934 - DNA, 15 bp, Homo sapiens
acatcaagtgtaatt

SEQ ID NO: 3823935 - DNA, 21 bp, Homo sapiens
acatcaagtgtaattagcttt

SEQ ID NO: 3823936 - DNA, 18 bp, Homo sapiens
acatcacatggcatgttt

SEQ ID NO: 3823937 - DNA, 18 bp, Homo sapiens
acatcagaaggtattttt

SEQ ID NO: 3823938 - DNA, 15 bp, Homo sapiens
acatcatatacctct

SEQ ID NO: 3823939 - DNA, 18 bp, Homo sapiens
acatcatatacctcttga

SEQ ID NO: 3823940 - DNA, 21 bp, Homo sapiens
acatcctaatagaaagaaatt

SEQ ID NO: 3823941 - DNA, 11 bp, Homo sapiens
acatctgcctt

SEQ ID NO: 3823942 - DNA, 14 bp, Homo sapiens
acatcttgatctgc

SEQ ID NO: 3823943 - DNA, 23 bp, Homo sapiens
acatcttgatctgctcagccctg

SEQ ID NO: 3823944 - DNA, 15 bp, Homo sapiens
acatgctggctcctg

SEQ ID NO: 3823945 - DNA, 16 bp, Homo sapiens
acatgctggctcctga

SEQ ID NO: 3823946 - DNA, 16 bp, Homo sapiens
acatggtgcctgagag

SEQ ID NO: 3823947 - DNA, 18 bp, Homo sapiens
acatggtgcctgagaggc

SEQ ID NO: 3823948 - DNA, 21 bp, Homo sapiens
acatgtaaaatcttgatagct

SEQ ID NO: 3823949 - DNA, 16 bp, Homo sapiens
acatgtccccttccct

SEQ ID NO: 3823950 - DNA, 23 bp, Homo sapiens
acattatttcgtgttgtgttctt

SEQ ID NO: 3823951 - DNA, 21 bp, Homo sapiens
acattctcttactttttgtaa

SEQ ID NO: 3823952 - DNA, 22 bp, Homo sapiens
accaaatatatgccttactatt

SEQ ID NO: 3823953 - DNA, 13 bp, Homo sapiens
accaaatgcttta

SEQ ID NO: 3823954 - DNA, 18 bp, Homo sapiens
accaacacacaggaactc

SEQ ID NO: 3823955 - DNA, 18 bp, Homo sapiens
accaacactgtaacattt

SEQ ID NO: 3823956 - DNA, 23 bp, Homo sapiens
accaagtattaaactgtaaatca

SEQ ID NO: 3823957 - DNA, 12 bp, Homo sapiens
accacacccagc

SEQ ID NO: 3823958 - DNA, 15 bp, Homo sapiens
accacacccagcctc

SEQ ID NO: 3823959 - DNA, 21 bp, Homo sapiens
accacaggccctttcctcagg

SEQ ID NO: 3823960 - DNA, 20 bp, Homo sapiens
accacccccgagcttgcctc

SEQ ID NO: 3823961 - DNA, 14 bp, Homo sapiens
accacgctggagct

SEQ ID NO: 3823962 - DNA, 16 bp, Homo sapiens
accagctgcgcttgct

SEQ ID NO: 3823963 - DNA, 18 bp, Homo sapiens
accagctgcgcttgcttt

SEQ ID NO: 3823964 - DNA, 20 bp, Homo sapiens
accagctgcgcttgcttttc

SEQ ID NO: 3823965 - DNA, 15 bp, Homo sapiens
accaggagctgctca

SEQ ID NO: 3823966 - DNA, 15 bp, Homo sapiens
accataaaaagctga

SEQ ID NO: 3823967 - DNA, 17 bp, Homo sapiens
accatctggcccaggct

SEQ ID NO: 3823968 - DNA, 17 bp, Homo sapiens
acccaaggatttttaaa

SEQ ID NO: 3823969 - DNA, 18 bp, Homo sapiens
acccaaggatttttaaaa

SEQ ID NO: 3823970 - DNA, 17 bp, Homo sapiens
aatgcataatgtcttta

SEQ ID NO: 3823971 - DNA, 21 bp, Homo sapiens
aatgccttaattaaagaattt

SEQ ID NO: 3823972 - DNA, 13 bp, Homo sapiens
aatgctgtatgtc

SEQ ID NO: 3823973 - DNA, 16 bp, Homo sapiens
aatggcaggttttaca

SEQ ID NO: 3823974 - DNA, 12 bp, Homo sapiens
aatgtaaagtct

SEQ ID NO: 3823975 - DNA, 13 bp, Homo sapiens
aatgtaaagtcta

SEQ ID NO: 3823976 - DNA, 15 bp, Homo sapiens
aatgtacaggttgga

SEQ ID NO: 3823977 - DNA, 20 bp, Homo sapiens
aatgtcacggctactctata

SEQ ID NO: 3823978 - DNA, 17 bp, Homo sapiens
aatgtctggggacaggc

SEQ ID NO: 3823979 - DNA, 18 bp, Homo sapiens
aatgtgaaagatgcatgt

SEQ ID NO: 3823980 - DNA, 13 bp, Homo sapiens
aatgttacaaaaa

SEQ ID NO: 3823981 - DNA, 23 bp, Homo sapiens
aatgttaggggtatttaatgtat

SEQ ID NO: 3823982 - DNA, 14 bp, Homo sapiens
aatgttttacaact

SEQ ID NO: 3823983 - DNA, 10 bp, Homo sapiens
aatgttttcg

SEQ ID NO: 3823984 - DNA, 14 bp, Homo sapiens
aattaacaaagtgt

SEQ ID NO: 3823985 - DNA, 19 bp, Homo sapiens
aattaacatgaatatttag

SEQ ID NO: 3823986 - DNA, 21 bp, Homo sapiens
aattaagaaagattaaatata

SEQ ID NO: 3823987 - DNA, 14 bp, Homo sapiens
aattaattaacatc

SEQ ID NO: 3823988 - DNA, 21 bp, Homo sapiens
aattaatttggacattatttc

SEQ ID NO: 3823989 - DNA, 14 bp, Homo sapiens
aattagctgggtgt

SEQ ID NO: 3823990 - DNA, 13 bp, Homo sapiens
aattattttatgt

SEQ ID NO: 3823991 - DNA, 17 bp, Homo sapiens
aattattttatgtcata

SEQ ID NO: 3823992 - DNA, 20 bp, Homo sapiens
aattatttttttaaacttca

SEQ ID NO: 3823993 - DNA, 21 bp, Homo sapiens
aattcatggttttaaagctaa

SEQ ID NO: 3823994 - DNA, 13 bp, Homo sapiens
aattccctctgga

SEQ ID NO: 3823995 - DNA, 13 bp, Homo sapiens
aattctttcatga

SEQ ID NO: 3823996 - DNA, 15 bp, Homo sapiens
aattgagagctttat

SEQ ID NO: 3823997 - DNA, 21 bp, Homo sapiens
aattgcattttttaaaacaag

SEQ ID NO: 3823998 - DNA, 18 bp, Homo sapiens
aattgtacaaaaaagtta

SEQ ID NO: 3823999 - DNA, 19 bp, Homo sapiens
aattgtacaaaaaagttat

SEQ ID NO: 3824000 - DNA, 20 bp, Homo sapiens
aattgtgtttataattttaa

SEQ ID NO: 3824001 - DNA, 16 bp, Homo sapiens
aattgttacaaattgt

SEQ ID NO: 3824002 - DNA, 22 bp, Homo sapiens
aagcctgtgtatcgtggagaaa

SEQ ID NO: 3824003 - DNA, 18 bp, Homo sapiens
aagctaataaaatatcat

SEQ ID NO: 3824004 - DNA, 20 bp, Homo sapiens
aagctaataaaatatcattc

SEQ ID NO: 3824005 - DNA, 21 bp, Homo sapiens
aagctaataaaatatcattca

SEQ ID NO: 3824006 - DNA, 22 bp, Homo sapiens
aagctcaagaggaaaagctaag

SEQ ID NO: 3824007 - DNA, 20 bp, Homo sapiens
aagctctaaggtaacaaatt

SEQ ID NO: 3824008 - DNA, 11 bp, Homo sapiens
aagctgacctt

SEQ ID NO: 3824009 - DNA, 16 bp, Homo sapiens
aagctgggagggaggg

SEQ ID NO: 3824010 - DNA, 20 bp, Homo sapiens
aagcttattaatgctaaggg

SEQ ID NO: 3824011 - DNA, 17 bp, Homo sapiens
aagcttctctctgagct

SEQ ID NO: 3824012 - DNA, 19 bp, Homo sapiens
aaggaaaaacacaagcaaa

SEQ ID NO: 3824013 - DNA, 12 bp, Homo sapiens
aaggaattttat

SEQ ID NO: 3824014 - DNA, 22 bp, Homo sapiens
aaggactatttataactaatat

SEQ ID NO: 3824015 - DNA, 16 bp, Homo sapiens
aaggagaaatagctgt

SEQ ID NO: 3824016 - DNA, 14 bp, Homo sapiens
aaggagagaaagtg

SEQ ID NO: 3824017 - DNA, 15 bp, Homo sapiens
aaggagcagaataaa

SEQ ID NO: 3824018 - DNA, 21 bp, Homo sapiens
aaggagtaggccactctttaa

SEQ ID NO: 3824019 - DNA, 19 bp, Homo sapiens
aaggatggtggggccccca

SEQ ID NO: 3824020 - DNA, 18 bp, Homo sapiens
aaggattttaaatgctgt

SEQ ID NO: 3824021 - DNA, 23 bp, Homo sapiens
aaggattttaaatgctgtatgtc

SEQ ID NO: 3824022 - DNA, 19 bp, Homo sapiens
aaggcaagagggggtggag

SEQ ID NO: 3824023 - DNA, 12 bp, Homo sapiens
aaggcagccaga

SEQ ID NO: 3824024 - DNA, 22 bp, Homo sapiens
aaggcagccagatccccagggc

SEQ ID NO: 3824025 - DNA, 20 bp, Homo sapiens
aaggccagaaaaggcagcca

SEQ ID NO: 3824026 - DNA, 21 bp, Homo sapiens
aaagttgtaatagagaatatt

SEQ ID NO: 3824027 - DNA, 13 bp, Homo sapiens
aaagttgtttata

SEQ ID NO: 3824028 - DNA, 16 bp, Homo sapiens
aaagttgtttataaaa

SEQ ID NO: 3824029 - DNA, 16 bp, Homo sapiens
aaagtttgttgaaaca

SEQ ID NO: 3824030 - DNA, 12 bp, Homo sapiens
aaataaacactg

SEQ ID NO: 3824031 - DNA, 14 bp, Homo sapiens
aaataaagcctgct

SEQ ID NO: 3824032 - DNA, 23 bp, Homo sapiens
aaataaaggcgatagctgacttt

SEQ ID NO: 3824033 - DNA, 15 bp, Homo sapiens
aaataaatctatatt

SEQ ID NO: 3824034 - DNA, 19 bp, Homo sapiens
aaatagagtgcataaataa

SEQ ID NO: 3824035 - DNA, 14 bp, Homo sapiens
aaatatataaacaa

SEQ ID NO: 3824036 - DNA, 19 bp, Homo sapiens
aaatatatataaatatata

SEQ ID NO: 3824037 - DNA, 16 bp, Homo sapiens
aaatatatctttgtaa

SEQ ID NO: 3824038 - DNA, 14 bp, Homo sapiens
aaatatcattcagc

SEQ ID NO: 3824039 - DNA, 15 bp, Homo sapiens
aaatatcattcagca

SEQ ID NO: 3824040 - DNA, 17 bp, Homo sapiens
aaatatcattcagcaac

SEQ ID NO: 3824041 - DNA, 22 bp, Homo sapiens
aaatattctattttcattttct

SEQ ID NO: 3824042 - DNA, 13 bp, Homo sapiens
aaatatttcataa

SEQ ID NO: 3824043 - DNA, 17 bp, Homo sapiens
aaatatttcataaatta

SEQ ID NO: 3824044 - DNA, 14 bp, Homo sapiens
aaatcagactatga

SEQ ID NO: 3824045 - DNA, 16 bp, Homo sapiens
aaatcataatgtaact

SEQ ID NO: 3824046 - DNA, 20 bp, Homo sapiens
aaatcatgtgcatatatctt

SEQ ID NO: 3824047 - DNA, 18 bp, Homo sapiens
aaatctgctctgtacatc

SEQ ID NO: 3824048 - DNA, 22 bp, Homo sapiens
aaatcttgatagctaaataact

SEQ ID NO: 3824049 - DNA, 18 bp, Homo sapiens
aaatgactactacacact

SEQ ID NO: 3824050 - DNA, 11 bp, Homo sapiens
aaatgagaaat

SEQ ID NO: 3824051 - DNA, 13 bp, Homo sapiens
aaatgagaaatct

SEQ ID NO: 3824052 - DNA, 18 bp, Homo sapiens
aaatgccacaagacataa

SEQ ID NO: 3824053 - DNA, 21 bp, Homo sapiens
aaatgccacaagacataattt

SEQ ID NO: 3824054 - DNA, 15 bp, Homo sapiens
aaatgcctgctgctg

SEQ ID NO: 3824055 - DNA, 17 bp, Homo sapiens
aaatgcctgctgctgcc

SEQ ID NO: 3824056 - DNA, 14 bp, Homo sapiens
aaatgctgtaaata

SEQ ID NO: 3824057 - DNA, 20 bp, Homo sapiens
aaatgctgtaaatatttcat

SEQ ID NO: 3824058 - DNA, 20 bp, Homo sapiens
aaatgctgtatgtcattaaa

SEQ ID NO: 3824059 - DNA, 18 bp, Homo sapiens
aaatggggagctggccta

SEQ ID NO: 3824060 - DNA, 17 bp, Homo sapiens
aaatgtattaactgaaa

SEQ ID NO: 3824061 - DNA, 14 bp, Homo sapiens
aaatgttacaaaaa

SEQ ID NO: 3824062 - DNA, 16 bp, Homo sapiens
aaatgttacaaaaaaa

SEQ ID NO: 3824063 - DNA, 22 bp, Homo sapiens
aaatgttttcccctaattttcc

SEQ ID NO: 3824064 - DNA, 18 bp, Homo sapiens
aaatgtttttttttaaag

SEQ ID NO: 3824065 - DNA, 18 bp, Homo sapiens
aaattaacaaagtgtcac

SEQ ID NO: 3824066 - DNA, 14 bp, Homo sapiens
aaattacatgaaga

SEQ ID NO: 3824067 - DNA, 18 bp, Homo sapiens
aaattatcaagctaataa

SEQ ID NO: 3824068 - DNA, 19 bp, Homo sapiens
aaattatcaagctaataaa

SEQ ID NO: 3824069 - DNA, 12 bp, Homo sapiens
aaattattttat

SEQ ID NO: 3824070 - DNA, 13 bp, Homo sapiens
aaattattttatg

SEQ ID NO: 3824071 - DNA, 14 bp, Homo sapiens
aaattattttatgt

SEQ ID NO: 3824072 - DNA, 14 bp, Homo sapiens
aaattccccttccc

SEQ ID NO: 3824073 - DNA, 14 bp, Homo sapiens
aaattccctctgga

SEQ ID NO: 3824074 - DNA, 23 bp, Homo sapiens
aaattccctctggagtttcatgt

SEQ ID NO: 3824075 - DNA, 13 bp, Homo sapiens
aaattctttcatg

SEQ ID NO: 3824076 - DNA, 16 bp, Homo sapiens
aaattgagagctttat

SEQ ID NO: 3824077 - DNA, 16 bp, Homo sapiens
aaattgcgaaatctgt

SEQ ID NO: 3824078 - DNA, 22 bp, Homo sapiens
aaatttagatttaatttacgtc

SEQ ID NO: 3824079 - DNA, 21 bp, Homo sapiens
aaatttataacagttataaag

SEQ ID NO: 3824080 - DNA, 23 bp, Homo sapiens
aaatttcatgaaaactttttaat

SEQ ID NO: 3824081 - DNA, 23 bp, Homo sapiens
aaatttttaatctttaattttac

SEQ ID NO: 3824082 - DNA, 15 bp, Homo sapiens
aacaaaaaataaaga

SEQ ID NO: 3824083 - DNA, 14 bp, Homo sapiens
aacaaacacacaca

SEQ ID NO: 3824084 - DNA, 15 bp, Homo sapiens
aacaaagaaattatg

SEQ ID NO: 3824085 - DNA, 18 bp, Homo sapiens
aacaacattattttaaaa

SEQ ID NO: 3824086 - DNA, 15 bp, Homo sapiens
aacaagaaagtttcc

SEQ ID NO: 3824087 - DNA, 17 bp, Homo sapiens
aacaaggggttacttta

SEQ ID NO: 3824088 - DNA, 14 bp, Homo sapiens
aacaataaagagat

SEQ ID NO: 3824089 - DNA, 16 bp, Homo sapiens
aacaataggtatttct

SEQ ID NO: 3824090 - DNA, 17 bp, Homo sapiens
aacaatgaagtgtttta

SEQ ID NO: 3824091 - DNA, 19 bp, Homo sapiens
aacaatggcaggttttaca

SEQ ID NO: 3824092 - DNA, 12 bp, Homo sapiens
aacacaagcaaa

SEQ ID NO: 3824093 - DNA, 13 bp, Homo sapiens
aacagctccttgg

SEQ ID NO: 3824094 - DNA, 22 bp, Homo sapiens
aacagctccttgggaggaagca

SEQ ID NO: 3824095 - DNA, 15 bp, Homo sapiens
aacagttataaagaa

SEQ ID NO: 3824096 - DNA, 19 bp, Homo sapiens
aacagttataaagaaagat

SEQ ID NO: 3824097 - DNA, 14 bp, Homo sapiens
aacataatcttaaa

SEQ ID NO: 3824098 - DNA, 13 bp, Homo sapiens
aacatcaaacacg

SEQ ID NO: 3824099 - DNA, 16 bp, Homo sapiens
aacatcatatacctct

SEQ ID NO: 3824100 - DNA, 20 bp, Homo sapiens
aacatcatatacctcttgaa

SEQ ID NO: 3824101 - DNA, 13 bp, Homo sapiens
aacatcctgctgc

SEQ ID NO: 3824102 - DNA, 16 bp, Homo sapiens
aacatgtccccttccc

SEQ ID NO: 3824103 - DNA, 17 bp, Homo sapiens
aacatgtccccttccct

SEQ ID NO: 3824104 - DNA, 21 bp, Homo sapiens
aacatgtgaatgaatacacag

SEQ ID NO: 3824105 - DNA, 18 bp, Homo sapiens
aacattattttaaaatca

SEQ ID NO: 3824106 - DNA, 21 bp, Homo sapiens
aacattattttaaaatcaaag

SEQ ID NO: 3824107 - DNA, 15 bp, Homo sapiens
aaccaggagctgctc

SEQ ID NO: 3824108 - DNA, 17 bp, Homo sapiens
aaccaggagctgctcac

SEQ ID NO: 3824109 - DNA, 22 bp, Homo sapiens
aaccaggattttgtgttttttc

SEQ ID NO: 3824110 - DNA, 18 bp, Homo sapiens
aaccccgaggggcttgca

SEQ ID NO: 3824111 - DNA, 17 bp, Homo sapiens
aaccctgtaagttacag

SEQ ID NO: 3824112 - DNA, 12 bp, Homo sapiens
aaccggatgcca

SEQ ID NO: 3824113 - DNA, 15 bp, Homo sapiens
aacctcactcttgcc

SEQ ID NO: 3824114 - DNA, 17 bp, Homo sapiens
aacctcactcttgccaa

SEQ ID NO: 3824115 - DNA, 16 bp, Homo sapiens
aacctcattgttctgt

SEQ ID NO: 3824116 - DNA, 22 bp, Homo sapiens
aaccttgtaaattccccttccc

SEQ ID NO: 3824117 - DNA, 16 bp, Homo sapiens
aacgcaaacctctcct

SEQ ID NO: 3824118 - DNA, 11 bp, Homo sapiens
aacgcattttg

SEQ ID NO: 3824119 - DNA, 21 bp, Homo sapiens
aacgcattttgggttgtttaa

SEQ ID NO: 3824120 - DNA, 22 bp, Homo sapiens
aactaaagtgtgctttataaaa

SEQ ID NO: 3824121 - DNA, 23 bp, Homo sapiens
aactaaagtgtgctttataaaaa

SEQ ID NO: 3824122 - DNA, 20 bp, Homo sapiens
aactaatatttgtctgtgtg

SEQ ID NO: 3824123 - DNA, 21 bp, Homo sapiens
aactaatatttgtctgtgtgc

SEQ ID NO: 3824124 - DNA, 15 bp, Homo sapiens
aactacatgtaaaat

SEQ ID NO: 3824125 - DNA, 15 bp, Homo sapiens
aactccacatctgcc

SEQ ID NO: 3824126 - DNA, 18 bp, Homo sapiens
aactctgccagccctgca

SEQ ID NO: 3824127 - DNA, 15 bp, Homo sapiens
aactctgtgtgagag

SEQ ID NO: 3824128 - DNA, 17 bp, Homo sapiens
aactgaagcataaacat

SEQ ID NO: 3824129 - DNA, 23 bp, Homo sapiens
aactgacagggcccagttaaata

SEQ ID NO: 3824130 - DNA, 16 bp, Homo sapiens
aactgagggctgatct

SEQ ID NO: 3824131 - DNA, 17 bp, Homo sapiens
aactgagggctgatctt

SEQ ID NO: 3824132 - DNA, 18 bp, Homo sapiens
aactgagggctgatcttt

SEQ ID NO: 3824133 - DNA, 12 bp, Homo sapiens
aactgctgccaa

SEQ ID NO: 3824134 - DNA, 16 bp, Homo sapiens
aactgtgaacctggag

SEQ ID NO: 3824135 - DNA, 17 bp, Homo sapiens
aacttcagttttactgc

SEQ ID NO: 3824136 - DNA, 19 bp, Homo sapiens
aacttcagttttactgcat

SEQ ID NO: 3824137 - DNA, 21 bp, Homo sapiens
aacttgtctctgtagaagctc

SEQ ID NO: 3824138 - DNA, 20 bp, Homo sapiens
aacttgtttacatagcattt

SEQ ID NO: 3824139 - DNA, 23 bp, Homo sapiens
aactttgggaaaaggtgtaaaac

SEQ ID NO: 3824140 - DNA, 13 bp, Homo sapiens
aagaaaactacag

SEQ ID NO: 3824141 - DNA, 15 bp, Homo sapiens
aagaaaactacatgt

SEQ ID NO: 3824142 - DNA, 21 bp, Homo sapiens
aagaaagaacgttccctttgg

SEQ ID NO: 3824143 - DNA, 17 bp, Homo sapiens
aagaaagattgtaaact

SEQ ID NO: 3824144 - DNA, 18 bp, Homo sapiens
aagaaagcacctgttttt

SEQ ID NO: 3824145 - DNA, 13 bp, Homo sapiens
aagaaagtttccc

SEQ ID NO: 3824146 - DNA, 22 bp, Homo sapiens
aagaaattatgtgccagattta

SEQ ID NO: 3824147 - DNA, 12 bp, Homo sapiens
aagaaattttat

SEQ ID NO: 3824148 - DNA, 19 bp, Homo sapiens
aagacaaaatttagattta

SEQ ID NO: 3824149 - DNA, 14 bp, Homo sapiens
aagacagagcaggc

SEQ ID NO: 3824150 - DNA, 15 bp, Homo sapiens
aagacagagcaggct

SEQ ID NO: 3824151 - DNA, 21 bp, Homo sapiens
aagacaggcacaaaatgtgac

SEQ ID NO: 3824152 - DNA, 20 bp, Homo sapiens
aagacataatttaaaataaa

SEQ ID NO: 3824153 - DNA, 22 bp, Homo sapiens
aagaccttgtgtgtatgtgtac

SEQ ID NO: 3824154 - DNA, 21 bp, Homo sapiens
aagagaagttattttctacag

SEQ ID NO: 3824155 - DNA, 17 bp, Homo sapiens
aagagaggagaggagag

SEQ ID NO: 3824156 - DNA, 18 bp, Homo sapiens
aagagaggagaggagaga

SEQ ID NO: 3824157 - DNA, 18 bp, Homo sapiens
aagagatacgaatttcta

SEQ ID NO: 3824158 - DNA, 14 bp, Homo sapiens
aagagcccttgcct

SEQ ID NO: 3824159 - DNA, 20 bp, Homo sapiens
acctctgcggaccccagctg

SEQ ID NO: 3824160 - DNA, 22 bp, Homo sapiens
acctgaagctatcgtaaaatta

SEQ ID NO: 3824161 - DNA, 22 bp, Homo sapiens
acctgagcctggccatgtcctc

SEQ ID NO: 3824162 - DNA, 15 bp, Homo sapiens
acctgatttacagtt

SEQ ID NO: 3824163 - DNA, 21 bp, Homo sapiens
acctgatttacagtttcaaaa

SEQ ID NO: 3824164 - DNA, 15 bp, Homo sapiens
acctgccaggcaggg

SEQ ID NO: 3824165 - DNA, 20 bp, Homo sapiens
acctgcctccggcctgcact

SEQ ID NO: 3824166 - DNA, 22 bp, Homo sapiens
acctgcctccggcctgcactcc

SEQ ID NO: 3824167 - DNA, 13 bp, Homo sapiens
acctggctgaggt

SEQ ID NO: 3824168 - DNA, 22 bp, Homo sapiens
acctgggttccccaccccgggc

SEQ ID NO: 3824169 - DNA, 13 bp, Homo sapiens
acctgtaataaat

SEQ ID NO: 3824170 - DNA, 19 bp, Homo sapiens
accttccttgcgaccacca

SEQ ID NO: 3824171 - DNA, 22 bp, Homo sapiens
accttctctccagagctcctga

SEQ ID NO: 3824172 - DNA, 18 bp, Homo sapiens
accttgtgtgtatgtgta

SEQ ID NO: 3824173 - DNA, 19 bp, Homo sapiens
acctttaactgagggctga

SEQ ID NO: 3824174 - DNA, 16 bp, Homo sapiens
acctttgtctgaagga

SEQ ID NO: 3824175 - DNA, 15 bp, Homo sapiens
acgaaagtaaagtaa

SEQ ID NO: 3824176 - DNA, 18 bp, Homo sapiens
acgaatcttctcaatggg

SEQ ID NO: 3824177 - DNA, 18 bp, Homo sapiens
acgaattatttttttaaa

SEQ ID NO: 3824178 - DNA, 20 bp, Homo sapiens
acgaattatttttttaaact

SEQ ID NO: 3824179 - DNA, 17 bp, Homo sapiens
acgaatttctatagact

SEQ ID NO: 3824180 - DNA, 18 bp, Homo sapiens
acgcaaacctctccttcc

SEQ ID NO: 3824181 - DNA, 14 bp, Homo sapiens
acgcagccacacag

SEQ ID NO: 3824182 - DNA, 19 bp, Homo sapiens
acgcagccacacagtggcc

SEQ ID NO: 3824183 - DNA, 13 bp, Homo sapiens
acgcattttgggt

SEQ ID NO: 3824184 - DNA, 23 bp, Homo sapiens
acgcattttgggttgtttaaaaa

SEQ ID NO: 3824185 - DNA, 19 bp, Homo sapiens
acgccctaggaggagaact

SEQ ID NO: 3824186 - DNA, 15 bp, Homo sapiens
acgccctcccctccc

SEQ ID NO: 3824187 - DNA, 18 bp, Homo sapiens
acgccctcccctcccctg

SEQ ID NO: 3824188 - DNA, 17 bp, Homo sapiens
acgctaaagagcccttg

SEQ ID NO: 3824189 - DNA, 20 bp, Homo sapiens
acgctaaagagcccttgcct

SEQ ID NO: 3824190 - DNA, 19 bp, Homo sapiens
acgctctaggcagaagaag

SEQ ID NO: 3824191 - DNA, 21 bp, Homo sapiens
acgctgattcctaaggcccag

SEQ ID NO: 3824192 - DNA, 12 bp, Homo sapiens
acgctggagctg

SEQ ID NO: 3824193 - DNA, 18 bp, Homo sapiens
acggtattatgcttcttg

SEQ ID NO: 3824194 - DNA, 14 bp, Homo sapiens
acgtgcaatttgtt

SEQ ID NO: 3824195 - DNA, 19 bp, Homo sapiens
acgtgcaatttgtttgtgc

SEQ ID NO: 3824196 - DNA, 11 bp, Homo sapiens
acgttcccttt

SEQ ID NO: 3824197 - DNA, 23 bp, Homo sapiens
acgttttgcctcatgaacactgg

SEQ ID NO: 3824198 - DNA, 16 bp, Homo sapiens
actaaaaatacaaaaa

SEQ ID NO: 3824199 - DNA, 14 bp, Homo sapiens
actaaaacattgtc

SEQ ID NO: 3824200 - DNA, 16 bp, Homo sapiens
actaaaacattgtcta

SEQ ID NO: 3824201 - DNA, 18 bp, Homo sapiens
actaaaacattgtctaca

SEQ ID NO: 3824202 - DNA, 20 bp, Homo sapiens
actaaagtgtgctttataaa

SEQ ID NO: 3824203 - DNA, 14 bp, Homo sapiens
actaacagattata

SEQ ID NO: 3824204 - DNA, 18 bp, Homo sapiens
actaacagattataataa

SEQ ID NO: 3824205 - DNA, 19 bp, Homo sapiens
actaacagattataataaa

SEQ ID NO: 3824206 - DNA, 20 bp, Homo sapiens
actaacagattataataaat

SEQ ID NO: 3824207 - DNA, 20 bp, Homo sapiens
actaagggtggagagttggg

SEQ ID NO: 3824208 - DNA, 23 bp, Homo sapiens
actaatatggttttgttttcaat

SEQ ID NO: 3824209 - DNA, 18 bp, Homo sapiens
actaatatttgtctgtgt

SEQ ID NO: 3824210 - DNA, 21 bp, Homo sapiens
actaatatttgtctgtgtgct

SEQ ID NO: 3824211 - DNA, 23 bp, Homo sapiens
actaatatttgtctgtgtgctac

SEQ ID NO: 3824212 - DNA, 14 bp, Homo sapiens
actacaccacacta

SEQ ID NO: 3824213 - DNA, 14 bp, Homo sapiens
actacatgtaaaat

SEQ ID NO: 3824214 - DNA, 15 bp, Homo sapiens
actagaacacagaaa

SEQ ID NO: 3824215 - DNA, 19 bp, Homo sapiens
actagcctttggctctgga

SEQ ID NO: 3824216 - DNA, 22 bp, Homo sapiens
actagcctttggctctggagac

SEQ ID NO: 3824217 - DNA, 15 bp, Homo sapiens
actagtgctgaagct

SEQ ID NO: 3824218 - DNA, 17 bp, Homo sapiens
actagtgctgaagctta

SEQ ID NO: 3824219 - DNA, 18 bp, Homo sapiens
actagtgctgaagcttat

SEQ ID NO: 3824220 - DNA, 22 bp, Homo sapiens
actatccatagtggacattgtt

SEQ ID NO: 3824221 - DNA, 19 bp, Homo sapiens
actcaagattcccaggagt

SEQ ID NO: 3824222 - DNA, 23 bp, Homo sapiens
actcaagattcccaggagttctg

SEQ ID NO: 3824223 - DNA, 18 bp, Homo sapiens
actcaggctgctccttct

SEQ ID NO: 3824224 - DNA, 11 bp, Homo sapiens
actccacacca

SEQ ID NO: 3824225 - DNA, 15 bp, Homo sapiens
actccacatctgcct

SEQ ID NO: 3824226 - DNA, 19 bp, Homo sapiens
actccagcagataaggccg

SEQ ID NO: 3824227 - DNA, 18 bp, Homo sapiens
actccagctgagtcctgg

SEQ ID NO: 3824228 - DNA, 21 bp, Homo sapiens
actccagctgagtcctggggt

SEQ ID NO: 3824229 - DNA, 14 bp, Homo sapiens
actccaggcccccg

SEQ ID NO: 3824230 - DNA, 23 bp, Homo sapiens
actccaggcccccgttgaagccg

SEQ ID NO: 3824231 - DNA, 15 bp, Homo sapiens
actccataaaaagaa

SEQ ID NO: 3824232 - DNA, 23 bp, Homo sapiens
actccctccccagatctgtcctg

SEQ ID NO: 3824233 - DNA, 17 bp, Homo sapiens
actcctcggcctggctc

SEQ ID NO: 3824234 - DNA, 21 bp, Homo sapiens
actcctgcctgcccccacacc

SEQ ID NO: 3824235 - DNA, 22 bp, Homo sapiens
actcctgcctgcccccacaccc

SEQ ID NO: 3824236 - DNA, 13 bp, Homo sapiens
actctatatactt

SEQ ID NO: 3824237 - DNA, 16 bp, Homo sapiens
actctgccagccctgc

SEQ ID NO: 3824238 - DNA, 14 bp, Homo sapiens
actctgtgtgagag

SEQ ID NO: 3824239 - DNA, 15 bp, Homo sapiens
actgaaagtctgtgg

SEQ ID NO: 3824240 - DNA, 20 bp, Homo sapiens
actgaaggaaaaacacaagc

SEQ ID NO: 3824241 - DNA, 22 bp, Homo sapiens
actgacagggcccagttaaata

SEQ ID NO: 3824242 - DNA, 16 bp, Homo sapiens
actgagaccttcaggc

SEQ ID NO: 3824243 - DNA, 20 bp, Homo sapiens
actgagccccgcagacctcc

SEQ ID NO: 3824244 - DNA, 17 bp, Homo sapiens
actgagggctgatcttt

SEQ ID NO: 3824245 - DNA, 12 bp, Homo sapiens
actgatgctttt

SEQ ID NO: 3824246 - DNA, 14 bp, Homo sapiens
actgatttagccat

SEQ ID NO: 3824247 - DNA, 16 bp, Homo sapiens
actgcagggccaggac

SEQ ID NO: 3824248 - DNA, 16 bp, Homo sapiens
actgccaggccagcct

SEQ ID NO: 3824249 - DNA, 23 bp, Homo sapiens
actgccaggccagcctccgagag

SEQ ID NO: 3824250 - DNA, 14 bp, Homo sapiens
actgcccctgccct

SEQ ID NO: 3824251 - DNA, 15 bp, Homo sapiens
actgcccctgccctg

SEQ ID NO: 3824252 - DNA, 19 bp, Homo sapiens
actgcccctgccctgagga

SEQ ID NO: 3824253 - DNA, 20 bp, Homo sapiens
actgctccctgaagccagcc

SEQ ID NO: 3824254 - DNA, 16 bp, Homo sapiens
actgctggtgtttatg

SEQ ID NO: 3824255 - DNA, 15 bp, Homo sapiens
actggaaaggggaga

SEQ ID NO: 3824256 - DNA, 17 bp, Homo sapiens
actggaaaggggagagc

SEQ ID NO: 3824257 - DNA, 22 bp, Homo sapiens
actggaaaggggagagcctgct

SEQ ID NO: 3824258 - DNA, 19 bp, Homo sapiens
actggaggttgaagccaag

SEQ ID NO: 3824259 - DNA, 21 bp, Homo sapiens
actggctgcaagtggttaaga

SEQ ID NO: 3824260 - DNA, 20 bp, Homo sapiens
actggctgccagctattttt

SEQ ID NO: 3824261 - DNA, 23 bp, Homo sapiens
actgggagagtccttagcctggg

SEQ ID NO: 3824262 - DNA, 13 bp, Homo sapiens
actggggggcttg

SEQ ID NO: 3824263 - DNA, 19 bp, Homo sapiens
actggtaggaaaaagcttt

SEQ ID NO: 3824264 - DNA, 20 bp, Homo sapiens
actggtgagggcaagaggtg

SEQ ID NO: 3824265 - DNA, 16 bp, Homo sapiens
actggttctacaaatt

SEQ ID NO: 3824266 - DNA, 15 bp, Homo sapiens
actgtaaatcataat

SEQ ID NO: 3824267 - DNA, 16 bp, Homo sapiens
actgtaaatcataatg

SEQ ID NO: 3824268 - DNA, 14 bp, Homo sapiens
actgtaacatttac

SEQ ID NO: 3824269 - DNA, 13 bp, Homo sapiens
actgtagatttca

SEQ ID NO: 3824270 - DNA, 19 bp, Homo sapiens
actgtatcatttcatgctt

SEQ ID NO: 3824271 - DNA, 12 bp, Homo sapiens
actgtattgatg

SEQ ID NO: 3824272 - DNA, 19 bp, Homo sapiens
actgtctcaaaaaaacaaa

SEQ ID NO: 3824273 - DNA, 14 bp, Homo sapiens
actgtctctgcctc

SEQ ID NO: 3824274 - DNA, 16 bp, Homo sapiens
actgtctctgcctctt

SEQ ID NO: 3824275 - DNA, 16 bp, Homo sapiens
actgtctgtgtccttg

SEQ ID NO: 3824276 - DNA, 21 bp, Homo sapiens
actgtgctttctattgtacag

SEQ ID NO: 3824277 - DNA, 18 bp, Homo sapiens
actgtggaggggagctgc

SEQ ID NO: 3824278 - DNA, 21 bp, Homo sapiens
actgtggaggggagctgctgg

SEQ ID NO: 3824279 - DNA, 22 bp, Homo sapiens
actgtgtttccatcctttgcat

SEQ ID NO: 3824280 - DNA, 14 bp, Homo sapiens
actgtgtttttgcc

SEQ ID NO: 3824281 - DNA, 19 bp, Homo sapiens
acttaaggagaaatagctg

SEQ ID NO: 3824282 - DNA, 15 bp, Homo sapiens
acttaagttaaacat

SEQ ID NO: 3824283 - DNA, 14 bp, Homo sapiens
acttaattgctttc

SEQ ID NO: 3824284 - DNA, 14 bp, Homo sapiens
acttcagttttact

SEQ ID NO: 3824285 - DNA, 20 bp, Homo sapiens
acttcagttttactgcattt

SEQ ID NO: 3824286 - DNA, 21 bp, Homo sapiens
acttcagttttactgcatttt

SEQ ID NO: 3824287 - DNA, 22 bp, Homo sapiens
acttctgtgtagacatggttct

SEQ ID NO: 3824288 - DNA, 12 bp, Homo sapiens
acttgaaaatta

SEQ ID NO: 3824289 - DNA, 14 bp, Homo sapiens
acttgaaaattaac

SEQ ID NO: 3824290 - DNA, 16 bp, Homo sapiens
acttgaaaattaacat

SEQ ID NO: 3824291 - DNA, 17 bp, Homo sapiens
aggagggctttgtgtct

SEQ ID NO: 3824292 - DNA, 18 bp, Homo sapiens
aggaggttgtgtcactga

SEQ ID NO: 3824293 - DNA, 24 bp, Homo sapiens
aggaggttgtgtcactgactcagg

SEQ ID NO: 3824294 - DNA, 19 bp, Homo sapiens
aggatcctggtattgtaat

SEQ ID NO: 3824295 - DNA, 16 bp, Homo sapiens
aggatcggcttcctca

SEQ ID NO: 3824296 - DNA, 15 bp, Homo sapiens
aggatgcctgagccc

SEQ ID NO: 3824297 - DNA, 15 bp, Homo sapiens
aggatggtggggccc

SEQ ID NO: 3824298 - DNA, 17 bp, Homo sapiens
aggatggtggggccccc

SEQ ID NO: 3824299 - DNA, 22 bp, Homo sapiens
aggatgtcgggagcatcctgct

SEQ ID NO: 3824300 - DNA, 23 bp, Homo sapiens
aggatgtcgggagcatcctgctg

SEQ ID NO: 3824301 - DNA, 14 bp, Homo sapiens
aggattagacagta

SEQ ID NO: 3824302 - DNA, 16 bp, Homo sapiens
aggattttaaatgctg

SEQ ID NO: 3824303 - DNA, 18 bp, Homo sapiens
aggattttaaatgctgta

SEQ ID NO: 3824304 - DNA, 17 bp, Homo sapiens
aggattttgtgtttttt

SEQ ID NO: 3824305 - DNA, 17 bp, Homo sapiens
aggcaagagggggtgga

SEQ ID NO: 3824306 - DNA, 21 bp, Homo sapiens
aggcaagagggggtggagggg

SEQ ID NO: 3824307 - DNA, 17 bp, Homo sapiens
aggcaataaataaatgt

SEQ ID NO: 3824308 - DNA, 15 bp, Homo sapiens
aggcacaaaatgtga

SEQ ID NO: 3824309 - DNA, 14 bp, Homo sapiens
aggcacacactgtg

SEQ ID NO: 3824310 - DNA, 16 bp, Homo sapiens
aggcacacactgtgct

SEQ ID NO: 3824311 - DNA, 20 bp, Homo sapiens
aggcacacactgtgctttct

SEQ ID NO: 3824312 - DNA, 23 bp, Homo sapiens
aggcacacactgtgctttctatt

SEQ ID NO: 3824313 - DNA, 19 bp, Homo sapiens
aggcagaagaagctgggag

SEQ ID NO: 3824314 - DNA, 20 bp, Homo sapiens
aggcagaagaagctgggagg

SEQ ID NO: 3824315 - DNA, 13 bp, Homo sapiens
aggcagagagcgg

SEQ ID NO: 3824316 - DNA, 20 bp, Homo sapiens
aggcagagagcggtctcagg

SEQ ID NO: 3824317 - DNA, 13 bp, Homo sapiens
aggcagccagatc

SEQ ID NO: 3824318 - DNA, 22 bp, Homo sapiens
aggcagccagatccccagggca

SEQ ID NO: 3824319 - DNA, 13 bp, Homo sapiens
aggcagctcctgt

SEQ ID NO: 3824320 - DNA, 14 bp, Homo sapiens
aggcagctcctgtt

SEQ ID NO: 3824321 - DNA, 17 bp, Homo sapiens
aggcaggagaatggcat

SEQ ID NO: 3824322 - DNA, 14 bp, Homo sapiens
aggcaggtagccag

SEQ ID NO: 3824323 - DNA, 24 bp, Homo sapiens
aggcattccagctcctccgtgctt

SEQ ID NO: 3824324 - DNA, 11 bp, Homo sapiens
aggccagcctc

SEQ ID NO: 3824325 - DNA, 13 bp, Homo sapiens
aggccagcctccg

SEQ ID NO: 3824326 - DNA, 14 bp, Homo sapiens
aggccaggatgcct

SEQ ID NO: 3824327 - DNA, 20 bp, Homo sapiens
aggccaggatgcctgagccc

SEQ ID NO: 3824328 - DNA, 21 bp, Homo sapiens
aggccatggggcagcctccag

SEQ ID NO: 3824329 - DNA, 20 bp, Homo sapiens
aggccatgttccaataaaca

SEQ ID NO: 3824330 - DNA, 21 bp, Homo sapiens
aggccatgttccaataaacag

SEQ ID NO: 3824331 - DNA, 15 bp, Homo sapiens
aggcccagctgccag

SEQ ID NO: 3824332 - DNA, 16 bp, Homo sapiens
aggcccagctgccagg

SEQ ID NO: 3824333 - DNA, 17 bp, Homo sapiens
aggcccagctgccaggg

SEQ ID NO: 3824334 - DNA, 17 bp, Homo sapiens
aggcccccgttgaagcc

SEQ ID NO: 3824335 - DNA, 18 bp, Homo sapiens
aggccctagctaataaac

SEQ ID NO: 3824336 - DNA, 15 bp, Homo sapiens
aggccgagcccacac

SEQ ID NO: 3824337 - DNA, 17 bp, Homo sapiens
aggccgagcccacacca

SEQ ID NO: 3824338 - DNA, 15 bp, Homo sapiens
aggccgtttgctttt

SEQ ID NO: 3824339 - DNA, 14 bp, Homo sapiens
aggcgaggctgccc

SEQ ID NO: 3824340 - DNA, 21 bp, Homo sapiens
aggcgggaaaagcagcccttg

SEQ ID NO: 3824341 - DNA, 18 bp, Homo sapiens
aggctagcttctgctttt

SEQ ID NO: 3824342 - DNA, 15 bp, Homo sapiens
aggctatggttgcca

SEQ ID NO: 3824343 - DNA, 24 bp, Homo sapiens
aggctcactgccaggccagcctcc

SEQ ID NO: 3824344 - DNA, 18 bp, Homo sapiens
aggctcagccctgagctg

SEQ ID NO: 3824345 - DNA, 18 bp, Homo sapiens
aggctcctgacctacctg

SEQ ID NO: 3824346 - DNA, 18 bp, Homo sapiens
aggctcctggtggggcag

SEQ ID NO: 3824347 - DNA, 18 bp, Homo sapiens
aggctcggggctccccac

SEQ ID NO: 3824348 - DNA, 22 bp, Homo sapiens
aggctcggggctccccacgccc

SEQ ID NO: 3824349 - DNA, 19 bp, Homo sapiens
aggctgagcacctttggaa

SEQ ID NO: 3824350 - DNA, 23 bp, Homo sapiens
aggctgaggcaggagaatggcat

SEQ ID NO: 3824351 - DNA, 14 bp, Homo sapiens
aggctgcaacgctg

SEQ ID NO: 3824352 - DNA, 19 bp, Homo sapiens
aggctgcaacgctgattcc

SEQ ID NO: 3824353 - DNA, 16 bp, Homo sapiens
aggctggcccccaccc

SEQ ID NO: 3824354 - DNA, 21 bp, Homo sapiens
aggctggcccccacccacctt

SEQ ID NO: 3824355 - DNA, 22 bp, Homo sapiens
aggctggcccccacccaccttc

SEQ ID NO: 3824356 - DNA, 23 bp, Homo sapiens
aggctggctcctggggatggcca

SEQ ID NO: 3824357 - DNA, 12 bp, Homo sapiens
aggctggtggga

SEQ ID NO: 3824358 - DNA, 17 bp, Homo sapiens
aggctggtgggaggggc

SEQ ID NO: 3824359 - DNA, 12 bp, Homo sapiens
aggctgtgccag

SEQ ID NO: 3824360 - DNA, 15 bp, Homo sapiens
aggctgtgccaggct

SEQ ID NO: 3824361 - DNA, 17 bp, Homo sapiens
aggctgtgccaggctgg

SEQ ID NO: 3824362 - DNA, 18 bp, Homo sapiens
aggctgtgccaggctggg

SEQ ID NO: 3824363 - DNA, 22 bp, Homo sapiens
aggctgtgccaggctgggaggc

SEQ ID NO: 3824364 - DNA, 22 bp, Homo sapiens
aggcttcctgcgtcctcctcac

SEQ ID NO: 3824365 - DNA, 14 bp, Homo sapiens
aggcttctccgcca

SEQ ID NO: 3824366 - DNA, 17 bp, Homo sapiens
aggcttctccgccagcc

SEQ ID NO: 3824367 - DNA, 14 bp, Homo sapiens
agggaagacagagc

SEQ ID NO: 3824368 - DNA, 23 bp, Homo sapiens
agggaagtcgcttttggtgcctg

SEQ ID NO: 3824369 - DNA, 23 bp, Homo sapiens
agggaatccccgaaggtgctgga

SEQ ID NO: 3824370 - DNA, 14 bp, Homo sapiens
agggacacaggaga

SEQ ID NO: 3824371 - DNA, 18 bp, Homo sapiens
agggacacaggagaccac

SEQ ID NO: 3824372 - DNA, 14 bp, Homo sapiens
agggacagggccat

SEQ ID NO: 3824373 - DNA, 15 bp, Homo sapiens
agggacatctgttct

SEQ ID NO: 3824374 - DNA, 17 bp, Homo sapiens
agggactgagaaattta

SEQ ID NO: 3824375 - DNA, 23 bp, Homo sapiens
agggagagcacctgttgtgtgcc

SEQ ID NO: 3824376 - DNA, 24 bp, Homo sapiens
agggagagcacctgttgtgtgcct

SEQ ID NO: 3824377 - DNA, 21 bp, Homo sapiens
agggagcatagaaggcaggtg

SEQ ID NO: 3824378 - DNA, 15 bp, Homo sapiens
agggaggaagaagct

SEQ ID NO: 3824379 - DNA, 21 bp, Homo sapiens
agggaggaagaagcttaggca

SEQ ID NO: 3824380 - DNA, 11 bp, Homo sapiens
agggagggtgg

SEQ ID NO: 3824381 - DNA, 14 bp, Homo sapiens
agggagggtggcag

SEQ ID NO: 3824382 - DNA, 16 bp, Homo sapiens
agggagggtggcagag

SEQ ID NO: 3824383 - DNA, 17 bp, Homo sapiens
agggagggtggcagaga

SEQ ID NO: 3824384 - DNA, 21 bp, Homo sapiens
agggatcctaatcccttcctc

SEQ ID NO: 3824385 - DNA, 14 bp, Homo sapiens
agggcaagaggtgc

SEQ ID NO: 3824386 - DNA, 23 bp, Homo sapiens
agggcagaggcaaggatggtggg

SEQ ID NO: 3824387 - DNA, 21 bp, Homo sapiens
agggcatgccccggccacctc

SEQ ID NO: 3824388 - DNA, 23 bp, Homo sapiens
agggcatgccccggccacctctg

SEQ ID NO: 3824389 - DNA, 19 bp, Homo sapiens
agggccaagccggcccaac

SEQ ID NO: 3824390 - DNA, 23 bp, Homo sapiens
agggccaagccggcccaacccaa

SEQ ID NO: 3824391 - DNA, 12 bp, Homo sapiens
agggccaggact

SEQ ID NO: 3824392 - DNA, 18 bp, Homo sapiens
agggcccagttaaatatg

SEQ ID NO: 3824393 - DNA, 20 bp, Homo sapiens
agggccctctggggctcagc

SEQ ID NO: 3824394 - DNA, 22 bp, Homo sapiens
agggccctctggggctcagccc

SEQ ID NO: 3824395 - DNA, 13 bp, Homo sapiens
agggccctgagga

SEQ ID NO: 3824396 - DNA, 17 bp, Homo sapiens
agggccctgaggaataa

SEQ ID NO: 3824397 - DNA, 18 bp, Homo sapiens
agggccctgaggaataaa

SEQ ID NO: 3824398 - DNA, 22 bp, Homo sapiens
agggcctgaggtctggctgctt

SEQ ID NO: 3824399 - DNA, 15 bp, Homo sapiens
agggcgcccagccca

SEQ ID NO: 3824400 - DNA, 20 bp, Homo sapiens
agggcgcccagcccaggcct

SEQ ID NO: 3824401 - DNA, 12 bp, Homo sapiens
agggctccagcc

SEQ ID NO: 3824402 - DNA, 19 bp, Homo sapiens
agggctctctttccttctt

SEQ ID NO: 3824403 - DNA, 12 bp, Homo sapiens
agggcttcctct

SEQ ID NO: 3824404 - DNA, 20 bp, Homo sapiens
agggcttcctctagaagcca

SEQ ID NO: 3824405 - DNA, 21 bp, Homo sapiens
agggcttcctctagaagccaa

SEQ ID NO: 3824406 - DNA, 15 bp, Homo sapiens
agggcttctgtggtt

SEQ ID NO: 3824407 - DNA, 15 bp, Homo sapiens
aggggagaagccaag

SEQ ID NO: 3824408 - DNA, 17 bp, Homo sapiens
aggggagaagccaaggg

SEQ ID NO: 3824409 - DNA, 15 bp, Homo sapiens
aggggagagcctgct

SEQ ID NO: 3824410 - DNA, 16 bp, Homo sapiens
aggggagagcctgctg

SEQ ID NO: 3824411 - DNA, 22 bp, Homo sapiens
aggggagagcctgctggcaccc

SEQ ID NO: 3824412 - DNA, 15 bp, Homo sapiens
aggggaggggggagc

SEQ ID NO: 3824413 - DNA, 16 bp, Homo sapiens
aggggctccccagagg

SEQ ID NO: 3824414 - DNA, 19 bp, Homo sapiens
aggggctggcttcaggagg

SEQ ID NO: 3824415 - DNA, 18 bp, Homo sapiens
agggggaggggagaagcc

SEQ ID NO: 3824416 - DNA, 20 bp, Homo sapiens
agggggaggtgaaaagggca

SEQ ID NO: 3824417 - DNA, 19 bp, Homo sapiens
agggggcttgaagccaaag

SEQ ID NO: 3824418 - DNA, 12 bp, Homo sapiens
aggggtatttaa

SEQ ID NO: 3824419 - DNA, 16 bp, Homo sapiens
aggggtgtggcagtgg

SEQ ID NO: 3824420 - DNA, 16 bp, Homo sapiens
agggtggacttagaaa

SEQ ID NO: 3824421 - DNA, 20 bp, Homo sapiens
agggtggacttagaaagcag

SEQ ID NO: 3824422 - DNA, 17 bp, Homo sapiens
agggtggcctcaagaaa

SEQ ID NO: 3824423 - DNA, 22 bp, Homo sapiens
atggggtagggtgagaagggca

SEQ ID NO: 3824424 - DNA, 15 bp, Homo sapiens
atggggtcagcaggc

SEQ ID NO: 3824425 - DNA, 16 bp, Homo sapiens
atggggtcagcaggcc

SEQ ID NO: 3824426 - DNA, 18 bp, Homo sapiens
atggggtcagcaggccca

SEQ ID NO: 3824427 - DNA, 23 bp, Homo sapiens
atggggtcagcaggcccaggaga

SEQ ID NO: 3824428 - DNA, 18 bp, Homo sapiens
atggtgaaatctgctctg

SEQ ID NO: 3824429 - DNA, 14 bp, Homo sapiens
atggtgcctgagag

SEQ ID NO: 3824430 - DNA, 17 bp, Homo sapiens
atggtgcctgagaggca

SEQ ID NO: 3824431 - DNA, 20 bp, Homo sapiens
atggtgcctgagaggcaggc

SEQ ID NO: 3824432 - DNA, 21 bp, Homo sapiens
atggtgcctgagaggcaggca

SEQ ID NO: 3824433 - DNA, 16 bp, Homo sapiens
atggtggggcccccag

SEQ ID NO: 3824434 - DNA, 13 bp, Homo sapiens
atggtgttggctt

SEQ ID NO: 3824435 - DNA, 18 bp, Homo sapiens
atggttaagtaattgcat

SEQ ID NO: 3824436 - DNA, 14 bp, Homo sapiens
atggttgccacccc

SEQ ID NO: 3824437 - DNA, 17 bp, Homo sapiens
atggttgccaccccaac

SEQ ID NO: 3824438 - DNA, 13 bp, Homo sapiens
atggttgtacata

SEQ ID NO: 3824439 - DNA, 18 bp, Homo sapiens
atggttttgttttcaatg

SEQ ID NO: 3824440 - DNA, 14 bp, Homo sapiens
atggtttttataat

SEQ ID NO: 3824441 - DNA, 15 bp, Homo sapiens
atgtaaaatcttgat

SEQ ID NO: 3824442 - DNA, 18 bp, Homo sapiens
atgtaaagtctagaaaat

SEQ ID NO: 3824443 - DNA, 19 bp, Homo sapiens
atgtaaagtctagaaaata

SEQ ID NO: 3824444 - DNA, 18 bp, Homo sapiens
atgtaactgaagcataaa

SEQ ID NO: 3824445 - DNA, 14 bp, Homo sapiens
atgtacaggttgga

SEQ ID NO: 3824446 - DNA, 11 bp, Homo sapiens
atgtacatgtg

SEQ ID NO: 3824447 - DNA, 14 bp, Homo sapiens
atgtacatgtgttg

SEQ ID NO: 3824448 - DNA, 21 bp, Homo sapiens
atgtagaacttgaactaacat

SEQ ID NO: 3824449 - DNA, 15 bp, Homo sapiens
atgtatatcagggtt

SEQ ID NO: 3824450 - DNA, 13 bp, Homo sapiens
atgtatgtgtgac

SEQ ID NO: 3824451 - DNA, 14 bp, Homo sapiens
atgtattaactgaa

SEQ ID NO: 3824452 - DNA, 19 bp, Homo sapiens
atgtcattgcccacttctg

SEQ ID NO: 3824453 - DNA, 21 bp, Homo sapiens
atgtctataagtatataaata

SEQ ID NO: 3824454 - DNA, 12 bp, Homo sapiens
atgtgaacattc

SEQ ID NO: 3824455 - DNA, 18 bp, Homo sapiens
atgtgaatgaatacacag

SEQ ID NO: 3824456 - DNA, 18 bp, Homo sapiens
atgtgaggggaatctgga

SEQ ID NO: 3824457 - DNA, 14 bp, Homo sapiens
atgtgcatatatct

SEQ ID NO: 3824458 - DNA, 23 bp, Homo sapiens
atgtgccttctagaatacatatt

SEQ ID NO: 3824459 - DNA, 13 bp, Homo sapiens
atgtgcttgaaga

SEQ ID NO: 3824460 - DNA, 14 bp, Homo sapiens
atgtgcttgaagat

SEQ ID NO: 3824461 - DNA, 22 bp, Homo sapiens
atgtgcttgaagattcaggctt

SEQ ID NO: 3824462 - DNA, 19 bp, Homo sapiens
atgttaggggtatttaatg

SEQ ID NO: 3824463 - DNA, 15 bp, Homo sapiens
atgttcaaaagaagt

SEQ ID NO: 3824464 - DNA, 18 bp, Homo sapiens
atgttccaataaacagga

SEQ ID NO: 3824465 - DNA, 15 bp, Homo sapiens
atgttgcatagaata

SEQ ID NO: 3824466 - DNA, 14 bp, Homo sapiens
atgttgctgacttt

SEQ ID NO: 3824467 - DNA, 17 bp, Homo sapiens
atgtttctcattttaaa

SEQ ID NO: 3824468 - DNA, 19 bp, Homo sapiens
atgtttctcattttaaaca

SEQ ID NO: 3824469 - DNA, 17 bp, Homo sapiens
atgttttcgcaaatgtt

SEQ ID NO: 3824470 - DNA, 13 bp, Homo sapiens
atgttttgtcatt

SEQ ID NO: 3824471 - DNA, 17 bp, Homo sapiens
atgtttttgaaacagaa

SEQ ID NO: 3824472 - DNA, 16 bp, Homo sapiens
attaaactgtaaatca

SEQ ID NO: 3824473 - DNA, 18 bp, Homo sapiens
attaaactgtaaatcata

SEQ ID NO: 3824474 - DNA, 18 bp, Homo sapiens
attaaagtgcactgtgtc

SEQ ID NO: 3824475 - DNA, 14 bp, Homo sapiens
attaaatatatctt

SEQ ID NO: 3824476 - DNA, 20 bp, Homo sapiens
attaaatatatctttgtaaa

SEQ ID NO: 3824477 - DNA, 21 bp, Homo sapiens
attaaatatatctttgtaaat

SEQ ID NO: 3824478 - DNA, 12 bp, Homo sapiens
attaacatcaaa

SEQ ID NO: 3824479 - DNA, 14 bp, Homo sapiens
attaacatcaaaca

SEQ ID NO: 3824480 - DNA, 22 bp, Homo sapiens
attaacggtgctaaccccgtct

SEQ ID NO: 3824481 - DNA, 14 bp, Homo sapiens
attaagtatatttg

SEQ ID NO: 3824482 - DNA, 20 bp, Homo sapiens
attaagtatatttgtaaaag

SEQ ID NO: 3824483 - DNA, 15 bp, Homo sapiens
attaagtgaaatttt

SEQ ID NO: 3824484 - DNA, 14 bp, Homo sapiens
attacattaacatt

SEQ ID NO: 3824485 - DNA, 21 bp, Homo sapiens
attacatttgaactatatcct

SEQ ID NO: 3824486 - DNA, 23 bp, Homo sapiens
attagacagtaagagtttacaag

SEQ ID NO: 3824487 - DNA, 15 bp, Homo sapiens
attatactgtagatt

SEQ ID NO: 3824488 - DNA, 16 bp, Homo sapiens
attatgcagaatactt

SEQ ID NO: 3824489 - DNA, 15 bp, Homo sapiens
attatgcttcttgga

SEQ ID NO: 3824490 - DNA, 21 bp, Homo sapiens
attatgtgccagatttatgca

SEQ ID NO: 3824491 - DNA, 20 bp, Homo sapiens
attatgtgtgttttaaaatg

SEQ ID NO: 3824492 - DNA, 12 bp, Homo sapiens
attatttcgtgt

SEQ ID NO: 3824493 - DNA, 14 bp, Homo sapiens
attatttggaaatt

SEQ ID NO: 3824494 - DNA, 16 bp, Homo sapiens
attattttatgttgca

SEQ ID NO: 3824495 - DNA, 18 bp, Homo sapiens
attatttttttaaacttc

SEQ ID NO: 3824496 - DNA, 22 bp, Homo sapiens
attatttttttaaacttcagtt

SEQ ID NO: 3824497 - DNA, 15 bp, Homo sapiens
attcaaatgttacaa

SEQ ID NO: 3824498 - DNA, 13 bp, Homo sapiens
attcacaaagaaa

SEQ ID NO: 3824499 - DNA, 13 bp, Homo sapiens
attcacattgtat

SEQ ID NO: 3824500 - DNA, 20 bp, Homo sapiens
attcacattgtattcagagt

SEQ ID NO: 3824501 - DNA, 19 bp, Homo sapiens
attcagtaacttgtttaca

SEQ ID NO: 3824502 - DNA, 13 bp, Homo sapiens
attcatacaacaa

SEQ ID NO: 3824503 - DNA, 17 bp, Homo sapiens
attcatacaacaaagag

SEQ ID NO: 3824504 - DNA, 19 bp, Homo sapiens
attcatggttttaaagcta

SEQ ID NO: 3824505 - DNA, 20 bp, Homo sapiens
attcatggttttaaagctaa

SEQ ID NO: 3824506 - DNA, 16 bp, Homo sapiens
attcatttattaagta

SEQ ID NO: 3824507 - DNA, 16 bp, Homo sapiens
attccactacacctgg

SEQ ID NO: 3824508 - DNA, 18 bp, Homo sapiens
attccactacacctggct

SEQ ID NO: 3824509 - DNA, 18 bp, Homo sapiens
attcccaggagttctgct

SEQ ID NO: 3824510 - DNA, 19 bp, Homo sapiens
attcctaaggcccagctgc

SEQ ID NO: 3824511 - DNA, 16 bp, Homo sapiens
attcctctaatgttgt

SEQ ID NO: 3824512 - DNA, 21 bp, Homo sapiens
attctaatgatggcccattct

SEQ ID NO: 3824513 - DNA, 15 bp, Homo sapiens
attctacttgctctg

SEQ ID NO: 3824514 - DNA, 17 bp, Homo sapiens
attctacttgctctgga

SEQ ID NO: 3824515 - DNA, 20 bp, Homo sapiens
attctacttgctctggacct

SEQ ID NO: 3824516 - DNA, 21 bp, Homo sapiens
attctacttgctctggacctg

SEQ ID NO: 3824517 - DNA, 20 bp, Homo sapiens
attctcccaggtaccagctg

SEQ ID NO: 3824518 - DNA, 21 bp, Homo sapiens
attctcccaggtaccagctgc

SEQ ID NO: 3824519 - DNA, 22 bp, Homo sapiens
attctcccaggtaccagctgcg

SEQ ID NO: 3824520 - DNA, 14 bp, Homo sapiens
attctcctgcctca

SEQ ID NO: 3824521 - DNA, 21 bp, Homo sapiens
attctcttactttttgtaaat

SEQ ID NO: 3824522 - DNA, 17 bp, Homo sapiens
attctgaccttgtgaac

SEQ ID NO: 3824523 - DNA, 16 bp, Homo sapiens
attctgtgaaactaat

SEQ ID NO: 3824524 - DNA, 18 bp, Homo sapiens
attctgtgaaactaatca

SEQ ID NO: 3824525 - DNA, 14 bp, Homo sapiens
attcttgaaagtat

SEQ ID NO: 3824526 - DNA, 17 bp, Homo sapiens
attgacaagtgtctttt

SEQ ID NO: 3824527 - DNA, 17 bp, Homo sapiens
attgagaaggagagaaa

SEQ ID NO: 3824528 - DNA, 22 bp, Homo sapiens
attgagattcacatgctggctc

SEQ ID NO: 3824529 - DNA, 17 bp, Homo sapiens
attgatccagaaagaaa

SEQ ID NO: 3824530 - DNA, 19 bp, Homo sapiens
attgatccagaaagaaaac

SEQ ID NO: 3824531 - DNA, 18 bp, Homo sapiens
attgcattttttaaaaca

SEQ ID NO: 3824532 - DNA, 16 bp, Homo sapiens
attgccagcttttata

SEQ ID NO: 3824533 - DNA, 13 bp, Homo sapiens
attgctgcatttt

SEQ ID NO: 3824534 - DNA, 13 bp, Homo sapiens
attgctttataaa

SEQ ID NO: 3824535 - DNA, 12 bp, Homo sapiens
attgctttcctg

SEQ ID NO: 3824536 - DNA, 23 bp, Homo sapiens
attgctttcctgcctccttgaaa

SEQ ID NO: 3824537 - DNA, 12 bp, Homo sapiens
attgggagaaag

SEQ ID NO: 3824538 - DNA, 23 bp, Homo sapiens
attgtaaactaaagtgtgcttta

SEQ ID NO: 3824539 - DNA, 14 bp, Homo sapiens
attgtacaaaaaag

SEQ ID NO: 3824540 - DNA, 17 bp, Homo sapiens
attgtacagtttgttta

SEQ ID NO: 3824541 - DNA, 19 bp, Homo sapiens
attgtacagtttgtttaca

SEQ ID NO: 3824542 - DNA, 14 bp, Homo sapiens
attgtgctttgtat

SEQ ID NO: 3824543 - DNA, 14 bp, Homo sapiens
attgtgtctgcagg

SEQ ID NO: 3824544 - DNA, 19 bp, Homo sapiens
attgtgttttaacaccaac

SEQ ID NO: 3824545 - DNA, 14 bp, Homo sapiens
attgtttcagtgtt

SEQ ID NO: 3824546 - DNA, 12 bp, Homo sapiens
attgttttgcat

SEQ ID NO: 3824547 - DNA, 18 bp, Homo sapiens
atttaaaataaataaact

SEQ ID NO: 3824548 - DNA, 20 bp, Homo sapiens
atttaatgatgcttcagtgg

SEQ ID NO: 3824549 - DNA, 22 bp, Homo sapiens
atttaatttacgtcttgagaaa

SEQ ID NO: 3824550 - DNA, 21 bp, Homo sapiens
atttacactcgaactcgggag

SEQ ID NO: 3824551 - DNA, 15 bp, Homo sapiens
atttacagtttcaaa

SEQ ID NO: 3824552 - DNA, 14 bp, Homo sapiens
atttagacaagaga

SEQ ID NO: 3824553 - DNA, 9 bp, Homo sapiens
atttataac

SEQ ID NO: 3824554 - DNA, 16 bp, Homo sapiens
atttataacagttata

SEQ ID NO: 3824555 - DNA, 18 bp, Homo sapiens
atttataactaatatggt

SEQ ID NO: 3824556 - DNA, 16 bp, Homo sapiens
caggacctgagcctgg

SEQ ID NO: 3824557 - DNA, 17 bp, Homo sapiens
caggacctgagcctggc

SEQ ID NO: 3824558 - DNA, 20 bp, Homo sapiens
caggactgagccccgcagac

SEQ ID NO: 3824559 - DNA, 19 bp, Homo sapiens
caggagaagggacaaaagg

SEQ ID NO: 3824560 - DNA, 16 bp, Homo sapiens
caggagaccacccccg

SEQ ID NO: 3824561 - DNA, 23 bp, Homo sapiens
caggagaccacccccgagcttgc

SEQ ID NO: 3824562 - DNA, 12 bp, Homo sapiens
caggagagagaa

SEQ ID NO: 3824563 - DNA, 20 bp, Homo sapiens
caggagagagaaagccaggc

SEQ ID NO: 3824564 - DNA, 21 bp, Homo sapiens
caggaggagttagccaaacaa

SEQ ID NO: 3824565 - DNA, 17 bp, Homo sapiens
caggaggccgttgcaga

SEQ ID NO: 3824566 - DNA, 22 bp, Homo sapiens
caggagggagcatagaaggcag

SEQ ID NO: 3824567 - DNA, 20 bp, Homo sapiens
caggagttctgctcattcta

SEQ ID NO: 3824568 - DNA, 19 bp, Homo sapiens
caggagtttcgttttcaaa

SEQ ID NO: 3824569 - DNA, 18 bp, Homo sapiens
caggatgatgactatgga

SEQ ID NO: 3824570 - DNA, 18 bp, Homo sapiens
caggatgcctgagccccc

SEQ ID NO: 3824571 - DNA, 17 bp, Homo sapiens
caggattttgtgttttt

SEQ ID NO: 3824572 - DNA, 22 bp, Homo sapiens
caggcaaggtctggcctcaggt

SEQ ID NO: 3824573 - DNA, 17 bp, Homo sapiens
caggcacaaaatgtgac

SEQ ID NO: 3824574 - DNA, 23 bp, Homo sapiens
caggcacaaaatgtgacatcttt

SEQ ID NO: 3824575 - DNA, 16 bp, Homo sapiens
caggcactagcctttg

SEQ ID NO: 3824576 - DNA, 20 bp, Homo sapiens
caggcaggtagccaggggga

SEQ ID NO: 3824577 - DNA, 15 bp, Homo sapiens
caggcagttctctcg

SEQ ID NO: 3824578 - DNA, 14 bp, Homo sapiens
caggcatagaggct

SEQ ID NO: 3824579 - DNA, 18 bp, Homo sapiens
caggcatagaggcttctc

SEQ ID NO: 3824580 - DNA, 13 bp, Homo sapiens
caggccagcctcc

SEQ ID NO: 3824581 - DNA, 19 bp, Homo sapiens
caggccagcctccgagagg

SEQ ID NO: 3824582 - DNA, 23 bp, Homo sapiens
caggccagcctccgagagggaga

SEQ ID NO: 3824583 - DNA, 17 bp, Homo sapiens
caggcccccgttgaagc

SEQ ID NO: 3824584 - DNA, 10 bp, Homo sapiens
caggcctggt

SEQ ID NO: 3824585 - DNA, 21 bp, Homo sapiens
caggcgggagcggtggccctg

SEQ ID NO: 3824586 - DNA, 23 bp, Homo sapiens
caggcgggagcggtggccctgtc

SEQ ID NO: 3824587 - DNA, 17 bp, Homo sapiens
caggctatggttgccac

SEQ ID NO: 3824588 - DNA, 18 bp, Homo sapiens
caggctatggttgccacc

SEQ ID NO: 3824589 - DNA, 20 bp, Homo sapiens
caggctatggttgccacccc

SEQ ID NO: 3824590 - DNA, 22 bp, Homo sapiens
caggctatggttgccaccccaa

SEQ ID NO: 3824591 - DNA, 16 bp, Homo sapiens
caggctcactgccagg

SEQ ID NO: 3824592 - DNA, 19 bp, Homo sapiens
caggctggcccccacccac

SEQ ID NO: 3824593 - DNA, 21 bp, Homo sapiens
caggctggcccccacccacct

SEQ ID NO: 3824594 - DNA, 14 bp, Homo sapiens
caggctgggaggct

SEQ ID NO: 3824595 - DNA, 15 bp, Homo sapiens
caggctgggaggctc

SEQ ID NO: 3824596 - DNA, 17 bp, Homo sapiens
caggcttgagttttcat

SEQ ID NO: 3824597 - DNA, 20 bp, Homo sapiens
caggcttgagttttcatttc

SEQ ID NO: 3824598 - DNA, 15 bp, Homo sapiens
caggcttgcattaaa

SEQ ID NO: 3824599 - DNA, 19 bp, Homo sapiens
caggctttgtgagagagga

SEQ ID NO: 3824600 - DNA, 22 bp, Homo sapiens
caggctttgtgagagaggacct

SEQ ID NO: 3824601 - DNA, 18 bp, Homo sapiens
cagggaagacagagcagg

SEQ ID NO: 3824602 - DNA, 19 bp, Homo sapiens
cagggaagacagagcaggc

SEQ ID NO: 3824603 - DNA, 19 bp, Homo sapiens
cagggatggccgttggcca

SEQ ID NO: 3824604 - DNA, 20 bp, Homo sapiens
cagggatggccgttggccac

SEQ ID NO: 3824605 - DNA, 13 bp, Homo sapiens
cagggcagcctcg

SEQ ID NO: 3824606 - DNA, 23 bp, Homo sapiens
cagggcatgccccggccacctct

SEQ ID NO: 3824607 - DNA, 15 bp, Homo sapiens
cagggccaggactga

SEQ ID NO: 3824608 - DNA, 17 bp, Homo sapiens
cagggcccagttaaata

SEQ ID NO: 3824609 - DNA, 16 bp, Homo sapiens
cagggctccagcctgt

SEQ ID NO: 3824610 - DNA, 22 bp, Homo sapiens
cagggctctctttccttcttgc

SEQ ID NO: 3824611 - DNA, 15 bp, Homo sapiens
caggggcgctggctg

SEQ ID NO: 3824612 - DNA, 14 bp, Homo sapiens
caggggctctggag

SEQ ID NO: 3824613 - DNA, 16 bp, Homo sapiens
caggggctctggagag

SEQ ID NO: 3824614 - DNA, 19 bp, Homo sapiens
caggggctctggagagaaa

SEQ ID NO: 3824615 - DNA, 15 bp, Homo sapiens
caggggctggcttca

SEQ ID NO: 3824616 - DNA, 19 bp, Homo sapiens
caggggctggcttcaggag

SEQ ID NO: 3824617 - DNA, 12 bp, Homo sapiens
caggggtggggg

SEQ ID NO: 3824618 - DNA, 20 bp, Homo sapiens
caggggtgggggtggaggct

SEQ ID NO: 3824619 - DNA, 22 bp, Homo sapiens
caggggtgggggtggaggcttc

SEQ ID NO: 3824620 - DNA, 14 bp, Homo sapiens
caggggtgtcctga

SEQ ID NO: 3824621 - DNA, 14 bp, Homo sapiens
caggtaccagctgc

SEQ ID NO: 3824622 - DNA, 18 bp, Homo sapiens
caggtaccagctgcgctt

SEQ ID NO: 3824623 - DNA, 19 bp, Homo sapiens
caggtaccagctgcgcttg

SEQ ID NO: 3824624 - DNA, 21 bp, Homo sapiens
caggtaccagctgcgcttgct

SEQ ID NO: 3824625 - DNA, 19 bp, Homo sapiens
caggtgaggaatttgaagc

SEQ ID NO: 3824626 - DNA, 20 bp, Homo sapiens
caggtgaggaatttgaagct

SEQ ID NO: 3824627 - DNA, 17 bp, Homo sapiens
caggttaaatatataaa

SEQ ID NO: 3824628 - DNA, 19 bp, Homo sapiens
caggttaaatatataaaca

SEQ ID NO: 3824629 - DNA, 17 bp, Homo sapiens
cagtaataaaaagccac

SEQ ID NO: 3824630 - DNA, 23 bp, Homo sapiens
cagtaataaaaagccaccacaca

SEQ ID NO: 3824631 - DNA, 18 bp, Homo sapiens
cagtagccccatcacatt

SEQ ID NO: 3824632 - DNA, 17 bp, Homo sapiens
cagtagtataatgtatg

SEQ ID NO: 3824633 - DNA, 18 bp, Homo sapiens
cagtatggtgctaatgtg

SEQ ID NO: 3824634 - DNA, 19 bp, Homo sapiens
cagtatggtgctaatgtgt

SEQ ID NO: 3824635 - DNA, 22 bp, Homo sapiens
cagtcagtgctggagaaatctt

SEQ ID NO: 3824636 - DNA, 15 bp, Homo sapiens
cagtcccaccctgct

SEQ ID NO: 3824637 - DNA, 17 bp, Homo sapiens
cagtccccacccctgcc

SEQ ID NO: 3824638 - DNA, 20 bp, Homo sapiens
cagtccccacccctgccccc

SEQ ID NO: 3824639 - DNA, 22 bp, Homo sapiens
cagtccccattttctggtaagg

SEQ ID NO: 3824640 - DNA, 14 bp, Homo sapiens
cagtcctcccctca

SEQ ID NO: 3824641 - DNA, 18 bp, Homo sapiens
cagtcctcccctcacagc

SEQ ID NO: 3824642 - DNA, 21 bp, Homo sapiens
cagtcctcccctcacagcctc

SEQ ID NO: 3824643 - DNA, 22 bp, Homo sapiens
cagtcctcccctcacagcctct

SEQ ID NO: 3824644 - DNA, 16 bp, Homo sapiens
cagtctgctctcagct

SEQ ID NO: 3824645 - DNA, 19 bp, Homo sapiens
cagtctgctctcagcttgt

SEQ ID NO: 3824646 - DNA, 22 bp, Homo sapiens
cagtctgctctcagcttgtgcc

SEQ ID NO: 3824647 - DNA, 18 bp, Homo sapiens
cagtgagctgagatcaca

SEQ ID NO: 3824648 - DNA, 15 bp, Homo sapiens
cagtgagtgagcctg

SEQ ID NO: 3824649 - DNA, 17 bp, Homo sapiens
cagtgagtgagcctggc

SEQ ID NO: 3824650 - DNA, 19 bp, Homo sapiens
cagtgagtgagcctggctc

SEQ ID NO: 3824651 - DNA, 16 bp, Homo sapiens
cagtgatgttgaaatt

SEQ ID NO: 3824652 - DNA, 21 bp, Homo sapiens
cagtgctggagaaatcttgaa

SEQ ID NO: 3824653 - DNA, 20 bp, Homo sapiens
cagtggccggggctgaagcc

SEQ ID NO: 3824654 - DNA, 21 bp, Homo sapiens
cagtggccggggctgaagcca

SEQ ID NO: 3824655 - DNA, 23 bp, Homo sapiens
cagtgggcactaagggtggagag

SEQ ID NO: 3824656 - DNA, 15 bp, Homo sapiens
cagtggttttatact

SEQ ID NO: 3824657 - DNA, 14 bp, Homo sapiens
cagtgtgcggagct

SEQ ID NO: 3824658 - DNA, 13 bp, Homo sapiens
cagttaaatatga

SEQ ID NO: 3824659 - DNA, 15 bp, Homo sapiens
cagttataaagaaag

SEQ ID NO: 3824660 - DNA, 23 bp, Homo sapiens
cagttcccgggccctcctgggca

SEQ ID NO: 3824661 - DNA, 13 bp, Homo sapiens
cagtttgtttaca

SEQ ID NO: 3824662 - DNA, 16 bp, Homo sapiens
cagtttgtttacacac

SEQ ID NO: 3824663 - DNA, 12 bp, Homo sapiens
cagttttactgc

SEQ ID NO: 3824664 - DNA, 13 bp, Homo sapiens
cagttttactgca

SEQ ID NO: 3824665 - DNA, 15 bp, Homo sapiens
cagttttactgcatt

SEQ ID NO: 3824666 - DNA, 23 bp, Homo sapiens
cataaaaactggttctacaaatt

SEQ ID NO: 3824667 - DNA, 17 bp, Homo sapiens
cataaaaagaaagctaa

SEQ ID NO: 3824668 - DNA, 22 bp, Homo sapiens
cataaaaagaaagctaatacta

SEQ ID NO: 3824669 - DNA, 16 bp, Homo sapiens
cataaagcaggcagaa

SEQ ID NO: 3824670 - DNA, 15 bp, Homo sapiens
cataatatattgtgt

SEQ ID NO: 3824671 - DNA, 16 bp, Homo sapiens
cataatatttgaacaa

SEQ ID NO: 3824672 - DNA, 14 bp, Homo sapiens
cataatgtaactga

SEQ ID NO: 3824673 - DNA, 21 bp, Homo sapiens
cataatgtaactgaagcataa

SEQ ID NO: 3824674 - DNA, 18 bp, Homo sapiens
cataattttcaaaagaaa

SEQ ID NO: 3824675 - DNA, 12 bp, Homo sapiens
catacacacaca

SEQ ID NO: 3824676 - DNA, 13 bp, Homo sapiens
catacacacacac

SEQ ID NO: 3824677 - DNA, 14 bp, Homo sapiens
catacacacacaca

SEQ ID NO: 3824678 - DNA, 19 bp, Homo sapiens
catagaggcttctccgcca

SEQ ID NO: 3824679 - DNA, 20 bp, Homo sapiens
catagaggcttctccgccag

SEQ ID NO: 3824680 - DNA, 21 bp, Homo sapiens
catagaggcttctccgccagc

SEQ ID NO: 3824681 - DNA, 22 bp, Homo sapiens
catagaggcttctccgccagcc

SEQ ID NO: 3824682 - DNA, 21 bp, Homo sapiens
catagcatttgtgtaaagact

SEQ ID NO: 3824683 - DNA, 13 bp, Homo sapiens
catagcccatccc

SEQ ID NO: 3824684 - DNA, 23 bp, Homo sapiens
catagtggacattgttggcagca

SEQ ID NO: 3824685 - DNA, 14 bp, Homo sapiens
catatacctcttga

SEQ ID NO: 3824686 - DNA, 22 bp, Homo sapiens
catatcagacttcaccaaatat

SEQ ID NO: 3824687 - DNA, 13 bp, Homo sapiens
ccatccctgcctg

SEQ ID NO: 3824688 - DNA, 14 bp, Homo sapiens
ccatcccttcccca

SEQ ID NO: 3824689 - DNA, 23 bp, Homo sapiens
ccatcctgctagcacctccccag

SEQ ID NO: 3824690 - DNA, 19 bp, Homo sapiens
ccatcgccagctgatgact

SEQ ID NO: 3824691 - DNA, 21 bp, Homo sapiens
ccatcgccagctgatgactca

SEQ ID NO: 3824692 - DNA, 17 bp, Homo sapiens
ccatctgcaccccttct

SEQ ID NO: 3824693 - DNA, 17 bp, Homo sapiens
ccatctggcccaggctg

SEQ ID NO: 3824694 - DNA, 19 bp, Homo sapiens
ccatctggcccaggctggc

SEQ ID NO: 3824695 - DNA, 21 bp, Homo sapiens
ccatgcagtgaccgcttcccc

SEQ ID NO: 3824696 - DNA, 14 bp, Homo sapiens
ccatgctggagcct

SEQ ID NO: 3824697 - DNA, 21 bp, Homo sapiens
ccatgctggagcctgtgtaac

SEQ ID NO: 3824698 - DNA, 22 bp, Homo sapiens
ccatgctggagcctgtgtaaca

SEQ ID NO: 3824699 - DNA, 15 bp, Homo sapiens
ccatggctgctttgt

SEQ ID NO: 3824700 - DNA, 23 bp, Homo sapiens
ccatggctggggggtctcagcat

SEQ ID NO: 3824701 - DNA, 13 bp, Homo sapiens
ccatggctttgtg

SEQ ID NO: 3824702 - DNA, 17 bp, Homo sapiens
ccatggctttgtgctgc

SEQ ID NO: 3824703 - DNA, 13 bp, Homo sapiens
ccatggggcagcc

SEQ ID NO: 3824704 - DNA, 15 bp, Homo sapiens
ccatggggcagcctc

SEQ ID NO: 3824705 - DNA, 20 bp, Homo sapiens
ccatggggcagcctccagtc

SEQ ID NO: 3824706 - DNA, 22 bp, Homo sapiens
ccatggggcagcctccagtctg

SEQ ID NO: 3824707 - DNA, 23 bp, Homo sapiens
ccatggggcagcctccagtctgc

SEQ ID NO: 3824708 - DNA, 20 bp, Homo sapiens
ccatgtgaaactcatctcat

SEQ ID NO: 3824709 - DNA, 20 bp, Homo sapiens
ccatgttggccaggctggtc

SEQ ID NO: 3824710 - DNA, 18 bp, Homo sapiens
ccattctacttgctctgg

SEQ ID NO: 3824711 - DNA, 22 bp, Homo sapiens
ccattctacttgctctggacct

SEQ ID NO: 3824712 - DNA, 13 bp, Homo sapiens
ccattctcccagg

SEQ ID NO: 3824713 - DNA, 14 bp, Homo sapiens
ccattctcccaggt

SEQ ID NO: 3824714 - DNA, 23 bp, Homo sapiens
ccattctcccaggtaccagctgc

SEQ ID NO: 3824715 - DNA, 19 bp, Homo sapiens
ccattgcgttattttcttt

SEQ ID NO: 3824716 - DNA, 21 bp, Homo sapiens
ccatttgtaaaacattccaaa

SEQ ID NO: 3824717 - DNA, 15 bp, Homo sapiens
ccattttatttcttt

SEQ ID NO: 3824718 - DNA, 16 bp, Homo sapiens
cccaaatcaatacact

SEQ ID NO: 3824719 - DNA, 21 bp, Homo sapiens
cccaaattatcaagctaataa

SEQ ID NO: 3824720 - DNA, 13 bp, Homo sapiens
cccaacccaacca

SEQ ID NO: 3824721 - DNA, 12 bp, Homo sapiens
cccaacttcccc

SEQ ID NO: 3824722 - DNA, 13 bp, Homo sapiens
cccaacttcccct

SEQ ID NO: 3824723 - DNA, 19 bp, Homo sapiens
cccaaggatttttaaaact

SEQ ID NO: 3824724 - DNA, 18 bp, Homo sapiens
cccacaccatctggccca

SEQ ID NO: 3824725 - DNA, 14 bp, Homo sapiens
cccacccccagcca

SEQ ID NO: 3824726 - DNA, 15 bp, Homo sapiens
cccaccccctgccct

SEQ ID NO: 3824727 - DNA, 17 bp, Homo sapiens
cccaccccctgccctgc

SEQ ID NO: 3824728 - DNA, 18 bp, Homo sapiens
cccaccccggggaccctg

SEQ ID NO: 3824729 - DNA, 20 bp, Homo sapiens
cccaccccggggaccctgtg

SEQ ID NO: 3824730 - DNA, 21 bp, Homo sapiens
cccaccccggggaccctgtga

SEQ ID NO: 3824731 - DNA, 16 bp, Homo sapiens
cccacccctgccccca

SEQ ID NO: 3824732 - DNA, 16 bp, Homo sapiens
cccaccgccctgcctc

SEQ ID NO: 3824733 - DNA, 19 bp, Homo sapiens
cccaccgtggaggaggaag

SEQ ID NO: 3824734 - DNA, 20 bp, Homo sapiens
cccaccgtggaggaggaagg

SEQ ID NO: 3824735 - DNA, 13 bp, Homo sapiens
cccacctccccac

SEQ ID NO: 3824736 - DNA, 17 bp, Homo sapiens
cccacgcccccatgcag

SEQ ID NO: 3824737 - DNA, 12 bp, Homo sapiens
cccactgggaga

SEQ ID NO: 3824738 - DNA, 21 bp, Homo sapiens
cccactgggagagtccttagc

SEQ ID NO: 3824739 - DNA, 13 bp, Homo sapiens
cccagaaggccag

SEQ ID NO: 3824740 - DNA, 21 bp, Homo sapiens
cccagacagggctccagcctg

SEQ ID NO: 3824741 - DNA, 22 bp, Homo sapiens
cccagacagggctccagcctgt

SEQ ID NO: 3824742 - DNA, 13 bp, Homo sapiens
cccagactccagg

SEQ ID NO: 3824743 - DNA, 17 bp, Homo sapiens
cccagactccaggcccc

SEQ ID NO: 3824744 - DNA, 19 bp, Homo sapiens
cccagactccaggcccccg

SEQ ID NO: 3824745 - DNA, 15 bp, Homo sapiens
cccagagatggctcc

SEQ ID NO: 3824746 - DNA, 16 bp, Homo sapiens
cccagagccaagctgg

SEQ ID NO: 3824747 - DNA, 18 bp, Homo sapiens
cccagccaggctatggtt

SEQ ID NO: 3824748 - DNA, 14 bp, Homo sapiens
cccagcccaggcct

SEQ ID NO: 3824749 - DNA, 15 bp, Homo sapiens
cccagcccaggcctg

SEQ ID NO: 3824750 - DNA, 13 bp, Homo sapiens
cccagcccctagc

SEQ ID NO: 3824751 - DNA, 18 bp, Homo sapiens
cccagcccctagcccagg

SEQ ID NO: 3824752 - DNA, 19 bp, Homo sapiens
cccagcccctagcccagga

SEQ ID NO: 3824753 - DNA, 12 bp, Homo sapiens
cccagcctcagt

SEQ ID NO: 3824754 - DNA, 22 bp, Homo sapiens
cccagcctggcctgtggctgcc

SEQ ID NO: 3824755 - DNA, 24 bp, Homo sapiens
cccagctgccagggaagacagagc

SEQ ID NO: 3824756 - DNA, 15 bp, Homo sapiens
cccagctgtgagcct

SEQ ID NO: 3824757 - DNA, 21 bp, Homo sapiens
cccaggacaccacacccagcc

SEQ ID NO: 3824758 - DNA, 23 bp, Homo sapiens
cccaggacaccacacccagcctc

SEQ ID NO: 3824759 - DNA, 15 bp, Homo sapiens
cccaggagttctgct

SEQ ID NO: 3824760 - DNA, 12 bp, Homo sapiens
cccaggcctggt

SEQ ID NO: 3824761 - DNA, 13 bp, Homo sapiens
cccaggcctggtg

SEQ ID NO: 3824762 - DNA, 15 bp, Homo sapiens
cccaggcctggtgga

SEQ ID NO: 3824763 - DNA, 23 bp, Homo sapiens
cccaggcgggagcggtggccctg

SEQ ID NO: 3824764 - DNA, 15 bp, Homo sapiens
cccaggtgaggaatt

SEQ ID NO: 3824765 - DNA, 13 bp, Homo sapiens
cccagtccccacc

SEQ ID NO: 3824766 - DNA, 15 bp, Homo sapiens
cccagtccccacccc

SEQ ID NO: 3824767 - DNA, 18 bp, Homo sapiens
cccagtccccacccctgc

SEQ ID NO: 3824768 - DNA, 22 bp, Homo sapiens
cccagttcccgggccctcctgg

SEQ ID NO: 3824769 - DNA, 15 bp, Homo sapiens
cccatccctgcctgg

SEQ ID NO: 3824770 - DNA, 17 bp, Homo sapiens
cccatccctgcctggtc

SEQ ID NO: 3824771 - DNA, 18 bp, Homo sapiens
cccatccctgcctggtca

SEQ ID NO: 3824772 - DNA, 22 bp, Homo sapiens
cccatcgccagctgatgactca

SEQ ID NO: 3824773 - DNA, 13 bp, Homo sapiens
cccatgctggagc

SEQ ID NO: 3824774 - DNA, 16 bp, Homo sapiens
cccatgctggagcctg

SEQ ID NO: 3824775 - DNA, 17 bp, Homo sapiens
cccatgctggagcctgt

SEQ ID NO: 3824776 - DNA, 19 bp, Homo sapiens
cccatgctggagcctgtgt

SEQ ID NO: 3824777 - DNA, 14 bp, Homo sapiens
cccatggcctcaga

SEQ ID NO: 3824778 - DNA, 15 bp, Homo sapiens
cccatggcctcagat

SEQ ID NO: 3824779 - DNA, 22 bp, Homo sapiens
cccatgtcccagcctggcctgt

SEQ ID NO: 3824780 - DNA, 15 bp, Homo sapiens
cccattcaccctgtg

SEQ ID NO: 3824781 - DNA, 14 bp, Homo sapiens
cccattctacttgc

SEQ ID NO: 3824782 - DNA, 15 bp, Homo sapiens
cccattctacttgct

SEQ ID NO: 3824783 - DNA, 20 bp, Homo sapiens
cccattctacttgctctgga

SEQ ID NO: 3824784 - DNA, 21 bp, Homo sapiens
cccattctacttgctctggac

SEQ ID NO: 3824785 - DNA, 22 bp, Homo sapiens
cccattctacttgctctggacc

SEQ ID NO: 3824786 - DNA, 16 bp, Homo sapiens
cccatttcccatctgc

SEQ ID NO: 3824787 - DNA, 19 bp, Homo sapiens
cccatttcccatctgcacc

SEQ ID NO: 3824788 - DNA, 20 bp, Homo sapiens
ccccaacagcgacatagccc

SEQ ID NO: 3824789 - DNA, 19 bp, Homo sapiens
ccccacccccagccaggct

SEQ ID NO: 3824790 - DNA, 16 bp, Homo sapiens
ccccaccccgggctct

SEQ ID NO: 3824791 - DNA, 14 bp, Homo sapiens
ccccacgccctccc

SEQ ID NO: 3824792 - DNA, 13 bp, Homo sapiens
ccccactgggaga

SEQ ID NO: 3824793 - DNA, 15 bp, Homo sapiens
ccccagactccaggc

SEQ ID NO: 3824794 - DNA, 16 bp, Homo sapiens
ccccagactccaggcc

SEQ ID NO: 3824795 - DNA, 17 bp, Homo sapiens
ccccagactccaggccc

SEQ ID NO: 3824796 - DNA, 18 bp, Homo sapiens
ccccagatctgtcctggg

SEQ ID NO: 3824797 - DNA, 19 bp, Homo sapiens
ccccagatctgtcctgggg

SEQ ID NO: 3824798 - DNA, 13 bp, Homo sapiens
ccccagcccaggg

SEQ ID NO: 3824799 - DNA, 15 bp, Homo sapiens
ccccagcccagggtg

SEQ ID NO: 3824800 - DNA, 14 bp, Homo sapiens
ccccagggcagcct

SEQ ID NO: 3824801 - DNA, 22 bp, Homo sapiens
ccccatcgccagctgatgactc

SEQ ID NO: 3824802 - DNA, 14 bp, Homo sapiens
ccccatgctggagc

SEQ ID NO: 3824803 - DNA, 16 bp, Homo sapiens
ccccatgctggagcct

SEQ ID NO: 3824804 - DNA, 19 bp, Homo sapiens
ccccatgctggagcctgtg

SEQ ID NO: 3824805 - DNA, 22 bp, Homo sapiens
ccccatgctggagcctgtgtaa

SEQ ID NO: 3824806 - DNA, 21 bp, Homo sapiens
ccccatttatccacctccatc

SEQ ID NO: 3824807 - DNA, 14 bp, Homo sapiens
cccccacccacctt

SEQ ID NO: 3824808 - DNA, 14 bp, Homo sapiens
cccccagccaggct

SEQ ID NO: 3824809 - DNA, 13 bp, Homo sapiens
cccccagccccgg

SEQ ID NO: 3824810 - DNA, 20 bp, Homo sapiens
cccccagtccccacccctgc

SEQ ID NO: 3824811 - DNA, 22 bp, Homo sapiens
cccccagtccccacccctgccc

SEQ ID NO: 3824812 - DNA, 21 bp, Homo sapiens
cccccgagcttgcctcagggc

SEQ ID NO: 3824813 - DNA, 19 bp, Homo sapiens
cccccgccacctccccact

SEQ ID NO: 3824814 - DNA, 23 bp, Homo sapiens
ccccctgcagccatcccaaggct

SEQ ID NO: 3824815 - DNA, 20 bp, Homo sapiens
ccccgatgtgagccgcctcg

SEQ ID NO: 3824816 - DNA, 22 bp, Homo sapiens
ccccgatgtgagccgcctcgga

SEQ ID NO: 3824817 - DNA, 13 bp, Homo sapiens
ccccgcagacctc

SEQ ID NO: 3824818 - DNA, 14 bp, Homo sapiens
ccccgcagacctcc

SEQ ID NO: 3824819 - DNA, 12 bp, Homo sapiens
cgcagctgaagc

SEQ ID NO: 3824820 - DNA, 14 bp, Homo sapiens
cgcagctgaagcct

SEQ ID NO: 3824821 - DNA, 15 bp, Homo sapiens
cgcagctgaagcctg

SEQ ID NO: 3824822 - DNA, 18 bp, Homo sapiens
cgcaggcgggaaaagcag

SEQ ID NO: 3824823 - DNA, 13 bp, Homo sapiens
cgcagggccctct

SEQ ID NO: 3824824 - DNA, 15 bp, Homo sapiens
cgcatcccctgcctc

SEQ ID NO: 3824825 - DNA, 14 bp, Homo sapiens
cgcatggtttttat

SEQ ID NO: 3824826 - DNA, 15 bp, Homo sapiens
cgcattgttttgcat

SEQ ID NO: 3824827 - DNA, 19 bp, Homo sapiens
cgcattttgggttgtttaa

SEQ ID NO: 3824828 - DNA, 16 bp, Homo sapiens
cgccaaactgtctctg

SEQ ID NO: 3824829 - DNA, 17 bp, Homo sapiens
cgccagcctcctctgga

SEQ ID NO: 3824830 - DNA, 23 bp, Homo sapiens
cgccagcctcctctggacggcag

SEQ ID NO: 3824831 - DNA, 13 bp, Homo sapiens
cgccagctgatga

SEQ ID NO: 3824832 - DNA, 15 bp, Homo sapiens
cgccagctgatgact

SEQ ID NO: 3824833 - DNA, 18 bp, Homo sapiens
cgccagctgatgactcaa

SEQ ID NO: 3824834 - DNA, 14 bp, Homo sapiens
cgcccacctcccca

SEQ ID NO: 3824835 - DNA, 12 bp, Homo sapiens
cgcccagcccag

SEQ ID NO: 3824836 - DNA, 14 bp, Homo sapiens
cgcccagcccaggc

SEQ ID NO: 3824837 - DNA, 16 bp, Homo sapiens
cgcccagcccaggcct

SEQ ID NO: 3824838 - DNA, 17 bp, Homo sapiens
cgcccagcccaggcctg

SEQ ID NO: 3824839 - DNA, 22 bp, Homo sapiens
cgcccccagtccccacccctgc

SEQ ID NO: 3824840 - DNA, 23 bp, Homo sapiens
cgccccggacagtggcacctggg

SEQ ID NO: 3824841 - DNA, 22 bp, Homo sapiens
cgccctcccctcccctgctgca

SEQ ID NO: 3824842 - DNA, 15 bp, Homo sapiens
cgctaaagagccctt

SEQ ID NO: 3824843 - DNA, 19 bp, Homo sapiens
cgctaaagagcccttgcct

SEQ ID NO: 3824844 - DNA, 22 bp, Homo sapiens
cgctaaagagcccttgcctccc

SEQ ID NO: 3824845 - DNA, 18 bp, Homo sapiens
cgctctcatgaagccctt

SEQ ID NO: 3824846 - DNA, 17 bp, Homo sapiens
cgctgattcctaaggcc

SEQ ID NO: 3824847 - DNA, 19 bp, Homo sapiens
cgctgctgcgccctgggct

SEQ ID NO: 3824848 - DNA, 15 bp, Homo sapiens
cgctggaccttttct

SEQ ID NO: 3824849 - DNA, 15 bp, Homo sapiens
cgcttttggtgcctg

SEQ ID NO: 3824850 - DNA, 18 bp, Homo sapiens
cgcttttggtgcctggct

SEQ ID NO: 3824851 - DNA, 14 bp, Homo sapiens
cggaccccagctgt

SEQ ID NO: 3824852 - DNA, 22 bp, Homo sapiens
cggaccccagctgtgagccttg

SEQ ID NO: 3824853 - DNA, 18 bp, Homo sapiens
cggagtgtggcctggatc

SEQ ID NO: 3824854 - DNA, 14 bp, Homo sapiens
cggcaggctcactg

SEQ ID NO: 3824855 - DNA, 17 bp, Homo sapiens
cggcaggctcactgcca

SEQ ID NO: 3824856 - DNA, 14 bp, Homo sapiens
cggccacaccccag

SEQ ID NO: 3824857 - DNA, 18 bp, Homo sapiens
cggccacaccccagactc

SEQ ID NO: 3824858 - DNA, 20 bp, Homo sapiens
cggccacaccccagactcca

SEQ ID NO: 3824859 - DNA, 11 bp, Homo sapiens
cggccacctct

SEQ ID NO: 3824860 - DNA, 17 bp, Homo sapiens
cggcctgcactccccca

SEQ ID NO: 3824861 - DNA, 18 bp, Homo sapiens
cggctgagctccagccac

SEQ ID NO: 3824862 - DNA, 23 bp, Homo sapiens
cgggaaaagcagcccttggccag

SEQ ID NO: 3824863 - DNA, 14 bp, Homo sapiens
cgggaacctcactc

SEQ ID NO: 3824864 - DNA, 15 bp, Homo sapiens
cgggaagctgacctt

SEQ ID NO: 3824865 - DNA, 17 bp, Homo sapiens
cgggagcatcctgctgc

SEQ ID NO: 3824866 - DNA, 17 bp, Homo sapiens
cgggagcggtggccctg

SEQ ID NO: 3824867 - DNA, 18 bp, Homo sapiens
cgggagggaacatcctgc

SEQ ID NO: 3824868 - DNA, 23 bp, Homo sapiens
cggggaggaggttgtgtcactga

SEQ ID NO: 3824869 - DNA, 20 bp, Homo sapiens
cggggcccccatcttggggg

SEQ ID NO: 3824870 - DNA, 12 bp, Homo sapiens
cggggctcagcc

SEQ ID NO: 3824871 - DNA, 14 bp, Homo sapiens
cggggctccccacg

SEQ ID NO: 3824872 - DNA, 17 bp, Homo sapiens
cggggctccccacgccc

SEQ ID NO: 3824873 - DNA, 13 bp, Homo sapiens
cggggctgaagcc

SEQ ID NO: 3824874 - DNA, 17 bp, Homo sapiens
cggggctgaagccacac

SEQ ID NO: 3824875 - DNA, 20 bp, Homo sapiens
cggggctgaagccacacagc

SEQ ID NO: 3824876 - DNA, 16 bp, Homo sapiens
cggtattatgcttctt

SEQ ID NO: 3824877 - DNA, 20 bp, Homo sapiens
cggttccctccccagctcct

SEQ ID NO: 3824878 - DNA, 15 bp, Homo sapiens
cgtattcttgaaagt

SEQ ID NO: 3824879 - DNA, 15 bp, Homo sapiens
cgtccatggtgctaa

SEQ ID NO: 3824880 - DNA, 21 bp, Homo sapiens
cgtcctcctcacctcatgccc

SEQ ID NO: 3824881 - DNA, 10 bp, Homo sapiens
cgtctttgca

SEQ ID NO: 3824882 - DNA, 19 bp, Homo sapiens
cgtgatatccatatgaaat

SEQ ID NO: 3824883 - DNA, 15 bp, Homo sapiens
cgtgcataaaaactg

SEQ ID NO: 3824884 - DNA, 18 bp, Homo sapiens
cgtgtgacctataatttt

SEQ ID NO: 3824885 - DNA, 22 bp, Homo sapiens
cgttaggacaaggctgtgccag

SEQ ID NO: 3824886 - DNA, 23 bp, Homo sapiens
cgtttcagtgtcaaataaacact

SEQ ID NO: 3824887 - DNA, 15 bp, Homo sapiens
cgttttatcaaaggc

SEQ ID NO: 3824888 - DNA, 17 bp, Homo sapiens
cgttttgcctcatgaac

SEQ ID NO: 3824889 - DNA, 17 bp, Homo sapiens
ctaaaaacaaaacaaac

SEQ ID NO: 3824890 - DNA, 22 bp, Homo sapiens
ctaaaacattgtctacagctcc

SEQ ID NO: 3824891 - DNA, 13 bp, Homo sapiens
ctaaaactctgcc

SEQ ID NO: 3824892 - DNA, 14 bp, Homo sapiens
ctaaaactctgcca

SEQ ID NO: 3824893 - DNA, 19 bp, Homo sapiens
ctaaaagattttgtgaaat

SEQ ID NO: 3824894 - DNA, 21 bp, Homo sapiens
ctaaacagagaaaagcttgga

SEQ ID NO: 3824895 - DNA, 20 bp, Homo sapiens
ctaaagacctgctgtaataa

SEQ ID NO: 3824896 - DNA, 23 bp, Homo sapiens
ctaaagacctgctgtaataaatg

SEQ ID NO: 3824897 - DNA, 20 bp, Homo sapiens
ctaaagagcccttgcctccc

SEQ ID NO: 3824898 - DNA, 23 bp, Homo sapiens
ctaaagagcccttgcctccccat

SEQ ID NO: 3824899 - DNA, 17 bp, Homo sapiens
ctaaagtgtgctttata

SEQ ID NO: 3824900 - DNA, 22 bp, Homo sapiens
ctaaataacttgccatttcttt

SEQ ID NO: 3824901 - DNA, 23 bp, Homo sapiens
ctaaataacttgccatttcttta

SEQ ID NO: 3824902 - DNA, 18 bp, Homo sapiens
ctaaatatattttaagac

SEQ ID NO: 3824903 - DNA, 15 bp, Homo sapiens
ctaagaaatcatgtg

SEQ ID NO: 3824904 - DNA, 22 bp, Homo sapiens
ctaagactcctcggcctggctc

SEQ ID NO: 3824905 - DNA, 23 bp, Homo sapiens
ctaagactcctcggcctggctcc

SEQ ID NO: 3824906 - DNA, 22 bp, Homo sapiens
ctaagagaagttattttctaca

SEQ ID NO: 3824907 - DNA, 16 bp, Homo sapiens
ctaagatgaatccaaa

SEQ ID NO: 3824908 - DNA, 19 bp, Homo sapiens
ctaagatgaatccaaatgt

SEQ ID NO: 3824909 - DNA, 12 bp, Homo sapiens
ctaaggcccagc

SEQ ID NO: 3824910 - DNA, 13 bp, Homo sapiens
ctaaggcccagct

SEQ ID NO: 3824911 - DNA, 15 bp, Homo sapiens
ctaaggcccagctgc

SEQ ID NO: 3824912 - DNA, 22 bp, Homo sapiens
ctaagtctgttattgttttgtt

SEQ ID NO: 3824913 - DNA, 24 bp, Homo sapiens
ctaatagcctaaaagattttgtga

SEQ ID NO: 3824914 - DNA, 17 bp, Homo sapiens
ctaatatttgtctgtgt

SEQ ID NO: 3824915 - DNA, 21 bp, Homo sapiens
ctaatatttgtctgtgtgcta

SEQ ID NO: 3824916 - DNA, 23 bp, Homo sapiens
ctaatatttgtctgtgtgctact

SEQ ID NO: 3824917 - DNA, 16 bp, Homo sapiens
ctaatgtgtctgtgga

SEQ ID NO: 3824918 - DNA, 17 bp, Homo sapiens
ctaatgtgtctgtggac

SEQ ID NO: 3824919 - DNA, 14 bp, Homo sapiens
ctaattcatttatt

SEQ ID NO: 3824920 - DNA, 18 bp, Homo sapiens
ctaatttctcctcccttc

SEQ ID NO: 3824921 - DNA, 22 bp, Homo sapiens
ctacaacatattgtttcagtgt

SEQ ID NO: 3824922 - DNA, 12 bp, Homo sapiens
ctacacctggct

SEQ ID NO: 3824923 - DNA, 21 bp, Homo sapiens
ctacagtggttttatactgaa

SEQ ID NO: 3824924 - DNA, 17 bp, Homo sapiens
ctaccaccacaccaaat

SEQ ID NO: 3824925 - DNA, 14 bp, Homo sapiens
ctacctcctcaggg

SEQ ID NO: 3824926 - DNA, 12 bp, Homo sapiens
ctactaacagat

SEQ ID NO: 3824927 - DNA, 21 bp, Homo sapiens
ctactaacagattataataaa

SEQ ID NO: 3824928 - DNA, 23 bp, Homo sapiens
ctactaacagattataataaatt

SEQ ID NO: 3824929 - DNA, 20 bp, Homo sapiens
ctactacacactgctcattt

SEQ ID NO: 3824930 - DNA, 15 bp, Homo sapiens
ctactgcccctgccc

SEQ ID NO: 3824931 - DNA, 19 bp, Homo sapiens
ctactgcccctgccctgag

SEQ ID NO: 3824932 - DNA, 22 bp, Homo sapiens
ctactgcccctgccctgaggag

SEQ ID NO: 3824933 - DNA, 21 bp, Homo sapiens
ctacttgctctggacctgccc

SEQ ID NO: 3824934 - DNA, 13 bp, Homo sapiens
ctagaagccaagg

SEQ ID NO: 3824935 - DNA, 21 bp, Homo sapiens
ctagaagccaagggaaagggg

SEQ ID NO: 3824936 - DNA, 16 bp, Homo sapiens
ctagaatggatttttc

SEQ ID NO: 3824937 - DNA, 22 bp, Homo sapiens
ctagagcatcatccttagaaat

SEQ ID NO: 3824938 - DNA, 17 bp, Homo sapiens
ctagagtgagggcctga

SEQ ID NO: 3824939 - DNA, 18 bp, Homo sapiens
ctagagtgagggcctgag

SEQ ID NO: 3824940 - DNA, 12 bp, Homo sapiens
ctagatttcaag

SEQ ID NO: 3824941 - DNA, 15 bp, Homo sapiens
ctagcacctccccag

SEQ ID NO: 3824942 - DNA, 17 bp, Homo sapiens
ctagcccaggagagaga

SEQ ID NO: 3824943 - DNA, 20 bp, Homo sapiens
ctagcccaggagagagaaag

SEQ ID NO: 3824944 - DNA, 13 bp, Homo sapiens
ctagcccctgtgg

SEQ ID NO: 3824945 - DNA, 20 bp, Homo sapiens
ctagcctttggctctggaga

SEQ ID NO: 3824946 - DNA, 20 bp, Homo sapiens
ctagctaaaccagaaaggtg

SEQ ID NO: 3824947 - DNA, 21 bp, Homo sapiens
ctagctggagtgccatggctg

SEQ ID NO: 3824948 - DNA, 14 bp, Homo sapiens
ctagcttctgcttt

SEQ ID NO: 3824949 - DNA, 15 bp, Homo sapiens
ctagcttctgctttt

SEQ ID NO: 3824950 - DNA, 22 bp, Homo sapiens
ctagcttctgcttttctgccct

SEQ ID NO: 3824951 - DNA, 15 bp, Homo sapiens
ctgggctgcctcctc

SEQ ID NO: 3824952 - DNA, 13 bp, Homo sapiens
ctgggcttggcct

SEQ ID NO: 3824953 - DNA, 20 bp, Homo sapiens
ctgggcttggcctgctgtga

SEQ ID NO: 3824954 - DNA, 12 bp, Homo sapiens
ctggggacaggc

SEQ ID NO: 3824955 - DNA, 16 bp, Homo sapiens
ctggggatggccaggt

SEQ ID NO: 3824956 - DNA, 15 bp, Homo sapiens
ctggggcaaggggca

SEQ ID NO: 3824957 - DNA, 18 bp, Homo sapiens
ctggggcaaggggcagcc

SEQ ID NO: 3824958 - DNA, 15 bp, Homo sapiens
ctggggcctggactg

SEQ ID NO: 3824959 - DNA, 20 bp, Homo sapiens
ctggggcctgtgtagccagt

SEQ ID NO: 3824960 - DNA, 13 bp, Homo sapiens
ctggggctcagcc

SEQ ID NO: 3824961 - DNA, 20 bp, Homo sapiens
ctggggctcagccctgagct

SEQ ID NO: 3824962 - DNA, 14 bp, Homo sapiens
ctgggtgggctctg

SEQ ID NO: 3824963 - DNA, 15 bp, Homo sapiens
ctgggtttgaagctg

SEQ ID NO: 3824964 - DNA, 20 bp, Homo sapiens
ctgggtttgaagctgctgtc

SEQ ID NO: 3824965 - DNA, 20 bp, Homo sapiens
ctggtaggaaaaagctttac

SEQ ID NO: 3824966 - DNA, 15 bp, Homo sapiens
ctggtattgtaatat

SEQ ID NO: 3824967 - DNA, 16 bp, Homo sapiens
ctggtattgtaatatt

SEQ ID NO: 3824968 - DNA, 18 bp, Homo sapiens
ctggtgaccggcctggac

SEQ ID NO: 3824969 - DNA, 12 bp, Homo sapiens
ctggtggggcag

SEQ ID NO: 3824970 - DNA, 23 bp, Homo sapiens
ctggtggggcagaaaggctgcaa

SEQ ID NO: 3824971 - DNA, 20 bp, Homo sapiens
ctggttctacaaatttttac

SEQ ID NO: 3824972 - DNA, 16 bp, Homo sapiens
ctggtttaactaatat

SEQ ID NO: 3824973 - DNA, 16 bp, Homo sapiens
ctgtaaatatttcata

SEQ ID NO: 3824974 - DNA, 14 bp, Homo sapiens
ctgtaaatcataat

SEQ ID NO: 3824975 - DNA, 15 bp, Homo sapiens
ctgtatgtcattaaa

SEQ ID NO: 3824976 - DNA, 21 bp, Homo sapiens
ctgtattttatttagacaaga

SEQ ID NO: 3824977 - DNA, 21 bp, Homo sapiens
ctgtatttttttttctaagag

SEQ ID NO: 3824978 - DNA, 13 bp, Homo sapiens
ctgtccccatagc

SEQ ID NO: 3824979 - DNA, 15 bp, Homo sapiens
ctgtccctcccacct

SEQ ID NO: 3824980 - DNA, 14 bp, Homo sapiens
ctgtcctcactgct

SEQ ID NO: 3824981 - DNA, 19 bp, Homo sapiens
ctgtcctcactgctccctg

SEQ ID NO: 3824982 - DNA, 11 bp, Homo sapiens
ctgtcctccca

SEQ ID NO: 3824983 - DNA, 22 bp, Homo sapiens
ctgtcctcccacccctccccac

SEQ ID NO: 3824984 - DNA, 14 bp, Homo sapiens
ctgtcctccccacc

SEQ ID NO: 3824985 - DNA, 23 bp, Homo sapiens
ctgtcggccacaccccagactcc

SEQ ID NO: 3824986 - DNA, 18 bp, Homo sapiens
ctgtctaaagtgggaaag

SEQ ID NO: 3824987 - DNA, 13 bp, Homo sapiens
ctgtctccaggca

SEQ ID NO: 3824988 - DNA, 18 bp, Homo sapiens
ctgtctccaggcagttct

SEQ ID NO: 3824989 - DNA, 14 bp, Homo sapiens
ctgtctctgcctct

SEQ ID NO: 3824990 - DNA, 13 bp, Homo sapiens
ctgtgaaactaat

SEQ ID NO: 3824991 - DNA, 21 bp, Homo sapiens
ctgtgacatggtgcctgagag

SEQ ID NO: 3824992 - DNA, 22 bp, Homo sapiens
ctgtgacatggtgcctgagagg

SEQ ID NO: 3824993 - DNA, 24 bp, Homo sapiens
ctgtgacatggtgcctgagaggca

SEQ ID NO: 3824994 - DNA, 17 bp, Homo sapiens
ctgtgagccttggctgt

SEQ ID NO: 3824995 - DNA, 17 bp, Homo sapiens
ctgtgcagggccctctg

SEQ ID NO: 3824996 - DNA, 17 bp, Homo sapiens
ctgtgcccgccctgggc

SEQ ID NO: 3824997 - DNA, 21 bp, Homo sapiens
ctgtgcccgccctgggctggg

SEQ ID NO: 3824998 - DNA, 22 bp, Homo sapiens
ctgtgccgcactagcctccctc

SEQ ID NO: 3824999 - DNA, 12 bp, Homo sapiens
ctgtgctttcta

SEQ ID NO: 3825000 - DNA, 22 bp, Homo sapiens
ctgtgctttctattgtacagaa

SEQ ID NO: 3825001 - DNA, 14 bp, Homo sapiens
ctgtggagactggg

SEQ ID NO: 3825002 - DNA, 14 bp, Homo sapiens
ctgtggaggggagc

SEQ ID NO: 3825003 - DNA, 20 bp, Homo sapiens
ctgtggaggggagctgctgg

SEQ ID NO: 3825004 - DNA, 22 bp, Homo sapiens
ctgtggaggggagctgctggcc

SEQ ID NO: 3825005 - DNA, 24 bp, Homo sapiens
ctgtggatcaaatccagcctgctg

SEQ ID NO: 3825006 - DNA, 21 bp, Homo sapiens
ctgtggcacagacccccgtcc

SEQ ID NO: 3825007 - DNA, 22 bp, Homo sapiens
ctgtggttgtggatgggaggct

SEQ ID NO: 3825008 - DNA, 23 bp, Homo sapiens
ctgtggttgtggatgggaggctc

SEQ ID NO: 3825009 - DNA, 18 bp, Homo sapiens
ctgtgtaacagctccttg

SEQ ID NO: 3825010 - DNA, 13 bp, Homo sapiens
ctgtgtagccagt

SEQ ID NO: 3825011 - DNA, 13 bp, Homo sapiens
ctgtgtgagagag

SEQ ID NO: 3825012 - DNA, 18 bp, Homo sapiens
ctgtgtgcagtggagctg

SEQ ID NO: 3825013 - DNA, 12 bp, Homo sapiens
ctgtgtgctact

SEQ ID NO: 3825014 - DNA, 15 bp, Homo sapiens
ctgtgtgctactaac

SEQ ID NO: 3825015 - DNA, 16 bp, Homo sapiens
ctgtgtttttgccact

SEQ ID NO: 3825016 - DNA, 19 bp, Homo sapiens
ctgttacctctgacatcaa

SEQ ID NO: 3825017 - DNA, 11 bp, Homo sapiens
ctgttctgagc

SEQ ID NO: 3825018 - DNA, 14 bp, Homo sapiens
ctgttgcaggcaaa

SEQ ID NO: 3825019 - DNA, 21 bp, Homo sapiens
ctgtttggaaatggggagctg

SEQ ID NO: 3825020 - DNA, 21 bp, Homo sapiens
cttaaaaccaaagagggcttc

SEQ ID NO: 3825021 - DNA, 21 bp, Homo sapiens
cttaattgctttcctgcctcc

SEQ ID NO: 3825022 - DNA, 13 bp, Homo sapiens
cttacatttcctg

SEQ ID NO: 3825023 - DNA, 16 bp, Homo sapiens
cttaccgagagccaaa

SEQ ID NO: 3825024 - DNA, 20 bp, Homo sapiens
cttactttcctttccccagc

SEQ ID NO: 3825025 - DNA, 21 bp, Homo sapiens
cttactttcctttccccagcc

SEQ ID NO: 3825026 - DNA, 14 bp, Homo sapiens
cttagaaagcaggg

SEQ ID NO: 3825027 - DNA, 17 bp, Homo sapiens
cttagagccaggcacac

SEQ ID NO: 3825028 - DNA, 15 bp, Homo sapiens
cttagcctgggcctc

SEQ ID NO: 3825029 - DNA, 18 bp, Homo sapiens
cttagcctgggcctcctc

SEQ ID NO: 3825030 - DNA, 17 bp, Homo sapiens
cttagcttcactcagct

SEQ ID NO: 3825031 - DNA, 21 bp, Homo sapiens
cttcaccaaagatctgctcct

SEQ ID NO: 3825032 - DNA, 13 bp, Homo sapiens
cttcaccaaatat

SEQ ID NO: 3825033 - DNA, 16 bp, Homo sapiens
cttcaggagggagcat

SEQ ID NO: 3825034 - DNA, 14 bp, Homo sapiens
cttcagttttactg

SEQ ID NO: 3825035 - DNA, 19 bp, Homo sapiens
cttcagttttactgcattt

SEQ ID NO: 3825036 - DNA, 20 bp, Homo sapiens
cttcagttttactgcatttt

SEQ ID NO: 3825037 - DNA, 12 bp, Homo sapiens
cttcataatttt

SEQ ID NO: 3825038 - DNA, 13 bp, Homo sapiens
cttccaggaaact

SEQ ID NO: 3825039 - DNA, 17 bp, Homo sapiens
cttccatcccaggacac

SEQ ID NO: 3825040 - DNA, 22 bp, Homo sapiens
cttccatcccaggacaccacac

SEQ ID NO: 3825041 - DNA, 17 bp, Homo sapiens
cttccccgatgtgagcc

SEQ ID NO: 3825042 - DNA, 22 bp, Homo sapiens
cttccccgatgtgagccgcctc

SEQ ID NO: 3825043 - DNA, 22 bp, Homo sapiens
cttccctagctttagaccctgg

SEQ ID NO: 3825044 - DNA, 20 bp, Homo sapiens
cttccctaggcacctctgtg

SEQ ID NO: 3825045 - DNA, 17 bp, Homo sapiens
cttccctttccttcccc

SEQ ID NO: 3825046 - DNA, 20 bp, Homo sapiens
cttccggttggaggctctca

SEQ ID NO: 3825047 - DNA, 20 bp, Homo sapiens
cttcctaggcattacccaaa

SEQ ID NO: 3825048 - DNA, 12 bp, Homo sapiens
cttcctctccca

SEQ ID NO: 3825049 - DNA, 20 bp, Homo sapiens
cttcctggctaggactgtgg

SEQ ID NO: 3825050 - DNA, 11 bp, Homo sapiens
cttccttctgc

SEQ ID NO: 3825051 - DNA, 16 bp, Homo sapiens
cttccttttccctgct

SEQ ID NO: 3825052 - DNA, 14 bp, Homo sapiens
cttctcatgctatt

SEQ ID NO: 3825053 - DNA, 16 bp, Homo sapiens
cttctcatgctatttc

SEQ ID NO: 3825054 - DNA, 22 bp, Homo sapiens
cttctccatcctttctgcctct

SEQ ID NO: 3825055 - DNA, 12 bp, Homo sapiens
cttctccgccag

SEQ ID NO: 3825056 - DNA, 13 bp, Homo sapiens
cttctccgccagc

SEQ ID NO: 3825057 - DNA, 17 bp, Homo sapiens
cttctccgccagcctcc

SEQ ID NO: 3825058 - DNA, 21 bp, Homo sapiens
cttctccgccagcctcctctg

SEQ ID NO: 3825059 - DNA, 23 bp, Homo sapiens
cttctccgccagcctcctctgga

SEQ ID NO: 3825060 - DNA, 15 bp, Homo sapiens
cttctctcctcccca

SEQ ID NO: 3825061 - DNA, 12 bp, Homo sapiens
cttctctctgag

SEQ ID NO: 3825062 - DNA, 15 bp, Homo sapiens
cttctctctgagctg

SEQ ID NO: 3825063 - DNA, 18 bp, Homo sapiens
cttctgcttttctgccct

SEQ ID NO: 3825064 - DNA, 21 bp, Homo sapiens
cttctgcttttctgccctggc

SEQ ID NO: 3825065 - DNA, 23 bp, Homo sapiens
cttctgcttttctgccctggctg

SEQ ID NO: 3825066 - DNA, 16 bp, Homo sapiens
cttctggattcttggc

SEQ ID NO: 3825067 - DNA, 17 bp, Homo sapiens
cttctggattcttggcc

SEQ ID NO: 3825068 - DNA, 15 bp, Homo sapiens
cttctgtgtagacat

SEQ ID NO: 3825069 - DNA, 12 bp, Homo sapiens
cttgaaaattaa

SEQ ID NO: 3825070 - DNA, 17 bp, Homo sapiens
cttgaagattcaggctt

SEQ ID NO: 3825071 - DNA, 15 bp, Homo sapiens
cttgaagccaaagaa

SEQ ID NO: 3825072 - DNA, 21 bp, Homo sapiens
cttgaatatgtgccttctaga

SEQ ID NO: 3825073 - DNA, 15 bp, Homo sapiens
cttgaggtcaggagt

SEQ ID NO: 3825074 - DNA, 22 bp, Homo sapiens
cttgatctgctcagccctggag

SEQ ID NO: 3825075 - DNA, 10 bp, Homo sapiens
cttgcatttt

SEQ ID NO: 3825076 - DNA, 16 bp, Homo sapiens
cttgcatttttttcct

SEQ ID NO: 3825077 - DNA, 21 bp, Homo sapiens
cttgccaacctgtaataaata

SEQ ID NO: 3825078 - DNA, 23 bp, Homo sapiens
cttgccaacctgtaataaatatg

SEQ ID NO: 3825079 - DNA, 18 bp, Homo sapiens
cttgccatttctttatat

SEQ ID NO: 3825080 - DNA, 17 bp, Homo sapiens
cttgccctgggctgcct

SEQ ID NO: 3825081 - DNA, 18 bp, Homo sapiens
cttgccctgggctgcctc

SEQ ID NO: 3825082 - DNA, 23 bp, Homo sapiens
cttgccgaaccaggagctgctca

SEQ ID NO: 3825083 - DNA, 22 bp, Homo sapiens
cttgcctcagggccaagccggc

SEQ ID NO: 3825084 - DNA, 22 bp, Homo sapiens
gcaggggctctggagagaaaca

SEQ ID NO: 3825085 - DNA, 13 bp, Homo sapiens
gcaggggttccca

SEQ ID NO: 3825086 - DNA, 22 bp, Homo sapiens
gcagtcctgagtgggtgttgca

SEQ ID NO: 3825087 - DNA, 15 bp, Homo sapiens
gcagtgagtgagcct

SEQ ID NO: 3825088 - DNA, 18 bp, Homo sapiens
gcagtgagtgagcctggc

SEQ ID NO: 3825089 - DNA, 21 bp, Homo sapiens
gcagtgagtgagcctggctct

SEQ ID NO: 3825090 - DNA, 14 bp, Homo sapiens
gcagtggagctggc

SEQ ID NO: 3825091 - DNA, 24 bp, Homo sapiens
gcagtggttttggcaaacgctaaa

SEQ ID NO: 3825092 - DNA, 15 bp, Homo sapiens
gcagttctctcgaat

SEQ ID NO: 3825093 - DNA, 14 bp, Homo sapiens
gcagtttttgaaag

SEQ ID NO: 3825094 - DNA, 15 bp, Homo sapiens
gcatatgtgttggct

SEQ ID NO: 3825095 - DNA, 18 bp, Homo sapiens
gcatatgtgttggcttgt

SEQ ID NO: 3825096 - DNA, 13 bp, Homo sapiens
gcatcccctgcct

SEQ ID NO: 3825097 - DNA, 14 bp, Homo sapiens
gcatcccctgcctc

SEQ ID NO: 3825098 - DNA, 16 bp, Homo sapiens
gcatcccctgcctcca

SEQ ID NO: 3825099 - DNA, 14 bp, Homo sapiens
gcatctatctcatc

SEQ ID NO: 3825100 - DNA, 18 bp, Homo sapiens
gcatgagctattgctaga

SEQ ID NO: 3825101 - DNA, 17 bp, Homo sapiens
gcattacccaaaagcaa

SEQ ID NO: 3825102 - DNA, 18 bp, Homo sapiens
gcattcctctaatgttgt

SEQ ID NO: 3825103 - DNA, 15 bp, Homo sapiens
gcattgttttgcatc

SEQ ID NO: 3825104 - DNA, 20 bp, Homo sapiens
gcatttggctggagcccggt

SEQ ID NO: 3825105 - DNA, 17 bp, Homo sapiens
gcatttgtaaaaagtag

SEQ ID NO: 3825106 - DNA, 23 bp, Homo sapiens
gcatttgtctattctccagctga

SEQ ID NO: 3825107 - DNA, 14 bp, Homo sapiens
gcattttaagcata

SEQ ID NO: 3825108 - DNA, 15 bp, Homo sapiens
gcattttaagcataa

SEQ ID NO: 3825109 - DNA, 17 bp, Homo sapiens
gcattttgggttgttta

SEQ ID NO: 3825110 - DNA, 15 bp, Homo sapiens
gcattttttaaaaca

SEQ ID NO: 3825111 - DNA, 17 bp, Homo sapiens
gcattttttaaaacaag

SEQ ID NO: 3825112 - DNA, 18 bp, Homo sapiens
gcattttttaaaacaaga

SEQ ID NO: 3825113 - DNA, 14 bp, Homo sapiens
gcatttttttcctt

SEQ ID NO: 3825114 - DNA, 14 bp, Homo sapiens
gccaaaaccaaatt

SEQ ID NO: 3825115 - DNA, 15 bp, Homo sapiens
gccaaaaccaaattg

SEQ ID NO: 3825116 - DNA, 23 bp, Homo sapiens
gccaaacaacaacaaaaacaaaa

SEQ ID NO: 3825117 - DNA, 11 bp, Homo sapiens
gccaaactgtc

SEQ ID NO: 3825118 - DNA, 16 bp, Homo sapiens
gccaacaacttctcca

SEQ ID NO: 3825119 - DNA, 23 bp, Homo sapiens
gccaacatcatatacctcttgaa

SEQ ID NO: 3825120 - DNA, 13 bp, Homo sapiens
gccaactccatgt

SEQ ID NO: 3825121 - DNA, 15 bp, Homo sapiens
gccaactccatgtca

SEQ ID NO: 3825122 - DNA, 22 bp, Homo sapiens
gccaactccatgtcagggaagt

SEQ ID NO: 3825123 - DNA, 13 bp, Homo sapiens
gccaagccctttg

SEQ ID NO: 3825124 - DNA, 17 bp, Homo sapiens
gccaagctggggcaagg

SEQ ID NO: 3825125 - DNA, 22 bp, Homo sapiens
gccaagctggggcaaggggcag

SEQ ID NO: 3825126 - DNA, 16 bp, Homo sapiens
gccaagggacacagga

SEQ ID NO: 3825127 - DNA, 13 bp, Homo sapiens
gccaagtggggtg

SEQ ID NO: 3825128 - DNA, 23 bp, Homo sapiens
gccaagtggggtgctgggaggag

SEQ ID NO: 3825129 - DNA, 15 bp, Homo sapiens
gccacacagcccaga

SEQ ID NO: 3825130 - DNA, 18 bp, Homo sapiens
gccacacagcccagaagg

SEQ ID NO: 3825131 - DNA, 20 bp, Homo sapiens
gccacacagcccagaaggcc

SEQ ID NO: 3825132 - DNA, 13 bp, Homo sapiens
gccacacagtggc

SEQ ID NO: 3825133 - DNA, 18 bp, Homo sapiens
gccacacagtggccgggg

SEQ ID NO: 3825134 - DNA, 18 bp, Homo sapiens
gccacaccccagactcca

SEQ ID NO: 3825135 - DNA, 23 bp, Homo sapiens
gccacatcttgatctgctcagcc

SEQ ID NO: 3825136 - DNA, 13 bp, Homo sapiens
gccaccactcctg

SEQ ID NO: 3825137 - DNA, 17 bp, Homo sapiens
gccaccactcctgcctg

SEQ ID NO: 3825138 - DNA, 12 bp, Homo sapiens
gccaccagagac

SEQ ID NO: 3825139 - DNA, 23 bp, Homo sapiens
gccaccagagaccgtcctcaccc

SEQ ID NO: 3825140 - DNA, 19 bp, Homo sapiens
gccacctccccactccagc

SEQ ID NO: 3825141 - DNA, 18 bp, Homo sapiens
gccacgatttagatttaa

SEQ ID NO: 3825142 - DNA, 16 bp, Homo sapiens
gccagaaaaggcagcc

SEQ ID NO: 3825143 - DNA, 22 bp, Homo sapiens
gccagaaaaggcagccagatcc

SEQ ID NO: 3825144 - DNA, 23 bp, Homo sapiens
gccagaaaaggcagccagatccc

SEQ ID NO: 3825145 - DNA, 15 bp, Homo sapiens
gccagaggccaggat

SEQ ID NO: 3825146 - DNA, 19 bp, Homo sapiens
gccagatccccagggcagc

SEQ ID NO: 3825147 - DNA, 23 bp, Homo sapiens
gccagatccccagggcagcctcg

SEQ ID NO: 3825148 - DNA, 13 bp, Homo sapiens
gccagccccaccc

SEQ ID NO: 3825149 - DNA, 20 bp, Homo sapiens
gccagccccacccccagcca

SEQ ID NO: 3825150 - DNA, 20 bp, Homo sapiens
gccagcctccgagagggaga

SEQ ID NO: 3825151 - DNA, 21 bp, Homo sapiens
gccagcctccgagagggagag

SEQ ID NO: 3825152 - DNA, 15 bp, Homo sapiens
gccagcctcctctgg

SEQ ID NO: 3825153 - DNA, 21 bp, Homo sapiens
gccagccttcttccatcccag

SEQ ID NO: 3825154 - DNA, 16 bp, Homo sapiens
gccagctgatgactca

SEQ ID NO: 3825155 - DNA, 15 bp, Homo sapiens
gccaggactgagccc

SEQ ID NO: 3825156 - DNA, 19 bp, Homo sapiens
gccaggactgagccccgca

SEQ ID NO: 3825157 - DNA, 23 bp, Homo sapiens
gccaggcacacactgtgctttct

SEQ ID NO: 3825158 - DNA, 16 bp, Homo sapiens
gccaggcaggggtggg

SEQ ID NO: 3825159 - DNA, 13 bp, Homo sapiens
gccaggccagcct

SEQ ID NO: 3825160 - DNA, 19 bp, Homo sapiens
gccaggccagcctccgaga

SEQ ID NO: 3825161 - DNA, 15 bp, Homo sapiens
gccaggctgggaggc

SEQ ID NO: 3825162 - DNA, 13 bp, Homo sapiens
gccaggctggtct

SEQ ID NO: 3825163 - DNA, 16 bp, Homo sapiens
gccagggaagacagag

SEQ ID NO: 3825164 - DNA, 17 bp, Homo sapiens
gccagggaagacagagc

SEQ ID NO: 3825165 - DNA, 22 bp, Homo sapiens
gccagggaagacagagcaggct

SEQ ID NO: 3825166 - DNA, 19 bp, Homo sapiens
gccatagaatggcacatgt

SEQ ID NO: 3825167 - DNA, 13 bp, Homo sapiens
gccatagagcctg

SEQ ID NO: 3825168 - DNA, 23 bp, Homo sapiens
gccatagagcctgaaatcatctt

SEQ ID NO: 3825169 - DNA, 21 bp, Homo sapiens
gccatccctcgtggtccccaa

SEQ ID NO: 3825170 - DNA, 22 bp, Homo sapiens
gccatcgtaaactgacacagtg

SEQ ID NO: 3825171 - DNA, 13 bp, Homo sapiens
gccatggctgctt

SEQ ID NO: 3825172 - DNA, 17 bp, Homo sapiens
gccatggggcagcctcc

SEQ ID NO: 3825173 - DNA, 18 bp, Homo sapiens
gccatggggcagcctcca

SEQ ID NO: 3825174 - DNA, 16 bp, Homo sapiens
gccatgttcaaaagaa

SEQ ID NO: 3825175 - DNA, 18 bp, Homo sapiens
gccatgttccaataaaca

SEQ ID NO: 3825176 - DNA, 19 bp, Homo sapiens
gccatgttccaataaacag

SEQ ID NO: 3825177 - DNA, 20 bp, Homo sapiens
gccatgttccaataaacagg

SEQ ID NO: 3825178 - DNA, 17 bp, Homo sapiens
gcccacaccatctggcc

SEQ ID NO: 3825179 - DNA, 19 bp, Homo sapiens
gcccacaccatctggccca

SEQ ID NO: 3825180 - DNA, 21 bp, Homo sapiens
gcccacaccatctggcccagg

SEQ ID NO: 3825181 - DNA, 15 bp, Homo sapiens
gcccaccccctgccc

SEQ ID NO: 3825182 - DNA, 17 bp, Homo sapiens
gcccaccccctgccctg

SEQ ID NO: 3825183 - DNA, 18 bp, Homo sapiens
gcccaccccctgccctgc

SEQ ID NO: 3825184 - DNA, 19 bp, Homo sapiens
gcccaccccctgccctgca

SEQ ID NO: 3825185 - DNA, 12 bp, Homo sapiens
gcccacctcccc

SEQ ID NO: 3825186 - DNA, 15 bp, Homo sapiens
gcccacttctgtgta

SEQ ID NO: 3825187 - DNA, 15 bp, Homo sapiens
gcccagaaggccaga

SEQ ID NO: 3825188 - DNA, 20 bp, Homo sapiens
gcccagaaggccagaaaagg

SEQ ID NO: 3825189 - DNA, 17 bp, Homo sapiens
gcccagagttgggggct

SEQ ID NO: 3825190 - DNA, 18 bp, Homo sapiens
gcccagcccaggcctggt

SEQ ID NO: 3825191 - DNA, 11 bp, Homo sapiens
gcccagctgcc

SEQ ID NO: 3825192 - DNA, 13 bp, Homo sapiens
gcccagctgccag

SEQ ID NO: 3825193 - DNA, 15 bp, Homo sapiens
gcccaggagagagaa

SEQ ID NO: 3825194 - DNA, 14 bp, Homo sapiens
gcccaggcctggtg

SEQ ID NO: 3825195 - DNA, 15 bp, Homo sapiens
gcccaggcctggtgg

SEQ ID NO: 3825196 - DNA, 22 bp, Homo sapiens
gcccaggcgggagcggtggccc

SEQ ID NO: 3825197 - DNA, 12 bp, Homo sapiens
gcccaggctggc

SEQ ID NO: 3825198 - DNA, 14 bp, Homo sapiens
gcccaggctggccc

SEQ ID NO: 3825199 - DNA, 16 bp, Homo sapiens
gcccagggagactccg

SEQ ID NO: 3825200 - DNA, 19 bp, Homo sapiens
gcccatccctgcctggtca

SEQ ID NO: 3825201 - DNA, 14 bp, Homo sapiens
gcccattctacttg

SEQ ID NO: 3825202 - DNA, 15 bp, Homo sapiens
gcccattctacttgc

SEQ ID NO: 3825203 - DNA, 20 bp, Homo sapiens
gcccattctacttgctctgg

SEQ ID NO: 3825204 - DNA, 16 bp, Homo sapiens
gccccactgggagagt

SEQ ID NO: 3825205 - DNA, 22 bp, Homo sapiens
gccccagagcagggtgttggga

SEQ ID NO: 3825206 - DNA, 18 bp, Homo sapiens
gccccaggagaagggaca

SEQ ID NO: 3825207 - DNA, 17 bp, Homo sapiens
gccccatgctggagcct

SEQ ID NO: 3825208 - DNA, 20 bp, Homo sapiens
gccccatgctggagcctgtg

SEQ ID NO: 3825209 - DNA, 22 bp, Homo sapiens
gcccccaatttcccagactaga

SEQ ID NO: 3825210 - DNA, 11 bp, Homo sapiens
gcccccacacc

SEQ ID NO: 3825211 - DNA, 17 bp, Homo sapiens
gcccccaccccggggac

SEQ ID NO: 3825212 - DNA, 20 bp, Homo sapiens
gcccccagccccggggtgag

SEQ ID NO: 3825213 - DNA, 18 bp, Homo sapiens
gcccccagtccccacccc

SEQ ID NO: 3825214 - DNA, 20 bp, Homo sapiens
gcccccagtccccacccctg

SEQ ID NO: 3825215 - DNA, 21 bp, Homo sapiens
gcccccagtccccacccctgc

SEQ ID NO: 3825216 - DNA, 15 bp, Homo sapiens
ggagcggtggccctg

SEQ ID NO: 3825217 - DNA, 18 bp, Homo sapiens
ggagctgctggccatggc

SEQ ID NO: 3825218 - DNA, 19 bp, Homo sapiens
ggagctgctggccatggct

SEQ ID NO: 3825219 - DNA, 16 bp, Homo sapiens
ggagctggcctaggtg

SEQ ID NO: 3825220 - DNA, 17 bp, Homo sapiens
ggaggaagcagaataaa

SEQ ID NO: 3825221 - DNA, 19 bp, Homo sapiens
ggaggaagcagaataaagc

SEQ ID NO: 3825222 - DNA, 13 bp, Homo sapiens
ggaggaaggcaag

SEQ ID NO: 3825223 - DNA, 12 bp, Homo sapiens
ggaggagggaga

SEQ ID NO: 3825224 - DNA, 13 bp, Homo sapiens
ggaggagggagag

SEQ ID NO: 3825225 - DNA, 17 bp, Homo sapiens
ggaggagttagccaaac

SEQ ID NO: 3825226 - DNA, 20 bp, Homo sapiens
ggaggctcctggtggggcag

SEQ ID NO: 3825227 - DNA, 15 bp, Homo sapiens
ggaggcttcctgcgt

SEQ ID NO: 3825228 - DNA, 13 bp, Homo sapiens
ggagggctttgtg

SEQ ID NO: 3825229 - DNA, 17 bp, Homo sapiens
ggaggggcgcccacctc

SEQ ID NO: 3825230 - DNA, 22 bp, Homo sapiens
ggaggggcgcccacctccccac

SEQ ID NO: 3825231 - DNA, 15 bp, Homo sapiens
ggaggggggagccag

SEQ ID NO: 3825232 - DNA, 17 bp, Homo sapiens
ggaggggtgtggcagtg

SEQ ID NO: 3825233 - DNA, 19 bp, Homo sapiens
ggaggtgaaaagggcagag

SEQ ID NO: 3825234 - DNA, 20 bp, Homo sapiens
ggaggtggaagaagggagaa

SEQ ID NO: 3825235 - DNA, 13 bp, Homo sapiens
ggaggttgcagtg

SEQ ID NO: 3825236 - DNA, 16 bp, Homo sapiens
ggaggttgtgtcactg

SEQ ID NO: 3825237 - DNA, 22 bp, Homo sapiens
ggagtcttatatcccaggtgag

SEQ ID NO: 3825238 - DNA, 13 bp, Homo sapiens
ggagtggccctga

SEQ ID NO: 3825239 - DNA, 19 bp, Homo sapiens
ggagtggccctgatccagg

SEQ ID NO: 3825240 - DNA, 12 bp, Homo sapiens
ggagtgtggcct

SEQ ID NO: 3825241 - DNA, 14 bp, Homo sapiens
ggagtgtggcctgg

SEQ ID NO: 3825242 - DNA, 12 bp, Homo sapiens
ggagttagccaa

SEQ ID NO: 3825243 - DNA, 16 bp, Homo sapiens
ggagttagccaaacaa

SEQ ID NO: 3825244 - DNA, 15 bp, Homo sapiens
ggatactgcagggcc

SEQ ID NO: 3825245 - DNA, 20 bp, Homo sapiens
ggatcacgaggtcaggagat

SEQ ID NO: 3825246 - DNA, 12 bp, Homo sapiens
ggatcagcaggg

SEQ ID NO: 3825247 - DNA, 12 bp, Homo sapiens
ggatccatcctg

SEQ ID NO: 3825248 - DNA, 14 bp, Homo sapiens
ggatcggcttcctc

SEQ ID NO: 3825249 - DNA, 20 bp, Homo sapiens
ggatgcctgagccccctgag

SEQ ID NO: 3825250 - DNA, 15 bp, Homo sapiens
ggatgggaggctcct

SEQ ID NO: 3825251 - DNA, 16 bp, Homo sapiens
ggatgggaggctcctg

SEQ ID NO: 3825252 - DNA, 17 bp, Homo sapiens
ggatgggaggctcctgg

SEQ ID NO: 3825253 - DNA, 23 bp, Homo sapiens
ggattggatgattgttcataata

SEQ ID NO: 3825254 - DNA, 16 bp, Homo sapiens
ggcaagagggggtgga

SEQ ID NO: 3825255 - DNA, 17 bp, Homo sapiens
ggcaagaggtgcctggg

SEQ ID NO: 3825256 - DNA, 20 bp, Homo sapiens
ggcaagaggtgcctgggagg

SEQ ID NO: 3825257 - DNA, 12 bp, Homo sapiens
ggcaaggatggt

SEQ ID NO: 3825258 - DNA, 14 bp, Homo sapiens
ggcaaggatggtgg

SEQ ID NO: 3825259 - DNA, 16 bp, Homo sapiens
ggcaaggggcagccag

SEQ ID NO: 3825260 - DNA, 18 bp, Homo sapiens
ggcacaaaatgtgacatc

SEQ ID NO: 3825261 - DNA, 21 bp, Homo sapiens
ggcacacactgtgctttctat

SEQ ID NO: 3825262 - DNA, 13 bp, Homo sapiens
ggcacagtggctc

SEQ ID NO: 3825263 - DNA, 20 bp, Homo sapiens
ggcacatgtcattgcccact

SEQ ID NO: 3825264 - DNA, 21 bp, Homo sapiens
ggcaccaaaccctgtcctccc

SEQ ID NO: 3825265 - DNA, 16 bp, Homo sapiens
ggcaccccaggcagct

SEQ ID NO: 3825266 - DNA, 20 bp, Homo sapiens
ggcaccccaggcagctcctg

SEQ ID NO: 3825267 - DNA, 21 bp, Homo sapiens
ggcactagcctttggctctgg

SEQ ID NO: 3825268 - DNA, 14 bp, Homo sapiens
ggcagaaaggctgc

SEQ ID NO: 3825269 - DNA, 14 bp, Homo sapiens
ggcagaagaagctg

SEQ ID NO: 3825270 - DNA, 19 bp, Homo sapiens
ggcagaagaagctgggagg

SEQ ID NO: 3825271 - DNA, 21 bp, Homo sapiens
ggcagaagaagctgggaggga

SEQ ID NO: 3825272 - DNA, 16 bp, Homo sapiens
ggcagagacagtgggc

SEQ ID NO: 3825273 - DNA, 14 bp, Homo sapiens
ggcagaggcaagga

SEQ ID NO: 3825274 - DNA, 19 bp, Homo sapiens
ggcagatgatttgggcaga

SEQ ID NO: 3825275 - DNA, 18 bp, Homo sapiens
ggcagcctccagtctgct

SEQ ID NO: 3825276 - DNA, 15 bp, Homo sapiens
ggcagctcctgtttg

SEQ ID NO: 3825277 - DNA, 16 bp, Homo sapiens
ggcaggggtgggggtg

SEQ ID NO: 3825278 - DNA, 16 bp, Homo sapiens
ggcagtgtgcggagct

SEQ ID NO: 3825279 - DNA, 22 bp, Homo sapiens
ggcatagaggcttctccgccag

SEQ ID NO: 3825280 - DNA, 12 bp, Homo sapiens
ggcatcacctgc

SEQ ID NO: 3825281 - DNA, 15 bp, Homo sapiens
ggcatgccccggcca

SEQ ID NO: 3825282 - DNA, 22 bp, Homo sapiens
ggcatgccccggccacctctgc

SEQ ID NO: 3825283 - DNA, 23 bp, Homo sapiens
ggcattccagctcctccgtgctt

SEQ ID NO: 3825284 - DNA, 23 bp, Homo sapiens
ggcattcctctaatgttgtgtgt

SEQ ID NO: 3825285 - DNA, 21 bp, Homo sapiens
ggccaagccggcccaacccaa

SEQ ID NO: 3825286 - DNA, 23 bp, Homo sapiens
ggccaagccggcccaacccaacc

SEQ ID NO: 3825287 - DNA, 13 bp, Homo sapiens
ggccacaccccag

SEQ ID NO: 3825288 - DNA, 15 bp, Homo sapiens
ggccacaccccagac

SEQ ID NO: 3825289 - DNA, 12 bp, Homo sapiens
ggccacctctgc

SEQ ID NO: 3825290 - DNA, 20 bp, Homo sapiens
ggccagaaaaggcagccaga

SEQ ID NO: 3825291 - DNA, 23 bp, Homo sapiens
ggccagaaaaggcagccagatcc

SEQ ID NO: 3825292 - DNA, 16 bp, Homo sapiens
ggccagcacagctgag

SEQ ID NO: 3825293 - DNA, 20 bp, Homo sapiens
ggccagccccacccccagcc

SEQ ID NO: 3825294 - DNA, 21 bp, Homo sapiens
ggccagccccacccccagcca

SEQ ID NO: 3825295 - DNA, 23 bp, Homo sapiens
ggccagccccacccccagccagg

SEQ ID NO: 3825296 - DNA, 13 bp, Homo sapiens
ggccaggatgcct

SEQ ID NO: 3825297 - DNA, 18 bp, Homo sapiens
ggccaggatgcctgagcc

SEQ ID NO: 3825298 - DNA, 23 bp, Homo sapiens
ggccaggatgcctgagccccctg

SEQ ID NO: 3825299 - DNA, 14 bp, Homo sapiens
ggccatggctgctt

SEQ ID NO: 3825300 - DNA, 22 bp, Homo sapiens
ggccatggggcagcctccagtc

SEQ ID NO: 3825301 - DNA, 23 bp, Homo sapiens
ggcccaaattatcaagctaataa

SEQ ID NO: 3825302 - DNA, 15 bp, Homo sapiens
ggcccaccagagctg

SEQ ID NO: 3825303 - DNA, 12 bp, Homo sapiens
ggcccaggctgg

SEQ ID NO: 3825304 - DNA, 22 bp, Homo sapiens
ggcccattctacttgctctgga

SEQ ID NO: 3825305 - DNA, 14 bp, Homo sapiens
ggcccccacccacc

SEQ ID NO: 3825306 - DNA, 15 bp, Homo sapiens
ggcccccacccacct

SEQ ID NO: 3825307 - DNA, 17 bp, Homo sapiens
ggcccccacccaccttc

SEQ ID NO: 3825308 - DNA, 13 bp, Homo sapiens
ggcccccagcacc

SEQ ID NO: 3825309 - DNA, 13 bp, Homo sapiens
ggcccccatcttg

SEQ ID NO: 3825310 - DNA, 23 bp, Homo sapiens
ggccccgtctcctgagggtcctg

SEQ ID NO: 3825311 - DNA, 14 bp, Homo sapiens
ggcccgggtcccac

SEQ ID NO: 3825312 - DNA, 13 bp, Homo sapiens
ggccctacagccc

SEQ ID NO: 3825313 - DNA, 12 bp, Homo sapiens
ggccctcctggg

SEQ ID NO: 3825314 - DNA, 20 bp, Homo sapiens
ggccctctgaggctcagccc

SEQ ID NO: 3825315 - DNA, 14 bp, Homo sapiens
ggccctctggggct

SEQ ID NO: 3825316 - DNA, 20 bp, Homo sapiens
ggccctctggggctcagccc

SEQ ID NO: 3825317 - DNA, 12 bp, Homo sapiens
ggccctgaggaa

SEQ ID NO: 3825318 - DNA, 13 bp, Homo sapiens
ggccctgatccag

SEQ ID NO: 3825319 - DNA, 17 bp, Homo sapiens
ggccctgatccaggaaa

SEQ ID NO: 3825320 - DNA, 21 bp, Homo sapiens
ggccctgtccctcccacctct

SEQ ID NO: 3825321 - DNA, 16 bp, Homo sapiens
ggcccttcctggctag

SEQ ID NO: 3825322 - DNA, 16 bp, Homo sapiens
ggccctttcctcaggc

SEQ ID NO: 3825323 - DNA, 13 bp, Homo sapiens
ggccgagcccaca

SEQ ID NO: 3825324 - DNA, 21 bp, Homo sapiens
ggccgctgctgaccagcactg

SEQ ID NO: 3825325 - DNA, 16 bp, Homo sapiens
ggccggggctgaagcc

SEQ ID NO: 3825326 - DNA, 16 bp, Homo sapiens
ggcctaggtgggagcc

SEQ ID NO: 3825327 - DNA, 23 bp, Homo sapiens
ggcctcaagaaacaatgtctggg

SEQ ID NO: 3825328 - DNA, 22 bp, Homo sapiens
ggcctccttcaccaaagatctg

SEQ ID NO: 3825329 - DNA, 23 bp, Homo sapiens
ggcctccttcaccaaagatctgc

SEQ ID NO: 3825330 - DNA, 21 bp, Homo sapiens
ggcctgaggtctggctgcttg

SEQ ID NO: 3825331 - DNA, 16 bp, Homo sapiens
ggcctgcacctctcca

SEQ ID NO: 3825332 - DNA, 10 bp, Homo sapiens
ggcctgctgt

SEQ ID NO: 3825333 - DNA, 12 bp, Homo sapiens
ggcctggatcca

SEQ ID NO: 3825334 - DNA, 17 bp, Homo sapiens
ggccttgccagcgagca

SEQ ID NO: 3825335 - DNA, 17 bp, Homo sapiens
ggcgcagctgaagcctg

SEQ ID NO: 3825336 - DNA, 19 bp, Homo sapiens
ggcgcagctgaagcctgga

SEQ ID NO: 3825337 - DNA, 12 bp, Homo sapiens
ggcgcccacctc

SEQ ID NO: 3825338 - DNA, 13 bp, Homo sapiens
ggcgcccagccca

SEQ ID NO: 3825339 - DNA, 14 bp, Homo sapiens
ggcgcccagcccag

SEQ ID NO: 3825340 - DNA, 15 bp, Homo sapiens
ggcgcccagcccagg

SEQ ID NO: 3825341 - DNA, 16 bp, Homo sapiens
ggcgcccagcccaggc

SEQ ID NO: 3825342 - DNA, 20 bp, Homo sapiens
ggcgcccagcccaggcctgg

SEQ ID NO: 3825343 - DNA, 21 bp, Homo sapiens
ggcgcccagcccaggcctggt

SEQ ID NO: 3825344 - DNA, 14 bp, Homo sapiens
ggcgctggctgcac

SEQ ID NO: 3825345 - DNA, 15 bp, Homo sapiens
ggcggctgagctcca

SEQ ID NO: 3825346 - DNA, 20 bp, Homo sapiens
ggcgggcggatcacgaggtc

SEQ ID NO: 3825347 - DNA, 20 bp, Homo sapiens
ggctagcttctgcttttctg

SEQ ID NO: 3825348 - DNA, 22 bp, Homo sapiens
ggctagcttctgcttttctgcc

SEQ ID NO: 3825349 - DNA, 17 bp, Homo sapiens
gtcccaggacctgagcc

SEQ ID NO: 3825350 - DNA, 20 bp, Homo sapiens
gtcccaggacctgagcctgg

SEQ ID NO: 3825351 - DNA, 11 bp, Homo sapiens
gtcccatctct

SEQ ID NO: 3825352 - DNA, 14 bp, Homo sapiens
gtccccacccctgc

SEQ ID NO: 3825353 - DNA, 15 bp, Homo sapiens
gtccccacccctgcc

SEQ ID NO: 3825354 - DNA, 14 bp, Homo sapiens
gtccccttcccttt

SEQ ID NO: 3825355 - DNA, 13 bp, Homo sapiens
gtccctcccacct

SEQ ID NO: 3825356 - DNA, 14 bp, Homo sapiens
gtccgtgggctggc

SEQ ID NO: 3825357 - DNA, 21 bp, Homo sapiens
gtcctcacccctgtcctcact

SEQ ID NO: 3825358 - DNA, 22 bp, Homo sapiens
gtcctcacccctgtcctcactg

SEQ ID NO: 3825359 - DNA, 20 bp, Homo sapiens
gtcctcactgctccctgaag

SEQ ID NO: 3825360 - DNA, 21 bp, Homo sapiens
gtcctcactgctccctgaagc

SEQ ID NO: 3825361 - DNA, 21 bp, Homo sapiens
gtcctcccacccctccccact

SEQ ID NO: 3825362 - DNA, 11 bp, Homo sapiens
gtcctcccctc

SEQ ID NO: 3825363 - DNA, 12 bp, Homo sapiens
gtcctcccctca

SEQ ID NO: 3825364 - DNA, 17 bp, Homo sapiens
gtcctcccctcacagcc

SEQ ID NO: 3825365 - DNA, 18 bp, Homo sapiens
gtcctcccctcacagcct

SEQ ID NO: 3825366 - DNA, 19 bp, Homo sapiens
gtcctcccctcacagcctc

SEQ ID NO: 3825367 - DNA, 23 bp, Homo sapiens
gtcctccggggctcagccctgag

SEQ ID NO: 3825368 - DNA, 21 bp, Homo sapiens
gtcctcctcacctcatgccca

SEQ ID NO: 3825369 - DNA, 21 bp, Homo sapiens
gtcctgctggtgaccggcctg

SEQ ID NO: 3825370 - DNA, 19 bp, Homo sapiens
gtccttagcctgggcctcc

SEQ ID NO: 3825371 - DNA, 21 bp, Homo sapiens
gtccttgtataaggagctttg

SEQ ID NO: 3825372 - DNA, 23 bp, Homo sapiens
gtcgagctggatgtcccacctct

SEQ ID NO: 3825373 - DNA, 20 bp, Homo sapiens
gtcggccacaccccagactc

SEQ ID NO: 3825374 - DNA, 21 bp, Homo sapiens
gtctagcctcattttgttttt

SEQ ID NO: 3825375 - DNA, 17 bp, Homo sapiens
gtctattctccagctga

SEQ ID NO: 3825376 - DNA, 22 bp, Homo sapiens
gtctcagcatgtagggcttctg

SEQ ID NO: 3825377 - DNA, 22 bp, Homo sapiens
gtctcaggctggtgggaggggc

SEQ ID NO: 3825378 - DNA, 18 bp, Homo sapiens
gtctcatctcctttgcta

SEQ ID NO: 3825379 - DNA, 16 bp, Homo sapiens
gtctctagaagtgcca

SEQ ID NO: 3825380 - DNA, 17 bp, Homo sapiens
gtctctggaatttgaaa

SEQ ID NO: 3825381 - DNA, 23 bp, Homo sapiens
gtctctttggggagagctggcag

SEQ ID NO: 3825382 - DNA, 21 bp, Homo sapiens
gtctgaaaaatgcctgctgct

SEQ ID NO: 3825383 - DNA, 23 bp, Homo sapiens
gtctgaaaaatgcctgctgctgc

SEQ ID NO: 3825384 - DNA, 14 bp, Homo sapiens
gtctgctcctccct

SEQ ID NO: 3825385 - DNA, 15 bp, Homo sapiens
gtctgctctcagctt

SEQ ID NO: 3825386 - DNA, 13 bp, Homo sapiens
gtctggggacagg

SEQ ID NO: 3825387 - DNA, 14 bp, Homo sapiens
gtctggggacaggc

SEQ ID NO: 3825388 - DNA, 16 bp, Homo sapiens
gtctggggacaggcct

SEQ ID NO: 3825389 - DNA, 13 bp, Homo sapiens
gtctgtcataata

SEQ ID NO: 3825390 - DNA, 20 bp, Homo sapiens
gtctgtcataatatttgaac

SEQ ID NO: 3825391 - DNA, 10 bp, Homo sapiens
gtctgtgtgc

SEQ ID NO: 3825392 - DNA, 11 bp, Homo sapiens
gtctgtgtgct

SEQ ID NO: 3825393 - DNA, 21 bp, Homo sapiens
gtctgtgtgctactaacagat

SEQ ID NO: 3825394 - DNA, 16 bp, Homo sapiens
gtctgttattgttttg

SEQ ID NO: 3825395 - DNA, 21 bp, Homo sapiens
gtcttgtgactagtgctgaag

SEQ ID NO: 3825396 - DNA, 22 bp, Homo sapiens
gtctttgtcatgcgtctctggc

SEQ ID NO: 3825397 - DNA, 15 bp, Homo sapiens
gtgaaactcatctca

SEQ ID NO: 3825398 - DNA, 17 bp, Homo sapiens
gtgaaatttcatgaaaa

SEQ ID NO: 3825399 - DNA, 21 bp, Homo sapiens
gtgaaatttcatgaaaacttt

SEQ ID NO: 3825400 - DNA, 15 bp, Homo sapiens
gtgaaattttaaatg

SEQ ID NO: 3825401 - DNA, 12 bp, Homo sapiens
gtgacccctgct

SEQ ID NO: 3825402 - DNA, 18 bp, Homo sapiens
gtgacccctgctttgccc

SEQ ID NO: 3825403 - DNA, 21 bp, Homo sapiens
gtgacccctgctttgccccac

SEQ ID NO: 3825404 - DNA, 13 bp, Homo sapiens
gtgaccgcttccc

SEQ ID NO: 3825405 - DNA, 14 bp, Homo sapiens
gtgacctataattt

SEQ ID NO: 3825406 - DNA, 21 bp, Homo sapiens
gtgactagtgctgaagcttat

SEQ ID NO: 3825407 - DNA, 16 bp, Homo sapiens
gtgacttaaggagaaa

SEQ ID NO: 3825408 - DNA, 13 bp, Homo sapiens
gtgagagaggacc

SEQ ID NO: 3825409 - DNA, 14 bp, Homo sapiens
gtgagagaggacct

SEQ ID NO: 3825410 - DNA, 15 bp, Homo sapiens
gtgagccgcctcgga

SEQ ID NO: 3825411 - DNA, 16 bp, Homo sapiens
gtgaggaatttgaagc

SEQ ID NO: 3825412 - DNA, 22 bp, Homo sapiens
gtgagggcaagaggtgcctggg

SEQ ID NO: 3825413 - DNA, 23 bp, Homo sapiens
gtgagggcaagaggtgcctggga

SEQ ID NO: 3825414 - DNA, 17 bp, Homo sapiens
gtgagtctgtcataata

SEQ ID NO: 3825415 - DNA, 13 bp, Homo sapiens
gtgagtgagcctg

SEQ ID NO: 3825416 - DNA, 14 bp, Homo sapiens
gtgagtgagcctgg

SEQ ID NO: 3825417 - DNA, 17 bp, Homo sapiens
gtgagtttgagctgcct

SEQ ID NO: 3825418 - DNA, 18 bp, Homo sapiens
gtgagtttgagctgcctt

SEQ ID NO: 3825419 - DNA, 21 bp, Homo sapiens
gtgatccgcccgcctctgcct

SEQ ID NO: 3825420 - DNA, 23 bp, Homo sapiens
gtgatccgcccgcctctgcctcc

SEQ ID NO: 3825421 - DNA, 12 bp, Homo sapiens
gtgatgtgttcg

SEQ ID NO: 3825422 - DNA, 20 bp, Homo sapiens
gtgcaatttgtttgtgcttc

SEQ ID NO: 3825423 - DNA, 21 bp, Homo sapiens
gtgcaccgttgggaccaatgc

SEQ ID NO: 3825424 - DNA, 13 bp, Homo sapiens
gtgcagggtcctc

SEQ ID NO: 3825425 - DNA, 21 bp, Homo sapiens
gtgccacagagggctgtgtct

SEQ ID NO: 3825426 - DNA, 17 bp, Homo sapiens
gtgccagcaaagcccca

SEQ ID NO: 3825427 - DNA, 18 bp, Homo sapiens
gtgccagcaaagccccat

SEQ ID NO: 3825428 - DNA, 19 bp, Homo sapiens
gtgccagcaaagccccatg

SEQ ID NO: 3825429 - DNA, 12 bp, Homo sapiens
gtgccaggctgg

SEQ ID NO: 3825430 - DNA, 13 bp, Homo sapiens
gtgccaggctggg

SEQ ID NO: 3825431 - DNA, 14 bp, Homo sapiens
gtgcccgccctggg

SEQ ID NO: 3825432 - DNA, 18 bp, Homo sapiens
gtgcccgccctgggctgg

SEQ ID NO: 3825433 - DNA, 17 bp, Homo sapiens
gtgcctgagaggcaggc

SEQ ID NO: 3825434 - DNA, 23 bp, Homo sapiens
gtgcctgggaggagtggccctga

SEQ ID NO: 3825435 - DNA, 16 bp, Homo sapiens
gtgctactaacagatt

SEQ ID NO: 3825436 - DNA, 21 bp, Homo sapiens
gtgctattctgtgaaactaat

SEQ ID NO: 3825437 - DNA, 14 bp, Homo sapiens
gtgctgaagcttat

SEQ ID NO: 3825438 - DNA, 19 bp, Homo sapiens
gtgctggaggtgggagcag

SEQ ID NO: 3825439 - DNA, 19 bp, Homo sapiens
gtgctgggaggagggagag

SEQ ID NO: 3825440 - DNA, 20 bp, Homo sapiens
gtgctgggattacaggtgta

SEQ ID NO: 3825441 - DNA, 12 bp, Homo sapiens
gtgctttataaa

SEQ ID NO: 3825442 - DNA, 18 bp, Homo sapiens
gtgcttttatagaggcta

SEQ ID NO: 3825443 - DNA, 15 bp, Homo sapiens
gtggaagaagggaga

SEQ ID NO: 3825444 - DNA, 18 bp, Homo sapiens
gtggaagaagggagaaga

SEQ ID NO: 3825445 - DNA, 20 bp, Homo sapiens
gtggaagaagggagaagaaa

SEQ ID NO: 3825446 - DNA, 15 bp, Homo sapiens
gtggaggcttcctgc

SEQ ID NO: 3825447 - DNA, 13 bp, Homo sapiens
gtggaggggagct

SEQ ID NO: 3825448 - DNA, 15 bp, Homo sapiens
gtggaggggagctgc

SEQ ID NO: 3825449 - DNA, 23 bp, Homo sapiens
gtggagggggaggggagaagcca

SEQ ID NO: 3825450 - DNA, 16 bp, Homo sapiens
gtggaggggtgtggca

SEQ ID NO: 3825451 - DNA, 23 bp, Homo sapiens
gtggaggggtgtggcagtggttt

SEQ ID NO: 3825452 - DNA, 16 bp, Homo sapiens
gtggatataaatatat

SEQ ID NO: 3825453 - DNA, 13 bp, Homo sapiens
gtggatgggaggc

SEQ ID NO: 3825454 - DNA, 15 bp, Homo sapiens
gtggatgggaggctc

SEQ ID NO: 3825455 - DNA, 20 bp, Homo sapiens
gtggatgggaggctcctggt

SEQ ID NO: 3825456 - DNA, 16 bp, Homo sapiens
gtggcagagacagtgg

SEQ ID NO: 3825457 - DNA, 19 bp, Homo sapiens
gtggcagagacagtgggca

SEQ ID NO: 3825458 - DNA, 17 bp, Homo sapiens
gtggccctgtccctccc

SEQ ID NO: 3825459 - DNA, 22 bp, Homo sapiens
gtggccctgtccctcccacctc

SEQ ID NO: 3825460 - DNA, 23 bp, Homo sapiens
gtggccctgtccctcccacctct

SEQ ID NO: 3825461 - DNA, 18 bp, Homo sapiens
gtggccggggctgaagcc

SEQ ID NO: 3825462 - DNA, 17 bp, Homo sapiens
gtggctcacgcctgtaa

SEQ ID NO: 3825463 - DNA, 12 bp, Homo sapiens
gtggctgccctc

SEQ ID NO: 3825464 - DNA, 22 bp, Homo sapiens
gtgggagcaggagattgagaag

SEQ ID NO: 3825465 - DNA, 21 bp, Homo sapiens
gtgggaggggcgcccacctcc

SEQ ID NO: 3825466 - DNA, 17 bp, Homo sapiens
gtgggcactaagggtgg

SEQ ID NO: 3825467 - DNA, 13 bp, Homo sapiens
gtggggcccccag

SEQ ID NO: 3825468 - DNA, 21 bp, Homo sapiens
gtggggcccccagcaccctct

SEQ ID NO: 3825469 - DNA, 15 bp, Homo sapiens
gtgggtgagatgctg

SEQ ID NO: 3825470 - DNA, 13 bp, Homo sapiens
gtggtccccaaca

SEQ ID NO: 3825471 - DNA, 16 bp, Homo sapiens
gtggttgtggatggga

SEQ ID NO: 3825472 - DNA, 13 bp, Homo sapiens
gtgtaacagctcc

SEQ ID NO: 3825473 - DNA, 14 bp, Homo sapiens
gtgtaacagctcct

SEQ ID NO: 3825474 - DNA, 18 bp, Homo sapiens
gtgtaacagttagccact

SEQ ID NO: 3825475 - DNA, 22 bp, Homo sapiens
gtgtaccaatcgtctcagcctt

SEQ ID NO: 3825476 - DNA, 16 bp, Homo sapiens
gtgtaggcctgcctta

SEQ ID NO: 3825477 - DNA, 19 bp, Homo sapiens
gtgtcactccataaaaaga

SEQ ID NO: 3825478 - DNA, 23 bp, Homo sapiens
gtgtcactccataaaaagaaagc

SEQ ID NO: 3825479 - DNA, 15 bp, Homo sapiens
gtgtcttactagaaa

SEQ ID NO: 3825480 - DNA, 13 bp, Homo sapiens
gtgtgctactaac

SEQ ID NO: 3825481 - DNA, 19 bp, Homo sapiens
tactttcctttccccagcc

SEQ ID NO: 3825482 - DNA, 13 bp, Homo sapiens
tactttttgtaaa

SEQ ID NO: 3825483 - DNA, 17 bp, Homo sapiens
tactttttgtaaatgct

SEQ ID NO: 3825484 - DNA, 18 bp, Homo sapiens
tactttttgtaaatgctg

SEQ ID NO: 3825485 - DNA, 13 bp, Homo sapiens
tagaaagaaatta

SEQ ID NO: 3825486 - DNA, 20 bp, Homo sapiens
tagaaagaaattacttctag

SEQ ID NO: 3825487 - DNA, 14 bp, Homo sapiens
tagaaagcaggggc

SEQ ID NO: 3825488 - DNA, 12 bp, Homo sapiens
tagaagccaagg

SEQ ID NO: 3825489 - DNA, 15 bp, Homo sapiens
tagaagccaagggaa

SEQ ID NO: 3825490 - DNA, 16 bp, Homo sapiens
tagaatacatattaca

SEQ ID NO: 3825491 - DNA, 19 bp, Homo sapiens
tagacactggctgccagct

SEQ ID NO: 3825492 - DNA, 19 bp, Homo sapiens
tagacagggtttcaccatg

SEQ ID NO: 3825493 - DNA, 20 bp, Homo sapiens
tagacaggttaaatatataa

SEQ ID NO: 3825494 - DNA, 22 bp, Homo sapiens
tagacaggttaaatatataaac

SEQ ID NO: 3825495 - DNA, 20 bp, Homo sapiens
tagacattctcttacttttt

SEQ ID NO: 3825496 - DNA, 23 bp, Homo sapiens
tagacattctcttactttttgta

SEQ ID NO: 3825497 - DNA, 12 bp, Homo sapiens
tagaccctgggt

SEQ ID NO: 3825498 - DNA, 14 bp, Homo sapiens
tagagccaggcaca

SEQ ID NO: 3825499 - DNA, 14 bp, Homo sapiens
tagagctcgaaata

SEQ ID NO: 3825500 - DNA, 18 bp, Homo sapiens
tagaggcttctccgccag

SEQ ID NO: 3825501 - DNA, 23 bp, Homo sapiens
tagaggcttctccgccagcctcc

SEQ ID NO: 3825502 - DNA, 16 bp, Homo sapiens
tagagtgcataaataa

SEQ ID NO: 3825503 - DNA, 21 bp, Homo sapiens
tagatgagtttttcattattt

SEQ ID NO: 3825504 - DNA, 14 bp, Homo sapiens
tagattcccttgca

SEQ ID NO: 3825505 - DNA, 18 bp, Homo sapiens
tagattcccttgcactgt

SEQ ID NO: 3825506 - DNA, 19 bp, Homo sapiens
tagatttaatgatgcttca

SEQ ID NO: 3825507 - DNA, 22 bp, Homo sapiens
tagatttaatgatgcttcagtg

SEQ ID NO: 3825508 - DNA, 20 bp, Homo sapiens
tagatttcagtagtttctaa

SEQ ID NO: 3825509 - DNA, 17 bp, Homo sapiens
tagcaaccatttgtaaa

SEQ ID NO: 3825510 - DNA, 23 bp, Homo sapiens
tagcacctccccagacagggctc

SEQ ID NO: 3825511 - DNA, 20 bp, Homo sapiens
tagccactgctggtgtttat

SEQ ID NO: 3825512 - DNA, 13 bp, Homo sapiens
tagccatgacctt

SEQ ID NO: 3825513 - DNA, 13 bp, Homo sapiens
tagcccaggagag

SEQ ID NO: 3825514 - DNA, 14 bp, Homo sapiens
tagcccaggagaga

SEQ ID NO: 3825515 - DNA, 17 bp, Homo sapiens
tagcccaggagagagaa

SEQ ID NO: 3825516 - DNA, 12 bp, Homo sapiens
tagcccatccct

SEQ ID NO: 3825517 - DNA, 17 bp, Homo sapiens
tagcccatccctgcctg

SEQ ID NO: 3825518 - DNA, 13 bp, Homo sapiens
tagcctaaaagat

SEQ ID NO: 3825519 - DNA, 16 bp, Homo sapiens
tagcctctcctttgta

SEQ ID NO: 3825520 - DNA, 18 bp, Homo sapiens
tagcctttggctctggag

SEQ ID NO: 3825521 - DNA, 18 bp, Homo sapiens
tagctcaaacgtggcttt

SEQ ID NO: 3825522 - DNA, 16 bp, Homo sapiens
tagctgactttcattt

SEQ ID NO: 3825523 - DNA, 19 bp, Homo sapiens
tagctggagtgccatggct

SEQ ID NO: 3825524 - DNA, 15 bp, Homo sapiens
tagcttcactcagct

SEQ ID NO: 3825525 - DNA, 20 bp, Homo sapiens
tagcttcactcagctggact

SEQ ID NO: 3825526 - DNA, 17 bp, Homo sapiens
tagctttagaccctggg

SEQ ID NO: 3825527 - DNA, 21 bp, Homo sapiens
taggaaaaagctttactcttt

SEQ ID NO: 3825528 - DNA, 20 bp, Homo sapiens
taggaaatttatacaaagaa

SEQ ID NO: 3825529 - DNA, 19 bp, Homo sapiens
taggaaggccatggggcag

SEQ ID NO: 3825530 - DNA, 23 bp, Homo sapiens
taggaaggccatggggcagcctc

SEQ ID NO: 3825531 - DNA, 16 bp, Homo sapiens
taggaattgtgtttat

SEQ ID NO: 3825532 - DNA, 14 bp, Homo sapiens
taggacaaggctgt

SEQ ID NO: 3825533 - DNA, 21 bp, Homo sapiens
taggacaaggctgtgccaggc

SEQ ID NO: 3825534 - DNA, 22 bp, Homo sapiens
taggacaaggctgtgccaggct

SEQ ID NO: 3825535 - DNA, 23 bp, Homo sapiens
taggacaaggctgtgccaggctg

SEQ ID NO: 3825536 - DNA, 18 bp, Homo sapiens
taggcagccagctacagg

SEQ ID NO: 3825537 - DNA, 13 bp, Homo sapiens
taggggagcaggg

SEQ ID NO: 3825538 - DNA, 12 bp, Homo sapiens
taggtgggagcc

SEQ ID NO: 3825539 - DNA, 19 bp, Homo sapiens
taggtgggagccaccactc

SEQ ID NO: 3825540 - DNA, 19 bp, Homo sapiens
tagtaccaaatgctttaaa

SEQ ID NO: 3825541 - DNA, 14 bp, Homo sapiens
tagtactgctttac

SEQ ID NO: 3825542 - DNA, 17 bp, Homo sapiens
tagtataatgtatgaat

SEQ ID NO: 3825543 - DNA, 22 bp, Homo sapiens
tagtataatgtatgaattttgt

SEQ ID NO: 3825544 - DNA, 17 bp, Homo sapiens
tagtatcagtcatgaca

SEQ ID NO: 3825545 - DNA, 12 bp, Homo sapiens
tagtgctgaagc

SEQ ID NO: 3825546 - DNA, 13 bp, Homo sapiens
tagtgtcacctgc

SEQ ID NO: 3825547 - DNA, 13 bp, Homo sapiens
tagttatatagat

SEQ ID NO: 3825548 - DNA, 17 bp, Homo sapiens
tagttcagaaggaagca

SEQ ID NO: 3825549 - DNA, 17 bp, Homo sapiens
tagttccacacaggttt

SEQ ID NO: 3825550 - DNA, 21 bp, Homo sapiens
tagttccacacaggtttgtaa

SEQ ID NO: 3825551 - DNA, 13 bp, Homo sapiens
tagtttgcccaga

SEQ ID NO: 3825552 - DNA, 14 bp, Homo sapiens
tagtttgcccagag

SEQ ID NO: 3825553 - DNA, 15 bp, Homo sapiens
tagtttgcccagagt

SEQ ID NO: 3825554 - DNA, 14 bp, Homo sapiens
tagttttgctcctt

SEQ ID NO: 3825555 - DNA, 19 bp, Homo sapiens
tagtttttattaaactcat

SEQ ID NO: 3825556 - DNA, 20 bp, Homo sapiens
tataaaaaaaagttgtttat

SEQ ID NO: 3825557 - DNA, 21 bp, Homo sapiens
tataaaaacccctaaaaacaa

SEQ ID NO: 3825558 - DNA, 17 bp, Homo sapiens
tataaaagcctgtttaa

SEQ ID NO: 3825559 - DNA, 20 bp, Homo sapiens
tataaaagcctgtttaagag

SEQ ID NO: 3825560 - DNA, 21 bp, Homo sapiens
tataaacaaacaaacaaaaat

SEQ ID NO: 3825561 - DNA, 18 bp, Homo sapiens
tataaagaaagattgtaa

SEQ ID NO: 3825562 - DNA, 14 bp, Homo sapiens
tataaataaatata

SEQ ID NO: 3825563 - DNA, 16 bp, Homo sapiens
tataaataaatatata

SEQ ID NO: 3825564 - DNA, 18 bp, Homo sapiens
tataaataaatatatata

SEQ ID NO: 3825565 - DNA, 10 bp, Homo sapiens
tataaatata

SEQ ID NO: 3825566 - DNA, 13 bp, Homo sapiens
tataaatatatat

SEQ ID NO: 3825567 - DNA, 19 bp, Homo sapiens
tataaatatatataaatat

SEQ ID NO: 3825568 - DNA, 21 bp, Homo sapiens
tataaatatatataaatatat

SEQ ID NO: 3825569 - DNA, 21 bp, Homo sapiens
tataacagttataaagaaaga

SEQ ID NO: 3825570 - DNA, 18 bp, Homo sapiens
tataactaatatggtttt

SEQ ID NO: 3825571 - DNA, 16 bp, Homo sapiens
tataagaaattttatt

SEQ ID NO: 3825572 - DNA, 16 bp, Homo sapiens
tataagtatataaata

SEQ ID NO: 3825573 - DNA, 15 bp, Homo sapiens
tataagtgtgtgttt

SEQ ID NO: 3825574 - DNA, 23 bp, Homo sapiens
tataagtgtgtgtttttcataaa

SEQ ID NO: 3825575 - DNA, 14 bp, Homo sapiens
tataatattcatac

SEQ ID NO: 3825576 - DNA, 16 bp, Homo sapiens
tataatgtatgaattt

SEQ ID NO: 3825577 - DNA, 20 bp, Homo sapiens
tataattcacattgtattca

SEQ ID NO: 3825578 - DNA, 14 bp, Homo sapiens
tatacaaagaaact

SEQ ID NO: 3825579 - DNA, 16 bp, Homo sapiens
tatacaaagaaacttt

SEQ ID NO: 3825580 - DNA, 13 bp, Homo sapiens
tatacatttctgt

SEQ ID NO: 3825581 - DNA, 23 bp, Homo sapiens
tatacctcttgaagaagaaggag

SEQ ID NO: 3825582 - DNA, 14 bp, Homo sapiens
tatactatattaac

SEQ ID NO: 3825583 - DNA, 21 bp, Homo sapiens
tatactatattaacttttatt

SEQ ID NO: 3825584 - DNA, 20 bp, Homo sapiens
tatactgaaggaaaaacaca

SEQ ID NO: 3825585 - DNA, 22 bp, Homo sapiens
tatactgaaggaaaaacacaag

SEQ ID NO: 3825586 - DNA, 23 bp, Homo sapiens
tatactgtagatttcagtagttt

SEQ ID NO: 3825587 - DNA, 16 bp, Homo sapiens
tatacttttgcttggt

SEQ ID NO: 3825588 - DNA, 16 bp, Homo sapiens
tatagataaagagata

SEQ ID NO: 3825589 - DNA, 19 bp, Homo sapiens
tatagtattaagtgaaatt

SEQ ID NO: 3825590 - DNA, 12 bp, Homo sapiens
tatataaacaaa

SEQ ID NO: 3825591 - DNA, 16 bp, Homo sapiens
tatataaacaaacaaa

SEQ ID NO: 3825592 - DNA, 15 bp, Homo sapiens
tatataaataaatat

SEQ ID NO: 3825593 - DNA, 18 bp, Homo sapiens
tatataaataaatatata

SEQ ID NO: 3825594 - DNA, 12 bp, Homo sapiens
tatataaatact

SEQ ID NO: 3825595 - DNA, 14 bp, Homo sapiens
tatatataaataaa

SEQ ID NO: 3825596 - DNA, 14 bp, Homo sapiens
tatatatcctctgt

SEQ ID NO: 3825597 - DNA, 19 bp, Homo sapiens
tatatcagggtttaacaat

SEQ ID NO: 3825598 - DNA, 14 bp, Homo sapiens
tatatctttgtaaa

SEQ ID NO: 3825599 - DNA, 17 bp, Homo sapiens
tatatgccttactattg

SEQ ID NO: 3825600 - DNA, 16 bp, Homo sapiens
tatatggaacgcattt

SEQ ID NO: 3825601 - DNA, 16 bp, Homo sapiens
tatatgtttgtggaat

SEQ ID NO: 3825602 - DNA, 16 bp, Homo sapiens
tatatttagtatcttt

SEQ ID NO: 3825603 - DNA, 15 bp, Homo sapiens
tatatttgtaaaagc

SEQ ID NO: 3825604 - DNA, 14 bp, Homo sapiens
tatattttaaatgt

SEQ ID NO: 3825605 - DNA, 17 bp, Homo sapiens
tatattttaaatgtgga

SEQ ID NO: 3825606 - DNA, 21 bp, Homo sapiens
tatattttgtgggcttaattg

SEQ ID NO: 3825607 - DNA, 23 bp, Homo sapiens
tatattttgtgggcttaattgaa

SEQ ID NO: 3825608 - DNA, 13 bp, Homo sapiens
tatcaagctaata

SEQ ID NO: 3825609 - DNA, 17 bp, Homo sapiens
tatcagacttcaccaaa

SEQ ID NO: 3825610 - DNA, 14 bp, Homo sapiens
tatcattcagcaac

SEQ ID NO: 3825611 - DNA, 18 bp, Homo sapiens
tatcatttcatgctttga

SEQ ID NO: 3825612 - DNA, 12 bp, Homo sapiens
tatccatatgaa

SEQ ID NO: 3825613 - DNA, 17 bp, Homo sapiens
tatccatgttgctgact

SEQ ID NO: 3825614 - DNA, 12 bp, Homo sapiens
tctggagagaaa

SEQ ID NO: 3825615 - DNA, 15 bp, Homo sapiens
tctggagagaaacaa

SEQ ID NO: 3825616 - DNA, 22 bp, Homo sapiens
tctggagtgagtctgtcataat

SEQ ID NO: 3825617 - DNA, 16 bp, Homo sapiens
tctggagtttcatgtt

SEQ ID NO: 3825618 - DNA, 15 bp, Homo sapiens
tctggattcttggcc

SEQ ID NO: 3825619 - DNA, 16 bp, Homo sapiens
tctggcccaggctggc

SEQ ID NO: 3825620 - DNA, 18 bp, Homo sapiens
tctggcctcaggtgggcc

SEQ ID NO: 3825621 - DNA, 17 bp, Homo sapiens
tctggctgtgacagcct

SEQ ID NO: 3825622 - DNA, 23 bp, Homo sapiens
tctggctgtgacagcctctgcag

SEQ ID NO: 3825623 - DNA, 21 bp, Homo sapiens
tctgggacctgccaggcaggg

SEQ ID NO: 3825624 - DNA, 22 bp, Homo sapiens
tctgggacctgccaggcagggg

SEQ ID NO: 3825625 - DNA, 16 bp, Homo sapiens
tctgggtttgaagctg

SEQ ID NO: 3825626 - DNA, 17 bp, Homo sapiens
tctgggtttgaagctgc

SEQ ID NO: 3825627 - DNA, 20 bp, Homo sapiens
tctgggtttgaagctgctgt

SEQ ID NO: 3825628 - DNA, 22 bp, Homo sapiens
tctggtttaactaatatttgtc

SEQ ID NO: 3825629 - DNA, 15 bp, Homo sapiens
tctgtaattacaact

SEQ ID NO: 3825630 - DNA, 14 bp, Homo sapiens
tctgtctccaggca

SEQ ID NO: 3825631 - DNA, 15 bp, Homo sapiens
tctgtctccaggcag

SEQ ID NO: 3825632 - DNA, 14 bp, Homo sapiens
tctgtgaaactaat

SEQ ID NO: 3825633 - DNA, 13 bp, Homo sapiens
tctgtgacctcag

SEQ ID NO: 3825634 - DNA, 15 bp, Homo sapiens
tctgtgacctcaggc

SEQ ID NO: 3825635 - DNA, 18 bp, Homo sapiens
tctgtgccaaagcagcta

SEQ ID NO: 3825636 - DNA, 11 bp, Homo sapiens
tctgtgtgcta

SEQ ID NO: 3825637 - DNA, 12 bp, Homo sapiens
tctgtgtgctac

SEQ ID NO: 3825638 - DNA, 15 bp, Homo sapiens
tctgtgtgctactaa

SEQ ID NO: 3825639 - DNA, 18 bp, Homo sapiens
tctgtgtttttttctgaa

SEQ ID NO: 3825640 - DNA, 13 bp, Homo sapiens
tctgttattgttt

SEQ ID NO: 3825641 - DNA, 14 bp, Homo sapiens
tcttactttttgta

SEQ ID NO: 3825642 - DNA, 16 bp, Homo sapiens
tcttactttttgtaaa

SEQ ID NO: 3825643 - DNA, 17 bp, Homo sapiens
tcttctcacagtcaaaa

SEQ ID NO: 3825644 - DNA, 20 bp, Homo sapiens
tcttctcacagtcaaaagga

SEQ ID NO: 3825645 - DNA, 17 bp, Homo sapiens
tcttgaatagcttatgt

SEQ ID NO: 3825646 - DNA, 15 bp, Homo sapiens
tcttgagaaatacta

SEQ ID NO: 3825647 - DNA, 17 bp, Homo sapiens
tcttgatctgctcagcc

SEQ ID NO: 3825648 - DNA, 19 bp, Homo sapiens
tcttgatctgctcagccct

SEQ ID NO: 3825649 - DNA, 20 bp, Homo sapiens
tcttgcatttttttccttta

SEQ ID NO: 3825650 - DNA, 20 bp, Homo sapiens
tcttgccaacctgtaataaa

SEQ ID NO: 3825651 - DNA, 12 bp, Homo sapiens
tcttgccttcag

SEQ ID NO: 3825652 - DNA, 18 bp, Homo sapiens
tcttggcccgcacagagc

SEQ ID NO: 3825653 - DNA, 22 bp, Homo sapiens
tcttggtggattagacaggtta

SEQ ID NO: 3825654 - DNA, 14 bp, Homo sapiens
tcttgtgactagtg

SEQ ID NO: 3825655 - DNA, 21 bp, Homo sapiens
tcttgtgactagtgctgaagc

SEQ ID NO: 3825656 - DNA, 22 bp, Homo sapiens
tcttgtgctggatggagcccag

SEQ ID NO: 3825657 - DNA, 14 bp, Homo sapiens
tctttaattttaca

SEQ ID NO: 3825658 - DNA, 15 bp, Homo sapiens
tctttcatgccattt

SEQ ID NO: 3825659 - DNA, 15 bp, Homo sapiens
tctttccttcttgcc

SEQ ID NO: 3825660 - DNA, 23 bp, Homo sapiens
tctttctttttccttcataattt

SEQ ID NO: 3825661 - DNA, 14 bp, Homo sapiens
tctttgtaaattat

SEQ ID NO: 3825662 - DNA, 19 bp, Homo sapiens
tctttgttggctcagaaaa

SEQ ID NO: 3825663 - DNA, 22 bp, Homo sapiens
tcttttccacatggcagatgat

SEQ ID NO: 3825664 - DNA, 13 bp, Homo sapiens
tctttttccttta

SEQ ID NO: 3825665 - DNA, 16 bp, Homo sapiens
tctttttcctttataa

SEQ ID NO: 3825666 - DNA, 12 bp, Homo sapiens
tctttttgaagt

SEQ ID NO: 3825667 - DNA, 14 bp, Homo sapiens
tctttttgattttt

SEQ ID NO: 3825668 - DNA, 21 bp, Homo sapiens
tcttttttctaaagtaaaaac

SEQ ID NO: 3825669 - DNA, 14 bp, Homo sapiens
tctttttttgcata

SEQ ID NO: 3825670 - DNA, 15 bp, Homo sapiens
tgaaaagggcagagg

SEQ ID NO: 3825671 - DNA, 17 bp, Homo sapiens
tgaaacaacattatttt

SEQ ID NO: 3825672 - DNA, 15 bp, Homo sapiens
tgaaactcatctcat

SEQ ID NO: 3825673 - DNA, 16 bp, Homo sapiens
tgaaactcatctcatt

SEQ ID NO: 3825674 - DNA, 18 bp, Homo sapiens
tgaaactttgctttgggt

SEQ ID NO: 3825675 - DNA, 17 bp, Homo sapiens
tgaaagtcttgtgacta

SEQ ID NO: 3825676 - DNA, 20 bp, Homo sapiens
tgaaagtcttgtgactagtg

SEQ ID NO: 3825677 - DNA, 15 bp, Homo sapiens
tgaaatatattttaa

SEQ ID NO: 3825678 - DNA, 20 bp, Homo sapiens
tgaaatatattttaaatgtg

SEQ ID NO: 3825679 - DNA, 21 bp, Homo sapiens
tgaaatatattttaaatgtgg

SEQ ID NO: 3825680 - DNA, 19 bp, Homo sapiens
tgaaatctgctctgtacat

SEQ ID NO: 3825681 - DNA, 16 bp, Homo sapiens
tgaaattttaaatgca

SEQ ID NO: 3825682 - DNA, 16 bp, Homo sapiens
tgaacatcagaaggta

SEQ ID NO: 3825683 - DNA, 19 bp, Homo sapiens
tgaacatcagaaggtattt

SEQ ID NO: 3825684 - DNA, 17 bp, Homo sapiens
tgaacattcctatcaat

SEQ ID NO: 3825685 - DNA, 15 bp, Homo sapiens
tgaagacaggcacaa

SEQ ID NO: 3825686 - DNA, 18 bp, Homo sapiens
tgaagacaggcacaaaat

SEQ ID NO: 3825687 - DNA, 15 bp, Homo sapiens
tgaagattcaggctt

SEQ ID NO: 3825688 - DNA, 16 bp, Homo sapiens
tgaagatttggttttt

SEQ ID NO: 3825689 - DNA, 12 bp, Homo sapiens
tgaagccaaaga

SEQ ID NO: 3825690 - DNA, 14 bp, Homo sapiens
tgaagccaagtggg

SEQ ID NO: 3825691 - DNA, 23 bp, Homo sapiens
tgaagccacacagcccagaaggc

SEQ ID NO: 3825692 - DNA, 21 bp, Homo sapiens
tgaagccagccttcttccatc

SEQ ID NO: 3825693 - DNA, 21 bp, Homo sapiens
tgaagcctctaacaaatgatc

SEQ ID NO: 3825694 - DNA, 21 bp, Homo sapiens
tgaagcctggacgcagccaca

SEQ ID NO: 3825695 - DNA, 20 bp, Homo sapiens
tgaagctatcgtaaaattaa

SEQ ID NO: 3825696 - DNA, 17 bp, Homo sapiens
tgaagctgctgtctcta

SEQ ID NO: 3825697 - DNA, 19 bp, Homo sapiens
tgaagcttattaatgctaa

SEQ ID NO: 3825698 - DNA, 20 bp, Homo sapiens
tgaagcttattaatgctaag

SEQ ID NO: 3825699 - DNA, 22 bp, Homo sapiens
tgaagcttattaatgctaaggg

SEQ ID NO: 3825700 - DNA, 18 bp, Homo sapiens
tgaaggattttaaatgct

SEQ ID NO: 3825701 - DNA, 14 bp, Homo sapiens
tgaagggtgctcag

SEQ ID NO: 3825702 - DNA, 23 bp, Homo sapiens
tgaagtaccaggccgtttgcttt

SEQ ID NO: 3825703 - DNA, 16 bp, Homo sapiens
tgaatacacaggactt

SEQ ID NO: 3825704 - DNA, 19 bp, Homo sapiens
tgaatatgtgccttctaga

SEQ ID NO: 3825705 - DNA, 17 bp, Homo sapiens
tgaatccaaatgtgaaa

SEQ ID NO: 3825706 - DNA, 20 bp, Homo sapiens
tgaatccaaatgtgaaagat

SEQ ID NO: 3825707 - DNA, 21 bp, Homo sapiens
tgaatgaaagtcttgtgacta

SEQ ID NO: 3825708 - DNA, 23 bp, Homo sapiens
tgaatgaaagtcttgtgactagt

SEQ ID NO: 3825709 - DNA, 13 bp, Homo sapiens
tgaatgaatacac

SEQ ID NO: 3825710 - DNA, 16 bp, Homo sapiens
tgaattattttctctc

SEQ ID NO: 3825711 - DNA, 21 bp, Homo sapiens
tgaattgcattttttaaaaca

SEQ ID NO: 3825712 - DNA, 17 bp, Homo sapiens
tgaattttgtaagtata

SEQ ID NO: 3825713 - DNA, 20 bp, Homo sapiens
tgacaaaggtaaatcagact

SEQ ID NO: 3825714 - DNA, 15 bp, Homo sapiens
tgacaacgaaagtaa

SEQ ID NO: 3825715 - DNA, 13 bp, Homo sapiens
tgacaagtgtgtc

SEQ ID NO: 3825716 - DNA, 14 bp, Homo sapiens
tgacacctttaaaa

SEQ ID NO: 3825717 - DNA, 16 bp, Homo sapiens
tgacacctttaaaaag

SEQ ID NO: 3825718 - DNA, 17 bp, Homo sapiens
tgacacctttaaaaagc

SEQ ID NO: 3825719 - DNA, 14 bp, Homo sapiens
tgacagcctctgca

SEQ ID NO: 3825720 - DNA, 14 bp, Homo sapiens
tgacagtagtacca

SEQ ID NO: 3825721 - DNA, 14 bp, Homo sapiens
tgacatcaagtgta

SEQ ID NO: 3825722 - DNA, 18 bp, Homo sapiens
tgacatcaagtgtaatta

SEQ ID NO: 3825723 - DNA, 16 bp, Homo sapiens
tgaccagcactgaccc

SEQ ID NO: 3825724 - DNA, 19 bp, Homo sapiens
tgaccagcactgaccccga

SEQ ID NO: 3825725 - DNA, 14 bp, Homo sapiens
tgacccaataaagg

SEQ ID NO: 3825726 - DNA, 13 bp, Homo sapiens
tgacccctcctca

SEQ ID NO: 3825727 - DNA, 21 bp, Homo sapiens
tgacccctcctcactggccat

SEQ ID NO: 3825728 - DNA, 22 bp, Homo sapiens
tgacccctcctcactggccatc

SEQ ID NO: 3825729 - DNA, 14 bp, Homo sapiens
tgacccctgctttg

SEQ ID NO: 3825730 - DNA, 19 bp, Homo sapiens
tgacctcaggtgatccgcc

SEQ ID NO: 3825731 - DNA, 18 bp, Homo sapiens
tgacctttaactgagggc

SEQ ID NO: 3825732 - DNA, 19 bp, Homo sapiens
tgacggtattatgcttctt

SEQ ID NO: 3825733 - DNA, 13 bp, Homo sapiens
tgactagtgctga

SEQ ID NO: 3825734 - DNA, 17 bp, Homo sapiens
tgactagtgctgaagct

SEQ ID NO: 3825735 - DNA, 22 bp, Homo sapiens
tgactagtgctgaagcttatta

SEQ ID NO: 3825736 - DNA, 15 bp, Homo sapiens
tgactcaagattccc

SEQ ID NO: 3825737 - DNA, 19 bp, Homo sapiens
tgactcaagattcccagga

SEQ ID NO: 3825738 - DNA, 14 bp, Homo sapiens
tgacttaaggagaa

SEQ ID NO: 3825739 - DNA, 18 bp, Homo sapiens
tgactttagatgggaagc

SEQ ID NO: 3825740 - DNA, 13 bp, Homo sapiens
tgactttcatttg

SEQ ID NO: 3825741 - DNA, 15 bp, Homo sapiens
tgagaaggagagaaa

SEQ ID NO: 3825742 - DNA, 22 bp, Homo sapiens
tgagagctttattgctgcattt

SEQ ID NO: 3825743 - DNA, 16 bp, Homo sapiens
tgagaggcaggcatag

SEQ ID NO: 3825744 - DNA, 18 bp, Homo sapiens
tgagatgaggttttggaa

SEQ ID NO: 3825745 - DNA, 15 bp, Homo sapiens
tgagatgctggagaa

SEQ ID NO: 3825746 - DNA, 17 bp, Homo sapiens
tgagatgctggagaaga

SEQ ID NO: 3825747 - DNA, 16 bp, Homo sapiens
tgtcggccacacccca

SEQ ID NO: 3825748 - DNA, 14 bp, Homo sapiens
tgtctataagtata

SEQ ID NO: 3825749 - DNA, 14 bp, Homo sapiens
tgtctattctccag

SEQ ID NO: 3825750 - DNA, 23 bp, Homo sapiens
tgtctctagaagtgccatctcaa

SEQ ID NO: 3825751 - DNA, 15 bp, Homo sapiens
tgtctctgtagaagc

SEQ ID NO: 3825752 - DNA, 22 bp, Homo sapiens
tgtctgaaaaatgcctgctgct

SEQ ID NO: 3825753 - DNA, 13 bp, Homo sapiens
tgtctggggacag

SEQ ID NO: 3825754 - DNA, 14 bp, Homo sapiens
tgtctggggacagg

SEQ ID NO: 3825755 - DNA, 10 bp, Homo sapiens
tgtctgtgtg

SEQ ID NO: 3825756 - DNA, 12 bp, Homo sapiens
tgtctgtgtgct

SEQ ID NO: 3825757 - DNA, 17 bp, Homo sapiens
tgtctgtgtgctactaa

SEQ ID NO: 3825758 - DNA, 19 bp, Homo sapiens
tgtctgtgtgctactaaca

SEQ ID NO: 3825759 - DNA, 12 bp, Homo sapiens
tgtcttgcattt

SEQ ID NO: 3825760 - DNA, 20 bp, Homo sapiens
tgtctttttcgccaaactgt

SEQ ID NO: 3825761 - DNA, 16 bp, Homo sapiens
tgtgaaagatgcatgt

SEQ ID NO: 3825762 - DNA, 14 bp, Homo sapiens
tgtgaaatttcatg

SEQ ID NO: 3825763 - DNA, 19 bp, Homo sapiens
tgtgaatgaatacacagga

SEQ ID NO: 3825764 - DNA, 23 bp, Homo sapiens
tgtgaatgaatacacaggactta

SEQ ID NO: 3825765 - DNA, 17 bp, Homo sapiens
tgtgacatggtgcctga

SEQ ID NO: 3825766 - DNA, 22 bp, Homo sapiens
tgtgactagtgctgaagcttat

SEQ ID NO: 3825767 - DNA, 17 bp, Homo sapiens
tgtgagagaggacctcc

SEQ ID NO: 3825768 - DNA, 16 bp, Homo sapiens
tgtgatataagtgtgt

SEQ ID NO: 3825769 - DNA, 20 bp, Homo sapiens
tgtgcaccgttgggaccaat

SEQ ID NO: 3825770 - DNA, 17 bp, Homo sapiens
tgtgcagtcactggagg

SEQ ID NO: 3825771 - DNA, 17 bp, Homo sapiens
tgtgcatgctcaaatga

SEQ ID NO: 3825772 - DNA, 15 bp, Homo sapiens
tgtgcccgccctggg

SEQ ID NO: 3825773 - DNA, 20 bp, Homo sapiens
tgtgcccgccctgggctggg

SEQ ID NO: 3825774 - DNA, 23 bp, Homo sapiens
tgtgcccgccctgggctgggccc

SEQ ID NO: 3825775 - DNA, 16 bp, Homo sapiens
tgtgcctataatccca

SEQ ID NO: 3825776 - DNA, 13 bp, Homo sapiens
tgtgctactaaca

SEQ ID NO: 3825777 - DNA, 13 bp, Homo sapiens
tgtgcttgaagat

SEQ ID NO: 3825778 - DNA, 16 bp, Homo sapiens
tgtgcttgaagattca

SEQ ID NO: 3825779 - DNA, 15 bp, Homo sapiens
tgtgctttctattgt

SEQ ID NO: 3825780 - DNA, 22 bp, Homo sapiens
tgtgctttgtatcagtcagtgc

SEQ ID NO: 3825781 - DNA, 19 bp, Homo sapiens
tgtggaccctcgctctctg

SEQ ID NO: 3825782 - DNA, 13 bp, Homo sapiens
tgtggagactggg

SEQ ID NO: 3825783 - DNA, 21 bp, Homo sapiens
tgtggatcaaatccagcctgc

SEQ ID NO: 3825784 - DNA, 15 bp, Homo sapiens
tgtggcagtggtttt

SEQ ID NO: 3825785 - DNA, 12 bp, Homo sapiens
tgtggcctggat

SEQ ID NO: 3825786 - DNA, 19 bp, Homo sapiens
tgtgggaaacctcattgtt

SEQ ID NO: 3825787 - DNA, 17 bp, Homo sapiens
tgtgggtggatataaat

SEQ ID NO: 3825788 - DNA, 16 bp, Homo sapiens
tgtggtctctttgggg

SEQ ID NO: 3825789 - DNA, 15 bp, Homo sapiens
tgtgtaacagctcct

SEQ ID NO: 3825790 - DNA, 23 bp, Homo sapiens
tgtgtaacagttagccactgctg

SEQ ID NO: 3825791 - DNA, 16 bp, Homo sapiens
tgtgtctgtggaccct

SEQ ID NO: 3825792 - DNA, 15 bp, Homo sapiens
tgtgtgagagagagg

SEQ ID NO: 3825793 - DNA, 16 bp, Homo sapiens
tgtgtgctactaacag

SEQ ID NO: 3825794 - DNA, 21 bp, Homo sapiens
tgtgtgggtggatataaatat

SEQ ID NO: 3825795 - DNA, 14 bp, Homo sapiens
tgtgtgtatgtgta

SEQ ID NO: 3825796 - DNA, 20 bp, Homo sapiens
tgtgttcgcgtgtgtgggtg

SEQ ID NO: 3825797 - DNA, 15 bp, Homo sapiens
tgtgttctttataac

SEQ ID NO: 3825798 - DNA, 18 bp, Homo sapiens
tgtgtttttcataaagca

SEQ ID NO: 3825799 - DNA, 22 bp, Homo sapiens
tgttaacaatggcaggttttac

SEQ ID NO: 3825800 - DNA, 23 bp, Homo sapiens
tgttaacaatggcaggttttaca

SEQ ID NO: 3825801 - DNA, 23 bp, Homo sapiens
tgttaatttattttaatgtaaat

SEQ ID NO: 3825802 - DNA, 18 bp, Homo sapiens
tgttacctctgacatcaa

SEQ ID NO: 3825803 - DNA, 23 bp, Homo sapiens
tgttactgccaaaaccaaattga

SEQ ID NO: 3825804 - DNA, 19 bp, Homo sapiens
tgttcaagttttcagcttt

SEQ ID NO: 3825805 - DNA, 13 bp, Homo sapiens
tgttcataaataa

SEQ ID NO: 3825806 - DNA, 18 bp, Homo sapiens
tgttcatagaccctctca

SEQ ID NO: 3825807 - DNA, 18 bp, Homo sapiens
tgttccccaccgccctgc

SEQ ID NO: 3825808 - DNA, 12 bp, Homo sapiens
tgttctatagct

SEQ ID NO: 3825809 - DNA, 11 bp, Homo sapiens
tgttctttata

SEQ ID NO: 3825810 - DNA, 12 bp, Homo sapiens
tgttctttataa

SEQ ID NO: 3825811 - DNA, 13 bp, Homo sapiens
tgttctttataac

SEQ ID NO: 3825812 - DNA, 15 bp, Homo sapiens
tgttgcaaaggaaat

SEQ ID NO: 3825813 - DNA, 13 bp, Homo sapiens
tgttgcaggcaaa

SEQ ID NO: 3825814 - DNA, 17 bp, Homo sapiens
tgttgcaggcaaatgta

SEQ ID NO: 3825815 - DNA, 10 bp, Homo sapiens
tgttgctttt

SEQ ID NO: 3825816 - DNA, 14 bp, Homo sapiens
tgttggcagcataa

SEQ ID NO: 3825817 - DNA, 21 bp, Homo sapiens
tgttggcagtgagtgagcctg

SEQ ID NO: 3825818 - DNA, 14 bp, Homo sapiens
tgttgtgtaacagt

SEQ ID NO: 3825819 - DNA, 19 bp, Homo sapiens
tgtttaaaaatttataaca

SEQ ID NO: 3825820 - DNA, 16 bp, Homo sapiens
tgtttaagtaattgcc

SEQ ID NO: 3825821 - DNA, 21 bp, Homo sapiens
tgtttaggaaatttatacaaa

SEQ ID NO: 3825822 - DNA, 22 bp, Homo sapiens
tgtttaggaaatttatacaaag

SEQ ID NO: 3825823 - DNA, 23 bp, Homo sapiens
tgtttataaacatgtccccttcc

SEQ ID NO: 3825824 - DNA, 19 bp, Homo sapiens
tgtttattgggcaataaaa

SEQ ID NO: 3825825 - DNA, 23 bp, Homo sapiens
tgtttggaaatggggagctggcc

SEQ ID NO: 3825826 - DNA, 15 bp, Homo sapiens
tgtttgtgcttctaa

SEQ ID NO: 3825827 - DNA, 19 bp, Homo sapiens
tgtttgtgcttctaatatt

SEQ ID NO: 3825828 - DNA, 17 bp, Homo sapiens
tgtttgtggaatggatt

SEQ ID NO: 3825829 - DNA, 12 bp, Homo sapiens
tgttttacaact

SEQ ID NO: 3825830 - DNA, 19 bp, Homo sapiens
tgttttacaatgatttgta

SEQ ID NO: 3825831 - DNA, 22 bp, Homo sapiens
tgttttacaatgatttgtaaag

SEQ ID NO: 3825832 - DNA, 21 bp, Homo sapiens
tgttttatagtattaagtgaa

SEQ ID NO: 3825833 - DNA, 22 bp, Homo sapiens
tgttttatagtattaagtgaaa

SEQ ID NO: 3825834 - DNA, 12 bp, Homo sapiens
tgttttgtagca

SEQ ID NO: 3825835 - DNA, 16 bp, Homo sapiens
ttaaaaaagaaagatt

SEQ ID NO: 3825836 - DNA, 19 bp, Homo sapiens
ttaaaaaagaaagatttta

SEQ ID NO: 3825837 - DNA, 16 bp, Homo sapiens
ttaaaaatttataaca

SEQ ID NO: 3825838 - DNA, 18 bp, Homo sapiens
ttaaaactcagatttaaa

SEQ ID NO: 3825839 - DNA, 21 bp, Homo sapiens
ttaaaactcagatttaaaaca

SEQ ID NO: 3825840 - DNA, 14 bp, Homo sapiens
ttaaaatatttgcc

SEQ ID NO: 3825841 - DNA, 12 bp, Homo sapiens
ttaaaatgttta

SEQ ID NO: 3825842 - DNA, 16 bp, Homo sapiens
ttaaaatgtttaggaa

SEQ ID NO: 3825843 - DNA, 18 bp, Homo sapiens
ttaaaatgtttaggaaat

SEQ ID NO: 3825844 - DNA, 21 bp, Homo sapiens
ttaaaatgtttaggaaattta

SEQ ID NO: 3825845 - DNA, 13 bp, Homo sapiens
ttaaactcttgaa

SEQ ID NO: 3825846 - DNA, 20 bp, Homo sapiens
ttaaactgtaaatcataatg

SEQ ID NO: 3825847 - DNA, 14 bp, Homo sapiens
ttaaacttcagttt

SEQ ID NO: 3825848 - DNA, 16 bp, Homo sapiens
ttaaagataagacttc

SEQ ID NO: 3825849 - DNA, 22 bp, Homo sapiens
ttaaatgccacaagacataatt

SEQ ID NO: 3825850 - DNA, 15 bp, Homo sapiens
ttaaatgctgtatgt

SEQ ID NO: 3825851 - DNA, 21 bp, Homo sapiens
ttaaatgtttttttttaaaga

SEQ ID NO: 3825852 - DNA, 23 bp, Homo sapiens
ttaacaatggcaggttttacacg

SEQ ID NO: 3825853 - DNA, 17 bp, Homo sapiens
ttaacactttctttttt

SEQ ID NO: 3825854 - DNA, 17 bp, Homo sapiens
ttaacttgagctttaaa

SEQ ID NO: 3825855 - DNA, 23 bp, Homo sapiens
ttaagcttaaaaaagaaagattt

SEQ ID NO: 3825856 - DNA, 13 bp, Homo sapiens
ttaaggagaaata

SEQ ID NO: 3825857 - DNA, 16 bp, Homo sapiens
ttaagtatatttgtaa

SEQ ID NO: 3825858 - DNA, 17 bp, Homo sapiens
ttaagtatatttgtaaa

SEQ ID NO: 3825859 - DNA, 15 bp, Homo sapiens
ttaagtgaaatttta

SEQ ID NO: 3825860 - DNA, 21 bp, Homo sapiens
ttaagtgaaattttaaatgca

SEQ ID NO: 3825861 - DNA, 11 bp, Homo sapiens
ttaataaagta

SEQ ID NO: 3825862 - DNA, 23 bp, Homo sapiens
ttaataaagtatattgaaagttt

SEQ ID NO: 3825863 - DNA, 21 bp, Homo sapiens
ttaatgactggctacagagta

SEQ ID NO: 3825864 - DNA, 15 bp, Homo sapiens
ttaatgtacagtaaa

SEQ ID NO: 3825865 - DNA, 22 bp, Homo sapiens
ttaatgttaggggtatttaatg

SEQ ID NO: 3825866 - DNA, 13 bp, Homo sapiens
ttaattaacatca

SEQ ID NO: 3825867 - DNA, 13 bp, Homo sapiens
ttaattgaaattt

SEQ ID NO: 3825868 - DNA, 22 bp, Homo sapiens
ttaatttattttaatgtaaata

SEQ ID NO: 3825869 - DNA, 16 bp, Homo sapiens
ttacaagaaataaatc

SEQ ID NO: 3825870 - DNA, 17 bp, Homo sapiens
ttacaagaaataaatct

SEQ ID NO: 3825871 - DNA, 17 bp, Homo sapiens
ttacaattaaactcaaa

SEQ ID NO: 3825872 - DNA, 13 bp, Homo sapiens
ttacatagcattt

SEQ ID NO: 3825873 - DNA, 13 bp, Homo sapiens
ttacattaacatt

SEQ ID NO: 3825874 - DNA, 14 bp, Homo sapiens
ttacattaacattt

SEQ ID NO: 3825875 - DNA, 20 bp, Homo sapiens
ttacccaaggatttttaaaa

SEQ ID NO: 3825876 - DNA, 24 bp, Homo sapiens
ttacccaaggatttttaaaactca

SEQ ID NO: 3825877 - DNA, 16 bp, Homo sapiens
ttaccgagagccaaac

SEQ ID NO: 3825878 - DNA, 19 bp, Homo sapiens
ttaccgagagccaaacaga

SEQ ID NO: 3825879 - DNA, 13 bp, Homo sapiens
ttacctttgacaa

SEQ ID NO: 3825880 - DNA, 12 bp, Homo sapiens
aaaaaaaagttg

SEQ ID NO: 3825881 - DNA, 12 bp, Homo sapiens
aaaaaagaaaga

SEQ ID NO: 3825882 - DNA, 13 bp, Homo sapiens
aaaaaagttataa

SEQ ID NO: 3825883 - DNA, 20 bp, Homo sapiens
aaaaacccctaaaaacaaaa

SEQ ID NO: 3825884 - DNA, 12 bp, Homo sapiens
aaaaactgtatt

SEQ ID NO: 3825885 - DNA, 14 bp, Homo sapiens
aaaaagaaagctaa

SEQ ID NO: 3825886 - DNA, 15 bp, Homo sapiens
aaaaagcagtttttg

SEQ ID NO: 3825887 - DNA, 22 bp, Homo sapiens
aaaaagtagattaaaatatttg

SEQ ID NO: 3825888 - DNA, 17 bp, Homo sapiens
aaaaatgcctgctgctg

SEQ ID NO: 3825889 - DNA, 21 bp, Homo sapiens
aaaaatttataacagttataa

SEQ ID NO: 3825890 - DNA, 10 bp, Homo sapiens
aaaacaaaaa

SEQ ID NO: 3825891 - DNA, 17 bp, Homo sapiens
aaaacaagaaagtttcc

SEQ ID NO: 3825892 - DNA, 15 bp, Homo sapiens
aaaacccagataaag

SEQ ID NO: 3825893 - DNA, 21 bp, Homo sapiens
aaaacccctaaaaacaaaaca

SEQ ID NO: 3825894 - DNA, 14 bp, Homo sapiens
aaaactacatgtaa

SEQ ID NO: 3825895 - DNA, 18 bp, Homo sapiens
aaaacttgctcccaggag

SEQ ID NO: 3825896 - DNA, 22 bp, Homo sapiens
aaaagattttgtgaaatttcat

SEQ ID NO: 3825897 - DNA, 19 bp, Homo sapiens
aaaagcaaggtgtttaagt

SEQ ID NO: 3825898 - DNA, 16 bp, Homo sapiens
aaaagcctgtttaaga

SEQ ID NO: 3825899 - DNA, 13 bp, Homo sapiens
aaaagctttactc

SEQ ID NO: 3825900 - DNA, 12 bp, Homo sapiens
aaaaggcagcca

SEQ ID NO: 3825901 - DNA, 23 bp, Homo sapiens
aaaaggccctagctaataaacct

SEQ ID NO: 3825902 - DNA, 13 bp, Homo sapiens
aaaaggtgtaaaa

SEQ ID NO: 3825903 - DNA, 15 bp, Homo sapiens
aaaataccttagctt

SEQ ID NO: 3825904 - DNA, 13 bp, Homo sapiens
aaaatatcattca

SEQ ID NO: 3825905 - DNA, 22 bp, Homo sapiens
aaaatcccttaatctatgtgca

SEQ ID NO: 3825906 - DNA, 22 bp, Homo sapiens
aaaatgttttcccctaattttc

SEQ ID NO: 3825907 - DNA, 12 bp, Homo sapiens
aaaattaagaaa

SEQ ID NO: 3825908 - DNA, 19 bp, Homo sapiens
aaaattttgtcccatctct

SEQ ID NO: 3825909 - DNA, 15 bp, Homo sapiens
aaaatttttaatctt

SEQ ID NO: 3825910 - DNA, 16 bp, Homo sapiens
aaaatttttaatcttt

SEQ ID NO: 3825911 - DNA, 9 bp, Homo sapiens
aaacaaaaa

SEQ ID NO: 3825912 - DNA, 18 bp, Homo sapiens
aaacaaaaattgctcaaa

SEQ ID NO: 3825913 - DNA, 16 bp, Homo sapiens
aaacaaaacaaacaca

SEQ ID NO: 3825914 - DNA, 15 bp, Homo sapiens
aaacaagaaagtttc

SEQ ID NO: 3825915 - DNA, 17 bp, Homo sapiens
aaacaagaaagtttccc

SEQ ID NO: 3825916 - DNA, 20 bp, Homo sapiens
aaacaatgaagtgttttaca

SEQ ID NO: 3825917 - DNA, 23 bp, Homo sapiens
aaacacggcttctcatgctattt

SEQ ID NO: 3825918 - DNA, 14 bp, Homo sapiens
aaacattgtctaca

SEQ ID NO: 3825919 - DNA, 18 bp, Homo sapiens
aaacccctaaaaacaaaa

SEQ ID NO: 3825920 - DNA, 17 bp, Homo sapiens
aaacctctccttcctca

SEQ ID NO: 3825921 - DNA, 18 bp, Homo sapiens
aaaccttttatatttagt

SEQ ID NO: 3825922 - DNA, 20 bp, Homo sapiens
aaacgtggcttttagacaga

SEQ ID NO: 3825923 - DNA, 17 bp, Homo sapiens
aaactccacatctgcct

SEQ ID NO: 3825924 - DNA, 14 bp, Homo sapiens
aaactcttgaatat

SEQ ID NO: 3825925 - DNA, 19 bp, Homo sapiens
aaactgacagggcccagtt

SEQ ID NO: 3825926 - DNA, 18 bp, Homo sapiens
aaacttcagttttactgc

SEQ ID NO: 3825927 - DNA, 20 bp, Homo sapiens
aaacttcagttttactgcat

SEQ ID NO: 3825928 - DNA, 21 bp, Homo sapiens
aaacttcagttttactgcatt

SEQ ID NO: 3825929 - DNA, 22 bp, Homo sapiens
aaactttgctttgggtttgtgg

SEQ ID NO: 3825930 - DNA, 21 bp, Homo sapiens
aaagaaactttttaataaagt

SEQ ID NO: 3825931 - DNA, 15 bp, Homo sapiens
aaagaaagattgtaa

SEQ ID NO: 3825932 - DNA, 18 bp, Homo sapiens
aaagaaagattgtaaact

SEQ ID NO: 3825933 - DNA, 15 bp, Homo sapiens
aaagaaagattttat

SEQ ID NO: 3825934 - DNA, 13 bp, Homo sapiens
aaagaaagctaat

SEQ ID NO: 3825935 - DNA, 15 bp, Homo sapiens
aaagaaattatgtgc

SEQ ID NO: 3825936 - DNA, 17 bp, Homo sapiens
aaagaccttgtgtgtat

SEQ ID NO: 3825937 - DNA, 23 bp, Homo sapiens
aaagaccttgtgtgtatgtgtac

SEQ ID NO: 3825938 - DNA, 15 bp, Homo sapiens
aaagagcccttgcct

SEQ ID NO: 3825939 - DNA, 18 bp, Homo sapiens
aaagagcccttgcctccc

SEQ ID NO: 3825940 - DNA, 15 bp, Homo sapiens
aaagattgtaaacta

SEQ ID NO: 3825941 - DNA, 11 bp, Homo sapiens
aaagattttat

SEQ ID NO: 3825942 - DNA, 21 bp, Homo sapiens
aaagattttgtgaaatttcat

SEQ ID NO: 3825943 - DNA, 23 bp, Homo sapiens
aaagattttgtgaaatttcatga

SEQ ID NO: 3825944 - DNA, 14 bp, Homo sapiens
aaagcaattttcct

SEQ ID NO: 3825945 - DNA, 15 bp, Homo sapiens
aaagcaattttcctt

SEQ ID NO: 3825946 - DNA, 19 bp, Homo sapiens
aaagcaattttccttgaag

SEQ ID NO: 3825947 - DNA, 21 bp, Homo sapiens
aaagcaattttccttgaagcc

SEQ ID NO: 3825948 - DNA, 22 bp, Homo sapiens
aaagcaattttccttgaagccg

SEQ ID NO: 3825949 - DNA, 18 bp, Homo sapiens
aaagcaggggctacaaga

SEQ ID NO: 3825950 - DNA, 18 bp, Homo sapiens
aaagccccatgctggagc

SEQ ID NO: 3825951 - DNA, 21 bp, Homo sapiens
aaagccccatgctggagcctg

SEQ ID NO: 3825952 - DNA, 16 bp, Homo sapiens
aaagcctgtttaagag

SEQ ID NO: 3825953 - DNA, 18 bp, Homo sapiens
aaagcctgtttaagagac

SEQ ID NO: 3825954 - DNA, 16 bp, Homo sapiens
aaagcttctctctgag

SEQ ID NO: 3825955 - DNA, 17 bp, Homo sapiens
aaagcttctctctgagc

SEQ ID NO: 3825956 - DNA, 20 bp, Homo sapiens
aaagctttactctttcatgc

SEQ ID NO: 3825957 - DNA, 16 bp, Homo sapiens
aaaggactatttataa

SEQ ID NO: 3825958 - DNA, 16 bp, Homo sapiens
aaaggcagccagatcc

SEQ ID NO: 3825959 - DNA, 21 bp, Homo sapiens
aaaggcagccagatccccagg

SEQ ID NO: 3825960 - DNA, 21 bp, Homo sapiens
aaaggcgatagctgactttca

SEQ ID NO: 3825961 - DNA, 14 bp, Homo sapiens
aaaggggagagcct

SEQ ID NO: 3825962 - DNA, 16 bp, Homo sapiens
aaaggggagagcctgc

SEQ ID NO: 3825963 - DNA, 15 bp, Homo sapiens
aaaggggtgctttta

SEQ ID NO: 3825964 - DNA, 19 bp, Homo sapiens
aaagtagattaaaatattt

SEQ ID NO: 3825965 - DNA, 21 bp, Homo sapiens
aaagtattgtgtttatgcatt

SEQ ID NO: 3825966 - DNA, 22 bp, Homo sapiens
aaagtctctggaatttgaaaca

SEQ ID NO: 3825967 - DNA, 18 bp, Homo sapiens
aaagtcttgtgactagtg

SEQ ID NO: 3825968 - DNA, 19 bp, Homo sapiens
aaagtcttgtgactagtgc

SEQ ID NO: 3825969 - DNA, 21 bp, Homo sapiens
aaagtcttgtgactagtgctg

SEQ ID NO: 3825970 - DNA, 15 bp, Homo sapiens
aaagttataagaaaa

SEQ ID NO: 3825971 - DNA, 16 bp, Homo sapiens
aaagttataagaaaac

SEQ ID NO: 3825972 - DNA, 22 bp, Homo sapiens
aaagtttccccaccagtgaatg

SEQ ID NO: 3825973 - DNA, 13 bp, Homo sapiens
aaataaacactgt

SEQ ID NO: 3825974 - DNA, 23 bp, Homo sapiens
aaataaactttgggaaaaggtgt

SEQ ID NO: 3825975 - DNA, 14 bp, Homo sapiens
aaataaataaactt

SEQ ID NO: 3825976 - DNA, 12 bp, Homo sapiens
aaataaatctat

SEQ ID NO: 3825977 - DNA, 17 bp, Homo sapiens
aaataacttgccatttc

SEQ ID NO: 3825978 - DNA, 19 bp, Homo sapiens
aaataacttgccatttctt

SEQ ID NO: 3825979 - DNA, 17 bp, Homo sapiens
aaatacagtagtataat

SEQ ID NO: 3825980 - DNA, 15 bp, Homo sapiens
aaatatataaacaaa

SEQ ID NO: 3825981 - DNA, 18 bp, Homo sapiens
aaatatataaacaaacaa

SEQ ID NO: 3825982 - DNA, 10 bp, Homo sapiens
aaatatatat

SEQ ID NO: 3825983 - DNA, 12 bp, Homo sapiens
aaatatatatat

SEQ ID NO: 3825984 - DNA, 17 bp, Homo sapiens
aaatatattttaaatgt

SEQ ID NO: 3825985 - DNA, 18 bp, Homo sapiens
aaatattctattttcatt

SEQ ID NO: 3825986 - DNA, 14 bp, Homo sapiens
aaatatttcataaa

SEQ ID NO: 3825987 - DNA, 21 bp, Homo sapiens
aaatcaaaggggatatatgtt

SEQ ID NO: 3825988 - DNA, 17 bp, Homo sapiens
aaatcaatacactagtt

SEQ ID NO: 3825989 - DNA, 21 bp, Homo sapiens
aaatcagactatgaagttttt

SEQ ID NO: 3825990 - DNA, 14 bp, Homo sapiens
aaatcataatgtaa

SEQ ID NO: 3825991 - DNA, 13 bp, Homo sapiens
acagctccttggg

SEQ ID NO: 3825992 - DNA, 14 bp, Homo sapiens
acagctccttggga

SEQ ID NO: 3825993 - DNA, 17 bp, Homo sapiens
acagcttcaccacttgt

SEQ ID NO: 3825994 - DNA, 21 bp, Homo sapiens
acagcttgagccgggcccctg

SEQ ID NO: 3825995 - DNA, 15 bp, Homo sapiens
acaggaactctgtgt

SEQ ID NO: 3825996 - DNA, 16 bp, Homo sapiens
acaggaactctgtgtg

SEQ ID NO: 3825997 - DNA, 21 bp, Homo sapiens
acaggaactctgtgtgagaga

SEQ ID NO: 3825998 - DNA, 23 bp, Homo sapiens
acaggaactctgtgtgagagaga

SEQ ID NO: 3825999 - DNA, 18 bp, Homo sapiens
acaggccctttcctcagg

SEQ ID NO: 3826000 - DNA, 19 bp, Homo sapiens
acaggccctttcctcaggc

SEQ ID NO: 3826001 - DNA, 24 bp, Homo sapiens
acagggcatgccccggccacctct

SEQ ID NO: 3826002 - DNA, 13 bp, Homo sapiens
acagggccctctg

SEQ ID NO: 3826003 - DNA, 14 bp, Homo sapiens
acagggctccagcc

SEQ ID NO: 3826004 - DNA, 16 bp, Homo sapiens
acagggctccagcctg

SEQ ID NO: 3826005 - DNA, 23 bp, Homo sapiens
acagggctccagcctgtcggcca

SEQ ID NO: 3826006 - DNA, 20 bp, Homo sapiens
acaggttaaatatataaaca

SEQ ID NO: 3826007 - DNA, 22 bp, Homo sapiens
acagtaagagtttacaagaaat

SEQ ID NO: 3826008 - DNA, 16 bp, Homo sapiens
acagtggccggggctg

SEQ ID NO: 3826009 - DNA, 20 bp, Homo sapiens
acagtggttttatactgaag

SEQ ID NO: 3826010 - DNA, 18 bp, Homo sapiens
acagttagccactgctgg

SEQ ID NO: 3826011 - DNA, 12 bp, Homo sapiens
acagttataaag

SEQ ID NO: 3826012 - DNA, 18 bp, Homo sapiens
acagttataaagaaagat

SEQ ID NO: 3826013 - DNA, 17 bp, Homo sapiens
acagttctatttgctat

SEQ ID NO: 3826014 - DNA, 18 bp, Homo sapiens
acagttggaaatccatcc

SEQ ID NO: 3826015 - DNA, 16 bp, Homo sapiens
acagtttgtttacaca

SEQ ID NO: 3826016 - DNA, 12 bp, Homo sapiens
acatacacacac

SEQ ID NO: 3826017 - DNA, 22 bp, Homo sapiens
acatagcatttgtgtaaagact

SEQ ID NO: 3826018 - DNA, 14 bp, Homo sapiens
acatagcccatccc

SEQ ID NO: 3826019 - DNA, 22 bp, Homo sapiens
acatatcagacttcaccaaata

SEQ ID NO: 3826020 - DNA, 17 bp, Homo sapiens
acatcaagtgtaattag

SEQ ID NO: 3826021 - DNA, 13 bp, Homo sapiens
acatcctgcagct

SEQ ID NO: 3826022 - DNA, 18 bp, Homo sapiens
acatctcaaatacagtag

SEQ ID NO: 3826023 - DNA, 23 bp, Homo sapiens
acatctgccttaaaaccaaagag

SEQ ID NO: 3826024 - DNA, 20 bp, Homo sapiens
acatcttgatctgctcagcc

SEQ ID NO: 3826025 - DNA, 21 bp, Homo sapiens
acatcttgatctgctcagccc

SEQ ID NO: 3826026 - DNA, 14 bp, Homo sapiens
acatctttggtcat

SEQ ID NO: 3826027 - DNA, 20 bp, Homo sapiens
acatgaatatttagtgttca

SEQ ID NO: 3826028 - DNA, 14 bp, Homo sapiens
acatgctggctcct

SEQ ID NO: 3826029 - DNA, 21 bp, Homo sapiens
acatggaccttctctccagag

SEQ ID NO: 3826030 - DNA, 14 bp, Homo sapiens
acatggcatgtttt

SEQ ID NO: 3826031 - DNA, 18 bp, Homo sapiens
acatggcatgttttgtca

SEQ ID NO: 3826032 - DNA, 13 bp, Homo sapiens
acatggtgcctga

SEQ ID NO: 3826033 - DNA, 23 bp, Homo sapiens
acatgtaaaatcttgatagctaa

SEQ ID NO: 3826034 - DNA, 13 bp, Homo sapiens
acatgtccccttc

SEQ ID NO: 3826035 - DNA, 14 bp, Homo sapiens
acatgtccccttcc

SEQ ID NO: 3826036 - DNA, 13 bp, Homo sapiens
acattattttaaa

SEQ ID NO: 3826037 - DNA, 16 bp, Homo sapiens
acattattttaaaatc

SEQ ID NO: 3826038 - DNA, 21 bp, Homo sapiens
acattcacaaagaaacgttgc

SEQ ID NO: 3826039 - DNA, 17 bp, Homo sapiens
acattcagcttcctgct

SEQ ID NO: 3826040 - DNA, 22 bp, Homo sapiens
acattctcttactttttgtaaa

SEQ ID NO: 3826041 - DNA, 15 bp, Homo sapiens
accaaagagggcttc

SEQ ID NO: 3826042 - DNA, 18 bp, Homo sapiens
accaaagagggcttcctc

SEQ ID NO: 3826043 - DNA, 17 bp, Homo sapiens
accaaagatctgctcct

SEQ ID NO: 3826044 - DNA, 22 bp, Homo sapiens
accaaatgctttaaaaactatt

SEQ ID NO: 3826045 - DNA, 20 bp, Homo sapiens
accaaattacatgaagattt

SEQ ID NO: 3826046 - DNA, 13 bp, Homo sapiens
accaacacacagg

SEQ ID NO: 3826047 - DNA, 17 bp, Homo sapiens
accaacactgtaacatt

SEQ ID NO: 3826048 - DNA, 15 bp, Homo sapiens
accaacctggccaac

SEQ ID NO: 3826049 - DNA, 19 bp, Homo sapiens
accaactttttcattccct

SEQ ID NO: 3826050 - DNA, 17 bp, Homo sapiens
accaagtaagacatctc

SEQ ID NO: 3826051 - DNA, 22 bp, Homo sapiens
accaagtaagacatctcaaata

SEQ ID NO: 3826052 - DNA, 22 bp, Homo sapiens
accaagtattaaactgtaaatc

SEQ ID NO: 3826053 - DNA, 18 bp, Homo sapiens
accaatgccttaattaaa

SEQ ID NO: 3826054 - DNA, 23 bp, Homo sapiens
accaatgggtttgccaagccctt

SEQ ID NO: 3826055 - DNA, 13 bp, Homo sapiens
accacacccagcc

SEQ ID NO: 3826056 - DNA, 14 bp, Homo sapiens
accacacccagcct

SEQ ID NO: 3826057 - DNA, 16 bp, Homo sapiens
accacacccagcctca

SEQ ID NO: 3826058 - DNA, 22 bp, Homo sapiens
accacacccagcctcagtcctc

SEQ ID NO: 3826059 - DNA, 24 bp, Homo sapiens
accacacccagcctcagtcctccc

SEQ ID NO: 3826060 - DNA, 22 bp, Homo sapiens
accacaggccctttcctcaggc

SEQ ID NO: 3826061 - DNA, 16 bp, Homo sapiens
accaccaacacacagg

SEQ ID NO: 3826062 - DNA, 22 bp, Homo sapiens
accaccaagtattaaactgtaa

SEQ ID NO: 3826063 - DNA, 24 bp, Homo sapiens
accacccccgagcttgcctcaggg

SEQ ID NO: 3826064 - DNA, 11 bp, Homo sapiens
accactcctgc

SEQ ID NO: 3826065 - DNA, 16 bp, Homo sapiens
accagtaataaaaagc

SEQ ID NO: 3826066 - DNA, 19 bp, Homo sapiens
accagtaataaaaagccac

SEQ ID NO: 3826067 - DNA, 23 bp, Homo sapiens
accatctggcccaggctggcccc

SEQ ID NO: 3826068 - DNA, 15 bp, Homo sapiens
acccaccgtggagga

SEQ ID NO: 3826069 - DNA, 15 bp, Homo sapiens
acccaccttccttgc

SEQ ID NO: 3826070 - DNA, 17 bp, Homo sapiens
acccaccttccttgcga

SEQ ID NO: 3826071 - DNA, 23 bp, Homo sapiens
acccaccttccttgcgaccacca

SEQ ID NO: 3826072 - DNA, 17 bp, Homo sapiens
acccagcctcagtcctc

SEQ ID NO: 3826073 - DNA, 22 bp, Homo sapiens
acccagcctcagtcctcccctc

SEQ ID NO: 3826074 - DNA, 14 bp, Homo sapiens
acccaggaggtgga

SEQ ID NO: 3826075 - DNA, 16 bp, Homo sapiens
acccatggcctcagat

SEQ ID NO: 3826076 - DNA, 19 bp, Homo sapiens
accccaaggacctgcctcc

SEQ ID NO: 3826077 - DNA, 17 bp, Homo sapiens
accccagactccaggcc

SEQ ID NO: 3826078 - DNA, 18 bp, Homo sapiens
accccagactccaggccc

SEQ ID NO: 3826079 - DNA, 19 bp, Homo sapiens
accccagactccaggcccc

SEQ ID NO: 3826080 - DNA, 18 bp, Homo sapiens
accccagctgtgagcctt

SEQ ID NO: 3826081 - DNA, 20 bp, Homo sapiens
accccagctgtgagccttgg

SEQ ID NO: 3826082 - DNA, 21 bp, Homo sapiens
accccatctggctgtgacagc

SEQ ID NO: 3826083 - DNA, 16 bp, Homo sapiens
acccccagccaggcta

SEQ ID NO: 3826084 - DNA, 24 bp, Homo sapiens
acccccgagcttgcctcagggcca

SEQ ID NO: 3826085 - DNA, 23 bp, Homo sapiens
accccctccttccctgtgtcttt

SEQ ID NO: 3826086 - DNA, 13 bp, Homo sapiens
accccctgccctg

SEQ ID NO: 3826087 - DNA, 14 bp, Homo sapiens
accccctgccctgc

SEQ ID NO: 3826088 - DNA, 18 bp, Homo sapiens
accccggggaccctgtga

SEQ ID NO: 3826089 - DNA, 15 bp, Homo sapiens
acccctaaaaacaaa

SEQ ID NO: 3826090 - DNA, 16 bp, Homo sapiens
acccctaaaaacaaaa

SEQ ID NO: 3826091 - DNA, 14 bp, Homo sapiens
acccctcctcactg

SEQ ID NO: 3826092 - DNA, 21 bp, Homo sapiens
acccctcctcactggccatcc

SEQ ID NO: 3826093 - DNA, 20 bp, Homo sapiens
acccctgcccccagccccgg

SEQ ID NO: 3826094 - DNA, 16 bp, Homo sapiens
acccctgctttgcccc

SEQ ID NO: 3826095 - DNA, 16 bp, Homo sapiens
acccctgtcctcactg

SEQ ID NO: 3826096 - DNA, 17 bp, Homo sapiens
acccctgtcctcactgc

SEQ ID NO: 3826097 - DNA, 17 bp, Homo sapiens
accccttctctcctccc

SEQ ID NO: 3826098 - DNA, 20 bp, Homo sapiens
accctggcaccgcattagag

SEQ ID NO: 3826099 - DNA, 10 bp, Homo sapiens
accctgttgc

SEQ ID NO: 3826100 - DNA, 16 bp, Homo sapiens
accctgttgcaaagga

SEQ ID NO: 3826101 - DNA, 20 bp, Homo sapiens
accctgttgcaaaggaaata

SEQ ID NO: 3826102 - DNA, 23 bp, Homo sapiens
accgagagccaaacagagcccag

SEQ ID NO: 3826103 - DNA, 14 bp, Homo sapiens
accgccctgcctct

SEQ ID NO: 3826104 - DNA, 12 bp, Homo sapiens
accggcctggac

SEQ ID NO: 3826105 - DNA, 17 bp, Homo sapiens
acctcaggcactagcct

SEQ ID NO: 3826106 - DNA, 19 bp, Homo sapiens
acctcaggcactagccttt

SEQ ID NO: 3826107 - DNA, 16 bp, Homo sapiens
acctcatgcccacccc

SEQ ID NO: 3826108 - DNA, 18 bp, Homo sapiens
acctccagcacgcgactt

SEQ ID NO: 3826109 - DNA, 23 bp, Homo sapiens
acctccagcacgcgacttctcag

SEQ ID NO: 3826110 - DNA, 14 bp, Homo sapiens
acctccatgccccc

SEQ ID NO: 3826111 - DNA, 20 bp, Homo sapiens
acctccccacgccctcccct

SEQ ID NO: 3826112 - DNA, 18 bp, Homo sapiens
acctccccactccagcag

SEQ ID NO: 3826113 - DNA, 17 bp, Homo sapiens
acctccccagacagggc

SEQ ID NO: 3826114 - DNA, 19 bp, Homo sapiens
acctccccagcccctagcc

SEQ ID NO: 3826115 - DNA, 13 bp, Homo sapiens
acctctccagctc

SEQ ID NO: 3826116 - DNA, 16 bp, Homo sapiens
acctctccagctcctc

SEQ ID NO: 3826117 - DNA, 12 bp, Homo sapiens
acctctcccacc

SEQ ID NO: 3826118 - DNA, 18 bp, Homo sapiens
acctctgcggaccccagc

SEQ ID NO: 3826119 - DNA, 19 bp, Homo sapiens
acctctgcggaccccagct

SEQ ID NO: 3826120 - DNA, 15 bp, Homo sapiens
acctctgtgacctca

SEQ ID NO: 3826121 - DNA, 16 bp, Homo sapiens
acctctgtgacctcag

SEQ ID NO: 3826122 - DNA, 10 bp, Homo sapiens
acctgagcct

SEQ ID NO: 3826123 - DNA, 21 bp, Homo sapiens
agcctgcgggaagctgacctt

SEQ ID NO: 3826124 - DNA, 10 bp, Homo sapiens
agcctgctgg

SEQ ID NO: 3826125 - DNA, 11 bp, Homo sapiens
agcctgctggc

SEQ ID NO: 3826126 - DNA, 17 bp, Homo sapiens
agcctgctggcacccac

SEQ ID NO: 3826127 - DNA, 18 bp, Homo sapiens
agcctgctggcacccacc

SEQ ID NO: 3826128 - DNA, 15 bp, Homo sapiens
agcctggacgcagcc

SEQ ID NO: 3826129 - DNA, 16 bp, Homo sapiens
agcctggacgcagcca

SEQ ID NO: 3826130 - DNA, 21 bp, Homo sapiens
agcctggacgcagccacacag

SEQ ID NO: 3826131 - DNA, 11 bp, Homo sapiens
agcctggctct

SEQ ID NO: 3826132 - DNA, 13 bp, Homo sapiens
agcctgggcctcc

SEQ ID NO: 3826133 - DNA, 15 bp, Homo sapiens
agcctgggcctcctc

SEQ ID NO: 3826134 - DNA, 21 bp, Homo sapiens
agcctgggcctcctcctagct

SEQ ID NO: 3826135 - DNA, 14 bp, Homo sapiens
agcctgtcggccac

SEQ ID NO: 3826136 - DNA, 19 bp, Homo sapiens
agcctgtcggccacacccc

SEQ ID NO: 3826137 - DNA, 23 bp, Homo sapiens
agcctgtcggccacaccccagac

SEQ ID NO: 3826138 - DNA, 13 bp, Homo sapiens
agcctgtgtaaca

SEQ ID NO: 3826139 - DNA, 16 bp, Homo sapiens
agcctttggctctgga

SEQ ID NO: 3826140 - DNA, 19 bp, Homo sapiens
agcgacatagcccatccct

SEQ ID NO: 3826141 - DNA, 21 bp, Homo sapiens
agcggtggccctgtccctccc

SEQ ID NO: 3826142 - DNA, 20 bp, Homo sapiens
agctaaataacttgccattt

SEQ ID NO: 3826143 - DNA, 21 bp, Homo sapiens
agctaaggctcgagttaaaac

SEQ ID NO: 3826144 - DNA, 19 bp, Homo sapiens
agctaataaaatatcattc

SEQ ID NO: 3826145 - DNA, 20 bp, Homo sapiens
agctaataaaatatcattca

SEQ ID NO: 3826146 - DNA, 14 bp, Homo sapiens
agctcaaaccctgt

SEQ ID NO: 3826147 - DNA, 19 bp, Homo sapiens
agctccagatgtttctcat

SEQ ID NO: 3826148 - DNA, 21 bp, Homo sapiens
agctcctcccacggggtcccc

SEQ ID NO: 3826149 - DNA, 22 bp, Homo sapiens
agctcctcccacggggtccccg

SEQ ID NO: 3826150 - DNA, 17 bp, Homo sapiens
agctcctcgtctttgaa

SEQ ID NO: 3826151 - DNA, 13 bp, Homo sapiens
agctccttcccta

SEQ ID NO: 3826152 - DNA, 17 bp, Homo sapiens
agctccttgggaggaag

SEQ ID NO: 3826153 - DNA, 18 bp, Homo sapiens
agctccttgggaggaagc

SEQ ID NO: 3826154 - DNA, 20 bp, Homo sapiens
agctccttgggaggaagcag

SEQ ID NO: 3826155 - DNA, 21 bp, Homo sapiens
agctccttgggaggaagcaga

SEQ ID NO: 3826156 - DNA, 17 bp, Homo sapiens
agctctaaggtaacaaa

SEQ ID NO: 3826157 - DNA, 16 bp, Homo sapiens
agctgaagcctggacg

SEQ ID NO: 3826158 - DNA, 18 bp, Homo sapiens
agctgaagcctggacgca

SEQ ID NO: 3826159 - DNA, 22 bp, Homo sapiens
agctgaagcctggacgcagcca

SEQ ID NO: 3826160 - DNA, 17 bp, Homo sapiens
agctgactttcatttgg

SEQ ID NO: 3826161 - DNA, 22 bp, Homo sapiens
agctgatgactcaagattccca

SEQ ID NO: 3826162 - DNA, 22 bp, Homo sapiens
agctgccagggaagacagagca

SEQ ID NO: 3826163 - DNA, 17 bp, Homo sapiens
agctgcctaggcagcca

SEQ ID NO: 3826164 - DNA, 10 bp, Homo sapiens
agctgccttc

SEQ ID NO: 3826165 - DNA, 13 bp, Homo sapiens
agctgctggccat

SEQ ID NO: 3826166 - DNA, 14 bp, Homo sapiens
agctgctgtctcta

SEQ ID NO: 3826167 - DNA, 15 bp, Homo sapiens
agctggagtgccatg

SEQ ID NO: 3826168 - DNA, 18 bp, Homo sapiens
agctggagtgccatggct

SEQ ID NO: 3826169 - DNA, 21 bp, Homo sapiens
agctggagtgccatggctggg

SEQ ID NO: 3826170 - DNA, 22 bp, Homo sapiens
agctggcagtgtgcggagctga

SEQ ID NO: 3826171 - DNA, 22 bp, Homo sapiens
agctggcctaggtgggagccac

SEQ ID NO: 3826172 - DNA, 15 bp, Homo sapiens
agctggcctcacctg

SEQ ID NO: 3826173 - DNA, 16 bp, Homo sapiens
agctggcctcacctgg

SEQ ID NO: 3826174 - DNA, 13 bp, Homo sapiens
agctgggagggag

SEQ ID NO: 3826175 - DNA, 19 bp, Homo sapiens
agctgggagggagggggag

SEQ ID NO: 3826176 - DNA, 21 bp, Homo sapiens
agctgttccccaccgccctgc

SEQ ID NO: 3826177 - DNA, 13 bp, Homo sapiens
agcttaggcaggg

SEQ ID NO: 3826178 - DNA, 23 bp, Homo sapiens
agcttatgtacaaaactttttaa

SEQ ID NO: 3826179 - DNA, 15 bp, Homo sapiens
agcttattaatgcta

SEQ ID NO: 3826180 - DNA, 19 bp, Homo sapiens
agcttattaatgctaaggg

SEQ ID NO: 3826181 - DNA, 15 bp, Homo sapiens
agcttctctctgagc

SEQ ID NO: 3826182 - DNA, 21 bp, Homo sapiens
agcttctgcttttctgccctg

SEQ ID NO: 3826183 - DNA, 24 bp, Homo sapiens
agcttgagccgggcccctgggctt

SEQ ID NO: 3826184 - DNA, 23 bp, Homo sapiens
agcttgattttcctaatggtctc

SEQ ID NO: 3826185 - DNA, 16 bp, Homo sapiens
agcttgcctaaaattc

SEQ ID NO: 3826186 - DNA, 14 bp, Homo sapiens
agcttgcctcaggg

SEQ ID NO: 3826187 - DNA, 15 bp, Homo sapiens
agcttgcctcagggc

SEQ ID NO: 3826188 - DNA, 16 bp, Homo sapiens
agcttgcctcagggcc

SEQ ID NO: 3826189 - DNA, 17 bp, Homo sapiens
agcttgcctcagggcca

SEQ ID NO: 3826190 - DNA, 15 bp, Homo sapiens
agcttggctgctcag

SEQ ID NO: 3826191 - DNA, 19 bp, Homo sapiens
agctttagaccctgggtgg

SEQ ID NO: 3826192 - DNA, 17 bp, Homo sapiens
agctttattgctgcatt

SEQ ID NO: 3826193 - DNA, 20 bp, Homo sapiens
agctttattgctgcatttta

SEQ ID NO: 3826194 - DNA, 21 bp, Homo sapiens
agctttattgctgcattttaa

SEQ ID NO: 3826195 - DNA, 15 bp, Homo sapiens
agctttgctcttgga

SEQ ID NO: 3826196 - DNA, 15 bp, Homo sapiens
agcttttcccttttt

SEQ ID NO: 3826197 - DNA, 19 bp, Homo sapiens
aggaaaaacacaagcaaaa

SEQ ID NO: 3826198 - DNA, 13 bp, Homo sapiens
aggaaaagctaag

SEQ ID NO: 3826199 - DNA, 14 bp, Homo sapiens
aggaaaatgtgagg

SEQ ID NO: 3826200 - DNA, 20 bp, Homo sapiens
aggaaactccacatctgcct

SEQ ID NO: 3826201 - DNA, 22 bp, Homo sapiens
aggaaactccacatctgcctta

SEQ ID NO: 3826202 - DNA, 15 bp, Homo sapiens
aggaactactgagga

SEQ ID NO: 3826203 - DNA, 17 bp, Homo sapiens
aggaactctgtgtgaga

SEQ ID NO: 3826204 - DNA, 16 bp, Homo sapiens
aggaagaagcttaggc

SEQ ID NO: 3826205 - DNA, 17 bp, Homo sapiens
aggaagaagcttaggca

SEQ ID NO: 3826206 - DNA, 18 bp, Homo sapiens
aggaagaagcttaggcag

SEQ ID NO: 3826207 - DNA, 18 bp, Homo sapiens
aggaagcagaataaagca

SEQ ID NO: 3826208 - DNA, 20 bp, Homo sapiens
aggaagcagaataaagcaat

SEQ ID NO: 3826209 - DNA, 18 bp, Homo sapiens
aggaagcttggctgctca

SEQ ID NO: 3826210 - DNA, 19 bp, Homo sapiens
aggaagcttggctgctcag

SEQ ID NO: 3826211 - DNA, 20 bp, Homo sapiens
aggaagcttggctgctcagt

SEQ ID NO: 3826212 - DNA, 14 bp, Homo sapiens
aggaaggcaagagg

SEQ ID NO: 3826213 - DNA, 22 bp, Homo sapiens
aggaaggccatggggcagcctc

SEQ ID NO: 3826214 - DNA, 13 bp, Homo sapiens
aggaataaagctt

SEQ ID NO: 3826215 - DNA, 14 bp, Homo sapiens
aggaataaagcttc

SEQ ID NO: 3826216 - DNA, 15 bp, Homo sapiens
aggaataaagcttct

SEQ ID NO: 3826217 - DNA, 16 bp, Homo sapiens
aggaataaagcttctc

SEQ ID NO: 3826218 - DNA, 21 bp, Homo sapiens
aggaataaagcttctctctga

SEQ ID NO: 3826219 - DNA, 23 bp, Homo sapiens
aggaataaagcttctctctgagc

SEQ ID NO: 3826220 - DNA, 15 bp, Homo sapiens
aggaatttgaagctc

SEQ ID NO: 3826221 - DNA, 12 bp, Homo sapiens
aggacaaggctg

SEQ ID NO: 3826222 - DNA, 23 bp, Homo sapiens
aggacaaggctgtgccaggctgg

SEQ ID NO: 3826223 - DNA, 13 bp, Homo sapiens
aggaccctcagcc

SEQ ID NO: 3826224 - DNA, 14 bp, Homo sapiens
aggaccctcagccc

SEQ ID NO: 3826225 - DNA, 23 bp, Homo sapiens
aggaccctcagccccaggagaag

SEQ ID NO: 3826226 - DNA, 13 bp, Homo sapiens
aggacctccatgc

SEQ ID NO: 3826227 - DNA, 16 bp, Homo sapiens
aggacctgagcctggc

SEQ ID NO: 3826228 - DNA, 13 bp, Homo sapiens
aggacctgcctcc

SEQ ID NO: 3826229 - DNA, 18 bp, Homo sapiens
aggacgacgaatcttctc

SEQ ID NO: 3826230 - DNA, 16 bp, Homo sapiens
aggactgagccccgca

SEQ ID NO: 3826231 - DNA, 14 bp, Homo sapiens
aggactgtggaggg

SEQ ID NO: 3826232 - DNA, 20 bp, Homo sapiens
aggactgtggaggggagctg

SEQ ID NO: 3826233 - DNA, 21 bp, Homo sapiens
aggagaattaggaaggccatg

SEQ ID NO: 3826234 - DNA, 15 bp, Homo sapiens
aggagaccacccccg

SEQ ID NO: 3826235 - DNA, 14 bp, Homo sapiens
aggagagagaaagc

SEQ ID NO: 3826236 - DNA, 18 bp, Homo sapiens
aggagagaggcagagagc

SEQ ID NO: 3826237 - DNA, 13 bp, Homo sapiens
aggagaggagaga

SEQ ID NO: 3826238 - DNA, 14 bp, Homo sapiens
aggagaggagagag

SEQ ID NO: 3826239 - DNA, 17 bp, Homo sapiens
aggagaggagagaggca

SEQ ID NO: 3826240 - DNA, 18 bp, Homo sapiens
aggagaggagagaggcag

SEQ ID NO: 3826241 - DNA, 19 bp, Homo sapiens
aggagattgagaaggagag

SEQ ID NO: 3826242 - DNA, 14 bp, Homo sapiens
aggagcctggaggg

SEQ ID NO: 3826243 - DNA, 14 bp, Homo sapiens
aggagggagaggga

SEQ ID NO: 3826244 - DNA, 15 bp, Homo sapiens
aggagggagagggag

SEQ ID NO: 3826245 - DNA, 21 bp, Homo sapiens
aggagtggccctgatccagga

SEQ ID NO: 3826246 - DNA, 15 bp, Homo sapiens
aggagttagccaaac

SEQ ID NO: 3826247 - DNA, 18 bp, Homo sapiens
aggagtttcgttttcaaa

SEQ ID NO: 3826248 - DNA, 24 bp, Homo sapiens
aggatcctggtattgtaatattaa

SEQ ID NO: 3826249 - DNA, 17 bp, Homo sapiens
aggatgcctgagccccc

SEQ ID NO: 3826250 - DNA, 19 bp, Homo sapiens
aggatgcctgagccccctg

SEQ ID NO: 3826251 - DNA, 22 bp, Homo sapiens
aggattagacagtaagagttta

SEQ ID NO: 3826252 - DNA, 17 bp, Homo sapiens
aggattgattatgcaga

SEQ ID NO: 3826253 - DNA, 10 bp, Homo sapiens
aggattttaa

SEQ ID NO: 3826254 - DNA, 17 bp, Homo sapiens
aggcaaatgtaaagtct

SEQ ID NO: 3826255 - DNA, 14 bp, Homo sapiens
ataaatgttttaca

SEQ ID NO: 3826256 - DNA, 12 bp, Homo sapiens
ataactaatatg

SEQ ID NO: 3826257 - DNA, 17 bp, Homo sapiens
ataactaatatggtttt

SEQ ID NO: 3826258 - DNA, 18 bp, Homo sapiens
ataagaaaactacatgta

SEQ ID NO: 3826259 - DNA, 15 bp, Homo sapiens
ataaggagctttgct

SEQ ID NO: 3826260 - DNA, 15 bp, Homo sapiens
ataaggccgagccca

SEQ ID NO: 3826261 - DNA, 19 bp, Homo sapiens
ataagtgtgtgtttttcat

SEQ ID NO: 3826262 - DNA, 17 bp, Homo sapiens
ataatacataaagttct

SEQ ID NO: 3826263 - DNA, 15 bp, Homo sapiens
ataatatttgaacaa

SEQ ID NO: 3826264 - DNA, 15 bp, Homo sapiens
ataatgtaactgaag

SEQ ID NO: 3826265 - DNA, 14 bp, Homo sapiens
ataatgtatgaatt

SEQ ID NO: 3826266 - DNA, 20 bp, Homo sapiens
ataatgtatgaattttgtaa

SEQ ID NO: 3826267 - DNA, 19 bp, Homo sapiens
ataattaattaattaacat

SEQ ID NO: 3826268 - DNA, 21 bp, Homo sapiens
ataattaattaattaacatca

SEQ ID NO: 3826269 - DNA, 19 bp, Homo sapiens
ataatttaaaataaataaa

SEQ ID NO: 3826270 - DNA, 13 bp, Homo sapiens
ataattttcaaaa

SEQ ID NO: 3826271 - DNA, 14 bp, Homo sapiens
atacaaagaaactt

SEQ ID NO: 3826272 - DNA, 15 bp, Homo sapiens
atacaaagaaacttt

SEQ ID NO: 3826273 - DNA, 22 bp, Homo sapiens
atacaacaaagaggattagaca

SEQ ID NO: 3826274 - DNA, 10 bp, Homo sapiens
atacacacac

SEQ ID NO: 3826275 - DNA, 12 bp, Homo sapiens
atacacacacac

SEQ ID NO: 3826276 - DNA, 14 bp, Homo sapiens
atacacacacacac

SEQ ID NO: 3826277 - DNA, 15 bp, Homo sapiens
atacacacacacaca

SEQ ID NO: 3826278 - DNA, 13 bp, Homo sapiens
atactatattaac

SEQ ID NO: 3826279 - DNA, 18 bp, Homo sapiens
atactatattaactttta

SEQ ID NO: 3826280 - DNA, 15 bp, Homo sapiens
atactgaaggaaaaa

SEQ ID NO: 3826281 - DNA, 15 bp, Homo sapiens
atacttgaaaattaa

SEQ ID NO: 3826282 - DNA, 13 bp, Homo sapiens
atagaaagaaatt

SEQ ID NO: 3826283 - DNA, 22 bp, Homo sapiens
atagaataaaatttttaatctt

SEQ ID NO: 3826284 - DNA, 14 bp, Homo sapiens
atagagcctgaaat

SEQ ID NO: 3826285 - DNA, 20 bp, Homo sapiens
atagaggctagcttctgctt

SEQ ID NO: 3826286 - DNA, 18 bp, Homo sapiens
atagaggcttctccgcca

SEQ ID NO: 3826287 - DNA, 21 bp, Homo sapiens
atagaggcttctccgccagcc

SEQ ID NO: 3826288 - DNA, 22 bp, Homo sapiens
atagaggcttctccgccagcct

SEQ ID NO: 3826289 - DNA, 12 bp, Homo sapiens
atagataaagag

SEQ ID NO: 3826290 - DNA, 23 bp, Homo sapiens
atagatgagtttttcattatttg

SEQ ID NO: 3826291 - DNA, 19 bp, Homo sapiens
atagcatttgtgtaaagac

SEQ ID NO: 3826292 - DNA, 16 bp, Homo sapiens
atagcccatccctgcc

SEQ ID NO: 3826293 - DNA, 17 bp, Homo sapiens
atagcccatccctgcct

SEQ ID NO: 3826294 - DNA, 14 bp, Homo sapiens
atagcctaaaagat

SEQ ID NO: 3826295 - DNA, 22 bp, Homo sapiens
atagcttttccctttttttaag

SEQ ID NO: 3826296 - DNA, 19 bp, Homo sapiens
atagtactgctttactgtg

SEQ ID NO: 3826297 - DNA, 18 bp, Homo sapiens
atagtgcaactgttttga

SEQ ID NO: 3826298 - DNA, 14 bp, Homo sapiens
atataaacaaacaa

SEQ ID NO: 3826299 - DNA, 16 bp, Homo sapiens
atataaataaatatat

SEQ ID NO: 3826300 - DNA, 17 bp, Homo sapiens
atataaataaatatata

SEQ ID NO: 3826301 - DNA, 22 bp, Homo sapiens
atataaataaatatatatatcc

SEQ ID NO: 3826302 - DNA, 13 bp, Homo sapiens
atataaatatata

SEQ ID NO: 3826303 - DNA, 19 bp, Homo sapiens
atatacaatatatattttg

SEQ ID NO: 3826304 - DNA, 21 bp, Homo sapiens
atatacaatatatattttgtg

SEQ ID NO: 3826305 - DNA, 20 bp, Homo sapiens
atatacctcttgaagaagaa

SEQ ID NO: 3826306 - DNA, 10 bp, Homo sapiens
atatataaaa

SEQ ID NO: 3826307 - DNA, 11 bp, Homo sapiens
atatataaaag

SEQ ID NO: 3826308 - DNA, 13 bp, Homo sapiens
atatataaataaa

SEQ ID NO: 3826309 - DNA, 16 bp, Homo sapiens
atatataaataaatat

SEQ ID NO: 3826310 - DNA, 18 bp, Homo sapiens
atatataaatatatataa

SEQ ID NO: 3826311 - DNA, 12 bp, Homo sapiens
atatatataaat

SEQ ID NO: 3826312 - DNA, 16 bp, Homo sapiens
atatatgtttgtggaa

SEQ ID NO: 3826313 - DNA, 17 bp, Homo sapiens
atatatgtttgtggaat

SEQ ID NO: 3826314 - DNA, 23 bp, Homo sapiens
atatattgtgttttaacaccaac

SEQ ID NO: 3826315 - DNA, 15 bp, Homo sapiens
atatattttaaatgt

SEQ ID NO: 3826316 - DNA, 13 bp, Homo sapiens
atatattttaaga

SEQ ID NO: 3826317 - DNA, 14 bp, Homo sapiens
atatctttgtaaat

SEQ ID NO: 3826318 - DNA, 16 bp, Homo sapiens
atatgatttgcatttt

SEQ ID NO: 3826319 - DNA, 20 bp, Homo sapiens
atattaaaaagaagtttcta

SEQ ID NO: 3826320 - DNA, 12 bp, Homo sapiens
atattcatacaa

SEQ ID NO: 3826321 - DNA, 15 bp, Homo sapiens
atattcatacaacaa

SEQ ID NO: 3826322 - DNA, 16 bp, Homo sapiens
atattcatacaacaaa

SEQ ID NO: 3826323 - DNA, 19 bp, Homo sapiens
atattgacaagtgtctttt

SEQ ID NO: 3826324 - DNA, 14 bp, Homo sapiens
atattgtgttttaa

SEQ ID NO: 3826325 - DNA, 14 bp, Homo sapiens
atatttcataaatt

SEQ ID NO: 3826326 - DNA, 15 bp, Homo sapiens
atatttgaacaaaaa

SEQ ID NO: 3826327 - DNA, 14 bp, Homo sapiens
atatttgtaaaagc

SEQ ID NO: 3826328 - DNA, 15 bp, Homo sapiens
atatttgtctgtgtg

SEQ ID NO: 3826329 - DNA, 19 bp, Homo sapiens
atcaaaggggatatatgtt

SEQ ID NO: 3826330 - DNA, 15 bp, Homo sapiens
atcaagctaataaaa

SEQ ID NO: 3826331 - DNA, 11 bp, Homo sapiens
atcaagtgtaa

SEQ ID NO: 3826332 - DNA, 15 bp, Homo sapiens
atcaagtgtaattag

SEQ ID NO: 3826333 - DNA, 23 bp, Homo sapiens
atcacatggcatgttttgtcatt

SEQ ID NO: 3826334 - DNA, 14 bp, Homo sapiens
atcacatttgtgat

SEQ ID NO: 3826335 - DNA, 13 bp, Homo sapiens
atcacttgaggtc

SEQ ID NO: 3826336 - DNA, 18 bp, Homo sapiens
atcagtatggtgctaatg

SEQ ID NO: 3826337 - DNA, 23 bp, Homo sapiens
atcatctttgttggctcagaaaa

SEQ ID NO: 3826338 - DNA, 13 bp, Homo sapiens
atcattcagcaac

SEQ ID NO: 3826339 - DNA, 13 bp, Homo sapiens
atcattgtacagt

SEQ ID NO: 3826340 - DNA, 22 bp, Homo sapiens
atcattgtacagtttgtttaca

SEQ ID NO: 3826341 - DNA, 13 bp, Homo sapiens
atcatttcatgct

SEQ ID NO: 3826342 - DNA, 14 bp, Homo sapiens
atcatttcatgctt

SEQ ID NO: 3826343 - DNA, 17 bp, Homo sapiens
atccaaatgtgaaagat

SEQ ID NO: 3826344 - DNA, 16 bp, Homo sapiens
atccaaattccctctg

SEQ ID NO: 3826345 - DNA, 14 bp, Homo sapiens
atccacctccatct

SEQ ID NO: 3826346 - DNA, 19 bp, Homo sapiens
atccactctgcctgcttac

SEQ ID NO: 3826347 - DNA, 16 bp, Homo sapiens
atccagaaagaaaact

SEQ ID NO: 3826348 - DNA, 19 bp, Homo sapiens
atccatagtggacattgtt

SEQ ID NO: 3826349 - DNA, 14 bp, Homo sapiens
atccatccagaggc

SEQ ID NO: 3826350 - DNA, 15 bp, Homo sapiens
atccatcctgctagc

SEQ ID NO: 3826351 - DNA, 22 bp, Homo sapiens
atcccaccgacccttcctggcc

SEQ ID NO: 3826352 - DNA, 22 bp, Homo sapiens
atcccaggacaccacacccagc

SEQ ID NO: 3826353 - DNA, 12 bp, Homo sapiens
atccccagggca

SEQ ID NO: 3826354 - DNA, 15 bp, Homo sapiens
atccctgcctggtca

SEQ ID NO: 3826355 - DNA, 15 bp, Homo sapiens
atcccttaatctatg

SEQ ID NO: 3826356 - DNA, 19 bp, Homo sapiens
atcctaatttctcctccct

SEQ ID NO: 3826357 - DNA, 21 bp, Homo sapiens
atcctactaagaagtttaagt

SEQ ID NO: 3826358 - DNA, 21 bp, Homo sapiens
atcctgccttagagccaggca

SEQ ID NO: 3826359 - DNA, 16 bp, Homo sapiens
atcctgctagcacctc

SEQ ID NO: 3826360 - DNA, 17 bp, Homo sapiens
atcctgctagcacctcc

SEQ ID NO: 3826361 - DNA, 18 bp, Homo sapiens
atcctgctagcacctccc

SEQ ID NO: 3826362 - DNA, 20 bp, Homo sapiens
atcctggtattgtaatatta

SEQ ID NO: 3826363 - DNA, 22 bp, Homo sapiens
atcctggtattgtaatattaaa

SEQ ID NO: 3826364 - DNA, 17 bp, Homo sapiens
atcctttctgcctctca

SEQ ID NO: 3826365 - DNA, 19 bp, Homo sapiens
atcgccaacttgtctctgt

SEQ ID NO: 3826366 - DNA, 13 bp, Homo sapiens
atcggcttcctca

SEQ ID NO: 3826367 - DNA, 14 bp, Homo sapiens
atcgtaaaattaag

SEQ ID NO: 3826368 - DNA, 23 bp, Homo sapiens
atcgttcctatacatttctgttc

SEQ ID NO: 3826369 - DNA, 16 bp, Homo sapiens
atctaaaaccaaatat

SEQ ID NO: 3826370 - DNA, 22 bp, Homo sapiens
atctaccttccagtcaggatga

SEQ ID NO: 3826371 - DNA, 15 bp, Homo sapiens
atctataacaaatgc

SEQ ID NO: 3826372 - DNA, 14 bp, Homo sapiens
atctatatttttgt

SEQ ID NO: 3826373 - DNA, 15 bp, Homo sapiens
atctcaataaagcac

SEQ ID NO: 3826374 - DNA, 17 bp, Homo sapiens
atctcatcccaataaaa

SEQ ID NO: 3826375 - DNA, 12 bp, Homo sapiens
atctcctttgct

SEQ ID NO: 3826376 - DNA, 15 bp, Homo sapiens
atctctaccccctca

SEQ ID NO: 3826377 - DNA, 18 bp, Homo sapiens
atctgcaccccttctctc

SEQ ID NO: 3826378 - DNA, 21 bp, Homo sapiens
atctgcaccccttctctcctc

SEQ ID NO: 3826379 - DNA, 17 bp, Homo sapiens
atctgctcagccctgga

SEQ ID NO: 3826380 - DNA, 23 bp, Homo sapiens
atctggaacgctctaggcagaag

SEQ ID NO: 3826381 - DNA, 13 bp, Homo sapiens
atctggcccaggc

SEQ ID NO: 3826382 - DNA, 17 bp, Homo sapiens
atctggcccaggctggc

SEQ ID NO: 3826383 - DNA, 19 bp, Homo sapiens
atctggcccaggctggccc

SEQ ID NO: 3826384 - DNA, 22 bp, Homo sapiens
atctggcccaggctggccccca

SEQ ID NO: 3826385 - DNA, 22 bp, Homo sapiens
atctgttgtgcatgctcaaatg

SEQ ID NO: 3826386 - DNA, 23 bp, Homo sapiens
atcttaaactcttgaatatgtgc

SEQ ID NO: 3826387 - DNA, 23 bp, Homo sapiens
atcttgaatagcttatgtacaaa

SEQ ID NO: 3826388 - DNA, 11 bp, Homo sapiens
atctttaactg

SEQ ID NO: 3826389 - DNA, 19 bp, Homo sapiens
attcaggcttgcattaaaa

SEQ ID NO: 3826390 - DNA, 22 bp, Homo sapiens
attcatttattaagtatatttg

SEQ ID NO: 3826391 - DNA, 22 bp, Homo sapiens
attccaggaggagttagccaaa

SEQ ID NO: 3826392 - DNA, 13 bp, Homo sapiens
attccctctggag

SEQ ID NO: 3826393 - DNA, 14 bp, Homo sapiens
attccctctggagt

SEQ ID NO: 3826394 - DNA, 18 bp, Homo sapiens
attcctaaggcccagctg

SEQ ID NO: 3826395 - DNA, 13 bp, Homo sapiens
attcctctaatgt

SEQ ID NO: 3826396 - DNA, 21 bp, Homo sapiens
attcgacctgatttacagttt

SEQ ID NO: 3826397 - DNA, 18 bp, Homo sapiens
attctaatgatggcccat

SEQ ID NO: 3826398 - DNA, 23 bp, Homo sapiens
attctaatgatggcccattctac

SEQ ID NO: 3826399 - DNA, 23 bp, Homo sapiens
attctaccctgttgcaaaggaaa

SEQ ID NO: 3826400 - DNA, 13 bp, Homo sapiens
attctacttgctc

SEQ ID NO: 3826401 - DNA, 18 bp, Homo sapiens
attctacttgctctggac

SEQ ID NO: 3826402 - DNA, 19 bp, Homo sapiens
attctacttgctctggacc

SEQ ID NO: 3826403 - DNA, 21 bp, Homo sapiens
attctattttcattttctgca

SEQ ID NO: 3826404 - DNA, 11 bp, Homo sapiens
attctcctgcc

SEQ ID NO: 3826405 - DNA, 22 bp, Homo sapiens
attctctaagatgaatccaaat

SEQ ID NO: 3826406 - DNA, 18 bp, Homo sapiens
attctcttactttttgta

SEQ ID NO: 3826407 - DNA, 19 bp, Homo sapiens
attctcttactttttgtaa

SEQ ID NO: 3826408 - DNA, 21 bp, Homo sapiens
attctttctttttccttcata

SEQ ID NO: 3826409 - DNA, 16 bp, Homo sapiens
attgaaatttatacac

SEQ ID NO: 3826410 - DNA, 19 bp, Homo sapiens
attgacaagtgtctttttg

SEQ ID NO: 3826411 - DNA, 13 bp, Homo sapiens
attgagaaggaga

SEQ ID NO: 3826412 - DNA, 22 bp, Homo sapiens
attgatccagaaagaaaacttg

SEQ ID NO: 3826413 - DNA, 22 bp, Homo sapiens
attgattcaaatgttacaaaaa

SEQ ID NO: 3826414 - DNA, 12 bp, Homo sapiens
attgcccacttc

SEQ ID NO: 3826415 - DNA, 17 bp, Homo sapiens
attggatgattgttcat

SEQ ID NO: 3826416 - DNA, 20 bp, Homo sapiens
attggatgattgttcataat

SEQ ID NO: 3826417 - DNA, 21 bp, Homo sapiens
attggatgattgttcataata

SEQ ID NO: 3826418 - DNA, 16 bp, Homo sapiens
attgggcaataaaaga

SEQ ID NO: 3826419 - DNA, 13 bp, Homo sapiens
attgtaaactaaa

SEQ ID NO: 3826420 - DNA, 16 bp, Homo sapiens
attgtaaactaaagtg

SEQ ID NO: 3826421 - DNA, 23 bp, Homo sapiens
attgtacaaaaaagttataagaa

SEQ ID NO: 3826422 - DNA, 18 bp, Homo sapiens
attgttcataatacataa

SEQ ID NO: 3826423 - DNA, 16 bp, Homo sapiens
attgttttgttaacaa

SEQ ID NO: 3826424 - DNA, 21 bp, Homo sapiens
attgttttgttaacaatggca

SEQ ID NO: 3826425 - DNA, 13 bp, Homo sapiens
atttaaaataaat

SEQ ID NO: 3826426 - DNA, 17 bp, Homo sapiens
atttaacttgagcttta

SEQ ID NO: 3826427 - DNA, 16 bp, Homo sapiens
atttaatgatgcttca

SEQ ID NO: 3826428 - DNA, 17 bp, Homo sapiens
atttaattttaatttta

SEQ ID NO: 3826429 - DNA, 13 bp, Homo sapiens
atttacagtttca

SEQ ID NO: 3826430 - DNA, 20 bp, Homo sapiens
atttagacaagagatgggaa

SEQ ID NO: 3826431 - DNA, 15 bp, Homo sapiens
atttagatttaatga

SEQ ID NO: 3826432 - DNA, 13 bp, Homo sapiens
atttagtgttcat

SEQ ID NO: 3826433 - DNA, 15 bp, Homo sapiens
atttataacagttat

SEQ ID NO: 3826434 - DNA, 21 bp, Homo sapiens
atttataacagttataaagaa

SEQ ID NO: 3826435 - DNA, 19 bp, Homo sapiens
atttatacaaagaaacttt

SEQ ID NO: 3826436 - DNA, 16 bp, Homo sapiens
atttatgcatattatt

SEQ ID NO: 3826437 - DNA, 15 bp, Homo sapiens
atttattaagtatat

SEQ ID NO: 3826438 - DNA, 15 bp, Homo sapiens
atttcataaattaac

SEQ ID NO: 3826439 - DNA, 23 bp, Homo sapiens
atttcatatatctatatgtctat

SEQ ID NO: 3826440 - DNA, 14 bp, Homo sapiens
atttcccatctgca

SEQ ID NO: 3826441 - DNA, 14 bp, Homo sapiens
atttcctaaatata

SEQ ID NO: 3826442 - DNA, 21 bp, Homo sapiens
atttcctaaatatattttaag

SEQ ID NO: 3826443 - DNA, 19 bp, Homo sapiens
atttcgtgttgtgttcttt

SEQ ID NO: 3826444 - DNA, 12 bp, Homo sapiens
atttctcctccc

SEQ ID NO: 3826445 - DNA, 14 bp, Homo sapiens
atttctcctccctt

SEQ ID NO: 3826446 - DNA, 17 bp, Homo sapiens
atttctcctcccttcct

SEQ ID NO: 3826447 - DNA, 19 bp, Homo sapiens
atttctcctcccttccttt

SEQ ID NO: 3826448 - DNA, 16 bp, Homo sapiens
atttcttccagtgatg

SEQ ID NO: 3826449 - DNA, 21 bp, Homo sapiens
atttcttccagtgatgttgaa

SEQ ID NO: 3826450 - DNA, 21 bp, Homo sapiens
atttgcaaataaaggctctgg

SEQ ID NO: 3826451 - DNA, 18 bp, Homo sapiens
atttgcattttttaaatt

SEQ ID NO: 3826452 - DNA, 19 bp, Homo sapiens
atttgcattttttaaattt

SEQ ID NO: 3826453 - DNA, 15 bp, Homo sapiens
atttgccctcctcct

SEQ ID NO: 3826454 - DNA, 23 bp, Homo sapiens
atttgctatctgaactaattcat

SEQ ID NO: 3826455 - DNA, 14 bp, Homo sapiens
atttggaaatttag

SEQ ID NO: 3826456 - DNA, 17 bp, Homo sapiens
atttggtttttgtcttg

SEQ ID NO: 3826457 - DNA, 22 bp, Homo sapiens
atttggtttttgtcttgcattt

SEQ ID NO: 3826458 - DNA, 15 bp, Homo sapiens
atttgtaaaagctaa

SEQ ID NO: 3826459 - DNA, 19 bp, Homo sapiens
atttgtctgtgtgctacta

SEQ ID NO: 3826460 - DNA, 16 bp, Homo sapiens
atttgtttgtgcttct

SEQ ID NO: 3826461 - DNA, 18 bp, Homo sapiens
atttgtttgtgcttctaa

SEQ ID NO: 3826462 - DNA, 23 bp, Homo sapiens
attttaaatgcacagttctattt

SEQ ID NO: 3826463 - DNA, 13 bp, Homo sapiens
attttaaatgtgg

SEQ ID NO: 3826464 - DNA, 17 bp, Homo sapiens
attttacctttgacaaa

SEQ ID NO: 3826465 - DNA, 17 bp, Homo sapiens
attttatgtgcttgaag

SEQ ID NO: 3826466 - DNA, 19 bp, Homo sapiens
attttatttagacaagaga

SEQ ID NO: 3826467 - DNA, 15 bp, Homo sapiens
attttcaaaagaaaa

SEQ ID NO: 3826468 - DNA, 22 bp, Homo sapiens
attttcaaaagaaaacccaaag

SEQ ID NO: 3826469 - DNA, 23 bp, Homo sapiens
attttcattttctgcaagcctgc

SEQ ID NO: 3826470 - DNA, 19 bp, Homo sapiens
attttcctgaagctgctta

SEQ ID NO: 3826471 - DNA, 12 bp, Homo sapiens
attttccttgaa

SEQ ID NO: 3826472 - DNA, 14 bp, Homo sapiens
attttccttgaagc

SEQ ID NO: 3826473 - DNA, 15 bp, Homo sapiens
attttccttgaagcc

SEQ ID NO: 3826474 - DNA, 14 bp, Homo sapiens
attttctacagtgg

SEQ ID NO: 3826475 - DNA, 23 bp, Homo sapiens
attttctttttcctttataattc

SEQ ID NO: 3826476 - DNA, 17 bp, Homo sapiens
attttctttttctgaag

SEQ ID NO: 3826477 - DNA, 12 bp, Homo sapiens
attttgaaactt

SEQ ID NO: 3826478 - DNA, 16 bp, Homo sapiens
attttgagaggctgag

SEQ ID NO: 3826479 - DNA, 15 bp, Homo sapiens
attttgggttgttta

SEQ ID NO: 3826480 - DNA, 16 bp, Homo sapiens
attttgggttgtttaa

SEQ ID NO: 3826481 - DNA, 22 bp, Homo sapiens
attttgggttgtttaaaaattt

SEQ ID NO: 3826482 - DNA, 21 bp, Homo sapiens
attttgtaagtataagaaatt

SEQ ID NO: 3826483 - DNA, 14 bp, Homo sapiens
attttgtgaaattt

SEQ ID NO: 3826484 - DNA, 20 bp, Homo sapiens
attttgtgggcttaattgaa

SEQ ID NO: 3826485 - DNA, 13 bp, Homo sapiens
attttgttttaat

SEQ ID NO: 3826486 - DNA, 15 bp, Homo sapiens
atttttaaaaaactg

SEQ ID NO: 3826487 - DNA, 21 bp, Homo sapiens
atttttactagaacacagaaa

SEQ ID NO: 3826488 - DNA, 18 bp, Homo sapiens
atttttgtaaatagttta

SEQ ID NO: 3826489 - DNA, 18 bp, Homo sapiens
attttttaaatgttcatg

SEQ ID NO: 3826490 - DNA, 14 bp, Homo sapiens
caaaaaataaagaa

SEQ ID NO: 3826491 - DNA, 17 bp, Homo sapiens
caaaacaaacacacaca

SEQ ID NO: 3826492 - DNA, 13 bp, Homo sapiens
caaaaccaaattg

SEQ ID NO: 3826493 - DNA, 14 bp, Homo sapiens
caaaaccaaattga

SEQ ID NO: 3826494 - DNA, 23 bp, Homo sapiens
caaaaggtactggtgagggcaag

SEQ ID NO: 3826495 - DNA, 15 bp, Homo sapiens
caaacaaacaaaaat

SEQ ID NO: 3826496 - DNA, 15 bp, Homo sapiens
caaacctctccttcc

SEQ ID NO: 3826497 - DNA, 23 bp, Homo sapiens
caaacgggaccaatgggtttgcc

SEQ ID NO: 3826498 - DNA, 18 bp, Homo sapiens
caaagagggcttcctcta

SEQ ID NO: 3826499 - DNA, 22 bp, Homo sapiens
caaagagggcttcctctagaag

SEQ ID NO: 3826500 - DNA, 14 bp, Homo sapiens
caaagatctgctcc

SEQ ID NO: 3826501 - DNA, 22 bp, Homo sapiens
caaagccccatgctggagcctg

SEQ ID NO: 3826502 - DNA, 15 bp, Homo sapiens
caaaggaaataaagc

SEQ ID NO: 3826503 - DNA, 15 bp, Homo sapiens
caaagggagggtggc

SEQ ID NO: 3826504 - DNA, 23 bp, Homo sapiens
caaagggagggtggcagagacag

SEQ ID NO: 3826505 - DNA, 21 bp, Homo sapiens
caaagtctctggaatttgaaa

SEQ ID NO: 3826506 - DNA, 18 bp, Homo sapiens
caaagtgtcactccataa

SEQ ID NO: 3826507 - DNA, 13 bp, Homo sapiens
caaataaacactg

SEQ ID NO: 3826508 - DNA, 20 bp, Homo sapiens
caaataaagcctgctctccc

SEQ ID NO: 3826509 - DNA, 21 bp, Homo sapiens
caaatacagtagtataatgta

SEQ ID NO: 3826510 - DNA, 14 bp, Homo sapiens
caaatcaatacact

SEQ ID NO: 3826511 - DNA, 16 bp, Homo sapiens
caaatgtgaaagatgc

SEQ ID NO: 3826512 - DNA, 12 bp, Homo sapiens
caaatgttacaa

SEQ ID NO: 3826513 - DNA, 12 bp, Homo sapiens
caaattacatga

SEQ ID NO: 3826514 - DNA, 16 bp, Homo sapiens
caaattccctctggag

SEQ ID NO: 3826515 - DNA, 13 bp, Homo sapiens
caacatatcagac

SEQ ID NO: 3826516 - DNA, 23 bp, Homo sapiens
caacatatcagacttcaccaaat

SEQ ID NO: 3826517 - DNA, 19 bp, Homo sapiens
caacatattgtttcagtgt

SEQ ID NO: 3826518 - DNA, 17 bp, Homo sapiens
caacccaataaaactga

SEQ ID NO: 3826519 - DNA, 22 bp, Homo sapiens
caaccccaaatcccccgactcc

SEQ ID NO: 3826520 - DNA, 21 bp, Homo sapiens
caacctctgccccccaagttc

SEQ ID NO: 3826521 - DNA, 14 bp, Homo sapiens
cagtagtaccaaat

SEQ ID NO: 3826522 - DNA, 15 bp, Homo sapiens
cagtataaaagacaa

SEQ ID NO: 3826523 - DNA, 23 bp, Homo sapiens
cagtcactggaggttgaagccaa

SEQ ID NO: 3826524 - DNA, 19 bp, Homo sapiens
cagtcagtgctggagaaat

SEQ ID NO: 3826525 - DNA, 19 bp, Homo sapiens
cagtcccaccctgctgctg

SEQ ID NO: 3826526 - DNA, 20 bp, Homo sapiens
cagtcccaccctgctgctgc

SEQ ID NO: 3826527 - DNA, 12 bp, Homo sapiens
cagtccccaccc

SEQ ID NO: 3826528 - DNA, 14 bp, Homo sapiens
cagtccccacccct

SEQ ID NO: 3826529 - DNA, 15 bp, Homo sapiens
cagtccccacccctg

SEQ ID NO: 3826530 - DNA, 18 bp, Homo sapiens
cagtccccattttctggt

SEQ ID NO: 3826531 - DNA, 12 bp, Homo sapiens
cagtcctcccct

SEQ ID NO: 3826532 - DNA, 13 bp, Homo sapiens
cagtcctcccctc

SEQ ID NO: 3826533 - DNA, 19 bp, Homo sapiens
cagtcctcccctcacagcc

SEQ ID NO: 3826534 - DNA, 23 bp, Homo sapiens
cagtcctcccctcacagcctctg

SEQ ID NO: 3826535 - DNA, 14 bp, Homo sapiens
cagtcctgaagcag

SEQ ID NO: 3826536 - DNA, 16 bp, Homo sapiens
cagtcctgaagcagca

SEQ ID NO: 3826537 - DNA, 14 bp, Homo sapiens
cagtgagtgagcct

SEQ ID NO: 3826538 - DNA, 16 bp, Homo sapiens
cagtgagtgagcctgg

SEQ ID NO: 3826539 - DNA, 18 bp, Homo sapiens
cagtgagtgagcctggct

SEQ ID NO: 3826540 - DNA, 21 bp, Homo sapiens
cagtgagtgagcctggctctt

SEQ ID NO: 3826541 - DNA, 22 bp, Homo sapiens
cagtgctggagaaatcttgaat

SEQ ID NO: 3826542 - DNA, 19 bp, Homo sapiens
cagtggctcacgcctgtaa

SEQ ID NO: 3826543 - DNA, 16 bp, Homo sapiens
cagtgtcaaataaaca

SEQ ID NO: 3826544 - DNA, 18 bp, Homo sapiens
cagtgtcaaataaacact

SEQ ID NO: 3826545 - DNA, 21 bp, Homo sapiens
cagtgtcaaataaacactgtg

SEQ ID NO: 3826546 - DNA, 22 bp, Homo sapiens
cagtgttcaaataaactgaagg

SEQ ID NO: 3826547 - DNA, 16 bp, Homo sapiens
cagttaaatatgattt

SEQ ID NO: 3826548 - DNA, 16 bp, Homo sapiens
cagttataaagaaaga

SEQ ID NO: 3826549 - DNA, 20 bp, Homo sapiens
cagttataaagaaagattgt

SEQ ID NO: 3826550 - DNA, 22 bp, Homo sapiens
cagttataaagaaagattgtaa

SEQ ID NO: 3826551 - DNA, 20 bp, Homo sapiens
cagttcccgggccctcctgg

SEQ ID NO: 3826552 - DNA, 15 bp, Homo sapiens
cagttctatttgcta

SEQ ID NO: 3826553 - DNA, 14 bp, Homo sapiens
cagtttgtttacac

SEQ ID NO: 3826554 - DNA, 16 bp, Homo sapiens
cagttttactgcattt

SEQ ID NO: 3826555 - DNA, 22 bp, Homo sapiens
cataaaaactggttctacaaat

SEQ ID NO: 3826556 - DNA, 14 bp, Homo sapiens
cataaaaagaaagc

SEQ ID NO: 3826557 - DNA, 14 bp, Homo sapiens
cataaagcaggcag

SEQ ID NO: 3826558 - DNA, 20 bp, Homo sapiens
cataaagttctctgtaatta

SEQ ID NO: 3826559 - DNA, 21 bp, Homo sapiens
cataaagttctctgtaattac

SEQ ID NO: 3826560 - DNA, 19 bp, Homo sapiens
cataaataattttgtttta

SEQ ID NO: 3826561 - DNA, 15 bp, Homo sapiens
cataatgtaactgaa

SEQ ID NO: 3826562 - DNA, 22 bp, Homo sapiens
cataatgtaactgaagcataaa

SEQ ID NO: 3826563 - DNA, 17 bp, Homo sapiens
cataatttaaaataaat

SEQ ID NO: 3826564 - DNA, 19 bp, Homo sapiens
cataatttaaaataaataa

SEQ ID NO: 3826565 - DNA, 17 bp, Homo sapiens
cataattttcaaaagaa

SEQ ID NO: 3826566 - DNA, 14 bp, Homo sapiens
catagaataaaatt

SEQ ID NO: 3826567 - DNA, 15 bp, Homo sapiens
catagaggcttctcc

SEQ ID NO: 3826568 - DNA, 21 bp, Homo sapiens
catatacctcttgaagaagaa

SEQ ID NO: 3826569 - DNA, 20 bp, Homo sapiens
catatcagacttcaccaaat

SEQ ID NO: 3826570 - DNA, 19 bp, Homo sapiens
catatccatgttgctgact

SEQ ID NO: 3826571 - DNA, 20 bp, Homo sapiens
catatccatgttgctgactt

SEQ ID NO: 3826572 - DNA, 16 bp, Homo sapiens
catattaaagataaga

SEQ ID NO: 3826573 - DNA, 19 bp, Homo sapiens
catattaaagataagactt

SEQ ID NO: 3826574 - DNA, 13 bp, Homo sapiens
catcaagtgtaat

SEQ ID NO: 3826575 - DNA, 15 bp, Homo sapiens
catcaagtgtaatta

SEQ ID NO: 3826576 - DNA, 20 bp, Homo sapiens
catcaagtgtaattagcttt

SEQ ID NO: 3826577 - DNA, 24 bp, Homo sapiens
catcacatggcatgttttgtcatt

SEQ ID NO: 3826578 - DNA, 16 bp, Homo sapiens
catcatatacctcttg

SEQ ID NO: 3826579 - DNA, 19 bp, Homo sapiens
catcatatacctcttgaag

SEQ ID NO: 3826580 - DNA, 19 bp, Homo sapiens
catcccaggacaccacacc

SEQ ID NO: 3826581 - DNA, 16 bp, Homo sapiens
catcccctgcctccat

SEQ ID NO: 3826582 - DNA, 14 bp, Homo sapiens
catccctgcctggt

SEQ ID NO: 3826583 - DNA, 23 bp, Homo sapiens
catcctgccttagagccaggcac

SEQ ID NO: 3826584 - DNA, 23 bp, Homo sapiens
catcctgctagcacctccccaga

SEQ ID NO: 3826585 - DNA, 14 bp, Homo sapiens
catcctgctgctta

SEQ ID NO: 3826586 - DNA, 19 bp, Homo sapiens
catcctttctgcctctcaa

SEQ ID NO: 3826587 - DNA, 15 bp, Homo sapiens
catcctttgcatttc

SEQ ID NO: 3826588 - DNA, 17 bp, Homo sapiens
catctaggtaaattaca

SEQ ID NO: 3826589 - DNA, 19 bp, Homo sapiens
catctcattacccttttct

SEQ ID NO: 3826590 - DNA, 13 bp, Homo sapiens
catctcctttgct

SEQ ID NO: 3826591 - DNA, 14 bp, Homo sapiens
catctcctttgcta

SEQ ID NO: 3826592 - DNA, 22 bp, Homo sapiens
catcttctttgcagcctgggtg

SEQ ID NO: 3826593 - DNA, 19 bp, Homo sapiens
catcttgatctgctcagcc

SEQ ID NO: 3826594 - DNA, 21 bp, Homo sapiens
catcttgggggtcacccatgg

SEQ ID NO: 3826595 - DNA, 21 bp, Homo sapiens
catctttgttggctcagaaaa

SEQ ID NO: 3826596 - DNA, 14 bp, Homo sapiens
catgaaaacttttt

SEQ ID NO: 3826597 - DNA, 15 bp, Homo sapiens
catgaacactggctg

SEQ ID NO: 3826598 - DNA, 17 bp, Homo sapiens
catgaaccccaggctgg

SEQ ID NO: 3826599 - DNA, 17 bp, Homo sapiens
catgaactgtgtttcca

SEQ ID NO: 3826600 - DNA, 22 bp, Homo sapiens
catgaagatttggtttttgtct

SEQ ID NO: 3826601 - DNA, 21 bp, Homo sapiens
catgaatatttagtgttcata

SEQ ID NO: 3826602 - DNA, 18 bp, Homo sapiens
catgcaccacgcccggct

SEQ ID NO: 3826603 - DNA, 15 bp, Homo sapiens
catgccattttattt

SEQ ID NO: 3826604 - DNA, 15 bp, Homo sapiens
catgcccaccccctg

SEQ ID NO: 3826605 - DNA, 19 bp, Homo sapiens
catgcccaccccctgccct

SEQ ID NO: 3826606 - DNA, 19 bp, Homo sapiens
catgcccccgccacctccc

SEQ ID NO: 3826607 - DNA, 17 bp, Homo sapiens
catgccccggccacctc

SEQ ID NO: 3826608 - DNA, 19 bp, Homo sapiens
catgccccggccacctctg

SEQ ID NO: 3826609 - DNA, 21 bp, Homo sapiens
catgccccggccacctctgcg

SEQ ID NO: 3826610 - DNA, 18 bp, Homo sapiens
catgcctgtaatcccagc

SEQ ID NO: 3826611 - DNA, 22 bp, Homo sapiens
catgctaatataagtttctttg

SEQ ID NO: 3826612 - DNA, 13 bp, Homo sapiens
catgctcaaatga

SEQ ID NO: 3826613 - DNA, 13 bp, Homo sapiens
catgctggagcct

SEQ ID NO: 3826614 - DNA, 14 bp, Homo sapiens
catgctggagcctg

SEQ ID NO: 3826615 - DNA, 19 bp, Homo sapiens
catgctggagcctgtgtaa

SEQ ID NO: 3826616 - DNA, 22 bp, Homo sapiens
catgctggagcctgtgtaacag

SEQ ID NO: 3826617 - DNA, 18 bp, Homo sapiens
catggaatgactgaagac

SEQ ID NO: 3826618 - DNA, 22 bp, Homo sapiens
catggaatgactgaagacaggc

SEQ ID NO: 3826619 - DNA, 18 bp, Homo sapiens
catggaccttctctccag

SEQ ID NO: 3826620 - DNA, 22 bp, Homo sapiens
catggacttctgccagcataat

SEQ ID NO: 3826621 - DNA, 14 bp, Homo sapiens
catggcagatgatt

SEQ ID NO: 3826622 - DNA, 22 bp, Homo sapiens
catggcagatgatttgggcaga

SEQ ID NO: 3826623 - DNA, 23 bp, Homo sapiens
catggcatgttttgtcattgttt

SEQ ID NO: 3826624 - DNA, 18 bp, Homo sapiens
catggcctcagatgatgg

SEQ ID NO: 3826625 - DNA, 20 bp, Homo sapiens
catggctggggggtctcagc

SEQ ID NO: 3826626 - DNA, 21 bp, Homo sapiens
catggctggggggtctcagca

SEQ ID NO: 3826627 - DNA, 13 bp, Homo sapiens
catggggcagcct

SEQ ID NO: 3826628 - DNA, 16 bp, Homo sapiens
catggggcagcctcca

SEQ ID NO: 3826629 - DNA, 17 bp, Homo sapiens
catggggcagcctccag

SEQ ID NO: 3826630 - DNA, 17 bp, Homo sapiens
catggtgaaatctgctc

SEQ ID NO: 3826631 - DNA, 16 bp, Homo sapiens
catggtgcctgagagg

SEQ ID NO: 3826632 - DNA, 18 bp, Homo sapiens
catggtgcctgagaggca

SEQ ID NO: 3826633 - DNA, 22 bp, Homo sapiens
catggtgcctgagaggcaggca

SEQ ID NO: 3826634 - DNA, 16 bp, Homo sapiens
catggttttaaagcta

SEQ ID NO: 3826635 - DNA, 18 bp, Homo sapiens
catggttttaaagctaaa

SEQ ID NO: 3826636 - DNA, 15 bp, Homo sapiens
catggtttttataat

SEQ ID NO: 3826637 - DNA, 13 bp, Homo sapiens
catgtaaaatctt

SEQ ID NO: 3826638 - DNA, 17 bp, Homo sapiens
catgtagaacttgaact

SEQ ID NO: 3826639 - DNA, 22 bp, Homo sapiens
catgtcattgcccacttctgtg

SEQ ID NO: 3826640 - DNA, 22 bp, Homo sapiens
catgtctctttggggagagctg

SEQ ID NO: 3826641 - DNA, 21 bp, Homo sapiens
catgtctgaaaaatgcctgct

SEQ ID NO: 3826642 - DNA, 24 bp, Homo sapiens
catgtctgaaaaatgcctgctgct

SEQ ID NO: 3826643 - DNA, 13 bp, Homo sapiens
catgtgaaactca

SEQ ID NO: 3826644 - DNA, 16 bp, Homo sapiens
catgtgggatgagttt

SEQ ID NO: 3826645 - DNA, 22 bp, Homo sapiens
catgtgttgagcgtattcttga

SEQ ID NO: 3826646 - DNA, 13 bp, Homo sapiens
catgttatgcctg

SEQ ID NO: 3826647 - DNA, 14 bp, Homo sapiens
catgttcaaaagaa

SEQ ID NO: 3826648 - DNA, 16 bp, Homo sapiens
catgttccaataaaca

SEQ ID NO: 3826649 - DNA, 15 bp, Homo sapiens
cattacccaaaagca

SEQ ID NO: 3826650 - DNA, 17 bp, Homo sapiens
cattattaataattaat

SEQ ID NO: 3826651 - DNA, 17 bp, Homo sapiens
cattcattcaatagata

SEQ ID NO: 3826652 - DNA, 16 bp, Homo sapiens
cctcctgagagctgtt

SEQ ID NO: 3826653 - DNA, 15 bp, Homo sapiens
cctcctgggcacccc

SEQ ID NO: 3826654 - DNA, 16 bp, Homo sapiens
cctcgagccatagagc

SEQ ID NO: 3826655 - DNA, 16 bp, Homo sapiens
cctcggagtgtggcct

SEQ ID NO: 3826656 - DNA, 17 bp, Homo sapiens
cctcgggaacctcactc

SEQ ID NO: 3826657 - DNA, 19 bp, Homo sapiens
cctcgtctttgaactgccg

SEQ ID NO: 3826658 - DNA, 15 bp, Homo sapiens
cctcgtggtccccaa

SEQ ID NO: 3826659 - DNA, 22 bp, Homo sapiens
cctcgttaggacaaggctgtgc

SEQ ID NO: 3826660 - DNA, 15 bp, Homo sapiens
cctctaacaaatgat

SEQ ID NO: 3826661 - DNA, 13 bp, Homo sapiens
cctctccagctcc

SEQ ID NO: 3826662 - DNA, 16 bp, Homo sapiens
cctctcccattcaccc

SEQ ID NO: 3826663 - DNA, 19 bp, Homo sapiens
cctctcccattcaccctgt

SEQ ID NO: 3826664 - DNA, 11 bp, Homo sapiens
cctctcctctg

SEQ ID NO: 3826665 - DNA, 12 bp, Homo sapiens
cctctccttcct

SEQ ID NO: 3826666 - DNA, 16 bp, Homo sapiens
cctctccttcctcaga

SEQ ID NO: 3826667 - DNA, 12 bp, Homo sapiens
cctctcctttgt

SEQ ID NO: 3826668 - DNA, 17 bp, Homo sapiens
cctctgacatcaagtgt

SEQ ID NO: 3826669 - DNA, 22 bp, Homo sapiens
cctctgacatcaagtgtaatta

SEQ ID NO: 3826670 - DNA, 13 bp, Homo sapiens
cctctgacccctc

SEQ ID NO: 3826671 - DNA, 16 bp, Homo sapiens
cctctgacccctcctc

SEQ ID NO: 3826672 - DNA, 18 bp, Homo sapiens
cctctgacccctcctcac

SEQ ID NO: 3826673 - DNA, 11 bp, Homo sapiens
cctctgagacc

SEQ ID NO: 3826674 - DNA, 21 bp, Homo sapiens
cctctgaggctcagccctgag

SEQ ID NO: 3826675 - DNA, 11 bp, Homo sapiens
cctctgccacc

SEQ ID NO: 3826676 - DNA, 13 bp, Homo sapiens
cctctgccaccag

SEQ ID NO: 3826677 - DNA, 19 bp, Homo sapiens
cctctgccaccagagaccg

SEQ ID NO: 3826678 - DNA, 16 bp, Homo sapiens
cctctgcctgccccgc

SEQ ID NO: 3826679 - DNA, 16 bp, Homo sapiens
cctctggacggcaggc

SEQ ID NO: 3826680 - DNA, 21 bp, Homo sapiens
cctctggacggcaggctcact

SEQ ID NO: 3826681 - DNA, 17 bp, Homo sapiens
cctctggagtttcatgt

SEQ ID NO: 3826682 - DNA, 14 bp, Homo sapiens
cctctggggctcag

SEQ ID NO: 3826683 - DNA, 17 bp, Homo sapiens
cctctggggctcagccc

SEQ ID NO: 3826684 - DNA, 23 bp, Homo sapiens
cctctggggctcagccctgagct

SEQ ID NO: 3826685 - DNA, 16 bp, Homo sapiens
cctctgtgacctcagg

SEQ ID NO: 3826686 - DNA, 17 bp, Homo sapiens
cctctgtgacctcaggc

SEQ ID NO: 3826687 - DNA, 17 bp, Homo sapiens
cctctgtgctgcatccc

SEQ ID NO: 3826688 - DNA, 23 bp, Homo sapiens
cctgaaatatattttaaatgtgg

SEQ ID NO: 3826689 - DNA, 18 bp, Homo sapiens
cctgaaatcatctttgtt

SEQ ID NO: 3826690 - DNA, 12 bp, Homo sapiens
cctgaagccagc

SEQ ID NO: 3826691 - DNA, 14 bp, Homo sapiens
cctgaagccagcct

SEQ ID NO: 3826692 - DNA, 23 bp, Homo sapiens
cctgaagctatcgtaaaattaag

SEQ ID NO: 3826693 - DNA, 11 bp, Homo sapiens
cctgagagctg

SEQ ID NO: 3826694 - DNA, 12 bp, Homo sapiens
cctgagagctgt

SEQ ID NO: 3826695 - DNA, 16 bp, Homo sapiens
cctgagagctgttccc

SEQ ID NO: 3826696 - DNA, 11 bp, Homo sapiens
cctgagcctgg

SEQ ID NO: 3826697 - DNA, 12 bp, Homo sapiens
cctgagcctggc

SEQ ID NO: 3826698 - DNA, 17 bp, Homo sapiens
cctgagcctggccatgt

SEQ ID NO: 3826699 - DNA, 11 bp, Homo sapiens
cctgaggaata

SEQ ID NO: 3826700 - DNA, 21 bp, Homo sapiens
cctgaggaataaagcttctct

SEQ ID NO: 3826701 - DNA, 16 bp, Homo sapiens
cctgaggagggccctg

SEQ ID NO: 3826702 - DNA, 19 bp, Homo sapiens
cctgaggagggccctgagg

SEQ ID NO: 3826703 - DNA, 20 bp, Homo sapiens
cctgaggagggccctgagga

SEQ ID NO: 3826704 - DNA, 21 bp, Homo sapiens
cctgaggagggccctgaggaa

SEQ ID NO: 3826705 - DNA, 12 bp, Homo sapiens
cctgaggtctgg

SEQ ID NO: 3826706 - DNA, 19 bp, Homo sapiens
cctgaggtctggctgcttg

SEQ ID NO: 3826707 - DNA, 21 bp, Homo sapiens
cctgaggtctggctgcttgcc

SEQ ID NO: 3826708 - DNA, 19 bp, Homo sapiens
cctgatccaggaaaatgtg

SEQ ID NO: 3826709 - DNA, 20 bp, Homo sapiens
cctgatttacagtttcaaaa

SEQ ID NO: 3826710 - DNA, 18 bp, Homo sapiens
cctgcacagggccctctg

SEQ ID NO: 3826711 - DNA, 23 bp, Homo sapiens
cctgcacagggccctctgaggct

SEQ ID NO: 3826712 - DNA, 16 bp, Homo sapiens
cctgcacctctccagc

SEQ ID NO: 3826713 - DNA, 19 bp, Homo sapiens
cctgcacgtcatgggaggg

SEQ ID NO: 3826714 - DNA, 13 bp, Homo sapiens
cctgcagcttatt

SEQ ID NO: 3826715 - DNA, 18 bp, Homo sapiens
cctgcagtaatctccagg

SEQ ID NO: 3826716 - DNA, 13 bp, Homo sapiens
cctgccaggcagg

SEQ ID NO: 3826717 - DNA, 22 bp, Homo sapiens
cctgccaggcaggggtgggggt

SEQ ID NO: 3826718 - DNA, 13 bp, Homo sapiens
cctgcccccacac

SEQ ID NO: 3826719 - DNA, 15 bp, Homo sapiens
cctgcccccacaccc

SEQ ID NO: 3826720 - DNA, 16 bp, Homo sapiens
cctgcccccacaccca

SEQ ID NO: 3826721 - DNA, 17 bp, Homo sapiens
cctgcccccacacccac

SEQ ID NO: 3826722 - DNA, 15 bp, Homo sapiens
cctgcccccagcccc

SEQ ID NO: 3826723 - DNA, 23 bp, Homo sapiens
cctgcccccgcatcccctgcctc

SEQ ID NO: 3826724 - DNA, 18 bp, Homo sapiens
cctgccccgcccccagtc

SEQ ID NO: 3826725 - DNA, 18 bp, Homo sapiens
cctgccctgaggagggcc

SEQ ID NO: 3826726 - DNA, 18 bp, Homo sapiens
cctgcctactgcccctgc

SEQ ID NO: 3826727 - DNA, 23 bp, Homo sapiens
cctgcctactgcccctgccctga

SEQ ID NO: 3826728 - DNA, 14 bp, Homo sapiens
cctgcctccatcct

SEQ ID NO: 3826729 - DNA, 19 bp, Homo sapiens
cctgcctccggcctgcact

SEQ ID NO: 3826730 - DNA, 14 bp, Homo sapiens
cctgcctccttgaa

SEQ ID NO: 3826731 - DNA, 14 bp, Homo sapiens
cctgcctgccccca

SEQ ID NO: 3826732 - DNA, 21 bp, Homo sapiens
cctgccttaccgagagccaaa

SEQ ID NO: 3826733 - DNA, 18 bp, Homo sapiens
cctgcgcagctccttccc

SEQ ID NO: 3826734 - DNA, 18 bp, Homo sapiens
cctgcgcagggccctctg

SEQ ID NO: 3826735 - DNA, 23 bp, Homo sapiens
cctgcgcagggccctctggggct

SEQ ID NO: 3826736 - DNA, 19 bp, Homo sapiens
cctgcgggaagctgacctt

SEQ ID NO: 3826737 - DNA, 18 bp, Homo sapiens
cctgcgtcctcctcacct

SEQ ID NO: 3826738 - DNA, 15 bp, Homo sapiens
cctgctgcaggggct

SEQ ID NO: 3826739 - DNA, 17 bp, Homo sapiens
cctgctgcaggggctct

SEQ ID NO: 3826740 - DNA, 21 bp, Homo sapiens
cctgctgcaggggctctggag

SEQ ID NO: 3826741 - DNA, 23 bp, Homo sapiens
cctgctgtgattccactacacct

SEQ ID NO: 3826742 - DNA, 19 bp, Homo sapiens
cctgcttgaactgctgcca

SEQ ID NO: 3826743 - DNA, 20 bp, Homo sapiens
cctgcttgaactgctgccaa

SEQ ID NO: 3826744 - DNA, 12 bp, Homo sapiens
cctgctttgccc

SEQ ID NO: 3826745 - DNA, 14 bp, Homo sapiens
cctgctttgcccca

SEQ ID NO: 3826746 - DNA, 23 bp, Homo sapiens
cctgctttgccccactgggagag

SEQ ID NO: 3826747 - DNA, 22 bp, Homo sapiens
cctgctttgtgcagggtcctcc

SEQ ID NO: 3826748 - DNA, 16 bp, Homo sapiens
cctggacgcagccaca

SEQ ID NO: 3826749 - DNA, 16 bp, Homo sapiens
cctggaggtgccagca

SEQ ID NO: 3826750 - DNA, 18 bp, Homo sapiens
cctggaggtgccagcaaa

SEQ ID NO: 3826751 - DNA, 22 bp, Homo sapiens
cctggaggtgccagcaaagccc

SEQ ID NO: 3826752 - DNA, 15 bp, Homo sapiens
cctggatccatcctg

SEQ ID NO: 3826753 - DNA, 16 bp, Homo sapiens
cctggatccatcctgc

SEQ ID NO: 3826754 - DNA, 14 bp, Homo sapiens
cctggccatgtcct

SEQ ID NO: 3826755 - DNA, 15 bp, Homo sapiens
cctggccatgtcctc

SEQ ID NO: 3826756 - DNA, 14 bp, Homo sapiens
cctggctaggactg

SEQ ID NO: 3826757 - DNA, 23 bp, Homo sapiens
cctggctaggactgtggagggga

SEQ ID NO: 3826758 - DNA, 18 bp, Homo sapiens
cctggctcctacccaccg

SEQ ID NO: 3826759 - DNA, 13 bp, Homo sapiens
cctggctcttgtg

SEQ ID NO: 3826760 - DNA, 20 bp, Homo sapiens
cctggctcttgtgctggatg

SEQ ID NO: 3826761 - DNA, 23 bp, Homo sapiens
cctggctgaggttcctctgcctg

SEQ ID NO: 3826762 - DNA, 16 bp, Homo sapiens
cctggctgctgccccc

SEQ ID NO: 3826763 - DNA, 17 bp, Homo sapiens
cctggctgctgccccca

SEQ ID NO: 3826764 - DNA, 12 bp, Homo sapiens
cctggcttccaa

SEQ ID NO: 3826765 - DNA, 18 bp, Homo sapiens
cctgggcaccccaggcag

SEQ ID NO: 3826766 - DNA, 21 bp, Homo sapiens
cctgggcaccccaggcagctc

SEQ ID NO: 3826767 - DNA, 22 bp, Homo sapiens
cctgggcgcagctgaagcctgg

SEQ ID NO: 3826768 - DNA, 14 bp, Homo sapiens
cctgggctgggccc

SEQ ID NO: 3826769 - DNA, 23 bp, Homo sapiens
cctgggctgggcccttcctggct

SEQ ID NO: 3826770 - DNA, 19 bp, Homo sapiens
cctgggcttggcctgctgt

SEQ ID NO: 3826771 - DNA, 20 bp, Homo sapiens
cctgggcttggcctgctgtg

SEQ ID NO: 3826772 - DNA, 21 bp, Homo sapiens
cctgggcttggcctgctgtga

SEQ ID NO: 3826773 - DNA, 14 bp, Homo sapiens
cctggggatggcca

SEQ ID NO: 3826774 - DNA, 15 bp, Homo sapiens
cctggggatggccag

SEQ ID NO: 3826775 - DNA, 21 bp, Homo sapiens
cctggggatggccaggtacaa

SEQ ID NO: 3826776 - DNA, 15 bp, Homo sapiens
cctgggtgggctctg

SEQ ID NO: 3826777 - DNA, 16 bp, Homo sapiens
cctgggtgggctctgt

SEQ ID NO: 3826778 - DNA, 13 bp, Homo sapiens
cctgtaataaata

SEQ ID NO: 3826779 - DNA, 18 bp, Homo sapiens
cctgtccctcccacctct

SEQ ID NO: 3826780 - DNA, 21 bp, Homo sapiens
cctgtccctcccacctctgtg

SEQ ID NO: 3826781 - DNA, 14 bp, Homo sapiens
cctgtcctcactgc

SEQ ID NO: 3826782 - DNA, 17 bp, Homo sapiens
cctgtcctcccacccct

SEQ ID NO: 3826783 - DNA, 16 bp, Homo sapiens
cctgtcggccacaccc

SEQ ID NO: 3826784 - DNA, 22 bp, Homo sapiens
cctgtcggccacaccccagact

SEQ ID NO: 3826785 - DNA, 16 bp, Homo sapiens
cgttttgcctcatgaa

SEQ ID NO: 3826786 - DNA, 22 bp, Homo sapiens
ctaaaactctgccagccctgca

SEQ ID NO: 3826787 - DNA, 23 bp, Homo sapiens
ctaaaagattttgtgaaatttca

SEQ ID NO: 3826788 - DNA, 22 bp, Homo sapiens
ctaaagagcccttgcctcccca

SEQ ID NO: 3826789 - DNA, 16 bp, Homo sapiens
ctaaagtgtgctttat

SEQ ID NO: 3826790 - DNA, 21 bp, Homo sapiens
ctaaagtgtgctttataaaaa

SEQ ID NO: 3826791 - DNA, 14 bp, Homo sapiens
ctaagaaatcatgt

SEQ ID NO: 3826792 - DNA, 16 bp, Homo sapiens
ctaagagaagttattt

SEQ ID NO: 3826793 - DNA, 24 bp, Homo sapiens
ctaagatgaatccaaatgtgaaag

SEQ ID NO: 3826794 - DNA, 19 bp, Homo sapiens
ctaaggcccagctgccagg

SEQ ID NO: 3826795 - DNA, 21 bp, Homo sapiens
ctaataaaatatcattcagca

SEQ ID NO: 3826796 - DNA, 15 bp, Homo sapiens
ctaatagaaagaaat

SEQ ID NO: 3826797 - DNA, 19 bp, Homo sapiens
ctaatatggttttgttttc

SEQ ID NO: 3826798 - DNA, 16 bp, Homo sapiens
ctaatatttattgctt

SEQ ID NO: 3826799 - DNA, 23 bp, Homo sapiens
ctaatgatggcccattctacttg

SEQ ID NO: 3826800 - DNA, 21 bp, Homo sapiens
ctaattcatttattaagtata

SEQ ID NO: 3826801 - DNA, 14 bp, Homo sapiens
ctaatttctcctcc

SEQ ID NO: 3826802 - DNA, 15 bp, Homo sapiens
ctaatttctcctccc

SEQ ID NO: 3826803 - DNA, 16 bp, Homo sapiens
ctaattttctttttct

SEQ ID NO: 3826804 - DNA, 13 bp, Homo sapiens
ctacaaattttta

SEQ ID NO: 3826805 - DNA, 17 bp, Homo sapiens
ctacacactgctcattt

SEQ ID NO: 3826806 - DNA, 13 bp, Homo sapiens
ctacacctggctg

SEQ ID NO: 3826807 - DNA, 16 bp, Homo sapiens
ctacagccctggaggc

SEQ ID NO: 3826808 - DNA, 17 bp, Homo sapiens
ctacagccctggaggcc

SEQ ID NO: 3826809 - DNA, 22 bp, Homo sapiens
ctacagttggaaatccatccag

SEQ ID NO: 3826810 - DNA, 15 bp, Homo sapiens
ctacctcctcaggga

SEQ ID NO: 3826811 - DNA, 13 bp, Homo sapiens
ctactaacagatt

SEQ ID NO: 3826812 - DNA, 19 bp, Homo sapiens
ctactaagaagtttaagta

SEQ ID NO: 3826813 - DNA, 15 bp, Homo sapiens
ctactctatatactt

SEQ ID NO: 3826814 - DNA, 13 bp, Homo sapiens
ctactgcccctgc

SEQ ID NO: 3826815 - DNA, 21 bp, Homo sapiens
ctactgcccctgccctgagga

SEQ ID NO: 3826816 - DNA, 14 bp, Homo sapiens
ctacttgctctgga

SEQ ID NO: 3826817 - DNA, 17 bp, Homo sapiens
ctacttgctctggacct

SEQ ID NO: 3826818 - DNA, 19 bp, Homo sapiens
ctacttgctctggacctgc

SEQ ID NO: 3826819 - DNA, 20 bp, Homo sapiens
ctagaaaataatgcaaatgt

SEQ ID NO: 3826820 - DNA, 16 bp, Homo sapiens
ctagaacacagaaagc

SEQ ID NO: 3826821 - DNA, 16 bp, Homo sapiens
ctagaggctgagcacc

SEQ ID NO: 3826822 - DNA, 17 bp, Homo sapiens
ctagagggtcggggagg

SEQ ID NO: 3826823 - DNA, 16 bp, Homo sapiens
ctagcacctccccaga

SEQ ID NO: 3826824 - DNA, 17 bp, Homo sapiens
ctagcacctccccagac

SEQ ID NO: 3826825 - DNA, 20 bp, Homo sapiens
ctagcacctccccagacagg

SEQ ID NO: 3826826 - DNA, 21 bp, Homo sapiens
ctagcacctccccagacaggg

SEQ ID NO: 3826827 - DNA, 16 bp, Homo sapiens
ctagcccaggagagag

SEQ ID NO: 3826828 - DNA, 18 bp, Homo sapiens
ctagcccaggagagagaa

SEQ ID NO: 3826829 - DNA, 22 bp, Homo sapiens
ctagcccaggagagagaaagcc

SEQ ID NO: 3826830 - DNA, 23 bp, Homo sapiens
ctagcccaggagagagaaagcca

SEQ ID NO: 3826831 - DNA, 20 bp, Homo sapiens
ctagcccctgtggagactgg

SEQ ID NO: 3826832 - DNA, 16 bp, Homo sapiens
ctagcctcattttgtt

SEQ ID NO: 3826833 - DNA, 15 bp, Homo sapiens
ctagcctttggctct

SEQ ID NO: 3826834 - DNA, 19 bp, Homo sapiens
ctagcctttggctctggag

SEQ ID NO: 3826835 - DNA, 21 bp, Homo sapiens
ctagcctttggctctggagac

SEQ ID NO: 3826836 - DNA, 15 bp, Homo sapiens
ctagctaaaccagaa

SEQ ID NO: 3826837 - DNA, 15 bp, Homo sapiens
ctagctaataaacct

SEQ ID NO: 3826838 - DNA, 15 bp, Homo sapiens
ctagctggagtgcca

SEQ ID NO: 3826839 - DNA, 23 bp, Homo sapiens
ctagcttctgcttttctgccctg

SEQ ID NO: 3826840 - DNA, 19 bp, Homo sapiens
ctagctttagaccctgggt

SEQ ID NO: 3826841 - DNA, 16 bp, Homo sapiens
ctaggcacctctgtgc

SEQ ID NO: 3826842 - DNA, 17 bp, Homo sapiens
ctaggcagaagaagctg

SEQ ID NO: 3826843 - DNA, 18 bp, Homo sapiens
ctaggcagaagaagctgg

SEQ ID NO: 3826844 - DNA, 23 bp, Homo sapiens
ctaggcagaagaagctgggaggg

SEQ ID NO: 3826845 - DNA, 20 bp, Homo sapiens
ctaggcagccagctacaggc

SEQ ID NO: 3826846 - DNA, 17 bp, Homo sapiens
ctaggggaggggggagc

SEQ ID NO: 3826847 - DNA, 20 bp, Homo sapiens
ctaggggaggggggagccag

SEQ ID NO: 3826848 - DNA, 22 bp, Homo sapiens
ctaggggaggggggagccagag

SEQ ID NO: 3826849 - DNA, 22 bp, Homo sapiens
ctaggggtcattttagctcaaa

SEQ ID NO: 3826850 - DNA, 17 bp, Homo sapiens
ctaggtgggagccacca

SEQ ID NO: 3826851 - DNA, 17 bp, Homo sapiens
ctagtgctgaagcttat

SEQ ID NO: 3826852 - DNA, 22 bp, Homo sapiens
ctagtgctgaagcttattaatg

SEQ ID NO: 3826853 - DNA, 15 bp, Homo sapiens
ctagttcagaaggaa

SEQ ID NO: 3826854 - DNA, 17 bp, Homo sapiens
ctagtttcccctctcat

SEQ ID NO: 3826855 - DNA, 22 bp, Homo sapiens
ctataacaaatgctttattatt

SEQ ID NO: 3826856 - DNA, 15 bp, Homo sapiens
ctataagtatataaa

SEQ ID NO: 3826857 - DNA, 18 bp, Homo sapiens
ctataattttgcaaatct

SEQ ID NO: 3826858 - DNA, 18 bp, Homo sapiens
ctatatacttttgcttgg

SEQ ID NO: 3826859 - DNA, 15 bp, Homo sapiens
ctatatccttcctag

SEQ ID NO: 3826860 - DNA, 14 bp, Homo sapiens
ctatattaactttt

SEQ ID NO: 3826861 - DNA, 23 bp, Homo sapiens
ctatcaatccaaattccctctgg

SEQ ID NO: 3826862 - DNA, 21 bp, Homo sapiens
ctatctcatctatctcaatcc

SEQ ID NO: 3826863 - DNA, 16 bp, Homo sapiens
ctatgcaattgtacaa

SEQ ID NO: 3826864 - DNA, 23 bp, Homo sapiens
ctatgcaattgtacaaaaaagtt

SEQ ID NO: 3826865 - DNA, 16 bp, Homo sapiens
ctatgcccagcctcca

SEQ ID NO: 3826866 - DNA, 10 bp, Homo sapiens
ctatggctca

SEQ ID NO: 3826867 - DNA, 15 bp, Homo sapiens
ctattctccagctga

SEQ ID NO: 3826868 - DNA, 18 bp, Homo sapiens
ctattctgtgaaactaat

SEQ ID NO: 3826869 - DNA, 23 bp, Homo sapiens
ctattgtattatagtactgcttt

SEQ ID NO: 3826870 - DNA, 17 bp, Homo sapiens
ctatttataactaatat

SEQ ID NO: 3826871 - DNA, 21 bp, Homo sapiens
ctatttgctatctgaactaat

SEQ ID NO: 3826872 - DNA, 21 bp, Homo sapiens
ctatttttactagaacacaga

SEQ ID NO: 3826873 - DNA, 20 bp, Homo sapiens
ctcaaaatgccacagcccag

SEQ ID NO: 3826874 - DNA, 15 bp, Homo sapiens
ctcaaacgtggcttt

SEQ ID NO: 3826875 - DNA, 22 bp, Homo sapiens
ctcaaagcaagctcttctcctc

SEQ ID NO: 3826876 - DNA, 22 bp, Homo sapiens
ctcaaatacagtagtataatgt

SEQ ID NO: 3826877 - DNA, 11 bp, Homo sapiens
ctcaagaaaca

SEQ ID NO: 3826878 - DNA, 17 bp, Homo sapiens
ctcaagattcccaggag

SEQ ID NO: 3826879 - DNA, 22 bp, Homo sapiens
ctcaagtgccctctccgagctg

SEQ ID NO: 3826880 - DNA, 18 bp, Homo sapiens
ctcaatgcaacctctgcc

SEQ ID NO: 3826881 - DNA, 19 bp, Homo sapiens
ctcaatgcaacctctgccc

SEQ ID NO: 3826882 - DNA, 16 bp, Homo sapiens
ctcaatgggggggcgg

SEQ ID NO: 3826883 - DNA, 21 bp, Homo sapiens
ctcacattcccccggtgcctc

SEQ ID NO: 3826884 - DNA, 13 bp, Homo sapiens
ctcacccctgtcc

SEQ ID NO: 3826885 - DNA, 15 bp, Homo sapiens
ctcacctcatgccca

SEQ ID NO: 3826886 - DNA, 17 bp, Homo sapiens
ctcacctcatgcccacc

SEQ ID NO: 3826887 - DNA, 13 bp, Homo sapiens
ctcacgcctgtaa

SEQ ID NO: 3826888 - DNA, 12 bp, Homo sapiens
ctcactacctcc

SEQ ID NO: 3826889 - DNA, 16 bp, Homo sapiens
ctcactcttgccaacc

SEQ ID NO: 3826890 - DNA, 19 bp, Homo sapiens
ctcactgccaggccagcct

SEQ ID NO: 3826891 - DNA, 15 bp, Homo sapiens
ctcactgctccctga

SEQ ID NO: 3826892 - DNA, 19 bp, Homo sapiens
ctcactgctccctgaagcc

SEQ ID NO: 3826893 - DNA, 20 bp, Homo sapiens
ctcactgctccctgaagcca

SEQ ID NO: 3826894 - DNA, 16 bp, Homo sapiens
ctcactggccatccct

SEQ ID NO: 3826895 - DNA, 19 bp, Homo sapiens
ctcacttttggaaggtgac

SEQ ID NO: 3826896 - DNA, 18 bp, Homo sapiens
ctcagatgatggggtcag

SEQ ID NO: 3826897 - DNA, 19 bp, Homo sapiens
ctcagcatgtagggcttct

SEQ ID NO: 3826898 - DNA, 22 bp, Homo sapiens
ctcagccccaggagaagggaca

SEQ ID NO: 3826899 - DNA, 13 bp, Homo sapiens
ctcagccctgagc

SEQ ID NO: 3826900 - DNA, 17 bp, Homo sapiens
ctcagccctgagctggc

SEQ ID NO: 3826901 - DNA, 17 bp, Homo sapiens
ctcagccctgagttggc

SEQ ID NO: 3826902 - DNA, 12 bp, Homo sapiens
ctcagccctgga

SEQ ID NO: 3826903 - DNA, 20 bp, Homo sapiens
ctcagccctggaggtgccag

SEQ ID NO: 3826904 - DNA, 16 bp, Homo sapiens
ctcagctgcttctccc

SEQ ID NO: 3826905 - DNA, 13 bp, Homo sapiens
ctcagcttgtgcc

SEQ ID NO: 3826906 - DNA, 15 bp, Homo sapiens
ctcagcttgtgcctt

SEQ ID NO: 3826907 - DNA, 22 bp, Homo sapiens
ctcagggccaagccggcccaac

SEQ ID NO: 3826908 - DNA, 14 bp, Homo sapiens
ctcagtcctcccct

SEQ ID NO: 3826909 - DNA, 16 bp, Homo sapiens
ctcagtcctcccctca

SEQ ID NO: 3826910 - DNA, 19 bp, Homo sapiens
ctcagtcctcccctcacag

SEQ ID NO: 3826911 - DNA, 20 bp, Homo sapiens
ctcagtcctcccctcacagc

SEQ ID NO: 3826912 - DNA, 22 bp, Homo sapiens
ctcagtcctcccctcacagcct

SEQ ID NO: 3826913 - DNA, 14 bp, Homo sapiens
ctcagtctccttgg

SEQ ID NO: 3826914 - DNA, 23 bp, Homo sapiens
ctcagttacacaaaggacctcag

SEQ ID NO: 3826915 - DNA, 16 bp, Homo sapiens
ctcatctcctttgcta

SEQ ID NO: 3826916 - DNA, 21 bp, Homo sapiens
ctgctccctgaagccagcctt

SEQ ID NO: 3826917 - DNA, 16 bp, Homo sapiens
ctgctcctccctctga

SEQ ID NO: 3826918 - DNA, 14 bp, Homo sapiens
ctgctctgtacatc

SEQ ID NO: 3826919 - DNA, 20 bp, Homo sapiens
ctgctgcaggggctctggag

SEQ ID NO: 3826920 - DNA, 15 bp, Homo sapiens
ctgctgcccccaccc

SEQ ID NO: 3826921 - DNA, 21 bp, Homo sapiens
ctgctgcccccaccccgggga

SEQ ID NO: 3826922 - DNA, 22 bp, Homo sapiens
ctgctgcccccaccccggggac

SEQ ID NO: 3826923 - DNA, 17 bp, Homo sapiens
ctgctgcgccctgggct

SEQ ID NO: 3826924 - DNA, 14 bp, Homo sapiens
ctgctggcacccac

SEQ ID NO: 3826925 - DNA, 20 bp, Homo sapiens
ctgcttaggggaatgttttc

SEQ ID NO: 3826926 - DNA, 20 bp, Homo sapiens
ctgcttatttattgaaaata

SEQ ID NO: 3826927 - DNA, 12 bp, Homo sapiens
ctgctttactgt

SEQ ID NO: 3826928 - DNA, 17 bp, Homo sapiens
ctgctttactgtgtatc

SEQ ID NO: 3826929 - DNA, 13 bp, Homo sapiens
ctgctttgcccca

SEQ ID NO: 3826930 - DNA, 16 bp, Homo sapiens
ctgctttgccccactg

SEQ ID NO: 3826931 - DNA, 20 bp, Homo sapiens
ctgcttttctgccctggctg

SEQ ID NO: 3826932 - DNA, 17 bp, Homo sapiens
ctgctttttatggcctg

SEQ ID NO: 3826933 - DNA, 18 bp, Homo sapiens
ctgctttttatggcctgt

SEQ ID NO: 3826934 - DNA, 16 bp, Homo sapiens
ctggaaaggggagagc

SEQ ID NO: 3826935 - DNA, 18 bp, Homo sapiens
ctggaaaggggagagcct

SEQ ID NO: 3826936 - DNA, 23 bp, Homo sapiens
ctggaaaggggagagcctgctgg

SEQ ID NO: 3826937 - DNA, 22 bp, Homo sapiens
ctggaaagttgggatttgcaaa

SEQ ID NO: 3826938 - DNA, 16 bp, Homo sapiens
ctggaacgctctaggc

SEQ ID NO: 3826939 - DNA, 17 bp, Homo sapiens
ctggaaggctgctttct

SEQ ID NO: 3826940 - DNA, 13 bp, Homo sapiens
ctggaatttgaaa

SEQ ID NO: 3826941 - DNA, 17 bp, Homo sapiens
ctggacctgcccccgca

SEQ ID NO: 3826942 - DNA, 22 bp, Homo sapiens
ctggaccttggccctacagccc

SEQ ID NO: 3826943 - DNA, 14 bp, Homo sapiens
ctggacggcaggct

SEQ ID NO: 3826944 - DNA, 22 bp, Homo sapiens
ctggacggcaggctcactgcca

SEQ ID NO: 3826945 - DNA, 16 bp, Homo sapiens
ctggagaagagaggag

SEQ ID NO: 3826946 - DNA, 11 bp, Homo sapiens
ctggagacagc

SEQ ID NO: 3826947 - DNA, 13 bp, Homo sapiens
ctggagacagccc

SEQ ID NO: 3826948 - DNA, 14 bp, Homo sapiens
ctggagacagcccc

SEQ ID NO: 3826949 - DNA, 15 bp, Homo sapiens
ctggagacagcccca

SEQ ID NO: 3826950 - DNA, 17 bp, Homo sapiens
ctggagacagccccaga

SEQ ID NO: 3826951 - DNA, 19 bp, Homo sapiens
ctggagacagccccagagc

SEQ ID NO: 3826952 - DNA, 20 bp, Homo sapiens
ctggagacagccccagagca

SEQ ID NO: 3826953 - DNA, 22 bp, Homo sapiens
ctggagacagccccagagcagg

SEQ ID NO: 3826954 - DNA, 21 bp, Homo sapiens
ctggagcaagccctgacccaa

SEQ ID NO: 3826955 - DNA, 20 bp, Homo sapiens
ctggagcccggtgttcagtg

SEQ ID NO: 3826956 - DNA, 12 bp, Homo sapiens
ctggagcctgtg

SEQ ID NO: 3826957 - DNA, 17 bp, Homo sapiens
ctggagcctgtgtaaca

SEQ ID NO: 3826958 - DNA, 18 bp, Homo sapiens
ctggagcctgtgtaacag

SEQ ID NO: 3826959 - DNA, 13 bp, Homo sapiens
ctggagctgtgta

SEQ ID NO: 3826960 - DNA, 19 bp, Homo sapiens
ctggaggtgccagcaaagc

SEQ ID NO: 3826961 - DNA, 18 bp, Homo sapiens
ctggaggtgggagcagga

SEQ ID NO: 3826962 - DNA, 19 bp, Homo sapiens
ctggaggtgggagcaggag

SEQ ID NO: 3826963 - DNA, 16 bp, Homo sapiens
ctggaggttgaagcca

SEQ ID NO: 3826964 - DNA, 16 bp, Homo sapiens
ctggagtgcagtggct

SEQ ID NO: 3826965 - DNA, 16 bp, Homo sapiens
ctggagtgccatggct

SEQ ID NO: 3826966 - DNA, 23 bp, Homo sapiens
ctggagtttcatgttatgcctgt

SEQ ID NO: 3826967 - DNA, 15 bp, Homo sapiens
ctggatccatcctgc

SEQ ID NO: 3826968 - DNA, 15 bp, Homo sapiens
ctggatggagcccag

SEQ ID NO: 3826969 - DNA, 16 bp, Homo sapiens
ctggatggagcccagg

SEQ ID NO: 3826970 - DNA, 20 bp, Homo sapiens
ctggcagtttgttgatcttt

SEQ ID NO: 3826971 - DNA, 15 bp, Homo sapiens
ctggccaccccatct

SEQ ID NO: 3826972 - DNA, 13 bp, Homo sapiens
ctggccatggctg

SEQ ID NO: 3826973 - DNA, 14 bp, Homo sapiens
ctggccatgtcctc

SEQ ID NO: 3826974 - DNA, 15 bp, Homo sapiens
ctggcccaggctggc

SEQ ID NO: 3826975 - DNA, 16 bp, Homo sapiens
ctggcccaggctggcc

SEQ ID NO: 3826976 - DNA, 18 bp, Homo sapiens
ctggcccccacccacctt

SEQ ID NO: 3826977 - DNA, 19 bp, Homo sapiens
ctggcctaggtgggagcca

SEQ ID NO: 3826978 - DNA, 14 bp, Homo sapiens
ctggcctcacctgg

SEQ ID NO: 3826979 - DNA, 18 bp, Homo sapiens
ctggcctcacctgggttc

SEQ ID NO: 3826980 - DNA, 22 bp, Homo sapiens
ctggcgccaacaacttctccat

SEQ ID NO: 3826981 - DNA, 19 bp, Homo sapiens
ctggctaggactgtggagg

SEQ ID NO: 3826982 - DNA, 22 bp, Homo sapiens
ctggctcctggggatggccagg

SEQ ID NO: 3826983 - DNA, 17 bp, Homo sapiens
ctggctgaggttcctct

SEQ ID NO: 3826984 - DNA, 21 bp, Homo sapiens
ctggctgaggttcctctgcct

SEQ ID NO: 3826985 - DNA, 14 bp, Homo sapiens
ctggctgcactcaa

SEQ ID NO: 3826986 - DNA, 15 bp, Homo sapiens
ctggctgctgccccc

SEQ ID NO: 3826987 - DNA, 13 bp, Homo sapiens
ctggctgcttgcc

SEQ ID NO: 3826988 - DNA, 14 bp, Homo sapiens
ctggctggtttgcc

SEQ ID NO: 3826989 - DNA, 18 bp, Homo sapiens
ctggctggtttgcccaga

SEQ ID NO: 3826990 - DNA, 19 bp, Homo sapiens
ctgggagagtccttagcct

SEQ ID NO: 3826991 - DNA, 19 bp, Homo sapiens
ctgggaggagggagaggga

SEQ ID NO: 3826992 - DNA, 12 bp, Homo sapiens
ctgggagggagg

SEQ ID NO: 3826993 - DNA, 15 bp, Homo sapiens
ctgggagggaggggg

SEQ ID NO: 3826994 - DNA, 16 bp, Homo sapiens
ctgggagggaggggga

SEQ ID NO: 3826995 - DNA, 21 bp, Homo sapiens
ctgggagggagggggaggtga

SEQ ID NO: 3826996 - DNA, 20 bp, Homo sapiens
ctgggatatcacttcatcct

SEQ ID NO: 3826997 - DNA, 22 bp, Homo sapiens
ctgggcaccccaggcagctcct

SEQ ID NO: 3826998 - DNA, 17 bp, Homo sapiens
ctgggcccttcctggct

SEQ ID NO: 3826999 - DNA, 18 bp, Homo sapiens
ctgggcccttcctggcta

SEQ ID NO: 3827000 - DNA, 20 bp, Homo sapiens
ctgggcctcctcctagctgg

SEQ ID NO: 3827001 - DNA, 23 bp, Homo sapiens
ctgggcctcctcctagctggagt

SEQ ID NO: 3827002 - DNA, 17 bp, Homo sapiens
ctgggcctgcacctctc

SEQ ID NO: 3827003 - DNA, 18 bp, Homo sapiens
ctgggcgcagctgaagcc

SEQ ID NO: 3827004 - DNA, 21 bp, Homo sapiens
ctgggcgcagctgaagcctgg

SEQ ID NO: 3827005 - DNA, 22 bp, Homo sapiens
ctgggcgcagctgaagcctgga

SEQ ID NO: 3827006 - DNA, 19 bp, Homo sapiens
ctgggctagaggctgagca

SEQ ID NO: 3827007 - DNA, 12 bp, Homo sapiens
ctgggctgcctc

SEQ ID NO: 3827008 - DNA, 13 bp, Homo sapiens
ctggggcctggac

SEQ ID NO: 3827009 - DNA, 16 bp, Homo sapiens
ctggggctcagccctg

SEQ ID NO: 3827010 - DNA, 18 bp, Homo sapiens
ctgggggatgcaaataaa

SEQ ID NO: 3827011 - DNA, 15 bp, Homo sapiens
ctgggtgggctctgt

SEQ ID NO: 3827012 - DNA, 21 bp, Homo sapiens
ctggtaggaaaaagctttact

SEQ ID NO: 3827013 - DNA, 18 bp, Homo sapiens
ctggtattgtaatattaa

SEQ ID NO: 3827014 - DNA, 19 bp, Homo sapiens
ctggtattgtaatattaaa

SEQ ID NO: 3827015 - DNA, 22 bp, Homo sapiens
ctggtgggaggggcgcccacct

SEQ ID NO: 3827016 - DNA, 21 bp, Homo sapiens
ctggtggggcagaaaggctgc

SEQ ID NO: 3827017 - DNA, 22 bp, Homo sapiens
ctggtggggcagaaaggctgca

SEQ ID NO: 3827018 - DNA, 14 bp, Homo sapiens
ctggtttgcccaga

SEQ ID NO: 3827019 - DNA, 15 bp, Homo sapiens
ctgtaaatatttcat

SEQ ID NO: 3827020 - DNA, 18 bp, Homo sapiens
ctgtaaatatttcataaa

SEQ ID NO: 3827021 - DNA, 12 bp, Homo sapiens
ctgtaataaata

SEQ ID NO: 3827022 - DNA, 13 bp, Homo sapiens
ctgtaataaatat

SEQ ID NO: 3827023 - DNA, 14 bp, Homo sapiens
ctgtaataaatgta

SEQ ID NO: 3827024 - DNA, 13 bp, Homo sapiens
ctgtaattacaac

SEQ ID NO: 3827025 - DNA, 14 bp, Homo sapiens
ctgtaattacaact

SEQ ID NO: 3827026 - DNA, 16 bp, Homo sapiens
ctgtaattacaactaa

SEQ ID NO: 3827027 - DNA, 21 bp, Homo sapiens
ctgtatggaatacaatgtaat

SEQ ID NO: 3827028 - DNA, 22 bp, Homo sapiens
ctgtatttttttttctaagaga

SEQ ID NO: 3827029 - DNA, 17 bp, Homo sapiens
ctgtccctcccacctct

SEQ ID NO: 3827030 - DNA, 18 bp, Homo sapiens
ctgtccctcccacctctg

SEQ ID NO: 3827031 - DNA, 19 bp, Homo sapiens
ctgtccctcccacctctgt

SEQ ID NO: 3827032 - DNA, 21 bp, Homo sapiens
ctgtccctcccacctctgtga

SEQ ID NO: 3827033 - DNA, 13 bp, Homo sapiens
ctgtcctcactgc

SEQ ID NO: 3827034 - DNA, 16 bp, Homo sapiens
ctgtcctcactgctcc

SEQ ID NO: 3827035 - DNA, 17 bp, Homo sapiens
ctgtcctccccaccccg

SEQ ID NO: 3827036 - DNA, 14 bp, Homo sapiens
ctgtcctgggggat

SEQ ID NO: 3827037 - DNA, 17 bp, Homo sapiens
ctgtcctgggggatgca

SEQ ID NO: 3827038 - DNA, 17 bp, Homo sapiens
ctgtcgcctgacagcat

SEQ ID NO: 3827039 - DNA, 14 bp, Homo sapiens
ctgtcggccacacc

SEQ ID NO: 3827040 - DNA, 18 bp, Homo sapiens
ctgtcggccacaccccag

SEQ ID NO: 3827041 - DNA, 19 bp, Homo sapiens
ctgtcggccacaccccaga

SEQ ID NO: 3827042 - DNA, 16 bp, Homo sapiens
ctgtgacatggtgcct

SEQ ID NO: 3827043 - DNA, 20 bp, Homo sapiens
ctgtgacatggtgcctgaga

SEQ ID NO: 3827044 - DNA, 17 bp, Homo sapiens
ctgtgacctcaggcact

SEQ ID NO: 3827045 - DNA, 16 bp, Homo sapiens
ctgtgcagggccctct

SEQ ID NO: 3827046 - DNA, 18 bp, Homo sapiens
ctgtgcagggccctctgg

SEQ ID NO: 3827047 - DNA, 22 bp, Homo sapiens
ctgtgcagggccctctggggct

SEQ ID NO: 3827048 - DNA, 23 bp, Homo sapiens
gagccccgcagacctccccagcc

SEQ ID NO: 3827049 - DNA, 17 bp, Homo sapiens
gagcccttgcctcccca

SEQ ID NO: 3827050 - DNA, 18 bp, Homo sapiens
gagccgcctcggagtgtg

SEQ ID NO: 3827051 - DNA, 13 bp, Homo sapiens
gagcctgctggca

SEQ ID NO: 3827052 - DNA, 23 bp, Homo sapiens
gagcctggccatgtcctcaaccc

SEQ ID NO: 3827053 - DNA, 12 bp, Homo sapiens
gagcctggctct

SEQ ID NO: 3827054 - DNA, 13 bp, Homo sapiens
gagcctgtgtaac

SEQ ID NO: 3827055 - DNA, 17 bp, Homo sapiens
gagcctgtgtaacagct

SEQ ID NO: 3827056 - DNA, 19 bp, Homo sapiens
gagcctgtgtaacagctcc

SEQ ID NO: 3827057 - DNA, 21 bp, Homo sapiens
gagcctgtgtaacagctcctt

SEQ ID NO: 3827058 - DNA, 16 bp, Homo sapiens
gagcggtctcaggctg

SEQ ID NO: 3827059 - DNA, 14 bp, Homo sapiens
gagctagtgtcacc

SEQ ID NO: 3827060 - DNA, 14 bp, Homo sapiens
gagctattgctaga

SEQ ID NO: 3827061 - DNA, 14 bp, Homo sapiens
gagctgccttccct

SEQ ID NO: 3827062 - DNA, 21 bp, Homo sapiens
gagctgctggccatggctgct

SEQ ID NO: 3827063 - DNA, 18 bp, Homo sapiens
gagctggcaccattcaga

SEQ ID NO: 3827064 - DNA, 21 bp, Homo sapiens
gagctgtgtaccaatcgtctc

SEQ ID NO: 3827065 - DNA, 17 bp, Homo sapiens
gagcttgcctcagggcc

SEQ ID NO: 3827066 - DNA, 22 bp, Homo sapiens
gagcttgcctcagggccaagcc

SEQ ID NO: 3827067 - DNA, 13 bp, Homo sapiens
gaggaagcagaat

SEQ ID NO: 3827068 - DNA, 14 bp, Homo sapiens
gaggaagcagaata

SEQ ID NO: 3827069 - DNA, 16 bp, Homo sapiens
gaggaagcagaataaa

SEQ ID NO: 3827070 - DNA, 17 bp, Homo sapiens
gaggaagcagaataaag

SEQ ID NO: 3827071 - DNA, 14 bp, Homo sapiens
gaggaataaagctt

SEQ ID NO: 3827072 - DNA, 17 bp, Homo sapiens
gaggaataaagcttctc

SEQ ID NO: 3827073 - DNA, 23 bp, Homo sapiens
gaggaataaagcttctctctgag

SEQ ID NO: 3827074 - DNA, 16 bp, Homo sapiens
gaggaatttgaagctc

SEQ ID NO: 3827075 - DNA, 20 bp, Homo sapiens
gaggaatttgaagctcagaa

SEQ ID NO: 3827076 - DNA, 18 bp, Homo sapiens
gaggaccctcagccccag

SEQ ID NO: 3827077 - DNA, 15 bp, Homo sapiens
gaggacctccatgcc

SEQ ID NO: 3827078 - DNA, 17 bp, Homo sapiens
gaggagaacttgaacaa

SEQ ID NO: 3827079 - DNA, 12 bp, Homo sapiens
gaggagagaggc

SEQ ID NO: 3827080 - DNA, 15 bp, Homo sapiens
gaggagagaggcaga

SEQ ID NO: 3827081 - DNA, 17 bp, Homo sapiens
gaggagaggagagaggc

SEQ ID NO: 3827082 - DNA, 13 bp, Homo sapiens
gaggaggaaggca

SEQ ID NO: 3827083 - DNA, 16 bp, Homo sapiens
gaggaggaaggcaaga

SEQ ID NO: 3827084 - DNA, 14 bp, Homo sapiens
gaggagggccctga

SEQ ID NO: 3827085 - DNA, 15 bp, Homo sapiens
gaggagggccctgag

SEQ ID NO: 3827086 - DNA, 16 bp, Homo sapiens
gaggagggccctgagg

SEQ ID NO: 3827087 - DNA, 21 bp, Homo sapiens
gaggagtggccctgatccagg

SEQ ID NO: 3827088 - DNA, 18 bp, Homo sapiens
gaggatcctggtattgta

SEQ ID NO: 3827089 - DNA, 19 bp, Homo sapiens
gaggcaataaataaatgtt

SEQ ID NO: 3827090 - DNA, 12 bp, Homo sapiens
gaggcagagagc

SEQ ID NO: 3827091 - DNA, 12 bp, Homo sapiens
gaggccaggatg

SEQ ID NO: 3827092 - DNA, 19 bp, Homo sapiens
gaggccaggatgcctgagc

SEQ ID NO: 3827093 - DNA, 22 bp, Homo sapiens
gaggccaggatgcctgagcccc

SEQ ID NO: 3827094 - DNA, 14 bp, Homo sapiens
gaggctcctggtgg

SEQ ID NO: 3827095 - DNA, 15 bp, Homo sapiens
gaggctcctggtggg

SEQ ID NO: 3827096 - DNA, 16 bp, Homo sapiens
gaggctcggggctccc

SEQ ID NO: 3827097 - DNA, 20 bp, Homo sapiens
gaggcttctccgccagcctc

SEQ ID NO: 3827098 - DNA, 23 bp, Homo sapiens
gaggcttctccgccagcctcctc

SEQ ID NO: 3827099 - DNA, 21 bp, Homo sapiens
gagggaatccccgaaggtgct

SEQ ID NO: 3827100 - DNA, 20 bp, Homo sapiens
gagggagcatagaaggcagg

SEQ ID NO: 3827101 - DNA, 13 bp, Homo sapiens
gagggagggggag

SEQ ID NO: 3827102 - DNA, 15 bp, Homo sapiens
gagggcaagaggtgc

SEQ ID NO: 3827103 - DNA, 17 bp, Homo sapiens
gagggccctgaggaata

SEQ ID NO: 3827104 - DNA, 22 bp, Homo sapiens
gagggccctgaggaataaagct

SEQ ID NO: 3827105 - DNA, 22 bp, Homo sapiens
gagggcctgaggtctggctgct

SEQ ID NO: 3827106 - DNA, 12 bp, Homo sapiens
gagggcgcccag

SEQ ID NO: 3827107 - DNA, 13 bp, Homo sapiens
gagggcgcccagc

SEQ ID NO: 3827108 - DNA, 16 bp, Homo sapiens
gagggcgcccagccca

SEQ ID NO: 3827109 - DNA, 17 bp, Homo sapiens
gagggcgcccagcccag

SEQ ID NO: 3827110 - DNA, 19 bp, Homo sapiens
gagggcgcccagcccaggc

SEQ ID NO: 3827111 - DNA, 20 bp, Homo sapiens
gagggcgcccagcccaggcc

SEQ ID NO: 3827112 - DNA, 21 bp, Homo sapiens
gagggcgcccagcccaggcct

SEQ ID NO: 3827113 - DNA, 14 bp, Homo sapiens
gaggggagaagcca

SEQ ID NO: 3827114 - DNA, 21 bp, Homo sapiens
gaggggagctgctggccatgg

SEQ ID NO: 3827115 - DNA, 14 bp, Homo sapiens
gagggggaggtgaa

SEQ ID NO: 3827116 - DNA, 13 bp, Homo sapiens
gaggggggagcca

SEQ ID NO: 3827117 - DNA, 15 bp, Homo sapiens
gaggggggagccaga

SEQ ID NO: 3827118 - DNA, 18 bp, Homo sapiens
gaggggggagccagaggc

SEQ ID NO: 3827119 - DNA, 14 bp, Homo sapiens
gaggggtgtggcag

SEQ ID NO: 3827120 - DNA, 20 bp, Homo sapiens
gagggtggcagagacagtgg

SEQ ID NO: 3827121 - DNA, 16 bp, Homo sapiens
gaggtcactggaaagg

SEQ ID NO: 3827122 - DNA, 18 bp, Homo sapiens
gaggtcactggaaagggg

SEQ ID NO: 3827123 - DNA, 19 bp, Homo sapiens
gaggtgccagcaaagcccc

SEQ ID NO: 3827124 - DNA, 13 bp, Homo sapiens
gaggtgcctggga

SEQ ID NO: 3827125 - DNA, 14 bp, Homo sapiens
gaggtgcctgggag

SEQ ID NO: 3827126 - DNA, 19 bp, Homo sapiens
gaggtgcctgggaggagtg

SEQ ID NO: 3827127 - DNA, 13 bp, Homo sapiens
gaggtggaagaag

SEQ ID NO: 3827128 - DNA, 15 bp, Homo sapiens
gaggtgggagcagga

SEQ ID NO: 3827129 - DNA, 16 bp, Homo sapiens
gaggttcctctgcctg

SEQ ID NO: 3827130 - DNA, 18 bp, Homo sapiens
gaggttcctctgcctgcc

SEQ ID NO: 3827131 - DNA, 12 bp, Homo sapiens
gagtcctggggt

SEQ ID NO: 3827132 - DNA, 19 bp, Homo sapiens
gagtccttagcctgggcct

SEQ ID NO: 3827133 - DNA, 14 bp, Homo sapiens
gagtgagggcctga

SEQ ID NO: 3827134 - DNA, 13 bp, Homo sapiens
gagtgccatggct

SEQ ID NO: 3827135 - DNA, 13 bp, Homo sapiens
gagtgctgtgaga

SEQ ID NO: 3827136 - DNA, 13 bp, Homo sapiens
gagtggccctgat

SEQ ID NO: 3827137 - DNA, 13 bp, Homo sapiens
gagtgtggcctgg

SEQ ID NO: 3827138 - DNA, 14 bp, Homo sapiens
gagtgtggcctgga

SEQ ID NO: 3827139 - DNA, 16 bp, Homo sapiens
gagtgtggcctggatc

SEQ ID NO: 3827140 - DNA, 23 bp, Homo sapiens
gagttcccaaagggagggtggca

SEQ ID NO: 3827141 - DNA, 20 bp, Homo sapiens
gagtttacaagaaataaatc

SEQ ID NO: 3827142 - DNA, 15 bp, Homo sapiens
gagttttcatttcat

SEQ ID NO: 3827143 - DNA, 16 bp, Homo sapiens
gagtttttcattattt

SEQ ID NO: 3827144 - DNA, 14 bp, Homo sapiens
gataaggccgagcc

SEQ ID NO: 3827145 - DNA, 17 bp, Homo sapiens
gatactgaatattgaca

SEQ ID NO: 3827146 - DNA, 17 bp, Homo sapiens
gatacttgaaaattaac

SEQ ID NO: 3827147 - DNA, 18 bp, Homo sapiens
gatagctaaataacttgc

SEQ ID NO: 3827148 - DNA, 17 bp, Homo sapiens
gatataagtgtgtgttt

SEQ ID NO: 3827149 - DNA, 21 bp, Homo sapiens
gatataagtgtgtgtttttca

SEQ ID NO: 3827150 - DNA, 13 bp, Homo sapiens
gatccccagggca

SEQ ID NO: 3827151 - DNA, 22 bp, Homo sapiens
gatcctaatcccttcctctccc

SEQ ID NO: 3827152 - DNA, 17 bp, Homo sapiens
gatcctggtattgtaat

SEQ ID NO: 3827153 - DNA, 16 bp, Homo sapiens
gatcggcttcctcagg

SEQ ID NO: 3827154 - DNA, 14 bp, Homo sapiens
gatctgctcagccc

SEQ ID NO: 3827155 - DNA, 18 bp, Homo sapiens
gatctgctcagccctgga

SEQ ID NO: 3827156 - DNA, 19 bp, Homo sapiens
gatctgctcagccctggag

SEQ ID NO: 3827157 - DNA, 20 bp, Homo sapiens
gatctgctcagccctggagg

SEQ ID NO: 3827158 - DNA, 15 bp, Homo sapiens
gatctgtcctggggg

SEQ ID NO: 3827159 - DNA, 15 bp, Homo sapiens
gatgaatccaaatgt

SEQ ID NO: 3827160 - DNA, 19 bp, Homo sapiens
gatgaatccaaatgtgaaa

SEQ ID NO: 3827161 - DNA, 14 bp, Homo sapiens
gatgactatggaaa

SEQ ID NO: 3827162 - DNA, 13 bp, Homo sapiens
gatgactcaagat

SEQ ID NO: 3827163 - DNA, 16 bp, Homo sapiens
gatgagtttttaaatg

SEQ ID NO: 3827164 - DNA, 15 bp, Homo sapiens
gatgatggggtcagc

SEQ ID NO: 3827165 - DNA, 19 bp, Homo sapiens
gatgatggggtcagcaggc

SEQ ID NO: 3827166 - DNA, 21 bp, Homo sapiens
gatgatggggtcagcaggccc

SEQ ID NO: 3827167 - DNA, 19 bp, Homo sapiens
gatgcaaataaagcctgct

SEQ ID NO: 3827168 - DNA, 20 bp, Homo sapiens
gatgcatgttactgccaaaa

SEQ ID NO: 3827169 - DNA, 14 bp, Homo sapiens
gatgctggagaaga

SEQ ID NO: 3827170 - DNA, 19 bp, Homo sapiens
gatgctggagaagagagga

SEQ ID NO: 3827171 - DNA, 14 bp, Homo sapiens
gatggagcccaggc

SEQ ID NO: 3827172 - DNA, 18 bp, Homo sapiens
gatggcccattctacttg

SEQ ID NO: 3827173 - DNA, 22 bp, Homo sapiens
gatggcccattctacttgctct

SEQ ID NO: 3827174 - DNA, 14 bp, Homo sapiens
gatgggaggctcct

SEQ ID NO: 3827175 - DNA, 13 bp, Homo sapiens
gatgtatgtgtga

SEQ ID NO: 3827176 - DNA, 21 bp, Homo sapiens
gattaaatatatctttgtaaa

SEQ ID NO: 3827177 - DNA, 13 bp, Homo sapiens
gattatacagaat

SEQ ID NO: 3827178 - DNA, 23 bp, Homo sapiens
gattccaggaggagttagccaaa

SEQ ID NO: 3827179 - DNA, 21 bp, Homo sapiens
gattcccaggagttctgctca

SEQ ID NO: 3827180 - DNA, 15 bp, Homo sapiens
gattcccgcatggtt

SEQ ID NO: 3827181 - DNA, 17 bp, Homo sapiens
gattcccgcatggtttt

SEQ ID NO: 3827182 - DNA, 15 bp, Homo sapiens
gctccttccctaggc

SEQ ID NO: 3827183 - DNA, 16 bp, Homo sapiens
gctccttgggaggaag

SEQ ID NO: 3827184 - DNA, 18 bp, Homo sapiens
gctccttgggaggaagca

SEQ ID NO: 3827185 - DNA, 19 bp, Homo sapiens
gctccttgggaggaagcag

SEQ ID NO: 3827186 - DNA, 20 bp, Homo sapiens
gctccttgggaggaagcaga

SEQ ID NO: 3827187 - DNA, 14 bp, Homo sapiens
gctcgcacctgcct

SEQ ID NO: 3827188 - DNA, 13 bp, Homo sapiens
gctcggggctccc

SEQ ID NO: 3827189 - DNA, 15 bp, Homo sapiens
gctcggggctcccca

SEQ ID NO: 3827190 - DNA, 13 bp, Homo sapiens
gctctcagcttgt

SEQ ID NO: 3827191 - DNA, 15 bp, Homo sapiens
gctctcagcttgtgc

SEQ ID NO: 3827192 - DNA, 13 bp, Homo sapiens
gctctcatgtctc

SEQ ID NO: 3827193 - DNA, 18 bp, Homo sapiens
gctctctgtctccaggca

SEQ ID NO: 3827194 - DNA, 19 bp, Homo sapiens
gctctctgtctccaggcag

SEQ ID NO: 3827195 - DNA, 13 bp, Homo sapiens
gctctggacctgc

SEQ ID NO: 3827196 - DNA, 14 bp, Homo sapiens
gctctggacctgcc

SEQ ID NO: 3827197 - DNA, 16 bp, Homo sapiens
gctctggagcaagccc

SEQ ID NO: 3827198 - DNA, 22 bp, Homo sapiens
gctctggagtgagtctgtcata

SEQ ID NO: 3827199 - DNA, 18 bp, Homo sapiens
gctctgtcctccccaccc

SEQ ID NO: 3827200 - DNA, 19 bp, Homo sapiens
gctctgtgcagtcactgga

SEQ ID NO: 3827201 - DNA, 21 bp, Homo sapiens
gctgaagccacacagcccaga

SEQ ID NO: 3827202 - DNA, 13 bp, Homo sapiens
gctgaagcctgga

SEQ ID NO: 3827203 - DNA, 20 bp, Homo sapiens
gctgaagcctggacgcagcc

SEQ ID NO: 3827204 - DNA, 22 bp, Homo sapiens
gctgaagcctggacgcagccac

SEQ ID NO: 3827205 - DNA, 16 bp, Homo sapiens
gctgaggaccctcagc

SEQ ID NO: 3827206 - DNA, 16 bp, Homo sapiens
gctgaggttcctctgc

SEQ ID NO: 3827207 - DNA, 17 bp, Homo sapiens
gctgaggttcctctgcc

SEQ ID NO: 3827208 - DNA, 20 bp, Homo sapiens
gctgaggttcctctgcctgc

SEQ ID NO: 3827209 - DNA, 13 bp, Homo sapiens
gctgagtcctggg

SEQ ID NO: 3827210 - DNA, 16 bp, Homo sapiens
gctgattcctaaggcc

SEQ ID NO: 3827211 - DNA, 20 bp, Homo sapiens
gctgattcctaaggcccagc

SEQ ID NO: 3827212 - DNA, 22 bp, Homo sapiens
gctgattcctaaggcccagctg

SEQ ID NO: 3827213 - DNA, 23 bp, Homo sapiens
gctgattcctaaggcccagctgc

SEQ ID NO: 3827214 - DNA, 12 bp, Homo sapiens
gctgcaggggct

SEQ ID NO: 3827215 - DNA, 22 bp, Homo sapiens
gctgcaggggctctggagagaa

SEQ ID NO: 3827216 - DNA, 14 bp, Homo sapiens
gctgcatcccacca

SEQ ID NO: 3827217 - DNA, 19 bp, Homo sapiens
gctgcatcccaccagcctg

SEQ ID NO: 3827218 - DNA, 19 bp, Homo sapiens
gctgcattttaagcataat

SEQ ID NO: 3827219 - DNA, 20 bp, Homo sapiens
gctgccagggaagacagagc

SEQ ID NO: 3827220 - DNA, 23 bp, Homo sapiens
gctgccagggaagacagagcagg

SEQ ID NO: 3827221 - DNA, 15 bp, Homo sapiens
gctgcccccaccccg

SEQ ID NO: 3827222 - DNA, 19 bp, Homo sapiens
gctgcccggcctccctccc

SEQ ID NO: 3827223 - DNA, 14 bp, Homo sapiens
gctgccctccatcc

SEQ ID NO: 3827224 - DNA, 16 bp, Homo sapiens
gctgccttccctagct

SEQ ID NO: 3827225 - DNA, 21 bp, Homo sapiens
gctgctgaccagcactgaccc

SEQ ID NO: 3827226 - DNA, 22 bp, Homo sapiens
gctgctgaccagcactgacccc

SEQ ID NO: 3827227 - DNA, 17 bp, Homo sapiens
gctgctgcgccctgggc

SEQ ID NO: 3827228 - DNA, 14 bp, Homo sapiens
gctgctggccatgg

SEQ ID NO: 3827229 - DNA, 23 bp, Homo sapiens
gctgctttgtagtttgcccagag

SEQ ID NO: 3827230 - DNA, 17 bp, Homo sapiens
gctggagaaatcttgaa

SEQ ID NO: 3827231 - DNA, 17 bp, Homo sapiens
gctggagaagagaggag

SEQ ID NO: 3827232 - DNA, 21 bp, Homo sapiens
gctggagaagagaggagagga

SEQ ID NO: 3827233 - DNA, 14 bp, Homo sapiens
gctggagcctgtgt

SEQ ID NO: 3827234 - DNA, 19 bp, Homo sapiens
gctggaggtgggagcagga

SEQ ID NO: 3827235 - DNA, 21 bp, Homo sapiens
gctggaggtgggagcaggaga

SEQ ID NO: 3827236 - DNA, 16 bp, Homo sapiens
gctggagtgcagtggc

SEQ ID NO: 3827237 - DNA, 15 bp, Homo sapiens
gctggagtgccatgg

SEQ ID NO: 3827238 - DNA, 16 bp, Homo sapiens
gctggatggagcccag

SEQ ID NO: 3827239 - DNA, 16 bp, Homo sapiens
gctggcacccaccgtg

SEQ ID NO: 3827240 - DNA, 21 bp, Homo sapiens
gctggcacccaccgtggagga

SEQ ID NO: 3827241 - DNA, 23 bp, Homo sapiens
gctggcacccaccgtggaggagg

SEQ ID NO: 3827242 - DNA, 19 bp, Homo sapiens
gctggcccccacccacctt

SEQ ID NO: 3827243 - DNA, 21 bp, Homo sapiens
gctggcctaggtgggagccac

SEQ ID NO: 3827244 - DNA, 15 bp, Homo sapiens
gctggcgtcacctgt

SEQ ID NO: 3827245 - DNA, 14 bp, Homo sapiens
gctgggagggaggg

SEQ ID NO: 3827246 - DNA, 17 bp, Homo sapiens
gctgggagggaggggga

SEQ ID NO: 3827247 - DNA, 19 bp, Homo sapiens
gctgggagggagggggagg

SEQ ID NO: 3827248 - DNA, 17 bp, Homo sapiens
gctgggcccttcctggc

SEQ ID NO: 3827249 - DNA, 19 bp, Homo sapiens
gctgggcccttcctggcta

SEQ ID NO: 3827250 - DNA, 20 bp, Homo sapiens
gctgggcccttcctggctag

SEQ ID NO: 3827251 - DNA, 22 bp, Homo sapiens
gctgggcccttcctggctagga

SEQ ID NO: 3827252 - DNA, 16 bp, Homo sapiens
gctggggggtctcagc

SEQ ID NO: 3827253 - DNA, 12 bp, Homo sapiens
gctggtgggagg

SEQ ID NO: 3827254 - DNA, 13 bp, Homo sapiens
gctggtgggaggg

SEQ ID NO: 3827255 - DNA, 16 bp, Homo sapiens
gctggtgtttatgtga

SEQ ID NO: 3827256 - DNA, 17 bp, Homo sapiens
gctggtttttcccacca

SEQ ID NO: 3827257 - DNA, 17 bp, Homo sapiens
gctgtaaatatttcata

SEQ ID NO: 3827258 - DNA, 14 bp, Homo sapiens
gctgtctctagaag

SEQ ID NO: 3827259 - DNA, 13 bp, Homo sapiens
gctgtgagccttg

SEQ ID NO: 3827260 - DNA, 15 bp, Homo sapiens
gctgtgccaggctgg

SEQ ID NO: 3827261 - DNA, 21 bp, Homo sapiens
gctgtgccaggctgggaggct

SEQ ID NO: 3827262 - DNA, 22 bp, Homo sapiens
gctgtgccaggctgggaggctc

SEQ ID NO: 3827263 - DNA, 16 bp, Homo sapiens
gctgtgtcttactaga

SEQ ID NO: 3827264 - DNA, 16 bp, Homo sapiens
gctgttcgcagcctca

SEQ ID NO: 3827265 - DNA, 16 bp, Homo sapiens
gctgttggcagtgagt

SEQ ID NO: 3827266 - DNA, 12 bp, Homo sapiens
gcttaattgaaa

SEQ ID NO: 3827267 - DNA, 19 bp, Homo sapiens
gcttattaatgctaagggc

SEQ ID NO: 3827268 - DNA, 20 bp, Homo sapiens
gcttattaatgctaagggca

SEQ ID NO: 3827269 - DNA, 15 bp, Homo sapiens
gcttctaatatttat

SEQ ID NO: 3827270 - DNA, 18 bp, Homo sapiens
gcttctaatatttattgc

SEQ ID NO: 3827271 - DNA, 16 bp, Homo sapiens
gcttctccgccagcct

SEQ ID NO: 3827272 - DNA, 19 bp, Homo sapiens
gcttctccgccagcctcct

SEQ ID NO: 3827273 - DNA, 21 bp, Homo sapiens
gcttctccgccagcctcctct

SEQ ID NO: 3827274 - DNA, 14 bp, Homo sapiens
gcttctgcttttct

SEQ ID NO: 3827275 - DNA, 16 bp, Homo sapiens
gcttctgcttttctgc

SEQ ID NO: 3827276 - DNA, 20 bp, Homo sapiens
gcttctgcttttctgccctg

SEQ ID NO: 3827277 - DNA, 18 bp, Homo sapiens
gcttgaagattcaggctt

SEQ ID NO: 3827278 - DNA, 14 bp, Homo sapiens
gcttgaagccaaag

SEQ ID NO: 3827279 - DNA, 15 bp, Homo sapiens
gcttgaagccaaaga

SEQ ID NO: 3827280 - DNA, 16 bp, Homo sapiens
gcttgaagccaaagaa

SEQ ID NO: 3827281 - DNA, 20 bp, Homo sapiens
gcttgaagccaaagaaaaat

SEQ ID NO: 3827282 - DNA, 21 bp, Homo sapiens
gcttgagccgggcccctgggc

SEQ ID NO: 3827283 - DNA, 13 bp, Homo sapiens
gcttgagttttca

SEQ ID NO: 3827284 - DNA, 21 bp, Homo sapiens
gcttgagttttcatttcatat

SEQ ID NO: 3827285 - DNA, 12 bp, Homo sapiens
gcttgcattaaa

SEQ ID NO: 3827286 - DNA, 12 bp, Homo sapiens
gcttgcttttct

SEQ ID NO: 3827287 - DNA, 15 bp, Homo sapiens
gcttggaatgggaga

SEQ ID NO: 3827288 - DNA, 14 bp, Homo sapiens
gcttggcctgctgt

SEQ ID NO: 3827289 - DNA, 15 bp, Homo sapiens
gcttggcctgctgtg

SEQ ID NO: 3827290 - DNA, 13 bp, Homo sapiens
gcttggttcattt

SEQ ID NO: 3827291 - DNA, 22 bp, Homo sapiens
gctttactctttcatgccattt

SEQ ID NO: 3827292 - DNA, 16 bp, Homo sapiens
gctttagaccctgggt

SEQ ID NO: 3827293 - DNA, 20 bp, Homo sapiens
gctttatgggtgttaattga

SEQ ID NO: 3827294 - DNA, 15 bp, Homo sapiens
gctttctattgtaca

SEQ ID NO: 3827295 - DNA, 21 bp, Homo sapiens
gctttgtagtttgcccagagt

SEQ ID NO: 3827296 - DNA, 13 bp, Homo sapiens
gctttgtgtctgg

SEQ ID NO: 3827297 - DNA, 14 bp, Homo sapiens
gcttttctgccctg

SEQ ID NO: 3827298 - DNA, 17 bp, Homo sapiens
gcttttctgccctggct

SEQ ID NO: 3827299 - DNA, 19 bp, Homo sapiens
gcttttctgccctggctgc

SEQ ID NO: 3827300 - DNA, 14 bp, Homo sapiens
gcttttctgtattt

SEQ ID NO: 3827301 - DNA, 16 bp, Homo sapiens
gcttttggtgcctggc

SEQ ID NO: 3827302 - DNA, 20 bp, Homo sapiens
gctttttctttttttgcata

SEQ ID NO: 3827303 - DNA, 15 bp, Homo sapiens
gcttttttagattta

SEQ ID NO: 3827304 - DNA, 13 bp, Homo sapiens
ggaaaaacacaag

SEQ ID NO: 3827305 - DNA, 16 bp, Homo sapiens
ggaaaactaactcagg

SEQ ID NO: 3827306 - DNA, 13 bp, Homo sapiens
ggaaaggggagag

SEQ ID NO: 3827307 - DNA, 14 bp, Homo sapiens
ggaaaggggagagc

SEQ ID NO: 3827308 - DNA, 16 bp, Homo sapiens
ggaaatggggagctgg

SEQ ID NO: 3827309 - DNA, 21 bp, Homo sapiens
ggaaatttatacaaagaaact

SEQ ID NO: 3827310 - DNA, 21 bp, Homo sapiens
ggaacctcactcttgccaacc

SEQ ID NO: 3827311 - DNA, 21 bp, Homo sapiens
ggaactgggtggtttggtttt

SEQ ID NO: 3827312 - DNA, 13 bp, Homo sapiens
ggaagaagggaga

SEQ ID NO: 3827313 - DNA, 14 bp, Homo sapiens
ggaagaagggagaa

SEQ ID NO: 3827314 - DNA, 14 bp, Homo sapiens
ggaagacagagcag

SEQ ID NO: 3827315 - DNA, 14 bp, Homo sapiens
gtatttttgtaaat

SEQ ID NO: 3827316 - DNA, 14 bp, Homo sapiens
gtcaaataaacact

SEQ ID NO: 3827317 - DNA, 20 bp, Homo sapiens
gtcacagggcatgccccggc

SEQ ID NO: 3827318 - DNA, 21 bp, Homo sapiens
gtcacatcctaatagaaagaa

SEQ ID NO: 3827319 - DNA, 15 bp, Homo sapiens
gtcacccatggcctc

SEQ ID NO: 3827320 - DNA, 19 bp, Homo sapiens
gtcacctgtgcagggccct

SEQ ID NO: 3827321 - DNA, 21 bp, Homo sapiens
gtcacgttttgcctcatgaac

SEQ ID NO: 3827322 - DNA, 19 bp, Homo sapiens
gtcactccataaaaagaaa

SEQ ID NO: 3827323 - DNA, 18 bp, Homo sapiens
gtcactggaggttgaagc

SEQ ID NO: 3827324 - DNA, 11 bp, Homo sapiens
gtcagcaggcc

SEQ ID NO: 3827325 - DNA, 18 bp, Homo sapiens
gtcagcaggcccaggaga

SEQ ID NO: 3827326 - DNA, 23 bp, Homo sapiens
gtcagcatttctagacttccaca

SEQ ID NO: 3827327 - DNA, 16 bp, Homo sapiens
gtcatgcgtctctggc

SEQ ID NO: 3827328 - DNA, 14 bp, Homo sapiens
gtcattgcccactt

SEQ ID NO: 3827329 - DNA, 17 bp, Homo sapiens
gtccatggtgctaagcg

SEQ ID NO: 3827330 - DNA, 15 bp, Homo sapiens
gtccattctcccagg

SEQ ID NO: 3827331 - DNA, 15 bp, Homo sapiens
gtcccaggacctgag

SEQ ID NO: 3827332 - DNA, 23 bp, Homo sapiens
gtcccaggacctgagcctggcca

SEQ ID NO: 3827333 - DNA, 12 bp, Homo sapiens
gtccccttccct

SEQ ID NO: 3827334 - DNA, 14 bp, Homo sapiens
gtcctcacccctgt

SEQ ID NO: 3827335 - DNA, 17 bp, Homo sapiens
gtcctcacccctgtcct

SEQ ID NO: 3827336 - DNA, 20 bp, Homo sapiens
gtcctcacccctgtcctcac

SEQ ID NO: 3827337 - DNA, 12 bp, Homo sapiens
gtcctcccaccc

SEQ ID NO: 3827338 - DNA, 18 bp, Homo sapiens
gtcctcccacccctcccc

SEQ ID NO: 3827339 - DNA, 13 bp, Homo sapiens
gtcctccccaccc

SEQ ID NO: 3827340 - DNA, 16 bp, Homo sapiens
gtcctcccctcacagc

SEQ ID NO: 3827341 - DNA, 18 bp, Homo sapiens
gtcctccggggctcagcc

SEQ ID NO: 3827342 - DNA, 20 bp, Homo sapiens
gtcctccggggctcagccct

SEQ ID NO: 3827343 - DNA, 13 bp, Homo sapiens
gtcctcctcacct

SEQ ID NO: 3827344 - DNA, 20 bp, Homo sapiens
gtccttagcctgggcctcct

SEQ ID NO: 3827345 - DNA, 18 bp, Homo sapiens
gtccttagtatcagtcat

SEQ ID NO: 3827346 - DNA, 19 bp, Homo sapiens
gtcgagggtcgtgagccca

SEQ ID NO: 3827347 - DNA, 22 bp, Homo sapiens
gtcgctctcatgaagcccttag

SEQ ID NO: 3827348 - DNA, 16 bp, Homo sapiens
gtcggccacaccccag

SEQ ID NO: 3827349 - DNA, 19 bp, Homo sapiens
gtcggccacaccccagact

SEQ ID NO: 3827350 - DNA, 23 bp, Homo sapiens
gtcggccacaccccagactccag

SEQ ID NO: 3827351 - DNA, 15 bp, Homo sapiens
gtctataagtatata

SEQ ID NO: 3827352 - DNA, 18 bp, Homo sapiens
gtctcaggctggtgggag

SEQ ID NO: 3827353 - DNA, 17 bp, Homo sapiens
gtctcatctcctttgct

SEQ ID NO: 3827354 - DNA, 13 bp, Homo sapiens
gtctcctcttcca

SEQ ID NO: 3827355 - DNA, 22 bp, Homo sapiens
gtctctagaagtgccatctcaa

SEQ ID NO: 3827356 - DNA, 18 bp, Homo sapiens
gtctctttggggagagct

SEQ ID NO: 3827357 - DNA, 21 bp, Homo sapiens
gtctctttggggagagctggc

SEQ ID NO: 3827358 - DNA, 16 bp, Homo sapiens
gtctgcaggtgcacca

SEQ ID NO: 3827359 - DNA, 13 bp, Homo sapiens
gtctgctctcagc

SEQ ID NO: 3827360 - DNA, 22 bp, Homo sapiens
gtctgctctcagcttgtgcctt

SEQ ID NO: 3827361 - DNA, 21 bp, Homo sapiens
gtctgtggaccctcgctctct

SEQ ID NO: 3827362 - DNA, 12 bp, Homo sapiens
gtctgtgtgcta

SEQ ID NO: 3827363 - DNA, 14 bp, Homo sapiens
gtctgtgtgctact

SEQ ID NO: 3827364 - DNA, 16 bp, Homo sapiens
gtctgtgtgctactaa

SEQ ID NO: 3827365 - DNA, 20 bp, Homo sapiens
gtctgtgtgctactaacaga

SEQ ID NO: 3827366 - DNA, 23 bp, Homo sapiens
gtctgttaggtgtacatcctgca

SEQ ID NO: 3827367 - DNA, 21 bp, Homo sapiens
gtctgttattgttttgttaac

SEQ ID NO: 3827368 - DNA, 15 bp, Homo sapiens
gtcttccttctgcct

SEQ ID NO: 3827369 - DNA, 12 bp, Homo sapiens
gtcttgcatttt

SEQ ID NO: 3827370 - DNA, 19 bp, Homo sapiens
gtcttgtgactagtgctga

SEQ ID NO: 3827371 - DNA, 20 bp, Homo sapiens
gtcttgtgactagtgctgaa

SEQ ID NO: 3827372 - DNA, 23 bp, Homo sapiens
gtcttttccacatggcagatgat

SEQ ID NO: 3827373 - DNA, 16 bp, Homo sapiens
gtctttttgaagtgtt

SEQ ID NO: 3827374 - DNA, 15 bp, Homo sapiens
gtgaaagatgcatgt

SEQ ID NO: 3827375 - DNA, 12 bp, Homo sapiens
gtgaaatttcat

SEQ ID NO: 3827376 - DNA, 14 bp, Homo sapiens
gtgaaatttcatga

SEQ ID NO: 3827377 - DNA, 12 bp, Homo sapiens
gtgaacctggag

SEQ ID NO: 3827378 - DNA, 13 bp, Homo sapiens
gtgacaagtgtgt

SEQ ID NO: 3827379 - DNA, 16 bp, Homo sapiens
gtgacagattatacag

SEQ ID NO: 3827380 - DNA, 15 bp, Homo sapiens
gtgacatggtgcctg

SEQ ID NO: 3827381 - DNA, 23 bp, Homo sapiens
gtgacatggtgcctgagaggcag

SEQ ID NO: 3827382 - DNA, 11 bp, Homo sapiens
gtgactagtgc

SEQ ID NO: 3827383 - DNA, 17 bp, Homo sapiens
gtgactagtgctgaagc

SEQ ID NO: 3827384 - DNA, 13 bp, Homo sapiens
gtgacttgggctc

SEQ ID NO: 3827385 - DNA, 14 bp, Homo sapiens
gtgagagagagggc

SEQ ID NO: 3827386 - DNA, 20 bp, Homo sapiens
gtgagagagagggcgcccag

SEQ ID NO: 3827387 - DNA, 15 bp, Homo sapiens
gtgagatgctggaga

SEQ ID NO: 3827388 - DNA, 18 bp, Homo sapiens
gtgagatgctggagaaga

SEQ ID NO: 3827389 - DNA, 22 bp, Homo sapiens
gtgagatgctggagaagagagg

SEQ ID NO: 3827390 - DNA, 12 bp, Homo sapiens
gtgagggcaaga

SEQ ID NO: 3827391 - DNA, 17 bp, Homo sapiens
gtgagggcaagaggtgc

SEQ ID NO: 3827392 - DNA, 15 bp, Homo sapiens
gtgagtccattctcc

SEQ ID NO: 3827393 - DNA, 18 bp, Homo sapiens
gtgagtctgtcataatat

SEQ ID NO: 3827394 - DNA, 23 bp, Homo sapiens
gtgattccactacacctggctga

SEQ ID NO: 3827395 - DNA, 15 bp, Homo sapiens
gtgattctcctgcct

SEQ ID NO: 3827396 - DNA, 15 bp, Homo sapiens
gtgcaccgttgggac

SEQ ID NO: 3827397 - DNA, 13 bp, Homo sapiens
gtgcactgtgtcc

SEQ ID NO: 3827398 - DNA, 23 bp, Homo sapiens
gtgcataaaaactggttctacaa

SEQ ID NO: 3827399 - DNA, 14 bp, Homo sapiens
gtgccagcaaagcc

SEQ ID NO: 3827400 - DNA, 15 bp, Homo sapiens
gtgccatgttcaaaa

SEQ ID NO: 3827401 - DNA, 24 bp, Homo sapiens
gtgcctgacaccacgctggagctg

SEQ ID NO: 3827402 - DNA, 15 bp, Homo sapiens
gtgcctgagaggcag

SEQ ID NO: 3827403 - DNA, 16 bp, Homo sapiens
gtgcctgagaggcagg

SEQ ID NO: 3827404 - DNA, 18 bp, Homo sapiens
gtgcctgagaggcaggca

SEQ ID NO: 3827405 - DNA, 14 bp, Homo sapiens
gtgcctgggaggag

SEQ ID NO: 3827406 - DNA, 20 bp, Homo sapiens
gtgccttaacctagagggtc

SEQ ID NO: 3827407 - DNA, 12 bp, Homo sapiens
gtgctactaaca

SEQ ID NO: 3827408 - DNA, 13 bp, Homo sapiens
gtgctggagaaat

SEQ ID NO: 3827409 - DNA, 17 bp, Homo sapiens
gtgctggaggtgggagc

SEQ ID NO: 3827410 - DNA, 21 bp, Homo sapiens
gtgctggaggtgggagcagga

SEQ ID NO: 3827411 - DNA, 24 bp, Homo sapiens
gtgctggaggtgggagcaggagat

SEQ ID NO: 3827412 - DNA, 19 bp, Homo sapiens
gtgctggatggagcccagg

SEQ ID NO: 3827413 - DNA, 20 bp, Homo sapiens
gtgctggatggagcccaggc

SEQ ID NO: 3827414 - DNA, 18 bp, Homo sapiens
gtgctgggaggagggaga

SEQ ID NO: 3827415 - DNA, 12 bp, Homo sapiens
gtgctttctatt

SEQ ID NO: 3827416 - DNA, 19 bp, Homo sapiens
gtgctttctattgtacaga

SEQ ID NO: 3827417 - DNA, 20 bp, Homo sapiens
gtgctttctattgtacagaa

SEQ ID NO: 3827418 - DNA, 20 bp, Homo sapiens
gtggacttagaaagcagggg

SEQ ID NO: 3827419 - DNA, 21 bp, Homo sapiens
gtggagagttgggggccagca

SEQ ID NO: 3827420 - DNA, 23 bp, Homo sapiens
gtggagagttgggggccagcaca

SEQ ID NO: 3827421 - DNA, 19 bp, Homo sapiens
gtggaggaggaaggcaaga

SEQ ID NO: 3827422 - DNA, 13 bp, Homo sapiens
gtggaggcttcct

SEQ ID NO: 3827423 - DNA, 14 bp, Homo sapiens
gtggaggcttcctg

SEQ ID NO: 3827424 - DNA, 13 bp, Homo sapiens
gtggatataaata

SEQ ID NO: 3827425 - DNA, 18 bp, Homo sapiens
gtggcagagacagtgggc

SEQ ID NO: 3827426 - DNA, 23 bp, Homo sapiens
gtggccggggctgaagccacaca

SEQ ID NO: 3827427 - DNA, 23 bp, Homo sapiens
gtggccttaagtctttttgaagt

SEQ ID NO: 3827428 - DNA, 23 bp, Homo sapiens
gtggctcaatgcaacctctgccc

SEQ ID NO: 3827429 - DNA, 22 bp, Homo sapiens
gtgggaaacctcattgttctgt

SEQ ID NO: 3827430 - DNA, 16 bp, Homo sapiens
gtgggatgagttttta

SEQ ID NO: 3827431 - DNA, 18 bp, Homo sapiens
gtgggctctgtgcagtca

SEQ ID NO: 3827432 - DNA, 12 bp, Homo sapiens
gtggggagaagg

SEQ ID NO: 3827433 - DNA, 17 bp, Homo sapiens
gtggggcagaaaggctg

SEQ ID NO: 3827434 - DNA, 14 bp, Homo sapiens
gtggggcccccagc

SEQ ID NO: 3827435 - DNA, 19 bp, Homo sapiens
gtggggcccccagcaccct

SEQ ID NO: 3827436 - DNA, 20 bp, Homo sapiens
gtgggggtggaggcttcctg

SEQ ID NO: 3827437 - DNA, 20 bp, Homo sapiens
gtgggtgagatgctggagaa

SEQ ID NO: 3827438 - DNA, 13 bp, Homo sapiens
gtgtaagccatca

SEQ ID NO: 3827439 - DNA, 14 bp, Homo sapiens
gtgtaattagcttt

SEQ ID NO: 3827440 - DNA, 20 bp, Homo sapiens
gtgtacatcctgcagcttat

SEQ ID NO: 3827441 - DNA, 13 bp, Homo sapiens
gtgtagattccct

SEQ ID NO: 3827442 - DNA, 17 bp, Homo sapiens
gtgtcaaataaacactg

SEQ ID NO: 3827443 - DNA, 17 bp, Homo sapiens
gtgtgctactaacagat

SEQ ID NO: 3827444 - DNA, 18 bp, Homo sapiens
gtgtgctactaacagatt

SEQ ID NO: 3827445 - DNA, 21 bp, Homo sapiens
gtgtgctactaacagattata

SEQ ID NO: 3827446 - DNA, 11 bp, Homo sapiens
gtgtgctttat

SEQ ID NO: 3827447 - DNA, 14 bp, Homo sapiens
gtgtggcagtggtt

SEQ ID NO: 3827448 - DNA, 12 bp, Homo sapiens
tattaactgaaa

SEQ ID NO: 3827449 - DNA, 22 bp, Homo sapiens
tattaagtatatttgtaaaagc

SEQ ID NO: 3827450 - DNA, 22 bp, Homo sapiens
tattaagtgaaattttaaatgc

SEQ ID NO: 3827451 - DNA, 14 bp, Homo sapiens
tattaatgctaagg

SEQ ID NO: 3827452 - DNA, 15 bp, Homo sapiens
tattaatgctaaggg

SEQ ID NO: 3827453 - DNA, 16 bp, Homo sapiens
tattagacattctctt

SEQ ID NO: 3827454 - DNA, 17 bp, Homo sapiens
tattatactgtagattt

SEQ ID NO: 3827455 - DNA, 14 bp, Homo sapiens
tattgggcaataaa

SEQ ID NO: 3827456 - DNA, 21 bp, Homo sapiens
tattgtaatattaaaaagaag

SEQ ID NO: 3827457 - DNA, 12 bp, Homo sapiens
tattgtacagaa

SEQ ID NO: 3827458 - DNA, 18 bp, Homo sapiens
tattgtgtttatgcattt

SEQ ID NO: 3827459 - DNA, 17 bp, Homo sapiens
tattgtgttttaacacc

SEQ ID NO: 3827460 - DNA, 18 bp, Homo sapiens
tattgttttgttaacaat

SEQ ID NO: 3827461 - DNA, 20 bp, Homo sapiens
tatttaatgtatttttgtaa

SEQ ID NO: 3827462 - DNA, 17 bp, Homo sapiens
tatttcttccagtgatg

SEQ ID NO: 3827463 - DNA, 15 bp, Homo sapiens
tatttgtctgtgtgc

SEQ ID NO: 3827464 - DNA, 18 bp, Homo sapiens
tatttgtctgtgtgctac

SEQ ID NO: 3827465 - DNA, 14 bp, Homo sapiens
tattttaaatgtgg

SEQ ID NO: 3827466 - DNA, 17 bp, Homo sapiens
tattttaaatgtggaat

SEQ ID NO: 3827467 - DNA, 14 bp, Homo sapiens
tattttctacagtg

SEQ ID NO: 3827468 - DNA, 15 bp, Homo sapiens
tattttctttttcct

SEQ ID NO: 3827469 - DNA, 22 bp, Homo sapiens
tattttgtgggcttaattgaaa

SEQ ID NO: 3827470 - DNA, 16 bp, Homo sapiens
tatttttggcattcct

SEQ ID NO: 3827471 - DNA, 11 bp, Homo sapiens
tatttttgtaa

SEQ ID NO: 3827472 - DNA, 22 bp, Homo sapiens
tatttttgtaaatagtttaaca

SEQ ID NO: 3827473 - DNA, 14 bp, Homo sapiens
tatttttttaaact

SEQ ID NO: 3827474 - DNA, 16 bp, Homo sapiens
tatttttttttctaag

SEQ ID NO: 3827475 - DNA, 13 bp, Homo sapiens
tcaaaaaagagga

SEQ ID NO: 3827476 - DNA, 22 bp, Homo sapiens
tcaaaaggaactgggtggtttg

SEQ ID NO: 3827477 - DNA, 13 bp, Homo sapiens
tcaaaccaggatt

SEQ ID NO: 3827478 - DNA, 21 bp, Homo sapiens
tcaaaccctgtaagttacagt

SEQ ID NO: 3827479 - DNA, 19 bp, Homo sapiens
tcaaagaccttgtgtgtat

SEQ ID NO: 3827480 - DNA, 22 bp, Homo sapiens
tcaaagcaagctcttctcctca

SEQ ID NO: 3827481 - DNA, 13 bp, Homo sapiens
tcaaataaacact

SEQ ID NO: 3827482 - DNA, 14 bp, Homo sapiens
tcaaataaacactg

SEQ ID NO: 3827483 - DNA, 21 bp, Homo sapiens
tcaaatacagtagtataatgt

SEQ ID NO: 3827484 - DNA, 22 bp, Homo sapiens
tcaaatacagtagtataatgta

SEQ ID NO: 3827485 - DNA, 14 bp, Homo sapiens
tcaaatgttacaaa

SEQ ID NO: 3827486 - DNA, 15 bp, Homo sapiens
tcaaatgttacaaaa

SEQ ID NO: 3827487 - DNA, 20 bp, Homo sapiens
tcaagattcccaggagttct

SEQ ID NO: 3827488 - DNA, 21 bp, Homo sapiens
tcaagcccagccacgtggagc

SEQ ID NO: 3827489 - DNA, 13 bp, Homo sapiens
tcaagctaataaa

SEQ ID NO: 3827490 - DNA, 19 bp, Homo sapiens
tcaagctaataaaatatca

SEQ ID NO: 3827491 - DNA, 22 bp, Homo sapiens
tcaagctaataaaatatcattc

SEQ ID NO: 3827492 - DNA, 23 bp, Homo sapiens
tcaagctaataaaatatcattca

SEQ ID NO: 3827493 - DNA, 15 bp, Homo sapiens
tcaagctaattttct

SEQ ID NO: 3827494 - DNA, 17 bp, Homo sapiens
tcaagtgattctcctgc

SEQ ID NO: 3827495 - DNA, 21 bp, Homo sapiens
tcaagtgattctcctgcctca

SEQ ID NO: 3827496 - DNA, 22 bp, Homo sapiens
tcaataaagcacgcagttatgt

SEQ ID NO: 3827497 - DNA, 17 bp, Homo sapiens
tcaatccaaattccctc

SEQ ID NO: 3827498 - DNA, 21 bp, Homo sapiens
tcaatcctaatttctcctccc

SEQ ID NO: 3827499 - DNA, 15 bp, Homo sapiens
tcacaacatatcaga

SEQ ID NO: 3827500 - DNA, 18 bp, Homo sapiens
tcacaattttctgtgcca

SEQ ID NO: 3827501 - DNA, 21 bp, Homo sapiens
tcacacagcctgtgtgcagtg

SEQ ID NO: 3827502 - DNA, 16 bp, Homo sapiens
tcacagcctctgaccc

SEQ ID NO: 3827503 - DNA, 18 bp, Homo sapiens
tcacagcctctgacccct

SEQ ID NO: 3827504 - DNA, 21 bp, Homo sapiens
tcacagcctctgacccctcct

SEQ ID NO: 3827505 - DNA, 22 bp, Homo sapiens
tcacagcctctgacccctcctc

SEQ ID NO: 3827506 - DNA, 20 bp, Homo sapiens
tcacagggcatgccccggcc

SEQ ID NO: 3827507 - DNA, 15 bp, Homo sapiens
tcacatgctggctcc

SEQ ID NO: 3827508 - DNA, 16 bp, Homo sapiens
tcacatggcatgtttt

SEQ ID NO: 3827509 - DNA, 11 bp, Homo sapiens
tcaccaccccc

SEQ ID NO: 3827510 - DNA, 19 bp, Homo sapiens
tcaccatgttggccaggct

SEQ ID NO: 3827511 - DNA, 17 bp, Homo sapiens
tcacccatggcctcaga

SEQ ID NO: 3827512 - DNA, 16 bp, Homo sapiens
tcacccctgtcctcac

SEQ ID NO: 3827513 - DNA, 13 bp, Homo sapiens
tcaccctgtgtaa

SEQ ID NO: 3827514 - DNA, 20 bp, Homo sapiens
tcacctcatgcccaccccct

SEQ ID NO: 3827515 - DNA, 20 bp, Homo sapiens
tcacctgcacagggccctct

SEQ ID NO: 3827516 - DNA, 21 bp, Homo sapiens
tcacctgcacagggccctctg

SEQ ID NO: 3827517 - DNA, 21 bp, Homo sapiens
tcacctgcgcagggccctctg

SEQ ID NO: 3827518 - DNA, 20 bp, Homo sapiens
tcacctgtgcagggccctct

SEQ ID NO: 3827519 - DNA, 16 bp, Homo sapiens
tcacctttccccactc

SEQ ID NO: 3827520 - DNA, 21 bp, Homo sapiens
tcacgcctgtaatcccagcac

SEQ ID NO: 3827521 - DNA, 17 bp, Homo sapiens
tcacggctactctatat

SEQ ID NO: 3827522 - DNA, 14 bp, Homo sapiens
tcactacctcctca

SEQ ID NO: 3827523 - DNA, 16 bp, Homo sapiens
tcactacctcctcagg

SEQ ID NO: 3827524 - DNA, 22 bp, Homo sapiens
tcactcagctggactgcattga

SEQ ID NO: 3827525 - DNA, 14 bp, Homo sapiens
tcactccataaaaa

SEQ ID NO: 3827526 - DNA, 18 bp, Homo sapiens
tcactccataaaaagaaa

SEQ ID NO: 3827527 - DNA, 20 bp, Homo sapiens
tcactccataaaaagaaagc

SEQ ID NO: 3827528 - DNA, 16 bp, Homo sapiens
tcactcttgccaacct

SEQ ID NO: 3827529 - DNA, 18 bp, Homo sapiens
tcactgccaggccagcct

SEQ ID NO: 3827530 - DNA, 19 bp, Homo sapiens
tcactgccaggccagcctc

SEQ ID NO: 3827531 - DNA, 20 bp, Homo sapiens
tcactgctccctgaagccag

SEQ ID NO: 3827532 - DNA, 21 bp, Homo sapiens
tcactgctccctgaagccagc

SEQ ID NO: 3827533 - DNA, 18 bp, Homo sapiens
tcactggaaaggggagag

SEQ ID NO: 3827534 - DNA, 23 bp, Homo sapiens
tcactggaaaggggagagcctgc

SEQ ID NO: 3827535 - DNA, 14 bp, Homo sapiens
tcactttggttttg

SEQ ID NO: 3827536 - DNA, 17 bp, Homo sapiens
tcactttggttttgggg

SEQ ID NO: 3827537 - DNA, 15 bp, Homo sapiens
tcagaaaatacctta

SEQ ID NO: 3827538 - DNA, 12 bp, Homo sapiens
tcagaagaaagg

SEQ ID NO: 3827539 - DNA, 21 bp, Homo sapiens
tcagaaggaagcaaaatccct

SEQ ID NO: 3827540 - DNA, 20 bp, Homo sapiens
tcagaaggtattttttaact

SEQ ID NO: 3827541 - DNA, 19 bp, Homo sapiens
tcagaatagtgatgtgttc

SEQ ID NO: 3827542 - DNA, 24 bp, Homo sapiens
tcagacattccatggtgattcctg

SEQ ID NO: 3827543 - DNA, 17 bp, Homo sapiens
tcagacctttgtctgaa

SEQ ID NO: 3827544 - DNA, 21 bp, Homo sapiens
tcagagtaatccaagcaaatg

SEQ ID NO: 3827545 - DNA, 12 bp, Homo sapiens
tcagcaggccca

SEQ ID NO: 3827546 - DNA, 14 bp, Homo sapiens
tcagcaggcccagg

SEQ ID NO: 3827547 - DNA, 16 bp, Homo sapiens
tcagcaggcccaggag

SEQ ID NO: 3827548 - DNA, 13 bp, Homo sapiens
tcagccctggagg

SEQ ID NO: 3827549 - DNA, 14 bp, Homo sapiens
tcagccctggaggt

SEQ ID NO: 3827550 - DNA, 21 bp, Homo sapiens
tcagccctggaggtgccagca

SEQ ID NO: 3827551 - DNA, 15 bp, Homo sapiens
tcagccgactcagca

SEQ ID NO: 3827552 - DNA, 15 bp, Homo sapiens
tcaggcactagcctt

SEQ ID NO: 3827553 - DNA, 16 bp, Homo sapiens
tcaggctggtgggagg

SEQ ID NO: 3827554 - DNA, 17 bp, Homo sapiens
tcaggctggtgggaggg

SEQ ID NO: 3827555 - DNA, 13 bp, Homo sapiens
tcagggccaagcc

SEQ ID NO: 3827556 - DNA, 17 bp, Homo sapiens
tcagggccaagccggcc

SEQ ID NO: 3827557 - DNA, 13 bp, Homo sapiens
tcagtctccttgg

SEQ ID NO: 3827558 - DNA, 15 bp, Homo sapiens
tcagtgtcaaataaa

SEQ ID NO: 3827559 - DNA, 17 bp, Homo sapiens
tcagtgtcaaataaaca

SEQ ID NO: 3827560 - DNA, 16 bp, Homo sapiens
tcataatatattgtgt

SEQ ID NO: 3827561 - DNA, 17 bp, Homo sapiens
tcataatatattgtgtt

SEQ ID NO: 3827562 - DNA, 19 bp, Homo sapiens
tcataattttcaaaagaaa

SEQ ID NO: 3827563 - DNA, 14 bp, Homo sapiens
tcatacaacaaaga

SEQ ID NO: 3827564 - DNA, 16 bp, Homo sapiens
tcatagaccctctcaa

SEQ ID NO: 3827565 - DNA, 15 bp, Homo sapiens
tcatagtttaattgg

SEQ ID NO: 3827566 - DNA, 16 bp, Homo sapiens
tcatatacctcttgaa

SEQ ID NO: 3827567 - DNA, 18 bp, Homo sapiens
tcatatatctatatgtct

SEQ ID NO: 3827568 - DNA, 20 bp, Homo sapiens
tcatatatctatatgtctat

SEQ ID NO: 3827569 - DNA, 11 bp, Homo sapiens
tcatccaggga

SEQ ID NO: 3827570 - DNA, 12 bp, Homo sapiens
tcatccagggaa

SEQ ID NO: 3827571 - DNA, 23 bp, Homo sapiens
tcatccagggaaatgcctcgagc

SEQ ID NO: 3827572 - DNA, 18 bp, Homo sapiens
tcatctaggtaaattaca

SEQ ID NO: 3827573 - DNA, 20 bp, Homo sapiens
tcatctcattacccttttct

SEQ ID NO: 3827574 - DNA, 21 bp, Homo sapiens
tcatctttgttggctcagaaa

SEQ ID NO: 3827575 - DNA, 23 bp, Homo sapiens
tcatctttgttggctcagaaaat

SEQ ID NO: 3827576 - DNA, 15 bp, Homo sapiens
tcatgaaaactggga

SEQ ID NO: 3827577 - DNA, 18 bp, Homo sapiens
tcatgccattttatttct

SEQ ID NO: 3827578 - DNA, 19 bp, Homo sapiens
tcatgccattttatttctt

SEQ ID NO: 3827579 - DNA, 19 bp, Homo sapiens
tcatgcccaccccctgccc

SEQ ID NO: 3827580 - DNA, 15 bp, Homo sapiens
tgagataatgttctg

SEQ ID NO: 3827581 - DNA, 21 bp, Homo sapiens
tgagattcacatgctggctcc

SEQ ID NO: 3827582 - DNA, 17 bp, Homo sapiens
tgagcaagacgccctct

SEQ ID NO: 3827583 - DNA, 22 bp, Homo sapiens
tgagcacctttggaaacaacat

SEQ ID NO: 3827584 - DNA, 16 bp, Homo sapiens
tgagccccgcagacct

SEQ ID NO: 3827585 - DNA, 24 bp, Homo sapiens
tgagccgcctcggagtgtggcctg

SEQ ID NO: 3827586 - DNA, 20 bp, Homo sapiens
tgagccgggcccctgggctt

SEQ ID NO: 3827587 - DNA, 14 bp, Homo sapiens
tgagctaggaattg

SEQ ID NO: 3827588 - DNA, 22 bp, Homo sapiens
tgagctagtgtcacctgcacag

SEQ ID NO: 3827589 - DNA, 21 bp, Homo sapiens
tgagctgcttatttattgaaa

SEQ ID NO: 3827590 - DNA, 17 bp, Homo sapiens
tgagctggcctcacctg

SEQ ID NO: 3827591 - DNA, 22 bp, Homo sapiens
tgaggaataaagcttctctctg

SEQ ID NO: 3827592 - DNA, 15 bp, Homo sapiens
tgaggaccctcagcc

SEQ ID NO: 3827593 - DNA, 20 bp, Homo sapiens
tgaggagggccctgaggaat

SEQ ID NO: 3827594 - DNA, 22 bp, Homo sapiens
tgaggagggccctgaggaataa

SEQ ID NO: 3827595 - DNA, 23 bp, Homo sapiens
tgaggagggccctgaggaataaa

SEQ ID NO: 3827596 - DNA, 13 bp, Homo sapiens
tgaggatcagagt

SEQ ID NO: 3827597 - DNA, 18 bp, Homo sapiens
tgaggccagcctgcggga

SEQ ID NO: 3827598 - DNA, 23 bp, Homo sapiens
tgaggccagcctgcgggaagctg

SEQ ID NO: 3827599 - DNA, 19 bp, Homo sapiens
tgagggcaagaggtgcctg

SEQ ID NO: 3827600 - DNA, 13 bp, Homo sapiens
tgaggggaatctg

SEQ ID NO: 3827601 - DNA, 14 bp, Homo sapiens
tgagggtcctgctg

SEQ ID NO: 3827602 - DNA, 15 bp, Homo sapiens
tgaggtctggctgct

SEQ ID NO: 3827603 - DNA, 16 bp, Homo sapiens
tgaggttcctctgcct

SEQ ID NO: 3827604 - DNA, 17 bp, Homo sapiens
tgaggttcctctgcctg

SEQ ID NO: 3827605 - DNA, 18 bp, Homo sapiens
tgaggttcctctgcctgc

SEQ ID NO: 3827606 - DNA, 21 bp, Homo sapiens
tgaggttcctctgcctgcccc

SEQ ID NO: 3827607 - DNA, 15 bp, Homo sapiens
tgagtatcataatat

SEQ ID NO: 3827608 - DNA, 20 bp, Homo sapiens
tgagtccattctcccaggta

SEQ ID NO: 3827609 - DNA, 12 bp, Homo sapiens
tgagtcctgggg

SEQ ID NO: 3827610 - DNA, 19 bp, Homo sapiens
tgagttcccaaagggaggg

SEQ ID NO: 3827611 - DNA, 22 bp, Homo sapiens
tgagttcccaaagggagggtgg

SEQ ID NO: 3827612 - DNA, 23 bp, Homo sapiens
tgagttcccaaagggagggtggc

SEQ ID NO: 3827613 - DNA, 16 bp, Homo sapiens
tgagtttgagctgcct

SEQ ID NO: 3827614 - DNA, 19 bp, Homo sapiens
tgagtttgagctgccttcc

SEQ ID NO: 3827615 - DNA, 21 bp, Homo sapiens
tgagtttgagctgccttccct

SEQ ID NO: 3827616 - DNA, 17 bp, Homo sapiens
tgagtttttaaatgcca

SEQ ID NO: 3827617 - DNA, 17 bp, Homo sapiens
tgatataagtgtgtgtt

SEQ ID NO: 3827618 - DNA, 23 bp, Homo sapiens
tgatataagtgtgtgtttttcat

SEQ ID NO: 3827619 - DNA, 23 bp, Homo sapiens
tgatccaggaaaatgtgagggga

SEQ ID NO: 3827620 - DNA, 22 bp, Homo sapiens
tgatcttttaagtttccttccc

SEQ ID NO: 3827621 - DNA, 17 bp, Homo sapiens
tgatgacagtagtacca

SEQ ID NO: 3827622 - DNA, 14 bp, Homo sapiens
tgatgactcaagat

SEQ ID NO: 3827623 - DNA, 15 bp, Homo sapiens
tgatgactcaagatt

SEQ ID NO: 3827624 - DNA, 20 bp, Homo sapiens
tgatggcccattctacttgc

SEQ ID NO: 3827625 - DNA, 17 bp, Homo sapiens
tgatggggtcagcaggc

SEQ ID NO: 3827626 - DNA, 18 bp, Homo sapiens
tgatggggtcagcaggcc

SEQ ID NO: 3827627 - DNA, 20 bp, Homo sapiens
tgatggggtcagcaggccca

SEQ ID NO: 3827628 - DNA, 14 bp, Homo sapiens
tgatgtacacattt

SEQ ID NO: 3827629 - DNA, 17 bp, Homo sapiens
tgatgtacacattttgt

SEQ ID NO: 3827630 - DNA, 10 bp, Homo sapiens
tgattcaaat

SEQ ID NO: 3827631 - DNA, 14 bp, Homo sapiens
tgattcaaatgtta

SEQ ID NO: 3827632 - DNA, 19 bp, Homo sapiens
tgattccactacacctggc

SEQ ID NO: 3827633 - DNA, 23 bp, Homo sapiens
tgattcctaaggcccagctgcca

SEQ ID NO: 3827634 - DNA, 14 bp, Homo sapiens
tgattgttcataat

SEQ ID NO: 3827635 - DNA, 20 bp, Homo sapiens
tgatttagccatgtgaaact

SEQ ID NO: 3827636 - DNA, 12 bp, Homo sapiens
tgatttgtaaag

SEQ ID NO: 3827637 - DNA, 22 bp, Homo sapiens
tgatttgtaaaggactatttat

SEQ ID NO: 3827638 - DNA, 15 bp, Homo sapiens
tgatttttaaatcat

SEQ ID NO: 3827639 - DNA, 22 bp, Homo sapiens
tgcaaataaaggctctggaagc

SEQ ID NO: 3827640 - DNA, 14 bp, Homo sapiens
tgcaacctctgccc

SEQ ID NO: 3827641 - DNA, 21 bp, Homo sapiens
tgcaacgctgattcctaaggc

SEQ ID NO: 3827642 - DNA, 19 bp, Homo sapiens
tgcaattgtacaaaaaagt

SEQ ID NO: 3827643 - DNA, 23 bp, Homo sapiens
tgcacaccgtgtgccatagaatg

SEQ ID NO: 3827644 - DNA, 16 bp, Homo sapiens
tgcacagactggtcca

SEQ ID NO: 3827645 - DNA, 14 bp, Homo sapiens
tgcactcaagaccc

SEQ ID NO: 3827646 - DNA, 19 bp, Homo sapiens
tgcactccggcctgggcga

SEQ ID NO: 3827647 - DNA, 12 bp, Homo sapiens
tgcagggccagg

SEQ ID NO: 3827648 - DNA, 13 bp, Homo sapiens
tgcagggccagga

SEQ ID NO: 3827649 - DNA, 20 bp, Homo sapiens
tgcagggccctctggggctc

SEQ ID NO: 3827650 - DNA, 13 bp, Homo sapiens
tgcaggggctctg

SEQ ID NO: 3827651 - DNA, 19 bp, Homo sapiens
tgcaggggctctggagaga

SEQ ID NO: 3827652 - DNA, 21 bp, Homo sapiens
tgcaggggctctggagagaaa

SEQ ID NO: 3827653 - DNA, 18 bp, Homo sapiens
tgcataaataattttgtt

SEQ ID NO: 3827654 - DNA, 22 bp, Homo sapiens
tgcataaataattttgttttaa

SEQ ID NO: 3827655 - DNA, 22 bp, Homo sapiens
tgcataacgtataaaagcctgt

SEQ ID NO: 3827656 - DNA, 15 bp, Homo sapiens
tgcatattaaagata

SEQ ID NO: 3827657 - DNA, 13 bp, Homo sapiens
tgcatgacctatc

SEQ ID NO: 3827658 - DNA, 22 bp, Homo sapiens
tgcatgttactgccaaaaccaa

SEQ ID NO: 3827659 - DNA, 15 bp, Homo sapiens
tgcattaataatcct

SEQ ID NO: 3827660 - DNA, 18 bp, Homo sapiens
tgcatttcaatttcaatg

SEQ ID NO: 3827661 - DNA, 17 bp, Homo sapiens
tgcattttttaaaacaa

SEQ ID NO: 3827662 - DNA, 15 bp, Homo sapiens
tgcattttttaaatt

SEQ ID NO: 3827663 - DNA, 20 bp, Homo sapiens
tgcattttttaaatttgcca

SEQ ID NO: 3827664 - DNA, 16 bp, Homo sapiens
tgcatttttttccttt

SEQ ID NO: 3827665 - DNA, 14 bp, Homo sapiens
tgccaaaaccaaat

SEQ ID NO: 3827666 - DNA, 17 bp, Homo sapiens
tgccaaagcagctacaa

SEQ ID NO: 3827667 - DNA, 18 bp, Homo sapiens
tgccaacctgtaataaat

SEQ ID NO: 3827668 - DNA, 20 bp, Homo sapiens
tgccaacctgtaataaatat

SEQ ID NO: 3827669 - DNA, 21 bp, Homo sapiens
tgccaacctgtaataaatatg

SEQ ID NO: 3827670 - DNA, 23 bp, Homo sapiens
tgccaacctgtaataaatatgag

SEQ ID NO: 3827671 - DNA, 12 bp, Homo sapiens
tgccaagccctt

SEQ ID NO: 3827672 - DNA, 18 bp, Homo sapiens
tgccaagttagctattgg

SEQ ID NO: 3827673 - DNA, 13 bp, Homo sapiens
tgccaccagagac

SEQ ID NO: 3827674 - DNA, 14 bp, Homo sapiens
tgccaccagagacc

SEQ ID NO: 3827675 - DNA, 18 bp, Homo sapiens
tgccaccagagaccgtcc

SEQ ID NO: 3827676 - DNA, 22 bp, Homo sapiens
tgccaccagagaccgtcctcac

SEQ ID NO: 3827677 - DNA, 23 bp, Homo sapiens
tgccaccagagaccgtcctcacc

SEQ ID NO: 3827678 - DNA, 14 bp, Homo sapiens
tgccagcaaagccc

SEQ ID NO: 3827679 - DNA, 16 bp, Homo sapiens
tgccagcaaagcccca

SEQ ID NO: 3827680 - DNA, 12 bp, Homo sapiens
tgccaggcaggg

SEQ ID NO: 3827681 - DNA, 13 bp, Homo sapiens
tgccaggctggga

SEQ ID NO: 3827682 - DNA, 16 bp, Homo sapiens
tgccaggctgggaggc

SEQ ID NO: 3827683 - DNA, 19 bp, Homo sapiens
tgccaggctgggaggctcg

SEQ ID NO: 3827684 - DNA, 17 bp, Homo sapiens
tgccagggaagacagag

SEQ ID NO: 3827685 - DNA, 23 bp, Homo sapiens
tgccagggaagacagagcaggct

SEQ ID NO: 3827686 - DNA, 21 bp, Homo sapiens
tgccagttttattttctaaat

SEQ ID NO: 3827687 - DNA, 17 bp, Homo sapiens
tgccatggaatgactga

SEQ ID NO: 3827688 - DNA, 15 bp, Homo sapiens
tgccatttctttata

SEQ ID NO: 3827689 - DNA, 11 bp, Homo sapiens
tgcccaccccc

SEQ ID NO: 3827690 - DNA, 16 bp, Homo sapiens
tgcccaccccctgccc

SEQ ID NO: 3827691 - DNA, 18 bp, Homo sapiens
tgcccaccccctgccctg

SEQ ID NO: 3827692 - DNA, 21 bp, Homo sapiens
tgcccacttctgtgtagacat

SEQ ID NO: 3827693 - DNA, 21 bp, Homo sapiens
tgcccagagccaagctggggc

SEQ ID NO: 3827694 - DNA, 16 bp, Homo sapiens
tgccccatttatccac

SEQ ID NO: 3827695 - DNA, 12 bp, Homo sapiens
tgcccccacacc

SEQ ID NO: 3827696 - DNA, 17 bp, Homo sapiens
tgcccccacacccactc

SEQ ID NO: 3827697 - DNA, 22 bp, Homo sapiens
tgcccccaccccggggaccctg

SEQ ID NO: 3827698 - DNA, 23 bp, Homo sapiens
tgcccccaccccggggaccctgt

SEQ ID NO: 3827699 - DNA, 14 bp, Homo sapiens
tgcccccagccccg

SEQ ID NO: 3827700 - DNA, 21 bp, Homo sapiens
tgcccccgcatcccctgcctc

SEQ ID NO: 3827701 - DNA, 15 bp, Homo sapiens
tgcccccgccacctc

SEQ ID NO: 3827702 - DNA, 16 bp, Homo sapiens
tgcccccgccacctcc

SEQ ID NO: 3827703 - DNA, 22 bp, Homo sapiens
tgcccccgccacctccccactc

SEQ ID NO: 3827704 - DNA, 18 bp, Homo sapiens
tgcccctgccctgaggag

SEQ ID NO: 3827705 - DNA, 17 bp, Homo sapiens
tgcccgccctccctcct

SEQ ID NO: 3827706 - DNA, 18 bp, Homo sapiens
tgccctcctgcccgccct

SEQ ID NO: 3827707 - DNA, 22 bp, Homo sapiens
tgccctgcacgtcatgggaggg

SEQ ID NO: 3827708 - DNA, 11 bp, Homo sapiens
tgccctggctg

SEQ ID NO: 3827709 - DNA, 12 bp, Homo sapiens
tgccctggctgc

SEQ ID NO: 3827710 - DNA, 16 bp, Homo sapiens
tgccctggctgctgcc

SEQ ID NO: 3827711 - DNA, 23 bp, Homo sapiens
tgttttaaaatgagaaatctaaa

SEQ ID NO: 3827712 - DNA, 20 bp, Homo sapiens
tgttttacaatgatttgtaa

SEQ ID NO: 3827713 - DNA, 21 bp, Homo sapiens
tgttttacaatgatttgtaaa

SEQ ID NO: 3827714 - DNA, 12 bp, Homo sapiens
tgttttatagta

SEQ ID NO: 3827715 - DNA, 17 bp, Homo sapiens
tgttttcaatgaattaa

SEQ ID NO: 3827716 - DNA, 22 bp, Homo sapiens
tgttttcaatgaattaagaaag

SEQ ID NO: 3827717 - DNA, 16 bp, Homo sapiens
tgttttcgcaaatgtt

SEQ ID NO: 3827718 - DNA, 13 bp, Homo sapiens
tgttttgttttat

SEQ ID NO: 3827719 - DNA, 18 bp, Homo sapiens
tgttttgttttatagtat

SEQ ID NO: 3827720 - DNA, 13 bp, Homo sapiens
tgtttttctttta

SEQ ID NO: 3827721 - DNA, 16 bp, Homo sapiens
tgtttttcttttagac

SEQ ID NO: 3827722 - DNA, 16 bp, Homo sapiens
tgtttttgccactgat

SEQ ID NO: 3827723 - DNA, 18 bp, Homo sapiens
tgtttttgccactgattt

SEQ ID NO: 3827724 - DNA, 16 bp, Homo sapiens
ttaaaaactatttaac

SEQ ID NO: 3827725 - DNA, 20 bp, Homo sapiens
ttaaaaagcagtttttgaaa

SEQ ID NO: 3827726 - DNA, 18 bp, Homo sapiens
ttaaaaagcatgttgtga

SEQ ID NO: 3827727 - DNA, 19 bp, Homo sapiens
ttaaaacaagaaagtttcc

SEQ ID NO: 3827728 - DNA, 20 bp, Homo sapiens
ttaaaacaagaaagtttccc

SEQ ID NO: 3827729 - DNA, 12 bp, Homo sapiens
ttaaaataaata

SEQ ID NO: 3827730 - DNA, 13 bp, Homo sapiens
ttaaaataaataa

SEQ ID NO: 3827731 - DNA, 18 bp, Homo sapiens
ttaaaatatttgcctcca

SEQ ID NO: 3827732 - DNA, 19 bp, Homo sapiens
ttaaaatgagaaatctaaa

SEQ ID NO: 3827733 - DNA, 15 bp, Homo sapiens
ttaaacaactttcca

SEQ ID NO: 3827734 - DNA, 18 bp, Homo sapiens
ttaaactcttgaatatgt

SEQ ID NO: 3827735 - DNA, 20 bp, Homo sapiens
ttaaactcttgaatatgtgc

SEQ ID NO: 3827736 - DNA, 15 bp, Homo sapiens
ttaaactgtaaatca

SEQ ID NO: 3827737 - DNA, 19 bp, Homo sapiens
ttaaagaatttaaaaaagt

SEQ ID NO: 3827738 - DNA, 17 bp, Homo sapiens
ttaaagtgcactgtgtc

SEQ ID NO: 3827739 - DNA, 17 bp, Homo sapiens
ttaaatatataaacaaa

SEQ ID NO: 3827740 - DNA, 18 bp, Homo sapiens
ttaaatatatctttgtaa

SEQ ID NO: 3827741 - DNA, 19 bp, Homo sapiens
ttaaatatgatttgcattt

SEQ ID NO: 3827742 - DNA, 13 bp, Homo sapiens
ttaaatgctgtat

SEQ ID NO: 3827743 - DNA, 13 bp, Homo sapiens
ttaaatgtggaat

SEQ ID NO: 3827744 - DNA, 13 bp, Homo sapiens
ttaaatgttcatg

SEQ ID NO: 3827745 - DNA, 12 bp, Homo sapiens
ttaaatttgcca

SEQ ID NO: 3827746 - DNA, 21 bp, Homo sapiens
ttaactaatatttgtctgtgt

SEQ ID NO: 3827747 - DNA, 22 bp, Homo sapiens
ttaactaatatttgtctgtgtg

SEQ ID NO: 3827748 - DNA, 22 bp, Homo sapiens
ttaactggaaggctgctttctc

SEQ ID NO: 3827749 - DNA, 20 bp, Homo sapiens
ttaagatggtaagacctctg

SEQ ID NO: 3827750 - DNA, 22 bp, Homo sapiens
ttaagtaagtaagtttcattct

SEQ ID NO: 3827751 - DNA, 14 bp, Homo sapiens
ttaagtaattgcca

SEQ ID NO: 3827752 - DNA, 21 bp, Homo sapiens
ttaagtatatttgtaaaagct

SEQ ID NO: 3827753 - DNA, 17 bp, Homo sapiens
ttaagtctttttgaagt

SEQ ID NO: 3827754 - DNA, 16 bp, Homo sapiens
ttaagtgaaattttaa

SEQ ID NO: 3827755 - DNA, 13 bp, Homo sapiens
ttaataaagtata

SEQ ID NO: 3827756 - DNA, 15 bp, Homo sapiens
ttaataaagtatatt

SEQ ID NO: 3827757 - DNA, 19 bp, Homo sapiens
ttaataaagtatattgaaa

SEQ ID NO: 3827758 - DNA, 18 bp, Homo sapiens
ttaatgtatttttgtaaa

SEQ ID NO: 3827759 - DNA, 15 bp, Homo sapiens
ttaattaacatcaaa

SEQ ID NO: 3827760 - DNA, 17 bp, Homo sapiens
ttaattaacatcaaaca

SEQ ID NO: 3827761 - DNA, 12 bp, Homo sapiens
ttaatttggaca

SEQ ID NO: 3827762 - DNA, 14 bp, Homo sapiens
ttacaatgatttgt

SEQ ID NO: 3827763 - DNA, 15 bp, Homo sapiens
ttacaatgatttgta

SEQ ID NO: 3827764 - DNA, 16 bp, Homo sapiens
ttacaatgatttgtaa

SEQ ID NO: 3827765 - DNA, 20 bp, Homo sapiens
ttacaatgatttgtaaagga

SEQ ID NO: 3827766 - DNA, 18 bp, Homo sapiens
ttacagtttcaaaaactg

SEQ ID NO: 3827767 - DNA, 21 bp, Homo sapiens
ttaccaatttaactagtcctg

SEQ ID NO: 3827768 - DNA, 20 bp, Homo sapiens
ttacgtaaacctgaaatata

SEQ ID NO: 3827769 - DNA, 15 bp, Homo sapiens
ttactattgtattat

SEQ ID NO: 3827770 - DNA, 18 bp, Homo sapiens
ttactgaatgttagaaga

SEQ ID NO: 3827771 - DNA, 12 bp, Homo sapiens
ttactgcatttt

SEQ ID NO: 3827772 - DNA, 19 bp, Homo sapiens
ttactgccaaaaccaaatt

SEQ ID NO: 3827773 - DNA, 20 bp, Homo sapiens
ttactgccaaaaccaaattg

SEQ ID NO: 3827774 - DNA, 18 bp, Homo sapiens
ttacttctagtcagtcat

SEQ ID NO: 3827775 - DNA, 19 bp, Homo sapiens
ttacttgagtatcataata

SEQ ID NO: 3827776 - DNA, 18 bp, Homo sapiens
ttactttttgtaaatgct

SEQ ID NO: 3827777 - DNA, 18 bp, Homo sapiens
ttagacaggttaaatata

SEQ ID NO: 3827778 - DNA, 21 bp, Homo sapiens
ttagacagtaagagtttacaa

SEQ ID NO: 3827779 - DNA, 22 bp, Homo sapiens
ttagagccaggcacacactgtg

SEQ ID NO: 3827780 - DNA, 14 bp, Homo sapiens
ttagatttaattta

SEQ ID NO: 3827781 - DNA, 15 bp, Homo sapiens
ttagccaaacaacaa

SEQ ID NO: 3827782 - DNA, 19 bp, Homo sapiens
ttagccaaacaacaacaaa

SEQ ID NO: 3827783 - DNA, 22 bp, Homo sapiens
ttagcctgggcctcctcctagc

SEQ ID NO: 3827784 - DNA, 18 bp, Homo sapiens
ttaggaaatttatacaaa

SEQ ID NO: 3827785 - DNA, 21 bp, Homo sapiens
ttaggaaatttatacaaagaa

SEQ ID NO: 3827786 - DNA, 20 bp, Homo sapiens
ttagttgcaactttgtataa

SEQ ID NO: 3827787 - DNA, 23 bp, Homo sapiens
ttataaaaacccctaaaaacaaa

SEQ ID NO: 3827788 - DNA, 22 bp, Homo sapiens
ttataaacatgtccccttccct

SEQ ID NO: 3827789 - DNA, 12 bp, Homo sapiens
ttataaagaaag

SEQ ID NO: 3827790 - DNA, 16 bp, Homo sapiens
ttataacagttataaa

SEQ ID NO: 3827791 - DNA, 18 bp, Homo sapiens
ttataactaatatggttt

SEQ ID NO: 3827792 - DNA, 12 bp, Homo sapiens
ttataataaatt

SEQ ID NO: 3827793 - DNA, 19 bp, Homo sapiens
ttataatattcatacaaca

SEQ ID NO: 3827794 - DNA, 21 bp, Homo sapiens
ttataatattcatacaacaaa

SEQ ID NO: 3827795 - DNA, 23 bp, Homo sapiens
ttataatattcatacaacaaaga

SEQ ID NO: 3827796 - DNA, 15 bp, Homo sapiens
ttatacaaagaaact

SEQ ID NO: 3827797 - DNA, 22 bp, Homo sapiens
ttatacagaattgtgtctgcag

SEQ ID NO: 3827798 - DNA, 15 bp, Homo sapiens
ttatactatattaac

SEQ ID NO: 3827799 - DNA, 22 bp, Homo sapiens
ttatactatattaacttttatt

SEQ ID NO: 3827800 - DNA, 20 bp, Homo sapiens
ttatagtattaagtgaaatt

SEQ ID NO: 3827801 - DNA, 19 bp, Homo sapiens
ttatatggaacgcattttg

SEQ ID NO: 3827802 - DNA, 20 bp, Homo sapiens
ttatatttttaaaaaactga

SEQ ID NO: 3827803 - DNA, 20 bp, Homo sapiens
ttatcaagctaataaaatat

SEQ ID NO: 3827804 - DNA, 16 bp, Homo sapiens
ttatccacctccatct

SEQ ID NO: 3827805 - DNA, 20 bp, Homo sapiens
ttatgatacttgaaaattaa

SEQ ID NO: 3827806 - DNA, 16 bp, Homo sapiens
ttatgtcatagtttaa

SEQ ID NO: 3827807 - DNA, 17 bp, Homo sapiens
ttattaagtatatttgt

SEQ ID NO: 3827808 - DNA, 18 bp, Homo sapiens
ttattaagtatatttgta

SEQ ID NO: 3827809 - DNA, 19 bp, Homo sapiens
ttattaagtatatttgtaa

SEQ ID NO: 3827810 - DNA, 13 bp, Homo sapiens
ttattgctgcatt

SEQ ID NO: 3827811 - DNA, 15 bp, Homo sapiens
ttattgggcaataaa

SEQ ID NO: 3827812 - DNA, 13 bp, Homo sapiens
ttattgttttgtt

SEQ ID NO: 3827813 - DNA, 18 bp, Homo sapiens
ttattgttttgttaacaa

SEQ ID NO: 3827814 - DNA, 18 bp, Homo sapiens
ttatttagacaagagatg

SEQ ID NO: 3827815 - DNA, 15 bp, Homo sapiens
ttatttggaaattta

SEQ ID NO: 3827816 - DNA, 16 bp, Homo sapiens
ttattttctaaattct

SEQ ID NO: 3827817 - DNA, 12 bp, Homo sapiens
ttattttctaca

SEQ ID NO: 3827818 - DNA, 16 bp, Homo sapiens
ttcaaaagaagttcat

SEQ ID NO: 3827819 - DNA, 16 bp, Homo sapiens
ttcaaaattgttacaa

SEQ ID NO: 3827820 - DNA, 21 bp, Homo sapiens
ttcaaaattgttacaaattgt

SEQ ID NO: 3827821 - DNA, 16 bp, Homo sapiens
ttcaaaccaggatttt

SEQ ID NO: 3827822 - DNA, 20 bp, Homo sapiens
ttcaagtgattctcctgcct

SEQ ID NO: 3827823 - DNA, 22 bp, Homo sapiens
ttcaagtgattctcctgcctca

SEQ ID NO: 3827824 - DNA, 16 bp, Homo sapiens
ttcaatgaattaagaa

SEQ ID NO: 3827825 - DNA, 19 bp, Homo sapiens
ttcaatgaattaagaaaga

SEQ ID NO: 3827826 - DNA, 15 bp, Homo sapiens
ttcacatgctggctc

SEQ ID NO: 3827827 - DNA, 14 bp, Homo sapiens
ttcactcagctgga

SEQ ID NO: 3827828 - DNA, 23 bp, Homo sapiens
ttcagaaggaagcaaaatccctt

SEQ ID NO: 3827829 - DNA, 22 bp, Homo sapiens
ttcagagttgatggttgtacat

SEQ ID NO: 3827830 - DNA, 18 bp, Homo sapiens
ttcagccgactcagcaac

SEQ ID NO: 3827831 - DNA, 14 bp, Homo sapiens
ttcaggccttgcct

SEQ ID NO: 3827832 - DNA, 18 bp, Homo sapiens
ttcaggcttgcattaaaa

SEQ ID NO: 3827833 - DNA, 22 bp, Homo sapiens
ttcaggcttgcattaaaagact

SEQ ID NO: 3827834 - DNA, 20 bp, Homo sapiens
ttcagtggaaatcaatcaga

SEQ ID NO: 3827835 - DNA, 22 bp, Homo sapiens
ttcagtgtcaaataaacactgt

SEQ ID NO: 3827836 - DNA, 18 bp, Homo sapiens
ttcagttttactgcattt

SEQ ID NO: 3827837 - DNA, 21 bp, Homo sapiens
ttcagttttactgcattttca

SEQ ID NO: 3827838 - DNA, 19 bp, Homo sapiens
ttcataattttcaaaagaa

SEQ ID NO: 3827839 - DNA, 17 bp, Homo sapiens
ttcatagaccctctcaa

SEQ ID NO: 3827840 - DNA, 21 bp, Homo sapiens
ttcatgccattttatttcttt

SEQ ID NO: 3827841 - DNA, 20 bp, Homo sapiens
ttcattatttggaaatttag

SEQ ID NO: 3827842 - DNA, 19 bp, Homo sapiens
ttcatttggggcatttgta

SEQ ID NO: 3827843 - DNA, 22 bp, Homo sapiens
ttgtctacagctccagatgttt

SEQ ID NO: 3827844 - DNA, 15 bp, Homo sapiens
ttgtctattctccag

SEQ ID NO: 3827845 - DNA, 17 bp, Homo sapiens
ttgtctgtgtgctacta

SEQ ID NO: 3827846 - DNA, 15 bp, Homo sapiens
ttgtcttgcattttt

SEQ ID NO: 3827847 - DNA, 19 bp, Homo sapiens
ttgtgacagattatacaga

SEQ ID NO: 3827848 - DNA, 22 bp, Homo sapiens
ttgtgactagtgctgaagctta

SEQ ID NO: 3827849 - DNA, 11 bp, Homo sapiens
ttgtgcttcta

SEQ ID NO: 3827850 - DNA, 13 bp, Homo sapiens
ttgtgctttgtat

SEQ ID NO: 3827851 - DNA, 15 bp, Homo sapiens
ttgtggaatggattt

SEQ ID NO: 3827852 - DNA, 15 bp, Homo sapiens
ttgtgtgtatgtgta

SEQ ID NO: 3827853 - DNA, 14 bp, Homo sapiens
ttgtgttctttata

SEQ ID NO: 3827854 - DNA, 16 bp, Homo sapiens
ttgtgttctttataac

SEQ ID NO: 3827855 - DNA, 16 bp, Homo sapiens
ttgttggctcagaaaa

SEQ ID NO: 3827856 - DNA, 17 bp, Homo sapiens
ttgttttcaatgaatta

SEQ ID NO: 3827857 - DNA, 19 bp, Homo sapiens
tttaaaaagcagtttttga

SEQ ID NO: 3827858 - DNA, 21 bp, Homo sapiens
tttaaaatgtttaggaaattt

SEQ ID NO: 3827859 - DNA, 18 bp, Homo sapiens
tttaaacttcagttttac

SEQ ID NO: 3827860 - DNA, 18 bp, Homo sapiens
tttaaatgcacagttcta

SEQ ID NO: 3827861 - DNA, 20 bp, Homo sapiens
tttaaatgcacagttctatt

SEQ ID NO: 3827862 - DNA, 16 bp, Homo sapiens
tttaaatgccacaaga

SEQ ID NO: 3827863 - DNA, 19 bp, Homo sapiens
tttaactgagggctgatct

SEQ ID NO: 3827864 - DNA, 17 bp, Homo sapiens
tttaactggaaggctgc

SEQ ID NO: 3827865 - DNA, 20 bp, Homo sapiens
tttaagacgaaacatttgtt

SEQ ID NO: 3827866 - DNA, 20 bp, Homo sapiens
tttaagtaattgccagcttt

SEQ ID NO: 3827867 - DNA, 20 bp, Homo sapiens
tttaataaagtatattgaaa

SEQ ID NO: 3827868 - DNA, 17 bp, Homo sapiens
tttacaatgatttgtaa

SEQ ID NO: 3827869 - DNA, 13 bp, Homo sapiens
tttacacgtctat

SEQ ID NO: 3827870 - DNA, 21 bp, Homo sapiens
tttacagtttcaaaaactgta

SEQ ID NO: 3827871 - DNA, 23 bp, Homo sapiens
tttacatcctactaagaagttta

SEQ ID NO: 3827872 - DNA, 13 bp, Homo sapiens
tttactctttcat

SEQ ID NO: 3827873 - DNA, 21 bp, Homo sapiens
tttactgcattttcacaacat

SEQ ID NO: 3827874 - DNA, 19 bp, Homo sapiens
tttactgtgtatctcaata

SEQ ID NO: 3827875 - DNA, 22 bp, Homo sapiens
tttagacaagagatgggaatga

SEQ ID NO: 3827876 - DNA, 16 bp, Homo sapiens
tttagatttattgtcc

SEQ ID NO: 3827877 - DNA, 20 bp, Homo sapiens
tttaggatgaccgtttctta

SEQ ID NO: 3827878 - DNA, 17 bp, Homo sapiens
tttagttgcaactttgt

SEQ ID NO: 3827879 - DNA, 22 bp, Homo sapiens
tttataacagttataaagaaag

SEQ ID NO: 3827880 - DNA, 20 bp, Homo sapiens
tttataaccaccaagtatta

SEQ ID NO: 3827881 - DNA, 15 bp, Homo sapiens
tttataatattcata

SEQ ID NO: 3827882 - DNA, 16 bp, Homo sapiens
tttataatattcatac

SEQ ID NO: 3827883 - DNA, 22 bp, Homo sapiens
tttataatattcatacaacaaa

SEQ ID NO: 3827884 - DNA, 14 bp, Homo sapiens
tttatgcatttcaa

SEQ ID NO: 3827885 - DNA, 10 bp, Homo sapiens
tttatgtgaa

SEQ ID NO: 3827886 - DNA, 15 bp, Homo sapiens
tttattagacattct

SEQ ID NO: 3827887 - DNA, 14 bp, Homo sapiens
tttattgctgcatt

SEQ ID NO: 3827888 - DNA, 15 bp, Homo sapiens
tttattgctgcattt

SEQ ID NO: 3827889 - DNA, 17 bp, Homo sapiens
tttattgctgcatttta

SEQ ID NO: 3827890 - DNA, 20 bp, Homo sapiens
tttattttgtgtttaggaac

SEQ ID NO: 3827891 - DNA, 12 bp, Homo sapiens
tttcaatttcaa

SEQ ID NO: 3827892 - DNA, 19 bp, Homo sapiens
tttcagacctttgtctgaa

SEQ ID NO: 3827893 - DNA, 16 bp, Homo sapiens
tttcagtagtttctaa

SEQ ID NO: 3827894 - DNA, 21 bp, Homo sapiens
tttcagtgtcaaataaacact

SEQ ID NO: 3827895 - DNA, 15 bp, Homo sapiens
tttcatgccatttta

SEQ ID NO: 3827896 - DNA, 20 bp, Homo sapiens
tttcatgccattttatttct

SEQ ID NO: 3827897 - DNA, 13 bp, Homo sapiens
tttcatttcatat

SEQ ID NO: 3827898 - DNA, 19 bp, Homo sapiens
tttccactgacaacgaaag

SEQ ID NO: 3827899 - DNA, 19 bp, Homo sapiens
tttccatcctttgcatttc

SEQ ID NO: 3827900 - DNA, 19 bp, Homo sapiens
tttcccaatattgagcagt

SEQ ID NO: 3827901 - DNA, 21 bp, Homo sapiens
tttcccaccaatcctcaccta

SEQ ID NO: 3827902 - DNA, 22 bp, Homo sapiens
tttcccatctgcaccccttctc

SEQ ID NO: 3827903 - DNA, 14 bp, Homo sapiens
tttcccctaatttt

SEQ ID NO: 3827904 - DNA, 16 bp, Homo sapiens
tttcctttccccagcc

SEQ ID NO: 3827905 - DNA, 12 bp, Homo sapiens
tttcgctttcct

SEQ ID NO: 3827906 - DNA, 15 bp, Homo sapiens
tttcgctttcctctg

SEQ ID NO: 3827907 - DNA, 16 bp, Homo sapiens
tttctaagtctgttat

SEQ ID NO: 3827908 - DNA, 19 bp, Homo sapiens
tttctacagtggttttata

SEQ ID NO: 3827909 - DNA, 14 bp, Homo sapiens
tttctcctcagaag

SEQ ID NO: 3827910 - DNA, 15 bp, Homo sapiens
tttctcctcagaagt

SEQ ID NO: 3827911 - DNA, 14 bp, Homo sapiens
tttctgccctggct

SEQ ID NO: 3827912 - DNA, 15 bp, Homo sapiens
tttctgccctggctg

SEQ ID NO: 3827913 - DNA, 20 bp, Homo sapiens
tttctgccctggctgctgcc

SEQ ID NO: 3827914 - DNA, 13 bp, Homo sapiens
tttctgcctctca

SEQ ID NO: 3827915 - DNA, 14 bp, Homo sapiens
tttctgttcatctt

SEQ ID NO: 3827916 - DNA, 22 bp, Homo sapiens
tttcttactgtcttttttctaa

SEQ ID NO: 3827917 - DNA, 23 bp, Homo sapiens
tttcttctgtatttttttttcta

SEQ ID NO: 3827918 - DNA, 16 bp, Homo sapiens
tttcttttagacacat

SEQ ID NO: 3827919 - DNA, 14 bp, Homo sapiens
tttgagaactgtca

SEQ ID NO: 3827920 - DNA, 21 bp, Homo sapiens
tttgattgagagtaacttaag

SEQ ID NO: 3827921 - DNA, 16 bp, Homo sapiens
tttgatttttaaatca

SEQ ID NO: 3827922 - DNA, 23 bp, Homo sapiens
tttgcaaataaaggctctggaag

SEQ ID NO: 3827923 - DNA, 14 bp, Homo sapiens
tttgccaagccctt

SEQ ID NO: 3827924 - DNA, 18 bp, Homo sapiens
tttgccaagccctttgct

SEQ ID NO: 3827925 - DNA, 19 bp, Homo sapiens
tttgccaagccctttgctg

SEQ ID NO: 3827926 - DNA, 12 bp, Homo sapiens
tttgccccactg

SEQ ID NO: 3827927 - DNA, 17 bp, Homo sapiens
tttgccccactgggaga

SEQ ID NO: 3827928 - DNA, 14 bp, Homo sapiens
tttgcctcatgaac

SEQ ID NO: 3827929 - DNA, 14 bp, Homo sapiens
tttggaaacaacat

SEQ ID NO: 3827930 - DNA, 22 bp, Homo sapiens
tttggagagtgggctgacatca

SEQ ID NO: 3827931 - DNA, 19 bp, Homo sapiens
tttggcaaacgctaaagag

SEQ ID NO: 3827932 - DNA, 14 bp, Homo sapiens
tttggcattcctct

SEQ ID NO: 3827933 - DNA, 17 bp, Homo sapiens
tttggcattcctctaat

SEQ ID NO: 3827934 - DNA, 14 bp, Homo sapiens
tttggctggagccc

SEQ ID NO: 3827935 - DNA, 22 bp, Homo sapiens
tttggggccgattgggagaaag

SEQ ID NO: 3827936 - DNA, 21 bp, Homo sapiens
tttgtaaattattttatgtca

SEQ ID NO: 3827937 - DNA, 14 bp, Homo sapiens
tttgtaagtaagta

SEQ ID NO: 3827938 - DNA, 19 bp, Homo sapiens
tttgtaagtaagtaagaaa

SEQ ID NO: 3827939 - DNA, 18 bp, Homo sapiens
tttgtagcaaccatttgt

SEQ ID NO: 3827940 - DNA, 17 bp, Homo sapiens
tttgtcattgttttcag

SEQ ID NO: 3827941 - DNA, 14 bp, Homo sapiens
tttgtgaaatttca

SEQ ID NO: 3827942 - DNA, 16 bp, Homo sapiens
tttgtgaaatttcatg

SEQ ID NO: 3827943 - DNA, 16 bp, Homo sapiens
tttgtgctgctgagtc

SEQ ID NO: 3827944 - DNA, 14 bp, Homo sapiens
tttgtgcttctaat

SEQ ID NO: 3827945 - DNA, 12 bp, Homo sapiens
tttgtttgtgct

SEQ ID NO: 3827946 - DNA, 12 bp, Homo sapiens
ttttaaagctaa

SEQ ID NO: 3827947 - DNA, 12 bp, Homo sapiens
ttttaaatgtgg

SEQ ID NO: 3827948 - DNA, 21 bp, Homo sapiens
ttttaaatttgccagttttat

SEQ ID NO: 3827949 - DNA, 13 bp, Homo sapiens
ttttaagcataat

SEQ ID NO: 3827950 - DNA, 20 bp, Homo sapiens
ttttactgcattttcacaac

SEQ ID NO: 3827951 - DNA, 12 bp, Homo sapiens
ttttacttgaag

SEQ ID NO: 3827952 - DNA, 14 bp, Homo sapiens
ttttacttgaagta

SEQ ID NO: 3827953 - DNA, 20 bp, Homo sapiens
ttttatgatacttgaaaatt

SEQ ID NO: 3827954 - DNA, 15 bp, Homo sapiens
ttttatgtgcttgaa

SEQ ID NO: 3827955 - DNA, 14 bp, Homo sapiens
ttttattagacatt

SEQ ID NO: 3827956 - DNA, 16 bp, Homo sapiens
ttttcacaacatatca

SEQ ID NO: 3827957 - DNA, 12 bp, Homo sapiens
ttttcatgtttt

SEQ ID NO: 3827958 - DNA, 19 bp, Homo sapiens
ttttcattatttggaaatt

SEQ ID NO: 3827959 - DNA, 12 bp, Homo sapiens
ttttcatttcat

SEQ ID NO: 3827960 - DNA, 16 bp, Homo sapiens
ttttcatttcatatat

SEQ ID NO: 3827961 - DNA, 18 bp, Homo sapiens
ttttcattttctgcaagc

SEQ ID NO: 3827962 - DNA, 22 bp, Homo sapiens
ttttcattttctgcaagcctgc

SEQ ID NO: 3827963 - DNA, 15 bp, Homo sapiens
ttttccttgaagccg

SEQ ID NO: 3827964 - DNA, 20 bp, Homo sapiens
ttttctaaattctttcatga

SEQ ID NO: 3827965 - DNA, 13 bp, Homo sapiens
ttttctacagtgg

SEQ ID NO: 3827966 - DNA, 13 bp, Homo sapiens
ttttctgccctgg

SEQ ID NO: 3827967 - DNA, 19 bp, Homo sapiens
ttttctttttttgcatatt

SEQ ID NO: 3827968 - DNA, 18 bp, Homo sapiens
ttttgaaagacaaaattt

SEQ ID NO: 3827969 - DNA, 19 bp, Homo sapiens
ttttggcaaacgctaaaga

SEQ ID NO: 3827970 - DNA, 23 bp, Homo sapiens
ttttgtaagtataagaaatttta

SEQ ID NO: 3827971 - DNA, 14 bp, Homo sapiens
ttttgtagatgcta

SEQ ID NO: 3827972 - DNA, 15 bp, Homo sapiens
ttttgtcttgcattt

SEQ ID NO: 3827973 - DNA, 12 bp, Homo sapiens
ttttgtgaaatt

SEQ ID NO: 3827974 - DNA, 13 bp, Homo sapiens
ttttgtgaaattt

SEQ ID NO: 3827975 - DNA, 17 bp, Homo sapiens
ttttgtgaaatttcatg

SEQ ID NO: 3827976 - DNA, 15 bp, Homo sapiens
tctgctcagccctgg

SEQ ID NO: 3827977 - DNA, 16 bp, Homo sapiens
tctgctcagccctgga

SEQ ID NO: 3827978 - DNA, 19 bp, Homo sapiens
tctgctcagccctggaggt

SEQ ID NO: 3827979 - DNA, 15 bp, Homo sapiens
tctgctcattctaat

SEQ ID NO: 3827980 - DNA, 14 bp, Homo sapiens
tctgctcctccctc

SEQ ID NO: 3827981 - DNA, 22 bp, Homo sapiens
tctgcttttctgccctggctgc

SEQ ID NO: 3827982 - DNA, 15 bp, Homo sapiens
tctggaaaactcagg

SEQ ID NO: 3827983 - DNA, 22 bp, Homo sapiens
tctggaacgctctaggcagaag

SEQ ID NO: 3827984 - DNA, 13 bp, Homo sapiens
tctggacctgccc

SEQ ID NO: 3827985 - DNA, 15 bp, Homo sapiens
tctggacggcaggct

SEQ ID NO: 3827986 - DNA, 19 bp, Homo sapiens
tctggacggcaggctcact

SEQ ID NO: 3827987 - DNA, 23 bp, Homo sapiens
tctggacggcaggctcactgcca

SEQ ID NO: 3827988 - DNA, 12 bp, Homo sapiens
tctggagacagc

SEQ ID NO: 3827989 - DNA, 20 bp, Homo sapiens
tctggagacagccccagagc

SEQ ID NO: 3827990 - DNA, 22 bp, Homo sapiens
tctggagacagccccagagcag

SEQ ID NO: 3827991 - DNA, 16 bp, Homo sapiens
tctggagcaagccctg

SEQ ID NO: 3827992 - DNA, 11 bp, Homo sapiens
tctggcccagg

SEQ ID NO: 3827993 - DNA, 12 bp, Homo sapiens
tctggcccaggc

SEQ ID NO: 3827994 - DNA, 14 bp, Homo sapiens
tctggcccaggctg

SEQ ID NO: 3827995 - DNA, 15 bp, Homo sapiens
tctggcccaggctgg

SEQ ID NO: 3827996 - DNA, 20 bp, Homo sapiens
tctgggcagatgaaaagcta

SEQ ID NO: 3827997 - DNA, 11 bp, Homo sapiens
tctggggacag

SEQ ID NO: 3827998 - DNA, 17 bp, Homo sapiens
tctggggctcagccctg

SEQ ID NO: 3827999 - DNA, 22 bp, Homo sapiens
tctggggctcagccctgagctg

SEQ ID NO: 3828000 - DNA, 22 bp, Homo sapiens
tctgtacaaagtactagctaaa

SEQ ID NO: 3828001 - DNA, 12 bp, Homo sapiens
tctgtcataata

SEQ ID NO: 3828002 - DNA, 16 bp, Homo sapiens
tctgtgacctcaggca

SEQ ID NO: 3828003 - DNA, 13 bp, Homo sapiens
tctgtggaccctc

SEQ ID NO: 3828004 - DNA, 22 bp, Homo sapiens
tctgtggaccctcgctctctgt

SEQ ID NO: 3828005 - DNA, 15 bp, Homo sapiens
tctgtggcccaagag

SEQ ID NO: 3828006 - DNA, 13 bp, Homo sapiens
tctgtgtagacat

SEQ ID NO: 3828007 - DNA, 13 bp, Homo sapiens
tctgtgtgctact

SEQ ID NO: 3828008 - DNA, 16 bp, Homo sapiens
tctgtgtgctactaac

SEQ ID NO: 3828009 - DNA, 20 bp, Homo sapiens
tctgtgtgctactaacagat

SEQ ID NO: 3828010 - DNA, 20 bp, Homo sapiens
tctgttacctctgacatcaa

SEQ ID NO: 3828011 - DNA, 12 bp, Homo sapiens
tctgttattgtt

SEQ ID NO: 3828012 - DNA, 15 bp, Homo sapiens
tcttactttttgtaa

SEQ ID NO: 3828013 - DNA, 23 bp, Homo sapiens
tcttactttttgtaaatgctgta

SEQ ID NO: 3828014 - DNA, 15 bp, Homo sapiens
tcttagaactctgct

SEQ ID NO: 3828015 - DNA, 17 bp, Homo sapiens
tcttccggttggaggct

SEQ ID NO: 3828016 - DNA, 15 bp, Homo sapiens
tcttgaatagcttat

SEQ ID NO: 3828017 - DNA, 23 bp, Homo sapiens
tcttgatctgctcagccctggag

SEQ ID NO: 3828018 - DNA, 11 bp, Homo sapiens
tcttgcatttt

SEQ ID NO: 3828019 - DNA, 23 bp, Homo sapiens
tcttgggggtcacccatggcctc

SEQ ID NO: 3828020 - DNA, 19 bp, Homo sapiens
tcttgtgactagtgctgaa

SEQ ID NO: 3828021 - DNA, 10 bp, Homo sapiens
tctttataac

SEQ ID NO: 3828022 - DNA, 23 bp, Homo sapiens
tctttcatcaatcattgtacagt

SEQ ID NO: 3828023 - DNA, 17 bp, Homo sapiens
tctttctttttccttca

SEQ ID NO: 3828024 - DNA, 21 bp, Homo sapiens
tgagcacctttggaaacaaca

SEQ ID NO: 3828025 - DNA, 24 bp, Homo sapiens
tgagcacctttggaaacaacattt

SEQ ID NO: 3828026 - DNA, 17 bp, Homo sapiens
tgagccccgcagacctc

SEQ ID NO: 3828027 - DNA, 22 bp, Homo sapiens
tgagccccgcagacctccccag

SEQ ID NO: 3828028 - DNA, 14 bp, Homo sapiens
tgagccgcctcgga

SEQ ID NO: 3828029 - DNA, 13 bp, Homo sapiens
tgagcctggctct

SEQ ID NO: 3828030 - DNA, 15 bp, Homo sapiens
tgagctccagccacc

SEQ ID NO: 3828031 - DNA, 11 bp, Homo sapiens
tgagctgcctt

SEQ ID NO: 3828032 - DNA, 12 bp, Homo sapiens
tgagctgccttc

SEQ ID NO: 3828033 - DNA, 22 bp, Homo sapiens
tgagctggcctcacctgggttc

SEQ ID NO: 3828034 - DNA, 18 bp, Homo sapiens
tgagcttgcctaaaattc

SEQ ID NO: 3828035 - DNA, 12 bp, Homo sapiens
tgaggaataaag

SEQ ID NO: 3828036 - DNA, 23 bp, Homo sapiens
tgaggaataaagcttctctctga

SEQ ID NO: 3828037 - DNA, 17 bp, Homo sapiens
tgaggaccctcagcccc

SEQ ID NO: 3828038 - DNA, 21 bp, Homo sapiens
tgaggaccctcagccccagga

SEQ ID NO: 3828039 - DNA, 22 bp, Homo sapiens
tgaggaccctcagccccaggag

SEQ ID NO: 3828040 - DNA, 16 bp, Homo sapiens
tgaggagggccctgag

SEQ ID NO: 3828041 - DNA, 18 bp, Homo sapiens
tgaggagggccctgagga

SEQ ID NO: 3828042 - DNA, 17 bp, Homo sapiens
tgaggatcagagtaatc

SEQ ID NO: 3828043 - DNA, 23 bp, Homo sapiens
tgaggcagcgcattgttttgcat

SEQ ID NO: 3828044 - DNA, 17 bp, Homo sapiens
tgaggggaatctggaac

SEQ ID NO: 3828045 - DNA, 16 bp, Homo sapiens
tgagggtcctgctggt

SEQ ID NO: 3828046 - DNA, 18 bp, Homo sapiens
tgaggtgggaggtggaag

SEQ ID NO: 3828047 - DNA, 21 bp, Homo sapiens
tgaggtgggaggtggaagaag

SEQ ID NO: 3828048 - DNA, 22 bp, Homo sapiens
tgaggtgggaggtggaagaagg

SEQ ID NO: 3828049 - DNA, 15 bp, Homo sapiens
tgaggttcctctgcc

SEQ ID NO: 3828050 - DNA, 19 bp, Homo sapiens
tgaggttcctctgcctgcc

SEQ ID NO: 3828051 - DNA, 13 bp, Homo sapiens
tgagtatcataat

SEQ ID NO: 3828052 - DNA, 17 bp, Homo sapiens
tgagtccattctcccag

SEQ ID NO: 3828053 - DNA, 23 bp, Homo sapiens
tgagtctgtcataatatttgaac

SEQ ID NO: 3828054 - DNA, 14 bp, Homo sapiens
tgagtgagcctggc

SEQ ID NO: 3828055 - DNA, 17 bp, Homo sapiens
tgagtgagcctggctct

SEQ ID NO: 3828056 - DNA, 13 bp, Homo sapiens
tgagttcccaaag

SEQ ID NO: 3828057 - DNA, 18 bp, Homo sapiens
tgagttcccaaagggagg

SEQ ID NO: 3828058 - DNA, 12 bp, Homo sapiens
tgagttcttact

SEQ ID NO: 3828059 - DNA, 18 bp, Homo sapiens
tgagtttgagctgccttc

SEQ ID NO: 3828060 - DNA, 22 bp, Homo sapiens
tgagttttcatttcatatatct

SEQ ID NO: 3828061 - DNA, 14 bp, Homo sapiens
tgagtttttcatta

SEQ ID NO: 3828062 - DNA, 18 bp, Homo sapiens
tgagtttttcattatttg

SEQ ID NO: 3828063 - DNA, 16 bp, Homo sapiens
tcctaatttctcctcc

SEQ ID NO: 3828064 - DNA, 19 bp, Homo sapiens
tcctaatttctcctccctt

SEQ ID NO: 3828065 - DNA, 22 bp, Homo sapiens
tcctagctggagtgccatggct

SEQ ID NO: 3828066 - DNA, 23 bp, Homo sapiens
tcctagctggagtgccatggctg

SEQ ID NO: 3828067 - DNA, 24 bp, Homo sapiens
tcctagctggagtgccatggctgg

SEQ ID NO: 3828068 - DNA, 16 bp, Homo sapiens
tcctagtgggttagtg

SEQ ID NO: 3828069 - DNA, 16 bp, Homo sapiens
tcctatacatttctgt

SEQ ID NO: 3828070 - DNA, 21 bp, Homo sapiens
tcctatcaatccaaattccct

SEQ ID NO: 3828071 - DNA, 21 bp, Homo sapiens
tcctcacccctgtcctcactg

SEQ ID NO: 3828072 - DNA, 16 bp, Homo sapiens
tcctcacctcatgccc

SEQ ID NO: 3828073 - DNA, 20 bp, Homo sapiens
tcctcactgctccctgaagc

SEQ ID NO: 3828074 - DNA, 21 bp, Homo sapiens
tcctcactgctccctgaagcc

SEQ ID NO: 3828075 - DNA, 17 bp, Homo sapiens
tcctcactggccatccc

SEQ ID NO: 3828076 - DNA, 21 bp, Homo sapiens
tcctcagaatagtgatgtgtt

SEQ ID NO: 3828077 - DNA, 22 bp, Homo sapiens
tcctcaggggcacagacctctc

SEQ ID NO: 3828078 - DNA, 17 bp, Homo sapiens
tcctcatcatgaaaact

SEQ ID NO: 3828079 - DNA, 21 bp, Homo sapiens
tcctcatcatgaaaactggga

SEQ ID NO: 3828080 - DNA, 12 bp, Homo sapiens
tcctcccaccca

SEQ ID NO: 3828081 - DNA, 20 bp, Homo sapiens
tcctcccacccaacttcccc

SEQ ID NO: 3828082 - DNA, 16 bp, Homo sapiens
tcctccccaaatcaat

SEQ ID NO: 3828083 - DNA, 23 bp, Homo sapiens
tcctcccctcacagcctctgacc

SEQ ID NO: 3828084 - DNA, 13 bp, Homo sapiens
tcctcccttcctt

SEQ ID NO: 3828085 - DNA, 19 bp, Homo sapiens
tcctcccttccttttccct

SEQ ID NO: 3828086 - DNA, 21 bp, Homo sapiens
tcctcccttccttttccctgc

SEQ ID NO: 3828087 - DNA, 16 bp, Homo sapiens
tcctcctgagagctgt

SEQ ID NO: 3828088 - DNA, 18 bp, Homo sapiens
tcctcctgagagctgttc

SEQ ID NO: 3828089 - DNA, 15 bp, Homo sapiens
tcctcggcctggctc

SEQ ID NO: 3828090 - DNA, 22 bp, Homo sapiens
tcctctagaagccaagggaaag

SEQ ID NO: 3828091 - DNA, 12 bp, Homo sapiens
tcctctgcctgc

SEQ ID NO: 3828092 - DNA, 15 bp, Homo sapiens
tcctctggacggcag

SEQ ID NO: 3828093 - DNA, 16 bp, Homo sapiens
tcctgagagctgttcc

SEQ ID NO: 3828094 - DNA, 19 bp, Homo sapiens
tcctgatgcaaaggtgggg

SEQ ID NO: 3828095 - DNA, 22 bp, Homo sapiens
tcctgattcccgcatggttttt

SEQ ID NO: 3828096 - DNA, 23 bp, Homo sapiens
tcctgattcccgcatggttttta

SEQ ID NO: 3828097 - DNA, 18 bp, Homo sapiens
tcctgccctgccctcctg

SEQ ID NO: 3828098 - DNA, 15 bp, Homo sapiens
tcctgcctgccccca

SEQ ID NO: 3828099 - DNA, 20 bp, Homo sapiens
tcctgcctgcgcagctcctt

SEQ ID NO: 3828100 - DNA, 17 bp, Homo sapiens
tcctgccttagagccag

SEQ ID NO: 3828101 - DNA, 16 bp, Homo sapiens
tcctgcgtcctcctca

SEQ ID NO: 3828102 - DNA, 16 bp, Homo sapiens
tcctgctagcacctcc

SEQ ID NO: 3828103 - DNA, 17 bp, Homo sapiens
tcctgctagcacctccc

SEQ ID NO: 3828104 - DNA, 19 bp, Homo sapiens
tcctgctagcacctcccca

SEQ ID NO: 3828105 - DNA, 20 bp, Homo sapiens
tcctgctagcacctccccag

SEQ ID NO: 3828106 - DNA, 14 bp, Homo sapiens
tcctgctggtgacc

SEQ ID NO: 3828107 - DNA, 22 bp, Homo sapiens
tcctggtggggcagaaaggctg

SEQ ID NO: 3828108 - DNA, 24 bp, Homo sapiens
tcctgtttggaaatggggagctgg

SEQ ID NO: 3828109 - DNA, 20 bp, Homo sapiens
tccttagcctgggcctcctc

SEQ ID NO: 3828110 - DNA, 22 bp, Homo sapiens
tccttagtatcagtcatgacag

SEQ ID NO: 3828111 - DNA, 12 bp, Homo sapiens
tccttccccctc

SEQ ID NO: 3828112 - DNA, 12 bp, Homo sapiens
tccttccctagg

SEQ ID NO: 3828113 - DNA, 13 bp, Homo sapiens
tccttccctaggc

SEQ ID NO: 3828114 - DNA, 17 bp, Homo sapiens
tccttccctgtgtcttt

SEQ ID NO: 3828115 - DNA, 14 bp, Homo sapiens
tccttcctcagaat

SEQ ID NO: 3828116 - DNA, 12 bp, Homo sapiens
tccttctgtgtt

SEQ ID NO: 3828117 - DNA, 12 bp, Homo sapiens
tccttgaagccg

SEQ ID NO: 3828118 - DNA, 15 bp, Homo sapiens
tgcctactgcccctg

SEQ ID NO: 3828119 - DNA, 21 bp, Homo sapiens
tgcctactgcccctgccctga

SEQ ID NO: 3828120 - DNA, 15 bp, Homo sapiens
tgcctaggcagccag

SEQ ID NO: 3828121 - DNA, 23 bp, Homo sapiens
tgcctaggcagccagctacaggc

SEQ ID NO: 3828122 - DNA, 19 bp, Homo sapiens
tgcctcagggccaagccgg

SEQ ID NO: 3828123 - DNA, 15 bp, Homo sapiens
tgcctcatgaacact

SEQ ID NO: 3828124 - DNA, 15 bp, Homo sapiens
tgcctccatcctagt

SEQ ID NO: 3828125 - DNA, 22 bp, Homo sapiens
tgcctccatgtagaacttgaac

SEQ ID NO: 3828126 - DNA, 20 bp, Homo sapiens
tgcctccggcctgcactccc

SEQ ID NO: 3828127 - DNA, 22 bp, Homo sapiens
tgcctcgagccatagagcctga

SEQ ID NO: 3828128 - DNA, 21 bp, Homo sapiens
tgcctgacaccacgctggagc

SEQ ID NO: 3828129 - DNA, 18 bp, Homo sapiens
tgcctgagaggcaggcat

SEQ ID NO: 3828130 - DNA, 19 bp, Homo sapiens
tgcctgagaggcaggcata

SEQ ID NO: 3828131 - DNA, 15 bp, Homo sapiens
tgcctgagccccctg

SEQ ID NO: 3828132 - DNA, 13 bp, Homo sapiens
tgcctgcccccac

SEQ ID NO: 3828133 - DNA, 17 bp, Homo sapiens
tgcctgcccccacaccc

SEQ ID NO: 3828134 - DNA, 19 bp, Homo sapiens
tgcctgcccccacacccac

SEQ ID NO: 3828135 - DNA, 16 bp, Homo sapiens
tgcctgcgcagctcct

SEQ ID NO: 3828136 - DNA, 19 bp, Homo sapiens
tgcctgcgcagctccttcc

SEQ ID NO: 3828137 - DNA, 21 bp, Homo sapiens
tgcctgctttttatggcctgt

SEQ ID NO: 3828138 - DNA, 23 bp, Homo sapiens
tgcctggctggtttgcccagagc

SEQ ID NO: 3828139 - DNA, 14 bp, Homo sapiens
tgcctgggaggagt

SEQ ID NO: 3828140 - DNA, 16 bp, Homo sapiens
tgcctgggaggagtgg

SEQ ID NO: 3828141 - DNA, 17 bp, Homo sapiens
tgcctgggaggagtggc

SEQ ID NO: 3828142 - DNA, 22 bp, Homo sapiens
tgcctggtcacagggcatgccc

SEQ ID NO: 3828143 - DNA, 14 bp, Homo sapiens
tgcctgttgcaggc

SEQ ID NO: 3828144 - DNA, 16 bp, Homo sapiens
tgcctgttgcaggcaa

SEQ ID NO: 3828145 - DNA, 16 bp, Homo sapiens
tgccttaaaaccaaag

SEQ ID NO: 3828146 - DNA, 17 bp, Homo sapiens
tgccttaacctagaggg

SEQ ID NO: 3828147 - DNA, 14 bp, Homo sapiens
tgcgaccaccaaca

SEQ ID NO: 3828148 - DNA, 23 bp, Homo sapiens
acttttatgatacttgaaaatta

SEQ ID NO: 3828149 - DNA, 19 bp, Homo sapiens
actttttccattttttaaa

SEQ ID NO: 3828150 - DNA, 16 bp, Homo sapiens
actttttgtaaatgct

SEQ ID NO: 3828151 - DNA, 17 bp, Homo sapiens
actttttgtaaatgctg

SEQ ID NO: 3828152 - DNA, 17 bp, Homo sapiens
agaaaaaaaaactgggg

SEQ ID NO: 3828153 - DNA, 13 bp, Homo sapiens
agaaaacaagaga

SEQ ID NO: 3828154 - DNA, 19 bp, Homo sapiens
agaaaacttgtattatgtg

SEQ ID NO: 3828155 - DNA, 21 bp, Homo sapiens
agaaaacttgtattatgtgtg

SEQ ID NO: 3828156 - DNA, 12 bp, Homo sapiens
agaaaaggcagc

SEQ ID NO: 3828157 - DNA, 14 bp, Homo sapiens
agaaaaggcagcca

SEQ ID NO: 3828158 - DNA, 16 bp, Homo sapiens
agaaaaggcagccaga

SEQ ID NO: 3828159 - DNA, 14 bp, Homo sapiens
agaaacaagagacc

SEQ ID NO: 3828160 - DNA, 14 bp, Homo sapiens
agaaacaataaaga

SEQ ID NO: 3828161 - DNA, 19 bp, Homo sapiens
agaaacaatgtctggggac

SEQ ID NO: 3828162 - DNA, 20 bp, Homo sapiens
agaaacaatgtctggggaca

SEQ ID NO: 3828163 - DNA, 18 bp, Homo sapiens
agaaagaacgttcccttt

SEQ ID NO: 3828164 - DNA, 23 bp, Homo sapiens
agaaagattaaatatatctttgt

SEQ ID NO: 3828165 - DNA, 14 bp, Homo sapiens
agaaagattgtaaa

SEQ ID NO: 3828166 - DNA, 13 bp, Homo sapiens
agaaagattttat

SEQ ID NO: 3828167 - DNA, 18 bp, Homo sapiens
agaaagattttatgtgct

SEQ ID NO: 3828168 - DNA, 12 bp, Homo sapiens
agaaagcagggg

SEQ ID NO: 3828169 - DNA, 14 bp, Homo sapiens
agaaaggctgcaac

SEQ ID NO: 3828170 - DNA, 22 bp, Homo sapiens
agaaaggtgagtttgagctgcc

SEQ ID NO: 3828171 - DNA, 20 bp, Homo sapiens
agaaagtttccccaccagtg

SEQ ID NO: 3828172 - DNA, 16 bp, Homo sapiens
agaaataaatctatat

SEQ ID NO: 3828173 - DNA, 16 bp, Homo sapiens
agaaatcttgaatagc

SEQ ID NO: 3828174 - DNA, 13 bp, Homo sapiens
agaaattatgtgc

SEQ ID NO: 3828175 - DNA, 21 bp, Homo sapiens
agaaattatgtgccagattta

SEQ ID NO: 3828176 - DNA, 23 bp, Homo sapiens
agaaattttattagacattctct

SEQ ID NO: 3828177 - DNA, 23 bp, Homo sapiens
agaacgttccctttggggatagt

SEQ ID NO: 3828178 - DNA, 14 bp, Homo sapiens
agaagaaaggagct

SEQ ID NO: 3828179 - DNA, 21 bp, Homo sapiens
agaagagaggagaggagagag

SEQ ID NO: 3828180 - DNA, 12 bp, Homo sapiens
agaagccaaggg

SEQ ID NO: 3828181 - DNA, 21 bp, Homo sapiens
agaagccaagggaaaggggtg

SEQ ID NO: 3828182 - DNA, 13 bp, Homo sapiens
agaagctgggagg

SEQ ID NO: 3828183 - DNA, 16 bp, Homo sapiens
agaagcttaggcaggg

SEQ ID NO: 3828184 - DNA, 17 bp, Homo sapiens
agaagcttaggcagggc

SEQ ID NO: 3828185 - DNA, 13 bp, Homo sapiens
agaaggagagaaa

SEQ ID NO: 3828186 - DNA, 11 bp, Homo sapiens
agaaggccaga

SEQ ID NO: 3828187 - DNA, 20 bp, Homo sapiens
agaaggccagaaaaggcagc

SEQ ID NO: 3828188 - DNA, 21 bp, Homo sapiens
agaaggccagaaaaggcagcc

SEQ ID NO: 3828189 - DNA, 15 bp, Homo sapiens
agaagggagaagaaa

SEQ ID NO: 3828190 - DNA, 15 bp, Homo sapiens
agaagtgccatctca

SEQ ID NO: 3828191 - DNA, 23 bp, Homo sapiens
agaagttattttctacagtggtt

SEQ ID NO: 3828192 - DNA, 14 bp, Homo sapiens
agaataaagcaatt

SEQ ID NO: 3828193 - DNA, 20 bp, Homo sapiens
agaataaatgttttacaact

SEQ ID NO: 3828194 - DNA, 21 bp, Homo sapiens
agaatatttttggcattcctc

SEQ ID NO: 3828195 - DNA, 14 bp, Homo sapiens
agaatggatttttc

SEQ ID NO: 3828196 - DNA, 17 bp, Homo sapiens
agaattgtgtctgcagg

SEQ ID NO: 3828197 - DNA, 21 bp, Homo sapiens
agacaaaacttcctgtttgtg

SEQ ID NO: 3828198 - DNA, 15 bp, Homo sapiens
agacaagagatggga

SEQ ID NO: 3828199 - DNA, 17 bp, Homo sapiens
agacacaagtggcctta

SEQ ID NO: 3828200 - DNA, 18 bp, Homo sapiens
agacactggctgccagct

SEQ ID NO: 3828201 - DNA, 20 bp, Homo sapiens
agacactggctgccagctat

SEQ ID NO: 3828202 - DNA, 22 bp, Homo sapiens
agacagagaccctctgccacca

SEQ ID NO: 3828203 - DNA, 12 bp, Homo sapiens
agacagagcagg

SEQ ID NO: 3828204 - DNA, 15 bp, Homo sapiens
agacagagcaggctt

SEQ ID NO: 3828205 - DNA, 17 bp, Homo sapiens
agacagagcaggctttg

SEQ ID NO: 3828206 - DNA, 21 bp, Homo sapiens
agacagagcaggctttgtgag

SEQ ID NO: 3828207 - DNA, 13 bp, Homo sapiens
aaaaaaaagttgt

SEQ ID NO: 3828208 - DNA, 12 bp, Homo sapiens
aaaaaaagttgt

SEQ ID NO: 3828209 - DNA, 12 bp, Homo sapiens
aaaaagaagttt

SEQ ID NO: 3828210 - DNA, 19 bp, Homo sapiens
aaaaagcagtttttgaaag

SEQ ID NO: 3828211 - DNA, 15 bp, Homo sapiens
aaaaagctttactct

SEQ ID NO: 3828212 - DNA, 12 bp, Homo sapiens
aaaaagttataa

SEQ ID NO: 3828213 - DNA, 21 bp, Homo sapiens
aaaaagttgtaatagagaata

SEQ ID NO: 3828214 - DNA, 23 bp, Homo sapiens
aaaaagttgtaatagagaatatt

SEQ ID NO: 3828215 - DNA, 13 bp, Homo sapiens
aaaaagttgttta

SEQ ID NO: 3828216 - DNA, 16 bp, Homo sapiens
aaaacaaacacacaca

SEQ ID NO: 3828217 - DNA, 15 bp, Homo sapiens
aaaacacaagcaaaa

SEQ ID NO: 3828218 - DNA, 17 bp, Homo sapiens
aaaacccaaagctctaa

SEQ ID NO: 3828219 - DNA, 18 bp, Homo sapiens
aaaacccctaaaaacaaa

SEQ ID NO: 3828220 - DNA, 19 bp, Homo sapiens
aaaacccctaaaaacaaaa

SEQ ID NO: 3828221 - DNA, 20 bp, Homo sapiens
aaaactcagatttaaaacaa

SEQ ID NO: 3828222 - DNA, 13 bp, Homo sapiens
aaaactcaggatt

SEQ ID NO: 3828223 - DNA, 12 bp, Homo sapiens
aaaactctgcca

SEQ ID NO: 3828224 - DNA, 21 bp, Homo sapiens
aaaactgatgttactagcctc

SEQ ID NO: 3828225 - DNA, 22 bp, Homo sapiens
aaaactggttctacaaattttt

SEQ ID NO: 3828226 - DNA, 20 bp, Homo sapiens
aaaagaagttcattcctgtc

SEQ ID NO: 3828227 - DNA, 21 bp, Homo sapiens
aaaagattttgtgaaatttca

SEQ ID NO: 3828228 - DNA, 14 bp, Homo sapiens
aaaagcaaggtgtt

SEQ ID NO: 3828229 - DNA, 19 bp, Homo sapiens
aaaagcagcccttggccag

SEQ ID NO: 3828230 - DNA, 14 bp, Homo sapiens
aaaaggcagccaga

SEQ ID NO: 3828231 - DNA, 23 bp, Homo sapiens
aaaaggcagccagatccccaggg

SEQ ID NO: 3828232 - DNA, 16 bp, Homo sapiens
aaaagggactgagaaa

SEQ ID NO: 3828233 - DNA, 19 bp, Homo sapiens
aaaagggactgagaaattt

SEQ ID NO: 3828234 - DNA, 16 bp, Homo sapiens
aaaaggtactggtgag

SEQ ID NO: 3828235 - DNA, 18 bp, Homo sapiens
aaaagttgtaatagagaa

SEQ ID NO: 3828236 - DNA, 19 bp, Homo sapiens
aaaagttgtaatagagaat

SEQ ID NO: 3828237 - DNA, 16 bp, Homo sapiens
aaaagttgtttataaa

SEQ ID NO: 3828238 - DNA, 17 bp, Homo sapiens
aaaagttgtttataaaa

SEQ ID NO: 3828239 - DNA, 18 bp, Homo sapiens
aaaagttgtttataaaaa

SEQ ID NO: 3828240 - DNA, 20 bp, Homo sapiens
aaaataaccctttggttttt

SEQ ID NO: 3828241 - DNA, 14 bp, Homo sapiens
aaaataatgcaaat

SEQ ID NO: 3828242 - DNA, 14 bp, Homo sapiens
aaaatatcattcag

SEQ ID NO: 3828243 - DNA, 16 bp, Homo sapiens
aaaatatcattcagca

SEQ ID NO: 3828244 - DNA, 20 bp, Homo sapiens
aaaatcccttaatctatgtg

SEQ ID NO: 3828245 - DNA, 12 bp, Homo sapiens
aaaatgagaaat

SEQ ID NO: 3828246 - DNA, 16 bp, Homo sapiens
aaaatgatatattaaa

SEQ ID NO: 3828247 - DNA, 16 bp, Homo sapiens
aaaatgcctgctgctg

SEQ ID NO: 3828248 - DNA, 22 bp, Homo sapiens
aaaatgtgacatctttggtcat

SEQ ID NO: 3828249 - DNA, 15 bp, Homo sapiens
aaaatgtgaggggaa

SEQ ID NO: 3828250 - DNA, 16 bp, Homo sapiens
aaaatgtttaggaaat

SEQ ID NO: 3828251 - DNA, 22 bp, Homo sapiens
aaaattaacatgaatatttagt

SEQ ID NO: 3828252 - DNA, 15 bp, Homo sapiens
aaaattatgctgcat

SEQ ID NO: 3828253 - DNA, 16 bp, Homo sapiens
aaaattctactgtatg

SEQ ID NO: 3828254 - DNA, 13 bp, Homo sapiens
aaacaaaacaaac

SEQ ID NO: 3828255 - DNA, 16 bp, Homo sapiens
aaacaagaaagtttcc

SEQ ID NO: 3828256 - DNA, 15 bp, Homo sapiens
aaacaataaagagat

SEQ ID NO: 3828257 - DNA, 14 bp, Homo sapiens
aaacaatgaagtgt

SEQ ID NO: 3828258 - DNA, 18 bp, Homo sapiens
aaacaatgaagtgtttta

SEQ ID NO: 3828259 - DNA, 24 bp, Homo sapiens
aaacacggcttctcatgctatttc

SEQ ID NO: 3828260 - DNA, 22 bp, Homo sapiens
aaacagtagccccatcacattt

SEQ ID NO: 3828261 - DNA, 15 bp, Homo sapiens
aaacatgtccccttc

SEQ ID NO: 3828262 - DNA, 17 bp, Homo sapiens
aaacatgtccccttccc

SEQ ID NO: 3828263 - DNA, 21 bp, Homo sapiens
aaaccaaagagggcttcctct

SEQ ID NO: 3828264 - DNA, 13 bp, Homo sapiens
aaacccctaaaaa

SEQ ID NO: 3828265 - DNA, 14 bp, Homo sapiens
aaaccctgtcctcc

SEQ ID NO: 3828266 - DNA, 16 bp, Homo sapiens
aaacctctccttcctc

SEQ ID NO: 3828267 - DNA, 14 bp, Homo sapiens
aaactacaccacac

SEQ ID NO: 3828268 - DNA, 22 bp, Homo sapiens
aaactacatgtaaaatcttgat

SEQ ID NO: 3828269 - DNA, 13 bp, Homo sapiens
aaactatttaact

SEQ ID NO: 3828270 - DNA, 14 bp, Homo sapiens
aaactcatctcatt

SEQ ID NO: 3828271 - DNA, 16 bp, Homo sapiens
aaactccacatctgcc

SEQ ID NO: 3828272 - DNA, 11 bp, Homo sapiens
aaactctgcca

SEQ ID NO: 3828273 - DNA, 16 bp, Homo sapiens
aaactcttgaatatgt

SEQ ID NO: 3828274 - DNA, 19 bp, Homo sapiens
aaactggttctacaaattt

SEQ ID NO: 3828275 - DNA, 12 bp, Homo sapiens
aaagaaactttt

SEQ ID NO: 3828276 - DNA, 18 bp, Homo sapiens
aaagaaagattttatgtg

SEQ ID NO: 3828277 - DNA, 12 bp, Homo sapiens
aaagaaagctaa

SEQ ID NO: 3828278 - DNA, 20 bp, Homo sapiens
aaagaagactgtgtttttgc

SEQ ID NO: 3828279 - DNA, 20 bp, Homo sapiens
aaagaccttgtgtgtatgtg

SEQ ID NO: 3828280 - DNA, 15 bp, Homo sapiens
aaagaggattagaca

SEQ ID NO: 3828281 - DNA, 16 bp, Homo sapiens
aaagattaaatatatc

SEQ ID NO: 3828282 - DNA, 16 bp, Homo sapiens
aaagattgtaaactaa

SEQ ID NO: 3828283 - DNA, 17 bp, Homo sapiens
aaagattttatgtgctt

SEQ ID NO: 3828284 - DNA, 23 bp, Homo sapiens
aaagattttatgtgcttgaagat

SEQ ID NO: 3828285 - DNA, 12 bp, Homo sapiens
aaagattttgtg

SEQ ID NO: 3828286 - DNA, 13 bp, Homo sapiens
aaagattttgtga

SEQ ID NO: 3828287 - DNA, 20 bp, Homo sapiens
aaagattttgtgaaatttca

SEQ ID NO: 3828288 - DNA, 13 bp, Homo sapiens
aaagcaattttcc

SEQ ID NO: 3828289 - DNA, 17 bp, Homo sapiens
aaagcaattttccttga

SEQ ID NO: 3828290 - DNA, 18 bp, Homo sapiens
aaagcaattttccttgaa

SEQ ID NO: 3828291 - DNA, 23 bp, Homo sapiens
aaagcaattttccttgaagccga

SEQ ID NO: 3828292 - DNA, 18 bp, Homo sapiens
aaagcagcccttggccag

SEQ ID NO: 3828293 - DNA, 15 bp, Homo sapiens
aaagcagtttttgaa

SEQ ID NO: 3828294 - DNA, 17 bp, Homo sapiens
aaagccccatgctggag

SEQ ID NO: 3828295 - DNA, 21 bp, Homo sapiens
aaagctaaggctcgagttaaa

SEQ ID NO: 3828296 - DNA, 19 bp, Homo sapiens
aaaggactatttataacta

SEQ ID NO: 3828297 - DNA, 23 bp, Homo sapiens
aaaggcagccagatccccagggc

SEQ ID NO: 3828298 - DNA, 12 bp, Homo sapiens
aaagggcagagg

SEQ ID NO: 3828299 - DNA, 14 bp, Homo sapiens
aaaggtaaatcaga

SEQ ID NO: 3828300 - DNA, 23 bp, Homo sapiens
aaaggtgagtttgagctgccttc

SEQ ID NO: 3828301 - DNA, 17 bp, Homo sapiens
aaaggtgtaaaacagta

SEQ ID NO: 3828302 - DNA, 23 bp, Homo sapiens
aaagtagattaaaatatttgcct

SEQ ID NO: 3828303 - DNA, 18 bp, Homo sapiens
aaagtattgtgtttatgc

SEQ ID NO: 3828304 - DNA, 14 bp, Homo sapiens
aaagtctagaaaat

SEQ ID NO: 3828305 - DNA, 20 bp, Homo sapiens
aaagtctctggaatttgaaa

SEQ ID NO: 3828306 - DNA, 13 bp, Homo sapiens
aaagtctctgggt

SEQ ID NO: 3828307 - DNA, 14 bp, Homo sapiens
aaagtgggaaagtt

SEQ ID NO: 3828308 - DNA, 21 bp, Homo sapiens
aaagtgtcactccataaaaag

SEQ ID NO: 3828309 - DNA, 13 bp, Homo sapiens
aaagtgtgcttta

SEQ ID NO: 3828310 - DNA, 16 bp, Homo sapiens
aaagtgtgctttataa

SEQ ID NO: 3828311 - DNA, 12 bp, Homo sapiens
aaataaactttg

SEQ ID NO: 3828312 - DNA, 15 bp, Homo sapiens
aaataaatatatata

SEQ ID NO: 3828313 - DNA, 22 bp, Homo sapiens
aaataacttgccatttctttat

SEQ ID NO: 3828314 - DNA, 13 bp, Homo sapiens
aaatacagtagta

SEQ ID NO: 3828315 - DNA, 9 bp, Homo sapiens
aaatatata

SEQ ID NO: 3828316 - DNA, 14 bp, Homo sapiens
aaatatatataaat

SEQ ID NO: 3828317 - DNA, 17 bp, Homo sapiens
aaatatatataaatata

SEQ ID NO: 3828318 - DNA, 21 bp, Homo sapiens
aaatatatataaatatatata

SEQ ID NO: 3828319 - DNA, 22 bp, Homo sapiens
aaatatatctttgtaaattatt

SEQ ID NO: 3828320 - DNA, 16 bp, Homo sapiens
aaatatattttaagac

SEQ ID NO: 3828321 - DNA, 13 bp, Homo sapiens
aaatatcattcag

SEQ ID NO: 3828322 - DNA, 12 bp, Homo sapiens
aaatatttcata

SEQ ID NO: 3828323 - DNA, 15 bp, Homo sapiens
aaatatttcataaat

SEQ ID NO: 3828324 - DNA, 15 bp, Homo sapiens
aaatatttgcctcca

SEQ ID NO: 3828325 - DNA, 22 bp, Homo sapiens
aaatatttgcctccatgtagaa

SEQ ID NO: 3828326 - DNA, 13 bp, Homo sapiens
aaatcattcattc

SEQ ID NO: 3828327 - DNA, 17 bp, Homo sapiens
aaatgactactacacac

SEQ ID NO: 3828328 - DNA, 22 bp, Homo sapiens
aaatgatatattaaaccttcag

SEQ ID NO: 3828329 - DNA, 22 bp, Homo sapiens
aaatgcacagttctatttgcta

SEQ ID NO: 3828330 - DNA, 15 bp, Homo sapiens
aaatgccacaagaca

SEQ ID NO: 3828331 - DNA, 14 bp, Homo sapiens
aaatgcctgctgct

SEQ ID NO: 3828332 - DNA, 13 bp, Homo sapiens
aaatgctgtaaat

SEQ ID NO: 3828333 - DNA, 16 bp, Homo sapiens
aaatgctgtaaatatt

SEQ ID NO: 3828334 - DNA, 17 bp, Homo sapiens
aaatgctgtaaatattt

SEQ ID NO: 3828335 - DNA, 13 bp, Homo sapiens
aaatgctgtatgt

SEQ ID NO: 3828336 - DNA, 19 bp, Homo sapiens
aaatgctttaaaaactatt

SEQ ID NO: 3828337 - DNA, 21 bp, Homo sapiens
aaatgctttaaaaactattta

SEQ ID NO: 3828338 - DNA, 16 bp, Homo sapiens
aaatgtattaactgaa

SEQ ID NO: 3828339 - DNA, 15 bp, Homo sapiens
aaatgttacaaaaaa

SEQ ID NO: 3828340 - DNA, 14 bp, Homo sapiens
aaatgttttacaac

SEQ ID NO: 3828341 - DNA, 21 bp, Homo sapiens
aaatgtttttttttaaagact

SEQ ID NO: 3828342 - DNA, 17 bp, Homo sapiens
aaattacatgaagattt

SEQ ID NO: 3828343 - DNA, 18 bp, Homo sapiens
aaattacatgaagatttg

SEQ ID NO: 3828344 - DNA, 13 bp, Homo sapiens
aaattatgctgca

SEQ ID NO: 3828345 - DNA, 23 bp, Homo sapiens
aaattatgtgccagatttatgca

SEQ ID NO: 3828346 - DNA, 21 bp, Homo sapiens
gtggccctgtccctcccacct

SEQ ID NO: 3828347 - DNA, 13 bp, Homo sapiens
gtggccggggctg

SEQ ID NO: 3828348 - DNA, 19 bp, Homo sapiens
gtggcgggtcccagctact

SEQ ID NO: 3828349 - DNA, 23 bp, Homo sapiens
gtgggagccaccactcctgcctg

SEQ ID NO: 3828350 - DNA, 17 bp, Homo sapiens
gtgggaggtggaagaag

SEQ ID NO: 3828351 - DNA, 18 bp, Homo sapiens
gtgggcactaagggtgga

SEQ ID NO: 3828352 - DNA, 18 bp, Homo sapiens
gtggggcagaaaggctgc

SEQ ID NO: 3828353 - DNA, 15 bp, Homo sapiens
gtggggcccccagca

SEQ ID NO: 3828354 - DNA, 16 bp, Homo sapiens
gtggggcccccagcac

SEQ ID NO: 3828355 - DNA, 22 bp, Homo sapiens
gtggggcccccagcaccctctg

SEQ ID NO: 3828356 - DNA, 15 bp, Homo sapiens
gtgggggtggaggct

SEQ ID NO: 3828357 - DNA, 20 bp, Homo sapiens
gtgggtaaatcagggacagg

SEQ ID NO: 3828358 - DNA, 18 bp, Homo sapiens
gtgggtggatataaatat

SEQ ID NO: 3828359 - DNA, 15 bp, Homo sapiens
gtggtattatactgt

SEQ ID NO: 3828360 - DNA, 14 bp, Homo sapiens
gtggttaagaatgt

SEQ ID NO: 3828361 - DNA, 15 bp, Homo sapiens
gtgtaacagctcctt

SEQ ID NO: 3828362 - DNA, 23 bp, Homo sapiens
gtgtaacagctccttgggaggaa

SEQ ID NO: 3828363 - DNA, 17 bp, Homo sapiens
gtgtatctcaataaagc

SEQ ID NO: 3828364 - DNA, 16 bp, Homo sapiens
gtgtcaaataaacact

SEQ ID NO: 3828365 - DNA, 14 bp, Homo sapiens
gtgtcactccataa

SEQ ID NO: 3828366 - DNA, 22 bp, Homo sapiens
gtgtcactccataaaaagaaag

SEQ ID NO: 3828367 - DNA, 16 bp, Homo sapiens
gtgtgagagagagggc

SEQ ID NO: 3828368 - DNA, 21 bp, Homo sapiens
gtgtggcctggatccatcctg

SEQ ID NO: 3828369 - DNA, 13 bp, Homo sapiens
gtgttctttataa

SEQ ID NO: 3828370 - DNA, 14 bp, Homo sapiens
gtgttgggatactg

SEQ ID NO: 3828371 - DNA, 21 bp, Homo sapiens
gtgttgggatactgcagggcc

SEQ ID NO: 3828372 - DNA, 21 bp, Homo sapiens
gtgttttacaatgatttgtaa

SEQ ID NO: 3828373 - DNA, 14 bp, Homo sapiens
gttaaatatgattt

SEQ ID NO: 3828374 - DNA, 19 bp, Homo sapiens
gttaacaatggcaggtttt

SEQ ID NO: 3828375 - DNA, 17 bp, Homo sapiens
gttacacaaaggacctc

SEQ ID NO: 3828376 - DNA, 13 bp, Homo sapiens
gttactagcctct

SEQ ID NO: 3828377 - DNA, 20 bp, Homo sapiens
gttactgccaaaaccaaatt

SEQ ID NO: 3828378 - DNA, 13 bp, Homo sapiens
gttactttacatc

SEQ ID NO: 3828379 - DNA, 15 bp, Homo sapiens
gttagccaaacaaca

SEQ ID NO: 3828380 - DNA, 15 bp, Homo sapiens
gttaggacaaggctg

SEQ ID NO: 3828381 - DNA, 16 bp, Homo sapiens
gttaggacaaggctgt

SEQ ID NO: 3828382 - DNA, 20 bp, Homo sapiens
gttatgcctgttgcaggcaa

SEQ ID NO: 3828383 - DNA, 16 bp, Homo sapiens
gttattgttttgttaa

SEQ ID NO: 3828384 - DNA, 14 bp, Homo sapiens
gttattttctacag

SEQ ID NO: 3828385 - DNA, 17 bp, Homo sapiens
gttattttctacagtgg

SEQ ID NO: 3828386 - DNA, 24 bp, Homo sapiens
gttcaagtgattctcctgcctcag

SEQ ID NO: 3828387 - DNA, 23 bp, Homo sapiens
gttcatgttagttttgctccttc

SEQ ID NO: 3828388 - DNA, 16 bp, Homo sapiens
gttcccaaagggaggg

SEQ ID NO: 3828389 - DNA, 23 bp, Homo sapiens
gttccctttggggatagtctgga

SEQ ID NO: 3828390 - DNA, 13 bp, Homo sapiens
gttcctctgcctg

SEQ ID NO: 3828391 - DNA, 15 bp, Homo sapiens
gttcctctgcctgcc

SEQ ID NO: 3828392 - DNA, 15 bp, Homo sapiens
gttcctgataattgt

SEQ ID NO: 3828393 - DNA, 13 bp, Homo sapiens
gttcgcagcctca

SEQ ID NO: 3828394 - DNA, 20 bp, Homo sapiens
gttctacaaatttttacttg

SEQ ID NO: 3828395 - DNA, 23 bp, Homo sapiens
gttctacaaatttttacttgaag

SEQ ID NO: 3828396 - DNA, 13 bp, Homo sapiens
gttctatttgcta

SEQ ID NO: 3828397 - DNA, 19 bp, Homo sapiens
gttctctgtaattacaact

SEQ ID NO: 3828398 - DNA, 12 bp, Homo sapiens
gttctttataac

SEQ ID NO: 3828399 - DNA, 13 bp, Homo sapiens
gttgaaattaagc

SEQ ID NO: 3828400 - DNA, 19 bp, Homo sapiens
gttgagcgtattcttgaaa

SEQ ID NO: 3828401 - DNA, 20 bp, Homo sapiens
gttgaggggctccccagagg

SEQ ID NO: 3828402 - DNA, 14 bp, Homo sapiens
gttgcaaaggaaat

SEQ ID NO: 3828403 - DNA, 14 bp, Homo sapiens
gttgcaactttgta

SEQ ID NO: 3828404 - DNA, 16 bp, Homo sapiens
gttgcagtgagctgag

SEQ ID NO: 3828405 - DNA, 19 bp, Homo sapiens
gttgcttttttagatttat

SEQ ID NO: 3828406 - DNA, 16 bp, Homo sapiens
gttggcagtgagtgag

SEQ ID NO: 3828407 - DNA, 15 bp, Homo sapiens
gttggcatcacctgc

SEQ ID NO: 3828408 - DNA, 16 bp, Homo sapiens
gttggcatcacctgcg

SEQ ID NO: 3828409 - DNA, 12 bp, Homo sapiens
gttggctcagaa

SEQ ID NO: 3828410 - DNA, 13 bp, Homo sapiens
gttggctcagaaa

SEQ ID NO: 3828411 - DNA, 18 bp, Homo sapiens
gttgggatactgcagggc

SEQ ID NO: 3828412 - DNA, 17 bp, Homo sapiens
gttgggggctaggggag

SEQ ID NO: 3828413 - DNA, 22 bp, Homo sapiens
gttggttttatactatattaac

SEQ ID NO: 3828414 - DNA, 17 bp, Homo sapiens
gttgtggatgggaggct

SEQ ID NO: 3828415 - DNA, 15 bp, Homo sapiens
gttgtttataaaaac

SEQ ID NO: 3828416 - DNA, 21 bp, Homo sapiens
gtttacacacgtgcaatttgt

SEQ ID NO: 3828417 - DNA, 16 bp, Homo sapiens
gtttatgcatttcaat

SEQ ID NO: 3828418 - DNA, 20 bp, Homo sapiens
gtttattgggcaataaaaga

SEQ ID NO: 3828419 - DNA, 21 bp, Homo sapiens
gtttcagtgtcaaataaacac

SEQ ID NO: 3828420 - DNA, 18 bp, Homo sapiens
gtttcatgttatgcctgt

SEQ ID NO: 3828421 - DNA, 13 bp, Homo sapiens
gtttcattctaaa

SEQ ID NO: 3828422 - DNA, 17 bp, Homo sapiens
gtttcattctaaaatca

SEQ ID NO: 3828423 - DNA, 18 bp, Homo sapiens
gtttccatcctttgcatt

SEQ ID NO: 3828424 - DNA, 20 bp, Homo sapiens
gtttccccaccagtgaatga

SEQ ID NO: 3828425 - DNA, 21 bp, Homo sapiens
gtttcccctctcatctgacct

SEQ ID NO: 3828426 - DNA, 23 bp, Homo sapiens
gtttccttccctacccagtcccc

SEQ ID NO: 3828427 - DNA, 15 bp, Homo sapiens
gtttctcctcagaag

SEQ ID NO: 3828428 - DNA, 19 bp, Homo sapiens
gtttgaagctgctgtctct

SEQ ID NO: 3828429 - DNA, 15 bp, Homo sapiens
gtttgccaagccctt

SEQ ID NO: 3828430 - DNA, 17 bp, Homo sapiens
gtttgccaagccctttg

SEQ ID NO: 3828431 - DNA, 21 bp, Homo sapiens
gtttggaaatggggagctggc

SEQ ID NO: 3828432 - DNA, 19 bp, Homo sapiens
gtttggttggttttatact

SEQ ID NO: 3828433 - DNA, 20 bp, Homo sapiens
gtttgtaagtaagtaagaaa

SEQ ID NO: 3828434 - DNA, 17 bp, Homo sapiens
gtttgttgatcttttaa

SEQ ID NO: 3828435 - DNA, 13 bp, Homo sapiens
gttttaacaccaa

SEQ ID NO: 3828436 - DNA, 11 bp, Homo sapiens
gttttacaact

SEQ ID NO: 3828437 - DNA, 18 bp, Homo sapiens
gttttacaatgatttgta

SEQ ID NO: 3828438 - DNA, 19 bp, Homo sapiens
gttttacaatgatttgtaa

SEQ ID NO: 3828439 - DNA, 22 bp, Homo sapiens
gttttacaatgatttgtaaagg

SEQ ID NO: 3828440 - DNA, 16 bp, Homo sapiens
taatatttgtctgtgt

SEQ ID NO: 3828441 - DNA, 22 bp, Homo sapiens
taatatttgtctgtgtgctact

SEQ ID NO: 3828442 - DNA, 16 bp, Homo sapiens
taatcctgcacagatc

SEQ ID NO: 3828443 - DNA, 15 bp, Homo sapiens
taatcctttagatta

SEQ ID NO: 3828444 - DNA, 12 bp, Homo sapiens
taatctatgtgc

SEQ ID NO: 3828445 - DNA, 14 bp, Homo sapiens
taatgcaaatgtca

SEQ ID NO: 3828446 - DNA, 23 bp, Homo sapiens
taatggtctcatctcctttgcta

SEQ ID NO: 3828447 - DNA, 17 bp, Homo sapiens
taatgtaactgaagcat

SEQ ID NO: 3828448 - DNA, 22 bp, Homo sapiens
taatgtaactgaagcataaaca

SEQ ID NO: 3828449 - DNA, 14 bp, Homo sapiens
taatgtatgaattt

SEQ ID NO: 3828450 - DNA, 21 bp, Homo sapiens
taatgtatgaattttgtaagt

SEQ ID NO: 3828451 - DNA, 22 bp, Homo sapiens
taatgtatgaattttgtaagta

SEQ ID NO: 3828452 - DNA, 17 bp, Homo sapiens
taatgtattaataccac

SEQ ID NO: 3828453 - DNA, 16 bp, Homo sapiens
taatgtatttttgtaa

SEQ ID NO: 3828454 - DNA, 19 bp, Homo sapiens
taatgtatttttgtaaata

SEQ ID NO: 3828455 - DNA, 19 bp, Homo sapiens
taatgtctttaaaaagcat

SEQ ID NO: 3828456 - DNA, 13 bp, Homo sapiens
taattaacatcaa

SEQ ID NO: 3828457 - DNA, 17 bp, Homo sapiens
taattaattaattaaca

SEQ ID NO: 3828458 - DNA, 15 bp, Homo sapiens
taattagcttttgga

SEQ ID NO: 3828459 - DNA, 18 bp, Homo sapiens
taattcatttattaagta

SEQ ID NO: 3828460 - DNA, 22 bp, Homo sapiens
taattgctttcctgcctccttg

SEQ ID NO: 3828461 - DNA, 24 bp, Homo sapiens
taattggtctaccaagtaagacat

SEQ ID NO: 3828462 - DNA, 14 bp, Homo sapiens
taatttctcctccc

SEQ ID NO: 3828463 - DNA, 21 bp, Homo sapiens
taatttggacattatttcgtg

SEQ ID NO: 3828464 - DNA, 19 bp, Homo sapiens
tacaaaaaagttataagaa

SEQ ID NO: 3828465 - DNA, 20 bp, Homo sapiens
tacaaaaaagttataagaaa

SEQ ID NO: 3828466 - DNA, 15 bp, Homo sapiens
tacaaaaattagctg

SEQ ID NO: 3828467 - DNA, 18 bp, Homo sapiens
tacaaagtactagctaaa

SEQ ID NO: 3828468 - DNA, 14 bp, Homo sapiens
tacaacaaagagga

SEQ ID NO: 3828469 - DNA, 14 bp, Homo sapiens
tacaatatatattt

SEQ ID NO: 3828470 - DNA, 17 bp, Homo sapiens
tacaatgatttgtaaag

SEQ ID NO: 3828471 - DNA, 10 bp, Homo sapiens
tacacacaca

SEQ ID NO: 3828472 - DNA, 23 bp, Homo sapiens
tacacacgtgcaatttgtttgtg

SEQ ID NO: 3828473 - DNA, 23 bp, Homo sapiens
tacacaggacttattatatcaga

SEQ ID NO: 3828474 - DNA, 12 bp, Homo sapiens
tacacctggctg

SEQ ID NO: 3828475 - DNA, 15 bp, Homo sapiens
tacacctggctgagg

SEQ ID NO: 3828476 - DNA, 14 bp, Homo sapiens
tacactagttgttt

SEQ ID NO: 3828477 - DNA, 19 bp, Homo sapiens
tacagaattgtgtctgcag

SEQ ID NO: 3828478 - DNA, 20 bp, Homo sapiens
tacagaattgtgtctgcagg

SEQ ID NO: 3828479 - DNA, 23 bp, Homo sapiens
tacagtcacaattttctgtgcca

SEQ ID NO: 3828480 - DNA, 21 bp, Homo sapiens
tacagtggttttatactgaag

SEQ ID NO: 3828481 - DNA, 19 bp, Homo sapiens
tacagttggaaatccatcc

SEQ ID NO: 3828482 - DNA, 16 bp, Homo sapiens
tacagtttgtttacac

SEQ ID NO: 3828483 - DNA, 13 bp, Homo sapiens
tacatttcctaaa

SEQ ID NO: 3828484 - DNA, 21 bp, Homo sapiens
taccaagtaagacatctcaaa

SEQ ID NO: 3828485 - DNA, 15 bp, Homo sapiens
taccaccacaccaaa

SEQ ID NO: 3828486 - DNA, 13 bp, Homo sapiens
taccagctgcgct

SEQ ID NO: 3828487 - DNA, 22 bp, Homo sapiens
taccagctgcgcttgcttttct

SEQ ID NO: 3828488 - DNA, 22 bp, Homo sapiens
tacccagtccccattttctggt

SEQ ID NO: 3828489 - DNA, 15 bp, Homo sapiens
taccgagagccaaac

SEQ ID NO: 3828490 - DNA, 18 bp, Homo sapiens
gtagattaaaatatttgc

SEQ ID NO: 3828491 - DNA, 19 bp, Homo sapiens
gtagtaccaaatgctttaa

SEQ ID NO: 3828492 - DNA, 21 bp, Homo sapiens
gtagtataatgtatgaatttt

SEQ ID NO: 3828493 - DNA, 16 bp, Homo sapiens
gtagtttgcccagagt

SEQ ID NO: 3828494 - DNA, 20 bp, Homo sapiens
gtatagatgagtttttcatt

SEQ ID NO: 3828495 - DNA, 22 bp, Homo sapiens
gtatattgatccagaaagaaaa

SEQ ID NO: 3828496 - DNA, 18 bp, Homo sapiens
gtatatttgtaaaagcta

SEQ ID NO: 3828497 - DNA, 23 bp, Homo sapiens
gtatcagtcagtgctggagaaat

SEQ ID NO: 3828498 - DNA, 14 bp, Homo sapiens
gtatcatttcatgc

SEQ ID NO: 3828499 - DNA, 14 bp, Homo sapiens
gtatctcaataaag

SEQ ID NO: 3828500 - DNA, 16 bp, Homo sapiens
gtatctcaataaagca

SEQ ID NO: 3828501 - DNA, 19 bp, Homo sapiens
gtatggaatacaatgtaat

SEQ ID NO: 3828502 - DNA, 11 bp, Homo sapiens
gtatgtgtgac

SEQ ID NO: 3828503 - DNA, 15 bp, Homo sapiens
gtattaagtgaaatt

SEQ ID NO: 3828504 - DNA, 21 bp, Homo sapiens
gtattatagtactgctttact

SEQ ID NO: 3828505 - DNA, 18 bp, Homo sapiens
gtattcttgaaagtattg

SEQ ID NO: 3828506 - DNA, 22 bp, Homo sapiens
gtatttttttttctaagagaag

SEQ ID NO: 3828507 - DNA, 13 bp, Homo sapiens
gtcaaataaacac

SEQ ID NO: 3828508 - DNA, 17 bp, Homo sapiens
gtcaaataaacactgtg

SEQ ID NO: 3828509 - DNA, 14 bp, Homo sapiens
gtcacacagcctgt

SEQ ID NO: 3828510 - DNA, 22 bp, Homo sapiens
gtcacctgtgcagggccctctg

SEQ ID NO: 3828511 - DNA, 12 bp, Homo sapiens
gtcactggaaag

SEQ ID NO: 3828512 - DNA, 18 bp, Homo sapiens
gtcactggaaaggggaga

SEQ ID NO: 3828513 - DNA, 20 bp, Homo sapiens
gtcactggaaaggggagagc

SEQ ID NO: 3828514 - DNA, 23 bp, Homo sapiens
gtcactggaggttgaagccaagt

SEQ ID NO: 3828515 - DNA, 14 bp, Homo sapiens
gtcagcaggcccag

SEQ ID NO: 3828516 - DNA, 15 bp, Homo sapiens
gtcagcaggcccagg

SEQ ID NO: 3828517 - DNA, 22 bp, Homo sapiens
gtcagccatcgccaacttgtct

SEQ ID NO: 3828518 - DNA, 12 bp, Homo sapiens
gtcaggatgacg

SEQ ID NO: 3828519 - DNA, 15 bp, Homo sapiens
gtcatgacagatgaa

SEQ ID NO: 3828520 - DNA, 15 bp, Homo sapiens
gtcattgcccacttc

SEQ ID NO: 3828521 - DNA, 18 bp, Homo sapiens
gtccaggaaatgtgcaca

SEQ ID NO: 3828522 - DNA, 16 bp, Homo sapiens
gtccccacccctgccc

SEQ ID NO: 3828523 - DNA, 17 bp, Homo sapiens
gtccccacccctgcccc

SEQ ID NO: 3828524 - DNA, 12 bp, Homo sapiens
gtccctcccacc

SEQ ID NO: 3828525 - DNA, 17 bp, Homo sapiens
gtccctcccacctctgt

SEQ ID NO: 3828526 - DNA, 18 bp, Homo sapiens
gtccctcccacctctgtg

SEQ ID NO: 3828527 - DNA, 23 bp, Homo sapiens
gtcctcacccctgtcctcactgc

SEQ ID NO: 3828528 - DNA, 19 bp, Homo sapiens
gtcctcactgctccctgaa

SEQ ID NO: 3828529 - DNA, 16 bp, Homo sapiens
gtcctcccacccctcc

SEQ ID NO: 3828530 - DNA, 15 bp, Homo sapiens
gtcctcccctcacag

SEQ ID NO: 3828531 - DNA, 20 bp, Homo sapiens
gtcctcccctcacagcctct

SEQ ID NO: 3828532 - DNA, 22 bp, Homo sapiens
gtcctcccctcacagcctctga

SEQ ID NO: 3828533 - DNA, 15 bp, Homo sapiens
gtcctcctcacctca

SEQ ID NO: 3828534 - DNA, 17 bp, Homo sapiens
gtcctcctcacctcatg

SEQ ID NO: 3828535 - DNA, 11 bp, Homo sapiens
gtcctgcttga

SEQ ID NO: 3828536 - DNA, 15 bp, Homo sapiens
gtcctgcttgaactg

SEQ ID NO: 3828537 - DNA, 20 bp, Homo sapiens
gtcctgcttgaactgctgcc

SEQ ID NO: 3828538 - DNA, 22 bp, Homo sapiens
gtcctgcttgaactgctgccaa

SEQ ID NO: 3828539 - DNA, 18 bp, Homo sapiens
gtcctgggggatgcaaat

SEQ ID NO: 3828540 - DNA, 14 bp, Homo sapiens
gtccttagcctggg

SEQ ID NO: 3828541 - DNA, 15 bp, Homo sapiens
gtccttagcctgggc

SEQ ID NO: 3828542 - DNA, 22 bp, Homo sapiens
gtcgcatcaagatttggcagga

SEQ ID NO: 3828543 - DNA, 20 bp, Homo sapiens
gtcgctctcatgaagccctt

SEQ ID NO: 3828544 - DNA, 22 bp, Homo sapiens
gtcgcttttggtgcctggctgg

SEQ ID NO: 3828545 - DNA, 21 bp, Homo sapiens
gtcggccacaccccagactcc

SEQ ID NO: 3828546 - DNA, 21 bp, Homo sapiens
gtctacagctccagatgtttc

SEQ ID NO: 3828547 - DNA, 20 bp, Homo sapiens
gtctataagtatataaatac

SEQ ID NO: 3828548 - DNA, 13 bp, Homo sapiens
gtctcaggctggt

SEQ ID NO: 3828549 - DNA, 21 bp, Homo sapiens
gtctctagaagtgccatctca

SEQ ID NO: 3828550 - DNA, 11 bp, Homo sapiens
gtctctgtaga

SEQ ID NO: 3828551 - DNA, 22 bp, Homo sapiens
gtctgaaaaatgcctgctgctg

SEQ ID NO: 3828552 - DNA, 16 bp, Homo sapiens
gtctgctcctccctcc

SEQ ID NO: 3828553 - DNA, 12 bp, Homo sapiens
gtctgctctcag

SEQ ID NO: 3828554 - DNA, 12 bp, Homo sapiens
gtctggggacag

SEQ ID NO: 3828555 - DNA, 15 bp, Homo sapiens
gtctggggacaggcc

SEQ ID NO: 3828556 - DNA, 15 bp, Homo sapiens
gtctgtgtgctacta

SEQ ID NO: 3828557 - DNA, 17 bp, Homo sapiens
gtctgtgtgctactaac

SEQ ID NO: 3828558 - DNA, 22 bp, Homo sapiens
gtctgtgtgctactaacagatt

SEQ ID NO: 3828559 - DNA, 12 bp, Homo sapiens
gtctgttagcca

SEQ ID NO: 3828560 - DNA, 15 bp, Homo sapiens
gtctgttattgtttt

SEQ ID NO: 3828561 - DNA, 14 bp, Homo sapiens
gtcttgagaaatac

SEQ ID NO: 3828562 - DNA, 13 bp, Homo sapiens
gtcttgtgactag

SEQ ID NO: 3828563 - DNA, 14 bp, Homo sapiens
gtgaaaagggcaga

SEQ ID NO: 3828564 - DNA, 16 bp, Homo sapiens
gtgaaaagggcagagg

SEQ ID NO: 3828565 - DNA, 16 bp, Homo sapiens
gtgaaatttcatgaaa

SEQ ID NO: 3828566 - DNA, 15 bp, Homo sapiens
gtgaatgaatacaca

SEQ ID NO: 3828567 - DNA, 14 bp, Homo sapiens
gtgacaagtgtgtc

SEQ ID NO: 3828568 - DNA, 22 bp, Homo sapiens
gtgacaggtttttatgggtact

SEQ ID NO: 3828569 - DNA, 16 bp, Homo sapiens
gtgacatggtgcctga

SEQ ID NO: 3828570 - DNA, 19 bp, Homo sapiens
gtgacatggtgcctgagag

SEQ ID NO: 3828571 - DNA, 24 bp, Homo sapiens
gtgacatggtgcctgagaggcagg

SEQ ID NO: 3828572 - DNA, 22 bp, Homo sapiens
gtgacccctgctttgccccact

SEQ ID NO: 3828573 - DNA, 14 bp, Homo sapiens
gtgactagtgctga

SEQ ID NO: 3828574 - DNA, 22 bp, Homo sapiens
gtgactagtgctgaagcttatt

SEQ ID NO: 3828575 - DNA, 15 bp, Homo sapiens
gtgacttaaggagaa

SEQ ID NO: 3828576 - DNA, 20 bp, Homo sapiens
gtgacttgggctccgctgtg

SEQ ID NO: 3828577 - DNA, 13 bp, Homo sapiens
gtgagagagaggg

SEQ ID NO: 3828578 - DNA, 15 bp, Homo sapiens
gtgagagaggacctc

SEQ ID NO: 3828579 - DNA, 17 bp, Homo sapiens
gtgagagaggacctcca

SEQ ID NO: 3828580 - DNA, 17 bp, Homo sapiens
gtgagatgctggagaag

SEQ ID NO: 3828581 - DNA, 19 bp, Homo sapiens
gtgagatgctggagaagag

SEQ ID NO: 3828582 - DNA, 14 bp, Homo sapiens
gtgagggcaagagg

SEQ ID NO: 3828583 - DNA, 18 bp, Homo sapiens
gtgagtgagcctggctct

SEQ ID NO: 3828584 - DNA, 15 bp, Homo sapiens
gtgagtttgagctgc

SEQ ID NO: 3828585 - DNA, 19 bp, Homo sapiens
gtgatataagtgtgtgttt

SEQ ID NO: 3828586 - DNA, 17 bp, Homo sapiens
gtgcaatttgtttgtgc

SEQ ID NO: 3828587 - DNA, 21 bp, Homo sapiens
gtgcaatttgtttgtgcttct

SEQ ID NO: 3828588 - DNA, 14 bp, Homo sapiens
gtgcagtcactgga

SEQ ID NO: 3828589 - DNA, 15 bp, Homo sapiens
gtgcagtggagctgg

SEQ ID NO: 3828590 - DNA, 19 bp, Homo sapiens
gtgcataaaaactggttct

SEQ ID NO: 3828591 - DNA, 23 bp, Homo sapiens
gggcactaagggtggagagttgg

SEQ ID NO: 3828592 - DNA, 14 bp, Homo sapiens
gggcagaaaggctg

SEQ ID NO: 3828593 - DNA, 15 bp, Homo sapiens
gggcagaaaggctgc

SEQ ID NO: 3828594 - DNA, 12 bp, Homo sapiens
gggcagaggcaa

SEQ ID NO: 3828595 - DNA, 13 bp, Homo sapiens
gggcagcctccag

SEQ ID NO: 3828596 - DNA, 19 bp, Homo sapiens
gggcagtcctgagtgggtg

SEQ ID NO: 3828597 - DNA, 23 bp, Homo sapiens
gggcccctgggcttggcctgctg

SEQ ID NO: 3828598 - DNA, 21 bp, Homo sapiens
gggccctctggggctcagccc

SEQ ID NO: 3828599 - DNA, 15 bp, Homo sapiens
gggcccttcctggct

SEQ ID NO: 3828600 - DNA, 16 bp, Homo sapiens
gggcccttcctggcta

SEQ ID NO: 3828601 - DNA, 24 bp, Homo sapiens
gggcccttcctggctaggactgtg

SEQ ID NO: 3828602 - DNA, 18 bp, Homo sapiens
gggccgattgggagaaag

SEQ ID NO: 3828603 - DNA, 13 bp, Homo sapiens
gggccgcaggcgg

SEQ ID NO: 3828604 - DNA, 23 bp, Homo sapiens
gggcctgaggtctggctgcttgc

SEQ ID NO: 3828605 - DNA, 16 bp, Homo sapiens
gggcgcagctgaagcc

SEQ ID NO: 3828606 - DNA, 22 bp, Homo sapiens
gggcgcagctgaagcctggacg

SEQ ID NO: 3828607 - DNA, 13 bp, Homo sapiens
gggcgcccagccc

SEQ ID NO: 3828608 - DNA, 15 bp, Homo sapiens
gggcgcccagcccag

SEQ ID NO: 3828609 - DNA, 22 bp, Homo sapiens
gggcgcccagcccaggcctggt

SEQ ID NO: 3828610 - DNA, 23 bp, Homo sapiens
gggctaggggaggggggagccag

SEQ ID NO: 3828611 - DNA, 13 bp, Homo sapiens
gggctccccacgc

SEQ ID NO: 3828612 - DNA, 16 bp, Homo sapiens
gggctccgctgtgccc

SEQ ID NO: 3828613 - DNA, 13 bp, Homo sapiens
gggctctggagag

SEQ ID NO: 3828614 - DNA, 17 bp, Homo sapiens
gggctgaagccacacag

SEQ ID NO: 3828615 - DNA, 23 bp, Homo sapiens
gggctgaagccacacagcccaga

SEQ ID NO: 3828616 - DNA, 22 bp, Homo sapiens
gggctgacatcaagtgtaatta

SEQ ID NO: 3828617 - DNA, 12 bp, Homo sapiens
gggctggcttca

SEQ ID NO: 3828618 - DNA, 17 bp, Homo sapiens
gggctggcttcaggagg

SEQ ID NO: 3828619 - DNA, 21 bp, Homo sapiens
gggctgggcccttcctggcta

SEQ ID NO: 3828620 - DNA, 19 bp, Homo sapiens
gggcttcctctagaagcca

SEQ ID NO: 3828621 - DNA, 13 bp, Homo sapiens
gggcttggcctgc

SEQ ID NO: 3828622 - DNA, 14 bp, Homo sapiens
ggggagagcctgct

SEQ ID NO: 3828623 - DNA, 19 bp, Homo sapiens
ggggatgcaaataaagcct

SEQ ID NO: 3828624 - DNA, 16 bp, Homo sapiens
ggggcagccagccctg

SEQ ID NO: 3828625 - DNA, 17 bp, Homo sapiens
ggggcagccagccctgg

SEQ ID NO: 3828626 - DNA, 12 bp, Homo sapiens
ggggcagcctcc

SEQ ID NO: 3828627 - DNA, 14 bp, Homo sapiens
ggggcagcctccag

SEQ ID NO: 3828628 - DNA, 16 bp, Homo sapiens
ggggcccccagcaccc

SEQ ID NO: 3828629 - DNA, 14 bp, Homo sapiens
ggggcctggactgg

SEQ ID NO: 3828630 - DNA, 15 bp, Homo sapiens
ggggctacaagaggg

SEQ ID NO: 3828631 - DNA, 18 bp, Homo sapiens
ggggctcagccctgagct

SEQ ID NO: 3828632 - DNA, 17 bp, Homo sapiens
ggggctctggagagaaa

SEQ ID NO: 3828633 - DNA, 13 bp, Homo sapiens
ggggctgaagcca

SEQ ID NO: 3828634 - DNA, 18 bp, Homo sapiens
ggggctgaagccacacag

SEQ ID NO: 3828635 - DNA, 23 bp, Homo sapiens
ggggctgaagccacacagcccag

SEQ ID NO: 3828636 - DNA, 16 bp, Homo sapiens
gggggactagcccctg

SEQ ID NO: 3828637 - DNA, 17 bp, Homo sapiens
gggggagccagaggcca

SEQ ID NO: 3828638 - DNA, 20 bp, Homo sapiens
gggggccagcacagctgagg

SEQ ID NO: 3828639 - DNA, 23 bp, Homo sapiens
gggggtcacccatggcctcagat

SEQ ID NO: 3828640 - DNA, 18 bp, Homo sapiens
ggggtcacccatggcctc

SEQ ID NO: 3828641 - DNA, 17 bp, Homo sapiens
ggggtcagcaggcccag

SEQ ID NO: 3828642 - DNA, 21 bp, Homo sapiens
ggggtcccaggacctgagcct

SEQ ID NO: 3828643 - DNA, 15 bp, Homo sapiens
gggtaaatcagggac

SEQ ID NO: 3828644 - DNA, 20 bp, Homo sapiens
gggtcacccatggcctcaga

SEQ ID NO: 3828645 - DNA, 14 bp, Homo sapiens
gggtcagcaggccc

SEQ ID NO: 3828646 - DNA, 16 bp, Homo sapiens
gggtcagcaggcccag

SEQ ID NO: 3828647 - DNA, 15 bp, Homo sapiens
gggtcccagctactc

SEQ ID NO: 3828648 - DNA, 18 bp, Homo sapiens
gggtcccaggacctgagc

SEQ ID NO: 3828649 - DNA, 21 bp, Homo sapiens
gggtgctattctgtgaaacta

SEQ ID NO: 3828650 - DNA, 15 bp, Homo sapiens
gggtgctgggaggag

SEQ ID NO: 3828651 - DNA, 21 bp, Homo sapiens
gggtggcagagacagtgggca

SEQ ID NO: 3828652 - DNA, 20 bp, Homo sapiens
ggtacaaccggatgccagcc

SEQ ID NO: 3828653 - DNA, 15 bp, Homo sapiens
ggtagaaaatgtttt

SEQ ID NO: 3828654 - DNA, 23 bp, Homo sapiens
ggtattatactgtagatttcagt

SEQ ID NO: 3828655 - DNA, 18 bp, Homo sapiens
ggtattatgcttcttgga

SEQ ID NO: 3828656 - DNA, 17 bp, Homo sapiens
ggtattgtaatattaaa

SEQ ID NO: 3828657 - DNA, 14 bp, Homo sapiens
ggtcacccatggcc

SEQ ID NO: 3828658 - DNA, 15 bp, Homo sapiens
ggtcacccatggcct

SEQ ID NO: 3828659 - DNA, 15 bp, Homo sapiens
ggtcactggaaaggg

SEQ ID NO: 3828660 - DNA, 12 bp, Homo sapiens
ggtcagcaggcc

SEQ ID NO: 3828661 - DNA, 17 bp, Homo sapiens
ggtcagcaggcccagga

SEQ ID NO: 3828662 - DNA, 17 bp, Homo sapiens
ggtcaggagatcgagac

SEQ ID NO: 3828663 - DNA, 21 bp, Homo sapiens
ggtccacagggctcctgaagg

SEQ ID NO: 3828664 - DNA, 21 bp, Homo sapiens
ggtcccaggacctgagcctgg

SEQ ID NO: 3828665 - DNA, 20 bp, Homo sapiens
ggtcctccggggctcagccc

SEQ ID NO: 3828666 - DNA, 14 bp, Homo sapiens
ggtctatggctcat

SEQ ID NO: 3828667 - DNA, 18 bp, Homo sapiens
ggtctcatctcctttgct

SEQ ID NO: 3828668 - DNA, 20 bp, Homo sapiens
ggtctcttactttcctttcc

SEQ ID NO: 3828669 - DNA, 22 bp, Homo sapiens
ggtgaaaagggcagaggcaagg

SEQ ID NO: 3828670 - DNA, 23 bp, Homo sapiens
ggtgacccctgctttgccccact

SEQ ID NO: 3828671 - DNA, 22 bp, Homo sapiens
ggtgagatgctggagaagagag

SEQ ID NO: 3828672 - DNA, 20 bp, Homo sapiens
ggtgaggaatttgaagctca

SEQ ID NO: 3828673 - DNA, 22 bp, Homo sapiens
ggtgatccgcccgcctctgcct

SEQ ID NO: 3828674 - DNA, 13 bp, Homo sapiens
ggtgccagcaaag

SEQ ID NO: 3828675 - DNA, 16 bp, Homo sapiens
ggtgccagcaaagccc

SEQ ID NO: 3828676 - DNA, 14 bp, Homo sapiens
ggtgcctgggagga

SEQ ID NO: 3828677 - DNA, 22 bp, Homo sapiens
ggtgctggaggtgggagcagga

SEQ ID NO: 3828678 - DNA, 18 bp, Homo sapiens
ggtggacttagaaagcag

SEQ ID NO: 3828679 - DNA, 19 bp, Homo sapiens
ggtggacttagaaagcagg

SEQ ID NO: 3828680 - DNA, 21 bp, Homo sapiens
ggtggacttagaaagcagggg

SEQ ID NO: 3828681 - DNA, 15 bp, Homo sapiens
ggtggatataaatat

SEQ ID NO: 3828682 - DNA, 21 bp, Homo sapiens
ggtggcagagacagtgggcac

SEQ ID NO: 3828683 - DNA, 23 bp, Homo sapiens
ggtggccctgtccctcccacctc

SEQ ID NO: 3828684 - DNA, 13 bp, Homo sapiens
ggtgggctctgtg

SEQ ID NO: 3828685 - DNA, 15 bp, Homo sapiens
ggtgtagattccctt

SEQ ID NO: 3828686 - DNA, 17 bp, Homo sapiens
ggtgttgcacagactgg

SEQ ID NO: 3828687 - DNA, 11 bp, Homo sapiens
ggttccctccc

SEQ ID NO: 3828688 - DNA, 20 bp, Homo sapiens
ggttccctccccagctcctc

SEQ ID NO: 3828689 - DNA, 18 bp, Homo sapiens
ggttgaggggctccccag

SEQ ID NO: 3828690 - DNA, 13 bp, Homo sapiens
ggttgccacccca

SEQ ID NO: 3828691 - DNA, 13 bp, Homo sapiens
ggttgtgtcactg

SEQ ID NO: 3828692 - DNA, 14 bp, Homo sapiens
ggttgtgtcactga

SEQ ID NO: 3828693 - DNA, 12 bp, Homo sapiens
ggtttgaaagcc

SEQ ID NO: 3828694 - DNA, 16 bp, Homo sapiens
ggtttggaaaactaac

SEQ ID NO: 3828695 - DNA, 16 bp, Homo sapiens
ggttttatactgaagg

SEQ ID NO: 3828696 - DNA, 21 bp, Homo sapiens
ggttttggcaaacgctaaaga

SEQ ID NO: 3828697 - DNA, 18 bp, Homo sapiens
ggtttttgtcttgcattt

SEQ ID NO: 3828698 - DNA, 21 bp, Homo sapiens
gtaaaaagtagattaaaatat

SEQ ID NO: 3828699 - DNA, 21 bp, Homo sapiens
gtaaaggactatttataacta

SEQ ID NO: 3828700 - DNA, 14 bp, Homo sapiens
gctaggggagcagg

SEQ ID NO: 3828701 - DNA, 14 bp, Homo sapiens
ggcacctctgtgct

SEQ ID NO: 3828702 - DNA, 14 bp, Homo sapiens
ggcactaagggtgg

SEQ ID NO: 3828703 - DNA, 18 bp, Homo sapiens
ggcactaagggtggagag

SEQ ID NO: 3828704 - DNA, 20 bp, Homo sapiens
ggcactagcctttggctctg

SEQ ID NO: 3828705 - DNA, 13 bp, Homo sapiens
ggcagaaaggctg

SEQ ID NO: 3828706 - DNA, 16 bp, Homo sapiens
ggcagaaaggctgcaa

SEQ ID NO: 3828707 - DNA, 17 bp, Homo sapiens
ggcagaagaagctggga

SEQ ID NO: 3828708 - DNA, 10 bp, Homo sapiens
ggcagagagc

SEQ ID NO: 3828709 - DNA, 22 bp, Homo sapiens
ggcagatgatttgggcagagcg

SEQ ID NO: 3828710 - DNA, 17 bp, Homo sapiens
ggcagccagatccccag

SEQ ID NO: 3828711 - DNA, 22 bp, Homo sapiens
ggcagccagatccccagggcag

SEQ ID NO: 3828712 - DNA, 18 bp, Homo sapiens
gcccctagcccaggagag

SEQ ID NO: 3828713 - DNA, 19 bp, Homo sapiens
gcccctagcccaggagaga

SEQ ID NO: 3828714 - DNA, 13 bp, Homo sapiens
gcccctgccctga

SEQ ID NO: 3828715 - DNA, 14 bp, Homo sapiens
gcccctgccctgag

SEQ ID NO: 3828716 - DNA, 23 bp, Homo sapiens
gccccttggatcaagcagaaaac

SEQ ID NO: 3828717 - DNA, 18 bp, Homo sapiens
gcccgaggtcgctgcagc

SEQ ID NO: 3828718 - DNA, 16 bp, Homo sapiens
gcccgccctgggctgg

SEQ ID NO: 3828719 - DNA, 13 bp, Homo sapiens
gcccgggtcccac

SEQ ID NO: 3828720 - DNA, 20 bp, Homo sapiens
gcccggtgttcagtggtttc

SEQ ID NO: 3828721 - DNA, 15 bp, Homo sapiens
gagagccaaacagag

SEQ ID NO: 3828722 - DNA, 21 bp, Homo sapiens
gagagccaaacagagcccagg

SEQ ID NO: 3828723 - DNA, 21 bp, Homo sapiens
gagagcggtctcaggctggtg

SEQ ID NO: 3828724 - DNA, 15 bp, Homo sapiens
gagaggacagcttga

SEQ ID NO: 3828725 - DNA, 18 bp, Homo sapiens
gagaggacagcttgagcc

SEQ ID NO: 3828726 - DNA, 12 bp, Homo sapiens
gagaggacctcc

SEQ ID NO: 3828727 - DNA, 17 bp, Homo sapiens
gagaggacctccatgcc

SEQ ID NO: 3828728 - DNA, 11 bp, Homo sapiens
gagaggagaga

SEQ ID NO: 3828729 - DNA, 18 bp, Homo sapiens
gagaggagagaggcagag

SEQ ID NO: 3828730 - DNA, 21 bp, Homo sapiens
gagaggcaataaataaatgtt

SEQ ID NO: 3828731 - DNA, 21 bp, Homo sapiens
gagaggcaggcatagaggctt

SEQ ID NO: 3828732 - DNA, 15 bp, Homo sapiens
gagagggcgcccagc

SEQ ID NO: 3828733 - DNA, 22 bp, Homo sapiens
gagagggcgcccagcccaggcc

SEQ ID NO: 3828734 - DNA, 21 bp, Homo sapiens
gagagtccttagcctgggcct

SEQ ID NO: 3828735 - DNA, 20 bp, Homo sapiens
gagagtgggtaaatcaggga

SEQ ID NO: 3828736 - DNA, 16 bp, Homo sapiens
gagatgagagtgggta

SEQ ID NO: 3828737 - DNA, 20 bp, Homo sapiens
gagatgggaatgaggtggga

SEQ ID NO: 3828738 - DNA, 13 bp, Homo sapiens
gagattgagaagg

SEQ ID NO: 3828739 - DNA, 20 bp, Homo sapiens
gagattgagaaggagagaaa

SEQ ID NO: 3828740 - DNA, 17 bp, Homo sapiens
gagcaagacgccctctc

SEQ ID NO: 3828741 - DNA, 13 bp, Homo sapiens
gagcaagtctgca

SEQ ID NO: 3828742 - DNA, 13 bp, Homo sapiens
gagcaatctggaa

SEQ ID NO: 3828743 - DNA, 14 bp, Homo sapiens
gagcaatctggaaa

SEQ ID NO: 3828744 - DNA, 15 bp, Homo sapiens
gagcaatctggaaaa

SEQ ID NO: 3828745 - DNA, 16 bp, Homo sapiens
gagcagaataaatgtt

SEQ ID NO: 3828746 - DNA, 20 bp, Homo sapiens
gagcaggagattgagaagga

SEQ ID NO: 3828747 - DNA, 22 bp, Homo sapiens
gagcaggagattgagaaggaga

SEQ ID NO: 3828748 - DNA, 18 bp, Homo sapiens
gagcaggctttgtgagag

SEQ ID NO: 3828749 - DNA, 16 bp, Homo sapiens
gagcagggtgttggga

SEQ ID NO: 3828750 - DNA, 15 bp, Homo sapiens
gagccaccactcctg

SEQ ID NO: 3828751 - DNA, 20 bp, Homo sapiens
gagccaccactcctgcctgc

SEQ ID NO: 3828752 - DNA, 15 bp, Homo sapiens
gagccagaggccagg

SEQ ID NO: 3828753 - DNA, 20 bp, Homo sapiens
gatggctccttgggatgaag

SEQ ID NO: 3828754 - DNA, 23 bp, Homo sapiens
gatgggaatgaggtgggaggtgg

SEQ ID NO: 3828755 - DNA, 15 bp, Homo sapiens
gatgggaggctcctg

SEQ ID NO: 3828756 - DNA, 18 bp, Homo sapiens
gatgggaggctcctggtg

SEQ ID NO: 3828757 - DNA, 16 bp, Homo sapiens
gatggggtcagcaggc

SEQ ID NO: 3828758 - DNA, 21 bp, Homo sapiens
gatggggtcagcaggcccagg

SEQ ID NO: 3828759 - DNA, 17 bp, Homo sapiens
gatggtggggcccccag

SEQ ID NO: 3828760 - DNA, 22 bp, Homo sapiens
gatggtggggcccccagcaccc

SEQ ID NO: 3828761 - DNA, 18 bp, Homo sapiens
gatgtagccatgacctta

SEQ ID NO: 3828762 - DNA, 14 bp, Homo sapiens
gatgtatgtgtgac

SEQ ID NO: 3828763 - DNA, 16 bp, Homo sapiens
gattaaaatatttgcc

SEQ ID NO: 3828764 - DNA, 23 bp, Homo sapiens
gattaaatatatctttgtaaatt

SEQ ID NO: 3828765 - DNA, 23 bp, Homo sapiens
gattaacggtgctaaccccgtct

SEQ ID NO: 3828766 - DNA, 16 bp, Homo sapiens
gattaaggtcctgctt

SEQ ID NO: 3828767 - DNA, 17 bp, Homo sapiens
gattaggtcacattaca

SEQ ID NO: 3828768 - DNA, 14 bp, Homo sapiens
gattataataaatt

SEQ ID NO: 3828769 - DNA, 20 bp, Homo sapiens
gattcaaatgttacaaaaaa

SEQ ID NO: 3828770 - DNA, 19 bp, Homo sapiens
gattcacatgctggctcct

SEQ ID NO: 3828771 - DNA, 17 bp, Homo sapiens
gattccactacacctgg

SEQ ID NO: 3828772 - DNA, 20 bp, Homo sapiens
gattccactacacctggctg

SEQ ID NO: 3828773 - DNA, 21 bp, Homo sapiens
gattccactacacctggctga

SEQ ID NO: 3828774 - DNA, 19 bp, Homo sapiens
gattcccaggagttctgct

SEQ ID NO: 3828775 - DNA, 22 bp, Homo sapiens
gattcccgcatggtttttataa

SEQ ID NO: 3828776 - DNA, 18 bp, Homo sapiens
gattcctaaaactctgcc

SEQ ID NO: 3828777 - DNA, 15 bp, Homo sapiens
gattcctaaggccca

SEQ ID NO: 3828778 - DNA, 16 bp, Homo sapiens
gattgagaaggagaga

SEQ ID NO: 3828779 - DNA, 20 bp, Homo sapiens
gattgtaaactaaagtgtgc

SEQ ID NO: 3828780 - DNA, 14 bp, Homo sapiens
gattgttcataata

SEQ ID NO: 3828781 - DNA, 16 bp, Homo sapiens
gatttacagtttcaaa

SEQ ID NO: 3828782 - DNA, 16 bp, Homo sapiens
gatttagccatgtgaa

SEQ ID NO: 3828783 - DNA, 20 bp, Homo sapiens
gattttatgtgcttgaagat

SEQ ID NO: 3828784 - DNA, 13 bp, Homo sapiens
gcaaacctctcct

SEQ ID NO: 3828785 - DNA, 14 bp, Homo sapiens
gcaaacctctcctt

SEQ ID NO: 3828786 - DNA, 16 bp, Homo sapiens
gcaaacctctccttcc

SEQ ID NO: 3828787 - DNA, 14 bp, Homo sapiens
gcaaacgctaaaga

SEQ ID NO: 3828788 - DNA, 20 bp, Homo sapiens
gcaaactttattttgtgttt

SEQ ID NO: 3828789 - DNA, 20 bp, Homo sapiens
gcaaagccccatgctggagc

SEQ ID NO: 3828790 - DNA, 23 bp, Homo sapiens
gcaaagccccatgctggagcctg

SEQ ID NO: 3828791 - DNA, 17 bp, Homo sapiens
gcaaataaagcctgctc

SEQ ID NO: 3828792 - DNA, 20 bp, Homo sapiens
gcaaatgtaaagtctagaaa

SEQ ID NO: 3828793 - DNA, 22 bp, Homo sapiens
gcaaatgtaaagtctagaaaat

SEQ ID NO: 3828794 - DNA, 23 bp, Homo sapiens
gcaaatgtgaatcattttacctt

SEQ ID NO: 3828795 - DNA, 23 bp, Homo sapiens
gcaacctctgccccccaagttca

SEQ ID NO: 3828796 - DNA, 23 bp, Homo sapiens
gcaagagggggtggaggggtgtg

SEQ ID NO: 3828797 - DNA, 11 bp, Homo sapiens
gcaagcctgcg

SEQ ID NO: 3828798 - DNA, 17 bp, Homo sapiens
gcaagctcttctcctca

SEQ ID NO: 3828799 - DNA, 23 bp, Homo sapiens
gcaaggatggtggggcccccagc

SEQ ID NO: 3828800 - DNA, 20 bp, Homo sapiens
gcaaggggcagccagccctg

SEQ ID NO: 3828801 - DNA, 19 bp, Homo sapiens
gcaaggtgtttaagtaatt

SEQ ID NO: 3828802 - DNA, 12 bp, Homo sapiens
gcaagtctgcag

SEQ ID NO: 3828803 - DNA, 15 bp, Homo sapiens
gcaagtggttaagaa

SEQ ID NO: 3828804 - DNA, 11 bp, Homo sapiens
gcaattttcct

SEQ ID NO: 3828805 - DNA, 13 bp, Homo sapiens
gcaattttccttg

SEQ ID NO: 3828806 - DNA, 17 bp, Homo sapiens
gcaattttccttgaagc

SEQ ID NO: 3828807 - DNA, 20 bp, Homo sapiens
gcaattttccttgaagccga

SEQ ID NO: 3828808 - DNA, 13 bp, Homo sapiens
gcacaaaatgtga

SEQ ID NO: 3828809 - DNA, 22 bp, Homo sapiens
gcacaaaattcgacctgattta

SEQ ID NO: 3828810 - DNA, 12 bp, Homo sapiens
gcacacactgtg

SEQ ID NO: 3828811 - DNA, 17 bp, Homo sapiens
gcacagacctctcccac

SEQ ID NO: 3828812 - DNA, 21 bp, Homo sapiens
gcacagggccctctgaggctc

SEQ ID NO: 3828813 - DNA, 14 bp, Homo sapiens
gcacagttctattt

SEQ ID NO: 3828814 - DNA, 20 bp, Homo sapiens
gcaccaaaccctgtcctccc

SEQ ID NO: 3828815 - DNA, 23 bp, Homo sapiens
gcaccaaaccctgtcctcccacc

SEQ ID NO: 3828816 - DNA, 18 bp, Homo sapiens
gcacccaccgtggaggag

SEQ ID NO: 3828817 - DNA, 20 bp, Homo sapiens
gcacccaccgtggaggagga

SEQ ID NO: 3828818 - DNA, 22 bp, Homo sapiens
gcaccccaggcagctcctgttt

SEQ ID NO: 3828819 - DNA, 20 bp, Homo sapiens
gcaccccttctctcctcccc

SEQ ID NO: 3828820 - DNA, 22 bp, Homo sapiens
gcaccgttgggaccaatgcctt

SEQ ID NO: 3828821 - DNA, 22 bp, Homo sapiens
gcacctccccagacagggctcc

SEQ ID NO: 3828822 - DNA, 15 bp, Homo sapiens
gcacctctccagctc

SEQ ID NO: 3828823 - DNA, 19 bp, Homo sapiens
gcacctctccagctcctcc

SEQ ID NO: 3828824 - DNA, 16 bp, Homo sapiens
gcacgcgacttctcag

SEQ ID NO: 3828825 - DNA, 18 bp, Homo sapiens
gcacgcgacttctcagga

SEQ ID NO: 3828826 - DNA, 13 bp, Homo sapiens
gcacgtcatggga

SEQ ID NO: 3828827 - DNA, 16 bp, Homo sapiens
gcactaagggtggaga

SEQ ID NO: 3828828 - DNA, 19 bp, Homo sapiens
gcactagcctccctctcct

SEQ ID NO: 3828829 - DNA, 15 bp, Homo sapiens
gcactagcctttggc

SEQ ID NO: 3828830 - DNA, 17 bp, Homo sapiens
gcactgtatcatttcat

SEQ ID NO: 3828831 - DNA, 13 bp, Homo sapiens
gcagaaaggctgc

SEQ ID NO: 3828832 - DNA, 18 bp, Homo sapiens
gcagaacagacactttaa

SEQ ID NO: 3828833 - DNA, 20 bp, Homo sapiens
gcagaagaagctgggaggga

SEQ ID NO: 3828834 - DNA, 22 bp, Homo sapiens
gcagaagaagctgggagggagg

SEQ ID NO: 3828835 - DNA, 17 bp, Homo sapiens
gcagaataaagcaattt

SEQ ID NO: 3828836 - DNA, 15 bp, Homo sapiens
gcagaataaatgttt

SEQ ID NO: 3828837 - DNA, 18 bp, Homo sapiens
gcagaataaatgttttac

SEQ ID NO: 3828838 - DNA, 13 bp, Homo sapiens
gcagacctcccca

SEQ ID NO: 3828839 - DNA, 16 bp, Homo sapiens
gcagacctccccagcc

SEQ ID NO: 3828840 - DNA, 19 bp, Homo sapiens
gcagagagcggtctcaggc

SEQ ID NO: 3828841 - DNA, 16 bp, Homo sapiens
gcagagcaagtctgca

SEQ ID NO: 3828842 - DNA, 18 bp, Homo sapiens
gcagagcaagtctgcagg

SEQ ID NO: 3828843 - DNA, 21 bp, Homo sapiens
gcagataaggccgagcccaca

SEQ ID NO: 3828844 - DNA, 16 bp, Homo sapiens
gcagatgaaaagctac

SEQ ID NO: 3828845 - DNA, 15 bp, Homo sapiens
gcagatggaaagaaa

SEQ ID NO: 3828846 - DNA, 12 bp, Homo sapiens
gcagcataaagg

SEQ ID NO: 3828847 - DNA, 15 bp, Homo sapiens
gcagcataaaggcct

SEQ ID NO: 3828848 - DNA, 13 bp, Homo sapiens
gcagccacacagt

SEQ ID NO: 3828849 - DNA, 22 bp, Homo sapiens
gcagccagatccccagggcagc

SEQ ID NO: 3828850 - DNA, 16 bp, Homo sapiens
gcagccatcccaaggc

SEQ ID NO: 3828851 - DNA, 13 bp, Homo sapiens
gcagcctccagtc

SEQ ID NO: 3828852 - DNA, 16 bp, Homo sapiens
gcagcctccagtctgc

SEQ ID NO: 3828853 - DNA, 18 bp, Homo sapiens
gcagcctgggtggctatg

SEQ ID NO: 3828854 - DNA, 14 bp, Homo sapiens
gcagctgaagcctg

SEQ ID NO: 3828855 - DNA, 17 bp, Homo sapiens
gcagctgaagcctggac

SEQ ID NO: 3828856 - DNA, 22 bp, Homo sapiens
gcaggagattgagaaggagaga

SEQ ID NO: 3828857 - DNA, 23 bp, Homo sapiens
gcaggagattgagaaggagagaa

SEQ ID NO: 3828858 - DNA, 19 bp, Homo sapiens
gcaggatcggcttcctcag

SEQ ID NO: 3828859 - DNA, 21 bp, Homo sapiens
gcaggattgattatgcagaat

SEQ ID NO: 3828860 - DNA, 18 bp, Homo sapiens
gcaggctcactgccaggc

SEQ ID NO: 3828861 - DNA, 17 bp, Homo sapiens
gcaggctttgtgagaga

SEQ ID NO: 3828862 - DNA, 16 bp, Homo sapiens
gcaggggctctggaga

SEQ ID NO: 3828863 - DNA, 18 bp, Homo sapiens
gcaggggctctggagaga

SEQ ID NO: 3828864 - DNA, 18 bp, Homo sapiens
ctttactgtgtatctcaa

SEQ ID NO: 3828865 - DNA, 16 bp, Homo sapiens
ctttagaccctgggtg

SEQ ID NO: 3828866 - DNA, 23 bp, Homo sapiens
ctttagaccctgggtgggctctg

SEQ ID NO: 3828867 - DNA, 23 bp, Homo sapiens
ctttagatgggaagcctgtgtat

SEQ ID NO: 3828868 - DNA, 22 bp, Homo sapiens
ctttataaaaaaaagttgttta

SEQ ID NO: 3828869 - DNA, 13 bp, Homo sapiens
ctttataaataaa

SEQ ID NO: 3828870 - DNA, 9 bp, Homo sapiens
ctttataac

SEQ ID NO: 3828871 - DNA, 19 bp, Homo sapiens
ctttatatggaacgcattt

SEQ ID NO: 3828872 - DNA, 21 bp, Homo sapiens
ctttcatcaatcattgtacag

SEQ ID NO: 3828873 - DNA, 21 bp, Homo sapiens
ctttcatttggggcatttgta

SEQ ID NO: 3828874 - DNA, 14 bp, Homo sapiens
ctttccccagccca

SEQ ID NO: 3828875 - DNA, 15 bp, Homo sapiens
ctttccccagcccag

SEQ ID NO: 3828876 - DNA, 19 bp, Homo sapiens
ctttcctgcctccttgaaa

SEQ ID NO: 3828877 - DNA, 12 bp, Homo sapiens
ctttccttcccc

SEQ ID NO: 3828878 - DNA, 14 bp, Homo sapiens
ctttccttcttgcc

SEQ ID NO: 3828879 - DNA, 14 bp, Homo sapiens
ctttctgcctctca

SEQ ID NO: 3828880 - DNA, 14 bp, Homo sapiens
ctttcttctctgct

SEQ ID NO: 3828881 - DNA, 13 bp, Homo sapiens
ctttctttttcct

SEQ ID NO: 3828882 - DNA, 17 bp, Homo sapiens
ctttgacaaaggtaaat

SEQ ID NO: 3828883 - DNA, 18 bp, Homo sapiens
ctttgccccactgggaga

SEQ ID NO: 3828884 - DNA, 12 bp, Homo sapiens
ctttgctcttgg

SEQ ID NO: 3828885 - DNA, 15 bp, Homo sapiens
ctttgctcttggaat

SEQ ID NO: 3828886 - DNA, 11 bp, Homo sapiens
ctttgctttgg

SEQ ID NO: 3828887 - DNA, 20 bp, Homo sapiens
ctttgctttgggtttgtggc

SEQ ID NO: 3828888 - DNA, 17 bp, Homo sapiens
ctttggaaacaacattt

SEQ ID NO: 3828889 - DNA, 15 bp, Homo sapiens
ctttgggcttttatt

SEQ ID NO: 3828890 - DNA, 20 bp, Homo sapiens
ctttggggatagtctggaaa

SEQ ID NO: 3828891 - DNA, 11 bp, Homo sapiens
ctttggttttg

SEQ ID NO: 3828892 - DNA, 11 bp, Homo sapiens
ctttggttttt

SEQ ID NO: 3828893 - DNA, 19 bp, Homo sapiens
ctttggtttttttcttctg

SEQ ID NO: 3828894 - DNA, 13 bp, Homo sapiens
ctttgtaaattat

SEQ ID NO: 3828895 - DNA, 22 bp, Homo sapiens
ctttgtaaattattttatgtca

SEQ ID NO: 3828896 - DNA, 17 bp, Homo sapiens
ctttgtagtttgcccag

SEQ ID NO: 3828897 - DNA, 20 bp, Homo sapiens
ctttgtatcagtcagtgctg

SEQ ID NO: 3828898 - DNA, 13 bp, Homo sapiens
ctttgtgagagag

SEQ ID NO: 3828899 - DNA, 14 bp, Homo sapiens
ctttgtgagagagg

SEQ ID NO: 3828900 - DNA, 21 bp, Homo sapiens
ctttgtgagagaggacctcca

SEQ ID NO: 3828901 - DNA, 24 bp, Homo sapiens
ctttgtgagagaggacctccatgc

SEQ ID NO: 3828902 - DNA, 16 bp, Homo sapiens
ctttgtgctgctgagt

SEQ ID NO: 3828903 - DNA, 14 bp, Homo sapiens
ctttgtgtctggcc

SEQ ID NO: 3828904 - DNA, 18 bp, Homo sapiens
ctttgtgtctggccagct

SEQ ID NO: 3828905 - DNA, 18 bp, Homo sapiens
ctttgttggctcagaaaa

SEQ ID NO: 3828906 - DNA, 20 bp, Homo sapiens
cttttagacacattagctct

SEQ ID NO: 3828907 - DNA, 19 bp, Homo sapiens
cttttatgtggtctctttg

SEQ ID NO: 3828908 - DNA, 19 bp, Homo sapiens
cttttattacggtgatcct

SEQ ID NO: 3828909 - DNA, 16 bp, Homo sapiens
cttttccacatggcag

SEQ ID NO: 3828910 - DNA, 15 bp, Homo sapiens
cttttccctgcttcc

SEQ ID NO: 3828911 - DNA, 18 bp, Homo sapiens
cttttccctgcttccagg

SEQ ID NO: 3828912 - DNA, 16 bp, Homo sapiens
aacaacatttaaggga

SEQ ID NO: 3828913 - DNA, 22 bp, Homo sapiens
aacaacatttaagggaatgtga

SEQ ID NO: 3828914 - DNA, 22 bp, Homo sapiens
aacaacttccgttgctgccatc

SEQ ID NO: 3828915 - DNA, 18 bp, Homo sapiens
aacaaggggttactttac

SEQ ID NO: 3828916 - DNA, 23 bp, Homo sapiens
aacaatgaagtgttttacaatga

SEQ ID NO: 3828917 - DNA, 22 bp, Homo sapiens
aacacagaaagcctatcaaaga

SEQ ID NO: 3828918 - DNA, 16 bp, Homo sapiens
aacagattataataaa

SEQ ID NO: 3828919 - DNA, 19 bp, Homo sapiens
aacagattataataaattg

SEQ ID NO: 3828920 - DNA, 10 bp, Homo sapiens
aacagctcct

SEQ ID NO: 3828921 - DNA, 15 bp, Homo sapiens
aacagctccttggga

SEQ ID NO: 3828922 - DNA, 23 bp, Homo sapiens
aacagctccttgggaggaagcag

SEQ ID NO: 3828923 - DNA, 22 bp, Homo sapiens
aacagtagccccatcacatttg

SEQ ID NO: 3828924 - DNA, 13 bp, Homo sapiens
aacagttgctttg

SEQ ID NO: 3828925 - DNA, 21 bp, Homo sapiens
aacagttgctttggattctct

SEQ ID NO: 3828926 - DNA, 14 bp, Homo sapiens
aacatgtgaatgaa

SEQ ID NO: 3828927 - DNA, 19 bp, Homo sapiens
aacattattttaaaatcaa

SEQ ID NO: 3828928 - DNA, 14 bp, Homo sapiens
aacattcctatcaa

SEQ ID NO: 3828929 - DNA, 15 bp, Homo sapiens
aacattcctatcaat

SEQ ID NO: 3828930 - DNA, 22 bp, Homo sapiens
aacatttgttctatagcttttc

SEQ ID NO: 3828931 - DNA, 21 bp, Homo sapiens
aaccactcggggcccccatct

SEQ ID NO: 3828932 - DNA, 13 bp, Homo sapiens
aaccagttggcta

SEQ ID NO: 3828933 - DNA, 23 bp, Homo sapiens
aaccagttggctaggggagcagg

SEQ ID NO: 3828934 - DNA, 18 bp, Homo sapiens
aacccaggaggtggaggt

SEQ ID NO: 3828935 - DNA, 19 bp, Homo sapiens
aacccaggaggtggaggtt

SEQ ID NO: 3828936 - DNA, 20 bp, Homo sapiens
aaccccgaggggcttgcagg

SEQ ID NO: 3828937 - DNA, 20 bp, Homo sapiens
aacctctgccccccaagttc

SEQ ID NO: 3828938 - DNA, 17 bp, Homo sapiens
aacctgtaagcccagca

SEQ ID NO: 3828939 - DNA, 14 bp, Homo sapiens
aacctgtaataaat

SEQ ID NO: 3828940 - DNA, 18 bp, Homo sapiens
aacctgtaataaatatga

SEQ ID NO: 3828941 - DNA, 18 bp, Homo sapiens
aaccttgtaaattcccct

SEQ ID NO: 3828942 - DNA, 23 bp, Homo sapiens
aaccttgtaaattccccttccca

SEQ ID NO: 3828943 - DNA, 23 bp, Homo sapiens
aacgctgattcctaaggcccagc

SEQ ID NO: 3828944 - DNA, 15 bp, Homo sapiens
aacgtataaaagcct

SEQ ID NO: 3828945 - DNA, 20 bp, Homo sapiens
aactaaagtgtgctttataa

SEQ ID NO: 3828946 - DNA, 19 bp, Homo sapiens
aactaatatttgtctgtgt

SEQ ID NO: 3828947 - DNA, 16 bp, Homo sapiens
aactatttaacttgag

SEQ ID NO: 3828948 - DNA, 24 bp, Homo sapiens
aactcaaagcaagctcttctcctc

SEQ ID NO: 3828949 - DNA, 14 bp, Homo sapiens
aactccacatctgc

SEQ ID NO: 3828950 - DNA, 16 bp, Homo sapiens
aactccacatctgcct

SEQ ID NO: 3828951 - DNA, 21 bp, Homo sapiens
aactccagctgagtcctgggg

SEQ ID NO: 3828952 - DNA, 13 bp, Homo sapiens
aactcctcccacc

SEQ ID NO: 3828953 - DNA, 14 bp, Homo sapiens
aactcgggagggaa

SEQ ID NO: 3828954 - DNA, 16 bp, Homo sapiens
aactcttgaatatgtg

SEQ ID NO: 3828955 - DNA, 20 bp, Homo sapiens
aactgaagcataaacatcac

SEQ ID NO: 3828956 - DNA, 22 bp, Homo sapiens
aactgacagggcccagttaaat

SEQ ID NO: 3828957 - DNA, 13 bp, Homo sapiens
aactgagggctga

SEQ ID NO: 3828958 - DNA, 19 bp, Homo sapiens
aactgatgttactagcctc

SEQ ID NO: 3828959 - DNA, 21 bp, Homo sapiens
aactgatgttactagcctctc

SEQ ID NO: 3828960 - DNA, 16 bp, Homo sapiens
aactgtaaatcataat

SEQ ID NO: 3828961 - DNA, 19 bp, Homo sapiens
aactgtgtttccatccttt

SEQ ID NO: 3828962 - DNA, 20 bp, Homo sapiens
aactgtgtttccatcctttg

SEQ ID NO: 3828963 - DNA, 22 bp, Homo sapiens
aacttcagttttactgcatttt

SEQ ID NO: 3828964 - DNA, 15 bp, Homo sapiens
aacttgtattatgtg

SEQ ID NO: 3828965 - DNA, 16 bp, Homo sapiens
aacttgtattatgtgt

SEQ ID NO: 3828966 - DNA, 14 bp, Homo sapiens
aacttgtctctgta

SEQ ID NO: 3828967 - DNA, 14 bp, Homo sapiens
aactttccactgac

SEQ ID NO: 3828968 - DNA, 17 bp, Homo sapiens
aactttttaataaagta

SEQ ID NO: 3828969 - DNA, 19 bp, Homo sapiens
aagaaaacccaaagctcta

SEQ ID NO: 3828970 - DNA, 21 bp, Homo sapiens
aagaaaacccaaagctctaag

SEQ ID NO: 3828971 - DNA, 20 bp, Homo sapiens
aagaaaactacatgtaaaat

SEQ ID NO: 3828972 - DNA, 12 bp, Homo sapiens
aagaagctggga

SEQ ID NO: 3828973 - DNA, 15 bp, Homo sapiens
aagaagctgggaggg

SEQ ID NO: 3828974 - DNA, 18 bp, Homo sapiens
aagaagctgggagggagg

SEQ ID NO: 3828975 - DNA, 14 bp, Homo sapiens
aagaatgtatatca

SEQ ID NO: 3828976 - DNA, 20 bp, Homo sapiens
aagaatttaatgtacagtaa

SEQ ID NO: 3828977 - DNA, 12 bp, Homo sapiens
aagacagagcag

SEQ ID NO: 3828978 - DNA, 16 bp, Homo sapiens
aagacagagcaggctt

SEQ ID NO: 3828979 - DNA, 21 bp, Homo sapiens
aagacagagcaggctttgtga

SEQ ID NO: 3828980 - DNA, 23 bp, Homo sapiens
aagacagagcaggctttgtgaga

SEQ ID NO: 3828981 - DNA, 18 bp, Homo sapiens
aagaccttgtgtgtatgt

SEQ ID NO: 3828982 - DNA, 13 bp, Homo sapiens
aagacgccctctc

SEQ ID NO: 3828983 - DNA, 15 bp, Homo sapiens
aagacttttatgata

SEQ ID NO: 3828984 - DNA, 19 bp, Homo sapiens
aagagaggagaggagagag

SEQ ID NO: 3828985 - DNA, 13 bp, Homo sapiens
aagagcccttgcc

SEQ ID NO: 3828986 - DNA, 18 bp, Homo sapiens
aagagcccttgcctcccc

SEQ ID NO: 3828987 - DNA, 22 bp, Homo sapiens
aagagggaatccccgaaggtgc

SEQ ID NO: 3828988 - DNA, 23 bp, Homo sapiens
aagaggtgcctgggaggagtggc

SEQ ID NO: 3828989 - DNA, 16 bp, Homo sapiens
aagagtttacaagaaa

SEQ ID NO: 3828990 - DNA, 12 bp, Homo sapiens
aagatctgctcc

SEQ ID NO: 3828991 - DNA, 13 bp, Homo sapiens
aagatctgctcct

SEQ ID NO: 3828992 - DNA, 16 bp, Homo sapiens
aagatctgctcctcgc

SEQ ID NO: 3828993 - DNA, 21 bp, Homo sapiens
aagatgaatccaaatgtgaaa

SEQ ID NO: 3828994 - DNA, 20 bp, Homo sapiens
aagatgcatgttactgccaa

SEQ ID NO: 3828995 - DNA, 12 bp, Homo sapiens
aagattaaatat

SEQ ID NO: 3828996 - DNA, 20 bp, Homo sapiens
aagattaaatatatctttgt

SEQ ID NO: 3828997 - DNA, 13 bp, Homo sapiens
aagattgtaaact

SEQ ID NO: 3828998 - DNA, 22 bp, Homo sapiens
aagattgtaaactaaagtgtgc

SEQ ID NO: 3828999 - DNA, 14 bp, Homo sapiens
aagatttggttttt

SEQ ID NO: 3829000 - DNA, 18 bp, Homo sapiens
aagatttggtttttgtct

SEQ ID NO: 3829001 - DNA, 22 bp, Homo sapiens
aagattttatgtgcttgaagat

SEQ ID NO: 3829002 - DNA, 15 bp, Homo sapiens
aagattttgtgaaat

SEQ ID NO: 3829003 - DNA, 16 bp, Homo sapiens
aagattttgtgaaatt

SEQ ID NO: 3829004 - DNA, 20 bp, Homo sapiens
aagattttgtgaaatttcat

SEQ ID NO: 3829005 - DNA, 20 bp, Homo sapiens
aagcaaatgtgaatcatttt

SEQ ID NO: 3829006 - DNA, 15 bp, Homo sapiens
aagcaagctcttctc

SEQ ID NO: 3829007 - DNA, 15 bp, Homo sapiens
aagcaaggtgtttaa

SEQ ID NO: 3829008 - DNA, 16 bp, Homo sapiens
aagcagcccttggcca

SEQ ID NO: 3829009 - DNA, 22 bp, Homo sapiens
aagcaggggctacaagagggaa

SEQ ID NO: 3829010 - DNA, 20 bp, Homo sapiens
aagcataaacatcacatggc

SEQ ID NO: 3829011 - DNA, 19 bp, Homo sapiens
aagcatatgtgttggcttg

SEQ ID NO: 3829012 - DNA, 13 bp, Homo sapiens
aagcatgttgtga

SEQ ID NO: 3829013 - DNA, 23 bp, Homo sapiens
aagccaagggaaaggggtgcttt

SEQ ID NO: 3829014 - DNA, 20 bp, Homo sapiens
aagccacacagcccagaagg

SEQ ID NO: 3829015 - DNA, 15 bp, Homo sapiens
aagccatcacacctg

SEQ ID NO: 3829016 - DNA, 23 bp, Homo sapiens
aagccccatgctggagcctgtgt

SEQ ID NO: 3829017 - DNA, 16 bp, Homo sapiens
aagcccttagggagag

SEQ ID NO: 3829018 - DNA, 17 bp, Homo sapiens
aagcccttagggagagc

SEQ ID NO: 3829019 - DNA, 13 bp, Homo sapiens
aagccctttgctg

SEQ ID NO: 3829020 - DNA, 16 bp, Homo sapiens
aagccctttgctgttc

SEQ ID NO: 3829021 - DNA, 16 bp, Homo sapiens
aagccggcccaaccca

SEQ ID NO: 3829022 - DNA, 11 bp, Homo sapiens
aagcctctaac

SEQ ID NO: 3829023 - DNA, 13 bp, Homo sapiens
aagcctctggaaa

SEQ ID NO: 3829024 - DNA, 16 bp, Homo sapiens
ttactgccaaaaccaa

SEQ ID NO: 3829025 - DNA, 13 bp, Homo sapiens
ttactgtgtatct

SEQ ID NO: 3829026 - DNA, 18 bp, Homo sapiens
ttacttgagtatcataat

SEQ ID NO: 3829027 - DNA, 18 bp, Homo sapiens
ttagacagtaagagttta

SEQ ID NO: 3829028 - DNA, 18 bp, Homo sapiens
ttagccactgctggtgtt

SEQ ID NO: 3829029 - DNA, 20 bp, Homo sapiens
ttaggaaatttatacaaaga

SEQ ID NO: 3829030 - DNA, 22 bp, Homo sapiens
ttaggaaatttatacaaagaaa

SEQ ID NO: 3829031 - DNA, 21 bp, Homo sapiens
ttataaaaaaaagttgtttat

SEQ ID NO: 3829032 - DNA, 19 bp, Homo sapiens
ttataacagttataaagaa

SEQ ID NO: 3829033 - DNA, 20 bp, Homo sapiens
ttataacagttataaagaaa

SEQ ID NO: 3829034 - DNA, 21 bp, Homo sapiens
ttataacagttataaagaaag

SEQ ID NO: 3829035 - DNA, 13 bp, Homo sapiens
ttataactaatat

SEQ ID NO: 3829036 - DNA, 16 bp, Homo sapiens
ttataactaatatggt

SEQ ID NO: 3829037 - DNA, 12 bp, Homo sapiens
ttataagaaaac

SEQ ID NO: 3829038 - DNA, 21 bp, Homo sapiens
ttataattttaaatgtttttt

SEQ ID NO: 3829039 - DNA, 11 bp, Homo sapiens
ttatactatat

SEQ ID NO: 3829040 - DNA, 17 bp, Homo sapiens
ttatactgtagatttca

SEQ ID NO: 3829041 - DNA, 18 bp, Homo sapiens
ttatagtactgctttact

SEQ ID NO: 3829042 - DNA, 13 bp, Homo sapiens
ttatcaagctaat

SEQ ID NO: 3829043 - DNA, 18 bp, Homo sapiens
ttatgcatttcaatttca

SEQ ID NO: 3829044 - DNA, 11 bp, Homo sapiens
ttatgcttctt

SEQ ID NO: 3829045 - DNA, 14 bp, Homo sapiens
ttatgcttcttgga

SEQ ID NO: 3829046 - DNA, 14 bp, Homo sapiens
ttatgtgcttgaag

SEQ ID NO: 3829047 - DNA, 13 bp, Homo sapiens
ttattaagtatat

SEQ ID NO: 3829048 - DNA, 13 bp, Homo sapiens
ttattaatgctaa

SEQ ID NO: 3829049 - DNA, 14 bp, Homo sapiens
ttattaatgctaag

SEQ ID NO: 3829050 - DNA, 16 bp, Homo sapiens
ttattgggcaataaaa

SEQ ID NO: 3829051 - DNA, 17 bp, Homo sapiens
ttattgggcaataaaag

SEQ ID NO: 3829052 - DNA, 20 bp, Homo sapiens
ttatttcgtgttgtgttctt

SEQ ID NO: 3829053 - DNA, 16 bp, Homo sapiens
ttatttggaaatttag

SEQ ID NO: 3829054 - DNA, 17 bp, Homo sapiens
ttattttaaaatcaaag

SEQ ID NO: 3829055 - DNA, 18 bp, Homo sapiens
ttattttatgtcatagtt

SEQ ID NO: 3829056 - DNA, 15 bp, Homo sapiens
ttcaaaaactgtatt

SEQ ID NO: 3829057 - DNA, 17 bp, Homo sapiens
ttcacagcttcaccact

SEQ ID NO: 3829058 - DNA, 19 bp, Homo sapiens
ttcacattgtattcagagt

SEQ ID NO: 3829059 - DNA, 13 bp, Homo sapiens
ttcaccaccccct

SEQ ID NO: 3829060 - DNA, 18 bp, Homo sapiens
ttcacttctcccaagact

SEQ ID NO: 3829061 - DNA, 22 bp, Homo sapiens
ttcagacctttgtctgaaggat

SEQ ID NO: 3829062 - DNA, 17 bp, Homo sapiens
ttcagttttactgcatt

SEQ ID NO: 3829063 - DNA, 22 bp, Homo sapiens
ttcagttttactgcattttcac

SEQ ID NO: 3829064 - DNA, 12 bp, Homo sapiens
ttcataaattaa

SEQ ID NO: 3829065 - DNA, 18 bp, Homo sapiens
ttcataaattaacaaagt

SEQ ID NO: 3829066 - DNA, 20 bp, Homo sapiens
ttcataaattaacaaagtgt

SEQ ID NO: 3829067 - DNA, 9 bp, Homo sapiens
ttcataatt

SEQ ID NO: 3829068 - DNA, 20 bp, Homo sapiens
ttcataattttcaaaagaaa

SEQ ID NO: 3829069 - DNA, 15 bp, Homo sapiens
ttcatatatctatat

SEQ ID NO: 3829070 - DNA, 13 bp, Homo sapiens
ttcatcaatcatt

SEQ ID NO: 3829071 - DNA, 23 bp, Homo sapiens
ttcatccactctgcctgcttaca

SEQ ID NO: 3829072 - DNA, 18 bp, Homo sapiens
ttcatgaaaactttttaa

SEQ ID NO: 3829073 - DNA, 14 bp, Homo sapiens
ttcatgccatttta

SEQ ID NO: 3829074 - DNA, 19 bp, Homo sapiens
ttcatgctttgatttacac

SEQ ID NO: 3829075 - DNA, 20 bp, Homo sapiens
ttcatggttttaaagctaaa

SEQ ID NO: 3829076 - DNA, 16 bp, Homo sapiens
ttcatgttatgcctgt

SEQ ID NO: 3829077 - DNA, 15 bp, Homo sapiens
ttcattatttggaaa

SEQ ID NO: 3829078 - DNA, 18 bp, Homo sapiens
ttcattcaatagatacca

SEQ ID NO: 3829079 - DNA, 14 bp, Homo sapiens
ttcatttattaagt

SEQ ID NO: 3829080 - DNA, 21 bp, Homo sapiens
ttcatttattaagtatatttg

SEQ ID NO: 3829081 - DNA, 23 bp, Homo sapiens
ttcatttattaagtatatttgta

SEQ ID NO: 3829082 - DNA, 21 bp, Homo sapiens
ttcatttggggcatttgtaaa

SEQ ID NO: 3829083 - DNA, 22 bp, Homo sapiens
ttcatttggggcatttgtaaaa

SEQ ID NO: 3829084 - DNA, 13 bp, Homo sapiens
ttccaataaacag

SEQ ID NO: 3829085 - DNA, 18 bp, Homo sapiens
ttccacatggcagatgat

SEQ ID NO: 3829086 - DNA, 15 bp, Homo sapiens
ttccactacacctgg

SEQ ID NO: 3829087 - DNA, 17 bp, Homo sapiens
ttccactacacctggct

SEQ ID NO: 3829088 - DNA, 18 bp, Homo sapiens
ttccactacacctggctg

SEQ ID NO: 3829089 - DNA, 17 bp, Homo sapiens
ttccactgacaacgaaa

SEQ ID NO: 3829090 - DNA, 22 bp, Homo sapiens
ttccaggaaactccacatctgc

SEQ ID NO: 3829091 - DNA, 21 bp, Homo sapiens
ttccaggaggagttagccaaa

SEQ ID NO: 3829092 - DNA, 19 bp, Homo sapiens
ttccatcctttgcatttct

SEQ ID NO: 3829093 - DNA, 12 bp, Homo sapiens
ttcccaaaggga

SEQ ID NO: 3829094 - DNA, 22 bp, Homo sapiens
ttcccagactagatttcaagct

SEQ ID NO: 3829095 - DNA, 16 bp, Homo sapiens
ttcccgcatggttttt

SEQ ID NO: 3829096 - DNA, 13 bp, Homo sapiens
ttccctccccagc

SEQ ID NO: 3829097 - DNA, 22 bp, Homo sapiens
ttccctgcccgaggtcgctgca

SEQ ID NO: 3829098 - DNA, 14 bp, Homo sapiens
ttccctgcttccag

SEQ ID NO: 3829099 - DNA, 16 bp, Homo sapiens
ttcccttgccctgggc

SEQ ID NO: 3829100 - DNA, 10 bp, Homo sapiens
ttccctttgg

SEQ ID NO: 3829101 - DNA, 17 bp, Homo sapiens
ttcctaaaactctgcca

SEQ ID NO: 3829102 - DNA, 19 bp, Homo sapiens
ttcctaaaactctgccagc

SEQ ID NO: 3829103 - DNA, 20 bp, Homo sapiens
ttcctaaatatattttaaga

SEQ ID NO: 3829104 - DNA, 19 bp, Homo sapiens
ttcctaatggtctcatctc

SEQ ID NO: 3829105 - DNA, 22 bp, Homo sapiens
ttcctatcaatccaaattccct

SEQ ID NO: 3829106 - DNA, 19 bp, Homo sapiens
ttcctgcctactgcccctg

SEQ ID NO: 3829107 - DNA, 13 bp, Homo sapiens
ttccttcataatt

SEQ ID NO: 3829108 - DNA, 18 bp, Homo sapiens
ttccttcataattttcaa

SEQ ID NO: 3829109 - DNA, 21 bp, Homo sapiens
ttccttcataattttcaaaag

SEQ ID NO: 3829110 - DNA, 14 bp, Homo sapiens
ttccttgaagccga

SEQ ID NO: 3829111 - DNA, 16 bp, Homo sapiens
ttcctttccccagccc

SEQ ID NO: 3829112 - DNA, 14 bp, Homo sapiens
ttccttttccctgc

SEQ ID NO: 3829113 - DNA, 13 bp, Homo sapiens
ttcgctttcctct

SEQ ID NO: 3829114 - DNA, 12 bp, Homo sapiens
ttctaaattctt

SEQ ID NO: 3829115 - DNA, 13 bp, Homo sapiens
ttctaagagaagt

SEQ ID NO: 3829116 - DNA, 21 bp, Homo sapiens
ttctaatatttattgctttat

SEQ ID NO: 3829117 - DNA, 15 bp, Homo sapiens
ttctacagtggtttt

SEQ ID NO: 3829118 - DNA, 21 bp, Homo sapiens
ttctacagtggttttatactg

SEQ ID NO: 3829119 - DNA, 21 bp, Homo sapiens
ttctaccctgttgcaaaggaa

SEQ ID NO: 3829120 - DNA, 14 bp, Homo sapiens
ttctacttgctctg

SEQ ID NO: 3829121 - DNA, 20 bp, Homo sapiens
ttctacttgctctggacctg

SEQ ID NO: 3829122 - DNA, 18 bp, Homo sapiens
ttctatttgctatctgaa

SEQ ID NO: 3829123 - DNA, 23 bp, Homo sapiens
ttctattttcattttctgcaagc

SEQ ID NO: 3829124 - DNA, 15 bp, Homo sapiens
ttctcaggacgacga

SEQ ID NO: 3829125 - DNA, 15 bp, Homo sapiens
ttctcatgctatttc

SEQ ID NO: 3829126 - DNA, 15 bp, Homo sapiens
ttctcattttaaaca

SEQ ID NO: 3829127 - DNA, 16 bp, Homo sapiens
ttctcattttaaacaa

SEQ ID NO: 3829128 - DNA, 19 bp, Homo sapiens
ttctcccaggtaccagctg

SEQ ID NO: 3829129 - DNA, 16 bp, Homo sapiens
ttctccgccagcctcc

SEQ ID NO: 3829130 - DNA, 17 bp, Homo sapiens
ttctccgccagcctcct

SEQ ID NO: 3829131 - DNA, 21 bp, Homo sapiens
ttctccgccagcctcctctgg

SEQ ID NO: 3829132 - DNA, 10 bp, Homo sapiens
ttctctctga

SEQ ID NO: 3829133 - DNA, 11 bp, Homo sapiens
ttctctctgag

SEQ ID NO: 3829134 - DNA, 21 bp, Homo sapiens
ttctgaccttgtgaacatcag

SEQ ID NO: 3829135 - DNA, 15 bp, Homo sapiens
ttctgctcattctaa

SEQ ID NO: 3829136 - DNA, 19 bp, Homo sapiens
ttctgcttttctgccctgg

SEQ ID NO: 3829137 - DNA, 15 bp, Homo sapiens
ttctggattcttggc

SEQ ID NO: 3829138 - DNA, 22 bp, Homo sapiens
ttctgggcagatgaaaagctac

SEQ ID NO: 3829139 - DNA, 20 bp, Homo sapiens
ttctgggtttgaagctgctg

SEQ ID NO: 3829140 - DNA, 21 bp, Homo sapiens
ttctgggtttgaagctgctgt

SEQ ID NO: 3829141 - DNA, 15 bp, Homo sapiens
ttctgtgaaactaat

SEQ ID NO: 3829142 - DNA, 13 bp, Homo sapiens
ttctgtgtagaca

SEQ ID NO: 3829143 - DNA, 14 bp, Homo sapiens
ttctgtgtagacat

SEQ ID NO: 3829144 - DNA, 22 bp, Homo sapiens
ttcttacttgagtatcataata

SEQ ID NO: 3829145 - DNA, 16 bp, Homo sapiens
ttcttccatcccagga

SEQ ID NO: 3829146 - DNA, 18 bp, Homo sapiens
ttcttggtggattagaca

SEQ ID NO: 3829147 - DNA, 13 bp, Homo sapiens
ttctttataacca

SEQ ID NO: 3829148 - DNA, 13 bp, Homo sapiens
ttctttttgattt

SEQ ID NO: 3829149 - DNA, 19 bp, Homo sapiens
ttgaaacaacattatttta

SEQ ID NO: 3829150 - DNA, 13 bp, Homo sapiens
ttgaaacagaacc

SEQ ID NO: 3829151 - DNA, 18 bp, Homo sapiens
ttgaaagacaaaatttag

SEQ ID NO: 3829152 - DNA, 11 bp, Homo sapiens
ttgaagccaaa

SEQ ID NO: 3829153 - DNA, 16 bp, Homo sapiens
ttgacaagtgtctttt

SEQ ID NO: 3829154 - DNA, 23 bp, Homo sapiens
ttgagaaatactatatatacaat

SEQ ID NO: 3829155 - DNA, 14 bp, Homo sapiens
ttgagaaggagaga

SEQ ID NO: 3829156 - DNA, 16 bp, Homo sapiens
ttgagaaggagagaaa

SEQ ID NO: 3829157 - DNA, 14 bp, Homo sapiens
ttgagctgccttcc

SEQ ID NO: 3829158 - DNA, 15 bp, Homo sapiens
ttgagctgccttccc

SEQ ID NO: 3829159 - DNA, 14 bp, Homo sapiens
ttgaggtcaggagt

SEQ ID NO: 3829160 - DNA, 16 bp, Homo sapiens
ttgatagctaaataac

SEQ ID NO: 3829161 - DNA, 17 bp, Homo sapiens
ttgatccagaaagaaaa

SEQ ID NO: 3829162 - DNA, 16 bp, Homo sapiens
tgtctaaagtgggaaa

SEQ ID NO: 3829163 - DNA, 19 bp, Homo sapiens
tgtctctttggggagagct

SEQ ID NO: 3829164 - DNA, 15 bp, Homo sapiens
tgtctggggacaggc

SEQ ID NO: 3829165 - DNA, 14 bp, Homo sapiens
tgtctgtgtgctac

SEQ ID NO: 3829166 - DNA, 15 bp, Homo sapiens
tgtctgtgtgctact

SEQ ID NO: 3829167 - DNA, 23 bp, Homo sapiens
tgtctgtgtgctactaacagatt

SEQ ID NO: 3829168 - DNA, 14 bp, Homo sapiens
tgtctgtttataaa

SEQ ID NO: 3829169 - DNA, 18 bp, Homo sapiens
tgtctttttgaaataaag

SEQ ID NO: 3829170 - DNA, 12 bp, Homo sapiens
tgtgaaagatgc

SEQ ID NO: 3829171 - DNA, 13 bp, Homo sapiens
tgtgaaatttcat

SEQ ID NO: 3829172 - DNA, 15 bp, Homo sapiens
tgtgaaatttcatga

SEQ ID NO: 3829173 - DNA, 14 bp, Homo sapiens
tgtgaacattccta

SEQ ID NO: 3829174 - DNA, 15 bp, Homo sapiens
tgtgaacattcctat

SEQ ID NO: 3829175 - DNA, 16 bp, Homo sapiens
tgtgaatcattttacc

SEQ ID NO: 3829176 - DNA, 14 bp, Homo sapiens
tgtgactagtgctg

SEQ ID NO: 3829177 - DNA, 15 bp, Homo sapiens
tgtgactagtgctga

SEQ ID NO: 3829178 - DNA, 16 bp, Homo sapiens
tgtgactagtgctgaa

SEQ ID NO: 3829179 - DNA, 20 bp, Homo sapiens
tgtgactagtgctgaagctt

SEQ ID NO: 3829180 - DNA, 20 bp, Homo sapiens
tgtgagagagagggcgccca

SEQ ID NO: 3829181 - DNA, 23 bp, Homo sapiens
tgtgagagagagggcgcccagcc

SEQ ID NO: 3829182 - DNA, 20 bp, Homo sapiens
tgtgatgtacacattttgta

SEQ ID NO: 3829183 - DNA, 20 bp, Homo sapiens
tgtgccagatttatgcatat

SEQ ID NO: 3829184 - DNA, 14 bp, Homo sapiens
tgtgccaggctggg

SEQ ID NO: 3829185 - DNA, 16 bp, Homo sapiens
tgtgccaggctgggag

SEQ ID NO: 3829186 - DNA, 17 bp, Homo sapiens
tgtgccaggctgggagg

SEQ ID NO: 3829187 - DNA, 22 bp, Homo sapiens
tgtgcccgccctgggctgggcc

SEQ ID NO: 3829188 - DNA, 13 bp, Homo sapiens
tgtgcggagctga

SEQ ID NO: 3829189 - DNA, 20 bp, Homo sapiens
tgtgcgtgcttgagtgtgtt

SEQ ID NO: 3829190 - DNA, 14 bp, Homo sapiens
tgtgctactaacag

SEQ ID NO: 3829191 - DNA, 17 bp, Homo sapiens
tgtgctactaacagatt

SEQ ID NO: 3829192 - DNA, 18 bp, Homo sapiens
tgtgctactaacagatta

SEQ ID NO: 3829193 - DNA, 14 bp, Homo sapiens
tgtgctgcatccca

SEQ ID NO: 3829194 - DNA, 19 bp, Homo sapiens
tgtgctggatggagcccag

SEQ ID NO: 3829195 - DNA, 23 bp, Homo sapiens
tgtgcttctaatatttattgctt

SEQ ID NO: 3829196 - DNA, 13 bp, Homo sapiens
tgtgctttataaa

SEQ ID NO: 3829197 - DNA, 20 bp, Homo sapiens
tgtgctttgtatcagtcagt

SEQ ID NO: 3829198 - DNA, 13 bp, Homo sapiens
tgtggacattgag

SEQ ID NO: 3829199 - DNA, 17 bp, Homo sapiens
tgtggatgggaggctcc

SEQ ID NO: 3829200 - DNA, 19 bp, Homo sapiens
tgtggatgggaggctcctg

SEQ ID NO: 3829201 - DNA, 11 bp, Homo sapiens
tgtggcagtgg

SEQ ID NO: 3829202 - DNA, 12 bp, Homo sapiens
tgtggcagtggt

SEQ ID NO: 3829203 - DNA, 22 bp, Homo sapiens
tgtggcctggatccatcctgct

SEQ ID NO: 3829204 - DNA, 20 bp, Homo sapiens
tgtgtaacagttagccactg

SEQ ID NO: 3829205 - DNA, 9 bp, Homo sapiens
tgtgtcttt

SEQ ID NO: 3829206 - DNA, 18 bp, Homo sapiens
tgtgtctttttcgccaaa

SEQ ID NO: 3829207 - DNA, 14 bp, Homo sapiens
tgtgtgctactaac

SEQ ID NO: 3829208 - DNA, 18 bp, Homo sapiens
tgtgtgctactaacagat

SEQ ID NO: 3829209 - DNA, 20 bp, Homo sapiens
tgtgtgggtggatataaata

SEQ ID NO: 3829210 - DNA, 12 bp, Homo sapiens
tgtgttctttat

SEQ ID NO: 3829211 - DNA, 22 bp, Homo sapiens
tgtgtttaggaactactgagga

SEQ ID NO: 3829212 - DNA, 15 bp, Homo sapiens
tgtgtttatgcattt

SEQ ID NO: 3829213 - DNA, 14 bp, Homo sapiens
tgttacaaattgta

SEQ ID NO: 3829214 - DNA, 14 bp, Homo sapiens
tgttactagcctct

SEQ ID NO: 3829215 - DNA, 21 bp, Homo sapiens
tgttactgccaaaaccaaatt

SEQ ID NO: 3829216 - DNA, 20 bp, Homo sapiens
tgttatgcctgttgcaggca

SEQ ID NO: 3829217 - DNA, 23 bp, Homo sapiens
tgttatgcctgttgcaggcaaat

SEQ ID NO: 3829218 - DNA, 13 bp, Homo sapiens
tgttcaaaagaag

SEQ ID NO: 3829219 - DNA, 14 bp, Homo sapiens
tgttcaaaagaagt

SEQ ID NO: 3829220 - DNA, 23 bp, Homo sapiens
tgttcatgttagttttgctcctt

SEQ ID NO: 3829221 - DNA, 15 bp, Homo sapiens
tgttccaataaacag

SEQ ID NO: 3829222 - DNA, 15 bp, Homo sapiens
tgttctgtgatataa

SEQ ID NO: 3829223 - DNA, 18 bp, Homo sapiens
tgttctgtgatataagtg

SEQ ID NO: 3829224 - DNA, 15 bp, Homo sapiens
tgttgcacagactgg

SEQ ID NO: 3829225 - DNA, 14 bp, Homo sapiens
tgttggctcagaaa

SEQ ID NO: 3829226 - DNA, 15 bp, Homo sapiens
tgttggctcagaaaa

SEQ ID NO: 3829227 - DNA, 18 bp, Homo sapiens
tgttgggatactgcaggg

SEQ ID NO: 3829228 - DNA, 19 bp, Homo sapiens
tgttgttttgtagcaacca

SEQ ID NO: 3829229 - DNA, 16 bp, Homo sapiens
tgtttacacacgtgca

SEQ ID NO: 3829230 - DNA, 13 bp, Homo sapiens
tgtttaggaaatt

SEQ ID NO: 3829231 - DNA, 21 bp, Homo sapiens
tgtttatgtgaacattcctat

SEQ ID NO: 3829232 - DNA, 19 bp, Homo sapiens
tgtttccatcctttgcatt

SEQ ID NO: 3829233 - DNA, 23 bp, Homo sapiens
tgtttccatcctttgcatttctc

SEQ ID NO: 3829234 - DNA, 22 bp, Homo sapiens
tgtttggaaatggggagctggc

SEQ ID NO: 3829235 - DNA, 15 bp, Homo sapiens
tgttttaacaccaac

SEQ ID NO: 3829236 - DNA, 11 bp, Homo sapiens
tgttttacaac

SEQ ID NO: 3829237 - DNA, 21 bp, Homo sapiens
tgttttcaatgaattaagaaa

SEQ ID NO: 3829238 - DNA, 19 bp, Homo sapiens
tgttttcccctaattttcc

SEQ ID NO: 3829239 - DNA, 20 bp, Homo sapiens
tgttttcccctaattttcca

SEQ ID NO: 3829240 - DNA, 13 bp, Homo sapiens
tgtttttgccact

SEQ ID NO: 3829241 - DNA, 18 bp, Homo sapiens
tgtttttttttaaagact

SEQ ID NO: 3829242 - DNA, 21 bp, Homo sapiens
tgttttttttttgtgtgtgct

SEQ ID NO: 3829243 - DNA, 11 bp, Homo sapiens
ttaaaaaactg

SEQ ID NO: 3829244 - DNA, 21 bp, Homo sapiens
ttaaaaaagaaagattttatg

SEQ ID NO: 3829245 - DNA, 22 bp, Homo sapiens
ttaaaaaagttgtaatagagaa

SEQ ID NO: 3829246 - DNA, 15 bp, Homo sapiens
ttaaaaagaagtttc

SEQ ID NO: 3829247 - DNA, 19 bp, Homo sapiens
ttaaaaagcagtttttgaa

SEQ ID NO: 3829248 - DNA, 24 bp, Homo sapiens
ttaaaacaaggggttactttacat

SEQ ID NO: 3829249 - DNA, 13 bp, Homo sapiens
ttaaaactcagat

SEQ ID NO: 3829250 - DNA, 18 bp, Homo sapiens
ttaaaagactgttttcag

SEQ ID NO: 3829251 - DNA, 15 bp, Homo sapiens
ttaaaatatttgcct

SEQ ID NO: 3829252 - DNA, 17 bp, Homo sapiens
ttaaaatgtttaggaaa

SEQ ID NO: 3829253 - DNA, 19 bp, Homo sapiens
ttaaaccataaaaagctga

SEQ ID NO: 3829254 - DNA, 22 bp, Homo sapiens
ttaaactcttgaatatgtgcct

SEQ ID NO: 3829255 - DNA, 20 bp, Homo sapiens
ttaaatatatctttgtaaat

SEQ ID NO: 3829256 - DNA, 16 bp, Homo sapiens
ttaaatatgatttgca

SEQ ID NO: 3829257 - DNA, 15 bp, Homo sapiens
ttaaatcattcattc

SEQ ID NO: 3829258 - DNA, 22 bp, Homo sapiens
ttaaatcattcattcaatagat

SEQ ID NO: 3829259 - DNA, 23 bp, Homo sapiens
ttaaatgtttttttttaaagact

SEQ ID NO: 3829260 - DNA, 19 bp, Homo sapiens
ttaaatttgccagttttat

SEQ ID NO: 3829261 - DNA, 21 bp, Homo sapiens
ttaactgagggctgatcttta

SEQ ID NO: 3829262 - DNA, 20 bp, Homo sapiens
ttaactggaaggctgctttc

SEQ ID NO: 3829263 - DNA, 22 bp, Homo sapiens
ttaagaaagattaaatatatct

SEQ ID NO: 3829264 - DNA, 19 bp, Homo sapiens
ttaagacgaaacatttgtt

SEQ ID NO: 3829265 - DNA, 19 bp, Homo sapiens
ttaagatggtaagacctct

SEQ ID NO: 3829266 - DNA, 22 bp, Homo sapiens
ttaagatggtaagacctctgag

SEQ ID NO: 3829267 - DNA, 22 bp, Homo sapiens
ttaagcttaaaaaagaaagatt

SEQ ID NO: 3829268 - DNA, 14 bp, Homo sapiens
ttaaggagaaatag

SEQ ID NO: 3829269 - DNA, 21 bp, Homo sapiens
ttaagggcatttaatcaggag

SEQ ID NO: 3829270 - DNA, 18 bp, Homo sapiens
ttaagtaaggaattttat

SEQ ID NO: 3829271 - DNA, 21 bp, Homo sapiens
ttaagtaagtaagtttcattc

SEQ ID NO: 3829272 - DNA, 13 bp, Homo sapiens
ttaatctttaatt

SEQ ID NO: 3829273 - DNA, 14 bp, Homo sapiens
ttaattaacatcaa

SEQ ID NO: 3829274 - DNA, 15 bp, Homo sapiens
ttaattaattaacat

SEQ ID NO: 3829275 - DNA, 19 bp, Homo sapiens
ttaattgctttcctgcctc

SEQ ID NO: 3829276 - DNA, 19 bp, Homo sapiens
ttacacacgtgcaatttgt

SEQ ID NO: 3829277 - DNA, 14 bp, Homo sapiens
ttacatttcctaaa

SEQ ID NO: 3829278 - DNA, 13 bp, Homo sapiens
ttacccaaaagca

SEQ ID NO: 3829279 - DNA, 20 bp, Homo sapiens
ttacctttgacaaaggtaaa

SEQ ID NO: 3829280 - DNA, 17 bp, Homo sapiens
ttactgcattttcacaa

SEQ ID NO: 3829281 - DNA, 22 bp, Homo sapiens
ttactgcattttcacaacatat

SEQ ID NO: 3829282 - DNA, 20 bp, Homo sapiens
tggctggggggtctcagcat

SEQ ID NO: 3829283 - DNA, 15 bp, Homo sapiens
tggctttgtgctgct

SEQ ID NO: 3829284 - DNA, 16 bp, Homo sapiens
tggctttgtgctgctg

SEQ ID NO: 3829285 - DNA, 15 bp, Homo sapiens
tggcttttagacaga

SEQ ID NO: 3829286 - DNA, 21 bp, Homo sapiens
tgggaaacctcattgttctgt

SEQ ID NO: 3829287 - DNA, 18 bp, Homo sapiens
tgggacctgccaggcagg

SEQ ID NO: 3829288 - DNA, 19 bp, Homo sapiens
tgggacctgccaggcaggg

SEQ ID NO: 3829289 - DNA, 23 bp, Homo sapiens
tgggagaggcaataaataaatgt

SEQ ID NO: 3829290 - DNA, 14 bp, Homo sapiens
tgggagcaggagat

SEQ ID NO: 3829291 - DNA, 12 bp, Homo sapiens
tgggaggaagca

SEQ ID NO: 3829292 - DNA, 16 bp, Homo sapiens
tgggaggaagcagaat

SEQ ID NO: 3829293 - DNA, 20 bp, Homo sapiens
tgggaggaagcagaataaag

SEQ ID NO: 3829294 - DNA, 16 bp, Homo sapiens
tgggaggctcctggtg

SEQ ID NO: 3829295 - DNA, 18 bp, Homo sapiens
tgggaggctcctggtggg

SEQ ID NO: 3829296 - DNA, 12 bp, Homo sapiens
tgggagggaggg

SEQ ID NO: 3829297 - DNA, 14 bp, Homo sapiens
tgggagggaggggg

SEQ ID NO: 3829298 - DNA, 12 bp, Homo sapiens
tgggatttgcaa

SEQ ID NO: 3829299 - DNA, 12 bp, Homo sapiens
tgggcaataaaa

SEQ ID NO: 3829300 - DNA, 21 bp, Homo sapiens
tgggcaccccaggcagctcct

SEQ ID NO: 3829301 - DNA, 16 bp, Homo sapiens
tgggcactaagggtgg

SEQ ID NO: 3829302 - DNA, 17 bp, Homo sapiens
tgggcactaagggtgga

SEQ ID NO: 3829303 - DNA, 20 bp, Homo sapiens
tgggcactaagggtggagag

SEQ ID NO: 3829304 - DNA, 20 bp, Homo sapiens
tgggcccttcctggctagga

SEQ ID NO: 3829305 - DNA, 17 bp, Homo sapiens
tgggcctcctcctagct

SEQ ID NO: 3829306 - DNA, 15 bp, Homo sapiens
tgggcttaattgaaa

SEQ ID NO: 3829307 - DNA, 16 bp, Homo sapiens
tgggcttggcctgctg

SEQ ID NO: 3829308 - DNA, 18 bp, Homo sapiens
tgggcttggcctgctgtg

SEQ ID NO: 3829309 - DNA, 22 bp, Homo sapiens
tgggcttttatttttttggaac

SEQ ID NO: 3829310 - DNA, 13 bp, Homo sapiens
tggggacaggcct

SEQ ID NO: 3829311 - DNA, 12 bp, Homo sapiens
tggggagaaggg

SEQ ID NO: 3829312 - DNA, 14 bp, Homo sapiens
tggggagctggcct

SEQ ID NO: 3829313 - DNA, 13 bp, Homo sapiens
tggggatggccag

SEQ ID NO: 3829314 - DNA, 22 bp, Homo sapiens
tggggcaaggggcagccagccc

SEQ ID NO: 3829315 - DNA, 14 bp, Homo sapiens
tggggcagaaaggc

SEQ ID NO: 3829316 - DNA, 19 bp, Homo sapiens
tggggcagcctccagtctg

SEQ ID NO: 3829317 - DNA, 16 bp, Homo sapiens
tggggcccccagcacc

SEQ ID NO: 3829318 - DNA, 19 bp, Homo sapiens
tggggcccccagcaccctc

SEQ ID NO: 3829319 - DNA, 17 bp, Homo sapiens
tgggggatgcaaataaa

SEQ ID NO: 3829320 - DNA, 21 bp, Homo sapiens
tgggggctaggggagggggga

SEQ ID NO: 3829321 - DNA, 21 bp, Homo sapiens
tgggggtcacccatggcctca

SEQ ID NO: 3829322 - DNA, 15 bp, Homo sapiens
tggggtcagcaggcc

SEQ ID NO: 3829323 - DNA, 13 bp, Homo sapiens
tggggtgctggga

SEQ ID NO: 3829324 - DNA, 18 bp, Homo sapiens
tgggtaaatcagggacag

SEQ ID NO: 3829325 - DNA, 20 bp, Homo sapiens
tgggtggatataaatatata

SEQ ID NO: 3829326 - DNA, 15 bp, Homo sapiens
tgggtgggctctgtg

SEQ ID NO: 3829327 - DNA, 19 bp, Homo sapiens
tgggtgggctctgtgcagt

SEQ ID NO: 3829328 - DNA, 14 bp, Homo sapiens
tgggtttgccaagc

SEQ ID NO: 3829329 - DNA, 22 bp, Homo sapiens
tgggtttgccaagccctttgct

SEQ ID NO: 3829330 - DNA, 16 bp, Homo sapiens
tggtaagacctctgag

SEQ ID NO: 3829331 - DNA, 18 bp, Homo sapiens
tggtattgtaatattaaa

SEQ ID NO: 3829332 - DNA, 17 bp, Homo sapiens
tggtcacagggcatgcc

SEQ ID NO: 3829333 - DNA, 22 bp, Homo sapiens
tggtccacagggctcctgaagg

SEQ ID NO: 3829334 - DNA, 17 bp, Homo sapiens
tggtccctgccctcatc

SEQ ID NO: 3829335 - DNA, 17 bp, Homo sapiens
tggtctaccaagtaaga

SEQ ID NO: 3829336 - DNA, 15 bp, Homo sapiens
tggtctcatctcctt

SEQ ID NO: 3829337 - DNA, 20 bp, Homo sapiens
tggtctcatctcctttgcta

SEQ ID NO: 3829338 - DNA, 21 bp, Homo sapiens
tggtctcatctcctttgctag

SEQ ID NO: 3829339 - DNA, 16 bp, Homo sapiens
tggtgaaatctgctct

SEQ ID NO: 3829340 - DNA, 17 bp, Homo sapiens
tggtgaaatctgctctg

SEQ ID NO: 3829341 - DNA, 23 bp, Homo sapiens
tggtgaaatctgctctgtacatc

SEQ ID NO: 3829342 - DNA, 13 bp, Homo sapiens
tggtgcctgagag

SEQ ID NO: 3829343 - DNA, 14 bp, Homo sapiens
tggtgcctgagagg

SEQ ID NO: 3829344 - DNA, 17 bp, Homo sapiens
tggtgcctgagaggcag

SEQ ID NO: 3829345 - DNA, 20 bp, Homo sapiens
tggtgcctgagaggcaggca

SEQ ID NO: 3829346 - DNA, 14 bp, Homo sapiens
tggtgctaatgtgt

SEQ ID NO: 3829347 - DNA, 17 bp, Homo sapiens
tggtggggcccccagca

SEQ ID NO: 3829348 - DNA, 23 bp, Homo sapiens
tggtgtttatgtgaacattccta

SEQ ID NO: 3829349 - DNA, 14 bp, Homo sapiens
tggttctacaaatt

SEQ ID NO: 3829350 - DNA, 15 bp, Homo sapiens
tggttgccaccccaa

SEQ ID NO: 3829351 - DNA, 14 bp, Homo sapiens
tggttggttttata

SEQ ID NO: 3829352 - DNA, 16 bp, Homo sapiens
tggttttaaagctaaa

SEQ ID NO: 3829353 - DNA, 19 bp, Homo sapiens
tggttttatactatattaa

SEQ ID NO: 3829354 - DNA, 16 bp, Homo sapiens
tggttttatactgaag

SEQ ID NO: 3829355 - DNA, 23 bp, Homo sapiens
tggttttatactgaaggaaaaac

SEQ ID NO: 3829356 - DNA, 22 bp, Homo sapiens
tggttttgttttcaatgaatta

SEQ ID NO: 3829357 - DNA, 22 bp, Homo sapiens
tgtaaaaagtagattaaaatat

SEQ ID NO: 3829358 - DNA, 13 bp, Homo sapiens
tgtaaaagctaag

SEQ ID NO: 3829359 - DNA, 18 bp, Homo sapiens
tgtaaactaaagtgtgct

SEQ ID NO: 3829360 - DNA, 17 bp, Homo sapiens
tgtaaaggactatttat

SEQ ID NO: 3829361 - DNA, 23 bp, Homo sapiens
tgtaaataaatgtacaggttgga

SEQ ID NO: 3829362 - DNA, 11 bp, Homo sapiens
tgtaaatgctg

SEQ ID NO: 3829363 - DNA, 20 bp, Homo sapiens
tgtaaattattttatgtcat

SEQ ID NO: 3829364 - DNA, 13 bp, Homo sapiens
tgtaacagctcct

SEQ ID NO: 3829365 - DNA, 14 bp, Homo sapiens
tgtaacagctcctt

SEQ ID NO: 3829366 - DNA, 22 bp, Homo sapiens
tgtaacagctccttgggaggaa

SEQ ID NO: 3829367 - DNA, 14 bp, Homo sapiens
tgtaactgaagcat

SEQ ID NO: 3829368 - DNA, 16 bp, Homo sapiens
tgtaactgaagcataa

SEQ ID NO: 3829369 - DNA, 20 bp, Homo sapiens
tgtaactgaagcataaacat

SEQ ID NO: 3829370 - DNA, 12 bp, Homo sapiens
tgtaagtataag

SEQ ID NO: 3829371 - DNA, 13 bp, Homo sapiens
tgtaataaatgta

SEQ ID NO: 3829372 - DNA, 19 bp, Homo sapiens
tgtaataaatgtattaact

SEQ ID NO: 3829373 - DNA, 19 bp, Homo sapiens
tgtaatattaaaaagaagt

SEQ ID NO: 3829374 - DNA, 23 bp, Homo sapiens
tgtaatattaaaaagaagtttct

SEQ ID NO: 3829375 - DNA, 15 bp, Homo sapiens
tgtaatctctcatgg

SEQ ID NO: 3829376 - DNA, 15 bp, Homo sapiens
tgtacaaaaaagtta

SEQ ID NO: 3829377 - DNA, 13 bp, Homo sapiens
tgtacagtttgtt

SEQ ID NO: 3829378 - DNA, 14 bp, Homo sapiens
tgtacagtttgttt

SEQ ID NO: 3829379 - DNA, 16 bp, Homo sapiens
tgtacagtttgtttac

SEQ ID NO: 3829380 - DNA, 15 bp, Homo sapiens
tgtagaacttgaact

SEQ ID NO: 3829381 - DNA, 17 bp, Homo sapiens
tgtagattcccttgcac

SEQ ID NO: 3829382 - DNA, 14 bp, Homo sapiens
tgtatataaaatgt

SEQ ID NO: 3829383 - DNA, 20 bp, Homo sapiens
tgtatcagtcagtgctggag

SEQ ID NO: 3829384 - DNA, 23 bp, Homo sapiens
tgtatcagtcagtgctggagaaa

SEQ ID NO: 3829385 - DNA, 12 bp, Homo sapiens
tgtatcatttca

SEQ ID NO: 3829386 - DNA, 16 bp, Homo sapiens
tgtatcatttcatgct

SEQ ID NO: 3829387 - DNA, 14 bp, Homo sapiens
tgtatctcaataaa

SEQ ID NO: 3829388 - DNA, 16 bp, Homo sapiens
tgtatctcaataaagc

SEQ ID NO: 3829389 - DNA, 19 bp, Homo sapiens
tgtatgaattttgtaagta

SEQ ID NO: 3829390 - DNA, 20 bp, Homo sapiens
tgtatgaattttgtaagtat

SEQ ID NO: 3829391 - DNA, 21 bp, Homo sapiens
tgtatgtcattaaagtgcact

SEQ ID NO: 3829392 - DNA, 22 bp, Homo sapiens
tgtatgtcattaaagtgcactg

SEQ ID NO: 3829393 - DNA, 18 bp, Homo sapiens
tgtattttatttagacaa

SEQ ID NO: 3829394 - DNA, 19 bp, Homo sapiens
tgtattttatttagacaag

SEQ ID NO: 3829395 - DNA, 19 bp, Homo sapiens
gaagcctatttttatattt

SEQ ID NO: 3829396 - DNA, 15 bp, Homo sapiens
gaagcctggacgcag

SEQ ID NO: 3829397 - DNA, 19 bp, Homo sapiens
gaagcctggacgcagccac

SEQ ID NO: 3829398 - DNA, 16 bp, Homo sapiens
gaagctgctgtctcta

SEQ ID NO: 3829399 - DNA, 12 bp, Homo sapiens
gaagctgggagg

SEQ ID NO: 3829400 - DNA, 14 bp, Homo sapiens
gaagctgggaggga

SEQ ID NO: 3829401 - DNA, 16 bp, Homo sapiens
gaagctgggagggagg

SEQ ID NO: 3829402 - DNA, 18 bp, Homo sapiens
gaagctgggagggagggg

SEQ ID NO: 3829403 - DNA, 19 bp, Homo sapiens
gaagcttattaatgctaag

SEQ ID NO: 3829404 - DNA, 20 bp, Homo sapiens
gaagcttattaatgctaagg

SEQ ID NO: 3829405 - DNA, 20 bp, Homo sapiens
gaaggagagaaagtgggtga

SEQ ID NO: 3829406 - DNA, 19 bp, Homo sapiens
gaaggattttaaatgctgt

SEQ ID NO: 3829407 - DNA, 20 bp, Homo sapiens
gaaggattttaaatgctgta

SEQ ID NO: 3829408 - DNA, 24 bp, Homo sapiens
gaaggattttaaatgctgtatgtc

SEQ ID NO: 3829409 - DNA, 23 bp, Homo sapiens
gaaggcaagagggggtggagggg

SEQ ID NO: 3829410 - DNA, 23 bp, Homo sapiens
gaaggccatggggcagcctccag

SEQ ID NO: 3829411 - DNA, 20 bp, Homo sapiens
gaagggacaaaaggtactgg

SEQ ID NO: 3829412 - DNA, 23 bp, Homo sapiens
gaagggtgctcagtctccttggt

SEQ ID NO: 3829413 - DNA, 21 bp, Homo sapiens
gaaggtgctggaggtgggagc

SEQ ID NO: 3829414 - DNA, 14 bp, Homo sapiens
gaagtgccatctca

SEQ ID NO: 3829415 - DNA, 23 bp, Homo sapiens
gaagtgttatttcatccagggaa

SEQ ID NO: 3829416 - DNA, 12 bp, Homo sapiens
gaagttggggaa

SEQ ID NO: 3829417 - DNA, 17 bp, Homo sapiens
gaagtttaagtaagtaa

SEQ ID NO: 3829418 - DNA, 14 bp, Homo sapiens
gaataaagcaattt

SEQ ID NO: 3829419 - DNA, 20 bp, Homo sapiens
gaataaagcttctctctgag

SEQ ID NO: 3829420 - DNA, 21 bp, Homo sapiens
gaataaagcttctctctgagc

SEQ ID NO: 3829421 - DNA, 23 bp, Homo sapiens
gaataaagcttctctctgagctg

SEQ ID NO: 3829422 - DNA, 18 bp, Homo sapiens
gaataaatgttttacaac

SEQ ID NO: 3829423 - DNA, 12 bp, Homo sapiens
gaatacatatta

SEQ ID NO: 3829424 - DNA, 21 bp, Homo sapiens
gaatattgacaagtgtctttt

SEQ ID NO: 3829425 - DNA, 20 bp, Homo sapiens
gaatatttttggcattcctc

SEQ ID NO: 3829426 - DNA, 21 bp, Homo sapiens
gaatccaaatgtgaaagatgc

SEQ ID NO: 3829427 - DNA, 16 bp, Homo sapiens
gaatccccgaaggtgc

SEQ ID NO: 3829428 - DNA, 21 bp, Homo sapiens
gaatgaaagtcttgtgactag

SEQ ID NO: 3829429 - DNA, 23 bp, Homo sapiens
gaatgaaagtcttgtgactagtg

SEQ ID NO: 3829430 - DNA, 15 bp, Homo sapiens
gaatgactgaagaca

SEQ ID NO: 3829431 - DNA, 14 bp, Homo sapiens
gaatgaggtgggag

SEQ ID NO: 3829432 - DNA, 18 bp, Homo sapiens
gaatgatgtatataaaat

SEQ ID NO: 3829433 - DNA, 16 bp, Homo sapiens
aagccccatgctggag

SEQ ID NO: 3829434 - DNA, 17 bp, Homo sapiens
aagccccatgctggagc

SEQ ID NO: 3829435 - DNA, 19 bp, Homo sapiens
aagccccatgctggagcct

SEQ ID NO: 3829436 - DNA, 20 bp, Homo sapiens
aagccccatgctggagcctg

SEQ ID NO: 3829437 - DNA, 14 bp, Homo sapiens
aagccctttgctgt

SEQ ID NO: 3829438 - DNA, 13 bp, Homo sapiens
aagccgctcccgg

SEQ ID NO: 3829439 - DNA, 14 bp, Homo sapiens
aagccggcccaacc

SEQ ID NO: 3829440 - DNA, 23 bp, Homo sapiens
aagcctatttttatatttttaaa

SEQ ID NO: 3829441 - DNA, 18 bp, Homo sapiens
aagcctgtttaagagaca

SEQ ID NO: 3829442 - DNA, 17 bp, Homo sapiens
aagctaataaaatatca

SEQ ID NO: 3829443 - DNA, 15 bp, Homo sapiens
aagctaatactaata

SEQ ID NO: 3829444 - DNA, 12 bp, Homo sapiens
aagctaattttc

SEQ ID NO: 3829445 - DNA, 12 bp, Homo sapiens
aagctcagaaag

SEQ ID NO: 3829446 - DNA, 13 bp, Homo sapiens
aagctgctgtctc

SEQ ID NO: 3829447 - DNA, 15 bp, Homo sapiens
aagctgctgtctcta

SEQ ID NO: 3829448 - DNA, 15 bp, Homo sapiens
aagctgggagggagg

SEQ ID NO: 3829449 - DNA, 15 bp, Homo sapiens
aagcttattaatgct

SEQ ID NO: 3829450 - DNA, 18 bp, Homo sapiens
aagcttggctgctcagtt

SEQ ID NO: 3829451 - DNA, 10 bp, Homo sapiens
aagctttact

SEQ ID NO: 3829452 - DNA, 20 bp, Homo sapiens
aaggaaaaacacaagcaaaa

SEQ ID NO: 3829453 - DNA, 11 bp, Homo sapiens
aaggagagaaa

SEQ ID NO: 3829454 - DNA, 16 bp, Homo sapiens
aaggagcagaataaat

SEQ ID NO: 3829455 - DNA, 18 bp, Homo sapiens
aaggagcagaataaatgt

SEQ ID NO: 3829456 - DNA, 16 bp, Homo sapiens
aaggagctttgctctt

SEQ ID NO: 3829457 - DNA, 23 bp, Homo sapiens
aaggataaagttggtaaaccttt

SEQ ID NO: 3829458 - DNA, 23 bp, Homo sapiens
aaggatgtcgggagcatcctgct

SEQ ID NO: 3829459 - DNA, 16 bp, Homo sapiens
aaggattggatgattg

SEQ ID NO: 3829460 - DNA, 21 bp, Homo sapiens
aaggcaaattgattcaaatgt

SEQ ID NO: 3829461 - DNA, 13 bp, Homo sapiens
aaggcaagagggg

SEQ ID NO: 3829462 - DNA, 21 bp, Homo sapiens
aaggcagccagatccccaggg

SEQ ID NO: 3829463 - DNA, 18 bp, Homo sapiens
aaggccagaaaaggcagc

SEQ ID NO: 3829464 - DNA, 21 bp, Homo sapiens
aaggccatggggcagcctcca

SEQ ID NO: 3829465 - DNA, 13 bp, Homo sapiens
aaggcccagctgc

SEQ ID NO: 3829466 - DNA, 15 bp, Homo sapiens
aaggcccagctgcca

SEQ ID NO: 3829467 - DNA, 16 bp, Homo sapiens
aaggcccagctgccag

SEQ ID NO: 3829468 - DNA, 13 bp, Homo sapiens
aaggccgagccca

SEQ ID NO: 3829469 - DNA, 16 bp, Homo sapiens
aaggctgtgccaggct

SEQ ID NO: 3829470 - DNA, 17 bp, Homo sapiens
aaggctgtgccaggctg

SEQ ID NO: 3829471 - DNA, 22 bp, Homo sapiens
aagggacacaggagaccacccc

SEQ ID NO: 3829472 - DNA, 17 bp, Homo sapiens
aagggactgagaaattt

SEQ ID NO: 3829473 - DNA, 15 bp, Homo sapiens
aagggagaagaaagg

SEQ ID NO: 3829474 - DNA, 18 bp, Homo sapiens
aagggagggtggcagaga

SEQ ID NO: 3829475 - DNA, 11 bp, Homo sapiens
aagggcagagg

SEQ ID NO: 3829476 - DNA, 16 bp, Homo sapiens
aagggcagaggcaagg

SEQ ID NO: 3829477 - DNA, 24 bp, Homo sapiens
aagggcagaggcaaggatggtggg

SEQ ID NO: 3829478 - DNA, 12 bp, Homo sapiens
aaggggagagcc

SEQ ID NO: 3829479 - DNA, 18 bp, Homo sapiens
aaggggagagcctgctgg

SEQ ID NO: 3829480 - DNA, 14 bp, Homo sapiens
aaggggtgctttta

SEQ ID NO: 3829481 - DNA, 17 bp, Homo sapiens
aaggggtgcttttatag

SEQ ID NO: 3829482 - DNA, 22 bp, Homo sapiens
aagggtggagagttgggggcca

SEQ ID NO: 3829483 - DNA, 15 bp, Homo sapiens
aaggtactggtgagg

SEQ ID NO: 3829484 - DNA, 23 bp, Homo sapiens
aaggtcctgcttgaactgctgcc

SEQ ID NO: 3829485 - DNA, 20 bp, Homo sapiens
aaggtgagtttgagctgcct

SEQ ID NO: 3829486 - DNA, 21 bp, Homo sapiens
aaggtgagtttgagctgcctt

SEQ ID NO: 3829487 - DNA, 15 bp, Homo sapiens
aaggtggggagaagg

SEQ ID NO: 3829488 - DNA, 16 bp, Homo sapiens
aaggtggggagaaggg

SEQ ID NO: 3829489 - DNA, 22 bp, Homo sapiens
aaggtgtttaagtaattgccag

SEQ ID NO: 3829490 - DNA, 21 bp, Homo sapiens
aagtaaagtattggatttttt

SEQ ID NO: 3829491 - DNA, 16 bp, Homo sapiens
aagtaagtaagaaaga

SEQ ID NO: 3829492 - DNA, 19 bp, Homo sapiens
aagtaagtttcattctaaa

SEQ ID NO: 3829493 - DNA, 13 bp, Homo sapiens
aagtaattgcatg

SEQ ID NO: 3829494 - DNA, 14 bp, Homo sapiens
aagtagattaaaat

SEQ ID NO: 3829495 - DNA, 19 bp, Homo sapiens
aagtagattaaaatatttg

SEQ ID NO: 3829496 - DNA, 12 bp, Homo sapiens
aagtatatttgt

SEQ ID NO: 3829497 - DNA, 14 bp, Homo sapiens
aagtatatttgtaa

SEQ ID NO: 3829498 - DNA, 15 bp, Homo sapiens
aagtatatttgtaaa

SEQ ID NO: 3829499 - DNA, 21 bp, Homo sapiens
aagtatatttgtaaaagctaa

SEQ ID NO: 3829500 - DNA, 12 bp, Homo sapiens
aagtattaaact

SEQ ID NO: 3829501 - DNA, 18 bp, Homo sapiens
aagtattaaactgtaaat

SEQ ID NO: 3829502 - DNA, 19 bp, Homo sapiens
aagtctctggaatttgaaa

SEQ ID NO: 3829503 - DNA, 21 bp, Homo sapiens
aagtcttgtgactagtgctga

SEQ ID NO: 3829504 - DNA, 22 bp, Homo sapiens
aagtcttgtgactagtgctgaa

SEQ ID NO: 3829505 - DNA, 21 bp, Homo sapiens
aagtcttttccacatggcaga

SEQ ID NO: 3829506 - DNA, 18 bp, Homo sapiens
aagtgaaattttaaatgc

SEQ ID NO: 3829507 - DNA, 16 bp, Homo sapiens
aagtgattctcctgcc

SEQ ID NO: 3829508 - DNA, 15 bp, Homo sapiens
aagtgccatctcaat

SEQ ID NO: 3829509 - DNA, 20 bp, Homo sapiens
aagtgccttaacctagaggg

SEQ ID NO: 3829510 - DNA, 18 bp, Homo sapiens
aagtggggtgctgggagg

SEQ ID NO: 3829511 - DNA, 16 bp, Homo sapiens
aagtgtaattagcttt

SEQ ID NO: 3829512 - DNA, 12 bp, Homo sapiens
aagtgtcttttt

SEQ ID NO: 3829513 - DNA, 16 bp, Homo sapiens
aagtgtgctttataaa

SEQ ID NO: 3829514 - DNA, 22 bp, Homo sapiens
aagtgttatttcatccagggaa

SEQ ID NO: 3829515 - DNA, 14 bp, Homo sapiens
aagttattttctac

SEQ ID NO: 3829516 - DNA, 21 bp, Homo sapiens
aagttattttctacagtggtt

SEQ ID NO: 3829517 - DNA, 12 bp, Homo sapiens
aagttgtttata

SEQ ID NO: 3829518 - DNA, 13 bp, Homo sapiens
aagtttcattcta

SEQ ID NO: 3829519 - DNA, 19 bp, Homo sapiens
aagtttcattctaaaatca

SEQ ID NO: 3829520 - DNA, 15 bp, Homo sapiens
aataaaatatcattc

SEQ ID NO: 3829521 - DNA, 17 bp, Homo sapiens
aataaaatatcattcag

SEQ ID NO: 3829522 - DNA, 13 bp, Homo sapiens
aataaagcaattt

SEQ ID NO: 3829523 - DNA, 16 bp, Homo sapiens
aataaagcaattttcc

SEQ ID NO: 3829524 - DNA, 17 bp, Homo sapiens
aataaagcaattttcct

SEQ ID NO: 3829525 - DNA, 22 bp, Homo sapiens
aataaagcaattttccttgaag

SEQ ID NO: 3829526 - DNA, 14 bp, Homo sapiens
aataaagcacgcag

SEQ ID NO: 3829527 - DNA, 10 bp, Homo sapiens
aataaagctt

SEQ ID NO: 3829528 - DNA, 19 bp, Homo sapiens
aataaagcttctctctgag

SEQ ID NO: 3829529 - DNA, 20 bp, Homo sapiens
aataaagcttctctctgagc

SEQ ID NO: 3829530 - DNA, 13 bp, Homo sapiens
aataaatatgagt

SEQ ID NO: 3829531 - DNA, 21 bp, Homo sapiens
aataaatctatatttttgtga

SEQ ID NO: 3829532 - DNA, 12 bp, Homo sapiens
aataaatgtatt

SEQ ID NO: 3829533 - DNA, 22 bp, Homo sapiens
aataaatgttttacaactcctg

SEQ ID NO: 3829534 - DNA, 16 bp, Homo sapiens
aataaattgtcatcag

SEQ ID NO: 3829535 - DNA, 24 bp, Homo sapiens
aataattaattaattaacatcaaa

SEQ ID NO: 3829536 - DNA, 15 bp, Homo sapiens
aataattttgtttta

SEQ ID NO: 3829537 - DNA, 17 bp, Homo sapiens
aatacactagttgtttc

SEQ ID NO: 3829538 - DNA, 14 bp, Homo sapiens
aatacataaagttc

SEQ ID NO: 3829539 - DNA, 16 bp, Homo sapiens
aatacatattacaaga

SEQ ID NO: 3829540 - DNA, 20 bp, Homo sapiens
aatactatagttatatagat

SEQ ID NO: 3829541 - DNA, 17 bp, Homo sapiens
aatactatatatacaat

SEQ ID NO: 3829542 - DNA, 15 bp, Homo sapiens
aatagagaatatttt

SEQ ID NO: 3829543 - DNA, 15 bp, Homo sapiens
aatagcctaaaagat

SEQ ID NO: 3829544 - DNA, 21 bp, Homo sapiens
aatagcttatgtacaaaactt

SEQ ID NO: 3829545 - DNA, 16 bp, Homo sapiens
aatataagtttctttg

SEQ ID NO: 3829546 - DNA, 23 bp, Homo sapiens
aatatataaacaaacaaacaaaa

SEQ ID NO: 3829547 - DNA, 12 bp, Homo sapiens
aatatatataaa

SEQ ID NO: 3829548 - DNA, 14 bp, Homo sapiens
aatatatatatcct

SEQ ID NO: 3829549 - DNA, 13 bp, Homo sapiens
aatatatgcctta

SEQ ID NO: 3829550 - DNA, 21 bp, Homo sapiens
aatatatgccttactattgta

SEQ ID NO: 3829551 - DNA, 23 bp, Homo sapiens
aatatatgccttactattgtatt

SEQ ID NO: 3829552 - DNA, 22 bp, Homo sapiens
aatatattgtgttttaacacca

SEQ ID NO: 3829553 - DNA, 15 bp, Homo sapiens
aatatcattcagcaa

SEQ ID NO: 3829554 - DNA, 16 bp, Homo sapiens
aatatcattcagcaac

SEQ ID NO: 3829555 - DNA, 14 bp, Homo sapiens
aatatgatttgcat

SEQ ID NO: 3829556 - DNA, 16 bp, Homo sapiens
aatatgatttgcattt

SEQ ID NO: 3829557 - DNA, 20 bp, Homo sapiens
aatatgatttgcatttttta

SEQ ID NO: 3829558 - DNA, 20 bp, Homo sapiens
aatatggttttgttttcaat

SEQ ID NO: 3829559 - DNA, 18 bp, Homo sapiens
aatatgtgccttctagaa

SEQ ID NO: 3829560 - DNA, 19 bp, Homo sapiens
aatattcatacaacaaaga

SEQ ID NO: 3829561 - DNA, 14 bp, Homo sapiens
aatatttattgctt

SEQ ID NO: 3829562 - DNA, 15 bp, Homo sapiens
aatatttattgcttt

SEQ ID NO: 3829563 - DNA, 17 bp, Homo sapiens
aatatttattgctttat

SEQ ID NO: 3829564 - DNA, 20 bp, Homo sapiens
aatatttgtctgtgtgctac

SEQ ID NO: 3829565 - DNA, 23 bp, Homo sapiens
aatatttgtctgtgtgctactaa

SEQ ID NO: 3829566 - DNA, 23 bp, Homo sapiens
agaaagattgtaaactaaagtgt

SEQ ID NO: 3829567 - DNA, 17 bp, Homo sapiens
agaaagcacctgttttt

SEQ ID NO: 3829568 - DNA, 18 bp, Homo sapiens
agaaagcacctgttttta

SEQ ID NO: 3829569 - DNA, 11 bp, Homo sapiens
agaaaggctgc

SEQ ID NO: 3829570 - DNA, 12 bp, Homo sapiens
agaaaggctgca

SEQ ID NO: 3829571 - DNA, 20 bp, Homo sapiens
agaaaggtgattccaggagg

SEQ ID NO: 3829572 - DNA, 20 bp, Homo sapiens
agaaagtgggtgagatgctg

SEQ ID NO: 3829573 - DNA, 21 bp, Homo sapiens
agaaagtgggtgagatgctgg

SEQ ID NO: 3829574 - DNA, 14 bp, Homo sapiens
agaaataaatctat

SEQ ID NO: 3829575 - DNA, 22 bp, Homo sapiens
agaaattatgtgccagatttat

SEQ ID NO: 3829576 - DNA, 17 bp, Homo sapiens
agaaatttataaacttt

SEQ ID NO: 3829577 - DNA, 20 bp, Homo sapiens
agaaattttattagacattc

SEQ ID NO: 3829578 - DNA, 19 bp, Homo sapiens
agaacacagaaagcctatc

SEQ ID NO: 3829579 - DNA, 21 bp, Homo sapiens
agaacacagaaagcctatcaa

SEQ ID NO: 3829580 - DNA, 20 bp, Homo sapiens
agaacgttccctttggggat

SEQ ID NO: 3829581 - DNA, 22 bp, Homo sapiens
agaactctgcttactaatgtat

SEQ ID NO: 3829582 - DNA, 17 bp, Homo sapiens
agaagaagctgggaggg

SEQ ID NO: 3829583 - DNA, 15 bp, Homo sapiens
agaagagaggagagg

SEQ ID NO: 3829584 - DNA, 16 bp, Homo sapiens
agaagagaggagagga

SEQ ID NO: 3829585 - DNA, 22 bp, Homo sapiens
agaagagaggagaggagagagg

SEQ ID NO: 3829586 - DNA, 20 bp, Homo sapiens
agaagccaagggacacagga

SEQ ID NO: 3829587 - DNA, 22 bp, Homo sapiens
agaagccaagggacacaggaga

SEQ ID NO: 3829588 - DNA, 13 bp, Homo sapiens
agaagctccgggt

SEQ ID NO: 3829589 - DNA, 19 bp, Homo sapiens
agaaggagagaaagtgggt

SEQ ID NO: 3829590 - DNA, 21 bp, Homo sapiens
agaaggagcagaataaatgtt

SEQ ID NO: 3829591 - DNA, 16 bp, Homo sapiens
agaagggagaagaaag

SEQ ID NO: 3829592 - DNA, 23 bp, Homo sapiens
agaaggtattctgaccttgtgaa

SEQ ID NO: 3829593 - DNA, 11 bp, Homo sapiens
agaagtgccat

SEQ ID NO: 3829594 - DNA, 13 bp, Homo sapiens
agaagttaccaaa

SEQ ID NO: 3829595 - DNA, 14 bp, Homo sapiens
agaataaaattttt

SEQ ID NO: 3829596 - DNA, 11 bp, Homo sapiens
agaataaagca

SEQ ID NO: 3829597 - DNA, 19 bp, Homo sapiens
agaataaagcaattttcct

SEQ ID NO: 3829598 - DNA, 23 bp, Homo sapiens
agaataaagcaattttccttgaa

SEQ ID NO: 3829599 - DNA, 15 bp, Homo sapiens
agaataaatgtttta

SEQ ID NO: 3829600 - DNA, 17 bp, Homo sapiens
agaataaatgttttaca

SEQ ID NO: 3829601 - DNA, 15 bp, Homo sapiens
agaatttaaaaaagt

SEQ ID NO: 3829602 - DNA, 13 bp, Homo sapiens
agacaaaatttag

SEQ ID NO: 3829603 - DNA, 19 bp, Homo sapiens
agacaaaatttagatttaa

SEQ ID NO: 3829604 - DNA, 22 bp, Homo sapiens
agacacaagtggccttaagtct

SEQ ID NO: 3829605 - DNA, 11 bp, Homo sapiens
agacacattca

SEQ ID NO: 3829606 - DNA, 19 bp, Homo sapiens
agacagagaccctctgcca

SEQ ID NO: 3829607 - DNA, 18 bp, Homo sapiens
agacagccccagagcagg

SEQ ID NO: 3829608 - DNA, 19 bp, Homo sapiens
agacagccccagagcaggg

SEQ ID NO: 3829609 - DNA, 20 bp, Homo sapiens
agacagccccagagcagggt

SEQ ID NO: 3829610 - DNA, 19 bp, Homo sapiens
agacaggcacaaaatgtga

SEQ ID NO: 3829611 - DNA, 11 bp, Homo sapiens
agacagggctc

SEQ ID NO: 3829612 - DNA, 13 bp, Homo sapiens
agacagggctcca

SEQ ID NO: 3829613 - DNA, 13 bp, Homo sapiens
agacataatttaa

SEQ ID NO: 3829614 - DNA, 17 bp, Homo sapiens
agacatctcaaatacag

SEQ ID NO: 3829615 - DNA, 20 bp, Homo sapiens
agacatggaccttctctcca

SEQ ID NO: 3829616 - DNA, 16 bp, Homo sapiens
agaccctctgccacca

SEQ ID NO: 3829617 - DNA, 21 bp, Homo sapiens
agaccctctgccaccagagac

SEQ ID NO: 3829618 - DNA, 20 bp, Homo sapiens
agaccctgggtgggctctgt

SEQ ID NO: 3829619 - DNA, 22 bp, Homo sapiens
agaccctgggtgggctctgtgc

SEQ ID NO: 3829620 - DNA, 16 bp, Homo sapiens
agaccgtcctcacccc

SEQ ID NO: 3829621 - DNA, 20 bp, Homo sapiens
agacctccccagcccctagc

SEQ ID NO: 3829622 - DNA, 15 bp, Homo sapiens
agacctctcccaccc

SEQ ID NO: 3829623 - DNA, 17 bp, Homo sapiens
agacctctgagaccaaa

SEQ ID NO: 3829624 - DNA, 20 bp, Homo sapiens
agacctgctgtaataaatgt

SEQ ID NO: 3829625 - DNA, 15 bp, Homo sapiens
agaccttgtgtgtat

SEQ ID NO: 3829626 - DNA, 17 bp, Homo sapiens
agacctttgtctgaagg

SEQ ID NO: 3829627 - DNA, 13 bp, Homo sapiens
agactagatttca

SEQ ID NO: 3829628 - DNA, 16 bp, Homo sapiens
agactagatttcaagc

SEQ ID NO: 3829629 - DNA, 12 bp, Homo sapiens
agactccaggcc

SEQ ID NO: 3829630 - DNA, 18 bp, Homo sapiens
agactggtccacagggct

SEQ ID NO: 3829631 - DNA, 13 bp, Homo sapiens
agagaaagccagg

SEQ ID NO: 3829632 - DNA, 14 bp, Homo sapiens
agagaaagccaggc

SEQ ID NO: 3829633 - DNA, 17 bp, Homo sapiens
agagaaagccaggcagg

SEQ ID NO: 3829634 - DNA, 19 bp, Homo sapiens
agagaaagccaggcaggta

SEQ ID NO: 3829635 - DNA, 21 bp, Homo sapiens
agagaagcctatttttatatt

SEQ ID NO: 3829636 - DNA, 23 bp, Homo sapiens
agagaagcctatttttatatttt

SEQ ID NO: 3829637 - DNA, 18 bp, Homo sapiens
agagacacaagtggcctt

SEQ ID NO: 3829638 - DNA, 19 bp, Homo sapiens
agagacacaagtggcctta

SEQ ID NO: 3829639 - DNA, 19 bp, Homo sapiens
agagaccctctgccaccag

SEQ ID NO: 3829640 - DNA, 23 bp, Homo sapiens
agagaccctctgccaccagagac

SEQ ID NO: 3829641 - DNA, 15 bp, Homo sapiens
agagagaaagccagg

SEQ ID NO: 3829642 - DNA, 14 bp, Homo sapiens
agagagagaggaca

SEQ ID NO: 3829643 - DNA, 15 bp, Homo sapiens
agagagagaggacag

SEQ ID NO: 3829644 - DNA, 12 bp, Homo sapiens
agagagagggcg

SEQ ID NO: 3829645 - DNA, 16 bp, Homo sapiens
agagagagggcgccca

SEQ ID NO: 3829646 - DNA, 17 bp, Homo sapiens
agagaggacctccatgc

SEQ ID NO: 3829647 - DNA, 13 bp, Homo sapiens
agagaggagagga

SEQ ID NO: 3829648 - DNA, 15 bp, Homo sapiens
agagaggcagagagc

SEQ ID NO: 3829649 - DNA, 16 bp, Homo sapiens
agagaggcagagagcg

SEQ ID NO: 3829650 - DNA, 12 bp, Homo sapiens
agagagggcgcc

SEQ ID NO: 3829651 - DNA, 13 bp, Homo sapiens
agagagggcgccc

SEQ ID NO: 3829652 - DNA, 19 bp, Homo sapiens
agagagggcgcccagccca

SEQ ID NO: 3829653 - DNA, 12 bp, Homo sapiens
agagatggctcc

SEQ ID NO: 3829654 - DNA, 19 bp, Homo sapiens
agagatgggaatgaggtgg

SEQ ID NO: 3829655 - DNA, 14 bp, Homo sapiens
agagcaagtctgca

SEQ ID NO: 3829656 - DNA, 20 bp, Homo sapiens
agagcaggctttgtgagaga

SEQ ID NO: 3829657 - DNA, 19 bp, Homo sapiens
agagccaggcacacactgt

SEQ ID NO: 3829658 - DNA, 14 bp, Homo sapiens
agagcggtctcagg

SEQ ID NO: 3829659 - DNA, 13 bp, Homo sapiens
agagctggcagtg

SEQ ID NO: 3829660 - DNA, 18 bp, Homo sapiens
agagctggggctgaggga

SEQ ID NO: 3829661 - DNA, 21 bp, Homo sapiens
agagctggggctgagggatgg

SEQ ID NO: 3829662 - DNA, 20 bp, Homo sapiens
agagctttattgctgcattt

SEQ ID NO: 3829663 - DNA, 15 bp, Homo sapiens
agaggacctccatgc

SEQ ID NO: 3829664 - DNA, 17 bp, Homo sapiens
agaggacctccatgccc

SEQ ID NO: 3829665 - DNA, 12 bp, Homo sapiens
agaggagaggag

SEQ ID NO: 3829666 - DNA, 15 bp, Homo sapiens
agaggagaggagaga

SEQ ID NO: 3829667 - DNA, 17 bp, Homo sapiens
agaggagaggagagagg

SEQ ID NO: 3829668 - DNA, 14 bp, Homo sapiens
agaggcaaggatgg

SEQ ID NO: 3829669 - DNA, 12 bp, Homo sapiens
agaggcagagag

SEQ ID NO: 3829670 - DNA, 14 bp, Homo sapiens
agaggcagagagcg

SEQ ID NO: 3829671 - DNA, 23 bp, Homo sapiens
agaggcagagagcggtctcaggc

SEQ ID NO: 3829672 - DNA, 17 bp, Homo sapiens
agaggctagcttctgct

SEQ ID NO: 3829673 - DNA, 16 bp, Homo sapiens
agaggcttctccgcca

SEQ ID NO: 3829674 - DNA, 17 bp, Homo sapiens
agaggcttctccgccag

SEQ ID NO: 3829675 - DNA, 23 bp, Homo sapiens
agaggcttctccgccagcctcct

SEQ ID NO: 3829676 - DNA, 12 bp, Homo sapiens
agagggagagag

SEQ ID NO: 3829677 - DNA, 19 bp, Homo sapiens
agagggcgcccagcccagg

SEQ ID NO: 3829678 - DNA, 21 bp, Homo sapiens
agagggcgcccagcccaggcc

SEQ ID NO: 3829679 - DNA, 22 bp, Homo sapiens
agagggcgcccagcccaggcct

SEQ ID NO: 3829680 - DNA, 12 bp, Homo sapiens
agagggggtgga

SEQ ID NO: 3829681 - DNA, 19 bp, Homo sapiens
agagggggtggaggggtgt

SEQ ID NO: 3829682 - DNA, 12 bp, Homo sapiens
agaggtgcctgg

SEQ ID NO: 3829683 - DNA, 21 bp, Homo sapiens
agaggtgcctgggaggagtgg

SEQ ID NO: 3829684 - DNA, 22 bp, Homo sapiens
agaggtgcctgggaggagtggc

SEQ ID NO: 3829685 - DNA, 14 bp, Homo sapiens
agagtgggttttgt

SEQ ID NO: 3829686 - DNA, 15 bp, Homo sapiens
agagtgggttttgtc

SEQ ID NO: 3829687 - DNA, 19 bp, Homo sapiens
agagtgggttttgtccatt

SEQ ID NO: 3829688 - DNA, 13 bp, Homo sapiens
agagtttacaaga

SEQ ID NO: 3829689 - DNA, 15 bp, Homo sapiens
agagtttacaagaaa

SEQ ID NO: 3829690 - DNA, 17 bp, Homo sapiens
agataaaggttcatgca

SEQ ID NO: 3829691 - DNA, 16 bp, Homo sapiens
agataaggccgagccc

SEQ ID NO: 3829692 - DNA, 20 bp, Homo sapiens
agataaggccgagcccacac

SEQ ID NO: 3829693 - DNA, 15 bp, Homo sapiens
agatccccagggcag

SEQ ID NO: 3829694 - DNA, 20 bp, Homo sapiens
agatccccagggcagcctcg

SEQ ID NO: 3829695 - DNA, 14 bp, Homo sapiens
agatctgtcctggg

SEQ ID NO: 3829696 - DNA, 21 bp, Homo sapiens
agatgaagaaggagcagaata

SEQ ID NO: 3829697 - DNA, 23 bp, Homo sapiens
agatgaatccaaatgtgaaagat

SEQ ID NO: 3829698 - DNA, 17 bp, Homo sapiens
agatgaggttttggaaa

SEQ ID NO: 3829699 - DNA, 22 bp, Homo sapiens
aggtttgtaagtaagtaagaaa

SEQ ID NO: 3829700 - DNA, 15 bp, Homo sapiens
agtaagacatctcaa

SEQ ID NO: 3829701 - DNA, 17 bp, Homo sapiens
agtaagacatctcaaat

SEQ ID NO: 3829702 - DNA, 19 bp, Homo sapiens
agtaagtttcattctaaaa

SEQ ID NO: 3829703 - DNA, 15 bp, Homo sapiens
agtaataaaaagcca

SEQ ID NO: 3829704 - DNA, 23 bp, Homo sapiens
agtaattgccagcttttatacca

SEQ ID NO: 3829705 - DNA, 17 bp, Homo sapiens
agtactgctttactgtg

SEQ ID NO: 3829706 - DNA, 21 bp, Homo sapiens
agtagattaaaatatttgcct

SEQ ID NO: 3829707 - DNA, 18 bp, Homo sapiens
agtagtaccaaatgcttt

SEQ ID NO: 3829708 - DNA, 19 bp, Homo sapiens
agtagtaccaaatgcttta

SEQ ID NO: 3829709 - DNA, 21 bp, Homo sapiens
agtagtaccaaatgctttaaa

SEQ ID NO: 3829710 - DNA, 19 bp, Homo sapiens
agtagttccacacaggttt

SEQ ID NO: 3829711 - DNA, 21 bp, Homo sapiens
agtagttccacacaggtttgt

SEQ ID NO: 3829712 - DNA, 14 bp, Homo sapiens
agtataaaagacaa

SEQ ID NO: 3829713 - DNA, 14 bp, Homo sapiens
agtatataaatact

SEQ ID NO: 3829714 - DNA, 22 bp, Homo sapiens
agtatcagtcatgacagatgaa

SEQ ID NO: 3829715 - DNA, 20 bp, Homo sapiens
agtatcataatatattgtgt

SEQ ID NO: 3829716 - DNA, 16 bp, Homo sapiens
agtatctttttattca

SEQ ID NO: 3829717 - DNA, 12 bp, Homo sapiens
agtatggtgcta

SEQ ID NO: 3829718 - DNA, 16 bp, Homo sapiens
agtatggtgctaatgt

SEQ ID NO: 3829719 - DNA, 19 bp, Homo sapiens
agtatggtgctaatgtgtc

SEQ ID NO: 3829720 - DNA, 15 bp, Homo sapiens
agtattaagtgaaat

SEQ ID NO: 3829721 - DNA, 17 bp, Homo sapiens
agtattaagtgaaattt

SEQ ID NO: 3829722 - DNA, 19 bp, Homo sapiens
agtattgtgtttatgcatt

SEQ ID NO: 3829723 - DNA, 21 bp, Homo sapiens
agtcactggaggttgaagcca

SEQ ID NO: 3829724 - DNA, 22 bp, Homo sapiens
agtcactggaggttgaagccaa

SEQ ID NO: 3829725 - DNA, 21 bp, Homo sapiens
agtcagtccagctcatctgcc

SEQ ID NO: 3829726 - DNA, 13 bp, Homo sapiens
agtcagtgctgga

SEQ ID NO: 3829727 - DNA, 14 bp, Homo sapiens
agtccattctccca

SEQ ID NO: 3829728 - DNA, 15 bp, Homo sapiens
agtccgtgggctggc

SEQ ID NO: 3829729 - DNA, 12 bp, Homo sapiens
agtcctcccctc

SEQ ID NO: 3829730 - DNA, 16 bp, Homo sapiens
agtcctcccctcacag

SEQ ID NO: 3829731 - DNA, 19 bp, Homo sapiens
agtcctcccctcacagcct

SEQ ID NO: 3829732 - DNA, 20 bp, Homo sapiens
agtcctcccctcacagcctc

SEQ ID NO: 3829733 - DNA, 21 bp, Homo sapiens
agtcctcccctcacagcctct

SEQ ID NO: 3829734 - DNA, 17 bp, Homo sapiens
agtcctgcagaggattt

SEQ ID NO: 3829735 - DNA, 18 bp, Homo sapiens
agtcctgcagaggattta

SEQ ID NO: 3829736 - DNA, 22 bp, Homo sapiens
agtccttagcctgggcctcctc

SEQ ID NO: 3829737 - DNA, 21 bp, Homo sapiens
agtcgctctcatgaagccctt

SEQ ID NO: 3829738 - DNA, 19 bp, Homo sapiens
agtctccaaagtctctgga

SEQ ID NO: 3829739 - DNA, 14 bp, Homo sapiens
agtctccttggtga

SEQ ID NO: 3829740 - DNA, 22 bp, Homo sapiens
agtctgttattgttttgttaac

SEQ ID NO: 3829741 - DNA, 17 bp, Homo sapiens
agtcttatatcccaggt

SEQ ID NO: 3829742 - DNA, 22 bp, Homo sapiens
agtcttgtgactagtgctgaag

SEQ ID NO: 3829743 - DNA, 15 bp, Homo sapiens
agtgaaattttaaat

SEQ ID NO: 3829744 - DNA, 17 bp, Homo sapiens
agtgaaattttaaatgc

SEQ ID NO: 3829745 - DNA, 22 bp, Homo sapiens
agtgaaggattggatgattgtt

SEQ ID NO: 3829746 - DNA, 16 bp, Homo sapiens
agtgagtgagcctggc

SEQ ID NO: 3829747 - DNA, 14 bp, Homo sapiens
agtgatggagcaga

SEQ ID NO: 3829748 - DNA, 17 bp, Homo sapiens
agtgcataaataatttt

SEQ ID NO: 3829749 - DNA, 22 bp, Homo sapiens
agtgcataaataattttgtttt

SEQ ID NO: 3829750 - DNA, 13 bp, Homo sapiens
agtgccatggctg

SEQ ID NO: 3829751 - DNA, 20 bp, Homo sapiens
agtgccttaacctagagggt

SEQ ID NO: 3829752 - DNA, 12 bp, Homo sapiens
agtgctgaagct

SEQ ID NO: 3829753 - DNA, 15 bp, Homo sapiens
agtgctggagaaatc

SEQ ID NO: 3829754 - DNA, 15 bp, Homo sapiens
agtgctgtgagatga

SEQ ID NO: 3829755 - DNA, 21 bp, Homo sapiens
agtggccggggctgaagccac

SEQ ID NO: 3829756 - DNA, 23 bp, Homo sapiens
agtggctcaatgcaacctctgcc

SEQ ID NO: 3829757 - DNA, 22 bp, Homo sapiens
agtgggcactaagggtggagag

SEQ ID NO: 3829758 - DNA, 22 bp, Homo sapiens
agtgggctgacatcaagtgtaa

SEQ ID NO: 3829759 - DNA, 23 bp, Homo sapiens
agtgggctgacatcaagtgtaat

SEQ ID NO: 3829760 - DNA, 13 bp, Homo sapiens
agtgggtgttgca

SEQ ID NO: 3829761 - DNA, 20 bp, Homo sapiens
agtggtattatactgtagat

SEQ ID NO: 3829762 - DNA, 17 bp, Homo sapiens
agtgtaattagcttttg

SEQ ID NO: 3829763 - DNA, 20 bp, Homo sapiens
agtgtaattagcttttggag

SEQ ID NO: 3829764 - DNA, 17 bp, Homo sapiens
agtgtcaaataaacact

SEQ ID NO: 3829765 - DNA, 12 bp, Homo sapiens
agtgtcacctgc

SEQ ID NO: 3829766 - DNA, 14 bp, Homo sapiens
agtgtggcctggat

SEQ ID NO: 3829767 - DNA, 21 bp, Homo sapiens
agtgtggcctggatccatcct

SEQ ID NO: 3829768 - DNA, 23 bp, Homo sapiens
agtgtggcctggatccatcctgc

SEQ ID NO: 3829769 - DNA, 19 bp, Homo sapiens
agtgtgtgtttttcataaa

SEQ ID NO: 3829770 - DNA, 21 bp, Homo sapiens
agtgttcataaataaagtttg

SEQ ID NO: 3829771 - DNA, 12 bp, Homo sapiens
agtgttttacaa

SEQ ID NO: 3829772 - DNA, 19 bp, Homo sapiens
agtgttttacaatgatttg

SEQ ID NO: 3829773 - DNA, 14 bp, Homo sapiens
agttaaacataaat

SEQ ID NO: 3829774 - DNA, 14 bp, Homo sapiens
agttaaatatgatt

SEQ ID NO: 3829775 - DNA, 19 bp, Homo sapiens
agttaaatatgatttgcat

SEQ ID NO: 3829776 - DNA, 20 bp, Homo sapiens
agttaaatatgatttgcatt

SEQ ID NO: 3829777 - DNA, 22 bp, Homo sapiens
agttaaatatgatttgcatttt

SEQ ID NO: 3829778 - DNA, 20 bp, Homo sapiens
agttagccactgctggtgtt

SEQ ID NO: 3829779 - DNA, 15 bp, Homo sapiens
agttataaagaaaga

SEQ ID NO: 3829780 - DNA, 17 bp, Homo sapiens
agttataaagaaagatt

SEQ ID NO: 3829781 - DNA, 18 bp, Homo sapiens
agttataaagaaagattg

SEQ ID NO: 3829782 - DNA, 23 bp, Homo sapiens
agttataagaaaactacatgtaa

SEQ ID NO: 3829783 - DNA, 15 bp, Homo sapiens
agttcacagcttcac

SEQ ID NO: 3829784 - DNA, 14 bp, Homo sapiens
agttctatttgcta

SEQ ID NO: 3829785 - DNA, 16 bp, Homo sapiens
agttctctcgaatact

SEQ ID NO: 3829786 - DNA, 23 bp, Homo sapiens
agttcttacttgagtatcataat

SEQ ID NO: 3829787 - DNA, 14 bp, Homo sapiens
agttgggggccagc

SEQ ID NO: 3829788 - DNA, 15 bp, Homo sapiens
agttgggggctaggg

SEQ ID NO: 3829789 - DNA, 19 bp, Homo sapiens
agttgggggctaggggagg

SEQ ID NO: 3829790 - DNA, 14 bp, Homo sapiens
agttgtttataaaa

SEQ ID NO: 3829791 - DNA, 16 bp, Homo sapiens
agttgtttataaaaac

SEQ ID NO: 3829792 - DNA, 12 bp, Homo sapiens
agtttacaagaa

SEQ ID NO: 3829793 - DNA, 13 bp, Homo sapiens
agtttacaagaaa

SEQ ID NO: 3829794 - DNA, 15 bp, Homo sapiens
agtttcaaaaactgt

SEQ ID NO: 3829795 - DNA, 17 bp, Homo sapiens
agtttccccaccagtga

SEQ ID NO: 3829796 - DNA, 22 bp, Homo sapiens
agtttccccaccagtgaatgaa

SEQ ID NO: 3829797 - DNA, 23 bp, Homo sapiens
agtttccccaccagtgaatgaaa

SEQ ID NO: 3829798 - DNA, 15 bp, Homo sapiens
agtttcgttttcaaa

SEQ ID NO: 3829799 - DNA, 16 bp, Homo sapiens
agtttcgttttcaaaa

SEQ ID NO: 3829800 - DNA, 11 bp, Homo sapiens
agtttctgagt

SEQ ID NO: 3829801 - DNA, 15 bp, Homo sapiens
agtttgagctgcctt

SEQ ID NO: 3829802 - DNA, 15 bp, Homo sapiens
agttttactgcattt

SEQ ID NO: 3829803 - DNA, 21 bp, Homo sapiens
agttttactgcattttcacaa

SEQ ID NO: 3829804 - DNA, 18 bp, Homo sapiens
agttttattttctaaatt

SEQ ID NO: 3829805 - DNA, 18 bp, Homo sapiens
agttttcatttcatatat

SEQ ID NO: 3829806 - DNA, 21 bp, Homo sapiens
ataaaaaaaagttgtttataa

SEQ ID NO: 3829807 - DNA, 16 bp, Homo sapiens
ataaaaagaaagctaa

SEQ ID NO: 3829808 - DNA, 18 bp, Homo sapiens
ataaaaagccaccacaca

SEQ ID NO: 3829809 - DNA, 18 bp, Homo sapiens
ataaaagcctgtttaaga

SEQ ID NO: 3829810 - DNA, 19 bp, Homo sapiens
ataaaagcctgtttaagag

SEQ ID NO: 3829811 - DNA, 13 bp, Homo sapiens
ataaaatatcatt

SEQ ID NO: 3829812 - DNA, 20 bp, Homo sapiens
ataaaatatcattcagcaac

SEQ ID NO: 3829813 - DNA, 19 bp, Homo sapiens
ataaaatgatatattaaac

SEQ ID NO: 3829814 - DNA, 22 bp, Homo sapiens
ataaaatgatatattaaacctt

SEQ ID NO: 3829815 - DNA, 13 bp, Homo sapiens
ataaacaaacaaa

SEQ ID NO: 3829816 - DNA, 14 bp, Homo sapiens
ataaacaaacaaac

SEQ ID NO: 3829817 - DNA, 20 bp, Homo sapiens
ataaagagatacgaatttct

SEQ ID NO: 3829818 - DNA, 11 bp, Homo sapiens
ataaagcaatt

SEQ ID NO: 3829819 - DNA, 14 bp, Homo sapiens
ataaagcaattttc

SEQ ID NO: 3829820 - DNA, 23 bp, Homo sapiens
ataaagcaattttccttgaagcc

SEQ ID NO: 3829821 - DNA, 20 bp, Homo sapiens
ataaagcacgcagttatgtt

SEQ ID NO: 3829822 - DNA, 13 bp, Homo sapiens
ataaagcttctct

SEQ ID NO: 3829823 - DNA, 17 bp, Homo sapiens
ataaagcttctctctga

SEQ ID NO: 3829824 - DNA, 21 bp, Homo sapiens
ataaagcttctctctgagctg

SEQ ID NO: 3829825 - DNA, 14 bp, Homo sapiens
ataaaggccttttt

SEQ ID NO: 3829826 - DNA, 17 bp, Homo sapiens
ataaaggctctggaagc

SEQ ID NO: 3829827 - DNA, 13 bp, Homo sapiens
ataaataaatata

SEQ ID NO: 3829828 - DNA, 14 bp, Homo sapiens
ataaataaatatat

SEQ ID NO: 3829829 - DNA, 20 bp, Homo sapiens
ataaataattttgttttaat

SEQ ID NO: 3829830 - DNA, 21 bp, Homo sapiens
ataaatatatataaatatata

SEQ ID NO: 3829831 - DNA, 12 bp, Homo sapiens
cagcccaggcct

SEQ ID NO: 3829832 - DNA, 22 bp, Homo sapiens
cagcccaggcctggtggagggg

SEQ ID NO: 3829833 - DNA, 15 bp, Homo sapiens
cagccccagagcagg

SEQ ID NO: 3829834 - DNA, 15 bp, Homo sapiens
cagccccgtgccagg

SEQ ID NO: 3829835 - DNA, 12 bp, Homo sapiens
cagcccctagcc

SEQ ID NO: 3829836 - DNA, 16 bp, Homo sapiens
cagcccctagcccagg

SEQ ID NO: 3829837 - DNA, 13 bp, Homo sapiens
cagccctgagcta

SEQ ID NO: 3829838 - DNA, 23 bp, Homo sapiens
cagccctgagctggcgtcacctg

SEQ ID NO: 3829839 - DNA, 22 bp, Homo sapiens
cagccctggaggtgccagcaaa

SEQ ID NO: 3829840 - DNA, 13 bp, Homo sapiens
cagcccttggcca

SEQ ID NO: 3829841 - DNA, 16 bp, Homo sapiens
cagcctcagtcctccc

SEQ ID NO: 3829842 - DNA, 19 bp, Homo sapiens
cagcctcagtcctcccctc

SEQ ID NO: 3829843 - DNA, 22 bp, Homo sapiens
cagcctcagtcctcccctcaca

SEQ ID NO: 3829844 - DNA, 13 bp, Homo sapiens
cagcctccagtct

SEQ ID NO: 3829845 - DNA, 16 bp, Homo sapiens
cagcctccagtctgct

SEQ ID NO: 3829846 - DNA, 15 bp, Homo sapiens
cagcctctgacccct

SEQ ID NO: 3829847 - DNA, 18 bp, Homo sapiens
cagcctctgacccctcct

SEQ ID NO: 3829848 - DNA, 20 bp, Homo sapiens
cagcctctgacccctcctca

SEQ ID NO: 3829849 - DNA, 17 bp, Homo sapiens
cagcctgtcggccacac

SEQ ID NO: 3829850 - DNA, 19 bp, Homo sapiens
cagcctgtcggccacaccc

SEQ ID NO: 3829851 - DNA, 22 bp, Homo sapiens
cagcctgtcggccacaccccag

SEQ ID NO: 3829852 - DNA, 24 bp, Homo sapiens
cagcctgtcggccacaccccagac

SEQ ID NO: 3829853 - DNA, 23 bp, Homo sapiens
cagcctgtgtgcagtggagctgg

SEQ ID NO: 3829854 - DNA, 16 bp, Homo sapiens
cagccttcttccatcc

SEQ ID NO: 3829855 - DNA, 23 bp, Homo sapiens
cagccttcttccatcccaggaca

SEQ ID NO: 3829856 - DNA, 16 bp, Homo sapiens
cagctatttttactag

SEQ ID NO: 3829857 - DNA, 15 bp, Homo sapiens
cagctccagatgttt

SEQ ID NO: 3829858 - DNA, 22 bp, Homo sapiens
cagctcctccgtgcttcctcag

SEQ ID NO: 3829859 - DNA, 13 bp, Homo sapiens
cagctcctgtttg

SEQ ID NO: 3829860 - DNA, 12 bp, Homo sapiens
cagctccttccc

SEQ ID NO: 3829861 - DNA, 18 bp, Homo sapiens
cagctccttgggaggaag

SEQ ID NO: 3829862 - DNA, 20 bp, Homo sapiens
cagctccttgggaggaagca

SEQ ID NO: 3829863 - DNA, 21 bp, Homo sapiens
cagctccttgggaggaagcag

SEQ ID NO: 3829864 - DNA, 13 bp, Homo sapiens
cagctgaagcctg

SEQ ID NO: 3829865 - DNA, 16 bp, Homo sapiens
cagctgagtcctgggg

SEQ ID NO: 3829866 - DNA, 16 bp, Homo sapiens
cagctgatgactcaag

SEQ ID NO: 3829867 - DNA, 22 bp, Homo sapiens
cagctgatgactcaagattccc

SEQ ID NO: 3829868 - DNA, 12 bp, Homo sapiens
cagctgccaggg

SEQ ID NO: 3829869 - DNA, 24 bp, Homo sapiens
cagctgccagggaagacagagcag

SEQ ID NO: 3829870 - DNA, 17 bp, Homo sapiens
cagctgcgcttgctttt

SEQ ID NO: 3829871 - DNA, 19 bp, Homo sapiens
cagctggactgcattgaag

SEQ ID NO: 3829872 - DNA, 19 bp, Homo sapiens
cagctgggctagaggctga

SEQ ID NO: 3829873 - DNA, 24 bp, Homo sapiens
cagctgggctagaggctgagcacc

SEQ ID NO: 3829874 - DNA, 15 bp, Homo sapiens
cagctgtgagccttg

SEQ ID NO: 3829875 - DNA, 20 bp, Homo sapiens
caggaaactccacatctgcc

SEQ ID NO: 3829876 - DNA, 21 bp, Homo sapiens
caggaaactccacatctgcct

SEQ ID NO: 3829877 - DNA, 13 bp, Homo sapiens
caggaactctgtg

SEQ ID NO: 3829878 - DNA, 16 bp, Homo sapiens
caggaactctgtgtga

SEQ ID NO: 3829879 - DNA, 20 bp, Homo sapiens
caggaactctgtgtgagaga

SEQ ID NO: 3829880 - DNA, 21 bp, Homo sapiens
caggaactctgtgtgagagag

SEQ ID NO: 3829881 - DNA, 21 bp, Homo sapiens
caggacacaacgctgctgcct

SEQ ID NO: 3829882 - DNA, 14 bp, Homo sapiens
caggacaccacacc

SEQ ID NO: 3829883 - DNA, 17 bp, Homo sapiens
caggacaccacacccag

SEQ ID NO: 3829884 - DNA, 19 bp, Homo sapiens
caggacaccacacccagcc

SEQ ID NO: 3829885 - DNA, 21 bp, Homo sapiens
caggacaccacacccagcctc

SEQ ID NO: 3829886 - DNA, 23 bp, Homo sapiens
caggacaccacacccagcctcag

SEQ ID NO: 3829887 - DNA, 23 bp, Homo sapiens
caggaccccaaggacctgcctcc

SEQ ID NO: 3829888 - DNA, 13 bp, Homo sapiens
caggacctgagcc

SEQ ID NO: 3829889 - DNA, 14 bp, Homo sapiens
caggacctgagcct

SEQ ID NO: 3829890 - DNA, 18 bp, Homo sapiens
caggacctgagcctggcc

SEQ ID NO: 3829891 - DNA, 14 bp, Homo sapiens
caggagaagggaca

SEQ ID NO: 3829892 - DNA, 15 bp, Homo sapiens
caggagaccaccccc

SEQ ID NO: 3829893 - DNA, 14 bp, Homo sapiens
caggagagagaaag

SEQ ID NO: 3829894 - DNA, 18 bp, Homo sapiens
caggagagagaaagccag

SEQ ID NO: 3829895 - DNA, 19 bp, Homo sapiens
caggagagagaaagccagg

SEQ ID NO: 3829896 - DNA, 24 bp, Homo sapiens
caggagatcgagaccgccctggct

SEQ ID NO: 3829897 - DNA, 17 bp, Homo sapiens
caggagattgagaagga

SEQ ID NO: 3829898 - DNA, 21 bp, Homo sapiens
caggagattgagaaggagaga

SEQ ID NO: 3829899 - DNA, 18 bp, Homo sapiens
caggaggagttagccaaa

SEQ ID NO: 3829900 - DNA, 20 bp, Homo sapiens
caggagggctttgtgtctgg

SEQ ID NO: 3829901 - DNA, 20 bp, Homo sapiens
caggaggtggaggttgcagt

SEQ ID NO: 3829902 - DNA, 15 bp, Homo sapiens
caggagttctgctca

SEQ ID NO: 3829903 - DNA, 22 bp, Homo sapiens
caggagttctgctcattctaat

SEQ ID NO: 3829904 - DNA, 20 bp, Homo sapiens
caggatcggcttcctcaggg

SEQ ID NO: 3829905 - DNA, 21 bp, Homo sapiens
caggatgacggtattatgctt

SEQ ID NO: 3829906 - DNA, 19 bp, Homo sapiens
caggatgcctgagccccct

SEQ ID NO: 3829907 - DNA, 23 bp, Homo sapiens
caggcactagcctttggctctgg

SEQ ID NO: 3829908 - DNA, 12 bp, Homo sapiens
caggcaggggtg

SEQ ID NO: 3829909 - DNA, 13 bp, Homo sapiens
caggcaggggtgg

SEQ ID NO: 3829910 - DNA, 17 bp, Homo sapiens
caggcaggggtgggggt

SEQ ID NO: 3829911 - DNA, 21 bp, Homo sapiens
caggcaggggtgggggtggag

SEQ ID NO: 3829912 - DNA, 23 bp, Homo sapiens
caggcaggggtgggggtggaggc

SEQ ID NO: 3829913 - DNA, 16 bp, Homo sapiens
caggcagttctctcga

SEQ ID NO: 3829914 - DNA, 17 bp, Homo sapiens
caggcagttctctcgaa

SEQ ID NO: 3829915 - DNA, 12 bp, Homo sapiens
caggccagcctc

SEQ ID NO: 3829916 - DNA, 16 bp, Homo sapiens
caggccagcctccgag

SEQ ID NO: 3829917 - DNA, 13 bp, Homo sapiens
caggcccaggaga

SEQ ID NO: 3829918 - DNA, 16 bp, Homo sapiens
caggccctttcctcag

SEQ ID NO: 3829919 - DNA, 17 bp, Homo sapiens
caggccctttcctcagg

SEQ ID NO: 3829920 - DNA, 16 bp, Homo sapiens
caggccgggcacagtg

SEQ ID NO: 3829921 - DNA, 19 bp, Homo sapiens
caggccgggcacagtggct

SEQ ID NO: 3829922 - DNA, 16 bp, Homo sapiens
caggcctggtggaggg

SEQ ID NO: 3829923 - DNA, 21 bp, Homo sapiens
caggcctggtggagggggagg

SEQ ID NO: 3829924 - DNA, 21 bp, Homo sapiens
caggctatggttgccacccca

SEQ ID NO: 3829925 - DNA, 13 bp, Homo sapiens
caggctcactgcc

SEQ ID NO: 3829926 - DNA, 18 bp, Homo sapiens
caggctcactgccaggcc

SEQ ID NO: 3829927 - DNA, 16 bp, Homo sapiens
caggctgctccttctc

SEQ ID NO: 3829928 - DNA, 19 bp, Homo sapiens
caggctggagtgcagtggc

SEQ ID NO: 3829929 - DNA, 20 bp, Homo sapiens
caggctggagtgcagtggct

SEQ ID NO: 3829930 - DNA, 15 bp, Homo sapiens
caggctggcccccac

SEQ ID NO: 3829931 - DNA, 23 bp, Homo sapiens
caggctggctcctggggatggcc

SEQ ID NO: 3829932 - DNA, 13 bp, Homo sapiens
caggctgggaggc

SEQ ID NO: 3829933 - DNA, 22 bp, Homo sapiens
caggcttgcattaaaagactgt

SEQ ID NO: 3829934 - DNA, 14 bp, Homo sapiens
caggctttgtgaga

SEQ ID NO: 3829935 - DNA, 17 bp, Homo sapiens
cagggaagacagagcag

SEQ ID NO: 3829936 - DNA, 20 bp, Homo sapiens
cagggaagacagagcaggct

SEQ ID NO: 3829937 - DNA, 17 bp, Homo sapiens
cagggaggaagaagctt

SEQ ID NO: 3829938 - DNA, 15 bp, Homo sapiens
cagggcagcctcgtt

SEQ ID NO: 3829939 - DNA, 16 bp, Homo sapiens
cagggccaagccggcc

SEQ ID NO: 3829940 - DNA, 23 bp, Homo sapiens
cagggccaagccggcccaaccca

SEQ ID NO: 3829941 - DNA, 14 bp, Homo sapiens
cagggccaggactg

SEQ ID NO: 3829942 - DNA, 20 bp, Homo sapiens
cagggccaggactgagcccc

SEQ ID NO: 3829943 - DNA, 14 bp, Homo sapiens
cagggctccagcct

SEQ ID NO: 3829944 - DNA, 22 bp, Homo sapiens
cagggctccagcctgtcggcca

SEQ ID NO: 3829945 - DNA, 16 bp, Homo sapiens
cagggctcctgaagga

SEQ ID NO: 3829946 - DNA, 18 bp, Homo sapiens
caggggcgctggctgcac

SEQ ID NO: 3829947 - DNA, 19 bp, Homo sapiens
caggggctacaagagggaa

SEQ ID NO: 3829948 - DNA, 13 bp, Homo sapiens
caggggctctgga

SEQ ID NO: 3829949 - DNA, 15 bp, Homo sapiens
caggggctctggaga

SEQ ID NO: 3829950 - DNA, 18 bp, Homo sapiens
caggggctctggagagaa

SEQ ID NO: 3829951 - DNA, 12 bp, Homo sapiens
caggggctggct

SEQ ID NO: 3829952 - DNA, 13 bp, Homo sapiens
caggggctggctt

SEQ ID NO: 3829953 - DNA, 23 bp, Homo sapiens
cagggtgttgggatactgcaggg

SEQ ID NO: 3829954 - DNA, 15 bp, Homo sapiens
cagggtttcaccatg

SEQ ID NO: 3829955 - DNA, 19 bp, Homo sapiens
caggtacaaccggatgcca

SEQ ID NO: 3829956 - DNA, 13 bp, Homo sapiens
caggtaccagctg

SEQ ID NO: 3829957 - DNA, 12 bp, Homo sapiens
caggtagccagg

SEQ ID NO: 3829958 - DNA, 17 bp, Homo sapiens
caggtctccccaggccc

SEQ ID NO: 3829959 - DNA, 15 bp, Homo sapiens
cagtaagagtttaca

SEQ ID NO: 3829960 - DNA, 21 bp, Homo sapiens
cagtaagagtttacaagaaat

SEQ ID NO: 3829961 - DNA, 16 bp, Homo sapiens
cagtaataaaaagcca

SEQ ID NO: 3829962 - DNA, 19 bp, Homo sapiens
cagtaataaaaagccacca

SEQ ID NO: 3829963 - DNA, 21 bp, Homo sapiens
cccagtcccaccctgctgctg

SEQ ID NO: 3829964 - DNA, 20 bp, Homo sapiens
cccagtccccacccctgccc

SEQ ID NO: 3829965 - DNA, 14 bp, Homo sapiens
cccatccctgcctg

SEQ ID NO: 3829966 - DNA, 23 bp, Homo sapiens
cccatcgccagctgatgactcaa

SEQ ID NO: 3829967 - DNA, 19 bp, Homo sapiens
cccatctgcaccccttctc

SEQ ID NO: 3829968 - DNA, 22 bp, Homo sapiens
cccatcttgggggtcacccatg

SEQ ID NO: 3829969 - DNA, 18 bp, Homo sapiens
cccatgctggagcctgtg

SEQ ID NO: 3829970 - DNA, 12 bp, Homo sapiens
cccatggcctca

SEQ ID NO: 3829971 - DNA, 23 bp, Homo sapiens
cccatgtcccagcctggcctgtg

SEQ ID NO: 3829972 - DNA, 18 bp, Homo sapiens
cccattctacttgctctg

SEQ ID NO: 3829973 - DNA, 18 bp, Homo sapiens
cccatttatccacctcca

SEQ ID NO: 3829974 - DNA, 17 bp, Homo sapiens
cccatttcccatctgca

SEQ ID NO: 3829975 - DNA, 15 bp, Homo sapiens
ccccaaatcaataca

SEQ ID NO: 3829976 - DNA, 16 bp, Homo sapiens
ccccaatttcccagac

SEQ ID NO: 3829977 - DNA, 16 bp, Homo sapiens
ccccacccccagccag

SEQ ID NO: 3829978 - DNA, 17 bp, Homo sapiens
ccccacccccagccagg

SEQ ID NO: 3829979 - DNA, 19 bp, Homo sapiens
ccccaccccggggaccctg

SEQ ID NO: 3829980 - DNA, 17 bp, Homo sapiens
ccccacccctgccccca

SEQ ID NO: 3829981 - DNA, 23 bp, Homo sapiens
ccccacccctgcccccagccccg

SEQ ID NO: 3829982 - DNA, 12 bp, Homo sapiens
ccccactccagc

SEQ ID NO: 3829983 - DNA, 15 bp, Homo sapiens
ccccactccagcaga

SEQ ID NO: 3829984 - DNA, 23 bp, Homo sapiens
ccccagacagggctccagcctgt

SEQ ID NO: 3829985 - DNA, 16 bp, Homo sapiens
ccccagatctgtcctg

SEQ ID NO: 3829986 - DNA, 20 bp, Homo sapiens
ccccagatctgtcctggggg

SEQ ID NO: 3829987 - DNA, 11 bp, Homo sapiens
ccccagccagg

SEQ ID NO: 3829988 - DNA, 15 bp, Homo sapiens
ccccagccaggctat

SEQ ID NO: 3829989 - DNA, 22 bp, Homo sapiens
ccccagcccctagcccaggaga

SEQ ID NO: 3829990 - DNA, 15 bp, Homo sapiens
ccccagctgtgagcc

SEQ ID NO: 3829991 - DNA, 19 bp, Homo sapiens
ccccagctgtgagccttgg

SEQ ID NO: 3829992 - DNA, 18 bp, Homo sapiens
ccccaggcagctcctgtt

SEQ ID NO: 3829993 - DNA, 12 bp, Homo sapiens
ccccagggcagc

SEQ ID NO: 3829994 - DNA, 16 bp, Homo sapiens
ccccagggcagcctcg

SEQ ID NO: 3829995 - DNA, 19 bp, Homo sapiens
ccccatcgccagctgatga

SEQ ID NO: 3829996 - DNA, 12 bp, Homo sapiens
ccccatgctgga

SEQ ID NO: 3829997 - DNA, 15 bp, Homo sapiens
ccccatgctggagcc

SEQ ID NO: 3829998 - DNA, 20 bp, Homo sapiens
ccccatgctggagcctgtgt

SEQ ID NO: 3829999 - DNA, 17 bp, Homo sapiens
ccccatttatccacctc

SEQ ID NO: 3830000 - DNA, 18 bp, Homo sapiens
ccccatttcccatctgca

SEQ ID NO: 3830001 - DNA, 19 bp, Homo sapiens
ccccatttcccatctgcac

SEQ ID NO: 3830002 - DNA, 22 bp, Homo sapiens
ccccatttcccatctgcacccc

SEQ ID NO: 3830003 - DNA, 11 bp, Homo sapiens
cccccagcacc

SEQ ID NO: 3830004 - DNA, 13 bp, Homo sapiens
cccccagcaccct

SEQ ID NO: 3830005 - DNA, 13 bp, Homo sapiens
cccccagccaggc

SEQ ID NO: 3830006 - DNA, 13 bp, Homo sapiens
cccccgagcttgc

SEQ ID NO: 3830007 - DNA, 15 bp, Homo sapiens
cccccgagcttgcct

SEQ ID NO: 3830008 - DNA, 22 bp, Homo sapiens
cccccgagcttgcctcagggcc

SEQ ID NO: 3830009 - DNA, 20 bp, Homo sapiens
ccccctgagttcccaaaggg

SEQ ID NO: 3830010 - DNA, 12 bp, Homo sapiens
ccccctgccctg

SEQ ID NO: 3830011 - DNA, 14 bp, Homo sapiens
ccccctgccctgca

SEQ ID NO: 3830012 - DNA, 18 bp, Homo sapiens
ccccgactccctccccag

SEQ ID NO: 3830013 - DNA, 22 bp, Homo sapiens
ccccgactccctccccagatct

SEQ ID NO: 3830014 - DNA, 19 bp, Homo sapiens
ccccgatgtgagccgcctc

SEQ ID NO: 3830015 - DNA, 12 bp, Homo sapiens
ccccgcagacct

SEQ ID NO: 3830016 - DNA, 19 bp, Homo sapiens
ccccgcagacctccccagc

SEQ ID NO: 3830017 - DNA, 23 bp, Homo sapiens
ccccgcagacctccccagcccct

SEQ ID NO: 3830018 - DNA, 17 bp, Homo sapiens
ccccgcatcccctgcct

SEQ ID NO: 3830019 - DNA, 14 bp, Homo sapiens
ccccggccacctct

SEQ ID NO: 3830020 - DNA, 16 bp, Homo sapiens
ccccggggaccctgtg

SEQ ID NO: 3830021 - DNA, 12 bp, Homo sapiens
ccccggtgcctc

SEQ ID NO: 3830022 - DNA, 18 bp, Homo sapiens
cccctagcccaggagaga

SEQ ID NO: 3830023 - DNA, 18 bp, Homo sapiens
cccctcccctgctgcagg

SEQ ID NO: 3830024 - DNA, 16 bp, Homo sapiens
cccctgcagccatccc

SEQ ID NO: 3830025 - DNA, 14 bp, Homo sapiens
cccctgccctgagg

SEQ ID NO: 3830026 - DNA, 16 bp, Homo sapiens
cccctgccctgaggag

SEQ ID NO: 3830027 - DNA, 21 bp, Homo sapiens
cccctgccctgaggagggccc

SEQ ID NO: 3830028 - DNA, 22 bp, Homo sapiens
cccctgctgcaggggctctgga

SEQ ID NO: 3830029 - DNA, 23 bp, Homo sapiens
cccctgctgcaggggctctggag

SEQ ID NO: 3830030 - DNA, 17 bp, Homo sapiens
cccctgctttgccccac

SEQ ID NO: 3830031 - DNA, 14 bp, Homo sapiens
cccctgtcctcact

SEQ ID NO: 3830032 - DNA, 19 bp, Homo sapiens
ccccttctctcctccccaa

SEQ ID NO: 3830033 - DNA, 13 bp, Homo sapiens
cccgagcttgcct

SEQ ID NO: 3830034 - DNA, 14 bp, Homo sapiens
cccgagcttgcctc

SEQ ID NO: 3830035 - DNA, 21 bp, Homo sapiens
cccgagcttgcctcagggcca

SEQ ID NO: 3830036 - DNA, 12 bp, Homo sapiens
cccgcagacctc

SEQ ID NO: 3830037 - DNA, 19 bp, Homo sapiens
cccgcagacctccccagcc

SEQ ID NO: 3830038 - DNA, 15 bp, Homo sapiens
cccgcatcccctgcc

SEQ ID NO: 3830039 - DNA, 17 bp, Homo sapiens
cccgcatcccctgcctc

SEQ ID NO: 3830040 - DNA, 20 bp, Homo sapiens
cccgcatcccctgcctccat

SEQ ID NO: 3830041 - DNA, 13 bp, Homo sapiens
cccgcctctgcct

SEQ ID NO: 3830042 - DNA, 12 bp, Homo sapiens
cccggccacctc

SEQ ID NO: 3830043 - DNA, 13 bp, Homo sapiens
cccggccacctct

SEQ ID NO: 3830044 - DNA, 14 bp, Homo sapiens
cccggccacctctg

SEQ ID NO: 3830045 - DNA, 20 bp, Homo sapiens
cccgggccctcctgggcacc

SEQ ID NO: 3830046 - DNA, 17 bp, Homo sapiens
cccggggaccctgtgac

SEQ ID NO: 3830047 - DNA, 12 bp, Homo sapiens
cccgggtcccac

SEQ ID NO: 3830048 - DNA, 22 bp, Homo sapiens
cccggttccctccccagctcct

SEQ ID NO: 3830049 - DNA, 20 bp, Homo sapiens
cccgtctgctcctccctccc

SEQ ID NO: 3830050 - DNA, 15 bp, Homo sapiens
cccgttgaagccgct

SEQ ID NO: 3830051 - DNA, 19 bp, Homo sapiens
ccctaaaaacaaaacaaac

SEQ ID NO: 3830052 - DNA, 16 bp, Homo sapiens
ccctagcccaggagag

SEQ ID NO: 3830053 - DNA, 17 bp, Homo sapiens
ccctagcccaggagaga

SEQ ID NO: 3830054 - DNA, 23 bp, Homo sapiens
ccctaggaggagaacttgaacaa

SEQ ID NO: 3830055 - DNA, 17 bp, Homo sapiens
ccctcacagcctctgac

SEQ ID NO: 3830056 - DNA, 15 bp, Homo sapiens
ccctcagccccagga

SEQ ID NO: 3830057 - DNA, 21 bp, Homo sapiens
ccctcatctttcatcaatcat

SEQ ID NO: 3830058 - DNA, 15 bp, Homo sapiens
ccctcccacctctgt

SEQ ID NO: 3830059 - DNA, 17 bp, Homo sapiens
ccctcccacctctgtga

SEQ ID NO: 3830060 - DNA, 12 bp, Homo sapiens
ccctccccagct

SEQ ID NO: 3830061 - DNA, 14 bp, Homo sapiens
ccctcccctgctgc

SEQ ID NO: 3830062 - DNA, 14 bp, Homo sapiens
ccctccctcctgcc

SEQ ID NO: 3830063 - DNA, 12 bp, Homo sapiens
ccctcctcactg

SEQ ID NO: 3830064 - DNA, 16 bp, Homo sapiens
ccctcctcactggcca

SEQ ID NO: 3830065 - DNA, 19 bp, Homo sapiens
ccctcctcactggccatcc

SEQ ID NO: 3830066 - DNA, 23 bp, Homo sapiens
ccctcctgcctgcgcagctcctt

SEQ ID NO: 3830067 - DNA, 16 bp, Homo sapiens
ccctcctgggcacccc

SEQ ID NO: 3830068 - DNA, 17 bp, Homo sapiens
ccctcctgggcacccca

SEQ ID NO: 3830069 - DNA, 15 bp, Homo sapiens
ccctcctttttatgt

SEQ ID NO: 3830070 - DNA, 15 bp, Homo sapiens
ccctctcaaccttgt

SEQ ID NO: 3830071 - DNA, 18 bp, Homo sapiens
ccctctgaggctcagccc

SEQ ID NO: 3830072 - DNA, 19 bp, Homo sapiens
ccctctgaggctcagccct

SEQ ID NO: 3830073 - DNA, 9 bp, Homo sapiens
ccctctgcc

SEQ ID NO: 3830074 - DNA, 17 bp, Homo sapiens
ccctctgttagtgccgc

SEQ ID NO: 3830075 - DNA, 11 bp, Homo sapiens
ccctgaagcca

SEQ ID NO: 3830076 - DNA, 14 bp, Homo sapiens
ccctgaagccagcc

SEQ ID NO: 3830077 - DNA, 17 bp, Homo sapiens
ccctgaagccagccttc

SEQ ID NO: 3830078 - DNA, 20 bp, Homo sapiens
ccctgagctggcctcacctg

SEQ ID NO: 3830079 - DNA, 20 bp, Homo sapiens
ccctgagctggcgtcacctg

SEQ ID NO: 3830080 - DNA, 13 bp, Homo sapiens
ccctgaggaataa

SEQ ID NO: 3830081 - DNA, 14 bp, Homo sapiens
ccctgaggaataaa

SEQ ID NO: 3830082 - DNA, 15 bp, Homo sapiens
ccctgaggaataaag

SEQ ID NO: 3830083 - DNA, 17 bp, Homo sapiens
ccctgaggaataaagct

SEQ ID NO: 3830084 - DNA, 18 bp, Homo sapiens
ccctgaggaataaagctt

SEQ ID NO: 3830085 - DNA, 15 bp, Homo sapiens
ccctgatccaggaaa

SEQ ID NO: 3830086 - DNA, 15 bp, Homo sapiens
ccctgcagccatccc

SEQ ID NO: 3830087 - DNA, 18 bp, Homo sapiens
ccctgcccccagccccgg

SEQ ID NO: 3830088 - DNA, 23 bp, Homo sapiens
ccctgcccgaggtcgctgcagcc

SEQ ID NO: 3830089 - DNA, 15 bp, Homo sapiens
ccctgccctgaggag

SEQ ID NO: 3830090 - DNA, 18 bp, Homo sapiens
ccctgccctgaggagggc

SEQ ID NO: 3830091 - DNA, 13 bp, Homo sapiens
ccctgccctgcac

SEQ ID NO: 3830092 - DNA, 18 bp, Homo sapiens
ccctgcctccatcctagt

SEQ ID NO: 3830093 - DNA, 16 bp, Homo sapiens
ccctgctgcaggggct

SEQ ID NO: 3830094 - DNA, 22 bp, Homo sapiens
ccctgctgcaggggctctggag

SEQ ID NO: 3830095 - DNA, 19 bp, Homo sapiens
ccctgctgctgctcctccc

SEQ ID NO: 3830096 - DNA, 16 bp, Homo sapiens
ctgaagacaggcacaa

SEQ ID NO: 3830097 - DNA, 22 bp, Homo sapiens
ctgaagacaggcacaaaatgtg

SEQ ID NO: 3830098 - DNA, 15 bp, Homo sapiens
ctgaagccacacagc

SEQ ID NO: 3830099 - DNA, 20 bp, Homo sapiens
ctgaagcctctaacaaatga

SEQ ID NO: 3830100 - DNA, 18 bp, Homo sapiens
ctgaagcctggacgcagc

SEQ ID NO: 3830101 - DNA, 20 bp, Homo sapiens
ctgaagcctggacgcagcca

SEQ ID NO: 3830102 - DNA, 16 bp, Homo sapiens
ctgaagcttattaatg

SEQ ID NO: 3830103 - DNA, 16 bp, Homo sapiens
ctgaaggaaaaacaca

SEQ ID NO: 3830104 - DNA, 21 bp, Homo sapiens
ctgaaggaaaaacacaagcaa

SEQ ID NO: 3830105 - DNA, 21 bp, Homo sapiens
ctgaaggactcaacattacat

SEQ ID NO: 3830106 - DNA, 14 bp, Homo sapiens
ctgaaggattttaa

SEQ ID NO: 3830107 - DNA, 14 bp, Homo sapiens
ctgaagggtgctca

SEQ ID NO: 3830108 - DNA, 22 bp, Homo sapiens
ctgaatattgacaagtgtcttt

SEQ ID NO: 3830109 - DNA, 15 bp, Homo sapiens
ctgacacctttaaaa

SEQ ID NO: 3830110 - DNA, 14 bp, Homo sapiens
ctgacatcaagtgt

SEQ ID NO: 3830111 - DNA, 12 bp, Homo sapiens
ctgacccaataa

SEQ ID NO: 3830112 - DNA, 14 bp, Homo sapiens
ctgacccctcctca

SEQ ID NO: 3830113 - DNA, 17 bp, Homo sapiens
ctgacccctcctcactg

SEQ ID NO: 3830114 - DNA, 20 bp, Homo sapiens
ctgacccctcctcactggcc

SEQ ID NO: 3830115 - DNA, 14 bp, Homo sapiens
ctgacctttaactg

SEQ ID NO: 3830116 - DNA, 16 bp, Homo sapiens
ctgacctttaactgag

SEQ ID NO: 3830117 - DNA, 23 bp, Homo sapiens
ctgactttttccattttttaaat

SEQ ID NO: 3830118 - DNA, 14 bp, Homo sapiens
ctgagagctgttcc

SEQ ID NO: 3830119 - DNA, 17 bp, Homo sapiens
ctgagaggcaggcatag

SEQ ID NO: 3830120 - DNA, 18 bp, Homo sapiens
ctgagcaagacgccctct

SEQ ID NO: 3830121 - DNA, 20 bp, Homo sapiens
ctgagcaagacgccctctcg

SEQ ID NO: 3830122 - DNA, 15 bp, Homo sapiens
ctgagctccagccac

SEQ ID NO: 3830123 - DNA, 19 bp, Homo sapiens
ctgagctctgcatttgtct

SEQ ID NO: 3830124 - DNA, 20 bp, Homo sapiens
ctgagctggcctcacctggg

SEQ ID NO: 3830125 - DNA, 21 bp, Homo sapiens
ctgagctggcgtcacctgtgc

SEQ ID NO: 3830126 - DNA, 22 bp, Homo sapiens
ctgagcttcagtataaaagaca

SEQ ID NO: 3830127 - DNA, 14 bp, Homo sapiens
ctgaggaccctcag

SEQ ID NO: 3830128 - DNA, 16 bp, Homo sapiens
ctgaggaccctcagcc

SEQ ID NO: 3830129 - DNA, 19 bp, Homo sapiens
ctgaggaccctcagcccca

SEQ ID NO: 3830130 - DNA, 23 bp, Homo sapiens
ctgaggaccctcagccccaggag

SEQ ID NO: 3830131 - DNA, 16 bp, Homo sapiens
ctgaggagggccctga

SEQ ID NO: 3830132 - DNA, 20 bp, Homo sapiens
ctgaggagggccctgaggaa

SEQ ID NO: 3830133 - DNA, 16 bp, Homo sapiens
ctgagggatggactga

SEQ ID NO: 3830134 - DNA, 20 bp, Homo sapiens
ctgagggatggactgatgct

SEQ ID NO: 3830135 - DNA, 21 bp, Homo sapiens
ctgagggatggactgatgctt

SEQ ID NO: 3830136 - DNA, 16 bp, Homo sapiens
ctgaggtctggctgct

SEQ ID NO: 3830137 - DNA, 20 bp, Homo sapiens
ctgaggttcctctgcctgcc

SEQ ID NO: 3830138 - DNA, 23 bp, Homo sapiens
ctgaggttcctctgcctgccccg

SEQ ID NO: 3830139 - DNA, 14 bp, Homo sapiens
ctgagtcctggggt

SEQ ID NO: 3830140 - DNA, 22 bp, Homo sapiens
ctgagtcgctctcatgaagccc

SEQ ID NO: 3830141 - DNA, 22 bp, Homo sapiens
ctgatctttaactggaaggctg

SEQ ID NO: 3830142 - DNA, 14 bp, Homo sapiens
ctgatgactcaaga

SEQ ID NO: 3830143 - DNA, 18 bp, Homo sapiens
ctgatgactcaagattcc

SEQ ID NO: 3830144 - DNA, 23 bp, Homo sapiens
ctgatgactcaagattcccagga

SEQ ID NO: 3830145 - DNA, 17 bp, Homo sapiens
ctgatgccatggaatga

SEQ ID NO: 3830146 - DNA, 16 bp, Homo sapiens
ctgatgttactagcct

SEQ ID NO: 3830147 - DNA, 22 bp, Homo sapiens
ctgattcctaaggcccagctgc

SEQ ID NO: 3830148 - DNA, 12 bp, Homo sapiens
ctgatttacagt

SEQ ID NO: 3830149 - DNA, 22 bp, Homo sapiens
ctgatttagccatgtgaaactc

SEQ ID NO: 3830150 - DNA, 22 bp, Homo sapiens
ctgcaacgctgattcctaaggc

SEQ ID NO: 3830151 - DNA, 23 bp, Homo sapiens
ctgcaacgctgattcctaaggcc

SEQ ID NO: 3830152 - DNA, 18 bp, Homo sapiens
ctgcacagggccctctga

SEQ ID NO: 3830153 - DNA, 11 bp, Homo sapiens
ctgcacctctc

SEQ ID NO: 3830154 - DNA, 17 bp, Homo sapiens
ctgcacctctccagctc

SEQ ID NO: 3830155 - DNA, 12 bp, Homo sapiens
ctgcacgtcatg

SEQ ID NO: 3830156 - DNA, 23 bp, Homo sapiens
ctgcactcccccagttcccgggc

SEQ ID NO: 3830157 - DNA, 19 bp, Homo sapiens
ctgcagccatcccaaggct

SEQ ID NO: 3830158 - DNA, 13 bp, Homo sapiens
ctgcagggccagg

SEQ ID NO: 3830159 - DNA, 21 bp, Homo sapiens
ctgcagggccaggactgagcc

SEQ ID NO: 3830160 - DNA, 12 bp, Homo sapiens
ctgcaggggctc

SEQ ID NO: 3830161 - DNA, 18 bp, Homo sapiens
ctgcaggggctctggaga

SEQ ID NO: 3830162 - DNA, 22 bp, Homo sapiens
ctgcaggggctctggagagaaa

SEQ ID NO: 3830163 - DNA, 17 bp, Homo sapiens
ctgcagtaatctccagg

SEQ ID NO: 3830164 - DNA, 20 bp, Homo sapiens
ctgcagtaatctccagggcc

SEQ ID NO: 3830165 - DNA, 13 bp, Homo sapiens
ctgcatcccacca

SEQ ID NO: 3830166 - DNA, 23 bp, Homo sapiens
ctgcatgacctatcagtatggtg

SEQ ID NO: 3830167 - DNA, 17 bp, Homo sapiens
ctgcatttggctggagc

SEQ ID NO: 3830168 - DNA, 21 bp, Homo sapiens
ctgcatttggctggagcccgg

SEQ ID NO: 3830169 - DNA, 22 bp, Homo sapiens
ctgcatttggctggagcccggt

SEQ ID NO: 3830170 - DNA, 13 bp, Homo sapiens
ctgcattttaagc

SEQ ID NO: 3830171 - DNA, 22 bp, Homo sapiens
ctgccaaaaccaaattgagctc

SEQ ID NO: 3830172 - DNA, 14 bp, Homo sapiens
ctgccaccagagac

SEQ ID NO: 3830173 - DNA, 12 bp, Homo sapiens
ctgccaggcagg

SEQ ID NO: 3830174 - DNA, 13 bp, Homo sapiens
ctgccaggcaggg

SEQ ID NO: 3830175 - DNA, 17 bp, Homo sapiens
ctgccaggcaggggtgg

SEQ ID NO: 3830176 - DNA, 15 bp, Homo sapiens
ctgccaggccagcct

SEQ ID NO: 3830177 - DNA, 17 bp, Homo sapiens
ctgccaggccagcctcc

SEQ ID NO: 3830178 - DNA, 18 bp, Homo sapiens
ctgccaggccagcctccg

SEQ ID NO: 3830179 - DNA, 16 bp, Homo sapiens
ctgccagggaagacag

SEQ ID NO: 3830180 - DNA, 17 bp, Homo sapiens
ctgccagggaagacaga

SEQ ID NO: 3830181 - DNA, 18 bp, Homo sapiens
ctgccagggaagacagag

SEQ ID NO: 3830182 - DNA, 20 bp, Homo sapiens
ctgccagggaagacagagca

SEQ ID NO: 3830183 - DNA, 24 bp, Homo sapiens
ctgccagggaagacagagcaggct

SEQ ID NO: 3830184 - DNA, 18 bp, Homo sapiens
ctgccatcagtctagtgg

SEQ ID NO: 3830185 - DNA, 15 bp, Homo sapiens
ctgcccccacaccca

SEQ ID NO: 3830186 - DNA, 14 bp, Homo sapiens
ctgcccccgcatcc

SEQ ID NO: 3830187 - DNA, 20 bp, Homo sapiens
ctgcccccgcatcccctgcc

SEQ ID NO: 3830188 - DNA, 17 bp, Homo sapiens
ctgccccgcccccagtc

SEQ ID NO: 3830189 - DNA, 18 bp, Homo sapiens
ctgccccgcccccagtcc

SEQ ID NO: 3830190 - DNA, 23 bp, Homo sapiens
ctgccccgcccccagtccccacc

SEQ ID NO: 3830191 - DNA, 19 bp, Homo sapiens
ctgcccgaggtcgctgcag

SEQ ID NO: 3830192 - DNA, 21 bp, Homo sapiens
ctgcccgaggtcgctgcagcc

SEQ ID NO: 3830193 - DNA, 22 bp, Homo sapiens
ctgcccgaggtcgctgcagccc

SEQ ID NO: 3830194 - DNA, 19 bp, Homo sapiens
ctgccctgaggagggccct

SEQ ID NO: 3830195 - DNA, 20 bp, Homo sapiens
ctgccctgcacgtcatggga

SEQ ID NO: 3830196 - DNA, 18 bp, Homo sapiens
ctgccctgccctcctgcc

SEQ ID NO: 3830197 - DNA, 18 bp, Homo sapiens
ctgccctggctgctgccc

SEQ ID NO: 3830198 - DNA, 21 bp, Homo sapiens
ctgccctggctgctgccccca

SEQ ID NO: 3830199 - DNA, 22 bp, Homo sapiens
ctgcctactgcccctgccctga

SEQ ID NO: 3830200 - DNA, 20 bp, Homo sapiens
ctgcctcttcccggagaatc

SEQ ID NO: 3830201 - DNA, 12 bp, Homo sapiens
ctgcctgagctt

SEQ ID NO: 3830202 - DNA, 15 bp, Homo sapiens
ctgcctgccccgccc

SEQ ID NO: 3830203 - DNA, 21 bp, Homo sapiens
ctgcctgccccgcccccagtc

SEQ ID NO: 3830204 - DNA, 22 bp, Homo sapiens
ctgcctgctttttatggcctgt

SEQ ID NO: 3830205 - DNA, 17 bp, Homo sapiens
ctgccttaaaaccaaag

SEQ ID NO: 3830206 - DNA, 18 bp, Homo sapiens
ctgccttaccgagagcca

SEQ ID NO: 3830207 - DNA, 15 bp, Homo sapiens
ctgccttagagccag

SEQ ID NO: 3830208 - DNA, 11 bp, Homo sapiens
ctgccttccct

SEQ ID NO: 3830209 - DNA, 20 bp, Homo sapiens
ctgccttctggattcttggc

SEQ ID NO: 3830210 - DNA, 18 bp, Homo sapiens
ctgcgcagggccctctgg

SEQ ID NO: 3830211 - DNA, 14 bp, Homo sapiens
ctgcgccctgggct

SEQ ID NO: 3830212 - DNA, 13 bp, Homo sapiens
ctgcgcttgcttt

SEQ ID NO: 3830213 - DNA, 14 bp, Homo sapiens
ctgcggaccccagc

SEQ ID NO: 3830214 - DNA, 23 bp, Homo sapiens
ctgcggaccccagctgtgagcct

SEQ ID NO: 3830215 - DNA, 19 bp, Homo sapiens
ctgcgggaagctgaccttt

SEQ ID NO: 3830216 - DNA, 22 bp, Homo sapiens
ctgcgggaagctgacctttaac

SEQ ID NO: 3830217 - DNA, 19 bp, Homo sapiens
ctgcgtcctcctcacctca

SEQ ID NO: 3830218 - DNA, 18 bp, Homo sapiens
ctgcgttcttgtgacaga

SEQ ID NO: 3830219 - DNA, 21 bp, Homo sapiens
ctgctagcacctccccagaca

SEQ ID NO: 3830220 - DNA, 22 bp, Homo sapiens
ctgctagcacctccccagacag

SEQ ID NO: 3830221 - DNA, 23 bp, Homo sapiens
ctgctagcacctccccagacagg

SEQ ID NO: 3830222 - DNA, 12 bp, Homo sapiens
ctgctcagccct

SEQ ID NO: 3830223 - DNA, 13 bp, Homo sapiens
ctgctcagccctg

SEQ ID NO: 3830224 - DNA, 15 bp, Homo sapiens
ctgctcagccctgga

SEQ ID NO: 3830225 - DNA, 21 bp, Homo sapiens
ctgctcagccctggaggtgcc

SEQ ID NO: 3830226 - DNA, 18 bp, Homo sapiens
ctgctccctgaagccagc

SEQ ID NO: 3830227 - DNA, 13 bp, Homo sapiens
gacagagcaggct

SEQ ID NO: 3830228 - DNA, 14 bp, Homo sapiens
gacagagcaggctt

SEQ ID NO: 3830229 - DNA, 17 bp, Homo sapiens
gacagagcaggctttgt

SEQ ID NO: 3830230 - DNA, 22 bp, Homo sapiens
gacagagcaggctttgtgagag

SEQ ID NO: 3830231 - DNA, 17 bp, Homo sapiens
gacagagcgagactgtc

SEQ ID NO: 3830232 - DNA, 16 bp, Homo sapiens
gacagatgaagaagga

SEQ ID NO: 3830233 - DNA, 19 bp, Homo sapiens
gacagccaactatggcctg

SEQ ID NO: 3830234 - DNA, 17 bp, Homo sapiens
gacagccccagagcagg

SEQ ID NO: 3830235 - DNA, 14 bp, Homo sapiens
gacaggcacaaaat

SEQ ID NO: 3830236 - DNA, 14 bp, Homo sapiens
gacagggctccagc

SEQ ID NO: 3830237 - DNA, 15 bp, Homo sapiens
gacagggctccagcc

SEQ ID NO: 3830238 - DNA, 18 bp, Homo sapiens
gacagggctccagcctgt

SEQ ID NO: 3830239 - DNA, 14 bp, Homo sapiens
gacagtaagagttt

SEQ ID NO: 3830240 - DNA, 22 bp, Homo sapiens
gacagtaagagtttacaagaaa

SEQ ID NO: 3830241 - DNA, 16 bp, Homo sapiens
gacagtcagcatttct

SEQ ID NO: 3830242 - DNA, 14 bp, Homo sapiens
gacatcaagtgtaa

SEQ ID NO: 3830243 - DNA, 19 bp, Homo sapiens
gacatggaccttctctcca

SEQ ID NO: 3830244 - DNA, 16 bp, Homo sapiens
gacatggtgcctgaga

SEQ ID NO: 3830245 - DNA, 13 bp, Homo sapiens
gacattatttcgt

SEQ ID NO: 3830246 - DNA, 21 bp, Homo sapiens
gaccaactttttcattccctg

SEQ ID NO: 3830247 - DNA, 13 bp, Homo sapiens
gaccaccaacaca

SEQ ID NO: 3830248 - DNA, 16 bp, Homo sapiens
gaccaccaacacacag

SEQ ID NO: 3830249 - DNA, 18 bp, Homo sapiens
gaccaccaacacacagga

SEQ ID NO: 3830250 - DNA, 11 bp, Homo sapiens
gaccacccccg

SEQ ID NO: 3830251 - DNA, 17 bp, Homo sapiens
gaccacccccgagcttg

SEQ ID NO: 3830252 - DNA, 22 bp, Homo sapiens
gaccacccccgagcttgcctca

SEQ ID NO: 3830253 - DNA, 15 bp, Homo sapiens
gaccagcactgaccc

SEQ ID NO: 3830254 - DNA, 13 bp, Homo sapiens
gacccagactccg

SEQ ID NO: 3830255 - DNA, 21 bp, Homo sapiens
gaccccaaggacctgcctccc

SEQ ID NO: 3830256 - DNA, 21 bp, Homo sapiens
gaccccgacctcagagagtac

SEQ ID NO: 3830257 - DNA, 12 bp, Homo sapiens
gacccctcctca

SEQ ID NO: 3830258 - DNA, 17 bp, Homo sapiens
gacccctcctcactggc

SEQ ID NO: 3830259 - DNA, 17 bp, Homo sapiens
gaccctcagccccagga

SEQ ID NO: 3830260 - DNA, 22 bp, Homo sapiens
gaccctcgagattaacggtgct

SEQ ID NO: 3830261 - DNA, 14 bp, Homo sapiens
gaccctctgccacc

SEQ ID NO: 3830262 - DNA, 16 bp, Homo sapiens
gaccctctgccaccag

SEQ ID NO: 3830263 - DNA, 20 bp, Homo sapiens
gaccctctgccaccagagac

SEQ ID NO: 3830264 - DNA, 20 bp, Homo sapiens
gaccctggcaccgcattaga

SEQ ID NO: 3830265 - DNA, 22 bp, Homo sapiens
gaccctgggtgggctctgtgca

SEQ ID NO: 3830266 - DNA, 20 bp, Homo sapiens
gaccctgtgacatggtgcct

SEQ ID NO: 3830267 - DNA, 12 bp, Homo sapiens
gaccggcctgga

SEQ ID NO: 3830268 - DNA, 15 bp, Homo sapiens
gacctacctggcccc

SEQ ID NO: 3830269 - DNA, 13 bp, Homo sapiens
gacctataatttt

SEQ ID NO: 3830270 - DNA, 14 bp, Homo sapiens
gacctcagctgctt

SEQ ID NO: 3830271 - DNA, 16 bp, Homo sapiens
gacctcagctgcttct

SEQ ID NO: 3830272 - DNA, 19 bp, Homo sapiens
gacctcaggcactagcctt

SEQ ID NO: 3830273 - DNA, 11 bp, Homo sapiens
gacctccatgc

SEQ ID NO: 3830274 - DNA, 22 bp, Homo sapiens
gacctccatgcccccgccacct

SEQ ID NO: 3830275 - DNA, 24 bp, Homo sapiens
gacctccatgcccccgccacctcc

SEQ ID NO: 3830276 - DNA, 13 bp, Homo sapiens
gacctccccagcc

SEQ ID NO: 3830277 - DNA, 15 bp, Homo sapiens
gacctctcccaccca

SEQ ID NO: 3830278 - DNA, 12 bp, Homo sapiens
gacctgagcctg

SEQ ID NO: 3830279 - DNA, 16 bp, Homo sapiens
gacctgccaggcaggg

SEQ ID NO: 3830280 - DNA, 18 bp, Homo sapiens
gacctgccaggcaggggt

SEQ ID NO: 3830281 - DNA, 21 bp, Homo sapiens
gacctgccaggcaggggtggg

SEQ ID NO: 3830282 - DNA, 17 bp, Homo sapiens
gaccttgtgaacatcag

SEQ ID NO: 3830283 - DNA, 19 bp, Homo sapiens
gacctttgtctgaaggatt

SEQ ID NO: 3830284 - DNA, 12 bp, Homo sapiens
gaccttttcttt

SEQ ID NO: 3830285 - DNA, 20 bp, Homo sapiens
gacgcagccacacagtggcc

SEQ ID NO: 3830286 - DNA, 12 bp, Homo sapiens
gacggaaaagtc

SEQ ID NO: 3830287 - DNA, 20 bp, Homo sapiens
gacggcaggctcactgccag

SEQ ID NO: 3830288 - DNA, 12 bp, Homo sapiens
gactagtgctga

SEQ ID NO: 3830289 - DNA, 14 bp, Homo sapiens
gactagtgctgaag

SEQ ID NO: 3830290 - DNA, 18 bp, Homo sapiens
gactatttataactaata

SEQ ID NO: 3830291 - DNA, 22 bp, Homo sapiens
gactatttataactaatatggt

SEQ ID NO: 3830292 - DNA, 18 bp, Homo sapiens
gactcaagattcccagga

SEQ ID NO: 3830293 - DNA, 20 bp, Homo sapiens
gactcaggctgctccttctc

SEQ ID NO: 3830294 - DNA, 12 bp, Homo sapiens
gactccaggccc

SEQ ID NO: 3830295 - DNA, 13 bp, Homo sapiens
gactccaggcccc

SEQ ID NO: 3830296 - DNA, 14 bp, Homo sapiens
gactccctccccag

SEQ ID NO: 3830297 - DNA, 17 bp, Homo sapiens
gactcctcggcctggct

SEQ ID NO: 3830298 - DNA, 13 bp, Homo sapiens
gactgagaaattt

SEQ ID NO: 3830299 - DNA, 12 bp, Homo sapiens
gactgtggaggg

SEQ ID NO: 3830300 - DNA, 13 bp, Homo sapiens
gactgtggagggg

SEQ ID NO: 3830301 - DNA, 15 bp, Homo sapiens
gactgtggaggggag

SEQ ID NO: 3830302 - DNA, 13 bp, Homo sapiens
gacttattatatc

SEQ ID NO: 3830303 - DNA, 21 bp, Homo sapiens
gacttctcaggacgacgaatc

SEQ ID NO: 3830304 - DNA, 18 bp, Homo sapiens
gagaaaatccccattgaa

SEQ ID NO: 3830305 - DNA, 16 bp, Homo sapiens
gagaaagccaggcagg

SEQ ID NO: 3830306 - DNA, 23 bp, Homo sapiens
gagaagccaagggacacaggaga

SEQ ID NO: 3830307 - DNA, 14 bp, Homo sapiens
gagaaggagagaaa

SEQ ID NO: 3830308 - DNA, 13 bp, Homo sapiens
gagacagccccag

SEQ ID NO: 3830309 - DNA, 14 bp, Homo sapiens
gagacagccccaga

SEQ ID NO: 3830310 - DNA, 12 bp, Homo sapiens
gagaccaccccc

SEQ ID NO: 3830311 - DNA, 22 bp, Homo sapiens
gagaccacccccgagcttgcct

SEQ ID NO: 3830312 - DNA, 23 bp, Homo sapiens
gagaccacccccgagcttgcctc

SEQ ID NO: 3830313 - DNA, 21 bp, Homo sapiens
gagaccctctgccaccagaga

SEQ ID NO: 3830314 - DNA, 21 bp, Homo sapiens
gagactgtctcaaaaaaacaa

SEQ ID NO: 3830315 - DNA, 15 bp, Homo sapiens
gagagaaagtgggtg

SEQ ID NO: 3830316 - DNA, 12 bp, Homo sapiens
gagagagaaagc

SEQ ID NO: 3830317 - DNA, 15 bp, Homo sapiens
gagagagaaagccag

SEQ ID NO: 3830318 - DNA, 14 bp, Homo sapiens
gagagagagagagg

SEQ ID NO: 3830319 - DNA, 15 bp, Homo sapiens
gagagaggacctcca

SEQ ID NO: 3830320 - DNA, 20 bp, Homo sapiens
gagagaggacctccatgccc

SEQ ID NO: 3830321 - DNA, 15 bp, Homo sapiens
gagagaggcagagag

SEQ ID NO: 3830322 - DNA, 16 bp, Homo sapiens
gagagaggcagagagc

SEQ ID NO: 3830323 - DNA, 18 bp, Homo sapiens
gagagagggcgcccagcc

SEQ ID NO: 3830324 - DNA, 20 bp, Homo sapiens
gagagagggcgcccagccca

SEQ ID NO: 3830325 - DNA, 23 bp, Homo sapiens
gagagagggcgcccagcccaggc

SEQ ID NO: 3830326 - DNA, 11 bp, Homo sapiens
gagagccaaac

SEQ ID NO: 3830327 - DNA, 13 bp, Homo sapiens
gagagcctgctgg

SEQ ID NO: 3830328 - DNA, 13 bp, Homo sapiens
gagaggacctcca

SEQ ID NO: 3830329 - DNA, 16 bp, Homo sapiens
gagaggacctccatgc

SEQ ID NO: 3830330 - DNA, 18 bp, Homo sapiens
gagaggacctccatgccc

SEQ ID NO: 3830331 - DNA, 12 bp, Homo sapiens
gagaggcagaga

SEQ ID NO: 3830332 - DNA, 13 bp, Homo sapiens
gagaggcagagag

SEQ ID NO: 3830333 - DNA, 14 bp, Homo sapiens
gagaggcagagagc

SEQ ID NO: 3830334 - DNA, 16 bp, Homo sapiens
gagaggcagagagcgg

SEQ ID NO: 3830335 - DNA, 11 bp, Homo sapiens
gagaggcaggc

SEQ ID NO: 3830336 - DNA, 10 bp, Homo sapiens
gagagggaga

SEQ ID NO: 3830337 - DNA, 14 bp, Homo sapiens
gagagggagagaga

SEQ ID NO: 3830338 - DNA, 18 bp, Homo sapiens
gagagggcgcccagccca

SEQ ID NO: 3830339 - DNA, 19 bp, Homo sapiens
gagagggcgcccagcccag

SEQ ID NO: 3830340 - DNA, 20 bp, Homo sapiens
gagagggcgcccagcccagg

SEQ ID NO: 3830341 - DNA, 15 bp, Homo sapiens
gagagtgggttttgt

SEQ ID NO: 3830342 - DNA, 17 bp, Homo sapiens
gagatacgaatttctat

SEQ ID NO: 3830343 - DNA, 15 bp, Homo sapiens
gagatgctggagaag

SEQ ID NO: 3830344 - DNA, 19 bp, Homo sapiens
gagatgctggagaagagag

SEQ ID NO: 3830345 - DNA, 20 bp, Homo sapiens
gagatgctggagaagagagg

SEQ ID NO: 3830346 - DNA, 21 bp, Homo sapiens
gagatgggaatgaggtgggag

SEQ ID NO: 3830347 - DNA, 17 bp, Homo sapiens
gagcaagccctgaccca

SEQ ID NO: 3830348 - DNA, 15 bp, Homo sapiens
gagcaagtctgcagg

SEQ ID NO: 3830349 - DNA, 13 bp, Homo sapiens
gagcagaataaat

SEQ ID NO: 3830350 - DNA, 18 bp, Homo sapiens
gagcaggagattgagaag

SEQ ID NO: 3830351 - DNA, 14 bp, Homo sapiens
gagcaggctttgtg

SEQ ID NO: 3830352 - DNA, 19 bp, Homo sapiens
gagcatcctgctgcttagg

SEQ ID NO: 3830353 - DNA, 11 bp, Homo sapiens
gagccagaggc

SEQ ID NO: 3830354 - DNA, 17 bp, Homo sapiens
gagccagaggccaggat

SEQ ID NO: 3830355 - DNA, 20 bp, Homo sapiens
gagccagaggccaggatgcc

SEQ ID NO: 3830356 - DNA, 15 bp, Homo sapiens
gagcccacaccatct

SEQ ID NO: 3830357 - DNA, 20 bp, Homo sapiens
gagcccacaccatctggccc

SEQ ID NO: 3830358 - DNA, 22 bp, Homo sapiens
gagcccacaccatctggcccag

SEQ ID NO: 3830359 - DNA, 13 bp, Homo sapiens
gagcccaggcggg

SEQ ID NO: 3830360 - DNA, 15 bp, Homo sapiens
gagcccaggcgggag

SEQ ID NO: 3830361 - DNA, 17 bp, Homo sapiens
gccctgggctgcctcct

SEQ ID NO: 3830362 - DNA, 18 bp, Homo sapiens
gccctgtccctcccacct

SEQ ID NO: 3830363 - DNA, 19 bp, Homo sapiens
gccctgtccctcccacctc

SEQ ID NO: 3830364 - DNA, 23 bp, Homo sapiens
gccctgtccctcccacctctgtg

SEQ ID NO: 3830365 - DNA, 23 bp, Homo sapiens
gcccttagggagagcacctgttg

SEQ ID NO: 3830366 - DNA, 13 bp, Homo sapiens
gccctttcctcag

SEQ ID NO: 3830367 - DNA, 20 bp, Homo sapiens
gccgactcagcaactttccc

SEQ ID NO: 3830368 - DNA, 19 bp, Homo sapiens
gccgagcccacaccatctg

SEQ ID NO: 3830369 - DNA, 16 bp, Homo sapiens
gccgcaataaatgctc

SEQ ID NO: 3830370 - DNA, 20 bp, Homo sapiens
gccgctcccggttccctccc

SEQ ID NO: 3830371 - DNA, 22 bp, Homo sapiens
gccgctcccggttccctcccca

SEQ ID NO: 3830372 - DNA, 19 bp, Homo sapiens
gccgggcccctgggcttgg

SEQ ID NO: 3830373 - DNA, 15 bp, Homo sapiens
gccggggctgaagcc

SEQ ID NO: 3830374 - DNA, 18 bp, Homo sapiens
gccggggctgaagccaca

SEQ ID NO: 3830375 - DNA, 20 bp, Homo sapiens
gcctaatcctttagattagg

SEQ ID NO: 3830376 - DNA, 16 bp, Homo sapiens
gcctaggtgggagcca

SEQ ID NO: 3830377 - DNA, 22 bp, Homo sapiens
gcctaggtgggagccaccactc

SEQ ID NO: 3830378 - DNA, 23 bp, Homo sapiens
gcctatcaaagaccttgtgtgta

SEQ ID NO: 3830379 - DNA, 18 bp, Homo sapiens
gcctatttttatattttt

SEQ ID NO: 3830380 - DNA, 23 bp, Homo sapiens
gcctcacctgggttccccacccc

SEQ ID NO: 3830381 - DNA, 12 bp, Homo sapiens
gcctcagggcca

SEQ ID NO: 3830382 - DNA, 16 bp, Homo sapiens
gcctcaggtgggccgc

SEQ ID NO: 3830383 - DNA, 16 bp, Homo sapiens
gcctcagtcctcccct

SEQ ID NO: 3830384 - DNA, 24 bp, Homo sapiens
gcctcagtcctcccctcacagcct

SEQ ID NO: 3830385 - DNA, 21 bp, Homo sapiens
gcctcatgaacactggctgca

SEQ ID NO: 3830386 - DNA, 14 bp, Homo sapiens
gcctccatcctagt

SEQ ID NO: 3830387 - DNA, 14 bp, Homo sapiens
gcctccggcctgca

SEQ ID NO: 3830388 - DNA, 18 bp, Homo sapiens
gcctccggcctgcactcc

SEQ ID NO: 3830389 - DNA, 13 bp, Homo sapiens
gcctcctcctgag

SEQ ID NO: 3830390 - DNA, 17 bp, Homo sapiens
gcctcctcctgagagct

SEQ ID NO: 3830391 - DNA, 17 bp, Homo sapiens
gcctcctctggacggca

SEQ ID NO: 3830392 - DNA, 14 bp, Homo sapiens
gcctcggagtgtgg

SEQ ID NO: 3830393 - DNA, 20 bp, Homo sapiens
gcctcgttaggacaaggctg

SEQ ID NO: 3830394 - DNA, 15 bp, Homo sapiens
gcctctcctttgtag

SEQ ID NO: 3830395 - DNA, 21 bp, Homo sapiens
gcctgacaccacgctggagct

SEQ ID NO: 3830396 - DNA, 19 bp, Homo sapiens
gcctgagaggcaggcatag

SEQ ID NO: 3830397 - DNA, 20 bp, Homo sapiens
gcctgagaggcaggcataga

SEQ ID NO: 3830398 - DNA, 13 bp, Homo sapiens
gcctgagccccct

SEQ ID NO: 3830399 - DNA, 20 bp, Homo sapiens
gcctgaggtctggctgcttg

SEQ ID NO: 3830400 - DNA, 15 bp, Homo sapiens
gcctgcccccacacc

SEQ ID NO: 3830401 - DNA, 21 bp, Homo sapiens
gcctgcccccacacccactcc

SEQ ID NO: 3830402 - DNA, 15 bp, Homo sapiens
gcctgcgcagctcct

SEQ ID NO: 3830403 - DNA, 20 bp, Homo sapiens
gcctgcgttcttgtgacaga

SEQ ID NO: 3830404 - DNA, 13 bp, Homo sapiens
gcctgctgctgcc

SEQ ID NO: 3830405 - DNA, 10 bp, Homo sapiens
gcctgctggc

SEQ ID NO: 3830406 - DNA, 13 bp, Homo sapiens
gcctgctggcacc

SEQ ID NO: 3830407 - DNA, 19 bp, Homo sapiens
gcctgctggcacccaccgt

SEQ ID NO: 3830408 - DNA, 22 bp, Homo sapiens
gcctgctgtgattccactacac

SEQ ID NO: 3830409 - DNA, 22 bp, Homo sapiens
gcctgctttttatggcctgtga

SEQ ID NO: 3830410 - DNA, 17 bp, Homo sapiens
gcctggacgcagccaca

SEQ ID NO: 3830411 - DNA, 19 bp, Homo sapiens
gcctggacgcagccacaca

SEQ ID NO: 3830412 - DNA, 21 bp, Homo sapiens
gcctggacgcagccacacagt

SEQ ID NO: 3830413 - DNA, 17 bp, Homo sapiens
gcctggatccatcctgc

SEQ ID NO: 3830414 - DNA, 22 bp, Homo sapiens
gcctggatccatcctgctagca

SEQ ID NO: 3830415 - DNA, 14 bp, Homo sapiens
gcctggcctgtggc

SEQ ID NO: 3830416 - DNA, 13 bp, Homo sapiens
gcctgggcctcct

SEQ ID NO: 3830417 - DNA, 20 bp, Homo sapiens
gcctgggcgacagagcgaga

SEQ ID NO: 3830418 - DNA, 20 bp, Homo sapiens
gcctgtcggccacaccccag

SEQ ID NO: 3830419 - DNA, 16 bp, Homo sapiens
gcctgtgtaacagctc

SEQ ID NO: 3830420 - DNA, 17 bp, Homo sapiens
gcctgtgtaacagctcc

SEQ ID NO: 3830421 - DNA, 22 bp, Homo sapiens
gcctgtgtaacagctccttggg

SEQ ID NO: 3830422 - DNA, 20 bp, Homo sapiens
gcctgtgtgcagtggagctg

SEQ ID NO: 3830423 - DNA, 14 bp, Homo sapiens
gcctgttgcaggca

SEQ ID NO: 3830424 - DNA, 19 bp, Homo sapiens
gccttaccgagagccaaac

SEQ ID NO: 3830425 - DNA, 14 bp, Homo sapiens
gccttagagccagg

SEQ ID NO: 3830426 - DNA, 17 bp, Homo sapiens
gccttagagccaggcac

SEQ ID NO: 3830427 - DNA, 16 bp, Homo sapiens
gccttcagatgttctc

SEQ ID NO: 3830428 - DNA, 23 bp, Homo sapiens
gccttccctagctttagaccctg

SEQ ID NO: 3830429 - DNA, 19 bp, Homo sapiens
gccttctggattcttggcc

SEQ ID NO: 3830430 - DNA, 17 bp, Homo sapiens
gccttcttccatcccag

SEQ ID NO: 3830431 - DNA, 20 bp, Homo sapiens
gccttcttccatcccaggac

SEQ ID NO: 3830432 - DNA, 19 bp, Homo sapiens
gcgaccaccaacacacagg

SEQ ID NO: 3830433 - DNA, 20 bp, Homo sapiens
gcgaccaccaacacacagga

SEQ ID NO: 3830434 - DNA, 14 bp, Homo sapiens
gcgacttctcagga

SEQ ID NO: 3830435 - DNA, 15 bp, Homo sapiens
gcgaggctgcccctt

SEQ ID NO: 3830436 - DNA, 14 bp, Homo sapiens
gcgatagctgactt

SEQ ID NO: 3830437 - DNA, 13 bp, Homo sapiens
gcgcagctccttc

SEQ ID NO: 3830438 - DNA, 15 bp, Homo sapiens
gcgcagctccttccc

SEQ ID NO: 3830439 - DNA, 16 bp, Homo sapiens
gcgcagctccttccct

SEQ ID NO: 3830440 - DNA, 17 bp, Homo sapiens
gcgcagctgaagcctgg

SEQ ID NO: 3830441 - DNA, 17 bp, Homo sapiens
gcgcattgttttgcatc

SEQ ID NO: 3830442 - DNA, 12 bp, Homo sapiens
gcgcccagccca

SEQ ID NO: 3830443 - DNA, 17 bp, Homo sapiens
gcgcccagcccaggcct

SEQ ID NO: 3830444 - DNA, 19 bp, Homo sapiens
gcgcccagcccaggcctgg

SEQ ID NO: 3830445 - DNA, 16 bp, Homo sapiens
gcgctggctgcactca

SEQ ID NO: 3830446 - DNA, 16 bp, Homo sapiens
gcgggtcccagctact

SEQ ID NO: 3830447 - DNA, 20 bp, Homo sapiens
gcggtctcaggctggtggga

SEQ ID NO: 3830448 - DNA, 15 bp, Homo sapiens
gcggtggccctgtcc

SEQ ID NO: 3830449 - DNA, 16 bp, Homo sapiens
gcgtgtgtgggtggat

SEQ ID NO: 3830450 - DNA, 22 bp, Homo sapiens
gctaaagagcccttgcctcccc

SEQ ID NO: 3830451 - DNA, 19 bp, Homo sapiens
gctaaataacttgccattt

SEQ ID NO: 3830452 - DNA, 21 bp, Homo sapiens
gctacagagtaacaaaaaata

SEQ ID NO: 3830453 - DNA, 22 bp, Homo sapiens
gctactaacagattataataaa

SEQ ID NO: 3830454 - DNA, 15 bp, Homo sapiens
gctagcacctcccca

SEQ ID NO: 3830455 - DNA, 18 bp, Homo sapiens
gctagcacctccccagac

SEQ ID NO: 3830456 - DNA, 19 bp, Homo sapiens
gctagcacctccccagaca

SEQ ID NO: 3830457 - DNA, 21 bp, Homo sapiens
gctagcacctccccagacagg

SEQ ID NO: 3830458 - DNA, 20 bp, Homo sapiens
gctaggactgtggaggggag

SEQ ID NO: 3830459 - DNA, 22 bp, Homo sapiens
gctaggactgtggaggggagct

SEQ ID NO: 3830460 - DNA, 23 bp, Homo sapiens
gctaggactgtggaggggagctg

SEQ ID NO: 3830461 - DNA, 14 bp, Homo sapiens
gctaggggaggggg

SEQ ID NO: 3830462 - DNA, 15 bp, Homo sapiens
gctaggggagggggg

SEQ ID NO: 3830463 - DNA, 17 bp, Homo sapiens
gctatcgtaaaattaag

SEQ ID NO: 3830464 - DNA, 16 bp, Homo sapiens
gctatctgaactaatt

SEQ ID NO: 3830465 - DNA, 20 bp, Homo sapiens
gctcaatgcaacctctgccc

SEQ ID NO: 3830466 - DNA, 16 bp, Homo sapiens
gctcactacctcctca

SEQ ID NO: 3830467 - DNA, 18 bp, Homo sapiens
gctcactacctcctcagg

SEQ ID NO: 3830468 - DNA, 13 bp, Homo sapiens
gctcactgccagg

SEQ ID NO: 3830469 - DNA, 21 bp, Homo sapiens
gctcactgccaggccagcctc

SEQ ID NO: 3830470 - DNA, 22 bp, Homo sapiens
gctcactgccaggccagcctcc

SEQ ID NO: 3830471 - DNA, 10 bp, Homo sapiens
gctcagaaaa

SEQ ID NO: 3830472 - DNA, 19 bp, Homo sapiens
gctcagccctgagctggcc

SEQ ID NO: 3830473 - DNA, 12 bp, Homo sapiens
gctcagccctgg

SEQ ID NO: 3830474 - DNA, 20 bp, Homo sapiens
gctcagccctggaggtgcca

SEQ ID NO: 3830475 - DNA, 20 bp, Homo sapiens
gctcatgcctgtaatcccag

SEQ ID NO: 3830476 - DNA, 14 bp, Homo sapiens
gctcatgtctgaaa

SEQ ID NO: 3830477 - DNA, 18 bp, Homo sapiens
gctccagcctgtcggcca

SEQ ID NO: 3830478 - DNA, 16 bp, Homo sapiens
gctccccacgccccca

SEQ ID NO: 3830479 - DNA, 17 bp, Homo sapiens
gctccccacgcccccat

SEQ ID NO: 3830480 - DNA, 20 bp, Homo sapiens
gctccccacgcccccatgca

SEQ ID NO: 3830481 - DNA, 19 bp, Homo sapiens
gctcccgtactgtctgtgt

SEQ ID NO: 3830482 - DNA, 14 bp, Homo sapiens
gctccctgaagcca

SEQ ID NO: 3830483 - DNA, 17 bp, Homo sapiens
gctccctgaagccagcc

SEQ ID NO: 3830484 - DNA, 18 bp, Homo sapiens
gctccctgaagccagcct

SEQ ID NO: 3830485 - DNA, 14 bp, Homo sapiens
gctcctccgtgctt

SEQ ID NO: 3830486 - DNA, 20 bp, Homo sapiens
gctcctccgtgcttcctcag

SEQ ID NO: 3830487 - DNA, 15 bp, Homo sapiens
gctcctgacctacct

SEQ ID NO: 3830488 - DNA, 12 bp, Homo sapiens
gctcctggtggg

SEQ ID NO: 3830489 - DNA, 15 bp, Homo sapiens
gctcctggtggggca

SEQ ID NO: 3830490 - DNA, 17 bp, Homo sapiens
gctcctggtggggcaga

SEQ ID NO: 3830491 - DNA, 18 bp, Homo sapiens
gctcctggtggggcagaa

SEQ ID NO: 3830492 - DNA, 17 bp, Homo sapiens
gctcctgtttggaaatg

SEQ ID NO: 3830493 - DNA, 17 bp, Homo sapiens
ggggagccagaggccag

SEQ ID NO: 3830494 - DNA, 16 bp, Homo sapiens
ggggagctggcctagg

SEQ ID NO: 3830495 - DNA, 22 bp, Homo sapiens
ggggatgcaaataaagcctgct

SEQ ID NO: 3830496 - DNA, 21 bp, Homo sapiens
ggggcacagacctctcccacc

SEQ ID NO: 3830497 - DNA, 15 bp, Homo sapiens
ggggcagccagccct

SEQ ID NO: 3830498 - DNA, 20 bp, Homo sapiens
ggggcagcctccagtctgct

SEQ ID NO: 3830499 - DNA, 17 bp, Homo sapiens
ggggcccccagcaccct

SEQ ID NO: 3830500 - DNA, 15 bp, Homo sapiens
ggggcccccatcttg

SEQ ID NO: 3830501 - DNA, 17 bp, Homo sapiens
ggggcctgtgtagccag

SEQ ID NO: 3830502 - DNA, 19 bp, Homo sapiens
ggggcctgtgtagccagtg

SEQ ID NO: 3830503 - DNA, 14 bp, Homo sapiens
ggggcgcccacctc

SEQ ID NO: 3830504 - DNA, 19 bp, Homo sapiens
ggggcgcccacctccccac

SEQ ID NO: 3830505 - DNA, 16 bp, Homo sapiens
ggggctacaagaggga

SEQ ID NO: 3830506 - DNA, 14 bp, Homo sapiens
ggggctcagccctg

SEQ ID NO: 3830507 - DNA, 20 bp, Homo sapiens
ggggctcagccctgagctgg

SEQ ID NO: 3830508 - DNA, 15 bp, Homo sapiens
ggggctccccacgcc

SEQ ID NO: 3830509 - DNA, 18 bp, Homo sapiens
ggggctctggagagaaac

SEQ ID NO: 3830510 - DNA, 14 bp, Homo sapiens
ggggctgaagccac

SEQ ID NO: 3830511 - DNA, 22 bp, Homo sapiens
ggggctgaagccacacagccca

SEQ ID NO: 3830512 - DNA, 13 bp, Homo sapiens
gggggagccagag

SEQ ID NO: 3830513 - DNA, 12 bp, Homo sapiens
gggggccagcac

SEQ ID NO: 3830514 - DNA, 14 bp, Homo sapiens
gggggcggctgagc

SEQ ID NO: 3830515 - DNA, 11 bp, Homo sapiens
ggggggcggct

SEQ ID NO: 3830516 - DNA, 15 bp, Homo sapiens
gggggtctcagcatg

SEQ ID NO: 3830517 - DNA, 15 bp, Homo sapiens
ggggtcagcaggccc

SEQ ID NO: 3830518 - DNA, 23 bp, Homo sapiens
ggggtcccaggacctgagcctgg

SEQ ID NO: 3830519 - DNA, 17 bp, Homo sapiens
ggggtggaggcttcctg

SEQ ID NO: 3830520 - DNA, 16 bp, Homo sapiens
gggtagaaaatgtttt

SEQ ID NO: 3830521 - DNA, 23 bp, Homo sapiens
gggtatttaatgtatttttgtaa

SEQ ID NO: 3830522 - DNA, 14 bp, Homo sapiens
gggtcacccatggc

SEQ ID NO: 3830523 - DNA, 17 bp, Homo sapiens
gggtcacccatggcctc

SEQ ID NO: 3830524 - DNA, 21 bp, Homo sapiens
gggtcacgttttgcctcatga

SEQ ID NO: 3830525 - DNA, 12 bp, Homo sapiens
gggtcagcaggc

SEQ ID NO: 3830526 - DNA, 13 bp, Homo sapiens
gggtcagcaggcc

SEQ ID NO: 3830527 - DNA, 17 bp, Homo sapiens
gggtcagcaggcccagg

SEQ ID NO: 3830528 - DNA, 21 bp, Homo sapiens
gggtcccaggacctgagcctg

SEQ ID NO: 3830529 - DNA, 22 bp, Homo sapiens
gggtcccaggacctgagcctgg

SEQ ID NO: 3830530 - DNA, 12 bp, Homo sapiens
gggtcgtgagcc

SEQ ID NO: 3830531 - DNA, 13 bp, Homo sapiens
gggtctcagcatg

SEQ ID NO: 3830532 - DNA, 16 bp, Homo sapiens
gggtgagaagggcagg

SEQ ID NO: 3830533 - DNA, 19 bp, Homo sapiens
gggtgagtccattctccca

SEQ ID NO: 3830534 - DNA, 22 bp, Homo sapiens
gggtgcttttatagaggctagc

SEQ ID NO: 3830535 - DNA, 20 bp, Homo sapiens
gggtggagagttgggggcca

SEQ ID NO: 3830536 - DNA, 14 bp, Homo sapiens
gggtggatataaat

SEQ ID NO: 3830537 - DNA, 12 bp, Homo sapiens
gggtggcagaga

SEQ ID NO: 3830538 - DNA, 15 bp, Homo sapiens
gggtggcagagacag

SEQ ID NO: 3830539 - DNA, 20 bp, Homo sapiens
gggtttcaccatgttggcca

SEQ ID NO: 3830540 - DNA, 14 bp, Homo sapiens
gggtttgaagctgc

SEQ ID NO: 3830541 - DNA, 20 bp, Homo sapiens
ggtaaatagagtgcataaat

SEQ ID NO: 3830542 - DNA, 13 bp, Homo sapiens
ggtaaatcaggga

SEQ ID NO: 3830543 - DNA, 12 bp, Homo sapiens
ggtaccagctgc

SEQ ID NO: 3830544 - DNA, 14 bp, Homo sapiens
ggtaccagctgcgc

SEQ ID NO: 3830545 - DNA, 15 bp, Homo sapiens
ggtaccagctgcgct

SEQ ID NO: 3830546 - DNA, 22 bp, Homo sapiens
ggtaggagtcttatatcccagg

SEQ ID NO: 3830547 - DNA, 14 bp, Homo sapiens
ggtcagcaggccca

SEQ ID NO: 3830548 - DNA, 16 bp, Homo sapiens
ggtcagcaggcccagg

SEQ ID NO: 3830549 - DNA, 18 bp, Homo sapiens
ggtcagcaggcccaggag

SEQ ID NO: 3830550 - DNA, 19 bp, Homo sapiens
ggtcccaggacctgagcct

SEQ ID NO: 3830551 - DNA, 14 bp, Homo sapiens
ggtccccgtagccc

SEQ ID NO: 3830552 - DNA, 21 bp, Homo sapiens
ggtctaccaagtaagacatct

SEQ ID NO: 3830553 - DNA, 13 bp, Homo sapiens
ggtctcagcatgt

SEQ ID NO: 3830554 - DNA, 17 bp, Homo sapiens
ggtgaccggcctggacc

SEQ ID NO: 3830555 - DNA, 15 bp, Homo sapiens
ggtgagaagggcagg

SEQ ID NO: 3830556 - DNA, 23 bp, Homo sapiens
ggtgaggaatttgaagctcagaa

SEQ ID NO: 3830557 - DNA, 18 bp, Homo sapiens
ggtgagggcaagaggtgc

SEQ ID NO: 3830558 - DNA, 20 bp, Homo sapiens
ggtgagtttgagctgccttc

SEQ ID NO: 3830559 - DNA, 22 bp, Homo sapiens
ggtgccacagagggctgtgtct

SEQ ID NO: 3830560 - DNA, 23 bp, Homo sapiens
ggtgccacagagggctgtgtctt

SEQ ID NO: 3830561 - DNA, 12 bp, Homo sapiens
ggtgccagcaaa

SEQ ID NO: 3830562 - DNA, 18 bp, Homo sapiens
ggtgccagcaaagcccca

SEQ ID NO: 3830563 - DNA, 17 bp, Homo sapiens
ggtgcctgagaggcagg

SEQ ID NO: 3830564 - DNA, 19 bp, Homo sapiens
ggtgcctgagaggcaggca

SEQ ID NO: 3830565 - DNA, 17 bp, Homo sapiens
ggtgcctgggaggagtg

SEQ ID NO: 3830566 - DNA, 16 bp, Homo sapiens
ggtgctaagcgggccc

SEQ ID NO: 3830567 - DNA, 21 bp, Homo sapiens
ggtgctggaggtgggagcagg

SEQ ID NO: 3830568 - DNA, 21 bp, Homo sapiens
ggtgcttttatagaggctagc

SEQ ID NO: 3830569 - DNA, 20 bp, Homo sapiens
ggtggacttagaaagcaggg

SEQ ID NO: 3830570 - DNA, 19 bp, Homo sapiens
ggtggagagttgggggcca

SEQ ID NO: 3830571 - DNA, 24 bp, Homo sapiens
ggtggagggggaggggagaagcca

SEQ ID NO: 3830572 - DNA, 19 bp, Homo sapiens
ggtggcagagacagtgggc

SEQ ID NO: 3830573 - DNA, 19 bp, Homo sapiens
ggtggctcatgcctgtaat

SEQ ID NO: 3830574 - DNA, 16 bp, Homo sapiens
ggtgggctctgtgcag

SEQ ID NO: 3830575 - DNA, 12 bp, Homo sapiens
ggtggggcagaa

SEQ ID NO: 3830576 - DNA, 19 bp, Homo sapiens
ggttccctccccagctcct

SEQ ID NO: 3830577 - DNA, 12 bp, Homo sapiens
ggtttgaagctg

SEQ ID NO: 3830578 - DNA, 12 bp, Homo sapiens
ggtttgccaagc

SEQ ID NO: 3830579 - DNA, 16 bp, Homo sapiens
ggtttgccaagccctt

SEQ ID NO: 3830580 - DNA, 18 bp, Homo sapiens
ggtttggaaaactaactc

SEQ ID NO: 3830581 - DNA, 19 bp, Homo sapiens
ggtttggaaaactaactca

SEQ ID NO: 3830582 - DNA, 20 bp, Homo sapiens
gtaaaaagtagattaaaata

SEQ ID NO: 3830583 - DNA, 23 bp, Homo sapiens
gtaaacctgaaatatattttaaa

SEQ ID NO: 3830584 - DNA, 16 bp, Homo sapiens
gtaaactaaagtgtgc

SEQ ID NO: 3830585 - DNA, 16 bp, Homo sapiens
gtaaagtctagaaaat

SEQ ID NO: 3830586 - DNA, 16 bp, Homo sapiens
gtaaatatttcataaa

SEQ ID NO: 3830587 - DNA, 10 bp, Homo sapiens
gtaaatgctg

SEQ ID NO: 3830588 - DNA, 18 bp, Homo sapiens
gtaaatgctgtaaatatt

SEQ ID NO: 3830589 - DNA, 20 bp, Homo sapiens
gtaaatgctgtaaatatttc

SEQ ID NO: 3830590 - DNA, 14 bp, Homo sapiens
gtaaattattttat

SEQ ID NO: 3830591 - DNA, 15 bp, Homo sapiens
gtaaattattttatg

SEQ ID NO: 3830592 - DNA, 17 bp, Homo sapiens
gtaacagttagccactg

SEQ ID NO: 3830593 - DNA, 14 bp, Homo sapiens
gtaactgaagcata

SEQ ID NO: 3830594 - DNA, 19 bp, Homo sapiens
gtaactgaagcataaacat

SEQ ID NO: 3830595 - DNA, 17 bp, Homo sapiens
gtaagaaagaaggcaaa

SEQ ID NO: 3830596 - DNA, 15 bp, Homo sapiens
gtaagagtttacaag

SEQ ID NO: 3830597 - DNA, 16 bp, Homo sapiens
gtaagcccagcatttg

SEQ ID NO: 3830598 - DNA, 14 bp, Homo sapiens
gtaagtaagaaaga

SEQ ID NO: 3830599 - DNA, 16 bp, Homo sapiens
gtaagtaagtaagaaa

SEQ ID NO: 3830600 - DNA, 11 bp, Homo sapiens
gtaataaatat

SEQ ID NO: 3830601 - DNA, 12 bp, Homo sapiens
gtaataaatatg

SEQ ID NO: 3830602 - DNA, 15 bp, Homo sapiens
gtaataaatgtatta

SEQ ID NO: 3830603 - DNA, 21 bp, Homo sapiens
gtaatccaagcaaatgtgaat

SEQ ID NO: 3830604 - DNA, 19 bp, Homo sapiens
gtaccagctgcgcttgctt

SEQ ID NO: 3830605 - DNA, 13 bp, Homo sapiens
gtactgtctgtgt

SEQ ID NO: 3830606 - DNA, 15 bp, Homo sapiens
gtagattcccttgca

SEQ ID NO: 3830607 - DNA, 19 bp, Homo sapiens
gtagccagggggactagcc

SEQ ID NO: 3830608 - DNA, 23 bp, Homo sapiens
gtagccagggggactagcccctg

SEQ ID NO: 3830609 - DNA, 18 bp, Homo sapiens
gtagctgggattacaggc

SEQ ID NO: 3830610 - DNA, 24 bp, Homo sapiens
gtagtggtattatactgtagattt

SEQ ID NO: 3830611 - DNA, 15 bp, Homo sapiens
gtagtttgcccagag

SEQ ID NO: 3830612 - DNA, 14 bp, Homo sapiens
gtataaaagacaaa

SEQ ID NO: 3830613 - DNA, 18 bp, Homo sapiens
gtataaaagggactgaga

SEQ ID NO: 3830614 - DNA, 20 bp, Homo sapiens
gtataaggagctttgctctt

SEQ ID NO: 3830615 - DNA, 17 bp, Homo sapiens
gtataattcacattgta

SEQ ID NO: 3830616 - DNA, 13 bp, Homo sapiens
gtatataaaatgt

SEQ ID NO: 3830617 - DNA, 14 bp, Homo sapiens
gtatatcagggttt

SEQ ID NO: 3830618 - DNA, 15 bp, Homo sapiens
gtatatttgtaaaag

SEQ ID NO: 3830619 - DNA, 18 bp, Homo sapiens
gtatgaattttgtaagta

SEQ ID NO: 3830620 - DNA, 20 bp, Homo sapiens
gtattaaactgtaaatcata

SEQ ID NO: 3830621 - DNA, 23 bp, Homo sapiens
gtattaaactgtaaatcataatg

SEQ ID NO: 3830622 - DNA, 19 bp, Homo sapiens
gtattaagtgaaattttaa

SEQ ID NO: 3830623 - DNA, 15 bp, Homo sapiens
gtattatgtgtgttt

SEQ ID NO: 3830624 - DNA, 23 bp, Homo sapiens
gtattgtgtttatgcatttcaat

SEQ ID NO: 3830625 - DNA, 22 bp, Homo sapiens
gtatttcttccagtgatgttga

SEQ ID NO: 3830626 - DNA, 15 bp, Homo sapiens
tagaacacagaaagc

SEQ ID NO: 3830627 - DNA, 15 bp, Homo sapiens
tagaacttgaactaa

SEQ ID NO: 3830628 - DNA, 17 bp, Homo sapiens
tagaagaggcctttgga

SEQ ID NO: 3830629 - DNA, 19 bp, Homo sapiens
tagaagccaagggaaaggg

SEQ ID NO: 3830630 - DNA, 14 bp, Homo sapiens
tagaagttaccaaa

SEQ ID NO: 3830631 - DNA, 20 bp, Homo sapiens
tagacagtaagagtttacaa

SEQ ID NO: 3830632 - DNA, 14 bp, Homo sapiens
tagaccctctcaag

SEQ ID NO: 3830633 - DNA, 12 bp, Homo sapiens
tagagccaggca

SEQ ID NO: 3830634 - DNA, 15 bp, Homo sapiens
tagagccaggcacac

SEQ ID NO: 3830635 - DNA, 21 bp, Homo sapiens
tagagccaggcacacactgtg

SEQ ID NO: 3830636 - DNA, 14 bp, Homo sapiens
tagaggcttctccg

SEQ ID NO: 3830637 - DNA, 19 bp, Homo sapiens
tagaggcttctccgccagc

SEQ ID NO: 3830638 - DNA, 21 bp, Homo sapiens
tagaggcttctccgccagcct

SEQ ID NO: 3830639 - DNA, 19 bp, Homo sapiens
tagagtgagggcctgaggt

SEQ ID NO: 3830640 - DNA, 15 bp, Homo sapiens
tagagtgcataaata

SEQ ID NO: 3830641 - DNA, 16 bp, Homo sapiens
tagatcacaactgaag

SEQ ID NO: 3830642 - DNA, 15 bp, Homo sapiens
tagatgagtttttca

SEQ ID NO: 3830643 - DNA, 17 bp, Homo sapiens
tagatgagtttttcatt

SEQ ID NO: 3830644 - DNA, 23 bp, Homo sapiens
tagattaggtcacattacattaa

SEQ ID NO: 3830645 - DNA, 14 bp, Homo sapiens
tagatttaatttac

SEQ ID NO: 3830646 - DNA, 23 bp, Homo sapiens
tagatttcagtagtttctaagtc

SEQ ID NO: 3830647 - DNA, 23 bp, Homo sapiens
tagccaaacaacaacaaaaacaa

SEQ ID NO: 3830648 - DNA, 13 bp, Homo sapiens
tagccactgctgg

SEQ ID NO: 3830649 - DNA, 23 bp, Homo sapiens
tagccatgtgaaactcatctcat

SEQ ID NO: 3830650 - DNA, 15 bp, Homo sapiens
tagcccaggagagag

SEQ ID NO: 3830651 - DNA, 14 bp, Homo sapiens
tagcccatccctgc

SEQ ID NO: 3830652 - DNA, 16 bp, Homo sapiens
tagcccatccctgcct

SEQ ID NO: 3830653 - DNA, 18 bp, Homo sapiens
tagcccatccctgcctgg

SEQ ID NO: 3830654 - DNA, 12 bp, Homo sapiens
tagcctccctct

SEQ ID NO: 3830655 - DNA, 17 bp, Homo sapiens
tagcctccctctcctct

SEQ ID NO: 3830656 - DNA, 22 bp, Homo sapiens
tagcctgggcctcctcctagct

SEQ ID NO: 3830657 - DNA, 23 bp, Homo sapiens
tagctctggagtgagtctgtcat

SEQ ID NO: 3830658 - DNA, 19 bp, Homo sapiens
tagctggtttttcccacca

SEQ ID NO: 3830659 - DNA, 13 bp, Homo sapiens
tagcttctgcttt

SEQ ID NO: 3830660 - DNA, 16 bp, Homo sapiens
tagcttctgcttttct

SEQ ID NO: 3830661 - DNA, 16 bp, Homo sapiens
tagctttagaccctgg

SEQ ID NO: 3830662 - DNA, 21 bp, Homo sapiens
taggaaggccatggggcagcc

SEQ ID NO: 3830663 - DNA, 22 bp, Homo sapiens
taggaaggccatggggcagcct

SEQ ID NO: 3830664 - DNA, 14 bp, Homo sapiens
taggaattgtgttt

SEQ ID NO: 3830665 - DNA, 15 bp, Homo sapiens
taggacaaggctgtg

SEQ ID NO: 3830666 - DNA, 18 bp, Homo sapiens
taggacaaggctgtgcca

SEQ ID NO: 3830667 - DNA, 20 bp, Homo sapiens
taggacaaggctgtgccagg

SEQ ID NO: 3830668 - DNA, 21 bp, Homo sapiens
taggagtcttatatcccaggt

SEQ ID NO: 3830669 - DNA, 19 bp, Homo sapiens
taggcagaagaagctggga

SEQ ID NO: 3830670 - DNA, 21 bp, Homo sapiens
taggcagaagaagctgggagg

SEQ ID NO: 3830671 - DNA, 22 bp, Homo sapiens
taggcagaagaagctgggaggg

SEQ ID NO: 3830672 - DNA, 12 bp, Homo sapiens
taggcctgcctt

SEQ ID NO: 3830673 - DNA, 14 bp, Homo sapiens
taggggaatgtttt

SEQ ID NO: 3830674 - DNA, 12 bp, Homo sapiens
taggggaggggg

SEQ ID NO: 3830675 - DNA, 23 bp, Homo sapiens
taggggaggggggagccagaggc

SEQ ID NO: 3830676 - DNA, 15 bp, Homo sapiens
taggtctcaatacct

SEQ ID NO: 3830677 - DNA, 22 bp, Homo sapiens
tagtaaaattctactgtatgga

SEQ ID NO: 3830678 - DNA, 20 bp, Homo sapiens
tagtaccaaatgctttaaaa

SEQ ID NO: 3830679 - DNA, 18 bp, Homo sapiens
tagtactgctttactgtg

SEQ ID NO: 3830680 - DNA, 14 bp, Homo sapiens
tagtattaagtgaa

SEQ ID NO: 3830681 - DNA, 12 bp, Homo sapiens
tagtctggaaag

SEQ ID NO: 3830682 - DNA, 19 bp, Homo sapiens
tagtgctgaagcttattaa

SEQ ID NO: 3830683 - DNA, 16 bp, Homo sapiens
tagttaagcatgactt

SEQ ID NO: 3830684 - DNA, 19 bp, Homo sapiens
tagtttctaagtctgttat

SEQ ID NO: 3830685 - DNA, 19 bp, Homo sapiens
tagtttgcccagagttggg

SEQ ID NO: 3830686 - DNA, 15 bp, Homo sapiens
tataaaaaaaagttg

SEQ ID NO: 3830687 - DNA, 18 bp, Homo sapiens
tataaaaaaaagttgttt

SEQ ID NO: 3830688 - DNA, 22 bp, Homo sapiens
tataaaaaaaagttgtttataa

SEQ ID NO: 3830689 - DNA, 14 bp, Homo sapiens
tataaaagcctgtt

SEQ ID NO: 3830690 - DNA, 13 bp, Homo sapiens
tataaaatgtgcg

SEQ ID NO: 3830691 - DNA, 17 bp, Homo sapiens
tataaacaaacaaacaa

SEQ ID NO: 3830692 - DNA, 17 bp, Homo sapiens
tataaatatatataaat

SEQ ID NO: 3830693 - DNA, 22 bp, Homo sapiens
tataaccaccaagtattaaact

SEQ ID NO: 3830694 - DNA, 15 bp, Homo sapiens
tataagaaaactaca

SEQ ID NO: 3830695 - DNA, 17 bp, Homo sapiens
tataaggagctttgctc

SEQ ID NO: 3830696 - DNA, 19 bp, Homo sapiens
tataaggagctttgctctt

SEQ ID NO: 3830697 - DNA, 12 bp, Homo sapiens
tataagtttctt

SEQ ID NO: 3830698 - DNA, 18 bp, Homo sapiens
tataatattcatacaaca

SEQ ID NO: 3830699 - DNA, 22 bp, Homo sapiens
tatacagaattgtgtctgcagg

SEQ ID NO: 3830700 - DNA, 14 bp, Homo sapiens
tatagactgacttt

SEQ ID NO: 3830701 - DNA, 14 bp, Homo sapiens
tatagataaagaga

SEQ ID NO: 3830702 - DNA, 15 bp, Homo sapiens
tatagataaagagat

SEQ ID NO: 3830703 - DNA, 20 bp, Homo sapiens
tatagatgagtttttcatta

SEQ ID NO: 3830704 - DNA, 19 bp, Homo sapiens
tatagtactgctttactgt

SEQ ID NO: 3830705 - DNA, 23 bp, Homo sapiens
tatagtactgctttactgtgtat

SEQ ID NO: 3830706 - DNA, 23 bp, Homo sapiens
tatagtattaagtgaaattttaa

SEQ ID NO: 3830707 - DNA, 16 bp, Homo sapiens
tatagttatatagata

SEQ ID NO: 3830708 - DNA, 20 bp, Homo sapiens
tatagttatatagataaaga

SEQ ID NO: 3830709 - DNA, 23 bp, Homo sapiens
tatataaaatgtgcgaggatcct

SEQ ID NO: 3830710 - DNA, 14 bp, Homo sapiens
tatataaatactat

SEQ ID NO: 3830711 - DNA, 20 bp, Homo sapiens
tatataaatatatataaata

SEQ ID NO: 3830712 - DNA, 15 bp, Homo sapiens
tatatagataaagag

SEQ ID NO: 3830713 - DNA, 16 bp, Homo sapiens
tatatatcctctgtat

SEQ ID NO: 3830714 - DNA, 12 bp, Homo sapiens
tatatctttgta

SEQ ID NO: 3830715 - DNA, 13 bp, Homo sapiens
tatatctttgtaa

SEQ ID NO: 3830716 - DNA, 15 bp, Homo sapiens
tatatgccttactat

SEQ ID NO: 3830717 - DNA, 18 bp, Homo sapiens
tatatgccttactattgt

SEQ ID NO: 3830718 - DNA, 15 bp, Homo sapiens
tatattaacttttat

SEQ ID NO: 3830719 - DNA, 16 bp, Homo sapiens
tatattgatccagaaa

SEQ ID NO: 3830720 - DNA, 15 bp, Homo sapiens
tatattgtgttttaa

SEQ ID NO: 3830721 - DNA, 19 bp, Homo sapiens
tatattgtgttttaacacc

SEQ ID NO: 3830722 - DNA, 12 bp, Homo sapiens
tatatttgtaaa

SEQ ID NO: 3830723 - DNA, 21 bp, Homo sapiens
tatcaaagaccttgtgtgtat

SEQ ID NO: 3830724 - DNA, 23 bp, Homo sapiens
tatcaatccaaattccctctgga

SEQ ID NO: 3830725 - DNA, 18 bp, Homo sapiens
tatcagacttcaccaaat

SEQ ID NO: 3830726 - DNA, 15 bp, Homo sapiens
tatcagtatggtgct

SEQ ID NO: 3830727 - DNA, 23 bp, Homo sapiens
tatcagtcatgacagatgaagaa

SEQ ID NO: 3830728 - DNA, 21 bp, Homo sapiens
tatcataatatattgtgtttt

SEQ ID NO: 3830729 - DNA, 12 bp, Homo sapiens
tatcattcagca

SEQ ID NO: 3830730 - DNA, 13 bp, Homo sapiens
tatcattcagcaa

SEQ ID NO: 3830731 - DNA, 15 bp, Homo sapiens
tatccttcctagtgg

SEQ ID NO: 3830732 - DNA, 15 bp, Homo sapiens
tatctatatgtctat

SEQ ID NO: 3830733 - DNA, 18 bp, Homo sapiens
tatctatatgtctataag

SEQ ID NO: 3830734 - DNA, 14 bp, Homo sapiens
tatctgaactaatt

SEQ ID NO: 3830735 - DNA, 16 bp, Homo sapiens
tatctttgtaaattat

SEQ ID NO: 3830736 - DNA, 20 bp, Homo sapiens
tatgaaattcatggcttttt

SEQ ID NO: 3830737 - DNA, 17 bp, Homo sapiens
tatgatacttgaaaatt

SEQ ID NO: 3830738 - DNA, 14 bp, Homo sapiens
tatgatttgcattt

SEQ ID NO: 3830739 - DNA, 20 bp, Homo sapiens
tatgcatattattttatgtt

SEQ ID NO: 3830740 - DNA, 17 bp, Homo sapiens
tatgcctgttgcaggca

SEQ ID NO: 3830741 - DNA, 22 bp, Homo sapiens
tatgctgcatttggctggagcc

SEQ ID NO: 3830742 - DNA, 13 bp, Homo sapiens
tatgcttcttgga

SEQ ID NO: 3830743 - DNA, 18 bp, Homo sapiens
tatggctcatgtctgaaa

SEQ ID NO: 3830744 - DNA, 20 bp, Homo sapiens
tatggctcatgtctgaaaaa

SEQ ID NO: 3830745 - DNA, 14 bp, Homo sapiens
tatggttgccaccc

SEQ ID NO: 3830746 - DNA, 18 bp, Homo sapiens
tatggttttgttttcaat

SEQ ID NO: 3830747 - DNA, 23 bp, Homo sapiens
tatggttttgttttcaatgaatt

SEQ ID NO: 3830748 - DNA, 18 bp, Homo sapiens
tatgtcatagtttaattg

SEQ ID NO: 3830749 - DNA, 15 bp, Homo sapiens
tatgtctataagtat

SEQ ID NO: 3830750 - DNA, 21 bp, Homo sapiens
tatgtctataagtatataaat

SEQ ID NO: 3830751 - DNA, 15 bp, Homo sapiens
tatgtgaacattcct

SEQ ID NO: 3830752 - DNA, 14 bp, Homo sapiens
tatgtgccagattt

SEQ ID NO: 3830753 - DNA, 12 bp, Homo sapiens
tattaaaaagaa

SEQ ID NO: 3830754 - DNA, 16 bp, Homo sapiens
tattaaaccttcagat

SEQ ID NO: 3830755 - DNA, 12 bp, Homo sapiens
tattaaactgta

SEQ ID NO: 3830756 - DNA, 19 bp, Homo sapiens
tattaaactgtaaatcata

SEQ ID NO: 3830757 - DNA, 21 bp, Homo sapiens
tattaaactgtaaatcataat

SEQ ID NO: 3830758 - DNA, 12 bp, Homo sapiens
tattaaagataa

SEQ ID NO: 3830759 - DNA, 14 bp, Homo sapiens
tctggaatttgaaa

SEQ ID NO: 3830760 - DNA, 14 bp, Homo sapiens
tctggacggcaggc

SEQ ID NO: 3830761 - DNA, 17 bp, Homo sapiens
tctggacggcaggctca

SEQ ID NO: 3830762 - DNA, 18 bp, Homo sapiens
tctggagacagccccaga

SEQ ID NO: 3830763 - DNA, 24 bp, Homo sapiens
tctggagacagccccagagcaggg

SEQ ID NO: 3830764 - DNA, 16 bp, Homo sapiens
tctggagtgagtctgt

SEQ ID NO: 3830765 - DNA, 13 bp, Homo sapiens
tctggcccaggct

SEQ ID NO: 3830766 - DNA, 22 bp, Homo sapiens
tctggcccaggctggcccccac

SEQ ID NO: 3830767 - DNA, 13 bp, Homo sapiens
tctggcctcaggt

SEQ ID NO: 3830768 - DNA, 19 bp, Homo sapiens
tctgtaattacaactaaat

SEQ ID NO: 3830769 - DNA, 23 bp, Homo sapiens
tctgtattttatttagacaagag

SEQ ID NO: 3830770 - DNA, 13 bp, Homo sapiens
tctgtcataatat

SEQ ID NO: 3830771 - DNA, 23 bp, Homo sapiens
tctgtgacctcaggcactagcct

SEQ ID NO: 3830772 - DNA, 20 bp, Homo sapiens
tctgtgccaaagcagctaca

SEQ ID NO: 3830773 - DNA, 14 bp, Homo sapiens
tctgtgtgctacta

SEQ ID NO: 3830774 - DNA, 16 bp, Homo sapiens
tctgttattgttttgt

SEQ ID NO: 3830775 - DNA, 23 bp, Homo sapiens
tctgttgtgcatgctcaaatgaa

SEQ ID NO: 3830776 - DNA, 18 bp, Homo sapiens
tcttaaactcttgaatat

SEQ ID NO: 3830777 - DNA, 16 bp, Homo sapiens
tcttacttgagtatca

SEQ ID NO: 3830778 - DNA, 18 bp, Homo sapiens
tcttacttgagtatcata

SEQ ID NO: 3830779 - DNA, 19 bp, Homo sapiens
tcttacttgagtatcataa

SEQ ID NO: 3830780 - DNA, 21 bp, Homo sapiens
tcttacttgagtatcataata

SEQ ID NO: 3830781 - DNA, 22 bp, Homo sapiens
tcttacttgagtatcataatat

SEQ ID NO: 3830782 - DNA, 23 bp, Homo sapiens
tcttactttcctttccccagccc

SEQ ID NO: 3830783 - DNA, 20 bp, Homo sapiens
tcttactttttgtaaatgct

SEQ ID NO: 3830784 - DNA, 18 bp, Homo sapiens
tcttccagtgatgttgaa

SEQ ID NO: 3830785 - DNA, 16 bp, Homo sapiens
tcttccatcccaggac

SEQ ID NO: 3830786 - DNA, 13 bp, Homo sapiens
tcttccttctgcc

SEQ ID NO: 3830787 - DNA, 14 bp, Homo sapiens
tcttctcctcagct

SEQ ID NO: 3830788 - DNA, 16 bp, Homo sapiens
tcttctcctcagcttg

SEQ ID NO: 3830789 - DNA, 22 bp, Homo sapiens
tcttctgtatttttttttctaa

SEQ ID NO: 3830790 - DNA, 15 bp, Homo sapiens
tcttgaactcctgac

SEQ ID NO: 3830791 - DNA, 14 bp, Homo sapiens
tcttgatctgctca

SEQ ID NO: 3830792 - DNA, 16 bp, Homo sapiens
tcttggaaaaagtgat

SEQ ID NO: 3830793 - DNA, 14 bp, Homo sapiens
tcttggagtcttcc

SEQ ID NO: 3830794 - DNA, 21 bp, Homo sapiens
tcttggcccgcacagagctgg

SEQ ID NO: 3830795 - DNA, 22 bp, Homo sapiens
tcttgtgactagtgctgaagct

SEQ ID NO: 3830796 - DNA, 23 bp, Homo sapiens
tcttgtgactagtgctgaagctt

SEQ ID NO: 3830797 - DNA, 17 bp, Homo sapiens
tctttaagtgaaggatt

SEQ ID NO: 3830798 - DNA, 16 bp, Homo sapiens
tctttacccaaggatt

SEQ ID NO: 3830799 - DNA, 21 bp, Homo sapiens
tctttacccaaggatttttaa

SEQ ID NO: 3830800 - DNA, 17 bp, Homo sapiens
tctttcatgccatttta

SEQ ID NO: 3830801 - DNA, 14 bp, Homo sapiens
tctttgaactgccg

SEQ ID NO: 3830802 - DNA, 23 bp, Homo sapiens
tctttggggagagctggcagtgt

SEQ ID NO: 3830803 - DNA, 14 bp, Homo sapiens
tctttggggtaaaa

SEQ ID NO: 3830804 - DNA, 14 bp, Homo sapiens
tctttttgaagtgt

SEQ ID NO: 3830805 - DNA, 15 bp, Homo sapiens
tctttttgattttta

SEQ ID NO: 3830806 - DNA, 19 bp, Homo sapiens
tctttttgtttttctttta

SEQ ID NO: 3830807 - DNA, 22 bp, Homo sapiens
tcttttttctaaagtaaaaaca

SEQ ID NO: 3830808 - DNA, 16 bp, Homo sapiens
tgaaaagggcagaggc

SEQ ID NO: 3830809 - DNA, 14 bp, Homo sapiens
tgaaaattaacatg

SEQ ID NO: 3830810 - DNA, 18 bp, Homo sapiens
tgaaacaacattatttta

SEQ ID NO: 3830811 - DNA, 22 bp, Homo sapiens
tgaaacaacattattttaaaat

SEQ ID NO: 3830812 - DNA, 15 bp, Homo sapiens
tgaaacactttgcat

SEQ ID NO: 3830813 - DNA, 12 bp, Homo sapiens
tgaaactaatca

SEQ ID NO: 3830814 - DNA, 16 bp, Homo sapiens
tgaaactttgctttgg

SEQ ID NO: 3830815 - DNA, 15 bp, Homo sapiens
tgaaagcctctggaa

SEQ ID NO: 3830816 - DNA, 21 bp, Homo sapiens
tgaaagtcttgtgactagtgc

SEQ ID NO: 3830817 - DNA, 19 bp, Homo sapiens
tgaaatatattttaaatgt

SEQ ID NO: 3830818 - DNA, 16 bp, Homo sapiens
tgaaatcatctttgtt

SEQ ID NO: 3830819 - DNA, 14 bp, Homo sapiens
tgaaatctgctctg

SEQ ID NO: 3830820 - DNA, 23 bp, Homo sapiens
tgaaatttatacaccaattgatt

SEQ ID NO: 3830821 - DNA, 12 bp, Homo sapiens
tgaaatttcatg

SEQ ID NO: 3830822 - DNA, 14 bp, Homo sapiens
tgaaattttaaatg

SEQ ID NO: 3830823 - DNA, 15 bp, Homo sapiens
tgaaattttaaatgc

SEQ ID NO: 3830824 - DNA, 19 bp, Homo sapiens
tgaacaaagtctctgggtc

SEQ ID NO: 3830825 - DNA, 18 bp, Homo sapiens
tgaacatcagaaggtatt

SEQ ID NO: 3830826 - DNA, 12 bp, Homo sapiens
tgaacattccta

SEQ ID NO: 3830827 - DNA, 20 bp, Homo sapiens
tgaactaacataatcttaaa

SEQ ID NO: 3830828 - DNA, 15 bp, Homo sapiens
tgaactaattcattt

SEQ ID NO: 3830829 - DNA, 16 bp, Homo sapiens
tgaactaattcattta

SEQ ID NO: 3830830 - DNA, 17 bp, Homo sapiens
tgaactaattcatttat

SEQ ID NO: 3830831 - DNA, 17 bp, Homo sapiens
tgaagacaggcacaaaa

SEQ ID NO: 3830832 - DNA, 22 bp, Homo sapiens
tgaagacaggcacaaaatgtga

SEQ ID NO: 3830833 - DNA, 16 bp, Homo sapiens
tgaagcataaacatca

SEQ ID NO: 3830834 - DNA, 11 bp, Homo sapiens
tgaagccaaag

SEQ ID NO: 3830835 - DNA, 14 bp, Homo sapiens
tgaagccaaagaaa

SEQ ID NO: 3830836 - DNA, 23 bp, Homo sapiens
tgaagccaagtggggtgctggga

SEQ ID NO: 3830837 - DNA, 18 bp, Homo sapiens
tgaagccacacagcccag

SEQ ID NO: 3830838 - DNA, 19 bp, Homo sapiens
tgaagccacacagcccaga

SEQ ID NO: 3830839 - DNA, 22 bp, Homo sapiens
tgaagccacacagcccagaagg

SEQ ID NO: 3830840 - DNA, 11 bp, Homo sapiens
tgaagcctgga

SEQ ID NO: 3830841 - DNA, 12 bp, Homo sapiens
tgaagcctggac

SEQ ID NO: 3830842 - DNA, 21 bp, Homo sapiens
tgaagctcagaaaggttgagg

SEQ ID NO: 3830843 - DNA, 12 bp, Homo sapiens
tgaagctgctgt

SEQ ID NO: 3830844 - DNA, 16 bp, Homo sapiens
tgaagctgctgtctct

SEQ ID NO: 3830845 - DNA, 16 bp, Homo sapiens
tgaagcttattaatgc

SEQ ID NO: 3830846 - DNA, 17 bp, Homo sapiens
tgaagcttattaatgct

SEQ ID NO: 3830847 - DNA, 23 bp, Homo sapiens
tgaaggaaaaacacaagcaaaaa

SEQ ID NO: 3830848 - DNA, 19 bp, Homo sapiens
tgaatagcttatgtacaaa

SEQ ID NO: 3830849 - DNA, 16 bp, Homo sapiens
tgaatatgtgccttct

SEQ ID NO: 3830850 - DNA, 20 bp, Homo sapiens
tgaatatgtgccttctagaa

SEQ ID NO: 3830851 - DNA, 18 bp, Homo sapiens
tgaatatttagtgttcat

SEQ ID NO: 3830852 - DNA, 23 bp, Homo sapiens
tgaatcattttacctttgacaaa

SEQ ID NO: 3830853 - DNA, 12 bp, Homo sapiens
tgaatccaaatg

SEQ ID NO: 3830854 - DNA, 16 bp, Homo sapiens
tgaatcctagggcctg

SEQ ID NO: 3830855 - DNA, 17 bp, Homo sapiens
tgaatgaatacacagga

SEQ ID NO: 3830856 - DNA, 11 bp, Homo sapiens
tgaattaagaa

SEQ ID NO: 3830857 - DNA, 19 bp, Homo sapiens
tgaattaagaaagattaaa

SEQ ID NO: 3830858 - DNA, 23 bp, Homo sapiens
tgaattaagaaagattaaatata

SEQ ID NO: 3830859 - DNA, 22 bp, Homo sapiens
tgaattttgtaagtataagaaa

SEQ ID NO: 3830860 - DNA, 17 bp, Homo sapiens
tgacaacgaaagtaaag

SEQ ID NO: 3830861 - DNA, 15 bp, Homo sapiens
tgacaagtgtctttt

SEQ ID NO: 3830862 - DNA, 12 bp, Homo sapiens
tgacaagtgtgt

SEQ ID NO: 3830863 - DNA, 13 bp, Homo sapiens
tgacacatcttca

SEQ ID NO: 3830864 - DNA, 19 bp, Homo sapiens
tgacacctttaaaaagcag

SEQ ID NO: 3830865 - DNA, 17 bp, Homo sapiens
tgacagatgaagaagga

SEQ ID NO: 3830866 - DNA, 23 bp, Homo sapiens
tgacagggcccagttaaatatga

SEQ ID NO: 3830867 - DNA, 15 bp, Homo sapiens
tgacatggtgcctga

SEQ ID NO: 3830868 - DNA, 21 bp, Homo sapiens
tgacatggtgcctgagaggca

SEQ ID NO: 3830869 - DNA, 18 bp, Homo sapiens
tgaccacaggcagttact

SEQ ID NO: 3830870 - DNA, 22 bp, Homo sapiens
tgaccgcttccccgatgtgagc

SEQ ID NO: 3830871 - DNA, 20 bp, Homo sapiens
tgaccggcctggaccttggc

SEQ ID NO: 3830872 - DNA, 18 bp, Homo sapiens
tgacctcaggcactagcc

SEQ ID NO: 3830873 - DNA, 13 bp, Homo sapiens
tgaccttacattt

SEQ ID NO: 3830874 - DNA, 19 bp, Homo sapiens
tgaccttgtgaacatcaga

SEQ ID NO: 3830875 - DNA, 21 bp, Homo sapiens
tgacctttaactgagggctga

SEQ ID NO: 3830876 - DNA, 18 bp, Homo sapiens
tgacggtattatgcttct

SEQ ID NO: 3830877 - DNA, 22 bp, Homo sapiens
tgactaaagacctgctgtaata

SEQ ID NO: 3830878 - DNA, 14 bp, Homo sapiens
tgactcaagattcc

SEQ ID NO: 3830879 - DNA, 22 bp, Homo sapiens
tgactcaagattcccaggagtt

SEQ ID NO: 3830880 - DNA, 15 bp, Homo sapiens
tgactttttccattt

SEQ ID NO: 3830881 - DNA, 17 bp, Homo sapiens
tgagaaatctaaaaaac

SEQ ID NO: 3830882 - DNA, 13 bp, Homo sapiens
tgagaaggagaga

SEQ ID NO: 3830883 - DNA, 23 bp, Homo sapiens
tgagaagggcaggggtgtcctga

SEQ ID NO: 3830884 - DNA, 11 bp, Homo sapiens
tgagagagagg

SEQ ID NO: 3830885 - DNA, 21 bp, Homo sapiens
tgagagagagggcgcccagcc

SEQ ID NO: 3830886 - DNA, 16 bp, Homo sapiens
tgagagaggacctcca

SEQ ID NO: 3830887 - DNA, 18 bp, Homo sapiens
tgagagaggacctccatg

SEQ ID NO: 3830888 - DNA, 15 bp, Homo sapiens
tgagagccccttggt

SEQ ID NO: 3830889 - DNA, 13 bp, Homo sapiens
tgagagctgttcc

SEQ ID NO: 3830890 - DNA, 13 bp, Homo sapiens
tgagaggctgagg

SEQ ID NO: 3830891 - DNA, 14 bp, Homo sapiens
tgtaaatatttcat

SEQ ID NO: 3830892 - DNA, 15 bp, Homo sapiens
tgtaaatatttcata

SEQ ID NO: 3830893 - DNA, 16 bp, Homo sapiens
tgtaaatatttcataa

SEQ ID NO: 3830894 - DNA, 15 bp, Homo sapiens
tgtaaatgctgtaaa

SEQ ID NO: 3830895 - DNA, 18 bp, Homo sapiens
tgtaaatgctgtaaatat

SEQ ID NO: 3830896 - DNA, 14 bp, Homo sapiens
tgtaaattatttta

SEQ ID NO: 3830897 - DNA, 17 bp, Homo sapiens
tgtaaattattttatgt

SEQ ID NO: 3830898 - DNA, 21 bp, Homo sapiens
tgtaaattattttatgtcata

SEQ ID NO: 3830899 - DNA, 17 bp, Homo sapiens
tgtaactgaagcataaa

SEQ ID NO: 3830900 - DNA, 17 bp, Homo sapiens
tgtaagtaagtaagaaa

SEQ ID NO: 3830901 - DNA, 20 bp, Homo sapiens
tgtaagtataagaaatttta

SEQ ID NO: 3830902 - DNA, 12 bp, Homo sapiens
tgtaataaatat

SEQ ID NO: 3830903 - DNA, 14 bp, Homo sapiens
tgtaataaatatga

SEQ ID NO: 3830904 - DNA, 16 bp, Homo sapiens
tgtaatagagaatatt

SEQ ID NO: 3830905 - DNA, 16 bp, Homo sapiens
tgtaatcccagcactt

SEQ ID NO: 3830906 - DNA, 15 bp, Homo sapiens
tgtaattacaactaa

SEQ ID NO: 3830907 - DNA, 17 bp, Homo sapiens
tgtaattacaactaaat

SEQ ID NO: 3830908 - DNA, 12 bp, Homo sapiens
tgtacaaaaaag

SEQ ID NO: 3830909 - DNA, 12 bp, Homo sapiens
tgtacaggttgg

SEQ ID NO: 3830910 - DNA, 18 bp, Homo sapiens
tgtacaggttggatgtgg

SEQ ID NO: 3830911 - DNA, 22 bp, Homo sapiens
tgtacagtttgtttacacacgt

SEQ ID NO: 3830912 - DNA, 16 bp, Homo sapiens
tgtagaacttgaacta

SEQ ID NO: 3830913 - DNA, 17 bp, Homo sapiens
tgtagcaaccatttgta

SEQ ID NO: 3830914 - DNA, 16 bp, Homo sapiens
tgtagtttgcccagag

SEQ ID NO: 3830915 - DNA, 17 bp, Homo sapiens
tgtagtttgcccagagt

SEQ ID NO: 3830916 - DNA, 22 bp, Homo sapiens
tgtataaaagggactgagaaat

SEQ ID NO: 3830917 - DNA, 19 bp, Homo sapiens
tgtataaggagctttgctc

SEQ ID NO: 3830918 - DNA, 16 bp, Homo sapiens
tgtatagatgagtttt

SEQ ID NO: 3830919 - DNA, 16 bp, Homo sapiens
tgtatataaaatgtgc

SEQ ID NO: 3830920 - DNA, 18 bp, Homo sapiens
tgtatataaaatgtgcga

SEQ ID NO: 3830921 - DNA, 16 bp, Homo sapiens
tgtatcgtggagaaac

SEQ ID NO: 3830922 - DNA, 18 bp, Homo sapiens
tgtatcgtggagaaacaa

SEQ ID NO: 3830923 - DNA, 22 bp, Homo sapiens
tgtatcgtggagaaacaagaga

SEQ ID NO: 3830924 - DNA, 12 bp, Homo sapiens
tgtatgaatttt

SEQ ID NO: 3830925 - DNA, 24 bp, Homo sapiens
tgtatgaattttgtaagtataaga

SEQ ID NO: 3830926 - DNA, 22 bp, Homo sapiens
tgtattatagtactgctttact

SEQ ID NO: 3830927 - DNA, 23 bp, Homo sapiens
tgtattgatgacagtagtaccaa

SEQ ID NO: 3830928 - DNA, 12 bp, Homo sapiens
tgtatttttgta

SEQ ID NO: 3830929 - DNA, 17 bp, Homo sapiens
tgtcaaataaacactgt

SEQ ID NO: 3830930 - DNA, 17 bp, Homo sapiens
tgtcactccataaaaag

SEQ ID NO: 3830931 - DNA, 16 bp, Homo sapiens
tgtcactgactcaggc

SEQ ID NO: 3830932 - DNA, 13 bp, Homo sapiens
tgtcatagtttaa

SEQ ID NO: 3830933 - DNA, 12 bp, Homo sapiens
tgtccccttccc

SEQ ID NO: 3830934 - DNA, 13 bp, Homo sapiens
tgtccctcccacc

SEQ ID NO: 3830935 - DNA, 20 bp, Homo sapiens
tgtccctcccacctctgtga

SEQ ID NO: 3830936 - DNA, 22 bp, Homo sapiens
tgtcctcaaccccaaatccccc

SEQ ID NO: 3830937 - DNA, 14 bp, Homo sapiens
tgtcgcctgacagc

SEQ ID NO: 3830938 - DNA, 17 bp, Homo sapiens
tgtcggccacaccccag

SEQ ID NO: 3830939 - DNA, 23 bp, Homo sapiens
tgtcggccacaccccagactcca

SEQ ID NO: 3830940 - DNA, 15 bp, Homo sapiens
tgtctataagtatat

SEQ ID NO: 3830941 - DNA, 19 bp, Homo sapiens
tgtctataagtatataaat

SEQ ID NO: 3830942 - DNA, 14 bp, Homo sapiens
tgtctccaggcagt

SEQ ID NO: 3830943 - DNA, 18 bp, Homo sapiens
tgtctgcaggattgatta

SEQ ID NO: 3830944 - DNA, 12 bp, Homo sapiens
tgtctggggaca

SEQ ID NO: 3830945 - DNA, 12 bp, Homo sapiens
tgtctgtgtcct

SEQ ID NO: 3830946 - DNA, 13 bp, Homo sapiens
tgtctgtgtgcta

SEQ ID NO: 3830947 - DNA, 14 bp, Homo sapiens
tgtcttgcattttt

SEQ ID NO: 3830948 - DNA, 18 bp, Homo sapiens
tgtcttgcatttttttcc

SEQ ID NO: 3830949 - DNA, 14 bp, Homo sapiens
tgtcttttttctaa

SEQ ID NO: 3830950 - DNA, 23 bp, Homo sapiens
tgtgaaagatgcatgttactgcc

SEQ ID NO: 3830951 - DNA, 16 bp, Homo sapiens
tgtgaaatttcatgaa

SEQ ID NO: 3830952 - DNA, 18 bp, Homo sapiens
tgtgacagattatacaga

SEQ ID NO: 3830953 - DNA, 16 bp, Homo sapiens
tgtgacatggtgcctg

SEQ ID NO: 3830954 - DNA, 18 bp, Homo sapiens
tgtgacatggtgcctgag

SEQ ID NO: 3830955 - DNA, 20 bp, Homo sapiens
tgtgacatggtgcctgagag

SEQ ID NO: 3830956 - DNA, 22 bp, Homo sapiens
tgtgacatggtgcctgagaggc

SEQ ID NO: 3830957 - DNA, 21 bp, Homo sapiens
tgtgacctataattttgcaaa

SEQ ID NO: 3830958 - DNA, 13 bp, Homo sapiens
tgtgacctcaggc

SEQ ID NO: 3830959 - DNA, 14 bp, Homo sapiens
tgtgacctcaggca

SEQ ID NO: 3830960 - DNA, 17 bp, Homo sapiens
tgtgactagtgctgaag

SEQ ID NO: 3830961 - DNA, 21 bp, Homo sapiens
tgtgagagagagggcgcccag

SEQ ID NO: 3830962 - DNA, 14 bp, Homo sapiens
tgtgagagaggacc

SEQ ID NO: 3830963 - DNA, 15 bp, Homo sapiens
tgtgaggggaatctg

SEQ ID NO: 3830964 - DNA, 22 bp, Homo sapiens
tgtgcagggtcctccggggctc

SEQ ID NO: 3830965 - DNA, 16 bp, Homo sapiens
tgtgcagtggagctgg

SEQ ID NO: 3830966 - DNA, 18 bp, Homo sapiens
tgtgccagatttatgcat

SEQ ID NO: 3830967 - DNA, 23 bp, Homo sapiens
tgtgcctgacaccacgctggagc

SEQ ID NO: 3830968 - DNA, 17 bp, Homo sapiens
tgtgccttgtaaataaa

SEQ ID NO: 3830969 - DNA, 15 bp, Homo sapiens
tgtgctactaacaga

SEQ ID NO: 3830970 - DNA, 16 bp, Homo sapiens
tgtgctactaacagat

SEQ ID NO: 3830971 - DNA, 18 bp, Homo sapiens
tgtgctgcatcccaccag

SEQ ID NO: 3830972 - DNA, 20 bp, Homo sapiens
tgtgctggatggagcccagg

SEQ ID NO: 3830973 - DNA, 21 bp, Homo sapiens
tgtgctggatggagcccaggc

SEQ ID NO: 3830974 - DNA, 12 bp, Homo sapiens
tgtgctttataa

SEQ ID NO: 3830975 - DNA, 14 bp, Homo sapiens
tgtgctttataaaa

SEQ ID NO: 3830976 - DNA, 11 bp, Homo sapiens
tgtgctttcta

SEQ ID NO: 3830977 - DNA, 17 bp, Homo sapiens
tgtgctttctattgtac

SEQ ID NO: 3830978 - DNA, 17 bp, Homo sapiens
tgtggaatgatgtatat

SEQ ID NO: 3830979 - DNA, 15 bp, Homo sapiens
tgtggaatggatttt

SEQ ID NO: 3830980 - DNA, 12 bp, Homo sapiens
tgtggaggggag

SEQ ID NO: 3830981 - DNA, 15 bp, Homo sapiens
tgtggaggggagctg

SEQ ID NO: 3830982 - DNA, 11 bp, Homo sapiens
tgtggcctgga

SEQ ID NO: 3830983 - DNA, 22 bp, Homo sapiens
tgtgggtggatataaatatata

SEQ ID NO: 3830984 - DNA, 20 bp, Homo sapiens
tgtggttgtggatgggaggc

SEQ ID NO: 3830985 - DNA, 14 bp, Homo sapiens
tgtgtaacagctcc

SEQ ID NO: 3830986 - DNA, 18 bp, Homo sapiens
tgtgtatctcaataaagc

SEQ ID NO: 3830987 - DNA, 22 bp, Homo sapiens
tgtgtatgtgtacgtgtgtgtg

SEQ ID NO: 3830988 - DNA, 12 bp, Homo sapiens
tgtgtctgcagg

SEQ ID NO: 3830989 - DNA, 17 bp, Homo sapiens
tgtgtgctactaacaga

SEQ ID NO: 3830990 - DNA, 19 bp, Homo sapiens
tgtgtgctactaacagatt

SEQ ID NO: 3830991 - DNA, 11 bp, Homo sapiens
tgtgtgtgctg

SEQ ID NO: 3830992 - DNA, 12 bp, Homo sapiens
tgtgttggcttg

SEQ ID NO: 3830993 - DNA, 23 bp, Homo sapiens
tgtgtttccatcctttgcatttc

SEQ ID NO: 3830994 - DNA, 13 bp, Homo sapiens
tgtgttttaacac

SEQ ID NO: 3830995 - DNA, 22 bp, Homo sapiens
tgtgttttaacaccaacactgt

SEQ ID NO: 3830996 - DNA, 15 bp, Homo sapiens
tgtgtttttcataaa

SEQ ID NO: 3830997 - DNA, 13 bp, Homo sapiens
tgttacaaaaaaa

SEQ ID NO: 3830998 - DNA, 17 bp, Homo sapiens
tgttacaaattgtagaa

SEQ ID NO: 3830999 - DNA, 18 bp, Homo sapiens
tgttacaaattgtagaag

SEQ ID NO: 3831000 - DNA, 20 bp, Homo sapiens
tgttaggtgtacatcctgca

SEQ ID NO: 3831001 - DNA, 18 bp, Homo sapiens
tgttagttttgctccttc

SEQ ID NO: 3831002 - DNA, 20 bp, Homo sapiens
tgttagttttgctccttctg

SEQ ID NO: 3831003 - DNA, 21 bp, Homo sapiens
tgttatgcctgttgcaggcaa

SEQ ID NO: 3831004 - DNA, 17 bp, Homo sapiens
tgttcataaataaagtt

SEQ ID NO: 3831005 - DNA, 16 bp, Homo sapiens
tgttcataatacataa

SEQ ID NO: 3831006 - DNA, 17 bp, Homo sapiens
tgttcataatacataaa

SEQ ID NO: 3831007 - DNA, 23 bp, Homo sapiens
tgttcgcgtgtgtgggtggatat

SEQ ID NO: 3831008 - DNA, 23 bp, Homo sapiens
tgttgagcgtattcttgaaagta

SEQ ID NO: 3831009 - DNA, 16 bp, Homo sapiens
tgttgaggtgaccact

SEQ ID NO: 3831010 - DNA, 16 bp, Homo sapiens
tgttgcaggcaaatgt

SEQ ID NO: 3831011 - DNA, 15 bp, Homo sapiens
tgttgcatagaataa

SEQ ID NO: 3831012 - DNA, 16 bp, Homo sapiens
tgttgtgatgtacaca

SEQ ID NO: 3831013 - DNA, 15 bp, Homo sapiens
tgttgtgttctttat

SEQ ID NO: 3831014 - DNA, 16 bp, Homo sapiens
tgttgtgttctttata

SEQ ID NO: 3831015 - DNA, 12 bp, Homo sapiens
tgtttaagagac

SEQ ID NO: 3831016 - DNA, 17 bp, Homo sapiens
tgtttaagtaattgcca

SEQ ID NO: 3831017 - DNA, 13 bp, Homo sapiens
tgtttatgcattt

SEQ ID NO: 3831018 - DNA, 17 bp, Homo sapiens
tgtttatgcatttcaat

SEQ ID NO: 3831019 - DNA, 19 bp, Homo sapiens
tgtttatgcatttcaattt

SEQ ID NO: 3831020 - DNA, 16 bp, Homo sapiens
tgtttatgtgaacatt

SEQ ID NO: 3831021 - DNA, 20 bp, Homo sapiens
tgtttatgtgaacattccta

SEQ ID NO: 3831022 - DNA, 12 bp, Homo sapiens
tgtttgtgcttc

SEQ ID NO: 3831023 - DNA, 13 bp, Homo sapiens
tgtttgtgcttct

SEQ ID NO: 3831024 - DNA, 18 bp, Homo sapiens
tgtttgtggaatggattt

SEQ ID NO: 3831025 - DNA, 16 bp, Homo sapiens
aagagcccttgcctcc

SEQ ID NO: 3831026 - DNA, 13 bp, Homo sapiens
aagagggggtgga

SEQ ID NO: 3831027 - DNA, 16 bp, Homo sapiens
aagagggggtggaggg

SEQ ID NO: 3831028 - DNA, 17 bp, Homo sapiens
aagaggtgcctgggagg

SEQ ID NO: 3831029 - DNA, 18 bp, Homo sapiens
aagaggtgcctgggagga

SEQ ID NO: 3831030 - DNA, 13 bp, Homo sapiens
aagagtttacaag

SEQ ID NO: 3831031 - DNA, 14 bp, Homo sapiens
aagataagtgcagt

SEQ ID NO: 3831032 - DNA, 14 bp, Homo sapiens
aagatgaatccaaa

SEQ ID NO: 3831033 - DNA, 22 bp, Homo sapiens
aagatgaatccaaatgtgaaag

SEQ ID NO: 3831034 - DNA, 13 bp, Homo sapiens
aagattcccagga

SEQ ID NO: 3831035 - DNA, 14 bp, Homo sapiens
aagattcccaggag

SEQ ID NO: 3831036 - DNA, 17 bp, Homo sapiens
aagattgtaaactaaag

SEQ ID NO: 3831037 - DNA, 21 bp, Homo sapiens
aagattgtaaactaaagtgtg

SEQ ID NO: 3831038 - DNA, 21 bp, Homo sapiens
aagattttatgtgcttgaaga

SEQ ID NO: 3831039 - DNA, 13 bp, Homo sapiens
aagcaaggtgttt

SEQ ID NO: 3831040 - DNA, 22 bp, Homo sapiens
aagcaattttccttgaagccga

SEQ ID NO: 3831041 - DNA, 17 bp, Homo sapiens
aagcacgcagttatgtt

SEQ ID NO: 3831042 - DNA, 11 bp, Homo sapiens
aagcagaataa

SEQ ID NO: 3831043 - DNA, 13 bp, Homo sapiens
aagcagaataaag

SEQ ID NO: 3831044 - DNA, 17 bp, Homo sapiens
aagcagaataaagcaat

SEQ ID NO: 3831045 - DNA, 19 bp, Homo sapiens
aagcagaataaagcaattt

SEQ ID NO: 3831046 - DNA, 22 bp, Homo sapiens
aagcagaataaagcaattttcc

SEQ ID NO: 3831047 - DNA, 23 bp, Homo sapiens
aagcagaataaagcaattttcct

SEQ ID NO: 3831048 - DNA, 13 bp, Homo sapiens
aagcagcccttgg

SEQ ID NO: 3831049 - DNA, 21 bp, Homo sapiens
aagcaggggctacaagaggga

SEQ ID NO: 3831050 - DNA, 16 bp, Homo sapiens
aagcagtttttgaaag

SEQ ID NO: 3831051 - DNA, 12 bp, Homo sapiens
aagcataaacat

SEQ ID NO: 3831052 - DNA, 13 bp, Homo sapiens
aagccaagggaaa

SEQ ID NO: 3831053 - DNA, 14 bp, Homo sapiens
aagccaagggaaag

SEQ ID NO: 3831054 - DNA, 16 bp, Homo sapiens
aagccaagggaaaggg

SEQ ID NO: 3831055 - DNA, 13 bp, Homo sapiens
aagccaagtgggg

SEQ ID NO: 3831056 - DNA, 17 bp, Homo sapiens
aagccacacagcccaga

SEQ ID NO: 3831057 - DNA, 11 bp, Homo sapiens
aagccagcctt

SEQ ID NO: 3831058 - DNA, 21 bp, Homo sapiens
aagccccatgctggagcctgt

SEQ ID NO: 3831059 - DNA, 20 bp, Homo sapiens
aagctgcctaggcagccagc

SEQ ID NO: 3831060 - DNA, 20 bp, Homo sapiens
aagcttaaaaaagaaagatt

SEQ ID NO: 3831061 - DNA, 16 bp, Homo sapiens
aagcttattaatgcta

SEQ ID NO: 3831062 - DNA, 17 bp, Homo sapiens
aagcttattaatgctaa

SEQ ID NO: 3831063 - DNA, 19 bp, Homo sapiens
aagcttattaatgctaagg

SEQ ID NO: 3831064 - DNA, 15 bp, Homo sapiens
aagcttctctctgag

SEQ ID NO: 3831065 - DNA, 16 bp, Homo sapiens
aagctttactctttca

SEQ ID NO: 3831066 - DNA, 16 bp, Homo sapiens
aaggaaaaacacaagc

SEQ ID NO: 3831067 - DNA, 13 bp, Homo sapiens
aaggagctttgct

SEQ ID NO: 3831068 - DNA, 14 bp, Homo sapiens
aaggagctttgctc

SEQ ID NO: 3831069 - DNA, 11 bp, Homo sapiens
aaggataaagt

SEQ ID NO: 3831070 - DNA, 21 bp, Homo sapiens
aaggcaagagggggtggaggg

SEQ ID NO: 3831071 - DNA, 16 bp, Homo sapiens
aaggcagccagatccc

SEQ ID NO: 3831072 - DNA, 20 bp, Homo sapiens
aaggcagccagatccccagg

SEQ ID NO: 3831073 - DNA, 21 bp, Homo sapiens
aaggccagaaaaggcagccag

SEQ ID NO: 3831074 - DNA, 15 bp, Homo sapiens
aaggccatggggcag

SEQ ID NO: 3831075 - DNA, 20 bp, Homo sapiens
aaggccatggggcagcctcc

SEQ ID NO: 3831076 - DNA, 23 bp, Homo sapiens
aaggccctagctaataaacctgt

SEQ ID NO: 3831077 - DNA, 15 bp, Homo sapiens
aaggccgagcccaca

SEQ ID NO: 3831078 - DNA, 14 bp, Homo sapiens
aaggcgatagctga

SEQ ID NO: 3831079 - DNA, 20 bp, Homo sapiens
aaggctcccgtactgtctgt

SEQ ID NO: 3831080 - DNA, 14 bp, Homo sapiens
aaggctgtgccagg

SEQ ID NO: 3831081 - DNA, 15 bp, Homo sapiens
aaggctgtgccaggc

SEQ ID NO: 3831082 - DNA, 22 bp, Homo sapiens
aaggctgtgccaggctgggagg

SEQ ID NO: 3831083 - DNA, 23 bp, Homo sapiens
aaggctgtgccaggctgggaggc

SEQ ID NO: 3831084 - DNA, 13 bp, Homo sapiens
aagggacacagga

SEQ ID NO: 3831085 - DNA, 15 bp, Homo sapiens
aagggactgagaaat

SEQ ID NO: 3831086 - DNA, 12 bp, Homo sapiens
aagggagaagaa

SEQ ID NO: 3831087 - DNA, 15 bp, Homo sapiens
aagggagggtggcag

SEQ ID NO: 3831088 - DNA, 17 bp, Homo sapiens
aagggagggtggcagag

SEQ ID NO: 3831089 - DNA, 20 bp, Homo sapiens
aagggatcctaatcccttcc

SEQ ID NO: 3831090 - DNA, 13 bp, Homo sapiens
aaggggcagccag

SEQ ID NO: 3831091 - DNA, 21 bp, Homo sapiens
aaggggcagccagccctggct

SEQ ID NO: 3831092 - DNA, 17 bp, Homo sapiens
aagggtggagagttggg

SEQ ID NO: 3831093 - DNA, 18 bp, Homo sapiens
aaggtttggaaaactaac

SEQ ID NO: 3831094 - DNA, 18 bp, Homo sapiens
aagtaaagtattggattt

SEQ ID NO: 3831095 - DNA, 17 bp, Homo sapiens
aagtaagacatctcaaa

SEQ ID NO: 3831096 - DNA, 16 bp, Homo sapiens
aagtaaggaattttat

SEQ ID NO: 3831097 - DNA, 17 bp, Homo sapiens
aagtaagtaagaaagaa

SEQ ID NO: 3831098 - DNA, 21 bp, Homo sapiens
aagtaagtttcattctaaaat

SEQ ID NO: 3831099 - DNA, 12 bp, Homo sapiens
aagtaattgcca

SEQ ID NO: 3831100 - DNA, 23 bp, Homo sapiens
aagtatataaatactatagttat

SEQ ID NO: 3831101 - DNA, 16 bp, Homo sapiens
aagtatatttgtaaaa

SEQ ID NO: 3831102 - DNA, 20 bp, Homo sapiens
aagtatatttgtaaaagcta

SEQ ID NO: 3831103 - DNA, 13 bp, Homo sapiens
aagtattggattt

SEQ ID NO: 3831104 - DNA, 19 bp, Homo sapiens
aagtcgcttttggtgcctg

SEQ ID NO: 3831105 - DNA, 14 bp, Homo sapiens
aagtctccaaagtc

SEQ ID NO: 3831106 - DNA, 19 bp, Homo sapiens
aagtctctgggtcacgttt

SEQ ID NO: 3831107 - DNA, 16 bp, Homo sapiens
aagtctgttattgttt

SEQ ID NO: 3831108 - DNA, 20 bp, Homo sapiens
aagtctgttattgttttgtt

SEQ ID NO: 3831109 - DNA, 14 bp, Homo sapiens
aagtcttgtgacta

SEQ ID NO: 3831110 - DNA, 20 bp, Homo sapiens
aagtcttgtgactagtgctg

SEQ ID NO: 3831111 - DNA, 23 bp, Homo sapiens
aagtcttgtgactagtgctgaag

SEQ ID NO: 3831112 - DNA, 15 bp, Homo sapiens
aagtctttttgaagt

SEQ ID NO: 3831113 - DNA, 14 bp, Homo sapiens
aagtgaaattttaa

SEQ ID NO: 3831114 - DNA, 15 bp, Homo sapiens
aagtgaaattttaaa

SEQ ID NO: 3831115 - DNA, 18 bp, Homo sapiens
aagtgatggagcagagca

SEQ ID NO: 3831116 - DNA, 19 bp, Homo sapiens
aagtgattctcctgcctca

SEQ ID NO: 3831117 - DNA, 14 bp, Homo sapiens
aagtgggtgagatg

SEQ ID NO: 3831118 - DNA, 12 bp, Homo sapiens
aagtgtaattag

SEQ ID NO: 3831119 - DNA, 11 bp, Homo sapiens
aagtgtctttt

SEQ ID NO: 3831120 - DNA, 15 bp, Homo sapiens
aagtgtgctttataa

SEQ ID NO: 3831121 - DNA, 21 bp, Homo sapiens
aagtgtgtgtttttcataaag

SEQ ID NO: 3831122 - DNA, 16 bp, Homo sapiens
aagttcattcctgtct

SEQ ID NO: 3831123 - DNA, 16 bp, Homo sapiens
aagttctctgtaatta

SEQ ID NO: 3831124 - DNA, 16 bp, Homo sapiens
aagttgtaatagagaa

SEQ ID NO: 3831125 - DNA, 17 bp, Homo sapiens
aagttgtaatagagaat

SEQ ID NO: 3831126 - DNA, 21 bp, Homo sapiens
aagttgtaatagagaatattt

SEQ ID NO: 3831127 - DNA, 22 bp, Homo sapiens
aagttgtaatagagaatatttt

SEQ ID NO: 3831128 - DNA, 12 bp, Homo sapiens
aataaaaagcca

SEQ ID NO: 3831129 - DNA, 18 bp, Homo sapiens
aataaaactgatgttact

SEQ ID NO: 3831130 - DNA, 16 bp, Homo sapiens
aataaaatatcattca

SEQ ID NO: 3831131 - DNA, 18 bp, Homo sapiens
aataaaatatcattcagc

SEQ ID NO: 3831132 - DNA, 22 bp, Homo sapiens
aataaactttgggaaaaggtgt

SEQ ID NO: 3831133 - DNA, 15 bp, Homo sapiens
aataaagcaattttc

SEQ ID NO: 3831134 - DNA, 18 bp, Homo sapiens
aataaagcaattttcctt

SEQ ID NO: 3831135 - DNA, 23 bp, Homo sapiens
aataaagcaattttccttgaagc

SEQ ID NO: 3831136 - DNA, 24 bp, Homo sapiens
aataaagcaattttccttgaagcc

SEQ ID NO: 3831137 - DNA, 22 bp, Homo sapiens
aataaagcttctctctgagctg

SEQ ID NO: 3831138 - DNA, 14 bp, Homo sapiens
aataaatatatata

SEQ ID NO: 3831139 - DNA, 16 bp, Homo sapiens
aataaatgttttacaa

SEQ ID NO: 3831140 - DNA, 19 bp, Homo sapiens
aataaatgttttacaactc

SEQ ID NO: 3831141 - DNA, 15 bp, Homo sapiens
aataaatgttttagt

SEQ ID NO: 3831142 - DNA, 15 bp, Homo sapiens
aataacttgccattt

SEQ ID NO: 3831143 - DNA, 18 bp, Homo sapiens
aataacttgccatttctt

SEQ ID NO: 3831144 - DNA, 21 bp, Homo sapiens
aataacttgccatttctttat

SEQ ID NO: 3831145 - DNA, 23 bp, Homo sapiens
aataattccacagtcctgaagca

SEQ ID NO: 3831146 - DNA, 16 bp, Homo sapiens
aatacagtagtataat

SEQ ID NO: 3831147 - DNA, 18 bp, Homo sapiens
aatacagtagtataatgt

SEQ ID NO: 3831148 - DNA, 18 bp, Homo sapiens
aatacatattacaagaaa

SEQ ID NO: 3831149 - DNA, 17 bp, Homo sapiens
aatactatagttatata

SEQ ID NO: 3831150 - DNA, 18 bp, Homo sapiens
aatagcctctcctttgta

SEQ ID NO: 3831151 - DNA, 17 bp, Homo sapiens
aatataagtttctttgc

SEQ ID NO: 3831152 - DNA, 14 bp, Homo sapiens
aatatataaacaaa

SEQ ID NO: 3831153 - DNA, 19 bp, Homo sapiens
aatatatataaatatatat

SEQ ID NO: 3831154 - DNA, 13 bp, Homo sapiens
aatatatattttg

SEQ ID NO: 3831155 - DNA, 13 bp, Homo sapiens
aatatatctttgt

SEQ ID NO: 3831156 - DNA, 16 bp, Homo sapiens
aatatatctttgtaaa

SEQ ID NO: 3831157 - DNA, 17 bp, Homo sapiens
aatatatctttgtaaat

SEQ ID NO: 3831158 - DNA, 15 bp, Homo sapiens
acttgaacaaagtct

SEQ ID NO: 3831159 - DNA, 15 bp, Homo sapiens
acttgagctttaaaa

SEQ ID NO: 3831160 - DNA, 17 bp, Homo sapiens
acttgagtatcataata

SEQ ID NO: 3831161 - DNA, 18 bp, Homo sapiens
acttgagtatcataatat

SEQ ID NO: 3831162 - DNA, 11 bp, Homo sapiens
acttgccattt

SEQ ID NO: 3831163 - DNA, 21 bp, Homo sapiens
acttgccatttctttatatgg

SEQ ID NO: 3831164 - DNA, 12 bp, Homo sapiens
acttgctctgga

SEQ ID NO: 3831165 - DNA, 18 bp, Homo sapiens
acttgctctggacctgcc

SEQ ID NO: 3831166 - DNA, 14 bp, Homo sapiens
acttgtattatgtg

SEQ ID NO: 3831167 - DNA, 15 bp, Homo sapiens
acttgtattatgtgt

SEQ ID NO: 3831168 - DNA, 19 bp, Homo sapiens
acttgtattatgtgtgttt

SEQ ID NO: 3831169 - DNA, 15 bp, Homo sapiens
acttgtccattgcgt

SEQ ID NO: 3831170 - DNA, 17 bp, Homo sapiens
acttgtccattgcgtta

SEQ ID NO: 3831171 - DNA, 19 bp, Homo sapiens
actttccactgacaacgaa

SEQ ID NO: 3831172 - DNA, 11 bp, Homo sapiens
actttcccttg

SEQ ID NO: 3831173 - DNA, 22 bp, Homo sapiens
actttgaggcagcgcattgttt

SEQ ID NO: 3831174 - DNA, 22 bp, Homo sapiens
actttgctttgggtttgtggca

SEQ ID NO: 3831175 - DNA, 13 bp, Homo sapiens
acttttgcttggt

SEQ ID NO: 3831176 - DNA, 16 bp, Homo sapiens
agaaaaaaaaactggg

SEQ ID NO: 3831177 - DNA, 18 bp, Homo sapiens
agaaaactacatgtaaaa

SEQ ID NO: 3831178 - DNA, 21 bp, Homo sapiens
agaaaactacatgtaaaatct

SEQ ID NO: 3831179 - DNA, 23 bp, Homo sapiens
agaaaactacatgtaaaatcttg

SEQ ID NO: 3831180 - DNA, 16 bp, Homo sapiens
agaaaataatgcaaat

SEQ ID NO: 3831181 - DNA, 19 bp, Homo sapiens
agaaactttttaataaagt

SEQ ID NO: 3831182 - DNA, 20 bp, Homo sapiens
agaaactttttaataaagta

SEQ ID NO: 3831183 - DNA, 21 bp, Homo sapiens
agaaactttttaataaagtat

SEQ ID NO: 3831184 - DNA, 14 bp, Homo sapiens
agaaagattaaata

SEQ ID NO: 3831185 - DNA, 19 bp, Homo sapiens
agaaagattgtaaactaaa

SEQ ID NO: 3831186 - DNA, 22 bp, Homo sapiens
agaaagattgtaaactaaagtg

SEQ ID NO: 3831187 - DNA, 14 bp, Homo sapiens
agaaagcaggggct

SEQ ID NO: 3831188 - DNA, 20 bp, Homo sapiens
agaaagcaggggctacaaga

SEQ ID NO: 3831189 - DNA, 15 bp, Homo sapiens
agaaagccaggcagg

SEQ ID NO: 3831190 - DNA, 19 bp, Homo sapiens
agaaagctaatactaatag

SEQ ID NO: 3831191 - DNA, 16 bp, Homo sapiens
agaaaggataaagttg

SEQ ID NO: 3831192 - DNA, 12 bp, Homo sapiens
agaaataaatct

SEQ ID NO: 3831193 - DNA, 13 bp, Homo sapiens
agaaataaatcta

SEQ ID NO: 3831194 - DNA, 15 bp, Homo sapiens
agaaattacttctag

SEQ ID NO: 3831195 - DNA, 12 bp, Homo sapiens
agaaattatgtg

SEQ ID NO: 3831196 - DNA, 14 bp, Homo sapiens
agaacgttcccttt

SEQ ID NO: 3831197 - DNA, 16 bp, Homo sapiens
agaacttgaacaaagt

SEQ ID NO: 3831198 - DNA, 20 bp, Homo sapiens
agaacttgaactaacataat

SEQ ID NO: 3831199 - DNA, 13 bp, Homo sapiens
agaagaagctggg

SEQ ID NO: 3831200 - DNA, 11 bp, Homo sapiens
agaagaaggag

SEQ ID NO: 3831201 - DNA, 13 bp, Homo sapiens
agaagagaggaga

SEQ ID NO: 3831202 - DNA, 20 bp, Homo sapiens
agaagagaggagaggagaga

SEQ ID NO: 3831203 - DNA, 11 bp, Homo sapiens
agaagccaagg

SEQ ID NO: 3831204 - DNA, 15 bp, Homo sapiens
agaagccaagggaaa

SEQ ID NO: 3831205 - DNA, 16 bp, Homo sapiens
agaagccaagggaaag

SEQ ID NO: 3831206 - DNA, 19 bp, Homo sapiens
agaagccaagggaaagggg

SEQ ID NO: 3831207 - DNA, 22 bp, Homo sapiens
agaagccaagggaaaggggtgc

SEQ ID NO: 3831208 - DNA, 15 bp, Homo sapiens
agaagccaagggaca

SEQ ID NO: 3831209 - DNA, 19 bp, Homo sapiens
agaagccaagggacacagg

SEQ ID NO: 3831210 - DNA, 16 bp, Homo sapiens
agaagctgggagggag

SEQ ID NO: 3831211 - DNA, 17 bp, Homo sapiens
agaagctgggagggagg

SEQ ID NO: 3831212 - DNA, 18 bp, Homo sapiens
agaagctgggagggaggg

SEQ ID NO: 3831213 - DNA, 15 bp, Homo sapiens
agaagcttaggcagg

SEQ ID NO: 3831214 - DNA, 22 bp, Homo sapiens
agaaggccagaaaaggcagcca

SEQ ID NO: 3831215 - DNA, 14 bp, Homo sapiens
agaagggagaagaa

SEQ ID NO: 3831216 - DNA, 11 bp, Homo sapiens
agaagggcagg

SEQ ID NO: 3831217 - DNA, 19 bp, Homo sapiens
agaaggtattttttaactc

SEQ ID NO: 3831218 - DNA, 16 bp, Homo sapiens
agaagtgccatctcaa

SEQ ID NO: 3831219 - DNA, 15 bp, Homo sapiens
agaagttcattcctg

SEQ ID NO: 3831220 - DNA, 17 bp, Homo sapiens
agaagttcattcctgtc

SEQ ID NO: 3831221 - DNA, 18 bp, Homo sapiens
agaagttcattcctgtct

SEQ ID NO: 3831222 - DNA, 12 bp, Homo sapiens
agaataaaattt

SEQ ID NO: 3831223 - DNA, 17 bp, Homo sapiens
agaataaaatttttaat

SEQ ID NO: 3831224 - DNA, 15 bp, Homo sapiens
agaataaagcaattt

SEQ ID NO: 3831225 - DNA, 17 bp, Homo sapiens
agaataaagcaattttc

SEQ ID NO: 3831226 - DNA, 18 bp, Homo sapiens
agaataaagcaattttcc

SEQ ID NO: 3831227 - DNA, 20 bp, Homo sapiens
agaataaagcaattttcctt

SEQ ID NO: 3831228 - DNA, 12 bp, Homo sapiens
agaataaatgtt

SEQ ID NO: 3831229 - DNA, 18 bp, Homo sapiens
agaataaatgttttacaa

SEQ ID NO: 3831230 - DNA, 14 bp, Homo sapiens
agaatacttttctc

SEQ ID NO: 3831231 - DNA, 22 bp, Homo sapiens
agaatatttttggcattcctct

SEQ ID NO: 3831232 - DNA, 23 bp, Homo sapiens
agaatatttttggcattcctcta

SEQ ID NO: 3831233 - DNA, 15 bp, Homo sapiens
agaattaggaaggcc

SEQ ID NO: 3831234 - DNA, 18 bp, Homo sapiens
agaattaggaaggccatg

SEQ ID NO: 3831235 - DNA, 16 bp, Homo sapiens
agaattgtgtctgcag

SEQ ID NO: 3831236 - DNA, 18 bp, Homo sapiens
agaattgtgtctgcagga

SEQ ID NO: 3831237 - DNA, 13 bp, Homo sapiens
agacaattgcatt

SEQ ID NO: 3831238 - DNA, 13 bp, Homo sapiens
agacagccccaga

SEQ ID NO: 3831239 - DNA, 15 bp, Homo sapiens
agacagccccagagc

SEQ ID NO: 3831240 - DNA, 12 bp, Homo sapiens
agacaggcacaa

SEQ ID NO: 3831241 - DNA, 14 bp, Homo sapiens
agacaggcacaaaa

SEQ ID NO: 3831242 - DNA, 15 bp, Homo sapiens
agacagggctccagc

SEQ ID NO: 3831243 - DNA, 17 bp, Homo sapiens
agacagggctccagcct

SEQ ID NO: 3831244 - DNA, 19 bp, Homo sapiens
agacagggctccagcctgt

SEQ ID NO: 3831245 - DNA, 19 bp, Homo sapiens
agacaggttaaatatataa

SEQ ID NO: 3831246 - DNA, 18 bp, Homo sapiens
agacagtaagagtttaca

SEQ ID NO: 3831247 - DNA, 19 bp, Homo sapiens
agacagtaagagtttacaa

SEQ ID NO: 3831248 - DNA, 23 bp, Homo sapiens
agacagtgggcactaagggtgga

SEQ ID NO: 3831249 - DNA, 24 bp, Homo sapiens
agacagtgggcactaagggtggag

SEQ ID NO: 3831250 - DNA, 15 bp, Homo sapiens
agacataatttaaaa

SEQ ID NO: 3831251 - DNA, 23 bp, Homo sapiens
agacattctcttactttttgtaa

SEQ ID NO: 3831252 - DNA, 16 bp, Homo sapiens
agaccaactttttcat

SEQ ID NO: 3831253 - DNA, 13 bp, Homo sapiens
agaccgtcctcac

SEQ ID NO: 3831254 - DNA, 14 bp, Homo sapiens
agaccgtcctcacc

SEQ ID NO: 3831255 - DNA, 14 bp, Homo sapiens
agacctccccagcc

SEQ ID NO: 3831256 - DNA, 15 bp, Homo sapiens
agacctccccagccc

SEQ ID NO: 3831257 - DNA, 23 bp, Homo sapiens
agacctccccagcccctagccca

SEQ ID NO: 3831258 - DNA, 13 bp, Homo sapiens
agacctctcccac

SEQ ID NO: 3831259 - DNA, 22 bp, Homo sapiens
agacctgctgtaataaatgtat

SEQ ID NO: 3831260 - DNA, 15 bp, Homo sapiens
agacctttgtctgaa

SEQ ID NO: 3831261 - DNA, 11 bp, Homo sapiens
agactccaggc

SEQ ID NO: 3831262 - DNA, 16 bp, Homo sapiens
agactccgcctgaggc

SEQ ID NO: 3831263 - DNA, 15 bp, Homo sapiens
agactggggcctgga

SEQ ID NO: 3831264 - DNA, 18 bp, Homo sapiens
agactgttttcagacctt

SEQ ID NO: 3831265 - DNA, 14 bp, Homo sapiens
agacttcaccaaat

SEQ ID NO: 3831266 - DNA, 12 bp, Homo sapiens
agacttttatga

SEQ ID NO: 3831267 - DNA, 18 bp, Homo sapiens
agagaaacaataaagaga

SEQ ID NO: 3831268 - DNA, 24 bp, Homo sapiens
agagaaagtgggtgagatgctgga

SEQ ID NO: 3831269 - DNA, 20 bp, Homo sapiens
agagaagcctatttttatat

SEQ ID NO: 3831270 - DNA, 22 bp, Homo sapiens
agagaagcctatttttatattt

SEQ ID NO: 3831271 - DNA, 15 bp, Homo sapiens
agagaccgtcctcac

SEQ ID NO: 3831272 - DNA, 19 bp, Homo sapiens
agagactggggcctggact

SEQ ID NO: 3831273 - DNA, 16 bp, Homo sapiens
agagagaaagccaggc

SEQ ID NO: 3831274 - DNA, 22 bp, Homo sapiens
agagagaaagccaggcaggtag

SEQ ID NO: 3831275 - DNA, 18 bp, Homo sapiens
agagagacacaagtggcc

SEQ ID NO: 3831276 - DNA, 15 bp, Homo sapiens
agagagagagagagg

SEQ ID NO: 3831277 - DNA, 22 bp, Homo sapiens
agagagagggcgcccagcccag

SEQ ID NO: 3831278 - DNA, 16 bp, Homo sapiens
agagaggacctccatg

SEQ ID NO: 3831279 - DNA, 17 bp, Homo sapiens
agagaggagaggagaga

SEQ ID NO: 3831280 - DNA, 16 bp, Homo sapiens
agagagggcgcccagc

SEQ ID NO: 3831281 - DNA, 17 bp, Homo sapiens
agagccaaacagagccc

SEQ ID NO: 3831282 - DNA, 18 bp, Homo sapiens
agagccaaacagagccca

SEQ ID NO: 3831283 - DNA, 19 bp, Homo sapiens
agagccaaacagagcccag

SEQ ID NO: 3831284 - DNA, 20 bp, Homo sapiens
agagccaaacagagcccagg

SEQ ID NO: 3831285 - DNA, 19 bp, Homo sapiens
agagcccttgcctccccat

SEQ ID NO: 3831286 - DNA, 12 bp, Homo sapiens
agagcctgctgg

SEQ ID NO: 3831287 - DNA, 13 bp, Homo sapiens
agagcctgctggc

SEQ ID NO: 3831288 - DNA, 19 bp, Homo sapiens
agagcctgctggcacccac

SEQ ID NO: 3831289 - DNA, 24 bp, Homo sapiens
agagcctgctggcacccaccgtgg

SEQ ID NO: 3831290 - DNA, 16 bp, Homo sapiens
agagctggcagtgtgc

SEQ ID NO: 3831291 - DNA, 19 bp, Homo sapiens
aggtacaaccggatgccag

SEQ ID NO: 3831292 - DNA, 20 bp, Homo sapiens
aggtacaaccggatgccagc

SEQ ID NO: 3831293 - DNA, 16 bp, Homo sapiens
aggtaccagctgcgct

SEQ ID NO: 3831294 - DNA, 23 bp, Homo sapiens
aggtaccagctgcgcttgctttt

SEQ ID NO: 3831295 - DNA, 22 bp, Homo sapiens
aggtactggtgagggcaagagg

SEQ ID NO: 3831296 - DNA, 21 bp, Homo sapiens
aggtagggtgtgtatatataa

SEQ ID NO: 3831297 - DNA, 23 bp, Homo sapiens
aggtataattcacattgtattca

SEQ ID NO: 3831298 - DNA, 22 bp, Homo sapiens
aggtcctgcttgaactgctgcc

SEQ ID NO: 3831299 - DNA, 14 bp, Homo sapiens
aggtcgctgcagcc

SEQ ID NO: 3831300 - DNA, 18 bp, Homo sapiens
aggtctttactgaatgtt

SEQ ID NO: 3831301 - DNA, 17 bp, Homo sapiens
aggtgaaaagggcagag

SEQ ID NO: 3831302 - DNA, 23 bp, Homo sapiens
aggtgaaaagggcagaggcaagg

SEQ ID NO: 3831303 - DNA, 21 bp, Homo sapiens
aggtgagcaaccagttggcta

SEQ ID NO: 3831304 - DNA, 21 bp, Homo sapiens
aggtgagtttgagctgccttc

SEQ ID NO: 3831305 - DNA, 16 bp, Homo sapiens
aggtgccagcaaagcc

SEQ ID NO: 3831306 - DNA, 19 bp, Homo sapiens
aggtgccagcaaagcccca

SEQ ID NO: 3831307 - DNA, 16 bp, Homo sapiens
aggtgcctgggaggag

SEQ ID NO: 3831308 - DNA, 21 bp, Homo sapiens
aggtgcctgggaggagtggcc

SEQ ID NO: 3831309 - DNA, 18 bp, Homo sapiens
aggtggaagaagggagaa

SEQ ID NO: 3831310 - DNA, 22 bp, Homo sapiens
aggtggaagaagggagaagaaa

SEQ ID NO: 3831311 - DNA, 20 bp, Homo sapiens
aggtggaggttgcagtgagc

SEQ ID NO: 3831312 - DNA, 15 bp, Homo sapiens
aggtggggagaaggg

SEQ ID NO: 3831313 - DNA, 14 bp, Homo sapiens
aggttcctctgcct

SEQ ID NO: 3831314 - DNA, 17 bp, Homo sapiens
aggttcctctgcctgcc

SEQ ID NO: 3831315 - DNA, 19 bp, Homo sapiens
aggttcctctgcctgcccc

SEQ ID NO: 3831316 - DNA, 20 bp, Homo sapiens
aggttcctctgcctgccccg

SEQ ID NO: 3831317 - DNA, 21 bp, Homo sapiens
aggttgaagcagaattgcttg

SEQ ID NO: 3831318 - DNA, 13 bp, Homo sapiens
aggttgaagccaa

SEQ ID NO: 3831319 - DNA, 18 bp, Homo sapiens
aggttgttttgttttata

SEQ ID NO: 3831320 - DNA, 17 bp, Homo sapiens
aggtttggaaaactaac

SEQ ID NO: 3831321 - DNA, 18 bp, Homo sapiens
aggtttggaaaactaact

SEQ ID NO: 3831322 - DNA, 23 bp, Homo sapiens
agtaaaaacaaagaaattatgtg

SEQ ID NO: 3831323 - DNA, 15 bp, Homo sapiens
agtaagagtttacaa

SEQ ID NO: 3831324 - DNA, 18 bp, Homo sapiens
agtaagagtttacaagaa

SEQ ID NO: 3831325 - DNA, 19 bp, Homo sapiens
agtaagagtttacaagaaa

SEQ ID NO: 3831326 - DNA, 15 bp, Homo sapiens
agtaagtaagaaaga

SEQ ID NO: 3831327 - DNA, 13 bp, Homo sapiens
agtaagtttcatt

SEQ ID NO: 3831328 - DNA, 14 bp, Homo sapiens
agtaagtttcattc

SEQ ID NO: 3831329 - DNA, 13 bp, Homo sapiens
agtaataaaaagc

SEQ ID NO: 3831330 - DNA, 20 bp, Homo sapiens
agtaataaaaagccaccaca

SEQ ID NO: 3831331 - DNA, 16 bp, Homo sapiens
agtaatcctgcacaga

SEQ ID NO: 3831332 - DNA, 14 bp, Homo sapiens
agtaccaaatgctt

SEQ ID NO: 3831333 - DNA, 20 bp, Homo sapiens
agtaccaggccgtttgcttt

SEQ ID NO: 3831334 - DNA, 16 bp, Homo sapiens
agtactgctttactgt

SEQ ID NO: 3831335 - DNA, 13 bp, Homo sapiens
agtagattaaaat

SEQ ID NO: 3831336 - DNA, 18 bp, Homo sapiens
agtagattaaaatatttg

SEQ ID NO: 3831337 - DNA, 22 bp, Homo sapiens
agtagtaccaaatgctttaaaa

SEQ ID NO: 3831338 - DNA, 21 bp, Homo sapiens
agtagtttctaagtctgttat

SEQ ID NO: 3831339 - DNA, 14 bp, Homo sapiens
agtataagaaattt

SEQ ID NO: 3831340 - DNA, 18 bp, Homo sapiens
agtataatgtatgaattt

SEQ ID NO: 3831341 - DNA, 23 bp, Homo sapiens
agtataatgtatgaattttgtaa

SEQ ID NO: 3831342 - DNA, 16 bp, Homo sapiens
agtatataaatactat

SEQ ID NO: 3831343 - DNA, 13 bp, Homo sapiens
agtatcataatat

SEQ ID NO: 3831344 - DNA, 21 bp, Homo sapiens
agtatggtgctaatgtgtctg

SEQ ID NO: 3831345 - DNA, 13 bp, Homo sapiens
agtattaaactgt

SEQ ID NO: 3831346 - DNA, 17 bp, Homo sapiens
agtattaaactgtaaat

SEQ ID NO: 3831347 - DNA, 13 bp, Homo sapiens
agtattaagtgaa

SEQ ID NO: 3831348 - DNA, 11 bp, Homo sapiens
agtcaggatga

SEQ ID NO: 3831349 - DNA, 17 bp, Homo sapiens
agtcagtgctggagaaa

SEQ ID NO: 3831350 - DNA, 18 bp, Homo sapiens
agtcagtgctggagaaat

SEQ ID NO: 3831351 - DNA, 21 bp, Homo sapiens
agtcagtgctggagaaatctt

SEQ ID NO: 3831352 - DNA, 15 bp, Homo sapiens
agtcatgacagatga

SEQ ID NO: 3831353 - DNA, 16 bp, Homo sapiens
agtcatgacagatgaa

SEQ ID NO: 3831354 - DNA, 19 bp, Homo sapiens
agtccattctcccaggtac

SEQ ID NO: 3831355 - DNA, 23 bp, Homo sapiens
agtcccaccctgctgctgctcct

SEQ ID NO: 3831356 - DNA, 15 bp, Homo sapiens
agtccccacccctgc

SEQ ID NO: 3831357 - DNA, 18 bp, Homo sapiens
agtccccacccctgcccc

SEQ ID NO: 3831358 - DNA, 15 bp, Homo sapiens
agtccttagcctggg

SEQ ID NO: 3831359 - DNA, 23 bp, Homo sapiens
agtccttagcctgggcctcctcc

SEQ ID NO: 3831360 - DNA, 19 bp, Homo sapiens
agtccttagtatcagtcat

SEQ ID NO: 3831361 - DNA, 18 bp, Homo sapiens
agtcgcttttggtgcctg

SEQ ID NO: 3831362 - DNA, 14 bp, Homo sapiens
agtctgctctcagc

SEQ ID NO: 3831363 - DNA, 20 bp, Homo sapiens
agtctgctctcagcttgtgc

SEQ ID NO: 3831364 - DNA, 11 bp, Homo sapiens
agtctggaaag

SEQ ID NO: 3831365 - DNA, 23 bp, Homo sapiens
agtctgtcataatatttgaacaa

SEQ ID NO: 3831366 - DNA, 16 bp, Homo sapiens
agtctgttattgtttt

SEQ ID NO: 3831367 - DNA, 18 bp, Homo sapiens
agtctgttattgttttgt

SEQ ID NO: 3831368 - DNA, 18 bp, Homo sapiens
agtcttttccacatggca

SEQ ID NO: 3831369 - DNA, 14 bp, Homo sapiens
agtgagcctggctc

SEQ ID NO: 3831370 - DNA, 18 bp, Homo sapiens
agtgatggagcagagcaa

SEQ ID NO: 3831371 - DNA, 18 bp, Homo sapiens
agtgcagtggctcaatgc

SEQ ID NO: 3831372 - DNA, 13 bp, Homo sapiens
agtgccatctcaa

SEQ ID NO: 3831373 - DNA, 15 bp, Homo sapiens
agtgccatggctggg

SEQ ID NO: 3831374 - DNA, 20 bp, Homo sapiens
agtgccgcaataaatgctca

SEQ ID NO: 3831375 - DNA, 21 bp, Homo sapiens
agtgccgcaataaatgctcaa

SEQ ID NO: 3831376 - DNA, 13 bp, Homo sapiens
agtgctgaagctt

SEQ ID NO: 3831377 - DNA, 16 bp, Homo sapiens
agtgctgaagcttatt

SEQ ID NO: 3831378 - DNA, 17 bp, Homo sapiens
agtggccctgatccagg

SEQ ID NO: 3831379 - DNA, 21 bp, Homo sapiens
agtggccctgatccaggaaaa

SEQ ID NO: 3831380 - DNA, 20 bp, Homo sapiens
agtggccggggctgaagcca

SEQ ID NO: 3831381 - DNA, 22 bp, Homo sapiens
agtggccggggctgaagccaca

SEQ ID NO: 3831382 - DNA, 23 bp, Homo sapiens
agtggggcaggcttgagttttca

SEQ ID NO: 3831383 - DNA, 18 bp, Homo sapiens
agtggggtgctgggagga

SEQ ID NO: 3831384 - DNA, 18 bp, Homo sapiens
agtgggtgagatgctgga

SEQ ID NO: 3831385 - DNA, 22 bp, Homo sapiens
agtgggtgagatgctggagaag

SEQ ID NO: 3831386 - DNA, 15 bp, Homo sapiens
agtggtccctgccct

SEQ ID NO: 3831387 - DNA, 15 bp, Homo sapiens
agtggttaagaatgt

SEQ ID NO: 3831388 - DNA, 21 bp, Homo sapiens
agtggttttatactgaaggaa

SEQ ID NO: 3831389 - DNA, 15 bp, Homo sapiens
agtgtcaaataaaca

SEQ ID NO: 3831390 - DNA, 19 bp, Homo sapiens
agtgtcaaataaacactgt

SEQ ID NO: 3831391 - DNA, 14 bp, Homo sapiens
agtgtgcggagctg

SEQ ID NO: 3831392 - DNA, 15 bp, Homo sapiens
agtgtgcggagctga

SEQ ID NO: 3831393 - DNA, 15 bp, Homo sapiens
agtgtggcctggatc

SEQ ID NO: 3831394 - DNA, 16 bp, Homo sapiens
agtgttcaaataaact

SEQ ID NO: 3831395 - DNA, 18 bp, Homo sapiens
agtgttcaaataaactga

SEQ ID NO: 3831396 - DNA, 16 bp, Homo sapiens
agtgttttacaatgat

SEQ ID NO: 3831397 - DNA, 22 bp, Homo sapiens
agtgttttacaatgatttgtaa

SEQ ID NO: 3831398 - DNA, 17 bp, Homo sapiens
agttaaaacaatgaagt

SEQ ID NO: 3831399 - DNA, 12 bp, Homo sapiens
agttaaatatga

SEQ ID NO: 3831400 - DNA, 13 bp, Homo sapiens
agttaaatatgat

SEQ ID NO: 3831401 - DNA, 15 bp, Homo sapiens
agttaaatatgattt

SEQ ID NO: 3831402 - DNA, 12 bp, Homo sapiens
agttagccaaac

SEQ ID NO: 3831403 - DNA, 18 bp, Homo sapiens
agttagccactgctggtg

SEQ ID NO: 3831404 - DNA, 18 bp, Homo sapiens
agttagctattgggagca

SEQ ID NO: 3831405 - DNA, 19 bp, Homo sapiens
agttataaagaaagattgt

SEQ ID NO: 3831406 - DNA, 13 bp, Homo sapiens
agttatatagata

SEQ ID NO: 3831407 - DNA, 20 bp, Homo sapiens
agttatatagataaagagat

SEQ ID NO: 3831408 - DNA, 14 bp, Homo sapiens
agttcattcctgtc

SEQ ID NO: 3831409 - DNA, 22 bp, Homo sapiens
agttcattcctgtctaaagtgg

SEQ ID NO: 3831410 - DNA, 23 bp, Homo sapiens
agttccacacaggtttgtaagta

SEQ ID NO: 3831411 - DNA, 16 bp, Homo sapiens
agttctctgtaattac

SEQ ID NO: 3831412 - DNA, 20 bp, Homo sapiens
agttctctgtaattacaact

SEQ ID NO: 3831413 - DNA, 15 bp, Homo sapiens
agttctgctcattct

SEQ ID NO: 3831414 - DNA, 15 bp, Homo sapiens
agttcttacttgagt

SEQ ID NO: 3831415 - DNA, 14 bp, Homo sapiens
agttgggggctagg

SEQ ID NO: 3831416 - DNA, 10 bp, Homo sapiens
agttgtttat

SEQ ID NO: 3831417 - DNA, 22 bp, Homo sapiens
agtttaagtaagtaagtttcat

SEQ ID NO: 3831418 - DNA, 14 bp, Homo sapiens
agtttcccctctca

SEQ ID NO: 3831419 - DNA, 18 bp, Homo sapiens
agtttctaagtctgttat

SEQ ID NO: 3831420 - DNA, 23 bp, Homo sapiens
agtttgagctgccttccctagct

SEQ ID NO: 3831421 - DNA, 15 bp, Homo sapiens
agtttgttgaaacac

SEQ ID NO: 3831422 - DNA, 15 bp, Homo sapiens
agtttgttgatcttt

SEQ ID NO: 3831423 - DNA, 12 bp, Homo sapiens
caagtgtaatta

SEQ ID NO: 3831424 - DNA, 13 bp, Homo sapiens
caagtgtaattag

SEQ ID NO: 3831425 - DNA, 22 bp, Homo sapiens
caagtgtaattagcttttggag

SEQ ID NO: 3831426 - DNA, 13 bp, Homo sapiens
caagtgtcttttt

SEQ ID NO: 3831427 - DNA, 19 bp, Homo sapiens
caagtttcataccaaatat

SEQ ID NO: 3831428 - DNA, 16 bp, Homo sapiens
caataaataaatgttt

SEQ ID NO: 3831429 - DNA, 13 bp, Homo sapiens
caatcattgtaca

SEQ ID NO: 3831430 - DNA, 14 bp, Homo sapiens
caatcattgtacag

SEQ ID NO: 3831431 - DNA, 23 bp, Homo sapiens
caatcattgtacagtttgtttac

SEQ ID NO: 3831432 - DNA, 21 bp, Homo sapiens
caatccaaattccctctggag

SEQ ID NO: 3831433 - DNA, 20 bp, Homo sapiens
caatcctaatttctcctccc

SEQ ID NO: 3831434 - DNA, 21 bp, Homo sapiens
caatcctaatttctcctccct

SEQ ID NO: 3831435 - DNA, 20 bp, Homo sapiens
caatcctcacctaacagtta

SEQ ID NO: 3831436 - DNA, 11 bp, Homo sapiens
caatctggaaa

SEQ ID NO: 3831437 - DNA, 18 bp, Homo sapiens
caatgaagtgttttacaa

SEQ ID NO: 3831438 - DNA, 16 bp, Homo sapiens
caatgaattaagaaag

SEQ ID NO: 3831439 - DNA, 17 bp, Homo sapiens
caatgaattaagaaaga

SEQ ID NO: 3831440 - DNA, 22 bp, Homo sapiens
caatgaattaagaaagattaaa

SEQ ID NO: 3831441 - DNA, 12 bp, Homo sapiens
caatgatttgta

SEQ ID NO: 3831442 - DNA, 16 bp, Homo sapiens
caatgatttgtaaagg

SEQ ID NO: 3831443 - DNA, 17 bp, Homo sapiens
caatgcaacctctgccc

SEQ ID NO: 3831444 - DNA, 17 bp, Homo sapiens
caatggcaggttttaca

SEQ ID NO: 3831445 - DNA, 13 bp, Homo sapiens
caatgtctgggga

SEQ ID NO: 3831446 - DNA, 16 bp, Homo sapiens
caatgtctggggacag

SEQ ID NO: 3831447 - DNA, 22 bp, Homo sapiens
caattgcattgctaccaagttt

SEQ ID NO: 3831448 - DNA, 13 bp, Homo sapiens
caattgtacaaaa

SEQ ID NO: 3831449 - DNA, 16 bp, Homo sapiens
caattgtgctttgtat

SEQ ID NO: 3831450 - DNA, 10 bp, Homo sapiens
caattttcct

SEQ ID NO: 3831451 - DNA, 15 bp, Homo sapiens
caattttccttgaag

SEQ ID NO: 3831452 - DNA, 20 bp, Homo sapiens
cacaaaattcgacctgattt

SEQ ID NO: 3831453 - DNA, 17 bp, Homo sapiens
cacaagaactcctccca

SEQ ID NO: 3831454 - DNA, 18 bp, Homo sapiens
cacaagacataatttaaa

SEQ ID NO: 3831455 - DNA, 13 bp, Homo sapiens
cacacacaaaact

SEQ ID NO: 3831456 - DNA, 23 bp, Homo sapiens
cacacactgtgctttctattgta

SEQ ID NO: 3831457 - DNA, 15 bp, Homo sapiens
cacacagcccagaag

SEQ ID NO: 3831458 - DNA, 12 bp, Homo sapiens
cacacagtggcc

SEQ ID NO: 3831459 - DNA, 21 bp, Homo sapiens
cacaccagtaataaaaagcca

SEQ ID NO: 3831460 - DNA, 16 bp, Homo sapiens
cacaccatctggccca

SEQ ID NO: 3831461 - DNA, 13 bp, Homo sapiens
cacacccagcctc

SEQ ID NO: 3831462 - DNA, 15 bp, Homo sapiens
cacacccagcctcag

SEQ ID NO: 3831463 - DNA, 14 bp, Homo sapiens
cacaccccagactc

SEQ ID NO: 3831464 - DNA, 18 bp, Homo sapiens
cacaccccagactccagg

SEQ ID NO: 3831465 - DNA, 21 bp, Homo sapiens
cacaccccagactccaggccc

SEQ ID NO: 3831466 - DNA, 21 bp, Homo sapiens
cacactaaaacattgtctaca

SEQ ID NO: 3831467 - DNA, 16 bp, Homo sapiens
cacactgtgctttcta

SEQ ID NO: 3831468 - DNA, 22 bp, Homo sapiens
cacactgtgctttctattgtac

SEQ ID NO: 3831469 - DNA, 23 bp, Homo sapiens
cacagaaagcctatcaaagacct

SEQ ID NO: 3831470 - DNA, 13 bp, Homo sapiens
cacagcccagaag

SEQ ID NO: 3831471 - DNA, 11 bp, Homo sapiens
cacagcctctg

SEQ ID NO: 3831472 - DNA, 12 bp, Homo sapiens
cacagcctctga

SEQ ID NO: 3831473 - DNA, 14 bp, Homo sapiens
cacagcctctgacc

SEQ ID NO: 3831474 - DNA, 15 bp, Homo sapiens
cacagcctctgaccc

SEQ ID NO: 3831475 - DNA, 20 bp, Homo sapiens
cacagcctctgacccctcct

SEQ ID NO: 3831476 - DNA, 20 bp, Homo sapiens
cacagctgaggaccctcagc

SEQ ID NO: 3831477 - DNA, 20 bp, Homo sapiens
cacaggaactctgtgtgaga

SEQ ID NO: 3831478 - DNA, 14 bp, Homo sapiens
cacagggccctctg

SEQ ID NO: 3831479 - DNA, 18 bp, Homo sapiens
cacagggctcctgaagga

SEQ ID NO: 3831480 - DNA, 16 bp, Homo sapiens
cacagtcctgaagcag

SEQ ID NO: 3831481 - DNA, 21 bp, Homo sapiens
cacagtggccggggctgaagc

SEQ ID NO: 3831482 - DNA, 22 bp, Homo sapiens
cacagtggccggggctgaagcc

SEQ ID NO: 3831483 - DNA, 14 bp, Homo sapiens
cacagttctatttg

SEQ ID NO: 3831484 - DNA, 18 bp, Homo sapiens
cacatcctaatagaaaga

SEQ ID NO: 3831485 - DNA, 13 bp, Homo sapiens
cacatctgcctta

SEQ ID NO: 3831486 - DNA, 13 bp, Homo sapiens
cacatcttcaggc

SEQ ID NO: 3831487 - DNA, 14 bp, Homo sapiens
cacatcttcatgtg

SEQ ID NO: 3831488 - DNA, 17 bp, Homo sapiens
cacatgctggctcctga

SEQ ID NO: 3831489 - DNA, 21 bp, Homo sapiens
cacatgtcattgcccacttct

SEQ ID NO: 3831490 - DNA, 15 bp, Homo sapiens
cacattcacaaagaa

SEQ ID NO: 3831491 - DNA, 20 bp, Homo sapiens
caccaaaccctgtcctccca

SEQ ID NO: 3831492 - DNA, 18 bp, Homo sapiens
caccaaagatctgctcct

SEQ ID NO: 3831493 - DNA, 14 bp, Homo sapiens
caccaacactgtaa

SEQ ID NO: 3831494 - DNA, 16 bp, Homo sapiens
caccaatcctcaccta

SEQ ID NO: 3831495 - DNA, 13 bp, Homo sapiens
caccacaccaaat

SEQ ID NO: 3831496 - DNA, 16 bp, Homo sapiens
caccacacccagcctc

SEQ ID NO: 3831497 - DNA, 15 bp, Homo sapiens
caccacgctggagct

SEQ ID NO: 3831498 - DNA, 15 bp, Homo sapiens
caccactcctgcctg

SEQ ID NO: 3831499 - DNA, 20 bp, Homo sapiens
caccactcctgcctgccccc

SEQ ID NO: 3831500 - DNA, 11 bp, Homo sapiens
caccagagacc

SEQ ID NO: 3831501 - DNA, 18 bp, Homo sapiens
caccagtaataaaaagcc

SEQ ID NO: 3831502 - DNA, 20 bp, Homo sapiens
caccagtaataaaaagccac

SEQ ID NO: 3831503 - DNA, 22 bp, Homo sapiens
caccagtaataaaaagccacca

SEQ ID NO: 3831504 - DNA, 12 bp, Homo sapiens
caccatctggcc

SEQ ID NO: 3831505 - DNA, 13 bp, Homo sapiens
caccatctggccc

SEQ ID NO: 3831506 - DNA, 20 bp, Homo sapiens
cacccacaagaactcctccc

SEQ ID NO: 3831507 - DNA, 12 bp, Homo sapiens
cacccagcctca

SEQ ID NO: 3831508 - DNA, 15 bp, Homo sapiens
cacccagcctcagtc

SEQ ID NO: 3831509 - DNA, 16 bp, Homo sapiens
cacccatggcctcaga

SEQ ID NO: 3831510 - DNA, 16 bp, Homo sapiens
caccccagactccagg

SEQ ID NO: 3831511 - DNA, 19 bp, Homo sapiens
caccccagactccaggccc

SEQ ID NO: 3831512 - DNA, 16 bp, Homo sapiens
cacccccagccaggct

SEQ ID NO: 3831513 - DNA, 17 bp, Homo sapiens
cacccccagccaggcta

SEQ ID NO: 3831514 - DNA, 17 bp, Homo sapiens
caccccctgccctgcac

SEQ ID NO: 3831515 - DNA, 20 bp, Homo sapiens
caccccgggctctcctgccc

SEQ ID NO: 3831516 - DNA, 21 bp, Homo sapiens
caccccgggctctcctgccct

SEQ ID NO: 3831517 - DNA, 18 bp, Homo sapiens
caccccggggaccctgtg

SEQ ID NO: 3831518 - DNA, 11 bp, Homo sapiens
cacccctgccc

SEQ ID NO: 3831519 - DNA, 14 bp, Homo sapiens
cacccctgccccca

SEQ ID NO: 3831520 - DNA, 17 bp, Homo sapiens
cacccctgtcctcactg

SEQ ID NO: 3831521 - DNA, 21 bp, Homo sapiens
cacccctgtcctcactgctcc

SEQ ID NO: 3831522 - DNA, 23 bp, Homo sapiens
cacccctgtcctcactgctccct

SEQ ID NO: 3831523 - DNA, 16 bp, Homo sapiens
caccgccctgcctctt

SEQ ID NO: 3831524 - DNA, 17 bp, Homo sapiens
caccgtggaggaggaag

SEQ ID NO: 3831525 - DNA, 16 bp, Homo sapiens
cacctcatgcccaccc

SEQ ID NO: 3831526 - DNA, 21 bp, Homo sapiens
cacctccccacgccctcccct

SEQ ID NO: 3831527 - DNA, 12 bp, Homo sapiens
cacctccccact

SEQ ID NO: 3831528 - DNA, 12 bp, Homo sapiens
cacctctgcgga

SEQ ID NO: 3831529 - DNA, 19 bp, Homo sapiens
cacctctgcggaccccagc

SEQ ID NO: 3831530 - DNA, 13 bp, Homo sapiens
cacctctgtgacc

SEQ ID NO: 3831531 - DNA, 18 bp, Homo sapiens
cacctctgtgacctcagg

SEQ ID NO: 3831532 - DNA, 21 bp, Homo sapiens
cacctgcctccggcctgcact

SEQ ID NO: 3831533 - DNA, 16 bp, Homo sapiens
cacctgcgcagggccc

SEQ ID NO: 3831534 - DNA, 20 bp, Homo sapiens
cacctgcgcagggccctctg

SEQ ID NO: 3831535 - DNA, 15 bp, Homo sapiens
cacctggccctagtg

SEQ ID NO: 3831536 - DNA, 16 bp, Homo sapiens
cacctgtgcagggccc

SEQ ID NO: 3831537 - DNA, 19 bp, Homo sapiens
cacctgttgtgtgcctgac

SEQ ID NO: 3831538 - DNA, 17 bp, Homo sapiens
caccttccttgcgacca

SEQ ID NO: 3831539 - DNA, 13 bp, Homo sapiens
cacgccctcccct

SEQ ID NO: 3831540 - DNA, 15 bp, Homo sapiens
cacgccctcccctcc

SEQ ID NO: 3831541 - DNA, 20 bp, Homo sapiens
cacgccctcccctcccctgc

SEQ ID NO: 3831542 - DNA, 21 bp, Homo sapiens
cacgccctcccctcccctgct

SEQ ID NO: 3831543 - DNA, 18 bp, Homo sapiens
cacgcgacttctcaggac

SEQ ID NO: 3831544 - DNA, 14 bp, Homo sapiens
cacgtcatgggagg

SEQ ID NO: 3831545 - DNA, 22 bp, Homo sapiens
cacgttttgcctcatgaacact

SEQ ID NO: 3831546 - DNA, 15 bp, Homo sapiens
cactacctcctcagg

SEQ ID NO: 3831547 - DNA, 16 bp, Homo sapiens
cactacctcctcaggg

SEQ ID NO: 3831548 - DNA, 17 bp, Homo sapiens
cactacctcctcaggga

SEQ ID NO: 3831549 - DNA, 18 bp, Homo sapiens
cactacctcctcagggat

SEQ ID NO: 3831550 - DNA, 20 bp, Homo sapiens
cactacctcctcagggatgg

SEQ ID NO: 3831551 - DNA, 19 bp, Homo sapiens
cactagcctccctctcctc

SEQ ID NO: 3831552 - DNA, 22 bp, Homo sapiens
cactagcctttggctctggaga

SEQ ID NO: 3831553 - DNA, 18 bp, Homo sapiens
cactccacaccagtaata

SEQ ID NO: 3831554 - DNA, 23 bp, Homo sapiens
cactccataaaaagaaagctaat

SEQ ID NO: 3831555 - DNA, 15 bp, Homo sapiens
cactcgaactcggga

SEQ ID NO: 3831556 - DNA, 15 bp, Homo sapiens
ccaccaatcctcacc

SEQ ID NO: 3831557 - DNA, 13 bp, Homo sapiens
ccaccactcctgc

SEQ ID NO: 3831558 - DNA, 17 bp, Homo sapiens
ccaccagagaccgtcct

SEQ ID NO: 3831559 - DNA, 20 bp, Homo sapiens
ccaccagagaccgtcctcac

SEQ ID NO: 3831560 - DNA, 15 bp, Homo sapiens
ccacccccagccagg

SEQ ID NO: 3831561 - DNA, 16 bp, Homo sapiens
ccacccccagccaggc

SEQ ID NO: 3831562 - DNA, 18 bp, Homo sapiens
ccacccccgagcttgcct

SEQ ID NO: 3831563 - DNA, 17 bp, Homo sapiens
ccaccccctgccctgca

SEQ ID NO: 3831564 - DNA, 22 bp, Homo sapiens
ccacccctgcccccagccccgg

SEQ ID NO: 3831565 - DNA, 16 bp, Homo sapiens
ccacccgcctccctct

SEQ ID NO: 3831566 - DNA, 13 bp, Homo sapiens
ccaccctgctgct

SEQ ID NO: 3831567 - DNA, 16 bp, Homo sapiens
ccaccgtggaggagga

SEQ ID NO: 3831568 - DNA, 12 bp, Homo sapiens
ccacctccccac

SEQ ID NO: 3831569 - DNA, 13 bp, Homo sapiens
ccacctccccact

SEQ ID NO: 3831570 - DNA, 19 bp, Homo sapiens
ccacctctgcggaccccag

SEQ ID NO: 3831571 - DNA, 15 bp, Homo sapiens
ccacctctgtgacct

SEQ ID NO: 3831572 - DNA, 18 bp, Homo sapiens
ccacctctgtgacctcag

SEQ ID NO: 3831573 - DNA, 23 bp, Homo sapiens
ccacctctgtgacctcaggcact

SEQ ID NO: 3831574 - DNA, 14 bp, Homo sapiens
ccaccttccttgcg

SEQ ID NO: 3831575 - DNA, 14 bp, Homo sapiens
ccacgccctcccct

SEQ ID NO: 3831576 - DNA, 15 bp, Homo sapiens
ccacgccctcccctc

SEQ ID NO: 3831577 - DNA, 22 bp, Homo sapiens
ccacgccctcccctcccctgct

SEQ ID NO: 3831578 - DNA, 13 bp, Homo sapiens
ccacgctggagct

SEQ ID NO: 3831579 - DNA, 16 bp, Homo sapiens
ccactacacctggctg

SEQ ID NO: 3831580 - DNA, 14 bp, Homo sapiens
ccactccacaccag

SEQ ID NO: 3831581 - DNA, 13 bp, Homo sapiens
ccactccagcaga

SEQ ID NO: 3831582 - DNA, 18 bp, Homo sapiens
ccactcggggcccccatc

SEQ ID NO: 3831583 - DNA, 20 bp, Homo sapiens
ccactcggggcccccatctt

SEQ ID NO: 3831584 - DNA, 21 bp, Homo sapiens
ccactgctggtgtttatgtga

SEQ ID NO: 3831585 - DNA, 12 bp, Homo sapiens
ccacttggccaa

SEQ ID NO: 3831586 - DNA, 16 bp, Homo sapiens
ccagaaaaggcagcca

SEQ ID NO: 3831587 - DNA, 16 bp, Homo sapiens
ccagacagggctccag

SEQ ID NO: 3831588 - DNA, 20 bp, Homo sapiens
ccagacagggctccagcctg

SEQ ID NO: 3831589 - DNA, 19 bp, Homo sapiens
ccagactccgcctgaggcc

SEQ ID NO: 3831590 - DNA, 18 bp, Homo sapiens
ccagagaccgtcctcacc

SEQ ID NO: 3831591 - DNA, 19 bp, Homo sapiens
ccagagatggctccttggg

SEQ ID NO: 3831592 - DNA, 21 bp, Homo sapiens
ccagagatggctccttgggat

SEQ ID NO: 3831593 - DNA, 12 bp, Homo sapiens
ccagagcagggt

SEQ ID NO: 3831594 - DNA, 20 bp, Homo sapiens
ccagagctgcctatgcccag

SEQ ID NO: 3831595 - DNA, 16 bp, Homo sapiens
ccagatccccagggca

SEQ ID NO: 3831596 - DNA, 20 bp, Homo sapiens
ccagatccccagggcagcct

SEQ ID NO: 3831597 - DNA, 21 bp, Homo sapiens
ccagatccccagggcagcctc

SEQ ID NO: 3831598 - DNA, 19 bp, Homo sapiens
ccagatgtttctcatttta

SEQ ID NO: 3831599 - DNA, 19 bp, Homo sapiens
ccagcaaagccccatgctg

SEQ ID NO: 3831600 - DNA, 21 bp, Homo sapiens
ccagcaaagccccatgctgga

SEQ ID NO: 3831601 - DNA, 18 bp, Homo sapiens
ccagcacagctgaggacc

SEQ ID NO: 3831602 - DNA, 20 bp, Homo sapiens
ccagcacagctgaggaccct

SEQ ID NO: 3831603 - DNA, 13 bp, Homo sapiens
ccagcactgaccc

SEQ ID NO: 3831604 - DNA, 19 bp, Homo sapiens
ccagcactttgggaggccg

SEQ ID NO: 3831605 - DNA, 23 bp, Homo sapiens
ccagcataatacttgctttggaa

SEQ ID NO: 3831606 - DNA, 20 bp, Homo sapiens
ccagccaccccgcagtcact

SEQ ID NO: 3831607 - DNA, 14 bp, Homo sapiens
ccagccacgtggag

SEQ ID NO: 3831608 - DNA, 12 bp, Homo sapiens
ccagcccaggcc

SEQ ID NO: 3831609 - DNA, 13 bp, Homo sapiens
ccagcccaggcct

SEQ ID NO: 3831610 - DNA, 16 bp, Homo sapiens
ccagcccaggcctggt

SEQ ID NO: 3831611 - DNA, 17 bp, Homo sapiens
ccagccccacccccagc

SEQ ID NO: 3831612 - DNA, 18 bp, Homo sapiens
ccagccccacccccagcc

SEQ ID NO: 3831613 - DNA, 20 bp, Homo sapiens
ccagccccacccccagccag

SEQ ID NO: 3831614 - DNA, 17 bp, Homo sapiens
ccagccccggggtgagt

SEQ ID NO: 3831615 - DNA, 17 bp, Homo sapiens
ccagcccctagcccagg

SEQ ID NO: 3831616 - DNA, 19 bp, Homo sapiens
ccagcccctagcccaggag

SEQ ID NO: 3831617 - DNA, 22 bp, Homo sapiens
ccagcccctagcccaggagaga

SEQ ID NO: 3831618 - DNA, 10 bp, Homo sapiens
ccagccctgg

SEQ ID NO: 3831619 - DNA, 22 bp, Homo sapiens
ccagcctcagtcctcccctcac

SEQ ID NO: 3831620 - DNA, 18 bp, Homo sapiens
ccagcctccgagagggag

SEQ ID NO: 3831621 - DNA, 21 bp, Homo sapiens
ccagcctccgagagggagaga

SEQ ID NO: 3831622 - DNA, 15 bp, Homo sapiens
ccagcctcctctgga

SEQ ID NO: 3831623 - DNA, 16 bp, Homo sapiens
ccagcctcctctggac

SEQ ID NO: 3831624 - DNA, 23 bp, Homo sapiens
ccagcctcctctggacggcaggc

SEQ ID NO: 3831625 - DNA, 21 bp, Homo sapiens
ccagcctgcgggaagctgacc

SEQ ID NO: 3831626 - DNA, 22 bp, Homo sapiens
ccagcctgcgggaagctgacct

SEQ ID NO: 3831627 - DNA, 23 bp, Homo sapiens
ccagcctgcgggaagctgacctt

SEQ ID NO: 3831628 - DNA, 12 bp, Homo sapiens
ccagctcctccc

SEQ ID NO: 3831629 - DNA, 22 bp, Homo sapiens
ccagctgaccctggttctctct

SEQ ID NO: 3831630 - DNA, 14 bp, Homo sapiens
ccagctgagtcctg

SEQ ID NO: 3831631 - DNA, 17 bp, Homo sapiens
ccagctgagtcctgggg

SEQ ID NO: 3831632 - DNA, 16 bp, Homo sapiens
ccagctgccagggaag

SEQ ID NO: 3831633 - DNA, 16 bp, Homo sapiens
ccagctgcgcttgctt

SEQ ID NO: 3831634 - DNA, 18 bp, Homo sapiens
ccagctgcgcttgctttt

SEQ ID NO: 3831635 - DNA, 21 bp, Homo sapiens
ccagctgcgcttgcttttctg

SEQ ID NO: 3831636 - DNA, 17 bp, Homo sapiens
ccagctgtgagccttgg

SEQ ID NO: 3831637 - DNA, 18 bp, Homo sapiens
ccagctgtgagccttggc

SEQ ID NO: 3831638 - DNA, 20 bp, Homo sapiens
ccaggaaactccacatctgc

SEQ ID NO: 3831639 - DNA, 22 bp, Homo sapiens
ccaggaaactccacatctgcct

SEQ ID NO: 3831640 - DNA, 16 bp, Homo sapiens
ccaggaaatgtgcaca

SEQ ID NO: 3831641 - DNA, 17 bp, Homo sapiens
ccaggacaccacaccca

SEQ ID NO: 3831642 - DNA, 18 bp, Homo sapiens
ccaggacaccacacccag

SEQ ID NO: 3831643 - DNA, 15 bp, Homo sapiens
ccaggacctgagcct

SEQ ID NO: 3831644 - DNA, 16 bp, Homo sapiens
ccaggacctgagcctg

SEQ ID NO: 3831645 - DNA, 18 bp, Homo sapiens
ccaggacctgagcctggc

SEQ ID NO: 3831646 - DNA, 15 bp, Homo sapiens
ccaggactgagcccc

SEQ ID NO: 3831647 - DNA, 20 bp, Homo sapiens
ccaggagaattaggaaggcc

SEQ ID NO: 3831648 - DNA, 23 bp, Homo sapiens
ccaggagaattaggaaggccatg

SEQ ID NO: 3831649 - DNA, 12 bp, Homo sapiens
ccaggagagaga

SEQ ID NO: 3831650 - DNA, 17 bp, Homo sapiens
ccaggagagagaaagcc

SEQ ID NO: 3831651 - DNA, 22 bp, Homo sapiens
ccaggaggaaactacaccacac

SEQ ID NO: 3831652 - DNA, 18 bp, Homo sapiens
ccaggaggagttagccaa

SEQ ID NO: 3831653 - DNA, 16 bp, Homo sapiens
ccaggagggctttgtg

SEQ ID NO: 3831654 - DNA, 15 bp, Homo sapiens
ccaggagttctgctc

SEQ ID NO: 3831655 - DNA, 17 bp, Homo sapiens
ccaggagttctgctcat

SEQ ID NO: 3831656 - DNA, 17 bp, Homo sapiens
ccaggatgcctgagccc

SEQ ID NO: 3831657 - DNA, 21 bp, Homo sapiens
ccaggatgcctgagccccctg

SEQ ID NO: 3831658 - DNA, 15 bp, Homo sapiens
ccaggattttgtgtt

SEQ ID NO: 3831659 - DNA, 15 bp, Homo sapiens
ccaggcacacactgt

SEQ ID NO: 3831660 - DNA, 16 bp, Homo sapiens
ccaggcacacactgtg

SEQ ID NO: 3831661 - DNA, 22 bp, Homo sapiens
ccaggcacacactgtgctttct

SEQ ID NO: 3831662 - DNA, 15 bp, Homo sapiens
ccaggcagctcctgt

SEQ ID NO: 3831663 - DNA, 21 bp, Homo sapiens
ccaggcaggggtgggggtgga

SEQ ID NO: 3831664 - DNA, 19 bp, Homo sapiens
ccaggccagcctccgagag

SEQ ID NO: 3831665 - DNA, 21 bp, Homo sapiens
ccaggcccccgttgaagccgc

SEQ ID NO: 3831666 - DNA, 18 bp, Homo sapiens
ccaggctatggttgccac

SEQ ID NO: 3831667 - DNA, 20 bp, Homo sapiens
ccaggctatggttgccaccc

SEQ ID NO: 3831668 - DNA, 16 bp, Homo sapiens
ccagggaagacagagc

SEQ ID NO: 3831669 - DNA, 22 bp, Homo sapiens
ccagggaagacagagcaggctt

SEQ ID NO: 3831670 - DNA, 18 bp, Homo sapiens
ccagggagactccgctgt

SEQ ID NO: 3831671 - DNA, 14 bp, Homo sapiens
ccaggggctggctt

SEQ ID NO: 3831672 - DNA, 18 bp, Homo sapiens
ccagggggactagcccct

SEQ ID NO: 3831673 - DNA, 20 bp, Homo sapiens
ccagggtggacttagaaagc

SEQ ID NO: 3831674 - DNA, 21 bp, Homo sapiens
ccaggtgaggaatttgaagct

SEQ ID NO: 3831675 - DNA, 18 bp, Homo sapiens
ccagtaataaaaagccac

SEQ ID NO: 3831676 - DNA, 19 bp, Homo sapiens
ccagtaataaaaagccacc

SEQ ID NO: 3831677 - DNA, 17 bp, Homo sapiens
ccagtccccacccctgc

SEQ ID NO: 3831678 - DNA, 21 bp, Homo sapiens
ccagtccccacccctgccccc

SEQ ID NO: 3831679 - DNA, 22 bp, Homo sapiens
ccagtccccacccctgccccca

SEQ ID NO: 3831680 - DNA, 15 bp, Homo sapiens
ccagtctgctctcag

SEQ ID NO: 3831681 - DNA, 16 bp, Homo sapiens
ccagtctgctctcagc

SEQ ID NO: 3831682 - DNA, 18 bp, Homo sapiens
ccagtctgctctcagctt

SEQ ID NO: 3831683 - DNA, 21 bp, Homo sapiens
ccagttcccgggccctcctgg

SEQ ID NO: 3831684 - DNA, 13 bp, Homo sapiens
ccataaaaagctg

SEQ ID NO: 3831685 - DNA, 14 bp, Homo sapiens
ccataaaaagctga

SEQ ID NO: 3831686 - DNA, 20 bp, Homo sapiens
ccatagctggtttttcccac

SEQ ID NO: 3831687 - DNA, 21 bp, Homo sapiens
ccatatgaaattcatggcttt

SEQ ID NO: 3831688 - DNA, 20 bp, Homo sapiens
cctgctgcaggggctctgga

SEQ ID NO: 3831689 - DNA, 22 bp, Homo sapiens
cctgctgcaggggctctggaga

SEQ ID NO: 3831690 - DNA, 11 bp, Homo sapiens
cctgctgctgc

SEQ ID NO: 3831691 - DNA, 14 bp, Homo sapiens
cctgctgctgccaa

SEQ ID NO: 3831692 - DNA, 9 bp, Homo sapiens
cctgctggc

SEQ ID NO: 3831693 - DNA, 15 bp, Homo sapiens
cctgctggcacccac

SEQ ID NO: 3831694 - DNA, 21 bp, Homo sapiens
cctgctggtgaccggcctgga

SEQ ID NO: 3831695 - DNA, 18 bp, Homo sapiens
cctgcttgaactgctgcc

SEQ ID NO: 3831696 - DNA, 20 bp, Homo sapiens
cctgctttttatggcctgtg

SEQ ID NO: 3831697 - DNA, 17 bp, Homo sapiens
cctggacgcagccacac

SEQ ID NO: 3831698 - DNA, 19 bp, Homo sapiens
cctggacgcagccacacag

SEQ ID NO: 3831699 - DNA, 18 bp, Homo sapiens
cctggagggaagttgggg

SEQ ID NO: 3831700 - DNA, 13 bp, Homo sapiens
cctggaggtgcca

SEQ ID NO: 3831701 - DNA, 19 bp, Homo sapiens
cctggaggtgccagcaaag

SEQ ID NO: 3831702 - DNA, 23 bp, Homo sapiens
cctggaggtgccagcaaagcccc

SEQ ID NO: 3831703 - DNA, 17 bp, Homo sapiens
cctggatccatcctgct

SEQ ID NO: 3831704 - DNA, 16 bp, Homo sapiens
cctggccatgtcctca

SEQ ID NO: 3831705 - DNA, 21 bp, Homo sapiens
cctggctaggactgtggaggg

SEQ ID NO: 3831706 - DNA, 20 bp, Homo sapiens
cctggctgaggttcctctgc

SEQ ID NO: 3831707 - DNA, 21 bp, Homo sapiens
cctggctgaggttcctctgcc

SEQ ID NO: 3831708 - DNA, 22 bp, Homo sapiens
cctggctgaggttcctctgcct

SEQ ID NO: 3831709 - DNA, 20 bp, Homo sapiens
cctggctgctgcccccaccc

SEQ ID NO: 3831710 - DNA, 21 bp, Homo sapiens
cctggctgctgcccccacccc

SEQ ID NO: 3831711 - DNA, 12 bp, Homo sapiens
cctgggcacccc

SEQ ID NO: 3831712 - DNA, 14 bp, Homo sapiens
cctgggcaccccag

SEQ ID NO: 3831713 - DNA, 20 bp, Homo sapiens
cctgggcaccccaggcagct

SEQ ID NO: 3831714 - DNA, 22 bp, Homo sapiens
cctgggcaccccaggcagctcc

SEQ ID NO: 3831715 - DNA, 18 bp, Homo sapiens
cctgggcctcctcctagc

SEQ ID NO: 3831716 - DNA, 22 bp, Homo sapiens
cctgggcctcctcctagctgga

SEQ ID NO: 3831717 - DNA, 18 bp, Homo sapiens
cctgggcctgcacctctc

SEQ ID NO: 3831718 - DNA, 18 bp, Homo sapiens
cctgggcgcagctgaagc

SEQ ID NO: 3831719 - DNA, 13 bp, Homo sapiens
cctgggctgcctc

SEQ ID NO: 3831720 - DNA, 15 bp, Homo sapiens
cctgggctgcctcct

SEQ ID NO: 3831721 - DNA, 23 bp, Homo sapiens
cctgggctgcctcctcctgagag

SEQ ID NO: 3831722 - DNA, 13 bp, Homo sapiens
cctgggcttggcc

SEQ ID NO: 3831723 - DNA, 15 bp, Homo sapiens
cctgggcttggcctg

SEQ ID NO: 3831724 - DNA, 16 bp, Homo sapiens
cctgggcttggcctgc

SEQ ID NO: 3831725 - DNA, 18 bp, Homo sapiens
cctgggcttggcctgctg

SEQ ID NO: 3831726 - DNA, 15 bp, Homo sapiens
cctgggttccccacc

SEQ ID NO: 3831727 - DNA, 13 bp, Homo sapiens
cctggtggggcag

SEQ ID NO: 3831728 - DNA, 22 bp, Homo sapiens
cctggtggggcagaaaggctgc

SEQ ID NO: 3831729 - DNA, 14 bp, Homo sapiens
cctgtaataaatat

SEQ ID NO: 3831730 - DNA, 15 bp, Homo sapiens
cctgtaataaatatg

SEQ ID NO: 3831731 - DNA, 16 bp, Homo sapiens
cctgtaataaatatga

SEQ ID NO: 3831732 - DNA, 21 bp, Homo sapiens
cctgtcccccacacccgtgtc

SEQ ID NO: 3831733 - DNA, 17 bp, Homo sapiens
cctgtccctcccacctc

SEQ ID NO: 3831734 - DNA, 19 bp, Homo sapiens
cctgtccctcccacctctg

SEQ ID NO: 3831735 - DNA, 20 bp, Homo sapiens
cctgtccctcccacctctgt

SEQ ID NO: 3831736 - DNA, 12 bp, Homo sapiens
cctgtcctcact

SEQ ID NO: 3831737 - DNA, 16 bp, Homo sapiens
cctgtcctcactgctc

SEQ ID NO: 3831738 - DNA, 20 bp, Homo sapiens
cctgtcctcccacccctccc

SEQ ID NO: 3831739 - DNA, 15 bp, Homo sapiens
cctgtcggccacacc

SEQ ID NO: 3831740 - DNA, 18 bp, Homo sapiens
cctgtcggccacacccca

SEQ ID NO: 3831741 - DNA, 19 bp, Homo sapiens
cctgtcggccacaccccag

SEQ ID NO: 3831742 - DNA, 21 bp, Homo sapiens
cctgtcggccacaccccagac

SEQ ID NO: 3831743 - DNA, 18 bp, Homo sapiens
cctgtgcagggccctctg

SEQ ID NO: 3831744 - DNA, 23 bp, Homo sapiens
cctgtgcagggccctctggggct

SEQ ID NO: 3831745 - DNA, 16 bp, Homo sapiens
cctgtggctgccctcc

SEQ ID NO: 3831746 - DNA, 13 bp, Homo sapiens
cctgtgtaacagc

SEQ ID NO: 3831747 - DNA, 17 bp, Homo sapiens
cctgtgtaacagctcct

SEQ ID NO: 3831748 - DNA, 18 bp, Homo sapiens
cctgtgtaacagctcctt

SEQ ID NO: 3831749 - DNA, 18 bp, Homo sapiens
cctgtgtctttttcgcca

SEQ ID NO: 3831750 - DNA, 18 bp, Homo sapiens
cctgtgtgcagtggagct

SEQ ID NO: 3831751 - DNA, 13 bp, Homo sapiens
cctgttgcaggca

SEQ ID NO: 3831752 - DNA, 18 bp, Homo sapiens
cctgttgcaggcaaatgt

SEQ ID NO: 3831753 - DNA, 19 bp, Homo sapiens
cctgttgcaggcaaatgta

SEQ ID NO: 3831754 - DNA, 15 bp, Homo sapiens
cctgtttaagagaca

SEQ ID NO: 3831755 - DNA, 23 bp, Homo sapiens
cctgtttggaaatggggagctgg

SEQ ID NO: 3831756 - DNA, 17 bp, Homo sapiens
ccttaaaaccaaagagg

SEQ ID NO: 3831757 - DNA, 18 bp, Homo sapiens
ccttaagtctttttgaag

SEQ ID NO: 3831758 - DNA, 15 bp, Homo sapiens
ccttacatttcctgg

SEQ ID NO: 3831759 - DNA, 18 bp, Homo sapiens
ccttagagccaggcacac

SEQ ID NO: 3831760 - DNA, 16 bp, Homo sapiens
ccttagagtgctgtga

SEQ ID NO: 3831761 - DNA, 19 bp, Homo sapiens
ccttagagtgctgtgagat

SEQ ID NO: 3831762 - DNA, 21 bp, Homo sapiens
ccttagcctgggcctcctcct

SEQ ID NO: 3831763 - DNA, 21 bp, Homo sapiens
ccttagcttcactcagctgga

SEQ ID NO: 3831764 - DNA, 13 bp, Homo sapiens
ccttcacccagag

SEQ ID NO: 3831765 - DNA, 18 bp, Homo sapiens
ccttcacccagagctgcc

SEQ ID NO: 3831766 - DNA, 21 bp, Homo sapiens
ccttcacccagagctgcctat

SEQ ID NO: 3831767 - DNA, 11 bp, Homo sapiens
ccttcataatt

SEQ ID NO: 3831768 - DNA, 12 bp, Homo sapiens
ccttccctagct

SEQ ID NO: 3831769 - DNA, 17 bp, Homo sapiens
ccttccctgtgtctttt

SEQ ID NO: 3831770 - DNA, 18 bp, Homo sapiens
ccttcctcagaatagtga

SEQ ID NO: 3831771 - DNA, 22 bp, Homo sapiens
ccttcctgcctactgcccctgc

SEQ ID NO: 3831772 - DNA, 17 bp, Homo sapiens
ccttccttgcgaccacc

SEQ ID NO: 3831773 - DNA, 13 bp, Homo sapiens
ccttccttttccc

SEQ ID NO: 3831774 - DNA, 19 bp, Homo sapiens
ccttccttttccctgcttc

SEQ ID NO: 3831775 - DNA, 23 bp, Homo sapiens
ccttccttttccctgcttccagg

SEQ ID NO: 3831776 - DNA, 13 bp, Homo sapiens
ccttctctccaga

SEQ ID NO: 3831777 - DNA, 16 bp, Homo sapiens
ccttctgcctgagctt

SEQ ID NO: 3831778 - DNA, 18 bp, Homo sapiens
ccttctggattcttggcc

SEQ ID NO: 3831779 - DNA, 21 bp, Homo sapiens
ccttctggattcttggcccgc

SEQ ID NO: 3831780 - DNA, 16 bp, Homo sapiens
ccttcttccatcccag

SEQ ID NO: 3831781 - DNA, 12 bp, Homo sapiens
ccttgcactgta

SEQ ID NO: 3831782 - DNA, 14 bp, Homo sapiens
ccttgccctgggct

SEQ ID NO: 3831783 - DNA, 14 bp, Homo sapiens
ccttgcctccccat

SEQ ID NO: 3831784 - DNA, 22 bp, Homo sapiens
ccttgcctccccatttcccatc

SEQ ID NO: 3831785 - DNA, 23 bp, Homo sapiens
ccttgcctccccatttcccatct

SEQ ID NO: 3831786 - DNA, 23 bp, Homo sapiens
ccttgcgaccaccaacacacagg

SEQ ID NO: 3831787 - DNA, 16 bp, Homo sapiens
ccttgggaggaagcag

SEQ ID NO: 3831788 - DNA, 18 bp, Homo sapiens
ccttgggaggaagcagaa

SEQ ID NO: 3831789 - DNA, 20 bp, Homo sapiens
ccttggtgccacagagggct

SEQ ID NO: 3831790 - DNA, 20 bp, Homo sapiens
ccttgtaaattccccttccc

SEQ ID NO: 3831791 - DNA, 15 bp, Homo sapiens
ccttgtgtgtatgtg

SEQ ID NO: 3831792 - DNA, 24 bp, Homo sapiens
cctttaactgagggctgatcttta

SEQ ID NO: 3831793 - DNA, 15 bp, Homo sapiens
cctttataattcttt

SEQ ID NO: 3831794 - DNA, 23 bp, Homo sapiens
cctttcaccaccccctccttccc

SEQ ID NO: 3831795 - DNA, 13 bp, Homo sapiens
cctttccccagcc

SEQ ID NO: 3831796 - DNA, 14 bp, Homo sapiens
cctttccccagccc

SEQ ID NO: 3831797 - DNA, 16 bp, Homo sapiens
cctttccccagcccag

SEQ ID NO: 3831798 - DNA, 17 bp, Homo sapiens
cctttccccagcccagg

SEQ ID NO: 3831799 - DNA, 18 bp, Homo sapiens
cctttccccagcccaggg

SEQ ID NO: 3831800 - DNA, 11 bp, Homo sapiens
cctttgccgcg

SEQ ID NO: 3831801 - DNA, 14 bp, Homo sapiens
cctttgctgttcgc

SEQ ID NO: 3831802 - DNA, 16 bp, Homo sapiens
cctttggctctggaga

SEQ ID NO: 3831803 - DNA, 19 bp, Homo sapiens
cctttggggatagtctgga

SEQ ID NO: 3831804 - DNA, 16 bp, Homo sapiens
cctttggtttttttct

SEQ ID NO: 3831805 - DNA, 15 bp, Homo sapiens
ccttttccctgcttc

SEQ ID NO: 3831806 - DNA, 12 bp, Homo sapiens
cgaaccaggagc

SEQ ID NO: 3831807 - DNA, 15 bp, Homo sapiens
cgaaccaggagctgc

SEQ ID NO: 3831808 - DNA, 14 bp, Homo sapiens
cgacccttcctggc

SEQ ID NO: 3831809 - DNA, 14 bp, Homo sapiens
cgagagggagagag

SEQ ID NO: 3831810 - DNA, 12 bp, Homo sapiens
cgagctcctcca

SEQ ID NO: 3831811 - DNA, 15 bp, Homo sapiens
cgagctggatgtccc

SEQ ID NO: 3831812 - DNA, 15 bp, Homo sapiens
cgagcttgcctcagg

SEQ ID NO: 3831813 - DNA, 19 bp, Homo sapiens
cgagcttgcctcagggcca

SEQ ID NO: 3831814 - DNA, 16 bp, Homo sapiens
cgatgtgagccgcctc

SEQ ID NO: 3831815 - DNA, 14 bp, Homo sapiens
cgattgggagaaag

SEQ ID NO: 3831816 - DNA, 17 bp, Homo sapiens
cgcacagagctggggct

SEQ ID NO: 3831817 - DNA, 15 bp, Homo sapiens
cgcagacctccccag

SEQ ID NO: 3831818 - DNA, 20 bp, Homo sapiens
cgcagagactggggcctgga

SEQ ID NO: 3831819 - DNA, 17 bp, Homo sapiens
cgcagccacacagtggc

SEQ ID NO: 3831820 - DNA, 18 bp, Homo sapiens
cgcagccacacagtggcc

SEQ ID NO: 3831821 - DNA, 19 bp, Homo sapiens
ctgcagtaatctccagggc

SEQ ID NO: 3831822 - DNA, 23 bp, Homo sapiens
ctgcattgaaggcgaggctgccc

SEQ ID NO: 3831823 - DNA, 16 bp, Homo sapiens
ctgcattttaagcata

SEQ ID NO: 3831824 - DNA, 23 bp, Homo sapiens
ctgcattttcacaacatatcaga

SEQ ID NO: 3831825 - DNA, 16 bp, Homo sapiens
ctgccaaaaccaaatt

SEQ ID NO: 3831826 - DNA, 15 bp, Homo sapiens
ctgccaactccatgt

SEQ ID NO: 3831827 - DNA, 21 bp, Homo sapiens
ctgccaccagagaccgtcctc

SEQ ID NO: 3831828 - DNA, 15 bp, Homo sapiens
ctgccaggcaggggt

SEQ ID NO: 3831829 - DNA, 20 bp, Homo sapiens
ctgccaggcaggggtggggg

SEQ ID NO: 3831830 - DNA, 19 bp, Homo sapiens
ctgccaggccagcctccga

SEQ ID NO: 3831831 - DNA, 21 bp, Homo sapiens
ctgccagggaagacagagcag

SEQ ID NO: 3831832 - DNA, 22 bp, Homo sapiens
ctgccagggaagacagagcagg

SEQ ID NO: 3831833 - DNA, 21 bp, Homo sapiens
ctgccccatttatccacctcc

SEQ ID NO: 3831834 - DNA, 22 bp, Homo sapiens
ctgccccatttatccacctcca

SEQ ID NO: 3831835 - DNA, 13 bp, Homo sapiens
ctgcccccacacc

SEQ ID NO: 3831836 - DNA, 17 bp, Homo sapiens
ctgcccccacacccact

SEQ ID NO: 3831837 - DNA, 16 bp, Homo sapiens
ctgcccccagccccgg

SEQ ID NO: 3831838 - DNA, 15 bp, Homo sapiens
ctgcccccgcatccc

SEQ ID NO: 3831839 - DNA, 16 bp, Homo sapiens
ctgcccccgcatcccc

SEQ ID NO: 3831840 - DNA, 21 bp, Homo sapiens
ctgcccccgcatcccctgcct

SEQ ID NO: 3831841 - DNA, 14 bp, Homo sapiens
ctgccccgccccca

SEQ ID NO: 3831842 - DNA, 16 bp, Homo sapiens
ctgcccctgccctgag

SEQ ID NO: 3831843 - DNA, 17 bp, Homo sapiens
ctgcccgccctccctcc

SEQ ID NO: 3831844 - DNA, 12 bp, Homo sapiens
ctgccctgagga

SEQ ID NO: 3831845 - DNA, 14 bp, Homo sapiens
ctgccctgaggagg

SEQ ID NO: 3831846 - DNA, 21 bp, Homo sapiens
ctgccctgaggagggccctga

SEQ ID NO: 3831847 - DNA, 22 bp, Homo sapiens
ctgccctgaggagggccctgag

SEQ ID NO: 3831848 - DNA, 17 bp, Homo sapiens
ctgccctgcacgtcatg

SEQ ID NO: 3831849 - DNA, 14 bp, Homo sapiens
ctgccctggctgct

SEQ ID NO: 3831850 - DNA, 19 bp, Homo sapiens
ctgcctatgcccagcctcc

SEQ ID NO: 3831851 - DNA, 14 bp, Homo sapiens
ctgcctccatccta

SEQ ID NO: 3831852 - DNA, 13 bp, Homo sapiens
ctgcctgccccca

SEQ ID NO: 3831853 - DNA, 16 bp, Homo sapiens
ctgcctgcccccacac

SEQ ID NO: 3831854 - DNA, 19 bp, Homo sapiens
ctgcctgccccgcccccag

SEQ ID NO: 3831855 - DNA, 22 bp, Homo sapiens
ctgcctgccccgcccccagtcc

SEQ ID NO: 3831856 - DNA, 18 bp, Homo sapiens
ctgcctgcgcagctcctt

SEQ ID NO: 3831857 - DNA, 19 bp, Homo sapiens
ctgccttaaaaccaaagag

SEQ ID NO: 3831858 - DNA, 22 bp, Homo sapiens
ctgccttaaaaccaaagagggc

SEQ ID NO: 3831859 - DNA, 17 bp, Homo sapiens
ctgccttagagccaggc

SEQ ID NO: 3831860 - DNA, 15 bp, Homo sapiens
ctgccttccctagct

SEQ ID NO: 3831861 - DNA, 16 bp, Homo sapiens
ctgcgcagctccttcc

SEQ ID NO: 3831862 - DNA, 17 bp, Homo sapiens
ctgcgcagggccctctg

SEQ ID NO: 3831863 - DNA, 17 bp, Homo sapiens
ctgcgcttgcttttctg

SEQ ID NO: 3831864 - DNA, 16 bp, Homo sapiens
ctgcggaccccagctg

SEQ ID NO: 3831865 - DNA, 13 bp, Homo sapiens
ctgcgtcctcctc

SEQ ID NO: 3831866 - DNA, 18 bp, Homo sapiens
ctgcgtcctcctcacctc

SEQ ID NO: 3831867 - DNA, 17 bp, Homo sapiens
ctgctagcacctcccca

SEQ ID NO: 3831868 - DNA, 16 bp, Homo sapiens
ctgctcactacctcct

SEQ ID NO: 3831869 - DNA, 20 bp, Homo sapiens
ctgctcactacctcctcagg

SEQ ID NO: 3831870 - DNA, 14 bp, Homo sapiens
ctgctcagccctgg

SEQ ID NO: 3831871 - DNA, 18 bp, Homo sapiens
ctgctcagccctggaggt

SEQ ID NO: 3831872 - DNA, 15 bp, Homo sapiens
ctgctccctgaagcc

SEQ ID NO: 3831873 - DNA, 22 bp, Homo sapiens
ctgctccctgaagccagccttc

SEQ ID NO: 3831874 - DNA, 13 bp, Homo sapiens
ctgctctcagctt

SEQ ID NO: 3831875 - DNA, 16 bp, Homo sapiens
ctgctctcagcttgtg

SEQ ID NO: 3831876 - DNA, 17 bp, Homo sapiens
ctgctctcagcttgtgc

SEQ ID NO: 3831877 - DNA, 19 bp, Homo sapiens
ctgctctcagcttgtgcct

SEQ ID NO: 3831878 - DNA, 14 bp, Homo sapiens
ctgctgccaactcc

SEQ ID NO: 3831879 - DNA, 14 bp, Homo sapiens
ctgctgcccccacc

SEQ ID NO: 3831880 - DNA, 23 bp, Homo sapiens
ctgctgcctgctttttatggcct

SEQ ID NO: 3831881 - DNA, 16 bp, Homo sapiens
ctgctgcgccctgggc

SEQ ID NO: 3831882 - DNA, 22 bp, Homo sapiens
ctgctgctcctccctctgaccc

SEQ ID NO: 3831883 - DNA, 15 bp, Homo sapiens
ctgctgctgccaagt

SEQ ID NO: 3831884 - DNA, 14 bp, Homo sapiens
ctgctgctgctcct

SEQ ID NO: 3831885 - DNA, 16 bp, Homo sapiens
ctgctggcacccaccg

SEQ ID NO: 3831886 - DNA, 19 bp, Homo sapiens
ctgctggtgtttatgtgaa

SEQ ID NO: 3831887 - DNA, 20 bp, Homo sapiens
ctgcttctcccacttggcca

SEQ ID NO: 3831888 - DNA, 21 bp, Homo sapiens
ctgcttctcccacttggccaa

SEQ ID NO: 3831889 - DNA, 17 bp, Homo sapiens
ctgcttgaactgctgcc

SEQ ID NO: 3831890 - DNA, 20 bp, Homo sapiens
ctgctttactgtgtatctca

SEQ ID NO: 3831891 - DNA, 15 bp, Homo sapiens
ctgctttgccccact

SEQ ID NO: 3831892 - DNA, 23 bp, Homo sapiens
ctgctttgtagtttgcccagagt

SEQ ID NO: 3831893 - DNA, 15 bp, Homo sapiens
ctgcttttctgccct

SEQ ID NO: 3831894 - DNA, 24 bp, Homo sapiens
ctgcttttctgccctggctgctgc

SEQ ID NO: 3831895 - DNA, 17 bp, Homo sapiens
ctggaaaggggagagcc

SEQ ID NO: 3831896 - DNA, 19 bp, Homo sapiens
ctggaaaggggagagcctg

SEQ ID NO: 3831897 - DNA, 22 bp, Homo sapiens
ctggaaaggggagagcctgctg

SEQ ID NO: 3831898 - DNA, 19 bp, Homo sapiens
ctggaacgctctaggcaga

SEQ ID NO: 3831899 - DNA, 22 bp, Homo sapiens
ctggaaggctgctttctccttt

SEQ ID NO: 3831900 - DNA, 15 bp, Homo sapiens
ctggacgcagccaca

SEQ ID NO: 3831901 - DNA, 20 bp, Homo sapiens
ctggacggcaggctcactgc

SEQ ID NO: 3831902 - DNA, 21 bp, Homo sapiens
ctggacggcaggctcactgcc

SEQ ID NO: 3831903 - DNA, 18 bp, Homo sapiens
ctggagaagagaggagag

SEQ ID NO: 3831904 - DNA, 14 bp, Homo sapiens
ctggagagaaacaa

SEQ ID NO: 3831905 - DNA, 15 bp, Homo sapiens
ctggagcaagccctg

SEQ ID NO: 3831906 - DNA, 19 bp, Homo sapiens
ctggagcaagccctgaccc

SEQ ID NO: 3831907 - DNA, 11 bp, Homo sapiens
ctggagcctgt

SEQ ID NO: 3831908 - DNA, 15 bp, Homo sapiens
ctggagcctgtgtaa

SEQ ID NO: 3831909 - DNA, 16 bp, Homo sapiens
ctggagcctgtgtaac

SEQ ID NO: 3831910 - DNA, 24 bp, Homo sapiens
ctggagcctgtgtaacagctcctt

SEQ ID NO: 3831911 - DNA, 23 bp, Homo sapiens
ctggaggtgccagcaaagcccca

SEQ ID NO: 3831912 - DNA, 17 bp, Homo sapiens
ctggaggttgaagccaa

SEQ ID NO: 3831913 - DNA, 14 bp, Homo sapiens
ctggagtgccatgg

SEQ ID NO: 3831914 - DNA, 18 bp, Homo sapiens
ctggagtgccatggctgg

SEQ ID NO: 3831915 - DNA, 14 bp, Homo sapiens
ctggagtttcatgt

SEQ ID NO: 3831916 - DNA, 14 bp, Homo sapiens
ctggatccatcctg

SEQ ID NO: 3831917 - DNA, 20 bp, Homo sapiens
ctggatccatcctgctagca

SEQ ID NO: 3831918 - DNA, 12 bp, Homo sapiens
ctggcccaggct

SEQ ID NO: 3831919 - DNA, 21 bp, Homo sapiens
ctggcgccaacaacttctcca

SEQ ID NO: 3831920 - DNA, 14 bp, Homo sapiens
ctggcgtcacctgt

SEQ ID NO: 3831921 - DNA, 14 bp, Homo sapiens
ctggctaggactgt

SEQ ID NO: 3831922 - DNA, 21 bp, Homo sapiens
ctggctaggactgtggagggg

SEQ ID NO: 3831923 - DNA, 20 bp, Homo sapiens
ctggctcctggggatggcca

SEQ ID NO: 3831924 - DNA, 21 bp, Homo sapiens
ctggctcctggggatggccag

SEQ ID NO: 3831925 - DNA, 20 bp, Homo sapiens
ctggctcttgtgctggatgg

SEQ ID NO: 3831926 - DNA, 20 bp, Homo sapiens
ctggctgaggttcctctgcc

SEQ ID NO: 3831927 - DNA, 23 bp, Homo sapiens
ctggctgcaagtggttaagaatg

SEQ ID NO: 3831928 - DNA, 16 bp, Homo sapiens
ctggctgccagctatt

SEQ ID NO: 3831929 - DNA, 13 bp, Homo sapiens
ctggctgctgccc

SEQ ID NO: 3831930 - DNA, 16 bp, Homo sapiens
ctggctgctgccccca

SEQ ID NO: 3831931 - DNA, 13 bp, Homo sapiens
ctggcttcaggag

SEQ ID NO: 3831932 - DNA, 16 bp, Homo sapiens
ctggcttccaaggctc

SEQ ID NO: 3831933 - DNA, 18 bp, Homo sapiens
ctgggacctgccaggcag

SEQ ID NO: 3831934 - DNA, 20 bp, Homo sapiens
ctgggacctgccaggcaggg

SEQ ID NO: 3831935 - DNA, 17 bp, Homo sapiens
ctgggagagtccttagc

SEQ ID NO: 3831936 - DNA, 21 bp, Homo sapiens
ctgggagagtccttagcctgg

SEQ ID NO: 3831937 - DNA, 14 bp, Homo sapiens
ctgggaggagggag

SEQ ID NO: 3831938 - DNA, 15 bp, Homo sapiens
ctgggaggagggaga

SEQ ID NO: 3831939 - DNA, 16 bp, Homo sapiens
ctgggaggagggagag

SEQ ID NO: 3831940 - DNA, 17 bp, Homo sapiens
ctgggaggagggagagg

SEQ ID NO: 3831941 - DNA, 13 bp, Homo sapiens
ctgggaggagtgg

SEQ ID NO: 3831942 - DNA, 19 bp, Homo sapiens
ctgggaggagtggccctga

SEQ ID NO: 3831943 - DNA, 12 bp, Homo sapiens
ctgggaggctcg

SEQ ID NO: 3831944 - DNA, 22 bp, Homo sapiens
ctgggaggctcggggctcccca

SEQ ID NO: 3831945 - DNA, 23 bp, Homo sapiens
ctgggaggctcggggctccccac

SEQ ID NO: 3831946 - DNA, 17 bp, Homo sapiens
ctgggcaccccaggcag

SEQ ID NO: 3831947 - DNA, 23 bp, Homo sapiens
ctgggcaccccaggcagctcctg

SEQ ID NO: 3831948 - DNA, 16 bp, Homo sapiens
ctgggcccttcctggc

SEQ ID NO: 3831949 - DNA, 12 bp, Homo sapiens
ctgggcctcctc

SEQ ID NO: 3831950 - DNA, 17 bp, Homo sapiens
ctgggcgcagctgaagc

SEQ ID NO: 3831951 - DNA, 19 bp, Homo sapiens
ctgggcgcagctgaagcct

SEQ ID NO: 3831952 - DNA, 20 bp, Homo sapiens
ctgggcgcagctgaagcctg

SEQ ID NO: 3831953 - DNA, 16 bp, Homo sapiens
gagaagagaggagagg

SEQ ID NO: 3831954 - DNA, 12 bp, Homo sapiens
gagaagccaagg

SEQ ID NO: 3831955 - DNA, 12 bp, Homo sapiens
gagaaggagaga

SEQ ID NO: 3831956 - DNA, 12 bp, Homo sapiens
gagaagggcagg

SEQ ID NO: 3831957 - DNA, 15 bp, Homo sapiens
gagacacattcacaa

SEQ ID NO: 3831958 - DNA, 23 bp, Homo sapiens
gagacagtgggcactaagggtgg

SEQ ID NO: 3831959 - DNA, 21 bp, Homo sapiens
gagaccacccccgagcttgcc

SEQ ID NO: 3831960 - DNA, 24 bp, Homo sapiens
gagaccacccccgagcttgcctca

SEQ ID NO: 3831961 - DNA, 15 bp, Homo sapiens
gagaccctctgccac

SEQ ID NO: 3831962 - DNA, 16 bp, Homo sapiens
gagaccgtcctcaccc

SEQ ID NO: 3831963 - DNA, 13 bp, Homo sapiens
gagaccttcaggc

SEQ ID NO: 3831964 - DNA, 16 bp, Homo sapiens
gagagaaagccaggca

SEQ ID NO: 3831965 - DNA, 21 bp, Homo sapiens
gagagaaagccaggcaggtag

SEQ ID NO: 3831966 - DNA, 20 bp, Homo sapiens
gagagaaagtgggtgagatg

SEQ ID NO: 3831967 - DNA, 22 bp, Homo sapiens
gagagaaagtgggtgagatgct

SEQ ID NO: 3831968 - DNA, 18 bp, Homo sapiens
gagagagaaagccaggca

SEQ ID NO: 3831969 - DNA, 12 bp, Homo sapiens
gagagagagggc

SEQ ID NO: 3831970 - DNA, 13 bp, Homo sapiens
gagagaggacagc

SEQ ID NO: 3831971 - DNA, 12 bp, Homo sapiens
gagagaggacct

SEQ ID NO: 3831972 - DNA, 19 bp, Homo sapiens
gagagaggacctccatgcc

SEQ ID NO: 3831973 - DNA, 13 bp, Homo sapiens
gagagaggcagag

SEQ ID NO: 3831974 - DNA, 21 bp, Homo sapiens
gagagagggcgcccagcccag

SEQ ID NO: 3831975 - DNA, 15 bp, Homo sapiens
gagagcctgctggca

SEQ ID NO: 3831976 - DNA, 12 bp, Homo sapiens
gagaggaagcct

SEQ ID NO: 3831977 - DNA, 12 bp, Homo sapiens
gagaggagagag

SEQ ID NO: 3831978 - DNA, 23 bp, Homo sapiens
gagaggcaataaataaatgtttt

SEQ ID NO: 3831979 - DNA, 15 bp, Homo sapiens
gagaggcaggcatag

SEQ ID NO: 3831980 - DNA, 21 bp, Homo sapiens
gagagggcgcccagcccaggc

SEQ ID NO: 3831981 - DNA, 14 bp, Homo sapiens
gagagtccttagcc

SEQ ID NO: 3831982 - DNA, 17 bp, Homo sapiens
gagagtccttagcctgg

SEQ ID NO: 3831983 - DNA, 23 bp, Homo sapiens
gagagtccttagcctgggcctcc

SEQ ID NO: 3831984 - DNA, 16 bp, Homo sapiens
gagagttgggggccag

SEQ ID NO: 3831985 - DNA, 19 bp, Homo sapiens
gagagttgggggccagcac

SEQ ID NO: 3831986 - DNA, 20 bp, Homo sapiens
gagagttgggggccagcaca

SEQ ID NO: 3831987 - DNA, 18 bp, Homo sapiens
gagatgctggagaagaga

SEQ ID NO: 3831988 - DNA, 14 bp, Homo sapiens
gagatggctccttg

SEQ ID NO: 3831989 - DNA, 23 bp, Homo sapiens
gagatggctccttgggatgaaga

SEQ ID NO: 3831990 - DNA, 21 bp, Homo sapiens
gagattcacatgctggctcct

SEQ ID NO: 3831991 - DNA, 17 bp, Homo sapiens
gagattgagaaggagag

SEQ ID NO: 3831992 - DNA, 18 bp, Homo sapiens
gagcagagcaagtctgca

SEQ ID NO: 3831993 - DNA, 17 bp, Homo sapiens
gagcaggctttgtgaga

SEQ ID NO: 3831994 - DNA, 15 bp, Homo sapiens
gagcagttcccaagg

SEQ ID NO: 3831995 - DNA, 14 bp, Homo sapiens
gagcatagaaggca

SEQ ID NO: 3831996 - DNA, 16 bp, Homo sapiens
gagcatagaaggcagg

SEQ ID NO: 3831997 - DNA, 18 bp, Homo sapiens
gagccaaacagagcccag

SEQ ID NO: 3831998 - DNA, 17 bp, Homo sapiens
gagccaccactcctgcc

SEQ ID NO: 3831999 - DNA, 18 bp, Homo sapiens
gagccagaggccaggatg

SEQ ID NO: 3832000 - DNA, 12 bp, Homo sapiens
gagcccacacca

SEQ ID NO: 3832001 - DNA, 16 bp, Homo sapiens
gagcccacaccatctg

SEQ ID NO: 3832002 - DNA, 17 bp, Homo sapiens
gagcccacaccatctgg

SEQ ID NO: 3832003 - DNA, 21 bp, Homo sapiens
gagccgcctcggagtgtggcc

SEQ ID NO: 3832004 - DNA, 15 bp, Homo sapiens
gagccgggcccctgg

SEQ ID NO: 3832005 - DNA, 15 bp, Homo sapiens
gagcctgctggcacc

SEQ ID NO: 3832006 - DNA, 18 bp, Homo sapiens
gagcctggccatgtcctc

SEQ ID NO: 3832007 - DNA, 18 bp, Homo sapiens
gagcctgtgtaacagctc

SEQ ID NO: 3832008 - DNA, 14 bp, Homo sapiens
gagcggtctcaggc

SEQ ID NO: 3832009 - DNA, 23 bp, Homo sapiens
gagcggtctcaggctggtgggag

SEQ ID NO: 3832010 - DNA, 23 bp, Homo sapiens
gagcggtggccctgtccctccca

SEQ ID NO: 3832011 - DNA, 20 bp, Homo sapiens
gagctgcctatgcccagcct

SEQ ID NO: 3832012 - DNA, 11 bp, Homo sapiens
gagctgccttc

SEQ ID NO: 3832013 - DNA, 13 bp, Homo sapiens
gagctgccttccc

SEQ ID NO: 3832014 - DNA, 23 bp, Homo sapiens
gagctggcctaggtgggagccac

SEQ ID NO: 3832015 - DNA, 18 bp, Homo sapiens
gagcttgcctcagggcca

SEQ ID NO: 3832016 - DNA, 19 bp, Homo sapiens
gagctttattgctgcattt

SEQ ID NO: 3832017 - DNA, 13 bp, Homo sapiens
gaggaaaagctaa

SEQ ID NO: 3832018 - DNA, 23 bp, Homo sapiens
gaggaaaggtttggaaaactaac

SEQ ID NO: 3832019 - DNA, 17 bp, Homo sapiens
gaggaagaagcttaggc

SEQ ID NO: 3832020 - DNA, 20 bp, Homo sapiens
gaggaagaagcttaggcagg

SEQ ID NO: 3832021 - DNA, 20 bp, Homo sapiens
gaggaagcagaataaagcaa

SEQ ID NO: 3832022 - DNA, 21 bp, Homo sapiens
gaggaaggcaagagggggtgg

SEQ ID NO: 3832023 - DNA, 16 bp, Homo sapiens
gaggaccctcagcccc

SEQ ID NO: 3832024 - DNA, 17 bp, Homo sapiens
gaggaccctcagcccca

SEQ ID NO: 3832025 - DNA, 14 bp, Homo sapiens
gaggagagaggcag

SEQ ID NO: 3832026 - DNA, 16 bp, Homo sapiens
gaggagagaggcagag

SEQ ID NO: 3832027 - DNA, 16 bp, Homo sapiens
gaggagaggagagagg

SEQ ID NO: 3832028 - DNA, 17 bp, Homo sapiens
gaggagggagagggagg

SEQ ID NO: 3832029 - DNA, 18 bp, Homo sapiens
gaggagggccctgaggaa

SEQ ID NO: 3832030 - DNA, 19 bp, Homo sapiens
gaggagggccctgaggaat

SEQ ID NO: 3832031 - DNA, 11 bp, Homo sapiens
gaggcagagag

SEQ ID NO: 3832032 - DNA, 15 bp, Homo sapiens
gaggcagagagcggt

SEQ ID NO: 3832033 - DNA, 15 bp, Homo sapiens
gaggccaggatgcct

SEQ ID NO: 3832034 - DNA, 12 bp, Homo sapiens
gaggctcctggt

SEQ ID NO: 3832035 - DNA, 19 bp, Homo sapiens
gaggctcctggtggggcag

SEQ ID NO: 3832036 - DNA, 20 bp, Homo sapiens
gaggctcctggtggggcaga

SEQ ID NO: 3832037 - DNA, 18 bp, Homo sapiens
gaggctcggggctcccca

SEQ ID NO: 3832038 - DNA, 15 bp, Homo sapiens
gaggctctcatgtct

SEQ ID NO: 3832039 - DNA, 21 bp, Homo sapiens
gaggctctcatgtctctttgg

SEQ ID NO: 3832040 - DNA, 21 bp, Homo sapiens
gaggcttcctgcgtcctcctc

SEQ ID NO: 3832041 - DNA, 22 bp, Homo sapiens
gaggcttctccgccagcctcct

SEQ ID NO: 3832042 - DNA, 13 bp, Homo sapiens
gagggagagagag

SEQ ID NO: 3832043 - DNA, 15 bp, Homo sapiens
gagggagagagagag

SEQ ID NO: 3832044 - DNA, 14 bp, Homo sapiens
gagggatggactga

SEQ ID NO: 3832045 - DNA, 14 bp, Homo sapiens
gagggcaagaggtg

SEQ ID NO: 3832046 - DNA, 22 bp, Homo sapiens
gagggcaagaggtgcctgggag

SEQ ID NO: 3832047 - DNA, 20 bp, Homo sapiens
gagggcaaggggtttccaca

SEQ ID NO: 3832048 - DNA, 12 bp, Homo sapiens
gagggccctgag

SEQ ID NO: 3832049 - DNA, 20 bp, Homo sapiens
gagggccctgaggaataaag

SEQ ID NO: 3832050 - DNA, 15 bp, Homo sapiens
gagggcctgaggtct

SEQ ID NO: 3832051 - DNA, 14 bp, Homo sapiens
gagggcgcccagcc

SEQ ID NO: 3832052 - DNA, 18 bp, Homo sapiens
gagggcgcccagcccagg

SEQ ID NO: 3832053 - DNA, 13 bp, Homo sapiens
gaggggagaagcc

SEQ ID NO: 3832054 - DNA, 15 bp, Homo sapiens
gaggggagaagccaa

SEQ ID NO: 3832055 - DNA, 19 bp, Homo sapiens
gaggggagctgctggccat

SEQ ID NO: 3832056 - DNA, 16 bp, Homo sapiens
gagggggaggggagaa

SEQ ID NO: 3832057 - DNA, 17 bp, Homo sapiens
gagggggcttgaagcca

SEQ ID NO: 3832058 - DNA, 19 bp, Homo sapiens
gaggggggagccagaggcc

SEQ ID NO: 3832059 - DNA, 13 bp, Homo sapiens
gagggggtggagg

SEQ ID NO: 3832060 - DNA, 13 bp, Homo sapiens
gaggtcgctgcag

SEQ ID NO: 3832061 - DNA, 17 bp, Homo sapiens
gaggtctggctgcttgc

SEQ ID NO: 3832062 - DNA, 18 bp, Homo sapiens
gaggtgaaaagggcagag

SEQ ID NO: 3832063 - DNA, 20 bp, Homo sapiens
gaggtgccagcaaagcccca

SEQ ID NO: 3832064 - DNA, 12 bp, Homo sapiens
gaggtgcctggg

SEQ ID NO: 3832065 - DNA, 16 bp, Homo sapiens
gaggtgcctgggagga

SEQ ID NO: 3832066 - DNA, 16 bp, Homo sapiens
gaggtggaagaaggga

SEQ ID NO: 3832067 - DNA, 17 bp, Homo sapiens
gaggtggaagaagggag

SEQ ID NO: 3832068 - DNA, 14 bp, Homo sapiens
gaggtgggagcagg

SEQ ID NO: 3832069 - DNA, 18 bp, Homo sapiens
gaggtgggaggtggaaga

SEQ ID NO: 3832070 - DNA, 19 bp, Homo sapiens
gaggttcctctgcctgccc

SEQ ID NO: 3832071 - DNA, 13 bp, Homo sapiens
gaggttgaagcca

SEQ ID NO: 3832072 - DNA, 13 bp, Homo sapiens
gagtatcataata

SEQ ID NO: 3832073 - DNA, 17 bp, Homo sapiens
gagtccattctcccagg

SEQ ID NO: 3832074 - DNA, 18 bp, Homo sapiens
gagtccattctcccaggt

SEQ ID NO: 3832075 - DNA, 20 bp, Homo sapiens
gagtccattctcccaggtac

SEQ ID NO: 3832076 - DNA, 11 bp, Homo sapiens
gagtcctgggg

SEQ ID NO: 3832077 - DNA, 20 bp, Homo sapiens
gagtcgctctcatgaagccc

SEQ ID NO: 3832078 - DNA, 13 bp, Homo sapiens
gagtgagcctggc

SEQ ID NO: 3832079 - DNA, 13 bp, Homo sapiens
gagtgagggcctg

SEQ ID NO: 3832080 - DNA, 14 bp, Homo sapiens
gagtgccatggctg

SEQ ID NO: 3832081 - DNA, 15 bp, Homo sapiens
gagtgccatggctgg

SEQ ID NO: 3832082 - DNA, 13 bp, Homo sapiens
gagtgggttttgt

SEQ ID NO: 3832083 - DNA, 23 bp, Homo sapiens
gagtgggttttgtccattattaa

SEQ ID NO: 3832084 - DNA, 19 bp, Homo sapiens
gagttagccaaacaacaac

SEQ ID NO: 3832085 - DNA, 18 bp, Homo sapiens
gagttcccaaagggaggg

SEQ ID NO: 3832086 - DNA, 21 bp, Homo sapiens
gagttctgctcattctaatga

SEQ ID NO: 3832087 - DNA, 16 bp, Homo sapiens
gagttgggggccagca

SEQ ID NO: 3832088 - DNA, 15 bp, Homo sapiens
gagttgggggctagg

SEQ ID NO: 3832089 - DNA, 22 bp, Homo sapiens
gagttgggggctaggggagggg

SEQ ID NO: 3832090 - DNA, 23 bp, Homo sapiens
gagtttttcattatttggaaatt

SEQ ID NO: 3832091 - DNA, 17 bp, Homo sapiens
gataaggccgagcccac

SEQ ID NO: 3832092 - DNA, 17 bp, Homo sapiens
gataatgttctgggaag

SEQ ID NO: 3832093 - DNA, 22 bp, Homo sapiens
gatacctttccccaaatagcct

SEQ ID NO: 3832094 - DNA, 21 bp, Homo sapiens
gatactgcagggccaggactg

SEQ ID NO: 3832095 - DNA, 16 bp, Homo sapiens
gatacttgaaaattaa

SEQ ID NO: 3832096 - DNA, 17 bp, Homo sapiens
gatagctgactttcatt

SEQ ID NO: 3832097 - DNA, 14 bp, Homo sapiens
gatagtctggaaag

SEQ ID NO: 3832098 - DNA, 13 bp, Homo sapiens
gatataaatatat

SEQ ID NO: 3832099 - DNA, 16 bp, Homo sapiens
gatataaatatatata

SEQ ID NO: 3832100 - DNA, 22 bp, Homo sapiens
gatataaatatatataaatata

SEQ ID NO: 3832101 - DNA, 14 bp, Homo sapiens
gatcacaactgaag

SEQ ID NO: 3832102 - DNA, 20 bp, Homo sapiens
gatcacttgaggtcaggagt

SEQ ID NO: 3832103 - DNA, 20 bp, Homo sapiens
gatcccaccgacccttcctg

SEQ ID NO: 3832104 - DNA, 15 bp, Homo sapiens
gatccccagggcagc

SEQ ID NO: 3832105 - DNA, 18 bp, Homo sapiens
gatccccagggcagcctc

SEQ ID NO: 3832106 - DNA, 19 bp, Homo sapiens
gatcgagaccgccctggct

SEQ ID NO: 3832107 - DNA, 13 bp, Homo sapiens
gatctgctcagcc

SEQ ID NO: 3832108 - DNA, 15 bp, Homo sapiens
gatctgctcagccct

SEQ ID NO: 3832109 - DNA, 16 bp, Homo sapiens
gatctgctcagccctg

SEQ ID NO: 3832110 - DNA, 11 bp, Homo sapiens
gatctgtcctg

SEQ ID NO: 3832111 - DNA, 14 bp, Homo sapiens
gatctgtcctgggg

SEQ ID NO: 3832112 - DNA, 18 bp, Homo sapiens
gatgaaaagctaccatca

SEQ ID NO: 3832113 - DNA, 14 bp, Homo sapiens
gatgaatccaaatg

SEQ ID NO: 3832114 - DNA, 22 bp, Homo sapiens
gatgatggggtcagcaggccca

SEQ ID NO: 3832115 - DNA, 17 bp, Homo sapiens
gatgattgttcataata

SEQ ID NO: 3832116 - DNA, 18 bp, Homo sapiens
gatgattgttcataatac

SEQ ID NO: 3832117 - DNA, 13 bp, Homo sapiens
gatgcctgagccc

SEQ ID NO: 3832118 - DNA, 16 bp, Homo sapiens
gatgcctgagccccct

SEQ ID NO: 3832119 - DNA, 20 bp, Homo sapiens
gatgcctgagccccctgagt

SEQ ID NO: 3832120 - DNA, 17 bp, Homo sapiens
gatgcttttagctcaaa

SEQ ID NO: 3832121 - DNA, 15 bp, Homo sapiens
gatggaaagaaagca

SEQ ID NO: 3832122 - DNA, 15 bp, Homo sapiens
gatggggtcagcagg

SEQ ID NO: 3832123 - DNA, 17 bp, Homo sapiens
gatggggtcagcaggcc

SEQ ID NO: 3832124 - DNA, 18 bp, Homo sapiens
gatggggtcagcaggccc

SEQ ID NO: 3832125 - DNA, 20 bp, Homo sapiens
gatggggtcagcaggcccag

SEQ ID NO: 3832126 - DNA, 19 bp, Homo sapiens
gatggtggggcccccagca

SEQ ID NO: 3832127 - DNA, 10 bp, Homo sapiens
gatgtgagcc

SEQ ID NO: 3832128 - DNA, 22 bp, Homo sapiens
gattagacagtaagagtttaca

SEQ ID NO: 3832129 - DNA, 17 bp, Homo sapiens
gattcaaatgttacaaa

SEQ ID NO: 3832130 - DNA, 16 bp, Homo sapiens
gattcccttgcactgt

SEQ ID NO: 3832131 - DNA, 22 bp, Homo sapiens
gattcccttgcactgtatcatt

SEQ ID NO: 3832132 - DNA, 16 bp, Homo sapiens
gattcctaaggcccag

SEQ ID NO: 3832133 - DNA, 17 bp, Homo sapiens
gattcctaaggcccagc

SEQ ID NO: 3832134 - DNA, 21 bp, Homo sapiens
gattcctaaggcccagctgcc

SEQ ID NO: 3832135 - DNA, 18 bp, Homo sapiens
gattgagaaggagagaaa

SEQ ID NO: 3832136 - DNA, 19 bp, Homo sapiens
gattgagaaggagagaaag

SEQ ID NO: 3832137 - DNA, 22 bp, Homo sapiens
gatttacagtttcaaaaactgt

SEQ ID NO: 3832138 - DNA, 12 bp, Homo sapiens
gatttagattta

SEQ ID NO: 3832139 - DNA, 23 bp, Homo sapiens
gatttgcaaataaaggctctgga

SEQ ID NO: 3832140 - DNA, 22 bp, Homo sapiens
gatttggtttttgtcttgcatt

SEQ ID NO: 3832141 - DNA, 23 bp, Homo sapiens
gattttaaaccataaaaagctga

SEQ ID NO: 3832142 - DNA, 16 bp, Homo sapiens
gattttatgtgcttga

SEQ ID NO: 3832143 - DNA, 21 bp, Homo sapiens
gattttatgtgcttgaagatt

SEQ ID NO: 3832144 - DNA, 14 bp, Homo sapiens
gattttgtgaaatt

SEQ ID NO: 3832145 - DNA, 15 bp, Homo sapiens
gattttgtgaaattt

SEQ ID NO: 3832146 - DNA, 17 bp, Homo sapiens
gattttgtgaaatttca

SEQ ID NO: 3832147 - DNA, 14 bp, Homo sapiens
gatttttaaaactc

SEQ ID NO: 3832148 - DNA, 21 bp, Homo sapiens
gatttttaaaactcagattta

SEQ ID NO: 3832149 - DNA, 14 bp, Homo sapiens
gcaaaccccaaaga

SEQ ID NO: 3832150 - DNA, 19 bp, Homo sapiens
gcaaacctctccttcctca

SEQ ID NO: 3832151 - DNA, 19 bp, Homo sapiens
gcaaagccccatgctggag

SEQ ID NO: 3832152 - DNA, 21 bp, Homo sapiens
gcaaagccccatgctggagcc

SEQ ID NO: 3832153 - DNA, 15 bp, Homo sapiens
gcaaataaagcctgc

SEQ ID NO: 3832154 - DNA, 16 bp, Homo sapiens
gcaaataaagcctgct

SEQ ID NO: 3832155 - DNA, 20 bp, Homo sapiens
gcaaataaaggctctggaag

SEQ ID NO: 3832156 - DNA, 14 bp, Homo sapiens
gcaaatctgttacc

SEQ ID NO: 3832157 - DNA, 18 bp, Homo sapiens
gcaaattgattcaaatgt

SEQ ID NO: 3832158 - DNA, 20 bp, Homo sapiens
gcaacgctgattcctaaggc

SEQ ID NO: 3832159 - DNA, 20 bp, Homo sapiens
gcaactttcccttgccctgg

SEQ ID NO: 3832160 - DNA, 21 bp, Homo sapiens
gcaagaggtgcctgggaggag

SEQ ID NO: 3832161 - DNA, 22 bp, Homo sapiens
gcaagaggtgcctgggaggagt

SEQ ID NO: 3832162 - DNA, 14 bp, Homo sapiens
gcaagccctgaccc

SEQ ID NO: 3832163 - DNA, 24 bp, Homo sapiens
gcaagcctgcgttcttgtgacaga

SEQ ID NO: 3832164 - DNA, 20 bp, Homo sapiens
gcaagtctgcaggtgcacca

SEQ ID NO: 3832165 - DNA, 14 bp, Homo sapiens
gcaatcagaagaaa

SEQ ID NO: 3832166 - DNA, 22 bp, Homo sapiens
gcaattgtacaaaaaagttata

SEQ ID NO: 3832167 - DNA, 16 bp, Homo sapiens
gcacaaaatgtgacat

SEQ ID NO: 3832168 - DNA, 23 bp, Homo sapiens
gcacaaaattcgacctgatttac

SEQ ID NO: 3832169 - DNA, 19 bp, Homo sapiens
gcacacactgtgctttcta

SEQ ID NO: 3832170 - DNA, 19 bp, Homo sapiens
gcaccccaggcagctcctg

SEQ ID NO: 3832171 - DNA, 12 bp, Homo sapiens
gcaccccttctc

SEQ ID NO: 3832172 - DNA, 13 bp, Homo sapiens
gcaccccttctct

SEQ ID NO: 3832173 - DNA, 17 bp, Homo sapiens
gcaccccttctctcctc

SEQ ID NO: 3832174 - DNA, 15 bp, Homo sapiens
gcacctccccagaca

SEQ ID NO: 3832175 - DNA, 16 bp, Homo sapiens
gcacctccccagacag

SEQ ID NO: 3832176 - DNA, 19 bp, Homo sapiens
gcacctccccagacagggc

SEQ ID NO: 3832177 - DNA, 13 bp, Homo sapiens
gcacctctgtgct

SEQ ID NO: 3832178 - DNA, 14 bp, Homo sapiens
gcacctctgtgctg

SEQ ID NO: 3832179 - DNA, 18 bp, Homo sapiens
gcacctgttgtgtgcctg

SEQ ID NO: 3832180 - DNA, 16 bp, Homo sapiens
gcactagcctccctct

SEQ ID NO: 3832181 - DNA, 17 bp, Homo sapiens
gcactagcctccctctc

SEQ ID NO: 3832182 - DNA, 16 bp, Homo sapiens
gcactagcctttggct

SEQ ID NO: 3832183 - DNA, 18 bp, Homo sapiens
gcactagcctttggctct

SEQ ID NO: 3832184 - DNA, 20 bp, Homo sapiens
gcactgtatcatttcatgct

SEQ ID NO: 3832185 - DNA, 21 bp, Homo sapiens
gcactgtatcatttcatgctt

SEQ ID NO: 3832186 - DNA, 14 bp, Homo sapiens
gcagaaaggctgca

SEQ ID NO: 3832187 - DNA, 18 bp, Homo sapiens
gcagaagaagctgggagg

SEQ ID NO: 3832188 - DNA, 13 bp, Homo sapiens
gcagaataaagca

SEQ ID NO: 3832189 - DNA, 15 bp, Homo sapiens
gcagacctccccagc

SEQ ID NO: 3832190 - DNA, 22 bp, Homo sapiens
gcagacctccccagcccctagc

SEQ ID NO: 3832191 - DNA, 17 bp, Homo sapiens
gcagaggcaaggatggt

SEQ ID NO: 3832192 - DNA, 16 bp, Homo sapiens
gcagataaggccgagc

SEQ ID NO: 3832193 - DNA, 19 bp, Homo sapiens
gcagccacacagtggccgg

SEQ ID NO: 3832194 - DNA, 19 bp, Homo sapiens
gcagccagccctggcttcc

SEQ ID NO: 3832195 - DNA, 15 bp, Homo sapiens
gcagcctccagtctg

SEQ ID NO: 3832196 - DNA, 18 bp, Homo sapiens
gcagcctccagtctgctc

SEQ ID NO: 3832197 - DNA, 23 bp, Homo sapiens
gcagcctccagtctgctctcagc

SEQ ID NO: 3832198 - DNA, 18 bp, Homo sapiens
gcagctcctgtttggaaa

SEQ ID NO: 3832199 - DNA, 13 bp, Homo sapiens
gcagctgaagcct

SEQ ID NO: 3832200 - DNA, 22 bp, Homo sapiens
gcagctgaagcctggacgcagc

SEQ ID NO: 3832201 - DNA, 20 bp, Homo sapiens
gcaggagtttcgttttcaaa

SEQ ID NO: 3832202 - DNA, 19 bp, Homo sapiens
gcaggattgattatgcaga

SEQ ID NO: 3832203 - DNA, 13 bp, Homo sapiens
gcaggcccaggag

SEQ ID NO: 3832204 - DNA, 14 bp, Homo sapiens
gcaggcccaggaga

SEQ ID NO: 3832205 - DNA, 15 bp, Homo sapiens
gcaggctcactgcca

SEQ ID NO: 3832206 - DNA, 17 bp, Homo sapiens
gcaggctcactgccagg

SEQ ID NO: 3832207 - DNA, 19 bp, Homo sapiens
gcaggctcactgccaggcc

SEQ ID NO: 3832208 - DNA, 21 bp, Homo sapiens
gcaggctcactgccaggccag

SEQ ID NO: 3832209 - DNA, 19 bp, Homo sapiens
gcaggctttgtgagagagg

SEQ ID NO: 3832210 - DNA, 14 bp, Homo sapiens
gcagggccaggact

SEQ ID NO: 3832211 - DNA, 15 bp, Homo sapiens
gcagggccaggactg

SEQ ID NO: 3832212 - DNA, 19 bp, Homo sapiens
gcagggccaggactgagcc

SEQ ID NO: 3832213 - DNA, 24 bp, Homo sapiens
gcagggccctctggggctcagccc

SEQ ID NO: 3832214 - DNA, 23 bp, Homo sapiens
gcagggctctctttccttcttgc

SEQ ID NO: 3832215 - DNA, 13 bp, Homo sapiens
gcaggggctctgg

SEQ ID NO: 3832216 - DNA, 14 bp, Homo sapiens
gcaggggctctgga

SEQ ID NO: 3832217 - DNA, 17 bp, Homo sapiens
gcaggggctctggagag

SEQ ID NO: 3832218 - DNA, 17 bp, Homo sapiens
gcttaacagttgctttg

SEQ ID NO: 3832219 - DNA, 19 bp, Homo sapiens
gcttaggtctagcctcatt

SEQ ID NO: 3832220 - DNA, 15 bp, Homo sapiens
gcttattaatgctaa

SEQ ID NO: 3832221 - DNA, 16 bp, Homo sapiens
gcttattaatgctaag

SEQ ID NO: 3832222 - DNA, 18 bp, Homo sapiens
gcttatttattgaaaata

SEQ ID NO: 3832223 - DNA, 14 bp, Homo sapiens
gcttcaccacttgt

SEQ ID NO: 3832224 - DNA, 16 bp, Homo sapiens
gcttcactcagctgga

SEQ ID NO: 3832225 - DNA, 23 bp, Homo sapiens
gcttcagtggaaatcaatcagaa

SEQ ID NO: 3832226 - DNA, 21 bp, Homo sapiens
gcttccaggaaactccacatc

SEQ ID NO: 3832227 - DNA, 15 bp, Homo sapiens
gcttcctctagaagc

SEQ ID NO: 3832228 - DNA, 22 bp, Homo sapiens
gcttcctctagaagccaaggga

SEQ ID NO: 3832229 - DNA, 20 bp, Homo sapiens
gcttcctgcgtcctcctcac

SEQ ID NO: 3832230 - DNA, 22 bp, Homo sapiens
gcttctaatatttattgcttta

SEQ ID NO: 3832231 - DNA, 18 bp, Homo sapiens
gcttctcccacttggcca

SEQ ID NO: 3832232 - DNA, 18 bp, Homo sapiens
gcttctccgccagcctcc

SEQ ID NO: 3832233 - DNA, 12 bp, Homo sapiens
gcttctctctga

SEQ ID NO: 3832234 - DNA, 15 bp, Homo sapiens
gcttctctctgagct

SEQ ID NO: 3832235 - DNA, 21 bp, Homo sapiens
gcttctgcttttctgccctgg

SEQ ID NO: 3832236 - DNA, 11 bp, Homo sapiens
gcttgaagcca

SEQ ID NO: 3832237 - DNA, 17 bp, Homo sapiens
gcttgagccgggcccct

SEQ ID NO: 3832238 - DNA, 14 bp, Homo sapiens
gcttgagttttcat

SEQ ID NO: 3832239 - DNA, 13 bp, Homo sapiens
gcttgcagggaca

SEQ ID NO: 3832240 - DNA, 16 bp, Homo sapiens
gcttgcctcagggcca

SEQ ID NO: 3832241 - DNA, 16 bp, Homo sapiens
gcttggcctgctgtga

SEQ ID NO: 3832242 - DNA, 13 bp, Homo sapiens
gcttggctgctca

SEQ ID NO: 3832243 - DNA, 15 bp, Homo sapiens
gctttaaaaactatt

SEQ ID NO: 3832244 - DNA, 23 bp, Homo sapiens
gctttaaaaactatttaacttga

SEQ ID NO: 3832245 - DNA, 21 bp, Homo sapiens
gctttactctttcatgccatt

SEQ ID NO: 3832246 - DNA, 14 bp, Homo sapiens
gctttactgtgtat

SEQ ID NO: 3832247 - DNA, 14 bp, Homo sapiens
gctttagaccctgg

SEQ ID NO: 3832248 - DNA, 15 bp, Homo sapiens
gctttagaccctggg

SEQ ID NO: 3832249 - DNA, 23 bp, Homo sapiens
gctttataaaaaaaagttgttta

SEQ ID NO: 3832250 - DNA, 13 bp, Homo sapiens
gctttctcctttc

SEQ ID NO: 3832251 - DNA, 19 bp, Homo sapiens
gctttgccccactgggaga

SEQ ID NO: 3832252 - DNA, 23 bp, Homo sapiens
gctttgccccactgggagagtcc

SEQ ID NO: 3832253 - DNA, 16 bp, Homo sapiens
gctttgggcttttatt

SEQ ID NO: 3832254 - DNA, 18 bp, Homo sapiens
gctttgtagtttgcccag

SEQ ID NO: 3832255 - DNA, 17 bp, Homo sapiens
gctttgtgcagggtcct

SEQ ID NO: 3832256 - DNA, 14 bp, Homo sapiens
gctttgtgctgctg

SEQ ID NO: 3832257 - DNA, 13 bp, Homo sapiens
gcttttagacaga

SEQ ID NO: 3832258 - DNA, 19 bp, Homo sapiens
gcttttatagaggctagct

SEQ ID NO: 3832259 - DNA, 22 bp, Homo sapiens
gcttttatagaggctagcttct

SEQ ID NO: 3832260 - DNA, 21 bp, Homo sapiens
gcttttccctttttttaagta

SEQ ID NO: 3832261 - DNA, 15 bp, Homo sapiens
gcttttctgccctgg

SEQ ID NO: 3832262 - DNA, 16 bp, Homo sapiens
gcttttctgccctggc

SEQ ID NO: 3832263 - DNA, 13 bp, Homo sapiens
gcttttggtgcct

SEQ ID NO: 3832264 - DNA, 15 bp, Homo sapiens
gcttttggtgcctgg

SEQ ID NO: 3832265 - DNA, 19 bp, Homo sapiens
gctttttctttttttgcat

SEQ ID NO: 3832266 - DNA, 16 bp, Homo sapiens
gcttttttagatttat

SEQ ID NO: 3832267 - DNA, 13 bp, Homo sapiens
ggaaaatgtgagg

SEQ ID NO: 3832268 - DNA, 18 bp, Homo sapiens
ggaaactccacatctgcc

SEQ ID NO: 3832269 - DNA, 21 bp, Homo sapiens
ggaaactccacatctgcctta

SEQ ID NO: 3832270 - DNA, 22 bp, Homo sapiens
ggaaagaaagcacctgttttta

SEQ ID NO: 3832271 - DNA, 12 bp, Homo sapiens
ggaaaggggaga

SEQ ID NO: 3832272 - DNA, 18 bp, Homo sapiens
ggaaaggggagagcctgc

SEQ ID NO: 3832273 - DNA, 21 bp, Homo sapiens
ggaaaggtttggaaaactaac

SEQ ID NO: 3832274 - DNA, 13 bp, Homo sapiens
ggaaatttataca

SEQ ID NO: 3832275 - DNA, 18 bp, Homo sapiens
ggaaatttatacaaagaa

SEQ ID NO: 3832276 - DNA, 19 bp, Homo sapiens
ggaacatgtgaatgaatac

SEQ ID NO: 3832277 - DNA, 18 bp, Homo sapiens
ggaacctcactcttgcca

SEQ ID NO: 3832278 - DNA, 18 bp, Homo sapiens
ggaacgctctaggcagaa

SEQ ID NO: 3832279 - DNA, 22 bp, Homo sapiens
ggaactctgtgtgagagagagg

SEQ ID NO: 3832280 - DNA, 18 bp, Homo sapiens
ggaagaagcttaggcagg

SEQ ID NO: 3832281 - DNA, 19 bp, Homo sapiens
ggaagaagcttaggcaggg

SEQ ID NO: 3832282 - DNA, 16 bp, Homo sapiens
ggaagacagagcaggc

SEQ ID NO: 3832283 - DNA, 12 bp, Homo sapiens
ggaagcagaata

SEQ ID NO: 3832284 - DNA, 17 bp, Homo sapiens
ggaagcagaataaagca

SEQ ID NO: 3832285 - DNA, 18 bp, Homo sapiens
ggaagcagaataaagcaa

SEQ ID NO: 3832286 - DNA, 19 bp, Homo sapiens
ggaagcagaataaagcaat

SEQ ID NO: 3832287 - DNA, 20 bp, Homo sapiens
ggaagcagaataaagcaatt

SEQ ID NO: 3832288 - DNA, 21 bp, Homo sapiens
ggaagcagaataaagcaattt

SEQ ID NO: 3832289 - DNA, 23 bp, Homo sapiens
ggaagccttcttagaactctgct

SEQ ID NO: 3832290 - DNA, 17 bp, Homo sapiens
ggaaggccatggggcag

SEQ ID NO: 3832291 - DNA, 20 bp, Homo sapiens
ggaaggccatggggcagcct

SEQ ID NO: 3832292 - DNA, 23 bp, Homo sapiens
ggaaggccatggggcagcctcca

SEQ ID NO: 3832293 - DNA, 21 bp, Homo sapiens
ggaagtcgcttttggtgcctg

SEQ ID NO: 3832294 - DNA, 20 bp, Homo sapiens
ggaataaagcttctctctga

SEQ ID NO: 3832295 - DNA, 21 bp, Homo sapiens
ggaataaagcttctctctgag

SEQ ID NO: 3832296 - DNA, 23 bp, Homo sapiens
ggaataaagcttctctctgagct

SEQ ID NO: 3832297 - DNA, 13 bp, Homo sapiens
ggaatcaagttct

SEQ ID NO: 3832298 - DNA, 17 bp, Homo sapiens
ggacaaggctgtgccag

SEQ ID NO: 3832299 - DNA, 17 bp, Homo sapiens
ggacacaggagaccacc

SEQ ID NO: 3832300 - DNA, 19 bp, Homo sapiens
ggacacaggagaccacccc

SEQ ID NO: 3832301 - DNA, 19 bp, Homo sapiens
ggacaccacacccagcctc

SEQ ID NO: 3832302 - DNA, 23 bp, Homo sapiens
ggaccaatgccttaattaaagaa

SEQ ID NO: 3832303 - DNA, 11 bp, Homo sapiens
ggaccccagct

SEQ ID NO: 3832304 - DNA, 12 bp, Homo sapiens
ggaccctcagcc

SEQ ID NO: 3832305 - DNA, 13 bp, Homo sapiens
ggaccctcagccc

SEQ ID NO: 3832306 - DNA, 19 bp, Homo sapiens
ggaccctcagccccaggag

SEQ ID NO: 3832307 - DNA, 12 bp, Homo sapiens
ggacctgagcct

SEQ ID NO: 3832308 - DNA, 19 bp, Homo sapiens
ggacctgagcctggccatg

SEQ ID NO: 3832309 - DNA, 16 bp, Homo sapiens
ggacctgccaggcagg

SEQ ID NO: 3832310 - DNA, 17 bp, Homo sapiens
ggacctgccaggcaggg

SEQ ID NO: 3832311 - DNA, 22 bp, Homo sapiens
ggacctgcccccgcatcccctg

SEQ ID NO: 3832312 - DNA, 15 bp, Homo sapiens
ggacctgcctccccg

SEQ ID NO: 3832313 - DNA, 15 bp, Homo sapiens
ggacgcagccacaca

SEQ ID NO: 3832314 - DNA, 14 bp, Homo sapiens
ggactgagaaattt

SEQ ID NO: 3832315 - DNA, 12 bp, Homo sapiens
ggactgagcccc

SEQ ID NO: 3832316 - DNA, 15 bp, Homo sapiens
ggactgagccccgca

SEQ ID NO: 3832317 - DNA, 22 bp, Homo sapiens
ggactgtggaggggagctgctg

SEQ ID NO: 3832318 - DNA, 17 bp, Homo sapiens
ggacttagaaagcaggg

SEQ ID NO: 3832319 - DNA, 18 bp, Homo sapiens
ggacttagaaagcagggg

SEQ ID NO: 3832320 - DNA, 13 bp, Homo sapiens
ggagaagagagga

SEQ ID NO: 3832321 - DNA, 22 bp, Homo sapiens
ggagaagagaggagaggagaga

SEQ ID NO: 3832322 - DNA, 18 bp, Homo sapiens
ggagaattaggaaggcca

SEQ ID NO: 3832323 - DNA, 17 bp, Homo sapiens
ggagacagccccagagc

SEQ ID NO: 3832324 - DNA, 21 bp, Homo sapiens
ggagacagccccagagcaggg

SEQ ID NO: 3832325 - DNA, 22 bp, Homo sapiens
ggagacagccccagagcagggt

SEQ ID NO: 3832326 - DNA, 11 bp, Homo sapiens
ggagaccaccc

SEQ ID NO: 3832327 - DNA, 13 bp, Homo sapiens
ggagaccaccccc

SEQ ID NO: 3832328 - DNA, 23 bp, Homo sapiens
ggagaccacccccgagcttgcct

SEQ ID NO: 3832329 - DNA, 18 bp, Homo sapiens
ggagagaaacaataaaga

SEQ ID NO: 3832330 - DNA, 16 bp, Homo sapiens
ggagagaaagtgggtg

SEQ ID NO: 3832331 - DNA, 12 bp, Homo sapiens
ggagagagaaag

SEQ ID NO: 3832332 - DNA, 18 bp, Homo sapiens
ggagagagaaagccaggc

SEQ ID NO: 3832333 - DNA, 19 bp, Homo sapiens
ggagagagagagagagagg

SEQ ID NO: 3832334 - DNA, 13 bp, Homo sapiens
ggagagaggcaga

SEQ ID NO: 3832335 - DNA, 18 bp, Homo sapiens
ggagagaggcagagagcg

SEQ ID NO: 3832336 - DNA, 11 bp, Homo sapiens
ggagagcctgc

SEQ ID NO: 3832337 - DNA, 13 bp, Homo sapiens
ggagagcctgctg

SEQ ID NO: 3832338 - DNA, 13 bp, Homo sapiens
ggagagggaggtc

SEQ ID NO: 3832339 - DNA, 18 bp, Homo sapiens
ggagagtccttagcctgg

SEQ ID NO: 3832340 - DNA, 22 bp, Homo sapiens
ggagagtccttagcctgggcct

SEQ ID NO: 3832341 - DNA, 16 bp, Homo sapiens
ggagcaatctggaaaa

SEQ ID NO: 3832342 - DNA, 15 bp, Homo sapiens
ggagcagaataaatg

SEQ ID NO: 3832343 - DNA, 16 bp, Homo sapiens
ggagcaggagattgag

SEQ ID NO: 3832344 - DNA, 21 bp, Homo sapiens
ggagcaggagattgagaagga

SEQ ID NO: 3832345 - DNA, 21 bp, Homo sapiens
ggagccaccactcctgcctgc

SEQ ID NO: 3832346 - DNA, 13 bp, Homo sapiens
ggagccagaggcc

SEQ ID NO: 3832347 - DNA, 15 bp, Homo sapiens
ggagccagaggccag

SEQ ID NO: 3832348 - DNA, 19 bp, Homo sapiens
ggagccagaggccaggatg

SEQ ID NO: 3832349 - DNA, 12 bp, Homo sapiens
ggagcctggagg

SEQ ID NO: 3832350 - DNA, 17 bp, Homo sapiens
ggagcctgtgtaacagc

SEQ ID NO: 3832351 - DNA, 12 bp, Homo sapiens
gtgtggcctgga

SEQ ID NO: 3832352 - DNA, 13 bp, Homo sapiens
gtgtggcctggat

SEQ ID NO: 3832353 - DNA, 21 bp, Homo sapiens
gtgtgtgggtggatataaata

SEQ ID NO: 3832354 - DNA, 12 bp, Homo sapiens
gtgtgttttaaa

SEQ ID NO: 3832355 - DNA, 13 bp, Homo sapiens
gtgtgttttaaaa

SEQ ID NO: 3832356 - DNA, 14 bp, Homo sapiens
gtgtgtttttcata

SEQ ID NO: 3832357 - DNA, 19 bp, Homo sapiens
gtgttcctgataattgtgc

SEQ ID NO: 3832358 - DNA, 22 bp, Homo sapiens
gtgtttatgtgaacattcctat

SEQ ID NO: 3832359 - DNA, 22 bp, Homo sapiens
gttaacaatggcaggttttaca

SEQ ID NO: 3832360 - DNA, 15 bp, Homo sapiens
gttaagtaattgcat

SEQ ID NO: 3832361 - DNA, 21 bp, Homo sapiens
gttacacaaaggacctcagct

SEQ ID NO: 3832362 - DNA, 14 bp, Homo sapiens
gttagccactgctg

SEQ ID NO: 3832363 - DNA, 22 bp, Homo sapiens
gttagccactgctggtgtttat

SEQ ID NO: 3832364 - DNA, 22 bp, Homo sapiens
gttataagaaaactacatgtaa

SEQ ID NO: 3832365 - DNA, 12 bp, Homo sapiens
gttattttctac

SEQ ID NO: 3832366 - DNA, 20 bp, Homo sapiens
gttcaagtgattctcctgcc

SEQ ID NO: 3832367 - DNA, 17 bp, Homo sapiens
gttcatagaccctctca

SEQ ID NO: 3832368 - DNA, 15 bp, Homo sapiens
gttccaataaacagg

SEQ ID NO: 3832369 - DNA, 19 bp, Homo sapiens
gttccccaccccgggctct

SEQ ID NO: 3832370 - DNA, 19 bp, Homo sapiens
gttcccgggccctcctggg

SEQ ID NO: 3832371 - DNA, 12 bp, Homo sapiens
gttcctctgcct

SEQ ID NO: 3832372 - DNA, 16 bp, Homo sapiens
gttcctctgcctgccc

SEQ ID NO: 3832373 - DNA, 22 bp, Homo sapiens
gttctacaaatttttacttgaa

SEQ ID NO: 3832374 - DNA, 17 bp, Homo sapiens
gttctctcgaatacttt

SEQ ID NO: 3832375 - DNA, 22 bp, Homo sapiens
gttcttacttgagtatcataat

SEQ ID NO: 3832376 - DNA, 15 bp, Homo sapiens
gttgcaaaggaaata

SEQ ID NO: 3832377 - DNA, 17 bp, Homo sapiens
gttgcagtgagctgaga

SEQ ID NO: 3832378 - DNA, 20 bp, Homo sapiens
gttgcagtgagctgagatca

SEQ ID NO: 3832379 - DNA, 13 bp, Homo sapiens
gttggccaggctg

SEQ ID NO: 3832380 - DNA, 14 bp, Homo sapiens
gttggctcagaaaa

SEQ ID NO: 3832381 - DNA, 18 bp, Homo sapiens
gttgggggctaggggagg

SEQ ID NO: 3832382 - DNA, 17 bp, Homo sapiens
gtttaaaaatttataac

SEQ ID NO: 3832383 - DNA, 23 bp, Homo sapiens
gtttaactaatatttgtctgtgt

SEQ ID NO: 3832384 - DNA, 19 bp, Homo sapiens
gtttaatctataacaaatg

SEQ ID NO: 3832385 - DNA, 16 bp, Homo sapiens
gtttataaaaacccct

SEQ ID NO: 3832386 - DNA, 15 bp, Homo sapiens
gtttatgcatttcaa

SEQ ID NO: 3832387 - DNA, 20 bp, Homo sapiens
gtttatgtgaacattcctat

SEQ ID NO: 3832388 - DNA, 23 bp, Homo sapiens
gtttcagtgtcaaataaacactg

SEQ ID NO: 3832389 - DNA, 21 bp, Homo sapiens
gtttcatgttatgcctgttgc

SEQ ID NO: 3832390 - DNA, 22 bp, Homo sapiens
gtttccatcctttgcatttctc

SEQ ID NO: 3832391 - DNA, 17 bp, Homo sapiens
gtttccttccctaccca

SEQ ID NO: 3832392 - DNA, 22 bp, Homo sapiens
gtttctaagtctgttattgttt

SEQ ID NO: 3832393 - DNA, 17 bp, Homo sapiens
gtttctcattttaaaca

SEQ ID NO: 3832394 - DNA, 12 bp, Homo sapiens
gtttgaagctgc

SEQ ID NO: 3832395 - DNA, 13 bp, Homo sapiens
gtttgaagctgct

SEQ ID NO: 3832396 - DNA, 14 bp, Homo sapiens
gtttgagctgcctt

SEQ ID NO: 3832397 - DNA, 22 bp, Homo sapiens
gtttgccaagccctttgctgtt

SEQ ID NO: 3832398 - DNA, 13 bp, Homo sapiens
gtttgcccagagc

SEQ ID NO: 3832399 - DNA, 15 bp, Homo sapiens
gtttgcccagagttg

SEQ ID NO: 3832400 - DNA, 13 bp, Homo sapiens
gttttaaagctaa

SEQ ID NO: 3832401 - DNA, 21 bp, Homo sapiens
gttttaacaccaacactgtaa

SEQ ID NO: 3832402 - DNA, 16 bp, Homo sapiens
gttttactgcattttc

SEQ ID NO: 3832403 - DNA, 20 bp, Homo sapiens
gttttattttctaaattctt

SEQ ID NO: 3832404 - DNA, 22 bp, Homo sapiens
gttttcaatgaattaagaaaga

SEQ ID NO: 3832405 - DNA, 20 bp, Homo sapiens
gttttggcaaacgctaaaga

SEQ ID NO: 3832406 - DNA, 16 bp, Homo sapiens
gttttgtccattatta

SEQ ID NO: 3832407 - DNA, 23 bp, Homo sapiens
gtttttaaatgccacaagacata

SEQ ID NO: 3832408 - DNA, 13 bp, Homo sapiens
gtttttgaaagac

SEQ ID NO: 3832409 - DNA, 22 bp, Homo sapiens
gtttttgaaagacaaaatttag

SEQ ID NO: 3832410 - DNA, 13 bp, Homo sapiens
taaaaaaaagttg

SEQ ID NO: 3832411 - DNA, 17 bp, Homo sapiens
taaaaacaaagaaatta

SEQ ID NO: 3832412 - DNA, 20 bp, Homo sapiens
taaaaacccctaaaaacaaa

SEQ ID NO: 3832413 - DNA, 22 bp, Homo sapiens
taaaaagcagtttttgaaagac

SEQ ID NO: 3832414 - DNA, 20 bp, Homo sapiens
taaaaagccaccacacactg

SEQ ID NO: 3832415 - DNA, 11 bp, Homo sapiens
taaaaagctga

SEQ ID NO: 3832416 - DNA, 16 bp, Homo sapiens
taaaaatttataacag

SEQ ID NO: 3832417 - DNA, 19 bp, Homo sapiens
taaaacaatgaagtgtttt

SEQ ID NO: 3832418 - DNA, 12 bp, Homo sapiens
taaaacattgtc

SEQ ID NO: 3832419 - DNA, 17 bp, Homo sapiens
taaaactcagatttaaa

SEQ ID NO: 3832420 - DNA, 21 bp, Homo sapiens
taaaagggactgagaaattta

SEQ ID NO: 3832421 - DNA, 14 bp, Homo sapiens
taaaatatcattca

SEQ ID NO: 3832422 - DNA, 19 bp, Homo sapiens
taaaatcttgatagctaaa

SEQ ID NO: 3832423 - DNA, 22 bp, Homo sapiens
taaaatcttgatagctaaataa

SEQ ID NO: 3832424 - DNA, 13 bp, Homo sapiens
taaaatgagaaat

SEQ ID NO: 3832425 - DNA, 15 bp, Homo sapiens
taaaatgagaaatct

SEQ ID NO: 3832426 - DNA, 18 bp, Homo sapiens
taaaatgatatattaaac

SEQ ID NO: 3832427 - DNA, 17 bp, Homo sapiens
taaaatgtttaggaaat

SEQ ID NO: 3832428 - DNA, 19 bp, Homo sapiens
taaaatgtttaggaaattt

SEQ ID NO: 3832429 - DNA, 17 bp, Homo sapiens
taaaatttttaatcttt

SEQ ID NO: 3832430 - DNA, 17 bp, Homo sapiens
taaaccataaaaagctg

SEQ ID NO: 3832431 - DNA, 19 bp, Homo sapiens
taaactaaagtgtgcttta

SEQ ID NO: 3832432 - DNA, 23 bp, Homo sapiens
taaactaaagtgtgctttataaa

SEQ ID NO: 3832433 - DNA, 17 bp, Homo sapiens
taaacttcagttttact

SEQ ID NO: 3832434 - DNA, 21 bp, Homo sapiens
taaagacctgctgtaataaat

SEQ ID NO: 3832435 - DNA, 17 bp, Homo sapiens
taaagagcccttgcctc

SEQ ID NO: 3832436 - DNA, 16 bp, Homo sapiens
taaagcaattttcctt

SEQ ID NO: 3832437 - DNA, 11 bp, Homo sapiens
taaagcctgct

SEQ ID NO: 3832438 - DNA, 15 bp, Homo sapiens
taaagcttctctctg

SEQ ID NO: 3832439 - DNA, 22 bp, Homo sapiens
taaaggactatttataactaat

SEQ ID NO: 3832440 - DNA, 16 bp, Homo sapiens
taaaggctctggaagc

SEQ ID NO: 3832441 - DNA, 22 bp, Homo sapiens
taaaggttcatgcaaactttat

SEQ ID NO: 3832442 - DNA, 19 bp, Homo sapiens
taaagtaaaaacaaagaaa

SEQ ID NO: 3832443 - DNA, 22 bp, Homo sapiens
taaagtaaaaacaaagaaatta

SEQ ID NO: 3832444 - DNA, 12 bp, Homo sapiens
taaagtatattg

SEQ ID NO: 3832445 - DNA, 18 bp, Homo sapiens
taaagtgtgctttataaa

SEQ ID NO: 3832446 - DNA, 19 bp, Homo sapiens
taaagttctctgtaattac

SEQ ID NO: 3832447 - DNA, 13 bp, Homo sapiens
taaataaactttg

SEQ ID NO: 3832448 - DNA, 12 bp, Homo sapiens
taaataaatata

SEQ ID NO: 3832449 - DNA, 15 bp, Homo sapiens
taaataaatatatat

SEQ ID NO: 3832450 - DNA, 11 bp, Homo sapiens
taaataaatgt

SEQ ID NO: 3832451 - DNA, 12 bp, Homo sapiens
taaataaatgtt

SEQ ID NO: 3832452 - DNA, 21 bp, Homo sapiens
taaataacttgccatttcttt

SEQ ID NO: 3832453 - DNA, 21 bp, Homo sapiens
taaataattttgttttaatct

SEQ ID NO: 3832454 - DNA, 22 bp, Homo sapiens
taaataattttgttttaatctt

SEQ ID NO: 3832455 - DNA, 12 bp, Homo sapiens
taaatactatag

SEQ ID NO: 3832456 - DNA, 20 bp, Homo sapiens
taaatagagtgcataaataa

SEQ ID NO: 3832457 - DNA, 17 bp, Homo sapiens
taaatatataaacaaac

SEQ ID NO: 3832458 - DNA, 14 bp, Homo sapiens
taaatatatataaa

SEQ ID NO: 3832459 - DNA, 19 bp, Homo sapiens
taaatatatataaatatat

SEQ ID NO: 3832460 - DNA, 18 bp, Homo sapiens
taaatatatctttgtaaa

SEQ ID NO: 3832461 - DNA, 16 bp, Homo sapiens
taaatatattttaaga

SEQ ID NO: 3832462 - DNA, 12 bp, Homo sapiens
taaatatttcat

SEQ ID NO: 3832463 - DNA, 19 bp, Homo sapiens
taaatatttcataaattaa

SEQ ID NO: 3832464 - DNA, 15 bp, Homo sapiens
taaatcattcattca

SEQ ID NO: 3832465 - DNA, 22 bp, Homo sapiens
taaatgcacagttctatttgct

SEQ ID NO: 3832466 - DNA, 15 bp, Homo sapiens
taaatgctgtaaata

SEQ ID NO: 3832467 - DNA, 20 bp, Homo sapiens
taaatgctgtaaatatttca

SEQ ID NO: 3832468 - DNA, 22 bp, Homo sapiens
taaatgctgtaaatatttcata

SEQ ID NO: 3832469 - DNA, 14 bp, Homo sapiens
taaatgttttacaa

SEQ ID NO: 3832470 - DNA, 15 bp, Homo sapiens
taaatgttttacaac

SEQ ID NO: 3832471 - DNA, 13 bp, Homo sapiens
taaattattttat

SEQ ID NO: 3832472 - DNA, 19 bp, Homo sapiens
taaattattttatgtcata

SEQ ID NO: 3832473 - DNA, 14 bp, Homo sapiens
taaattctttcatg

SEQ ID NO: 3832474 - DNA, 16 bp, Homo sapiens
taaattctttcatgag

SEQ ID NO: 3832475 - DNA, 14 bp, Homo sapiens
taaatttgccagtt

SEQ ID NO: 3832476 - DNA, 20 bp, Homo sapiens
taacaaagtgtcactccata

SEQ ID NO: 3832477 - DNA, 16 bp, Homo sapiens
taacaatggcaggttt

SEQ ID NO: 3832478 - DNA, 19 bp, Homo sapiens
taacagattataataaatt

SEQ ID NO: 3832479 - DNA, 20 bp, Homo sapiens
taacagattataataaattg

SEQ ID NO: 3832480 - DNA, 22 bp, Homo sapiens
taacagctccttgggaggaagc

SEQ ID NO: 3832481 - DNA, 19 bp, Homo sapiens
taacagttagccactgctg

SEQ ID NO: 3832482 - DNA, 15 bp, Homo sapiens
taacagttataaaga

SEQ ID NO: 3832483 - DNA, 14 bp, Homo sapiens
tcatctcctttgct

SEQ ID NO: 3832484 - DNA, 15 bp, Homo sapiens
tcatctcctttgcta

SEQ ID NO: 3832485 - DNA, 13 bp, Homo sapiens
tcatctgccaaaa

SEQ ID NO: 3832486 - DNA, 22 bp, Homo sapiens
tcatctttgttggctcagaaaa

SEQ ID NO: 3832487 - DNA, 11 bp, Homo sapiens
tcatgaacact

SEQ ID NO: 3832488 - DNA, 14 bp, Homo sapiens
tcatgaacactggc

SEQ ID NO: 3832489 - DNA, 13 bp, Homo sapiens
tcatgacagatga

SEQ ID NO: 3832490 - DNA, 14 bp, Homo sapiens
tcatgcaaacttta

SEQ ID NO: 3832491 - DNA, 23 bp, Homo sapiens
tcatgcaaactttattttgtgtt

SEQ ID NO: 3832492 - DNA, 21 bp, Homo sapiens
tcatgccattttatttctttt

SEQ ID NO: 3832493 - DNA, 13 bp, Homo sapiens
tcatgcccacccc

SEQ ID NO: 3832494 - DNA, 15 bp, Homo sapiens
tcatgcccaccccct

SEQ ID NO: 3832495 - DNA, 16 bp, Homo sapiens
tcatgcccaccccctg

SEQ ID NO: 3832496 - DNA, 22 bp, Homo sapiens
tcatgcccaccccctgccctgc

SEQ ID NO: 3832497 - DNA, 17 bp, Homo sapiens
tcatgcgtctctggccc

SEQ ID NO: 3832498 - DNA, 16 bp, Homo sapiens
tcatggctttttcttt

SEQ ID NO: 3832499 - DNA, 19 bp, Homo sapiens
tcatggtgaaatctgctct

SEQ ID NO: 3832500 - DNA, 17 bp, Homo sapiens
tcatggttttaaagcta

SEQ ID NO: 3832501 - DNA, 18 bp, Homo sapiens
tcatggttttaaagctaa

SEQ ID NO: 3832502 - DNA, 14 bp, Homo sapiens
tcatgtccccctta

SEQ ID NO: 3832503 - DNA, 19 bp, Homo sapiens
tcatgttatgcctgttgca

SEQ ID NO: 3832504 - DNA, 22 bp, Homo sapiens
tcatgttatgcctgttgcaggc

SEQ ID NO: 3832505 - DNA, 13 bp, Homo sapiens
tcattaaagtgca

SEQ ID NO: 3832506 - DNA, 17 bp, Homo sapiens
tcattaaagtgcactgt

SEQ ID NO: 3832507 - DNA, 16 bp, Homo sapiens
tcattacccttttctg

SEQ ID NO: 3832508 - DNA, 18 bp, Homo sapiens
tcattagaagttaccaaa

SEQ ID NO: 3832509 - DNA, 11 bp, Homo sapiens
tcattcctgtc

SEQ ID NO: 3832510 - DNA, 18 bp, Homo sapiens
tcattctaatgatggccc

SEQ ID NO: 3832511 - DNA, 16 bp, Homo sapiens
tcattgcccacttctg

SEQ ID NO: 3832512 - DNA, 17 bp, Homo sapiens
tcatttattaagtatat

SEQ ID NO: 3832513 - DNA, 17 bp, Homo sapiens
tcatttggggcatttgt

SEQ ID NO: 3832514 - DNA, 13 bp, Homo sapiens
tcattttctgcaa

SEQ ID NO: 3832515 - DNA, 11 bp, Homo sapiens
tccaaatgtga

SEQ ID NO: 3832516 - DNA, 16 bp, Homo sapiens
tccaaatgtgaaagat

SEQ ID NO: 3832517 - DNA, 19 bp, Homo sapiens
tccaaattccctctggagt

SEQ ID NO: 3832518 - DNA, 12 bp, Homo sapiens
tccaataaacag

SEQ ID NO: 3832519 - DNA, 13 bp, Homo sapiens
tccaataaacagg

SEQ ID NO: 3832520 - DNA, 23 bp, Homo sapiens
tccacaaaattatgctgcatttg

SEQ ID NO: 3832521 - DNA, 19 bp, Homo sapiens
tccacagggctcctgaagg

SEQ ID NO: 3832522 - DNA, 21 bp, Homo sapiens
tccacagggctcctgaaggaa

SEQ ID NO: 3832523 - DNA, 14 bp, Homo sapiens
tccacctccatctt

SEQ ID NO: 3832524 - DNA, 22 bp, Homo sapiens
tccagagaagcctatttttata

SEQ ID NO: 3832525 - DNA, 21 bp, Homo sapiens
tccagatgtttctcattttaa

SEQ ID NO: 3832526 - DNA, 14 bp, Homo sapiens
tccagcagataagg

SEQ ID NO: 3832527 - DNA, 21 bp, Homo sapiens
tccagctcctccgtgcttcct

SEQ ID NO: 3832528 - DNA, 14 bp, Homo sapiens
tccagctgagtcct

SEQ ID NO: 3832529 - DNA, 18 bp, Homo sapiens
tccagctgagtcctgggg

SEQ ID NO: 3832530 - DNA, 21 bp, Homo sapiens
tccaggaggagttagccaaac

SEQ ID NO: 3832531 - DNA, 10 bp, Homo sapiens
tccaggcccc

SEQ ID NO: 3832532 - DNA, 13 bp, Homo sapiens
tccagtcaggatg

SEQ ID NO: 3832533 - DNA, 23 bp, Homo sapiens
tccagtctgctctcagcttgtgc

SEQ ID NO: 3832534 - DNA, 19 bp, Homo sapiens
tccataaaaagaaagctaa

SEQ ID NO: 3832535 - DNA, 12 bp, Homo sapiens
tccatcctgcta

SEQ ID NO: 3832536 - DNA, 17 bp, Homo sapiens
tccatcctttctgcctc

SEQ ID NO: 3832537 - DNA, 17 bp, Homo sapiens
tccatcctttgcatttc

SEQ ID NO: 3832538 - DNA, 16 bp, Homo sapiens
tccatcttctttgcag

SEQ ID NO: 3832539 - DNA, 18 bp, Homo sapiens
tccatgcccccgccacct

SEQ ID NO: 3832540 - DNA, 19 bp, Homo sapiens
tccatgcccccgccacctc

SEQ ID NO: 3832541 - DNA, 15 bp, Homo sapiens
tccatgttgctgact

SEQ ID NO: 3832542 - DNA, 15 bp, Homo sapiens
tccattctcccaggt

SEQ ID NO: 3832543 - DNA, 17 bp, Homo sapiens
tccattttttaaatgtt

SEQ ID NO: 3832544 - DNA, 18 bp, Homo sapiens
tcccaccaatcctcacct

SEQ ID NO: 3832545 - DNA, 21 bp, Homo sapiens
tcccacccctccccactcatc

SEQ ID NO: 3832546 - DNA, 11 bp, Homo sapiens
tcccacctctg

SEQ ID NO: 3832547 - DNA, 20 bp, Homo sapiens
tcccacctctgtgacctcag

SEQ ID NO: 3832548 - DNA, 13 bp, Homo sapiens
tcccacttggcca

SEQ ID NO: 3832549 - DNA, 16 bp, Homo sapiens
tcccagcctggcctgt

SEQ ID NO: 3832550 - DNA, 18 bp, Homo sapiens
tcccaggagttctgctca

SEQ ID NO: 3832551 - DNA, 19 bp, Homo sapiens
tcccaggtgaggaatttga

SEQ ID NO: 3832552 - DNA, 13 bp, Homo sapiens
tcccatctgcacc

SEQ ID NO: 3832553 - DNA, 19 bp, Homo sapiens
tcccatctgcaccccttct

SEQ ID NO: 3832554 - DNA, 17 bp, Homo sapiens
tcccatggctttgtgct

SEQ ID NO: 3832555 - DNA, 21 bp, Homo sapiens
tcccatgtcccagcctggcct

SEQ ID NO: 3832556 - DNA, 13 bp, Homo sapiens
tccccaccagtga

SEQ ID NO: 3832557 - DNA, 21 bp, Homo sapiens
tccccaccagtgaatgaaagt

SEQ ID NO: 3832558 - DNA, 14 bp, Homo sapiens
tccccacgccctcc

SEQ ID NO: 3832559 - DNA, 14 bp, Homo sapiens
tccccactccagca

SEQ ID NO: 3832560 - DNA, 17 bp, Homo sapiens
tccccactccagcagat

SEQ ID NO: 3832561 - DNA, 19 bp, Homo sapiens
tccccagacagggctccag

SEQ ID NO: 3832562 - DNA, 17 bp, Homo sapiens
tccccagagatggctcc

SEQ ID NO: 3832563 - DNA, 17 bp, Homo sapiens
tccccagatctgtcctg

SEQ ID NO: 3832564 - DNA, 15 bp, Homo sapiens
tccccagcccagggt

SEQ ID NO: 3832565 - DNA, 13 bp, Homo sapiens
tccccagccccta

SEQ ID NO: 3832566 - DNA, 17 bp, Homo sapiens
tccccagggcagcctcg

SEQ ID NO: 3832567 - DNA, 23 bp, Homo sapiens
tccccatagctggtttttcccac

SEQ ID NO: 3832568 - DNA, 17 bp, Homo sapiens
tccccatttcccatctg

SEQ ID NO: 3832569 - DNA, 14 bp, Homo sapiens
tccccattttctgg

SEQ ID NO: 3832570 - DNA, 16 bp, Homo sapiens
tcccccggtgcctctc

SEQ ID NO: 3832571 - DNA, 19 bp, Homo sapiens
tccccgaaggtgctggagg

SEQ ID NO: 3832572 - DNA, 17 bp, Homo sapiens
tccccggaagtgcctta

SEQ ID NO: 3832573 - DNA, 13 bp, Homo sapiens
tccccgtggtctc

SEQ ID NO: 3832574 - DNA, 20 bp, Homo sapiens
tcccctcacagcctctgacc

SEQ ID NO: 3832575 - DNA, 16 bp, Homo sapiens
tcccctcccctgctgc

SEQ ID NO: 3832576 - DNA, 21 bp, Homo sapiens
tcccctgctgcaggggctctg

SEQ ID NO: 3832577 - DNA, 17 bp, Homo sapiens
tcccgggccctcctggg

SEQ ID NO: 3832578 - DNA, 18 bp, Homo sapiens
tcccgggccctcctgggc

SEQ ID NO: 3832579 - DNA, 22 bp, Homo sapiens
tcccggttccctccccagctcc

SEQ ID NO: 3832580 - DNA, 19 bp, Homo sapiens
tccctagctttagaccctg

SEQ ID NO: 3832581 - DNA, 20 bp, Homo sapiens
tccctagctttagaccctgg

SEQ ID NO: 3832582 - DNA, 22 bp, Homo sapiens
tccctagctttagaccctgggt

SEQ ID NO: 3832583 - DNA, 16 bp, Homo sapiens
tccctaggcacctctg

SEQ ID NO: 3832584 - DNA, 17 bp, Homo sapiens
tccctaggcacctctgt

SEQ ID NO: 3832585 - DNA, 21 bp, Homo sapiens
tccctccccagatctgtcctg

SEQ ID NO: 3832586 - DNA, 15 bp, Homo sapiens
tccctccccagctcc

SEQ ID NO: 3832587 - DNA, 12 bp, Homo sapiens
tccctctggagt

SEQ ID NO: 3832588 - DNA, 18 bp, Homo sapiens
tccctctggagtttcatg

SEQ ID NO: 3832589 - DNA, 20 bp, Homo sapiens
tccctctggagtttcatgtt

SEQ ID NO: 3832590 - DNA, 12 bp, Homo sapiens
tccctgaagcca

SEQ ID NO: 3832591 - DNA, 16 bp, Homo sapiens
tccctgaagccagcct

SEQ ID NO: 3832592 - DNA, 18 bp, Homo sapiens
tccctgaagccagccttc

SEQ ID NO: 3832593 - DNA, 19 bp, Homo sapiens
tccctgaagccagccttct

SEQ ID NO: 3832594 - DNA, 11 bp, Homo sapiens
tccctgcctgg

SEQ ID NO: 3832595 - DNA, 17 bp, Homo sapiens
tcccttccttttccctg

SEQ ID NO: 3832596 - DNA, 18 bp, Homo sapiens
tcccttccttttccctgc

SEQ ID NO: 3832597 - DNA, 13 bp, Homo sapiens
tccctttttttaa

SEQ ID NO: 3832598 - DNA, 21 bp, Homo sapiens
tccctttttttaagtaaggaa

SEQ ID NO: 3832599 - DNA, 15 bp, Homo sapiens
tccgagagggagaga

SEQ ID NO: 3832600 - DNA, 15 bp, Homo sapiens
tccggcctgcactcc

SEQ ID NO: 3832601 - DNA, 23 bp, Homo sapiens
tccggcctgcactcccccagttc

SEQ ID NO: 3832602 - DNA, 17 bp, Homo sapiens
tccggggctcagccctg

SEQ ID NO: 3832603 - DNA, 14 bp, Homo sapiens
tccgggtgtagatt

SEQ ID NO: 3832604 - DNA, 22 bp, Homo sapiens
tccgggtgtagattcccttgca

SEQ ID NO: 3832605 - DNA, 18 bp, Homo sapiens
tcctaaaactctgccagc

SEQ ID NO: 3832606 - DNA, 13 bp, Homo sapiens
tcctaaggcccag

SEQ ID NO: 3832607 - DNA, 17 bp, Homo sapiens
tcctaaggcccagctgc

SEQ ID NO: 3832608 - DNA, 18 bp, Homo sapiens
tcctaaggcccagctgcc

SEQ ID NO: 3832609 - DNA, 17 bp, Homo sapiens
tcctaatagaaagaaat

SEQ ID NO: 3832610 - DNA, 22 bp, Homo sapiens
tcctaatcccttcctctcccat

SEQ ID NO: 3832611 - DNA, 22 bp, Homo sapiens
tcctaatggtctcatctccttt

SEQ ID NO: 3832612 - DNA, 21 bp, Homo sapiens
tcctagctggagtgccatggc

SEQ ID NO: 3832613 - DNA, 12 bp, Homo sapiens
tcctcacccctg

SEQ ID NO: 3832614 - DNA, 14 bp, Homo sapiens
tcctcacccctgtc

SEQ ID NO: 3832615 - DNA, 21 bp, Homo sapiens
tcctcacctcatgcccacccc

SEQ ID NO: 3832616 - DNA, 19 bp, Homo sapiens
tggccaccccatctggctg

SEQ ID NO: 3832617 - DNA, 20 bp, Homo sapiens
tggccaggctggtcttgaac

SEQ ID NO: 3832618 - DNA, 12 bp, Homo sapiens
tggcccaagaga

SEQ ID NO: 3832619 - DNA, 22 bp, Homo sapiens
tggcccaggctggcccccaccc

SEQ ID NO: 3832620 - DNA, 15 bp, Homo sapiens
tggcccattctactt

SEQ ID NO: 3832621 - DNA, 16 bp, Homo sapiens
tggcccattctacttg

SEQ ID NO: 3832622 - DNA, 17 bp, Homo sapiens
tggcccattctacttgc

SEQ ID NO: 3832623 - DNA, 21 bp, Homo sapiens
tggcccattctacttgctctg

SEQ ID NO: 3832624 - DNA, 22 bp, Homo sapiens
tggcccccacccaccttccttg

SEQ ID NO: 3832625 - DNA, 16 bp, Homo sapiens
tggccctagtgacagg

SEQ ID NO: 3832626 - DNA, 18 bp, Homo sapiens
tggccctgatccaggaaa

SEQ ID NO: 3832627 - DNA, 17 bp, Homo sapiens
tggccctgtccctccca

SEQ ID NO: 3832628 - DNA, 22 bp, Homo sapiens
tggccctgtccctcccacctct

SEQ ID NO: 3832629 - DNA, 14 bp, Homo sapiens
tggccgttggccac

SEQ ID NO: 3832630 - DNA, 22 bp, Homo sapiens
tggcctaggtgggagccaccac

SEQ ID NO: 3832631 - DNA, 23 bp, Homo sapiens
tggcctaggtgggagccaccact

SEQ ID NO: 3832632 - DNA, 22 bp, Homo sapiens
tggcctcacctgggttccccac

SEQ ID NO: 3832633 - DNA, 23 bp, Homo sapiens
tggctaacatggtgaaacatggt

SEQ ID NO: 3832634 - DNA, 11 bp, Homo sapiens
tggctaggact

SEQ ID NO: 3832635 - DNA, 21 bp, Homo sapiens
tggctaggactgtggagggga

SEQ ID NO: 3832636 - DNA, 22 bp, Homo sapiens
tggctaggactgtggaggggag

SEQ ID NO: 3832637 - DNA, 11 bp, Homo sapiens
tggctcctgaa

SEQ ID NO: 3832638 - DNA, 21 bp, Homo sapiens
tggctccttgggatgaagagg

SEQ ID NO: 3832639 - DNA, 21 bp, Homo sapiens
tggctctggagacagccccag

SEQ ID NO: 3832640 - DNA, 18 bp, Homo sapiens
tggctgaggttcctctgc

SEQ ID NO: 3832641 - DNA, 11 bp, Homo sapiens
tggctgccctc

SEQ ID NO: 3832642 - DNA, 20 bp, Homo sapiens
tggctgtgacagcctctgca

SEQ ID NO: 3832643 - DNA, 13 bp, Homo sapiens
tggcttaaaatgt

SEQ ID NO: 3832644 - DNA, 13 bp, Homo sapiens
tggcttcaggagg

SEQ ID NO: 3832645 - DNA, 17 bp, Homo sapiens
tggctttgtgctgctga

SEQ ID NO: 3832646 - DNA, 20 bp, Homo sapiens
tgggacctgccaggcagggg

SEQ ID NO: 3832647 - DNA, 23 bp, Homo sapiens
tgggacctgccaggcaggggtgg

SEQ ID NO: 3832648 - DNA, 13 bp, Homo sapiens
tgggagcaggaga

SEQ ID NO: 3832649 - DNA, 22 bp, Homo sapiens
tgggagcaggagattgagaagg

SEQ ID NO: 3832650 - DNA, 23 bp, Homo sapiens
tgggagcaggagattgagaagga

SEQ ID NO: 3832651 - DNA, 19 bp, Homo sapiens
tgggagccaccactcctgc

SEQ ID NO: 3832652 - DNA, 13 bp, Homo sapiens
tgggaggaagcag

SEQ ID NO: 3832653 - DNA, 14 bp, Homo sapiens
tgggaggaagcaga

SEQ ID NO: 3832654 - DNA, 22 bp, Homo sapiens
tgggaggaagcagaataaagca

SEQ ID NO: 3832655 - DNA, 11 bp, Homo sapiens
tgggagggagg

SEQ ID NO: 3832656 - DNA, 16 bp, Homo sapiens
tgggagggagggggag

SEQ ID NO: 3832657 - DNA, 21 bp, Homo sapiens
tgggagggagggggaggtgaa

SEQ ID NO: 3832658 - DNA, 16 bp, Homo sapiens
tgggatactgcagggc

SEQ ID NO: 3832659 - DNA, 21 bp, Homo sapiens
tgggattacaggtgtaagcca

SEQ ID NO: 3832660 - DNA, 19 bp, Homo sapiens
tgggcagatgaaaagctac

SEQ ID NO: 3832661 - DNA, 14 bp, Homo sapiens
tgggcccttcctgg

SEQ ID NO: 3832662 - DNA, 20 bp, Homo sapiens
tgggcctcctcctagctgga

SEQ ID NO: 3832663 - DNA, 20 bp, Homo sapiens
tgggcgcagctgaagcctgg

SEQ ID NO: 3832664 - DNA, 15 bp, Homo sapiens
tgggctcgtctttgc

SEQ ID NO: 3832665 - DNA, 16 bp, Homo sapiens
tgggctcgtctttgca

SEQ ID NO: 3832666 - DNA, 17 bp, Homo sapiens
tgggctcgtctttgcag

SEQ ID NO: 3832667 - DNA, 18 bp, Homo sapiens
tgggctctgtgcagtcac

SEQ ID NO: 3832668 - DNA, 23 bp, Homo sapiens
tgggctgacatcaagtgtaatta

SEQ ID NO: 3832669 - DNA, 11 bp, Homo sapiens
tgggctgcctc

SEQ ID NO: 3832670 - DNA, 22 bp, Homo sapiens
tgggctgcctcctcctgagagc

SEQ ID NO: 3832671 - DNA, 14 bp, Homo sapiens
tgggcttggcctgc

SEQ ID NO: 3832672 - DNA, 12 bp, Homo sapiens
tgggcttttatt

SEQ ID NO: 3832673 - DNA, 14 bp, Homo sapiens
tggggagagctggc

SEQ ID NO: 3832674 - DNA, 13 bp, Homo sapiens
tggggagctggcc

SEQ ID NO: 3832675 - DNA, 18 bp, Homo sapiens
tggggatagtctggaaag

SEQ ID NO: 3832676 - DNA, 12 bp, Homo sapiens
tggggcagcctc

SEQ ID NO: 3832677 - DNA, 14 bp, Homo sapiens
tggggcagcctcca

SEQ ID NO: 3832678 - DNA, 16 bp, Homo sapiens
tggggcatttgtaaaa

SEQ ID NO: 3832679 - DNA, 13 bp, Homo sapiens
tgggggccagcac

SEQ ID NO: 3832680 - DNA, 19 bp, Homo sapiens
tggggtagggtgagaaggg

SEQ ID NO: 3832681 - DNA, 18 bp, Homo sapiens
tgggtgagatgctggaga

SEQ ID NO: 3832682 - DNA, 17 bp, Homo sapiens
tgggtggtttggttttt

SEQ ID NO: 3832683 - DNA, 18 bp, Homo sapiens
tgggttgtttaaaaattt

SEQ ID NO: 3832684 - DNA, 18 bp, Homo sapiens
tgggtttgaagctgctgt

SEQ ID NO: 3832685 - DNA, 20 bp, Homo sapiens
tggtaggaaaaagctttact

SEQ ID NO: 3832686 - DNA, 23 bp, Homo sapiens
tggtccacagggctcctgaagga

SEQ ID NO: 3832687 - DNA, 20 bp, Homo sapiens
tggtgacccctgctttgccc

SEQ ID NO: 3832688 - DNA, 22 bp, Homo sapiens
tggtgggaggggcgcccacctc

SEQ ID NO: 3832689 - DNA, 23 bp, Homo sapiens
tggtgggaggggcgcccacctcc

SEQ ID NO: 3832690 - DNA, 15 bp, Homo sapiens
tggtggggcccccag

SEQ ID NO: 3832691 - DNA, 20 bp, Homo sapiens
tggttaagaatgtatatcag

SEQ ID NO: 3832692 - DNA, 19 bp, Homo sapiens
tggttgccaccccaaccca

SEQ ID NO: 3832693 - DNA, 20 bp, Homo sapiens
tggttgtacatataagtgat

SEQ ID NO: 3832694 - DNA, 21 bp, Homo sapiens
tggttgtggatgggaggctcc

SEQ ID NO: 3832695 - DNA, 15 bp, Homo sapiens
tggtttgcccagagc

SEQ ID NO: 3832696 - DNA, 16 bp, Homo sapiens
tggtttggtttttgtt

SEQ ID NO: 3832697 - DNA, 18 bp, Homo sapiens
tggttttagttgcaactt

SEQ ID NO: 3832698 - DNA, 20 bp, Homo sapiens
tggttttgttttcaatgaat

SEQ ID NO: 3832699 - DNA, 22 bp, Homo sapiens
tgtaaactaaagtgtgctttat

SEQ ID NO: 3832700 - DNA, 19 bp, Homo sapiens
tgtaaaggactatttataa

SEQ ID NO: 3832701 - DNA, 22 bp, Homo sapiens
tgtaaatagtttaacactttct

SEQ ID NO: 3832702 - DNA, 17 bp, Homo sapiens
tgtaaatatttcataaa

SEQ ID NO: 3832703 - DNA, 18 bp, Homo sapiens
tgtaaatatttcataaat

SEQ ID NO: 3832704 - DNA, 20 bp, Homo sapiens
tgtaaatatttcataaatta

SEQ ID NO: 3832705 - DNA, 16 bp, Homo sapiens
tgtaaatgctgtaaat

SEQ ID NO: 3832706 - DNA, 15 bp, Homo sapiens
tgtaaattccccttc

SEQ ID NO: 3832707 - DNA, 13 bp, Homo sapiens
tgtaacaacttcc

SEQ ID NO: 3832708 - DNA, 17 bp, Homo sapiens
tgtaacagctccttggg

SEQ ID NO: 3832709 - DNA, 18 bp, Homo sapiens
tgtaacagctccttggga

SEQ ID NO: 3832710 - DNA, 11 bp, Homo sapiens
tgtaacattta

SEQ ID NO: 3832711 - DNA, 16 bp, Homo sapiens
tgtaagcccagcattt

SEQ ID NO: 3832712 - DNA, 23 bp, Homo sapiens
tgtaagtaagtaagaaagaaggc

SEQ ID NO: 3832713 - DNA, 18 bp, Homo sapiens
tgtaagtataagaaattt

SEQ ID NO: 3832714 - DNA, 13 bp, Homo sapiens
tgtaataaatatg

SEQ ID NO: 3832715 - DNA, 15 bp, Homo sapiens
tgtaataaatatgag

SEQ ID NO: 3832716 - DNA, 14 bp, Homo sapiens
tgtaataaatgtat

SEQ ID NO: 3832717 - DNA, 14 bp, Homo sapiens
tgtacacattttgt

SEQ ID NO: 3832718 - DNA, 14 bp, Homo sapiens
tgtacatataagtg

SEQ ID NO: 3832719 - DNA, 20 bp, Homo sapiens
tgtacatcctgcagcttatt

SEQ ID NO: 3832720 - DNA, 14 bp, Homo sapiens
tgtactctcctttt

SEQ ID NO: 3832721 - DNA, 14 bp, Homo sapiens
tgtagaacttgaac

SEQ ID NO: 3832722 - DNA, 20 bp, Homo sapiens
tgtagatttcagtagtttct

SEQ ID NO: 3832723 - DNA, 14 bp, Homo sapiens
tgtaggcctgcctt

SEQ ID NO: 3832724 - DNA, 15 bp, Homo sapiens
tgtagtttgcccaga

SEQ ID NO: 3832725 - DNA, 20 bp, Homo sapiens
tgtatagatgagtttttcat

SEQ ID NO: 3832726 - DNA, 15 bp, Homo sapiens
tgtatataaaatgtg

SEQ ID NO: 3832727 - DNA, 19 bp, Homo sapiens
tgtatcatttcatgctttg

SEQ ID NO: 3832728 - DNA, 21 bp, Homo sapiens
tgtatcatttcatgctttgat

SEQ ID NO: 3832729 - DNA, 17 bp, Homo sapiens
tgtatcgtggagaaaca

SEQ ID NO: 3832730 - DNA, 15 bp, Homo sapiens
tgtatctcaataaag

SEQ ID NO: 3832731 - DNA, 17 bp, Homo sapiens
tgtatctcaataaagca

SEQ ID NO: 3832732 - DNA, 16 bp, Homo sapiens
tgtatgaattttgtaa

SEQ ID NO: 3832733 - DNA, 22 bp, Homo sapiens
tgtatgaattttgtaagtataa

SEQ ID NO: 3832734 - DNA, 16 bp, Homo sapiens
tgtatggatagtaaaa

SEQ ID NO: 3832735 - DNA, 13 bp, Homo sapiens
tgtatgtcattaa

SEQ ID NO: 3832736 - DNA, 17 bp, Homo sapiens
tgtattaactgaaacct

SEQ ID NO: 3832737 - DNA, 16 bp, Homo sapiens
tgtatttttgtaaata

SEQ ID NO: 3832738 - DNA, 21 bp, Homo sapiens
tgtcactccataaaaagaaag

SEQ ID NO: 3832739 - DNA, 17 bp, Homo sapiens
tgtcattgcccacttct

SEQ ID NO: 3832740 - DNA, 21 bp, Homo sapiens
tgtcattgttttcaggtactg

SEQ ID NO: 3832741 - DNA, 17 bp, Homo sapiens
tgtcccatctctacccc

SEQ ID NO: 3832742 - DNA, 19 bp, Homo sapiens
tgtcctcaaccccaaatcc

SEQ ID NO: 3832743 - DNA, 15 bp, Homo sapiens
tgtcctcactgctcc

SEQ ID NO: 3832744 - DNA, 19 bp, Homo sapiens
tgtcctcactgctccctga

SEQ ID NO: 3832745 - DNA, 22 bp, Homo sapiens
tgtcctcactgctccctgaagc

SEQ ID NO: 3832746 - DNA, 17 bp, Homo sapiens
tgtcctcccacccctcc

SEQ ID NO: 3832747 - DNA, 22 bp, Homo sapiens
tgtcctgggggatgcaaataaa

SEQ ID NO: 3832748 - DNA, 17 bp, Homo sapiens
tttcctttccccagccc

SEQ ID NO: 3832749 - DNA, 20 bp, Homo sapiens
tttcctttccccagcccagg

SEQ ID NO: 3832750 - DNA, 18 bp, Homo sapiens
tttcgccaaactgtctct

SEQ ID NO: 3832751 - DNA, 12 bp, Homo sapiens
tttctaaagtaa

SEQ ID NO: 3832752 - DNA, 13 bp, Homo sapiens
tttctaagagaag

SEQ ID NO: 3832753 - DNA, 23 bp, Homo sapiens
tttctcctttcaccaccccctcc

SEQ ID NO: 3832754 - DNA, 15 bp, Homo sapiens
tttctgaagcctcta

SEQ ID NO: 3832755 - DNA, 13 bp, Homo sapiens
tttctgccctggc

SEQ ID NO: 3832756 - DNA, 14 bp, Homo sapiens
tttctgcctctcaa

SEQ ID NO: 3832757 - DNA, 16 bp, Homo sapiens
tttcttccagtgatgt

SEQ ID NO: 3832758 - DNA, 21 bp, Homo sapiens
tttcttccagtgatgttgaaa

SEQ ID NO: 3832759 - DNA, 16 bp, Homo sapiens
tttctttttcctttat

SEQ ID NO: 3832760 - DNA, 16 bp, Homo sapiens
tttctttttttgcata

SEQ ID NO: 3832761 - DNA, 23 bp, Homo sapiens
tttgaaataaagaaccagtccct

SEQ ID NO: 3832762 - DNA, 14 bp, Homo sapiens
tttgaagctgctgt

SEQ ID NO: 3832763 - DNA, 14 bp, Homo sapiens
tttgagctgccttc

SEQ ID NO: 3832764 - DNA, 17 bp, Homo sapiens
tttgagctgccttccct

SEQ ID NO: 3832765 - DNA, 22 bp, Homo sapiens
tttgattgagagtaacttaagt

SEQ ID NO: 3832766 - DNA, 22 bp, Homo sapiens
tttgcaaataaaggctctggaa

SEQ ID NO: 3832767 - DNA, 19 bp, Homo sapiens
tttgcataacgtataaaag

SEQ ID NO: 3832768 - DNA, 17 bp, Homo sapiens
tttgcctcatgaacact

SEQ ID NO: 3832769 - DNA, 14 bp, Homo sapiens
tttgctcttggaat

SEQ ID NO: 3832770 - DNA, 13 bp, Homo sapiens
tttgcttggttca

SEQ ID NO: 3832771 - DNA, 14 bp, Homo sapiens
tttggaaaactaac

SEQ ID NO: 3832772 - DNA, 13 bp, Homo sapiens
tttggaaacaaca

SEQ ID NO: 3832773 - DNA, 15 bp, Homo sapiens
tttggaaacaacatt

SEQ ID NO: 3832774 - DNA, 18 bp, Homo sapiens
tttggaaatggggagctg

SEQ ID NO: 3832775 - DNA, 20 bp, Homo sapiens
tttggaaatggggagctggc

SEQ ID NO: 3832776 - DNA, 21 bp, Homo sapiens
tttggaaatggggagctggcc

SEQ ID NO: 3832777 - DNA, 24 bp, Homo sapiens
tttggaaatggggagctggcctag

SEQ ID NO: 3832778 - DNA, 19 bp, Homo sapiens
tttggcattcctctaatgt

SEQ ID NO: 3832779 - DNA, 14 bp, Homo sapiens
tttgggcttttatt

SEQ ID NO: 3832780 - DNA, 19 bp, Homo sapiens
tttggggatagtctggaaa

SEQ ID NO: 3832781 - DNA, 18 bp, Homo sapiens
tttgtaaattattttatg

SEQ ID NO: 3832782 - DNA, 12 bp, Homo sapiens
tttgtataaaag

SEQ ID NO: 3832783 - DNA, 21 bp, Homo sapiens
tttgtcttgcatttttttcct

SEQ ID NO: 3832784 - DNA, 12 bp, Homo sapiens
tttgtgcttcta

SEQ ID NO: 3832785 - DNA, 19 bp, Homo sapiens
tttgtgggcttaattgaaa

SEQ ID NO: 3832786 - DNA, 13 bp, Homo sapiens
tttgttgcttttt

SEQ ID NO: 3832787 - DNA, 16 bp, Homo sapiens
tttgtttgtgcttcta

SEQ ID NO: 3832788 - DNA, 18 bp, Homo sapiens
tttgttttcaatgaatta

SEQ ID NO: 3832789 - DNA, 22 bp, Homo sapiens
ttttaaaacaagaaagtttccc

SEQ ID NO: 3832790 - DNA, 21 bp, Homo sapiens
ttttaaatgccacaagacata

SEQ ID NO: 3832791 - DNA, 15 bp, Homo sapiens
ttttaaatgtggaat

SEQ ID NO: 3832792 - DNA, 19 bp, Homo sapiens
ttttaactcccaagcagta

SEQ ID NO: 3832793 - DNA, 20 bp, Homo sapiens
ttttaataaagtatattgaa

SEQ ID NO: 3832794 - DNA, 14 bp, Homo sapiens
ttttacacgtctat

SEQ ID NO: 3832795 - DNA, 19 bp, Homo sapiens
ttttacacgtctatgcaat

SEQ ID NO: 3832796 - DNA, 15 bp, Homo sapiens
ttttactagaacaca

SEQ ID NO: 3832797 - DNA, 12 bp, Homo sapiens
ttttactgcatt

SEQ ID NO: 3832798 - DNA, 19 bp, Homo sapiens
ttttagttgcaactttgta

SEQ ID NO: 3832799 - DNA, 14 bp, Homo sapiens
ttttataatattca

SEQ ID NO: 3832800 - DNA, 18 bp, Homo sapiens
ttttataatattcataca

SEQ ID NO: 3832801 - DNA, 19 bp, Homo sapiens
ttttatgtcatagtttaat

SEQ ID NO: 3832802 - DNA, 12 bp, Homo sapiens
ttttatgtgctt

SEQ ID NO: 3832803 - DNA, 18 bp, Homo sapiens
ttttattacggtgatcct

SEQ ID NO: 3832804 - DNA, 17 bp, Homo sapiens
ttttattagacattctc

SEQ ID NO: 3832805 - DNA, 15 bp, Homo sapiens
ttttcatttcatata

SEQ ID NO: 3832806 - DNA, 16 bp, Homo sapiens
ttttcattttctgcaa

SEQ ID NO: 3832807 - DNA, 20 bp, Homo sapiens
ttttccttcataattttcaa

SEQ ID NO: 3832808 - DNA, 15 bp, Homo sapiens
ttttctaagagaagt

SEQ ID NO: 3832809 - DNA, 14 bp, Homo sapiens
ttttctacagtggt

SEQ ID NO: 3832810 - DNA, 16 bp, Homo sapiens
ttttctgcaagcctgc

SEQ ID NO: 3832811 - DNA, 23 bp, Homo sapiens
ttttctttacccaaggattttta

SEQ ID NO: 3832812 - DNA, 18 bp, Homo sapiens
ttttgatttttaaatcat

SEQ ID NO: 3832813 - DNA, 14 bp, Homo sapiens
ttttgcctcatgaa

SEQ ID NO: 3832814 - DNA, 18 bp, Homo sapiens
ttttgcctcatgaacact

SEQ ID NO: 3832815 - DNA, 15 bp, Homo sapiens
ttttgggttgtttaa

SEQ ID NO: 3832816 - DNA, 16 bp, Homo sapiens
ttttgtaaatgctgta

SEQ ID NO: 3832817 - DNA, 17 bp, Homo sapiens
ttttgtaaatgctgtaa

SEQ ID NO: 3832818 - DNA, 20 bp, Homo sapiens
ttttgtaaatgctgtaaata

SEQ ID NO: 3832819 - DNA, 15 bp, Homo sapiens
ttttgtaagtataag

SEQ ID NO: 3832820 - DNA, 13 bp, Homo sapiens
ttttgtcttgcat

SEQ ID NO: 3832821 - DNA, 23 bp, Homo sapiens
ttttgtgaaatttcatgaaaact

SEQ ID NO: 3832822 - DNA, 23 bp, Homo sapiens
ttttgtgccatgttcaaaagaag

SEQ ID NO: 3832823 - DNA, 22 bp, Homo sapiens
ttttgttaacaatggcaggttt

SEQ ID NO: 3832824 - DNA, 15 bp, Homo sapiens
tttttaaacttcagt

SEQ ID NO: 3832825 - DNA, 13 bp, Homo sapiens
tttttaatcttta

SEQ ID NO: 3832826 - DNA, 15 bp, Homo sapiens
tttttctaagagaag

SEQ ID NO: 3832827 - DNA, 16 bp, Homo sapiens
tttttctaagagaagt

SEQ ID NO: 3832828 - DNA, 17 bp, Homo sapiens
tttttctttttttgcat

SEQ ID NO: 3832829 - DNA, 12 bp, Homo sapiens
tttttgtaaatg

SEQ ID NO: 3832830 - DNA, 14 bp, Homo sapiens
tttttgtcttgcat

SEQ ID NO: 3832831 - DNA, 14 bp, Homo sapiens
tttttttctaagag

SEQ ID NO: 3832832 - DNA, 22 bp, Homo sapiens
agacagagcaggctttgtgaga

SEQ ID NO: 3832833 - DNA, 22 bp, Homo sapiens
agacagccaactatggcctgtg

SEQ ID NO: 3832834 - DNA, 12 bp, Homo sapiens
agacagccccag

SEQ ID NO: 3832835 - DNA, 20 bp, Homo sapiens
agacaggcacaaaatgtgac

SEQ ID NO: 3832836 - DNA, 14 bp, Homo sapiens
agacagggctccag

SEQ ID NO: 3832837 - DNA, 16 bp, Homo sapiens
agacagggctccagcc

SEQ ID NO: 3832838 - DNA, 17 bp, Homo sapiens
agacaggttaaatatat

SEQ ID NO: 3832839 - DNA, 23 bp, Homo sapiens
agacaggttaaatatataaacaa

SEQ ID NO: 3832840 - DNA, 18 bp, Homo sapiens
agacataatttaaaataa

SEQ ID NO: 3832841 - DNA, 21 bp, Homo sapiens
agacataatttaaaataaata

SEQ ID NO: 3832842 - DNA, 19 bp, Homo sapiens
agacatggaccttctctcc

SEQ ID NO: 3832843 - DNA, 22 bp, Homo sapiens
agaccaactttttcattccctg

SEQ ID NO: 3832844 - DNA, 21 bp, Homo sapiens
agaccacccccgagcttgcct

SEQ ID NO: 3832845 - DNA, 17 bp, Homo sapiens
agaccctcgagattaac

SEQ ID NO: 3832846 - DNA, 15 bp, Homo sapiens
agaccctctgccacc

SEQ ID NO: 3832847 - DNA, 14 bp, Homo sapiens
agaccgccctggct

SEQ ID NO: 3832848 - DNA, 18 bp, Homo sapiens
agaccgtcctcacccctg

SEQ ID NO: 3832849 - DNA, 11 bp, Homo sapiens
agacctctgag

SEQ ID NO: 3832850 - DNA, 18 bp, Homo sapiens
agaccttgtgtgtatgtg

SEQ ID NO: 3832851 - DNA, 19 bp, Homo sapiens
agacctttgtctgaaggat

SEQ ID NO: 3832852 - DNA, 18 bp, Homo sapiens
agacgaaacatttgttct

SEQ ID NO: 3832853 - DNA, 22 bp, Homo sapiens
agacgccctaggaggagaactt

SEQ ID NO: 3832854 - DNA, 13 bp, Homo sapiens
agactccaggccc

SEQ ID NO: 3832855 - DNA, 14 bp, Homo sapiens
agactccaggcccc

SEQ ID NO: 3832856 - DNA, 21 bp, Homo sapiens
agactccaggcccccgttgaa

SEQ ID NO: 3832857 - DNA, 16 bp, Homo sapiens
agactggggcctggac

SEQ ID NO: 3832858 - DNA, 18 bp, Homo sapiens
agactggggggcttgaaa

SEQ ID NO: 3832859 - DNA, 16 bp, Homo sapiens
agactggtccacaggg

SEQ ID NO: 3832860 - DNA, 18 bp, Homo sapiens
agacttcaccaaatatat

SEQ ID NO: 3832861 - DNA, 15 bp, Homo sapiens
agacttttatgatac

SEQ ID NO: 3832862 - DNA, 16 bp, Homo sapiens
agagaaagccaggcag

SEQ ID NO: 3832863 - DNA, 21 bp, Homo sapiens
agagaaggtagggtgtgtata

SEQ ID NO: 3832864 - DNA, 22 bp, Homo sapiens
agagaatatttttggcattcct

SEQ ID NO: 3832865 - DNA, 23 bp, Homo sapiens
agagaatatttttggcattcctc

SEQ ID NO: 3832866 - DNA, 23 bp, Homo sapiens
agagaccaactttttcattccct

SEQ ID NO: 3832867 - DNA, 24 bp, Homo sapiens
agagaccaactttttcattccctg

SEQ ID NO: 3832868 - DNA, 21 bp, Homo sapiens
agagaccctctgccaccagag

SEQ ID NO: 3832869 - DNA, 22 bp, Homo sapiens
agagaccgtcctcacccctgtc

SEQ ID NO: 3832870 - DNA, 23 bp, Homo sapiens
agagaccgtcctcacccctgtcc

SEQ ID NO: 3832871 - DNA, 13 bp, Homo sapiens
agagagagagagg

SEQ ID NO: 3832872 - DNA, 17 bp, Homo sapiens
agagagagggcgcccag

SEQ ID NO: 3832873 - DNA, 23 bp, Homo sapiens
agagagagggcgcccagcccagg

SEQ ID NO: 3832874 - DNA, 21 bp, Homo sapiens
agagagcggtctcaggctggt

SEQ ID NO: 3832875 - DNA, 13 bp, Homo sapiens
agagaggacagct

SEQ ID NO: 3832876 - DNA, 14 bp, Homo sapiens
agagaggacctcca

SEQ ID NO: 3832877 - DNA, 13 bp, Homo sapiens
agagaggcagaga

SEQ ID NO: 3832878 - DNA, 14 bp, Homo sapiens
agagaggcagagag

SEQ ID NO: 3832879 - DNA, 14 bp, Homo sapiens
agagagggcgccca

SEQ ID NO: 3832880 - DNA, 17 bp, Homo sapiens
agagagggcgcccagcc

SEQ ID NO: 3832881 - DNA, 22 bp, Homo sapiens
agagagggcgcccagcccaggc

SEQ ID NO: 3832882 - DNA, 21 bp, Homo sapiens
agagcacctgttgtgtgcctg

SEQ ID NO: 3832883 - DNA, 13 bp, Homo sapiens
agagcaggctttg

SEQ ID NO: 3832884 - DNA, 17 bp, Homo sapiens
agagcaggctttgtgag

SEQ ID NO: 3832885 - DNA, 18 bp, Homo sapiens
agagcaggctttgtgaga

SEQ ID NO: 3832886 - DNA, 10 bp, Homo sapiens
agagccaaac

SEQ ID NO: 3832887 - DNA, 16 bp, Homo sapiens
agagccaaacagagcc

SEQ ID NO: 3832888 - DNA, 13 bp, Homo sapiens
agagccaggcaca

SEQ ID NO: 3832889 - DNA, 11 bp, Homo sapiens
agagcctgctg

SEQ ID NO: 3832890 - DNA, 23 bp, Homo sapiens
agagcggtctcaggctggtggga

SEQ ID NO: 3832891 - DNA, 14 bp, Homo sapiens
agagctttattgct

SEQ ID NO: 3832892 - DNA, 12 bp, Homo sapiens
agaggacctcca

SEQ ID NO: 3832893 - DNA, 14 bp, Homo sapiens
agaggacctccatg

SEQ ID NO: 3832894 - DNA, 16 bp, Homo sapiens
agaggagaggagagag

SEQ ID NO: 3832895 - DNA, 15 bp, Homo sapiens
agaggcaaggatggt

SEQ ID NO: 3832896 - DNA, 13 bp, Homo sapiens
agaggcaataaat

SEQ ID NO: 3832897 - DNA, 13 bp, Homo sapiens
agaggcagagagc

SEQ ID NO: 3832898 - DNA, 13 bp, Homo sapiens
agaggccaggatg

SEQ ID NO: 3832899 - DNA, 19 bp, Homo sapiens
agaggcttctccgccagcc

SEQ ID NO: 3832900 - DNA, 21 bp, Homo sapiens
agaggcttctccgccagcctc

SEQ ID NO: 3832901 - DNA, 13 bp, Homo sapiens
agagggagagaga

SEQ ID NO: 3832902 - DNA, 20 bp, Homo sapiens
agagggaggtcactggaaag

SEQ ID NO: 3832903 - DNA, 18 bp, Homo sapiens
agagggcgcccagcccag

SEQ ID NO: 3832904 - DNA, 12 bp, Homo sapiens
agagggcttcct

SEQ ID NO: 3832905 - DNA, 22 bp, Homo sapiens
agagggcttcctctagaagcca

SEQ ID NO: 3832906 - DNA, 17 bp, Homo sapiens
agaggtgcctgggagga

SEQ ID NO: 3832907 - DNA, 20 bp, Homo sapiens
agagtaatccaagcaaatgt

SEQ ID NO: 3832908 - DNA, 17 bp, Homo sapiens
agagtccttagcctggg

SEQ ID NO: 3832909 - DNA, 22 bp, Homo sapiens
agagtgcataaataattttgtt

SEQ ID NO: 3832910 - DNA, 15 bp, Homo sapiens
tccttgcgaccacca

SEQ ID NO: 3832911 - DNA, 17 bp, Homo sapiens
tccttgggaggaagcag

SEQ ID NO: 3832912 - DNA, 19 bp, Homo sapiens
tccttgggaggaagcagaa

SEQ ID NO: 3832913 - DNA, 21 bp, Homo sapiens
tccttgggaggaagcagaata

SEQ ID NO: 3832914 - DNA, 22 bp, Homo sapiens
tccttgggaggaagcagaataa

SEQ ID NO: 3832915 - DNA, 13 bp, Homo sapiens
tcctttataattc

SEQ ID NO: 3832916 - DNA, 14 bp, Homo sapiens
tcctttccccagcc

SEQ ID NO: 3832917 - DNA, 17 bp, Homo sapiens
tcctttccccagcccag

SEQ ID NO: 3832918 - DNA, 15 bp, Homo sapiens
tcctttgcatttctc

SEQ ID NO: 3832919 - DNA, 13 bp, Homo sapiens
tccttttccctgc

SEQ ID NO: 3832920 - DNA, 15 bp, Homo sapiens
tccttttccctgctt

SEQ ID NO: 3832921 - DNA, 18 bp, Homo sapiens
tcgagttaaaacaatgaa

SEQ ID NO: 3832922 - DNA, 15 bp, Homo sapiens
tcgcacctgcctccg

SEQ ID NO: 3832923 - DNA, 18 bp, Homo sapiens
tcgcaggggcgctggctg

SEQ ID NO: 3832924 - DNA, 17 bp, Homo sapiens
tcgccaaactgtctctg

SEQ ID NO: 3832925 - DNA, 21 bp, Homo sapiens
tcgccaaactgtctctgcctc

SEQ ID NO: 3832926 - DNA, 19 bp, Homo sapiens
tcgccaacttgtctctgta

SEQ ID NO: 3832927 - DNA, 20 bp, Homo sapiens
tcgccaacttgtctctgtag

SEQ ID NO: 3832928 - DNA, 21 bp, Homo sapiens
tcgccagctgatgactcaaga

SEQ ID NO: 3832929 - DNA, 14 bp, Homo sapiens
tcgcttttggtgcc

SEQ ID NO: 3832930 - DNA, 17 bp, Homo sapiens
tcggagtgtggcctgga

SEQ ID NO: 3832931 - DNA, 14 bp, Homo sapiens
tcggcttcctcagg

SEQ ID NO: 3832932 - DNA, 15 bp, Homo sapiens
tcgggaacctcactc

SEQ ID NO: 3832933 - DNA, 16 bp, Homo sapiens
tcggggcccccatctt

SEQ ID NO: 3832934 - DNA, 16 bp, Homo sapiens
tcgtaaaattaagaaa

SEQ ID NO: 3832935 - DNA, 22 bp, Homo sapiens
tcgtggtccccaacagcgacat

SEQ ID NO: 3832936 - DNA, 21 bp, Homo sapiens
tcgtgttgtgttctttataac

SEQ ID NO: 3832937 - DNA, 22 bp, Homo sapiens
tcgttaggacaaggctgtgcca

SEQ ID NO: 3832938 - DNA, 20 bp, Homo sapiens
tctaatatttattgctttat

SEQ ID NO: 3832939 - DNA, 12 bp, Homo sapiens
tctacagtggtt

SEQ ID NO: 3832940 - DNA, 21 bp, Homo sapiens
tctactgtatggaatacaatg

SEQ ID NO: 3832941 - DNA, 13 bp, Homo sapiens
tctacttgctctg

SEQ ID NO: 3832942 - DNA, 14 bp, Homo sapiens
tctacttgctctgg

SEQ ID NO: 3832943 - DNA, 11 bp, Homo sapiens
tctagaaaata

SEQ ID NO: 3832944 - DNA, 20 bp, Homo sapiens
tctagaaaataatgcaaatg

SEQ ID NO: 3832945 - DNA, 23 bp, Homo sapiens
tctagaaaataatgcaaatgtca

SEQ ID NO: 3832946 - DNA, 23 bp, Homo sapiens
tctagaagccaagggaaaggggt

SEQ ID NO: 3832947 - DNA, 15 bp, Homo sapiens
tctatatttttgtga

SEQ ID NO: 3832948 - DNA, 21 bp, Homo sapiens
tctatggctcatgtctgaaaa

SEQ ID NO: 3832949 - DNA, 21 bp, Homo sapiens
tctcaaatacagtagtataat

SEQ ID NO: 3832950 - DNA, 23 bp, Homo sapiens
tctcaataaagcacgcagttatg

SEQ ID NO: 3832951 - DNA, 18 bp, Homo sapiens
tctcacagtcaaaaggaa

SEQ ID NO: 3832952 - DNA, 19 bp, Homo sapiens
tctcacttttggaaggtga

SEQ ID NO: 3832953 - DNA, 13 bp, Homo sapiens
tctcagcttgtgc

SEQ ID NO: 3832954 - DNA, 14 bp, Homo sapiens
tctcagcttgtgcc

SEQ ID NO: 3832955 - DNA, 17 bp, Homo sapiens
tctcatgctatttctac

SEQ ID NO: 3832956 - DNA, 17 bp, Homo sapiens
tctcattacccttttct

SEQ ID NO: 3832957 - DNA, 22 bp, Homo sapiens
tctccatcctttctgcctctca

SEQ ID NO: 3832958 - DNA, 23 bp, Homo sapiens
tctcccaggggctggcttcagga

SEQ ID NO: 3832959 - DNA, 15 bp, Homo sapiens
tctccgccagcctcc

SEQ ID NO: 3832960 - DNA, 14 bp, Homo sapiens
tctcctcccttcct

SEQ ID NO: 3832961 - DNA, 23 bp, Homo sapiens
tctcctgccctgccctcctgccc

SEQ ID NO: 3832962 - DNA, 17 bp, Homo sapiens
tctccttcctcagaata

SEQ ID NO: 3832963 - DNA, 20 bp, Homo sapiens
tctctaagatgaatccaaat

SEQ ID NO: 3832964 - DNA, 24 bp, Homo sapiens
tctctaagatgaatccaaatgtga

SEQ ID NO: 3832965 - DNA, 18 bp, Homo sapiens
tctctagaagtgccatct

SEQ ID NO: 3832966 - DNA, 17 bp, Homo sapiens
tctctccagagctcctg

SEQ ID NO: 3832967 - DNA, 22 bp, Homo sapiens
tctctcccaggggctggcttca

SEQ ID NO: 3832968 - DNA, 17 bp, Homo sapiens
tctctcgaatactttga

SEQ ID NO: 3832969 - DNA, 15 bp, Homo sapiens
tctctgcctcttccc

SEQ ID NO: 3832970 - DNA, 18 bp, Homo sapiens
tctctgtctccaggcagt

SEQ ID NO: 3832971 - DNA, 18 bp, Homo sapiens
tctctttccttcttgcct

SEQ ID NO: 3832972 - DNA, 20 bp, Homo sapiens
tctgaaaaatgcctgctgct

SEQ ID NO: 3832973 - DNA, 21 bp, Homo sapiens
tctgaagcctctaacaaatga

SEQ ID NO: 3832974 - DNA, 10 bp, Homo sapiens
tctgaattat

SEQ ID NO: 3832975 - DNA, 17 bp, Homo sapiens
tctgacatcaagtgtaa

SEQ ID NO: 3832976 - DNA, 17 bp, Homo sapiens
tctgacccctcctcact

SEQ ID NO: 3832977 - DNA, 18 bp, Homo sapiens
tctgacccctcctcactg

SEQ ID NO: 3832978 - DNA, 18 bp, Homo sapiens
tctgagctctgcatttgt

SEQ ID NO: 3832979 - DNA, 22 bp, Homo sapiens
tctgaggctcagccctgagctg

SEQ ID NO: 3832980 - DNA, 15 bp, Homo sapiens
tctgcaagcctgcgt

SEQ ID NO: 3832981 - DNA, 20 bp, Homo sapiens
tctgcaccccttctctcctc

SEQ ID NO: 3832982 - DNA, 14 bp, Homo sapiens
tctgcatttgtcta

SEQ ID NO: 3832983 - DNA, 13 bp, Homo sapiens
tctgccctggctg

SEQ ID NO: 3832984 - DNA, 16 bp, Homo sapiens
tctgccctggctgctg

SEQ ID NO: 3832985 - DNA, 12 bp, Homo sapiens
tctgcctgcccc

SEQ ID NO: 3832986 - DNA, 16 bp, Homo sapiens
tctgccttaaaaccaa

SEQ ID NO: 3832987 - DNA, 14 bp, Homo sapiens
tctgcggaccccag

SEQ ID NO: 3832988 - DNA, 17 bp, Homo sapiens
tctgcggaccccagctg

SEQ ID NO: 3832989 - DNA, 22 bp, Homo sapiens
tctgcggaccccagctgtgagc

SEQ ID NO: 3832990 - DNA, 13 bp, Homo sapiens
tctgctcagccct

SEQ ID NO: 3832991 - DNA, 16 bp, Homo sapiens
tgatatccatatgaaa

SEQ ID NO: 3832992 - DNA, 20 bp, Homo sapiens
tgatatccatatgaaattca

SEQ ID NO: 3832993 - DNA, 18 bp, Homo sapiens
tgatctagttcagaagga

SEQ ID NO: 3832994 - DNA, 18 bp, Homo sapiens
tgatctgctcagccctgg

SEQ ID NO: 3832995 - DNA, 22 bp, Homo sapiens
tgatctttaactggaaggctgc

SEQ ID NO: 3832996 - DNA, 22 bp, Homo sapiens
tgatgactcaagattcccagga

SEQ ID NO: 3832997 - DNA, 19 bp, Homo sapiens
tgatgcaaaggtggggaga

SEQ ID NO: 3832998 - DNA, 21 bp, Homo sapiens
tgatggggtcagcaggcccag

SEQ ID NO: 3832999 - DNA, 22 bp, Homo sapiens
tgatggggtcagcaggcccagg

SEQ ID NO: 3833000 - DNA, 14 bp, Homo sapiens
tgatggttgtacat

SEQ ID NO: 3833001 - DNA, 13 bp, Homo sapiens
tgatgtatataaa

SEQ ID NO: 3833002 - DNA, 19 bp, Homo sapiens
tgatgtatataaaatgtgc

SEQ ID NO: 3833003 - DNA, 12 bp, Homo sapiens
tgattcaaatgt

SEQ ID NO: 3833004 - DNA, 19 bp, Homo sapiens
tgattcaaatgttacaaaa

SEQ ID NO: 3833005 - DNA, 20 bp, Homo sapiens
tgattccactacacctggct

SEQ ID NO: 3833006 - DNA, 16 bp, Homo sapiens
tgattcctaaggccca

SEQ ID NO: 3833007 - DNA, 17 bp, Homo sapiens
tgattcctaaggcccag

SEQ ID NO: 3833008 - DNA, 13 bp, Homo sapiens
tgattctcctgcc

SEQ ID NO: 3833009 - DNA, 21 bp, Homo sapiens
tgattctcctgcctcagcctc

SEQ ID NO: 3833010 - DNA, 13 bp, Homo sapiens
tgatttacagttt

SEQ ID NO: 3833011 - DNA, 22 bp, Homo sapiens
tgattttaaaccataaaaagct

SEQ ID NO: 3833012 - DNA, 11 bp, Homo sapiens
tgatttttaaa

SEQ ID NO: 3833013 - DNA, 17 bp, Homo sapiens
tgcaaataaagcctgct

SEQ ID NO: 3833014 - DNA, 14 bp, Homo sapiens
tgcaaataaaggct

SEQ ID NO: 3833015 - DNA, 20 bp, Homo sapiens
tgcaaataaaggctctggaa

SEQ ID NO: 3833016 - DNA, 14 bp, Homo sapiens
tgcaaatctgttac

SEQ ID NO: 3833017 - DNA, 23 bp, Homo sapiens
tgcaacctctgccccccaagttc

SEQ ID NO: 3833018 - DNA, 12 bp, Homo sapiens
tgcaagcctgcg

SEQ ID NO: 3833019 - DNA, 14 bp, Homo sapiens
tgcaagcctgcgtt

SEQ ID NO: 3833020 - DNA, 13 bp, Homo sapiens
tgcaattgtacaa

SEQ ID NO: 3833021 - DNA, 14 bp, Homo sapiens
tgcaattgtacaaa

SEQ ID NO: 3833022 - DNA, 17 bp, Homo sapiens
tgcaatttgtttgtgct

SEQ ID NO: 3833023 - DNA, 19 bp, Homo sapiens
tgcaatttgtttgtgcttc

SEQ ID NO: 3833024 - DNA, 21 bp, Homo sapiens
tgcacaaaattcgacctgatt

SEQ ID NO: 3833025 - DNA, 21 bp, Homo sapiens
tgcacagggccctctgaggct

SEQ ID NO: 3833026 - DNA, 17 bp, Homo sapiens
tgcacagttctatttgc

SEQ ID NO: 3833027 - DNA, 16 bp, Homo sapiens
tgcaccacgcccggct

SEQ ID NO: 3833028 - DNA, 19 bp, Homo sapiens
tgcaccccttctctcctcc

SEQ ID NO: 3833029 - DNA, 15 bp, Homo sapiens
tgcacgtcatgggag

SEQ ID NO: 3833030 - DNA, 18 bp, Homo sapiens
tgcagaggatttaactgt

SEQ ID NO: 3833031 - DNA, 12 bp, Homo sapiens
tgcagcctgggt

SEQ ID NO: 3833032 - DNA, 15 bp, Homo sapiens
tgcagggccaggact

SEQ ID NO: 3833033 - DNA, 23 bp, Homo sapiens
tgcagggccaggactgagccccg

SEQ ID NO: 3833034 - DNA, 17 bp, Homo sapiens
tgcagtaatctccaggg

SEQ ID NO: 3833035 - DNA, 19 bp, Homo sapiens
tgcagtaatctccagggcc

SEQ ID NO: 3833036 - DNA, 14 bp, Homo sapiens
tgcagtcactggag

SEQ ID NO: 3833037 - DNA, 13 bp, Homo sapiens
tgcagtgagctga

SEQ ID NO: 3833038 - DNA, 22 bp, Homo sapiens
tgcataaaaactggttctacaa

SEQ ID NO: 3833039 - DNA, 16 bp, Homo sapiens
tgcataatgtctttaa

SEQ ID NO: 3833040 - DNA, 16 bp, Homo sapiens
tgcatgctcaaatgaa

SEQ ID NO: 3833041 - DNA, 17 bp, Homo sapiens
tgcatgctcaaatgaaa

SEQ ID NO: 3833042 - DNA, 19 bp, Homo sapiens
tgcattaataatccttcca

SEQ ID NO: 3833043 - DNA, 17 bp, Homo sapiens
tgcatttggctggagcc

SEQ ID NO: 3833044 - DNA, 16 bp, Homo sapiens
tgcatttgtctattct

SEQ ID NO: 3833045 - DNA, 17 bp, Homo sapiens
tgcattttaagcataat

SEQ ID NO: 3833046 - DNA, 15 bp, Homo sapiens
tgcattttttaaaac

SEQ ID NO: 3833047 - DNA, 16 bp, Homo sapiens
tgccaaaaccaaattg

SEQ ID NO: 3833048 - DNA, 22 bp, Homo sapiens
tgccaacctgtaataaatatga

SEQ ID NO: 3833049 - DNA, 22 bp, Homo sapiens
tgccaactccatgtcagggaag

SEQ ID NO: 3833050 - DNA, 14 bp, Homo sapiens
tgccaagccctttg

SEQ ID NO: 3833051 - DNA, 15 bp, Homo sapiens
tgccaagccctttgc

SEQ ID NO: 3833052 - DNA, 17 bp, Homo sapiens
tgccaagccctttgctg

SEQ ID NO: 3833053 - DNA, 19 bp, Homo sapiens
tgccaccagagaccgtcct

SEQ ID NO: 3833054 - DNA, 14 bp, Homo sapiens
tgccaccccaaccc

SEQ ID NO: 3833055 - DNA, 13 bp, Homo sapiens
tgccagcaaagcc

SEQ ID NO: 3833056 - DNA, 24 bp, Homo sapiens
tgccagcaaagccccatgctggag

SEQ ID NO: 3833057 - DNA, 14 bp, Homo sapiens
tgccaggagcctgg

SEQ ID NO: 3833058 - DNA, 20 bp, Homo sapiens
tgccaggagcctggagggaa

SEQ ID NO: 3833059 - DNA, 16 bp, Homo sapiens
tgccaggcaggggtgg

SEQ ID NO: 3833060 - DNA, 17 bp, Homo sapiens
tgccaggcaggggtggg

SEQ ID NO: 3833061 - DNA, 12 bp, Homo sapiens
tgccaggctggg

SEQ ID NO: 3833062 - DNA, 15 bp, Homo sapiens
tgccaggctgggagg

SEQ ID NO: 3833063 - DNA, 17 bp, Homo sapiens
tgccaggctgggaggct

SEQ ID NO: 3833064 - DNA, 16 bp, Homo sapiens
tgccagggaagacaga

SEQ ID NO: 3833065 - DNA, 22 bp, Homo sapiens
tgccagggaagacagagcaggc

SEQ ID NO: 3833066 - DNA, 23 bp, Homo sapiens
tgccatctcaattgtgctttgta

SEQ ID NO: 3833067 - DNA, 14 bp, Homo sapiens
tgccatggctgggg

SEQ ID NO: 3833068 - DNA, 22 bp, Homo sapiens
tgccatggctggggggtctcag

SEQ ID NO: 3833069 - DNA, 13 bp, Homo sapiens
tgcccaccccctg

SEQ ID NO: 3833070 - DNA, 15 bp, Homo sapiens
tgcccaccccctgcc

SEQ ID NO: 3833071 - DNA, 20 bp, Homo sapiens
tgcccaccccctgccctgca

SEQ ID NO: 3833072 - DNA, 16 bp, Homo sapiens
tgcccacttctgtgta

SEQ ID NO: 3833073 - DNA, 14 bp, Homo sapiens
tgccccactgggag

SEQ ID NO: 3833074 - DNA, 23 bp, Homo sapiens
tgccccactgggagagtccttag

SEQ ID NO: 3833075 - DNA, 16 bp, Homo sapiens
tgcccccaatttccca

SEQ ID NO: 3833076 - DNA, 13 bp, Homo sapiens
tgcccccacaccc

SEQ ID NO: 3833077 - DNA, 19 bp, Homo sapiens
tgcccccgccacctcccca

SEQ ID NO: 3833078 - DNA, 16 bp, Homo sapiens
tgccccggccacctct

SEQ ID NO: 3833079 - DNA, 13 bp, Homo sapiens
tgcccctgccctg

SEQ ID NO: 3833080 - DNA, 15 bp, Homo sapiens
tgcccctgccctgag

SEQ ID NO: 3833081 - DNA, 17 bp, Homo sapiens
tgcccgaggtcgctgca

SEQ ID NO: 3833082 - DNA, 15 bp, Homo sapiens
tgcccgccctccctc

SEQ ID NO: 3833083 - DNA, 21 bp, Homo sapiens
tgcccgccctccctcctgcct

SEQ ID NO: 3833084 - DNA, 17 bp, Homo sapiens
tgcccggcctccctccc

SEQ ID NO: 3833085 - DNA, 19 bp, Homo sapiens
tgccctgaggagggccctg

SEQ ID NO: 3833086 - DNA, 20 bp, Homo sapiens
tgccctgaggagggccctga

SEQ ID NO: 3833087 - DNA, 23 bp, Homo sapiens
tgccctgaggagggccctgagga

SEQ ID NO: 3833088 - DNA, 14 bp, Homo sapiens
tgccctggctgctg

SEQ ID NO: 3833089 - DNA, 19 bp, Homo sapiens
tctttgcttcacttctccc

SEQ ID NO: 3833090 - DNA, 18 bp, Homo sapiens
tctttggggagagctggc

SEQ ID NO: 3833091 - DNA, 11 bp, Homo sapiens
tctttgtaaat

SEQ ID NO: 3833092 - DNA, 16 bp, Homo sapiens
tcttttagacacatta

SEQ ID NO: 3833093 - DNA, 23 bp, Homo sapiens
tcttttccacatggcagatgatt

SEQ ID NO: 3833094 - DNA, 17 bp, Homo sapiens
tctttttcctttataat

SEQ ID NO: 3833095 - DNA, 20 bp, Homo sapiens
tctttttcgccaaactgtct

SEQ ID NO: 3833096 - DNA, 15 bp, Homo sapiens
tgaaaactttttaat

SEQ ID NO: 3833097 - DNA, 20 bp, Homo sapiens
tgaaacaacattattttaaa

SEQ ID NO: 3833098 - DNA, 16 bp, Homo sapiens
tgaaacactttgcata

SEQ ID NO: 3833099 - DNA, 15 bp, Homo sapiens
tgaaagatgcatgtt

SEQ ID NO: 3833100 - DNA, 22 bp, Homo sapiens
tgaaagtcttgtgactagtgct

SEQ ID NO: 3833101 - DNA, 23 bp, Homo sapiens
tgaaagtcttgtgactagtgctg

SEQ ID NO: 3833102 - DNA, 20 bp, Homo sapiens
tgaaataaagaaccagtccc

SEQ ID NO: 3833103 - DNA, 16 bp, Homo sapiens
tgaaatatattttaaa

SEQ ID NO: 3833104 - DNA, 23 bp, Homo sapiens
tgaaatcatctttgttggctcag

SEQ ID NO: 3833105 - DNA, 20 bp, Homo sapiens
tgaaatctgctctgtacatc

SEQ ID NO: 3833106 - DNA, 16 bp, Homo sapiens
tgaaatttatacacca

SEQ ID NO: 3833107 - DNA, 13 bp, Homo sapiens
tgaaatttcatga

SEQ ID NO: 3833108 - DNA, 14 bp, Homo sapiens
tgaaatttcatgaa

SEQ ID NO: 3833109 - DNA, 13 bp, Homo sapiens
tgaaattttaaat

SEQ ID NO: 3833110 - DNA, 13 bp, Homo sapiens
tgaacaaaaattg

SEQ ID NO: 3833111 - DNA, 18 bp, Homo sapiens
tgaactaattcatttatt

SEQ ID NO: 3833112 - DNA, 21 bp, Homo sapiens
tgaactatatccttcctagtg

SEQ ID NO: 3833113 - DNA, 12 bp, Homo sapiens
tgaactgctgcc

SEQ ID NO: 3833114 - DNA, 13 bp, Homo sapiens
tgaactgctgcca

SEQ ID NO: 3833115 - DNA, 21 bp, Homo sapiens
tgaactgctgccaactccatg

SEQ ID NO: 3833116 - DNA, 16 bp, Homo sapiens
tgaagaaggagcagaa

SEQ ID NO: 3833117 - DNA, 17 bp, Homo sapiens
tgaagaaggagcagaat

SEQ ID NO: 3833118 - DNA, 18 bp, Homo sapiens
tgaagaaggagcagaata

SEQ ID NO: 3833119 - DNA, 22 bp, Homo sapiens
tgaagaaggagcagaataaatg

SEQ ID NO: 3833120 - DNA, 14 bp, Homo sapiens
tgaagattcaggct

SEQ ID NO: 3833121 - DNA, 17 bp, Homo sapiens
tgaagatttggtttttg

SEQ ID NO: 3833122 - DNA, 14 bp, Homo sapiens
tgaagcataaacat

SEQ ID NO: 3833123 - DNA, 22 bp, Homo sapiens
tgaagccaagtggggtgctggg

SEQ ID NO: 3833124 - DNA, 20 bp, Homo sapiens
tgaagccacacagcccagaa

SEQ ID NO: 3833125 - DNA, 13 bp, Homo sapiens
tgaagccagcctt

SEQ ID NO: 3833126 - DNA, 14 bp, Homo sapiens
tgaagccagccttc

SEQ ID NO: 3833127 - DNA, 16 bp, Homo sapiens
tgaagccagccttctt

SEQ ID NO: 3833128 - DNA, 15 bp, Homo sapiens
tgaagccgctcccgg

SEQ ID NO: 3833129 - DNA, 22 bp, Homo sapiens
tgaagcctggacgcagccacac

SEQ ID NO: 3833130 - DNA, 18 bp, Homo sapiens
tgaagcttattaatgcta

SEQ ID NO: 3833131 - DNA, 23 bp, Homo sapiens
tgaagcttattaatgctaagggc

SEQ ID NO: 3833132 - DNA, 16 bp, Homo sapiens
tgaagtgttttacaat

SEQ ID NO: 3833133 - DNA, 18 bp, Homo sapiens
tgaagtgttttacaatga

SEQ ID NO: 3833134 - DNA, 21 bp, Homo sapiens
tgaatatgtgccttctagaat

SEQ ID NO: 3833135 - DNA, 11 bp, Homo sapiens
tgaatccaaat

SEQ ID NO: 3833136 - DNA, 13 bp, Homo sapiens
tgaatccaaatgt

SEQ ID NO: 3833137 - DNA, 14 bp, Homo sapiens
tgaatccaaatgtg

SEQ ID NO: 3833138 - DNA, 16 bp, Homo sapiens
tgaatccaaatgtgaa

SEQ ID NO: 3833139 - DNA, 21 bp, Homo sapiens
tgaatccaaatgtgaaagatg

SEQ ID NO: 3833140 - DNA, 20 bp, Homo sapiens
tgaattaagaaagattaaat

SEQ ID NO: 3833141 - DNA, 22 bp, Homo sapiens
tgaattgcattttttaaaacaa

SEQ ID NO: 3833142 - DNA, 14 bp, Homo sapiens
tgaattttgtaagt

SEQ ID NO: 3833143 - DNA, 16 bp, Homo sapiens
tgacaacgaaagtaaa

SEQ ID NO: 3833144 - DNA, 21 bp, Homo sapiens
tgacaaggacgcccgaagcac

SEQ ID NO: 3833145 - DNA, 22 bp, Homo sapiens
tgacaccacgctggagctgtgt

SEQ ID NO: 3833146 - DNA, 11 bp, Homo sapiens
tgacagatgaa

SEQ ID NO: 3833147 - DNA, 21 bp, Homo sapiens
tgacagtagtaccaaatgctt

SEQ ID NO: 3833148 - DNA, 22 bp, Homo sapiens
tgacatcaagtgtaattagctt

SEQ ID NO: 3833149 - DNA, 23 bp, Homo sapiens
tgacatcaagtgtaattagcttt

SEQ ID NO: 3833150 - DNA, 17 bp, Homo sapiens
tgacatggtgcctgaga

SEQ ID NO: 3833151 - DNA, 12 bp, Homo sapiens
tgacccaataaa

SEQ ID NO: 3833152 - DNA, 23 bp, Homo sapiens
tgaccgcttccccgatgtgagcc

SEQ ID NO: 3833153 - DNA, 18 bp, Homo sapiens
tgacctacctggcccctg

SEQ ID NO: 3833154 - DNA, 20 bp, Homo sapiens
tgacctcaggtgatccgccc

SEQ ID NO: 3833155 - DNA, 14 bp, Homo sapiens
tgactagtgctgaa

SEQ ID NO: 3833156 - DNA, 15 bp, Homo sapiens
tgactagtgctgaag

SEQ ID NO: 3833157 - DNA, 17 bp, Homo sapiens
tgactcaagattcccag

SEQ ID NO: 3833158 - DNA, 18 bp, Homo sapiens
tgactcaagattcccagg

SEQ ID NO: 3833159 - DNA, 17 bp, Homo sapiens
tgacttaaggagaaata

SEQ ID NO: 3833160 - DNA, 14 bp, Homo sapiens
tgactttcatttgg

SEQ ID NO: 3833161 - DNA, 20 bp, Homo sapiens
tgagaaatactatatataca

SEQ ID NO: 3833162 - DNA, 13 bp, Homo sapiens
tgagaaatctaaa

SEQ ID NO: 3833163 - DNA, 17 bp, Homo sapiens
tgagaaatttataaact

SEQ ID NO: 3833164 - DNA, 12 bp, Homo sapiens
tgagaaggagag

SEQ ID NO: 3833165 - DNA, 16 bp, Homo sapiens
tgagaaggagagaaag

SEQ ID NO: 3833166 - DNA, 23 bp, Homo sapiens
tgagagaaggtagggtgtgtata

SEQ ID NO: 3833167 - DNA, 12 bp, Homo sapiens
tgagagagaggg

SEQ ID NO: 3833168 - DNA, 23 bp, Homo sapiens
tgagagaggacctccatgccccc

SEQ ID NO: 3833169 - DNA, 12 bp, Homo sapiens
tgagaggcaggc

SEQ ID NO: 3833170 - DNA, 13 bp, Homo sapiens
tgagaggcaggca

SEQ ID NO: 3833171 - DNA, 14 bp, Homo sapiens
tgagaggcaggcat

SEQ ID NO: 3833172 - DNA, 18 bp, Homo sapiens
tgagagtaacttaagtta

SEQ ID NO: 3833173 - DNA, 16 bp, Homo sapiens
tgagatgctggagaag

SEQ ID NO: 3833174 - DNA, 18 bp, Homo sapiens
tgagatgctggagaagag

SEQ ID NO: 3833175 - DNA, 14 bp, Homo sapiens
tgagatgtgttcac

SEQ ID NO: 3833176 - DNA, 20 bp, Homo sapiens
tgagattcacatgctggctc

SEQ ID NO: 3833177 - DNA, 18 bp, Homo sapiens
tgagcaagacgccctctc

SEQ ID NO: 3833178 - DNA, 20 bp, Homo sapiens
aatcaatacactagttgttt

SEQ ID NO: 3833179 - DNA, 22 bp, Homo sapiens
aatcagtgccccagatgtacat

SEQ ID NO: 3833180 - DNA, 13 bp, Homo sapiens
aatcattgtacag

SEQ ID NO: 3833181 - DNA, 15 bp, Homo sapiens
aatccaaattccctc

SEQ ID NO: 3833182 - DNA, 13 bp, Homo sapiens
aatcccttcctct

SEQ ID NO: 3833183 - DNA, 21 bp, Homo sapiens
aatcctaatttctcctccctt

SEQ ID NO: 3833184 - DNA, 18 bp, Homo sapiens
aatctatatttttgtgaa

SEQ ID NO: 3833185 - DNA, 11 bp, Homo sapiens
aatctggaaaa

SEQ ID NO: 3833186 - DNA, 19 bp, Homo sapiens
aatcttgatagctaaataa

SEQ ID NO: 3833187 - DNA, 15 bp, Homo sapiens
aatctttaattttac

SEQ ID NO: 3833188 - DNA, 16 bp, Homo sapiens
aatctttaattttaca

SEQ ID NO: 3833189 - DNA, 17 bp, Homo sapiens
aatctttttgtttttct

SEQ ID NO: 3833190 - DNA, 21 bp, Homo sapiens
aatgaaagtcttgtgactagt

SEQ ID NO: 3833191 - DNA, 17 bp, Homo sapiens
aatgaattaagaaagat

SEQ ID NO: 3833192 - DNA, 22 bp, Homo sapiens
aatgactaaagacctgctgtaa

SEQ ID NO: 3833193 - DNA, 19 bp, Homo sapiens
aatgatatattaaaccttc

SEQ ID NO: 3833194 - DNA, 22 bp, Homo sapiens
aatgatgcttcagtggaaatca

SEQ ID NO: 3833195 - DNA, 14 bp, Homo sapiens
aatgatggcccatt

SEQ ID NO: 3833196 - DNA, 22 bp, Homo sapiens
aatgatttgtaaaggactattt

SEQ ID NO: 3833197 - DNA, 16 bp, Homo sapiens
aatgcaacctctgccc

SEQ ID NO: 3833198 - DNA, 20 bp, Homo sapiens
aatgcctcgagccatagagc

SEQ ID NO: 3833199 - DNA, 13 bp, Homo sapiens
aatgctgtaaata

SEQ ID NO: 3833200 - DNA, 14 bp, Homo sapiens
aatgctgtaaatat

SEQ ID NO: 3833201 - DNA, 16 bp, Homo sapiens
aatgctgtatgtcatt

SEQ ID NO: 3833202 - DNA, 19 bp, Homo sapiens
aatgctgtatgtcattaaa

SEQ ID NO: 3833203 - DNA, 22 bp, Homo sapiens
aatgctttaaaaactatttaac

SEQ ID NO: 3833204 - DNA, 23 bp, Homo sapiens
aatgctttaaaaactatttaact

SEQ ID NO: 3833205 - DNA, 19 bp, Homo sapiens
aatggcatgaaccccaggc

SEQ ID NO: 3833206 - DNA, 19 bp, Homo sapiens
aatgggagaggcaataaat

SEQ ID NO: 3833207 - DNA, 15 bp, Homo sapiens
aatgggggggcggct

SEQ ID NO: 3833208 - DNA, 22 bp, Homo sapiens
aatggtctcatctcctttgcta

SEQ ID NO: 3833209 - DNA, 16 bp, Homo sapiens
aatgtaaagtctagaa

SEQ ID NO: 3833210 - DNA, 17 bp, Homo sapiens
aatgtatttttgtaaat

SEQ ID NO: 3833211 - DNA, 19 bp, Homo sapiens
aatgtatttttgtaaatag

SEQ ID NO: 3833212 - DNA, 12 bp, Homo sapiens
aatgtgagcaca

SEQ ID NO: 3833213 - DNA, 12 bp, Homo sapiens
aatgttacaaaa

SEQ ID NO: 3833214 - DNA, 15 bp, Homo sapiens
aatgttacaaaaaaa

SEQ ID NO: 3833215 - DNA, 22 bp, Homo sapiens
aatgttagaagaggcctttgga

SEQ ID NO: 3833216 - DNA, 20 bp, Homo sapiens
aatgttaggggtatttaatg

SEQ ID NO: 3833217 - DNA, 14 bp, Homo sapiens
aatgttctgggaag

SEQ ID NO: 3833218 - DNA, 13 bp, Homo sapiens
aatgttttacaac

SEQ ID NO: 3833219 - DNA, 15 bp, Homo sapiens
aatgtttttttttaa

SEQ ID NO: 3833220 - DNA, 22 bp, Homo sapiens
aatgtttttttttaaagacttt

SEQ ID NO: 3833221 - DNA, 23 bp, Homo sapiens
aattaacaaagtgtcactccata

SEQ ID NO: 3833222 - DNA, 12 bp, Homo sapiens
aattaagaaaga

SEQ ID NO: 3833223 - DNA, 13 bp, Homo sapiens
aattaagaaagat

SEQ ID NO: 3833224 - DNA, 14 bp, Homo sapiens
aattaagaaagatt

SEQ ID NO: 3833225 - DNA, 20 bp, Homo sapiens
aattaagaaagattaaatat

SEQ ID NO: 3833226 - DNA, 21 bp, Homo sapiens
aattaagaaaggataaagttg

SEQ ID NO: 3833227 - DNA, 16 bp, Homo sapiens
aattaattaacatcaa

SEQ ID NO: 3833228 - DNA, 19 bp, Homo sapiens
aattaccttttttgttgtt

SEQ ID NO: 3833229 - DNA, 16 bp, Homo sapiens
aattaggaaggccatg

SEQ ID NO: 3833230 - DNA, 16 bp, Homo sapiens
aattatcaagctaata

SEQ ID NO: 3833231 - DNA, 19 bp, Homo sapiens
aattatcaagctaataaaa

SEQ ID NO: 3833232 - DNA, 16 bp, Homo sapiens
aattatttttttaaac

SEQ ID NO: 3833233 - DNA, 14 bp, Homo sapiens
aattcatggctttt

SEQ ID NO: 3833234 - DNA, 14 bp, Homo sapiens
aattcgacctgatt

SEQ ID NO: 3833235 - DNA, 12 bp, Homo sapiens
aattctttcttt

SEQ ID NO: 3833236 - DNA, 23 bp, Homo sapiens
aattgagagctttattgctgcat

SEQ ID NO: 3833237 - DNA, 17 bp, Homo sapiens
aattgctcaaaaaagag

SEQ ID NO: 3833238 - DNA, 13 bp, Homo sapiens
aattgtacaaaaa

SEQ ID NO: 3833239 - DNA, 23 bp, Homo sapiens
aattgtacaaaaaagttataaga

SEQ ID NO: 3833240 - DNA, 14 bp, Homo sapiens
aattgtgtctgcag

SEQ ID NO: 3833241 - DNA, 21 bp, Homo sapiens
aattgtgtttataattttaaa

SEQ ID NO: 3833242 - DNA, 17 bp, Homo sapiens
aatttaggggtagaaaa

SEQ ID NO: 3833243 - DNA, 10 bp, Homo sapiens
aatttataac

SEQ ID NO: 3833244 - DNA, 11 bp, Homo sapiens
aatttataaca

SEQ ID NO: 3833245 - DNA, 22 bp, Homo sapiens
aatttataacagttataaagaa

SEQ ID NO: 3833246 - DNA, 12 bp, Homo sapiens
aatttatacaaa

SEQ ID NO: 3833247 - DNA, 19 bp, Homo sapiens
aatttatacaaagaaactt

SEQ ID NO: 3833248 - DNA, 14 bp, Homo sapiens
aatttctcctccct

SEQ ID NO: 3833249 - DNA, 18 bp, Homo sapiens
aatttgaagctcagaaag

SEQ ID NO: 3833250 - DNA, 22 bp, Homo sapiens
aatttgccagttttattttcta

SEQ ID NO: 3833251 - DNA, 13 bp, Homo sapiens
aatttgtttgtgc

SEQ ID NO: 3833252 - DNA, 16 bp, Homo sapiens
aatttgtttgtgcttc

SEQ ID NO: 3833253 - DNA, 12 bp, Homo sapiens
aattttacattt

SEQ ID NO: 3833254 - DNA, 17 bp, Homo sapiens
acaaaacaaacacacac

SEQ ID NO: 3833255 - DNA, 13 bp, Homo sapiens
acaaaacttcctg

SEQ ID NO: 3833256 - DNA, 14 bp, Homo sapiens
acaaacaaaaattg

SEQ ID NO: 3833257 - DNA, 23 bp, Homo sapiens
acaaagaaactttttaataaagt

SEQ ID NO: 3833258 - DNA, 20 bp, Homo sapiens
acaaagaggattagacagta

SEQ ID NO: 3833259 - DNA, 14 bp, Homo sapiens
acaaatgatctagt

SEQ ID NO: 3833260 - DNA, 19 bp, Homo sapiens
acaaatttttacttgaagt

SEQ ID NO: 3833261 - DNA, 14 bp, Homo sapiens
acaaccggatgcca

SEQ ID NO: 3833262 - DNA, 22 bp, Homo sapiens
acaacgcaaacctctccttcct

SEQ ID NO: 3833263 - DNA, 17 bp, Homo sapiens
acaagaaagtttcccca

SEQ ID NO: 3833264 - DNA, 14 bp, Homo sapiens
acaaggctgtgcca

SEQ ID NO: 3833265 - DNA, 13 bp, Homo sapiens
acaagtggcctta

SEQ ID NO: 3833266 - DNA, 13 bp, Homo sapiens
acaagtgtctttt

SEQ ID NO: 3833267 - DNA, 13 bp, Homo sapiens
acaatatatattt

SEQ ID NO: 3833268 - DNA, 20 bp, Homo sapiens
acaatgaagtgttttacaat

SEQ ID NO: 3833269 - DNA, 19 bp, Homo sapiens
acaatgcataatgtcttta

SEQ ID NO: 3833270 - DNA, 16 bp, Homo sapiens
acaattttctgtgcca

SEQ ID NO: 3833271 - DNA, 13 bp, Homo sapiens
acacaaaactttg

SEQ ID NO: 3833272 - DNA, 15 bp, Homo sapiens
acacacacacacaca

SEQ ID NO: 3833273 - DNA, 12 bp, Homo sapiens
acacacacacat

SEQ ID NO: 3833274 - DNA, 20 bp, Homo sapiens
acacacaggaactctgtgtg

SEQ ID NO: 3833275 - DNA, 19 bp, Homo sapiens
acacacgtgcaatttgttt

SEQ ID NO: 3833276 - DNA, 19 bp, Homo sapiens
acacactgtgctttctatt

SEQ ID NO: 3833277 - DNA, 17 bp, Homo sapiens
acacagaaagcctatca

SEQ ID NO: 3833278 - DNA, 17 bp, Homo sapiens
acacagcccagaaggcc

SEQ ID NO: 3833279 - DNA, 23 bp, Homo sapiens
acacagtggccggggctgaagcc

SEQ ID NO: 3833280 - DNA, 15 bp, Homo sapiens
acacatacacacaca

SEQ ID NO: 3833281 - DNA, 17 bp, Homo sapiens
acaccaacactgtaaca

SEQ ID NO: 3833282 - DNA, 13 bp, Homo sapiens
acaccacacccag

SEQ ID NO: 3833283 - DNA, 15 bp, Homo sapiens
acaccacacccagcc

SEQ ID NO: 3833284 - DNA, 17 bp, Homo sapiens
acaccacacccagcctc

SEQ ID NO: 3833285 - DNA, 21 bp, Homo sapiens
acaccacgctggagctgtgta

SEQ ID NO: 3833286 - DNA, 20 bp, Homo sapiens
acaccagtaataaaaagcca

SEQ ID NO: 3833287 - DNA, 21 bp, Homo sapiens
acaccagtaataaaaagccac

SEQ ID NO: 3833288 - DNA, 18 bp, Homo sapiens
acaccatctggcccaggc

SEQ ID NO: 3833289 - DNA, 19 bp, Homo sapiens
acaccatctggcccaggct

SEQ ID NO: 3833290 - DNA, 23 bp, Homo sapiens
acaccatctggcccaggctggcc

SEQ ID NO: 3833291 - DNA, 22 bp, Homo sapiens
acacccactccacaccagtaat

SEQ ID NO: 3833292 - DNA, 13 bp, Homo sapiens
acacccagcctca

SEQ ID NO: 3833293 - DNA, 14 bp, Homo sapiens
acaccccagactcc

SEQ ID NO: 3833294 - DNA, 18 bp, Homo sapiens
acaccccagactccaggc

SEQ ID NO: 3833295 - DNA, 23 bp, Homo sapiens
acacctgagttcacagcttcacc

SEQ ID NO: 3833296 - DNA, 22 bp, Homo sapiens
acacgtctatgcaattgtacaa

SEQ ID NO: 3833297 - DNA, 23 bp, Homo sapiens
acacgtgcaatttgtttgtgctt

SEQ ID NO: 3833298 - DNA, 21 bp, Homo sapiens
acactcgaactcgggagggaa

SEQ ID NO: 3833299 - DNA, 14 bp, Homo sapiens
acactttctttttt

SEQ ID NO: 3833300 - DNA, 18 bp, Homo sapiens
acagaattgtgtctgcag

SEQ ID NO: 3833301 - DNA, 15 bp, Homo sapiens
acagacccccgtcct

SEQ ID NO: 3833302 - DNA, 15 bp, Homo sapiens
acagacctctcccac

SEQ ID NO: 3833303 - DNA, 19 bp, Homo sapiens
acagccaactatggcctgt

SEQ ID NO: 3833304 - DNA, 14 bp, Homo sapiens
acagccccagagca

SEQ ID NO: 3833305 - DNA, 17 bp, Homo sapiens
acagccccagagcaggg

SEQ ID NO: 3833306 - DNA, 23 bp, Homo sapiens
acagccctggaggccgctgctga

SEQ ID NO: 3833307 - DNA, 21 bp, Homo sapiens
acagctccagatgtttctcat

SEQ ID NO: 3833308 - DNA, 22 bp, Homo sapiens
acagctccagatgtttctcatt

SEQ ID NO: 3833309 - DNA, 23 bp, Homo sapiens
acagctccagatgtttctcattt

SEQ ID NO: 3833310 - DNA, 16 bp, Homo sapiens
agatgagtttttcatt

SEQ ID NO: 3833311 - DNA, 24 bp, Homo sapiens
agatgatggggtcagcaggcccag

SEQ ID NO: 3833312 - DNA, 21 bp, Homo sapiens
agatgcatgttactgccaaaa

SEQ ID NO: 3833313 - DNA, 16 bp, Homo sapiens
agatgctggagaagag

SEQ ID NO: 3833314 - DNA, 19 bp, Homo sapiens
agatgctggagaagagagg

SEQ ID NO: 3833315 - DNA, 17 bp, Homo sapiens
agatggaaagaaagcac

SEQ ID NO: 3833316 - DNA, 13 bp, Homo sapiens
agatgggaatgag

SEQ ID NO: 3833317 - DNA, 19 bp, Homo sapiens
agatggtaagacctctgag

SEQ ID NO: 3833318 - DNA, 12 bp, Homo sapiens
agatgtacatgt

SEQ ID NO: 3833319 - DNA, 18 bp, Homo sapiens
agatgtgttcacaatgga

SEQ ID NO: 3833320 - DNA, 18 bp, Homo sapiens
agatgtttctcattttaa

SEQ ID NO: 3833321 - DNA, 22 bp, Homo sapiens
agatgtttctcattttaaacaa

SEQ ID NO: 3833322 - DNA, 13 bp, Homo sapiens
agattaaatatat

SEQ ID NO: 3833323 - DNA, 19 bp, Homo sapiens
agattaaatatatctttgt

SEQ ID NO: 3833324 - DNA, 20 bp, Homo sapiens
agattaaatatatctttgta

SEQ ID NO: 3833325 - DNA, 22 bp, Homo sapiens
agattaaatatatctttgtaaa

SEQ ID NO: 3833326 - DNA, 13 bp, Homo sapiens
agattataataaa

SEQ ID NO: 3833327 - DNA, 20 bp, Homo sapiens
agattcaggcttgcattaaa

SEQ ID NO: 3833328 - DNA, 13 bp, Homo sapiens
agattcccaggag

SEQ ID NO: 3833329 - DNA, 15 bp, Homo sapiens
agattcccaggagtt

SEQ ID NO: 3833330 - DNA, 16 bp, Homo sapiens
agattcccaggagttc

SEQ ID NO: 3833331 - DNA, 22 bp, Homo sapiens
agattcccaggagttctgctca

SEQ ID NO: 3833332 - DNA, 16 bp, Homo sapiens
agattgagaaggagag

SEQ ID NO: 3833333 - DNA, 18 bp, Homo sapiens
agattgagaaggagagaa

SEQ ID NO: 3833334 - DNA, 14 bp, Homo sapiens
agatttatgcatat

SEQ ID NO: 3833335 - DNA, 23 bp, Homo sapiens
agatttcagtagtttctaagtct

SEQ ID NO: 3833336 - DNA, 22 bp, Homo sapiens
agatttggtttttgtcttgcat

SEQ ID NO: 3833337 - DNA, 14 bp, Homo sapiens
agattttatgtgct

SEQ ID NO: 3833338 - DNA, 22 bp, Homo sapiens
agattttgtgaaatttcatgaa

SEQ ID NO: 3833339 - DNA, 13 bp, Homo sapiens
agcaaaatccctt

SEQ ID NO: 3833340 - DNA, 19 bp, Homo sapiens
agcaaagccccatgctgga

SEQ ID NO: 3833341 - DNA, 23 bp, Homo sapiens
agcaaagccccatgctggagcct

SEQ ID NO: 3833342 - DNA, 15 bp, Homo sapiens
agcaagacgccctct

SEQ ID NO: 3833343 - DNA, 15 bp, Homo sapiens
agcaattttccttga

SEQ ID NO: 3833344 - DNA, 14 bp, Homo sapiens
agcacagctgagga

SEQ ID NO: 3833345 - DNA, 19 bp, Homo sapiens
agcacagctgaggaccctc

SEQ ID NO: 3833346 - DNA, 22 bp, Homo sapiens
agcacctccccagacagggctc

SEQ ID NO: 3833347 - DNA, 17 bp, Homo sapiens
agcacgcgacttctcag

SEQ ID NO: 3833348 - DNA, 11 bp, Homo sapiens
agcagaaataa

SEQ ID NO: 3833349 - DNA, 18 bp, Homo sapiens
agcagagcaagtctgcag

SEQ ID NO: 3833350 - DNA, 20 bp, Homo sapiens
agcagagcaagtctgcaggt

SEQ ID NO: 3833351 - DNA, 16 bp, Homo sapiens
agcagataaggccgag

SEQ ID NO: 3833352 - DNA, 20 bp, Homo sapiens
agcagataaggccgagccca

SEQ ID NO: 3833353 - DNA, 17 bp, Homo sapiens
agcagatggaaagaaag

SEQ ID NO: 3833354 - DNA, 13 bp, Homo sapiens
agcagcccttggc

SEQ ID NO: 3833355 - DNA, 22 bp, Homo sapiens
agcagcccttggccagaagtca

SEQ ID NO: 3833356 - DNA, 20 bp, Homo sapiens
agcaggagattgagaaggag

SEQ ID NO: 3833357 - DNA, 16 bp, Homo sapiens
agcaggctttgtgaga

SEQ ID NO: 3833358 - DNA, 18 bp, Homo sapiens
agcaggctttgtgagaga

SEQ ID NO: 3833359 - DNA, 21 bp, Homo sapiens
agcaggctttgtgagagagga

SEQ ID NO: 3833360 - DNA, 22 bp, Homo sapiens
agcaggctttgtgagagaggac

SEQ ID NO: 3833361 - DNA, 23 bp, Homo sapiens
agcaggctttgtgagagaggacc

SEQ ID NO: 3833362 - DNA, 16 bp, Homo sapiens
agcaggggctacaaga

SEQ ID NO: 3833363 - DNA, 20 bp, Homo sapiens
agcaggggctacaagaggga

SEQ ID NO: 3833364 - DNA, 17 bp, Homo sapiens
agcagggtgttgggata

SEQ ID NO: 3833365 - DNA, 18 bp, Homo sapiens
agcataaacatcacatgg

SEQ ID NO: 3833366 - DNA, 20 bp, Homo sapiens
agcataaacatcacatggca

SEQ ID NO: 3833367 - DNA, 21 bp, Homo sapiens
agcataatacttgctttggaa

SEQ ID NO: 3833368 - DNA, 12 bp, Homo sapiens
agcataattaat

SEQ ID NO: 3833369 - DNA, 19 bp, Homo sapiens
agcatcatccttagaaatc

SEQ ID NO: 3833370 - DNA, 21 bp, Homo sapiens
agcatcctgccttagagccag

SEQ ID NO: 3833371 - DNA, 23 bp, Homo sapiens
agcatcctgccttagagccaggc

SEQ ID NO: 3833372 - DNA, 17 bp, Homo sapiens
agcatcctgctgcttag

SEQ ID NO: 3833373 - DNA, 15 bp, Homo sapiens
agcatctatctcatc

SEQ ID NO: 3833374 - DNA, 15 bp, Homo sapiens
agcattttgagaggc

SEQ ID NO: 3833375 - DNA, 16 bp, Homo sapiens
agcattttgagaggct

SEQ ID NO: 3833376 - DNA, 18 bp, Homo sapiens
agcattttgagaggctga

SEQ ID NO: 3833377 - DNA, 12 bp, Homo sapiens
agccaaagaaaa

SEQ ID NO: 3833378 - DNA, 20 bp, Homo sapiens
agccaagggaaaggggtgct

SEQ ID NO: 3833379 - DNA, 23 bp, Homo sapiens
agccaagggaaaggggtgctttt

SEQ ID NO: 3833380 - DNA, 20 bp, Homo sapiens
agccaagggacacaggagac

SEQ ID NO: 3833381 - DNA, 13 bp, Homo sapiens
agccaagtggggt

SEQ ID NO: 3833382 - DNA, 16 bp, Homo sapiens
agccaagtggggtgct

SEQ ID NO: 3833383 - DNA, 15 bp, Homo sapiens
agccacacagcccag

SEQ ID NO: 3833384 - DNA, 20 bp, Homo sapiens
agccacacagcccagaaggc

SEQ ID NO: 3833385 - DNA, 21 bp, Homo sapiens
agccacacagtggccggggct

SEQ ID NO: 3833386 - DNA, 15 bp, Homo sapiens
agccaccactcctgc

SEQ ID NO: 3833387 - DNA, 18 bp, Homo sapiens
agccaccactcctgcctg

SEQ ID NO: 3833388 - DNA, 19 bp, Homo sapiens
agccaccactcctgcctgc

SEQ ID NO: 3833389 - DNA, 17 bp, Homo sapiens
agccactgctggtgttt

SEQ ID NO: 3833390 - DNA, 17 bp, Homo sapiens
agccagatccccagggc

SEQ ID NO: 3833391 - DNA, 19 bp, Homo sapiens
agccagatccccagggcag

SEQ ID NO: 3833392 - DNA, 12 bp, Homo sapiens
agccagccctgg

SEQ ID NO: 3833393 - DNA, 18 bp, Homo sapiens
agccagccctggcttcca

SEQ ID NO: 3833394 - DNA, 12 bp, Homo sapiens
agccaggcacac

SEQ ID NO: 3833395 - DNA, 18 bp, Homo sapiens
agccaggcacacactgtg

SEQ ID NO: 3833396 - DNA, 16 bp, Homo sapiens
agccaggctatggttg

SEQ ID NO: 3833397 - DNA, 21 bp, Homo sapiens
agccagggggactagcccctg

SEQ ID NO: 3833398 - DNA, 16 bp, Homo sapiens
agccagtgggtgctat

SEQ ID NO: 3833399 - DNA, 23 bp, Homo sapiens
agccatcgccaacttgtctctgt

SEQ ID NO: 3833400 - DNA, 15 bp, Homo sapiens
agcccacaccatctg

SEQ ID NO: 3833401 - DNA, 23 bp, Homo sapiens
agcccacaccatctggcccaggc

SEQ ID NO: 3833402 - DNA, 23 bp, Homo sapiens
agcccaccccgtccatggtgcta

SEQ ID NO: 3833403 - DNA, 14 bp, Homo sapiens
agcccaggagagag

SEQ ID NO: 3833404 - DNA, 18 bp, Homo sapiens
agcccaggagagagaaag

SEQ ID NO: 3833405 - DNA, 13 bp, Homo sapiens
agcccaggcctgg

SEQ ID NO: 3833406 - DNA, 14 bp, Homo sapiens
agcccaggcctggt

SEQ ID NO: 3833407 - DNA, 13 bp, Homo sapiens
agcccatccctgc

SEQ ID NO: 3833408 - DNA, 17 bp, Homo sapiens
agcccatccctgcctgg

SEQ ID NO: 3833409 - DNA, 16 bp, Homo sapiens
agccccacccccagcc

SEQ ID NO: 3833410 - DNA, 17 bp, Homo sapiens
agccccacccccagcca

SEQ ID NO: 3833411 - DNA, 19 bp, Homo sapiens
agccccacccccagccagg

SEQ ID NO: 3833412 - DNA, 20 bp, Homo sapiens
agccccacccccagccaggc

SEQ ID NO: 3833413 - DNA, 12 bp, Homo sapiens
agccccagagca

SEQ ID NO: 3833414 - DNA, 17 bp, Homo sapiens
agccccatgctggagcc

SEQ ID NO: 3833415 - DNA, 23 bp, Homo sapiens
agccccatgctggagcctgtgta

SEQ ID NO: 3833416 - DNA, 22 bp, Homo sapiens
agccccgcagacctccccagcc

SEQ ID NO: 3833417 - DNA, 23 bp, Homo sapiens
agccccgcagacctccccagccc

SEQ ID NO: 3833418 - DNA, 15 bp, Homo sapiens
agcccctagcccagg

SEQ ID NO: 3833419 - DNA, 16 bp, Homo sapiens
agcccctagcccagga

SEQ ID NO: 3833420 - DNA, 19 bp, Homo sapiens
agcccctagcccaggagag

SEQ ID NO: 3833421 - DNA, 16 bp, Homo sapiens
agccctgagctggcct

SEQ ID NO: 3833422 - DNA, 22 bp, Homo sapiens
agccctgagctggcctcacctg

SEQ ID NO: 3833423 - DNA, 11 bp, Homo sapiens
agccctggagg

SEQ ID NO: 3833424 - DNA, 21 bp, Homo sapiens
agccctggaggtgccagcaaa

SEQ ID NO: 3833425 - DNA, 16 bp, Homo sapiens
agcccttagggagagc

SEQ ID NO: 3833426 - DNA, 12 bp, Homo sapiens
agccctttgctg

SEQ ID NO: 3833427 - DNA, 21 bp, Homo sapiens
agccctttgctgttcgcagcc

SEQ ID NO: 3833428 - DNA, 14 bp, Homo sapiens
agccgggcccctgg

SEQ ID NO: 3833429 - DNA, 18 bp, Homo sapiens
agccgggcccctgggctt

SEQ ID NO: 3833430 - DNA, 16 bp, Homo sapiens
agcctatttttatatt

SEQ ID NO: 3833431 - DNA, 15 bp, Homo sapiens
agcctccagtctgct

SEQ ID NO: 3833432 - DNA, 21 bp, Homo sapiens
agcctccagtctgctctcagc

SEQ ID NO: 3833433 - DNA, 11 bp, Homo sapiens
agcctccctct

SEQ ID NO: 3833434 - DNA, 12 bp, Homo sapiens
agcctccctctc

SEQ ID NO: 3833435 - DNA, 17 bp, Homo sapiens
agcctccgagagggaga

SEQ ID NO: 3833436 - DNA, 18 bp, Homo sapiens
agcctccgagagggagag

SEQ ID NO: 3833437 - DNA, 19 bp, Homo sapiens
agcctcgttaggacaaggc

SEQ ID NO: 3833438 - DNA, 21 bp, Homo sapiens
agcctcgttaggacaaggctg

SEQ ID NO: 3833439 - DNA, 16 bp, Homo sapiens
agcctctaacaaatga

SEQ ID NO: 3833440 - DNA, 22 bp, Homo sapiens
agcctgagcaagacgccctctc

SEQ ID NO: 3833441 - DNA, 20 bp, Homo sapiens
agcctgcgggaagctgacct

SEQ ID NO: 3833442 - DNA, 20 bp, Homo sapiens
atctttgttggctcagaaaa

SEQ ID NO: 3833443 - DNA, 16 bp, Homo sapiens
atgaaaactttttaat

SEQ ID NO: 3833444 - DNA, 11 bp, Homo sapiens
atgaactgtgt

SEQ ID NO: 3833445 - DNA, 20 bp, Homo sapiens
atgaagtgttttacaatgat

SEQ ID NO: 3833446 - DNA, 12 bp, Homo sapiens
atgaatccaaat

SEQ ID NO: 3833447 - DNA, 13 bp, Homo sapiens
atgaattttgtaa

SEQ ID NO: 3833448 - DNA, 22 bp, Homo sapiens
atgaattttgtaagtataagaa

SEQ ID NO: 3833449 - DNA, 14 bp, Homo sapiens
atgaccttacattt

SEQ ID NO: 3833450 - DNA, 17 bp, Homo sapiens
atgacggtattatgctt

SEQ ID NO: 3833451 - DNA, 20 bp, Homo sapiens
atgactcaagattcccagga

SEQ ID NO: 3833452 - DNA, 21 bp, Homo sapiens
atgactcaagattcccaggag

SEQ ID NO: 3833453 - DNA, 13 bp, Homo sapiens
atgagagcccctt

SEQ ID NO: 3833454 - DNA, 22 bp, Homo sapiens
atgagtggtgacttaaggagaa

SEQ ID NO: 3833455 - DNA, 13 bp, Homo sapiens
atgagtttttaaa

SEQ ID NO: 3833456 - DNA, 20 bp, Homo sapiens
atgatggcccattctacttg

SEQ ID NO: 3833457 - DNA, 14 bp, Homo sapiens
atgatggggtcagc

SEQ ID NO: 3833458 - DNA, 20 bp, Homo sapiens
atgatttgcattttttaaat

SEQ ID NO: 3833459 - DNA, 17 bp, Homo sapiens
atgatttgtaaaggact

SEQ ID NO: 3833460 - DNA, 21 bp, Homo sapiens
atgatttgtaaaggactattt

SEQ ID NO: 3833461 - DNA, 18 bp, Homo sapiens
atgcaaataaagcctgct

SEQ ID NO: 3833462 - DNA, 14 bp, Homo sapiens
atgcaacctctgcc

SEQ ID NO: 3833463 - DNA, 20 bp, Homo sapiens
atgcaattgtacaaaaaagt

SEQ ID NO: 3833464 - DNA, 12 bp, Homo sapiens
atgcacagttct

SEQ ID NO: 3833465 - DNA, 19 bp, Homo sapiens
atgcacagttctatttgct

SEQ ID NO: 3833466 - DNA, 20 bp, Homo sapiens
atgcacagttctatttgcta

SEQ ID NO: 3833467 - DNA, 21 bp, Homo sapiens
atgcacagttctatttgctat

SEQ ID NO: 3833468 - DNA, 17 bp, Homo sapiens
atgcatgagctattgct

SEQ ID NO: 3833469 - DNA, 17 bp, Homo sapiens
atgccacaagacataat

SEQ ID NO: 3833470 - DNA, 17 bp, Homo sapiens
atgccattttatttctt

SEQ ID NO: 3833471 - DNA, 12 bp, Homo sapiens
atgcccaccccc

SEQ ID NO: 3833472 - DNA, 16 bp, Homo sapiens
atgcccccgccacctc

SEQ ID NO: 3833473 - DNA, 17 bp, Homo sapiens
atgccccggccacctct

SEQ ID NO: 3833474 - DNA, 19 bp, Homo sapiens
atgcctcgagccatagagc

SEQ ID NO: 3833475 - DNA, 17 bp, Homo sapiens
atgcctgttgcaggcaa

SEQ ID NO: 3833476 - DNA, 17 bp, Homo sapiens
atgccttaattaaagaa

SEQ ID NO: 3833477 - DNA, 14 bp, Homo sapiens
atgcgtctctggcc

SEQ ID NO: 3833478 - DNA, 20 bp, Homo sapiens
atgctaagggcaggcccaaa

SEQ ID NO: 3833479 - DNA, 12 bp, Homo sapiens
atgctcaaatga

SEQ ID NO: 3833480 - DNA, 21 bp, Homo sapiens
atgctgcatttggctggagcc

SEQ ID NO: 3833481 - DNA, 22 bp, Homo sapiens
atgctgcatttggctggagccc

SEQ ID NO: 3833482 - DNA, 14 bp, Homo sapiens
atgctggagaagag

SEQ ID NO: 3833483 - DNA, 13 bp, Homo sapiens
atgctggagcctg

SEQ ID NO: 3833484 - DNA, 14 bp, Homo sapiens
atgctggagcctgt

SEQ ID NO: 3833485 - DNA, 16 bp, Homo sapiens
atgctggagcctgtgt

SEQ ID NO: 3833486 - DNA, 15 bp, Homo sapiens
atgctgtaaatattt

SEQ ID NO: 3833487 - DNA, 14 bp, Homo sapiens
atgctgtatgtcat

SEQ ID NO: 3833488 - DNA, 19 bp, Homo sapiens
atgctgtatgtcattaaag

SEQ ID NO: 3833489 - DNA, 12 bp, Homo sapiens
atgcttcttgga

SEQ ID NO: 3833490 - DNA, 18 bp, Homo sapiens
atggaacgcattttgggt

SEQ ID NO: 3833491 - DNA, 16 bp, Homo sapiens
atggaccttctctcca

SEQ ID NO: 3833492 - DNA, 12 bp, Homo sapiens
atggagcccagg

SEQ ID NO: 3833493 - DNA, 13 bp, Homo sapiens
atggagcccaggc

SEQ ID NO: 3833494 - DNA, 23 bp, Homo sapiens
atggagcccaggcgggagcggtg

SEQ ID NO: 3833495 - DNA, 18 bp, Homo sapiens
atggatcatgtccccctt

SEQ ID NO: 3833496 - DNA, 16 bp, Homo sapiens
atggcatgttttgtca

SEQ ID NO: 3833497 - DNA, 14 bp, Homo sapiens
atggccaggtacaa

SEQ ID NO: 3833498 - DNA, 17 bp, Homo sapiens
atggcccattctacttg

SEQ ID NO: 3833499 - DNA, 19 bp, Homo sapiens
atggcccattctacttgct

SEQ ID NO: 3833500 - DNA, 24 bp, Homo sapiens
atggcccattctacttgctctgga

SEQ ID NO: 3833501 - DNA, 15 bp, Homo sapiens
atggccgttggccac

SEQ ID NO: 3833502 - DNA, 23 bp, Homo sapiens
atggctttttctttttttgcata

SEQ ID NO: 3833503 - DNA, 23 bp, Homo sapiens
atgggagaggcaataaataaatg

SEQ ID NO: 3833504 - DNA, 20 bp, Homo sapiens
atgggagggggcttgaagcc

SEQ ID NO: 3833505 - DNA, 22 bp, Homo sapiens
atgggagggggcttgaagccaa

SEQ ID NO: 3833506 - DNA, 23 bp, Homo sapiens
atgggagggggcttgaagccaaa

SEQ ID NO: 3833507 - DNA, 12 bp, Homo sapiens
atggggagctgg

SEQ ID NO: 3833508 - DNA, 13 bp, Homo sapiens
atggggagctggc

SEQ ID NO: 3833509 - DNA, 15 bp, Homo sapiens
atggggcagcctcca

SEQ ID NO: 3833510 - DNA, 17 bp, Homo sapiens
atggtaagacctctgag

SEQ ID NO: 3833511 - DNA, 23 bp, Homo sapiens
atggtctcatctcctttgctagt

SEQ ID NO: 3833512 - DNA, 15 bp, Homo sapiens
atggtgcctgagagg

SEQ ID NO: 3833513 - DNA, 16 bp, Homo sapiens
atggtgctaatgtgtc

SEQ ID NO: 3833514 - DNA, 17 bp, Homo sapiens
atggtgctaatgtgtct

SEQ ID NO: 3833515 - DNA, 17 bp, Homo sapiens
atggtggggcccccagc

SEQ ID NO: 3833516 - DNA, 23 bp, Homo sapiens
atggtggggcccccagcaccctc

SEQ ID NO: 3833517 - DNA, 13 bp, Homo sapiens
atggttgccaccc

SEQ ID NO: 3833518 - DNA, 22 bp, Homo sapiens
atggttttgttttcaatgaatt

SEQ ID NO: 3833519 - DNA, 16 bp, Homo sapiens
atgtaaaatcttgata

SEQ ID NO: 3833520 - DNA, 22 bp, Homo sapiens
atgtaaaatcttgatagctaaa

SEQ ID NO: 3833521 - DNA, 13 bp, Homo sapiens
atgtacaaaactt

SEQ ID NO: 3833522 - DNA, 13 bp, Homo sapiens
atgtacacatttt

SEQ ID NO: 3833523 - DNA, 15 bp, Homo sapiens
atgtatataaaatgt

SEQ ID NO: 3833524 - DNA, 17 bp, Homo sapiens
atgtatataaaatgtgc

SEQ ID NO: 3833525 - DNA, 14 bp, Homo sapiens
atgtatgaattttg

SEQ ID NO: 3833526 - DNA, 18 bp, Homo sapiens
atgtatgaattttgtaag

SEQ ID NO: 3833527 - DNA, 22 bp, Homo sapiens
atgtatgtgtgacaagtgtgtc

SEQ ID NO: 3833528 - DNA, 15 bp, Homo sapiens
atgtattaactgaaa

SEQ ID NO: 3833529 - DNA, 20 bp, Homo sapiens
atgtcacggctactctatat

SEQ ID NO: 3833530 - DNA, 23 bp, Homo sapiens
atgtctgaaaaatgcctgctgct

SEQ ID NO: 3833531 - DNA, 18 bp, Homo sapiens
atgtgaaactcatctcat

SEQ ID NO: 3833532 - DNA, 13 bp, Homo sapiens
atgtgagcacaat

SEQ ID NO: 3833533 - DNA, 17 bp, Homo sapiens
atgtgaggggaatctgg

SEQ ID NO: 3833534 - DNA, 22 bp, Homo sapiens
atgtgccttctagaatacatat

SEQ ID NO: 3833535 - DNA, 14 bp, Homo sapiens
atgtgtctgtggac

SEQ ID NO: 3833536 - DNA, 23 bp, Homo sapiens
atgtgttgagcgtattcttgaaa

SEQ ID NO: 3833537 - DNA, 13 bp, Homo sapiens
atgttactgccaa

SEQ ID NO: 3833538 - DNA, 16 bp, Homo sapiens
atgttaggggtattta

SEQ ID NO: 3833539 - DNA, 20 bp, Homo sapiens
atgttagttttgctccttct

SEQ ID NO: 3833540 - DNA, 15 bp, Homo sapiens
atgttccaataaaca

SEQ ID NO: 3833541 - DNA, 16 bp, Homo sapiens
atgttccaataaacag

SEQ ID NO: 3833542 - DNA, 15 bp, Homo sapiens
atgtttaggaaattt

SEQ ID NO: 3833543 - DNA, 15 bp, Homo sapiens
atgtttctcatttta

SEQ ID NO: 3833544 - DNA, 21 bp, Homo sapiens
attaaaaagaagtttctatat

SEQ ID NO: 3833545 - DNA, 15 bp, Homo sapiens
attaaaatatttgcc

SEQ ID NO: 3833546 - DNA, 15 bp, Homo sapiens
attaaagataagact

SEQ ID NO: 3833547 - DNA, 17 bp, Homo sapiens
attaaagataagacttc

SEQ ID NO: 3833548 - DNA, 17 bp, Homo sapiens
attaaagtgcactgtgt

SEQ ID NO: 3833549 - DNA, 16 bp, Homo sapiens
attaaatatatctttg

SEQ ID NO: 3833550 - DNA, 18 bp, Homo sapiens
attaaatatatctttgta

SEQ ID NO: 3833551 - DNA, 19 bp, Homo sapiens
attaagaaagattaaatat

SEQ ID NO: 3833552 - DNA, 22 bp, Homo sapiens
attaagaaagattaaatatatc

SEQ ID NO: 3833553 - DNA, 13 bp, Homo sapiens
attaagcttaaaa

SEQ ID NO: 3833554 - DNA, 15 bp, Homo sapiens
attaagtatatttgt

SEQ ID NO: 3833555 - DNA, 16 bp, Homo sapiens
attaagtatatttgta

SEQ ID NO: 3833556 - DNA, 19 bp, Homo sapiens
attaagtatatttgtaaaa

SEQ ID NO: 3833557 - DNA, 23 bp, Homo sapiens
attaagtatatttgtaaaagcta

SEQ ID NO: 3833558 - DNA, 24 bp, Homo sapiens
attaagtatatttgtaaaagctaa

SEQ ID NO: 3833559 - DNA, 19 bp, Homo sapiens
attaagtgaaattttaaat

SEQ ID NO: 3833560 - DNA, 14 bp, Homo sapiens
attaatgctaaggg

SEQ ID NO: 3833561 - DNA, 18 bp, Homo sapiens
attaccaaattacatgaa

SEQ ID NO: 3833562 - DNA, 16 bp, Homo sapiens
attatagtactgcttt

SEQ ID NO: 3833563 - DNA, 13 bp, Homo sapiens
attatcaagctaa

SEQ ID NO: 3833564 - DNA, 16 bp, Homo sapiens
attatcaagctaataa

SEQ ID NO: 3833565 - DNA, 17 bp, Homo sapiens
attatgcagaatacttt

SEQ ID NO: 3833566 - DNA, 19 bp, Homo sapiens
attatgccctcttctcaca

SEQ ID NO: 3833567 - DNA, 13 bp, Homo sapiens
attatgtgccaga

SEQ ID NO: 3833568 - DNA, 15 bp, Homo sapiens
attatgtgtgtttta

SEQ ID NO: 3833569 - DNA, 16 bp, Homo sapiens
attattttaaaatcaa

SEQ ID NO: 3833570 - DNA, 16 bp, Homo sapiens
attattttatgtcata

SEQ ID NO: 3833571 - DNA, 16 bp, Homo sapiens
attatttttttaaact

SEQ ID NO: 3833572 - DNA, 16 bp, Homo sapiens
attcacatgctggctc

SEQ ID NO: 3833573 - DNA, 18 bp, Homo sapiens
attcacatgctggctcct

SEQ ID NO: 3833574 - DNA, 14 bp, Homo sapiens
attcagctcatgga

SEQ ID NO: 3833575 - DNA, 16 bp, Homo sapiens
caacctgtaataaata

SEQ ID NO: 3833576 - DNA, 18 bp, Homo sapiens
caacctgtaataaatatg

SEQ ID NO: 3833577 - DNA, 19 bp, Homo sapiens
caacctgtaataaatatga

SEQ ID NO: 3833578 - DNA, 13 bp, Homo sapiens
caactatggcctg

SEQ ID NO: 3833579 - DNA, 14 bp, Homo sapiens
caactatggcctgt

SEQ ID NO: 3833580 - DNA, 22 bp, Homo sapiens
caactccacgaggtgaaaaata

SEQ ID NO: 3833581 - DNA, 14 bp, Homo sapiens
caactgaagataac

SEQ ID NO: 3833582 - DNA, 19 bp, Homo sapiens
caactttcccttgccctgg

SEQ ID NO: 3833583 - DNA, 21 bp, Homo sapiens
caagaaacaatgtctggggac

SEQ ID NO: 3833584 - DNA, 13 bp, Homo sapiens
caagaactcctcc

SEQ ID NO: 3833585 - DNA, 15 bp, Homo sapiens
caagaactcctccca

SEQ ID NO: 3833586 - DNA, 16 bp, Homo sapiens
caagagaccaactttt

SEQ ID NO: 3833587 - DNA, 16 bp, Homo sapiens
caagagggaatccccg

SEQ ID NO: 3833588 - DNA, 17 bp, Homo sapiens
caagagggggtggaggg

SEQ ID NO: 3833589 - DNA, 18 bp, Homo sapiens
caagaggtgcctgggagg

SEQ ID NO: 3833590 - DNA, 15 bp, Homo sapiens
caagattcccaggag

SEQ ID NO: 3833591 - DNA, 21 bp, Homo sapiens
caagattcccaggagttctgc

SEQ ID NO: 3833592 - DNA, 17 bp, Homo sapiens
caagcaaatgtgaatca

SEQ ID NO: 3833593 - DNA, 22 bp, Homo sapiens
caagcagtagcaggacgatgat

SEQ ID NO: 3833594 - DNA, 15 bp, Homo sapiens
caagccctttgctgt

SEQ ID NO: 3833595 - DNA, 19 bp, Homo sapiens
caagccctttgctgttcgc

SEQ ID NO: 3833596 - DNA, 16 bp, Homo sapiens
caagccggcccaaccc

SEQ ID NO: 3833597 - DNA, 22 bp, Homo sapiens
caagctaataaaatatcattca

SEQ ID NO: 3833598 - DNA, 14 bp, Homo sapiens
caagctcttctcct

SEQ ID NO: 3833599 - DNA, 16 bp, Homo sapiens
caagctcttctcctca

SEQ ID NO: 3833600 - DNA, 23 bp, Homo sapiens
caagctcttctcctcagcttggg

SEQ ID NO: 3833601 - DNA, 15 bp, Homo sapiens
caaggacctgcctcc

SEQ ID NO: 3833602 - DNA, 16 bp, Homo sapiens
caaggacctgcctccc

SEQ ID NO: 3833603 - DNA, 12 bp, Homo sapiens
caagggaaaggg

SEQ ID NO: 3833604 - DNA, 14 bp, Homo sapiens
caaggggcagccag

SEQ ID NO: 3833605 - DNA, 20 bp, Homo sapiens
caaggggcagccagccctgg

SEQ ID NO: 3833606 - DNA, 14 bp, Homo sapiens
caaggtcaggaggc

SEQ ID NO: 3833607 - DNA, 18 bp, Homo sapiens
caaggtctggcctcaggt

SEQ ID NO: 3833608 - DNA, 17 bp, Homo sapiens
caaggtgtttaagtaat

SEQ ID NO: 3833609 - DNA, 20 bp, Homo sapiens
caagtaatcctgcacagatc

SEQ ID NO: 3833610 - DNA, 14 bp, Homo sapiens
caagtattaaactg

SEQ ID NO: 3833611 - DNA, 22 bp, Homo sapiens
caagtattaaactgtaaatcat

SEQ ID NO: 3833612 - DNA, 17 bp, Homo sapiens
caagtctgcaggtgcac

SEQ ID NO: 3833613 - DNA, 21 bp, Homo sapiens
caagtggggtgctgggaggag

SEQ ID NO: 3833614 - DNA, 17 bp, Homo sapiens
caagtggttaagaatgt

SEQ ID NO: 3833615 - DNA, 23 bp, Homo sapiens
caagtgtaattagcttttggaga

SEQ ID NO: 3833616 - DNA, 12 bp, Homo sapiens
caataaagagat

SEQ ID NO: 3833617 - DNA, 21 bp, Homo sapiens
caataaagcacgcagttatgt

SEQ ID NO: 3833618 - DNA, 13 bp, Homo sapiens
caataaataaatg

SEQ ID NO: 3833619 - DNA, 14 bp, Homo sapiens
caataaataaatgt

SEQ ID NO: 3833620 - DNA, 12 bp, Homo sapiens
caataaatgctc

SEQ ID NO: 3833621 - DNA, 17 bp, Homo sapiens
caatacactagttgttt

SEQ ID NO: 3833622 - DNA, 20 bp, Homo sapiens
caatagtgcaactgttttga

SEQ ID NO: 3833623 - DNA, 15 bp, Homo sapiens
caatattgagcagtt

SEQ ID NO: 3833624 - DNA, 15 bp, Homo sapiens
caatcagaagaaagg

SEQ ID NO: 3833625 - DNA, 14 bp, Homo sapiens
caatcatgtgccag

SEQ ID NO: 3833626 - DNA, 21 bp, Homo sapiens
caatcattgtacagtttgttt

SEQ ID NO: 3833627 - DNA, 19 bp, Homo sapiens
caatccaaattccctctgg

SEQ ID NO: 3833628 - DNA, 15 bp, Homo sapiens
caatgaattaagaaa

SEQ ID NO: 3833629 - DNA, 14 bp, Homo sapiens
caatgatttgtaaa

SEQ ID NO: 3833630 - DNA, 22 bp, Homo sapiens
caatgggggggcggctgagctc

SEQ ID NO: 3833631 - DNA, 22 bp, Homo sapiens
caatgtttattgggcaataaaa

SEQ ID NO: 3833632 - DNA, 14 bp, Homo sapiens
caattgtacaaaaa

SEQ ID NO: 3833633 - DNA, 15 bp, Homo sapiens
caatttcaatggtgt

SEQ ID NO: 3833634 - DNA, 13 bp, Homo sapiens
caattttccttga

SEQ ID NO: 3833635 - DNA, 12 bp, Homo sapiens
cacaaaactttg

SEQ ID NO: 3833636 - DNA, 22 bp, Homo sapiens
cacaaaattatgctgcatttgg

SEQ ID NO: 3833637 - DNA, 13 bp, Homo sapiens
cacaacgctgctg

SEQ ID NO: 3833638 - DNA, 21 bp, Homo sapiens
cacaagacataatttaaaata

SEQ ID NO: 3833639 - DNA, 22 bp, Homo sapiens
cacaagcaaaaaaaaaaaaaag

SEQ ID NO: 3833640 - DNA, 14 bp, Homo sapiens
cacacacaaaactt

SEQ ID NO: 3833641 - DNA, 11 bp, Homo sapiens
cacacacacac

SEQ ID NO: 3833642 - DNA, 13 bp, Homo sapiens
cacacacacacaa

SEQ ID NO: 3833643 - DNA, 22 bp, Homo sapiens
cacacactgtgctttctattgt

SEQ ID NO: 3833644 - DNA, 16 bp, Homo sapiens
cacacagcccagaagg

SEQ ID NO: 3833645 - DNA, 13 bp, Homo sapiens
cacacagcctgtg

SEQ ID NO: 3833646 - DNA, 20 bp, Homo sapiens
cacacaggaactctgtgtga

SEQ ID NO: 3833647 - DNA, 19 bp, Homo sapiens
cacacagtggccggggctg

SEQ ID NO: 3833648 - DNA, 22 bp, Homo sapiens
cacaccagtaataaaaagccac

SEQ ID NO: 3833649 - DNA, 12 bp, Homo sapiens
cacacccagcct

SEQ ID NO: 3833650 - DNA, 14 bp, Homo sapiens
cacacccagcctca

SEQ ID NO: 3833651 - DNA, 19 bp, Homo sapiens
cacacccagcctcagtcct

SEQ ID NO: 3833652 - DNA, 20 bp, Homo sapiens
cacaccccagactccaggcc

SEQ ID NO: 3833653 - DNA, 22 bp, Homo sapiens
cacaccccagactccaggcccc

SEQ ID NO: 3833654 - DNA, 19 bp, Homo sapiens
cacacggcaatcagaagaa

SEQ ID NO: 3833655 - DNA, 19 bp, Homo sapiens
cacactaaaacattgtcta

SEQ ID NO: 3833656 - DNA, 18 bp, Homo sapiens
cacactccacctccagca

SEQ ID NO: 3833657 - DNA, 14 bp, Homo sapiens
cacactgtgctttc

SEQ ID NO: 3833658 - DNA, 15 bp, Homo sapiens
cacactgtgctttct

SEQ ID NO: 3833659 - DNA, 23 bp, Homo sapiens
cacactgtgctttctattgtaca

SEQ ID NO: 3833660 - DNA, 18 bp, Homo sapiens
cacagaaagcctatcaaa

SEQ ID NO: 3833661 - DNA, 16 bp, Homo sapiens
cacagacctctcccac

SEQ ID NO: 3833662 - DNA, 12 bp, Homo sapiens
cacagcccagaa

SEQ ID NO: 3833663 - DNA, 19 bp, Homo sapiens
cacagcccagaaggccaga

SEQ ID NO: 3833664 - DNA, 17 bp, Homo sapiens
cacagcctctgacccct

SEQ ID NO: 3833665 - DNA, 23 bp, Homo sapiens
cacagcctctgacccctcctcac

SEQ ID NO: 3833666 - DNA, 16 bp, Homo sapiens
cacagctgaggaccct

SEQ ID NO: 3833667 - DNA, 13 bp, Homo sapiens
cacaggaaaccag

SEQ ID NO: 3833668 - DNA, 16 bp, Homo sapiens
cacaggaactctgtgt

SEQ ID NO: 3833669 - DNA, 15 bp, Homo sapiens
cacaggagaccaccc

SEQ ID NO: 3833670 - DNA, 16 bp, Homo sapiens
cacaggagaccacccc

SEQ ID NO: 3833671 - DNA, 17 bp, Homo sapiens
cacaggagaccaccccc

SEQ ID NO: 3833672 - DNA, 20 bp, Homo sapiens
cacaggcagttacttctgag

SEQ ID NO: 3833673 - DNA, 23 bp, Homo sapiens
cacaggccctttcctcaggcaag

SEQ ID NO: 3833674 - DNA, 23 bp, Homo sapiens
cacagggcatgccccggccacct

SEQ ID NO: 3833675 - DNA, 17 bp, Homo sapiens
cacagttctatttgcta

SEQ ID NO: 3833676 - DNA, 18 bp, Homo sapiens
cacatcttcatgtggaca

SEQ ID NO: 3833677 - DNA, 20 bp, Homo sapiens
cacatcttgatctgctcagc

SEQ ID NO: 3833678 - DNA, 20 bp, Homo sapiens
cacatgcaccacgcccggct

SEQ ID NO: 3833679 - DNA, 13 bp, Homo sapiens
cacatgctggctc

SEQ ID NO: 3833680 - DNA, 18 bp, Homo sapiens
cacatggcagatgatttg

SEQ ID NO: 3833681 - DNA, 18 bp, Homo sapiens
cacattacattaacattt

SEQ ID NO: 3833682 - DNA, 16 bp, Homo sapiens
cacattcacaaagaaa

SEQ ID NO: 3833683 - DNA, 13 bp, Homo sapiens
cacattttgtaat

SEQ ID NO: 3833684 - DNA, 14 bp, Homo sapiens
caccaacacacagg

SEQ ID NO: 3833685 - DNA, 16 bp, Homo sapiens
caccaagtattaaact

SEQ ID NO: 3833686 - DNA, 21 bp, Homo sapiens
caccaagtattaaactgtaaa

SEQ ID NO: 3833687 - DNA, 23 bp, Homo sapiens
caccacaggccctttcctcaggc

SEQ ID NO: 3833688 - DNA, 14 bp, Homo sapiens
caccactcctgcct

SEQ ID NO: 3833689 - DNA, 19 bp, Homo sapiens
caccagagaccgtcctcac

SEQ ID NO: 3833690 - DNA, 20 bp, Homo sapiens
caccagagaccgtcctcacc

SEQ ID NO: 3833691 - DNA, 20 bp, Homo sapiens
caccagtgaatgaaagtctt

SEQ ID NO: 3833692 - DNA, 17 bp, Homo sapiens
caccatctggcccaggc

SEQ ID NO: 3833693 - DNA, 13 bp, Homo sapiens
cacccaccgtgga

SEQ ID NO: 3833694 - DNA, 16 bp, Homo sapiens
cacccaccgtggagga

SEQ ID NO: 3833695 - DNA, 17 bp, Homo sapiens
cacccaccttccttgcg

SEQ ID NO: 3833696 - DNA, 16 bp, Homo sapiens
cacccagagctgccta

SEQ ID NO: 3833697 - DNA, 11 bp, Homo sapiens
cacccagcctc

SEQ ID NO: 3833698 - DNA, 14 bp, Homo sapiens
cacccagcctcagt

SEQ ID NO: 3833699 - DNA, 14 bp, Homo sapiens
cacccatggcctca

SEQ ID NO: 3833700 - DNA, 14 bp, Homo sapiens
caccccagactcca

SEQ ID NO: 3833701 - DNA, 15 bp, Homo sapiens
caccccagactccag

SEQ ID NO: 3833702 - DNA, 18 bp, Homo sapiens
caccccagactccaggcc

SEQ ID NO: 3833703 - DNA, 19 bp, Homo sapiens
caccccaggcagctcctgt

SEQ ID NO: 3833704 - DNA, 20 bp, Homo sapiens
caccccaggcagctcctgtt

SEQ ID NO: 3833705 - DNA, 13 bp, Homo sapiens
cacccccagccag

SEQ ID NO: 3833706 - DNA, 14 bp, Homo sapiens
cacccctccccact

SEQ ID NO: 3833707 - DNA, 20 bp, Homo sapiens
cacccctgtcctcactgctc

SEQ ID NO: 3833708 - DNA, 17 bp, Homo sapiens
cattcccccggtgcctc

SEQ ID NO: 3833709 - DNA, 13 bp, Homo sapiens
cattctacttgct

SEQ ID NO: 3833710 - DNA, 14 bp, Homo sapiens
cattctacttgctc

SEQ ID NO: 3833711 - DNA, 15 bp, Homo sapiens
cattctacttgctct

SEQ ID NO: 3833712 - DNA, 23 bp, Homo sapiens
cattctacttgctctggacctgc

SEQ ID NO: 3833713 - DNA, 15 bp, Homo sapiens
cattctcccaggtac

SEQ ID NO: 3833714 - DNA, 21 bp, Homo sapiens
cattctcccaggtaccagctg

SEQ ID NO: 3833715 - DNA, 22 bp, Homo sapiens
cattctcttactttttgtaaat

SEQ ID NO: 3833716 - DNA, 23 bp, Homo sapiens
cattgagattcacatgctggctc

SEQ ID NO: 3833717 - DNA, 18 bp, Homo sapiens
cattgcgttattttcttt

SEQ ID NO: 3833718 - DNA, 16 bp, Homo sapiens
cattgctaccaagttt

SEQ ID NO: 3833719 - DNA, 15 bp, Homo sapiens
cattggcctctgtct

SEQ ID NO: 3833720 - DNA, 14 bp, Homo sapiens
cattgtacagtttg

SEQ ID NO: 3833721 - DNA, 22 bp, Homo sapiens
cattgtacagtttgtttacaca

SEQ ID NO: 3833722 - DNA, 22 bp, Homo sapiens
cattgtatggatagtaaaattc

SEQ ID NO: 3833723 - DNA, 14 bp, Homo sapiens
cattgttttgcatc

SEQ ID NO: 3833724 - DNA, 15 bp, Homo sapiens
catttaatcaggagg

SEQ ID NO: 3833725 - DNA, 19 bp, Homo sapiens
catttcatatatctatatg

SEQ ID NO: 3833726 - DNA, 14 bp, Homo sapiens
catttcatgctttg

SEQ ID NO: 3833727 - DNA, 13 bp, Homo sapiens
catttctttatat

SEQ ID NO: 3833728 - DNA, 15 bp, Homo sapiens
catttgtaaaaagta

SEQ ID NO: 3833729 - DNA, 22 bp, Homo sapiens
catttgtctattctccagctga

SEQ ID NO: 3833730 - DNA, 11 bp, Homo sapiens
cattttctgca

SEQ ID NO: 3833731 - DNA, 15 bp, Homo sapiens
cattttctgcaagcc

SEQ ID NO: 3833732 - DNA, 19 bp, Homo sapiens
cattttgggttgtttaaaa

SEQ ID NO: 3833733 - DNA, 14 bp, Homo sapiens
cattttttaaaaca

SEQ ID NO: 3833734 - DNA, 15 bp, Homo sapiens
catttttttccttta

SEQ ID NO: 3833735 - DNA, 15 bp, Homo sapiens
ccaaaccctgtcctc

SEQ ID NO: 3833736 - DNA, 20 bp, Homo sapiens
ccaaaccctgtcctcccacc

SEQ ID NO: 3833737 - DNA, 17 bp, Homo sapiens
ccaaagagggcttcctc

SEQ ID NO: 3833738 - DNA, 19 bp, Homo sapiens
ccaaagatctgctcctcgc

SEQ ID NO: 3833739 - DNA, 18 bp, Homo sapiens
ccaaagcagctacaataa

SEQ ID NO: 3833740 - DNA, 23 bp, Homo sapiens
ccaaagggagggtggcagagaca

SEQ ID NO: 3833741 - DNA, 22 bp, Homo sapiens
ccaaatagcctctcctttgtag

SEQ ID NO: 3833742 - DNA, 22 bp, Homo sapiens
ccaaatgctttaaaaactattt

SEQ ID NO: 3833743 - DNA, 14 bp, Homo sapiens
ccaaatgtgaaaga

SEQ ID NO: 3833744 - DNA, 22 bp, Homo sapiens
ccaaattatcaagctaataaaa

SEQ ID NO: 3833745 - DNA, 13 bp, Homo sapiens
ccaacacacagga

SEQ ID NO: 3833746 - DNA, 14 bp, Homo sapiens
ccaacacacaggaa

SEQ ID NO: 3833747 - DNA, 14 bp, Homo sapiens
ccaacccaataaaa

SEQ ID NO: 3833748 - DNA, 16 bp, Homo sapiens
ccaacctgtaataaat

SEQ ID NO: 3833749 - DNA, 14 bp, Homo sapiens
ccaactatggcctg

SEQ ID NO: 3833750 - DNA, 17 bp, Homo sapiens
ccaacttgtctctgtag

SEQ ID NO: 3833751 - DNA, 16 bp, Homo sapiens
ccaaggacctgcctcc

SEQ ID NO: 3833752 - DNA, 16 bp, Homo sapiens
ccaaggctcctgacct

SEQ ID NO: 3833753 - DNA, 22 bp, Homo sapiens
ccaagggaaaggggtgctttta

SEQ ID NO: 3833754 - DNA, 15 bp, Homo sapiens
ccaagggacacagga

SEQ ID NO: 3833755 - DNA, 17 bp, Homo sapiens
ccaagggacacaggaga

SEQ ID NO: 3833756 - DNA, 20 bp, Homo sapiens
ccaagggacacaggagacca

SEQ ID NO: 3833757 - DNA, 16 bp, Homo sapiens
ccaagtggggtgctgg

SEQ ID NO: 3833758 - DNA, 22 bp, Homo sapiens
ccaagttagctattgggagcaa

SEQ ID NO: 3833759 - DNA, 13 bp, Homo sapiens
ccaataaacagga

SEQ ID NO: 3833760 - DNA, 19 bp, Homo sapiens
ccacaaaattatgctgcat

SEQ ID NO: 3833761 - DNA, 20 bp, Homo sapiens
ccacaagacataatttaaaa

SEQ ID NO: 3833762 - DNA, 12 bp, Homo sapiens
ccacacagccca

SEQ ID NO: 3833763 - DNA, 19 bp, Homo sapiens
ccacacagtggccggggct

SEQ ID NO: 3833764 - DNA, 12 bp, Homo sapiens
ccacaccatctg

SEQ ID NO: 3833765 - DNA, 21 bp, Homo sapiens
ccacaccatctggcccaggct

SEQ ID NO: 3833766 - DNA, 18 bp, Homo sapiens
ccacacccactccacacc

SEQ ID NO: 3833767 - DNA, 12 bp, Homo sapiens
ccacacccagcc

SEQ ID NO: 3833768 - DNA, 23 bp, Homo sapiens
ccacacggcaatcagaagaaagg

SEQ ID NO: 3833769 - DNA, 23 bp, Homo sapiens
ccacatctgccttaaaaccaaag

SEQ ID NO: 3833770 - DNA, 22 bp, Homo sapiens
ccacatcttgatctgctcagcc

SEQ ID NO: 3833771 - DNA, 23 bp, Homo sapiens
ccacatcttgatctgctcagccc

SEQ ID NO: 3833772 - DNA, 16 bp, Homo sapiens
ccaccaacacacagga

SEQ ID NO: 3833773 - DNA, 17 bp, Homo sapiens
ccaccactcctgcctgc

SEQ ID NO: 3833774 - DNA, 18 bp, Homo sapiens
ccaccactcctgcctgcc

SEQ ID NO: 3833775 - DNA, 21 bp, Homo sapiens
ccaccagagaccgtcctcacc

SEQ ID NO: 3833776 - DNA, 22 bp, Homo sapiens
ccaccagagaccgtcctcaccc

SEQ ID NO: 3833777 - DNA, 12 bp, Homo sapiens
ccaccagagctg

SEQ ID NO: 3833778 - DNA, 12 bp, Homo sapiens
ccacccccagcc

SEQ ID NO: 3833779 - DNA, 13 bp, Homo sapiens
ccacccccagcca

SEQ ID NO: 3833780 - DNA, 17 bp, Homo sapiens
ccacccccagccaggct

SEQ ID NO: 3833781 - DNA, 21 bp, Homo sapiens
ccacccccgagcttgcctcag

SEQ ID NO: 3833782 - DNA, 19 bp, Homo sapiens
ccaccccctccttccctgt

SEQ ID NO: 3833783 - DNA, 20 bp, Homo sapiens
ccaccccgggctctcctgcc

SEQ ID NO: 3833784 - DNA, 18 bp, Homo sapiens
ccaccccggggaccctgt

SEQ ID NO: 3833785 - DNA, 20 bp, Homo sapiens
ccaccccggggaccctgtga

SEQ ID NO: 3833786 - DNA, 13 bp, Homo sapiens
ccacccctgcccc

SEQ ID NO: 3833787 - DNA, 16 bp, Homo sapiens
ccaccctgctgctgct

SEQ ID NO: 3833788 - DNA, 13 bp, Homo sapiens
ccacctccccacg

SEQ ID NO: 3833789 - DNA, 17 bp, Homo sapiens
ccacctccccacgccct

SEQ ID NO: 3833790 - DNA, 18 bp, Homo sapiens
ccacctccccactccagc

SEQ ID NO: 3833791 - DNA, 11 bp, Homo sapiens
ccacctctgcg

SEQ ID NO: 3833792 - DNA, 13 bp, Homo sapiens
ccacctctgcgga

SEQ ID NO: 3833793 - DNA, 22 bp, Homo sapiens
ccacctctgcggaccccagctg

SEQ ID NO: 3833794 - DNA, 22 bp, Homo sapiens
ccacctctgtgacctcaggcac

SEQ ID NO: 3833795 - DNA, 21 bp, Homo sapiens
ccacgccctcccctcccctgc

SEQ ID NO: 3833796 - DNA, 13 bp, Homo sapiens
ccactacacctgg

SEQ ID NO: 3833797 - DNA, 17 bp, Homo sapiens
ccactacacctggctga

SEQ ID NO: 3833798 - DNA, 14 bp, Homo sapiens
ccactcctgcctgc

SEQ ID NO: 3833799 - DNA, 21 bp, Homo sapiens
ccactcggggcccccatcttg

SEQ ID NO: 3833800 - DNA, 16 bp, Homo sapiens
ccactgatttagccat

SEQ ID NO: 3833801 - DNA, 21 bp, Homo sapiens
ccacttctgtgtagacatggt

SEQ ID NO: 3833802 - DNA, 20 bp, Homo sapiens
ccacttgggactagatcaca

SEQ ID NO: 3833803 - DNA, 18 bp, Homo sapiens
ccacttgtccattgcgtt

SEQ ID NO: 3833804 - DNA, 15 bp, Homo sapiens
ccagaaaaggcagcc

SEQ ID NO: 3833805 - DNA, 19 bp, Homo sapiens
ccagaaaaggcagccagat

SEQ ID NO: 3833806 - DNA, 12 bp, Homo sapiens
ccagacagggct

SEQ ID NO: 3833807 - DNA, 19 bp, Homo sapiens
ccagacagggctccagcct

SEQ ID NO: 3833808 - DNA, 22 bp, Homo sapiens
ccagacagggctccagcctgtc

SEQ ID NO: 3833809 - DNA, 16 bp, Homo sapiens
ccagactccaggcccc

SEQ ID NO: 3833810 - DNA, 18 bp, Homo sapiens
ccagactccaggcccccg

SEQ ID NO: 3833811 - DNA, 19 bp, Homo sapiens
ccagagaagcctattttta

SEQ ID NO: 3833812 - DNA, 12 bp, Homo sapiens
ccagaggccagg

SEQ ID NO: 3833813 - DNA, 13 bp, Homo sapiens
ccagaggccagga

SEQ ID NO: 3833814 - DNA, 20 bp, Homo sapiens
ccagaggtcacacagcctgt

SEQ ID NO: 3833815 - DNA, 14 bp, Homo sapiens
ccagagttgggggc

SEQ ID NO: 3833816 - DNA, 13 bp, Homo sapiens
ccagatccccagg

SEQ ID NO: 3833817 - DNA, 22 bp, Homo sapiens
ccagatccccagggcagcctcg

SEQ ID NO: 3833818 - DNA, 23 bp, Homo sapiens
ccagatccccagggcagcctcgt

SEQ ID NO: 3833819 - DNA, 13 bp, Homo sapiens
ccagatctgtcct

SEQ ID NO: 3833820 - DNA, 15 bp, Homo sapiens
ccagatctgtcctgg

SEQ ID NO: 3833821 - DNA, 17 bp, Homo sapiens
ccagatctgtcctgggg

SEQ ID NO: 3833822 - DNA, 14 bp, Homo sapiens
ccagcaaagcccca

SEQ ID NO: 3833823 - DNA, 22 bp, Homo sapiens
ccagcacagctgaggaccctca

SEQ ID NO: 3833824 - DNA, 20 bp, Homo sapiens
ccagcagataaggccgagcc

SEQ ID NO: 3833825 - DNA, 22 bp, Homo sapiens
ccagccaggctatggttgccac

SEQ ID NO: 3833826 - DNA, 10 bp, Homo sapiens
ccagcccagg

SEQ ID NO: 3833827 - DNA, 11 bp, Homo sapiens
ccagcccaggc

SEQ ID NO: 3833828 - DNA, 17 bp, Homo sapiens
ccagcccaggcctggtg

SEQ ID NO: 3833829 - DNA, 14 bp, Homo sapiens
ccagcccagggtgg

SEQ ID NO: 3833830 - DNA, 21 bp, Homo sapiens
ccagccccacccccagccagg

SEQ ID NO: 3833831 - DNA, 16 bp, Homo sapiens
ccagccccgtgccagg

SEQ ID NO: 3833832 - DNA, 15 bp, Homo sapiens
ccagcccctagccca

SEQ ID NO: 3833833 - DNA, 11 bp, Homo sapiens
ccagccctgca

SEQ ID NO: 3833834 - DNA, 12 bp, Homo sapiens
ccagcctcagtc

SEQ ID NO: 3833835 - DNA, 19 bp, Homo sapiens
ccagcctcagtcctcccct

SEQ ID NO: 3833836 - DNA, 13 bp, Homo sapiens
ccagcctcctctg

SEQ ID NO: 3833837 - DNA, 14 bp, Homo sapiens
ccagcctcctctgg

SEQ ID NO: 3833838 - DNA, 19 bp, Homo sapiens
ccagcctgcgggaagctga

SEQ ID NO: 3833839 - DNA, 23 bp, Homo sapiens
ccagcctggcctgtggctgccct

SEQ ID NO: 3833840 - DNA, 18 bp, Homo sapiens
ccagcctgtcggccacac

SEQ ID NO: 3833841 - DNA, 14 bp, Homo sapiens
ccctgcttccagga

SEQ ID NO: 3833842 - DNA, 17 bp, Homo sapiens
ccctgctttgccccact

SEQ ID NO: 3833843 - DNA, 23 bp, Homo sapiens
ccctgctttgccccactgggaga

SEQ ID NO: 3833844 - DNA, 13 bp, Homo sapiens
ccctggaggtgcc

SEQ ID NO: 3833845 - DNA, 14 bp, Homo sapiens
ccctggaggtgcca

SEQ ID NO: 3833846 - DNA, 16 bp, Homo sapiens
ccctggaggtgccagc

SEQ ID NO: 3833847 - DNA, 18 bp, Homo sapiens
ccctggctgctgccccca

SEQ ID NO: 3833848 - DNA, 23 bp, Homo sapiens
ccctgggcgcagctgaagcctgg

SEQ ID NO: 3833849 - DNA, 21 bp, Homo sapiens
ccctgggctgcctcctcctga

SEQ ID NO: 3833850 - DNA, 23 bp, Homo sapiens
ccctgggctgggcccttcctggc

SEQ ID NO: 3833851 - DNA, 18 bp, Homo sapiens
ccctgggcttggcctgct

SEQ ID NO: 3833852 - DNA, 22 bp, Homo sapiens
ccctgggcttggcctgctgtga

SEQ ID NO: 3833853 - DNA, 10 bp, Homo sapiens
ccctgtccct

SEQ ID NO: 3833854 - DNA, 15 bp, Homo sapiens
ccctgtccctcccac

SEQ ID NO: 3833855 - DNA, 17 bp, Homo sapiens
ccctgtccctcccacct

SEQ ID NO: 3833856 - DNA, 18 bp, Homo sapiens
ccctgtccctcccacctc

SEQ ID NO: 3833857 - DNA, 21 bp, Homo sapiens
ccctgtccctcccacctctgt

SEQ ID NO: 3833858 - DNA, 22 bp, Homo sapiens
ccctgtccctcccacctctgtg

SEQ ID NO: 3833859 - DNA, 24 bp, Homo sapiens
ccctgtccctcccacctctgtgac

SEQ ID NO: 3833860 - DNA, 19 bp, Homo sapiens
ccctgtgacatggtgcctg

SEQ ID NO: 3833861 - DNA, 22 bp, Homo sapiens
ccctgtgacatggtgcctgaga

SEQ ID NO: 3833862 - DNA, 22 bp, Homo sapiens
cccttccccagagatggctcct

SEQ ID NO: 3833863 - DNA, 18 bp, Homo sapiens
cccttccttttccctgct

SEQ ID NO: 3833864 - DNA, 12 bp, Homo sapiens
cccttgcctccc

SEQ ID NO: 3833865 - DNA, 14 bp, Homo sapiens
ccctttcctcaggc

SEQ ID NO: 3833866 - DNA, 13 bp, Homo sapiens
ccctttggggata

SEQ ID NO: 3833867 - DNA, 22 bp, Homo sapiens
ccctttggggatagtctggaaa

SEQ ID NO: 3833868 - DNA, 15 bp, Homo sapiens
ccgacctcagagagt

SEQ ID NO: 3833869 - DNA, 16 bp, Homo sapiens
ccgagcccacaccatc

SEQ ID NO: 3833870 - DNA, 20 bp, Homo sapiens
ccgagcttgcctcagggcca

SEQ ID NO: 3833871 - DNA, 20 bp, Homo sapiens
ccgaggcgggcggatcacga

SEQ ID NO: 3833872 - DNA, 22 bp, Homo sapiens
ccgatgtgagccgcctcggagt

SEQ ID NO: 3833873 - DNA, 14 bp, Homo sapiens
ccgcatcccctgcc

SEQ ID NO: 3833874 - DNA, 22 bp, Homo sapiens
ccgcatcccctgcctccatcct

SEQ ID NO: 3833875 - DNA, 14 bp, Homo sapiens
ccgccacctcccca

SEQ ID NO: 3833876 - DNA, 14 bp, Homo sapiens
ccgccagcctcctc

SEQ ID NO: 3833877 - DNA, 21 bp, Homo sapiens
ccgcccttgccgaaccaggag

SEQ ID NO: 3833878 - DNA, 17 bp, Homo sapiens
ccgccgtggtgacccct

SEQ ID NO: 3833879 - DNA, 21 bp, Homo sapiens
ccgcctcggagtgtggcctgg

SEQ ID NO: 3833880 - DNA, 14 bp, Homo sapiens
ccgctcccggttcc

SEQ ID NO: 3833881 - DNA, 12 bp, Homo sapiens
ccggatgccagc

SEQ ID NO: 3833882 - DNA, 13 bp, Homo sapiens
ccggccacctctg

SEQ ID NO: 3833883 - DNA, 11 bp, Homo sapiens
ccggcctggac

SEQ ID NO: 3833884 - DNA, 12 bp, Homo sapiens
ccggcctggacc

SEQ ID NO: 3833885 - DNA, 14 bp, Homo sapiens
ccgggcccctgggc

SEQ ID NO: 3833886 - DNA, 16 bp, Homo sapiens
ccgggctctcctgccc

SEQ ID NO: 3833887 - DNA, 16 bp, Homo sapiens
ccggttccctccccag

SEQ ID NO: 3833888 - DNA, 20 bp, Homo sapiens
ccggttccctccccagctcc

SEQ ID NO: 3833889 - DNA, 17 bp, Homo sapiens
ccgtactgtctgtgtcc

SEQ ID NO: 3833890 - DNA, 11 bp, Homo sapiens
ccgtcctcacc

SEQ ID NO: 3833891 - DNA, 23 bp, Homo sapiens
ccgtcctcacccctgtcctcact

SEQ ID NO: 3833892 - DNA, 15 bp, Homo sapiens
ccgtgcttcctcagt

SEQ ID NO: 3833893 - DNA, 23 bp, Homo sapiens
ccgtggaggaggaaggcaagagg

SEQ ID NO: 3833894 - DNA, 14 bp, Homo sapiens
ccgtggtgacccct

SEQ ID NO: 3833895 - DNA, 15 bp, Homo sapiens
cctaaaactctgcca

SEQ ID NO: 3833896 - DNA, 14 bp, Homo sapiens
cctaaggcccagct

SEQ ID NO: 3833897 - DNA, 15 bp, Homo sapiens
cctaaggcccagctg

SEQ ID NO: 3833898 - DNA, 16 bp, Homo sapiens
cctaaggcccagctgc

SEQ ID NO: 3833899 - DNA, 17 bp, Homo sapiens
cctaaggcccagctgcc

SEQ ID NO: 3833900 - DNA, 18 bp, Homo sapiens
cctaaggcccagctgcca

SEQ ID NO: 3833901 - DNA, 16 bp, Homo sapiens
cctaatttctcctccc

SEQ ID NO: 3833902 - DNA, 17 bp, Homo sapiens
cctaatttctcctccct

SEQ ID NO: 3833903 - DNA, 21 bp, Homo sapiens
cctacccagtccccattttct

SEQ ID NO: 3833904 - DNA, 22 bp, Homo sapiens
cctacccagtccccattttctg

SEQ ID NO: 3833905 - DNA, 19 bp, Homo sapiens
cctactgcccctgccctga

SEQ ID NO: 3833906 - DNA, 20 bp, Homo sapiens
cctactgcccctgccctgag

SEQ ID NO: 3833907 - DNA, 11 bp, Homo sapiens
cctagcccagg

SEQ ID NO: 3833908 - DNA, 15 bp, Homo sapiens
cctagcccaggagag

SEQ ID NO: 3833909 - DNA, 18 bp, Homo sapiens
cctagcccaggagagaga

SEQ ID NO: 3833910 - DNA, 20 bp, Homo sapiens
cctagcccaggagagagaaa

SEQ ID NO: 3833911 - DNA, 16 bp, Homo sapiens
cctagctggagtgcca

SEQ ID NO: 3833912 - DNA, 23 bp, Homo sapiens
cctagctttagaccctgggtggg

SEQ ID NO: 3833913 - DNA, 14 bp, Homo sapiens
cctaggcagccagc

SEQ ID NO: 3833914 - DNA, 21 bp, Homo sapiens
cctaggcagccagctacaggc

SEQ ID NO: 3833915 - DNA, 19 bp, Homo sapiens
cctaggtgggagccaccac

SEQ ID NO: 3833916 - DNA, 20 bp, Homo sapiens
cctaggtgggagccaccact

SEQ ID NO: 3833917 - DNA, 15 bp, Homo sapiens
cctataattttgcaa

SEQ ID NO: 3833918 - DNA, 22 bp, Homo sapiens
cctatcaatccaaattccctct

SEQ ID NO: 3833919 - DNA, 21 bp, Homo sapiens
cctatttttgtagatgctatt

SEQ ID NO: 3833920 - DNA, 12 bp, Homo sapiens
cctcacagcctc

SEQ ID NO: 3833921 - DNA, 14 bp, Homo sapiens
cctcacagcctctg

SEQ ID NO: 3833922 - DNA, 22 bp, Homo sapiens
cctcacagcctctgacccctcc

SEQ ID NO: 3833923 - DNA, 19 bp, Homo sapiens
cctcacccctgtcctcact

SEQ ID NO: 3833924 - DNA, 15 bp, Homo sapiens
cctcacctcatgccc

SEQ ID NO: 3833925 - DNA, 16 bp, Homo sapiens
cctcacctcatgccca

SEQ ID NO: 3833926 - DNA, 22 bp, Homo sapiens
cctcacctcatgcccaccccct

SEQ ID NO: 3833927 - DNA, 16 bp, Homo sapiens
cctcactgctccctga

SEQ ID NO: 3833928 - DNA, 21 bp, Homo sapiens
cctcactgctccctgaagcca

SEQ ID NO: 3833929 - DNA, 15 bp, Homo sapiens
cctcactggccatcc

SEQ ID NO: 3833930 - DNA, 18 bp, Homo sapiens
cctcactggccatccctc

SEQ ID NO: 3833931 - DNA, 14 bp, Homo sapiens
cctcagccccagga

SEQ ID NO: 3833932 - DNA, 21 bp, Homo sapiens
cctcagccccaggagaaggga

SEQ ID NO: 3833933 - DNA, 20 bp, Homo sapiens
cctcaggcaaggtctggcct

SEQ ID NO: 3833934 - DNA, 15 bp, Homo sapiens
cctcaggcactagcc

SEQ ID NO: 3833935 - DNA, 18 bp, Homo sapiens
cctcaggcactagccttt

SEQ ID NO: 3833936 - DNA, 15 bp, Homo sapiens
cctcaggtgggccgc

SEQ ID NO: 3833937 - DNA, 11 bp, Homo sapiens
cctcagtcctc

SEQ ID NO: 3833938 - DNA, 22 bp, Homo sapiens
cctcatgcccaccccctgccct

SEQ ID NO: 3833939 - DNA, 23 bp, Homo sapiens
cctcatgcccaccccctgccctg

SEQ ID NO: 3833940 - DNA, 22 bp, Homo sapiens
cctccagcacgcgacttctcag

SEQ ID NO: 3833941 - DNA, 19 bp, Homo sapiens
cctccagtctgctctcagc

SEQ ID NO: 3833942 - DNA, 16 bp, Homo sapiens
cctccatcccttcccc

SEQ ID NO: 3833943 - DNA, 17 bp, Homo sapiens
cctccatcccttcccca

SEQ ID NO: 3833944 - DNA, 20 bp, Homo sapiens
cctccatcccttccccagag

SEQ ID NO: 3833945 - DNA, 23 bp, Homo sapiens
cctccatgcccccgccacctccc

SEQ ID NO: 3833946 - DNA, 12 bp, Homo sapiens
cctcccacctct

SEQ ID NO: 3833947 - DNA, 15 bp, Homo sapiens
cctcccacctctgtg

SEQ ID NO: 3833948 - DNA, 19 bp, Homo sapiens
cctcccacctctgtgacct

SEQ ID NO: 3833949 - DNA, 13 bp, Homo sapiens
cctccccacgccc

SEQ ID NO: 3833950 - DNA, 15 bp, Homo sapiens
cctccccacgccctc

SEQ ID NO: 3833951 - DNA, 14 bp, Homo sapiens
cctccccactccag

SEQ ID NO: 3833952 - DNA, 14 bp, Homo sapiens
cctccccagacagg

SEQ ID NO: 3833953 - DNA, 17 bp, Homo sapiens
cctccccagacagggct

SEQ ID NO: 3833954 - DNA, 21 bp, Homo sapiens
cctccccagacagggctccag

SEQ ID NO: 3833955 - DNA, 14 bp, Homo sapiens
cctccccagcccct

SEQ ID NO: 3833956 - DNA, 21 bp, Homo sapiens
cctccccatttcccatctgca

SEQ ID NO: 3833957 - DNA, 16 bp, Homo sapiens
cctcccctcacagcct

SEQ ID NO: 3833958 - DNA, 18 bp, Homo sapiens
cctcccctcacagcctct

SEQ ID NO: 3833959 - DNA, 14 bp, Homo sapiens
cctcccctcccctg

SEQ ID NO: 3833960 - DNA, 12 bp, Homo sapiens
cctcccctgctg

SEQ ID NO: 3833961 - DNA, 15 bp, Homo sapiens
cctcccttccttttc

SEQ ID NO: 3833962 - DNA, 17 bp, Homo sapiens
cctccggggctcagccc

SEQ ID NO: 3833963 - DNA, 19 bp, Homo sapiens
cctccggggctcagccctg

SEQ ID NO: 3833964 - DNA, 15 bp, Homo sapiens
cctcctcacctcatg

SEQ ID NO: 3833965 - DNA, 19 bp, Homo sapiens
cctcctcacctcatgccca

SEQ ID NO: 3833966 - DNA, 14 bp, Homo sapiens
cctcctcactggcc

SEQ ID NO: 3833967 - DNA, 15 bp, Homo sapiens
cctcctcactggcca

SEQ ID NO: 3833968 - DNA, 13 bp, Homo sapiens
cctcctcagggat

SEQ ID NO: 3833969 - DNA, 13 bp, Homo sapiens
cctcctcctagct

SEQ ID NO: 3833970 - DNA, 21 bp, Homo sapiens
cctcctctggacggcaggctc

SEQ ID NO: 3833971 - DNA, 22 bp, Homo sapiens
cctcctctggacggcaggctca

SEQ ID NO: 3833972 - DNA, 14 bp, Homo sapiens
cctcctgagagctg

SEQ ID NO: 3833973 - DNA, 21 bp, Homo sapiens
cctgtgacatggtgcctgaga

SEQ ID NO: 3833974 - DNA, 22 bp, Homo sapiens
cctgtgacatggtgcctgagag

SEQ ID NO: 3833975 - DNA, 22 bp, Homo sapiens
cctgtgagctaggaattgtgtt

SEQ ID NO: 3833976 - DNA, 20 bp, Homo sapiens
cctgtgtaacagctccttgg

SEQ ID NO: 3833977 - DNA, 21 bp, Homo sapiens
cctgtgtaacagctccttggg

SEQ ID NO: 3833978 - DNA, 22 bp, Homo sapiens
cctgtgtaacaggaccccaagg

SEQ ID NO: 3833979 - DNA, 15 bp, Homo sapiens
cctgtgtagccagtg

SEQ ID NO: 3833980 - DNA, 12 bp, Homo sapiens
cctgtgtctttt

SEQ ID NO: 3833981 - DNA, 13 bp, Homo sapiens
cctgtgtcttttt

SEQ ID NO: 3833982 - DNA, 13 bp, Homo sapiens
cctgttgtgtgcc

SEQ ID NO: 3833983 - DNA, 16 bp, Homo sapiens
cctgttgtgtgcctga

SEQ ID NO: 3833984 - DNA, 12 bp, Homo sapiens
cctgtttaagag

SEQ ID NO: 3833985 - DNA, 21 bp, Homo sapiens
cctgtttggaaatggggagct

SEQ ID NO: 3833986 - DNA, 14 bp, Homo sapiens
ccttaatctatgtg

SEQ ID NO: 3833987 - DNA, 15 bp, Homo sapiens
ccttaattaaagaat

SEQ ID NO: 3833988 - DNA, 17 bp, Homo sapiens
ccttaccgagagccaaa

SEQ ID NO: 3833989 - DNA, 15 bp, Homo sapiens
ccttagagccaggca

SEQ ID NO: 3833990 - DNA, 15 bp, Homo sapiens
ccttagagtgctgtg

SEQ ID NO: 3833991 - DNA, 18 bp, Homo sapiens
ccttccctttccttcccc

SEQ ID NO: 3833992 - DNA, 19 bp, Homo sapiens
ccttccctttccttccccc

SEQ ID NO: 3833993 - DNA, 18 bp, Homo sapiens
ccttccttgcgaccacca

SEQ ID NO: 3833994 - DNA, 21 bp, Homo sapiens
ccttccttgcgaccaccaaca

SEQ ID NO: 3833995 - DNA, 15 bp, Homo sapiens
ccttccttttccctg

SEQ ID NO: 3833996 - DNA, 16 bp, Homo sapiens
ccttccttttccctgc

SEQ ID NO: 3833997 - DNA, 20 bp, Homo sapiens
ccttctctagtttcccctct

SEQ ID NO: 3833998 - DNA, 17 bp, Homo sapiens
ccttctggattcttggc

SEQ ID NO: 3833999 - DNA, 19 bp, Homo sapiens
ccttctggattcttggccc

SEQ ID NO: 3834000 - DNA, 18 bp, Homo sapiens
ccttcttccatcccagga

SEQ ID NO: 3834001 - DNA, 22 bp, Homo sapiens
ccttcttccatcccaggacacc

SEQ ID NO: 3834002 - DNA, 11 bp, Homo sapiens
ccttgaagccg

SEQ ID NO: 3834003 - DNA, 19 bp, Homo sapiens
ccttgccctgggctgcctc

SEQ ID NO: 3834004 - DNA, 15 bp, Homo sapiens
ccttggccctacagc

SEQ ID NO: 3834005 - DNA, 14 bp, Homo sapiens
ccttgggaggaagc

SEQ ID NO: 3834006 - DNA, 19 bp, Homo sapiens
ccttgggaggaagcagaat

SEQ ID NO: 3834007 - DNA, 21 bp, Homo sapiens
ccttgggaggaagcagaataa

SEQ ID NO: 3834008 - DNA, 22 bp, Homo sapiens
ccttgggaggaagcagaataaa

SEQ ID NO: 3834009 - DNA, 20 bp, Homo sapiens
ccttggtgattaaggtcctg

SEQ ID NO: 3834010 - DNA, 18 bp, Homo sapiens
ccttgtaaattccccttc

SEQ ID NO: 3834011 - DNA, 10 bp, Homo sapiens
cctttataat

SEQ ID NO: 3834012 - DNA, 12 bp, Homo sapiens
cctttccccagc

SEQ ID NO: 3834013 - DNA, 11 bp, Homo sapiens
cctttctggcc

SEQ ID NO: 3834014 - DNA, 14 bp, Homo sapiens
cctttgacaaaggt

SEQ ID NO: 3834015 - DNA, 12 bp, Homo sapiens
cctttgctgttc

SEQ ID NO: 3834016 - DNA, 20 bp, Homo sapiens
cctttgctgttcgcagcctc

SEQ ID NO: 3834017 - DNA, 15 bp, Homo sapiens
cctttggctctggag

SEQ ID NO: 3834018 - DNA, 19 bp, Homo sapiens
cgaattatttttttaaact

SEQ ID NO: 3834019 - DNA, 20 bp, Homo sapiens
cgaattatttttttaaactt

SEQ ID NO: 3834020 - DNA, 22 bp, Homo sapiens
cgacatagcccatccctgcctg

SEQ ID NO: 3834021 - DNA, 13 bp, Homo sapiens
cgacggaaaagtc

SEQ ID NO: 3834022 - DNA, 18 bp, Homo sapiens
cgactcagcaactttccc

SEQ ID NO: 3834023 - DNA, 14 bp, Homo sapiens
cgacttctcaggac

SEQ ID NO: 3834024 - DNA, 13 bp, Homo sapiens
cgagcaccctcat

SEQ ID NO: 3834025 - DNA, 16 bp, Homo sapiens
cgagcccacaccatct

SEQ ID NO: 3834026 - DNA, 18 bp, Homo sapiens
cgagcccacaccatctgg

SEQ ID NO: 3834027 - DNA, 21 bp, Homo sapiens
cgagcccacaccatctggccc

SEQ ID NO: 3834028 - DNA, 14 bp, Homo sapiens
cgagcttgcctcag

SEQ ID NO: 3834029 - DNA, 13 bp, Homo sapiens
cgaggatcctggt

SEQ ID NO: 3834030 - DNA, 17 bp, Homo sapiens
cgagggtcgtgagccca

SEQ ID NO: 3834031 - DNA, 16 bp, Homo sapiens
cgatagtgacacatct

SEQ ID NO: 3834032 - DNA, 18 bp, Homo sapiens
cgcaaacctctccttcct

SEQ ID NO: 3834033 - DNA, 13 bp, Homo sapiens
cgcacagagctgg

SEQ ID NO: 3834034 - DNA, 16 bp, Homo sapiens
cgcactagcctccctc

SEQ ID NO: 3834035 - DNA, 17 bp, Homo sapiens
cgcactagcctccctct

SEQ ID NO: 3834036 - DNA, 18 bp, Homo sapiens
cgcactagcctccctctc

SEQ ID NO: 3834037 - DNA, 16 bp, Homo sapiens
cgcagacctccccagc

SEQ ID NO: 3834038 - DNA, 18 bp, Homo sapiens
cgcagacctccccagccc

SEQ ID NO: 3834039 - DNA, 19 bp, Homo sapiens
cgcagacctccccagcccc

SEQ ID NO: 3834040 - DNA, 16 bp, Homo sapiens
cgcagctgaagcctgg

SEQ ID NO: 3834041 - DNA, 17 bp, Homo sapiens
cgcagctgaagcctgga

SEQ ID NO: 3834042 - DNA, 22 bp, Homo sapiens
cgcagggccctctggggctcag

SEQ ID NO: 3834043 - DNA, 20 bp, Homo sapiens
cgcaggggcgctggctgcac

SEQ ID NO: 3834044 - DNA, 14 bp, Homo sapiens
cgcatcccctgcct

SEQ ID NO: 3834045 - DNA, 16 bp, Homo sapiens
cgcatcccctgcctcc

SEQ ID NO: 3834046 - DNA, 19 bp, Homo sapiens
cgccacctccccactccag

SEQ ID NO: 3834047 - DNA, 15 bp, Homo sapiens
cgccagcctcctctg

SEQ ID NO: 3834048 - DNA, 21 bp, Homo sapiens
cgccagcctcctctggacggc

SEQ ID NO: 3834049 - DNA, 11 bp, Homo sapiens
cgcccacctcc

SEQ ID NO: 3834050 - DNA, 18 bp, Homo sapiens
cgcccagcccaggcctgg

SEQ ID NO: 3834051 - DNA, 18 bp, Homo sapiens
cgcccccatgcagtgacc

SEQ ID NO: 3834052 - DNA, 15 bp, Homo sapiens
cgcccgcctctgcct

SEQ ID NO: 3834053 - DNA, 17 bp, Homo sapiens
cgcccgcctctgcctcc

SEQ ID NO: 3834054 - DNA, 14 bp, Homo sapiens
cgccctcccctccc

SEQ ID NO: 3834055 - DNA, 16 bp, Homo sapiens
cgccctcccctcccct

SEQ ID NO: 3834056 - DNA, 18 bp, Homo sapiens
cgccctcccctcccctgc

SEQ ID NO: 3834057 - DNA, 20 bp, Homo sapiens
cgccctcccctcccctgctg

SEQ ID NO: 3834058 - DNA, 13 bp, Homo sapiens
cgccctccctcct

SEQ ID NO: 3834059 - DNA, 17 bp, Homo sapiens
cgcctcggagtgtggcc

SEQ ID NO: 3834060 - DNA, 18 bp, Homo sapiens
cgcctcggagtgtggcct

SEQ ID NO: 3834061 - DNA, 20 bp, Homo sapiens
cgcctcggagtgtggcctgg

SEQ ID NO: 3834062 - DNA, 13 bp, Homo sapiens
cgcctctgcctcc

SEQ ID NO: 3834063 - DNA, 16 bp, Homo sapiens
cgcgacttctcaggac

SEQ ID NO: 3834064 - DNA, 23 bp, Homo sapiens
cgcgtgtgtgggtggatataaat

SEQ ID NO: 3834065 - DNA, 21 bp, Homo sapiens
cgctaaagagcccttgcctcc

SEQ ID NO: 3834066 - DNA, 19 bp, Homo sapiens
cgctgattcctaaggccca

SEQ ID NO: 3834067 - DNA, 13 bp, Homo sapiens
cgctggctgcact

SEQ ID NO: 3834068 - DNA, 13 bp, Homo sapiens
cggaccccagctg

SEQ ID NO: 3834069 - DNA, 16 bp, Homo sapiens
cggagtgtggcctgga

SEQ ID NO: 3834070 - DNA, 17 bp, Homo sapiens
cggagtgtggcctggat

SEQ ID NO: 3834071 - DNA, 22 bp, Homo sapiens
cggcaccaaaccctgtcctccc

SEQ ID NO: 3834072 - DNA, 18 bp, Homo sapiens
cggcaggctcactgccag

SEQ ID NO: 3834073 - DNA, 19 bp, Homo sapiens
cggcaggctcactgccagg

SEQ ID NO: 3834074 - DNA, 15 bp, Homo sapiens
cggccacaccccaga

SEQ ID NO: 3834075 - DNA, 19 bp, Homo sapiens
cggccacaccccagactcc

SEQ ID NO: 3834076 - DNA, 12 bp, Homo sapiens
cggccacctctg

SEQ ID NO: 3834077 - DNA, 13 bp, Homo sapiens
cggccacctctgc

SEQ ID NO: 3834078 - DNA, 14 bp, Homo sapiens
cggcgactcggccc

SEQ ID NO: 3834079 - DNA, 14 bp, Homo sapiens
cggcttcctcaggg

SEQ ID NO: 3834080 - DNA, 22 bp, Homo sapiens
cgggaaaagcagcccttggcca

SEQ ID NO: 3834081 - DNA, 23 bp, Homo sapiens
cgggcccctgggcttggcctgct

SEQ ID NO: 3834082 - DNA, 15 bp, Homo sapiens
cgggctctcctgccc

SEQ ID NO: 3834083 - DNA, 12 bp, Homo sapiens
cggggaccctgt

SEQ ID NO: 3834084 - DNA, 13 bp, Homo sapiens
cggggctcagccc

SEQ ID NO: 3834085 - DNA, 19 bp, Homo sapiens
cggggctgaagccacacag

SEQ ID NO: 3834086 - DNA, 22 bp, Homo sapiens
cggggctgaagccacacagccc

SEQ ID NO: 3834087 - DNA, 16 bp, Homo sapiens
cggggtccccgtagcc

SEQ ID NO: 3834088 - DNA, 19 bp, Homo sapiens
cggggtccccgtagccccg

SEQ ID NO: 3834089 - DNA, 13 bp, Homo sapiens
cgggtcccagcta

SEQ ID NO: 3834090 - DNA, 14 bp, Homo sapiens
cggtattatgcttc

SEQ ID NO: 3834091 - DNA, 17 bp, Homo sapiens
cggtattatgcttcttg

SEQ ID NO: 3834092 - DNA, 20 bp, Homo sapiens
cggttggaggctctcatgtc

SEQ ID NO: 3834093 - DNA, 14 bp, Homo sapiens
cgtaaaattaagaa

SEQ ID NO: 3834094 - DNA, 16 bp, Homo sapiens
cgtaaacctgaaatat

SEQ ID NO: 3834095 - DNA, 16 bp, Homo sapiens
cgtataaaagcctgtt

SEQ ID NO: 3834096 - DNA, 22 bp, Homo sapiens
cgtataaaagcctgtttaagag

SEQ ID NO: 3834097 - DNA, 22 bp, Homo sapiens
cgtcctcacccctgtcctcact

SEQ ID NO: 3834098 - DNA, 17 bp, Homo sapiens
cgtcctcctcacctcat

SEQ ID NO: 3834099 - DNA, 17 bp, Homo sapiens
cgtctctggccctcgtg

SEQ ID NO: 3834100 - DNA, 13 bp, Homo sapiens
cgtggagaaacaa

SEQ ID NO: 3834101 - DNA, 16 bp, Homo sapiens
cgtggtgacccctgct

SEQ ID NO: 3834102 - DNA, 22 bp, Homo sapiens
cgtgtgtgggtggatataaata

SEQ ID NO: 3834103 - DNA, 17 bp, Homo sapiens
cgtgttgtgttctttat

SEQ ID NO: 3834104 - DNA, 21 bp, Homo sapiens
cgttattttctttttccttta

SEQ ID NO: 3834105 - DNA, 18 bp, Homo sapiens
cgttgaagccgctcccgg

SEQ ID NO: 3834106 - DNA, 13 bp, Homo sapiens
ctgtgccaaagca

SEQ ID NO: 3834107 - DNA, 12 bp, Homo sapiens
ctgtgccaggct

SEQ ID NO: 3834108 - DNA, 16 bp, Homo sapiens
ctgtgccaggctggga

SEQ ID NO: 3834109 - DNA, 18 bp, Homo sapiens
ctgtgccaggctgggagg

SEQ ID NO: 3834110 - DNA, 19 bp, Homo sapiens
ctgtgccaggctgggaggc

SEQ ID NO: 3834111 - DNA, 13 bp, Homo sapiens
ctgtgctttctat

SEQ ID NO: 3834112 - DNA, 18 bp, Homo sapiens
ctgtggaccctcgctctc

SEQ ID NO: 3834113 - DNA, 23 bp, Homo sapiens
ctgtggaccctcgctctctgtct

SEQ ID NO: 3834114 - DNA, 16 bp, Homo sapiens
ctgtggaggggagctg

SEQ ID NO: 3834115 - DNA, 15 bp, Homo sapiens
ctgtggcccaagaga

SEQ ID NO: 3834116 - DNA, 14 bp, Homo sapiens
ctgtgtaacagctc

SEQ ID NO: 3834117 - DNA, 16 bp, Homo sapiens
ctgtgtaacagctcct

SEQ ID NO: 3834118 - DNA, 17 bp, Homo sapiens
ctgtgtaacagctcctt

SEQ ID NO: 3834119 - DNA, 22 bp, Homo sapiens
ctgtgtaacagctccttgggag

SEQ ID NO: 3834120 - DNA, 15 bp, Homo sapiens
ctgtgtaacaggacc

SEQ ID NO: 3834121 - DNA, 15 bp, Homo sapiens
ctgtgtagacatggt

SEQ ID NO: 3834122 - DNA, 16 bp, Homo sapiens
ctgtgtgagagagagg

SEQ ID NO: 3834123 - DNA, 17 bp, Homo sapiens
ctgtgtgagagagaggg

SEQ ID NO: 3834124 - DNA, 13 bp, Homo sapiens
ctgtgtgctacta

SEQ ID NO: 3834125 - DNA, 23 bp, Homo sapiens
ctgttacctctgacatcaagtgt

SEQ ID NO: 3834126 - DNA, 18 bp, Homo sapiens
ctgttattgttttgttaa

SEQ ID NO: 3834127 - DNA, 22 bp, Homo sapiens
ctgttattgttttgttaacaat

SEQ ID NO: 3834128 - DNA, 20 bp, Homo sapiens
ctgttccccaccgccctgcc

SEQ ID NO: 3834129 - DNA, 21 bp, Homo sapiens
ctgttccccaccgccctgcct

SEQ ID NO: 3834130 - DNA, 12 bp, Homo sapiens
ctgtttaagaga

SEQ ID NO: 3834131 - DNA, 23 bp, Homo sapiens
ctgtttggaaatggggagctggc

SEQ ID NO: 3834132 - DNA, 14 bp, Homo sapiens
cttaaaaccaaaga

SEQ ID NO: 3834133 - DNA, 15 bp, Homo sapiens
cttaacagttgcttt

SEQ ID NO: 3834134 - DNA, 17 bp, Homo sapiens
cttaaggagaaatagct

SEQ ID NO: 3834135 - DNA, 17 bp, Homo sapiens
cttaattaaagaattta

SEQ ID NO: 3834136 - DNA, 12 bp, Homo sapiens
cttaattgaaac

SEQ ID NO: 3834137 - DNA, 14 bp, Homo sapiens
cttaattgaaacaa

SEQ ID NO: 3834138 - DNA, 12 bp, Homo sapiens
cttacatttcct

SEQ ID NO: 3834139 - DNA, 15 bp, Homo sapiens
cttaccgagagccaa

SEQ ID NO: 3834140 - DNA, 13 bp, Homo sapiens
cttactattgtat

SEQ ID NO: 3834141 - DNA, 18 bp, Homo sapiens
cttagagtgctgtgagat

SEQ ID NO: 3834142 - DNA, 11 bp, Homo sapiens
cttagcctggg

SEQ ID NO: 3834143 - DNA, 15 bp, Homo sapiens
cttagtatcagtcat

SEQ ID NO: 3834144 - DNA, 15 bp, Homo sapiens
cttattaatgctaag

SEQ ID NO: 3834145 - DNA, 19 bp, Homo sapiens
cttattaatgctaagggca

SEQ ID NO: 3834146 - DNA, 20 bp, Homo sapiens
cttcaccaaagatctgctcc

SEQ ID NO: 3834147 - DNA, 12 bp, Homo sapiens
cttcactcagct

SEQ ID NO: 3834148 - DNA, 15 bp, Homo sapiens
cttcatgtggacatt

SEQ ID NO: 3834149 - DNA, 22 bp, Homo sapiens
cttccaggaaactccacatctg

SEQ ID NO: 3834150 - DNA, 23 bp, Homo sapiens
cttccaggaaactccacatctgc

SEQ ID NO: 3834151 - DNA, 13 bp, Homo sapiens
cttccagtcagga

SEQ ID NO: 3834152 - DNA, 18 bp, Homo sapiens
cttccagtgatgttgaaa

SEQ ID NO: 3834153 - DNA, 17 bp, Homo sapiens
cttccccagagatggct

SEQ ID NO: 3834154 - DNA, 21 bp, Homo sapiens
cttccccgatgtgagccgcct

SEQ ID NO: 3834155 - DNA, 14 bp, Homo sapiens
cttccccttagagt

SEQ ID NO: 3834156 - DNA, 21 bp, Homo sapiens
cttccctagctttagaccctg

SEQ ID NO: 3834157 - DNA, 22 bp, Homo sapiens
cttccctaggcacctctgtgct

SEQ ID NO: 3834158 - DNA, 16 bp, Homo sapiens
cttccctgtgtctttt

SEQ ID NO: 3834159 - DNA, 20 bp, Homo sapiens
cttcctgcctactgcccctg

SEQ ID NO: 3834160 - DNA, 21 bp, Homo sapiens
cttcctgcctactgcccctgc

SEQ ID NO: 3834161 - DNA, 16 bp, Homo sapiens
cttcctgcgtcctcct

SEQ ID NO: 3834162 - DNA, 17 bp, Homo sapiens
cttccttgcgaccacca

SEQ ID NO: 3834163 - DNA, 14 bp, Homo sapiens
cttccttttccctg

SEQ ID NO: 3834164 - DNA, 15 bp, Homo sapiens
cttccttttccctgc

SEQ ID NO: 3834165 - DNA, 19 bp, Homo sapiens
cttccttttccctgcttcc

SEQ ID NO: 3834166 - DNA, 21 bp, Homo sapiens
cttctaatatttattgcttta

SEQ ID NO: 3834167 - DNA, 22 bp, Homo sapiens
cttctagaatacatattacaag

SEQ ID NO: 3834168 - DNA, 17 bp, Homo sapiens
cttctcatgctatttct

SEQ ID NO: 3834169 - DNA, 20 bp, Homo sapiens
cttctccatcctttctgcct

SEQ ID NO: 3834170 - DNA, 16 bp, Homo sapiens
cttctccgccagcctc

SEQ ID NO: 3834171 - DNA, 14 bp, Homo sapiens
cttctcctcagctt

SEQ ID NO: 3834172 - DNA, 13 bp, Homo sapiens
cttctctcctccc

SEQ ID NO: 3834173 - DNA, 11 bp, Homo sapiens
cttctctctga

SEQ ID NO: 3834174 - DNA, 13 bp, Homo sapiens
cttctctctgagc

SEQ ID NO: 3834175 - DNA, 16 bp, Homo sapiens
cttctgcttttctgcc

SEQ ID NO: 3834176 - DNA, 17 bp, Homo sapiens
cttctgcttttctgccc

SEQ ID NO: 3834177 - DNA, 19 bp, Homo sapiens
cttctgcttttctgccctg

SEQ ID NO: 3834178 - DNA, 22 bp, Homo sapiens
cttctgcttttctgccctggct

SEQ ID NO: 3834179 - DNA, 23 bp, Homo sapiens
cttctgggcagatgaaaagctac

SEQ ID NO: 3834180 - DNA, 14 bp, Homo sapiens
cttcttccatccca

SEQ ID NO: 3834181 - DNA, 15 bp, Homo sapiens
cttcttccatcccag

SEQ ID NO: 3834182 - DNA, 18 bp, Homo sapiens
cttgaaaattaacatgaa

SEQ ID NO: 3834183 - DNA, 14 bp, Homo sapiens
cttgaactgctgcc

SEQ ID NO: 3834184 - DNA, 15 bp, Homo sapiens
cttgaactgctgcca

SEQ ID NO: 3834185 - DNA, 12 bp, Homo sapiens
cttgaagccaaa

SEQ ID NO: 3834186 - DNA, 16 bp, Homo sapiens
cttgaagccaaagaaa

SEQ ID NO: 3834187 - DNA, 18 bp, Homo sapiens
cttgaatcctagggcctg

SEQ ID NO: 3834188 - DNA, 14 bp, Homo sapiens
cttgagtatcataa

SEQ ID NO: 3834189 - DNA, 16 bp, Homo sapiens
cttgagtatcataata

SEQ ID NO: 3834190 - DNA, 17 bp, Homo sapiens
cttgatctgctcagccc

SEQ ID NO: 3834191 - DNA, 19 bp, Homo sapiens
cttgatctgctcagccctg

SEQ ID NO: 3834192 - DNA, 20 bp, Homo sapiens
cttgatctgctcagccctgg

SEQ ID NO: 3834193 - DNA, 22 bp, Homo sapiens
cttgattttcctaatggtctca

SEQ ID NO: 3834194 - DNA, 22 bp, Homo sapiens
cttgcactgtatcatttcatgc

SEQ ID NO: 3834195 - DNA, 12 bp, Homo sapiens
cttgcatttttt

SEQ ID NO: 3834196 - DNA, 19 bp, Homo sapiens
cttgcatttttttccttta

SEQ ID NO: 3834197 - DNA, 20 bp, Homo sapiens
cttgccaacctgtaataaat

SEQ ID NO: 3834198 - DNA, 14 bp, Homo sapiens
cttgccatttcttt

SEQ ID NO: 3834199 - DNA, 22 bp, Homo sapiens
cttgccatttctttatatggaa

SEQ ID NO: 3834200 - DNA, 16 bp, Homo sapiens
cttgccctgggctgcc

SEQ ID NO: 3834201 - DNA, 22 bp, Homo sapiens
cttgcgaccaccaacacacagg

SEQ ID NO: 3834202 - DNA, 14 bp, Homo sapiens
cttgctcccaggag

SEQ ID NO: 3834203 - DNA, 14 bp, Homo sapiens
cttgctctggacct

SEQ ID NO: 3834204 - DNA, 18 bp, Homo sapiens
cttgctctggacctgccc

SEQ ID NO: 3834205 - DNA, 15 bp, Homo sapiens
cttgctgccttctgg

SEQ ID NO: 3834206 - DNA, 20 bp, Homo sapiens
cttgctgccttctggattct

SEQ ID NO: 3834207 - DNA, 16 bp, Homo sapiens
cttggaaaaagtgatg

SEQ ID NO: 3834208 - DNA, 15 bp, Homo sapiens
cttggaatgggagag

SEQ ID NO: 3834209 - DNA, 19 bp, Homo sapiens
cttggatcaagcagaaaac

SEQ ID NO: 3834210 - DNA, 16 bp, Homo sapiens
cttggccctacagccc

SEQ ID NO: 3834211 - DNA, 18 bp, Homo sapiens
cttggccctacagccctg

SEQ ID NO: 3834212 - DNA, 12 bp, Homo sapiens
cttggcctgctg

SEQ ID NO: 3834213 - DNA, 19 bp, Homo sapiens
cttgggactagatcacaac

SEQ ID NO: 3834214 - DNA, 14 bp, Homo sapiens
cttgggaggaagca

SEQ ID NO: 3834215 - DNA, 17 bp, Homo sapiens
cttgggaggaagcagaa

SEQ ID NO: 3834216 - DNA, 20 bp, Homo sapiens
cttgggaggaagcagaataa

SEQ ID NO: 3834217 - DNA, 22 bp, Homo sapiens
cttggtgattaaggtcctgctt

SEQ ID NO: 3834218 - DNA, 18 bp, Homo sapiens
cttgtaaattccccttcc

SEQ ID NO: 3834219 - DNA, 18 bp, Homo sapiens
cttgtgactagtgctgaa

SEQ ID NO: 3834220 - DNA, 22 bp, Homo sapiens
ctttaactgagggctgatcttt

SEQ ID NO: 3834221 - DNA, 14 bp, Homo sapiens
ctttactctttcat

SEQ ID NO: 3834222 - DNA, 14 bp, Homo sapiens
ctttagaccctggg

SEQ ID NO: 3834223 - DNA, 17 bp, Homo sapiens
ctttataaaaaaaagtt

SEQ ID NO: 3834224 - DNA, 23 bp, Homo sapiens
ctttataaaaaaaagttgtttat

SEQ ID NO: 3834225 - DNA, 20 bp, Homo sapiens
ctttatatggaacgcatttt

SEQ ID NO: 3834226 - DNA, 21 bp, Homo sapiens
ctttatatggaacgcattttg

SEQ ID NO: 3834227 - DNA, 16 bp, Homo sapiens
ctttattgctgcattt

SEQ ID NO: 3834228 - DNA, 20 bp, Homo sapiens
ctttcatcaatcattgtaca

SEQ ID NO: 3834229 - DNA, 16 bp, Homo sapiens
ctttcatgagcttgcc

SEQ ID NO: 3834230 - DNA, 21 bp, Homo sapiens
ctttcatgccattttatttct

SEQ ID NO: 3834231 - DNA, 13 bp, Homo sapiens
ctttccccagccc

SEQ ID NO: 3834232 - DNA, 17 bp, Homo sapiens
ctttccccagcccaggg

SEQ ID NO: 3834233 - DNA, 19 bp, Homo sapiens
ctttcccttgccctgggct

SEQ ID NO: 3834234 - DNA, 21 bp, Homo sapiens
ctttcctcaggcaaggtctgg

SEQ ID NO: 3834235 - DNA, 14 bp, Homo sapiens
ctttccttccccct

SEQ ID NO: 3834236 - DNA, 15 bp, Homo sapiens
ctttccttccccctc

SEQ ID NO: 3834237 - DNA, 15 bp, Homo sapiens
ctttctattgtacag

SEQ ID NO: 3834238 - DNA, 14 bp, Homo sapiens
ctttctgatgtctt

SEQ ID NO: 3834239 - DNA, 19 bp, Homo sapiens
gattcctaaggcccagctg

SEQ ID NO: 3834240 - DNA, 15 bp, Homo sapiens
gattctctaagatga

SEQ ID NO: 3834241 - DNA, 16 bp, Homo sapiens
gattgattgatacatt

SEQ ID NO: 3834242 - DNA, 16 bp, Homo sapiens
gattgtaaactaaagt

SEQ ID NO: 3834243 - DNA, 20 bp, Homo sapiens
gattgttcataatacataaa

SEQ ID NO: 3834244 - DNA, 15 bp, Homo sapiens
gatttaactgtgaac

SEQ ID NO: 3834245 - DNA, 16 bp, Homo sapiens
gatttagatttaatga

SEQ ID NO: 3834246 - DNA, 18 bp, Homo sapiens
gatttgcattttttaaat

SEQ ID NO: 3834247 - DNA, 12 bp, Homo sapiens
gatttggcagga

SEQ ID NO: 3834248 - DNA, 23 bp, Homo sapiens
gatttggcaggatcggcttcctc

SEQ ID NO: 3834249 - DNA, 13 bp, Homo sapiens
gattttaaatgct

SEQ ID NO: 3834250 - DNA, 17 bp, Homo sapiens
gattttatgtgcttgaa

SEQ ID NO: 3834251 - DNA, 21 bp, Homo sapiens
gattttcctgaagctgcttaa

SEQ ID NO: 3834252 - DNA, 20 bp, Homo sapiens
gattttgtgttttttcgttc

SEQ ID NO: 3834253 - DNA, 18 bp, Homo sapiens
gcaaaaaaaaaaaaaagc

SEQ ID NO: 3834254 - DNA, 18 bp, Homo sapiens
gcaaactttattttgtgt

SEQ ID NO: 3834255 - DNA, 12 bp, Homo sapiens
gcaaatgtgaat

SEQ ID NO: 3834256 - DNA, 16 bp, Homo sapiens
gcaaccagttggctag

SEQ ID NO: 3834257 - DNA, 18 bp, Homo sapiens
gcaaccagttggctaggg

SEQ ID NO: 3834258 - DNA, 21 bp, Homo sapiens
gcaacgctgattcctaaggcc

SEQ ID NO: 3834259 - DNA, 22 bp, Homo sapiens
gcaactttgtataaaagggact

SEQ ID NO: 3834260 - DNA, 16 bp, Homo sapiens
gcaagacgccctctcg

SEQ ID NO: 3834261 - DNA, 20 bp, Homo sapiens
gcaagagggggtggaggggt

SEQ ID NO: 3834262 - DNA, 22 bp, Homo sapiens
gcaagagggggtggaggggtgt

SEQ ID NO: 3834263 - DNA, 15 bp, Homo sapiens
gcaagctcttctcct

SEQ ID NO: 3834264 - DNA, 15 bp, Homo sapiens
gcaaggatggtgggg

SEQ ID NO: 3834265 - DNA, 22 bp, Homo sapiens
gcaaggatggtggggcccccag

SEQ ID NO: 3834266 - DNA, 19 bp, Homo sapiens
gcaaggtctggcctcaggt

SEQ ID NO: 3834267 - DNA, 22 bp, Homo sapiens
gcaaggtctggcctcaggtggg

SEQ ID NO: 3834268 - DNA, 15 bp, Homo sapiens
gcaatcagaagaaag

SEQ ID NO: 3834269 - DNA, 13 bp, Homo sapiens
gcaatctggaaaa

SEQ ID NO: 3834270 - DNA, 20 bp, Homo sapiens
gcaatttgtttgtgcttcta

SEQ ID NO: 3834271 - DNA, 16 bp, Homo sapiens
gcacagacctctccca

SEQ ID NO: 3834272 - DNA, 18 bp, Homo sapiens
gcacagacctctcccacc

SEQ ID NO: 3834273 - DNA, 16 bp, Homo sapiens
gcacagttctatttgc

SEQ ID NO: 3834274 - DNA, 21 bp, Homo sapiens
gcacatgcaccacgcccggct

SEQ ID NO: 3834275 - DNA, 21 bp, Homo sapiens
gcacatgtcattgcccacttc

SEQ ID NO: 3834276 - DNA, 22 bp, Homo sapiens
gcacatgtcattgcccacttct

SEQ ID NO: 3834277 - DNA, 18 bp, Homo sapiens
gcaccaaaccctgtcctc

SEQ ID NO: 3834278 - DNA, 21 bp, Homo sapiens
gcaccattcagactttcagcc

SEQ ID NO: 3834279 - DNA, 19 bp, Homo sapiens
gcacccaccgtggaggagg

SEQ ID NO: 3834280 - DNA, 21 bp, Homo sapiens
gcaccccaggcagctcctgtt

SEQ ID NO: 3834281 - DNA, 19 bp, Homo sapiens
gcaccccttctctcctccc

SEQ ID NO: 3834282 - DNA, 21 bp, Homo sapiens
gcaccccttctctcctcccca

SEQ ID NO: 3834283 - DNA, 22 bp, Homo sapiens
gcaccccttctctcctccccaa

SEQ ID NO: 3834284 - DNA, 12 bp, Homo sapiens
gcacctccccag

SEQ ID NO: 3834285 - DNA, 21 bp, Homo sapiens
gcacctccccagacagggctc

SEQ ID NO: 3834286 - DNA, 22 bp, Homo sapiens
gcacctttggaaacaacattta

SEQ ID NO: 3834287 - DNA, 22 bp, Homo sapiens
gcactagcctccctctcctctg

SEQ ID NO: 3834288 - DNA, 22 bp, Homo sapiens
gcactagcctttggctctggag

SEQ ID NO: 3834289 - DNA, 19 bp, Homo sapiens
gcactgtatcatttcatgc

SEQ ID NO: 3834290 - DNA, 12 bp, Homo sapiens
gcagaaaggctg

SEQ ID NO: 3834291 - DNA, 16 bp, Homo sapiens
gcagaagaagctggga

SEQ ID NO: 3834292 - DNA, 11 bp, Homo sapiens
gcagaataaag

SEQ ID NO: 3834293 - DNA, 12 bp, Homo sapiens
gcagaataaagc

SEQ ID NO: 3834294 - DNA, 20 bp, Homo sapiens
gcagaataaagcaattttcc

SEQ ID NO: 3834295 - DNA, 21 bp, Homo sapiens
gcagaataaagcaattttcct

SEQ ID NO: 3834296 - DNA, 22 bp, Homo sapiens
gcagaataaagcaattttcctt

SEQ ID NO: 3834297 - DNA, 13 bp, Homo sapiens
gcagaataaatgt

SEQ ID NO: 3834298 - DNA, 21 bp, Homo sapiens
gcagaataaatgttttacaac

SEQ ID NO: 3834299 - DNA, 17 bp, Homo sapiens
gcagacctccccagccc

SEQ ID NO: 3834300 - DNA, 19 bp, Homo sapiens
gcagacctccccagcccct

SEQ ID NO: 3834301 - DNA, 23 bp, Homo sapiens
gcagacctccccagcccctagcc

SEQ ID NO: 3834302 - DNA, 16 bp, Homo sapiens
gcagaggcaaggatgg

SEQ ID NO: 3834303 - DNA, 20 bp, Homo sapiens
gcagataaggccgagcccac

SEQ ID NO: 3834304 - DNA, 15 bp, Homo sapiens
gcagatgaaaagcta

SEQ ID NO: 3834305 - DNA, 19 bp, Homo sapiens
gcagatgatttgggcagag

SEQ ID NO: 3834306 - DNA, 20 bp, Homo sapiens
gcagccacacagtggccggg

SEQ ID NO: 3834307 - DNA, 23 bp, Homo sapiens
gcagccacacagtggccggggct

SEQ ID NO: 3834308 - DNA, 16 bp, Homo sapiens
gcagccagatccccag

SEQ ID NO: 3834309 - DNA, 19 bp, Homo sapiens
gcagccagatccccagggc

SEQ ID NO: 3834310 - DNA, 21 bp, Homo sapiens
gcagccagatccccagggcag

SEQ ID NO: 3834311 - DNA, 14 bp, Homo sapiens
gcagccagccctgg

SEQ ID NO: 3834312 - DNA, 20 bp, Homo sapiens
gcagccagctacaggcttga

SEQ ID NO: 3834313 - DNA, 12 bp, Homo sapiens
gcagccatccca

SEQ ID NO: 3834314 - DNA, 18 bp, Homo sapiens
gcagccatcccaaggctc

SEQ ID NO: 3834315 - DNA, 21 bp, Homo sapiens
gcagccattggcctctgtctc

SEQ ID NO: 3834316 - DNA, 15 bp, Homo sapiens
gcagcccttggccag

SEQ ID NO: 3834317 - DNA, 14 bp, Homo sapiens
gcagcctccagtct

SEQ ID NO: 3834318 - DNA, 17 bp, Homo sapiens
gcagcctccagtctgct

SEQ ID NO: 3834319 - DNA, 18 bp, Homo sapiens
gcagcctcgttaggacaa

SEQ ID NO: 3834320 - DNA, 15 bp, Homo sapiens
gcagcgcattgtttt

SEQ ID NO: 3834321 - DNA, 15 bp, Homo sapiens
gcagctgaagcctgg

SEQ ID NO: 3834322 - DNA, 21 bp, Homo sapiens
gcagctgaagcctggacgcag

SEQ ID NO: 3834323 - DNA, 18 bp, Homo sapiens
gcaggagattgagaagga

SEQ ID NO: 3834324 - DNA, 21 bp, Homo sapiens
gcaggagattgagaaggagag

SEQ ID NO: 3834325 - DNA, 22 bp, Homo sapiens
gcaggatcggcttcctcagggg

SEQ ID NO: 3834326 - DNA, 17 bp, Homo sapiens
gcaggcatagaggcttc

SEQ ID NO: 3834327 - DNA, 22 bp, Homo sapiens
gcaggctcactgccaggccagc

SEQ ID NO: 3834328 - DNA, 16 bp, Homo sapiens
gcagggaggaagaagc

SEQ ID NO: 3834329 - DNA, 23 bp, Homo sapiens
gcagggaggaagaagcttaggca

SEQ ID NO: 3834330 - DNA, 19 bp, Homo sapiens
gcaggggctctggagagaa

SEQ ID NO: 3834331 - DNA, 21 bp, Homo sapiens
gcaggggctctggagagaaac

SEQ ID NO: 3834332 - DNA, 17 bp, Homo sapiens
gcaggggtgggggtgga

SEQ ID NO: 3834333 - DNA, 20 bp, Homo sapiens
gcaggggtgggggtggaggc

SEQ ID NO: 3834334 - DNA, 24 bp, Homo sapiens
gcagggtcctccggggctcagccc

SEQ ID NO: 3834335 - DNA, 14 bp, Homo sapiens
gcagggtgttggga

SEQ ID NO: 3834336 - DNA, 19 bp, Homo sapiens
gcaggtagccagggggact

SEQ ID NO: 3834337 - DNA, 21 bp, Homo sapiens
gcaggtagccagggggactag

SEQ ID NO: 3834338 - DNA, 17 bp, Homo sapiens
gcaggtgagcaaccagt

SEQ ID NO: 3834339 - DNA, 14 bp, Homo sapiens
gcataaaggccttt

SEQ ID NO: 3834340 - DNA, 21 bp, Homo sapiens
gcataaataattttgttttaa

SEQ ID NO: 3834341 - DNA, 15 bp, Homo sapiens
gcatagaaggcaggt

SEQ ID NO: 3834342 - DNA, 16 bp, Homo sapiens
gcatagaggcttctcc

SEQ ID NO: 3834343 - DNA, 22 bp, Homo sapiens
gcatagaggcttctccgccagc

SEQ ID NO: 3834344 - DNA, 18 bp, Homo sapiens
gcatattattttatgttg

SEQ ID NO: 3834345 - DNA, 15 bp, Homo sapiens
gcatcccctgcctcc

SEQ ID NO: 3834346 - DNA, 23 bp, Homo sapiens
gcatgactttagatgggaagcct

SEQ ID NO: 3834347 - DNA, 15 bp, Homo sapiens
gcatgagctattgct

SEQ ID NO: 3834348 - DNA, 19 bp, Homo sapiens
gcatgccccggccacctct

SEQ ID NO: 3834349 - DNA, 20 bp, Homo sapiens
gcatgccccggccacctctg

SEQ ID NO: 3834350 - DNA, 21 bp, Homo sapiens
gcatgccccggccacctctgc

SEQ ID NO: 3834351 - DNA, 14 bp, Homo sapiens
gcatgttttgtcat

SEQ ID NO: 3834352 - DNA, 20 bp, Homo sapiens
gcatgttttgtcattgtttt

SEQ ID NO: 3834353 - DNA, 20 bp, Homo sapiens
gcattgaaggcgaggctgcc

SEQ ID NO: 3834354 - DNA, 14 bp, Homo sapiens
gcattgttttgcat

SEQ ID NO: 3834355 - DNA, 15 bp, Homo sapiens
gcatttcaatttcaa

SEQ ID NO: 3834356 - DNA, 19 bp, Homo sapiens
gcatttggctggagcccgg

SEQ ID NO: 3834357 - DNA, 12 bp, Homo sapiens
gcatttgtaaaa

SEQ ID NO: 3834358 - DNA, 15 bp, Homo sapiens
gccaaagcagctaca

SEQ ID NO: 3834359 - DNA, 16 bp, Homo sapiens
gccaaagcagctacaa

SEQ ID NO: 3834360 - DNA, 18 bp, Homo sapiens
gccaacctgtaataaata

SEQ ID NO: 3834361 - DNA, 14 bp, Homo sapiens
gccaactatggcct

SEQ ID NO: 3834362 - DNA, 15 bp, Homo sapiens
gccaactatggcctg

SEQ ID NO: 3834363 - DNA, 17 bp, Homo sapiens
gccaagccctttgctgt

SEQ ID NO: 3834364 - DNA, 21 bp, Homo sapiens
gccaagccggcccaacccaac

SEQ ID NO: 3834365 - DNA, 14 bp, Homo sapiens
gccaagggacacag

SEQ ID NO: 3834366 - DNA, 18 bp, Homo sapiens
gccaagtggggtgctggg

SEQ ID NO: 3834367 - DNA, 20 bp, Homo sapiens
gccaagtggggtgctgggag

SEQ ID NO: 3834368 - DNA, 22 bp, Homo sapiens
gccaagttagctattgggagca

SEQ ID NO: 3834369 - DNA, 14 bp, Homo sapiens
gccacacagcccag

SEQ ID NO: 3834370 - DNA, 23 bp, Homo sapiens
ggaagcaaaatcccttaatctat

SEQ ID NO: 3834371 - DNA, 13 bp, Homo sapiens
ggaagcagaataa

SEQ ID NO: 3834372 - DNA, 16 bp, Homo sapiens
ggaagcagaataaagc

SEQ ID NO: 3834373 - DNA, 22 bp, Homo sapiens
ggaagcagaataaagcaatttt

SEQ ID NO: 3834374 - DNA, 22 bp, Homo sapiens
ggaataaagcttctctctgagc

SEQ ID NO: 3834375 - DNA, 15 bp, Homo sapiens
ggaatacaatgtaat

SEQ ID NO: 3834376 - DNA, 14 bp, Homo sapiens
ggaatgactgaaga

SEQ ID NO: 3834377 - DNA, 17 bp, Homo sapiens
ggaatgactgaagacag

SEQ ID NO: 3834378 - DNA, 18 bp, Homo sapiens
ggaatgactgaagacagg

SEQ ID NO: 3834379 - DNA, 20 bp, Homo sapiens
ggaatgactgaagacaggca

SEQ ID NO: 3834380 - DNA, 18 bp, Homo sapiens
ggaatgatgtatataaaa

SEQ ID NO: 3834381 - DNA, 11 bp, Homo sapiens
ggaatgggaga

SEQ ID NO: 3834382 - DNA, 20 bp, Homo sapiens
ggacaaaaggtactggtgag

SEQ ID NO: 3834383 - DNA, 18 bp, Homo sapiens
ggacaaggctgtgccagg

SEQ ID NO: 3834384 - DNA, 23 bp, Homo sapiens
ggacaaggctgtgccaggctggg

SEQ ID NO: 3834385 - DNA, 17 bp, Homo sapiens
ggacaccacacccagcc

SEQ ID NO: 3834386 - DNA, 18 bp, Homo sapiens
ggacaccacacccagcct

SEQ ID NO: 3834387 - DNA, 21 bp, Homo sapiens
ggaccccagctgtgagccttg

SEQ ID NO: 3834388 - DNA, 21 bp, Homo sapiens
ggaccctcagccccaggagaa

SEQ ID NO: 3834389 - DNA, 23 bp, Homo sapiens
ggaccctcagccccaggagaagg

SEQ ID NO: 3834390 - DNA, 22 bp, Homo sapiens
ggaccctgtgacatggtgcctg

SEQ ID NO: 3834391 - DNA, 14 bp, Homo sapiens
ggacctccatgccc

SEQ ID NO: 3834392 - DNA, 14 bp, Homo sapiens
ggacctgagcctgg

SEQ ID NO: 3834393 - DNA, 14 bp, Homo sapiens
ggacctgccaggca

SEQ ID NO: 3834394 - DNA, 23 bp, Homo sapiens
ggacctgcccccgcatcccctgc

SEQ ID NO: 3834395 - DNA, 17 bp, Homo sapiens
ggacgacgaatcttctc

SEQ ID NO: 3834396 - DNA, 14 bp, Homo sapiens
ggactagcccctgt

SEQ ID NO: 3834397 - DNA, 18 bp, Homo sapiens
ggactgtgacttgggctc

SEQ ID NO: 3834398 - DNA, 19 bp, Homo sapiens
ggactgtggaggggagctg

SEQ ID NO: 3834399 - DNA, 23 bp, Homo sapiens
ggactgtggaggggagctgctgg

SEQ ID NO: 3834400 - DNA, 15 bp, Homo sapiens
ggacttagaaagcag

SEQ ID NO: 3834401 - DNA, 20 bp, Homo sapiens
ggacttagaaagcaggggct

SEQ ID NO: 3834402 - DNA, 15 bp, Homo sapiens
ggagaacttgaacaa

SEQ ID NO: 3834403 - DNA, 20 bp, Homo sapiens
ggagaacttgaacaaagtct

SEQ ID NO: 3834404 - DNA, 14 bp, Homo sapiens
ggagaagagaggag

SEQ ID NO: 3834405 - DNA, 22 bp, Homo sapiens
ggagaagccaagggacacagga

SEQ ID NO: 3834406 - DNA, 14 bp, Homo sapiens
ggagacagccccag

SEQ ID NO: 3834407 - DNA, 24 bp, Homo sapiens
ggagagaaagtgggtgagatgctg

SEQ ID NO: 3834408 - DNA, 10 bp, Homo sapiens
ggagagagaa

SEQ ID NO: 3834409 - DNA, 17 bp, Homo sapiens
ggagagagaaagccagg

SEQ ID NO: 3834410 - DNA, 21 bp, Homo sapiens
ggagagagaaagccaggcagg

SEQ ID NO: 3834411 - DNA, 16 bp, Homo sapiens
ggagagaggcagagag

SEQ ID NO: 3834412 - DNA, 11 bp, Homo sapiens
ggagagctggc

SEQ ID NO: 3834413 - DNA, 13 bp, Homo sapiens
ggagagctggcag

SEQ ID NO: 3834414 - DNA, 15 bp, Homo sapiens
ggagaggagagaggc

SEQ ID NO: 3834415 - DNA, 19 bp, Homo sapiens
ggagagttgggggccagca

SEQ ID NO: 3834416 - DNA, 14 bp, Homo sapiens
ggagattgagaagg

SEQ ID NO: 3834417 - DNA, 13 bp, Homo sapiens
ggagcaagccctg

SEQ ID NO: 3834418 - DNA, 20 bp, Homo sapiens
ggagcagaataaatgtttta

SEQ ID NO: 3834419 - DNA, 18 bp, Homo sapiens
ggagcatagaaggcaggt

SEQ ID NO: 3834420 - DNA, 17 bp, Homo sapiens
ggagccaccactcctgc

SEQ ID NO: 3834421 - DNA, 12 bp, Homo sapiens
ggagccagaggc

SEQ ID NO: 3834422 - DNA, 14 bp, Homo sapiens
ggagccagaggcca

SEQ ID NO: 3834423 - DNA, 20 bp, Homo sapiens
ggagccagaggccaggatgc

SEQ ID NO: 3834424 - DNA, 19 bp, Homo sapiens
ggagcccaggcgggagcgg

SEQ ID NO: 3834425 - DNA, 22 bp, Homo sapiens
ggagcccaggcgggagcggtgg

SEQ ID NO: 3834426 - DNA, 21 bp, Homo sapiens
ggagcctagagtgagggcctg

SEQ ID NO: 3834427 - DNA, 16 bp, Homo sapiens
ggagcctgtgtaacag

SEQ ID NO: 3834428 - DNA, 19 bp, Homo sapiens
ggagcctgtgtaacagctc

SEQ ID NO: 3834429 - DNA, 20 bp, Homo sapiens
ggagcctgtgtaacagctcc

SEQ ID NO: 3834430 - DNA, 17 bp, Homo sapiens
ggagctgctggccatgg

SEQ ID NO: 3834431 - DNA, 21 bp, Homo sapiens
ggagctgctggccatggctgc

SEQ ID NO: 3834432 - DNA, 12 bp, Homo sapiens
ggagctttgctc

SEQ ID NO: 3834433 - DNA, 12 bp, Homo sapiens
ggaggaagcaga

SEQ ID NO: 3834434 - DNA, 13 bp, Homo sapiens
ggaggaagcagaa

SEQ ID NO: 3834435 - DNA, 14 bp, Homo sapiens
ggaggaagcagaat

SEQ ID NO: 3834436 - DNA, 20 bp, Homo sapiens
ggaggaagcagaataaagca

SEQ ID NO: 3834437 - DNA, 13 bp, Homo sapiens
ggaggaggaaggc

SEQ ID NO: 3834438 - DNA, 17 bp, Homo sapiens
ggaggcaggagtttcgt

SEQ ID NO: 3834439 - DNA, 15 bp, Homo sapiens
ggagggccctgagga

SEQ ID NO: 3834440 - DNA, 17 bp, Homo sapiens
ggagggccctgaggaat

SEQ ID NO: 3834441 - DNA, 22 bp, Homo sapiens
ggagggccctgaggaataaagc

SEQ ID NO: 3834442 - DNA, 21 bp, Homo sapiens
ggagggctttgtgtctggcca

SEQ ID NO: 3834443 - DNA, 13 bp, Homo sapiens
ggaggggagaagc

SEQ ID NO: 3834444 - DNA, 14 bp, Homo sapiens
ggaggggagctgct

SEQ ID NO: 3834445 - DNA, 15 bp, Homo sapiens
ggaggggagctgctg

SEQ ID NO: 3834446 - DNA, 16 bp, Homo sapiens
ggaggggagctgctgg

SEQ ID NO: 3834447 - DNA, 19 bp, Homo sapiens
ggaggggagctgctggcca

SEQ ID NO: 3834448 - DNA, 19 bp, Homo sapiens
ggagggggtcggggtccca

SEQ ID NO: 3834449 - DNA, 14 bp, Homo sapiens
ggagggtggcagag

SEQ ID NO: 3834450 - DNA, 17 bp, Homo sapiens
ggaggtcactggaaagg

SEQ ID NO: 3834451 - DNA, 21 bp, Homo sapiens
ggaggtcactggaaaggggag

SEQ ID NO: 3834452 - DNA, 17 bp, Homo sapiens
ggaggtcgtgtatttgg

SEQ ID NO: 3834453 - DNA, 13 bp, Homo sapiens
ggaggtgccagca

SEQ ID NO: 3834454 - DNA, 19 bp, Homo sapiens
ggaggtgccagcaaagccc

SEQ ID NO: 3834455 - DNA, 17 bp, Homo sapiens
ggaggtggaagaaggga

SEQ ID NO: 3834456 - DNA, 16 bp, Homo sapiens
ggaggtgggagcagga

SEQ ID NO: 3834457 - DNA, 16 bp, Homo sapiens
ggagtgcagtggctca

SEQ ID NO: 3834458 - DNA, 16 bp, Homo sapiens
ggagtgccatggctgg

SEQ ID NO: 3834459 - DNA, 15 bp, Homo sapiens
ggagtgtggcctgga

SEQ ID NO: 3834460 - DNA, 13 bp, Homo sapiens
ggatataaatata

SEQ ID NO: 3834461 - DNA, 14 bp, Homo sapiens
ggatataaatatat

SEQ ID NO: 3834462 - DNA, 20 bp, Homo sapiens
ggatgcaaataaagcctgct

SEQ ID NO: 3834463 - DNA, 17 bp, Homo sapiens
ggatgcctgagccccct

SEQ ID NO: 3834464 - DNA, 11 bp, Homo sapiens
ggatgggaggc

SEQ ID NO: 3834465 - DNA, 20 bp, Homo sapiens
ggatggtggggcccccagca

SEQ ID NO: 3834466 - DNA, 17 bp, Homo sapiens
ggattttgtgttttttc

SEQ ID NO: 3834467 - DNA, 23 bp, Homo sapiens
ggcaaatgtaaagtctagaaaat

SEQ ID NO: 3834468 - DNA, 22 bp, Homo sapiens
ggcaagaggtgcctgggaggag

SEQ ID NO: 3834469 - DNA, 15 bp, Homo sapiens
ggcaaggggtttcca

SEQ ID NO: 3834470 - DNA, 24 bp, Homo sapiens
ggcacagacccccgtcctgtcccc

SEQ ID NO: 3834471 - DNA, 22 bp, Homo sapiens
ggcaccaaaccctgtcctccca

SEQ ID NO: 3834472 - DNA, 20 bp, Homo sapiens
ggcacccaccgtggaggagg

SEQ ID NO: 3834473 - DNA, 21 bp, Homo sapiens
ggcacccaccgtggaggagga

SEQ ID NO: 3834474 - DNA, 17 bp, Homo sapiens
ggcaccccaggcagctc

SEQ ID NO: 3834475 - DNA, 15 bp, Homo sapiens
ggcagaaaggctgca

SEQ ID NO: 3834476 - DNA, 19 bp, Homo sapiens
ggcagagagcggtctcagg

SEQ ID NO: 3834477 - DNA, 18 bp, Homo sapiens
ggcagaggcaaggatggt

SEQ ID NO: 3834478 - DNA, 17 bp, Homo sapiens
ggcagatgaaaagctac

SEQ ID NO: 3834479 - DNA, 11 bp, Homo sapiens
ggcagccagat

SEQ ID NO: 3834480 - DNA, 21 bp, Homo sapiens
ggcagccagatccccagggca

SEQ ID NO: 3834481 - DNA, 23 bp, Homo sapiens
ggcagcctccagtctgctctcag

SEQ ID NO: 3834482 - DNA, 13 bp, Homo sapiens
ggcagctcctgtt

SEQ ID NO: 3834483 - DNA, 23 bp, Homo sapiens
ggcaggatcggcttcctcagggg

SEQ ID NO: 3834484 - DNA, 16 bp, Homo sapiens
ggcaggggtgtcctga

SEQ ID NO: 3834485 - DNA, 14 bp, Homo sapiens
ggcaggtagccagg

SEQ ID NO: 3834486 - DNA, 16 bp, Homo sapiens
ggcagtcctgagtggg

SEQ ID NO: 3834487 - DNA, 16 bp, Homo sapiens
ggcagtgagtgagcct

SEQ ID NO: 3834488 - DNA, 18 bp, Homo sapiens
ggcagtgagtgagcctgg

SEQ ID NO: 3834489 - DNA, 15 bp, Homo sapiens
ggcagttctctcgaa

SEQ ID NO: 3834490 - DNA, 19 bp, Homo sapiens
ggcagtttgttgatctttt

SEQ ID NO: 3834491 - DNA, 14 bp, Homo sapiens
ggcattcctctaat

SEQ ID NO: 3834492 - DNA, 14 bp, Homo sapiens
ggccaagcagggag

SEQ ID NO: 3834493 - DNA, 17 bp, Homo sapiens
ggccacaccccagactc

SEQ ID NO: 3834494 - DNA, 18 bp, Homo sapiens
ggccacaccccagactcc

SEQ ID NO: 3834495 - DNA, 19 bp, Homo sapiens
ggccacccgcctccctctc

SEQ ID NO: 3834496 - DNA, 19 bp, Homo sapiens
ggccacgtcttccttctgc

SEQ ID NO: 3834497 - DNA, 22 bp, Homo sapiens
ggccagccccacccccagccag

SEQ ID NO: 3834498 - DNA, 19 bp, Homo sapiens
ggccagcctccgagaggga

SEQ ID NO: 3834499 - DNA, 13 bp, Homo sapiens
ggccaggactgag

SEQ ID NO: 3834500 - DNA, 20 bp, Homo sapiens
ggccaggactgagccccgca

SEQ ID NO: 3834501 - DNA, 17 bp, Homo sapiens
ggccaggatgcctgagc

SEQ ID NO: 3834502 - DNA, 13 bp, Homo sapiens
gtgtgtatgtgta

SEQ ID NO: 3834503 - DNA, 19 bp, Homo sapiens
gtgttatttcatccaggga

SEQ ID NO: 3834504 - DNA, 13 bp, Homo sapiens
gtgttctgtgata

SEQ ID NO: 3834505 - DNA, 17 bp, Homo sapiens
gtgttgagcgtattctt

SEQ ID NO: 3834506 - DNA, 20 bp, Homo sapiens
gtgttgagcgtattcttgaa

SEQ ID NO: 3834507 - DNA, 19 bp, Homo sapiens
gtgttgtttgctccagtga

SEQ ID NO: 3834508 - DNA, 17 bp, Homo sapiens
gtgtttatgcatttcaa

SEQ ID NO: 3834509 - DNA, 19 bp, Homo sapiens
gtgttttacaatgatttgt

SEQ ID NO: 3834510 - DNA, 18 bp, Homo sapiens
gtgtttttcataaagcag

SEQ ID NO: 3834511 - DNA, 15 bp, Homo sapiens
gttaaaacaatgaag

SEQ ID NO: 3834512 - DNA, 17 bp, Homo sapiens
gttaaatatataaacaa

SEQ ID NO: 3834513 - DNA, 13 bp, Homo sapiens
gttaagaatgtat

SEQ ID NO: 3834514 - DNA, 14 bp, Homo sapiens
gttactagcctctc

SEQ ID NO: 3834515 - DNA, 12 bp, Homo sapiens
gttactttacat

SEQ ID NO: 3834516 - DNA, 19 bp, Homo sapiens
gttagaagaggcctttgga

SEQ ID NO: 3834517 - DNA, 14 bp, Homo sapiens
gttaggacaaggct

SEQ ID NO: 3834518 - DNA, 17 bp, Homo sapiens
gttaggacaaggctgtg

SEQ ID NO: 3834519 - DNA, 20 bp, Homo sapiens
gttataaagaaagattgtaa

SEQ ID NO: 3834520 - DNA, 13 bp, Homo sapiens
gttatatagataa

SEQ ID NO: 3834521 - DNA, 15 bp, Homo sapiens
gttattttctacagt

SEQ ID NO: 3834522 - DNA, 16 bp, Homo sapiens
gttcataatacataaa

SEQ ID NO: 3834523 - DNA, 13 bp, Homo sapiens
gttcattcctgtc

SEQ ID NO: 3834524 - DNA, 14 bp, Homo sapiens
gttccaataaacag

SEQ ID NO: 3834525 - DNA, 23 bp, Homo sapiens
gttcccatgtcccagcctggcct

SEQ ID NO: 3834526 - DNA, 13 bp, Homo sapiens
gttccctccccag

SEQ ID NO: 3834527 - DNA, 15 bp, Homo sapiens
gttccctccccagct

SEQ ID NO: 3834528 - DNA, 18 bp, Homo sapiens
gttccctccccagctcct

SEQ ID NO: 3834529 - DNA, 14 bp, Homo sapiens
gttcctctgcctgc

SEQ ID NO: 3834530 - DNA, 21 bp, Homo sapiens
gttctctcccaggggctggct

SEQ ID NO: 3834531 - DNA, 15 bp, Homo sapiens
gttctctgtaattac

SEQ ID NO: 3834532 - DNA, 23 bp, Homo sapiens
gttcttacttgagtatcataata

SEQ ID NO: 3834533 - DNA, 23 bp, Homo sapiens
gttggcagtgagtgagcctggct

SEQ ID NO: 3834534 - DNA, 15 bp, Homo sapiens
gttggctcagaaaat

SEQ ID NO: 3834535 - DNA, 21 bp, Homo sapiens
gttgggatactgcagggccag

SEQ ID NO: 3834536 - DNA, 15 bp, Homo sapiens
gttgtggatgggagg

SEQ ID NO: 3834537 - DNA, 20 bp, Homo sapiens
gttgtggatgggaggctcct

SEQ ID NO: 3834538 - DNA, 19 bp, Homo sapiens
gttgtgtcactgactcagg

SEQ ID NO: 3834539 - DNA, 20 bp, Homo sapiens
gttgtttaaaaatttataac

SEQ ID NO: 3834540 - DNA, 23 bp, Homo sapiens
gttgtttaaaaatttataacagt

SEQ ID NO: 3834541 - DNA, 14 bp, Homo sapiens
gttgtttataaaaa

SEQ ID NO: 3834542 - DNA, 14 bp, Homo sapiens
gtttaaaaatttat

SEQ ID NO: 3834543 - DNA, 18 bp, Homo sapiens
gtttaaaaatttataaca

SEQ ID NO: 3834544 - DNA, 22 bp, Homo sapiens
gtttaagtaagtaagtttcatt

SEQ ID NO: 3834545 - DNA, 15 bp, Homo sapiens
gtttaggaaatttat

SEQ ID NO: 3834546 - DNA, 22 bp, Homo sapiens
gtttataaacatgtccccttcc

SEQ ID NO: 3834547 - DNA, 17 bp, Homo sapiens
gtttattgggcaataaa

SEQ ID NO: 3834548 - DNA, 17 bp, Homo sapiens
gtttcaaaaactgtatt

SEQ ID NO: 3834549 - DNA, 19 bp, Homo sapiens
gtttcaaaaactgtattga

SEQ ID NO: 3834550 - DNA, 16 bp, Homo sapiens
gtttccttatattatg

SEQ ID NO: 3834551 - DNA, 15 bp, Homo sapiens
gtttgaagctgctgt

SEQ ID NO: 3834552 - DNA, 20 bp, Homo sapiens
gtttgaagctgctgtctcta

SEQ ID NO: 3834553 - DNA, 15 bp, Homo sapiens
gtttgagctgccttc

SEQ ID NO: 3834554 - DNA, 18 bp, Homo sapiens
gtttgagctgccttccct

SEQ ID NO: 3834555 - DNA, 16 bp, Homo sapiens
gtttgctttttcaggt

SEQ ID NO: 3834556 - DNA, 12 bp, Homo sapiens
gtttggaaaact

SEQ ID NO: 3834557 - DNA, 20 bp, Homo sapiens
gtttggaaatggggagctgg

SEQ ID NO: 3834558 - DNA, 15 bp, Homo sapiens
gtttgtggaatggat

SEQ ID NO: 3834559 - DNA, 14 bp, Homo sapiens
gttttaaagctaaa

SEQ ID NO: 3834560 - DNA, 18 bp, Homo sapiens
gttttaacaccaacactg

SEQ ID NO: 3834561 - DNA, 20 bp, Homo sapiens
gttttacaatgatttgtaaa

SEQ ID NO: 3834562 - DNA, 21 bp, Homo sapiens
gttttacaatgatttgtaaag

SEQ ID NO: 3834563 - DNA, 15 bp, Homo sapiens
gttttactgcatttt

SEQ ID NO: 3834564 - DNA, 17 bp, Homo sapiens
gttttactgcattttca

SEQ ID NO: 3834565 - DNA, 15 bp, Homo sapiens
gttttatactgaagg

SEQ ID NO: 3834566 - DNA, 20 bp, Homo sapiens
gttttatagtattaagtgaa

SEQ ID NO: 3834567 - DNA, 22 bp, Homo sapiens
gttttatagtattaagtgaaat

SEQ ID NO: 3834568 - DNA, 13 bp, Homo sapiens
gttttcaatgaat

SEQ ID NO: 3834569 - DNA, 16 bp, Homo sapiens
gttttcaatgaattaa

SEQ ID NO: 3834570 - DNA, 22 bp, Homo sapiens
gttttcaggtactgagttctta

SEQ ID NO: 3834571 - DNA, 19 bp, Homo sapiens
gttttgattgagagtaact

SEQ ID NO: 3834572 - DNA, 19 bp, Homo sapiens
gttttgctccttctgtgtt

SEQ ID NO: 3834573 - DNA, 14 bp, Homo sapiens
gttttgttaacaat

SEQ ID NO: 3834574 - DNA, 15 bp, Homo sapiens
gtttttcataaagca

SEQ ID NO: 3834575 - DNA, 13 bp, Homo sapiens
gtttttcattatt

SEQ ID NO: 3834576 - DNA, 17 bp, Homo sapiens
gtttttgaaacagaacc

SEQ ID NO: 3834577 - DNA, 18 bp, Homo sapiens
gtttttgccactgattta

SEQ ID NO: 3834578 - DNA, 15 bp, Homo sapiens
gtttttgtcttgcat

SEQ ID NO: 3834579 - DNA, 17 bp, Homo sapiens
gtttttgtcttgcattt

SEQ ID NO: 3834580 - DNA, 19 bp, Homo sapiens
gtttttgttgcttttttag

SEQ ID NO: 3834581 - DNA, 19 bp, Homo sapiens
gtttttttcttctgtattt

SEQ ID NO: 3834582 - DNA, 19 bp, Homo sapiens
taaaaacccctaaaaacaa

SEQ ID NO: 3834583 - DNA, 17 bp, Homo sapiens
taaaaactatttaactt

SEQ ID NO: 3834584 - DNA, 20 bp, Homo sapiens
taaaaagaaagctaatacta

SEQ ID NO: 3834585 - DNA, 15 bp, Homo sapiens
taaaaagaagtttct

SEQ ID NO: 3834586 - DNA, 20 bp, Homo sapiens
taaaaagcagtttttgaaag

SEQ ID NO: 3834587 - DNA, 17 bp, Homo sapiens
taaaaagcatgttgtga

SEQ ID NO: 3834588 - DNA, 19 bp, Homo sapiens
taaaaagccaccacacact

SEQ ID NO: 3834589 - DNA, 13 bp, Homo sapiens
taaaaagctgacc

SEQ ID NO: 3834590 - DNA, 17 bp, Homo sapiens
taaaaatttataacagt

SEQ ID NO: 3834591 - DNA, 20 bp, Homo sapiens
taaaacaagaaagtttcccc

SEQ ID NO: 3834592 - DNA, 13 bp, Homo sapiens
taaaaccaaagag

SEQ ID NO: 3834593 - DNA, 13 bp, Homo sapiens
taaaagattttgt

SEQ ID NO: 3834594 - DNA, 16 bp, Homo sapiens
taaaaggttgtgtaca

SEQ ID NO: 3834595 - DNA, 16 bp, Homo sapiens
taaaatatcattcagc

SEQ ID NO: 3834596 - DNA, 13 bp, Homo sapiens
taaaatatttgcc

SEQ ID NO: 3834597 - DNA, 18 bp, Homo sapiens
taaaatatttgcctccat

SEQ ID NO: 3834598 - DNA, 20 bp, Homo sapiens
taaaatcagaggtaaataga

SEQ ID NO: 3834599 - DNA, 18 bp, Homo sapiens
taaaatcttgatagctaa

SEQ ID NO: 3834600 - DNA, 19 bp, Homo sapiens
taaaattcggaatggtttt

SEQ ID NO: 3834601 - DNA, 18 bp, Homo sapiens
taaacaaacaaacaaaaa

SEQ ID NO: 3834602 - DNA, 17 bp, Homo sapiens
taaacataaataaatat

SEQ ID NO: 3834603 - DNA, 21 bp, Homo sapiens
taaacatcacatggcatgttt

SEQ ID NO: 3834604 - DNA, 16 bp, Homo sapiens
taaacatgtccccttc

SEQ ID NO: 3834605 - DNA, 22 bp, Homo sapiens
taaaccagaaaggtgattccag

SEQ ID NO: 3834606 - DNA, 18 bp, Homo sapiens
taaaccataaaaagctga

SEQ ID NO: 3834607 - DNA, 20 bp, Homo sapiens
taaactaaagtgtgctttat

SEQ ID NO: 3834608 - DNA, 22 bp, Homo sapiens
taaactaaagtgtgctttataa

SEQ ID NO: 3834609 - DNA, 19 bp, Homo sapiens
taaactgtaaatcataatg

SEQ ID NO: 3834610 - DNA, 11 bp, Homo sapiens
taaacttcagt

SEQ ID NO: 3834611 - DNA, 13 bp, Homo sapiens
taaagaaagattg

SEQ ID NO: 3834612 - DNA, 16 bp, Homo sapiens
taaagaaagattgtaa

SEQ ID NO: 3834613 - DNA, 20 bp, Homo sapiens
taaagaaagattgtaaacta

SEQ ID NO: 3834614 - DNA, 23 bp, Homo sapiens
taaagaaagattgtaaactaaag

SEQ ID NO: 3834615 - DNA, 15 bp, Homo sapiens
taaagaaccagtccc

SEQ ID NO: 3834616 - DNA, 18 bp, Homo sapiens
taaagaatttaaaaaagt

SEQ ID NO: 3834617 - DNA, 21 bp, Homo sapiens
taaagaatttaatgtacagta

SEQ ID NO: 3834618 - DNA, 21 bp, Homo sapiens
taaagagcccttgcctcccca

SEQ ID NO: 3834619 - DNA, 11 bp, Homo sapiens
taaagcaattt

SEQ ID NO: 3834620 - DNA, 14 bp, Homo sapiens
taaagcaattttcc

SEQ ID NO: 3834621 - DNA, 17 bp, Homo sapiens
taaagcaattttccttg

SEQ ID NO: 3834622 - DNA, 22 bp, Homo sapiens
taaagcaattttccttgaagcc

SEQ ID NO: 3834623 - DNA, 19 bp, Homo sapiens
taaagcacgcagttatgtt

SEQ ID NO: 3834624 - DNA, 16 bp, Homo sapiens
taaagcttctctctga

SEQ ID NO: 3834625 - DNA, 17 bp, Homo sapiens
taaagcttctctctgag

SEQ ID NO: 3834626 - DNA, 15 bp, Homo sapiens
taaaggctctggaag

SEQ ID NO: 3834627 - DNA, 21 bp, Homo sapiens
taaagtaaaaacaaagaaatt

SEQ ID NO: 3834628 - DNA, 17 bp, Homo sapiens
taaagtatattgaaagt

SEQ ID NO: 3834629 - DNA, 15 bp, Homo sapiens
taaagtattggattt

SEQ ID NO: 3834630 - DNA, 15 bp, Homo sapiens
taaagtgtgctttat

SEQ ID NO: 3834631 - DNA, 16 bp, Homo sapiens
taaagtgtgctttata

SEQ ID NO: 3834632 - DNA, 17 bp, Homo sapiens
taaagttctctgtaatt

SEQ ID NO: 3834633 - DNA, 16 bp, Homo sapiens
taaagttggtaaacct

SEQ ID NO: 3834634 - DNA, 12 bp, Homo sapiens
taaataaagttt

SEQ ID NO: 3834635 - DNA, 23 bp, Homo sapiens
tcatgcccaccccctgccctgca

SEQ ID NO: 3834636 - DNA, 13 bp, Homo sapiens
tcatgctatttct

SEQ ID NO: 3834637 - DNA, 15 bp, Homo sapiens
tcatgctatttctac

SEQ ID NO: 3834638 - DNA, 15 bp, Homo sapiens
tcatgctttgattta

SEQ ID NO: 3834639 - DNA, 23 bp, Homo sapiens
tcatgggagggggcttgaagcca

SEQ ID NO: 3834640 - DNA, 19 bp, Homo sapiens
tcatggttttaaagctaaa

SEQ ID NO: 3834641 - DNA, 21 bp, Homo sapiens
tcatgtcacatcctaatagaa

SEQ ID NO: 3834642 - DNA, 15 bp, Homo sapiens
tcatgtgtctgttta

SEQ ID NO: 3834643 - DNA, 19 bp, Homo sapiens
tcattaaagtgcactgtgt

SEQ ID NO: 3834644 - DNA, 10 bp, Homo sapiens
tcattcagca

SEQ ID NO: 3834645 - DNA, 14 bp, Homo sapiens
tcattgtacagttt

SEQ ID NO: 3834646 - DNA, 19 bp, Homo sapiens
tcattgtacagtttgttta

SEQ ID NO: 3834647 - DNA, 13 bp, Homo sapiens
tcattgttctgta

SEQ ID NO: 3834648 - DNA, 15 bp, Homo sapiens
tcatttattaagtat

SEQ ID NO: 3834649 - DNA, 23 bp, Homo sapiens
tcatttattaagtatatttgtaa

SEQ ID NO: 3834650 - DNA, 14 bp, Homo sapiens
tcatttcatgcttt

SEQ ID NO: 3834651 - DNA, 12 bp, Homo sapiens
tcattttaaaca

SEQ ID NO: 3834652 - DNA, 21 bp, Homo sapiens
tcattttaaacaactttccac

SEQ ID NO: 3834653 - DNA, 14 bp, Homo sapiens
tcattttctgcaag

SEQ ID NO: 3834654 - DNA, 14 bp, Homo sapiens
tcattttttttccc

SEQ ID NO: 3834655 - DNA, 23 bp, Homo sapiens
tccaaagtctctggaatttgaaa

SEQ ID NO: 3834656 - DNA, 13 bp, Homo sapiens
tccaaatgtgaaa

SEQ ID NO: 3834657 - DNA, 15 bp, Homo sapiens
tccaagcaaatgtga

SEQ ID NO: 3834658 - DNA, 17 bp, Homo sapiens
tccaagcaaatgtgaat

SEQ ID NO: 3834659 - DNA, 22 bp, Homo sapiens
tccaaggctcccgtactgtctg

SEQ ID NO: 3834660 - DNA, 14 bp, Homo sapiens
tccaataaacagga

SEQ ID NO: 3834661 - DNA, 14 bp, Homo sapiens
tccacacaggtttg

SEQ ID NO: 3834662 - DNA, 15 bp, Homo sapiens
tccactacacctggc

SEQ ID NO: 3834663 - DNA, 17 bp, Homo sapiens
tccactacacctggctg

SEQ ID NO: 3834664 - DNA, 18 bp, Homo sapiens
tccactacacctggctga

SEQ ID NO: 3834665 - DNA, 18 bp, Homo sapiens
tccagatgtttctcattt

SEQ ID NO: 3834666 - DNA, 15 bp, Homo sapiens
tccagcagataaggc

SEQ ID NO: 3834667 - DNA, 23 bp, Homo sapiens
tccagccaccccgcagtcacttt

SEQ ID NO: 3834668 - DNA, 20 bp, Homo sapiens
tccagcctgctgcctgcttt

SEQ ID NO: 3834669 - DNA, 18 bp, Homo sapiens
tccagcctgtcggccaca

SEQ ID NO: 3834670 - DNA, 15 bp, Homo sapiens
tccagctgagtcctg

SEQ ID NO: 3834671 - DNA, 19 bp, Homo sapiens
tccagctgagtcctggggt

SEQ ID NO: 3834672 - DNA, 21 bp, Homo sapiens
tccagctgagtcctggggttg

SEQ ID NO: 3834673 - DNA, 17 bp, Homo sapiens
tccaggaaatgtgcaca

SEQ ID NO: 3834674 - DNA, 20 bp, Homo sapiens
tccaggcagttctctcgaat

SEQ ID NO: 3834675 - DNA, 21 bp, Homo sapiens
tccaggcccccgttgaagccg

SEQ ID NO: 3834676 - DNA, 15 bp, Homo sapiens
tccagggaaatgcct

SEQ ID NO: 3834677 - DNA, 14 bp, Homo sapiens
tccagtctgctctc

SEQ ID NO: 3834678 - DNA, 17 bp, Homo sapiens
tccagtctgctctcagc

SEQ ID NO: 3834679 - DNA, 19 bp, Homo sapiens
tccagtctgctctcagctt

SEQ ID NO: 3834680 - DNA, 16 bp, Homo sapiens
tccataaaaagaaagc

SEQ ID NO: 3834681 - DNA, 15 bp, Homo sapiens
tccatcccaggacac

SEQ ID NO: 3834682 - DNA, 16 bp, Homo sapiens
tccatcccttccccag

SEQ ID NO: 3834683 - DNA, 16 bp, Homo sapiens
tccatcctgctagcac

SEQ ID NO: 3834684 - DNA, 15 bp, Homo sapiens
tccatcctttgcatt

SEQ ID NO: 3834685 - DNA, 16 bp, Homo sapiens
tccatcctttgcattt

SEQ ID NO: 3834686 - DNA, 15 bp, Homo sapiens
tccatcttctttgca

SEQ ID NO: 3834687 - DNA, 23 bp, Homo sapiens
tccatgcccccgccacctcccca

SEQ ID NO: 3834688 - DNA, 13 bp, Homo sapiens
tccatggtgctaa

SEQ ID NO: 3834689 - DNA, 23 bp, Homo sapiens
tccatgtagaacttgaactaaca

SEQ ID NO: 3834690 - DNA, 20 bp, Homo sapiens
tcccaaggctcctgacctac

SEQ ID NO: 3834691 - DNA, 20 bp, Homo sapiens
tcccacccacaagaactcct

SEQ ID NO: 3834692 - DNA, 13 bp, Homo sapiens
tcccacctctgtg

SEQ ID NO: 3834693 - DNA, 18 bp, Homo sapiens
tcccacctctgtgacctc

SEQ ID NO: 3834694 - DNA, 12 bp, Homo sapiens
tcccagactaga

SEQ ID NO: 3834695 - DNA, 18 bp, Homo sapiens
tcccaggacaccacaccc

SEQ ID NO: 3834696 - DNA, 19 bp, Homo sapiens
tcccaggacctgagcctgg

SEQ ID NO: 3834697 - DNA, 17 bp, Homo sapiens
tcccaggagggctttgt

SEQ ID NO: 3834698 - DNA, 18 bp, Homo sapiens
tcccaggtaccagctgcg

SEQ ID NO: 3834699 - DNA, 21 bp, Homo sapiens
tcccaggtaccagctgcgctt

SEQ ID NO: 3834700 - DNA, 21 bp, Homo sapiens
tcccatggctttgtgctgctg

SEQ ID NO: 3834701 - DNA, 19 bp, Homo sapiens
tcccattcaccctgtgtaa

SEQ ID NO: 3834702 - DNA, 23 bp, Homo sapiens
tccccaacagcgacatagcccat

SEQ ID NO: 3834703 - DNA, 13 bp, Homo sapiens
tccccacccctgc

SEQ ID NO: 3834704 - DNA, 18 bp, Homo sapiens
tccccacccctgccccca

SEQ ID NO: 3834705 - DNA, 21 bp, Homo sapiens
tccccaccgccctgcctcttc

SEQ ID NO: 3834706 - DNA, 14 bp, Homo sapiens
tccccacgccccca

SEQ ID NO: 3834707 - DNA, 21 bp, Homo sapiens
tccccagacagggctccagcc

SEQ ID NO: 3834708 - DNA, 23 bp, Homo sapiens
tccccagacagggctccagcctg

SEQ ID NO: 3834709 - DNA, 19 bp, Homo sapiens
tccccagagatggctcctt

SEQ ID NO: 3834710 - DNA, 22 bp, Homo sapiens
tccccagagatggctccttggg

SEQ ID NO: 3834711 - DNA, 10 bp, Homo sapiens
tccccagccc

SEQ ID NO: 3834712 - DNA, 12 bp, Homo sapiens
tccccagcccag

SEQ ID NO: 3834713 - DNA, 12 bp, Homo sapiens
tccccagggcag

SEQ ID NO: 3834714 - DNA, 20 bp, Homo sapiens
tccccatcgccagctgatga

SEQ ID NO: 3834715 - DNA, 15 bp, Homo sapiens
tccccatttcccatc

SEQ ID NO: 3834716 - DNA, 16 bp, Homo sapiens
tccccatttcccatct

SEQ ID NO: 3834717 - DNA, 19 bp, Homo sapiens
tccccatttcccatctgca

SEQ ID NO: 3834718 - DNA, 19 bp, Homo sapiens
tccccgatgtgagccgcct

SEQ ID NO: 3834719 - DNA, 24 bp, Homo sapiens
tccccgatgtgagccgcctcggag

SEQ ID NO: 3834720 - DNA, 14 bp, Homo sapiens
tcccctcccctgct

SEQ ID NO: 3834721 - DNA, 17 bp, Homo sapiens
tcccctcccctgctgca

SEQ ID NO: 3834722 - DNA, 12 bp, Homo sapiens
tcccctgcctcc

SEQ ID NO: 3834723 - DNA, 15 bp, Homo sapiens
tcccctgcctccatc

SEQ ID NO: 3834724 - DNA, 17 bp, Homo sapiens
tcccctgcctccatcct

SEQ ID NO: 3834725 - DNA, 15 bp, Homo sapiens
tcccctgctgcaggg

SEQ ID NO: 3834726 - DNA, 17 bp, Homo sapiens
tcccctgctgcaggggc

SEQ ID NO: 3834727 - DNA, 18 bp, Homo sapiens
tcccctgctgcaggggct

SEQ ID NO: 3834728 - DNA, 23 bp, Homo sapiens
tcccctgctgcaggggctctgga

SEQ ID NO: 3834729 - DNA, 21 bp, Homo sapiens
tccccttagagtgctgtgaga

SEQ ID NO: 3834730 - DNA, 15 bp, Homo sapiens
tccccttcccaaccc

SEQ ID NO: 3834731 - DNA, 14 bp, Homo sapiens
tcccgcatggtttt

SEQ ID NO: 3834732 - DNA, 22 bp, Homo sapiens
tcccgcatggtttttataatat

SEQ ID NO: 3834733 - DNA, 18 bp, Homo sapiens
tcccgtactgtctgtgtc

SEQ ID NO: 3834734 - DNA, 15 bp, Homo sapiens
tccctacccagtccc

SEQ ID NO: 3834735 - DNA, 14 bp, Homo sapiens
tccctcccacctct

SEQ ID NO: 3834736 - DNA, 11 bp, Homo sapiens
tccctccccag

SEQ ID NO: 3834737 - DNA, 16 bp, Homo sapiens
tccctcctgcctgcgc

SEQ ID NO: 3834738 - DNA, 13 bp, Homo sapiens
tccctctcctctg

SEQ ID NO: 3834739 - DNA, 15 bp, Homo sapiens
tccctctcctctgtc

SEQ ID NO: 3834740 - DNA, 12 bp, Homo sapiens
tccctctgaccc

SEQ ID NO: 3834741 - DNA, 13 bp, Homo sapiens
tccctctgaccca

SEQ ID NO: 3834742 - DNA, 14 bp, Homo sapiens
tccctctgacccag

SEQ ID NO: 3834743 - DNA, 17 bp, Homo sapiens
tccctctggagtttcat

SEQ ID NO: 3834744 - DNA, 23 bp, Homo sapiens
tccctgcccgaggtcgctgcagc

SEQ ID NO: 3834745 - DNA, 15 bp, Homo sapiens
tccctgcctggtcac

SEQ ID NO: 3834746 - DNA, 14 bp, Homo sapiens
tccctgtgtctttt

SEQ ID NO: 3834747 - DNA, 19 bp, Homo sapiens
tcccttccttttccctgct

SEQ ID NO: 3834748 - DNA, 19 bp, Homo sapiens
tcccttgcactgtatcatt

SEQ ID NO: 3834749 - DNA, 16 bp, Homo sapiens
tccctttttttaagta

SEQ ID NO: 3834750 - DNA, 14 bp, Homo sapiens
tccgagagggagag

SEQ ID NO: 3834751 - DNA, 15 bp, Homo sapiens
tccgccagcctcctc

SEQ ID NO: 3834752 - DNA, 17 bp, Homo sapiens
tccgccagcctcctctg

SEQ ID NO: 3834753 - DNA, 20 bp, Homo sapiens
tccgccagcctcctctggac

SEQ ID NO: 3834754 - DNA, 19 bp, Homo sapiens
tccgcccgcctctgcctcc

SEQ ID NO: 3834755 - DNA, 14 bp, Homo sapiens
tccgctgtgcccgc

SEQ ID NO: 3834756 - DNA, 20 bp, Homo sapiens
tccgctgtgcccgccctggg

SEQ ID NO: 3834757 - DNA, 18 bp, Homo sapiens
tccggcctgcactccccc

SEQ ID NO: 3834758 - DNA, 19 bp, Homo sapiens
tcctaaatatattttaaga

SEQ ID NO: 3834759 - DNA, 16 bp, Homo sapiens
tcctaaggcccagctg

SEQ ID NO: 3834760 - DNA, 15 bp, Homo sapiens
tcctaatttctcctc

SEQ ID NO: 3834761 - DNA, 23 bp, Homo sapiens
tcctacagttggaaatccatcca

SEQ ID NO: 3834762 - DNA, 22 bp, Homo sapiens
tcctaggcattacccaaaagca

SEQ ID NO: 3834763 - DNA, 17 bp, Homo sapiens
tcctagggcctgggttt

SEQ ID NO: 3834764 - DNA, 13 bp, Homo sapiens
tcctcacccctgt

SEQ ID NO: 3834765 - DNA, 17 bp, Homo sapiens
tcctcacccctgtcctc

SEQ ID NO: 3834766 - DNA, 19 bp, Homo sapiens
tcctcacccctgtcctcac

SEQ ID NO: 3834767 - DNA, 20 bp, Homo sapiens
tcctcacccctgtcctcact

SEQ ID NO: 3834768 - DNA, 20 bp, Homo sapiens
tgccctggctgctgccccca

SEQ ID NO: 3834769 - DNA, 19 bp, Homo sapiens
tgccctgggctgcctcctc

SEQ ID NO: 3834770 - DNA, 15 bp, Homo sapiens
tgccgcaataaatgc

SEQ ID NO: 3834771 - DNA, 20 bp, Homo sapiens
tgccgcactagcctccctct

SEQ ID NO: 3834772 - DNA, 18 bp, Homo sapiens
tgcctactgcccctgccc

SEQ ID NO: 3834773 - DNA, 14 bp, Homo sapiens
tgcctcatgaacac

SEQ ID NO: 3834774 - DNA, 20 bp, Homo sapiens
tgcctccccatttcccatct

SEQ ID NO: 3834775 - DNA, 22 bp, Homo sapiens
tgcctccccatttcccatctgc

SEQ ID NO: 3834776 - DNA, 23 bp, Homo sapiens
tgcctccccatttcccatctgca

SEQ ID NO: 3834777 - DNA, 15 bp, Homo sapiens
tgcctccggcctgca

SEQ ID NO: 3834778 - DNA, 15 bp, Homo sapiens
tgcctcctcctgaga

SEQ ID NO: 3834779 - DNA, 18 bp, Homo sapiens
tgcctcgggaacctcact

SEQ ID NO: 3834780 - DNA, 23 bp, Homo sapiens
tgcctcgggaacctcactcttgc

SEQ ID NO: 3834781 - DNA, 24 bp, Homo sapiens
tgcctcgggaacctcactcttgcc

SEQ ID NO: 3834782 - DNA, 14 bp, Homo sapiens
tgcctctcccatgg

SEQ ID NO: 3834783 - DNA, 14 bp, Homo sapiens
tgcctgagaggcag

SEQ ID NO: 3834784 - DNA, 15 bp, Homo sapiens
tgcctgagaggcagg

SEQ ID NO: 3834785 - DNA, 12 bp, Homo sapiens
tgcctgagcccc

SEQ ID NO: 3834786 - DNA, 13 bp, Homo sapiens
tgcctgagccccc

SEQ ID NO: 3834787 - DNA, 12 bp, Homo sapiens
tgcctgccccgc

SEQ ID NO: 3834788 - DNA, 12 bp, Homo sapiens
tgcctgctgctg

SEQ ID NO: 3834789 - DNA, 12 bp, Homo sapiens
tgcctgggagga

SEQ ID NO: 3834790 - DNA, 16 bp, Homo sapiens
tgcctggtcacagggc

SEQ ID NO: 3834791 - DNA, 17 bp, Homo sapiens
tgcctggtcacagggca

SEQ ID NO: 3834792 - DNA, 20 bp, Homo sapiens
tgcctgttgcaggcaaatgt

SEQ ID NO: 3834793 - DNA, 20 bp, Homo sapiens
tgccttaaaaccaaagaggg

SEQ ID NO: 3834794 - DNA, 17 bp, Homo sapiens
tgccttaccgagagcca

SEQ ID NO: 3834795 - DNA, 20 bp, Homo sapiens
tgccttaccgagagccaaac

SEQ ID NO: 3834796 - DNA, 19 bp, Homo sapiens
tgccttagagccaggcaca

SEQ ID NO: 3834797 - DNA, 13 bp, Homo sapiens
tgccttccctagc

SEQ ID NO: 3834798 - DNA, 14 bp, Homo sapiens
tgccttccctagct

SEQ ID NO: 3834799 - DNA, 17 bp, Homo sapiens
tgccttccctagcttta

SEQ ID NO: 3834800 - DNA, 21 bp, Homo sapiens
tgcgaccaccaacacacagga

SEQ ID NO: 3834801 - DNA, 15 bp, Homo sapiens
tgcgcagctccttcc

SEQ ID NO: 3834802 - DNA, 14 bp, Homo sapiens
tgcgcttgcttttc

SEQ ID NO: 3834803 - DNA, 23 bp, Homo sapiens
tgcggaccccagctgtgagcctt

SEQ ID NO: 3834804 - DNA, 13 bp, Homo sapiens
tgcgggaagctga

SEQ ID NO: 3834805 - DNA, 22 bp, Homo sapiens
tgcgtcctcctcacctcatgcc

SEQ ID NO: 3834806 - DNA, 22 bp, Homo sapiens
tgctaaccccgtctgctcctcc

SEQ ID NO: 3834807 - DNA, 13 bp, Homo sapiens
tgctactaacaga

SEQ ID NO: 3834808 - DNA, 15 bp, Homo sapiens
tgctactaacagatt

SEQ ID NO: 3834809 - DNA, 23 bp, Homo sapiens
tgctactaacagattataataaa

SEQ ID NO: 3834810 - DNA, 20 bp, Homo sapiens
tgctagcacctccccagaca

SEQ ID NO: 3834811 - DNA, 23 bp, Homo sapiens
tgctagcacctccccagacaggg

SEQ ID NO: 3834812 - DNA, 18 bp, Homo sapiens
tgctatctgaactaattc

SEQ ID NO: 3834813 - DNA, 18 bp, Homo sapiens
tgctcaatcatgtgccag

SEQ ID NO: 3834814 - DNA, 19 bp, Homo sapiens
tgctcaatcatgtgccaga

SEQ ID NO: 3834815 - DNA, 13 bp, Homo sapiens
tgctcactacctc

SEQ ID NO: 3834816 - DNA, 17 bp, Homo sapiens
tgctcactacctcctca

SEQ ID NO: 3834817 - DNA, 18 bp, Homo sapiens
tgctcactacctcctcag

SEQ ID NO: 3834818 - DNA, 12 bp, Homo sapiens
tgctcagccctg

SEQ ID NO: 3834819 - DNA, 16 bp, Homo sapiens
tgctcagccctggagg

SEQ ID NO: 3834820 - DNA, 20 bp, Homo sapiens
tgctcagccctggaggtgcc

SEQ ID NO: 3834821 - DNA, 15 bp, Homo sapiens
tgctcagtctccttg

SEQ ID NO: 3834822 - DNA, 19 bp, Homo sapiens
tgctcattctaatgatggc

SEQ ID NO: 3834823 - DNA, 21 bp, Homo sapiens
tgctcattctaatgatggccc

SEQ ID NO: 3834824 - DNA, 20 bp, Homo sapiens
tgctccctgaagccagcctt

SEQ ID NO: 3834825 - DNA, 13 bp, Homo sapiens
tgctcctccctcc

SEQ ID NO: 3834826 - DNA, 15 bp, Homo sapiens
tgctcctccctctga

SEQ ID NO: 3834827 - DNA, 21 bp, Homo sapiens
tgctcctcgctcgcacctgcc

SEQ ID NO: 3834828 - DNA, 11 bp, Homo sapiens
tgctctcagct

SEQ ID NO: 3834829 - DNA, 14 bp, Homo sapiens
tgctctcagcttgt

SEQ ID NO: 3834830 - DNA, 19 bp, Homo sapiens
tgctctcagcttgtgcctt

SEQ ID NO: 3834831 - DNA, 13 bp, Homo sapiens
tgctctggacctg

SEQ ID NO: 3834832 - DNA, 16 bp, Homo sapiens
tgctctggacctgccc

SEQ ID NO: 3834833 - DNA, 18 bp, Homo sapiens
tgctctgtcctccccacc

SEQ ID NO: 3834834 - DNA, 19 bp, Homo sapiens
tgctgaagcttattaatgc

SEQ ID NO: 3834835 - DNA, 15 bp, Homo sapiens
tgctgcatcccacca

SEQ ID NO: 3834836 - DNA, 12 bp, Homo sapiens
tgctgcatttta

SEQ ID NO: 3834837 - DNA, 20 bp, Homo sapiens
tgctgcattttaagcataat

SEQ ID NO: 3834838 - DNA, 15 bp, Homo sapiens
tgctgcccccacccc

SEQ ID NO: 3834839 - DNA, 20 bp, Homo sapiens
tgctgcccccaccccgggga

SEQ ID NO: 3834840 - DNA, 17 bp, Homo sapiens
tgctgcctgctttttat

SEQ ID NO: 3834841 - DNA, 13 bp, Homo sapiens
tgctgccttctgg

SEQ ID NO: 3834842 - DNA, 20 bp, Homo sapiens
tgctgccttctggattcttg

SEQ ID NO: 3834843 - DNA, 16 bp, Homo sapiens
tgctgctgctcctccc

SEQ ID NO: 3834844 - DNA, 18 bp, Homo sapiens
tgctggagaaatcttgaa

SEQ ID NO: 3834845 - DNA, 13 bp, Homo sapiens
tgctggagaagag

SEQ ID NO: 3834846 - DNA, 12 bp, Homo sapiens
tgctggagcctg

SEQ ID NO: 3834847 - DNA, 13 bp, Homo sapiens
tgctggagcctgt

SEQ ID NO: 3834848 - DNA, 15 bp, Homo sapiens
tgctggagcctgtgt

SEQ ID NO: 3834849 - DNA, 17 bp, Homo sapiens
tgctggagcctgtgtaa

SEQ ID NO: 3834850 - DNA, 19 bp, Homo sapiens
tgctggagcctgtgtaaca

SEQ ID NO: 3834851 - DNA, 15 bp, Homo sapiens
tgctggaggtgggag

SEQ ID NO: 3834852 - DNA, 16 bp, Homo sapiens
tgctggaggtgggagc

SEQ ID NO: 3834853 - DNA, 22 bp, Homo sapiens
tgctggaggtgggagcaggaga

SEQ ID NO: 3834854 - DNA, 23 bp, Homo sapiens
tgctggaggtgggagcaggagat

SEQ ID NO: 3834855 - DNA, 17 bp, Homo sapiens
tgctggatggagcccag

SEQ ID NO: 3834856 - DNA, 18 bp, Homo sapiens
tgctggatggagcccagg

SEQ ID NO: 3834857 - DNA, 12 bp, Homo sapiens
tgctggccatgg

SEQ ID NO: 3834858 - DNA, 20 bp, Homo sapiens
tgctgggaggagggagaggg

SEQ ID NO: 3834859 - DNA, 22 bp, Homo sapiens
tgctggtgtttatgtgaacatt

SEQ ID NO: 3834860 - DNA, 17 bp, Homo sapiens
tgctgtaaatatttcat

SEQ ID NO: 3834861 - DNA, 23 bp, Homo sapiens
tgctgtaaatatttcataaatta

SEQ ID NO: 3834862 - DNA, 14 bp, Homo sapiens
tgctgtctctagaa

SEQ ID NO: 3834863 - DNA, 21 bp, Homo sapiens
tgcttaacagttgctttggat

SEQ ID NO: 3834864 - DNA, 12 bp, Homo sapiens
tgctttataaat

SEQ ID NO: 3834865 - DNA, 15 bp, Homo sapiens
tgctttgccccactg

SEQ ID NO: 3834866 - DNA, 20 bp, Homo sapiens
tgctttgccccactgggaga

SEQ ID NO: 3834867 - DNA, 15 bp, Homo sapiens
tgctttgggtttgtg

SEQ ID NO: 3834868 - DNA, 22 bp, Homo sapiens
tgctttgtatcagtcagtgctg

SEQ ID NO: 3834869 - DNA, 16 bp, Homo sapiens
tgcttttctgccctgg

SEQ ID NO: 3834870 - DNA, 14 bp, Homo sapiens
tgctttttcaggtt

SEQ ID NO: 3834871 - DNA, 13 bp, Homo sapiens
tgcttttttagat

SEQ ID NO: 3834872 - DNA, 12 bp, Homo sapiens
tggaaaaagtga

SEQ ID NO: 3834873 - DNA, 17 bp, Homo sapiens
tggaaaaagtgatggag

SEQ ID NO: 3834874 - DNA, 9 bp, Homo sapiens
tggaaaact

SEQ ID NO: 3834875 - DNA, 13 bp, Homo sapiens
tggaaaggggaga

SEQ ID NO: 3834876 - DNA, 15 bp, Homo sapiens
tggaaaggggagagc

SEQ ID NO: 3834877 - DNA, 18 bp, Homo sapiens
tggaaatggggagctggc

SEQ ID NO: 3834878 - DNA, 14 bp, Homo sapiens
tggaacgcattttg

SEQ ID NO: 3834879 - DNA, 15 bp, Homo sapiens
tggaatgatgtatat

SEQ ID NO: 3834880 - DNA, 19 bp, Homo sapiens
tggaatggattttcctgaa

SEQ ID NO: 3834881 - DNA, 15 bp, Homo sapiens
tggaattactgaaag

SEQ ID NO: 3834882 - DNA, 14 bp, Homo sapiens
tggaatttgaaaca

SEQ ID NO: 3834883 - DNA, 22 bp, Homo sapiens
tggacattgttggcagcataaa

SEQ ID NO: 3834884 - DNA, 20 bp, Homo sapiens
tggacggcaggctcactgcc

SEQ ID NO: 3834885 - DNA, 23 bp, Homo sapiens
tggacggcaggctcactgccagg

SEQ ID NO: 3834886 - DNA, 15 bp, Homo sapiens
tggactgatgctttt

SEQ ID NO: 3834887 - DNA, 15 bp, Homo sapiens
tggacttagaaagca

SEQ ID NO: 3834888 - DNA, 16 bp, Homo sapiens
tggacttagaaagcag

SEQ ID NO: 3834889 - DNA, 19 bp, Homo sapiens
tggagaagagaggagagga

SEQ ID NO: 3834890 - DNA, 13 bp, Homo sapiens
tggagacagcccc

SEQ ID NO: 3834891 - DNA, 19 bp, Homo sapiens
tggagagttgggggccagc

SEQ ID NO: 3834892 - DNA, 14 bp, Homo sapiens
tggagcaagccctg

SEQ ID NO: 3834893 - DNA, 16 bp, Homo sapiens
tggagcccaggcggga

SEQ ID NO: 3834894 - DNA, 17 bp, Homo sapiens
tggagcctgtgtaacag

SEQ ID NO: 3834895 - DNA, 17 bp, Homo sapiens
tggaggaggaaggcaag

SEQ ID NO: 3834896 - DNA, 15 bp, Homo sapiens
tggaggccgctgctg

SEQ ID NO: 3834897 - DNA, 16 bp, Homo sapiens
tggaggcttcctgcgt

SEQ ID NO: 3834898 - DNA, 22 bp, Homo sapiens
tggaggcttcctgcgtcctcct

SEQ ID NO: 3834899 - DNA, 16 bp, Homo sapiens
tggaggggagctgctg

SEQ ID NO: 3834900 - DNA, 20 bp, Homo sapiens
tggagggggaggggagaagc

SEQ ID NO: 3834901 - DNA, 13 bp, Homo sapiens
ttccaacgtaaat

SEQ ID NO: 3834902 - DNA, 21 bp, Homo sapiens
ttccacaaaattatgctgcat

SEQ ID NO: 3834903 - DNA, 19 bp, Homo sapiens
ttccactacacctggctga

SEQ ID NO: 3834904 - DNA, 22 bp, Homo sapiens
ttccagagaagcctatttttat

SEQ ID NO: 3834905 - DNA, 23 bp, Homo sapiens
ttccaggaaactccacatctgcc

SEQ ID NO: 3834906 - DNA, 20 bp, Homo sapiens
ttccaggaggagttagccaa

SEQ ID NO: 3834907 - DNA, 22 bp, Homo sapiens
ttccaggaggagttagccaaac

SEQ ID NO: 3834908 - DNA, 17 bp, Homo sapiens
ttccagtgatgttgaaa

SEQ ID NO: 3834909 - DNA, 17 bp, Homo sapiens
ttccatcctttgcattt

SEQ ID NO: 3834910 - DNA, 20 bp, Homo sapiens
ttccatcctttgcatttctc

SEQ ID NO: 3834911 - DNA, 16 bp, Homo sapiens
ttcccaccaatcctca

SEQ ID NO: 3834912 - DNA, 20 bp, Homo sapiens
ttcccaggagttctgctcat

SEQ ID NO: 3834913 - DNA, 14 bp, Homo sapiens
ttcccatctgcacc

SEQ ID NO: 3834914 - DNA, 17 bp, Homo sapiens
ttccccaccgccctgcc

SEQ ID NO: 3834915 - DNA, 12 bp, Homo sapiens
ttccccagccca

SEQ ID NO: 3834916 - DNA, 15 bp, Homo sapiens
ttccccagcccaggg

SEQ ID NO: 3834917 - DNA, 11 bp, Homo sapiens
ttcccctctcc

SEQ ID NO: 3834918 - DNA, 20 bp, Homo sapiens
ttccccttagagtgctgtga

SEQ ID NO: 3834919 - DNA, 12 bp, Homo sapiens
ttccccttccca

SEQ ID NO: 3834920 - DNA, 16 bp, Homo sapiens
ttccctgcttccagga

SEQ ID NO: 3834921 - DNA, 14 bp, Homo sapiens
ttccctgtgtcttt

SEQ ID NO: 3834922 - DNA, 22 bp, Homo sapiens
ttccctttggggatagtctgga

SEQ ID NO: 3834923 - DNA, 14 bp, Homo sapiens
ttcctaaggcccag

SEQ ID NO: 3834924 - DNA, 17 bp, Homo sapiens
ttcctaaggcccagctg

SEQ ID NO: 3834925 - DNA, 18 bp, Homo sapiens
ttcctaaggcccagctgc

SEQ ID NO: 3834926 - DNA, 21 bp, Homo sapiens
ttcctaaggcccagctgccag

SEQ ID NO: 3834927 - DNA, 23 bp, Homo sapiens
ttcctaaggcccagctgccaggg

SEQ ID NO: 3834928 - DNA, 22 bp, Homo sapiens
ttcctctaccaccacaccaaat

SEQ ID NO: 3834929 - DNA, 15 bp, Homo sapiens
ttcctctagaagcca

SEQ ID NO: 3834930 - DNA, 17 bp, Homo sapiens
ttcctctagaagccaag

SEQ ID NO: 3834931 - DNA, 15 bp, Homo sapiens
ttcctctgcctgccc

SEQ ID NO: 3834932 - DNA, 16 bp, Homo sapiens
ttcctctgcctgcccc

SEQ ID NO: 3834933 - DNA, 15 bp, Homo sapiens
ttcctgcgtcctcct

SEQ ID NO: 3834934 - DNA, 19 bp, Homo sapiens
ttcctgcgtcctcctcacc

SEQ ID NO: 3834935 - DNA, 17 bp, Homo sapiens
ttccttcttgccttcag

SEQ ID NO: 3834936 - DNA, 17 bp, Homo sapiens
ttcctttataattcttt

SEQ ID NO: 3834937 - DNA, 15 bp, Homo sapiens
ttccttttccctgct

SEQ ID NO: 3834938 - DNA, 17 bp, Homo sapiens
ttccttttccctgcttc

SEQ ID NO: 3834939 - DNA, 18 bp, Homo sapiens
ttcgccaaactgtctctg

SEQ ID NO: 3834940 - DNA, 12 bp, Homo sapiens
ttctaagagaag

SEQ ID NO: 3834941 - DNA, 18 bp, Homo sapiens
ttctaatatttattgctt

SEQ ID NO: 3834942 - DNA, 19 bp, Homo sapiens
ttctaatatttattgcttt

SEQ ID NO: 3834943 - DNA, 12 bp, Homo sapiens
ttctactgtatg

SEQ ID NO: 3834944 - DNA, 13 bp, Homo sapiens
ttctacttgctct

SEQ ID NO: 3834945 - DNA, 14 bp, Homo sapiens
ttctatagcttttc

SEQ ID NO: 3834946 - DNA, 13 bp, Homo sapiens
ttctatttgctat

SEQ ID NO: 3834947 - DNA, 21 bp, Homo sapiens
ttctattttcattttctgcaa

SEQ ID NO: 3834948 - DNA, 21 bp, Homo sapiens
ttctcaggacgacgaatcttc

SEQ ID NO: 3834949 - DNA, 15 bp, Homo sapiens
ttctccgccagcctc

SEQ ID NO: 3834950 - DNA, 19 bp, Homo sapiens
ttctcctcccttccttttc

SEQ ID NO: 3834951 - DNA, 13 bp, Homo sapiens
ttctcctgcctca

SEQ ID NO: 3834952 - DNA, 19 bp, Homo sapiens
ttctctagtttcccctctc

SEQ ID NO: 3834953 - DNA, 12 bp, Homo sapiens
ttctctcctccc

SEQ ID NO: 3834954 - DNA, 15 bp, Homo sapiens
ttctctcctccccaa

SEQ ID NO: 3834955 - DNA, 17 bp, Homo sapiens
ttctctcctccccaaat

SEQ ID NO: 3834956 - DNA, 14 bp, Homo sapiens
ttctctctgagctg

SEQ ID NO: 3834957 - DNA, 13 bp, Homo sapiens
ttctctgtaatta

SEQ ID NO: 3834958 - DNA, 15 bp, Homo sapiens
ttctctgtaattaca

SEQ ID NO: 3834959 - DNA, 18 bp, Homo sapiens
ttctctgtaattacaact

SEQ ID NO: 3834960 - DNA, 19 bp, Homo sapiens
ttctcttactttttgtaaa

SEQ ID NO: 3834961 - DNA, 22 bp, Homo sapiens
ttctgaagcctctaacaaatga

SEQ ID NO: 3834962 - DNA, 14 bp, Homo sapiens
ttctgccctggctg

SEQ ID NO: 3834963 - DNA, 16 bp, Homo sapiens
ttctgccctggctgct

SEQ ID NO: 3834964 - DNA, 20 bp, Homo sapiens
ttctgccctggctgctgccc

SEQ ID NO: 3834965 - DNA, 19 bp, Homo sapiens
ttctgctcattctaatgat

SEQ ID NO: 3834966 - DNA, 17 bp, Homo sapiens
ttctgcttttctgccct

SEQ ID NO: 3834967 - DNA, 20 bp, Homo sapiens
ttctgtatttttttttctaa

SEQ ID NO: 3834968 - DNA, 21 bp, Homo sapiens
ttctgtgccaaagcagctaca

SEQ ID NO: 3834969 - DNA, 13 bp, Homo sapiens
ttcttccatccca

SEQ ID NO: 3834970 - DNA, 12 bp, Homo sapiens
ttcttgccttca

SEQ ID NO: 3834971 - DNA, 18 bp, Homo sapiens
ttcttggagtcttccaaa

SEQ ID NO: 3834972 - DNA, 22 bp, Homo sapiens
ttcttgtgacagattatacaga

SEQ ID NO: 3834973 - DNA, 23 bp, Homo sapiens
ttctttttccttcataattttca

SEQ ID NO: 3834974 - DNA, 15 bp, Homo sapiens
ttctttttttgcata

SEQ ID NO: 3834975 - DNA, 16 bp, Homo sapiens
ttctttttttgcatat

SEQ ID NO: 3834976 - DNA, 18 bp, Homo sapiens
ttgaaaattaacatgaat

SEQ ID NO: 3834977 - DNA, 18 bp, Homo sapiens
ttgaaacaacattatttt

SEQ ID NO: 3834978 - DNA, 13 bp, Homo sapiens
ttgaagattcagg

SEQ ID NO: 3834979 - DNA, 15 bp, Homo sapiens
ttgaagccaaagaaa

SEQ ID NO: 3834980 - DNA, 14 bp, Homo sapiens
ttgaagctcagaaa

SEQ ID NO: 3834981 - DNA, 14 bp, Homo sapiens
ttgaatatgtgcct

SEQ ID NO: 3834982 - DNA, 23 bp, Homo sapiens
ttgaattgcattttttaaaacaa

SEQ ID NO: 3834983 - DNA, 16 bp, Homo sapiens
ttgagctgccttccct

SEQ ID NO: 3834984 - DNA, 19 bp, Homo sapiens
ttgaggggctccccagagg

SEQ ID NO: 3834985 - DNA, 15 bp, Homo sapiens
ttgagtatcataata

SEQ ID NO: 3834986 - DNA, 15 bp, Homo sapiens
ttgagttttcatttc

SEQ ID NO: 3834987 - DNA, 21 bp, Homo sapiens
ttgattgagagtaacttaagt

SEQ ID NO: 3834988 - DNA, 21 bp, Homo sapiens
ttgcactgtatcatttcatgc

SEQ ID NO: 3834989 - DNA, 14 bp, Homo sapiens
ttgcatagaataaa

SEQ ID NO: 3834990 - DNA, 17 bp, Homo sapiens
ttgcattaaaagactgt

SEQ ID NO: 3834991 - DNA, 22 bp, Homo sapiens
ttgccaacctgtaataaatatg

SEQ ID NO: 3834992 - DNA, 16 bp, Homo sapiens
ttgccaagccctttgc

SEQ ID NO: 3834993 - DNA, 17 bp, Homo sapiens
ttgccaagccctttgct

SEQ ID NO: 3834994 - DNA, 18 bp, Homo sapiens
ttgccaagccctttgctg

SEQ ID NO: 3834995 - DNA, 18 bp, Homo sapiens
ttgccagttttattttct

SEQ ID NO: 3834996 - DNA, 12 bp, Homo sapiens
ttgccatttctt

SEQ ID NO: 3834997 - DNA, 16 bp, Homo sapiens
ttgcccacttctgtgt

SEQ ID NO: 3834998 - DNA, 17 bp, Homo sapiens
ttgcccacttctgtgta

SEQ ID NO: 3834999 - DNA, 16 bp, Homo sapiens
ttgccccactgggaga

SEQ ID NO: 3835000 - DNA, 18 bp, Homo sapiens
ttgccctgggctgcctcc

SEQ ID NO: 3835001 - DNA, 21 bp, Homo sapiens
ttgcgaccaccaacacacagg

SEQ ID NO: 3835002 - DNA, 22 bp, Homo sapiens
ttgctcccaggagggctttgtg

SEQ ID NO: 3835003 - DNA, 13 bp, Homo sapiens
ttgctctggacct

SEQ ID NO: 3835004 - DNA, 16 bp, Homo sapiens
ttgctctggacctgcc

SEQ ID NO: 3835005 - DNA, 13 bp, Homo sapiens
ttgctgcatttta

SEQ ID NO: 3835006 - DNA, 15 bp, Homo sapiens
ttgctgcattttaag

SEQ ID NO: 3835007 - DNA, 17 bp, Homo sapiens
ttgctgcattttaagca

SEQ ID NO: 3835008 - DNA, 16 bp, Homo sapiens
ttgctttataaataaa

SEQ ID NO: 3835009 - DNA, 17 bp, Homo sapiens
ttggaaaaagtgatgga

SEQ ID NO: 3835010 - DNA, 17 bp, Homo sapiens
ttggaaaactaactcag

SEQ ID NO: 3835011 - DNA, 18 bp, Homo sapiens
ttggaaatggggagctgg

SEQ ID NO: 3835012 - DNA, 19 bp, Homo sapiens
ttggaaatggggagctggc

SEQ ID NO: 3835013 - DNA, 19 bp, Homo sapiens
ttggatgattgttcataat

SEQ ID NO: 3835014 - DNA, 14 bp, Homo sapiens
ttggcctgctgtga

SEQ ID NO: 3835015 - DNA, 12 bp, Homo sapiens
ttggctcagaaa

SEQ ID NO: 3835016 - DNA, 14 bp, Homo sapiens
ttggctctggagac

SEQ ID NO: 3835017 - DNA, 20 bp, Homo sapiens
ttggctctggagacagcccc

SEQ ID NO: 3835018 - DNA, 22 bp, Homo sapiens
ttggctctggagacagccccag

SEQ ID NO: 3835019 - DNA, 19 bp, Homo sapiens
ttgggagcaatctggaaaa

SEQ ID NO: 3835020 - DNA, 22 bp, Homo sapiens
ttgggaggaagcagaataaagc

SEQ ID NO: 3835021 - DNA, 16 bp, Homo sapiens
ttgggatactgcaggg

SEQ ID NO: 3835022 - DNA, 13 bp, Homo sapiens
ttgggttgtttaa

SEQ ID NO: 3835023 - DNA, 17 bp, Homo sapiens
ttgggttgtttaaaaat

SEQ ID NO: 3835024 - DNA, 12 bp, Homo sapiens
ttggtaaacctt

SEQ ID NO: 3835025 - DNA, 21 bp, Homo sapiens
ttggttttatactatattaac

SEQ ID NO: 3835026 - DNA, 23 bp, Homo sapiens
ttgtaaaaagtagattaaaatat

SEQ ID NO: 3835027 - DNA, 14 bp, Homo sapiens
ttgtaaaagctaag

SEQ ID NO: 3835028 - DNA, 13 bp, Homo sapiens
ttgtaaactaaag

SEQ ID NO: 3835029 - DNA, 15 bp, Homo sapiens
ttgtaaatagtttaa

SEQ ID NO: 3835030 - DNA, 18 bp, Homo sapiens
ttgtacaaaaaagttata

SEQ ID NO: 3835031 - DNA, 16 bp, Homo sapiens
ttgtagtttgcccaga

SEQ ID NO: 3835032 - DNA, 21 bp, Homo sapiens
ttgtattatagtactgcttta

SEQ ID NO: 3835033 - DNA, 14 bp, Homo sapiens
ttgtattcagagtt

SEQ ID NO: 3835034 - DNA, 17 bp, Homo sapiens
aatatattgtgttttaa

SEQ ID NO: 3835035 - DNA, 16 bp, Homo sapiens
aatatattttaaatgt

SEQ ID NO: 3835036 - DNA, 15 bp, Homo sapiens
aatatattttaagac

SEQ ID NO: 3835037 - DNA, 21 bp, Homo sapiens
aatatattttaagacgaaaca

SEQ ID NO: 3835038 - DNA, 20 bp, Homo sapiens
aatattaaaaagaagtttct

SEQ ID NO: 3835039 - DNA, 22 bp, Homo sapiens
aatattagtttttattaaactc

SEQ ID NO: 3835040 - DNA, 20 bp, Homo sapiens
aatattgacaagtgtctttt

SEQ ID NO: 3835041 - DNA, 12 bp, Homo sapiens
aatatttattgc

SEQ ID NO: 3835042 - DNA, 11 bp, Homo sapiens
aatatttcata

SEQ ID NO: 3835043 - DNA, 13 bp, Homo sapiens
aatatttcataaa

SEQ ID NO: 3835044 - DNA, 20 bp, Homo sapiens
aatatttcataaattaacaa

SEQ ID NO: 3835045 - DNA, 17 bp, Homo sapiens
aatatttgtctgtgtgc

SEQ ID NO: 3835046 - DNA, 23 bp, Homo sapiens
aatcaaaggggatatatgtttgt

SEQ ID NO: 3835047 - DNA, 13 bp, Homo sapiens
aatcaatcagaag

SEQ ID NO: 3835048 - DNA, 21 bp, Homo sapiens
aatcccagctacttgggaggt

SEQ ID NO: 3835049 - DNA, 20 bp, Homo sapiens
aatcccttaatctatgtgca

SEQ ID NO: 3835050 - DNA, 17 bp, Homo sapiens
aatcccttcctctccca

SEQ ID NO: 3835051 - DNA, 16 bp, Homo sapiens
aatcctaatttctcct

SEQ ID NO: 3835052 - DNA, 13 bp, Homo sapiens
aatcctgcacaga

SEQ ID NO: 3835053 - DNA, 15 bp, Homo sapiens
aatctatatttttgt

SEQ ID NO: 3835054 - DNA, 16 bp, Homo sapiens
aatcttgatagctaaa

SEQ ID NO: 3835055 - DNA, 19 bp, Homo sapiens
aatgaaagtcttgtgacta

SEQ ID NO: 3835056 - DNA, 20 bp, Homo sapiens
aatgaaagtcttgtgactag

SEQ ID NO: 3835057 - DNA, 20 bp, Homo sapiens
aatgactggctacagagtaa

SEQ ID NO: 3835058 - DNA, 12 bp, Homo sapiens
aatgagaaatct

SEQ ID NO: 3835059 - DNA, 23 bp, Homo sapiens
aatgaggtgggaggtggaagaag

SEQ ID NO: 3835060 - DNA, 13 bp, Homo sapiens
aatgatggcccat

SEQ ID NO: 3835061 - DNA, 21 bp, Homo sapiens
aatgatggcccattctacttg

SEQ ID NO: 3835062 - DNA, 22 bp, Homo sapiens
aatgatggcccattctacttgc

SEQ ID NO: 3835063 - DNA, 13 bp, Homo sapiens
aatgatttgtaaa

SEQ ID NO: 3835064 - DNA, 18 bp, Homo sapiens
aatgatttgtaaaggact

SEQ ID NO: 3835065 - DNA, 17 bp, Homo sapiens
aatgcacagttctattt

SEQ ID NO: 3835066 - DNA, 18 bp, Homo sapiens
aatgcacagttctatttg

SEQ ID NO: 3835067 - DNA, 20 bp, Homo sapiens
aatgcacagttctatttgct

SEQ ID NO: 3835068 - DNA, 19 bp, Homo sapiens
aatgcataatgtctttaaa

SEQ ID NO: 3835069 - DNA, 13 bp, Homo sapiens
aatgcctgctgct

SEQ ID NO: 3835070 - DNA, 14 bp, Homo sapiens
aatgcctgctgctg

SEQ ID NO: 3835071 - DNA, 18 bp, Homo sapiens
aatgcctgctgctgccaa

SEQ ID NO: 3835072 - DNA, 19 bp, Homo sapiens
aatgccttaattaaagaat

SEQ ID NO: 3835073 - DNA, 20 bp, Homo sapiens
aatgctgtatgtcattaaag

SEQ ID NO: 3835074 - DNA, 21 bp, Homo sapiens
aatgctgtatgtcattaaagt

SEQ ID NO: 3835075 - DNA, 17 bp, Homo sapiens
aatggcaggttttacac

SEQ ID NO: 3835076 - DNA, 15 bp, Homo sapiens
aatggggagctggcc

SEQ ID NO: 3835077 - DNA, 21 bp, Homo sapiens
aatggtctcatctcctttgct

SEQ ID NO: 3835078 - DNA, 15 bp, Homo sapiens
aatgtaaagtctaga

SEQ ID NO: 3835079 - DNA, 19 bp, Homo sapiens
aatgtaaagtctagaaaat

SEQ ID NO: 3835080 - DNA, 23 bp, Homo sapiens
aatgtaactgaagcataaacatc

SEQ ID NO: 3835081 - DNA, 16 bp, Homo sapiens
aatgtatgaattttgt

SEQ ID NO: 3835082 - DNA, 17 bp, Homo sapiens
aatgtatgaattttgta

SEQ ID NO: 3835083 - DNA, 18 bp, Homo sapiens
aatgtatgaattttgtaa

SEQ ID NO: 3835084 - DNA, 22 bp, Homo sapiens
aatgtatgaattttgtaagtat

SEQ ID NO: 3835085 - DNA, 15 bp, Homo sapiens
aatgtatttttgtaa

SEQ ID NO: 3835086 - DNA, 14 bp, Homo sapiens
aatgtctggggaca

SEQ ID NO: 3835087 - DNA, 12 bp, Homo sapiens
aatgttgtgtgt

SEQ ID NO: 3835088 - DNA, 14 bp, Homo sapiens
aatgtttaggaaat

SEQ ID NO: 3835089 - DNA, 16 bp, Homo sapiens
aatgtttaggaaattt

SEQ ID NO: 3835090 - DNA, 21 bp, Homo sapiens
aatgtttattgggcaataaaa

SEQ ID NO: 3835091 - DNA, 19 bp, Homo sapiens
aattaagaaagattaaata

SEQ ID NO: 3835092 - DNA, 20 bp, Homo sapiens
aattaagaaaggataaagtt

SEQ ID NO: 3835093 - DNA, 15 bp, Homo sapiens
aattacaactaaatt

SEQ ID NO: 3835094 - DNA, 23 bp, Homo sapiens
aattacatgaagatttggttttt

SEQ ID NO: 3835095 - DNA, 15 bp, Homo sapiens
aattatcaagctaat

SEQ ID NO: 3835096 - DNA, 12 bp, Homo sapiens
aattatgctgca

SEQ ID NO: 3835097 - DNA, 18 bp, Homo sapiens
aattatttttttaaactt

SEQ ID NO: 3835098 - DNA, 19 bp, Homo sapiens
aattcatggctttttcttt

SEQ ID NO: 3835099 - DNA, 16 bp, Homo sapiens
aattcatttattaagt

SEQ ID NO: 3835100 - DNA, 18 bp, Homo sapiens
aattcatttattaagtat

SEQ ID NO: 3835101 - DNA, 23 bp, Homo sapiens
aattcatttattaagtatatttg

SEQ ID NO: 3835102 - DNA, 12 bp, Homo sapiens
aattccccttcc

SEQ ID NO: 3835103 - DNA, 14 bp, Homo sapiens
aattccctctggag

SEQ ID NO: 3835104 - DNA, 17 bp, Homo sapiens
aattgccagcttttata

SEQ ID NO: 3835105 - DNA, 14 bp, Homo sapiens
aattgctcaaaaaa

SEQ ID NO: 3835106 - DNA, 18 bp, Homo sapiens
aattgctttcctgcctcc

SEQ ID NO: 3835107 - DNA, 14 bp, Homo sapiens
aattgtacaaaaaa

SEQ ID NO: 3835108 - DNA, 13 bp, Homo sapiens
aattgtgtctgca

SEQ ID NO: 3835109 - DNA, 22 bp, Homo sapiens
aatttaaaataaataaactttg

SEQ ID NO: 3835110 - DNA, 14 bp, Homo sapiens
aatttcatgaaaac

SEQ ID NO: 3835111 - DNA, 20 bp, Homo sapiens
aatttgaaacactttgcata

SEQ ID NO: 3835112 - DNA, 15 bp, Homo sapiens
aatttgtttgtgctt

SEQ ID NO: 3835113 - DNA, 18 bp, Homo sapiens
aatttgtttgtgcttcta

SEQ ID NO: 3835114 - DNA, 13 bp, Homo sapiens
aattttaaatgca

SEQ ID NO: 3835115 - DNA, 15 bp, Homo sapiens
aattttcaaaagaaa

SEQ ID NO: 3835116 - DNA, 17 bp, Homo sapiens
aattttcaaaagaaaac

SEQ ID NO: 3835117 - DNA, 17 bp, Homo sapiens
aattttccttgaagccg

SEQ ID NO: 3835118 - DNA, 18 bp, Homo sapiens
aattttctttttctgaag

SEQ ID NO: 3835119 - DNA, 19 bp, Homo sapiens
aattttgtaagtataagaa

SEQ ID NO: 3835120 - DNA, 13 bp, Homo sapiens
aattttgttttaa

SEQ ID NO: 3835121 - DNA, 20 bp, Homo sapiens
acaaaaaagttataagaaaa

SEQ ID NO: 3835122 - DNA, 21 bp, Homo sapiens
acaaaattatgctgcatttgg

SEQ ID NO: 3835123 - DNA, 14 bp, Homo sapiens
acaaagtctctggg

SEQ ID NO: 3835124 - DNA, 17 bp, Homo sapiens
acaactaaattattatg

SEQ ID NO: 3835125 - DNA, 15 bp, Homo sapiens
acaagaaagtttccc

SEQ ID NO: 3835126 - DNA, 21 bp, Homo sapiens
acaagaaagtttccccaccag

SEQ ID NO: 3835127 - DNA, 14 bp, Homo sapiens
acaagaactcctcc

SEQ ID NO: 3835128 - DNA, 17 bp, Homo sapiens
acaagagaccaactttt

SEQ ID NO: 3835129 - DNA, 20 bp, Homo sapiens
acaaggctgtgccaggctgg

SEQ ID NO: 3835130 - DNA, 12 bp, Homo sapiens
acaagtgtcttt

SEQ ID NO: 3835131 - DNA, 14 bp, Homo sapiens
acaataaagagatt

SEQ ID NO: 3835132 - DNA, 17 bp, Homo sapiens
acaatgaagtgttttac

SEQ ID NO: 3835133 - DNA, 14 bp, Homo sapiens
acaatgatttgtaa

SEQ ID NO: 3835134 - DNA, 16 bp, Homo sapiens
acaatgatttgtaaag

SEQ ID NO: 3835135 - DNA, 20 bp, Homo sapiens
acaatgatttgtaaaggact

SEQ ID NO: 3835136 - DNA, 19 bp, Homo sapiens
acaatgtctggggacaggc

SEQ ID NO: 3835137 - DNA, 21 bp, Homo sapiens
acacacaaaactttgaggcag

SEQ ID NO: 3835138 - DNA, 19 bp, Homo sapiens
acacacaggaactctgtgt

SEQ ID NO: 3835139 - DNA, 16 bp, Homo sapiens
acacacatacacacac

SEQ ID NO: 3835140 - DNA, 22 bp, Homo sapiens
acacacgtgcaatttgtttgtg

SEQ ID NO: 3835141 - DNA, 11 bp, Homo sapiens
acacactgtgc

SEQ ID NO: 3835142 - DNA, 17 bp, Homo sapiens
acacactgtgctttcta

SEQ ID NO: 3835143 - DNA, 21 bp, Homo sapiens
acacactgtgctttctattgt

SEQ ID NO: 3835144 - DNA, 22 bp, Homo sapiens
acacactgtgctttctattgta

SEQ ID NO: 3835145 - DNA, 16 bp, Homo sapiens
acacagcccagaaggc

SEQ ID NO: 3835146 - DNA, 19 bp, Homo sapiens
acacagcccagaaggccag

SEQ ID NO: 3835147 - DNA, 14 bp, Homo sapiens
acacagcctgtgtg

SEQ ID NO: 3835148 - DNA, 14 bp, Homo sapiens
acacatacacacac

SEQ ID NO: 3835149 - DNA, 23 bp, Homo sapiens
acacatacacacacacacacaaa

SEQ ID NO: 3835150 - DNA, 12 bp, Homo sapiens
acaccaaatgac

SEQ ID NO: 3835151 - DNA, 14 bp, Homo sapiens
acaccacacccagc

SEQ ID NO: 3835152 - DNA, 18 bp, Homo sapiens
acaccacacccagcctca

SEQ ID NO: 3835153 - DNA, 19 bp, Homo sapiens
acaccacgctggagctgtg

SEQ ID NO: 3835154 - DNA, 16 bp, Homo sapiens
acaccatctggcccag

SEQ ID NO: 3835155 - DNA, 21 bp, Homo sapiens
acaccatctggcccaggctgg

SEQ ID NO: 3835156 - DNA, 13 bp, Homo sapiens
acaccccagactc

SEQ ID NO: 3835157 - DNA, 19 bp, Homo sapiens
acaccccagactccaggcc

SEQ ID NO: 3835158 - DNA, 20 bp, Homo sapiens
acaccccagactccaggccc

SEQ ID NO: 3835159 - DNA, 19 bp, Homo sapiens
acacctgagttcacagctt

SEQ ID NO: 3835160 - DNA, 14 bp, Homo sapiens
acacggcttctcat

SEQ ID NO: 3835161 - DNA, 23 bp, Homo sapiens
acacgtctatgcaattgtacaaa

SEQ ID NO: 3835162 - DNA, 20 bp, Homo sapiens
acactccacctccagcacgc

SEQ ID NO: 3835163 - DNA, 17 bp, Homo sapiens
acactcgaactcgggag

SEQ ID NO: 3835164 - DNA, 22 bp, Homo sapiens
acactgtgctttctattgtaca

SEQ ID NO: 3835165 - DNA, 22 bp, Homo sapiens
acagacatggaccttctctcca

SEQ ID NO: 3835166 - DNA, 22 bp, Homo sapiens
agagctggcagtgtgcggagct

SEQ ID NO: 3835167 - DNA, 11 bp, Homo sapiens
agaggagagag

SEQ ID NO: 3835168 - DNA, 12 bp, Homo sapiens
agaggagagagg

SEQ ID NO: 3835169 - DNA, 23 bp, Homo sapiens
agaggcaaggatggtggggcccc

SEQ ID NO: 3835170 - DNA, 20 bp, Homo sapiens
agaggcaataaataaatgtt

SEQ ID NO: 3835171 - DNA, 22 bp, Homo sapiens
agaggcaataaataaatgtttt

SEQ ID NO: 3835172 - DNA, 22 bp, Homo sapiens
agaggccatgttccaataaaca

SEQ ID NO: 3835173 - DNA, 14 bp, Homo sapiens
agaggctgagcacc

SEQ ID NO: 3835174 - DNA, 12 bp, Homo sapiens
agaggcttctcc

SEQ ID NO: 3835175 - DNA, 20 bp, Homo sapiens
agaggcttctccgccagcct

SEQ ID NO: 3835176 - DNA, 22 bp, Homo sapiens
agaggcttctccgccagcctcc

SEQ ID NO: 3835177 - DNA, 22 bp, Homo sapiens
agagggaggtcactggaaaggg

SEQ ID NO: 3835178 - DNA, 16 bp, Homo sapiens
agagggcgcccagccc

SEQ ID NO: 3835179 - DNA, 17 bp, Homo sapiens
agagggcgcccagccca

SEQ ID NO: 3835180 - DNA, 23 bp, Homo sapiens
agagggcgcccagcccaggcctg

SEQ ID NO: 3835181 - DNA, 18 bp, Homo sapiens
agagggtcggggaggagg

SEQ ID NO: 3835182 - DNA, 16 bp, Homo sapiens
agaggtgcctgggagg

SEQ ID NO: 3835183 - DNA, 20 bp, Homo sapiens
agaggtgcctgggaggagtg

SEQ ID NO: 3835184 - DNA, 18 bp, Homo sapiens
agagtaatccaagcaaat

SEQ ID NO: 3835185 - DNA, 22 bp, Homo sapiens
agagtaatccaagcaaatgtga

SEQ ID NO: 3835186 - DNA, 21 bp, Homo sapiens
agagtgggctgacatcaagtg

SEQ ID NO: 3835187 - DNA, 20 bp, Homo sapiens
agagttgatggttgtacata

SEQ ID NO: 3835188 - DNA, 19 bp, Homo sapiens
agagttgggggccagcaca

SEQ ID NO: 3835189 - DNA, 23 bp, Homo sapiens
agagttgggggctaggggagggg

SEQ ID NO: 3835190 - DNA, 14 bp, Homo sapiens
agagtttacaagaa

SEQ ID NO: 3835191 - DNA, 17 bp, Homo sapiens
agagtttacaagaaata

SEQ ID NO: 3835192 - DNA, 14 bp, Homo sapiens
agataaagagatac

SEQ ID NO: 3835193 - DNA, 21 bp, Homo sapiens
agatccccagggcagcctcgt

SEQ ID NO: 3835194 - DNA, 12 bp, Homo sapiens
agatctgctcct

SEQ ID NO: 3835195 - DNA, 13 bp, Homo sapiens
agatctgctcctc

SEQ ID NO: 3835196 - DNA, 14 bp, Homo sapiens
agatgaaaagctac

SEQ ID NO: 3835197 - DNA, 20 bp, Homo sapiens
agatgatggggtcagcaggc

SEQ ID NO: 3835198 - DNA, 21 bp, Homo sapiens
agatgatggggtcagcaggcc

SEQ ID NO: 3835199 - DNA, 22 bp, Homo sapiens
agatgatggggtcagcaggccc

SEQ ID NO: 3835200 - DNA, 20 bp, Homo sapiens
agatgcatgttactgccaaa

SEQ ID NO: 3835201 - DNA, 13 bp, Homo sapiens
agatgctggagaa

SEQ ID NO: 3835202 - DNA, 20 bp, Homo sapiens
agatgctggagaagagagga

SEQ ID NO: 3835203 - DNA, 19 bp, Homo sapiens
agatggctccttgggatga

SEQ ID NO: 3835204 - DNA, 21 bp, Homo sapiens
agattaaatatatctttgtaa

SEQ ID NO: 3835205 - DNA, 12 bp, Homo sapiens
agattaatgact

SEQ ID NO: 3835206 - DNA, 17 bp, Homo sapiens
agattatacagaattgt

SEQ ID NO: 3835207 - DNA, 18 bp, Homo sapiens
agattcacatgctggctc

SEQ ID NO: 3835208 - DNA, 12 bp, Homo sapiens
agattcccagga

SEQ ID NO: 3835209 - DNA, 14 bp, Homo sapiens
agattcccaggagt

SEQ ID NO: 3835210 - DNA, 17 bp, Homo sapiens
agattcccaggagttct

SEQ ID NO: 3835211 - DNA, 19 bp, Homo sapiens
agattcccaggagttctgc

SEQ ID NO: 3835212 - DNA, 17 bp, Homo sapiens
agattgagaaggagaga

SEQ ID NO: 3835213 - DNA, 19 bp, Homo sapiens
agattgagaaggagagaaa

SEQ ID NO: 3835214 - DNA, 16 bp, Homo sapiens
agattgtaaactaaag

SEQ ID NO: 3835215 - DNA, 12 bp, Homo sapiens
agatttattgtc

SEQ ID NO: 3835216 - DNA, 18 bp, Homo sapiens
agatttcagtagtttcta

SEQ ID NO: 3835217 - DNA, 19 bp, Homo sapiens
agattttgtgaaatttcat

SEQ ID NO: 3835218 - DNA, 23 bp, Homo sapiens
agcaaaaaaaaaaaaaagcatct

SEQ ID NO: 3835219 - DNA, 21 bp, Homo sapiens
agcaaagccccatgctggagc

SEQ ID NO: 3835220 - DNA, 15 bp, Homo sapiens
agcaaccatttgtaa

SEQ ID NO: 3835221 - DNA, 15 bp, Homo sapiens
agcaactttcccttg

SEQ ID NO: 3835222 - DNA, 12 bp, Homo sapiens
agcaagccctga

SEQ ID NO: 3835223 - DNA, 22 bp, Homo sapiens
agcaagccctgacccaataaag

SEQ ID NO: 3835224 - DNA, 17 bp, Homo sapiens
agcaaggtgtttaagta

SEQ ID NO: 3835225 - DNA, 13 bp, Homo sapiens
agcaatctggaaa

SEQ ID NO: 3835226 - DNA, 22 bp, Homo sapiens
agcaatgccacgatttagattt

SEQ ID NO: 3835227 - DNA, 12 bp, Homo sapiens
agcaattttcct

SEQ ID NO: 3835228 - DNA, 13 bp, Homo sapiens
agcaattttcctt

SEQ ID NO: 3835229 - DNA, 17 bp, Homo sapiens
agcaattttccttgaag

SEQ ID NO: 3835230 - DNA, 19 bp, Homo sapiens
agcaattttccttgaagcc

SEQ ID NO: 3835231 - DNA, 21 bp, Homo sapiens
agcaccctctgttagtgccgc

SEQ ID NO: 3835232 - DNA, 23 bp, Homo sapiens
agcacctccccagacagggctcc

SEQ ID NO: 3835233 - DNA, 18 bp, Homo sapiens
agcacctgttgtgtgcct

SEQ ID NO: 3835234 - DNA, 19 bp, Homo sapiens
agcacctgttgtgtgcctg

SEQ ID NO: 3835235 - DNA, 17 bp, Homo sapiens
agcagaataaatgtttt

SEQ ID NO: 3835236 - DNA, 15 bp, Homo sapiens
agcagaattgcttga

SEQ ID NO: 3835237 - DNA, 17 bp, Homo sapiens
agcagagcaagtctgca

SEQ ID NO: 3835238 - DNA, 15 bp, Homo sapiens
agcagatggaaagaa

SEQ ID NO: 3835239 - DNA, 23 bp, Homo sapiens
agcaggagattgagaaggagaga

SEQ ID NO: 3835240 - DNA, 13 bp, Homo sapiens
agcaggcccagga

SEQ ID NO: 3835241 - DNA, 17 bp, Homo sapiens
agcaggctttgtgagag

SEQ ID NO: 3835242 - DNA, 24 bp, Homo sapiens
agcaggctttgtgagagaggacct

SEQ ID NO: 3835243 - DNA, 11 bp, Homo sapiens
agcagggagga

SEQ ID NO: 3835244 - DNA, 13 bp, Homo sapiens
agcagttcccaag

SEQ ID NO: 3835245 - DNA, 16 bp, Homo sapiens
agcagtttttgaaaga

SEQ ID NO: 3835246 - DNA, 18 bp, Homo sapiens
agcatatgtgttggcttg

SEQ ID NO: 3835247 - DNA, 20 bp, Homo sapiens
agcatgactttagatgggaa

SEQ ID NO: 3835248 - DNA, 15 bp, Homo sapiens
agccaagctggggca

SEQ ID NO: 3835249 - DNA, 14 bp, Homo sapiens
agccaagggaaagg

SEQ ID NO: 3835250 - DNA, 16 bp, Homo sapiens
agccaagggaaagggg

SEQ ID NO: 3835251 - DNA, 15 bp, Homo sapiens
agccaagggacacag

SEQ ID NO: 3835252 - DNA, 16 bp, Homo sapiens
agccaagggacacagg

SEQ ID NO: 3835253 - DNA, 14 bp, Homo sapiens
agccacacagccca

SEQ ID NO: 3835254 - DNA, 21 bp, Homo sapiens
agccacacagcccagaaggcc

SEQ ID NO: 3835255 - DNA, 15 bp, Homo sapiens
agccacacagtggcc

SEQ ID NO: 3835256 - DNA, 10 bp, Homo sapiens
agccagaggc

SEQ ID NO: 3835257 - DNA, 13 bp, Homo sapiens
agccagaggccag

SEQ ID NO: 3835258 - DNA, 15 bp, Homo sapiens
agccagaggccagga

SEQ ID NO: 3835259 - DNA, 17 bp, Homo sapiens
agccagaggccaggatg

SEQ ID NO: 3835260 - DNA, 18 bp, Homo sapiens
agccagaggccaggatgc

SEQ ID NO: 3835261 - DNA, 18 bp, Homo sapiens
agccagatccccagggca

SEQ ID NO: 3835262 - DNA, 20 bp, Homo sapiens
agccagatccccagggcagc

SEQ ID NO: 3835263 - DNA, 22 bp, Homo sapiens
agccagatccccagggcagcct

SEQ ID NO: 3835264 - DNA, 22 bp, Homo sapiens
agccagctacaggcttgagctt

SEQ ID NO: 3835265 - DNA, 23 bp, Homo sapiens
agccaggcacacactgtgctttc

SEQ ID NO: 3835266 - DNA, 18 bp, Homo sapiens
agccagggggactagccc

SEQ ID NO: 3835267 - DNA, 23 bp, Homo sapiens
agccagggggactagcccctgtg

SEQ ID NO: 3835268 - DNA, 16 bp, Homo sapiens
agccatcccaaggctc

SEQ ID NO: 3835269 - DNA, 15 bp, Homo sapiens
agccatgtgaaactc

SEQ ID NO: 3835270 - DNA, 18 bp, Homo sapiens
agccattggcctctgtct

SEQ ID NO: 3835271 - DNA, 16 bp, Homo sapiens
agcccacaccatctgg

SEQ ID NO: 3835272 - DNA, 17 bp, Homo sapiens
agcccacaccatctggc

SEQ ID NO: 3835273 - DNA, 19 bp, Homo sapiens
agcccacaccatctggccc

SEQ ID NO: 3835274 - DNA, 20 bp, Homo sapiens
agcccacaccatctggccca

SEQ ID NO: 3835275 - DNA, 22 bp, Homo sapiens
agcccacaccatctggcccagg

SEQ ID NO: 3835276 - DNA, 15 bp, Homo sapiens
agcccagaaggccag

SEQ ID NO: 3835277 - DNA, 13 bp, Homo sapiens
agcccagccacgt

SEQ ID NO: 3835278 - DNA, 15 bp, Homo sapiens
agcccaggagagaga

SEQ ID NO: 3835279 - DNA, 18 bp, Homo sapiens
agcccatccctgcctggt

SEQ ID NO: 3835280 - DNA, 16 bp, Homo sapiens
agccccatgctggagc

SEQ ID NO: 3835281 - DNA, 18 bp, Homo sapiens
agccccatgctggagcct

SEQ ID NO: 3835282 - DNA, 19 bp, Homo sapiens
agccccatgctggagcctg

SEQ ID NO: 3835283 - DNA, 20 bp, Homo sapiens
agccccatgctggagcctgt

SEQ ID NO: 3835284 - DNA, 21 bp, Homo sapiens
agccccatgctggagcctgtg

SEQ ID NO: 3835285 - DNA, 14 bp, Homo sapiens
agccccgcagacct

SEQ ID NO: 3835286 - DNA, 24 bp, Homo sapiens
agccccggggtgagtccattctcc

SEQ ID NO: 3835287 - DNA, 15 bp, Homo sapiens
agccccgtgccagga

SEQ ID NO: 3835288 - DNA, 21 bp, Homo sapiens
agcccctagcccaggagagag

SEQ ID NO: 3835289 - DNA, 23 bp, Homo sapiens
agcccctagcccaggagagagaa

SEQ ID NO: 3835290 - DNA, 13 bp, Homo sapiens
agcccctggatct

SEQ ID NO: 3835291 - DNA, 22 bp, Homo sapiens
agccctgagctagtgtcacctg

SEQ ID NO: 3835292 - DNA, 22 bp, Homo sapiens
agccctgagctggcgtcacctg

SEQ ID NO: 3835293 - DNA, 20 bp, Homo sapiens
agccctgagttggcatcacc

SEQ ID NO: 3835294 - DNA, 22 bp, Homo sapiens
agccctgagttggcatcacctg

SEQ ID NO: 3835295 - DNA, 22 bp, Homo sapiens
agccctgcagtaatctccaggg

SEQ ID NO: 3835296 - DNA, 16 bp, Homo sapiens
agccctggaggtgcca

SEQ ID NO: 3835297 - DNA, 22 bp, Homo sapiens
atccacctccatcttctttgca

SEQ ID NO: 3835298 - DNA, 15 bp, Homo sapiens
atccatatgaaattc

SEQ ID NO: 3835299 - DNA, 14 bp, Homo sapiens
atccatcctgctag

SEQ ID NO: 3835300 - DNA, 19 bp, Homo sapiens
atcccaccgacccttcctg

SEQ ID NO: 3835301 - DNA, 22 bp, Homo sapiens
atcccaggtgaggaatttgaag

SEQ ID NO: 3835302 - DNA, 16 bp, Homo sapiens
atccccagggcagcct

SEQ ID NO: 3835303 - DNA, 17 bp, Homo sapiens
atccccagggcagcctc

SEQ ID NO: 3835304 - DNA, 18 bp, Homo sapiens
atccccagggcagcctcg

SEQ ID NO: 3835305 - DNA, 12 bp, Homo sapiens
atcccctgcctc

SEQ ID NO: 3835306 - DNA, 20 bp, Homo sapiens
atccgcccgcctctgcctcc

SEQ ID NO: 3835307 - DNA, 18 bp, Homo sapiens
atcctaatttctcctccc

SEQ ID NO: 3835308 - DNA, 13 bp, Homo sapiens
atcctagggcctg

SEQ ID NO: 3835309 - DNA, 23 bp, Homo sapiens
atcctgccttagagccaggcaca

SEQ ID NO: 3835310 - DNA, 22 bp, Homo sapiens
atcctgctagcacctccccaga

SEQ ID NO: 3835311 - DNA, 15 bp, Homo sapiens
atcctggtattgtaa

SEQ ID NO: 3835312 - DNA, 19 bp, Homo sapiens
atcctttctgcctctcaac

SEQ ID NO: 3835313 - DNA, 12 bp, Homo sapiens
atcctttgcatt

SEQ ID NO: 3835314 - DNA, 16 bp, Homo sapiens
atcctttgcatttctc

SEQ ID NO: 3835315 - DNA, 17 bp, Homo sapiens
atcctttgcatttctct

SEQ ID NO: 3835316 - DNA, 14 bp, Homo sapiens
atcgccaacttgtc

SEQ ID NO: 3835317 - DNA, 21 bp, Homo sapiens
atcgccagctgatgactcaag

SEQ ID NO: 3835318 - DNA, 23 bp, Homo sapiens
atcgccagctgatgactcaagat

SEQ ID NO: 3835319 - DNA, 13 bp, Homo sapiens
atcgtaaaattaa

SEQ ID NO: 3835320 - DNA, 17 bp, Homo sapiens
atcgtaaaattaagaaa

SEQ ID NO: 3835321 - DNA, 21 bp, Homo sapiens
atcgtggagaaacaagagacc

SEQ ID NO: 3835322 - DNA, 22 bp, Homo sapiens
atctatatgtctataagtatat

SEQ ID NO: 3835323 - DNA, 18 bp, Homo sapiens
atctcaattgtgctttgt

SEQ ID NO: 3835324 - DNA, 20 bp, Homo sapiens
atctgaactaattcatttat

SEQ ID NO: 3835325 - DNA, 20 bp, Homo sapiens
atctgcaccccttctctcct

SEQ ID NO: 3835326 - DNA, 18 bp, Homo sapiens
atctgccttaaaaccaaa

SEQ ID NO: 3835327 - DNA, 19 bp, Homo sapiens
atctgccttaaaaccaaag

SEQ ID NO: 3835328 - DNA, 16 bp, Homo sapiens
atctgctcagccctgg

SEQ ID NO: 3835329 - DNA, 18 bp, Homo sapiens
atctgctcagccctggag

SEQ ID NO: 3835330 - DNA, 18 bp, Homo sapiens
atctggaacgctctaggc

SEQ ID NO: 3835331 - DNA, 15 bp, Homo sapiens
atctggcccaggctg

SEQ ID NO: 3835332 - DNA, 16 bp, Homo sapiens
atctggcccaggctgg

SEQ ID NO: 3835333 - DNA, 12 bp, Homo sapiens
atctgtcctggg

SEQ ID NO: 3835334 - DNA, 13 bp, Homo sapiens
atctgtcctgggg

SEQ ID NO: 3835335 - DNA, 14 bp, Homo sapiens
atctgtcctggggg

SEQ ID NO: 3835336 - DNA, 14 bp, Homo sapiens
atcttctttgcagc

SEQ ID NO: 3835337 - DNA, 18 bp, Homo sapiens
atcttgatagctaaataa

SEQ ID NO: 3835338 - DNA, 15 bp, Homo sapiens
atcttgggggtcacc

SEQ ID NO: 3835339 - DNA, 23 bp, Homo sapiens
atcttgggggtcacccatggcct

SEQ ID NO: 3835340 - DNA, 19 bp, Homo sapiens
atcttggtccaggaaatgt

SEQ ID NO: 3835341 - DNA, 21 bp, Homo sapiens
atctttaattttacatttcct

SEQ ID NO: 3835342 - DNA, 20 bp, Homo sapiens
atctttcatcaatcattgta

SEQ ID NO: 3835343 - DNA, 13 bp, Homo sapiens
atctttttattca

SEQ ID NO: 3835344 - DNA, 12 bp, Homo sapiens
atgaaaactggg

SEQ ID NO: 3835345 - DNA, 16 bp, Homo sapiens
atgaagaaggagcaga

SEQ ID NO: 3835346 - DNA, 22 bp, Homo sapiens
atgaagaaggagcagaataaat

SEQ ID NO: 3835347 - DNA, 16 bp, Homo sapiens
atgaagatttggtttt

SEQ ID NO: 3835348 - DNA, 23 bp, Homo sapiens
atgaagttttttttatacaggat

SEQ ID NO: 3835349 - DNA, 14 bp, Homo sapiens
atgaatacacagga

SEQ ID NO: 3835350 - DNA, 16 bp, Homo sapiens
atgaatatttagtgtt

SEQ ID NO: 3835351 - DNA, 21 bp, Homo sapiens
atgaatatttagtgttcataa

SEQ ID NO: 3835352 - DNA, 13 bp, Homo sapiens
atgaatccaaatg

SEQ ID NO: 3835353 - DNA, 15 bp, Homo sapiens
atgaatccaaatgtg

SEQ ID NO: 3835354 - DNA, 16 bp, Homo sapiens
atgaatccaaatgtga

SEQ ID NO: 3835355 - DNA, 19 bp, Homo sapiens
atgaatccaaatgtgaaag

SEQ ID NO: 3835356 - DNA, 20 bp, Homo sapiens
atgaattaagaaagattaaa

SEQ ID NO: 3835357 - DNA, 15 bp, Homo sapiens
atgaattttgtaagt

SEQ ID NO: 3835358 - DNA, 16 bp, Homo sapiens
atgaattttgtaagta

SEQ ID NO: 3835359 - DNA, 19 bp, Homo sapiens
atgaattttgtaagtataa

SEQ ID NO: 3835360 - DNA, 23 bp, Homo sapiens
atgaattttgtaagtataagaaa

SEQ ID NO: 3835361 - DNA, 23 bp, Homo sapiens
atgacagtagtaccaaatgcttt

SEQ ID NO: 3835362 - DNA, 16 bp, Homo sapiens
atgacggtattatgct

SEQ ID NO: 3835363 - DNA, 20 bp, Homo sapiens
atgacggtattatgcttctt

SEQ ID NO: 3835364 - DNA, 16 bp, Homo sapiens
atgactactacacact

SEQ ID NO: 3835365 - DNA, 24 bp, Homo sapiens
atgactactacacactgctcattt

SEQ ID NO: 3835366 - DNA, 19 bp, Homo sapiens
atgactcaagattcccagg

SEQ ID NO: 3835367 - DNA, 23 bp, Homo sapiens
atgactcaagattcccaggagtt

SEQ ID NO: 3835368 - DNA, 12 bp, Homo sapiens
atgactgaagac

SEQ ID NO: 3835369 - DNA, 22 bp, Homo sapiens
atgactgaagacaggcacaaaa

SEQ ID NO: 3835370 - DNA, 15 bp, Homo sapiens
atgagaaatctaaaa

SEQ ID NO: 3835371 - DNA, 22 bp, Homo sapiens
atgaggtgggaggtggaagaag

SEQ ID NO: 3835372 - DNA, 15 bp, Homo sapiens
atgagtttttaaatg

SEQ ID NO: 3835373 - DNA, 15 bp, Homo sapiens
atgagtttttcatta

SEQ ID NO: 3835374 - DNA, 23 bp, Homo sapiens
atgatctaagaaatcatgtgcat

SEQ ID NO: 3835375 - DNA, 12 bp, Homo sapiens
atgatggcccat

SEQ ID NO: 3835376 - DNA, 15 bp, Homo sapiens
atgatggcccattct

SEQ ID NO: 3835377 - DNA, 19 bp, Homo sapiens
atgatggcccattctactt

SEQ ID NO: 3835378 - DNA, 21 bp, Homo sapiens
atgatggcccattctacttgc

SEQ ID NO: 3835379 - DNA, 19 bp, Homo sapiens
atgatggggtcagcaggcc

SEQ ID NO: 3835380 - DNA, 20 bp, Homo sapiens
atgatggggtcagcaggccc

SEQ ID NO: 3835381 - DNA, 17 bp, Homo sapiens
atgatgtatataaaatg

SEQ ID NO: 3835382 - DNA, 22 bp, Homo sapiens
atgatttgcattttttaaattt

SEQ ID NO: 3835383 - DNA, 13 bp, Homo sapiens
atgatttgtaaag

SEQ ID NO: 3835384 - DNA, 19 bp, Homo sapiens
atgcaaataaagcctgctc

SEQ ID NO: 3835385 - DNA, 14 bp, Homo sapiens
atgcaattgtacaa

SEQ ID NO: 3835386 - DNA, 17 bp, Homo sapiens
atgcaattgtacaaaaa

SEQ ID NO: 3835387 - DNA, 14 bp, Homo sapiens
atgcagaatacttt

SEQ ID NO: 3835388 - DNA, 17 bp, Homo sapiens
atgcagtgaccgcttcc

SEQ ID NO: 3835389 - DNA, 20 bp, Homo sapiens
atgcatattattttatgttg

SEQ ID NO: 3835390 - DNA, 16 bp, Homo sapiens
atgcatgttactgcca

SEQ ID NO: 3835391 - DNA, 15 bp, Homo sapiens
atgccatggaatgac

SEQ ID NO: 3835392 - DNA, 16 bp, Homo sapiens
atgcccaccccctgcc

SEQ ID NO: 3835393 - DNA, 17 bp, Homo sapiens
atgcccaccccctgccc

SEQ ID NO: 3835394 - DNA, 19 bp, Homo sapiens
atgcccaccccctgccctg

SEQ ID NO: 3835395 - DNA, 20 bp, Homo sapiens
atgcccaccccctgccctgc

SEQ ID NO: 3835396 - DNA, 17 bp, Homo sapiens
atgcccagcctccaact

SEQ ID NO: 3835397 - DNA, 15 bp, Homo sapiens
atgcccccgccacct

SEQ ID NO: 3835398 - DNA, 20 bp, Homo sapiens
atgcccccgccacctcccca

SEQ ID NO: 3835399 - DNA, 16 bp, Homo sapiens
atgccccggccacctc

SEQ ID NO: 3835400 - DNA, 19 bp, Homo sapiens
atgccccggccacctctgc

SEQ ID NO: 3835401 - DNA, 17 bp, Homo sapiens
atgcctgagccccctga

SEQ ID NO: 3835402 - DNA, 18 bp, Homo sapiens
atgcctgagccccctgag

SEQ ID NO: 3835403 - DNA, 16 bp, Homo sapiens
atgcctgctgctgcca

SEQ ID NO: 3835404 - DNA, 20 bp, Homo sapiens
atgcctgttgcaggcaaatg

SEQ ID NO: 3835405 - DNA, 21 bp, Homo sapiens
atgcctgttgcaggcaaatgt

SEQ ID NO: 3835406 - DNA, 13 bp, Homo sapiens
atgctatttctac

SEQ ID NO: 3835407 - DNA, 15 bp, Homo sapiens
atgctatttctacct

SEQ ID NO: 3835408 - DNA, 22 bp, Homo sapiens
atgctgaccttcacccagagct

SEQ ID NO: 3835409 - DNA, 11 bp, Homo sapiens
atgctggagcc

SEQ ID NO: 3835410 - DNA, 22 bp, Homo sapiens
atgctggagcctgtgtaacagc

SEQ ID NO: 3835411 - DNA, 14 bp, Homo sapiens
atgctgtaaatatt

SEQ ID NO: 3835412 - DNA, 17 bp, Homo sapiens
atgctgtaaatatttca

SEQ ID NO: 3835413 - DNA, 18 bp, Homo sapiens
atgcttggaatgggagag

SEQ ID NO: 3835414 - DNA, 15 bp, Homo sapiens
atggaacgcattttg

SEQ ID NO: 3835415 - DNA, 20 bp, Homo sapiens
atggaacgcattttgggttg

SEQ ID NO: 3835416 - DNA, 15 bp, Homo sapiens
atggaatgactgaag

SEQ ID NO: 3835417 - DNA, 18 bp, Homo sapiens
atggataggcacaggaaa

SEQ ID NO: 3835418 - DNA, 19 bp, Homo sapiens
atggcacatgtcattgccc

SEQ ID NO: 3835419 - DNA, 18 bp, Homo sapiens
atggctcatgtctgaaaa

SEQ ID NO: 3835420 - DNA, 22 bp, Homo sapiens
atggctccttgggatgaagagg

SEQ ID NO: 3835421 - DNA, 22 bp, Homo sapiens
atggctggggggtctcagcatg

SEQ ID NO: 3835422 - DNA, 17 bp, Homo sapiens
atggctttgtgctgctg

SEQ ID NO: 3835423 - DNA, 20 bp, Homo sapiens
atggctttgtgctgctgagt

SEQ ID NO: 3835424 - DNA, 17 bp, Homo sapiens
atgggaagcctgtgtat

SEQ ID NO: 3835425 - DNA, 18 bp, Homo sapiens
atgggagaggcaataaat

SEQ ID NO: 3835426 - DNA, 13 bp, Homo sapiens
atgggaggctcct

SEQ ID NO: 3835427 - DNA, 16 bp, Homo sapiens
atgggaggctcctggt

SEQ ID NO: 3835428 - DNA, 13 bp, Homo sapiens
atggggcagcctc

SEQ ID NO: 3835429 - DNA, 13 bp, Homo sapiens
cactctttaagtg

SEQ ID NO: 3835430 - DNA, 14 bp, Homo sapiens
cactgacaacgaaa

SEQ ID NO: 3835431 - DNA, 14 bp, Homo sapiens
cactgccaggccag

SEQ ID NO: 3835432 - DNA, 21 bp, Homo sapiens
cactgccaggccagcctccga

SEQ ID NO: 3835433 - DNA, 13 bp, Homo sapiens
cactgctcatttg

SEQ ID NO: 3835434 - DNA, 14 bp, Homo sapiens
cactgctccctgaa

SEQ ID NO: 3835435 - DNA, 17 bp, Homo sapiens
cactgctccctgaagcc

SEQ ID NO: 3835436 - DNA, 19 bp, Homo sapiens
cactgctccctgaagccag

SEQ ID NO: 3835437 - DNA, 20 bp, Homo sapiens
cactgctccctgaagccagc

SEQ ID NO: 3835438 - DNA, 21 bp, Homo sapiens
cactgctccctgaagccagcc

SEQ ID NO: 3835439 - DNA, 22 bp, Homo sapiens
cactgctccctgaagccagcct

SEQ ID NO: 3835440 - DNA, 16 bp, Homo sapiens
cactgctggtgtttat

SEQ ID NO: 3835441 - DNA, 23 bp, Homo sapiens
cactgctggtgtttatgtgaaca

SEQ ID NO: 3835442 - DNA, 15 bp, Homo sapiens
cactggaaaggggag

SEQ ID NO: 3835443 - DNA, 18 bp, Homo sapiens
cactggaaaggggagagc

SEQ ID NO: 3835444 - DNA, 15 bp, Homo sapiens
cactggctgccagct

SEQ ID NO: 3835445 - DNA, 15 bp, Homo sapiens
cactgggagagtcct

SEQ ID NO: 3835446 - DNA, 23 bp, Homo sapiens
cactgggagagtccttagcctgg

SEQ ID NO: 3835447 - DNA, 22 bp, Homo sapiens
cactgtatcatttcatgctttg

SEQ ID NO: 3835448 - DNA, 12 bp, Homo sapiens
cacttctgtgta

SEQ ID NO: 3835449 - DNA, 16 bp, Homo sapiens
cacttctgtgtagaca

SEQ ID NO: 3835450 - DNA, 15 bp, Homo sapiens
cacttgaatcctagg

SEQ ID NO: 3835451 - DNA, 18 bp, Homo sapiens
cacttgaggtcaggagtt

SEQ ID NO: 3835452 - DNA, 18 bp, Homo sapiens
cacttggccaagcaggga

SEQ ID NO: 3835453 - DNA, 23 bp, Homo sapiens
cacttttggaaggtgacttttca

SEQ ID NO: 3835454 - DNA, 16 bp, Homo sapiens
cagaaaaggcagccag

SEQ ID NO: 3835455 - DNA, 17 bp, Homo sapiens
cagaaaaggcagccaga

SEQ ID NO: 3835456 - DNA, 18 bp, Homo sapiens
cagaaaaggcagccagat

SEQ ID NO: 3835457 - DNA, 17 bp, Homo sapiens
cagaaaataccttagct

SEQ ID NO: 3835458 - DNA, 14 bp, Homo sapiens
cagaaagcctatca

SEQ ID NO: 3835459 - DNA, 12 bp, Homo sapiens
cagaaaggctgc

SEQ ID NO: 3835460 - DNA, 15 bp, Homo sapiens
cagaagaagctggga

SEQ ID NO: 3835461 - DNA, 20 bp, Homo sapiens
cagaaggccagaaaaggcag

SEQ ID NO: 3835462 - DNA, 14 bp, Homo sapiens
cagaataaagcaat

SEQ ID NO: 3835463 - DNA, 15 bp, Homo sapiens
cagaataaagcaatt

SEQ ID NO: 3835464 - DNA, 19 bp, Homo sapiens
cagaataaagcaattttcc

SEQ ID NO: 3835465 - DNA, 21 bp, Homo sapiens
cagaataaagcaattttcctt

SEQ ID NO: 3835466 - DNA, 22 bp, Homo sapiens
cagaataaagcaattttccttg

SEQ ID NO: 3835467 - DNA, 17 bp, Homo sapiens
cagaataaatgttttac

SEQ ID NO: 3835468 - DNA, 20 bp, Homo sapiens
cagaataaatgttttacaac

SEQ ID NO: 3835469 - DNA, 16 bp, Homo sapiens
cagaattgtgtctgca

SEQ ID NO: 3835470 - DNA, 18 bp, Homo sapiens
cagaattgtgtctgcagg

SEQ ID NO: 3835471 - DNA, 13 bp, Homo sapiens
cagacagggctcc

SEQ ID NO: 3835472 - DNA, 14 bp, Homo sapiens
cagacctctcccac

SEQ ID NO: 3835473 - DNA, 18 bp, Homo sapiens
cagacctttgtctgaagg

SEQ ID NO: 3835474 - DNA, 22 bp, Homo sapiens
cagactttcagccgactcagca

SEQ ID NO: 3835475 - DNA, 15 bp, Homo sapiens
cagagacagtgggca

SEQ ID NO: 3835476 - DNA, 13 bp, Homo sapiens
cagagaccgtcct

SEQ ID NO: 3835477 - DNA, 17 bp, Homo sapiens
cagagatggctccttgg

SEQ ID NO: 3835478 - DNA, 18 bp, Homo sapiens
cagagatggctccttggg

SEQ ID NO: 3835479 - DNA, 17 bp, Homo sapiens
cagagcaagtctgcagg

SEQ ID NO: 3835480 - DNA, 20 bp, Homo sapiens
cagagcaggctttgtgagag

SEQ ID NO: 3835481 - DNA, 23 bp, Homo sapiens
cagagcaggctttgtgagagagg

SEQ ID NO: 3835482 - DNA, 14 bp, Homo sapiens
cagagccaagctgg

SEQ ID NO: 3835483 - DNA, 18 bp, Homo sapiens
cagagccaagctggggca

SEQ ID NO: 3835484 - DNA, 15 bp, Homo sapiens
cagagcccagggaga

SEQ ID NO: 3835485 - DNA, 13 bp, Homo sapiens
cagagctgcctat

SEQ ID NO: 3835486 - DNA, 13 bp, Homo sapiens
cagagctggggct

SEQ ID NO: 3835487 - DNA, 14 bp, Homo sapiens
cagaggcaaggatg

SEQ ID NO: 3835488 - DNA, 22 bp, Homo sapiens
cagaggcaaggatggtggggcc

SEQ ID NO: 3835489 - DNA, 14 bp, Homo sapiens
cagaggccaggatg

SEQ ID NO: 3835490 - DNA, 14 bp, Homo sapiens
cagagggctgtgtc

SEQ ID NO: 3835491 - DNA, 23 bp, Homo sapiens
cagaggtcacacagcctgtgtgc

SEQ ID NO: 3835492 - DNA, 14 bp, Homo sapiens
cagagttgggggct

SEQ ID NO: 3835493 - DNA, 22 bp, Homo sapiens
cagataaggccgagcccacacc

SEQ ID NO: 3835494 - DNA, 15 bp, Homo sapiens
cagatctgtcctggg

SEQ ID NO: 3835495 - DNA, 16 bp, Homo sapiens
cagatctgtcctgggg

SEQ ID NO: 3835496 - DNA, 22 bp, Homo sapiens
cagatgatggggtcagcaggcc

SEQ ID NO: 3835497 - DNA, 14 bp, Homo sapiens
cagatggaaagaaa

SEQ ID NO: 3835498 - DNA, 15 bp, Homo sapiens
cagatgtacatgtgt

SEQ ID NO: 3835499 - DNA, 12 bp, Homo sapiens
cagatgtttctc

SEQ ID NO: 3835500 - DNA, 23 bp, Homo sapiens
cagatgtttctcattttaaacaa

SEQ ID NO: 3835501 - DNA, 17 bp, Homo sapiens
cagattataataaattg

SEQ ID NO: 3835502 - DNA, 14 bp, Homo sapiens
cagatttaaaacaa

SEQ ID NO: 3835503 - DNA, 13 bp, Homo sapiens
cagatttatgcat

SEQ ID NO: 3835504 - DNA, 12 bp, Homo sapiens
cagcaaagcccc

SEQ ID NO: 3835505 - DNA, 13 bp, Homo sapiens
cagcaaagcccca

SEQ ID NO: 3835506 - DNA, 23 bp, Homo sapiens
cagcaaagccccatgctggagcc

SEQ ID NO: 3835507 - DNA, 11 bp, Homo sapiens
cagcaccctct

SEQ ID NO: 3835508 - DNA, 15 bp, Homo sapiens
cagcagataaggccg

SEQ ID NO: 3835509 - DNA, 22 bp, Homo sapiens
cagcagataaggccgagcccac

SEQ ID NO: 3835510 - DNA, 18 bp, Homo sapiens
cagcagatggaaagaaag

SEQ ID NO: 3835511 - DNA, 16 bp, Homo sapiens
cagcaggcccaggaga

SEQ ID NO: 3835512 - DNA, 15 bp, Homo sapiens
cagcataaaggcctt

SEQ ID NO: 3835513 - DNA, 13 bp, Homo sapiens
cagcatacctcaa

SEQ ID NO: 3835514 - DNA, 11 bp, Homo sapiens
cagccagatcc

SEQ ID NO: 3835515 - DNA, 14 bp, Homo sapiens
cagccagatcccca

SEQ ID NO: 3835516 - DNA, 15 bp, Homo sapiens
cagccagatccccag

SEQ ID NO: 3835517 - DNA, 17 bp, Homo sapiens
cagccagatccccaggg

SEQ ID NO: 3835518 - DNA, 18 bp, Homo sapiens
cagccagatccccagggc

SEQ ID NO: 3835519 - DNA, 20 bp, Homo sapiens
cagccagatccccagggcag

SEQ ID NO: 3835520 - DNA, 21 bp, Homo sapiens
cagccagatccccagggcagc

SEQ ID NO: 3835521 - DNA, 22 bp, Homo sapiens
cagccagatccccagggcagcc

SEQ ID NO: 3835522 - DNA, 14 bp, Homo sapiens
cagccagccctggc

SEQ ID NO: 3835523 - DNA, 11 bp, Homo sapiens
cagccaggcta

SEQ ID NO: 3835524 - DNA, 21 bp, Homo sapiens
cagccaggctatggttgccac

SEQ ID NO: 3835525 - DNA, 19 bp, Homo sapiens
cagccattggcctctgtct

SEQ ID NO: 3835526 - DNA, 19 bp, Homo sapiens
cagcccaggcctggtggag

SEQ ID NO: 3835527 - DNA, 23 bp, Homo sapiens
cagccccacccccagccaggcta

SEQ ID NO: 3835528 - DNA, 15 bp, Homo sapiens
cagccccaggagaag

SEQ ID NO: 3835529 - DNA, 22 bp, Homo sapiens
cagcccctagcccaggagagag

SEQ ID NO: 3835530 - DNA, 23 bp, Homo sapiens
cagcccctagcccaggagagaga

SEQ ID NO: 3835531 - DNA, 13 bp, Homo sapiens
cagccctgagctg

SEQ ID NO: 3835532 - DNA, 14 bp, Homo sapiens
cagccctggcttcc

SEQ ID NO: 3835533 - DNA, 22 bp, Homo sapiens
cagccgactcagcaactttccc

SEQ ID NO: 3835534 - DNA, 15 bp, Homo sapiens
cagcctcagtcctcc

SEQ ID NO: 3835535 - DNA, 17 bp, Homo sapiens
cagcctccgagagggag

SEQ ID NO: 3835536 - DNA, 17 bp, Homo sapiens
cagcctctgacccctcc

SEQ ID NO: 3835537 - DNA, 21 bp, Homo sapiens
cagcctctgacccctcctcac

SEQ ID NO: 3835538 - DNA, 19 bp, Homo sapiens
cagcctgcgggaagctgac

SEQ ID NO: 3835539 - DNA, 21 bp, Homo sapiens
cagcctgcgggaagctgacct

SEQ ID NO: 3835540 - DNA, 23 bp, Homo sapiens
cagcctgcgggaagctgaccttt

SEQ ID NO: 3835541 - DNA, 12 bp, Homo sapiens
cagcctggcctg

SEQ ID NO: 3835542 - DNA, 13 bp, Homo sapiens
cagcctggcctgt

SEQ ID NO: 3835543 - DNA, 20 bp, Homo sapiens
cagcctgtcggccacacccc

SEQ ID NO: 3835544 - DNA, 23 bp, Homo sapiens
cagcctgtcggccacaccccaga

SEQ ID NO: 3835545 - DNA, 16 bp, Homo sapiens
cagcctgtgtgcagtg

SEQ ID NO: 3835546 - DNA, 21 bp, Homo sapiens
cagccttcttccatcccagga

SEQ ID NO: 3835547 - DNA, 20 bp, Homo sapiens
cagcgacatagcccatccct

SEQ ID NO: 3835548 - DNA, 16 bp, Homo sapiens
cagctcatctgccaaa

SEQ ID NO: 3835549 - DNA, 19 bp, Homo sapiens
cagctcctccgtgcttcct

SEQ ID NO: 3835550 - DNA, 12 bp, Homo sapiens
cagctccttggg

SEQ ID NO: 3835551 - DNA, 16 bp, Homo sapiens
cagctgaagcctggac

SEQ ID NO: 3835552 - DNA, 15 bp, Homo sapiens
cagctgaggaccctc

SEQ ID NO: 3835553 - DNA, 22 bp, Homo sapiens
cagctgaggaccctcagcccca

SEQ ID NO: 3835554 - DNA, 13 bp, Homo sapiens
cagctgccaggga

SEQ ID NO: 3835555 - DNA, 22 bp, Homo sapiens
cagctgccagggaagacagagc

SEQ ID NO: 3835556 - DNA, 19 bp, Homo sapiens
cagctgcgcttgcttttct

SEQ ID NO: 3835557 - DNA, 17 bp, Homo sapiens
cagctgggctagaggct

SEQ ID NO: 3835558 - DNA, 20 bp, Homo sapiens
cagctgggctagaggctgag

SEQ ID NO: 3835559 - DNA, 17 bp, Homo sapiens
cagctgtgagccttggc

SEQ ID NO: 3835560 - DNA, 18 bp, Homo sapiens
cagcttggggcagccatt

SEQ ID NO: 3835561 - DNA, 16 bp, Homo sapiens
caggaaaatgtgaggg

SEQ ID NO: 3835562 - DNA, 20 bp, Homo sapiens
ccccgcagacctccccagcc

SEQ ID NO: 3835563 - DNA, 16 bp, Homo sapiens
ccccgcatcccctgcc

SEQ ID NO: 3835564 - DNA, 19 bp, Homo sapiens
ccccgcatcccctgcctcc

SEQ ID NO: 3835565 - DNA, 16 bp, Homo sapiens
ccccgcccccagtccc

SEQ ID NO: 3835566 - DNA, 13 bp, Homo sapiens
ccccggccacctc

SEQ ID NO: 3835567 - DNA, 18 bp, Homo sapiens
ccccgtccatggtgctaa

SEQ ID NO: 3835568 - DNA, 22 bp, Homo sapiens
cccctaaaaacaaaacaaacac

SEQ ID NO: 3835569 - DNA, 14 bp, Homo sapiens
cccctcacagcctc

SEQ ID NO: 3835570 - DNA, 15 bp, Homo sapiens
cccctcccctgctgc

SEQ ID NO: 3835571 - DNA, 23 bp, Homo sapiens
cccctcctcactggccatccctc

SEQ ID NO: 3835572 - DNA, 17 bp, Homo sapiens
cccctctcatctgacct

SEQ ID NO: 3835573 - DNA, 18 bp, Homo sapiens
cccctctcatctgacctt

SEQ ID NO: 3835574 - DNA, 13 bp, Homo sapiens
cccctgccctgca

SEQ ID NO: 3835575 - DNA, 14 bp, Homo sapiens
cccctgccctgcac

SEQ ID NO: 3835576 - DNA, 19 bp, Homo sapiens
cccctgctgcaggggctct

SEQ ID NO: 3835577 - DNA, 14 bp, Homo sapiens
cccctgctttgccc

SEQ ID NO: 3835578 - DNA, 20 bp, Homo sapiens
cccctgggcttggcctgctg

SEQ ID NO: 3835579 - DNA, 22 bp, Homo sapiens
cccctgggcttggcctgctgtg

SEQ ID NO: 3835580 - DNA, 15 bp, Homo sapiens
cccctgtcctcactg

SEQ ID NO: 3835581 - DNA, 14 bp, Homo sapiens
ccccttctctcctc

SEQ ID NO: 3835582 - DNA, 15 bp, Homo sapiens
ccccttctctcctcc

SEQ ID NO: 3835583 - DNA, 15 bp, Homo sapiens
cccgagcttgcctca

SEQ ID NO: 3835584 - DNA, 14 bp, Homo sapiens
cccgcatcccctgc

SEQ ID NO: 3835585 - DNA, 16 bp, Homo sapiens
cccgcatcccctgcct

SEQ ID NO: 3835586 - DNA, 15 bp, Homo sapiens
cccggccacctctgc

SEQ ID NO: 3835587 - DNA, 21 bp, Homo sapiens
cccggccacctctgcggaccc

SEQ ID NO: 3835588 - DNA, 17 bp, Homo sapiens
cccgggccctcctgggc

SEQ ID NO: 3835589 - DNA, 15 bp, Homo sapiens
cccggggaccctgtg

SEQ ID NO: 3835590 - DNA, 16 bp, Homo sapiens
cccggggaccctgtga

SEQ ID NO: 3835591 - DNA, 21 bp, Homo sapiens
cccggggaccctgtgacatgg

SEQ ID NO: 3835592 - DNA, 21 bp, Homo sapiens
cccggttccctccccagctcc

SEQ ID NO: 3835593 - DNA, 13 bp, Homo sapiens
cccgtagccccgg

SEQ ID NO: 3835594 - DNA, 13 bp, Homo sapiens
cccgtctgctcct

SEQ ID NO: 3835595 - DNA, 21 bp, Homo sapiens
ccctaaaaacaaaacaaacac

SEQ ID NO: 3835596 - DNA, 15 bp, Homo sapiens
ccctagctaataaac

SEQ ID NO: 3835597 - DNA, 17 bp, Homo sapiens
ccctagctaataaacct

SEQ ID NO: 3835598 - DNA, 17 bp, Homo sapiens
ccctagctttagaccct

SEQ ID NO: 3835599 - DNA, 21 bp, Homo sapiens
ccctagctttagaccctgggt

SEQ ID NO: 3835600 - DNA, 13 bp, Homo sapiens
ccctcacagcctc

SEQ ID NO: 3835601 - DNA, 16 bp, Homo sapiens
ccctcacagcctctga

SEQ ID NO: 3835602 - DNA, 18 bp, Homo sapiens
ccctcacagcctctgacc

SEQ ID NO: 3835603 - DNA, 13 bp, Homo sapiens
ccctcccacctct

SEQ ID NO: 3835604 - DNA, 14 bp, Homo sapiens
ccctccccagatct

SEQ ID NO: 3835605 - DNA, 21 bp, Homo sapiens
ccctccccagatctgtcctgg

SEQ ID NO: 3835606 - DNA, 23 bp, Homo sapiens
ccctccccagatctgtcctgggg

SEQ ID NO: 3835607 - DNA, 16 bp, Homo sapiens
ccctcccctcccctgc

SEQ ID NO: 3835608 - DNA, 13 bp, Homo sapiens
ccctcccctgctg

SEQ ID NO: 3835609 - DNA, 16 bp, Homo sapiens
ccctcccgcagagact

SEQ ID NO: 3835610 - DNA, 15 bp, Homo sapiens
ccctcctcactggcc

SEQ ID NO: 3835611 - DNA, 11 bp, Homo sapiens
ccctctgaccc

SEQ ID NO: 3835612 - DNA, 12 bp, Homo sapiens
ccctctgccacc

SEQ ID NO: 3835613 - DNA, 15 bp, Homo sapiens
ccctctggggctcag

SEQ ID NO: 3835614 - DNA, 19 bp, Homo sapiens
ccctctggggctcagccct

SEQ ID NO: 3835615 - DNA, 18 bp, Homo sapiens
ccctgaagccagccttct

SEQ ID NO: 3835616 - DNA, 20 bp, Homo sapiens
ccctgacacctttaaaaagc

SEQ ID NO: 3835617 - DNA, 17 bp, Homo sapiens
ccctgagctagtgtcac

SEQ ID NO: 3835618 - DNA, 20 bp, Homo sapiens
ccctgagctagtgtcacctg

SEQ ID NO: 3835619 - DNA, 19 bp, Homo sapiens
ccctgagctggcctcacct

SEQ ID NO: 3835620 - DNA, 16 bp, Homo sapiens
ccctgagctggcgtca

SEQ ID NO: 3835621 - DNA, 16 bp, Homo sapiens
ccctgaggaataaagc

SEQ ID NO: 3835622 - DNA, 15 bp, Homo sapiens
ccctgaggagggccc

SEQ ID NO: 3835623 - DNA, 18 bp, Homo sapiens
ccctgaggagggccctga

SEQ ID NO: 3835624 - DNA, 19 bp, Homo sapiens
ccctgaggagggccctgag

SEQ ID NO: 3835625 - DNA, 20 bp, Homo sapiens
ccctgaggagggccctgagg

SEQ ID NO: 3835626 - DNA, 22 bp, Homo sapiens
ccctgaggagggccctgaggaa

SEQ ID NO: 3835627 - DNA, 17 bp, Homo sapiens
ccctgagttcccaaagg

SEQ ID NO: 3835628 - DNA, 16 bp, Homo sapiens
ccctgagttggcatca

SEQ ID NO: 3835629 - DNA, 20 bp, Homo sapiens
ccctgagttggcatcacctg

SEQ ID NO: 3835630 - DNA, 14 bp, Homo sapiens
ccctgcacgtcatg

SEQ ID NO: 3835631 - DNA, 20 bp, Homo sapiens
ccctgcagccatcccaaggc

SEQ ID NO: 3835632 - DNA, 12 bp, Homo sapiens
ccctgccctgca

SEQ ID NO: 3835633 - DNA, 12 bp, Homo sapiens
ccctgcctccat

SEQ ID NO: 3835634 - DNA, 13 bp, Homo sapiens
ccctgctgcaggg

SEQ ID NO: 3835635 - DNA, 15 bp, Homo sapiens
ccctgctgcaggggc

SEQ ID NO: 3835636 - DNA, 19 bp, Homo sapiens
ccctgctgcaggggctctg

SEQ ID NO: 3835637 - DNA, 15 bp, Homo sapiens
ccctgcttccaggaa

SEQ ID NO: 3835638 - DNA, 16 bp, Homo sapiens
ccctgctttgccccac

SEQ ID NO: 3835639 - DNA, 22 bp, Homo sapiens
ccctgctttgccccactgggag

SEQ ID NO: 3835640 - DNA, 13 bp, Homo sapiens
ccctggctgctgc

SEQ ID NO: 3835641 - DNA, 15 bp, Homo sapiens
ccctggctgctgccc

SEQ ID NO: 3835642 - DNA, 22 bp, Homo sapiens
ccctggctgctgcccccacccc

SEQ ID NO: 3835643 - DNA, 13 bp, Homo sapiens
ccctgggctgcct

SEQ ID NO: 3835644 - DNA, 14 bp, Homo sapiens
ccctgggctgcctc

SEQ ID NO: 3835645 - DNA, 20 bp, Homo sapiens
ccctgggctgcctcctcctg

SEQ ID NO: 3835646 - DNA, 22 bp, Homo sapiens
ccctgggctgcctcctcctgag

SEQ ID NO: 3835647 - DNA, 21 bp, Homo sapiens
ccctgggcttggcctgctgtg

SEQ ID NO: 3835648 - DNA, 18 bp, Homo sapiens
ccctgggtgggctctgtg

SEQ ID NO: 3835649 - DNA, 12 bp, Homo sapiens
ccctgtccctcc

SEQ ID NO: 3835650 - DNA, 16 bp, Homo sapiens
ccctgtcctcactgct

SEQ ID NO: 3835651 - DNA, 18 bp, Homo sapiens
ccctgtgacatggtgcct

SEQ ID NO: 3835652 - DNA, 20 bp, Homo sapiens
ccctgtgacatggtgcctga

SEQ ID NO: 3835653 - DNA, 16 bp, Homo sapiens
ccctgtggagactggg

SEQ ID NO: 3835654 - DNA, 13 bp, Homo sapiens
ccctgtgtctttt

SEQ ID NO: 3835655 - DNA, 19 bp, Homo sapiens
cccttagagtgctgtgaga

SEQ ID NO: 3835656 - DNA, 15 bp, Homo sapiens
cccttcctctcccat

SEQ ID NO: 3835657 - DNA, 16 bp, Homo sapiens
cccttcctctcccatt

SEQ ID NO: 3835658 - DNA, 14 bp, Homo sapiens
cccttcctggctag

SEQ ID NO: 3835659 - DNA, 16 bp, Homo sapiens
cccttcctggctagga

SEQ ID NO: 3835660 - DNA, 14 bp, Homo sapiens
cccttgcactgtat

SEQ ID NO: 3835661 - DNA, 13 bp, Homo sapiens
cccttgcctcccc

SEQ ID NO: 3835662 - DNA, 19 bp, Homo sapiens
cccttgcctccccatttcc

SEQ ID NO: 3835663 - DNA, 11 bp, Homo sapiens
cccttggccag

SEQ ID NO: 3835664 - DNA, 21 bp, Homo sapiens
cccttggtgccacagagggct

SEQ ID NO: 3835665 - DNA, 23 bp, Homo sapiens
ccctttggggatagtctggaaag

SEQ ID NO: 3835666 - DNA, 15 bp, Homo sapiens
ccgagagccaaacag

SEQ ID NO: 3835667 - DNA, 15 bp, Homo sapiens
ccgagcccacaccat

SEQ ID NO: 3835668 - DNA, 19 bp, Homo sapiens
ccgagcccacaccatctgg

SEQ ID NO: 3835669 - DNA, 22 bp, Homo sapiens
ccgcagagactggggcctggac

SEQ ID NO: 3835670 - DNA, 20 bp, Homo sapiens
ccgcaggctgcccggcctcc

SEQ ID NO: 3835671 - DNA, 17 bp, Homo sapiens
ccgcatcccctgcctcc

SEQ ID NO: 3835672 - DNA, 18 bp, Homo sapiens
ccgcatcccctgcctcca

SEQ ID NO: 3835673 - DNA, 20 bp, Homo sapiens
ccgcatggtttttataatat

SEQ ID NO: 3835674 - DNA, 15 bp, Homo sapiens
ccgccacctccccac

SEQ ID NO: 3835675 - DNA, 13 bp, Homo sapiens
ccgccagcctcct

SEQ ID NO: 3835676 - DNA, 18 bp, Homo sapiens
ccgccagcctcctctgga

SEQ ID NO: 3835677 - DNA, 20 bp, Homo sapiens
ccgcctcggagtgtggcctg

SEQ ID NO: 3835678 - DNA, 23 bp, Homo sapiens
ccgcctcggagtgtggcctggat

SEQ ID NO: 3835679 - DNA, 12 bp, Homo sapiens
ccgcctctgcct

SEQ ID NO: 3835680 - DNA, 14 bp, Homo sapiens
ccgcctctgcctcc

SEQ ID NO: 3835681 - DNA, 17 bp, Homo sapiens
ccgcctgaggccagcct

SEQ ID NO: 3835682 - DNA, 20 bp, Homo sapiens
ccgcctgaggccagcctgcg

SEQ ID NO: 3835683 - DNA, 21 bp, Homo sapiens
ccgctcccggttccctcccca

SEQ ID NO: 3835684 - DNA, 12 bp, Homo sapiens
ccgctgtgcccg

SEQ ID NO: 3835685 - DNA, 18 bp, Homo sapiens
ccgctgtgcccgccctgg

SEQ ID NO: 3835686 - DNA, 14 bp, Homo sapiens
ccgctgtgggaaac

SEQ ID NO: 3835687 - DNA, 16 bp, Homo sapiens
ccgggcccctgggctt

SEQ ID NO: 3835688 - DNA, 15 bp, Homo sapiens
ccgggccctcctggg

SEQ ID NO: 3835689 - DNA, 23 bp, Homo sapiens
ccgggccctcctgggcaccccag

SEQ ID NO: 3835690 - DNA, 23 bp, Homo sapiens
ccgggctctcctgccctgccctc

SEQ ID NO: 3835691 - DNA, 15 bp, Homo sapiens
ccggggctgaagcca

SEQ ID NO: 3835692 - DNA, 21 bp, Homo sapiens
ccggggctgaagccacacagc

SEQ ID NO: 3835693 - DNA, 21 bp, Homo sapiens
ccggttccctccccagctcct

SEQ ID NO: 3835694 - DNA, 16 bp, Homo sapiens
ccgtggaggaggaagg

SEQ ID NO: 3835695 - DNA, 14 bp, Homo sapiens
ctaggactgtggag

SEQ ID NO: 3835696 - DNA, 16 bp, Homo sapiens
ctaggactgtggaggg

SEQ ID NO: 3835697 - DNA, 19 bp, Homo sapiens
ctaggactgtggaggggag

SEQ ID NO: 3835698 - DNA, 22 bp, Homo sapiens
ctaggactgtggaggggagctg

SEQ ID NO: 3835699 - DNA, 17 bp, Homo sapiens
ctaggcacctctgtgct

SEQ ID NO: 3835700 - DNA, 18 bp, Homo sapiens
ctaggcacctctgtgctg

SEQ ID NO: 3835701 - DNA, 19 bp, Homo sapiens
ctaggcagaagaagctggg

SEQ ID NO: 3835702 - DNA, 20 bp, Homo sapiens
ctaggcagaagaagctggga

SEQ ID NO: 3835703 - DNA, 15 bp, Homo sapiens
ctagggcctgggttt

SEQ ID NO: 3835704 - DNA, 12 bp, Homo sapiens
ctaggggagcag

SEQ ID NO: 3835705 - DNA, 19 bp, Homo sapiens
ctaggggaggggggagcca

SEQ ID NO: 3835706 - DNA, 23 bp, Homo sapiens
ctaggggaggggggagccagagg

SEQ ID NO: 3835707 - DNA, 13 bp, Homo sapiens
ctaggtgggagcc

SEQ ID NO: 3835708 - DNA, 15 bp, Homo sapiens
ctagtgctgaagctt

SEQ ID NO: 3835709 - DNA, 16 bp, Homo sapiens
ctagtgctgaagctta

SEQ ID NO: 3835710 - DNA, 21 bp, Homo sapiens
ctagtgctgaagcttattaat

SEQ ID NO: 3835711 - DNA, 15 bp, Homo sapiens
ctagtgtctttgtca

SEQ ID NO: 3835712 - DNA, 15 bp, Homo sapiens
ctatacatttctgtt

SEQ ID NO: 3835713 - DNA, 21 bp, Homo sapiens
ctatcaaagaccttgtgtgta

SEQ ID NO: 3835714 - DNA, 17 bp, Homo sapiens
ctatcgtaaaattaaga

SEQ ID NO: 3835715 - DNA, 18 bp, Homo sapiens
ctatcgtaaaattaagaa

SEQ ID NO: 3835716 - DNA, 18 bp, Homo sapiens
ctatctcaatcctaattt

SEQ ID NO: 3835717 - DNA, 12 bp, Homo sapiens
ctatctcatcta

SEQ ID NO: 3835718 - DNA, 20 bp, Homo sapiens
ctatctgaactaattcattt

SEQ ID NO: 3835719 - DNA, 17 bp, Homo sapiens
ctatgcaattgtacaaa

SEQ ID NO: 3835720 - DNA, 16 bp, Homo sapiens
ctatggttgccacccc

SEQ ID NO: 3835721 - DNA, 17 bp, Homo sapiens
ctatggttgccacccca

SEQ ID NO: 3835722 - DNA, 12 bp, Homo sapiens
ctattgtacaga

SEQ ID NO: 3835723 - DNA, 15 bp, Homo sapiens
ctatttataactaat

SEQ ID NO: 3835724 - DNA, 14 bp, Homo sapiens
ctcaaaaaagagga

SEQ ID NO: 3835725 - DNA, 15 bp, Homo sapiens
ctcaagattcccagg

SEQ ID NO: 3835726 - DNA, 14 bp, Homo sapiens
ctcaatcctaattt

SEQ ID NO: 3835727 - DNA, 20 bp, Homo sapiens
ctcaatcctaatttctcctc

SEQ ID NO: 3835728 - DNA, 22 bp, Homo sapiens
ctcaatcctaatttctcctccc

SEQ ID NO: 3835729 - DNA, 16 bp, Homo sapiens
ctcaattgtgctttgt

SEQ ID NO: 3835730 - DNA, 19 bp, Homo sapiens
ctcaattgtgctttgtatc

SEQ ID NO: 3835731 - DNA, 19 bp, Homo sapiens
ctcacagcctctgacccct

SEQ ID NO: 3835732 - DNA, 18 bp, Homo sapiens
ctcacagtcaaaaggaac

SEQ ID NO: 3835733 - DNA, 19 bp, Homo sapiens
ctcacccctgtcctcactg

SEQ ID NO: 3835734 - DNA, 20 bp, Homo sapiens
ctcacccctgtcctcactgc

SEQ ID NO: 3835735 - DNA, 22 bp, Homo sapiens
ctcacccctgtcctcactgctc

SEQ ID NO: 3835736 - DNA, 15 bp, Homo sapiens
ctcactacctcctca

SEQ ID NO: 3835737 - DNA, 18 bp, Homo sapiens
ctcactacctcctcaggg

SEQ ID NO: 3835738 - DNA, 20 bp, Homo sapiens
ctcactacctcctcagggat

SEQ ID NO: 3835739 - DNA, 14 bp, Homo sapiens
ctcactgccaggcc

SEQ ID NO: 3835740 - DNA, 22 bp, Homo sapiens
ctcactgccaggccagcctccg

SEQ ID NO: 3835741 - DNA, 23 bp, Homo sapiens
ctcactgctccctgaagccagcc

SEQ ID NO: 3835742 - DNA, 14 bp, Homo sapiens
ctcactggccatcc

SEQ ID NO: 3835743 - DNA, 21 bp, Homo sapiens
ctcactttggttttggggtgt

SEQ ID NO: 3835744 - DNA, 20 bp, Homo sapiens
ctcagatgatggggtcagca

SEQ ID NO: 3835745 - DNA, 16 bp, Homo sapiens
ctcagatttaaaacaa

SEQ ID NO: 3835746 - DNA, 20 bp, Homo sapiens
ctcagcaactttcccttgcc

SEQ ID NO: 3835747 - DNA, 17 bp, Homo sapiens
ctcagcatgtagggctt

SEQ ID NO: 3835748 - DNA, 14 bp, Homo sapiens
ctcagccccaggag

SEQ ID NO: 3835749 - DNA, 18 bp, Homo sapiens
ctcagccccaggagaagg

SEQ ID NO: 3835750 - DNA, 23 bp, Homo sapiens
ctcagccccaggagaagggacaa

SEQ ID NO: 3835751 - DNA, 20 bp, Homo sapiens
ctcagccctgagctggcctc

SEQ ID NO: 3835752 - DNA, 15 bp, Homo sapiens
ctcagccctgagttg

SEQ ID NO: 3835753 - DNA, 19 bp, Homo sapiens
ctcagccctggaggtgcca

SEQ ID NO: 3835754 - DNA, 22 bp, Homo sapiens
ctcagccctggaggtgccagca

SEQ ID NO: 3835755 - DNA, 13 bp, Homo sapiens
ctcagctgcttct

SEQ ID NO: 3835756 - DNA, 15 bp, Homo sapiens
ctcagctgcttctcc

SEQ ID NO: 3835757 - DNA, 17 bp, Homo sapiens
ctcagctgcttctccca

SEQ ID NO: 3835758 - DNA, 17 bp, Homo sapiens
ctcagctggactgcatt

SEQ ID NO: 3835759 - DNA, 18 bp, Homo sapiens
ctcaggcactagcctttg

SEQ ID NO: 3835760 - DNA, 23 bp, Homo sapiens
ctcaggcactagcctttggctct

SEQ ID NO: 3835761 - DNA, 13 bp, Homo sapiens
ctcaggctgctcc

SEQ ID NO: 3835762 - DNA, 22 bp, Homo sapiens
ctcagggatggccgttggccac

SEQ ID NO: 3835763 - DNA, 13 bp, Homo sapiens
ctcagggccaagc

SEQ ID NO: 3835764 - DNA, 14 bp, Homo sapiens
ctcagggccaagcc

SEQ ID NO: 3835765 - DNA, 17 bp, Homo sapiens
ctcaggggcacagacct

SEQ ID NO: 3835766 - DNA, 17 bp, Homo sapiens
ctcagtcctcccctcac

SEQ ID NO: 3835767 - DNA, 23 bp, Homo sapiens
ctcagtcctcccctcacagcctc

SEQ ID NO: 3835768 - DNA, 10 bp, Homo sapiens
ctcatcacta

SEQ ID NO: 3835769 - DNA, 18 bp, Homo sapiens
ctcatcactaaacagaga

SEQ ID NO: 3835770 - DNA, 21 bp, Homo sapiens
ctcatctaggtaaattacagt

SEQ ID NO: 3835771 - DNA, 18 bp, Homo sapiens
ctcatctatctcaatcct

SEQ ID NO: 3835772 - DNA, 15 bp, Homo sapiens
ctcatgctaatataa

SEQ ID NO: 3835773 - DNA, 12 bp, Homo sapiens
ctcatgctattt

SEQ ID NO: 3835774 - DNA, 21 bp, Homo sapiens
ctcatggtgaaatctgctctg

SEQ ID NO: 3835775 - DNA, 15 bp, Homo sapiens
ctcatgtctgaaaaa

SEQ ID NO: 3835776 - DNA, 20 bp, Homo sapiens
ctcattctaatgatggccca

SEQ ID NO: 3835777 - DNA, 19 bp, Homo sapiens
ctcatttgagaactgtcag

SEQ ID NO: 3835778 - DNA, 17 bp, Homo sapiens
ctcattttgtttttgtt

SEQ ID NO: 3835779 - DNA, 16 bp, Homo sapiens
ctccacatctgcctta

SEQ ID NO: 3835780 - DNA, 19 bp, Homo sapiens
ctccagcagataaggccga

SEQ ID NO: 3835781 - DNA, 11 bp, Homo sapiens
ctccagcctgt

SEQ ID NO: 3835782 - DNA, 18 bp, Homo sapiens
ctccagcctgtcggccac

SEQ ID NO: 3835783 - DNA, 17 bp, Homo sapiens
ctccagctgagtcctgg

SEQ ID NO: 3835784 - DNA, 18 bp, Homo sapiens
ctccagctgagtcctggg

SEQ ID NO: 3835785 - DNA, 21 bp, Homo sapiens
ctccagtctgctctcagcttg

SEQ ID NO: 3835786 - DNA, 14 bp, Homo sapiens
ctccatcccttccc

SEQ ID NO: 3835787 - DNA, 19 bp, Homo sapiens
ctccatcctttctgcctct

SEQ ID NO: 3835788 - DNA, 16 bp, Homo sapiens
ctccatcttctttgca

SEQ ID NO: 3835789 - DNA, 15 bp, Homo sapiens
ctccatgtcagggaa

SEQ ID NO: 3835790 - DNA, 13 bp, Homo sapiens
ctcccacctctgt

SEQ ID NO: 3835791 - DNA, 20 bp, Homo sapiens
ctcccacctctgtgacctca

SEQ ID NO: 3835792 - DNA, 13 bp, Homo sapiens
ctcccacttggcc

SEQ ID NO: 3835793 - DNA, 16 bp, Homo sapiens
ctcccaggtaccagct

SEQ ID NO: 3835794 - DNA, 17 bp, Homo sapiens
ctcccaggtaccagctg

SEQ ID NO: 3835795 - DNA, 24 bp, Homo sapiens
ctcccaggtaccagctgcgcttgc

SEQ ID NO: 3835796 - DNA, 18 bp, Homo sapiens
ctcccatggctttgtgct

SEQ ID NO: 3835797 - DNA, 22 bp, Homo sapiens
ctcccatggctttgtgctgctg

SEQ ID NO: 3835798 - DNA, 16 bp, Homo sapiens
ctcccattcaccctgt

SEQ ID NO: 3835799 - DNA, 12 bp, Homo sapiens
ctccccacgccc

SEQ ID NO: 3835800 - DNA, 16 bp, Homo sapiens
ctccccagatctgtcc

SEQ ID NO: 3835801 - DNA, 17 bp, Homo sapiens
ctccccagcccctagcc

SEQ ID NO: 3835802 - DNA, 19 bp, Homo sapiens
ctccccagcccctagccca

SEQ ID NO: 3835803 - DNA, 17 bp, Homo sapiens
ctccccagctcctcgtc

SEQ ID NO: 3835804 - DNA, 17 bp, Homo sapiens
ctccccatttcccatct

SEQ ID NO: 3835805 - DNA, 20 bp, Homo sapiens
ctccccatttcccatctgca

SEQ ID NO: 3835806 - DNA, 18 bp, Homo sapiens
ctccccggaagtgcctta

SEQ ID NO: 3835807 - DNA, 17 bp, Homo sapiens
ctcccctcacagcctct

SEQ ID NO: 3835808 - DNA, 20 bp, Homo sapiens
ctcccctcacagcctctgac

SEQ ID NO: 3835809 - DNA, 15 bp, Homo sapiens
ctcccctcccctgct

SEQ ID NO: 3835810 - DNA, 18 bp, Homo sapiens
ctcccctcccctgctgca

SEQ ID NO: 3835811 - DNA, 16 bp, Homo sapiens
ctcccctgctgcaggg

SEQ ID NO: 3835812 - DNA, 22 bp, Homo sapiens
ctccctccccagatctgtcctg

SEQ ID NO: 3835813 - DNA, 23 bp, Homo sapiens
ctccctccccagatctgtcctgg

SEQ ID NO: 3835814 - DNA, 12 bp, Homo sapiens
ctccctcctgcc

SEQ ID NO: 3835815 - DNA, 14 bp, Homo sapiens
ctccctctcctctg

SEQ ID NO: 3835816 - DNA, 14 bp, Homo sapiens
ctccctctgaccca

SEQ ID NO: 3835817 - DNA, 13 bp, Homo sapiens
ctccctgaagcca

SEQ ID NO: 3835818 - DNA, 12 bp, Homo sapiens
ctccgccagcct

SEQ ID NO: 3835819 - DNA, 14 bp, Homo sapiens
ctccgctgtgcccg

SEQ ID NO: 3835820 - DNA, 17 bp, Homo sapiens
ctccggggctcagccct

SEQ ID NO: 3835821 - DNA, 18 bp, Homo sapiens
ctccggggctcagccctg

SEQ ID NO: 3835822 - DNA, 16 bp, Homo sapiens
ctccgtgcttcctcag

SEQ ID NO: 3835823 - DNA, 20 bp, Homo sapiens
ctcctacccaccgcccttgc

SEQ ID NO: 3835824 - DNA, 20 bp, Homo sapiens
ctcctagctggagtgccatg

SEQ ID NO: 3835825 - DNA, 22 bp, Homo sapiens
ctcctagctggagtgccatggc

SEQ ID NO: 3835826 - DNA, 17 bp, Homo sapiens
ctcctcacctcatgccc

SEQ ID NO: 3835827 - DNA, 12 bp, Homo sapiens
cttgcctcccca

SEQ ID NO: 3835828 - DNA, 15 bp, Homo sapiens
cttgctctggacctg

SEQ ID NO: 3835829 - DNA, 17 bp, Homo sapiens
cttgcttttctgtattt

SEQ ID NO: 3835830 - DNA, 15 bp, Homo sapiens
cttggatcaagcaga

SEQ ID NO: 3835831 - DNA, 15 bp, Homo sapiens
cttggccaagcaggg

SEQ ID NO: 3835832 - DNA, 18 bp, Homo sapiens
cttggcccgcacagagct

SEQ ID NO: 3835833 - DNA, 13 bp, Homo sapiens
cttggctgctcag

SEQ ID NO: 3835834 - DNA, 19 bp, Homo sapiens
cttgggaggaagcagaata

SEQ ID NO: 3835835 - DNA, 23 bp, Homo sapiens
cttgggaggaagcagaataaagc

SEQ ID NO: 3835836 - DNA, 17 bp, Homo sapiens
cttgggctccgctgtgc

SEQ ID NO: 3835837 - DNA, 21 bp, Homo sapiens
cttgggctccgctgtgcccgc

SEQ ID NO: 3835838 - DNA, 22 bp, Homo sapiens
cttggggcagccattggcctct

SEQ ID NO: 3835839 - DNA, 22 bp, Homo sapiens
cttgggggtcacccatggcctc

SEQ ID NO: 3835840 - DNA, 20 bp, Homo sapiens
cttgtataaggagctttgct

SEQ ID NO: 3835841 - DNA, 21 bp, Homo sapiens
cttgtataaggagctttgctc

SEQ ID NO: 3835842 - DNA, 22 bp, Homo sapiens
cttgtccattgcgttattttct

SEQ ID NO: 3835843 - DNA, 13 bp, Homo sapiens
cttgtctctgtag

SEQ ID NO: 3835844 - DNA, 19 bp, Homo sapiens
cttgtgacagattatacag

SEQ ID NO: 3835845 - DNA, 20 bp, Homo sapiens
cttgtgactagtgctgaagc

SEQ ID NO: 3835846 - DNA, 22 bp, Homo sapiens
cttgtgactagtgctgaagctt

SEQ ID NO: 3835847 - DNA, 23 bp, Homo sapiens
cttgtgctggatggagcccaggc

SEQ ID NO: 3835848 - DNA, 19 bp, Homo sapiens
ctttaaaaactatttaact

SEQ ID NO: 3835849 - DNA, 23 bp, Homo sapiens
ctttaaaaactatttaacttgag

SEQ ID NO: 3835850 - DNA, 18 bp, Homo sapiens
ctttaactggaaggctgc

SEQ ID NO: 3835851 - DNA, 16 bp, Homo sapiens
ctttataaaaaaaagt

SEQ ID NO: 3835852 - DNA, 18 bp, Homo sapiens
ctttataaaaaaaagttg

SEQ ID NO: 3835853 - DNA, 18 bp, Homo sapiens
ctttataattctttcttt

SEQ ID NO: 3835854 - DNA, 17 bp, Homo sapiens
ctttattgctgcatttt

SEQ ID NO: 3835855 - DNA, 18 bp, Homo sapiens
ctttattgctgcatttta

SEQ ID NO: 3835856 - DNA, 22 bp, Homo sapiens
ctttcagccgactcagcaactt

SEQ ID NO: 3835857 - DNA, 13 bp, Homo sapiens
ctttcatgccatt

SEQ ID NO: 3835858 - DNA, 14 bp, Homo sapiens
ctttcatgccattt

SEQ ID NO: 3835859 - DNA, 16 bp, Homo sapiens
ctttcatgccatttta

SEQ ID NO: 3835860 - DNA, 22 bp, Homo sapiens
ctttcatttggggcatttgtaa

SEQ ID NO: 3835861 - DNA, 23 bp, Homo sapiens
ctttcatttggggcatttgtaaa

SEQ ID NO: 3835862 - DNA, 14 bp, Homo sapiens
ctttcccttgccct

SEQ ID NO: 3835863 - DNA, 12 bp, Homo sapiens
ctttcctgcctc

SEQ ID NO: 3835864 - DNA, 13 bp, Homo sapiens
ctttccttcttgc

SEQ ID NO: 3835865 - DNA, 16 bp, Homo sapiens
ctttcctttccccagc

SEQ ID NO: 3835866 - DNA, 17 bp, Homo sapiens
ctttcctttccccagcc

SEQ ID NO: 3835867 - DNA, 20 bp, Homo sapiens
ctttcctttccccagcccag

SEQ ID NO: 3835868 - DNA, 21 bp, Homo sapiens
ctttcctttccccagcccagg

SEQ ID NO: 3835869 - DNA, 11 bp, Homo sapiens
ctttgcatttc

SEQ ID NO: 3835870 - DNA, 12 bp, Homo sapiens
ctttgctttggg

SEQ ID NO: 3835871 - DNA, 14 bp, Homo sapiens
ctttggctctggag

SEQ ID NO: 3835872 - DNA, 23 bp, Homo sapiens
ctttggggagagctggcagtgtg

SEQ ID NO: 3835873 - DNA, 23 bp, Homo sapiens
ctttggggccgattgggagaaag

SEQ ID NO: 3835874 - DNA, 9 bp, Homo sapiens
ctttgtaaa

SEQ ID NO: 3835875 - DNA, 15 bp, Homo sapiens
ctttgtaaattattt

SEQ ID NO: 3835876 - DNA, 16 bp, Homo sapiens
ctttgtaaattatttt

SEQ ID NO: 3835877 - DNA, 14 bp, Homo sapiens
ctttgttggctcag

SEQ ID NO: 3835878 - DNA, 18 bp, Homo sapiens
cttttaaaatcagtgatt

SEQ ID NO: 3835879 - DNA, 17 bp, Homo sapiens
cttttatgtggtctctt

SEQ ID NO: 3835880 - DNA, 13 bp, Homo sapiens
cttttccctgctt

SEQ ID NO: 3835881 - DNA, 17 bp, Homo sapiens
cttttctgccctggctg

SEQ ID NO: 3835882 - DNA, 20 bp, Homo sapiens
cttttctgggtttgaagctg

SEQ ID NO: 3835883 - DNA, 21 bp, Homo sapiens
cttttctgggtttgaagctgc

SEQ ID NO: 3835884 - DNA, 22 bp, Homo sapiens
cttttggtgcctggctggtttg

SEQ ID NO: 3835885 - DNA, 23 bp, Homo sapiens
cttttgtgccatgttcaaaagaa

SEQ ID NO: 3835886 - DNA, 14 bp, Homo sapiens
ctttttaataaagt

SEQ ID NO: 3835887 - DNA, 22 bp, Homo sapiens
ctttttatgttgccagtttaat

SEQ ID NO: 3835888 - DNA, 14 bp, Homo sapiens
ctttttcattccct

SEQ ID NO: 3835889 - DNA, 20 bp, Homo sapiens
ctttttccattttttaaatg

SEQ ID NO: 3835890 - DNA, 16 bp, Homo sapiens
ctttttcctttataat

SEQ ID NO: 3835891 - DNA, 13 bp, Homo sapiens
ctttttcgccaaa

SEQ ID NO: 3835892 - DNA, 21 bp, Homo sapiens
ctttttcgccaaactgtctct

SEQ ID NO: 3835893 - DNA, 15 bp, Homo sapiens
ctttttgtaaatgct

SEQ ID NO: 3835894 - DNA, 23 bp, Homo sapiens
ctttttgtaaatgctgtaaatat

SEQ ID NO: 3835895 - DNA, 16 bp, Homo sapiens
cttttttgttgttttg

SEQ ID NO: 3835896 - DNA, 18 bp, Homo sapiens
ctttttttacgtaaacct

SEQ ID NO: 3835897 - DNA, 14 bp, Homo sapiens
gaaaaacacaagca

SEQ ID NO: 3835898 - DNA, 14 bp, Homo sapiens
gaaaaatgcctgct

SEQ ID NO: 3835899 - DNA, 18 bp, Homo sapiens
gaaaaatgcctgctgctg

SEQ ID NO: 3835900 - DNA, 13 bp, Homo sapiens
gaaaactaactca

SEQ ID NO: 3835901 - DNA, 19 bp, Homo sapiens
gaaaacttgtattatgtgt

SEQ ID NO: 3835902 - DNA, 22 bp, Homo sapiens
gaaaacttgtattatgtgtgtt

SEQ ID NO: 3835903 - DNA, 16 bp, Homo sapiens
gaaaactttttaatgg

SEQ ID NO: 3835904 - DNA, 15 bp, Homo sapiens
gaaaaggcagccaga

SEQ ID NO: 3835905 - DNA, 16 bp, Homo sapiens
gaaaaggcagccagat

SEQ ID NO: 3835906 - DNA, 15 bp, Homo sapiens
gaaaagggcagaggc

SEQ ID NO: 3835907 - DNA, 18 bp, Homo sapiens
gaaaattgcgaaatctgt

SEQ ID NO: 3835908 - DNA, 15 bp, Homo sapiens
gaaacaacattattt

SEQ ID NO: 3835909 - DNA, 15 bp, Homo sapiens
gaaacaataaagaga

SEQ ID NO: 3835910 - DNA, 22 bp, Homo sapiens
gaaacaatgtctggggacaggc

SEQ ID NO: 3835911 - DNA, 16 bp, Homo sapiens
gaaacactttgcataa

SEQ ID NO: 3835912 - DNA, 16 bp, Homo sapiens
gaaactttgctttggg

SEQ ID NO: 3835913 - DNA, 19 bp, Homo sapiens
gaaactttttaataaagta

SEQ ID NO: 3835914 - DNA, 17 bp, Homo sapiens
gaaagaaagaaagaaag

SEQ ID NO: 3835915 - DNA, 17 bp, Homo sapiens
gaaagaaagaagactgt

SEQ ID NO: 3835916 - DNA, 21 bp, Homo sapiens
gaaagagtactcttgtttcct

SEQ ID NO: 3835917 - DNA, 15 bp, Homo sapiens
gaaagattaaatata

SEQ ID NO: 3835918 - DNA, 16 bp, Homo sapiens
gaaagattgtaaacta

SEQ ID NO: 3835919 - DNA, 23 bp, Homo sapiens
gaaagccaggcaggtagccaggg

SEQ ID NO: 3835920 - DNA, 14 bp, Homo sapiens
gaaagcctctggaa

SEQ ID NO: 3835921 - DNA, 15 bp, Homo sapiens
gaaagcctctggaaa

SEQ ID NO: 3835922 - DNA, 16 bp, Homo sapiens
gaaagctaatactaat

SEQ ID NO: 3835923 - DNA, 15 bp, Homo sapiens
gaaaggggtgctttt

SEQ ID NO: 3835924 - DNA, 23 bp, Homo sapiens
gaaaggtgagtttgagctgcctt

SEQ ID NO: 3835925 - DNA, 18 bp, Homo sapiens
gaaaggtttggaaaacta

SEQ ID NO: 3835926 - DNA, 20 bp, Homo sapiens
gaaaggtttggaaaactaac

SEQ ID NO: 3835927 - DNA, 19 bp, Homo sapiens
gaaagtcttgtgactagtg

SEQ ID NO: 3835928 - DNA, 20 bp, Homo sapiens
gaaagtcttgtgactagtgc

SEQ ID NO: 3835929 - DNA, 21 bp, Homo sapiens
gaaagtgggtgagatgctgga

SEQ ID NO: 3835930 - DNA, 11 bp, Homo sapiens
gaaagtttccc

SEQ ID NO: 3835931 - DNA, 20 bp, Homo sapiens
gaaagtttccccaccagtga

SEQ ID NO: 3835932 - DNA, 14 bp, Homo sapiens
gaaatcatgtgcat

SEQ ID NO: 3835933 - DNA, 15 bp, Homo sapiens
gaaatcatgtgcata

SEQ ID NO: 3835934 - DNA, 16 bp, Homo sapiens
gaaatggggagctggc

SEQ ID NO: 3835935 - DNA, 15 bp, Homo sapiens
gaaattcatggcttt

SEQ ID NO: 3835936 - DNA, 15 bp, Homo sapiens
gaaatttatacaaag

SEQ ID NO: 3835937 - DNA, 12 bp, Homo sapiens
gaaatttcatga

SEQ ID NO: 3835938 - DNA, 16 bp, Homo sapiens
gaaattttaaatgcac

SEQ ID NO: 3835939 - DNA, 18 bp, Homo sapiens
gaaattttattagacatt

SEQ ID NO: 3835940 - DNA, 21 bp, Homo sapiens
gaacaaaagttcgaaagaaaa

SEQ ID NO: 3835941 - DNA, 11 bp, Homo sapiens
gaacctcactc

SEQ ID NO: 3835942 - DNA, 17 bp, Homo sapiens
gaacctcactcttgcca

SEQ ID NO: 3835943 - DNA, 18 bp, Homo sapiens
gaacctcactcttgccaa

SEQ ID NO: 3835944 - DNA, 20 bp, Homo sapiens
gaacctcactcttgccaacc

SEQ ID NO: 3835945 - DNA, 12 bp, Homo sapiens
gaacgcattttg

SEQ ID NO: 3835946 - DNA, 14 bp, Homo sapiens
gaactcctcccacc

SEQ ID NO: 3835947 - DNA, 15 bp, Homo sapiens
gaactcctcccaccc

SEQ ID NO: 3835948 - DNA, 12 bp, Homo sapiens
gaacttgaacaa

SEQ ID NO: 3835949 - DNA, 13 bp, Homo sapiens
gaacttgaacaaa

SEQ ID NO: 3835950 - DNA, 19 bp, Homo sapiens
gaacttgaacaaagtctct

SEQ ID NO: 3835951 - DNA, 14 bp, Homo sapiens
gaagaagctgggag

SEQ ID NO: 3835952 - DNA, 23 bp, Homo sapiens
gaagaagctgggagggaggggga

SEQ ID NO: 3835953 - DNA, 23 bp, Homo sapiens
gaagaaggagcagaataaatgtt

SEQ ID NO: 3835954 - DNA, 15 bp, Homo sapiens
gaagaagggagaaga

SEQ ID NO: 3835955 - DNA, 16 bp, Homo sapiens
gaagaagggagaagaa

SEQ ID NO: 3835956 - DNA, 17 bp, Homo sapiens
gaagaagggagaagaaa

SEQ ID NO: 3835957 - DNA, 19 bp, Homo sapiens
gaagacaggcacaaaatgt

SEQ ID NO: 3835958 - DNA, 12 bp, Homo sapiens
gaagcagaataa

SEQ ID NO: 3835959 - DNA, 14 bp, Homo sapiens
gaagcagaataaag

SEQ ID NO: 3835960 - DNA, 20 bp, Homo sapiens
gccttggctgttggcagtga

SEQ ID NO: 3835961 - DNA, 13 bp, Homo sapiens
gcctttggctctg

SEQ ID NO: 3835962 - DNA, 15 bp, Homo sapiens
gcctttggctctgga

SEQ ID NO: 3835963 - DNA, 16 bp, Homo sapiens
gcctttggctctggag

SEQ ID NO: 3835964 - DNA, 18 bp, Homo sapiens
gcgacatagcccatccct

SEQ ID NO: 3835965 - DNA, 15 bp, Homo sapiens
gcgacttctcaggac

SEQ ID NO: 3835966 - DNA, 14 bp, Homo sapiens
gcgcagctccttcc

SEQ ID NO: 3835967 - DNA, 12 bp, Homo sapiens
gcgcccacctcc

SEQ ID NO: 3835968 - DNA, 13 bp, Homo sapiens
gcggaccccagct

SEQ ID NO: 3835969 - DNA, 19 bp, Homo sapiens
gcggctgagctccagccac

SEQ ID NO: 3835970 - DNA, 18 bp, Homo sapiens
gcgggagcggtggccctg

SEQ ID NO: 3835971 - DNA, 16 bp, Homo sapiens
gcgggccttgccagcg

SEQ ID NO: 3835972 - DNA, 22 bp, Homo sapiens
gcggtctcaggctggtgggagg

SEQ ID NO: 3835973 - DNA, 14 bp, Homo sapiens
gcggtggccctgtc

SEQ ID NO: 3835974 - DNA, 22 bp, Homo sapiens
gcgtcacctgtgcagggccctc

SEQ ID NO: 3835975 - DNA, 13 bp, Homo sapiens
gcgtgcataaaaa

SEQ ID NO: 3835976 - DNA, 23 bp, Homo sapiens
gcgtgtgtgggtggatataaata

SEQ ID NO: 3835977 - DNA, 23 bp, Homo sapiens
gctaaagagcccttgcctcccca

SEQ ID NO: 3835978 - DNA, 19 bp, Homo sapiens
gctaaccccgtctgctcct

SEQ ID NO: 3835979 - DNA, 20 bp, Homo sapiens
gctaataaaatatcattcag

SEQ ID NO: 3835980 - DNA, 21 bp, Homo sapiens
gctaataaaatatcattcagc

SEQ ID NO: 3835981 - DNA, 17 bp, Homo sapiens
gctaatgtgtctgtgga

SEQ ID NO: 3835982 - DNA, 23 bp, Homo sapiens
gctactaacagattataataaat

SEQ ID NO: 3835983 - DNA, 13 bp, Homo sapiens
gctagcacctccc

SEQ ID NO: 3835984 - DNA, 17 bp, Homo sapiens
gctagcttctgcttttc

SEQ ID NO: 3835985 - DNA, 22 bp, Homo sapiens
gctagcttctgcttttctgccc

SEQ ID NO: 3835986 - DNA, 23 bp, Homo sapiens
gctagcttctgcttttctgccct

SEQ ID NO: 3835987 - DNA, 22 bp, Homo sapiens
gctaggggaggggggagccaga

SEQ ID NO: 3835988 - DNA, 15 bp, Homo sapiens
gctatcgtaaaatta

SEQ ID NO: 3835989 - DNA, 15 bp, Homo sapiens
gctatggttgccacc

SEQ ID NO: 3835990 - DNA, 21 bp, Homo sapiens
gctatggttgccaccccaacc

SEQ ID NO: 3835991 - DNA, 20 bp, Homo sapiens
gctattctgtgaaactaatc

SEQ ID NO: 3835992 - DNA, 17 bp, Homo sapiens
gctcaatcatgtgccag

SEQ ID NO: 3835993 - DNA, 11 bp, Homo sapiens
gctcagaaaat

SEQ ID NO: 3835994 - DNA, 11 bp, Homo sapiens
gctcagccctg

SEQ ID NO: 3835995 - DNA, 15 bp, Homo sapiens
gctcagccctgagct

SEQ ID NO: 3835996 - DNA, 19 bp, Homo sapiens
gctcagccctgagctggcg

SEQ ID NO: 3835997 - DNA, 14 bp, Homo sapiens
gctcagccctggag

SEQ ID NO: 3835998 - DNA, 15 bp, Homo sapiens
gctcagccctggagg

SEQ ID NO: 3835999 - DNA, 15 bp, Homo sapiens
gctcagtctccttgg

SEQ ID NO: 3836000 - DNA, 18 bp, Homo sapiens
gctcatctgccaaaatgt

SEQ ID NO: 3836001 - DNA, 17 bp, Homo sapiens
gctcatttgagaactgt

SEQ ID NO: 3836002 - DNA, 11 bp, Homo sapiens
gctccagcctg

SEQ ID NO: 3836003 - DNA, 12 bp, Homo sapiens
gctccagcctgt

SEQ ID NO: 3836004 - DNA, 13 bp, Homo sapiens
gctccagcctgtc

SEQ ID NO: 3836005 - DNA, 16 bp, Homo sapiens
gctcccaggagggctt

SEQ ID NO: 3836006 - DNA, 13 bp, Homo sapiens
gctcccggttccc

SEQ ID NO: 3836007 - DNA, 19 bp, Homo sapiens
gctcccggttccctcccca

SEQ ID NO: 3836008 - DNA, 12 bp, Homo sapiens
gctccctgaagc

SEQ ID NO: 3836009 - DNA, 16 bp, Homo sapiens
gctccctgaagccagc

SEQ ID NO: 3836010 - DNA, 15 bp, Homo sapiens
gctcctccctctgac

SEQ ID NO: 3836011 - DNA, 21 bp, Homo sapiens
gctcctcgctcgcacctgcct

SEQ ID NO: 3836012 - DNA, 21 bp, Homo sapiens
gctcctcgtctttgaactgcc

SEQ ID NO: 3836013 - DNA, 22 bp, Homo sapiens
gctcctcgtctttgaactgccg

SEQ ID NO: 3836014 - DNA, 19 bp, Homo sapiens
gctcctgaagggtgctcag

SEQ ID NO: 3836015 - DNA, 21 bp, Homo sapiens
gctccttctctagtttcccct

SEQ ID NO: 3836016 - DNA, 14 bp, Homo sapiens
gctctcagcttgtg

SEQ ID NO: 3836017 - DNA, 17 bp, Homo sapiens
gctctcatgaagccctt

SEQ ID NO: 3836018 - DNA, 18 bp, Homo sapiens
gctctcatgaagccctta

SEQ ID NO: 3836019 - DNA, 12 bp, Homo sapiens
gctctcctgccc

SEQ ID NO: 3836020 - DNA, 22 bp, Homo sapiens
gctctcctgccctgccctcctg

SEQ ID NO: 3836021 - DNA, 12 bp, Homo sapiens
gctctggacctg

SEQ ID NO: 3836022 - DNA, 18 bp, Homo sapiens
gctctggagacagcccca

SEQ ID NO: 3836023 - DNA, 20 bp, Homo sapiens
gctctggagacagccccaga

SEQ ID NO: 3836024 - DNA, 13 bp, Homo sapiens
gctctggagagaa

SEQ ID NO: 3836025 - DNA, 14 bp, Homo sapiens
gctctggagagaaa

SEQ ID NO: 3836026 - DNA, 15 bp, Homo sapiens
gctctggagagaaac

SEQ ID NO: 3836027 - DNA, 18 bp, Homo sapiens
gctctggagcaagccctg

SEQ ID NO: 3836028 - DNA, 14 bp, Homo sapiens
gctctgtgcagtca

SEQ ID NO: 3836029 - DNA, 21 bp, Homo sapiens
gctctgtgcagtcactggagg

SEQ ID NO: 3836030 - DNA, 16 bp, Homo sapiens
gctgaagccacacagc

SEQ ID NO: 3836031 - DNA, 20 bp, Homo sapiens
gctgaagccacacagcccag

SEQ ID NO: 3836032 - DNA, 14 bp, Homo sapiens
gctgaagcctggac

SEQ ID NO: 3836033 - DNA, 21 bp, Homo sapiens
gctgaagcctggacgcagcca

SEQ ID NO: 3836034 - DNA, 21 bp, Homo sapiens
gctgaagcttattaatgctaa

SEQ ID NO: 3836035 - DNA, 13 bp, Homo sapiens
gctgagcaccttt

SEQ ID NO: 3836036 - DNA, 17 bp, Homo sapiens
gctgagctccagccacc

SEQ ID NO: 3836037 - DNA, 14 bp, Homo sapiens
gctgaggaccctca

SEQ ID NO: 3836038 - DNA, 19 bp, Homo sapiens
gctgaggaccctcagcccc

SEQ ID NO: 3836039 - DNA, 13 bp, Homo sapiens
gctgaggttcctc

SEQ ID NO: 3836040 - DNA, 18 bp, Homo sapiens
gctgaggttcctctgcct

SEQ ID NO: 3836041 - DNA, 22 bp, Homo sapiens
gctgagtcgctctcatgaagcc

SEQ ID NO: 3836042 - DNA, 23 bp, Homo sapiens
gctgagtcgctctcatgaagccc

SEQ ID NO: 3836043 - DNA, 11 bp, Homo sapiens
gctgcaggggc

SEQ ID NO: 3836044 - DNA, 15 bp, Homo sapiens
gctgcaggggctctg

SEQ ID NO: 3836045 - DNA, 16 bp, Homo sapiens
gctgcaggggctctgg

SEQ ID NO: 3836046 - DNA, 17 bp, Homo sapiens
gctgcaggggctctgga

SEQ ID NO: 3836047 - DNA, 21 bp, Homo sapiens
gctgcaggggctctggagaga

SEQ ID NO: 3836048 - DNA, 18 bp, Homo sapiens
gctgcatttggctggagc

SEQ ID NO: 3836049 - DNA, 20 bp, Homo sapiens
gctgcatttggctggagccc

SEQ ID NO: 3836050 - DNA, 18 bp, Homo sapiens
gctgcattttaagcataa

SEQ ID NO: 3836051 - DNA, 14 bp, Homo sapiens
gctgccagggaaga

SEQ ID NO: 3836052 - DNA, 23 bp, Homo sapiens
gctgccccatttatccacctcca

SEQ ID NO: 3836053 - DNA, 17 bp, Homo sapiens
gctgcctaggcagccag

SEQ ID NO: 3836054 - DNA, 21 bp, Homo sapiens
gctgcctatgcccagcctcca

SEQ ID NO: 3836055 - DNA, 16 bp, Homo sapiens
gctgcctcctcctgag

SEQ ID NO: 3836056 - DNA, 21 bp, Homo sapiens
gctgcctcctcctgagagctg

SEQ ID NO: 3836057 - DNA, 12 bp, Homo sapiens
gctgccttccct

SEQ ID NO: 3836058 - DNA, 15 bp, Homo sapiens
gctgccttccctagc

SEQ ID NO: 3836059 - DNA, 19 bp, Homo sapiens
gctgccttctggattcttg

SEQ ID NO: 3836060 - DNA, 16 bp, Homo sapiens
gctgcgccctgggctc

SEQ ID NO: 3836061 - DNA, 17 bp, Homo sapiens
gctgcgcttgcttttct

SEQ ID NO: 3836062 - DNA, 17 bp, Homo sapiens
gctgctgcccccacccc

SEQ ID NO: 3836063 - DNA, 12 bp, Homo sapiens
gctgcttgcccc

SEQ ID NO: 3836064 - DNA, 22 bp, Homo sapiens
gctgctttgtagtttgcccaga

SEQ ID NO: 3836065 - DNA, 21 bp, Homo sapiens
gctggactgcattgaaggcga

SEQ ID NO: 3836066 - DNA, 13 bp, Homo sapiens
gctggagaagaga

SEQ ID NO: 3836067 - DNA, 15 bp, Homo sapiens
gctggagaagagagg

SEQ ID NO: 3836068 - DNA, 18 bp, Homo sapiens
gctggagaagagaggaga

SEQ ID NO: 3836069 - DNA, 10 bp, Homo sapiens
gctggagcct

SEQ ID NO: 3836070 - DNA, 11 bp, Homo sapiens
gctggagcctg

SEQ ID NO: 3836071 - DNA, 23 bp, Homo sapiens
gctggagcctgtgtaacagctcc

SEQ ID NO: 3836072 - DNA, 17 bp, Homo sapiens
gctggagtgccatggct

SEQ ID NO: 3836073 - DNA, 21 bp, Homo sapiens
gctggagtgccatggctgggg

SEQ ID NO: 3836074 - DNA, 14 bp, Homo sapiens
gctggatggagccc

SEQ ID NO: 3836075 - DNA, 20 bp, Homo sapiens
gctggcagtgtgcggagctg

SEQ ID NO: 3836076 - DNA, 13 bp, Homo sapiens
gctggcccccacc

SEQ ID NO: 3836077 - DNA, 19 bp, Homo sapiens
gctggcctaggtgggagcc

SEQ ID NO: 3836078 - DNA, 15 bp, Homo sapiens
gctggcctcacctgg

SEQ ID NO: 3836079 - DNA, 13 bp, Homo sapiens
gctggctcctgaa

SEQ ID NO: 3836080 - DNA, 18 bp, Homo sapiens
gctgggaggagggagagg

SEQ ID NO: 3836081 - DNA, 22 bp, Homo sapiens
gctgggaggagggagagggagg

SEQ ID NO: 3836082 - DNA, 21 bp, Homo sapiens
gctgggagggagggggaggtg

SEQ ID NO: 3836083 - DNA, 16 bp, Homo sapiens
gctgggcccttcctgg

SEQ ID NO: 3836084 - DNA, 22 bp, Homo sapiens
gctgggctagaggctgagcacc

SEQ ID NO: 3836085 - DNA, 18 bp, Homo sapiens
gctggggggtctcagcat

SEQ ID NO: 3836086 - DNA, 17 bp, Homo sapiens
gctggtttgcccagagc

SEQ ID NO: 3836087 - DNA, 15 bp, Homo sapiens
gctggtttttcccac

SEQ ID NO: 3836088 - DNA, 14 bp, Homo sapiens
gctgtaaatatttc

SEQ ID NO: 3836089 - DNA, 16 bp, Homo sapiens
gctgtaaatatttcat

SEQ ID NO: 3836090 - DNA, 20 bp, Homo sapiens
gctgtaaatatttcataaat

SEQ ID NO: 3836091 - DNA, 17 bp, Homo sapiens
gctgtgcccgccctggg

SEQ ID NO: 3836092 - DNA, 22 bp, Homo sapiens
gctgttggcagtgagtgagcct

SEQ ID NO: 3836093 - DNA, 15 bp, Homo sapiens
ggggtcacccatggc

SEQ ID NO: 3836094 - DNA, 14 bp, Homo sapiens
ggggtcagcaggcc

SEQ ID NO: 3836095 - DNA, 19 bp, Homo sapiens
ggggtcagcaggcccagga

SEQ ID NO: 3836096 - DNA, 15 bp, Homo sapiens
ggggtcccaggacct

SEQ ID NO: 3836097 - DNA, 15 bp, Homo sapiens
gggtcacccatggcc

SEQ ID NO: 3836098 - DNA, 15 bp, Homo sapiens
gggtcagcaggccca

SEQ ID NO: 3836099 - DNA, 15 bp, Homo sapiens
gggtgagatgctgga

SEQ ID NO: 3836100 - DNA, 18 bp, Homo sapiens
gggtgagatgctggagaa

SEQ ID NO: 3836101 - DNA, 14 bp, Homo sapiens
gggtgctcagtctc

SEQ ID NO: 3836102 - DNA, 20 bp, Homo sapiens
gggtgcttttatagaggcta

SEQ ID NO: 3836103 - DNA, 14 bp, Homo sapiens
gggtggagagttgg

SEQ ID NO: 3836104 - DNA, 21 bp, Homo sapiens
gggtggatataaatatatata

SEQ ID NO: 3836105 - DNA, 17 bp, Homo sapiens
gggtttgccaagccctt

SEQ ID NO: 3836106 - DNA, 22 bp, Homo sapiens
gggtttgccaagccctttgctg

SEQ ID NO: 3836107 - DNA, 21 bp, Homo sapiens
ggtaaaaggagggtggcctca

SEQ ID NO: 3836108 - DNA, 22 bp, Homo sapiens
ggtaaatcagactatgaagttt

SEQ ID NO: 3836109 - DNA, 17 bp, Homo sapiens
ggtacaaccggatgcca

SEQ ID NO: 3836110 - DNA, 16 bp, Homo sapiens
ggtcacccatggcctc

SEQ ID NO: 3836111 - DNA, 18 bp, Homo sapiens
ggtcacccatggcctcag

SEQ ID NO: 3836112 - DNA, 13 bp, Homo sapiens
ggtcactggaaag

SEQ ID NO: 3836113 - DNA, 13 bp, Homo sapiens
ggtcagcaggccc

SEQ ID NO: 3836114 - DNA, 20 bp, Homo sapiens
ggtcagcaggcccaggagaa

SEQ ID NO: 3836115 - DNA, 23 bp, Homo sapiens
ggtcctgcttgaactgctgccaa

SEQ ID NO: 3836116 - DNA, 12 bp, Homo sapiens
ggtcgctgcagc

SEQ ID NO: 3836117 - DNA, 18 bp, Homo sapiens
ggtctatggctcatgtct

SEQ ID NO: 3836118 - DNA, 18 bp, Homo sapiens
ggtctcaggctggtggga

SEQ ID NO: 3836119 - DNA, 13 bp, Homo sapiens
ggtctggctgctt

SEQ ID NO: 3836120 - DNA, 17 bp, Homo sapiens
ggtgaaaagggcagagg

SEQ ID NO: 3836121 - DNA, 14 bp, Homo sapiens
ggtgagatgctgga

SEQ ID NO: 3836122 - DNA, 23 bp, Homo sapiens
ggtgagatgctggagaagagagg

SEQ ID NO: 3836123 - DNA, 19 bp, Homo sapiens
ggtgaggaatttgaagctc

SEQ ID NO: 3836124 - DNA, 22 bp, Homo sapiens
ggtgagggcaagaggtgcctgg

SEQ ID NO: 3836125 - DNA, 18 bp, Homo sapiens
ggtgagtccattctccca

SEQ ID NO: 3836126 - DNA, 19 bp, Homo sapiens
ggtgagtttgagctgcctt

SEQ ID NO: 3836127 - DNA, 19 bp, Homo sapiens
ggtgccagcaaagccccat

SEQ ID NO: 3836128 - DNA, 15 bp, Homo sapiens
ggtgcctgagaggca

SEQ ID NO: 3836129 - DNA, 13 bp, Homo sapiens
ggtgcctgggagg

SEQ ID NO: 3836130 - DNA, 18 bp, Homo sapiens
ggtgcctgggaggagtgg

SEQ ID NO: 3836131 - DNA, 16 bp, Homo sapiens
ggtgctaaccccgtct

SEQ ID NO: 3836132 - DNA, 20 bp, Homo sapiens
ggtgctgggaggagggagag

SEQ ID NO: 3836133 - DNA, 19 bp, Homo sapiens
ggtgcttttatagaggcta

SEQ ID NO: 3836134 - DNA, 17 bp, Homo sapiens
ggtggacttagaaagca

SEQ ID NO: 3836135 - DNA, 15 bp, Homo sapiens
ggtggaggcttcctg

SEQ ID NO: 3836136 - DNA, 19 bp, Homo sapiens
ggtggagggggaggggaga

SEQ ID NO: 3836137 - DNA, 13 bp, Homo sapiens
ggtggatataaat

SEQ ID NO: 3836138 - DNA, 11 bp, Homo sapiens
ggtggcagaga

SEQ ID NO: 3836139 - DNA, 14 bp, Homo sapiens
ggtggcagagacag

SEQ ID NO: 3836140 - DNA, 20 bp, Homo sapiens
ggtggcagagacagtgggca

SEQ ID NO: 3836141 - DNA, 19 bp, Homo sapiens
ggtggcatgtgcctataat

SEQ ID NO: 3836142 - DNA, 13 bp, Homo sapiens
ggtggccctgtcc

SEQ ID NO: 3836143 - DNA, 13 bp, Homo sapiens
ggtgggagcagga

SEQ ID NO: 3836144 - DNA, 16 bp, Homo sapiens
ggtgggccgcaggcgg

SEQ ID NO: 3836145 - DNA, 19 bp, Homo sapiens
ggtggggcagaaaggctgc

SEQ ID NO: 3836146 - DNA, 13 bp, Homo sapiens
ggtggggccccca

SEQ ID NO: 3836147 - DNA, 14 bp, Homo sapiens
ggtggggcccccag

SEQ ID NO: 3836148 - DNA, 15 bp, Homo sapiens
ggtggggcccccagc

SEQ ID NO: 3836149 - DNA, 20 bp, Homo sapiens
ggtggggcccccagcaccct

SEQ ID NO: 3836150 - DNA, 19 bp, Homo sapiens
ggttcattttttttccctt

SEQ ID NO: 3836151 - DNA, 14 bp, Homo sapiens
ggttcctctgcctg

SEQ ID NO: 3836152 - DNA, 15 bp, Homo sapiens
ggttcctctgcctgc

SEQ ID NO: 3836153 - DNA, 17 bp, Homo sapiens
ggttcctctgcctgccc

SEQ ID NO: 3836154 - DNA, 18 bp, Homo sapiens
ggttcctctgcctgcccc

SEQ ID NO: 3836155 - DNA, 22 bp, Homo sapiens
ggttgtggatgggaggctcctg

SEQ ID NO: 3836156 - DNA, 13 bp, Homo sapiens
ggtttgaagctgc

SEQ ID NO: 3836157 - DNA, 23 bp, Homo sapiens
ggttttgtccattattaataatt

SEQ ID NO: 3836158 - DNA, 18 bp, Homo sapiens
gtaaaaacaaagaaatta

SEQ ID NO: 3836159 - DNA, 20 bp, Homo sapiens
gtaaaaacaaagaaattatg

SEQ ID NO: 3836160 - DNA, 17 bp, Homo sapiens
gtaaaaagtagattaaa

SEQ ID NO: 3836161 - DNA, 13 bp, Homo sapiens
gtaaaccttttat

SEQ ID NO: 3836162 - DNA, 15 bp, Homo sapiens
gtaaactaaagtgtg

SEQ ID NO: 3836163 - DNA, 20 bp, Homo sapiens
gtaaactaaagtgtgcttta

SEQ ID NO: 3836164 - DNA, 21 bp, Homo sapiens
gtaaatagagtgcataaataa

SEQ ID NO: 3836165 - DNA, 14 bp, Homo sapiens
gtaaatcagggaca

SEQ ID NO: 3836166 - DNA, 13 bp, Homo sapiens
gtaaatcataatg

SEQ ID NO: 3836167 - DNA, 19 bp, Homo sapiens
gtaaatgctgtaaatattt

SEQ ID NO: 3836168 - DNA, 20 bp, Homo sapiens
gtaaattattttatgtcata

SEQ ID NO: 3836169 - DNA, 14 bp, Homo sapiens
gtaaattccccttc

SEQ ID NO: 3836170 - DNA, 15 bp, Homo sapiens
gtaaattccccttcc

SEQ ID NO: 3836171 - DNA, 21 bp, Homo sapiens
gtaacaaaaaataaagaattt

SEQ ID NO: 3836172 - DNA, 12 bp, Homo sapiens
gtaacagctcct

SEQ ID NO: 3836173 - DNA, 17 bp, Homo sapiens
gtaacagctccttggga

SEQ ID NO: 3836174 - DNA, 12 bp, Homo sapiens
gtaacatttacg

SEQ ID NO: 3836175 - DNA, 22 bp, Homo sapiens
gtaactgaagcataaacatcac

SEQ ID NO: 3836176 - DNA, 18 bp, Homo sapiens
gtaacttggatgtagcca

SEQ ID NO: 3836177 - DNA, 22 bp, Homo sapiens
gtaagagtttacaagaaataaa

SEQ ID NO: 3836178 - DNA, 15 bp, Homo sapiens
gtaagtaagaaagaa

SEQ ID NO: 3836179 - DNA, 13 bp, Homo sapiens
gtaataaatatga

SEQ ID NO: 3836180 - DNA, 14 bp, Homo sapiens
gtaataaatatgag

SEQ ID NO: 3836181 - DNA, 14 bp, Homo sapiens
gtaatattaaaaag

SEQ ID NO: 3836182 - DNA, 21 bp, Homo sapiens
gtacaaaaaagttataagaaa

SEQ ID NO: 3836183 - DNA, 11 bp, Homo sapiens
gtacaggttgg

SEQ ID NO: 3836184 - DNA, 17 bp, Homo sapiens
gtacaggttggatgtgg

SEQ ID NO: 3836185 - DNA, 18 bp, Homo sapiens
gtacagtttgtttacaca

SEQ ID NO: 3836186 - DNA, 19 bp, Homo sapiens
gtacagtttgtttacacac

SEQ ID NO: 3836187 - DNA, 15 bp, Homo sapiens
gtactctccttttat

SEQ ID NO: 3836188 - DNA, 16 bp, Homo sapiens
gtactgtctgtgtcct

SEQ ID NO: 3836189 - DNA, 13 bp, Homo sapiens
gtagaaaatgttt

SEQ ID NO: 3836190 - DNA, 22 bp, Homo sapiens
gtagccagggggactagcccct

SEQ ID NO: 3836191 - DNA, 17 bp, Homo sapiens
gtagggtgagaagggca

SEQ ID NO: 3836192 - DNA, 16 bp, Homo sapiens
gtagtaccaaatgctt

SEQ ID NO: 3836193 - DNA, 20 bp, Homo sapiens
gtagtataatgtatgaattt

SEQ ID NO: 3836194 - DNA, 19 bp, Homo sapiens
gtagtttgcccagagttgg

SEQ ID NO: 3836195 - DNA, 18 bp, Homo sapiens
gtataaaagcctgtttaa

SEQ ID NO: 3836196 - DNA, 21 bp, Homo sapiens
gtataaaagcctgtttaagag

SEQ ID NO: 3836197 - DNA, 17 bp, Homo sapiens
gtataatgtatgaattt

SEQ ID NO: 3836198 - DNA, 19 bp, Homo sapiens
gtataatgtatgaattttg

SEQ ID NO: 3836199 - DNA, 15 bp, Homo sapiens
gtatataaaatgtgc

SEQ ID NO: 3836200 - DNA, 13 bp, Homo sapiens
gtatatttgtaaa

SEQ ID NO: 3836201 - DNA, 14 bp, Homo sapiens
gtatatttgtaaaa

SEQ ID NO: 3836202 - DNA, 21 bp, Homo sapiens
gtatgtgtacgtgtgtgtgcg

SEQ ID NO: 3836203 - DNA, 19 bp, Homo sapiens
gtattaaactgtaaatcat

SEQ ID NO: 3836204 - DNA, 22 bp, Homo sapiens
gtattaagtgaaattttaaatg

SEQ ID NO: 3836205 - DNA, 17 bp, Homo sapiens
gtattatactgtagatt

SEQ ID NO: 3836206 - DNA, 23 bp, Homo sapiens
gtattatagtactgctttactgt

SEQ ID NO: 3836207 - DNA, 22 bp, Homo sapiens
gtattctgaccttgtgaacatc

SEQ ID NO: 3836208 - DNA, 11 bp, Homo sapiens
gtattgtaata

SEQ ID NO: 3836209 - DNA, 15 bp, Homo sapiens
gtattgtaatattaa

SEQ ID NO: 3836210 - DNA, 16 bp, Homo sapiens
gtattgtaatattaaa

SEQ ID NO: 3836211 - DNA, 11 bp, Homo sapiens
gtatttaatgt

SEQ ID NO: 3836212 - DNA, 16 bp, Homo sapiens
gtatttttttttctaa

SEQ ID NO: 3836213 - DNA, 13 bp, Homo sapiens
gtcacacagcctg

SEQ ID NO: 3836214 - DNA, 22 bp, Homo sapiens
gtcacatcctaatagaaagaaa

SEQ ID NO: 3836215 - DNA, 14 bp, Homo sapiens
gtcacccatggcct

SEQ ID NO: 3836216 - DNA, 22 bp, Homo sapiens
gtcacctgcacagggccctctg

SEQ ID NO: 3836217 - DNA, 21 bp, Homo sapiens
gtcacctgtgcagggccctct

SEQ ID NO: 3836218 - DNA, 14 bp, Homo sapiens
gtcacggctactct

SEQ ID NO: 3836219 - DNA, 16 bp, Homo sapiens
gtcacggctactctat

SEQ ID NO: 3836220 - DNA, 15 bp, Homo sapiens
gtcactggaaagggg

SEQ ID NO: 3836221 - DNA, 12 bp, Homo sapiens
gtcagcaggccc

SEQ ID NO: 3836222 - DNA, 16 bp, Homo sapiens
gtcagcaggcccagga

SEQ ID NO: 3836223 - DNA, 14 bp, Homo sapiens
gtcattaaagtgca

SEQ ID NO: 3836224 - DNA, 20 bp, Homo sapiens
gtcattaaagtgcactgtgt

SEQ ID NO: 3836225 - DNA, 21 bp, Homo sapiens
gtcattgcccacttctgtgta

SEQ ID NO: 3836226 - DNA, 12 bp, Homo sapiens
tatctttgtaaa

SEQ ID NO: 3836227 - DNA, 15 bp, Homo sapiens
tatctttgtaaatta

SEQ ID NO: 3836228 - DNA, 18 bp, Homo sapiens
tatctttgtaaattattt

SEQ ID NO: 3836229 - DNA, 14 bp, Homo sapiens
tatgaattttgtaa

SEQ ID NO: 3836230 - DNA, 15 bp, Homo sapiens
tatgaattttgtaag

SEQ ID NO: 3836231 - DNA, 20 bp, Homo sapiens
tatgaattttgtaagtataa

SEQ ID NO: 3836232 - DNA, 12 bp, Homo sapiens
tatgatttgcat

SEQ ID NO: 3836233 - DNA, 22 bp, Homo sapiens
tatggcctgtgagctaggaatt

SEQ ID NO: 3836234 - DNA, 19 bp, Homo sapiens
tatggttttgttttcaatg

SEQ ID NO: 3836235 - DNA, 20 bp, Homo sapiens
tatgtctataagtatataaa

SEQ ID NO: 3836236 - DNA, 20 bp, Homo sapiens
tatgtgccttctagaataca

SEQ ID NO: 3836237 - DNA, 20 bp, Homo sapiens
tatgtgtttctcctcagaag

SEQ ID NO: 3836238 - DNA, 12 bp, Homo sapiens
tatgttgcatag

SEQ ID NO: 3836239 - DNA, 13 bp, Homo sapiens
tattaaaaagaag

SEQ ID NO: 3836240 - DNA, 17 bp, Homo sapiens
tattaaagataagactt

SEQ ID NO: 3836241 - DNA, 17 bp, Homo sapiens
tattaagtatatttgta

SEQ ID NO: 3836242 - DNA, 18 bp, Homo sapiens
tattaagtatatttgtaa

SEQ ID NO: 3836243 - DNA, 19 bp, Homo sapiens
tattaagtatatttgtaaa

SEQ ID NO: 3836244 - DNA, 13 bp, Homo sapiens
tattaagtgaaat

SEQ ID NO: 3836245 - DNA, 17 bp, Homo sapiens
tattaagtgaaatttta

SEQ ID NO: 3836246 - DNA, 18 bp, Homo sapiens
tattaagtgaaattttaa

SEQ ID NO: 3836247 - DNA, 12 bp, Homo sapiens
tattaatgctaa

SEQ ID NO: 3836248 - DNA, 15 bp, Homo sapiens
tattcagctcatgga

SEQ ID NO: 3836249 - DNA, 22 bp, Homo sapiens
tattctattttcattttctgca

SEQ ID NO: 3836250 - DNA, 17 bp, Homo sapiens
tattctgtgaaactaat

SEQ ID NO: 3836251 - DNA, 14 bp, Homo sapiens
tattcttgaaagta

SEQ ID NO: 3836252 - DNA, 20 bp, Homo sapiens
tattcttgaaagtattgtgt

SEQ ID NO: 3836253 - DNA, 17 bp, Homo sapiens
tattgacaagtgtcttt

SEQ ID NO: 3836254 - DNA, 13 bp, Homo sapiens
tattgctgcattt

SEQ ID NO: 3836255 - DNA, 16 bp, Homo sapiens
tattgctttataaata

SEQ ID NO: 3836256 - DNA, 13 bp, Homo sapiens
tattggatttttt

SEQ ID NO: 3836257 - DNA, 15 bp, Homo sapiens
tattgtgttttaaca

SEQ ID NO: 3836258 - DNA, 15 bp, Homo sapiens
tattgtttaagcaga

SEQ ID NO: 3836259 - DNA, 16 bp, Homo sapiens
tattgtttcagtgttc

SEQ ID NO: 3836260 - DNA, 22 bp, Homo sapiens
tatttcgtgttgtgttctttat

SEQ ID NO: 3836261 - DNA, 23 bp, Homo sapiens
tatttcgtgttgtgttctttata

SEQ ID NO: 3836262 - DNA, 18 bp, Homo sapiens
tatttctacctcactttg

SEQ ID NO: 3836263 - DNA, 20 bp, Homo sapiens
tatttgcctccatgtagaac

SEQ ID NO: 3836264 - DNA, 16 bp, Homo sapiens
tatttgtaaaagctaa

SEQ ID NO: 3836265 - DNA, 16 bp, Homo sapiens
tatttgtctgtgtgct

SEQ ID NO: 3836266 - DNA, 14 bp, Homo sapiens
tattttaagacgaa

SEQ ID NO: 3836267 - DNA, 22 bp, Homo sapiens
tattttaagacgaaacatttgt

SEQ ID NO: 3836268 - DNA, 20 bp, Homo sapiens
tattttgtgtttaggaacta

SEQ ID NO: 3836269 - DNA, 12 bp, Homo sapiens
tatttttgtaaa

SEQ ID NO: 3836270 - DNA, 13 bp, Homo sapiens
tatttttgtaaat

SEQ ID NO: 3836271 - DNA, 16 bp, Homo sapiens
tcaaaattgttacaaa

SEQ ID NO: 3836272 - DNA, 14 bp, Homo sapiens
tcaaaggccccctt

SEQ ID NO: 3836273 - DNA, 16 bp, Homo sapiens
tcaaataaacactgtg

SEQ ID NO: 3836274 - DNA, 19 bp, Homo sapiens
tcaaatacagtagtataat

SEQ ID NO: 3836275 - DNA, 13 bp, Homo sapiens
tcaaatgttacaa

SEQ ID NO: 3836276 - DNA, 16 bp, Homo sapiens
tcaaatgttacaaaaa

SEQ ID NO: 3836277 - DNA, 14 bp, Homo sapiens
tcaaccccaaatcc

SEQ ID NO: 3836278 - DNA, 22 bp, Homo sapiens
tcaaccttgtaaattccccttc

SEQ ID NO: 3836279 - DNA, 16 bp, Homo sapiens
tcaagattcccaggag

SEQ ID NO: 3836280 - DNA, 17 bp, Homo sapiens
tcaagattcccaggagt

SEQ ID NO: 3836281 - DNA, 13 bp, Homo sapiens
tcaagcagaaaac

SEQ ID NO: 3836282 - DNA, 22 bp, Homo sapiens
tcaagcccagccacgtggagcc

SEQ ID NO: 3836283 - DNA, 16 bp, Homo sapiens
tcaagtgattctcctg

SEQ ID NO: 3836284 - DNA, 14 bp, Homo sapiens
tcaagtgtaattag

SEQ ID NO: 3836285 - DNA, 22 bp, Homo sapiens
tcaagtgtaattagcttttgga

SEQ ID NO: 3836286 - DNA, 18 bp, Homo sapiens
tcaatacactagttgttt

SEQ ID NO: 3836287 - DNA, 18 bp, Homo sapiens
tcaatcattgtacagttt

SEQ ID NO: 3836288 - DNA, 20 bp, Homo sapiens
tcaatccaaattccctctgg

SEQ ID NO: 3836289 - DNA, 21 bp, Homo sapiens
tcaatccaaattccctctgga

SEQ ID NO: 3836290 - DNA, 17 bp, Homo sapiens
tcaatgcaacctctgcc

SEQ ID NO: 3836291 - DNA, 11 bp, Homo sapiens
tcacagcctct

SEQ ID NO: 3836292 - DNA, 13 bp, Homo sapiens
tcacagcctctga

SEQ ID NO: 3836293 - DNA, 19 bp, Homo sapiens
tcacagcctctgacccctc

SEQ ID NO: 3836294 - DNA, 17 bp, Homo sapiens
tcacatcctaatagaaa

SEQ ID NO: 3836295 - DNA, 13 bp, Homo sapiens
tcacatgctggct

SEQ ID NO: 3836296 - DNA, 14 bp, Homo sapiens
tcacatgctggctc

SEQ ID NO: 3836297 - DNA, 20 bp, Homo sapiens
tcaccaccccctccttccct

SEQ ID NO: 3836298 - DNA, 17 bp, Homo sapiens
tcacccagagctgccta

SEQ ID NO: 3836299 - DNA, 20 bp, Homo sapiens
tcacccagagctgcctatgc

SEQ ID NO: 3836300 - DNA, 14 bp, Homo sapiens
tcacccatggcctc

SEQ ID NO: 3836301 - DNA, 14 bp, Homo sapiens
tcacccctgtcctc

SEQ ID NO: 3836302 - DNA, 23 bp, Homo sapiens
tcacctgcacagggccctctgag

SEQ ID NO: 3836303 - DNA, 21 bp, Homo sapiens
tcacctgtgcagggccctctg

SEQ ID NO: 3836304 - DNA, 22 bp, Homo sapiens
tcacctgtgcagggccctctgg

SEQ ID NO: 3836305 - DNA, 20 bp, Homo sapiens
tcactacctcctcagggatg

SEQ ID NO: 3836306 - DNA, 16 bp, Homo sapiens
tcactccataaaaaga

SEQ ID NO: 3836307 - DNA, 17 bp, Homo sapiens
tcactccataaaaagaa

SEQ ID NO: 3836308 - DNA, 14 bp, Homo sapiens
tcactgccaggcca

SEQ ID NO: 3836309 - DNA, 15 bp, Homo sapiens
tcactgccaggccag

SEQ ID NO: 3836310 - DNA, 18 bp, Homo sapiens
tcactgctccctgaagcc

SEQ ID NO: 3836311 - DNA, 19 bp, Homo sapiens
tcactgctccctgaagcca

SEQ ID NO: 3836312 - DNA, 24 bp, Homo sapiens
tcactgctccctgaagccagcctt

SEQ ID NO: 3836313 - DNA, 17 bp, Homo sapiens
tcactggaaaggggaga

SEQ ID NO: 3836314 - DNA, 15 bp, Homo sapiens
tcactggccatccct

SEQ ID NO: 3836315 - DNA, 21 bp, Homo sapiens
tcacttgaatcctagggcctg

SEQ ID NO: 3836316 - DNA, 18 bp, Homo sapiens
tcacttgaggtcaggagt

SEQ ID NO: 3836317 - DNA, 15 bp, Homo sapiens
tcactttggttttgg

SEQ ID NO: 3836318 - DNA, 16 bp, Homo sapiens
tcagacttcaccaaat

SEQ ID NO: 3836319 - DNA, 21 bp, Homo sapiens
tcagatgatggggtcagcagg

SEQ ID NO: 3836320 - DNA, 13 bp, Homo sapiens
tcagatttaaaac

SEQ ID NO: 3836321 - DNA, 18 bp, Homo sapiens
tcagcatgtagggcttct

SEQ ID NO: 3836322 - DNA, 18 bp, Homo sapiens
tcagccccaggagaaggg

SEQ ID NO: 3836323 - DNA, 20 bp, Homo sapiens
tcagccccaggagaagggac

SEQ ID NO: 3836324 - DNA, 14 bp, Homo sapiens
tcagccctgagctg

SEQ ID NO: 3836325 - DNA, 24 bp, Homo sapiens
tcagccctgagctggcctcacctg

SEQ ID NO: 3836326 - DNA, 12 bp, Homo sapiens
tcagccctggag

SEQ ID NO: 3836327 - DNA, 20 bp, Homo sapiens
tcagcctcttgagtagctgg

SEQ ID NO: 3836328 - DNA, 12 bp, Homo sapiens
tcagctgcttct

SEQ ID NO: 3836329 - DNA, 15 bp, Homo sapiens
tcagctgcttctccc

SEQ ID NO: 3836330 - DNA, 17 bp, Homo sapiens
tcagctggactgcattg

SEQ ID NO: 3836331 - DNA, 18 bp, Homo sapiens
tcaggaggccgttgcaga

SEQ ID NO: 3836332 - DNA, 22 bp, Homo sapiens
tcaggcagagctgtggcacaga

SEQ ID NO: 3836333 - DNA, 17 bp, Homo sapiens
tcaggccttgcctggga

SEQ ID NO: 3836334 - DNA, 17 bp, Homo sapiens
tcaggcttgcattaaaa

SEQ ID NO: 3836335 - DNA, 23 bp, Homo sapiens
tcaggcttgcattaaaagactgt

SEQ ID NO: 3836336 - DNA, 21 bp, Homo sapiens
tcagggatggccgttggccac

SEQ ID NO: 3836337 - DNA, 12 bp, Homo sapiens
tcagggccaagc

SEQ ID NO: 3836338 - DNA, 14 bp, Homo sapiens
tcagggccaagccg

SEQ ID NO: 3836339 - DNA, 22 bp, Homo sapiens
tcagggccaagccggcccaacc

SEQ ID NO: 3836340 - DNA, 19 bp, Homo sapiens
tcagtaacttgtttacata

SEQ ID NO: 3836341 - DNA, 18 bp, Homo sapiens
tcagtagtttctaagtct

SEQ ID NO: 3836342 - DNA, 13 bp, Homo sapiens
tcagtcagtgctg

SEQ ID NO: 3836343 - DNA, 16 bp, Homo sapiens
tcagtcagtgctggag

SEQ ID NO: 3836344 - DNA, 13 bp, Homo sapiens
tcagtcctcccct

SEQ ID NO: 3836345 - DNA, 18 bp, Homo sapiens
tcagtcctcccctcacag

SEQ ID NO: 3836346 - DNA, 22 bp, Homo sapiens
tcagtcctcccctcacagcctc

SEQ ID NO: 3836347 - DNA, 21 bp, Homo sapiens
tcagtggtttccctgcccgag

SEQ ID NO: 3836348 - DNA, 14 bp, Homo sapiens
tcagtgtcaaataa

SEQ ID NO: 3836349 - DNA, 19 bp, Homo sapiens
tcagtgtcaaataaacact

SEQ ID NO: 3836350 - DNA, 24 bp, Homo sapiens
tcataaagcaggcagaactcatct

SEQ ID NO: 3836351 - DNA, 19 bp, Homo sapiens
tcataatatttgaacaaaa

SEQ ID NO: 3836352 - DNA, 20 bp, Homo sapiens
tcataatatttgaacaaaaa

SEQ ID NO: 3836353 - DNA, 16 bp, Homo sapiens
tcataatgtaactgaa

SEQ ID NO: 3836354 - DNA, 13 bp, Homo sapiens
tcataattttcaa

SEQ ID NO: 3836355 - DNA, 14 bp, Homo sapiens
tcataattttcaaa

SEQ ID NO: 3836356 - DNA, 17 bp, Homo sapiens
tcatacaacaaagagga

SEQ ID NO: 3836357 - DNA, 14 bp, Homo sapiens
tcatatatctatat

SEQ ID NO: 3836358 - DNA, 15 bp, Homo sapiens
tcatcaatcattgta

SEQ ID NO: 3836359 - DNA, 23 bp, Homo sapiens
tgagatgctggagaagagaggag

SEQ ID NO: 3836360 - DNA, 16 bp, Homo sapiens
tgagattcacatgctg

SEQ ID NO: 3836361 - DNA, 23 bp, Homo sapiens
tgagattcacatgctggctcctg

SEQ ID NO: 3836362 - DNA, 17 bp, Homo sapiens
tgagcagttcccaagga

SEQ ID NO: 3836363 - DNA, 17 bp, Homo sapiens
tgagccaaattctaaag

SEQ ID NO: 3836364 - DNA, 23 bp, Homo sapiens
tgagccccctgagttcccaaagg

SEQ ID NO: 3836365 - DNA, 23 bp, Homo sapiens
tgagccccgcagacctccccagc

SEQ ID NO: 3836366 - DNA, 22 bp, Homo sapiens
tgagccgcctcggagtgtggcc

SEQ ID NO: 3836367 - DNA, 16 bp, Homo sapiens
tgagccgggcccctgg

SEQ ID NO: 3836368 - DNA, 17 bp, Homo sapiens
tgagccgggcccctggg

SEQ ID NO: 3836369 - DNA, 19 bp, Homo sapiens
tgagccgggcccctgggct

SEQ ID NO: 3836370 - DNA, 19 bp, Homo sapiens
tgagcctggccatgtcctc

SEQ ID NO: 3836371 - DNA, 14 bp, Homo sapiens
tgagctccagccac

SEQ ID NO: 3836372 - DNA, 21 bp, Homo sapiens
tgagctccagccaccccgcag

SEQ ID NO: 3836373 - DNA, 23 bp, Homo sapiens
tgagctctgcatttgtctattct

SEQ ID NO: 3836374 - DNA, 17 bp, Homo sapiens
tgagctgccttccctag

SEQ ID NO: 3836375 - DNA, 19 bp, Homo sapiens
tgagctgccttccctagct

SEQ ID NO: 3836376 - DNA, 19 bp, Homo sapiens
tgaggatcagagtaatcca

SEQ ID NO: 3836377 - DNA, 21 bp, Homo sapiens
tgagggcatcttggtccagga

SEQ ID NO: 3836378 - DNA, 20 bp, Homo sapiens
tgaggttcctctgcctgccc

SEQ ID NO: 3836379 - DNA, 14 bp, Homo sapiens
tgagtatcataata

SEQ ID NO: 3836380 - DNA, 23 bp, Homo sapiens
tgagtatcataatatattgtgtt

SEQ ID NO: 3836381 - DNA, 13 bp, Homo sapiens
tgagtcctggggt

SEQ ID NO: 3836382 - DNA, 16 bp, Homo sapiens
tgagtctgtcataata

SEQ ID NO: 3836383 - DNA, 16 bp, Homo sapiens
tgagtgagcctggctc

SEQ ID NO: 3836384 - DNA, 19 bp, Homo sapiens
tgagtgagcctggctcttg

SEQ ID NO: 3836385 - DNA, 17 bp, Homo sapiens
tgagttcccaaagggag

SEQ ID NO: 3836386 - DNA, 15 bp, Homo sapiens
tgagtttttcattat

SEQ ID NO: 3836387 - DNA, 18 bp, Homo sapiens
tgatactgacaggtatca

SEQ ID NO: 3836388 - DNA, 23 bp, Homo sapiens
tgatccagaaagaaaacttgtat

SEQ ID NO: 3836389 - DNA, 20 bp, Homo sapiens
tgatctcatcccaataaaat

SEQ ID NO: 3836390 - DNA, 19 bp, Homo sapiens
tgatctgctcagccctgga

SEQ ID NO: 3836391 - DNA, 12 bp, Homo sapiens
tgatcttttaag

SEQ ID NO: 3836392 - DNA, 23 bp, Homo sapiens
tgatgactcaagattcccaggag

SEQ ID NO: 3836393 - DNA, 15 bp, Homo sapiens
tgatggagcagagca

SEQ ID NO: 3836394 - DNA, 17 bp, Homo sapiens
tgatggcccattctact

SEQ ID NO: 3836395 - DNA, 18 bp, Homo sapiens
tgatggcccattctactt

SEQ ID NO: 3836396 - DNA, 19 bp, Homo sapiens
tgatggcccattctacttg

SEQ ID NO: 3836397 - DNA, 21 bp, Homo sapiens
tgatggcccattctacttgct

SEQ ID NO: 3836398 - DNA, 15 bp, Homo sapiens
tgatggggtcagcag

SEQ ID NO: 3836399 - DNA, 21 bp, Homo sapiens
tgatggttgtacatataagtg

SEQ ID NO: 3836400 - DNA, 18 bp, Homo sapiens
tgattaaggtcctgcttg

SEQ ID NO: 3836401 - DNA, 17 bp, Homo sapiens
tgattcaaatgttacaa

SEQ ID NO: 3836402 - DNA, 18 bp, Homo sapiens
tgattcaaatgttacaaa

SEQ ID NO: 3836403 - DNA, 23 bp, Homo sapiens
tgattccactacacctggctgag

SEQ ID NO: 3836404 - DNA, 17 bp, Homo sapiens
tgattcccgcatggttt

SEQ ID NO: 3836405 - DNA, 20 bp, Homo sapiens
tgattcccgcatggttttta

SEQ ID NO: 3836406 - DNA, 22 bp, Homo sapiens
tgattcctaaaactctgccagc

SEQ ID NO: 3836407 - DNA, 20 bp, Homo sapiens
tgattcctaaggcccagctg

SEQ ID NO: 3836408 - DNA, 14 bp, Homo sapiens
tgattctcctgcct

SEQ ID NO: 3836409 - DNA, 16 bp, Homo sapiens
tgattctcctgcctca

SEQ ID NO: 3836410 - DNA, 17 bp, Homo sapiens
tgattgagagtaactta

SEQ ID NO: 3836411 - DNA, 15 bp, Homo sapiens
tgattgttcataata

SEQ ID NO: 3836412 - DNA, 20 bp, Homo sapiens
tgattgttcataatacataa

SEQ ID NO: 3836413 - DNA, 17 bp, Homo sapiens
tgatttacagtttcaaa

SEQ ID NO: 3836414 - DNA, 12 bp, Homo sapiens
tgatttgcattt

SEQ ID NO: 3836415 - DNA, 17 bp, Homo sapiens
tgcaaaggtggggagaa

SEQ ID NO: 3836416 - DNA, 20 bp, Homo sapiens
tgcaaaggtggggagaaggg

SEQ ID NO: 3836417 - DNA, 18 bp, Homo sapiens
tgcaactttgtataaaag

SEQ ID NO: 3836418 - DNA, 15 bp, Homo sapiens
tgcaattgtacaaaa

SEQ ID NO: 3836419 - DNA, 20 bp, Homo sapiens
tgcaatttgtttgtgcttct

SEQ ID NO: 3836420 - DNA, 16 bp, Homo sapiens
tgcacagttctatttg

SEQ ID NO: 3836421 - DNA, 15 bp, Homo sapiens
tgcaccccttctctc

SEQ ID NO: 3836422 - DNA, 20 bp, Homo sapiens
tgcaccccttctctcctccc

SEQ ID NO: 3836423 - DNA, 12 bp, Homo sapiens
tgcacctctcca

SEQ ID NO: 3836424 - DNA, 20 bp, Homo sapiens
tgcactgtatcatttcatgc

SEQ ID NO: 3836425 - DNA, 13 bp, Homo sapiens
tgcagaggattta

SEQ ID NO: 3836426 - DNA, 16 bp, Homo sapiens
tgcagggccctctggg

SEQ ID NO: 3836427 - DNA, 18 bp, Homo sapiens
tgcaggggctctggagag

SEQ ID NO: 3836428 - DNA, 19 bp, Homo sapiens
tgcagggtcctccggggct

SEQ ID NO: 3836429 - DNA, 20 bp, Homo sapiens
tgcagggtcctccggggctc

SEQ ID NO: 3836430 - DNA, 13 bp, Homo sapiens
tgcaggtgcacca

SEQ ID NO: 3836431 - DNA, 17 bp, Homo sapiens
tgcagtcactggaggtt

SEQ ID NO: 3836432 - DNA, 16 bp, Homo sapiens
tgcagtgaccgcttcc

SEQ ID NO: 3836433 - DNA, 15 bp, Homo sapiens
tgcagtggagctggc

SEQ ID NO: 3836434 - DNA, 11 bp, Homo sapiens
tgcataaaaac

SEQ ID NO: 3836435 - DNA, 13 bp, Homo sapiens
tgcataaaaactg

SEQ ID NO: 3836436 - DNA, 23 bp, Homo sapiens
tgcataacgtataaaagcctgtt

SEQ ID NO: 3836437 - DNA, 15 bp, Homo sapiens
tgcataatgtcttta

SEQ ID NO: 3836438 - DNA, 17 bp, Homo sapiens
tgcatagaataaaattt

SEQ ID NO: 3836439 - DNA, 18 bp, Homo sapiens
tgcatattattttatgtt

SEQ ID NO: 3836440 - DNA, 15 bp, Homo sapiens
tgcatattcccctct

SEQ ID NO: 3836441 - DNA, 19 bp, Homo sapiens
tgcatcccaccagcctgag

SEQ ID NO: 3836442 - DNA, 15 bp, Homo sapiens
tgcatgctcaaatga

SEQ ID NO: 3836443 - DNA, 14 bp, Homo sapiens
tgcatttggctgga

SEQ ID NO: 3836444 - DNA, 16 bp, Homo sapiens
tgcatttggctggagc

SEQ ID NO: 3836445 - DNA, 15 bp, Homo sapiens
tgcatttgtctattc

SEQ ID NO: 3836446 - DNA, 14 bp, Homo sapiens
tgcattttaagcat

SEQ ID NO: 3836447 - DNA, 16 bp, Homo sapiens
tgcattttaagcataa

SEQ ID NO: 3836448 - DNA, 12 bp, Homo sapiens
tgcattttcaca

SEQ ID NO: 3836449 - DNA, 19 bp, Homo sapiens
tgcattttttaaaacaaga

SEQ ID NO: 3836450 - DNA, 17 bp, Homo sapiens
tgccaaaaccaaattga

SEQ ID NO: 3836451 - DNA, 19 bp, Homo sapiens
tgccaacctgtaataaata

SEQ ID NO: 3836452 - DNA, 16 bp, Homo sapiens
tgccaagccctttgct

SEQ ID NO: 3836453 - DNA, 21 bp, Homo sapiens
tgccacatcttgatctgctca

SEQ ID NO: 3836454 - DNA, 21 bp, Homo sapiens
tgccaccagagaccgtcctca

SEQ ID NO: 3836455 - DNA, 15 bp, Homo sapiens
tgccaccccaaccca

SEQ ID NO: 3836456 - DNA, 14 bp, Homo sapiens
tgccaggccagcct

SEQ ID NO: 3836457 - DNA, 16 bp, Homo sapiens
tgccaggccagcctcc

SEQ ID NO: 3836458 - DNA, 17 bp, Homo sapiens
tgccaggccagcctccg

SEQ ID NO: 3836459 - DNA, 13 bp, Homo sapiens
tgccagggaagac

SEQ ID NO: 3836460 - DNA, 14 bp, Homo sapiens
tgccagggaagaca

SEQ ID NO: 3836461 - DNA, 18 bp, Homo sapiens
tgccagggaagacagagc

SEQ ID NO: 3836462 - DNA, 19 bp, Homo sapiens
tgccagggaagacagagca

SEQ ID NO: 3836463 - DNA, 21 bp, Homo sapiens
tgccagggaagacagagcagg

SEQ ID NO: 3836464 - DNA, 23 bp, Homo sapiens
tgccagtttaatcattgcctggt

SEQ ID NO: 3836465 - DNA, 21 bp, Homo sapiens
tgccatggaatgactgaagac

SEQ ID NO: 3836466 - DNA, 13 bp, Homo sapiens
tgccatggctggg

SEQ ID NO: 3836467 - DNA, 20 bp, Homo sapiens
tgccatggctggggggtctc

SEQ ID NO: 3836468 - DNA, 11 bp, Homo sapiens
tgcccacttct

SEQ ID NO: 3836469 - DNA, 22 bp, Homo sapiens
tgcccagagccaagctggggca

SEQ ID NO: 3836470 - DNA, 18 bp, Homo sapiens
tgcccagcctccaactcc

SEQ ID NO: 3836471 - DNA, 15 bp, Homo sapiens
tgccccactgggaga

SEQ ID NO: 3836472 - DNA, 19 bp, Homo sapiens
tgcccccacacccactcca

SEQ ID NO: 3836473 - DNA, 22 bp, Homo sapiens
tgcccccgcatcccctgcctcc

SEQ ID NO: 3836474 - DNA, 13 bp, Homo sapiens
tgccccggccacc

SEQ ID NO: 3836475 - DNA, 15 bp, Homo sapiens
tgccccggccacctc

SEQ ID NO: 3836476 - DNA, 14 bp, Homo sapiens
tgcccctgccctga

SEQ ID NO: 3836477 - DNA, 16 bp, Homo sapiens
tgcccctgccctgagg

SEQ ID NO: 3836478 - DNA, 18 bp, Homo sapiens
tgccccttggatcaagca

SEQ ID NO: 3836479 - DNA, 13 bp, Homo sapiens
tgcccgccctggg

SEQ ID NO: 3836480 - DNA, 12 bp, Homo sapiens
tgccctgaggag

SEQ ID NO: 3836481 - DNA, 15 bp, Homo sapiens
tgccctggctgctgc

SEQ ID NO: 3836482 - DNA, 17 bp, Homo sapiens
tgccctggctgctgccc

SEQ ID NO: 3836483 - DNA, 17 bp, Homo sapiens
tgccctgggctgcctcc

SEQ ID NO: 3836484 - DNA, 13 bp, Homo sapiens
tgccgaaccagga

SEQ ID NO: 3836485 - DNA, 22 bp, Homo sapiens
tgccgcactagcctccctctcc

SEQ ID NO: 3836486 - DNA, 17 bp, Homo sapiens
tgcctccccatttccca

SEQ ID NO: 3836487 - DNA, 19 bp, Homo sapiens
tgcctccggcctgcactcc

SEQ ID NO: 3836488 - DNA, 22 bp, Homo sapiens
tgcctgacaccacgctggagct

SEQ ID NO: 3836489 - DNA, 23 bp, Homo sapiens
tgcctgacaccacgctggagctg

SEQ ID NO: 3836490 - DNA, 13 bp, Homo sapiens
tgcctgagaggca

SEQ ID NO: 3836491 - DNA, 20 bp, Homo sapiens
ttactagaacacagaaagcc

SEQ ID NO: 3836492 - DNA, 19 bp, Homo sapiens
ttactctttcatgccattt

SEQ ID NO: 3836493 - DNA, 15 bp, Homo sapiens
ttactgcattttcac

SEQ ID NO: 3836494 - DNA, 17 bp, Homo sapiens
ttactgccaaaaccaaa

SEQ ID NO: 3836495 - DNA, 21 bp, Homo sapiens
ttactgccaaaaccaaattga

SEQ ID NO: 3836496 - DNA, 19 bp, Homo sapiens
ttactgtcttttttctaaa

SEQ ID NO: 3836497 - DNA, 22 bp, Homo sapiens
ttacttgagtatcataatatat

SEQ ID NO: 3836498 - DNA, 15 bp, Homo sapiens
ttactttttgtaaat

SEQ ID NO: 3836499 - DNA, 22 bp, Homo sapiens
ttagacagtaagagtttacaag

SEQ ID NO: 3836500 - DNA, 21 bp, Homo sapiens
ttagagccaggcacacactgt

SEQ ID NO: 3836501 - DNA, 16 bp, Homo sapiens
ttagagctcgaaataa

SEQ ID NO: 3836502 - DNA, 20 bp, Homo sapiens
ttagatgggaagcctgtgta

SEQ ID NO: 3836503 - DNA, 12 bp, Homo sapiens
ttagatttaatg

SEQ ID NO: 3836504 - DNA, 16 bp, Homo sapiens
ttagcctgggcctcct

SEQ ID NO: 3836505 - DNA, 17 bp, Homo sapiens
ttagctattgggagcaa

SEQ ID NO: 3836506 - DNA, 14 bp, Homo sapiens
ttagtgttcataaa

SEQ ID NO: 3836507 - DNA, 13 bp, Homo sapiens
ttagttgcaactt

SEQ ID NO: 3836508 - DNA, 16 bp, Homo sapiens
ttataaacttttttct

SEQ ID NO: 3836509 - DNA, 22 bp, Homo sapiens
ttataaacttttttcttactgt

SEQ ID NO: 3836510 - DNA, 15 bp, Homo sapiens
ttataacagttataa

SEQ ID NO: 3836511 - DNA, 16 bp, Homo sapiens
ttataatattcataca

SEQ ID NO: 3836512 - DNA, 12 bp, Homo sapiens
ttataattttaa

SEQ ID NO: 3836513 - DNA, 17 bp, Homo sapiens
ttataattttaaatgtt

SEQ ID NO: 3836514 - DNA, 12 bp, Homo sapiens
ttatacaaagaa

SEQ ID NO: 3836515 - DNA, 13 bp, Homo sapiens
ttatacaaagaaa

SEQ ID NO: 3836516 - DNA, 23 bp, Homo sapiens
ttatacagaattgtgtctgcagg

SEQ ID NO: 3836517 - DNA, 22 bp, Homo sapiens
ttatagtactgctttactgtgt

SEQ ID NO: 3836518 - DNA, 14 bp, Homo sapiens
ttatagtattaagt

SEQ ID NO: 3836519 - DNA, 14 bp, Homo sapiens
ttatgcatttcaat

SEQ ID NO: 3836520 - DNA, 18 bp, Homo sapiens
ttatgtgcttgaagattc

SEQ ID NO: 3836521 - DNA, 20 bp, Homo sapiens
ttattaagtatatttgtaaa

SEQ ID NO: 3836522 - DNA, 14 bp, Homo sapiens
ttattgctgcattt

SEQ ID NO: 3836523 - DNA, 15 bp, Homo sapiens
ttattgctgcatttt

SEQ ID NO: 3836524 - DNA, 16 bp, Homo sapiens
ttattgctgcatttta

SEQ ID NO: 3836525 - DNA, 22 bp, Homo sapiens
ttattgtttaagcagaaataaa

SEQ ID NO: 3836526 - DNA, 14 bp, Homo sapiens
ttattgttttgtta

SEQ ID NO: 3836527 - DNA, 16 bp, Homo sapiens
ttattttaaaatcaaa

SEQ ID NO: 3836528 - DNA, 15 bp, Homo sapiens
ttattttctaaattc

SEQ ID NO: 3836529 - DNA, 13 bp, Homo sapiens
ttatttttttctg

SEQ ID NO: 3836530 - DNA, 17 bp, Homo sapiens
ttatttttttctgaatt

SEQ ID NO: 3836531 - DNA, 13 bp, Homo sapiens
ttcaaaagaaaac

SEQ ID NO: 3836532 - DNA, 15 bp, Homo sapiens
ttcaaatgttacaaa

SEQ ID NO: 3836533 - DNA, 18 bp, Homo sapiens
ttcaaatgttacaaaaaa

SEQ ID NO: 3836534 - DNA, 14 bp, Homo sapiens
ttcacttctcccaa

SEQ ID NO: 3836535 - DNA, 18 bp, Homo sapiens
ttcagacctttgtctgaa

SEQ ID NO: 3836536 - DNA, 21 bp, Homo sapiens
ttcagagttgatggttgtaca

SEQ ID NO: 3836537 - DNA, 15 bp, Homo sapiens
ttcagtagtttctaa

SEQ ID NO: 3836538 - DNA, 23 bp, Homo sapiens
ttcagtagtttctaagtctgtta

SEQ ID NO: 3836539 - DNA, 14 bp, Homo sapiens
ttcagttttactgc

SEQ ID NO: 3836540 - DNA, 20 bp, Homo sapiens
ttcataaataaagtttgttg

SEQ ID NO: 3836541 - DNA, 16 bp, Homo sapiens
ttcataaattaacaaa

SEQ ID NO: 3836542 - DNA, 16 bp, Homo sapiens
ttcatagaccctctca

SEQ ID NO: 3836543 - DNA, 18 bp, Homo sapiens
ttcattttctgcaagcct

SEQ ID NO: 3836544 - DNA, 22 bp, Homo sapiens
ttccactacacctggctgaggt

SEQ ID NO: 3836545 - DNA, 15 bp, Homo sapiens
ttccagtcaggatga

SEQ ID NO: 3836546 - DNA, 18 bp, Homo sapiens
ttccagtgatgttgaaat

SEQ ID NO: 3836547 - DNA, 19 bp, Homo sapiens
ttccagtgatgttgaaatt

SEQ ID NO: 3836548 - DNA, 18 bp, Homo sapiens
ttccatcctttgcatttc

SEQ ID NO: 3836549 - DNA, 19 bp, Homo sapiens
ttccattttttaaatgttc

SEQ ID NO: 3836550 - DNA, 16 bp, Homo sapiens
ttcccagactagattt

SEQ ID NO: 3836551 - DNA, 16 bp, Homo sapiens
ttcccctaattttcca

SEQ ID NO: 3836552 - DNA, 18 bp, Homo sapiens
ttccctccccagctcctc

SEQ ID NO: 3836553 - DNA, 15 bp, Homo sapiens
ttccctgtgtctttt

SEQ ID NO: 3836554 - DNA, 16 bp, Homo sapiens
ttcccttgcactgtat

SEQ ID NO: 3836555 - DNA, 15 bp, Homo sapiens
ttcccttgccctggg

SEQ ID NO: 3836556 - DNA, 15 bp, Homo sapiens
ttccctttttttaag

SEQ ID NO: 3836557 - DNA, 19 bp, Homo sapiens
ttcctaaggcccagctgcc

SEQ ID NO: 3836558 - DNA, 22 bp, Homo sapiens
ttcctaatggtctcatctcctt

SEQ ID NO: 3836559 - DNA, 20 bp, Homo sapiens
ttcctaggtataattcacat

SEQ ID NO: 3836560 - DNA, 12 bp, Homo sapiens
ttcctctcccat

SEQ ID NO: 3836561 - DNA, 19 bp, Homo sapiens
ttcctctcccattcaccct

SEQ ID NO: 3836562 - DNA, 14 bp, Homo sapiens
ttcctctgcctgcc

SEQ ID NO: 3836563 - DNA, 21 bp, Homo sapiens
ttcctgaagctgcttaacagt

SEQ ID NO: 3836564 - DNA, 17 bp, Homo sapiens
ttcctgataattgtgca

SEQ ID NO: 3836565 - DNA, 18 bp, Homo sapiens
ttcctgataattgtgcac

SEQ ID NO: 3836566 - DNA, 22 bp, Homo sapiens
ttcctgataattgtgcacacct

SEQ ID NO: 3836567 - DNA, 16 bp, Homo sapiens
ttcctgcgtcctcctc

SEQ ID NO: 3836568 - DNA, 13 bp, Homo sapiens
ttcctggctagga

SEQ ID NO: 3836569 - DNA, 14 bp, Homo sapiens
ttcctgtctaaagt

SEQ ID NO: 3836570 - DNA, 14 bp, Homo sapiens
ttccttcataattt

SEQ ID NO: 3836571 - DNA, 12 bp, Homo sapiens
ttcctttataat

SEQ ID NO: 3836572 - DNA, 16 bp, Homo sapiens
ttcctttataattctt

SEQ ID NO: 3836573 - DNA, 14 bp, Homo sapiens
ttcctttccccagc

SEQ ID NO: 3836574 - DNA, 15 bp, Homo sapiens
ttcctttccccagcc

SEQ ID NO: 3836575 - DNA, 16 bp, Homo sapiens
ttccttttccctgctt

SEQ ID NO: 3836576 - DNA, 17 bp, Homo sapiens
ttcgacctgatttacag

SEQ ID NO: 3836577 - DNA, 18 bp, Homo sapiens
ttcgacctgatttacagt

SEQ ID NO: 3836578 - DNA, 14 bp, Homo sapiens
ttcgccaaactgtc

SEQ ID NO: 3836579 - DNA, 17 bp, Homo sapiens
ttcgccaaactgtctct

SEQ ID NO: 3836580 - DNA, 12 bp, Homo sapiens
ttcggaatggtt

SEQ ID NO: 3836581 - DNA, 15 bp, Homo sapiens
ttctaaagtaaaaac

SEQ ID NO: 3836582 - DNA, 18 bp, Homo sapiens
ttctaagagaagttattt

SEQ ID NO: 3836583 - DNA, 16 bp, Homo sapiens
ttctaatgatggccca

SEQ ID NO: 3836584 - DNA, 23 bp, Homo sapiens
ttctacttgctctggacctgccc

SEQ ID NO: 3836585 - DNA, 12 bp, Homo sapiens
ttctatttgcta

SEQ ID NO: 3836586 - DNA, 20 bp, Homo sapiens
ttctattttcattttctgca

SEQ ID NO: 3836587 - DNA, 21 bp, Homo sapiens
ttctccatcctttctgcctct

SEQ ID NO: 3836588 - DNA, 17 bp, Homo sapiens
ttctcccacttggccaa

SEQ ID NO: 3836589 - DNA, 13 bp, Homo sapiens
ttctccgccagcc

SEQ ID NO: 3836590 - DNA, 18 bp, Homo sapiens
ttctccgccagcctcctc

SEQ ID NO: 3836591 - DNA, 20 bp, Homo sapiens
ttctccgccagcctcctctg

SEQ ID NO: 3836592 - DNA, 15 bp, Homo sapiens
ttctctaagatgaat

SEQ ID NO: 3836593 - DNA, 23 bp, Homo sapiens
ttctctaagatgaatccaaatgt

SEQ ID NO: 3836594 - DNA, 21 bp, Homo sapiens
ttctctcccaggggctggctt

SEQ ID NO: 3836595 - DNA, 23 bp, Homo sapiens
ttctctcccaggggctggcttca

SEQ ID NO: 3836596 - DNA, 12 bp, Homo sapiens
ttctctctgagc

SEQ ID NO: 3836597 - DNA, 17 bp, Homo sapiens
ttctctgtaattacaac

SEQ ID NO: 3836598 - DNA, 14 bp, Homo sapiens
ttctgaagcctcta

SEQ ID NO: 3836599 - DNA, 13 bp, Homo sapiens
ttctgccctggct

SEQ ID NO: 3836600 - DNA, 19 bp, Homo sapiens
ttctgccctggctgctgcc

SEQ ID NO: 3836601 - DNA, 13 bp, Homo sapiens
ttctgcctctcaa

SEQ ID NO: 3836602 - DNA, 13 bp, Homo sapiens
ttctgcttttctg

SEQ ID NO: 3836603 - DNA, 18 bp, Homo sapiens
ttctgcttttctgccctg

SEQ ID NO: 3836604 - DNA, 18 bp, Homo sapiens
ttctgggtttgaagctgc

SEQ ID NO: 3836605 - DNA, 19 bp, Homo sapiens
ttcttccagtgatgttgaa

SEQ ID NO: 3836606 - DNA, 14 bp, Homo sapiens
ttcttccatcccag

SEQ ID NO: 3836607 - DNA, 17 bp, Homo sapiens
ttcttccatcccaggac

SEQ ID NO: 3836608 - DNA, 14 bp, Homo sapiens
ttcttctctgctgc

SEQ ID NO: 3836609 - DNA, 21 bp, Homo sapiens
ttctttatatggaacgcattt

SEQ ID NO: 3836610 - DNA, 15 bp, Homo sapiens
ttctttttccttcat

SEQ ID NO: 3836611 - DNA, 21 bp, Homo sapiens
ttgaactaacataatcttaaa

SEQ ID NO: 3836612 - DNA, 14 bp, Homo sapiens
ttgaagccaaagaa

SEQ ID NO: 3836613 - DNA, 16 bp, Homo sapiens
ttgaagccgctcccgg

SEQ ID NO: 3836614 - DNA, 15 bp, Homo sapiens
ttgacaagtgtcttt

SEQ ID NO: 3836615 - DNA, 17 bp, Homo sapiens
ttgagaaggagagaaag

SEQ ID NO: 3836616 - DNA, 16 bp, Homo sapiens
ttgagatgtgttcaca

SEQ ID NO: 3836617 - DNA, 19 bp, Homo sapiens
ttgagccgggcccctgggc

SEQ ID NO: 3836618 - DNA, 20 bp, Homo sapiens
ttgagccgggcccctgggct

SEQ ID NO: 3836619 - DNA, 15 bp, Homo sapiens
ttgagctcagcttcc

SEQ ID NO: 3836620 - DNA, 11 bp, Homo sapiens
ttgagctgcct

SEQ ID NO: 3836621 - DNA, 12 bp, Homo sapiens
ttgagctgcctt

SEQ ID NO: 3836622 - DNA, 13 bp, Homo sapiens
ttgagctgccttc

SEQ ID NO: 3836623 - DNA, 19 bp, Homo sapiens
ttgagctgccttccctagc

SEQ ID NO: 3836624 - DNA, 12 bp, Homo sapiens
ttgagttttcat

SEQ ID NO: 3836625 - DNA, 18 bp, Homo sapiens
tcccaggacctgagcctg

SEQ ID NO: 3836626 - DNA, 20 bp, Homo sapiens
tcccaggacctgagcctggc

SEQ ID NO: 3836627 - DNA, 21 bp, Homo sapiens
tcccaggacctgagcctggcc

SEQ ID NO: 3836628 - DNA, 15 bp, Homo sapiens
tcccaggagttctgc

SEQ ID NO: 3836629 - DNA, 19 bp, Homo sapiens
tcccaggagttctgctcat

SEQ ID NO: 3836630 - DNA, 16 bp, Homo sapiens
tcccaggtaccagctg

SEQ ID NO: 3836631 - DNA, 19 bp, Homo sapiens
tcccaggtaccagctgcgc

SEQ ID NO: 3836632 - DNA, 20 bp, Homo sapiens
tcccaggtgaggaatttgaa

SEQ ID NO: 3836633 - DNA, 22 bp, Homo sapiens
tcccatgtgggatgagttttta

SEQ ID NO: 3836634 - DNA, 23 bp, Homo sapiens
tccccaaatcaatacactagttg

SEQ ID NO: 3836635 - DNA, 23 bp, Homo sapiens
tccccaccccgggctctcctgcc

SEQ ID NO: 3836636 - DNA, 14 bp, Homo sapiens
tccccacccctgcc

SEQ ID NO: 3836637 - DNA, 16 bp, Homo sapiens
tccccacccctgcccc

SEQ ID NO: 3836638 - DNA, 16 bp, Homo sapiens
tccccacgcccccatg

SEQ ID NO: 3836639 - DNA, 18 bp, Homo sapiens
tccccacgccctcccctc

SEQ ID NO: 3836640 - DNA, 13 bp, Homo sapiens
tccccactccagc

SEQ ID NO: 3836641 - DNA, 15 bp, Homo sapiens
tccccagacagggct

SEQ ID NO: 3836642 - DNA, 18 bp, Homo sapiens
tccccagacagggctcca

SEQ ID NO: 3836643 - DNA, 20 bp, Homo sapiens
tccccagacagggctccagc

SEQ ID NO: 3836644 - DNA, 22 bp, Homo sapiens
tccccagacagggctccagcct

SEQ ID NO: 3836645 - DNA, 21 bp, Homo sapiens
tccccagatctgtcctggggg

SEQ ID NO: 3836646 - DNA, 22 bp, Homo sapiens
tccccagatctgtcctggggga

SEQ ID NO: 3836647 - DNA, 11 bp, Homo sapiens
tccccagcccc

SEQ ID NO: 3836648 - DNA, 16 bp, Homo sapiens
tccccagcccctagcc

SEQ ID NO: 3836649 - DNA, 20 bp, Homo sapiens
tccccagcccctagcccagg

SEQ ID NO: 3836650 - DNA, 21 bp, Homo sapiens
tccccagcccctagcccagga

SEQ ID NO: 3836651 - DNA, 11 bp, Homo sapiens
tccccagggca

SEQ ID NO: 3836652 - DNA, 14 bp, Homo sapiens
tccccagggcagcc

SEQ ID NO: 3836653 - DNA, 19 bp, Homo sapiens
tccccatcgccagctgatg

SEQ ID NO: 3836654 - DNA, 20 bp, Homo sapiens
tccccatttcccatctgcac

SEQ ID NO: 3836655 - DNA, 15 bp, Homo sapiens
tccccattttctggt

SEQ ID NO: 3836656 - DNA, 19 bp, Homo sapiens
tccccctgcagccatccca

SEQ ID NO: 3836657 - DNA, 23 bp, Homo sapiens
tccccctgcagccatcccaaggc

SEQ ID NO: 3836658 - DNA, 13 bp, Homo sapiens
tcccctcacagcc

SEQ ID NO: 3836659 - DNA, 16 bp, Homo sapiens
tcccctcacagcctct

SEQ ID NO: 3836660 - DNA, 17 bp, Homo sapiens
tcccctcacagcctctg

SEQ ID NO: 3836661 - DNA, 13 bp, Homo sapiens
tcccctcccctgc

SEQ ID NO: 3836662 - DNA, 19 bp, Homo sapiens
tcccctctcatctgacctt

SEQ ID NO: 3836663 - DNA, 20 bp, Homo sapiens
tcccctctcatctgacctta

SEQ ID NO: 3836664 - DNA, 19 bp, Homo sapiens
tccccttagagtgctgtga

SEQ ID NO: 3836665 - DNA, 23 bp, Homo sapiens
tcccggttccctccccagctcct

SEQ ID NO: 3836666 - DNA, 15 bp, Homo sapiens
tccctcccacctctg

SEQ ID NO: 3836667 - DNA, 16 bp, Homo sapiens
tccctcccacctctgt

SEQ ID NO: 3836668 - DNA, 19 bp, Homo sapiens
tccctcccacctctgtgac

SEQ ID NO: 3836669 - DNA, 21 bp, Homo sapiens
tccctcccacctctgtgacct

SEQ ID NO: 3836670 - DNA, 15 bp, Homo sapiens
tccctccccagatct

SEQ ID NO: 3836671 - DNA, 22 bp, Homo sapiens
tccctccccagatctgtcctgg

SEQ ID NO: 3836672 - DNA, 23 bp, Homo sapiens
tccctccccagatctgtcctggg

SEQ ID NO: 3836673 - DNA, 14 bp, Homo sapiens
tccctccccagctc

SEQ ID NO: 3836674 - DNA, 23 bp, Homo sapiens
tccctccccctgcagccatccca

SEQ ID NO: 3836675 - DNA, 17 bp, Homo sapiens
tccctcccgcagagact

SEQ ID NO: 3836676 - DNA, 16 bp, Homo sapiens
tccctctcctctgtcc

SEQ ID NO: 3836677 - DNA, 14 bp, Homo sapiens
tccctctgtaatta

SEQ ID NO: 3836678 - DNA, 17 bp, Homo sapiens
tccctgaagccagcctt

SEQ ID NO: 3836679 - DNA, 15 bp, Homo sapiens
tccctgccctcatct

SEQ ID NO: 3836680 - DNA, 16 bp, Homo sapiens
tccctgccctcatctc

SEQ ID NO: 3836681 - DNA, 14 bp, Homo sapiens
tccctgcttccagg

SEQ ID NO: 3836682 - DNA, 18 bp, Homo sapiens
tccctgcttccaggaaac

SEQ ID NO: 3836683 - DNA, 13 bp, Homo sapiens
tccctgtgtcttt

SEQ ID NO: 3836684 - DNA, 16 bp, Homo sapiens
tccctgtgtctttttc

SEQ ID NO: 3836685 - DNA, 20 bp, Homo sapiens
tcccttccttttccctgctt

SEQ ID NO: 3836686 - DNA, 23 bp, Homo sapiens
tccctttggggatagtctggaaa

SEQ ID NO: 3836687 - DNA, 13 bp, Homo sapiens
tccgagagggaga

SEQ ID NO: 3836688 - DNA, 11 bp, Homo sapiens
tccgccagcct

SEQ ID NO: 3836689 - DNA, 12 bp, Homo sapiens
tccgccagcctc

SEQ ID NO: 3836690 - DNA, 13 bp, Homo sapiens
tccgccagcctcc

SEQ ID NO: 3836691 - DNA, 14 bp, Homo sapiens
tccgccagcctcct

SEQ ID NO: 3836692 - DNA, 16 bp, Homo sapiens
tccgccagcctcctct

SEQ ID NO: 3836693 - DNA, 17 bp, Homo sapiens
tccgcccgcctctgcct

SEQ ID NO: 3836694 - DNA, 20 bp, Homo sapiens
tccgcctgaggccagcctgc

SEQ ID NO: 3836695 - DNA, 16 bp, Homo sapiens
tccgtgcttcctcagt

SEQ ID NO: 3836696 - DNA, 14 bp, Homo sapiens
tcctaaggcccagc

SEQ ID NO: 3836697 - DNA, 22 bp, Homo sapiens
tcctaaggcccagctgccaggg

SEQ ID NO: 3836698 - DNA, 13 bp, Homo sapiens
aatttaaaaaagt

SEQ ID NO: 3836699 - DNA, 21 bp, Homo sapiens
aatttaaaataaataaacttt

SEQ ID NO: 3836700 - DNA, 20 bp, Homo sapiens
aatttacgtcttgagaaata

SEQ ID NO: 3836701 - DNA, 17 bp, Homo sapiens
aatttagatttaattta

SEQ ID NO: 3836702 - DNA, 16 bp, Homo sapiens
aatttatacaaagaaa

SEQ ID NO: 3836703 - DNA, 17 bp, Homo sapiens
aatttatacaaagaaac

SEQ ID NO: 3836704 - DNA, 19 bp, Homo sapiens
aatttattttaatgtaaat

SEQ ID NO: 3836705 - DNA, 19 bp, Homo sapiens
aatttcccagactagattt

SEQ ID NO: 3836706 - DNA, 12 bp, Homo sapiens
aatttctcctcc

SEQ ID NO: 3836707 - DNA, 20 bp, Homo sapiens
aatttctcctcccttccttt

SEQ ID NO: 3836708 - DNA, 16 bp, Homo sapiens
aattttaaaatgttta

SEQ ID NO: 3836709 - DNA, 21 bp, Homo sapiens
aattttaaaatgtttaggaaa

SEQ ID NO: 3836710 - DNA, 12 bp, Homo sapiens
aattttaaatgc

SEQ ID NO: 3836711 - DNA, 20 bp, Homo sapiens
aattttattagacattctct

SEQ ID NO: 3836712 - DNA, 23 bp, Homo sapiens
aattttctttttctgaagcctct

SEQ ID NO: 3836713 - DNA, 17 bp, Homo sapiens
aattttgtaagtataag

SEQ ID NO: 3836714 - DNA, 22 bp, Homo sapiens
aatttttaatctttaattttac

SEQ ID NO: 3836715 - DNA, 12 bp, Homo sapiens
acaaaaaagtta

SEQ ID NO: 3836716 - DNA, 15 bp, Homo sapiens
acaaaaaagttataa

SEQ ID NO: 3836717 - DNA, 21 bp, Homo sapiens
acaaaaaagttataagaaaac

SEQ ID NO: 3836718 - DNA, 12 bp, Homo sapiens
acaaaaacaaaa

SEQ ID NO: 3836719 - DNA, 20 bp, Homo sapiens
acaaaaattgagagctttat

SEQ ID NO: 3836720 - DNA, 14 bp, Homo sapiens
acaaaactttttaa

SEQ ID NO: 3836721 - DNA, 12 bp, Homo sapiens
acaaaatgtgac

SEQ ID NO: 3836722 - DNA, 20 bp, Homo sapiens
acaaaattcgacctgattta

SEQ ID NO: 3836723 - DNA, 13 bp, Homo sapiens
acaaacacacaca

SEQ ID NO: 3836724 - DNA, 14 bp, Homo sapiens
acaaagaaattatg

SEQ ID NO: 3836725 - DNA, 22 bp, Homo sapiens
acaacattattttaaaatcaaa

SEQ ID NO: 3836726 - DNA, 20 bp, Homo sapiens
acaacttccgttgctgccat

SEQ ID NO: 3836727 - DNA, 20 bp, Homo sapiens
acaagaactcctcccaccca

SEQ ID NO: 3836728 - DNA, 21 bp, Homo sapiens
acaagacataatttaaaataa

SEQ ID NO: 3836729 - DNA, 12 bp, Homo sapiens
acaataaagaga

SEQ ID NO: 3836730 - DNA, 13 bp, Homo sapiens
acaatgatttgta

SEQ ID NO: 3836731 - DNA, 15 bp, Homo sapiens
acaatgatttgtaaa

SEQ ID NO: 3836732 - DNA, 21 bp, Homo sapiens
acaatggcaggttttacacgt

SEQ ID NO: 3836733 - DNA, 9 bp, Homo sapiens
acacacaca

SEQ ID NO: 3836734 - DNA, 23 bp, Homo sapiens
acacactgtgctttctattgtac

SEQ ID NO: 3836735 - DNA, 11 bp, Homo sapiens
acacagcccag

SEQ ID NO: 3836736 - DNA, 12 bp, Homo sapiens
acacagcccaga

SEQ ID NO: 3836737 - DNA, 13 bp, Homo sapiens
acacagcccagaa

SEQ ID NO: 3836738 - DNA, 19 bp, Homo sapiens
acacaggaactctgtgtga

SEQ ID NO: 3836739 - DNA, 22 bp, Homo sapiens
acacaggaactctgtgtgagag

SEQ ID NO: 3836740 - DNA, 23 bp, Homo sapiens
acacaggaactctgtgtgagaga

SEQ ID NO: 3836741 - DNA, 22 bp, Homo sapiens
acacaggacttattatatcaga

SEQ ID NO: 3836742 - DNA, 17 bp, Homo sapiens
acacaggagaccacccc

SEQ ID NO: 3836743 - DNA, 17 bp, Homo sapiens
acacagtggccggggct

SEQ ID NO: 3836744 - DNA, 18 bp, Homo sapiens
acacagtggccggggctg

SEQ ID NO: 3836745 - DNA, 20 bp, Homo sapiens
acaccaaatgactactacac

SEQ ID NO: 3836746 - DNA, 15 bp, Homo sapiens
acaccatctggccca

SEQ ID NO: 3836747 - DNA, 17 bp, Homo sapiens
acaccatctggcccagg

SEQ ID NO: 3836748 - DNA, 20 bp, Homo sapiens
acaccatctggcccaggctg

SEQ ID NO: 3836749 - DNA, 22 bp, Homo sapiens
acaccatctggcccaggctggc

SEQ ID NO: 3836750 - DNA, 12 bp, Homo sapiens
acacccagcctc

SEQ ID NO: 3836751 - DNA, 14 bp, Homo sapiens
acacccagcctcag

SEQ ID NO: 3836752 - DNA, 16 bp, Homo sapiens
acacccagcctcagtc

SEQ ID NO: 3836753 - DNA, 20 bp, Homo sapiens
acacccagcctcagtcctcc

SEQ ID NO: 3836754 - DNA, 23 bp, Homo sapiens
acacccagcctcagtcctcccct

SEQ ID NO: 3836755 - DNA, 16 bp, Homo sapiens
acaccccagactccag

SEQ ID NO: 3836756 - DNA, 19 bp, Homo sapiens
acacctggctgaggttcct

SEQ ID NO: 3836757 - DNA, 18 bp, Homo sapiens
acacgtctatgcaattgt

SEQ ID NO: 3836758 - DNA, 22 bp, Homo sapiens
acactggctgccagctattttt

SEQ ID NO: 3836759 - DNA, 15 bp, Homo sapiens
acactgtgctttcta

SEQ ID NO: 3836760 - DNA, 23 bp, Homo sapiens
acactgtgctttctattgtacag

SEQ ID NO: 3836761 - DNA, 15 bp, Homo sapiens
acagagcaggctttg

SEQ ID NO: 3836762 - DNA, 18 bp, Homo sapiens
acagagcaggctttgtga

SEQ ID NO: 3836763 - DNA, 20 bp, Homo sapiens
acagagcaggctttgtgaga

SEQ ID NO: 3836764 - DNA, 22 bp, Homo sapiens
acagagcaggctttgtgagaga

SEQ ID NO: 3836765 - DNA, 21 bp, Homo sapiens
acagattataataaattgtca

SEQ ID NO: 3836766 - DNA, 17 bp, Homo sapiens
acagccaactatggcct

SEQ ID NO: 3836767 - DNA, 13 bp, Homo sapiens
acagcccagaagg

SEQ ID NO: 3836768 - DNA, 13 bp, Homo sapiens
acagccccagagc

SEQ ID NO: 3836769 - DNA, 15 bp, Homo sapiens
acagccccagagcag

SEQ ID NO: 3836770 - DNA, 20 bp, Homo sapiens
acagcctctgacccctcctc

SEQ ID NO: 3836771 - DNA, 14 bp, Homo sapiens
acagcgacatagcc

SEQ ID NO: 3836772 - DNA, 20 bp, Homo sapiens
acagcgacatagcccatccc

SEQ ID NO: 3836773 - DNA, 15 bp, Homo sapiens
acagctccttgggag

SEQ ID NO: 3836774 - DNA, 17 bp, Homo sapiens
acagctccttgggagga

SEQ ID NO: 3836775 - DNA, 17 bp, Homo sapiens
acagctgaggaccctca

SEQ ID NO: 3836776 - DNA, 22 bp, Homo sapiens
acagcttcaccacttgtccatt

SEQ ID NO: 3836777 - DNA, 16 bp, Homo sapiens
acagcttgagccgggc

SEQ ID NO: 3836778 - DNA, 21 bp, Homo sapiens
acaggccctttcctcaggcaa

SEQ ID NO: 3836779 - DNA, 22 bp, Homo sapiens
acagggcatgccccggccacct

SEQ ID NO: 3836780 - DNA, 18 bp, Homo sapiens
acagggcccagttaaata

SEQ ID NO: 3836781 - DNA, 15 bp, Homo sapiens
acagggctccagcct

SEQ ID NO: 3836782 - DNA, 17 bp, Homo sapiens
acagggctccagcctgt

SEQ ID NO: 3836783 - DNA, 17 bp, Homo sapiens
acagtaagagtttacaa

SEQ ID NO: 3836784 - DNA, 23 bp, Homo sapiens
acagtaagagtttacaagaaata

SEQ ID NO: 3836785 - DNA, 22 bp, Homo sapiens
acagtagccccatcacatttgt

SEQ ID NO: 3836786 - DNA, 22 bp, Homo sapiens
acagtcacaattttctgtgcca

SEQ ID NO: 3836787 - DNA, 15 bp, Homo sapiens
acagtcctgaagcag

SEQ ID NO: 3836788 - DNA, 15 bp, Homo sapiens
acagttataaagaaa

SEQ ID NO: 3836789 - DNA, 14 bp, Homo sapiens
acagtttgtttaca

SEQ ID NO: 3836790 - DNA, 22 bp, Homo sapiens
acagtttgtttacacacgtgca

SEQ ID NO: 3836791 - DNA, 21 bp, Homo sapiens
acataaagttctctgtaatta

SEQ ID NO: 3836792 - DNA, 14 bp, Homo sapiens
acataatttaaaat

SEQ ID NO: 3836793 - DNA, 18 bp, Homo sapiens
acatagcccatccctgcc

SEQ ID NO: 3836794 - DNA, 22 bp, Homo sapiens
acatagcccatccctgcctggt

SEQ ID NO: 3836795 - DNA, 20 bp, Homo sapiens
acgctgattcctaaggccca

SEQ ID NO: 3836796 - DNA, 15 bp, Homo sapiens
acggcaggctcactg

SEQ ID NO: 3836797 - DNA, 16 bp, Homo sapiens
acggtttcaaaccagg

SEQ ID NO: 3836798 - DNA, 19 bp, Homo sapiens
acgtaaacctgaaatatat

SEQ ID NO: 3836799 - DNA, 21 bp, Homo sapiens
acgtctatgcaattgtacaaa

SEQ ID NO: 3836800 - DNA, 22 bp, Homo sapiens
acgtgcaatttgtttgtgcttc

SEQ ID NO: 3836801 - DNA, 18 bp, Homo sapiens
acgtggcttttagacaga

SEQ ID NO: 3836802 - DNA, 23 bp, Homo sapiens
actaaagtgtgctttataaaaaa

SEQ ID NO: 3836803 - DNA, 10 bp, Homo sapiens
actaacagat

SEQ ID NO: 3836804 - DNA, 22 bp, Homo sapiens
actaacagattataataaattg

SEQ ID NO: 3836805 - DNA, 15 bp, Homo sapiens
actaactcaggtgta

SEQ ID NO: 3836806 - DNA, 14 bp, Homo sapiens
actaagaagtttaa

SEQ ID NO: 3836807 - DNA, 20 bp, Homo sapiens
actaatagcctaaaagattt

SEQ ID NO: 3836808 - DNA, 19 bp, Homo sapiens
actaatatttgtctgtgtg

SEQ ID NO: 3836809 - DNA, 20 bp, Homo sapiens
actaatatttgtctgtgtgc

SEQ ID NO: 3836810 - DNA, 16 bp, Homo sapiens
actaattcatttatta

SEQ ID NO: 3836811 - DNA, 14 bp, Homo sapiens
actacacctggctg

SEQ ID NO: 3836812 - DNA, 14 bp, Homo sapiens
actacctcctcagg

SEQ ID NO: 3836813 - DNA, 15 bp, Homo sapiens
actacctcctcaggg

SEQ ID NO: 3836814 - DNA, 19 bp, Homo sapiens
actacctcctcagggatgg

SEQ ID NO: 3836815 - DNA, 14 bp, Homo sapiens
actagatcacaact

SEQ ID NO: 3836816 - DNA, 13 bp, Homo sapiens
actagcctccctc

SEQ ID NO: 3836817 - DNA, 15 bp, Homo sapiens
actagcctccctctc

SEQ ID NO: 3836818 - DNA, 23 bp, Homo sapiens
actagcctccctctcctctgtcc

SEQ ID NO: 3836819 - DNA, 18 bp, Homo sapiens
actagcctttggctctgg

SEQ ID NO: 3836820 - DNA, 20 bp, Homo sapiens
actagcctttggctctggag

SEQ ID NO: 3836821 - DNA, 19 bp, Homo sapiens
actagtgctgaagcttatt

SEQ ID NO: 3836822 - DNA, 15 bp, Homo sapiens
actatattaactttt

SEQ ID NO: 3836823 - DNA, 18 bp, Homo sapiens
actatattaacttttatt

SEQ ID NO: 3836824 - DNA, 22 bp, Homo sapiens
actatgaagttttttttataca

SEQ ID NO: 3836825 - DNA, 22 bp, Homo sapiens
actatttaacttgagctttaaa

SEQ ID NO: 3836826 - DNA, 16 bp, Homo sapiens
actcaagattcccagg

SEQ ID NO: 3836827 - DNA, 17 bp, Homo sapiens
actcaagattcccagga

SEQ ID NO: 3836828 - DNA, 18 bp, Homo sapiens
actcaagattcccaggag

SEQ ID NO: 3836829 - DNA, 18 bp, Homo sapiens
actcatctaggtaaatta

SEQ ID NO: 3836830 - DNA, 17 bp, Homo sapiens
actccacatctgcctta

SEQ ID NO: 3836831 - DNA, 12 bp, Homo sapiens
actccagcagat

SEQ ID NO: 3836832 - DNA, 19 bp, Homo sapiens
actccagctgagtcctggg

SEQ ID NO: 3836833 - DNA, 20 bp, Homo sapiens
actccagctgagtcctgggg

SEQ ID NO: 3836834 - DNA, 20 bp, Homo sapiens
actccataaaaagaaagcta

SEQ ID NO: 3836835 - DNA, 19 bp, Homo sapiens
actcccccagttcccgggc

SEQ ID NO: 3836836 - DNA, 21 bp, Homo sapiens
actccctcgtcgagctggatg

SEQ ID NO: 3836837 - DNA, 16 bp, Homo sapiens
actccggcctgggcga

SEQ ID NO: 3836838 - DNA, 20 bp, Homo sapiens
actcgggagggaacatcctg

SEQ ID NO: 3836839 - DNA, 16 bp, Homo sapiens
actcggggcccccatc

SEQ ID NO: 3836840 - DNA, 19 bp, Homo sapiens
actctgtgtgagagagagg

SEQ ID NO: 3836841 - DNA, 17 bp, Homo sapiens
actctttcatgccattt

SEQ ID NO: 3836842 - DNA, 17 bp, Homo sapiens
actgaagacaggcacaa

SEQ ID NO: 3836843 - DNA, 21 bp, Homo sapiens
actgaagacaggcacaaaatg

SEQ ID NO: 3836844 - DNA, 23 bp, Homo sapiens
actgaagacaggcacaaaatgtg

SEQ ID NO: 3836845 - DNA, 13 bp, Homo sapiens
actgaagcataaa

SEQ ID NO: 3836846 - DNA, 19 bp, Homo sapiens
actgaagcataaacatcac

SEQ ID NO: 3836847 - DNA, 18 bp, Homo sapiens
actgaaggaaaaacacaa

SEQ ID NO: 3836848 - DNA, 22 bp, Homo sapiens
actgaaggaaaaacacaagcaa

SEQ ID NO: 3836849 - DNA, 23 bp, Homo sapiens
actgaaggaaaaacacaagcaaa

SEQ ID NO: 3836850 - DNA, 23 bp, Homo sapiens
actgaatattgacaagtgtcttt

SEQ ID NO: 3836851 - DNA, 11 bp, Homo sapiens
actgaatgtta

SEQ ID NO: 3836852 - DNA, 18 bp, Homo sapiens
actgacaacgaaagtaaa

SEQ ID NO: 3836853 - DNA, 19 bp, Homo sapiens
actgactttttccattttt

SEQ ID NO: 3836854 - DNA, 21 bp, Homo sapiens
actgagaaatttataaacttt

SEQ ID NO: 3836855 - DNA, 14 bp, Homo sapiens
actgagccccgcag

SEQ ID NO: 3836856 - DNA, 23 bp, Homo sapiens
actgagccccgcagacctcccca

SEQ ID NO: 3836857 - DNA, 14 bp, Homo sapiens
actgaggatcagag

SEQ ID NO: 3836858 - DNA, 22 bp, Homo sapiens
actgcactccggcctgggcgac

SEQ ID NO: 3836859 - DNA, 22 bp, Homo sapiens
actgcagggccaggactgagcc

SEQ ID NO: 3836860 - DNA, 12 bp, Homo sapiens
actgcattttca

SEQ ID NO: 3836861 - DNA, 13 bp, Homo sapiens
actgcattttcac

SEQ ID NO: 3836862 - DNA, 18 bp, Homo sapiens
actgccaggccagcctcc

SEQ ID NO: 3836863 - DNA, 18 bp, Homo sapiens
actgcccctgccctgagg

SEQ ID NO: 3836864 - DNA, 22 bp, Homo sapiens
actgcctcgggaacctcactct

SEQ ID NO: 3836865 - DNA, 16 bp, Homo sapiens
actgctccctgaagcc

SEQ ID NO: 3836866 - DNA, 23 bp, Homo sapiens
actgctccctgaagccagccttc

SEQ ID NO: 3836867 - DNA, 22 bp, Homo sapiens
actgctggtgtttatgtgaaca

SEQ ID NO: 3836868 - DNA, 24 bp, Homo sapiens
actgctggtgtttatgtgaacatt

SEQ ID NO: 3836869 - DNA, 11 bp, Homo sapiens
actgctttact

SEQ ID NO: 3836870 - DNA, 14 bp, Homo sapiens
actgctttactgtg

SEQ ID NO: 3836871 - DNA, 21 bp, Homo sapiens
actggaaaggggagagcctgc

SEQ ID NO: 3836872 - DNA, 16 bp, Homo sapiens
actggaggttgaagcc

SEQ ID NO: 3836873 - DNA, 18 bp, Homo sapiens
actggcctgcctcctccg

SEQ ID NO: 3836874 - DNA, 14 bp, Homo sapiens
actgggagagtcct

SEQ ID NO: 3836875 - DNA, 22 bp, Homo sapiens
actgggagagtccttagcctgg

SEQ ID NO: 3836876 - DNA, 22 bp, Homo sapiens
actgggaggccgggcatggtgg

SEQ ID NO: 3836877 - DNA, 18 bp, Homo sapiens
actgggtggtttggtttt

SEQ ID NO: 3836878 - DNA, 17 bp, Homo sapiens
actggtgagggcaagag

SEQ ID NO: 3836879 - DNA, 21 bp, Homo sapiens
actggtgagggcaagaggtgc

SEQ ID NO: 3836880 - DNA, 17 bp, Homo sapiens
actgtatcatttcatgc

SEQ ID NO: 3836881 - DNA, 16 bp, Homo sapiens
actgtcttttttctaa

SEQ ID NO: 3836882 - DNA, 23 bp, Homo sapiens
actgtcttttttctaaagtaaaa

SEQ ID NO: 3836883 - DNA, 18 bp, Homo sapiens
actgtgaacctggagggc

SEQ ID NO: 3836884 - DNA, 11 bp, Homo sapiens
actgtgctttc

SEQ ID NO: 3836885 - DNA, 12 bp, Homo sapiens
actgtgctttct

SEQ ID NO: 3836886 - DNA, 14 bp, Homo sapiens
actgtgctttctat

SEQ ID NO: 3836887 - DNA, 12 bp, Homo sapiens
actgtggagggg

SEQ ID NO: 3836888 - DNA, 17 bp, Homo sapiens
actgtggaggggagctg

SEQ ID NO: 3836889 - DNA, 22 bp, Homo sapiens
actgtggaggggagctgctggc

SEQ ID NO: 3836890 - DNA, 16 bp, Homo sapiens
actgtgtatctcaata

SEQ ID NO: 3836891 - DNA, 21 bp, Homo sapiens
actgtgtatctcaataaagca

SEQ ID NO: 3836892 - DNA, 19 bp, Homo sapiens
actgttctgagccaaattc

SEQ ID NO: 3836893 - DNA, 15 bp, Homo sapiens
acttaaggagaaata

SEQ ID NO: 3836894 - DNA, 16 bp, Homo sapiens
acttaaggagaaatag

SEQ ID NO: 3836895 - DNA, 21 bp, Homo sapiens
acttaattgctttcctgcctc

SEQ ID NO: 3836896 - DNA, 15 bp, Homo sapiens
acttagaaagcaggg

SEQ ID NO: 3836897 - DNA, 19 bp, Homo sapiens
acttagaaagcaggggcta

SEQ ID NO: 3836898 - DNA, 15 bp, Homo sapiens
acttattatatcaga

SEQ ID NO: 3836899 - DNA, 17 bp, Homo sapiens
acttcagttttactgca

SEQ ID NO: 3836900 - DNA, 22 bp, Homo sapiens
acttcagttttactgcattttc

SEQ ID NO: 3836901 - DNA, 22 bp, Homo sapiens
acttctccatcctttctgcctc

SEQ ID NO: 3836902 - DNA, 22 bp, Homo sapiens
acttctgccagcataatacttg

SEQ ID NO: 3836903 - DNA, 15 bp, Homo sapiens
acttctgtgtagaca

SEQ ID NO: 3836904 - DNA, 17 bp, Homo sapiens
acttgaaaattaacatg

SEQ ID NO: 3836905 - DNA, 19 bp, Homo sapiens
acttgaatcctagggcctg

SEQ ID NO: 3836906 - DNA, 15 bp, Homo sapiens
acttgagtatcataa

SEQ ID NO: 3836907 - DNA, 17 bp, Homo sapiens
acttgccatttctttat

SEQ ID NO: 3836908 - DNA, 14 bp, Homo sapiens
acttgctctggacc

SEQ ID NO: 3836909 - DNA, 16 bp, Homo sapiens
acttgctctggacctg

SEQ ID NO: 3836910 - DNA, 10 bp, Homo sapiens
acttggccaa

SEQ ID NO: 3836911 - DNA, 19 bp, Homo sapiens
acttggccaagcagggagg

SEQ ID NO: 3836912 - DNA, 16 bp, Homo sapiens
acttgtttacatagca

SEQ ID NO: 3836913 - DNA, 15 bp, Homo sapiens
actttattttgtgtt

SEQ ID NO: 3836914 - DNA, 22 bp, Homo sapiens
actttcctttccccagcccagg

SEQ ID NO: 3836915 - DNA, 12 bp, Homo sapiens
actttgctttgg

SEQ ID NO: 3836916 - DNA, 11 bp, Homo sapiens
actttggtttt

SEQ ID NO: 3836917 - DNA, 12 bp, Homo sapiens
actttggttttg

SEQ ID NO: 3836918 - DNA, 12 bp, Homo sapiens
acttttatgata

SEQ ID NO: 3836919 - DNA, 17 bp, Homo sapiens
agaaaacccaaagctct

SEQ ID NO: 3836920 - DNA, 13 bp, Homo sapiens
agaaaagcttgga

SEQ ID NO: 3836921 - DNA, 13 bp, Homo sapiens
agaaaaggcagcc

SEQ ID NO: 3836922 - DNA, 15 bp, Homo sapiens
agaaaaggcagccag

SEQ ID NO: 3836923 - DNA, 23 bp, Homo sapiens
agaaaatcccggtgcttgcagta

SEQ ID NO: 3836924 - DNA, 16 bp, Homo sapiens
agaaacaataaagaga

SEQ ID NO: 3836925 - DNA, 23 bp, Homo sapiens
agaaacaatgtctggggacaggc

SEQ ID NO: 3836926 - DNA, 16 bp, Homo sapiens
agaaagattaaatata

SEQ ID NO: 3836927 - DNA, 17 bp, Homo sapiens
agaaagattaaatatat

SEQ ID NO: 3836928 - DNA, 18 bp, Homo sapiens
agaaagattaaatatatc

SEQ ID NO: 3836929 - DNA, 18 bp, Homo sapiens
agaaagattgtaaactaa

SEQ ID NO: 3836930 - DNA, 18 bp, Homo sapiens
agaaaggagctgagatga

SEQ ID NO: 3836931 - DNA, 23 bp, Homo sapiens
agaaaggtgagtttgagctgcct

SEQ ID NO: 3836932 - DNA, 19 bp, Homo sapiens
agaaaggtgattccaggag

SEQ ID NO: 3836933 - DNA, 12 bp, Homo sapiens
agaaagtttccc

SEQ ID NO: 3836934 - DNA, 16 bp, Homo sapiens
agaaatactatatata

SEQ ID NO: 3836935 - DNA, 17 bp, Homo sapiens
agaaatagctgtataga

SEQ ID NO: 3836936 - DNA, 22 bp, Homo sapiens
agaaatcaatagtgcaactgtt

SEQ ID NO: 3836937 - DNA, 12 bp, Homo sapiens
agaaatctaaaa

SEQ ID NO: 3836938 - DNA, 15 bp, Homo sapiens
agaaatctaaaaaac

SEQ ID NO: 3836939 - DNA, 16 bp, Homo sapiens
agaaatttataaactt

SEQ ID NO: 3836940 - DNA, 12 bp, Homo sapiens
agaaattttatt

SEQ ID NO: 3836941 - DNA, 13 bp, Homo sapiens
agaacttgaacaa

SEQ ID NO: 3836942 - DNA, 14 bp, Homo sapiens
agaagaagctggga

SEQ ID NO: 3836943 - DNA, 18 bp, Homo sapiens
agaagccaagggaaaggg

SEQ ID NO: 3836944 - DNA, 22 bp, Homo sapiens
agaagctgggagggagggggag

SEQ ID NO: 3836945 - DNA, 13 bp, Homo sapiens
agaagcttaggca

SEQ ID NO: 3836946 - DNA, 14 bp, Homo sapiens
agaaggagagaaag

SEQ ID NO: 3836947 - DNA, 18 bp, Homo sapiens
agaaggagagaaagtggg

SEQ ID NO: 3836948 - DNA, 17 bp, Homo sapiens
agaagtttaagtaagta

SEQ ID NO: 3836949 - DNA, 23 bp, Homo sapiens
agaagtttaagtaagtaagtttc

SEQ ID NO: 3836950 - DNA, 12 bp, Homo sapiens
agaataaagcaa

SEQ ID NO: 3836951 - DNA, 13 bp, Homo sapiens
agaataaagcaat

SEQ ID NO: 3836952 - DNA, 16 bp, Homo sapiens
agaataaagcaatttt

SEQ ID NO: 3836953 - DNA, 22 bp, Homo sapiens
agaataaagcaattttccttga

SEQ ID NO: 3836954 - DNA, 19 bp, Homo sapiens
agaataaatgttttacaac

SEQ ID NO: 3836955 - DNA, 16 bp, Homo sapiens
agaatacttttctctt

SEQ ID NO: 3836956 - DNA, 21 bp, Homo sapiens
agaatggcatgaaccccaggc

SEQ ID NO: 3836957 - DNA, 13 bp, Homo sapiens
agaattaggaagg

SEQ ID NO: 3836958 - DNA, 15 bp, Homo sapiens
agaattgtgtctgca

SEQ ID NO: 3836959 - DNA, 16 bp, Homo sapiens
agacaaaatttagatt

SEQ ID NO: 3836960 - DNA, 13 bp, Homo sapiens
agacagagcaggc

SEQ ID NO: 3836961 - DNA, 14 bp, Homo sapiens
agacagagcaggct

SEQ ID NO: 3836962 - DNA, 17 bp, Homo sapiens
agacagccccagagcag

SEQ ID NO: 3836963 - DNA, 18 bp, Homo sapiens
agacagggctccagcctg

SEQ ID NO: 3836964 - DNA, 20 bp, Homo sapiens
agacaggttaaatatataaa

SEQ ID NO: 3836965 - DNA, 14 bp, Homo sapiens
agacagtaagagtt

SEQ ID NO: 3836966 - DNA, 20 bp, Homo sapiens
agacagtaagagtttacaag

SEQ ID NO: 3836967 - DNA, 12 bp, Homo sapiens
agacataattta

SEQ ID NO: 3836968 - DNA, 14 bp, Homo sapiens
agacatctcaaata

SEQ ID NO: 3836969 - DNA, 24 bp, Homo sapiens
agacatggaccttctctccagagc

SEQ ID NO: 3836970 - DNA, 20 bp, Homo sapiens
agacattctcttactttttg

SEQ ID NO: 3836971 - DNA, 13 bp, Homo sapiens
agaccaacttttt

SEQ ID NO: 3836972 - DNA, 22 bp, Homo sapiens
agaccacccccgagcttgcctc

SEQ ID NO: 3836973 - DNA, 12 bp, Homo sapiens
agaccctctcaa

SEQ ID NO: 3836974 - DNA, 17 bp, Homo sapiens
agaccctctgccaccag

SEQ ID NO: 3836975 - DNA, 20 bp, Homo sapiens
agaccctctgccaccagaga

SEQ ID NO: 3836976 - DNA, 17 bp, Homo sapiens
agaccctgggtgggctc

SEQ ID NO: 3836977 - DNA, 19 bp, Homo sapiens
agaccctgggtgggctctg

SEQ ID NO: 3836978 - DNA, 17 bp, Homo sapiens
aaggccatggggcagcc

SEQ ID NO: 3836979 - DNA, 18 bp, Homo sapiens
aaggccatggggcagcct

SEQ ID NO: 3836980 - DNA, 14 bp, Homo sapiens
aaggcccagctgcc

SEQ ID NO: 3836981 - DNA, 18 bp, Homo sapiens
aaggcccagctgccaggg

SEQ ID NO: 3836982 - DNA, 17 bp, Homo sapiens
aaggccgagcccacacc

SEQ ID NO: 3836983 - DNA, 20 bp, Homo sapiens
aaggctgtgccaggctggga

SEQ ID NO: 3836984 - DNA, 21 bp, Homo sapiens
aagggacacaggagaccaccc

SEQ ID NO: 3836985 - DNA, 16 bp, Homo sapiens
aagggagaagaaaggt

SEQ ID NO: 3836986 - DNA, 14 bp, Homo sapiens
aaggggagagcctg

SEQ ID NO: 3836987 - DNA, 20 bp, Homo sapiens
aagggtgctcagtctccttg

SEQ ID NO: 3836988 - DNA, 16 bp, Homo sapiens
aaggtctggcctcagg

SEQ ID NO: 3836989 - DNA, 17 bp, Homo sapiens
aaggtttggaaaactaa

SEQ ID NO: 3836990 - DNA, 13 bp, Homo sapiens
aagtaaaaacaaa

SEQ ID NO: 3836991 - DNA, 12 bp, Homo sapiens
aagtaaagtaaa

SEQ ID NO: 3836992 - DNA, 13 bp, Homo sapiens
aagtaagaaagaa

SEQ ID NO: 3836993 - DNA, 20 bp, Homo sapiens
aagtaagacatctcaaatac

SEQ ID NO: 3836994 - DNA, 14 bp, Homo sapiens
aagtactagctaaa

SEQ ID NO: 3836995 - DNA, 22 bp, Homo sapiens
aagtagattaaaatatttgcct

SEQ ID NO: 3836996 - DNA, 17 bp, Homo sapiens
aagtatattgaaagttt

SEQ ID NO: 3836997 - DNA, 19 bp, Homo sapiens
aagtatatttgtaaaagct

SEQ ID NO: 3836998 - DNA, 21 bp, Homo sapiens
aagtattaaactgtaaatcat

SEQ ID NO: 3836999 - DNA, 15 bp, Homo sapiens
aagtattggattttt

SEQ ID NO: 3837000 - DNA, 13 bp, Homo sapiens
aagtattgtgttt

SEQ ID NO: 3837001 - DNA, 12 bp, Homo sapiens
aagtctagaaaa

SEQ ID NO: 3837002 - DNA, 21 bp, Homo sapiens
aagtctagaaaataatgcaaa

SEQ ID NO: 3837003 - DNA, 15 bp, Homo sapiens
aagtctccaaagtct

SEQ ID NO: 3837004 - DNA, 19 bp, Homo sapiens
aagtctgtggcccaagaga

SEQ ID NO: 3837005 - DNA, 15 bp, Homo sapiens
aagtctgttattgtt

SEQ ID NO: 3837006 - DNA, 17 bp, Homo sapiens
aagtctgttattgtttt

SEQ ID NO: 3837007 - DNA, 21 bp, Homo sapiens
aagtctgttattgttttgtta

SEQ ID NO: 3837008 - DNA, 19 bp, Homo sapiens
aagtcttgtgactagtgct

SEQ ID NO: 3837009 - DNA, 19 bp, Homo sapiens
aagtgatggagcagagcaa

SEQ ID NO: 3837010 - DNA, 13 bp, Homo sapiens
aagtgcagtcaca

SEQ ID NO: 3837011 - DNA, 14 bp, Homo sapiens
aagtgccatctcaa

SEQ ID NO: 3837012 - DNA, 16 bp, Homo sapiens
aagtggttaagaatgt

SEQ ID NO: 3837013 - DNA, 20 bp, Homo sapiens
aagtggttaagaatgtatat

SEQ ID NO: 3837014 - DNA, 20 bp, Homo sapiens
aagtgtcactccataaaaag

SEQ ID NO: 3837015 - DNA, 12 bp, Homo sapiens
aagtgtgtgttt

SEQ ID NO: 3837016 - DNA, 16 bp, Homo sapiens
aagtgtgtgtttttca

SEQ ID NO: 3837017 - DNA, 23 bp, Homo sapiens
aagtgttttacaatgatttgtaa

SEQ ID NO: 3837018 - DNA, 14 bp, Homo sapiens
aagttagctattgg

SEQ ID NO: 3837019 - DNA, 13 bp, Homo sapiens
aagttataagaaa

SEQ ID NO: 3837020 - DNA, 22 bp, Homo sapiens
aagttctctgtaattacaacta

SEQ ID NO: 3837021 - DNA, 20 bp, Homo sapiens
aagttgtaatagagaatatt

SEQ ID NO: 3837022 - DNA, 14 bp, Homo sapiens
aagttgtttataaa

SEQ ID NO: 3837023 - DNA, 17 bp, Homo sapiens
aagtttccccaccagtg

SEQ ID NO: 3837024 - DNA, 12 bp, Homo sapiens
aataaaatatca

SEQ ID NO: 3837025 - DNA, 14 bp, Homo sapiens
aataaaatatcatt

SEQ ID NO: 3837026 - DNA, 21 bp, Homo sapiens
aataaaatatcattcagcaac

SEQ ID NO: 3837027 - DNA, 12 bp, Homo sapiens
aataaaattttt

SEQ ID NO: 3837028 - DNA, 10 bp, Homo sapiens
aataaacact

SEQ ID NO: 3837029 - DNA, 12 bp, Homo sapiens
aataaacactgt

SEQ ID NO: 3837030 - DNA, 13 bp, Homo sapiens
aataaacactgtg

SEQ ID NO: 3837031 - DNA, 12 bp, Homo sapiens
aataaacaggag

SEQ ID NO: 3837032 - DNA, 21 bp, Homo sapiens
aataaagcacgcagttatgtt

SEQ ID NO: 3837033 - DNA, 13 bp, Homo sapiens
aataaataaactt

SEQ ID NO: 3837034 - DNA, 11 bp, Homo sapiens
aataaatatat

SEQ ID NO: 3837035 - DNA, 13 bp, Homo sapiens
aataaatatatat

SEQ ID NO: 3837036 - DNA, 16 bp, Homo sapiens
aataaatatatatatc

SEQ ID NO: 3837037 - DNA, 13 bp, Homo sapiens
aataaatctatat

SEQ ID NO: 3837038 - DNA, 14 bp, Homo sapiens
aataaatgttttac

SEQ ID NO: 3837039 - DNA, 21 bp, Homo sapiens
aataaatgttttacaactcct

SEQ ID NO: 3837040 - DNA, 18 bp, Homo sapiens
aataaccctttggttttt

SEQ ID NO: 3837041 - DNA, 16 bp, Homo sapiens
aatacactagttgttt

SEQ ID NO: 3837042 - DNA, 21 bp, Homo sapiens
aatactaatagcctaaaagat

SEQ ID NO: 3837043 - DNA, 20 bp, Homo sapiens
aatagcctaaaagattttgt

SEQ ID NO: 3837044 - DNA, 12 bp, Homo sapiens
aatatataaaca

SEQ ID NO: 3837045 - DNA, 19 bp, Homo sapiens
aatatataaacaaacaaac

SEQ ID NO: 3837046 - DNA, 14 bp, Homo sapiens
aatatatctttgta

SEQ ID NO: 3837047 - DNA, 15 bp, Homo sapiens
aatatatctttgtaa

SEQ ID NO: 3837048 - DNA, 19 bp, Homo sapiens
aatatatctttgtaaatta

SEQ ID NO: 3837049 - DNA, 13 bp, Homo sapiens
aatatattgtgtt

SEQ ID NO: 3837050 - DNA, 14 bp, Homo sapiens
aatatattttaaga

SEQ ID NO: 3837051 - DNA, 14 bp, Homo sapiens
aatatcattcagca

SEQ ID NO: 3837052 - DNA, 17 bp, Homo sapiens
aatatgatttgcatttt

SEQ ID NO: 3837053 - DNA, 18 bp, Homo sapiens
aatatggttttgttttca

SEQ ID NO: 3837054 - DNA, 19 bp, Homo sapiens
aatattcagtaacttgttt

SEQ ID NO: 3837055 - DNA, 17 bp, Homo sapiens
aatattcatacaacaaa

SEQ ID NO: 3837056 - DNA, 21 bp, Homo sapiens
aatatttattgctttataaat

SEQ ID NO: 3837057 - DNA, 15 bp, Homo sapiens
aatatttgtctgtgt

SEQ ID NO: 3837058 - DNA, 18 bp, Homo sapiens
aatatttgtctgtgtgct

SEQ ID NO: 3837059 - DNA, 22 bp, Homo sapiens
aatatttgtctgtgtgctacta

SEQ ID NO: 3837060 - DNA, 21 bp, Homo sapiens
aatatttttggcattcctcta

SEQ ID NO: 3837061 - DNA, 23 bp, Homo sapiens
aatatttttggcattcctctaat

SEQ ID NO: 3837062 - DNA, 19 bp, Homo sapiens
aatcaaaggggatatatgt

SEQ ID NO: 3837063 - DNA, 21 bp, Homo sapiens
aatcaaaggggatatatgttt

SEQ ID NO: 3837064 - DNA, 14 bp, Homo sapiens
aatcagaagaaagg

SEQ ID NO: 3837065 - DNA, 12 bp, Homo sapiens
aatcattgtaca

SEQ ID NO: 3837066 - DNA, 15 bp, Homo sapiens
aatcattgtacagtt

SEQ ID NO: 3837067 - DNA, 16 bp, Homo sapiens
aatcattgtacagttt

SEQ ID NO: 3837068 - DNA, 18 bp, Homo sapiens
aatcattgtacagtttgt

SEQ ID NO: 3837069 - DNA, 20 bp, Homo sapiens
aatcattgtacagtttgttt

SEQ ID NO: 3837070 - DNA, 22 bp, Homo sapiens
aatcattgtacagtttgtttac

SEQ ID NO: 3837071 - DNA, 19 bp, Homo sapiens
aatccaaattccctctgga

SEQ ID NO: 3837072 - DNA, 17 bp, Homo sapiens
aatccaagcaaatgtga

SEQ ID NO: 3837073 - DNA, 13 bp, Homo sapiens
aatccagcctgct

SEQ ID NO: 3837074 - DNA, 12 bp, Homo sapiens
aatcccagcact

SEQ ID NO: 3837075 - DNA, 21 bp, Homo sapiens
aatcccagcattttgagaggc

SEQ ID NO: 3837076 - DNA, 18 bp, Homo sapiens
aatcccttcctctcccat

SEQ ID NO: 3837077 - DNA, 19 bp, Homo sapiens
aatcctaatttctcctccc

SEQ ID NO: 3837078 - DNA, 24 bp, Homo sapiens
aatcctaatttctcctcccttcct

SEQ ID NO: 3837079 - DNA, 20 bp, Homo sapiens
aatgaattaagaaagattaa

SEQ ID NO: 3837080 - DNA, 13 bp, Homo sapiens
aatgactgaagac

SEQ ID NO: 3837081 - DNA, 21 bp, Homo sapiens
aatgatctagttcagaaggaa

SEQ ID NO: 3837082 - DNA, 23 bp, Homo sapiens
aatgatctagttcagaaggaagc

SEQ ID NO: 3837083 - DNA, 15 bp, Homo sapiens
aatgatttgtaaagg

SEQ ID NO: 3837084 - DNA, 13 bp, Homo sapiens
aaattattacata

SEQ ID NO: 3837085 - DNA, 15 bp, Homo sapiens
aaattattttatgtc

SEQ ID NO: 3837086 - DNA, 19 bp, Homo sapiens
aaattattttatgtcatag

SEQ ID NO: 3837087 - DNA, 17 bp, Homo sapiens
aaattcatggctttttc

SEQ ID NO: 3837088 - DNA, 13 bp, Homo sapiens
aaattccccttcc

SEQ ID NO: 3837089 - DNA, 13 bp, Homo sapiens
aaattccctctgg

SEQ ID NO: 3837090 - DNA, 17 bp, Homo sapiens
aaattcgacctgattta

SEQ ID NO: 3837091 - DNA, 17 bp, Homo sapiens
aaattcggaatggtttt

SEQ ID NO: 3837092 - DNA, 17 bp, Homo sapiens
aaattgattcaaatgtt

SEQ ID NO: 3837093 - DNA, 15 bp, Homo sapiens
aaattgctcaaaaaa

SEQ ID NO: 3837094 - DNA, 19 bp, Homo sapiens
aaatttatacaaagaaact

SEQ ID NO: 3837095 - DNA, 13 bp, Homo sapiens
aaatttcatgaaa

SEQ ID NO: 3837096 - DNA, 22 bp, Homo sapiens
aaatttgccagttttattttct

SEQ ID NO: 3837097 - DNA, 20 bp, Homo sapiens
aacaaaaaatgtgctgttca

SEQ ID NO: 3837098 - DNA, 21 bp, Homo sapiens
aacaaatgctttattatttat

SEQ ID NO: 3837099 - DNA, 14 bp, Homo sapiens
aacaacattatttt

SEQ ID NO: 3837100 - DNA, 16 bp, Homo sapiens
cactgccaggccagcc

SEQ ID NO: 3837101 - DNA, 18 bp, Homo sapiens
cactgccaggccagcctc

SEQ ID NO: 3837102 - DNA, 19 bp, Homo sapiens
cactgccaggccagcctcc

SEQ ID NO: 3837103 - DNA, 20 bp, Homo sapiens
cactgccaggccagcctccg

SEQ ID NO: 3837104 - DNA, 22 bp, Homo sapiens
cactgcctcgggaacctcactc

SEQ ID NO: 3837105 - DNA, 23 bp, Homo sapiens
cactgctcatttgagaactgtca

SEQ ID NO: 3837106 - DNA, 18 bp, Homo sapiens
cactgctccctgaagcca

SEQ ID NO: 3837107 - DNA, 23 bp, Homo sapiens
cactgctccctgaagccagcctt

SEQ ID NO: 3837108 - DNA, 13 bp, Homo sapiens
cactgctggtgtt

SEQ ID NO: 3837109 - DNA, 21 bp, Homo sapiens
cactgctggtgtttatgtgaa

SEQ ID NO: 3837110 - DNA, 12 bp, Homo sapiens
cactggaaaggg

SEQ ID NO: 3837111 - DNA, 16 bp, Homo sapiens
cactggaaaggggaga

SEQ ID NO: 3837112 - DNA, 22 bp, Homo sapiens
cactggaaaggggagagcctgc

SEQ ID NO: 3837113 - DNA, 23 bp, Homo sapiens
cactggaaaggggagagcctgct

SEQ ID NO: 3837114 - DNA, 18 bp, Homo sapiens
cactggaggttgaagcca

SEQ ID NO: 3837115 - DNA, 14 bp, Homo sapiens
cactggccatccct

SEQ ID NO: 3837116 - DNA, 18 bp, Homo sapiens
cactggctgccagctatt

SEQ ID NO: 3837117 - DNA, 12 bp, Homo sapiens
cactgggagagt

SEQ ID NO: 3837118 - DNA, 15 bp, Homo sapiens
cactgtaacatttac

SEQ ID NO: 3837119 - DNA, 17 bp, Homo sapiens
cactgtaacatttacga

SEQ ID NO: 3837120 - DNA, 17 bp, Homo sapiens
cactgtatcatttcatg

SEQ ID NO: 3837121 - DNA, 23 bp, Homo sapiens
cactgtgctttctattgtacaga

SEQ ID NO: 3837122 - DNA, 23 bp, Homo sapiens
cacttaattgctttcctgcctcc

SEQ ID NO: 3837123 - DNA, 14 bp, Homo sapiens
cactttggttttgg

SEQ ID NO: 3837124 - DNA, 15 bp, Homo sapiens
cagaaaaggcagcca

SEQ ID NO: 3837125 - DNA, 21 bp, Homo sapiens
cagaaaaggcagccagatccc

SEQ ID NO: 3837126 - DNA, 17 bp, Homo sapiens
cagaagaagctgggagg

SEQ ID NO: 3837127 - DNA, 19 bp, Homo sapiens
cagaagaagctgggaggga

SEQ ID NO: 3837128 - DNA, 16 bp, Homo sapiens
cagaagtcaagcccag

SEQ ID NO: 3837129 - DNA, 12 bp, Homo sapiens
cagaataaagca

SEQ ID NO: 3837130 - DNA, 18 bp, Homo sapiens
caagtggggtgctgggag

SEQ ID NO: 3837131 - DNA, 19 bp, Homo sapiens
caagtggggtgctgggagg

SEQ ID NO: 3837132 - DNA, 16 bp, Homo sapiens
caagtgtaattagctt

SEQ ID NO: 3837133 - DNA, 12 bp, Homo sapiens
caagtgtctttt

SEQ ID NO: 3837134 - DNA, 17 bp, Homo sapiens
caagtgtgtctcctgtg

SEQ ID NO: 3837135 - DNA, 15 bp, Homo sapiens
caataaataaatgtt

SEQ ID NO: 3837136 - DNA, 17 bp, Homo sapiens
caataaataaatgtttt

SEQ ID NO: 3837137 - DNA, 19 bp, Homo sapiens
caatacactagttgtttct

SEQ ID NO: 3837138 - DNA, 15 bp, Homo sapiens
caatcatgtgccaga

SEQ ID NO: 3837139 - DNA, 15 bp, Homo sapiens
caatcattgtacagt

SEQ ID NO: 3837140 - DNA, 22 bp, Homo sapiens
caatcattgtacagtttgttta

SEQ ID NO: 3837141 - DNA, 17 bp, Homo sapiens
caatccaaattccctct

SEQ ID NO: 3837142 - DNA, 19 bp, Homo sapiens
caatcctaatttctcctcc

SEQ ID NO: 3837143 - DNA, 22 bp, Homo sapiens
caatgaagtgttttacaatgat

SEQ ID NO: 3837144 - DNA, 16 bp, Homo sapiens
caatgcaacctctgcc

SEQ ID NO: 3837145 - DNA, 13 bp, Homo sapiens
caatggcaggttt

SEQ ID NO: 3837146 - DNA, 21 bp, Homo sapiens
caatgggtttgccaagccctt

SEQ ID NO: 3837147 - DNA, 15 bp, Homo sapiens
caatgtctggggaca

SEQ ID NO: 3837148 - DNA, 17 bp, Homo sapiens
caatgtctggggacagg

SEQ ID NO: 3837149 - DNA, 19 bp, Homo sapiens
caattgattttaaaccata

SEQ ID NO: 3837150 - DNA, 15 bp, Homo sapiens
caattgtacaaaaaa

SEQ ID NO: 3837151 - DNA, 18 bp, Homo sapiens
caattgtacaaaaaagtt

SEQ ID NO: 3837152 - DNA, 16 bp, Homo sapiens
caatttgtttgtgctt

SEQ ID NO: 3837153 - DNA, 19 bp, Homo sapiens
caatttgtttgtgcttcta

SEQ ID NO: 3837154 - DNA, 14 bp, Homo sapiens
caattttccttgaa

SEQ ID NO: 3837155 - DNA, 16 bp, Homo sapiens
caattttccttgaagc

SEQ ID NO: 3837156 - DNA, 17 bp, Homo sapiens
caattttccttgaagcc

SEQ ID NO: 3837157 - DNA, 18 bp, Homo sapiens
cacaaaggacctcagctg

SEQ ID NO: 3837158 - DNA, 21 bp, Homo sapiens
cacaaaggacctcagctgctt

SEQ ID NO: 3837159 - DNA, 20 bp, Homo sapiens
cacaatgcataatgtcttta

SEQ ID NO: 3837160 - DNA, 20 bp, Homo sapiens
cacaattttctgtgccaaag

SEQ ID NO: 3837161 - DNA, 13 bp, Homo sapiens
cacacacacacac

SEQ ID NO: 3837162 - DNA, 14 bp, Homo sapiens
cacacacacacaca

SEQ ID NO: 3837163 - DNA, 15 bp, Homo sapiens
cacacacatacacac

SEQ ID NO: 3837164 - DNA, 13 bp, Homo sapiens
cacacagcccaga

SEQ ID NO: 3837165 - DNA, 19 bp, Homo sapiens
cacacagcccagaaggcca

SEQ ID NO: 3837166 - DNA, 18 bp, Homo sapiens
cacacaggaactctgtgt

SEQ ID NO: 3837167 - DNA, 15 bp, Homo sapiens
atggcccattctact

SEQ ID NO: 3837168 - DNA, 23 bp, Homo sapiens
atggcccattctacttgctctgg

SEQ ID NO: 3837169 - DNA, 23 bp, Homo sapiens
atggcctcagatgatggggtcag

SEQ ID NO: 3837170 - DNA, 23 bp, Homo sapiens
atggctccttgggatgaagaggg

SEQ ID NO: 3837171 - DNA, 14 bp, Homo sapiens
atggctttgtgctg

SEQ ID NO: 3837172 - DNA, 22 bp, Homo sapiens
atggctttttctttttttgcat

SEQ ID NO: 3837173 - DNA, 18 bp, Homo sapiens
atgggaatgaggtgggag

SEQ ID NO: 3837174 - DNA, 14 bp, Homo sapiens
atgggaggctcctg

SEQ ID NO: 3837175 - DNA, 17 bp, Homo sapiens
atgggaggctcctggtg

SEQ ID NO: 3837176 - DNA, 18 bp, Homo sapiens
atgggaggctcctggtgg

SEQ ID NO: 3837177 - DNA, 16 bp, Homo sapiens
atggggagctggccta

SEQ ID NO: 3837178 - DNA, 17 bp, Homo sapiens
atggggtcagcaggccc

SEQ ID NO: 3837179 - DNA, 14 bp, Homo sapiens
atggtaagacctct

SEQ ID NO: 3837180 - DNA, 23 bp, Homo sapiens
atggtgcctgagaggcaggcata

SEQ ID NO: 3837181 - DNA, 14 bp, Homo sapiens
atggtgctaatgtg

SEQ ID NO: 3837182 - DNA, 22 bp, Homo sapiens
atggtgctaatgtgtctgtgga

SEQ ID NO: 3837183 - DNA, 18 bp, Homo sapiens
atggtggggcccccagca

SEQ ID NO: 3837184 - DNA, 22 bp, Homo sapiens
atggtggggcccccagcaccct

SEQ ID NO: 3837185 - DNA, 23 bp, Homo sapiens
atggttgccaccccaacccaata

SEQ ID NO: 3837186 - DNA, 16 bp, Homo sapiens
atggttttaaagctaa

SEQ ID NO: 3837187 - DNA, 21 bp, Homo sapiens
atgtaaaatcttgatagctaa

SEQ ID NO: 3837188 - DNA, 15 bp, Homo sapiens
atgtaactgaagcat

SEQ ID NO: 3837189 - DNA, 16 bp, Homo sapiens
atgtatataaaatgtg

SEQ ID NO: 3837190 - DNA, 16 bp, Homo sapiens
atgtatgaattttgta

SEQ ID NO: 3837191 - DNA, 17 bp, Homo sapiens
atgtatgaattttgtaa

SEQ ID NO: 3837192 - DNA, 16 bp, Homo sapiens
atgtatttttgtaaat

SEQ ID NO: 3837193 - DNA, 19 bp, Homo sapiens
atgtatttttgtaaatagt

SEQ ID NO: 3837194 - DNA, 21 bp, Homo sapiens
atgtcacatcctaatagaaag

SEQ ID NO: 3837195 - DNA, 16 bp, Homo sapiens
atgtcattaaagtgca

SEQ ID NO: 3837196 - DNA, 15 bp, Homo sapiens
atgtcattgcccact

SEQ ID NO: 3837197 - DNA, 23 bp, Homo sapiens
atgtcattgcccacttctgtgta

SEQ ID NO: 3837198 - DNA, 12 bp, Homo sapiens
atgtccccttcc

SEQ ID NO: 3837199 - DNA, 16 bp, Homo sapiens
atgtctctttggggag

SEQ ID NO: 3837200 - DNA, 13 bp, Homo sapiens
atgtctggggaca

SEQ ID NO: 3837201 - DNA, 16 bp, Homo sapiens
atgtctggggacaggc

SEQ ID NO: 3837202 - DNA, 13 bp, Homo sapiens
atgtgaaagatgc

SEQ ID NO: 3837203 - DNA, 18 bp, Homo sapiens
atgtgaaagatgcatgtt

SEQ ID NO: 3837204 - DNA, 15 bp, Homo sapiens
atgtgaacattccta

SEQ ID NO: 3837205 - DNA, 17 bp, Homo sapiens
atgtgagccgcctcgga

SEQ ID NO: 3837206 - DNA, 13 bp, Homo sapiens
atgtggctgcccc

SEQ ID NO: 3837207 - DNA, 19 bp, Homo sapiens
atgtgggatgagtttttaa

SEQ ID NO: 3837208 - DNA, 16 bp, Homo sapiens
atgtgtacgtgtgtgt

SEQ ID NO: 3837209 - DNA, 23 bp, Homo sapiens
atgtgtgttttaaaatgagaaat

SEQ ID NO: 3837210 - DNA, 14 bp, Homo sapiens
atgttacaaaaaaa

SEQ ID NO: 3837211 - DNA, 13 bp, Homo sapiens
atgttcaaaagaa

SEQ ID NO: 3837212 - DNA, 17 bp, Homo sapiens
atgttgcatagaataaa

SEQ ID NO: 3837213 - DNA, 19 bp, Homo sapiens
atgtttgtggaatggattt

SEQ ID NO: 3837214 - DNA, 20 bp, Homo sapiens
cataatatttgaacaaaaat

SEQ ID NO: 3837215 - DNA, 15 bp, Homo sapiens
cataatttaaaataa

SEQ ID NO: 3837216 - DNA, 13 bp, Homo sapiens
catacaacaaaga

SEQ ID NO: 3837217 - DNA, 14 bp, Homo sapiens
catagaaggcaggt

SEQ ID NO: 3837218 - DNA, 16 bp, Homo sapiens
catagaaggcaggtga

SEQ ID NO: 3837219 - DNA, 23 bp, Homo sapiens
catagaggcttctccgccagcct

SEQ ID NO: 3837220 - DNA, 16 bp, Homo sapiens
catagcccatccctgc

SEQ ID NO: 3837221 - DNA, 18 bp, Homo sapiens
catagcccatccctgcct

SEQ ID NO: 3837222 - DNA, 23 bp, Homo sapiens
catagcccatccctgcctggtca

SEQ ID NO: 3837223 - DNA, 16 bp, Homo sapiens
catataagtgattgct

SEQ ID NO: 3837224 - DNA, 12 bp, Homo sapiens
catatacctctt

SEQ ID NO: 3837225 - DNA, 20 bp, Homo sapiens
catatacctcttgaagaaga

SEQ ID NO: 3837226 - DNA, 16 bp, Homo sapiens
catatcagacttcacc

SEQ ID NO: 3837227 - DNA, 21 bp, Homo sapiens
catattattttatgttgcata

SEQ ID NO: 3837228 - DNA, 18 bp, Homo sapiens
catattgtttcagtgttc

SEQ ID NO: 3837229 - DNA, 21 bp, Homo sapiens
catcaagtgtaattagctttt

SEQ ID NO: 3837230 - DNA, 14 bp, Homo sapiens
catcaatcattgta

SEQ ID NO: 3837231 - DNA, 15 bp, Homo sapiens
catcagaaggtattt

SEQ ID NO: 3837232 - DNA, 23 bp, Homo sapiens
catcagaaggtattttttaactc

SEQ ID NO: 3837233 - DNA, 13 bp, Homo sapiens
catcccaggacac

SEQ ID NO: 3837234 - DNA, 13 bp, Homo sapiens
catcccctgcctc

SEQ ID NO: 3837235 - DNA, 13 bp, Homo sapiens
catccctgcctgg

SEQ ID NO: 3837236 - DNA, 13 bp, Homo sapiens
catcccttcccca

SEQ ID NO: 3837237 - DNA, 14 bp, Homo sapiens
catcccttccccag

SEQ ID NO: 3837238 - DNA, 17 bp, Homo sapiens
catcctaatagaaagaa

SEQ ID NO: 3837239 - DNA, 14 bp, Homo sapiens
catcctactaagaa

SEQ ID NO: 3837240 - DNA, 22 bp, Homo sapiens
catcctgccttagagccaggca

SEQ ID NO: 3837241 - DNA, 22 bp, Homo sapiens
catcctgctagcacctccccag

SEQ ID NO: 3837242 - DNA, 18 bp, Homo sapiens
catcctttctgcctctca

SEQ ID NO: 3837243 - DNA, 14 bp, Homo sapiens
catcctttgcattt

SEQ ID NO: 3837244 - DNA, 21 bp, Homo sapiens
catcgccagctgatgactcaa

SEQ ID NO: 3837245 - DNA, 14 bp, Homo sapiens
catcgggctgtcgc

SEQ ID NO: 3837246 - DNA, 16 bp, Homo sapiens
catctatctcaatcct

SEQ ID NO: 3837247 - DNA, 16 bp, Homo sapiens
catctcaattgtgctt

SEQ ID NO: 3837248 - DNA, 20 bp, Homo sapiens
catctcaattgtgctttgta

SEQ ID NO: 3837249 - DNA, 22 bp, Homo sapiens
catctcaattgtgctttgtatc

SEQ ID NO: 3837250 - DNA, 20 bp, Homo sapiens
catctcattacccttttctg

SEQ ID NO: 3837251 - DNA, 12 bp, Homo sapiens
catctcctttgc

SEQ ID NO: 3837252 - DNA, 19 bp, Homo sapiens
catctgcaccccttctctc

SEQ ID NO: 3837253 - DNA, 23 bp, Homo sapiens
catctgcaccccttctctcctcc

SEQ ID NO: 3837254 - DNA, 18 bp, Homo sapiens
catctgccttaaaaccaa

SEQ ID NO: 3837255 - DNA, 20 bp, Homo sapiens
catctgccttaaaaccaaag

SEQ ID NO: 3837256 - DNA, 13 bp, Homo sapiens
catctggcccagg

SEQ ID NO: 3837257 - DNA, 16 bp, Homo sapiens
catctggcccaggctg

SEQ ID NO: 3837258 - DNA, 17 bp, Homo sapiens
catctggcccaggctgg

SEQ ID NO: 3837259 - DNA, 18 bp, Homo sapiens
catctggcccaggctggc

SEQ ID NO: 3837260 - DNA, 20 bp, Homo sapiens
catcttgatctgctcagccc

SEQ ID NO: 3837261 - DNA, 21 bp, Homo sapiens
catcttgatctgctcagccct

SEQ ID NO: 3837262 - DNA, 24 bp, Homo sapiens
catcttgggggtcacccatggcct

SEQ ID NO: 3837263 - DNA, 21 bp, Homo sapiens
catctttcatcaatcattgta

SEQ ID NO: 3837264 - DNA, 18 bp, Homo sapiens
catgaagatttggttttt

SEQ ID NO: 3837265 - DNA, 13 bp, Homo sapiens
catgaagccctta

SEQ ID NO: 3837266 - DNA, 13 bp, Homo sapiens
catgacagatgaa

SEQ ID NO: 3837267 - DNA, 21 bp, Homo sapiens
catgaccttacatttcctggg

SEQ ID NO: 3837268 - DNA, 13 bp, Homo sapiens
catgcccaccccc

SEQ ID NO: 3837269 - DNA, 20 bp, Homo sapiens
catgcccaccccctgccctg

SEQ ID NO: 3837270 - DNA, 23 bp, Homo sapiens
catgcccaccccctgccctgcac

SEQ ID NO: 3837271 - DNA, 16 bp, Homo sapiens
catgcccccgccacct

SEQ ID NO: 3837272 - DNA, 17 bp, Homo sapiens
catgcccccgccacctc

SEQ ID NO: 3837273 - DNA, 18 bp, Homo sapiens
catgcccccgccacctcc

SEQ ID NO: 3837274 - DNA, 23 bp, Homo sapiens
catgcccccgccacctccccact

SEQ ID NO: 3837275 - DNA, 20 bp, Homo sapiens
catgccccggccacctctgc

SEQ ID NO: 3837276 - DNA, 14 bp, Homo sapiens
catgctggctcctg

SEQ ID NO: 3837277 - DNA, 12 bp, Homo sapiens
catgctttgatt

SEQ ID NO: 3837278 - DNA, 13 bp, Homo sapiens
catggaatgactg

SEQ ID NO: 3837279 - DNA, 16 bp, Homo sapiens
catggaatgactgaag

SEQ ID NO: 3837280 - DNA, 21 bp, Homo sapiens
catggaatgactgaagacagg

SEQ ID NO: 3837281 - DNA, 23 bp, Homo sapiens
catggcagatgatttgggcagag

SEQ ID NO: 3837282 - DNA, 12 bp, Homo sapiens
catggcctcaga

SEQ ID NO: 3837283 - DNA, 15 bp, Homo sapiens
catggctaagcttta

SEQ ID NO: 3837284 - DNA, 13 bp, Homo sapiens
catggctttttct

SEQ ID NO: 3837285 - DNA, 23 bp, Homo sapiens
catggctttttctttttttgcat

SEQ ID NO: 3837286 - DNA, 14 bp, Homo sapiens
catgggagggggct

SEQ ID NO: 3837287 - DNA, 22 bp, Homo sapiens
catgggagggggcttgaagcca

SEQ ID NO: 3837288 - DNA, 18 bp, Homo sapiens
catggggcagcctccagt

SEQ ID NO: 3837289 - DNA, 19 bp, Homo sapiens
catggtgattcctgggaag

SEQ ID NO: 3837290 - DNA, 13 bp, Homo sapiens
catggtgcctgag

SEQ ID NO: 3837291 - DNA, 14 bp, Homo sapiens
catggtgcctgaga

SEQ ID NO: 3837292 - DNA, 17 bp, Homo sapiens
catggtgcctgagaggc

SEQ ID NO: 3837293 - DNA, 17 bp, Homo sapiens
catggtttttataatat

SEQ ID NO: 3837294 - DNA, 23 bp, Homo sapiens
catgtagaacttgaactaacata

SEQ ID NO: 3837295 - DNA, 18 bp, Homo sapiens
catgtcattgcccacttc

SEQ ID NO: 3837296 - DNA, 13 bp, Homo sapiens
catgtccccctta

SEQ ID NO: 3837297 - DNA, 12 bp, Homo sapiens
catgtccccttc

SEQ ID NO: 3837298 - DNA, 13 bp, Homo sapiens
catgtccccttcc

SEQ ID NO: 3837299 - DNA, 13 bp, Homo sapiens
catgtctgaaaaa

SEQ ID NO: 3837300 - DNA, 12 bp, Homo sapiens
catgtgaaactc

SEQ ID NO: 3837301 - DNA, 16 bp, Homo sapiens
catgtgcctataatcc

SEQ ID NO: 3837302 - DNA, 21 bp, Homo sapiens
catgttagttttgctccttct

SEQ ID NO: 3837303 - DNA, 13 bp, Homo sapiens
catgttcaaaaga

SEQ ID NO: 3837304 - DNA, 16 bp, Homo sapiens
catgttcaaaagaagt

SEQ ID NO: 3837305 - DNA, 14 bp, Homo sapiens
catgttccaataaa

SEQ ID NO: 3837306 - DNA, 17 bp, Homo sapiens
catgttccaataaacag

SEQ ID NO: 3837307 - DNA, 13 bp, Homo sapiens
catgttgctgact

SEQ ID NO: 3837308 - DNA, 15 bp, Homo sapiens
catgttgctgacttt

SEQ ID NO: 3837309 - DNA, 15 bp, Homo sapiens
cattacccttttctg

SEQ ID NO: 3837310 - DNA, 17 bp, Homo sapiens
cattacccttttctggg

SEQ ID NO: 3837311 - DNA, 19 bp, Homo sapiens
cattagaagttaccaaatt

SEQ ID NO: 3837312 - DNA, 22 bp, Homo sapiens
cattatttcgtgttgtgttctt

SEQ ID NO: 3837313 - DNA, 16 bp, Homo sapiens
cattctacttgctctg

SEQ ID NO: 3837314 - DNA, 21 bp, Homo sapiens
cattctacttgctctggacct

SEQ ID NO: 3837315 - DNA, 23 bp, Homo sapiens
cattctcccaggtaccagctgcg

SEQ ID NO: 3837316 - DNA, 15 bp, Homo sapiens
cattgcccacttctg

SEQ ID NO: 3837317 - DNA, 23 bp, Homo sapiens
cattgcccacttctgtgtagaca

SEQ ID NO: 3837318 - DNA, 20 bp, Homo sapiens
cattgtacagtttgtttaca

SEQ ID NO: 3837319 - DNA, 23 bp, Homo sapiens
cattgtattcagagttgatggtt

SEQ ID NO: 3837320 - DNA, 14 bp, Homo sapiens
catttattaagtat

SEQ ID NO: 3837321 - DNA, 10 bp, Homo sapiens
catttcatat

SEQ ID NO: 3837322 - DNA, 14 bp, Homo sapiens
catttcccatctgc

SEQ ID NO: 3837323 - DNA, 17 bp, Homo sapiens
catttcccatctgcacc

SEQ ID NO: 3837324 - DNA, 15 bp, Homo sapiens
catttcctaaatata

SEQ ID NO: 3837325 - DNA, 17 bp, Homo sapiens
catttctttatatggaa

SEQ ID NO: 3837326 - DNA, 16 bp, Homo sapiens
catttgagaactgtca

SEQ ID NO: 3837327 - DNA, 15 bp, Homo sapiens
catttggctggagcc

SEQ ID NO: 3837328 - DNA, 18 bp, Homo sapiens
catttggggcatttgtaa

SEQ ID NO: 3837329 - DNA, 19 bp, Homo sapiens
catttggggcatttgtaaa

SEQ ID NO: 3837330 - DNA, 11 bp, Homo sapiens
catttgtaaaa

SEQ ID NO: 3837331 - DNA, 19 bp, Homo sapiens
catttgtaaaaagtagatt

SEQ ID NO: 3837332 - DNA, 22 bp, Homo sapiens
catttgtaaaaagtagattaaa

SEQ ID NO: 3837333 - DNA, 19 bp, Homo sapiens
cattttaaacaactttcca

SEQ ID NO: 3837334 - DNA, 15 bp, Homo sapiens
cattttaagcataat

SEQ ID NO: 3837335 - DNA, 17 bp, Homo sapiens
cattttaagcataatta

SEQ ID NO: 3837336 - DNA, 18 bp, Homo sapiens
cattttaagcataattaa

SEQ ID NO: 3837337 - DNA, 19 bp, Homo sapiens
cattttaagcataattaat

SEQ ID NO: 3837338 - DNA, 21 bp, Homo sapiens
cattttcgctttcctctggtt

SEQ ID NO: 3837339 - DNA, 18 bp, Homo sapiens
cattttctgcaagcctgc

SEQ ID NO: 3837340 - DNA, 17 bp, Homo sapiens
cattttgggttgtttaa

SEQ ID NO: 3837341 - DNA, 14 bp, Homo sapiens
ccaaaaccaaattg

SEQ ID NO: 3837342 - DNA, 18 bp, Homo sapiens
ccaaaccctgtcctccca

SEQ ID NO: 3837343 - DNA, 18 bp, Homo sapiens
ccaaactgtctctgcctc

SEQ ID NO: 3837344 - DNA, 21 bp, Homo sapiens
ccaaagatctgctcctcgctc

SEQ ID NO: 3837345 - DNA, 22 bp, Homo sapiens
ccaaatatttgaaaggatggta

SEQ ID NO: 3837346 - DNA, 17 bp, Homo sapiens
ccaaatgtgaaagatgc

SEQ ID NO: 3837347 - DNA, 17 bp, Homo sapiens
ccaaattccctctggag

SEQ ID NO: 3837348 - DNA, 20 bp, Homo sapiens
ccaacacacaggaactctgt

SEQ ID NO: 3837349 - DNA, 14 bp, Homo sapiens
aggggagaagccaa

SEQ ID NO: 3837350 - DNA, 19 bp, Homo sapiens
aggggaggggggagccaga

SEQ ID NO: 3837351 - DNA, 22 bp, Homo sapiens
aggggaggggggagccagaggc

SEQ ID NO: 3837352 - DNA, 14 bp, Homo sapiens
aggggcagccagcc

SEQ ID NO: 3837353 - DNA, 17 bp, Homo sapiens
aggggcagccagccctg

SEQ ID NO: 3837354 - DNA, 17 bp, Homo sapiens
aggggctacaagaggga

SEQ ID NO: 3837355 - DNA, 18 bp, Homo sapiens
aggggctacaagagggaa

SEQ ID NO: 3837356 - DNA, 17 bp, Homo sapiens
aggggctctggagagaa

SEQ ID NO: 3837357 - DNA, 21 bp, Homo sapiens
aggggctctggagagaaacaa

SEQ ID NO: 3837358 - DNA, 16 bp, Homo sapiens
aggggctggcttcagg

SEQ ID NO: 3837359 - DNA, 18 bp, Homo sapiens
agggggcttgaagccaaa

SEQ ID NO: 3837360 - DNA, 15 bp, Homo sapiens
aggggggagccagag

SEQ ID NO: 3837361 - DNA, 19 bp, Homo sapiens
aggggggagccagaggcca

SEQ ID NO: 3837362 - DNA, 20 bp, Homo sapiens
aggggggagccagaggccag

SEQ ID NO: 3837363 - DNA, 15 bp, Homo sapiens
agggggtggaggggt

SEQ ID NO: 3837364 - DNA, 18 bp, Homo sapiens
aggggtagaaaatgtttt

SEQ ID NO: 3837365 - DNA, 19 bp, Homo sapiens
aggggtgggggtggaggct

SEQ ID NO: 3837366 - DNA, 18 bp, Homo sapiens
aggggtgtggcagtggtt

SEQ ID NO: 3837367 - DNA, 18 bp, Homo sapiens
agggtagtttgcaaacaa

SEQ ID NO: 3837368 - DNA, 19 bp, Homo sapiens
agggtgctcagtctccttg

SEQ ID NO: 3837369 - DNA, 21 bp, Homo sapiens
agggtggacttagaaagcagg

SEQ ID NO: 3837370 - DNA, 23 bp, Homo sapiens
agggtggacttagaaagcagggg

SEQ ID NO: 3837371 - DNA, 16 bp, Homo sapiens
agggtggcctcaagaa

SEQ ID NO: 3837372 - DNA, 21 bp, Homo sapiens
agggtgttgggatactgcagg

SEQ ID NO: 3837373 - DNA, 18 bp, Homo sapiens
aggtacaaccggatgcca

SEQ ID NO: 3837374 - DNA, 19 bp, Homo sapiens
aggtactggtgagggcaag

SEQ ID NO: 3837375 - DNA, 23 bp, Homo sapiens
aggtactggtgagggcaagaggt

SEQ ID NO: 3837376 - DNA, 20 bp, Homo sapiens
aggtcactggaaaggggaga

SEQ ID NO: 3837377 - DNA, 16 bp, Homo sapiens
aggtctggcctcaggt

SEQ ID NO: 3837378 - DNA, 16 bp, Homo sapiens
aggtctggctgcttgc

SEQ ID NO: 3837379 - DNA, 16 bp, Homo sapiens
aggtgaaaagggcaga

SEQ ID NO: 3837380 - DNA, 19 bp, Homo sapiens
aggtgaaaagggcagaggc

SEQ ID NO: 3837381 - DNA, 23 bp, Homo sapiens
aggtgatccgcccgcctctgcct

SEQ ID NO: 3837382 - DNA, 14 bp, Homo sapiens
aggtgcctgggagg

SEQ ID NO: 3837383 - DNA, 14 bp, Homo sapiens
aggtgctggaggtg

SEQ ID NO: 3837384 - DNA, 19 bp, Homo sapiens
aggtgctggaggtgggagc

SEQ ID NO: 3837385 - DNA, 17 bp, Homo sapiens
aggtggaagaagggaga

SEQ ID NO: 3837386 - DNA, 19 bp, Homo sapiens
aggtggaagaagggagaag

SEQ ID NO: 3837387 - DNA, 23 bp, Homo sapiens
aggtggaggttgcagtgagctga

SEQ ID NO: 3837388 - DNA, 13 bp, Homo sapiens
aggtgggagcagg

SEQ ID NO: 3837389 - DNA, 16 bp, Homo sapiens
aggtgggagcaggaga

SEQ ID NO: 3837390 - DNA, 13 bp, Homo sapiens
aggtggggagaag

SEQ ID NO: 3837391 - DNA, 14 bp, Homo sapiens
aggtggggagaagg

SEQ ID NO: 3837392 - DNA, 15 bp, Homo sapiens
aggtgtaaaacagta

SEQ ID NO: 3837393 - DNA, 23 bp, Homo sapiens
aggtgtatttattgtttaagcag

SEQ ID NO: 3837394 - DNA, 17 bp, Homo sapiens
aggttcatgcaaacttt

SEQ ID NO: 3837395 - DNA, 12 bp, Homo sapiens
aggttcctctgc

SEQ ID NO: 3837396 - DNA, 13 bp, Homo sapiens
aggttcctctgcc

SEQ ID NO: 3837397 - DNA, 16 bp, Homo sapiens
aggttcctctgcctgc

SEQ ID NO: 3837398 - DNA, 12 bp, Homo sapiens
aggttgaagcca

SEQ ID NO: 3837399 - DNA, 16 bp, Homo sapiens
agtaaaaacaaagaaa

SEQ ID NO: 3837400 - DNA, 15 bp, Homo sapiens
agtaaagtaaagtat

SEQ ID NO: 3837401 - DNA, 23 bp, Homo sapiens
agtaaggaattttatttttttct

SEQ ID NO: 3837402 - DNA, 17 bp, Homo sapiens
agtaagtttcattctaa

SEQ ID NO: 3837403 - DNA, 16 bp, Homo sapiens
agtaataaaaagccac

SEQ ID NO: 3837404 - DNA, 15 bp, Homo sapiens
agtaatccaagcaaa

SEQ ID NO: 3837405 - DNA, 21 bp, Homo sapiens
agtaatccaagcaaatgtgaa

SEQ ID NO: 3837406 - DNA, 14 bp, Homo sapiens
agtaatctccaggg

SEQ ID NO: 3837407 - DNA, 21 bp, Homo sapiens
agtaccaggccgtttgctttt

SEQ ID NO: 3837408 - DNA, 17 bp, Homo sapiens
agtagtaccaaatgctt

SEQ ID NO: 3837409 - DNA, 16 bp, Homo sapiens
agtagtataatgtatg

SEQ ID NO: 3837410 - DNA, 14 bp, Homo sapiens
agtagttccacaca

SEQ ID NO: 3837411 - DNA, 18 bp, Homo sapiens
agtataagaaattttatt

SEQ ID NO: 3837412 - DNA, 19 bp, Homo sapiens
ataagaaaactacatgtaa

SEQ ID NO: 3837413 - DNA, 15 bp, Homo sapiens
ataagaaattttatt

SEQ ID NO: 3837414 - DNA, 14 bp, Homo sapiens
ataagacttcctct

SEQ ID NO: 3837415 - DNA, 21 bp, Homo sapiens
ataaggccgagcccacaccat

SEQ ID NO: 3837416 - DNA, 16 bp, Homo sapiens
ataagtatataaatac

SEQ ID NO: 3837417 - DNA, 22 bp, Homo sapiens
ataagtgtgtgtttttcataaa

SEQ ID NO: 3837418 - DNA, 18 bp, Homo sapiens
ataagtttctttgcttca

SEQ ID NO: 3837419 - DNA, 19 bp, Homo sapiens
ataatacttgctttggaaa

SEQ ID NO: 3837420 - DNA, 14 bp, Homo sapiens
ataatattcataca

SEQ ID NO: 3837421 - DNA, 18 bp, Homo sapiens
ataatgtatgaattttgt

SEQ ID NO: 3837422 - DNA, 23 bp, Homo sapiens
ataattaatttggacattatttc

SEQ ID NO: 3837423 - DNA, 23 bp, Homo sapiens
ataattcacattgtattcagagt

SEQ ID NO: 3837424 - DNA, 16 bp, Homo sapiens
ataatttaaaataaat

SEQ ID NO: 3837425 - DNA, 18 bp, Homo sapiens
ataattttcaaaagaaaa

SEQ ID NO: 3837426 - DNA, 16 bp, Homo sapiens
ataattttgttttaat

SEQ ID NO: 3837427 - DNA, 16 bp, Homo sapiens
atacaccaattgattt

SEQ ID NO: 3837428 - DNA, 21 bp, Homo sapiens
atacagaattgtgtctgcagg

SEQ ID NO: 3837429 - DNA, 22 bp, Homo sapiens
atacagaattgtgtctgcagga

SEQ ID NO: 3837430 - DNA, 21 bp, Homo sapiens
atacaggatgatgactatgga

SEQ ID NO: 3837431 - DNA, 19 bp, Homo sapiens
atacgaatttctatagact

SEQ ID NO: 3837432 - DNA, 21 bp, Homo sapiens
atactaatagcctaaaagatt

SEQ ID NO: 3837433 - DNA, 12 bp, Homo sapiens
atactgaaggaa

SEQ ID NO: 3837434 - DNA, 14 bp, Homo sapiens
atactgaaggaaaa

SEQ ID NO: 3837435 - DNA, 20 bp, Homo sapiens
atactgaaggaaaaacacaa

SEQ ID NO: 3837436 - DNA, 22 bp, Homo sapiens
atactgaaggaaaaacacaagc

SEQ ID NO: 3837437 - DNA, 15 bp, Homo sapiens
atactgcagggccag

SEQ ID NO: 3837438 - DNA, 17 bp, Homo sapiens
atactgcagggccagga

SEQ ID NO: 3837439 - DNA, 19 bp, Homo sapiens
atactgcagggccaggact

SEQ ID NO: 3837440 - DNA, 19 bp, Homo sapiens
atagaataaaatttttaat

SEQ ID NO: 3837441 - DNA, 21 bp, Homo sapiens
atagactgactttttccattt

SEQ ID NO: 3837442 - DNA, 19 bp, Homo sapiens
atagaggctagcttctgct

SEQ ID NO: 3837443 - DNA, 23 bp, Homo sapiens
atagaggcttctccgccagcctc

SEQ ID NO: 3837444 - DNA, 21 bp, Homo sapiens
atagctaaataacttgccatt

SEQ ID NO: 3837445 - DNA, 22 bp, Homo sapiens
atagctaaataacttgccattt

SEQ ID NO: 3837446 - DNA, 16 bp, Homo sapiens
atagtaaaattctact

SEQ ID NO: 3837447 - DNA, 17 bp, Homo sapiens
atagtactgctttactg

SEQ ID NO: 3837448 - DNA, 18 bp, Homo sapiens
atagtactgctttactgt

SEQ ID NO: 3837449 - DNA, 17 bp, Homo sapiens
atagtattaagtgaaat

SEQ ID NO: 3837450 - DNA, 13 bp, Homo sapiens
atagtctggaaag

SEQ ID NO: 3837451 - DNA, 23 bp, Homo sapiens
atagttatatagataaagagata

SEQ ID NO: 3837452 - DNA, 13 bp, Homo sapiens
atataaaatgtgc

SEQ ID NO: 3837453 - DNA, 15 bp, Homo sapiens
atataaataaatata

SEQ ID NO: 3837454 - DNA, 12 bp, Homo sapiens
atataaatatat

SEQ ID NO: 3837455 - DNA, 14 bp, Homo sapiens
atataaatatatat

SEQ ID NO: 3837456 - DNA, 15 bp, Homo sapiens
atataaatatatata

SEQ ID NO: 3837457 - DNA, 17 bp, Homo sapiens
atataaatatatataaa

SEQ ID NO: 3837458 - DNA, 20 bp, Homo sapiens
atatacaatatatattttgt

SEQ ID NO: 3837459 - DNA, 23 bp, Homo sapiens
atatataaacaaacaaacaaaaa

SEQ ID NO: 3837460 - DNA, 13 bp, Homo sapiens
atatatacaatat

SEQ ID NO: 3837461 - DNA, 12 bp, Homo sapiens
atatatcctctg

SEQ ID NO: 3837462 - DNA, 15 bp, Homo sapiens
atatatctttgtaaa

SEQ ID NO: 3837463 - DNA, 16 bp, Homo sapiens
atatatgccttactat

SEQ ID NO: 3837464 - DNA, 15 bp, Homo sapiens
atatatgtttgtgga

SEQ ID NO: 3837465 - DNA, 14 bp, Homo sapiens
atatattttaagac

SEQ ID NO: 3837466 - DNA, 15 bp, Homo sapiens
atatattttaagacg

SEQ ID NO: 3837467 - DNA, 18 bp, Homo sapiens
atatcagacttcaccaaa

SEQ ID NO: 3837468 - DNA, 19 bp, Homo sapiens
atatcagacttcaccaaat

SEQ ID NO: 3837469 - DNA, 12 bp, Homo sapiens
atatctttgtaa

SEQ ID NO: 3837470 - DNA, 13 bp, Homo sapiens
atatgatttgcat

SEQ ID NO: 3837471 - DNA, 22 bp, Homo sapiens
atatgatttgcattttttaaat

SEQ ID NO: 3837472 - DNA, 14 bp, Homo sapiens
atatgccttactat

SEQ ID NO: 3837473 - DNA, 21 bp, Homo sapiens
atatggttttgttttcaatga

SEQ ID NO: 3837474 - DNA, 14 bp, Homo sapiens
atattattttatgt

SEQ ID NO: 3837475 - DNA, 22 bp, Homo sapiens
atattattttatgttgcataga

SEQ ID NO: 3837476 - DNA, 19 bp, Homo sapiens
atattcatacaacaaagag

SEQ ID NO: 3837477 - DNA, 18 bp, Homo sapiens
atattgacaagtgtcttt

SEQ ID NO: 3837478 - DNA, 17 bp, Homo sapiens
atattgtgttttaacac

SEQ ID NO: 3837479 - DNA, 20 bp, Homo sapiens
atattgtgttttaacaccaa

SEQ ID NO: 3837480 - DNA, 12 bp, Homo sapiens
atatttattgct

SEQ ID NO: 3837481 - DNA, 13 bp, Homo sapiens
atatttgtaaaag

SEQ ID NO: 3837482 - DNA, 16 bp, Homo sapiens
atatttgtctgtgtgc

SEQ ID NO: 3837483 - DNA, 17 bp, Homo sapiens
atatttgtctgtgtgct

SEQ ID NO: 3837484 - DNA, 20 bp, Homo sapiens
atatttgtctgtgtgctact

SEQ ID NO: 3837485 - DNA, 22 bp, Homo sapiens
atatttgtctgtgtgctactaa

SEQ ID NO: 3837486 - DNA, 23 bp, Homo sapiens
atatttgtctgtgtgctactaac

SEQ ID NO: 3837487 - DNA, 14 bp, Homo sapiens
atattttaaatgtg

SEQ ID NO: 3837488 - DNA, 15 bp, Homo sapiens
atattttaaatgtgg

SEQ ID NO: 3837489 - DNA, 22 bp, Homo sapiens
atattttgtgggcttaattgaa

SEQ ID NO: 3837490 - DNA, 17 bp, Homo sapiens
atatttttaaaaaactg

SEQ ID NO: 3837491 - DNA, 18 bp, Homo sapiens
atatttttggcattcctc

SEQ ID NO: 3837492 - DNA, 23 bp, Homo sapiens
atatttttgttactgttctgagc

SEQ ID NO: 3837493 - DNA, 12 bp, Homo sapiens
atcaagtgtaat

SEQ ID NO: 3837494 - DNA, 12 bp, Homo sapiens
atcaatacacta

SEQ ID NO: 3837495 - DNA, 18 bp, Homo sapiens
atcaatagtgcaactgtt

SEQ ID NO: 3837496 - DNA, 22 bp, Homo sapiens
atcaatagtgcaactgttttga

SEQ ID NO: 3837497 - DNA, 14 bp, Homo sapiens
atcaatcattgtac

SEQ ID NO: 3837498 - DNA, 15 bp, Homo sapiens
atcaatcattgtaca

SEQ ID NO: 3837499 - DNA, 19 bp, Homo sapiens
atcaatcattgtacagttt

SEQ ID NO: 3837500 - DNA, 21 bp, Homo sapiens
atcaatcattgtacagtttgt

SEQ ID NO: 3837501 - DNA, 21 bp, Homo sapiens
atcaatccaaattccctctgg

SEQ ID NO: 3837502 - DNA, 13 bp, Homo sapiens
atcacatttgtga

SEQ ID NO: 3837503 - DNA, 19 bp, Homo sapiens
atcagactatgaagttttt

SEQ ID NO: 3837504 - DNA, 18 bp, Homo sapiens
atcagtgccccagatgta

SEQ ID NO: 3837505 - DNA, 23 bp, Homo sapiens
atcataatgtaactgaagcataa

SEQ ID NO: 3837506 - DNA, 17 bp, Homo sapiens
atcatgtgcatatatct

SEQ ID NO: 3837507 - DNA, 12 bp, Homo sapiens
atcatttcatgc

SEQ ID NO: 3837508 - DNA, 18 bp, Homo sapiens
atcatttcatgctttgat

SEQ ID NO: 3837509 - DNA, 18 bp, Homo sapiens
atccagaaagaaaacttg

SEQ ID NO: 3837510 - DNA, 22 bp, Homo sapiens
atccagctgggctagaggctga

SEQ ID NO: 3837511 - DNA, 19 bp, Homo sapiens
atccaggaaaatgtgaggg

SEQ ID NO: 3837512 - DNA, 13 bp, Homo sapiens
atccatcctgcta

SEQ ID NO: 3837513 - DNA, 15 bp, Homo sapiens
atccatgttgctgac

SEQ ID NO: 3837514 - DNA, 21 bp, Homo sapiens
atccatgttgctgacttttcc

SEQ ID NO: 3837515 - DNA, 20 bp, Homo sapiens
atcccaccgacccttcctgg

SEQ ID NO: 3837516 - DNA, 21 bp, Homo sapiens
atcccaccgacccttcctggc

SEQ ID NO: 3837517 - DNA, 12 bp, Homo sapiens
atcccaggacac

SEQ ID NO: 3837518 - DNA, 23 bp, Homo sapiens
atcccaggtgaggaatttgaagc

SEQ ID NO: 3837519 - DNA, 15 bp, Homo sapiens
atccccagggcagcc

SEQ ID NO: 3837520 - DNA, 18 bp, Homo sapiens
atccgcccgcctctgcct

SEQ ID NO: 3837521 - DNA, 17 bp, Homo sapiens
atcctaatagaaagaaa

SEQ ID NO: 3837522 - DNA, 15 bp, Homo sapiens
atcctaatttctcct

SEQ ID NO: 3837523 - DNA, 17 bp, Homo sapiens
atcctagggcctgggtt

SEQ ID NO: 3837524 - DNA, 19 bp, Homo sapiens
atcctgccttagagccagg

SEQ ID NO: 3837525 - DNA, 22 bp, Homo sapiens
atcctgccttagagccaggcac

SEQ ID NO: 3837526 - DNA, 19 bp, Homo sapiens
atcctgctagcacctcccc

SEQ ID NO: 3837527 - DNA, 19 bp, Homo sapiens
atcctgctgcatgacctat

SEQ ID NO: 3837528 - DNA, 17 bp, Homo sapiens
atcctggtattgtaata

SEQ ID NO: 3837529 - DNA, 13 bp, Homo sapiens
atcctttgcattt

SEQ ID NO: 3837530 - DNA, 23 bp, Homo sapiens
atccttttggcgtgatatccata

SEQ ID NO: 3837531 - DNA, 20 bp, Homo sapiens
atcgccaacttgtctctgta

SEQ ID NO: 3837532 - DNA, 21 bp, Homo sapiens
atcgccaacttgtctctgtag

SEQ ID NO: 3837533 - DNA, 19 bp, Homo sapiens
atcgccagctgatgactca

SEQ ID NO: 3837534 - DNA, 17 bp, Homo sapiens
atctagttcagaaggaa

SEQ ID NO: 3837535 - DNA, 13 bp, Homo sapiens
atctatgtgcacc

SEQ ID NO: 3837536 - DNA, 18 bp, Homo sapiens
atctcaaatacagtagta

SEQ ID NO: 3837537 - DNA, 21 bp, Homo sapiens
atctcaaatacagtagtataa

SEQ ID NO: 3837538 - DNA, 13 bp, Homo sapiens
atctcctttgcta

SEQ ID NO: 3837539 - DNA, 21 bp, Homo sapiens
atctgaactaattcatttatt

SEQ ID NO: 3837540 - DNA, 17 bp, Homo sapiens
atctgcaccccttctct

SEQ ID NO: 3837541 - DNA, 22 bp, Homo sapiens
atctgcaccccttctctcctcc

SEQ ID NO: 3837542 - DNA, 23 bp, Homo sapiens
atctgcaccccttctctcctccc

SEQ ID NO: 3837543 - DNA, 16 bp, Homo sapiens
agatggctccttggga

SEQ ID NO: 3837544 - DNA, 18 bp, Homo sapiens
agatgggaagcctgtgta

SEQ ID NO: 3837545 - DNA, 23 bp, Homo sapiens
agatggtaagacctctgagacca

SEQ ID NO: 3837546 - DNA, 21 bp, Homo sapiens
agatgtttctcattttaaaca

SEQ ID NO: 3837547 - DNA, 23 bp, Homo sapiens
agatgtttctcattttaaacaac

SEQ ID NO: 3837548 - DNA, 13 bp, Homo sapiens
agattaaaatatt

SEQ ID NO: 3837549 - DNA, 14 bp, Homo sapiens
agattaaaatattt

SEQ ID NO: 3837550 - DNA, 23 bp, Homo sapiens
agattaaatatatctttgtaaat

SEQ ID NO: 3837551 - DNA, 14 bp, Homo sapiens
agattataataaat

SEQ ID NO: 3837552 - DNA, 21 bp, Homo sapiens
agattcaggcttgcattaaaa

SEQ ID NO: 3837553 - DNA, 19 bp, Homo sapiens
agattttatgtgcttgaag

SEQ ID NO: 3837554 - DNA, 20 bp, Homo sapiens
agattttatgtgcttgaaga

SEQ ID NO: 3837555 - DNA, 15 bp, Homo sapiens
agattttgtgaaatt

SEQ ID NO: 3837556 - DNA, 16 bp, Homo sapiens
agattttgtgaaattt

SEQ ID NO: 3837557 - DNA, 18 bp, Homo sapiens
agattttgtgaaatttca

SEQ ID NO: 3837558 - DNA, 20 bp, Homo sapiens
agattttgtgaaatttcatg

SEQ ID NO: 3837559 - DNA, 15 bp, Homo sapiens
agcaaccagttggct

SEQ ID NO: 3837560 - DNA, 14 bp, Homo sapiens
agcaagtctgcagg

SEQ ID NO: 3837561 - DNA, 17 bp, Homo sapiens
agcaatgccacgattta

SEQ ID NO: 3837562 - DNA, 16 bp, Homo sapiens
agcaattttccttgaa

SEQ ID NO: 3837563 - DNA, 18 bp, Homo sapiens
agcaattttccttgaagc

SEQ ID NO: 3837564 - DNA, 20 bp, Homo sapiens
agcaattttccttgaagccg

SEQ ID NO: 3837565 - DNA, 21 bp, Homo sapiens
agcaattttccttgaagccga

SEQ ID NO: 3837566 - DNA, 20 bp, Homo sapiens
agcacagctgaggaccctca

SEQ ID NO: 3837567 - DNA, 23 bp, Homo sapiens
agcacagctgaggaccctcagcc

SEQ ID NO: 3837568 - DNA, 13 bp, Homo sapiens
agcacctccccag

SEQ ID NO: 3837569 - DNA, 15 bp, Homo sapiens
agcacctccccagac

SEQ ID NO: 3837570 - DNA, 18 bp, Homo sapiens
agcacctccccagacagg

SEQ ID NO: 3837571 - DNA, 21 bp, Homo sapiens
agcacctccccagacagggct

SEQ ID NO: 3837572 - DNA, 21 bp, Homo sapiens
agcacctgttgtgtgcctgac

SEQ ID NO: 3837573 - DNA, 13 bp, Homo sapiens
agcacctgttttt

SEQ ID NO: 3837574 - DNA, 18 bp, Homo sapiens
agcacgcgacttctcagg

SEQ ID NO: 3837575 - DNA, 11 bp, Homo sapiens
agcagaataaa

SEQ ID NO: 3837576 - DNA, 14 bp, Homo sapiens
agcagaataaagca

SEQ ID NO: 3837577 - DNA, 16 bp, Homo sapiens
agcagaataaagcaat

SEQ ID NO: 3837578 - DNA, 17 bp, Homo sapiens
agcagaataaagcaatt

SEQ ID NO: 3837579 - DNA, 19 bp, Homo sapiens
agcagagcaagtctgcagg

SEQ ID NO: 3837580 - DNA, 17 bp, Homo sapiens
agcagataaggccgagc

SEQ ID NO: 3837581 - DNA, 23 bp, Homo sapiens
agcagataaggccgagcccacac

SEQ ID NO: 3837582 - DNA, 15 bp, Homo sapiens
agcaggagattgaga

SEQ ID NO: 3837583 - DNA, 18 bp, Homo sapiens
agcaggagattgagaagg

SEQ ID NO: 3837584 - DNA, 19 bp, Homo sapiens
agcaggagattgagaagga

SEQ ID NO: 3837585 - DNA, 14 bp, Homo sapiens
agcaggcccaggag

SEQ ID NO: 3837586 - DNA, 15 bp, Homo sapiens
agcaggcccaggaga

SEQ ID NO: 3837587 - DNA, 16 bp, Homo sapiens
agcaggcccaggagaa

SEQ ID NO: 3837588 - DNA, 19 bp, Homo sapiens
agcaggggctacaagaggg

SEQ ID NO: 3837589 - DNA, 23 bp, Homo sapiens
agcagttcccaaggacagtcagc

SEQ ID NO: 3837590 - DNA, 14 bp, Homo sapiens
agcagtttttgaaa

SEQ ID NO: 3837591 - DNA, 14 bp, Homo sapiens
agcataaacatcac

SEQ ID NO: 3837592 - DNA, 16 bp, Homo sapiens
agcatagaaggcaggt

SEQ ID NO: 3837593 - DNA, 22 bp, Homo sapiens
agcatcctgccttagagccagg

SEQ ID NO: 3837594 - DNA, 20 bp, Homo sapiens
agcatgttgtgatgtacaca

SEQ ID NO: 3837595 - DNA, 13 bp, Homo sapiens
agccaaagaaaaa

SEQ ID NO: 3837596 - DNA, 17 bp, Homo sapiens
agccaactatggcctgt

SEQ ID NO: 3837597 - DNA, 20 bp, Homo sapiens
agccaagtggggtgctggga

SEQ ID NO: 3837598 - DNA, 16 bp, Homo sapiens
agccacacagcccaga

SEQ ID NO: 3837599 - DNA, 14 bp, Homo sapiens
agccacacagtggc

SEQ ID NO: 3837600 - DNA, 15 bp, Homo sapiens
agccaccacacactg

SEQ ID NO: 3837601 - DNA, 19 bp, Homo sapiens
agccactgctggtgtttat

SEQ ID NO: 3837602 - DNA, 23 bp, Homo sapiens
agccagatccccagggcagcctc

SEQ ID NO: 3837603 - DNA, 18 bp, Homo sapiens
agccagccttcttccatc

SEQ ID NO: 3837604 - DNA, 23 bp, Homo sapiens
agccagccttcttccatcccagg

SEQ ID NO: 3837605 - DNA, 18 bp, Homo sapiens
agccagctacaggcttga

SEQ ID NO: 3837606 - DNA, 19 bp, Homo sapiens
agccaggaggaaactacac

SEQ ID NO: 3837607 - DNA, 11 bp, Homo sapiens
agccaggcaca

SEQ ID NO: 3837608 - DNA, 21 bp, Homo sapiens
agccaggcaggtagccagggg

SEQ ID NO: 3837609 - DNA, 22 bp, Homo sapiens
agccagggggactagcccctgt

SEQ ID NO: 3837610 - DNA, 13 bp, Homo sapiens
agcccagaaggcc

SEQ ID NO: 3837611 - DNA, 14 bp, Homo sapiens
agcccagaaggcca

SEQ ID NO: 3837612 - DNA, 16 bp, Homo sapiens
agcccaggagagagaa

SEQ ID NO: 3837613 - DNA, 22 bp, Homo sapiens
agcccaggagagagaaagccag

SEQ ID NO: 3837614 - DNA, 15 bp, Homo sapiens
agcccaggcctggtg

SEQ ID NO: 3837615 - DNA, 20 bp, Homo sapiens
agcccatccctgcctggtca

SEQ ID NO: 3837616 - DNA, 22 bp, Homo sapiens
agccccacccccagccaggcta

SEQ ID NO: 3837617 - DNA, 16 bp, Homo sapiens
agccccagagcagggt

SEQ ID NO: 3837618 - DNA, 14 bp, Homo sapiens
agccccaggagaag

SEQ ID NO: 3837619 - DNA, 14 bp, Homo sapiens
agccccatgctgga

SEQ ID NO: 3837620 - DNA, 18 bp, Homo sapiens
agccccgcagacctcccc

SEQ ID NO: 3837621 - DNA, 12 bp, Homo sapiens
agcccctagccc

SEQ ID NO: 3837622 - DNA, 14 bp, Homo sapiens
agcccctagcccag

SEQ ID NO: 3837623 - DNA, 22 bp, Homo sapiens
agcccctagcccaggagagaga

SEQ ID NO: 3837624 - DNA, 15 bp, Homo sapiens
agcccctgtggagac

SEQ ID NO: 3837625 - DNA, 18 bp, Homo sapiens
agcccctgtggagactgg

SEQ ID NO: 3837626 - DNA, 15 bp, Homo sapiens
agccctggaggtgcc

SEQ ID NO: 3837627 - DNA, 18 bp, Homo sapiens
agccctggaggtgccagc

SEQ ID NO: 3837628 - DNA, 22 bp, Homo sapiens
agccctggaggtgccagcaaag

SEQ ID NO: 3837629 - DNA, 13 bp, Homo sapiens
agcccttgcctcc

SEQ ID NO: 3837630 - DNA, 12 bp, Homo sapiens
agcccttggcca

SEQ ID NO: 3837631 - DNA, 13 bp, Homo sapiens
agccgactcagca

SEQ ID NO: 3837632 - DNA, 18 bp, Homo sapiens
agccgcctcggagtgtgg

SEQ ID NO: 3837633 - DNA, 22 bp, Homo sapiens
agccgctcccggttccctcccc

SEQ ID NO: 3837634 - DNA, 23 bp, Homo sapiens
agccgctcccggttccctcccca

SEQ ID NO: 3837635 - DNA, 21 bp, Homo sapiens
agccggcccaacccaaccact

SEQ ID NO: 3837636 - DNA, 16 bp, Homo sapiens
agccgggcccctgggc

SEQ ID NO: 3837637 - DNA, 17 bp, Homo sapiens
agccgggcccctgggct

SEQ ID NO: 3837638 - DNA, 11 bp, Homo sapiens
agcctcagtcc

SEQ ID NO: 3837639 - DNA, 18 bp, Homo sapiens
agcctcagtcctcccctc

SEQ ID NO: 3837640 - DNA, 20 bp, Homo sapiens
agcctcagtcctcccctcac

SEQ ID NO: 3837641 - DNA, 14 bp, Homo sapiens
agcctccagtctgc

SEQ ID NO: 3837642 - DNA, 15 bp, Homo sapiens
agcctccctctcctc

SEQ ID NO: 3837643 - DNA, 12 bp, Homo sapiens
agcctcctctgg

SEQ ID NO: 3837644 - DNA, 18 bp, Homo sapiens
agcctcctctggacggca

SEQ ID NO: 3837645 - DNA, 14 bp, Homo sapiens
agcctcgttaggac

SEQ ID NO: 3837646 - DNA, 23 bp, Homo sapiens
agcctcgttaggacaaggctgtg

SEQ ID NO: 3837647 - DNA, 12 bp, Homo sapiens
agcctctgaccc

SEQ ID NO: 3837648 - DNA, 18 bp, Homo sapiens
agcctctgacccctcctc

SEQ ID NO: 3837649 - DNA, 20 bp, Homo sapiens
agcctctgacccctcctcac

SEQ ID NO: 3837650 - DNA, 19 bp, Homo sapiens
agcctgaaatcatctttgt

SEQ ID NO: 3837651 - DNA, 16 bp, Homo sapiens
agcctgcgggaagctg

SEQ ID NO: 3837652 - DNA, 22 bp, Homo sapiens
agcctgcgggaagctgaccttt

SEQ ID NO: 3837653 - DNA, 17 bp, Homo sapiens
agcctgctgcctgcttt

SEQ ID NO: 3837654 - DNA, 14 bp, Homo sapiens
agcctggacgcagc

SEQ ID NO: 3837655 - DNA, 17 bp, Homo sapiens
agcctggacgcagccac

SEQ ID NO: 3837656 - DNA, 19 bp, Homo sapiens
agcctggagggaagttggg

SEQ ID NO: 3837657 - DNA, 18 bp, Homo sapiens
agcctggccatgtcctca

SEQ ID NO: 3837658 - DNA, 23 bp, Homo sapiens
agcctgggcctcctcctagctgg

SEQ ID NO: 3837659 - DNA, 20 bp, Homo sapiens
agcctgtcggccacacccca

SEQ ID NO: 3837660 - DNA, 21 bp, Homo sapiens
agcctgtcggccacaccccag

SEQ ID NO: 3837661 - DNA, 15 bp, Homo sapiens
agcctgtgtaacagc

SEQ ID NO: 3837662 - DNA, 16 bp, Homo sapiens
agcctgtgtaacagct

SEQ ID NO: 3837663 - DNA, 13 bp, Homo sapiens
agcctgtttaaga

SEQ ID NO: 3837664 - DNA, 20 bp, Homo sapiens
agccttcttccatcccagga

SEQ ID NO: 3837665 - DNA, 22 bp, Homo sapiens
agccttcttccatcccaggaca

SEQ ID NO: 3837666 - DNA, 21 bp, Homo sapiens
agcgacatagcccatccctgc

SEQ ID NO: 3837667 - DNA, 18 bp, Homo sapiens
agcgcattgttttgcatc

SEQ ID NO: 3837668 - DNA, 13 bp, Homo sapiens
agcggtctcaggc

SEQ ID NO: 3837669 - DNA, 12 bp, Homo sapiens
agcggtggccct

SEQ ID NO: 3837670 - DNA, 15 bp, Homo sapiens
agcggtggccctgtc

SEQ ID NO: 3837671 - DNA, 14 bp, Homo sapiens
agctaataaaatat

SEQ ID NO: 3837672 - DNA, 21 bp, Homo sapiens
agctaataaaatatcattcag

SEQ ID NO: 3837673 - DNA, 12 bp, Homo sapiens
agctaataaacc

SEQ ID NO: 3837674 - DNA, 15 bp, Homo sapiens
agctaatactaatag

SEQ ID NO: 3837675 - DNA, 13 bp, Homo sapiens
agctacaggcttg

SEQ ID NO: 3837676 - DNA, 23 bp, Homo sapiens
agctacttgggaggttgaagcag

SEQ ID NO: 3837677 - DNA, 20 bp, Homo sapiens
agctcaagaggaaaagctaa

SEQ ID NO: 3837678 - DNA, 11 bp, Homo sapiens
agctcagaaag

SEQ ID NO: 3837679 - DNA, 15 bp, Homo sapiens
agctcatctgccaaa

SEQ ID NO: 3837680 - DNA, 15 bp, Homo sapiens
agctccagatgtttc

SEQ ID NO: 3837681 - DNA, 12 bp, Homo sapiens
agctccagccac

SEQ ID NO: 3837682 - DNA, 22 bp, Homo sapiens
agctcctccgtgcttcctcagt

SEQ ID NO: 3837683 - DNA, 13 bp, Homo sapiens
agctcctgtttgg

SEQ ID NO: 3837684 - DNA, 19 bp, Homo sapiens
agctccttgggaggaagca

SEQ ID NO: 3837685 - DNA, 22 bp, Homo sapiens
agctccttgggaggaagcagaa

SEQ ID NO: 3837686 - DNA, 23 bp, Homo sapiens
agctccttgggaggaagcagaat

SEQ ID NO: 3837687 - DNA, 12 bp, Homo sapiens
agctgaagcctg

SEQ ID NO: 3837688 - DNA, 13 bp, Homo sapiens
agctgaagcctgg

SEQ ID NO: 3837689 - DNA, 15 bp, Homo sapiens
agctgaagcctggac

SEQ ID NO: 3837690 - DNA, 23 bp, Homo sapiens
agctgaagcctggacgcagccac

SEQ ID NO: 3837691 - DNA, 17 bp, Homo sapiens
agctgaccacaggcagt

SEQ ID NO: 3837692 - DNA, 14 bp, Homo sapiens
agctgactttcatt

SEQ ID NO: 3837693 - DNA, 16 bp, Homo sapiens
agctgaggaccctcag

SEQ ID NO: 3837694 - DNA, 14 bp, Homo sapiens
agctgagtcctggg

SEQ ID NO: 3837695 - DNA, 16 bp, Homo sapiens
agctgagtcctggggt

SEQ ID NO: 3837696 - DNA, 11 bp, Homo sapiens
agctgatgact

SEQ ID NO: 3837697 - DNA, 12 bp, Homo sapiens
agctgccaggga

SEQ ID NO: 3837698 - DNA, 13 bp, Homo sapiens
agctgccagggaa

SEQ ID NO: 3837699 - DNA, 15 bp, Homo sapiens
agctgccagggaaga

SEQ ID NO: 3837700 - DNA, 20 bp, Homo sapiens
agctgccagggaagacagag

SEQ ID NO: 3837701 - DNA, 19 bp, Homo sapiens
agctgccttccctagcttt

SEQ ID NO: 3837702 - DNA, 16 bp, Homo sapiens
agctgctggccatggc

SEQ ID NO: 3837703 - DNA, 18 bp, Homo sapiens
agctgctggccatggctg

SEQ ID NO: 3837704 - DNA, 20 bp, Homo sapiens
agctgctggccatggctgct

SEQ ID NO: 3837705 - DNA, 18 bp, Homo sapiens
agctgcttaacagttgct

SEQ ID NO: 3837706 - DNA, 14 bp, Homo sapiens
agctgggagggagg

SEQ ID NO: 3837707 - DNA, 17 bp, Homo sapiens
agctggggctgagggat

SEQ ID NO: 3837708 - DNA, 16 bp, Homo sapiens
agctgtgagccttggc

SEQ ID NO: 3837709 - DNA, 18 bp, Homo sapiens
agctgtgagccttggctg

SEQ ID NO: 3837710 - DNA, 16 bp, Homo sapiens
agcttattaatgctaa

SEQ ID NO: 3837711 - DNA, 20 bp, Homo sapiens
agcttcaccacttgtccatt

SEQ ID NO: 3837712 - DNA, 14 bp, Homo sapiens
agcttcactcagct

SEQ ID NO: 3837713 - DNA, 14 bp, Homo sapiens
agcttctctctgag

SEQ ID NO: 3837714 - DNA, 19 bp, Homo sapiens
agcttctgcttttctgccc

SEQ ID NO: 3837715 - DNA, 22 bp, Homo sapiens
agcttctgcttttctgccctgg

SEQ ID NO: 3837716 - DNA, 23 bp, Homo sapiens
agcttctgcttttctgccctggc

SEQ ID NO: 3837717 - DNA, 21 bp, Homo sapiens
agcttgagccgggcccctggg

SEQ ID NO: 3837718 - DNA, 19 bp, Homo sapiens
agcttgcctcagggccaag

SEQ ID NO: 3837719 - DNA, 12 bp, Homo sapiens
agcttgtgcctt

SEQ ID NO: 3837720 - DNA, 13 bp, Homo sapiens
agctttagaccct

SEQ ID NO: 3837721 - DNA, 16 bp, Homo sapiens
agctttagaccctggg

SEQ ID NO: 3837722 - DNA, 17 bp, Homo sapiens
agctttagaccctgggt

SEQ ID NO: 3837723 - DNA, 18 bp, Homo sapiens
agcttttggagagtgggc

SEQ ID NO: 3837724 - DNA, 18 bp, Homo sapiens
agcttttggagagtgggt

SEQ ID NO: 3837725 - DNA, 19 bp, Homo sapiens
aggaaaatgtgaggggaat

SEQ ID NO: 3837726 - DNA, 23 bp, Homo sapiens
aggaaaccagttaggtctcaata

SEQ ID NO: 3837727 - DNA, 21 bp, Homo sapiens
aggaaaggtttggaaaactaa

SEQ ID NO: 3837728 - DNA, 22 bp, Homo sapiens
aggaaaggtttggaaaactaac

SEQ ID NO: 3837729 - DNA, 17 bp, Homo sapiens
aggaaatttatacaaag

SEQ ID NO: 3837730 - DNA, 18 bp, Homo sapiens
aggaaatttatacaaaga

SEQ ID NO: 3837731 - DNA, 22 bp, Homo sapiens
aggaaatttatacaaagaaact

SEQ ID NO: 3837732 - DNA, 18 bp, Homo sapiens
aggaactctgtgtgagag

SEQ ID NO: 3837733 - DNA, 19 bp, Homo sapiens
aggaactctgtgtgagaga

SEQ ID NO: 3837734 - DNA, 11 bp, Homo sapiens
aggaagcagaa

SEQ ID NO: 3837735 - DNA, 13 bp, Homo sapiens
aggaagcagaata

SEQ ID NO: 3837736 - DNA, 23 bp, Homo sapiens
aggaagcagaataaagcaatttt

SEQ ID NO: 3837737 - DNA, 20 bp, Homo sapiens
aggaaggccatggggcagcc

SEQ ID NO: 3837738 - DNA, 13 bp, Homo sapiens
aggaatttgaagc

SEQ ID NO: 3837739 - DNA, 17 bp, Homo sapiens
aggaatttgaagctcag

SEQ ID NO: 3837740 - DNA, 14 bp, Homo sapiens
aggacaaggctgtg

SEQ ID NO: 3837741 - DNA, 16 bp, Homo sapiens
aggacaaggctgtgcc

SEQ ID NO: 3837742 - DNA, 19 bp, Homo sapiens
aggacaaggctgtgccagg

SEQ ID NO: 3837743 - DNA, 22 bp, Homo sapiens
aggacaaggctgtgccaggctg

SEQ ID NO: 3837744 - DNA, 17 bp, Homo sapiens
aggacaccacacccagc

SEQ ID NO: 3837745 - DNA, 23 bp, Homo sapiens
aggacaccacacccagcctcagt

SEQ ID NO: 3837746 - DNA, 15 bp, Homo sapiens
aggacctcagctgct

SEQ ID NO: 3837747 - DNA, 14 bp, Homo sapiens
aggacctccatgcc

SEQ ID NO: 3837748 - DNA, 13 bp, Homo sapiens
aggacctgagcct

SEQ ID NO: 3837749 - DNA, 15 bp, Homo sapiens
aggacctgagcctgg

SEQ ID NO: 3837750 - DNA, 17 bp, Homo sapiens
aggactcaacattacat

SEQ ID NO: 3837751 - DNA, 13 bp, Homo sapiens
aggactgagcccc

SEQ ID NO: 3837752 - DNA, 24 bp, Homo sapiens
aggactgagccccgcagacctccc

SEQ ID NO: 3837753 - DNA, 20 bp, Homo sapiens
aggactggtaggaaaaagct

SEQ ID NO: 3837754 - DNA, 16 bp, Homo sapiens
aggactgtggagggga

SEQ ID NO: 3837755 - DNA, 17 bp, Homo sapiens
aggactgtggaggggag

SEQ ID NO: 3837756 - DNA, 21 bp, Homo sapiens
aggactgtggaggggagctgc

SEQ ID NO: 3837757 - DNA, 12 bp, Homo sapiens
aggagaccaccc

SEQ ID NO: 3837758 - DNA, 14 bp, Homo sapiens
aggagaccaccccc

SEQ ID NO: 3837759 - DNA, 18 bp, Homo sapiens
aggagaccacccccgagc

SEQ ID NO: 3837760 - DNA, 18 bp, Homo sapiens
aggagagagaaagccagg

SEQ ID NO: 3837761 - DNA, 14 bp, Homo sapiens
aggagagaggcaga

SEQ ID NO: 3837762 - DNA, 16 bp, Homo sapiens
aggagattgagaagga

SEQ ID NO: 3837763 - DNA, 17 bp, Homo sapiens
aggagattgagaaggag

SEQ ID NO: 3837764 - DNA, 21 bp, Homo sapiens
aggagattgagaaggagagaa

SEQ ID NO: 3837765 - DNA, 13 bp, Homo sapiens
aggagcagaataa

SEQ ID NO: 3837766 - DNA, 13 bp, Homo sapiens
aggagctttgctc

SEQ ID NO: 3837767 - DNA, 14 bp, Homo sapiens
aggaggaaggcaag

SEQ ID NO: 3837768 - DNA, 18 bp, Homo sapiens
aggagggccctgaggaat

SEQ ID NO: 3837769 - DNA, 20 bp, Homo sapiens
aggagggccctgaggaataa

SEQ ID NO: 3837770 - DNA, 14 bp, Homo sapiens
aggagggctttgtg

SEQ ID NO: 3837771 - DNA, 20 bp, Homo sapiens
aggaggtggaggttgcagtg

SEQ ID NO: 3837772 - DNA, 19 bp, Homo sapiens
aggagtcttatatcccagg

SEQ ID NO: 3837773 - DNA, 17 bp, Homo sapiens
aggagtggccctgatcc

SEQ ID NO: 3837774 - DNA, 13 bp, Homo sapiens
aggagttagccaa

SEQ ID NO: 3837775 - DNA, 19 bp, Homo sapiens
aggagtttcgttttcaaaa

SEQ ID NO: 3837776 - DNA, 12 bp, Homo sapiens
aggatcctggta

SEQ ID NO: 3837777 - DNA, 15 bp, Homo sapiens
aggatcggcttcctc

SEQ ID NO: 3837778 - DNA, 20 bp, Homo sapiens
aggatcggcttcctcagggg

SEQ ID NO: 3837779 - DNA, 19 bp, Homo sapiens
aggatggtggggcccccag

SEQ ID NO: 3837780 - DNA, 22 bp, Homo sapiens
aggatggtggggcccccagcac

SEQ ID NO: 3837781 - DNA, 18 bp, Homo sapiens
aggattagacagtaagag

SEQ ID NO: 3837782 - DNA, 15 bp, Homo sapiens
aggatttttaaaact

SEQ ID NO: 3837783 - DNA, 23 bp, Homo sapiens
aggatttttaaaactcagattta

SEQ ID NO: 3837784 - DNA, 15 bp, Homo sapiens
aggcaaggatggtgg

SEQ ID NO: 3837785 - DNA, 21 bp, Homo sapiens
aggcacacactgtgctttcta

SEQ ID NO: 3837786 - DNA, 13 bp, Homo sapiens
aggcactagcctt

SEQ ID NO: 3837787 - DNA, 15 bp, Homo sapiens
aggcactagcctttg

SEQ ID NO: 3837788 - DNA, 23 bp, Homo sapiens
aggcactagcctttggctctgga

SEQ ID NO: 3837789 - DNA, 15 bp, Homo sapiens
aggcagaagaagctg

SEQ ID NO: 3837790 - DNA, 16 bp, Homo sapiens
aggcagaagaagctgg

SEQ ID NO: 3837791 - DNA, 9 bp, Homo sapiens
aggcagaga

SEQ ID NO: 3837792 - DNA, 11 bp, Homo sapiens
aggcagagagc

SEQ ID NO: 3837793 - DNA, 15 bp, Homo sapiens
aggcagccagatccc

SEQ ID NO: 3837794 - DNA, 17 bp, Homo sapiens
aggcagccagatcccca

SEQ ID NO: 3837795 - DNA, 21 bp, Homo sapiens
aggcagccagatccccagggc

SEQ ID NO: 3837796 - DNA, 23 bp, Homo sapiens
aggcagccagatccccagggcag

SEQ ID NO: 3837797 - DNA, 16 bp, Homo sapiens
aggcagcgcattgttt

SEQ ID NO: 3837798 - DNA, 21 bp, Homo sapiens
aggcagcgcattgttttgcat

SEQ ID NO: 3837799 - DNA, 15 bp, Homo sapiens
aggcagctcctgttt

SEQ ID NO: 3837800 - DNA, 16 bp, Homo sapiens
aggcagctcctgtttg

SEQ ID NO: 3837801 - DNA, 20 bp, Homo sapiens
aggcaggagtttcgttttca

SEQ ID NO: 3837802 - DNA, 16 bp, Homo sapiens
aggcaggggtgggggt

SEQ ID NO: 3837803 - DNA, 19 bp, Homo sapiens
aggcaggggtgggggtgga

SEQ ID NO: 3837804 - DNA, 15 bp, Homo sapiens
aggcaggtagccagg

SEQ ID NO: 3837805 - DNA, 15 bp, Homo sapiens
aggcatagaggcttc

SEQ ID NO: 3837806 - DNA, 22 bp, Homo sapiens
aggcatagaggcttctccgcca

SEQ ID NO: 3837807 - DNA, 16 bp, Homo sapiens
aggccagaaaaggcag

SEQ ID NO: 3837808 - DNA, 18 bp, Homo sapiens
aggccagaaaaggcagcc

SEQ ID NO: 3837809 - DNA, 19 bp, Homo sapiens
aggccagaaaaggcagcca

SEQ ID NO: 3837810 - DNA, 22 bp, Homo sapiens
aggccagaaaaggcagccagat

SEQ ID NO: 3837811 - DNA, 18 bp, Homo sapiens
aggccagcctccgagagg

SEQ ID NO: 3837812 - DNA, 22 bp, Homo sapiens
aggccagcctccgagagggaga

SEQ ID NO: 3837813 - DNA, 22 bp, Homo sapiens
aggccagcctgcgggaagctga

SEQ ID NO: 3837814 - DNA, 18 bp, Homo sapiens
aggccaggatgcctgagc

SEQ ID NO: 3837815 - DNA, 13 bp, Homo sapiens
aggccatggggca

SEQ ID NO: 3837816 - DNA, 15 bp, Homo sapiens
aggccatggggcagc

SEQ ID NO: 3837817 - DNA, 16 bp, Homo sapiens
aggccatggggcagcc

SEQ ID NO: 3837818 - DNA, 19 bp, Homo sapiens
aggccatggggcagcctcc

SEQ ID NO: 3837819 - DNA, 23 bp, Homo sapiens
aggccatggggcagcctccagtc

SEQ ID NO: 3837820 - DNA, 22 bp, Homo sapiens
aggcccaaattatcaagctaat

SEQ ID NO: 3837821 - DNA, 18 bp, Homo sapiens
aggcccccgttgaagccg

SEQ ID NO: 3837822 - DNA, 14 bp, Homo sapiens
aggccccctttcta

SEQ ID NO: 3837823 - DNA, 17 bp, Homo sapiens
aggccctttcctcaggc

SEQ ID NO: 3837824 - DNA, 13 bp, Homo sapiens
aggccgaggtagg

SEQ ID NO: 3837825 - DNA, 17 bp, Homo sapiens
aggctagcttctgcttt

SEQ ID NO: 3837826 - DNA, 12 bp, Homo sapiens
aggctcactgcc

SEQ ID NO: 3837827 - DNA, 13 bp, Homo sapiens
aggctcactgcca

SEQ ID NO: 3837828 - DNA, 16 bp, Homo sapiens
aggctcactgccaggc

SEQ ID NO: 3837829 - DNA, 19 bp, Homo sapiens
aggctcactgccaggccag

SEQ ID NO: 3837830 - DNA, 19 bp, Homo sapiens
aggctcagccctgagctgg

SEQ ID NO: 3837831 - DNA, 16 bp, Homo sapiens
aggctcctggtggggc

SEQ ID NO: 3837832 - DNA, 17 bp, Homo sapiens
aggctcctggtggggca

SEQ ID NO: 3837833 - DNA, 12 bp, Homo sapiens
aggctcggggct

SEQ ID NO: 3837834 - DNA, 15 bp, Homo sapiens
aggctcggggctccc

SEQ ID NO: 3837835 - DNA, 19 bp, Homo sapiens
aggctctcatgtctctttg

SEQ ID NO: 3837836 - DNA, 14 bp, Homo sapiens
aggctgagcacctt

SEQ ID NO: 3837837 - DNA, 12 bp, Homo sapiens
aggctgaggcag

SEQ ID NO: 3837838 - DNA, 17 bp, Homo sapiens
aggctggcccccaccca

SEQ ID NO: 3837839 - DNA, 23 bp, Homo sapiens
aggctggcccccacccaccttcc

SEQ ID NO: 3837840 - DNA, 16 bp, Homo sapiens
aggcttctccgccagc

SEQ ID NO: 3837841 - DNA, 19 bp, Homo sapiens
aggcttctccgccagcctc

SEQ ID NO: 3837842 - DNA, 21 bp, Homo sapiens
aggcttctccgccagcctcct

SEQ ID NO: 3837843 - DNA, 20 bp, Homo sapiens
aggcttgcattaaaagactg

SEQ ID NO: 3837844 - DNA, 21 bp, Homo sapiens
aggcttgcattaaaagactgt

SEQ ID NO: 3837845 - DNA, 15 bp, Homo sapiens
agggaaaggggtgct

SEQ ID NO: 3837846 - DNA, 18 bp, Homo sapiens
agggaaaggggtgctttt

SEQ ID NO: 3837847 - DNA, 13 bp, Homo sapiens
agggaacatcctg

SEQ ID NO: 3837848 - DNA, 16 bp, Homo sapiens
agggaagacagagcag

SEQ ID NO: 3837849 - DNA, 16 bp, Homo sapiens
agggaatgtgagcaca

SEQ ID NO: 3837850 - DNA, 22 bp, Homo sapiens
agggacaaaaggtactggtgag

SEQ ID NO: 3837851 - DNA, 12 bp, Homo sapiens
agggacacagga

SEQ ID NO: 3837852 - DNA, 20 bp, Homo sapiens
agggacacaggagaccaccc

SEQ ID NO: 3837853 - DNA, 18 bp, Homo sapiens
agggacagggccatgggg

SEQ ID NO: 3837854 - DNA, 16 bp, Homo sapiens
agggagaagaaaggtg

SEQ ID NO: 3837855 - DNA, 22 bp, Homo sapiens
agggagagagagagagagagga

SEQ ID NO: 3837856 - DNA, 13 bp, Homo sapiens
agggagagggagg

SEQ ID NO: 3837857 - DNA, 19 bp, Homo sapiens
agggagcatagaaggcagg

SEQ ID NO: 3837858 - DNA, 16 bp, Homo sapiens
agggagggggaggtga

SEQ ID NO: 3837859 - DNA, 22 bp, Homo sapiens
agggagggggaggtgaaaaggg

SEQ ID NO: 3837860 - DNA, 19 bp, Homo sapiens
agggagggtggcagagaca

SEQ ID NO: 3837861 - DNA, 23 bp, Homo sapiens
agggagggtggcagagacagtgg

SEQ ID NO: 3837862 - DNA, 17 bp, Homo sapiens
agggatggactgatgct

SEQ ID NO: 3837863 - DNA, 12 bp, Homo sapiens
agggcagaggca

SEQ ID NO: 3837864 - DNA, 15 bp, Homo sapiens
agggcagaggcaagg

SEQ ID NO: 3837865 - DNA, 14 bp, Homo sapiens
agggccaagccggc

SEQ ID NO: 3837866 - DNA, 17 bp, Homo sapiens
agggccctctggggctc

SEQ ID NO: 3837867 - DNA, 14 bp, Homo sapiens
agggccctgaggaa

SEQ ID NO: 3837868 - DNA, 22 bp, Homo sapiens
agggccctgaggaataaagctt

SEQ ID NO: 3837869 - DNA, 21 bp, Homo sapiens
agggcctgaggtctggctgct

SEQ ID NO: 3837870 - DNA, 18 bp, Homo sapiens
agggcgcccagcccaggc

SEQ ID NO: 3837871 - DNA, 13 bp, Homo sapiens
agggctccagcct

SEQ ID NO: 3837872 - DNA, 22 bp, Homo sapiens
agggctccagcctgtcggccac

SEQ ID NO: 3837873 - DNA, 13 bp, Homo sapiens
aggggaatgtttt

SEQ ID NO: 3837874 - DNA, 17 bp, Homo sapiens
ccccatgctggagcctg

SEQ ID NO: 3837875 - DNA, 21 bp, Homo sapiens
ccccatgctggagcctgtgta

SEQ ID NO: 3837876 - DNA, 23 bp, Homo sapiens
ccccatgctggagcctgtgtaac

SEQ ID NO: 3837877 - DNA, 20 bp, Homo sapiens
ccccatttcccatctgcacc

SEQ ID NO: 3837878 - DNA, 20 bp, Homo sapiens
cccccaccccggggaccctg

SEQ ID NO: 3837879 - DNA, 11 bp, Homo sapiens
cccccagccag

SEQ ID NO: 3837880 - DNA, 12 bp, Homo sapiens
cccccagccagg

SEQ ID NO: 3837881 - DNA, 23 bp, Homo sapiens
cccccgagcttgcctcagggcca

SEQ ID NO: 3837882 - DNA, 15 bp, Homo sapiens
cccccgcatcccctg

SEQ ID NO: 3837883 - DNA, 13 bp, Homo sapiens
ccccctgccctgc

SEQ ID NO: 3837884 - DNA, 24 bp, Homo sapiens
ccccgatgtgagccgcctcggagt

SEQ ID NO: 3837885 - DNA, 13 bp, Homo sapiens
ccccgcccagccc

SEQ ID NO: 3837886 - DNA, 16 bp, Homo sapiens
ccccggaagtgcctta

SEQ ID NO: 3837887 - DNA, 16 bp, Homo sapiens
ccccggccacctctgc

SEQ ID NO: 3837888 - DNA, 17 bp, Homo sapiens
ccccggccacctctgcg

SEQ ID NO: 3837889 - DNA, 18 bp, Homo sapiens
ccccgtagccccggcccc

SEQ ID NO: 3837890 - DNA, 20 bp, Homo sapiens
ccccgttgaagccgctcccg

SEQ ID NO: 3837891 - DNA, 12 bp, Homo sapiens
cccctagcccag

SEQ ID NO: 3837892 - DNA, 13 bp, Homo sapiens
cccctagcccagg

SEQ ID NO: 3837893 - DNA, 17 bp, Homo sapiens
cccctagcccaggagag

SEQ ID NO: 3837894 - DNA, 20 bp, Homo sapiens
cccctagcccaggagagaga

SEQ ID NO: 3837895 - DNA, 13 bp, Homo sapiens
cccctcacagcct

SEQ ID NO: 3837896 - DNA, 17 bp, Homo sapiens
cccctcacagcctctga

SEQ ID NO: 3837897 - DNA, 18 bp, Homo sapiens
cccctcacagcctctgac

SEQ ID NO: 3837898 - DNA, 20 bp, Homo sapiens
cccctcacagcctctgaccc

SEQ ID NO: 3837899 - DNA, 12 bp, Homo sapiens
cccctccccact

SEQ ID NO: 3837900 - DNA, 13 bp, Homo sapiens
cccctcccctgct

SEQ ID NO: 3837901 - DNA, 12 bp, Homo sapiens
cccctcctcact

SEQ ID NO: 3837902 - DNA, 13 bp, Homo sapiens
cccctcctcactg

SEQ ID NO: 3837903 - DNA, 13 bp, Homo sapiens
cccctgccctgag

SEQ ID NO: 3837904 - DNA, 15 bp, Homo sapiens
cccctgccctgagga

SEQ ID NO: 3837905 - DNA, 20 bp, Homo sapiens
cccctgccctgaggagggcc

SEQ ID NO: 3837906 - DNA, 12 bp, Homo sapiens
cccctgccctgc

SEQ ID NO: 3837907 - DNA, 16 bp, Homo sapiens
cccctgggcttggcct

SEQ ID NO: 3837908 - DNA, 18 bp, Homo sapiens
cccctgggcttggcctgc

SEQ ID NO: 3837909 - DNA, 21 bp, Homo sapiens
cccctgggcttggcctgctgt

SEQ ID NO: 3837910 - DNA, 13 bp, Homo sapiens
cccctgtcctcac

SEQ ID NO: 3837911 - DNA, 17 bp, Homo sapiens
ccccttggatcaagcag

SEQ ID NO: 3837912 - DNA, 16 bp, Homo sapiens
cccgatgtgagccgcc

SEQ ID NO: 3837913 - DNA, 17 bp, Homo sapiens
cccgatgtgagccgcct

SEQ ID NO: 3837914 - DNA, 19 bp, Homo sapiens
cccgcacagagctggggct

SEQ ID NO: 3837915 - DNA, 18 bp, Homo sapiens
cccgcagacctccccagc

SEQ ID NO: 3837916 - DNA, 19 bp, Homo sapiens
cccgcatcccctgcctcca

SEQ ID NO: 3837917 - DNA, 19 bp, Homo sapiens
cccgcatggtttttataat

SEQ ID NO: 3837918 - DNA, 16 bp, Homo sapiens
cccgccacctccccac

SEQ ID NO: 3837919 - DNA, 20 bp, Homo sapiens
cccggccacctctgcggacc

SEQ ID NO: 3837920 - DNA, 19 bp, Homo sapiens
cccggcccccgcccagccc

SEQ ID NO: 3837921 - DNA, 15 bp, Homo sapiens
cccggcctccctccc

SEQ ID NO: 3837922 - DNA, 15 bp, Homo sapiens
cccgggccctcctgg

SEQ ID NO: 3837923 - DNA, 21 bp, Homo sapiens
cccgggccctcctgggcaccc

SEQ ID NO: 3837924 - DNA, 17 bp, Homo sapiens
cccggttccctccccag

SEQ ID NO: 3837925 - DNA, 23 bp, Homo sapiens
cccgtctcctgagggtcctgctg

SEQ ID NO: 3837926 - DNA, 14 bp, Homo sapiens
ccctaattttccag

SEQ ID NO: 3837927 - DNA, 13 bp, Homo sapiens
ccctacagccctg

SEQ ID NO: 3837928 - DNA, 13 bp, Homo sapiens
ccctagcccagga

SEQ ID NO: 3837929 - DNA, 18 bp, Homo sapiens
ccctagcccaggagagag

SEQ ID NO: 3837930 - DNA, 18 bp, Homo sapiens
ccctagctaataaacctg

SEQ ID NO: 3837931 - DNA, 19 bp, Homo sapiens
ccctagctttagaccctgg

SEQ ID NO: 3837932 - DNA, 17 bp, Homo sapiens
ccctaggcacctctgtg

SEQ ID NO: 3837933 - DNA, 15 bp, Homo sapiens
ccctcacagcctctg

SEQ ID NO: 3837934 - DNA, 16 bp, Homo sapiens
ccctcagccccaggag

SEQ ID NO: 3837935 - DNA, 14 bp, Homo sapiens
ccctcccacctctg

SEQ ID NO: 3837936 - DNA, 19 bp, Homo sapiens
ccctcccacctctgtgacc

SEQ ID NO: 3837937 - DNA, 22 bp, Homo sapiens
ccctccccagatctgtcctggg

SEQ ID NO: 3837938 - DNA, 15 bp, Homo sapiens
ccctccccagctcct

SEQ ID NO: 3837939 - DNA, 12 bp, Homo sapiens
ccctcccctccc

SEQ ID NO: 3837940 - DNA, 14 bp, Homo sapiens
ccctcctcactggc

SEQ ID NO: 3837941 - DNA, 21 bp, Homo sapiens
ccctcctcactggccatccct

SEQ ID NO: 3837942 - DNA, 15 bp, Homo sapiens
ccctcctgcctgcgc

SEQ ID NO: 3837943 - DNA, 22 bp, Homo sapiens
ccctcgctctctgtctccaggc

SEQ ID NO: 3837944 - DNA, 18 bp, Homo sapiens
ccctcgtggtccccaaca

SEQ ID NO: 3837945 - DNA, 20 bp, Homo sapiens
ccctcgtggtccccaacagc

SEQ ID NO: 3837946 - DNA, 23 bp, Homo sapiens
ccctcgtggtccccaacagcgac

SEQ ID NO: 3837947 - DNA, 14 bp, Homo sapiens
ccctctgccaccag

SEQ ID NO: 3837948 - DNA, 18 bp, Homo sapiens
ccctctggggctcagccc

SEQ ID NO: 3837949 - DNA, 15 bp, Homo sapiens
ccctgaagccagcct

SEQ ID NO: 3837950 - DNA, 13 bp, Homo sapiens
ccctgaggagggc

SEQ ID NO: 3837951 - DNA, 19 bp, Homo sapiens
ccctgagttcccaaaggga

SEQ ID NO: 3837952 - DNA, 22 bp, Homo sapiens
ccctgagttcccaaagggaggg

SEQ ID NO: 3837953 - DNA, 14 bp, Homo sapiens
ccctgatccaggaa

SEQ ID NO: 3837954 - DNA, 13 bp, Homo sapiens
ccctgcacgtcat

SEQ ID NO: 3837955 - DNA, 15 bp, Homo sapiens
ccctgcacgtcatgg

SEQ ID NO: 3837956 - DNA, 16 bp, Homo sapiens
ccctgcagccatccca

SEQ ID NO: 3837957 - DNA, 21 bp, Homo sapiens
ccctgcagtaatctccagggc

SEQ ID NO: 3837958 - DNA, 22 bp, Homo sapiens
ccctgcccccaatttcccagac

SEQ ID NO: 3837959 - DNA, 18 bp, Homo sapiens
ccctgccctcatctctct

SEQ ID NO: 3837960 - DNA, 13 bp, Homo sapiens
ccctgccctcctg

SEQ ID NO: 3837961 - DNA, 15 bp, Homo sapiens
ccctgccctcctgcc

SEQ ID NO: 3837962 - DNA, 12 bp, Homo sapiens
ccctgccctgag

SEQ ID NO: 3837963 - DNA, 13 bp, Homo sapiens
ccctgccctgagg

SEQ ID NO: 3837964 - DNA, 13 bp, Homo sapiens
ccctgcctccatc

SEQ ID NO: 3837965 - DNA, 21 bp, Homo sapiens
ccctgctgcaggggctctgga

SEQ ID NO: 3837966 - DNA, 16 bp, Homo sapiens
ccctgcttccaggaaa

SEQ ID NO: 3837967 - DNA, 18 bp, Homo sapiens
ccctgctttgccccactg

SEQ ID NO: 3837968 - DNA, 17 bp, Homo sapiens
ccctggaggtgccagca

SEQ ID NO: 3837969 - DNA, 20 bp, Homo sapiens
ccctggaggtgccagcaaag

SEQ ID NO: 3837970 - DNA, 22 bp, Homo sapiens
ccctggaggtgccagcaaagcc

SEQ ID NO: 3837971 - DNA, 11 bp, Homo sapiens
ccctggctgcc

SEQ ID NO: 3837972 - DNA, 14 bp, Homo sapiens
ccctggctgctgcc

SEQ ID NO: 3837973 - DNA, 12 bp, Homo sapiens
ccctggcttcca

SEQ ID NO: 3837974 - DNA, 20 bp, Homo sapiens
ccctgggcctgcacctctcc

SEQ ID NO: 3837975 - DNA, 21 bp, Homo sapiens
ccctgggcgcagctgaagcct

SEQ ID NO: 3837976 - DNA, 22 bp, Homo sapiens
ccctgggcgcagctgaagcctg

SEQ ID NO: 3837977 - DNA, 19 bp, Homo sapiens
ccctgggcttggcctgctg

SEQ ID NO: 3837978 - DNA, 17 bp, Homo sapiens
ccctgggtgggctctgt

SEQ ID NO: 3837979 - DNA, 20 bp, Homo sapiens
ccctgggtgggctctgtgca

SEQ ID NO: 3837980 - DNA, 20 bp, Homo sapiens
ccctgtccctcccacctctg

SEQ ID NO: 3837981 - DNA, 23 bp, Homo sapiens
ccctgtccctcccacctctgtga

SEQ ID NO: 3837982 - DNA, 17 bp, Homo sapiens
ccctgtcctcactgctc

SEQ ID NO: 3837983 - DNA, 18 bp, Homo sapiens
ccctgtcctcactgctcc

SEQ ID NO: 3837984 - DNA, 17 bp, Homo sapiens
ccctgtgacatggtgcc

SEQ ID NO: 3837985 - DNA, 21 bp, Homo sapiens
ccctgtgacatggtgcctgag

SEQ ID NO: 3837986 - DNA, 12 bp, Homo sapiens
ccctgtgtcttt

SEQ ID NO: 3837987 - DNA, 18 bp, Homo sapiens
ccctgttgcaaaggaaat

SEQ ID NO: 3837988 - DNA, 19 bp, Homo sapiens
cccttccttttccctgctt

SEQ ID NO: 3837989 - DNA, 15 bp, Homo sapiens
cccttgcctccccat

SEQ ID NO: 3837990 - DNA, 18 bp, Homo sapiens
cccttgcctccccatttc

SEQ ID NO: 3837991 - DNA, 20 bp, Homo sapiens
cccttgcctccccatttccc

SEQ ID NO: 3837992 - DNA, 23 bp, Homo sapiens
cccttgcctccccatttcccatc

SEQ ID NO: 3837993 - DNA, 18 bp, Homo sapiens
ccctttccttccccctcg

SEQ ID NO: 3837994 - DNA, 23 bp, Homo sapiens
ccgaaggtgctggaggtgggagc

SEQ ID NO: 3837995 - DNA, 11 bp, Homo sapiens
ccgactcagca

SEQ ID NO: 3837996 - DNA, 15 bp, Homo sapiens
ccgagcttgcctcag

SEQ ID NO: 3837997 - DNA, 16 bp, Homo sapiens
ccgagcttgcctcagg

SEQ ID NO: 3837998 - DNA, 21 bp, Homo sapiens
ccgagcttgcctcagggccaa

SEQ ID NO: 3837999 - DNA, 18 bp, Homo sapiens
ccgcactagcctccctct

SEQ ID NO: 3838000 - DNA, 15 bp, Homo sapiens
ccgcagacctcccca

SEQ ID NO: 3838001 - DNA, 16 bp, Homo sapiens
ccgcagacctccccag

SEQ ID NO: 3838002 - DNA, 18 bp, Homo sapiens
ccgcagacctccccagcc

SEQ ID NO: 3838003 - DNA, 19 bp, Homo sapiens
ccgcagacctccccagccc

SEQ ID NO: 3838004 - DNA, 13 bp, Homo sapiens
ccgcatcccctgc

SEQ ID NO: 3838005 - DNA, 15 bp, Homo sapiens
ccgcatcccctgcct

SEQ ID NO: 3838006 - DNA, 16 bp, Homo sapiens
ccgcatcccctgcctc

SEQ ID NO: 3838007 - DNA, 20 bp, Homo sapiens
ccgccacctccccactccag

SEQ ID NO: 3838008 - DNA, 21 bp, Homo sapiens
ccgccacctccccactccagc

SEQ ID NO: 3838009 - DNA, 23 bp, Homo sapiens
ccgccacctccccactccagcag

SEQ ID NO: 3838010 - DNA, 11 bp, Homo sapiens
ccgccagcctc

SEQ ID NO: 3838011 - DNA, 15 bp, Homo sapiens
ccgccagcctcctct

SEQ ID NO: 3838012 - DNA, 13 bp, Homo sapiens
ccgcccccagtcc

SEQ ID NO: 3838013 - DNA, 16 bp, Homo sapiens
ccgccgtggtgacccc

SEQ ID NO: 3838014 - DNA, 22 bp, Homo sapiens
ccgcctcggagtgtggcctgga

SEQ ID NO: 3838015 - DNA, 12 bp, Homo sapiens
ccggccacctct

SEQ ID NO: 3838016 - DNA, 14 bp, Homo sapiens
ccggccacctctgc

SEQ ID NO: 3838017 - DNA, 15 bp, Homo sapiens
ccggccacctctgcg

SEQ ID NO: 3838018 - DNA, 15 bp, Homo sapiens
ccggggaccctgtga

SEQ ID NO: 3838019 - DNA, 14 bp, Homo sapiens
ccggggctcagccc

SEQ ID NO: 3838020 - DNA, 16 bp, Homo sapiens
ccggggctgaagccac

SEQ ID NO: 3838021 - DNA, 20 bp, Homo sapiens
ccggggctgaagccacacag

SEQ ID NO: 3838022 - DNA, 18 bp, Homo sapiens
ccgggtgtagattccctt

SEQ ID NO: 3838023 - DNA, 17 bp, Homo sapiens
ccggttccctccccagc

SEQ ID NO: 3838024 - DNA, 16 bp, Homo sapiens
ccgtccatggtgctaa

SEQ ID NO: 3838025 - DNA, 14 bp, Homo sapiens
ccgtcctcacccct

SEQ ID NO: 3838026 - DNA, 16 bp, Homo sapiens
ccgtcctcacccctgt

SEQ ID NO: 3838027 - DNA, 18 bp, Homo sapiens
ccgtctgctcctccctcc

SEQ ID NO: 3838028 - DNA, 20 bp, Homo sapiens
ccgtggaggaggaaggcaag

SEQ ID NO: 3838029 - DNA, 22 bp, Homo sapiens
ccgtggaggaggaaggcaagag

SEQ ID NO: 3838030 - DNA, 17 bp, Homo sapiens
ccgttgctgccatcgta

SEQ ID NO: 3838031 - DNA, 18 bp, Homo sapiens
ccgtttgctttttcaggt

SEQ ID NO: 3838032 - DNA, 17 bp, Homo sapiens
cctaaaaacaaaacaaa

SEQ ID NO: 3838033 - DNA, 18 bp, Homo sapiens
cctaaatatattttaaga

SEQ ID NO: 3838034 - DNA, 14 bp, Homo sapiens
cctaatagaaagaa

SEQ ID NO: 3838035 - DNA, 15 bp, Homo sapiens
cctaatttctcctcc

SEQ ID NO: 3838036 - DNA, 18 bp, Homo sapiens
cctaatttctcctccctt

SEQ ID NO: 3838037 - DNA, 17 bp, Homo sapiens
cctactaagaagtttaa

SEQ ID NO: 3838038 - DNA, 15 bp, Homo sapiens
cctactgcccctgcc

SEQ ID NO: 3838039 - DNA, 23 bp, Homo sapiens
cctactgcccctgccctgaggag

SEQ ID NO: 3838040 - DNA, 13 bp, Homo sapiens
cctagcccaggag

SEQ ID NO: 3838041 - DNA, 19 bp, Homo sapiens
cctagcccaggagagagaa

SEQ ID NO: 3838042 - DNA, 23 bp, Homo sapiens
cctagctggagtgccatggctgg

SEQ ID NO: 3838043 - DNA, 22 bp, Homo sapiens
cctagctttagaccctgggtgg

SEQ ID NO: 3838044 - DNA, 13 bp, Homo sapiens
cctaggtgggagc

SEQ ID NO: 3838045 - DNA, 18 bp, Homo sapiens
cctaggtgggagccacca

SEQ ID NO: 3838046 - DNA, 15 bp, Homo sapiens
cctagtgacaggttt

SEQ ID NO: 3838047 - DNA, 17 bp, Homo sapiens
cctatgcccagcctcca

SEQ ID NO: 3838048 - DNA, 23 bp, Homo sapiens
cctcaaccccaaatcccccgact

SEQ ID NO: 3838049 - DNA, 15 bp, Homo sapiens
cctcacagcctctga

SEQ ID NO: 3838050 - DNA, 20 bp, Homo sapiens
cctcacagcctctgacccct

SEQ ID NO: 3838051 - DNA, 21 bp, Homo sapiens
cctcacagcctctgacccctc

SEQ ID NO: 3838052 - DNA, 15 bp, Homo sapiens
cctcacccctgtcct

SEQ ID NO: 3838053 - DNA, 20 bp, Homo sapiens
cctcacccctgtcctcactg

SEQ ID NO: 3838054 - DNA, 21 bp, Homo sapiens
cctcacccctgtcctcactgc

SEQ ID NO: 3838055 - DNA, 22 bp, Homo sapiens
cctcacccctgtcctcactgct

SEQ ID NO: 3838056 - DNA, 16 bp, Homo sapiens
cctcacctaacagtta

SEQ ID NO: 3838057 - DNA, 12 bp, Homo sapiens
cctcacctcatg

SEQ ID NO: 3838058 - DNA, 14 bp, Homo sapiens
cctcacctcatgcc

SEQ ID NO: 3838059 - DNA, 17 bp, Homo sapiens
cctcacctcatgcccac

SEQ ID NO: 3838060 - DNA, 16 bp, Homo sapiens
cctcactcttgccaac

SEQ ID NO: 3838061 - DNA, 19 bp, Homo sapiens
cctcactgctccctgaagc

SEQ ID NO: 3838062 - DNA, 22 bp, Homo sapiens
cctcactggccatccctcgtgg

SEQ ID NO: 3838063 - DNA, 16 bp, Homo sapiens
cctcagccccaggaga

SEQ ID NO: 3838064 - DNA, 17 bp, Homo sapiens
cctcagccccaggagaa

SEQ ID NO: 3838065 - DNA, 17 bp, Homo sapiens
cctcaggcactagcctt

SEQ ID NO: 3838066 - DNA, 22 bp, Homo sapiens
cctcaggcactagcctttggct

SEQ ID NO: 3838067 - DNA, 23 bp, Homo sapiens
cctcagggatggccgttggccac

SEQ ID NO: 3838068 - DNA, 18 bp, Homo sapiens
cctcaggtgggccgcagg

SEQ ID NO: 3838069 - DNA, 17 bp, Homo sapiens
cctcagtcctcccctca

SEQ ID NO: 3838070 - DNA, 19 bp, Homo sapiens
cctcagtcctcccctcaca

SEQ ID NO: 3838071 - DNA, 22 bp, Homo sapiens
cctcagtcctcccctcacagcc

SEQ ID NO: 3838072 - DNA, 24 bp, Homo sapiens
cctcagtcctcccctcacagcctc

SEQ ID NO: 3838073 - DNA, 17 bp, Homo sapiens
cctcatctttcatcaat

SEQ ID NO: 3838074 - DNA, 18 bp, Homo sapiens
cctcatgaacactggctg

SEQ ID NO: 3838075 - DNA, 15 bp, Homo sapiens
cctcatgcccacccc

SEQ ID NO: 3838076 - DNA, 16 bp, Homo sapiens
cctccagtctgctctc

SEQ ID NO: 3838077 - DNA, 18 bp, Homo sapiens
cctccagtctgctctcag

SEQ ID NO: 3838078 - DNA, 21 bp, Homo sapiens
cctccagtctgctctcagctt

SEQ ID NO: 3838079 - DNA, 18 bp, Homo sapiens
cctccatcttctttgcag

SEQ ID NO: 3838080 - DNA, 11 bp, Homo sapiens
cctccatgccc

SEQ ID NO: 3838081 - DNA, 18 bp, Homo sapiens
cctccccactccagcaga

SEQ ID NO: 3838082 - DNA, 18 bp, Homo sapiens
cctccccagacagggctc

SEQ ID NO: 3838083 - DNA, 22 bp, Homo sapiens
cctccccagcccctagcccagg

SEQ ID NO: 3838084 - DNA, 15 bp, Homo sapiens
cctccccagctcctc

SEQ ID NO: 3838085 - DNA, 15 bp, Homo sapiens
cctcccctcccctgc

SEQ ID NO: 3838086 - DNA, 16 bp, Homo sapiens
cctcccctcccctgct

SEQ ID NO: 3838087 - DNA, 20 bp, Homo sapiens
cctcccctgctgcaggggct

SEQ ID NO: 3838088 - DNA, 14 bp, Homo sapiens
cctccctcctgcct

SEQ ID NO: 3838089 - DNA, 16 bp, Homo sapiens
cctccggcctgcactc

SEQ ID NO: 3838090 - DNA, 13 bp, Homo sapiens
cctcctagctgga

SEQ ID NO: 3838091 - DNA, 13 bp, Homo sapiens
cctcctcacctca

SEQ ID NO: 3838092 - DNA, 14 bp, Homo sapiens
cctcctcacctcat

SEQ ID NO: 3838093 - DNA, 16 bp, Homo sapiens
cctcctcacctcatgc

SEQ ID NO: 3838094 - DNA, 22 bp, Homo sapiens
cctcctcacctcatgcccaccc

SEQ ID NO: 3838095 - DNA, 17 bp, Homo sapiens
cctcctcactggccatc

SEQ ID NO: 3838096 - DNA, 12 bp, Homo sapiens
cctcctcaggga

SEQ ID NO: 3838097 - DNA, 12 bp, Homo sapiens
cctcctcctagc

SEQ ID NO: 3838098 - DNA, 14 bp, Homo sapiens
cctcctcctagctg

SEQ ID NO: 3838099 - DNA, 21 bp, Homo sapiens
cctcctcctgagagctgttcc

SEQ ID NO: 3838100 - DNA, 15 bp, Homo sapiens
cctcctgagagctgt

SEQ ID NO: 3838101 - DNA, 18 bp, Homo sapiens
cctcctgcccgccctccc

SEQ ID NO: 3838102 - DNA, 20 bp, Homo sapiens
cctcctgggcaccccaggca

SEQ ID NO: 3838103 - DNA, 18 bp, Homo sapiens
cctcggagtgtggcctgg

SEQ ID NO: 3838104 - DNA, 20 bp, Homo sapiens
cctcggagtgtggcctggat

SEQ ID NO: 3838105 - DNA, 20 bp, Homo sapiens
cctcgttaggacaaggctgt

SEQ ID NO: 3838106 - DNA, 19 bp, Homo sapiens
cctctaccaccacaccaaa

SEQ ID NO: 3838107 - DNA, 16 bp, Homo sapiens
cctctagaagccaagg

SEQ ID NO: 3838108 - DNA, 13 bp, Homo sapiens
cctctccttcctc

SEQ ID NO: 3838109 - DNA, 13 bp, Homo sapiens
ccttttccctgct

SEQ ID NO: 3838110 - DNA, 14 bp, Homo sapiens
ccttttccctgctt

SEQ ID NO: 3838111 - DNA, 21 bp, Homo sapiens
ccttttgctctgtcctcccca

SEQ ID NO: 3838112 - DNA, 16 bp, Homo sapiens
cgaaggtgctggaggt

SEQ ID NO: 3838113 - DNA, 17 bp, Homo sapiens
cgaatactttgaatgtt

SEQ ID NO: 3838114 - DNA, 14 bp, Homo sapiens
cgaccaccaacaca

SEQ ID NO: 3838115 - DNA, 19 bp, Homo sapiens
cgaccaccaacacacagga

SEQ ID NO: 3838116 - DNA, 23 bp, Homo sapiens
cgacctgatttacagtttcaaaa

SEQ ID NO: 3838117 - DNA, 18 bp, Homo sapiens
cgacttctcaggacgacg

SEQ ID NO: 3838118 - DNA, 13 bp, Homo sapiens
cgagagggagaga

SEQ ID NO: 3838119 - DNA, 19 bp, Homo sapiens
cgagcccacaccatctggc

SEQ ID NO: 3838120 - DNA, 16 bp, Homo sapiens
cgagcttgcctcaggg

SEQ ID NO: 3838121 - DNA, 22 bp, Homo sapiens
cgagcttgcctcagggccaagc

SEQ ID NO: 3838122 - DNA, 21 bp, Homo sapiens
cgaggctgccccttggatcaa

SEQ ID NO: 3838123 - DNA, 14 bp, Homo sapiens
cgaggtcgctgcag

SEQ ID NO: 3838124 - DNA, 20 bp, Homo sapiens
cgatagtgacacatcttcag

SEQ ID NO: 3838125 - DNA, 12 bp, Homo sapiens
cgatgtgagccg

SEQ ID NO: 3838126 - DNA, 18 bp, Homo sapiens
cgcacctgcctccggcct

SEQ ID NO: 3838127 - DNA, 13 bp, Homo sapiens
cgcagccacacag

SEQ ID NO: 3838128 - DNA, 14 bp, Homo sapiens
cgcagccacacagt

SEQ ID NO: 3838129 - DNA, 20 bp, Homo sapiens
cgcagccacacagtggccgg

SEQ ID NO: 3838130 - DNA, 13 bp, Homo sapiens
cgcagctccttcc

SEQ ID NO: 3838131 - DNA, 14 bp, Homo sapiens
cgcagctccttccc

SEQ ID NO: 3838132 - DNA, 21 bp, Homo sapiens
cgcagctgaagcctggacgca

SEQ ID NO: 3838133 - DNA, 18 bp, Homo sapiens
cgcatcccctgcctccat

SEQ ID NO: 3838134 - DNA, 16 bp, Homo sapiens
cgcattgttttgcatc

SEQ ID NO: 3838135 - DNA, 15 bp, Homo sapiens
cgccaaactgtctct

SEQ ID NO: 3838136 - DNA, 20 bp, Homo sapiens
cgccacctccccactccagc

SEQ ID NO: 3838137 - DNA, 13 bp, Homo sapiens
cgccagcctcctc

SEQ ID NO: 3838138 - DNA, 14 bp, Homo sapiens
cgccagcctcctct

SEQ ID NO: 3838139 - DNA, 16 bp, Homo sapiens
cgccagcctcctctgg

SEQ ID NO: 3838140 - DNA, 17 bp, Homo sapiens
cgccagctgatgactca

SEQ ID NO: 3838141 - DNA, 12 bp, Homo sapiens
cgcccacctccc

SEQ ID NO: 3838142 - DNA, 15 bp, Homo sapiens
cgcccagcccaggcc

SEQ ID NO: 3838143 - DNA, 19 bp, Homo sapiens
cgcccagcccaggcctggt

SEQ ID NO: 3838144 - DNA, 18 bp, Homo sapiens
cgcccagccccaggtctc

SEQ ID NO: 3838145 - DNA, 23 bp, Homo sapiens
cgccctaggaggagaacttgaac

SEQ ID NO: 3838146 - DNA, 21 bp, Homo sapiens
cgccctgggctcgtctttgca

SEQ ID NO: 3838147 - DNA, 19 bp, Homo sapiens
cgccgtggtgacccctgct

SEQ ID NO: 3838148 - DNA, 22 bp, Homo sapiens
cgccgtggtgacccctgctttg

SEQ ID NO: 3838149 - DNA, 11 bp, Homo sapiens
cgcctctgcct

SEQ ID NO: 3838150 - DNA, 16 bp, Homo sapiens
cgcctgaggccagcct

SEQ ID NO: 3838151 - DNA, 20 bp, Homo sapiens
cgcctgtaatcccagcactt

SEQ ID NO: 3838152 - DNA, 21 bp, Homo sapiens
cgctcccggttccctccccag

SEQ ID NO: 3838153 - DNA, 22 bp, Homo sapiens
ccccaccccggggaccctgtga

SEQ ID NO: 3838154 - DNA, 23 bp, Homo sapiens
ccccaccccggggaccctgtgac

SEQ ID NO: 3838155 - DNA, 11 bp, Homo sapiens
ccccagacagg

SEQ ID NO: 3838156 - DNA, 14 bp, Homo sapiens
ccccagacagggct

SEQ ID NO: 3838157 - DNA, 22 bp, Homo sapiens
ccccagacagggctccagcctg

SEQ ID NO: 3838158 - DNA, 17 bp, Homo sapiens
ccccagatctgtcctgg

SEQ ID NO: 3838159 - DNA, 13 bp, Homo sapiens
ccccagccaggct

SEQ ID NO: 3838160 - DNA, 11 bp, Homo sapiens
ccccagcccag

SEQ ID NO: 3838161 - DNA, 12 bp, Homo sapiens
ccccagcccagg

SEQ ID NO: 3838162 - DNA, 15 bp, Homo sapiens
ccccagcccctagcc

SEQ ID NO: 3838163 - DNA, 20 bp, Homo sapiens
ccccagcccctagcccagga

SEQ ID NO: 3838164 - DNA, 16 bp, Homo sapiens
ccccagctgtgagcct

SEQ ID NO: 3838165 - DNA, 19 bp, Homo sapiens
ccccaggctggagtgcagt

SEQ ID NO: 3838166 - DNA, 23 bp, Homo sapiens
ccccaggctggagtgcagtggct

SEQ ID NO: 3838167 - DNA, 22 bp, Homo sapiens
ccccaggtctccccaggccctc

SEQ ID NO: 3838168 - DNA, 23 bp, Homo sapiens
ccccagttcccgggccctcctgg

SEQ ID NO: 3838169 - DNA, 23 bp, Homo sapiens
ccccatcttgggggtcacccatg

SEQ ID NO: 3838170 - DNA, 20 bp, Homo sapiens
ctaatttctcctcccttcct

SEQ ID NO: 3838171 - DNA, 21 bp, Homo sapiens
ctacaacatattgtttcagtg

SEQ ID NO: 3838172 - DNA, 22 bp, Homo sapiens
ctacaataatagagaggaagcc

SEQ ID NO: 3838173 - DNA, 15 bp, Homo sapiens
ctacaggcttgagct

SEQ ID NO: 3838174 - DNA, 16 bp, Homo sapiens
ctacagtggttttata

SEQ ID NO: 3838175 - DNA, 20 bp, Homo sapiens
ctaccaccacaccaaatgac

SEQ ID NO: 3838176 - DNA, 21 bp, Homo sapiens
ctaccaccacaccaaatgact

SEQ ID NO: 3838177 - DNA, 19 bp, Homo sapiens
ctaccttccagtcaggatg

SEQ ID NO: 3838178 - DNA, 11 bp, Homo sapiens
ctactaacaga

SEQ ID NO: 3838179 - DNA, 22 bp, Homo sapiens
ctactaacagattataataaat

SEQ ID NO: 3838180 - DNA, 21 bp, Homo sapiens
ctactctatatacttttgctt

SEQ ID NO: 3838181 - DNA, 12 bp, Homo sapiens
ctagaagccaag

SEQ ID NO: 3838182 - DNA, 16 bp, Homo sapiens
ctagaagccaagggaa

SEQ ID NO: 3838183 - DNA, 20 bp, Homo sapiens
ctagaagccaagggaaaggg

SEQ ID NO: 3838184 - DNA, 13 bp, Homo sapiens
ctagaagtgccat

SEQ ID NO: 3838185 - DNA, 18 bp, Homo sapiens
ctagcacctccccagaca

SEQ ID NO: 3838186 - DNA, 19 bp, Homo sapiens
ctagcacctccccagacag

SEQ ID NO: 3838187 - DNA, 22 bp, Homo sapiens
ctagcacctccccagacagggc

SEQ ID NO: 3838188 - DNA, 15 bp, Homo sapiens
ctagcccaggagaga

SEQ ID NO: 3838189 - DNA, 19 bp, Homo sapiens
ctagcccaggagagagaaa

SEQ ID NO: 3838190 - DNA, 13 bp, Homo sapiens
ctagcctccctct

SEQ ID NO: 3838191 - DNA, 22 bp, Homo sapiens
ctagcctccctctcctctgtcc

SEQ ID NO: 3838192 - DNA, 16 bp, Homo sapiens
ctagcctttggctctg

SEQ ID NO: 3838193 - DNA, 17 bp, Homo sapiens
ctagcctttggctctgg

SEQ ID NO: 3838194 - DNA, 18 bp, Homo sapiens
ctagcctttggctctgga

SEQ ID NO: 3838195 - DNA, 22 bp, Homo sapiens
ctagctggagtgccatggctgg

SEQ ID NO: 3838196 - DNA, 23 bp, Homo sapiens
ctagctggagtgccatggctggg

SEQ ID NO: 3838197 - DNA, 13 bp, Homo sapiens
ctagcttctgctt

SEQ ID NO: 3838198 - DNA, 18 bp, Homo sapiens
ctagcttctgcttttctg

SEQ ID NO: 3838199 - DNA, 21 bp, Homo sapiens
ctagcttctgcttttctgccc

SEQ ID NO: 3838200 - DNA, 20 bp, Homo sapiens
ctaggactgtggaggggagc

SEQ ID NO: 3838201 - DNA, 23 bp, Homo sapiens
ctaggaggagaacttgaacaaag

SEQ ID NO: 3838202 - DNA, 22 bp, Homo sapiens
ctaggcagaagaagctgggagg

SEQ ID NO: 3838203 - DNA, 19 bp, Homo sapiens
ctaggcattacccaaaagc

SEQ ID NO: 3838204 - DNA, 13 bp, Homo sapiens
ctaggggaggggg

SEQ ID NO: 3838205 - DNA, 12 bp, Homo sapiens
ctaggtgggagc

SEQ ID NO: 3838206 - DNA, 13 bp, Homo sapiens
ctagtgacaggtt

SEQ ID NO: 3838207 - DNA, 13 bp, Homo sapiens
ctagtgctgaagc

SEQ ID NO: 3838208 - DNA, 14 bp, Homo sapiens
ctagtgctgaagct

SEQ ID NO: 3838209 - DNA, 17 bp, Homo sapiens
ctagtgtcacctgcaca

SEQ ID NO: 3838210 - DNA, 18 bp, Homo sapiens
ctataagtatataaatac

SEQ ID NO: 3838211 - DNA, 19 bp, Homo sapiens
ctataagtatataaatact

SEQ ID NO: 3838212 - DNA, 15 bp, Homo sapiens
ctataattttgcaaa

SEQ ID NO: 3838213 - DNA, 19 bp, Homo sapiens
ctatcaatccaaattccct

SEQ ID NO: 3838214 - DNA, 22 bp, Homo sapiens
ctatgaagttttttttatacag

SEQ ID NO: 3838215 - DNA, 24 bp, Homo sapiens
ctatgatctcatcccaataaaatg

SEQ ID NO: 3838216 - DNA, 13 bp, Homo sapiens
ctatgcccagcct

SEQ ID NO: 3838217 - DNA, 15 bp, Homo sapiens
ctatgcccagcctcc

SEQ ID NO: 3838218 - DNA, 20 bp, Homo sapiens
ctatggttgccaccccaacc

SEQ ID NO: 3838219 - DNA, 20 bp, Homo sapiens
ctattctgtgaaactaatca

SEQ ID NO: 3838220 - DNA, 17 bp, Homo sapiens
ctgcctcgggaacctca

SEQ ID NO: 3838221 - DNA, 14 bp, Homo sapiens
ctgcctgccccgcc

SEQ ID NO: 3838222 - DNA, 22 bp, Homo sapiens
ctgcctgctttgtgcagggtcc

SEQ ID NO: 3838223 - DNA, 16 bp, Homo sapiens
ctgccttaaaaccaaa

SEQ ID NO: 3838224 - DNA, 18 bp, Homo sapiens
ctgccttaaaaccaaaga

SEQ ID NO: 3838225 - DNA, 21 bp, Homo sapiens
ctgccttaccgagagccaaac

SEQ ID NO: 3838226 - DNA, 12 bp, Homo sapiens
ctgccttcccta

SEQ ID NO: 3838227 - DNA, 17 bp, Homo sapiens
ctgccttccctagcttt

SEQ ID NO: 3838228 - DNA, 14 bp, Homo sapiens
ctgcgcagctcctt

SEQ ID NO: 3838229 - DNA, 16 bp, Homo sapiens
ctgcgcagggccctct

SEQ ID NO: 3838230 - DNA, 22 bp, Homo sapiens
ctgcgcagggccctctggggct

SEQ ID NO: 3838231 - DNA, 13 bp, Homo sapiens
ctgcgccctgggc

SEQ ID NO: 3838232 - DNA, 13 bp, Homo sapiens
ctgcggaccccag

SEQ ID NO: 3838233 - DNA, 20 bp, Homo sapiens
ctgcggaccccagctgtgag

SEQ ID NO: 3838234 - DNA, 14 bp, Homo sapiens
ctgcgggaagctga

SEQ ID NO: 3838235 - DNA, 15 bp, Homo sapiens
ctgcgtcctcctcac

SEQ ID NO: 3838236 - DNA, 17 bp, Homo sapiens
ctgcgtcctcctcacct

SEQ ID NO: 3838237 - DNA, 19 bp, Homo sapiens
ctgctcactacctcctcag

SEQ ID NO: 3838238 - DNA, 17 bp, Homo sapiens
ctgctcagccctggagg

SEQ ID NO: 3838239 - DNA, 22 bp, Homo sapiens
ctgctcattctaatgatggccc

SEQ ID NO: 3838240 - DNA, 23 bp, Homo sapiens
ctgctcattctaatgatggccca

SEQ ID NO: 3838241 - DNA, 15 bp, Homo sapiens
ctgctcatttgagaa

SEQ ID NO: 3838242 - DNA, 14 bp, Homo sapiens
ctgctccctgaagc

SEQ ID NO: 3838243 - DNA, 17 bp, Homo sapiens
ctgctccctgaagccag

SEQ ID NO: 3838244 - DNA, 19 bp, Homo sapiens
ctgctccctgaagccagcc

SEQ ID NO: 3838245 - DNA, 14 bp, Homo sapiens
ctgctcctccctcc

SEQ ID NO: 3838246 - DNA, 14 bp, Homo sapiens
ctgctcctccctct

SEQ ID NO: 3838247 - DNA, 19 bp, Homo sapiens
ctgctcctcgctcgcacct

SEQ ID NO: 3838248 - DNA, 22 bp, Homo sapiens
ctgctcctcgctcgcacctgcc

SEQ ID NO: 3838249 - DNA, 11 bp, Homo sapiens
ctgctgcaggg

SEQ ID NO: 3838250 - DNA, 12 bp, Homo sapiens
ctgctgcagggg

SEQ ID NO: 3838251 - DNA, 18 bp, Homo sapiens
ctgctgcaggggctctgg

SEQ ID NO: 3838252 - DNA, 19 bp, Homo sapiens
ctgctgcaggggctctgga

SEQ ID NO: 3838253 - DNA, 21 bp, Homo sapiens
ctgctgcaggggctctggaga

SEQ ID NO: 3838254 - DNA, 18 bp, Homo sapiens
ctgctgcgccctgggctc

SEQ ID NO: 3838255 - DNA, 15 bp, Homo sapiens
ctgctgctcctccct

SEQ ID NO: 3838256 - DNA, 20 bp, Homo sapiens
ctgctgctcctccctctgac

SEQ ID NO: 3838257 - DNA, 17 bp, Homo sapiens
ctgctggcacccaccgt

SEQ ID NO: 3838258 - DNA, 14 bp, Homo sapiens
ctgctggccatggc

SEQ ID NO: 3838259 - DNA, 15 bp, Homo sapiens
ctgctggtgtttatg

SEQ ID NO: 3838260 - DNA, 20 bp, Homo sapiens
ctgctgtaataaatgtatta

SEQ ID NO: 3838261 - DNA, 16 bp, Homo sapiens
ctgctgtgattccact

SEQ ID NO: 3838262 - DNA, 22 bp, Homo sapiens
ctgctgtgattccactacacct

SEQ ID NO: 3838263 - DNA, 17 bp, Homo sapiens
ctgctttgccccactgg

SEQ ID NO: 3838264 - DNA, 20 bp, Homo sapiens
ctgctttgtagtttgcccag

SEQ ID NO: 3838265 - DNA, 21 bp, Homo sapiens
ctgctttgtagtttgcccaga

SEQ ID NO: 3838266 - DNA, 22 bp, Homo sapiens
ctgctttgtagtttgcccagag

SEQ ID NO: 3838267 - DNA, 16 bp, Homo sapiens
ctgcttttctgccctg

SEQ ID NO: 3838268 - DNA, 18 bp, Homo sapiens
ctgcttttctgccctggc

SEQ ID NO: 3838269 - DNA, 15 bp, Homo sapiens
ctggaaaactcagga

SEQ ID NO: 3838270 - DNA, 20 bp, Homo sapiens
ctggaaaggggagagcctgc

SEQ ID NO: 3838271 - DNA, 12 bp, Homo sapiens
ctggaacgctct

SEQ ID NO: 3838272 - DNA, 17 bp, Homo sapiens
ctggaacgctctaggca

SEQ ID NO: 3838273 - DNA, 12 bp, Homo sapiens
ctggacctgccc

SEQ ID NO: 3838274 - DNA, 19 bp, Homo sapiens
ctggacctgcccccgcatc

SEQ ID NO: 3838275 - DNA, 17 bp, Homo sapiens
ctggacgcagccacaca

SEQ ID NO: 3838276 - DNA, 18 bp, Homo sapiens
ctggacgcagccacacag

SEQ ID NO: 3838277 - DNA, 13 bp, Homo sapiens
ctggacggcaggc

SEQ ID NO: 3838278 - DNA, 14 bp, Homo sapiens
ctggagaagagagg

SEQ ID NO: 3838279 - DNA, 19 bp, Homo sapiens
ctggagaagagaggagagg

SEQ ID NO: 3838280 - DNA, 20 bp, Homo sapiens
ctggagaagagaggagagga

SEQ ID NO: 3838281 - DNA, 14 bp, Homo sapiens
ctggagcaagccct

SEQ ID NO: 3838282 - DNA, 20 bp, Homo sapiens
ctggagcaagccctgaccca

SEQ ID NO: 3838283 - DNA, 13 bp, Homo sapiens
ctggagcctgtgt

SEQ ID NO: 3838284 - DNA, 14 bp, Homo sapiens
ctggagcctgtgta

SEQ ID NO: 3838285 - DNA, 19 bp, Homo sapiens
ctggagcctgtgtaacagc

SEQ ID NO: 3838286 - DNA, 23 bp, Homo sapiens
ctggagcctgtgtaacagctcct

SEQ ID NO: 3838287 - DNA, 22 bp, Homo sapiens
ctggaggtgccagcaaagcccc

SEQ ID NO: 3838288 - DNA, 14 bp, Homo sapiens
ctggaggtgggagc

SEQ ID NO: 3838289 - DNA, 17 bp, Homo sapiens
ctggaggtgggagcagg

SEQ ID NO: 3838290 - DNA, 21 bp, Homo sapiens
ctggaggtgggagcaggagat

SEQ ID NO: 3838291 - DNA, 22 bp, Homo sapiens
ctggaggtgggagcaggagatt

SEQ ID NO: 3838292 - DNA, 19 bp, Homo sapiens
ctggaggttgaagccaagt

SEQ ID NO: 3838293 - DNA, 19 bp, Homo sapiens
ctggagtgccatggctggg

SEQ ID NO: 3838294 - DNA, 19 bp, Homo sapiens
ctggatccatcctgctagc

SEQ ID NO: 3838295 - DNA, 19 bp, Homo sapiens
ctggcacccaccgtggagg

SEQ ID NO: 3838296 - DNA, 17 bp, Homo sapiens
ctggcagtgtgcggagc

SEQ ID NO: 3838297 - DNA, 18 bp, Homo sapiens
ctggcagtgtgcggagct

SEQ ID NO: 3838298 - DNA, 17 bp, Homo sapiens
ctggccatccctcgtgg

SEQ ID NO: 3838299 - DNA, 23 bp, Homo sapiens
ctggccatccctcgtggtcccca

SEQ ID NO: 3838300 - DNA, 15 bp, Homo sapiens
ctggccatggctgct

SEQ ID NO: 3838301 - DNA, 15 bp, Homo sapiens
ctggccatgtcctca

SEQ ID NO: 3838302 - DNA, 17 bp, Homo sapiens
ctggcccaggctggccc

SEQ ID NO: 3838303 - DNA, 21 bp, Homo sapiens
ctggcccaggctggcccccac

SEQ ID NO: 3838304 - DNA, 17 bp, Homo sapiens
ctggcctaggtgggagc

SEQ ID NO: 3838305 - DNA, 24 bp, Homo sapiens
ctggcctaggtgggagccaccact

SEQ ID NO: 3838306 - DNA, 16 bp, Homo sapiens
ctggcgtcacctgtgc

SEQ ID NO: 3838307 - DNA, 19 bp, Homo sapiens
ctggctcctgaagggtgct

SEQ ID NO: 3838308 - DNA, 22 bp, Homo sapiens
ctggctgaggttcctctgcctg

SEQ ID NO: 3838309 - DNA, 12 bp, Homo sapiens
ctggctgctgcc

SEQ ID NO: 3838310 - DNA, 19 bp, Homo sapiens
ctggctgctgcccccaccc

SEQ ID NO: 3838311 - DNA, 17 bp, Homo sapiens
ctggctggtttgcccag

SEQ ID NO: 3838312 - DNA, 14 bp, Homo sapiens
ctggcttccaaggc

SEQ ID NO: 3838313 - DNA, 23 bp, Homo sapiens
ctgggaaggaagcttggctgctc

SEQ ID NO: 3838314 - DNA, 19 bp, Homo sapiens
ctgggacctgccaggcagg

SEQ ID NO: 3838315 - DNA, 23 bp, Homo sapiens
ctgggaggagggagagggaggtc

SEQ ID NO: 3838316 - DNA, 18 bp, Homo sapiens
ctgggaggagtggccctg

SEQ ID NO: 3838317 - DNA, 14 bp, Homo sapiens
ctgggagggagggg

SEQ ID NO: 3838318 - DNA, 18 bp, Homo sapiens
ctgggagggagggggagg

SEQ ID NO: 3838319 - DNA, 19 bp, Homo sapiens
ctgggcaccccaggcagct

SEQ ID NO: 3838320 - DNA, 21 bp, Homo sapiens
ctgggcaccccaggcagctcc

SEQ ID NO: 3838321 - DNA, 19 bp, Homo sapiens
ctgggcccttcctggctag

SEQ ID NO: 3838322 - DNA, 13 bp, Homo sapiens
ctgggcctcctcc

SEQ ID NO: 3838323 - DNA, 21 bp, Homo sapiens
ctgggcctcctcctagctgga

SEQ ID NO: 3838324 - DNA, 22 bp, Homo sapiens
ctgggcctcctcctagctggag

SEQ ID NO: 3838325 - DNA, 14 bp, Homo sapiens
ctgggcgcagctga

SEQ ID NO: 3838326 - DNA, 23 bp, Homo sapiens
ctgggcgcagctgaagcctggac

SEQ ID NO: 3838327 - DNA, 21 bp, Homo sapiens
ctgggctagaggctgagcacc

SEQ ID NO: 3838328 - DNA, 13 bp, Homo sapiens
ctgggctgcctcc

SEQ ID NO: 3838329 - DNA, 21 bp, Homo sapiens
ctgggctgggcccttcctggc

SEQ ID NO: 3838330 - DNA, 15 bp, Homo sapiens
ctgggcttggcctgc

SEQ ID NO: 3838331 - DNA, 13 bp, Homo sapiens
ctggggacaggcc

SEQ ID NO: 3838332 - DNA, 20 bp, Homo sapiens
ctggggatggccaggtacaa

SEQ ID NO: 3838333 - DNA, 14 bp, Homo sapiens
ctggggctcagccc

SEQ ID NO: 3838334 - DNA, 21 bp, Homo sapiens
ctggggctcagccctgagcta

SEQ ID NO: 3838335 - DNA, 23 bp, Homo sapiens
ctgggttccccaccccgggctct

SEQ ID NO: 3838336 - DNA, 23 bp, Homo sapiens
ctggtcacagggcatgccccggc

SEQ ID NO: 3838337 - DNA, 23 bp, Homo sapiens
ctggtgggaggggcgcccacctc

SEQ ID NO: 3838338 - DNA, 20 bp, Homo sapiens
ctggtggggcagaaaggctg

SEQ ID NO: 3838339 - DNA, 16 bp, Homo sapiens
ctggtgtttatgtgaa

SEQ ID NO: 3838340 - DNA, 16 bp, Homo sapiens
ctggtttgcccagagc

SEQ ID NO: 3838341 - DNA, 14 bp, Homo sapiens
ctgtaaatatttca

SEQ ID NO: 3838342 - DNA, 18 bp, Homo sapiens
ctgtaagcccagcatttg

SEQ ID NO: 3838343 - DNA, 15 bp, Homo sapiens
ctgtaataaatatga

SEQ ID NO: 3838344 - DNA, 16 bp, Homo sapiens
ctgtaataaatatgag

SEQ ID NO: 3838345 - DNA, 17 bp, Homo sapiens
ctgtaataaatatgagt

SEQ ID NO: 3838346 - DNA, 18 bp, Homo sapiens
ctgtaattacaactaaat

SEQ ID NO: 3838347 - DNA, 19 bp, Homo sapiens
ctgtagatttcagtagttt

SEQ ID NO: 3838348 - DNA, 21 bp, Homo sapiens
ctgtatagatgagtttttcat

SEQ ID NO: 3838349 - DNA, 16 bp, Homo sapiens
ctgtatcatttcatgc

SEQ ID NO: 3838350 - DNA, 15 bp, Homo sapiens
ctgtattgatgacag

SEQ ID NO: 3838351 - DNA, 22 bp, Homo sapiens
ctgtattttatttagacaagag

SEQ ID NO: 3838352 - DNA, 18 bp, Homo sapiens
ctgtatttttttttctaa

SEQ ID NO: 3838353 - DNA, 21 bp, Homo sapiens
ctgtcccccacacccgtgtca

SEQ ID NO: 3838354 - DNA, 13 bp, Homo sapiens
ctgtccctcccac

SEQ ID NO: 3838355 - DNA, 16 bp, Homo sapiens
ctgtccctcccacctc

SEQ ID NO: 3838356 - DNA, 18 bp, Homo sapiens
ctctaagatgaatccaaa

SEQ ID NO: 3838357 - DNA, 17 bp, Homo sapiens
ctctaccaccacaccaa

SEQ ID NO: 3838358 - DNA, 22 bp, Homo sapiens
ctctagaagccaagggaaaggg

SEQ ID NO: 3838359 - DNA, 18 bp, Homo sapiens
ctctagaagtgccatctc

SEQ ID NO: 3838360 - DNA, 21 bp, Homo sapiens
ctctagaagtgccatctcaat

SEQ ID NO: 3838361 - DNA, 19 bp, Homo sapiens
ctctaggcagaagaagctg

SEQ ID NO: 3838362 - DNA, 20 bp, Homo sapiens
ctctaggcagaagaagctgg

SEQ ID NO: 3838363 - DNA, 16 bp, Homo sapiens
ctctcagcttgtgcct

SEQ ID NO: 3838364 - DNA, 16 bp, Homo sapiens
ctctcatctgacctta

SEQ ID NO: 3838365 - DNA, 16 bp, Homo sapiens
ctctccagctcctccc

SEQ ID NO: 3838366 - DNA, 16 bp, Homo sapiens
ctctcccatggctttg

SEQ ID NO: 3838367 - DNA, 19 bp, Homo sapiens
ctctcccatggctttgtgc

SEQ ID NO: 3838368 - DNA, 11 bp, Homo sapiens
ctctcctcccc

SEQ ID NO: 3838369 - DNA, 14 bp, Homo sapiens
ctctcctgccctgc

SEQ ID NO: 3838370 - DNA, 17 bp, Homo sapiens
ctctctttccttcttgc

SEQ ID NO: 3838371 - DNA, 16 bp, Homo sapiens
ctctgacatcaagtgt

SEQ ID NO: 3838372 - DNA, 18 bp, Homo sapiens
ctctgacatcaagtgtaa

SEQ ID NO: 3838373 - DNA, 14 bp, Homo sapiens
ctctgacccctcct

SEQ ID NO: 3838374 - DNA, 21 bp, Homo sapiens
ctctgacccctcctcactggc

SEQ ID NO: 3838375 - DNA, 16 bp, Homo sapiens
ctctgagaccaaaatt

SEQ ID NO: 3838376 - DNA, 15 bp, Homo sapiens
ctctgaggctcagcc

SEQ ID NO: 3838377 - DNA, 16 bp, Homo sapiens
ctctgaggctcagccc

SEQ ID NO: 3838378 - DNA, 22 bp, Homo sapiens
ctctgaggctcagccctgagct

SEQ ID NO: 3838379 - DNA, 20 bp, Homo sapiens
ctctgcagtccgtgggctgg

SEQ ID NO: 3838380 - DNA, 14 bp, Homo sapiens
ctctgccaccagag

SEQ ID NO: 3838381 - DNA, 16 bp, Homo sapiens
ctctgccaccagagac

SEQ ID NO: 3838382 - DNA, 18 bp, Homo sapiens
ctctgccaccagagaccg

SEQ ID NO: 3838383 - DNA, 23 bp, Homo sapiens
ctctgccaccagagaccgtcctc

SEQ ID NO: 3838384 - DNA, 17 bp, Homo sapiens
ctctgccccccaagttc

SEQ ID NO: 3838385 - DNA, 10 bp, Homo sapiens
ctctgcctcc

SEQ ID NO: 3838386 - DNA, 18 bp, Homo sapiens
ctctgcctcttcccggag

SEQ ID NO: 3838387 - DNA, 12 bp, Homo sapiens
ctctgcctgccc

SEQ ID NO: 3838388 - DNA, 16 bp, Homo sapiens
ctctgcggaccccagc

SEQ ID NO: 3838389 - DNA, 18 bp, Homo sapiens
ctctggacggcaggctca

SEQ ID NO: 3838390 - DNA, 20 bp, Homo sapiens
ctctggagacagccccagag

SEQ ID NO: 3838391 - DNA, 13 bp, Homo sapiens
ctctggagagaaa

SEQ ID NO: 3838392 - DNA, 19 bp, Homo sapiens
ctctggagcaagccctgac

SEQ ID NO: 3838393 - DNA, 20 bp, Homo sapiens
ctctggagtttcatgttatg

SEQ ID NO: 3838394 - DNA, 13 bp, Homo sapiens
ctctggggctcag

SEQ ID NO: 3838395 - DNA, 17 bp, Homo sapiens
ctctggggctcagccct

SEQ ID NO: 3838396 - DNA, 18 bp, Homo sapiens
ctctggggctcagccctg

SEQ ID NO: 3838397 - DNA, 14 bp, Homo sapiens
ctctgtcctcccca

SEQ ID NO: 3838398 - DNA, 14 bp, Homo sapiens
ctctgtctccaggc

SEQ ID NO: 3838399 - DNA, 16 bp, Homo sapiens
ctctgtgacctcaggc

SEQ ID NO: 3838400 - DNA, 17 bp, Homo sapiens
ctcttactttttgtaaa

SEQ ID NO: 3838401 - DNA, 18 bp, Homo sapiens
ctcttactttttgtaaat

SEQ ID NO: 3838402 - DNA, 20 bp, Homo sapiens
ctcttggaattactgaaagt

SEQ ID NO: 3838403 - DNA, 16 bp, Homo sapiens
ctctttcatgccattt

SEQ ID NO: 3838404 - DNA, 16 bp, Homo sapiens
ctgaaaaatgcctgct

SEQ ID NO: 3838405 - DNA, 20 bp, Homo sapiens
ctgaaatatattttaaatgt

SEQ ID NO: 3838406 - DNA, 22 bp, Homo sapiens
ctgaaatatattttaaatgtgg

SEQ ID NO: 3838407 - DNA, 23 bp, Homo sapiens
ctgaaatatattttaaatgtgga

SEQ ID NO: 3838408 - DNA, 17 bp, Homo sapiens
ctgaaatcatctttgtt

SEQ ID NO: 3838409 - DNA, 20 bp, Homo sapiens
ctgaactaattcatttatta

SEQ ID NO: 3838410 - DNA, 14 bp, Homo sapiens
ctgaagacaggcac

SEQ ID NO: 3838411 - DNA, 17 bp, Homo sapiens
ctgaagacaggcacaaa

SEQ ID NO: 3838412 - DNA, 21 bp, Homo sapiens
ctgaagacaggcacaaaatgt

SEQ ID NO: 3838413 - DNA, 12 bp, Homo sapiens
ctgaagcataaa

SEQ ID NO: 3838414 - DNA, 24 bp, Homo sapiens
ctgaagccacacagcccagaaggc

SEQ ID NO: 3838415 - DNA, 14 bp, Homo sapiens
ctgaagccagcctt

SEQ ID NO: 3838416 - DNA, 12 bp, Homo sapiens
ctgaagcctcta

SEQ ID NO: 3838417 - DNA, 16 bp, Homo sapiens
ctgaagcctggacgca

SEQ ID NO: 3838418 - DNA, 14 bp, Homo sapiens
ctgaagcttattaa

SEQ ID NO: 3838419 - DNA, 17 bp, Homo sapiens
ctgaagcttattaatgc

SEQ ID NO: 3838420 - DNA, 20 bp, Homo sapiens
ctgaagcttattaatgctaa

SEQ ID NO: 3838421 - DNA, 14 bp, Homo sapiens
ctgaaggaaaaaca

SEQ ID NO: 3838422 - DNA, 18 bp, Homo sapiens
ctgaaggaaaaacacaag

SEQ ID NO: 3838423 - DNA, 22 bp, Homo sapiens
ctgaaggaaaaacacaagcaaa

SEQ ID NO: 3838424 - DNA, 19 bp, Homo sapiens
ctgaaggattttaaatgct

SEQ ID NO: 3838425 - DNA, 16 bp, Homo sapiens
ctgaagggtgctcagt

SEQ ID NO: 3838426 - DNA, 20 bp, Homo sapiens
ctgaagggtgctcagtctcc

SEQ ID NO: 3838427 - DNA, 23 bp, Homo sapiens
ctgaatattgacaagtgtctttt

SEQ ID NO: 3838428 - DNA, 13 bp, Homo sapiens
tcaagtgtaatta

SEQ ID NO: 3838429 - DNA, 17 bp, Homo sapiens
tcaagtgtaattagctt

SEQ ID NO: 3838430 - DNA, 18 bp, Homo sapiens
tcaatagtgcaactgttt

SEQ ID NO: 3838431 - DNA, 21 bp, Homo sapiens
tcaatagtgcaactgttttga

SEQ ID NO: 3838432 - DNA, 17 bp, Homo sapiens
tcaatcagaaggtattc

SEQ ID NO: 3838433 - DNA, 19 bp, Homo sapiens
tcaatccaaattccctctg

SEQ ID NO: 3838434 - DNA, 14 bp, Homo sapiens
tcacacagcctgtg

SEQ ID NO: 3838435 - DNA, 18 bp, Homo sapiens
tcacacagcctgtgtgca

SEQ ID NO: 3838436 - DNA, 17 bp, Homo sapiens
tcacagcctctgacccc

SEQ ID NO: 3838437 - DNA, 22 bp, Homo sapiens
tcaccaaagatctgctcctcgc

SEQ ID NO: 3838438 - DNA, 23 bp, Homo sapiens
tcaccacttgtccattgcgttat

SEQ ID NO: 3838439 - DNA, 16 bp, Homo sapiens
tcacccagagctgcct

SEQ ID NO: 3838440 - DNA, 15 bp, Homo sapiens
tcacccatggcctca

SEQ ID NO: 3838441 - DNA, 18 bp, Homo sapiens
tcacccatggcctcagat

SEQ ID NO: 3838442 - DNA, 13 bp, Homo sapiens
tcacccctgtcct

SEQ ID NO: 3838443 - DNA, 17 bp, Homo sapiens
tcacccctgtcctcact

SEQ ID NO: 3838444 - DNA, 20 bp, Homo sapiens
tcacccctgtcctcactgct

SEQ ID NO: 3838445 - DNA, 23 bp, Homo sapiens
tcacctcatgcccaccccctgcc

SEQ ID NO: 3838446 - DNA, 20 bp, Homo sapiens
tcacctgcgcagggccctct

SEQ ID NO: 3838447 - DNA, 22 bp, Homo sapiens
tcactaccattgtaacttggat

SEQ ID NO: 3838448 - DNA, 23 bp, Homo sapiens
tcactccataaaaagaaagctaa

SEQ ID NO: 3838449 - DNA, 22 bp, Homo sapiens
tcactgactcaggctgctcctt

SEQ ID NO: 3838450 - DNA, 11 bp, Homo sapiens
tcactgccagg

SEQ ID NO: 3838451 - DNA, 20 bp, Homo sapiens
tcactgccaggccagcctcc

SEQ ID NO: 3838452 - DNA, 21 bp, Homo sapiens
tcactggaaaggggagagcct

SEQ ID NO: 3838453 - DNA, 22 bp, Homo sapiens
tcagacttcaccaaatatatgc

SEQ ID NO: 3838454 - DNA, 22 bp, Homo sapiens
tcagagttgatggttgtacata

SEQ ID NO: 3838455 - DNA, 22 bp, Homo sapiens
tcagatgatggggtcagcaggc

SEQ ID NO: 3838456 - DNA, 23 bp, Homo sapiens
tcagatgatggggtcagcaggcc

SEQ ID NO: 3838457 - DNA, 15 bp, Homo sapiens
tcagatttaaaacaa

SEQ ID NO: 3838458 - DNA, 23 bp, Homo sapiens
tcagcaactttcccttgccctgg

SEQ ID NO: 3838459 - DNA, 11 bp, Homo sapiens
tcagcaggccc

SEQ ID NO: 3838460 - DNA, 13 bp, Homo sapiens
tcagccccaggag

SEQ ID NO: 3838461 - DNA, 15 bp, Homo sapiens
tcagccccaggagaa

SEQ ID NO: 3838462 - DNA, 15 bp, Homo sapiens
tcagccctgagctgg

SEQ ID NO: 3838463 - DNA, 17 bp, Homo sapiens
tcagccctggaggtgcc

SEQ ID NO: 3838464 - DNA, 19 bp, Homo sapiens
tcagccctggaggtgccag

SEQ ID NO: 3838465 - DNA, 22 bp, Homo sapiens
tcagctgagtggggcaggcttg

SEQ ID NO: 3838466 - DNA, 22 bp, Homo sapiens
tcagctttaagatatctttgga

SEQ ID NO: 3838467 - DNA, 18 bp, Homo sapiens
tcaggcaaggtctggcct

SEQ ID NO: 3838468 - DNA, 16 bp, Homo sapiens
tcaggcactagccttt

SEQ ID NO: 3838469 - DNA, 22 bp, Homo sapiens
tcaggcactagcctttggctct

SEQ ID NO: 3838470 - DNA, 14 bp, Homo sapiens
tcaggctggtggga

SEQ ID NO: 3838471 - DNA, 21 bp, Homo sapiens
tcaggcttgcattaaaagact

SEQ ID NO: 3838472 - DNA, 19 bp, Homo sapiens
tcagggccaagccggccca

SEQ ID NO: 3838473 - DNA, 21 bp, Homo sapiens
tcagggccaagccggcccaac

SEQ ID NO: 3838474 - DNA, 22 bp, Homo sapiens
tcaggggcacagacctctccca

SEQ ID NO: 3838475 - DNA, 17 bp, Homo sapiens
tcagtaacttgtttaca

SEQ ID NO: 3838476 - DNA, 20 bp, Homo sapiens
tcagtagtttctaagtctgt

SEQ ID NO: 3838477 - DNA, 14 bp, Homo sapiens
tcagtatggtgcta

SEQ ID NO: 3838478 - DNA, 17 bp, Homo sapiens
tcagtcatccaggctta

SEQ ID NO: 3838479 - DNA, 17 bp, Homo sapiens
tcagtcctcccctcaca

SEQ ID NO: 3838480 - DNA, 19 bp, Homo sapiens
tcagtcctcccctcacagc

SEQ ID NO: 3838481 - DNA, 21 bp, Homo sapiens
tcagtcctcccctcacagcct

SEQ ID NO: 3838482 - DNA, 21 bp, Homo sapiens
tcagtgtcaaataaacactgt

SEQ ID NO: 3838483 - DNA, 22 bp, Homo sapiens
tcagtgtcaaataaacactgtg

SEQ ID NO: 3838484 - DNA, 18 bp, Homo sapiens
tcagttttactgcatttt

SEQ ID NO: 3838485 - DNA, 18 bp, Homo sapiens
tcataaataaagtttgtt

SEQ ID NO: 3838486 - DNA, 13 bp, Homo sapiens
tcataatacataa

SEQ ID NO: 3838487 - DNA, 21 bp, Homo sapiens
tcataatacataaagttctct

SEQ ID NO: 3838488 - DNA, 17 bp, Homo sapiens
tcatatacctcttgaag

SEQ ID NO: 3838489 - DNA, 14 bp, Homo sapiens
tcatcaatcattgt

SEQ ID NO: 3838490 - DNA, 16 bp, Homo sapiens
tcatcaatcattgtac

SEQ ID NO: 3838491 - DNA, 19 bp, Homo sapiens
tcatcaatcattgtacagt

SEQ ID NO: 3838492 - DNA, 19 bp, Homo sapiens
taggggtagaaaatgtttt

SEQ ID NO: 3838493 - DNA, 16 bp, Homo sapiens
taggtaaattacagtt

SEQ ID NO: 3838494 - DNA, 23 bp, Homo sapiens
taggtgggagccaccactcctgc

SEQ ID NO: 3838495 - DNA, 16 bp, Homo sapiens
tagtaccaaatgcttt

SEQ ID NO: 3838496 - DNA, 23 bp, Homo sapiens
tagtatcagtcatgacagatgaa

SEQ ID NO: 3838497 - DNA, 15 bp, Homo sapiens
tagtgctgaagctta

SEQ ID NO: 3838498 - DNA, 18 bp, Homo sapiens
tagtgctgaagcttatta

SEQ ID NO: 3838499 - DNA, 13 bp, Homo sapiens
tagttccacacag

SEQ ID NO: 3838500 - DNA, 20 bp, Homo sapiens
tagttgcaactttgtataaa

SEQ ID NO: 3838501 - DNA, 22 bp, Homo sapiens
tagttttgctccttctgtgttt

SEQ ID NO: 3838502 - DNA, 16 bp, Homo sapiens
tataaaaaaaagttgt

SEQ ID NO: 3838503 - DNA, 22 bp, Homo sapiens
tataaaaacccctaaaaacaaa

SEQ ID NO: 3838504 - DNA, 23 bp, Homo sapiens
tataaaaacccctaaaaacaaaa

SEQ ID NO: 3838505 - DNA, 12 bp, Homo sapiens
tataaaagcctg

SEQ ID NO: 3838506 - DNA, 19 bp, Homo sapiens
tataaaagcctgtttaaga

SEQ ID NO: 3838507 - DNA, 12 bp, Homo sapiens
tataaaatgtgc

SEQ ID NO: 3838508 - DNA, 18 bp, Homo sapiens
tataaacaaacaaacaaa

SEQ ID NO: 3838509 - DNA, 23 bp, Homo sapiens
tataaacaaacaaacaaaaattg

SEQ ID NO: 3838510 - DNA, 16 bp, Homo sapiens
tataaagaaagattgt

SEQ ID NO: 3838511 - DNA, 20 bp, Homo sapiens
tataaagaaagattgtaaac

SEQ ID NO: 3838512 - DNA, 13 bp, Homo sapiens
tataaataaatat

SEQ ID NO: 3838513 - DNA, 17 bp, Homo sapiens
tataaataaatatatat

SEQ ID NO: 3838514 - DNA, 14 bp, Homo sapiens
tataaatatatata

SEQ ID NO: 3838515 - DNA, 22 bp, Homo sapiens
tataaatatatataaatatata

SEQ ID NO: 3838516 - DNA, 23 bp, Homo sapiens
tataaatatatataaatatatat

SEQ ID NO: 3838517 - DNA, 18 bp, Homo sapiens
tataacagttataaagaa

SEQ ID NO: 3838518 - DNA, 13 bp, Homo sapiens
tataagaaaacta

SEQ ID NO: 3838519 - DNA, 21 bp, Homo sapiens
tataagaaattttattagaca

SEQ ID NO: 3838520 - DNA, 19 bp, Homo sapiens
tataagtatataaatacta

SEQ ID NO: 3838521 - DNA, 17 bp, Homo sapiens
tataagtgtgtgttttt

SEQ ID NO: 3838522 - DNA, 19 bp, Homo sapiens
tataatattcatacaacaa

SEQ ID NO: 3838523 - DNA, 20 bp, Homo sapiens
tataatgtatgaattttgta

SEQ ID NO: 3838524 - DNA, 21 bp, Homo sapiens
tataattttgcaaatctgtta

SEQ ID NO: 3838525 - DNA, 19 bp, Homo sapiens
tatacaatatatattttgt

SEQ ID NO: 3838526 - DNA, 12 bp, Homo sapiens
tatactgaagga

SEQ ID NO: 3838527 - DNA, 16 bp, Homo sapiens
tatagtactgctttac

SEQ ID NO: 3838528 - DNA, 15 bp, Homo sapiens
tatagtattaagtga

SEQ ID NO: 3838529 - DNA, 16 bp, Homo sapiens
tatagtattaagtgaa

SEQ ID NO: 3838530 - DNA, 17 bp, Homo sapiens
tatagtattaagtgaaa

SEQ ID NO: 3838531 - DNA, 14 bp, Homo sapiens
tatataaaatgtgc

SEQ ID NO: 3838532 - DNA, 16 bp, Homo sapiens
tatataaaatgtgcga

SEQ ID NO: 3838533 - DNA, 13 bp, Homo sapiens
tatataaacaaac

SEQ ID NO: 3838534 - DNA, 11 bp, Homo sapiens
tatataaataa

SEQ ID NO: 3838535 - DNA, 22 bp, Homo sapiens
tatataaataaatatatatatc

SEQ ID NO: 3838536 - DNA, 12 bp, Homo sapiens
tatatataaata

SEQ ID NO: 3838537 - DNA, 13 bp, Homo sapiens
tatatataaataa

SEQ ID NO: 3838538 - DNA, 14 bp, Homo sapiens
tatatatacaatat

SEQ ID NO: 3838539 - DNA, 14 bp, Homo sapiens
tatatctttcagat

SEQ ID NO: 3838540 - DNA, 15 bp, Homo sapiens
tatatctttgtaaat

SEQ ID NO: 3838541 - DNA, 18 bp, Homo sapiens
tatatctttgtaaattat

SEQ ID NO: 3838542 - DNA, 19 bp, Homo sapiens
tatatctttgtaaattatt

SEQ ID NO: 3838543 - DNA, 21 bp, Homo sapiens
tatatggaacgcattttgggt

SEQ ID NO: 3838544 - DNA, 15 bp, Homo sapiens
tatatgtttgtggaa

SEQ ID NO: 3838545 - DNA, 22 bp, Homo sapiens
tatatgtttgtggaatggattt

SEQ ID NO: 3838546 - DNA, 13 bp, Homo sapiens
tatattaactttt

SEQ ID NO: 3838547 - DNA, 17 bp, Homo sapiens
tatattaacttttatta

SEQ ID NO: 3838548 - DNA, 21 bp, Homo sapiens
tatattgtgttttaacaccaa

SEQ ID NO: 3838549 - DNA, 15 bp, Homo sapiens
tatattttaaatgtg

SEQ ID NO: 3838550 - DNA, 14 bp, Homo sapiens
gttttactgcattt

SEQ ID NO: 3838551 - DNA, 20 bp, Homo sapiens
gttttactgcattttcacaa

SEQ ID NO: 3838552 - DNA, 15 bp, Homo sapiens
gttttattttctaaa

SEQ ID NO: 3838553 - DNA, 18 bp, Homo sapiens
gttttcagacctttgtct

SEQ ID NO: 3838554 - DNA, 22 bp, Homo sapiens
gttttcagacctttgtctgaag

SEQ ID NO: 3838555 - DNA, 12 bp, Homo sapiens
gttttcatttca

SEQ ID NO: 3838556 - DNA, 19 bp, Homo sapiens
gttttcatttcatatatct

SEQ ID NO: 3838557 - DNA, 19 bp, Homo sapiens
gttttgcctcatgaacact

SEQ ID NO: 3838558 - DNA, 17 bp, Homo sapiens
gtttttataatattcat

SEQ ID NO: 3838559 - DNA, 14 bp, Homo sapiens
gtttttgaaacaga

SEQ ID NO: 3838560 - DNA, 15 bp, Homo sapiens
gtttttttttaaaga

SEQ ID NO: 3838561 - DNA, 23 bp, Homo sapiens
taaaaacaaaacaaacacacaca

SEQ ID NO: 3838562 - DNA, 14 bp, Homo sapiens
taaaaagaagtttc

SEQ ID NO: 3838563 - DNA, 19 bp, Homo sapiens
taaaaagcagtttttgaaa

SEQ ID NO: 3838564 - DNA, 16 bp, Homo sapiens
taaaaagccaccacac

SEQ ID NO: 3838565 - DNA, 17 bp, Homo sapiens
taaaaagtagattaaaa

SEQ ID NO: 3838566 - DNA, 22 bp, Homo sapiens
taaaaagtagattaaaatattt

SEQ ID NO: 3838567 - DNA, 14 bp, Homo sapiens
taaaaatttataac

SEQ ID NO: 3838568 - DNA, 15 bp, Homo sapiens
taaaaatttataaca

SEQ ID NO: 3838569 - DNA, 18 bp, Homo sapiens
taaaacaagaaagtttcc

SEQ ID NO: 3838570 - DNA, 22 bp, Homo sapiens
taaaacaaggggttactttaca

SEQ ID NO: 3838571 - DNA, 23 bp, Homo sapiens
taaaacaatgaagtgttttacaa

SEQ ID NO: 3838572 - DNA, 11 bp, Homo sapiens
taaaaccaaag

SEQ ID NO: 3838573 - DNA, 14 bp, Homo sapiens
taaaactcagattt

SEQ ID NO: 3838574 - DNA, 22 bp, Homo sapiens
taaaagattttgtgaaatttca

SEQ ID NO: 3838575 - DNA, 23 bp, Homo sapiens
taaaaggagggtggcctcaagaa

SEQ ID NO: 3838576 - DNA, 20 bp, Homo sapiens
taaaagggactgagaaattt

SEQ ID NO: 3838577 - DNA, 15 bp, Homo sapiens
taaaatatcattcag

SEQ ID NO: 3838578 - DNA, 18 bp, Homo sapiens
taaaatatcattcagcaa

SEQ ID NO: 3838579 - DNA, 19 bp, Homo sapiens
taaaatatcattcagcaac

SEQ ID NO: 3838580 - DNA, 21 bp, Homo sapiens
taaaatcttgatagctaaata

SEQ ID NO: 3838581 - DNA, 20 bp, Homo sapiens
taaaattcggaatggttttc

SEQ ID NO: 3838582 - DNA, 16 bp, Homo sapiens
taaaattctactgtat

SEQ ID NO: 3838583 - DNA, 19 bp, Homo sapiens
taaaatttttaatctttaa

SEQ ID NO: 3838584 - DNA, 15 bp, Homo sapiens
taaacaaacaaacaa

SEQ ID NO: 3838585 - DNA, 21 bp, Homo sapiens
taaaccttcagattaatgact

SEQ ID NO: 3838586 - DNA, 21 bp, Homo sapiens
taaactaaagtgtgctttata

SEQ ID NO: 3838587 - DNA, 14 bp, Homo sapiens
taaactgtaaatca

SEQ ID NO: 3838588 - DNA, 15 bp, Homo sapiens
taaactgtaaatcat

SEQ ID NO: 3838589 - DNA, 19 bp, Homo sapiens
taaacttcagttttactgc

SEQ ID NO: 3838590 - DNA, 20 bp, Homo sapiens
taaacttttttcttactgtc

SEQ ID NO: 3838591 - DNA, 21 bp, Homo sapiens
taaagaaagattgtaaactaa

SEQ ID NO: 3838592 - DNA, 13 bp, Homo sapiens
gtgcataaataat

SEQ ID NO: 3838593 - DNA, 18 bp, Homo sapiens
gtgcataaataattttgt

SEQ ID NO: 3838594 - DNA, 16 bp, Homo sapiens
gtgccagcaaagcccc

SEQ ID NO: 3838595 - DNA, 14 bp, Homo sapiens
gtgccaggctggga

SEQ ID NO: 3838596 - DNA, 18 bp, Homo sapiens
gtgccaggctgggaggct

SEQ ID NO: 3838597 - DNA, 19 bp, Homo sapiens
gtgccaggctgggaggctc

SEQ ID NO: 3838598 - DNA, 15 bp, Homo sapiens
gtgcccgccctgggc

SEQ ID NO: 3838599 - DNA, 16 bp, Homo sapiens
gtgcctctcccatggc

SEQ ID NO: 3838600 - DNA, 23 bp, Homo sapiens
gtgcctgacaccacgctggagct

SEQ ID NO: 3838601 - DNA, 14 bp, Homo sapiens
gtgcctgagaggca

SEQ ID NO: 3838602 - DNA, 12 bp, Homo sapiens
gtgcctgggagg

SEQ ID NO: 3838603 - DNA, 15 bp, Homo sapiens
gtgcctgggaggagt

SEQ ID NO: 3838604 - DNA, 13 bp, Homo sapiens
gtgcggagctgat

SEQ ID NO: 3838605 - DNA, 14 bp, Homo sapiens
gtgctaatgtgtct

SEQ ID NO: 3838606 - DNA, 20 bp, Homo sapiens
gtgctaatgtgtctgtggac

SEQ ID NO: 3838607 - DNA, 13 bp, Homo sapiens
gtgctactaacag

SEQ ID NO: 3838608 - DNA, 14 bp, Homo sapiens
gtgctactaacaga

SEQ ID NO: 3838609 - DNA, 15 bp, Homo sapiens
gtgctgaagcttatt

SEQ ID NO: 3838610 - DNA, 20 bp, Homo sapiens
gtgctgcgatgggggatcag

SEQ ID NO: 3838611 - DNA, 16 bp, Homo sapiens
gtgctggaggtgggag

SEQ ID NO: 3838612 - DNA, 15 bp, Homo sapiens
gtgctgggaggaggg

SEQ ID NO: 3838613 - DNA, 23 bp, Homo sapiens
gtgctgggaggagggagagggag

SEQ ID NO: 3838614 - DNA, 12 bp, Homo sapiens
gtgcttgaagat

SEQ ID NO: 3838615 - DNA, 20 bp, Homo sapiens
gtgcttgaagattcaggctt

SEQ ID NO: 3838616 - DNA, 16 bp, Homo sapiens
gtggaagaagggagaa

SEQ ID NO: 3838617 - DNA, 12 bp, Homo sapiens
gtggaccctcgc

SEQ ID NO: 3838618 - DNA, 16 bp, Homo sapiens
gtggacttagaaagca

SEQ ID NO: 3838619 - DNA, 19 bp, Homo sapiens
gtggacttagaaagcaggg

SEQ ID NO: 3838620 - DNA, 22 bp, Homo sapiens
gtggacttagaaagcaggggct

SEQ ID NO: 3838621 - DNA, 19 bp, Homo sapiens
gtggagactggggggcttg

SEQ ID NO: 3838622 - DNA, 20 bp, Homo sapiens
gtggagagttgggggccagc

SEQ ID NO: 3838623 - DNA, 18 bp, Homo sapiens
gtggaggggagctgctgg

SEQ ID NO: 3838624 - DNA, 15 bp, Homo sapiens
gtggaggggtgtggc

SEQ ID NO: 3838625 - DNA, 23 bp, Homo sapiens
gtggaggttgcagtgagctgaga

SEQ ID NO: 3838626 - DNA, 17 bp, Homo sapiens
gtggccctgatccagga

SEQ ID NO: 3838627 - DNA, 16 bp, Homo sapiens
gtggccctgtccctcc

SEQ ID NO: 3838628 - DNA, 21 bp, Homo sapiens
gctttagacactggctgccag

SEQ ID NO: 3838629 - DNA, 10 bp, Homo sapiens
gctttataaa

SEQ ID NO: 3838630 - DNA, 20 bp, Homo sapiens
gctttataaaaaaaagttgt

SEQ ID NO: 3838631 - DNA, 14 bp, Homo sapiens
gctttataaataaa

SEQ ID NO: 3838632 - DNA, 19 bp, Homo sapiens
gctttcctgcctccttgaa

SEQ ID NO: 3838633 - DNA, 14 bp, Homo sapiens
gctttgccccactg

SEQ ID NO: 3838634 - DNA, 16 bp, Homo sapiens
gctttgccccactggg

SEQ ID NO: 3838635 - DNA, 16 bp, Homo sapiens
gctttgtgagagagga

SEQ ID NO: 3838636 - DNA, 16 bp, Homo sapiens
gctttgtgctgctgag

SEQ ID NO: 3838637 - DNA, 16 bp, Homo sapiens
gcttttatagaggcta

SEQ ID NO: 3838638 - DNA, 20 bp, Homo sapiens
gcttttccctttttttaagt

SEQ ID NO: 3838639 - DNA, 22 bp, Homo sapiens
gcttttctgccctggctgctgc

SEQ ID NO: 3838640 - DNA, 15 bp, Homo sapiens
ggaaaactaactcag

SEQ ID NO: 3838641 - DNA, 16 bp, Homo sapiens
ggaaaatgtgagggga

SEQ ID NO: 3838642 - DNA, 19 bp, Homo sapiens
ggaaaccaaggtcaggagg

SEQ ID NO: 3838643 - DNA, 19 bp, Homo sapiens
ggaaaggggagagcctgct

SEQ ID NO: 3838644 - DNA, 21 bp, Homo sapiens
ggaaaggggagagcctgctgg

SEQ ID NO: 3838645 - DNA, 18 bp, Homo sapiens
ggaaagttgcatttaatg

SEQ ID NO: 3838646 - DNA, 15 bp, Homo sapiens
ggaaatggggagctg

SEQ ID NO: 3838647 - DNA, 17 bp, Homo sapiens
ggaaatggggagctggc

SEQ ID NO: 3838648 - DNA, 21 bp, Homo sapiens
ggaactctgtgtgagagagag

SEQ ID NO: 3838649 - DNA, 22 bp, Homo sapiens
ggaagaaaattatgtaaagttt

SEQ ID NO: 3838650 - DNA, 15 bp, Homo sapiens
ggaagaagggagaag

SEQ ID NO: 3838651 - DNA, 18 bp, Homo sapiens
ggaagaagggagaagaaa

SEQ ID NO: 3838652 - DNA, 14 bp, Homo sapiens
ggaagcagaataaa

SEQ ID NO: 3838653 - DNA, 15 bp, Homo sapiens
ggaagcagaataaag

SEQ ID NO: 3838654 - DNA, 21 bp, Homo sapiens
ggaaggccatggggcagcctc

SEQ ID NO: 3838655 - DNA, 22 bp, Homo sapiens
ggaaggccatggggcagcctcc

SEQ ID NO: 3838656 - DNA, 12 bp, Homo sapiens
ggaataaagctt

SEQ ID NO: 3838657 - DNA, 15 bp, Homo sapiens
ggaatgactgaagac

SEQ ID NO: 3838658 - DNA, 21 bp, Homo sapiens
ggaatgaggtgggaggtggaa

SEQ ID NO: 3838659 - DNA, 23 bp, Homo sapiens
ggaatgatgtatataaaatgtgc

SEQ ID NO: 3838660 - DNA, 12 bp, Homo sapiens
ggaattgtgttt

SEQ ID NO: 3838661 - DNA, 22 bp, Homo sapiens
ggacaaggctgtgccaggctgg

SEQ ID NO: 3838662 - DNA, 19 bp, Homo sapiens
ggacagcttgagccgggcc

SEQ ID NO: 3838663 - DNA, 18 bp, Homo sapiens
ggaccctcagccccagga

SEQ ID NO: 3838664 - DNA, 20 bp, Homo sapiens
ggaccctcagccccaggaga

SEQ ID NO: 3838665 - DNA, 16 bp, Homo sapiens
ggaccctgtgacatgg

SEQ ID NO: 3838666 - DNA, 16 bp, Homo sapiens
ggacctcagctgcttc

SEQ ID NO: 3838667 - DNA, 17 bp, Homo sapiens
ggacctgagcctggcca

SEQ ID NO: 3838668 - DNA, 11 bp, Homo sapiens
ggacctgcccc

SEQ ID NO: 3838669 - DNA, 14 bp, Homo sapiens
ggacgcagccacac

SEQ ID NO: 3838670 - DNA, 22 bp, Homo sapiens
ggactagcccctgtggagactg

SEQ ID NO: 3838671 - DNA, 18 bp, Homo sapiens
ggactgagaaatttataa

SEQ ID NO: 3838672 - DNA, 17 bp, Homo sapiens
ggactgtggaggggagc

SEQ ID NO: 3838673 - DNA, 10 bp, Homo sapiens
ggagaaacaa

SEQ ID NO: 3838674 - DNA, 15 bp, Homo sapiens
ggagaagagaggaga

SEQ ID NO: 3838675 - DNA, 21 bp, Homo sapiens
ggagaagccaagggacacagg

SEQ ID NO: 3838676 - DNA, 20 bp, Homo sapiens
ggagaatccagctgggctag

SEQ ID NO: 3838677 - DNA, 20 bp, Homo sapiens
ggagaattaggaaggccatg

SEQ ID NO: 3838678 - DNA, 19 bp, Homo sapiens
ggagacagccccagagcag

SEQ ID NO: 3838679 - DNA, 20 bp, Homo sapiens
ggagacagccccagagcagg

SEQ ID NO: 3838680 - DNA, 23 bp, Homo sapiens
ggagacagccccagagcagggtg

SEQ ID NO: 3838681 - DNA, 14 bp, Homo sapiens
ggagaccacccccg

SEQ ID NO: 3838682 - DNA, 17 bp, Homo sapiens
ggagaccacccccgagc

SEQ ID NO: 3838683 - DNA, 18 bp, Homo sapiens
ggagaccacccccgagct

SEQ ID NO: 3838684 - DNA, 15 bp, Homo sapiens
ggagactggggggct

SEQ ID NO: 3838685 - DNA, 18 bp, Homo sapiens
ggagactggggggcttga

SEQ ID NO: 3838686 - DNA, 18 bp, Homo sapiens
ggagagaaagtgggtgag

SEQ ID NO: 3838687 - DNA, 20 bp, Homo sapiens
ggagagagaaagccaggcag

SEQ ID NO: 3838688 - DNA, 10 bp, Homo sapiens
ggagagaggc

SEQ ID NO: 3838689 - DNA, 16 bp, Homo sapiens
ggagagcctgctggca

SEQ ID NO: 3838690 - DNA, 18 bp, Homo sapiens
ggagagctggcagtgtgc

SEQ ID NO: 3838691 - DNA, 18 bp, Homo sapiens
ggagaggagagaggcaga

SEQ ID NO: 3838692 - DNA, 19 bp, Homo sapiens
ggagagtccttagcctggg

SEQ ID NO: 3838693 - DNA, 20 bp, Homo sapiens
ggagattgagaaggagagaa

SEQ ID NO: 3838694 - DNA, 14 bp, Homo sapiens
ggagcaagccctga

SEQ ID NO: 3838695 - DNA, 17 bp, Homo sapiens
ggagcaagccctgaccc

SEQ ID NO: 3838696 - DNA, 19 bp, Homo sapiens
ggagcagagcaagtctgca

SEQ ID NO: 3838697 - DNA, 15 bp, Homo sapiens
ggagcaggagattga

SEQ ID NO: 3838698 - DNA, 22 bp, Homo sapiens
ggagcaggagattgagaaggag

SEQ ID NO: 3838699 - DNA, 23 bp, Homo sapiens
ggagcaggagattgagaaggaga

SEQ ID NO: 3838700 - DNA, 16 bp, Homo sapiens
ggagccagaggccagg

SEQ ID NO: 3838701 - DNA, 17 bp, Homo sapiens
ggagccagaggccagga

SEQ ID NO: 3838702 - DNA, 15 bp, Homo sapiens
ggagcctgtgtaaca

SEQ ID NO: 3838703 - DNA, 18 bp, Homo sapiens
ggagcctgtgtaacagct

SEQ ID NO: 3838704 - DNA, 21 bp, Homo sapiens
ggagcctgtgtaacagctcct

SEQ ID NO: 3838705 - DNA, 22 bp, Homo sapiens
ggaggaagcagaataaagcaat

SEQ ID NO: 3838706 - DNA, 14 bp, Homo sapiens
ggaggaaggcaaga

SEQ ID NO: 3838707 - DNA, 13 bp, Homo sapiens
ggaggctcctggt

SEQ ID NO: 3838708 - DNA, 15 bp, Homo sapiens
ggaggctcggggctc

SEQ ID NO: 3838709 - DNA, 17 bp, Homo sapiens
ggaggctcggggctccc

SEQ ID NO: 3838710 - DNA, 20 bp, Homo sapiens
ggaggctcggggctccccac

SEQ ID NO: 3838711 - DNA, 13 bp, Homo sapiens
ggagggagaggga

SEQ ID NO: 3838712 - DNA, 19 bp, Homo sapiens
ggagggagggggaggtgaa

SEQ ID NO: 3838713 - DNA, 16 bp, Homo sapiens
ggagggccctgaggaa

SEQ ID NO: 3838714 - DNA, 19 bp, Homo sapiens
ggagggccctgaggaataa

SEQ ID NO: 3838715 - DNA, 21 bp, Homo sapiens
ggaggggagctgctggccatg

SEQ ID NO: 3838716 - DNA, 17 bp, Homo sapiens
ggagggggaggggagaa

SEQ ID NO: 3838717 - DNA, 16 bp, Homo sapiens
ggagggggcttgaagc

SEQ ID NO: 3838718 - DNA, 21 bp, Homo sapiens
ggagggggcttgaagccaaag

SEQ ID NO: 3838719 - DNA, 16 bp, Homo sapiens
ggaggggggagccaga

SEQ ID NO: 3838720 - DNA, 18 bp, Homo sapiens
ggaggggggagccagagg

SEQ ID NO: 3838721 - DNA, 12 bp, Homo sapiens
ggagggtggcag

SEQ ID NO: 3838722 - DNA, 13 bp, Homo sapiens
ggagggtggcaga

SEQ ID NO: 3838723 - DNA, 15 bp, Homo sapiens
ggagggtggcagaga

SEQ ID NO: 3838724 - DNA, 18 bp, Homo sapiens
ggagggtggcagagacag

SEQ ID NO: 3838725 - DNA, 13 bp, Homo sapiens
ggaggtcactgga

SEQ ID NO: 3838726 - DNA, 20 bp, Homo sapiens
ggaggtgaaaagggcagagg

SEQ ID NO: 3838727 - DNA, 21 bp, Homo sapiens
ggaggtgaaaagggcagaggc

SEQ ID NO: 3838728 - DNA, 14 bp, Homo sapiens
ggaggtgccagcaa

SEQ ID NO: 3838729 - DNA, 20 bp, Homo sapiens
ggaggtggaggttgcagtga

SEQ ID NO: 3838730 - DNA, 19 bp, Homo sapiens
ggaggtgggagcaggagat

SEQ ID NO: 3838731 - DNA, 15 bp, Homo sapiens
ggagtgccatggctg

SEQ ID NO: 3838732 - DNA, 13 bp, Homo sapiens
ggagtgtggcctg

SEQ ID NO: 3838733 - DNA, 22 bp, Homo sapiens
ggagtgtggcctggatccatcc

SEQ ID NO: 3838734 - DNA, 14 bp, Homo sapiens
ggagttctgctcat

SEQ ID NO: 3838735 - DNA, 15 bp, Homo sapiens
ggatcagcagggcag

SEQ ID NO: 3838736 - DNA, 18 bp, Homo sapiens
ggatgatgactatggaaa

SEQ ID NO: 3838737 - DNA, 12 bp, Homo sapiens
ggatgcaaataa

SEQ ID NO: 3838738 - DNA, 22 bp, Homo sapiens
ggatgccagccccgtgccagga

SEQ ID NO: 3838739 - DNA, 14 bp, Homo sapiens
ggatgcctgagccc

SEQ ID NO: 3838740 - DNA, 21 bp, Homo sapiens
ggatggagcccaggcgggagc

SEQ ID NO: 3838741 - DNA, 16 bp, Homo sapiens
ggattagacagtaaga

SEQ ID NO: 3838742 - DNA, 18 bp, Homo sapiens
ggattgattatgcagaat

SEQ ID NO: 3838743 - DNA, 17 bp, Homo sapiens
ggcaaaccccaaagaga

SEQ ID NO: 3838744 - DNA, 21 bp, Homo sapiens
ggcaagaggtgcctgggagga

SEQ ID NO: 3838745 - DNA, 24 bp, Homo sapiens
ggcaaggggcagccagccctggct

SEQ ID NO: 3838746 - DNA, 18 bp, Homo sapiens
ggcaataaataaatgttt

SEQ ID NO: 3838747 - DNA, 12 bp, Homo sapiens
ggcacaaaatgt

SEQ ID NO: 3838748 - DNA, 14 bp, Homo sapiens
ggcacaaaatgtga

SEQ ID NO: 3838749 - DNA, 19 bp, Homo sapiens
ggcacagacctctcccacc

SEQ ID NO: 3838750 - DNA, 12 bp, Homo sapiens
ggcacagtggct

SEQ ID NO: 3838751 - DNA, 22 bp, Homo sapiens
ggcacatgtcattgcccacttc

SEQ ID NO: 3838752 - DNA, 15 bp, Homo sapiens
ggcaccccaggcagc

SEQ ID NO: 3838753 - DNA, 19 bp, Homo sapiens
ggcaccccaggcagctcct

SEQ ID NO: 3838754 - DNA, 12 bp, Homo sapiens
gggagcaggaga

SEQ ID NO: 3838755 - DNA, 13 bp, Homo sapiens
gggagcaggagat

SEQ ID NO: 3838756 - DNA, 18 bp, Homo sapiens
gggagcatagaaggcagg

SEQ ID NO: 3838757 - DNA, 14 bp, Homo sapiens
gggagccagaggcc

SEQ ID NO: 3838758 - DNA, 16 bp, Homo sapiens
gggagccagaggccag

SEQ ID NO: 3838759 - DNA, 18 bp, Homo sapiens
gggagccagaggccagga

SEQ ID NO: 3838760 - DNA, 14 bp, Homo sapiens
gggagctgctggcc

SEQ ID NO: 3838761 - DNA, 12 bp, Homo sapiens
gggaggaagcag

SEQ ID NO: 3838762 - DNA, 18 bp, Homo sapiens
gggaggaagcagaataaa

SEQ ID NO: 3838763 - DNA, 13 bp, Homo sapiens
gggaggagggaga

SEQ ID NO: 3838764 - DNA, 19 bp, Homo sapiens
gggaggaggttgtgtcact

SEQ ID NO: 3838765 - DNA, 14 bp, Homo sapiens
gggaggagtggccc

SEQ ID NO: 3838766 - DNA, 20 bp, Homo sapiens
gggaggctgaggcaggagaa

SEQ ID NO: 3838767 - DNA, 16 bp, Homo sapiens
gggaggggggagccag

SEQ ID NO: 3838768 - DNA, 18 bp, Homo sapiens
gggagggtggcagagaca

SEQ ID NO: 3838769 - DNA, 18 bp, Homo sapiens
gggatggactgatgcttt

SEQ ID NO: 3838770 - DNA, 15 bp, Homo sapiens
gggcaagaggtgcct

SEQ ID NO: 3838771 - DNA, 19 bp, Homo sapiens
gggcaagaggtgcctggga

SEQ ID NO: 3838772 - DNA, 20 bp, Homo sapiens
gggcaccccaggcagctcct

SEQ ID NO: 3838773 - DNA, 19 bp, Homo sapiens
gggcactaagggtggagag

SEQ ID NO: 3838774 - DNA, 13 bp, Homo sapiens
gccctacagccct

SEQ ID NO: 3838775 - DNA, 16 bp, Homo sapiens
gccctcccctcccctg

SEQ ID NO: 3838776 - DNA, 19 bp, Homo sapiens
gccctcccctcccctgctg

SEQ ID NO: 3838777 - DNA, 20 bp, Homo sapiens
gccctcccctcccctgctgc

SEQ ID NO: 3838778 - DNA, 22 bp, Homo sapiens
gccctcccctcccctgctgcag

SEQ ID NO: 3838779 - DNA, 16 bp, Homo sapiens
gccctccctcctgcct

SEQ ID NO: 3838780 - DNA, 12 bp, Homo sapiens
gccctcctgggc

SEQ ID NO: 3838781 - DNA, 13 bp, Homo sapiens
gccctcctgggca

SEQ ID NO: 3838782 - DNA, 14 bp, Homo sapiens
gccctcctgggcac

SEQ ID NO: 3838783 - DNA, 23 bp, Homo sapiens
gccctcctgggcaccccaggcag

SEQ ID NO: 3838784 - DNA, 21 bp, Homo sapiens
gccctctgaggctcagccctg

SEQ ID NO: 3838785 - DNA, 16 bp, Homo sapiens
gccctctggggctcag

SEQ ID NO: 3838786 - DNA, 21 bp, Homo sapiens
gccctctggggctcagccctg

SEQ ID NO: 3838787 - DNA, 12 bp, Homo sapiens
gccctgaggaat

SEQ ID NO: 3838788 - DNA, 18 bp, Homo sapiens
gccctgaggaataaagct

SEQ ID NO: 3838789 - DNA, 21 bp, Homo sapiens
gccctgagttggcatcacctg

SEQ ID NO: 3838790 - DNA, 16 bp, Homo sapiens
gccctgatccaggaaa

SEQ ID NO: 3838791 - DNA, 19 bp, Homo sapiens
gccctggaggccgctgctg

SEQ ID NO: 3838792 - DNA, 24 bp, Homo sapiens
gccctggaggtgccagcaaagccc

SEQ ID NO: 3838793 - DNA, 11 bp, Homo sapiens
gccctggctgc

SEQ ID NO: 3838794 - DNA, 14 bp, Homo sapiens
gccctggctgctgc

SEQ ID NO: 3838795 - DNA, 16 bp, Homo sapiens
gccctggctgctgccc

SEQ ID NO: 3838796 - DNA, 17 bp, Homo sapiens
gccctggctgctgcccc

SEQ ID NO: 3838797 - DNA, 22 bp, Homo sapiens
gccctggctgctgcccccaccc

SEQ ID NO: 3838798 - DNA, 19 bp, Homo sapiens
gccctgggcgcagctgaag

SEQ ID NO: 3838799 - DNA, 17 bp, Homo sapiens
gccctgtccctcccacc

SEQ ID NO: 3838800 - DNA, 20 bp, Homo sapiens
gccctgtccctcccacctct

SEQ ID NO: 3838801 - DNA, 12 bp, Homo sapiens
gccgaaccagga

SEQ ID NO: 3838802 - DNA, 13 bp, Homo sapiens
gccgagcccacac

SEQ ID NO: 3838803 - DNA, 19 bp, Homo sapiens
gccgccgtggtgacccctg

SEQ ID NO: 3838804 - DNA, 19 bp, Homo sapiens
gccgcctcggagtgtggcc

SEQ ID NO: 3838805 - DNA, 21 bp, Homo sapiens
gccgcctcggagtgtggcctg

SEQ ID NO: 3838806 - DNA, 22 bp, Homo sapiens
gccgcctcggagtgtggcctgg

SEQ ID NO: 3838807 - DNA, 23 bp, Homo sapiens
gccgcctcggagtgtggcctgga

SEQ ID NO: 3838808 - DNA, 16 bp, Homo sapiens
gccgggcacagtggct

SEQ ID NO: 3838809 - DNA, 12 bp, Homo sapiens
gccgggcccctg

SEQ ID NO: 3838810 - DNA, 14 bp, Homo sapiens
gccgggcccctggg

SEQ ID NO: 3838811 - DNA, 17 bp, Homo sapiens
gccgtggtgacccctgc

SEQ ID NO: 3838812 - DNA, 14 bp, Homo sapiens
gccgttggccacgt

SEQ ID NO: 3838813 - DNA, 11 bp, Homo sapiens
gccgtttgctt

SEQ ID NO: 3838814 - DNA, 22 bp, Homo sapiens
gcctaaaagattttgtgaaatt

SEQ ID NO: 3838815 - DNA, 17 bp, Homo sapiens
gcctactgcccctgccc

SEQ ID NO: 3838816 - DNA, 20 bp, Homo sapiens
gcctactgcccctgccctga

SEQ ID NO: 3838817 - DNA, 22 bp, Homo sapiens
gcctactgcccctgccctgagg

SEQ ID NO: 3838818 - DNA, 18 bp, Homo sapiens
gcctatgcccagcctcca

SEQ ID NO: 3838819 - DNA, 17 bp, Homo sapiens
gcctcagggccaagccg

SEQ ID NO: 3838820 - DNA, 19 bp, Homo sapiens
gcctcagggccaagccggc

SEQ ID NO: 3838821 - DNA, 20 bp, Homo sapiens
gcctcagggccaagccggcc

SEQ ID NO: 3838822 - DNA, 21 bp, Homo sapiens
gcctcagggccaagccggccc

SEQ ID NO: 3838823 - DNA, 15 bp, Homo sapiens
gcctcagtcctcccc

SEQ ID NO: 3838824 - DNA, 18 bp, Homo sapiens
gcctcagtcctcccctca

SEQ ID NO: 3838825 - DNA, 14 bp, Homo sapiens
gcctccagtctgct

SEQ ID NO: 3838826 - DNA, 19 bp, Homo sapiens
gcctccagtctgctctcag

SEQ ID NO: 3838827 - DNA, 16 bp, Homo sapiens
gcctccccatttccca

SEQ ID NO: 3838828 - DNA, 20 bp, Homo sapiens
gcctccccatttcccatctg

SEQ ID NO: 3838829 - DNA, 21 bp, Homo sapiens
gcctccccatttcccatctgc

SEQ ID NO: 3838830 - DNA, 22 bp, Homo sapiens
gcctccccatttcccatctgca

SEQ ID NO: 3838831 - DNA, 23 bp, Homo sapiens
gcctccccatttcccatctgcac

SEQ ID NO: 3838832 - DNA, 19 bp, Homo sapiens
gcctccctctcctctgtcc

SEQ ID NO: 3838833 - DNA, 20 bp, Homo sapiens
gcctccctctcctctgtccc

SEQ ID NO: 3838834 - DNA, 17 bp, Homo sapiens
gcctccggcctgcactc

SEQ ID NO: 3838835 - DNA, 19 bp, Homo sapiens
gcctcctcctagctggagt

SEQ ID NO: 3838836 - DNA, 20 bp, Homo sapiens
gcctcgagccatagagcctg

SEQ ID NO: 3838837 - DNA, 17 bp, Homo sapiens
gcctcggagtgtggcct

SEQ ID NO: 3838838 - DNA, 18 bp, Homo sapiens
gcctcgggaacctcactc

SEQ ID NO: 3838839 - DNA, 18 bp, Homo sapiens
gcctcgttaggacaaggc

SEQ ID NO: 3838840 - DNA, 23 bp, Homo sapiens
gcctctcccatggctttgtgctg

SEQ ID NO: 3838841 - DNA, 14 bp, Homo sapiens
gcctctcctttgta

SEQ ID NO: 3838842 - DNA, 13 bp, Homo sapiens
gcctctgacccct

SEQ ID NO: 3838843 - DNA, 15 bp, Homo sapiens
gcctctgacccctcc

SEQ ID NO: 3838844 - DNA, 22 bp, Homo sapiens
gcctctgacccctcctcactgg

SEQ ID NO: 3838845 - DNA, 18 bp, Homo sapiens
gcctcttggaaaaagtga

SEQ ID NO: 3838846 - DNA, 14 bp, Homo sapiens
gcctgagaggcagg

SEQ ID NO: 3838847 - DNA, 16 bp, Homo sapiens
gcctgaggtctggctg

SEQ ID NO: 3838848 - DNA, 21 bp, Homo sapiens
gcctgccccgcccccagtccc

SEQ ID NO: 3838849 - DNA, 17 bp, Homo sapiens
gcctgcgcagctccttc

SEQ ID NO: 3838850 - DNA, 14 bp, Homo sapiens
gcctgctgctgcca

SEQ ID NO: 3838851 - DNA, 15 bp, Homo sapiens
gcctgctgctgccaa

SEQ ID NO: 3838852 - DNA, 16 bp, Homo sapiens
gcctgctgctgccaag

SEQ ID NO: 3838853 - DNA, 17 bp, Homo sapiens
gcctgctggcacccacc

SEQ ID NO: 3838854 - DNA, 18 bp, Homo sapiens
gcctgctttttatggcct

SEQ ID NO: 3838855 - DNA, 19 bp, Homo sapiens
gcctgctttttatggcctg

SEQ ID NO: 3838856 - DNA, 14 bp, Homo sapiens
gcctggacgcagcc

SEQ ID NO: 3838857 - DNA, 16 bp, Homo sapiens
gcctggatccatcctg

SEQ ID NO: 3838858 - DNA, 18 bp, Homo sapiens
gcctggatccatcctgct

SEQ ID NO: 3838859 - DNA, 21 bp, Homo sapiens
gcctggctggtttgcccagag

SEQ ID NO: 3838860 - DNA, 15 bp, Homo sapiens
gcctgggaggagtgg

SEQ ID NO: 3838861 - DNA, 19 bp, Homo sapiens
gcctgggcctcctcctagc

SEQ ID NO: 3838862 - DNA, 21 bp, Homo sapiens
gcctgggcctcctcctagctg

SEQ ID NO: 3838863 - DNA, 23 bp, Homo sapiens
gcctgggcgacagagcgagactg

SEQ ID NO: 3838864 - DNA, 16 bp, Homo sapiens
gcctgtcggccacacc

SEQ ID NO: 3838865 - DNA, 17 bp, Homo sapiens
gcctgtcggccacaccc

SEQ ID NO: 3838866 - DNA, 19 bp, Homo sapiens
gcctgtcggccacacccca

SEQ ID NO: 3838867 - DNA, 23 bp, Homo sapiens
gcctgtcggccacaccccagact

SEQ ID NO: 3838868 - DNA, 19 bp, Homo sapiens
gcctgtgtaacagctcctt

SEQ ID NO: 3838869 - DNA, 23 bp, Homo sapiens
gcctgtgtaacagctccttggga

SEQ ID NO: 3838870 - DNA, 19 bp, Homo sapiens
gccttaattaaagaattta

SEQ ID NO: 3838871 - DNA, 23 bp, Homo sapiens
gccttaccgagagccaaacagag

SEQ ID NO: 3838872 - DNA, 23 bp, Homo sapiens
gccttagagccaggcacacactg

SEQ ID NO: 3838873 - DNA, 21 bp, Homo sapiens
gccttctggattcttggcccg

SEQ ID NO: 3838874 - DNA, 21 bp, Homo sapiens
gcgacatagcccatccctgcc

SEQ ID NO: 3838875 - DNA, 13 bp, Homo sapiens
gcgaccaccaaca

SEQ ID NO: 3838876 - DNA, 14 bp, Homo sapiens
gcgagtggcttagg

SEQ ID NO: 3838877 - DNA, 18 bp, Homo sapiens
gcgcagctgaagcctgga

SEQ ID NO: 3838878 - DNA, 13 bp, Homo sapiens
gcgcccagcccag

SEQ ID NO: 3838879 - DNA, 15 bp, Homo sapiens
gcgcccagcccaggc

SEQ ID NO: 3838880 - DNA, 14 bp, Homo sapiens
gcggaccccagctg

SEQ ID NO: 3838881 - DNA, 14 bp, Homo sapiens
gcggctgagctcca

SEQ ID NO: 3838882 - DNA, 14 bp, Homo sapiens
gcgggaaaagcagc

SEQ ID NO: 3838883 - DNA, 21 bp, Homo sapiens
gcgggagcggtggccctgtcc

SEQ ID NO: 3838884 - DNA, 20 bp, Homo sapiens
gcgtcctcctcacctcatgc

SEQ ID NO: 3838885 - DNA, 15 bp, Homo sapiens
gcgtctctggccctc

SEQ ID NO: 3838886 - DNA, 14 bp, Homo sapiens
gctaaagagccctt

SEQ ID NO: 3838887 - DNA, 21 bp, Homo sapiens
gctaaggctcgagttaaaaca

SEQ ID NO: 3838888 - DNA, 14 bp, Homo sapiens
gctaataaaatatc

SEQ ID NO: 3838889 - DNA, 19 bp, Homo sapiens
gctaataaaatatcattca

SEQ ID NO: 3838890 - DNA, 21 bp, Homo sapiens
gctaatgtgtctgtggaccct

SEQ ID NO: 3838891 - DNA, 17 bp, Homo sapiens
gctacaataatagagag

SEQ ID NO: 3838892 - DNA, 17 bp, Homo sapiens
gctacagagtaacaaaa

SEQ ID NO: 3838893 - DNA, 19 bp, Homo sapiens
gctactcgggaggctgagg

SEQ ID NO: 3838894 - DNA, 16 bp, Homo sapiens
gctagcacctccccag

SEQ ID NO: 3838895 - DNA, 20 bp, Homo sapiens
gctagcacctccccagacag

SEQ ID NO: 3838896 - DNA, 12 bp, Homo sapiens
gctagcttctgc

SEQ ID NO: 3838897 - DNA, 21 bp, Homo sapiens
gctaggaattgtgtttataat

SEQ ID NO: 3838898 - DNA, 17 bp, Homo sapiens
gctaggactgtggaggg

SEQ ID NO: 3838899 - DNA, 18 bp, Homo sapiens
gctaggactgtggagggg

SEQ ID NO: 3838900 - DNA, 21 bp, Homo sapiens
gctaggactgtggaggggagc

SEQ ID NO: 3838901 - DNA, 22 bp, Homo sapiens
gatccatcctgctagcacctcc

SEQ ID NO: 3838902 - DNA, 14 bp, Homo sapiens
gatccccagggcag

SEQ ID NO: 3838903 - DNA, 18 bp, Homo sapiens
gatccgcccgcctctgcc

SEQ ID NO: 3838904 - DNA, 19 bp, Homo sapiens
gatccgcccgcctctgcct

SEQ ID NO: 3838905 - DNA, 21 bp, Homo sapiens
gatccgcccgcctctgcctcc

SEQ ID NO: 3838906 - DNA, 23 bp, Homo sapiens
gatcctggtattgtaatattaaa

SEQ ID NO: 3838907 - DNA, 17 bp, Homo sapiens
gatctgctcagccctgg

SEQ ID NO: 3838908 - DNA, 11 bp, Homo sapiens
gatctgctcct

SEQ ID NO: 3838909 - DNA, 13 bp, Homo sapiens
gatctgtcctggg

SEQ ID NO: 3838910 - DNA, 23 bp, Homo sapiens
gatgaatccaaatgtgaaagatg

SEQ ID NO: 3838911 - DNA, 21 bp, Homo sapiens
gatgacggtattatgcttctt

SEQ ID NO: 3838912 - DNA, 16 bp, Homo sapiens
gatgactcaagattcc

SEQ ID NO: 3838913 - DNA, 21 bp, Homo sapiens
gatgactcaagattcccagga

SEQ ID NO: 3838914 - DNA, 21 bp, Homo sapiens
gatgagtttttcattatttgg

SEQ ID NO: 3838915 - DNA, 14 bp, Homo sapiens
gatgatgactatgg

SEQ ID NO: 3838916 - DNA, 16 bp, Homo sapiens
gatgatttgggcagag

SEQ ID NO: 3838917 - DNA, 11 bp, Homo sapiens
gatgcaaataa

SEQ ID NO: 3838918 - DNA, 19 bp, Homo sapiens
gatgccagccccgtgccag

SEQ ID NO: 3838919 - DNA, 20 bp, Homo sapiens
gatgctggagaagagaggag

SEQ ID NO: 3838920 - DNA, 17 bp, Homo sapiens
gatggagcccaggcggg

SEQ ID NO: 3838921 - DNA, 19 bp, Homo sapiens
gatggagcccaggcgggag

SEQ ID NO: 3838922 - DNA, 15 bp, Homo sapiens
gatggccaggtacaa

SEQ ID NO: 3838923 - DNA, 19 bp, Homo sapiens
gatggcccattctacttgc

SEQ ID NO: 3838924 - DNA, 20 bp, Homo sapiens
gatggcccattctacttgct

SEQ ID NO: 3838925 - DNA, 14 bp, Homo sapiens
gcatgccccggcca

SEQ ID NO: 3838926 - DNA, 23 bp, Homo sapiens
gcatgccccggccacctctgcgg

SEQ ID NO: 3838927 - DNA, 14 bp, Homo sapiens
gcatgctcaaatga

SEQ ID NO: 3838928 - DNA, 17 bp, Homo sapiens
gcatgtagggcttctgt

SEQ ID NO: 3838929 - DNA, 16 bp, Homo sapiens
gcatgttactgccaaa

SEQ ID NO: 3838930 - DNA, 21 bp, Homo sapiens
gcatgttgtgatgtacacatt

SEQ ID NO: 3838931 - DNA, 19 bp, Homo sapiens
gcattcctctaatgttgtg

SEQ ID NO: 3838932 - DNA, 16 bp, Homo sapiens
gcatttaatcaggagg

SEQ ID NO: 3838933 - DNA, 16 bp, Homo sapiens
gcatttcaatttcaat

SEQ ID NO: 3838934 - DNA, 11 bp, Homo sapiens
gcatttgtcta

SEQ ID NO: 3838935 - DNA, 12 bp, Homo sapiens
gcatttgtctat

SEQ ID NO: 3838936 - DNA, 19 bp, Homo sapiens
gcattttaagcataattaa

SEQ ID NO: 3838937 - DNA, 20 bp, Homo sapiens
gcattttgggttgtttaaaa

SEQ ID NO: 3838938 - DNA, 16 bp, Homo sapiens
gcattttttaaaacaa

SEQ ID NO: 3838939 - DNA, 21 bp, Homo sapiens
gccaacctgtaataaatatga

SEQ ID NO: 3838940 - DNA, 17 bp, Homo sapiens
gccaacttgtctctgta

SEQ ID NO: 3838941 - DNA, 18 bp, Homo sapiens
gccaacttgtctctgtag

SEQ ID NO: 3838942 - DNA, 14 bp, Homo sapiens
gccaagcagggagg

SEQ ID NO: 3838943 - DNA, 23 bp, Homo sapiens
gccaagccggcccaacccaacca

SEQ ID NO: 3838944 - DNA, 16 bp, Homo sapiens
gccaagttagctattg

SEQ ID NO: 3838945 - DNA, 13 bp, Homo sapiens
gccacacagccca

SEQ ID NO: 3838946 - DNA, 20 bp, Homo sapiens
gccacacagtggccggggct

SEQ ID NO: 3838947 - DNA, 19 bp, Homo sapiens
gccacagagggctgtgtct

SEQ ID NO: 3838948 - DNA, 14 bp, Homo sapiens
gccaccactcctgc

SEQ ID NO: 3838949 - DNA, 16 bp, Homo sapiens
gccaccactcctgcct

SEQ ID NO: 3838950 - DNA, 13 bp, Homo sapiens
gccaccccaaccc

SEQ ID NO: 3838951 - DNA, 14 bp, Homo sapiens
gccaccccaaccca

SEQ ID NO: 3838952 - DNA, 10 bp, Homo sapiens
gccacccgcc

SEQ ID NO: 3838953 - DNA, 13 bp, Homo sapiens
gccacctccccac

SEQ ID NO: 3838954 - DNA, 17 bp, Homo sapiens
gccacctccccactcca

SEQ ID NO: 3838955 - DNA, 20 bp, Homo sapiens
gccacctccccactccagca

SEQ ID NO: 3838956 - DNA, 21 bp, Homo sapiens
gccacctccccactccagcag

SEQ ID NO: 3838957 - DNA, 22 bp, Homo sapiens
gccacctccccactccagcaga

SEQ ID NO: 3838958 - DNA, 23 bp, Homo sapiens
gccacctctgcggaccccagctg

SEQ ID NO: 3838959 - DNA, 15 bp, Homo sapiens
gccagaaaaggcagc

SEQ ID NO: 3838960 - DNA, 17 bp, Homo sapiens
gccagaaaaggcagcca

SEQ ID NO: 3838961 - DNA, 18 bp, Homo sapiens
gccagaaaaggcagccag

SEQ ID NO: 3838962 - DNA, 19 bp, Homo sapiens
gccagaaaaggcagccaga

SEQ ID NO: 3838963 - DNA, 21 bp, Homo sapiens
gccagaaaaggcagccagatc

SEQ ID NO: 3838964 - DNA, 16 bp, Homo sapiens
gccagaggccaggatg

SEQ ID NO: 3838965 - DNA, 19 bp, Homo sapiens
gccagaggccaggatgcct

SEQ ID NO: 3838966 - DNA, 18 bp, Homo sapiens
gccagatccccagggcag

SEQ ID NO: 3838967 - DNA, 22 bp, Homo sapiens
gccagatccccagggcagcctc

SEQ ID NO: 3838968 - DNA, 22 bp, Homo sapiens
gccagcaaagccccatgctgga

SEQ ID NO: 3838969 - DNA, 23 bp, Homo sapiens
gccagcaaagccccatgctggag

SEQ ID NO: 3838970 - DNA, 23 bp, Homo sapiens
gccagccccacccccagccaggc

SEQ ID NO: 3838971 - DNA, 17 bp, Homo sapiens
gccagccccgtgccagg

SEQ ID NO: 3838972 - DNA, 12 bp, Homo sapiens
gccagccctgca

SEQ ID NO: 3838973 - DNA, 11 bp, Homo sapiens
gccagccctgg

SEQ ID NO: 3838974 - DNA, 18 bp, Homo sapiens
gccagcctccgagaggga

SEQ ID NO: 3838975 - DNA, 13 bp, Homo sapiens
gccagcctcctct

SEQ ID NO: 3838976 - DNA, 17 bp, Homo sapiens
gccagcctcctctggac

SEQ ID NO: 3838977 - DNA, 22 bp, Homo sapiens
gccagcctgcgggaagctgacc

SEQ ID NO: 3838978 - DNA, 16 bp, Homo sapiens
gccaggactgagcccc

SEQ ID NO: 3838979 - DNA, 20 bp, Homo sapiens
gccaggatgcctgagccccc

SEQ ID NO: 3838980 - DNA, 15 bp, Homo sapiens
gccaggccagcctcc

SEQ ID NO: 3838981 - DNA, 20 bp, Homo sapiens
gccaggctatggttgccacc

SEQ ID NO: 3838982 - DNA, 21 bp, Homo sapiens
gccaggctatggttgccaccc

SEQ ID NO: 3838983 - DNA, 22 bp, Homo sapiens
gccaggctatggttgccacccc

SEQ ID NO: 3838984 - DNA, 13 bp, Homo sapiens
gccaggctgggag

SEQ ID NO: 3838985 - DNA, 18 bp, Homo sapiens
gccagggaagacagagca

SEQ ID NO: 3838986 - DNA, 19 bp, Homo sapiens
gccagggaagacagagcag

SEQ ID NO: 3838987 - DNA, 19 bp, Homo sapiens
gccagggggactagcccct

SEQ ID NO: 3838988 - DNA, 15 bp, Homo sapiens
gccagttttattttc

SEQ ID NO: 3838989 - DNA, 17 bp, Homo sapiens
gccatagagcctgaaat

SEQ ID NO: 3838990 - DNA, 14 bp, Homo sapiens
gccatccctcgtgg

SEQ ID NO: 3838991 - DNA, 13 bp, Homo sapiens
gccatggctgggg

SEQ ID NO: 3838992 - DNA, 22 bp, Homo sapiens
gccatggctggggggtctcagc

SEQ ID NO: 3838993 - DNA, 23 bp, Homo sapiens
gccatggctggggggtctcagca

SEQ ID NO: 3838994 - DNA, 13 bp, Homo sapiens
gccatggggcagc

SEQ ID NO: 3838995 - DNA, 15 bp, Homo sapiens
gccatggggcagcct

SEQ ID NO: 3838996 - DNA, 20 bp, Homo sapiens
gccatgtgaaactcatctca

SEQ ID NO: 3838997 - DNA, 21 bp, Homo sapiens
gcccaaattatcaagctaata

SEQ ID NO: 3838998 - DNA, 22 bp, Homo sapiens
gcccaaattatcaagctaataa

SEQ ID NO: 3838999 - DNA, 13 bp, Homo sapiens
gcccaacccaacc

SEQ ID NO: 3839000 - DNA, 16 bp, Homo sapiens
gcccaacccaaccact

SEQ ID NO: 3839001 - DNA, 14 bp, Homo sapiens
gcccacaccatctg

SEQ ID NO: 3839002 - DNA, 14 bp, Homo sapiens
gcccaccagagctg

SEQ ID NO: 3839003 - DNA, 14 bp, Homo sapiens
gcccaccccctgcc

SEQ ID NO: 3839004 - DNA, 20 bp, Homo sapiens
gcccaccccctgccctgcac

SEQ ID NO: 3839005 - DNA, 23 bp, Homo sapiens
gcccacttctgtgtagacatggt

SEQ ID NO: 3839006 - DNA, 17 bp, Homo sapiens
gcccagctgccagggaa

SEQ ID NO: 3839007 - DNA, 20 bp, Homo sapiens
gcccagctgccagggaagac

SEQ ID NO: 3839008 - DNA, 16 bp, Homo sapiens
gcccaggagagagaaa

SEQ ID NO: 3839009 - DNA, 20 bp, Homo sapiens
gcccaggagagagaaagcca

SEQ ID NO: 3839010 - DNA, 23 bp, Homo sapiens
gcccaggagagagaaagccaggc

SEQ ID NO: 3839011 - DNA, 13 bp, Homo sapiens
gcccaggcctggt

SEQ ID NO: 3839012 - DNA, 17 bp, Homo sapiens
gcccaggcctggtggag

SEQ ID NO: 3839013 - DNA, 23 bp, Homo sapiens
gcccagggtggacttagaaagca

SEQ ID NO: 3839014 - DNA, 13 bp, Homo sapiens
gcccagttaaata

SEQ ID NO: 3839015 - DNA, 17 bp, Homo sapiens
gcccattctacttgctc

SEQ ID NO: 3839016 - DNA, 18 bp, Homo sapiens
gcccattctacttgctct

SEQ ID NO: 3839017 - DNA, 21 bp, Homo sapiens
gcccattctacttgctctgga

SEQ ID NO: 3839018 - DNA, 22 bp, Homo sapiens
gcccattctacttgctctggac

SEQ ID NO: 3839019 - DNA, 13 bp, Homo sapiens
gccccacccccag

SEQ ID NO: 3839020 - DNA, 15 bp, Homo sapiens
gccccacccccagcc

SEQ ID NO: 3839021 - DNA, 16 bp, Homo sapiens
gccccacccccagcca

SEQ ID NO: 3839022 - DNA, 18 bp, Homo sapiens
gccccacccccagccagg

SEQ ID NO: 3839023 - DNA, 19 bp, Homo sapiens
gccccaggtctccccaggc

SEQ ID NO: 3839024 - DNA, 23 bp, Homo sapiens
gccccagtcccaccctgctgctg

SEQ ID NO: 3839025 - DNA, 19 bp, Homo sapiens
gccccatgctggagcctgt

SEQ ID NO: 3839026 - DNA, 21 bp, Homo sapiens
gccccatgctggagcctgtgt

SEQ ID NO: 3839027 - DNA, 23 bp, Homo sapiens
gccccatgctggagcctgtgtaa

SEQ ID NO: 3839028 - DNA, 20 bp, Homo sapiens
gccccatttatccacctcca

SEQ ID NO: 3839029 - DNA, 15 bp, Homo sapiens
gcccccacccacctt

SEQ ID NO: 3839030 - DNA, 16 bp, Homo sapiens
gcccccacccaccttc

SEQ ID NO: 3839031 - DNA, 22 bp, Homo sapiens
gcccccaccccggggaccctgt

SEQ ID NO: 3839032 - DNA, 15 bp, Homo sapiens
gcccccagtccccac

SEQ ID NO: 3839033 - DNA, 22 bp, Homo sapiens
gcccccagtccccacccctgcc

SEQ ID NO: 3839034 - DNA, 20 bp, Homo sapiens
gcccccgcatcccctgcctc

SEQ ID NO: 3839035 - DNA, 14 bp, Homo sapiens
gcccccgcccagcc

SEQ ID NO: 3839036 - DNA, 14 bp, Homo sapiens
gcccccgttgaagc

SEQ ID NO: 3839037 - DNA, 21 bp, Homo sapiens
gccccgcccccagtccccacc

SEQ ID NO: 3839038 - DNA, 13 bp, Homo sapiens
gccccggccacct

SEQ ID NO: 3839039 - DNA, 15 bp, Homo sapiens
gccccggccacctct

SEQ ID NO: 3839040 - DNA, 17 bp, Homo sapiens
gccccggccacctctgc

SEQ ID NO: 3839041 - DNA, 18 bp, Homo sapiens
gccccggccacctctgcg

SEQ ID NO: 3839042 - DNA, 19 bp, Homo sapiens
gccccggggtgagtccatt

SEQ ID NO: 3839043 - DNA, 20 bp, Homo sapiens
gccccgtctcctgagggtcc

SEQ ID NO: 3839044 - DNA, 21 bp, Homo sapiens
ctgtcctcactgctccctgaa

SEQ ID NO: 3839045 - DNA, 11 bp, Homo sapiens
ctgtcctgggg

SEQ ID NO: 3839046 - DNA, 12 bp, Homo sapiens
ctgtcctggggg

SEQ ID NO: 3839047 - DNA, 23 bp, Homo sapiens
ctgtcctgggggatgcaaataaa

SEQ ID NO: 3839048 - DNA, 16 bp, Homo sapiens
ctgtgacagcctctgc

SEQ ID NO: 3839049 - DNA, 17 bp, Homo sapiens
ctgtgacatggtgcctg

SEQ ID NO: 3839050 - DNA, 14 bp, Homo sapiens
ctgtgacctcaggc

SEQ ID NO: 3839051 - DNA, 22 bp, Homo sapiens
ctgtgacctcaggcactagcct

SEQ ID NO: 3839052 - DNA, 16 bp, Homo sapiens
ctgtgcagtcactgga

SEQ ID NO: 3839053 - DNA, 11 bp, Homo sapiens
ctgtgccaggc

SEQ ID NO: 3839054 - DNA, 14 bp, Homo sapiens
ctgtgccaggctgg

SEQ ID NO: 3839055 - DNA, 19 bp, Homo sapiens
ctgtgcccgccctgggctg

SEQ ID NO: 3839056 - DNA, 23 bp, Homo sapiens
ctgtgcccgccctgggctgggcc

SEQ ID NO: 3839057 - DNA, 15 bp, Homo sapiens
ctgtgctttctattg

SEQ ID NO: 3839058 - DNA, 16 bp, Homo sapiens
ctgtgctttctattgt

SEQ ID NO: 3839059 - DNA, 16 bp, Homo sapiens
ctgtggaccctcgctc

SEQ ID NO: 3839060 - DNA, 17 bp, Homo sapiens
ctgtggaggggagctgc

SEQ ID NO: 3839061 - DNA, 19 bp, Homo sapiens
ctgtggaggggagctgctg

SEQ ID NO: 3839062 - DNA, 21 bp, Homo sapiens
ctgtggaggggagctgctggc

SEQ ID NO: 3839063 - DNA, 20 bp, Homo sapiens
ctgtgtaacaggaccccaag

SEQ ID NO: 3839064 - DNA, 22 bp, Homo sapiens
ctgtgtccttgtataaggagct

SEQ ID NO: 3839065 - DNA, 10 bp, Homo sapiens
ctgtgtcttt

SEQ ID NO: 3839066 - DNA, 12 bp, Homo sapiens
ctgtgtcttttt

SEQ ID NO: 3839067 - DNA, 14 bp, Homo sapiens
ctgtgtgagagaga

SEQ ID NO: 3839068 - DNA, 14 bp, Homo sapiens
ctgtgtgctactaa

SEQ ID NO: 3839069 - DNA, 17 bp, Homo sapiens
ctgtgtgctactaacag

SEQ ID NO: 3839070 - DNA, 18 bp, Homo sapiens
ctgtgtgctactaacaga

SEQ ID NO: 3839071 - DNA, 19 bp, Homo sapiens
ctgtgtgctactaacagat

SEQ ID NO: 3839072 - DNA, 13 bp, Homo sapiens
ctgttgcaggcaa

SEQ ID NO: 3839073 - DNA, 21 bp, Homo sapiens
ctgttggcagtgagtgagcct

SEQ ID NO: 3839074 - DNA, 22 bp, Homo sapiens
ctgttggcagtgagtgagcctg

SEQ ID NO: 3839075 - DNA, 19 bp, Homo sapiens
ctgtttggaaatggggagc

SEQ ID NO: 3839076 - DNA, 13 bp, Homo sapiens
cttaaaaccaaag

SEQ ID NO: 3839077 - DNA, 18 bp, Homo sapiens
cttaagtctttttgaagt

SEQ ID NO: 3839078 - DNA, 18 bp, Homo sapiens
cttaagtttatttttcct

SEQ ID NO: 3839079 - DNA, 12 bp, Homo sapiens
cttaattaaaga

SEQ ID NO: 3839080 - DNA, 13 bp, Homo sapiens
cttaattaaagaa

SEQ ID NO: 3839081 - DNA, 23 bp, Homo sapiens
cttaattgaaacaacattatttt

SEQ ID NO: 3839082 - DNA, 14 bp, Homo sapiens
cttaattgctttcc

SEQ ID NO: 3839083 - DNA, 17 bp, Homo sapiens
cttaccgagagccaaac

SEQ ID NO: 3839084 - DNA, 14 bp, Homo sapiens
cttactattgtatt

SEQ ID NO: 3839085 - DNA, 20 bp, Homo sapiens
cttacttgagtatcataata

SEQ ID NO: 3839086 - DNA, 23 bp, Homo sapiens
cttactttcctttccccagccca

SEQ ID NO: 3839087 - DNA, 16 bp, Homo sapiens
cttactttttgtaaat

SEQ ID NO: 3839088 - DNA, 19 bp, Homo sapiens
cttactttttgtaaatgct

SEQ ID NO: 3839089 - DNA, 16 bp, Homo sapiens
cttagaaagcaggggc

SEQ ID NO: 3839090 - DNA, 18 bp, Homo sapiens
cttagaaagcaggggcta

SEQ ID NO: 3839091 - DNA, 14 bp, Homo sapiens
cttagagccaggca

SEQ ID NO: 3839092 - DNA, 23 bp, Homo sapiens
cttagcctgggcctcctcctagc

SEQ ID NO: 3839093 - DNA, 18 bp, Homo sapiens
cttagcttcactcagctg

SEQ ID NO: 3839094 - DNA, 14 bp, Homo sapiens
cttagggagagcac

SEQ ID NO: 3839095 - DNA, 18 bp, Homo sapiens
cttaggggaatgttttcg

SEQ ID NO: 3839096 - DNA, 13 bp, Homo sapiens
cttatattatgga

SEQ ID NO: 3839097 - DNA, 24 bp, Homo sapiens
cttcaccaaagatctgctcctcgc

SEQ ID NO: 3839098 - DNA, 21 bp, Homo sapiens
cttcacccagagctgcctatg

SEQ ID NO: 3839099 - DNA, 14 bp, Homo sapiens
cttcacttctccca

SEQ ID NO: 3839100 - DNA, 20 bp, Homo sapiens
ttgatctgctcagccctgga

SEQ ID NO: 3839101 - DNA, 16 bp, Homo sapiens
tttctaagagaagtta

SEQ ID NO: 3839102 - DNA, 20 bp, Homo sapiens
tttctagacttccacaaaat

SEQ ID NO: 3839103 - DNA, 16 bp, Homo sapiens
tttctattgtacagaa

SEQ ID NO: 3839104 - DNA, 23 bp, Homo sapiens
tcatctcattacccttttctggg

SEQ ID NO: 3839105 - DNA, 13 bp, Homo sapiens
tcatgaacactgg

SEQ ID NO: 3839106 - DNA, 13 bp, Homo sapiens
tcatgaagccctt

SEQ ID NO: 3839107 - DNA, 20 bp, Homo sapiens
tcatgaagcccttagggaga

SEQ ID NO: 3839108 - DNA, 16 bp, Homo sapiens
tcatgacagatgaaga

SEQ ID NO: 3839109 - DNA, 14 bp, Homo sapiens
tcatgccattttat

SEQ ID NO: 3839110 - DNA, 16 bp, Homo sapiens
tcatgccattttattt

SEQ ID NO: 3839111 - DNA, 20 bp, Homo sapiens
tcatgcccaccccctgccct

SEQ ID NO: 3839112 - DNA, 16 bp, Homo sapiens
tcatgctatttctacc

SEQ ID NO: 3839113 - DNA, 14 bp, Homo sapiens
tcatgtctgaaaaa

SEQ ID NO: 3839114 - DNA, 20 bp, Homo sapiens
tcatgttagttttgctcctt

SEQ ID NO: 3839115 - DNA, 21 bp, Homo sapiens
tcatgtttttgaaacagaacc

SEQ ID NO: 3839116 - DNA, 16 bp, Homo sapiens
tcattctaaaatcaga

SEQ ID NO: 3839117 - DNA, 17 bp, Homo sapiens
tcattgcccacttctgt

SEQ ID NO: 3839118 - DNA, 17 bp, Homo sapiens
tcattgtacagtttgtt

SEQ ID NO: 3839119 - DNA, 17 bp, Homo sapiens
tcattgttctgtacaaa

SEQ ID NO: 3839120 - DNA, 13 bp, Homo sapiens
tcattgttttcag

SEQ ID NO: 3839121 - DNA, 14 bp, Homo sapiens
tcatttattaagta

SEQ ID NO: 3839122 - DNA, 16 bp, Homo sapiens
tcatttcatgctttga

SEQ ID NO: 3839123 - DNA, 19 bp, Homo sapiens
tcatttggggcatttgtaa

SEQ ID NO: 3839124 - DNA, 14 bp, Homo sapiens
tcattttaaacaac

SEQ ID NO: 3839125 - DNA, 16 bp, Homo sapiens
tcattttctgcaagcc

SEQ ID NO: 3839126 - DNA, 13 bp, Homo sapiens
tccaaattccctc

SEQ ID NO: 3839127 - DNA, 18 bp, Homo sapiens
tccaaattccctctggag

SEQ ID NO: 3839128 - DNA, 21 bp, Homo sapiens
tccaacgtaaattattacata

SEQ ID NO: 3839129 - DNA, 23 bp, Homo sapiens
tccaactccagctgagtcctggg

SEQ ID NO: 3839130 - DNA, 18 bp, Homo sapiens
tccaatggagttcagaga

SEQ ID NO: 3839131 - DNA, 20 bp, Homo sapiens
tccacaccagtaataaaaag

SEQ ID NO: 3839132 - DNA, 23 bp, Homo sapiens
tccacaccagtaataaaaagcca

SEQ ID NO: 3839133 - DNA, 20 bp, Homo sapiens
tccacagggctcctgaagga

SEQ ID NO: 3839134 - DNA, 15 bp, Homo sapiens
tccacatctgcctta

SEQ ID NO: 3839135 - DNA, 16 bp, Homo sapiens
tccacatggcagatga

SEQ ID NO: 3839136 - DNA, 17 bp, Homo sapiens
tccacatggcagatgat

SEQ ID NO: 3839137 - DNA, 18 bp, Homo sapiens
tccactgacaacgaaagt

SEQ ID NO: 3839138 - DNA, 23 bp, Homo sapiens
tccagaaagaaaacttgtattat

SEQ ID NO: 3839139 - DNA, 18 bp, Homo sapiens
tccagcagataaggccga

SEQ ID NO: 3839140 - DNA, 16 bp, Homo sapiens
tccagctcatctgcca

SEQ ID NO: 3839141 - DNA, 23 bp, Homo sapiens
tccagctgaccctggttctctct

SEQ ID NO: 3839142 - DNA, 18 bp, Homo sapiens
tccaggaaaatgtgaggg

SEQ ID NO: 3839143 - DNA, 21 bp, Homo sapiens
tccaggaaaatgtgaggggaa

SEQ ID NO: 3839144 - DNA, 21 bp, Homo sapiens
tccaggaaactccacatctgc

SEQ ID NO: 3839145 - DNA, 23 bp, Homo sapiens
tccaggaaactccacatctgcct

SEQ ID NO: 3839146 - DNA, 19 bp, Homo sapiens
tccaggaggagttagccaa

SEQ ID NO: 3839147 - DNA, 21 bp, Homo sapiens
tccagtctgctctcagcttgt

SEQ ID NO: 3839148 - DNA, 12 bp, Homo sapiens
tccagtgatgtt

SEQ ID NO: 3839149 - DNA, 18 bp, Homo sapiens
tccagtgatgttgaaatt

SEQ ID NO: 3839150 - DNA, 22 bp, Homo sapiens
tccatcccaggacaccacaccc

SEQ ID NO: 3839151 - DNA, 14 bp, Homo sapiens
tccatcccttcccc

SEQ ID NO: 3839152 - DNA, 18 bp, Homo sapiens
tccatgtagaacttgaac

SEQ ID NO: 3839153 - DNA, 13 bp, Homo sapiens
tccatgttgctga

SEQ ID NO: 3839154 - DNA, 14 bp, Homo sapiens
tccattctcccagg

SEQ ID NO: 3839155 - DNA, 21 bp, Homo sapiens
tcccaaagggagggtggcaga

SEQ ID NO: 3839156 - DNA, 21 bp, Homo sapiens
tcccacctctgtgacctcagg

SEQ ID NO: 3839157 - DNA, 22 bp, Homo sapiens
tcccacctctgtgacctcaggc

SEQ ID NO: 3839158 - DNA, 21 bp, Homo sapiens
tcccacggggtccccgtagcc

SEQ ID NO: 3839159 - DNA, 14 bp, Homo sapiens
tcccacttggccaa

SEQ ID NO: 3839160 - DNA, 23 bp, Homo sapiens
tcccacttggccaagcagggagg

SEQ ID NO: 3839161 - DNA, 20 bp, Homo sapiens
tcccagactagatttcaagc

SEQ ID NO: 3839162 - DNA, 22 bp, Homo sapiens
tcccagcattttgagaggctga

SEQ ID NO: 3839163 - DNA, 23 bp, Homo sapiens
tcccagcctggcctgtggctgcc

SEQ ID NO: 3839164 - DNA, 16 bp, Homo sapiens
tcccagctacttggga

SEQ ID NO: 3839165 - DNA, 19 bp, Homo sapiens
tcccaggacaccacaccca

SEQ ID NO: 3839166 - DNA, 16 bp, Homo sapiens
tcccaggacctgagcc

SEQ ID NO: 3839167 - DNA, 21 bp, Homo sapiens
aaaaagcagtttttgaaagac

SEQ ID NO: 3839168 - DNA, 16 bp, Homo sapiens
aaaaagctttactctt

SEQ ID NO: 3839169 - DNA, 19 bp, Homo sapiens
aaaaagtagattaaaatat

SEQ ID NO: 3839170 - DNA, 16 bp, Homo sapiens
aaaaagttgtttataa

SEQ ID NO: 3839171 - DNA, 12 bp, Homo sapiens
aaaaatttataa

SEQ ID NO: 3839172 - DNA, 14 bp, Homo sapiens
aaaaatttataaca

SEQ ID NO: 3839173 - DNA, 22 bp, Homo sapiens
aaaaatttataacagttataaa

SEQ ID NO: 3839174 - DNA, 17 bp, Homo sapiens
aaaactacatgtaaaat

SEQ ID NO: 3839175 - DNA, 13 bp, Homo sapiens
aaaagaaagctaa

SEQ ID NO: 3839176 - DNA, 20 bp, Homo sapiens
aaaagattttgtgaaatttc

SEQ ID NO: 3839177 - DNA, 23 bp, Homo sapiens
aaaagattttgtgaaatttcatg

SEQ ID NO: 3839178 - DNA, 19 bp, Homo sapiens
aaaagcagtttttgaaaga

SEQ ID NO: 3839179 - DNA, 12 bp, Homo sapiens
aaaagctttact

SEQ ID NO: 3839180 - DNA, 13 bp, Homo sapiens
aaaagggcagagg

SEQ ID NO: 3839181 - DNA, 20 bp, Homo sapiens
aaaaggtgtaggcctgcctt

SEQ ID NO: 3839182 - DNA, 22 bp, Homo sapiens
aaaagtagattaaaatatttgc

SEQ ID NO: 3839183 - DNA, 22 bp, Homo sapiens
aaaagttgtaatagagaatatt

SEQ ID NO: 3839184 - DNA, 15 bp, Homo sapiens
aaaatgcctgctgct

SEQ ID NO: 3839185 - DNA, 10 bp, Homo sapiens
aaaatgttta

SEQ ID NO: 3839186 - DNA, 14 bp, Homo sapiens
aaaatgtttaggaa

SEQ ID NO: 3839187 - DNA, 12 bp, Homo sapiens
aaaatgttttcc

SEQ ID NO: 3839188 - DNA, 13 bp, Homo sapiens
aaaattaagaaag

SEQ ID NO: 3839189 - DNA, 21 bp, Homo sapiens
aaaattcgacctgatttacag

SEQ ID NO: 3839190 - DNA, 23 bp, Homo sapiens
aaaattcgacctgatttacagtt

SEQ ID NO: 3839191 - DNA, 19 bp, Homo sapiens
aaaattgagagctttattg

SEQ ID NO: 3839192 - DNA, 17 bp, Homo sapiens
aaaatttagatttaatt

SEQ ID NO: 3839193 - DNA, 18 bp, Homo sapiens
aaaatttataacagttat

SEQ ID NO: 3839194 - DNA, 18 bp, Homo sapiens
aaacaaaaaatgtgctgt

SEQ ID NO: 3839195 - DNA, 14 bp, Homo sapiens
aaacaataaagaga

SEQ ID NO: 3839196 - DNA, 19 bp, Homo sapiens
aaacagagaaaagcttgga

SEQ ID NO: 3839197 - DNA, 19 bp, Homo sapiens
aaaccaaagagggcttcct

SEQ ID NO: 3839198 - DNA, 20 bp, Homo sapiens
aaaccaaagagggcttcctc

SEQ ID NO: 3839199 - DNA, 17 bp, Homo sapiens
aaacccctaaaaacaaa

SEQ ID NO: 3839200 - DNA, 17 bp, Homo sapiens
aaacctcattgttctgt

SEQ ID NO: 3839201 - DNA, 22 bp, Homo sapiens
aaacgctaaagagcccttgcct

SEQ ID NO: 3839202 - DNA, 21 bp, Homo sapiens
aaactaaagtgtgctttataa

SEQ ID NO: 3839203 - DNA, 16 bp, Homo sapiens
aaactacaccacacta

SEQ ID NO: 3839204 - DNA, 14 bp, Homo sapiens
aaactacatgtaaa

SEQ ID NO: 3839205 - DNA, 18 bp, Homo sapiens
aaactacatgtaaaatct

SEQ ID NO: 3839206 - DNA, 16 bp, Homo sapiens
aaactcagatttaaaa

SEQ ID NO: 3839207 - DNA, 17 bp, Homo sapiens
aaactcagatttaaaac

SEQ ID NO: 3839208 - DNA, 13 bp, Homo sapiens
aaactcatctcat

SEQ ID NO: 3839209 - DNA, 18 bp, Homo sapiens
aaactccacatctgcctt

SEQ ID NO: 3839210 - DNA, 22 bp, Homo sapiens
aaactggttctacaaattttta

SEQ ID NO: 3839211 - DNA, 14 bp, Homo sapiens
aaactgtattgatg

SEQ ID NO: 3839212 - DNA, 11 bp, Homo sapiens
aaactgtctct

SEQ ID NO: 3839213 - DNA, 17 bp, Homo sapiens
aaacttcagttttactg

SEQ ID NO: 3839214 - DNA, 22 bp, Homo sapiens
aaacttcagttttactgcattt

SEQ ID NO: 3839215 - DNA, 16 bp, Homo sapiens
aaacttgtattatgtg

SEQ ID NO: 3839216 - DNA, 18 bp, Homo sapiens
aaactttttaatggcaat

SEQ ID NO: 3839217 - DNA, 22 bp, Homo sapiens
aaactttttaatggcaataatg

SEQ ID NO: 3839218 - DNA, 12 bp, Homo sapiens
aaagaaaacttg

SEQ ID NO: 3839219 - DNA, 20 bp, Homo sapiens
aaagaaaacttgtattatgt

SEQ ID NO: 3839220 - DNA, 22 bp, Homo sapiens
aaagaaactttttaataaagta

SEQ ID NO: 3839221 - DNA, 12 bp, Homo sapiens
aaagaaagattt

SEQ ID NO: 3839222 - DNA, 13 bp, Homo sapiens
aaagaaattatgt

SEQ ID NO: 3839223 - DNA, 21 bp, Homo sapiens
aaagaggattagacagtaaga

SEQ ID NO: 3839224 - DNA, 14 bp, Homo sapiens
aaagataagacttc

SEQ ID NO: 3839225 - DNA, 21 bp, Homo sapiens
aaagattgtaaactaaagtgt

SEQ ID NO: 3839226 - DNA, 22 bp, Homo sapiens
aaagattttatgtgcttgaaga

SEQ ID NO: 3839227 - DNA, 24 bp, Homo sapiens
aaagattttatgtgcttgaagatt

SEQ ID NO: 3839228 - DNA, 14 bp, Homo sapiens
aaagattttgtgaa

SEQ ID NO: 3839229 - DNA, 16 bp, Homo sapiens
aaagattttgtgaaat

SEQ ID NO: 3839230 - DNA, 17 bp, Homo sapiens
aaagattttgtgaaatt

SEQ ID NO: 3839231 - DNA, 19 bp, Homo sapiens
aaagattttgtgaaatttc

SEQ ID NO: 3839232 - DNA, 20 bp, Homo sapiens
aaagcaattttccttgaagc

SEQ ID NO: 3839233 - DNA, 16 bp, Homo sapiens
aaagcacgcagttatg

SEQ ID NO: 3839234 - DNA, 19 bp, Homo sapiens
aaagcaggcagaactcatc

SEQ ID NO: 3839235 - DNA, 22 bp, Homo sapiens
aaagcaggggctacaagaggga

SEQ ID NO: 3839236 - DNA, 21 bp, Homo sapiens
aaagcagtttttgaaagacaa

SEQ ID NO: 3839237 - DNA, 14 bp, Homo sapiens
aaagccaccacaca

SEQ ID NO: 3839238 - DNA, 19 bp, Homo sapiens
aaagccccatgctggagcc

SEQ ID NO: 3839239 - DNA, 20 bp, Homo sapiens
aaagccccatgctggagcct

SEQ ID NO: 3839240 - DNA, 14 bp, Homo sapiens
aaagcctgctctcc

SEQ ID NO: 3839241 - DNA, 15 bp, Homo sapiens
aaagctctaaggtaa

SEQ ID NO: 3839242 - DNA, 14 bp, Homo sapiens
aaagcttctctctg

SEQ ID NO: 3839243 - DNA, 22 bp, Homo sapiens
aaaggaactgggtggtttggtt

SEQ ID NO: 3839244 - DNA, 14 bp, Homo sapiens
aaaggctctggaag

SEQ ID NO: 3839245 - DNA, 18 bp, Homo sapiens
aaagggagggtggcagag

SEQ ID NO: 3839246 - DNA, 19 bp, Homo sapiens
aaagggagggtggcagaga

SEQ ID NO: 3839247 - DNA, 19 bp, Homo sapiens
aaaggggagagcctgctgg

SEQ ID NO: 3839248 - DNA, 21 bp, Homo sapiens
aaaggtgagtttgagctgcct

SEQ ID NO: 3839249 - DNA, 21 bp, Homo sapiens
aaagtaaaaacaaagaaatta

SEQ ID NO: 3839250 - DNA, 20 bp, Homo sapiens
aaagtagattaaaatatttg

SEQ ID NO: 3839251 - DNA, 21 bp, Homo sapiens
aaagtagattaaaatatttgc

SEQ ID NO: 3839252 - DNA, 22 bp, Homo sapiens
aaagtagattaaaatatttgcc

SEQ ID NO: 3839253 - DNA, 15 bp, Homo sapiens
aaagtcttgtgacta

SEQ ID NO: 3839254 - DNA, 22 bp, Homo sapiens
aaagtcttgtgactagtgctga

SEQ ID NO: 3839255 - DNA, 14 bp, Homo sapiens
aaagtgcactgtgt

SEQ ID NO: 3839256 - DNA, 16 bp, Homo sapiens
aaagtgtcactccata

SEQ ID NO: 3839257 - DNA, 17 bp, Homo sapiens
aaagtgtgctttataaa

SEQ ID NO: 3839258 - DNA, 14 bp, Homo sapiens
aaagttataagaaa

SEQ ID NO: 3839259 - DNA, 17 bp, Homo sapiens
aaagttctctgtaatta

SEQ ID NO: 3839260 - DNA, 16 bp, Homo sapiens
aaagttggtaaacctt

SEQ ID NO: 3839261 - DNA, 12 bp, Homo sapiens
acagagcaggct

SEQ ID NO: 3839262 - DNA, 16 bp, Homo sapiens
acagagcaggctttgt

SEQ ID NO: 3839263 - DNA, 21 bp, Homo sapiens
acagagcaggctttgtgagag

SEQ ID NO: 3839264 - DNA, 15 bp, Homo sapiens
acagagcccagggag

SEQ ID NO: 3839265 - DNA, 19 bp, Homo sapiens
acagagcccagggagactc

SEQ ID NO: 3839266 - DNA, 15 bp, Homo sapiens
acagatgaagaagga

SEQ ID NO: 3839267 - DNA, 22 bp, Homo sapiens
acagatgaagaaggagcagaat

SEQ ID NO: 3839268 - DNA, 16 bp, Homo sapiens
acagattataataaat

SEQ ID NO: 3839269 - DNA, 17 bp, Homo sapiens
acagattataataaatt

SEQ ID NO: 3839270 - DNA, 20 bp, Homo sapiens
acagattataataaattgtc

SEQ ID NO: 3839271 - DNA, 14 bp, Homo sapiens
acagcccagaaggc

SEQ ID NO: 3839272 - DNA, 16 bp, Homo sapiens
acagcccagaaggcca

SEQ ID NO: 3839273 - DNA, 17 bp, Homo sapiens
acagcccagaaggccag

SEQ ID NO: 3839274 - DNA, 18 bp, Homo sapiens
acagcccagaaggccaga

SEQ ID NO: 3839275 - DNA, 16 bp, Homo sapiens
acagccccagagcagg

SEQ ID NO: 3839276 - DNA, 12 bp, Homo sapiens
acagcctctgac

SEQ ID NO: 3839277 - DNA, 16 bp, Homo sapiens
acagcctctgacccct

SEQ ID NO: 3839278 - DNA, 21 bp, Homo sapiens
acagcctctgacccctcctca

SEQ ID NO: 3839279 - DNA, 22 bp, Homo sapiens
acagcctctgacccctcctcac

SEQ ID NO: 3839280 - DNA, 22 bp, Homo sapiens
acagctccttgggaggaagcag

SEQ ID NO: 3839281 - DNA, 23 bp, Homo sapiens
acagctccttgggaggaagcaga

SEQ ID NO: 3839282 - DNA, 18 bp, Homo sapiens
acagctgaggaccctcag

SEQ ID NO: 3839283 - DNA, 22 bp, Homo sapiens
acaggaactctgtgtgagagag

SEQ ID NO: 3839284 - DNA, 16 bp, Homo sapiens
acaggacttattatat

SEQ ID NO: 3839285 - DNA, 14 bp, Homo sapiens
acaggagaccaccc

SEQ ID NO: 3839286 - DNA, 16 bp, Homo sapiens
acaggagaccaccccc

SEQ ID NO: 3839287 - DNA, 21 bp, Homo sapiens
acaggatgatgactatggaaa

SEQ ID NO: 3839288 - DNA, 14 bp, Homo sapiens
acaggcacaaaatg

SEQ ID NO: 3839289 - DNA, 17 bp, Homo sapiens
acaggcacaaaatgtga

SEQ ID NO: 3839290 - DNA, 23 bp, Homo sapiens
acagggcatgccccggccacctc

SEQ ID NO: 3839291 - DNA, 18 bp, Homo sapiens
acagggctccagcctgtc

SEQ ID NO: 3839292 - DNA, 17 bp, Homo sapiens
acagggctcctgaagga

SEQ ID NO: 3839293 - DNA, 22 bp, Homo sapiens
acaggttaaatatataaacaaa

SEQ ID NO: 3839294 - DNA, 16 bp, Homo sapiens
acagtaagagtttaca

SEQ ID NO: 3839295 - DNA, 18 bp, Homo sapiens
acagtaagagtttacaag

SEQ ID NO: 3839296 - DNA, 21 bp, Homo sapiens
acagtagtaccaaatgcttta

SEQ ID NO: 3839297 - DNA, 23 bp, Homo sapiens
acagtagtaccaaatgctttaaa

SEQ ID NO: 3839298 - DNA, 16 bp, Homo sapiens
acagtagtataatgta

SEQ ID NO: 3839299 - DNA, 21 bp, Homo sapiens
acagtagtataatgtatgaat

SEQ ID NO: 3839300 - DNA, 15 bp, Homo sapiens
acagtcagcatttct

SEQ ID NO: 3839301 - DNA, 15 bp, Homo sapiens
acagtggccggggct

SEQ ID NO: 3839302 - DNA, 21 bp, Homo sapiens
acagtggccggggctgaagcc

SEQ ID NO: 3839303 - DNA, 22 bp, Homo sapiens
acagtggccggggctgaagcca

SEQ ID NO: 3839304 - DNA, 18 bp, Homo sapiens
acagtggttttatactga

SEQ ID NO: 3839305 - DNA, 19 bp, Homo sapiens
acagttataaagaaagatt

SEQ ID NO: 3839306 - DNA, 16 bp, Homo sapiens
acagttctatttgcta

SEQ ID NO: 3839307 - DNA, 23 bp, Homo sapiens
acagttctatttgctatctgaac

SEQ ID NO: 3839308 - DNA, 22 bp, Homo sapiens
acataatttaaaataaataaac

SEQ ID NO: 3839309 - DNA, 18 bp, Homo sapiens
acatattgtttcagtgtt

SEQ ID NO: 3839310 - DNA, 11 bp, Homo sapiens
acatcaagtgt

SEQ ID NO: 3839311 - DNA, 15 bp, Homo sapiens
acatcctactaagaa

SEQ ID NO: 3839312 - DNA, 12 bp, Homo sapiens
acatctgcctta

SEQ ID NO: 3839313 - DNA, 13 bp, Homo sapiens
acatcttcatgtg

SEQ ID NO: 3839314 - DNA, 18 bp, Homo sapiens
acatggaccttctctcca

SEQ ID NO: 3839315 - DNA, 14 bp, Homo sapiens
acatggcagatgat

SEQ ID NO: 3839316 - DNA, 20 bp, Homo sapiens
acatggtgcctgagaggcag

SEQ ID NO: 3839317 - DNA, 13 bp, Homo sapiens
acatgtaaaatct

SEQ ID NO: 3839318 - DNA, 12 bp, Homo sapiens
acattaacattt

SEQ ID NO: 3839319 - DNA, 17 bp, Homo sapiens
acattacattaacattt

SEQ ID NO: 3839320 - DNA, 12 bp, Homo sapiens
acattattttaa

SEQ ID NO: 3839321 - DNA, 23 bp, Homo sapiens
acattctcttactttttgtaaat

SEQ ID NO: 3839322 - DNA, 21 bp, Homo sapiens
acatttaagggaatgtgagca

SEQ ID NO: 3839323 - DNA, 19 bp, Homo sapiens
acatttgttctatagcttt

SEQ ID NO: 3839324 - DNA, 19 bp, Homo sapiens
accaaatgctttaaaaact

SEQ ID NO: 3839325 - DNA, 15 bp, Homo sapiens
accaactttttcatt

SEQ ID NO: 3839326 - DNA, 20 bp, Homo sapiens
accaagtaagacatctcaaa

SEQ ID NO: 3839327 - DNA, 17 bp, Homo sapiens
accaattgattttaaac

SEQ ID NO: 3839328 - DNA, 15 bp, Homo sapiens
accaccaacacacag

SEQ ID NO: 3839329 - DNA, 22 bp, Homo sapiens
accacccccgagcttgcctcag

SEQ ID NO: 3839330 - DNA, 16 bp, Homo sapiens
accacgctggagctgt

SEQ ID NO: 3839331 - DNA, 19 bp, Homo sapiens
accactcggggcccccatc

SEQ ID NO: 3839332 - DNA, 18 bp, Homo sapiens
accagagaccgtcctcac

SEQ ID NO: 3839333 - DNA, 19 bp, Homo sapiens
accagctgcgcttgctttt

SEQ ID NO: 3839334 - DNA, 16 bp, Homo sapiens
accaggagctgctcac

SEQ ID NO: 3839335 - DNA, 18 bp, Homo sapiens
accagtaataaaaagcca

SEQ ID NO: 3839336 - DNA, 15 bp, Homo sapiens
accatctggcccagg

SEQ ID NO: 3839337 - DNA, 16 bp, Homo sapiens
accatctggcccaggc

SEQ ID NO: 3839338 - DNA, 18 bp, Homo sapiens
accatctggcccaggctg

SEQ ID NO: 3839339 - DNA, 19 bp, Homo sapiens
accatctggcccaggctgg

SEQ ID NO: 3839340 - DNA, 15 bp, Homo sapiens
acccaaggattttta

SEQ ID NO: 3839341 - DNA, 15 bp, Homo sapiens
acccagagctgccta

SEQ ID NO: 3839342 - DNA, 21 bp, Homo sapiens
acccagataaaggttcatgca

SEQ ID NO: 3839343 - DNA, 13 bp, Homo sapiens
acccagcctcagt

SEQ ID NO: 3839344 - DNA, 23 bp, Homo sapiens
acccaggaggtggaggttgcagt

SEQ ID NO: 3839345 - DNA, 19 bp, Homo sapiens
accccaacccaataaaact

SEQ ID NO: 3839346 - DNA, 22 bp, Homo sapiens
accccaaggacctgcctccccg

SEQ ID NO: 3839347 - DNA, 21 bp, Homo sapiens
accccacgcgtgcataaaaac

SEQ ID NO: 3839348 - DNA, 17 bp, Homo sapiens
accccagctgtgagcct

SEQ ID NO: 3839349 - DNA, 21 bp, Homo sapiens
accccagctgtgagccttggc

SEQ ID NO: 3839350 - DNA, 16 bp, Homo sapiens
accccaggcagctcct

SEQ ID NO: 3839351 - DNA, 11 bp, Homo sapiens
acccccagcca

SEQ ID NO: 3839352 - DNA, 14 bp, Homo sapiens
acccccagccaggc

SEQ ID NO: 3839353 - DNA, 18 bp, Homo sapiens
acccccgagcttgcctca

SEQ ID NO: 3839354 - DNA, 19 bp, Homo sapiens
acccccgagcttgcctcag

SEQ ID NO: 3839355 - DNA, 15 bp, Homo sapiens
accccgggctctcct

SEQ ID NO: 3839356 - DNA, 15 bp, Homo sapiens
accccggggaccctg

SEQ ID NO: 3839357 - DNA, 17 bp, Homo sapiens
acccctaaaaacaaaac

SEQ ID NO: 3839358 - DNA, 17 bp, Homo sapiens
acccctcctcactggcc

SEQ ID NO: 3839359 - DNA, 18 bp, Homo sapiens
acccctcctcactggcca

SEQ ID NO: 3839360 - DNA, 19 bp, Homo sapiens
acccctcctcactggccat

SEQ ID NO: 3839361 - DNA, 19 bp, Homo sapiens
accctcagccccaggagaa

SEQ ID NO: 3839362 - DNA, 17 bp, Homo sapiens
accctcgctctctgtct

SEQ ID NO: 3839363 - DNA, 12 bp, Homo sapiens
accctgtcctcc

SEQ ID NO: 3839364 - DNA, 14 bp, Homo sapiens
accctgtcctccca

SEQ ID NO: 3839365 - DNA, 16 bp, Homo sapiens
accctgtcctcccacc

SEQ ID NO: 3839366 - DNA, 21 bp, Homo sapiens
accctgtgacatggtgcctga

SEQ ID NO: 3839367 - DNA, 19 bp, Homo sapiens
accctgttgcaaaggaaat

SEQ ID NO: 3839368 - DNA, 21 bp, Homo sapiens
accctttggtttttttcttct

SEQ ID NO: 3839369 - DNA, 23 bp, Homo sapiens
accctttggtttttttcttctgt

SEQ ID NO: 3839370 - DNA, 11 bp, Homo sapiens
accggcctgga

SEQ ID NO: 3839371 - DNA, 14 bp, Homo sapiens
accggcctggacct

SEQ ID NO: 3839372 - DNA, 15 bp, Homo sapiens
accgtcctcacccct

SEQ ID NO: 3839373 - DNA, 17 bp, Homo sapiens
accgtcctcacccctgt

SEQ ID NO: 3839374 - DNA, 18 bp, Homo sapiens
accgtcctcacccctgtc

SEQ ID NO: 3839375 - DNA, 21 bp, Homo sapiens
accgtcctcacccctgtcctc

SEQ ID NO: 3839376 - DNA, 13 bp, Homo sapiens
acctcagctgctt

SEQ ID NO: 3839377 - DNA, 13 bp, Homo sapiens
acctcatgcccac

SEQ ID NO: 3839378 - DNA, 20 bp, Homo sapiens
acctcatgcccaccccctgc

SEQ ID NO: 3839379 - DNA, 23 bp, Homo sapiens
acctcatgcccaccccctgccct

SEQ ID NO: 3839380 - DNA, 10 bp, Homo sapiens
acctccatgc

SEQ ID NO: 3839381 - DNA, 22 bp, Homo sapiens
acctccatgcccccgccacctc

SEQ ID NO: 3839382 - DNA, 19 bp, Homo sapiens
acctccccacgccctcccc

SEQ ID NO: 3839383 - DNA, 21 bp, Homo sapiens
acctccccacgccctcccctc

SEQ ID NO: 3839384 - DNA, 22 bp, Homo sapiens
acctccccacgccctcccctcc

SEQ ID NO: 3839385 - DNA, 12 bp, Homo sapiens
acctccccactc

SEQ ID NO: 3839386 - DNA, 15 bp, Homo sapiens
acctccccactccag

SEQ ID NO: 3839387 - DNA, 12 bp, Homo sapiens
acctccccagac

SEQ ID NO: 3839388 - DNA, 15 bp, Homo sapiens
acctccccagacagg

SEQ ID NO: 3839389 - DNA, 19 bp, Homo sapiens
acctccccagacagggctc

SEQ ID NO: 3839390 - DNA, 13 bp, Homo sapiens
acctcctcaggga

SEQ ID NO: 3839391 - DNA, 11 bp, Homo sapiens
acctctcccac

SEQ ID NO: 3839392 - DNA, 14 bp, Homo sapiens
acctctgcggaccc

SEQ ID NO: 3839393 - DNA, 17 bp, Homo sapiens
agccctggaggtgccag

SEQ ID NO: 3839394 - DNA, 15 bp, Homo sapiens
agcccttagggagag

SEQ ID NO: 3839395 - DNA, 12 bp, Homo sapiens
agcccttgcctc

SEQ ID NO: 3839396 - DNA, 14 bp, Homo sapiens
agcccttgcctccc

SEQ ID NO: 3839397 - DNA, 16 bp, Homo sapiens
agcccttgcctcccca

SEQ ID NO: 3839398 - DNA, 23 bp, Homo sapiens
agcccttgcctccccatttccca

SEQ ID NO: 3839399 - DNA, 11 bp, Homo sapiens
agcccttggcc

SEQ ID NO: 3839400 - DNA, 13 bp, Homo sapiens
agccctttgctgt

SEQ ID NO: 3839401 - DNA, 23 bp, Homo sapiens
agccgcctcggagtgtggcctgg

SEQ ID NO: 3839402 - DNA, 13 bp, Homo sapiens
agccggcccaacc

SEQ ID NO: 3839403 - DNA, 17 bp, Homo sapiens
agcctatcaaagacctt

SEQ ID NO: 3839404 - DNA, 15 bp, Homo sapiens
agcctcagtcctccc

SEQ ID NO: 3839405 - DNA, 23 bp, Homo sapiens
agcctccaactccagctgagtcc

SEQ ID NO: 3839406 - DNA, 24 bp, Homo sapiens
agcctccaactccagctgagtcct

SEQ ID NO: 3839407 - DNA, 20 bp, Homo sapiens
agcctccagtctgctctcag

SEQ ID NO: 3839408 - DNA, 23 bp, Homo sapiens
agcctccagtctgctctcagctt

SEQ ID NO: 3839409 - DNA, 17 bp, Homo sapiens
agcctccctctcctctg

SEQ ID NO: 3839410 - DNA, 20 bp, Homo sapiens
agcctccctctcctctgtcc

SEQ ID NO: 3839411 - DNA, 14 bp, Homo sapiens
agcctcctctggac

SEQ ID NO: 3839412 - DNA, 22 bp, Homo sapiens
agcctcgttaggacaaggctgt

SEQ ID NO: 3839413 - DNA, 14 bp, Homo sapiens
agcctctcctttgt

SEQ ID NO: 3839414 - DNA, 15 bp, Homo sapiens
agcctctgacccctc

SEQ ID NO: 3839415 - DNA, 17 bp, Homo sapiens
agcctctgacccctcct

SEQ ID NO: 3839416 - DNA, 21 bp, Homo sapiens
agcctctgacccctcctcact

SEQ ID NO: 3839417 - DNA, 22 bp, Homo sapiens
agcctctgacccctcctcactg

SEQ ID NO: 3839418 - DNA, 17 bp, Homo sapiens
agcctgcgggaagctga

SEQ ID NO: 3839419 - DNA, 14 bp, Homo sapiens
agcctgggcctcct

SEQ ID NO: 3839420 - DNA, 13 bp, Homo sapiens
agcctgtcggcca

SEQ ID NO: 3839421 - DNA, 22 bp, Homo sapiens
agcctgtgtgcagtggagctgg

SEQ ID NO: 3839422 - DNA, 15 bp, Homo sapiens
agcctgtttaagaga

SEQ ID NO: 3839423 - DNA, 22 bp, Homo sapiens
agccttcattaggaggccgagg

SEQ ID NO: 3839424 - DNA, 17 bp, Homo sapiens
agcctttggctctggag

SEQ ID NO: 3839425 - DNA, 18 bp, Homo sapiens
agcctttggctctggaga

SEQ ID NO: 3839426 - DNA, 23 bp, Homo sapiens
agcctttggctctggagacagcc

SEQ ID NO: 3839427 - DNA, 17 bp, Homo sapiens
agcgggcccgggtccca

SEQ ID NO: 3839428 - DNA, 22 bp, Homo sapiens
agcggtctcaggctggtgggag

SEQ ID NO: 3839429 - DNA, 23 bp, Homo sapiens
agcggtctcaggctggtgggagg

SEQ ID NO: 3839430 - DNA, 14 bp, Homo sapiens
agcgtattcttgaa

SEQ ID NO: 3839431 - DNA, 22 bp, Homo sapiens
agctaaataacttgccatttct

SEQ ID NO: 3839432 - DNA, 15 bp, Homo sapiens
agctaataaaatatc

SEQ ID NO: 3839433 - DNA, 18 bp, Homo sapiens
agctaataaaatatcatt

SEQ ID NO: 3839434 - DNA, 23 bp, Homo sapiens
agctaataaaatatcattcagca

SEQ ID NO: 3839435 - DNA, 18 bp, Homo sapiens
agctaggaattgtgttta

SEQ ID NO: 3839436 - DNA, 16 bp, Homo sapiens
agctagtgtcacctgc

SEQ ID NO: 3839437 - DNA, 17 bp, Homo sapiens
agctatcgtaaaattaa

SEQ ID NO: 3839438 - DNA, 22 bp, Homo sapiens
agctattgggagcaatctggaa

SEQ ID NO: 3839439 - DNA, 16 bp, Homo sapiens
agctcatctgccaaaa

SEQ ID NO: 3839440 - DNA, 16 bp, Homo sapiens
agctccagatgtttct

SEQ ID NO: 3839441 - DNA, 22 bp, Homo sapiens
agctccgggtgtagattccctt

SEQ ID NO: 3839442 - DNA, 20 bp, Homo sapiens
agctcctccgtgcttcctca

SEQ ID NO: 3839443 - DNA, 15 bp, Homo sapiens
agctcctgtttggaa

SEQ ID NO: 3839444 - DNA, 17 bp, Homo sapiens
agctcgaaataaaggcg

SEQ ID NO: 3839445 - DNA, 17 bp, Homo sapiens
agctctggagcaagccc

SEQ ID NO: 3839446 - DNA, 23 bp, Homo sapiens
agctctggagtgagtctgtcata

SEQ ID NO: 3839447 - DNA, 14 bp, Homo sapiens
agctgaagcctgga

SEQ ID NO: 3839448 - DNA, 17 bp, Homo sapiens
agctgaagcctggacgc

SEQ ID NO: 3839449 - DNA, 21 bp, Homo sapiens
agctgaagcctggacgcagcc

SEQ ID NO: 3839450 - DNA, 16 bp, Homo sapiens
agctgaccacaggcag

SEQ ID NO: 3839451 - DNA, 21 bp, Homo sapiens
agctgacctttaactgagggc

SEQ ID NO: 3839452 - DNA, 16 bp, Homo sapiens
agctgactttcatttg

SEQ ID NO: 3839453 - DNA, 17 bp, Homo sapiens
agctgaggaccctcagc

SEQ ID NO: 3839454 - DNA, 21 bp, Homo sapiens
agctgaggaccctcagcccca

SEQ ID NO: 3839455 - DNA, 15 bp, Homo sapiens
agctgagtcctgggg

SEQ ID NO: 3839456 - DNA, 15 bp, Homo sapiens
agctgatgactcaag

SEQ ID NO: 3839457 - DNA, 23 bp, Homo sapiens
agctgccagggaagacagagcag

SEQ ID NO: 3839458 - DNA, 12 bp, Homo sapiens
agctgccttccc

SEQ ID NO: 3839459 - DNA, 13 bp, Homo sapiens
agctgccttccct

SEQ ID NO: 3839460 - DNA, 18 bp, Homo sapiens
agctgccttccctagctt

SEQ ID NO: 3839461 - DNA, 17 bp, Homo sapiens
agctgcgcttgcttttc

SEQ ID NO: 3839462 - DNA, 23 bp, Homo sapiens
agctgctcactacctcctcaggg

SEQ ID NO: 3839463 - DNA, 13 bp, Homo sapiens
agctgctgtctct

SEQ ID NO: 3839464 - DNA, 22 bp, Homo sapiens
agctgcttctcccacttggcca

SEQ ID NO: 3839465 - DNA, 23 bp, Homo sapiens
agctgcttctcccacttggccaa

SEQ ID NO: 3839466 - DNA, 20 bp, Homo sapiens
agctggactgcattgaaggc

SEQ ID NO: 3839467 - DNA, 19 bp, Homo sapiens
agctggagtgccatggctg

SEQ ID NO: 3839468 - DNA, 23 bp, Homo sapiens
agctggagtgccatggctggggg

SEQ ID NO: 3839469 - DNA, 16 bp, Homo sapiens
agctgggagggagggg

SEQ ID NO: 3839470 - DNA, 18 bp, Homo sapiens
agctgggctagaggctga

SEQ ID NO: 3839471 - DNA, 18 bp, Homo sapiens
agctgggtgtggtggcat

SEQ ID NO: 3839472 - DNA, 18 bp, Homo sapiens
agctggtttttcccacca

SEQ ID NO: 3839473 - DNA, 17 bp, Homo sapiens
agctgtgagccttggct

SEQ ID NO: 3839474 - DNA, 20 bp, Homo sapiens
agctgtgtaccaatcgtctc

SEQ ID NO: 3839475 - DNA, 17 bp, Homo sapiens
agcttattaatgctaag

SEQ ID NO: 3839476 - DNA, 18 bp, Homo sapiens
agcttattaatgctaagg

SEQ ID NO: 3839477 - DNA, 22 bp, Homo sapiens
agcttattaatgctaagggcag

SEQ ID NO: 3839478 - DNA, 20 bp, Homo sapiens
agcttcccccccaccacagg

SEQ ID NO: 3839479 - DNA, 17 bp, Homo sapiens
agcttctgcttttctgc

SEQ ID NO: 3839480 - DNA, 13 bp, Homo sapiens
agcttgcctcagg

SEQ ID NO: 3839481 - DNA, 19 bp, Homo sapiens
agctttaaattcatggttt

SEQ ID NO: 3839482 - DNA, 22 bp, Homo sapiens
agctttagaccctgggtgggct

SEQ ID NO: 3839483 - DNA, 18 bp, Homo sapiens
agctttattgctgcattt

SEQ ID NO: 3839484 - DNA, 17 bp, Homo sapiens
aggaaaaacacaagcaa

SEQ ID NO: 3839485 - DNA, 16 bp, Homo sapiens
aggaaaaagctttact

SEQ ID NO: 3839486 - DNA, 16 bp, Homo sapiens
aggaaactccacatct

SEQ ID NO: 3839487 - DNA, 21 bp, Homo sapiens
aggaaactccacatctgcctt

SEQ ID NO: 3839488 - DNA, 20 bp, Homo sapiens
aggaagaagcttaggcaggg

SEQ ID NO: 3839489 - DNA, 12 bp, Homo sapiens
aggaagcagaat

SEQ ID NO: 3839490 - DNA, 15 bp, Homo sapiens
aggaagcagaataaa

SEQ ID NO: 3839491 - DNA, 16 bp, Homo sapiens
aggaagcagaataaag

SEQ ID NO: 3839492 - DNA, 19 bp, Homo sapiens
aggaagcagaataaagcaa

SEQ ID NO: 3839493 - DNA, 22 bp, Homo sapiens
aggaagcagaataaagcaattt

SEQ ID NO: 3839494 - DNA, 21 bp, Homo sapiens
aggaaggccatggggcagcct

SEQ ID NO: 3839495 - DNA, 18 bp, Homo sapiens
aggaataaagcttctctc

SEQ ID NO: 3839496 - DNA, 23 bp, Homo sapiens
aggaattgtgtttataattttaa

SEQ ID NO: 3839497 - DNA, 18 bp, Homo sapiens
aggaatttgaagctcaga

SEQ ID NO: 3839498 - DNA, 22 bp, Homo sapiens
aggaattttatttttttctgaa

SEQ ID NO: 3839499 - DNA, 17 bp, Homo sapiens
aggacaaggctgtgcca

SEQ ID NO: 3839500 - DNA, 20 bp, Homo sapiens
aggacaaggctgtgccaggc

SEQ ID NO: 3839501 - DNA, 18 bp, Homo sapiens
aggacaccacacccagcc

SEQ ID NO: 3839502 - DNA, 19 bp, Homo sapiens
aggacaccacacccagcct

SEQ ID NO: 3839503 - DNA, 20 bp, Homo sapiens
aggacaccacacccagcctc

SEQ ID NO: 3839504 - DNA, 14 bp, Homo sapiens
aggacctgagcctg

SEQ ID NO: 3839505 - DNA, 18 bp, Homo sapiens
aggacctgagcctggcca

SEQ ID NO: 3839506 - DNA, 14 bp, Homo sapiens
aggacctgcctccc

SEQ ID NO: 3839507 - DNA, 19 bp, Homo sapiens
aggacgacgaatcttctca

SEQ ID NO: 3839508 - DNA, 13 bp, Homo sapiens
aggactatttata

SEQ ID NO: 3839509 - DNA, 18 bp, Homo sapiens
aggactcaacattacatt

SEQ ID NO: 3839510 - DNA, 13 bp, Homo sapiens
aggactgtggagg

SEQ ID NO: 3839511 - DNA, 18 bp, Homo sapiens
aggactgtggaggggagc

SEQ ID NO: 3839512 - DNA, 13 bp, Homo sapiens
aggagaccacccc

SEQ ID NO: 3839513 - DNA, 23 bp, Homo sapiens
aggagaccacccccgagcttgcc

SEQ ID NO: 3839514 - DNA, 12 bp, Homo sapiens
aggagagagaaa

SEQ ID NO: 3839515 - DNA, 22 bp, Homo sapiens
aggagagagaaagccaggcagg

SEQ ID NO: 3839516 - DNA, 13 bp, Homo sapiens
aggagattgagaa

SEQ ID NO: 3839517 - DNA, 15 bp, Homo sapiens
aggagattgagaagg

SEQ ID NO: 3839518 - DNA, 17 bp, Homo sapiens
aggaggaaggcaagagg

SEQ ID NO: 3839519 - DNA, 13 bp, Homo sapiens
aggagggagaggg

SEQ ID NO: 3839520 - DNA, 13 bp, Homo sapiens
aggagggccctga

SEQ ID NO: 3839521 - DNA, 15 bp, Homo sapiens
aggagggccctgagg

SEQ ID NO: 3839522 - DNA, 17 bp, Homo sapiens
aggagggccctgaggaa

SEQ ID NO: 3839523 - DNA, 22 bp, Homo sapiens
aggagggccctgaggaataaag

SEQ ID NO: 3839524 - DNA, 16 bp, Homo sapiens
agttttactgcatttt

SEQ ID NO: 3839525 - DNA, 19 bp, Homo sapiens
agttttattttctaaattc

SEQ ID NO: 3839526 - DNA, 18 bp, Homo sapiens
agtttttcattatttgga

SEQ ID NO: 3839527 - DNA, 16 bp, Homo sapiens
agtttttgaaagacaa

SEQ ID NO: 3839528 - DNA, 15 bp, Homo sapiens
agttttttttataca

SEQ ID NO: 3839529 - DNA, 15 bp, Homo sapiens
ataaaaaaaagttgt

SEQ ID NO: 3839530 - DNA, 16 bp, Homo sapiens
ataaaatatcattcag

SEQ ID NO: 3839531 - DNA, 17 bp, Homo sapiens
ataaaatatcattcagc

SEQ ID NO: 3839532 - DNA, 18 bp, Homo sapiens
ataaaatatcattcagca

SEQ ID NO: 3839533 - DNA, 19 bp, Homo sapiens
ataaaatatcattcagcaa

SEQ ID NO: 3839534 - DNA, 20 bp, Homo sapiens
ataaacaaacaaacaaaaat

SEQ ID NO: 3839535 - DNA, 18 bp, Homo sapiens
ataaacatgtccccttcc

SEQ ID NO: 3839536 - DNA, 16 bp, Homo sapiens
ataaagaaagattgta

SEQ ID NO: 3839537 - DNA, 22 bp, Homo sapiens
ataaagagatacgaatttctat

SEQ ID NO: 3839538 - DNA, 16 bp, Homo sapiens
ataaagcaattttcct

SEQ ID NO: 3839539 - DNA, 12 bp, Homo sapiens
ataaagcctgct

SEQ ID NO: 3839540 - DNA, 18 bp, Homo sapiens
ataaagcttctctctgag

SEQ ID NO: 3839541 - DNA, 19 bp, Homo sapiens
ataaagcttctctctgagc

SEQ ID NO: 3839542 - DNA, 17 bp, Homo sapiens
ataaaggttcatgcaaa

SEQ ID NO: 3839543 - DNA, 17 bp, Homo sapiens
ataaagtatattgaaag

SEQ ID NO: 3839544 - DNA, 20 bp, Homo sapiens
ataaagtatattgaaagttt

SEQ ID NO: 3839545 - DNA, 13 bp, Homo sapiens
ataaataaacttt

SEQ ID NO: 3839546 - DNA, 12 bp, Homo sapiens
ataaataaatat

SEQ ID NO: 3839547 - DNA, 15 bp, Homo sapiens
ataaataaatatata

SEQ ID NO: 3839548 - DNA, 13 bp, Homo sapiens
ataaataaatgtt

SEQ ID NO: 3839549 - DNA, 12 bp, Homo sapiens
ataaatatatat

SEQ ID NO: 3839550 - DNA, 20 bp, Homo sapiens
ataaatatatataaatatat

SEQ ID NO: 3839551 - DNA, 20 bp, Homo sapiens
ataaatatatatatcctctg

SEQ ID NO: 3839552 - DNA, 20 bp, Homo sapiens
ataaatctatatttttgtga

SEQ ID NO: 3839553 - DNA, 22 bp, Homo sapiens
ataaatgttttacaactcctga

SEQ ID NO: 3839554 - DNA, 11 bp, Homo sapiens
ataacaaatgc

SEQ ID NO: 3839555 - DNA, 17 bp, Homo sapiens
ataacttgccatttctt

SEQ ID NO: 3839556 - DNA, 13 bp, Homo sapiens
ataagaaatttta

SEQ ID NO: 3839557 - DNA, 16 bp, Homo sapiens
ataaggagctttgctc

SEQ ID NO: 3839558 - DNA, 20 bp, Homo sapiens
ataaggccgagcccacacca

SEQ ID NO: 3839559 - DNA, 17 bp, Homo sapiens
ataagtatataaatact

SEQ ID NO: 3839560 - DNA, 19 bp, Homo sapiens
ataagtatataaatactat

SEQ ID NO: 3839561 - DNA, 21 bp, Homo sapiens
ataatattcatacaacaaaga

SEQ ID NO: 3839562 - DNA, 15 bp, Homo sapiens
ataatgcaaatgtca

SEQ ID NO: 3839563 - DNA, 14 bp, Homo sapiens
ataatgtaactgaa

SEQ ID NO: 3839564 - DNA, 20 bp, Homo sapiens
ataatgtaactgaagcataa

SEQ ID NO: 3839565 - DNA, 19 bp, Homo sapiens
ataatgtatgaattttgta

SEQ ID NO: 3839566 - DNA, 17 bp, Homo sapiens
ataattctttctttttc

SEQ ID NO: 3839567 - DNA, 21 bp, Homo sapiens
ataattctttctttttccttc

SEQ ID NO: 3839568 - DNA, 13 bp, Homo sapiens
ataatttaaaata

SEQ ID NO: 3839569 - DNA, 17 bp, Homo sapiens
ataatttaaaataaata

SEQ ID NO: 3839570 - DNA, 12 bp, Homo sapiens
ataattttaaat

SEQ ID NO: 3839571 - DNA, 14 bp, Homo sapiens
ataattttaaatgt

SEQ ID NO: 3839572 - DNA, 16 bp, Homo sapiens
ataattttcaaaagaa

SEQ ID NO: 3839573 - DNA, 19 bp, Homo sapiens
ataattttgcaaatctgtt

SEQ ID NO: 3839574 - DNA, 13 bp, Homo sapiens
atacaaagaaact

SEQ ID NO: 3839575 - DNA, 17 bp, Homo sapiens
atacaaagaaacttttt

SEQ ID NO: 3839576 - DNA, 13 bp, Homo sapiens
atacacacacaca

SEQ ID NO: 3839577 - DNA, 16 bp, Homo sapiens
atacacacacacacac

SEQ ID NO: 3839578 - DNA, 14 bp, Homo sapiens
atacataaagttct

SEQ ID NO: 3839579 - DNA, 20 bp, Homo sapiens
atacataaagttctctgtaa

SEQ ID NO: 3839580 - DNA, 23 bp, Homo sapiens
atacataaagttctctgtaatta

SEQ ID NO: 3839581 - DNA, 19 bp, Homo sapiens
atactatagttatatagat

SEQ ID NO: 3839582 - DNA, 14 bp, Homo sapiens
atactgcagggcca

SEQ ID NO: 3839583 - DNA, 16 bp, Homo sapiens
atacttgaaaattaac

SEQ ID NO: 3839584 - DNA, 19 bp, Homo sapiens
atacttgaaaattaacatg

SEQ ID NO: 3839585 - DNA, 16 bp, Homo sapiens
atacttttgcttggtt

SEQ ID NO: 3839586 - DNA, 15 bp, Homo sapiens
atagagtgcataaat

SEQ ID NO: 3839587 - DNA, 15 bp, Homo sapiens
atagataaagagata

SEQ ID NO: 3839588 - DNA, 19 bp, Homo sapiens
atagatgagtttttcatta

SEQ ID NO: 3839589 - DNA, 15 bp, Homo sapiens
atagcctctcctttg

SEQ ID NO: 3839590 - DNA, 17 bp, Homo sapiens
ataggcacaggaaacca

SEQ ID NO: 3839591 - DNA, 15 bp, Homo sapiens
atagtactgctttac

SEQ ID NO: 3839592 - DNA, 12 bp, Homo sapiens
atagtctggaaa

SEQ ID NO: 3839593 - DNA, 15 bp, Homo sapiens
atagtgcaactgttt

SEQ ID NO: 3839594 - DNA, 22 bp, Homo sapiens
atagtggacattgttggcagca

SEQ ID NO: 3839595 - DNA, 15 bp, Homo sapiens
atagttatatagata

SEQ ID NO: 3839596 - DNA, 19 bp, Homo sapiens
atataaaaggttgtgtaca

SEQ ID NO: 3839597 - DNA, 15 bp, Homo sapiens
atataaacaaacaaa

SEQ ID NO: 3839598 - DNA, 19 bp, Homo sapiens
atataaataaatatatata

SEQ ID NO: 3839599 - DNA, 11 bp, Homo sapiens
atataaatata

SEQ ID NO: 3839600 - DNA, 21 bp, Homo sapiens
atataaatatatataaatata

SEQ ID NO: 3839601 - DNA, 15 bp, Homo sapiens
atataagtgattgct

SEQ ID NO: 3839602 - DNA, 12 bp, Homo sapiens
atatacaatata

SEQ ID NO: 3839603 - DNA, 13 bp, Homo sapiens
atatacaatatat

SEQ ID NO: 3839604 - DNA, 21 bp, Homo sapiens
atatacctcttgaagaagaag

SEQ ID NO: 3839605 - DNA, 15 bp, Homo sapiens
atatataaacaaaca

SEQ ID NO: 3839606 - DNA, 11 bp, Homo sapiens
atatataaata

SEQ ID NO: 3839607 - DNA, 12 bp, Homo sapiens
atatataaataa

SEQ ID NO: 3839608 - DNA, 17 bp, Homo sapiens
atatataaataaatata

SEQ ID NO: 3839609 - DNA, 14 bp, Homo sapiens
atatatatcctctg

SEQ ID NO: 3839610 - DNA, 13 bp, Homo sapiens
atatatctttgta

SEQ ID NO: 3839611 - DNA, 14 bp, Homo sapiens
atatatctttgtaa

SEQ ID NO: 3839612 - DNA, 13 bp, Homo sapiens
atatattaaacct

SEQ ID NO: 3839613 - DNA, 19 bp, Homo sapiens
atatattgtgttttaacac

SEQ ID NO: 3839614 - DNA, 14 bp, Homo sapiens
atatattttaaatg

SEQ ID NO: 3839615 - DNA, 17 bp, Homo sapiens
atatattttaaatgtgg

SEQ ID NO: 3839616 - DNA, 12 bp, Homo sapiens
atatattttaag

SEQ ID NO: 3839617 - DNA, 11 bp, Homo sapiens
atatcctctgt

SEQ ID NO: 3839618 - DNA, 15 bp, Homo sapiens
atatctttgtaaatt

SEQ ID NO: 3839619 - DNA, 19 bp, Homo sapiens
atatctttgtaaattattt

SEQ ID NO: 3839620 - DNA, 22 bp, Homo sapiens
atatctttgtaaattattttat

SEQ ID NO: 3839621 - DNA, 14 bp, Homo sapiens
atatgatttgcatt

SEQ ID NO: 3839622 - DNA, 18 bp, Homo sapiens
atatgccttactattgta

SEQ ID NO: 3839623 - DNA, 18 bp, Homo sapiens
atatggttttgttttcaa

SEQ ID NO: 3839624 - DNA, 15 bp, Homo sapiens
atatgtctataagta

SEQ ID NO: 3839625 - DNA, 23 bp, Homo sapiens
atatgtctataagtatataaata

SEQ ID NO: 3839626 - DNA, 15 bp, Homo sapiens
atattaaaaagaagt

SEQ ID NO: 3839627 - DNA, 14 bp, Homo sapiens
atattcatacaaca

SEQ ID NO: 3839628 - DNA, 18 bp, Homo sapiens
atattcatacaacaaaga

SEQ ID NO: 3839629 - DNA, 22 bp, Homo sapiens
atattgatccagaaagaaaact

SEQ ID NO: 3839630 - DNA, 13 bp, Homo sapiens
atatttattgctt

SEQ ID NO: 3839631 - DNA, 18 bp, Homo sapiens
atatttattgctttataa

SEQ ID NO: 3839632 - DNA, 21 bp, Homo sapiens
atatttattgctttataaata

SEQ ID NO: 3839633 - DNA, 13 bp, Homo sapiens
atatttcataaat

SEQ ID NO: 3839634 - DNA, 15 bp, Homo sapiens
atatttgtaaaagct

SEQ ID NO: 3839635 - DNA, 17 bp, Homo sapiens
atatttgtaaaagctaa

SEQ ID NO: 3839636 - DNA, 14 bp, Homo sapiens
atatttgtctgtgt

SEQ ID NO: 3839637 - DNA, 19 bp, Homo sapiens
atatttgtctgtgtgctac

SEQ ID NO: 3839638 - DNA, 21 bp, Homo sapiens
atatttgtctgtgtgctacta

SEQ ID NO: 3839639 - DNA, 14 bp, Homo sapiens
atattttaagacga

SEQ ID NO: 3839640 - DNA, 15 bp, Homo sapiens
atatttttaaaaaac

SEQ ID NO: 3839641 - DNA, 13 bp, Homo sapiens
atatttttgtgaa

SEQ ID NO: 3839642 - DNA, 17 bp, Homo sapiens
atcaagatttggcagga

SEQ ID NO: 3839643 - DNA, 13 bp, Homo sapiens
atcaagcagaaaa

SEQ ID NO: 3839644 - DNA, 14 bp, Homo sapiens
atcaagcagaaaac

SEQ ID NO: 3839645 - DNA, 13 bp, Homo sapiens
atcaagctaataa

SEQ ID NO: 3839646 - DNA, 16 bp, Homo sapiens
atcaatcagaaggtat

SEQ ID NO: 3839647 - DNA, 16 bp, Homo sapiens
atcaatcattgtacag

SEQ ID NO: 3839648 - DNA, 19 bp, Homo sapiens
atcaatccaaattccctct

SEQ ID NO: 3839649 - DNA, 16 bp, Homo sapiens
atcacatggcatgttt

SEQ ID NO: 3839650 - DNA, 13 bp, Homo sapiens
atcagaagaaagg

SEQ ID NO: 3839651 - DNA, 19 bp, Homo sapiens
atcagaaggtattttttaa

SEQ ID NO: 3839652 - DNA, 19 bp, Homo sapiens
atcagacttcaccaaatat

SEQ ID NO: 3839653 - DNA, 12 bp, Homo sapiens
atcattcagcaa

SEQ ID NO: 3839654 - DNA, 13 bp, Homo sapiens
atcattgcctggt

SEQ ID NO: 3839655 - DNA, 18 bp, Homo sapiens
atcattgtacagtttgtt

SEQ ID NO: 3839656 - DNA, 14 bp, Homo sapiens
atcattgtatggat

SEQ ID NO: 3839657 - DNA, 20 bp, Homo sapiens
atcattttacctttgacaaa

SEQ ID NO: 3839658 - DNA, 19 bp, Homo sapiens
atccaaattccctctggag

SEQ ID NO: 3839659 - DNA, 16 bp, Homo sapiens
atttatacaaagaaac

SEQ ID NO: 3839660 - DNA, 18 bp, Homo sapiens
atttatacaaagaaactt

SEQ ID NO: 3839661 - DNA, 12 bp, Homo sapiens
atttattgcttt

SEQ ID NO: 3839662 - DNA, 14 bp, Homo sapiens
atttattgctttat

SEQ ID NO: 3839663 - DNA, 16 bp, Homo sapiens
atttattttaatgtaa

SEQ ID NO: 3839664 - DNA, 20 bp, Homo sapiens
atttcaatggtgttggcttc

SEQ ID NO: 3839665 - DNA, 14 bp, Homo sapiens
atttcaatttcaat

SEQ ID NO: 3839666 - DNA, 15 bp, Homo sapiens
atttcagtagtttct

SEQ ID NO: 3839667 - DNA, 22 bp, Homo sapiens
atttcataaattaacaaagtgt

SEQ ID NO: 3839668 - DNA, 12 bp, Homo sapiens
atttcatgaaaa

SEQ ID NO: 3839669 - DNA, 17 bp, Homo sapiens
atttcatgaaaactttt

SEQ ID NO: 3839670 - DNA, 14 bp, Homo sapiens
atttctttttgatt

SEQ ID NO: 3839671 - DNA, 15 bp, Homo sapiens
atttgaacaaaaatt

SEQ ID NO: 3839672 - DNA, 17 bp, Homo sapiens
atttgaagctcagaaag

SEQ ID NO: 3839673 - DNA, 21 bp, Homo sapiens
atttgccagttttattttcta

SEQ ID NO: 3839674 - DNA, 14 bp, Homo sapiens
atttgtaaaaagta

SEQ ID NO: 3839675 - DNA, 15 bp, Homo sapiens
atttgtaaaaagtag

SEQ ID NO: 3839676 - DNA, 17 bp, Homo sapiens
atttgtaaaaagtagat

SEQ ID NO: 3839677 - DNA, 21 bp, Homo sapiens
atttgtaaaggactatttata

SEQ ID NO: 3839678 - DNA, 14 bp, Homo sapiens
atttgtctgtgtgc

SEQ ID NO: 3839679 - DNA, 17 bp, Homo sapiens
atttgtctgtgtgctac

SEQ ID NO: 3839680 - DNA, 20 bp, Homo sapiens
atttgtctgtgtgctactaa

SEQ ID NO: 3839681 - DNA, 21 bp, Homo sapiens
atttgtctgtgtgctactaac

SEQ ID NO: 3839682 - DNA, 19 bp, Homo sapiens
atttgttctatagcttttc

SEQ ID NO: 3839683 - DNA, 13 bp, Homo sapiens
attttaaaatcaa

SEQ ID NO: 3839684 - DNA, 15 bp, Homo sapiens
attttaaaatgttta

SEQ ID NO: 3839685 - DNA, 22 bp, Homo sapiens
attttaaaccataaaaagctga

SEQ ID NO: 3839686 - DNA, 12 bp, Homo sapiens
attttatgtgct

SEQ ID NO: 3839687 - DNA, 18 bp, Homo sapiens
attttatgtgcttgaaga

SEQ ID NO: 3839688 - DNA, 17 bp, Homo sapiens
attttatttagacaaga

SEQ ID NO: 3839689 - DNA, 22 bp, Homo sapiens
attttatttagacaagagatgg

SEQ ID NO: 3839690 - DNA, 21 bp, Homo sapiens
attttatttttttctgaatta

SEQ ID NO: 3839691 - DNA, 14 bp, Homo sapiens
attttcacaacata

SEQ ID NO: 3839692 - DNA, 13 bp, Homo sapiens
attttctaaattc

SEQ ID NO: 3839693 - DNA, 18 bp, Homo sapiens
attttctttttctgaagc

SEQ ID NO: 3839694 - DNA, 20 bp, Homo sapiens
attttgaaactttgctttgg

SEQ ID NO: 3839695 - DNA, 18 bp, Homo sapiens
attttgggttgtttaaaa

SEQ ID NO: 3839696 - DNA, 21 bp, Homo sapiens
attttgggttgtttaaaaatt

SEQ ID NO: 3839697 - DNA, 12 bp, Homo sapiens
attttgtaagta

SEQ ID NO: 3839698 - DNA, 20 bp, Homo sapiens
attttgtaagtataagaaat

SEQ ID NO: 3839699 - DNA, 12 bp, Homo sapiens
attttgtgaaat

SEQ ID NO: 3839700 - DNA, 16 bp, Homo sapiens
attttgtgaaatttca

SEQ ID NO: 3839701 - DNA, 18 bp, Homo sapiens
attttgtgaaatttcatg

SEQ ID NO: 3839702 - DNA, 13 bp, Homo sapiens
atttttaaaactc

SEQ ID NO: 3839703 - DNA, 13 bp, Homo sapiens
atttttacttgaa

SEQ ID NO: 3839704 - DNA, 16 bp, Homo sapiens
atttttggcattcctc

SEQ ID NO: 3839705 - DNA, 12 bp, Homo sapiens
atttttgtaaat

SEQ ID NO: 3839706 - DNA, 19 bp, Homo sapiens
atttttttttctaagagaa

SEQ ID NO: 3839707 - DNA, 13 bp, Homo sapiens
caaaaaataaaga

SEQ ID NO: 3839708 - DNA, 15 bp, Homo sapiens
caaaaaatgtgctgt

SEQ ID NO: 3839709 - DNA, 13 bp, Homo sapiens
caaaacaaacaca

SEQ ID NO: 3839710 - DNA, 16 bp, Homo sapiens
caaaacaaacacacac

SEQ ID NO: 3839711 - DNA, 15 bp, Homo sapiens
caaaaccaaattgag

SEQ ID NO: 3839712 - DNA, 12 bp, Homo sapiens
caaaagaagttc

SEQ ID NO: 3839713 - DNA, 16 bp, Homo sapiens
caaaattatgctgcat

SEQ ID NO: 3839714 - DNA, 23 bp, Homo sapiens
caaaattcgacctgatttacagt

SEQ ID NO: 3839715 - DNA, 20 bp, Homo sapiens
caaaattttgtcccatctct

SEQ ID NO: 3839716 - DNA, 11 bp, Homo sapiens
caaacacacac

SEQ ID NO: 3839717 - DNA, 12 bp, Homo sapiens
caaacacacaca

SEQ ID NO: 3839718 - DNA, 22 bp, Homo sapiens
caaacacggcttctcatgctat

SEQ ID NO: 3839719 - DNA, 13 bp, Homo sapiens
caaacctctcctt

SEQ ID NO: 3839720 - DNA, 18 bp, Homo sapiens
caaacctctccttcctca

SEQ ID NO: 3839721 - DNA, 13 bp, Homo sapiens
caaacgctaaaga

SEQ ID NO: 3839722 - DNA, 13 bp, Homo sapiens
caaagaaattatg

SEQ ID NO: 3839723 - DNA, 23 bp, Homo sapiens
caaagaccttgtgtgtatgtgta

SEQ ID NO: 3839724 - DNA, 19 bp, Homo sapiens
caaagaggattagacagta

SEQ ID NO: 3839725 - DNA, 16 bp, Homo sapiens
caaagatctgctcctc

SEQ ID NO: 3839726 - DNA, 21 bp, Homo sapiens
caaagcaagctcttctcctca

SEQ ID NO: 3839727 - DNA, 22 bp, Homo sapiens
caaaggtaaatcagactatgaa

SEQ ID NO: 3839728 - DNA, 19 bp, Homo sapiens
caaagtgctgggattacag

SEQ ID NO: 3839729 - DNA, 23 bp, Homo sapiens
caaagtgtcactccataaaaaga

SEQ ID NO: 3839730 - DNA, 14 bp, Homo sapiens
caaataaacactgt

SEQ ID NO: 3839731 - DNA, 22 bp, Homo sapiens
caaatacagtagtataatgtat

SEQ ID NO: 3839732 - DNA, 17 bp, Homo sapiens
caaatcaatacactagt

SEQ ID NO: 3839733 - DNA, 13 bp, Homo sapiens
caaatgtaaagtc

SEQ ID NO: 3839734 - DNA, 13 bp, Homo sapiens
caaatgttacaaa

SEQ ID NO: 3839735 - DNA, 14 bp, Homo sapiens
caaatgttacaaaa

SEQ ID NO: 3839736 - DNA, 16 bp, Homo sapiens
caaatgttacaaaaaa

SEQ ID NO: 3839737 - DNA, 18 bp, Homo sapiens
caaattaagatggtaaga

SEQ ID NO: 3839738 - DNA, 17 bp, Homo sapiens
caaattatcaagctaat

SEQ ID NO: 3839739 - DNA, 21 bp, Homo sapiens
caaattatcaagctaataaaa

SEQ ID NO: 3839740 - DNA, 17 bp, Homo sapiens
caaatttttacttgaag

SEQ ID NO: 3839741 - DNA, 17 bp, Homo sapiens
caacaaagaggattaga

SEQ ID NO: 3839742 - DNA, 13 bp, Homo sapiens
caacactgtaaca

SEQ ID NO: 3839743 - DNA, 21 bp, Homo sapiens
caacagcgacatagcccatcc

SEQ ID NO: 3839744 - DNA, 23 bp, Homo sapiens
caacagcgacatagcccatccct

SEQ ID NO: 3839745 - DNA, 19 bp, Homo sapiens
caacatcatatacctcttg

SEQ ID NO: 3839746 - DNA, 14 bp, Homo sapiens
caacattattttaa

SEQ ID NO: 3839747 - DNA, 19 bp, Homo sapiens
caaccactcggggccccca

SEQ ID NO: 3839748 - DNA, 19 bp, Homo sapiens
caacccaataaaactgatg

SEQ ID NO: 3839749 - DNA, 13 bp, Homo sapiens
caaccggatgcca

SEQ ID NO: 3839750 - DNA, 14 bp, Homo sapiens
caaccggatgccag

SEQ ID NO: 3839751 - DNA, 12 bp, Homo sapiens
caacctctgccc

SEQ ID NO: 3839752 - DNA, 22 bp, Homo sapiens
caacctgtaataaatatgagtg

SEQ ID NO: 3839753 - DNA, 18 bp, Homo sapiens
caacgcaaacctctcctt

SEQ ID NO: 3839754 - DNA, 21 bp, Homo sapiens
caacgctgattcctaaggccc

SEQ ID NO: 3839755 - DNA, 19 bp, Homo sapiens
caacgtaaattattacata

SEQ ID NO: 3839756 - DNA, 21 bp, Homo sapiens
caactccagctgagtcctggg

SEQ ID NO: 3839757 - DNA, 19 bp, Homo sapiens
caactgttttgatactgaa

SEQ ID NO: 3839758 - DNA, 11 bp, Homo sapiens
caacttcccct

SEQ ID NO: 3839759 - DNA, 15 bp, Homo sapiens
caacttgtctctgta

SEQ ID NO: 3839760 - DNA, 23 bp, Homo sapiens
caactttcccttgccctgggctg

SEQ ID NO: 3839761 - DNA, 11 bp, Homo sapiens
caactttgtat

SEQ ID NO: 3839762 - DNA, 19 bp, Homo sapiens
caactttttcattccctgc

SEQ ID NO: 3839763 - DNA, 12 bp, Homo sapiens
caagaaaactac

SEQ ID NO: 3839764 - DNA, 20 bp, Homo sapiens
caagaaacaatgtctgggga

SEQ ID NO: 3839765 - DNA, 21 bp, Homo sapiens
caagacataatttaaaataaa

SEQ ID NO: 3839766 - DNA, 22 bp, Homo sapiens
caagactccctcgtcgagctgg

SEQ ID NO: 3839767 - DNA, 15 bp, Homo sapiens
caagagggggtggag

SEQ ID NO: 3839768 - DNA, 18 bp, Homo sapiens
caagagggggtggagggg

SEQ ID NO: 3839769 - DNA, 21 bp, Homo sapiens
caagagggggtggaggggtgt

SEQ ID NO: 3839770 - DNA, 19 bp, Homo sapiens
caagaggtgcctgggagga

SEQ ID NO: 3839771 - DNA, 22 bp, Homo sapiens
caagaggtgcctgggaggagtg

SEQ ID NO: 3839772 - DNA, 19 bp, Homo sapiens
caagattcccaggagttct

SEQ ID NO: 3839773 - DNA, 20 bp, Homo sapiens
caagattcccaggagttctg

SEQ ID NO: 3839774 - DNA, 12 bp, Homo sapiens
caagcagggagg

SEQ ID NO: 3839775 - DNA, 14 bp, Homo sapiens
caagccctttgctg

SEQ ID NO: 3839776 - DNA, 15 bp, Homo sapiens
caagccggcccaacc

SEQ ID NO: 3839777 - DNA, 16 bp, Homo sapiens
caagctaataaaatat

SEQ ID NO: 3839778 - DNA, 17 bp, Homo sapiens
caagctaataaaatatc

SEQ ID NO: 3839779 - DNA, 19 bp, Homo sapiens
caagctaataaaatatcat

SEQ ID NO: 3839780 - DNA, 15 bp, Homo sapiens
caagctcttctcctc

SEQ ID NO: 3839781 - DNA, 17 bp, Homo sapiens
caagctcttctcctcag

SEQ ID NO: 3839782 - DNA, 23 bp, Homo sapiens
caaggatggtggggcccccagca

SEQ ID NO: 3839783 - DNA, 18 bp, Homo sapiens
caaggctgtgccaggctg

SEQ ID NO: 3839784 - DNA, 19 bp, Homo sapiens
caaggctgtgccaggctgg

SEQ ID NO: 3839785 - DNA, 20 bp, Homo sapiens
caaggctgtgccaggctggg

SEQ ID NO: 3839786 - DNA, 16 bp, Homo sapiens
caagggaaaggggtgc

SEQ ID NO: 3839787 - DNA, 20 bp, Homo sapiens
caagggaaaggggtgctttt

SEQ ID NO: 3839788 - DNA, 13 bp, Homo sapiens
caaggtctggcct

SEQ ID NO: 3839789 - DNA, 12 bp, Homo sapiens
caagtctgcagg

SEQ ID NO: 3839790 - DNA, 15 bp, Homo sapiens
caagtggggtgctgg

SEQ ID NO: 3839791 - DNA, 22 bp, Homo sapiens
caagtggttaagaatgtatatc

SEQ ID NO: 3839792 - DNA, 18 bp, Homo sapiens
catattaaagataagact

SEQ ID NO: 3839793 - DNA, 14 bp, Homo sapiens
catattacaagaaa

SEQ ID NO: 3839794 - DNA, 14 bp, Homo sapiens
catcaagtgtaatt

SEQ ID NO: 3839795 - DNA, 15 bp, Homo sapiens
catcaatcattgtac

SEQ ID NO: 3839796 - DNA, 16 bp, Homo sapiens
catcacatggcatgtt

SEQ ID NO: 3839797 - DNA, 20 bp, Homo sapiens
catcacttgaatcctagggc

SEQ ID NO: 3839798 - DNA, 21 bp, Homo sapiens
catcccaggacaccacaccca

SEQ ID NO: 3839799 - DNA, 22 bp, Homo sapiens
catcccaggacaccacacccag

SEQ ID NO: 3839800 - DNA, 14 bp, Homo sapiens
catcccctgcctcc

SEQ ID NO: 3839801 - DNA, 16 bp, Homo sapiens
catccctgcctggtca

SEQ ID NO: 3839802 - DNA, 20 bp, Homo sapiens
catcctgccttagagccagg

SEQ ID NO: 3839803 - DNA, 21 bp, Homo sapiens
catcctgccttagagccaggc

SEQ ID NO: 3839804 - DNA, 16 bp, Homo sapiens
catcgccagctgatga

SEQ ID NO: 3839805 - DNA, 20 bp, Homo sapiens
catcgccagctgatgactca

SEQ ID NO: 3839806 - DNA, 18 bp, Homo sapiens
catctaggtaaattacag

SEQ ID NO: 3839807 - DNA, 15 bp, Homo sapiens
catctatctcaatcc

SEQ ID NO: 3839808 - DNA, 20 bp, Homo sapiens
catctatctcatctatctca

SEQ ID NO: 3839809 - DNA, 20 bp, Homo sapiens
catctcctttgctagtgtct

SEQ ID NO: 3839810 - DNA, 17 bp, Homo sapiens
catctgcaccccttctc

SEQ ID NO: 3839811 - DNA, 22 bp, Homo sapiens
catctgcaccccttctctcctc

SEQ ID NO: 3839812 - DNA, 17 bp, Homo sapiens
catctgccaaaatgtag

SEQ ID NO: 3839813 - DNA, 14 bp, Homo sapiens
catctggcccaggc

SEQ ID NO: 3839814 - DNA, 21 bp, Homo sapiens
catcttctttgcagcctgggt

SEQ ID NO: 3839815 - DNA, 23 bp, Homo sapiens
catcttgatctgctcagccctgg

SEQ ID NO: 3839816 - DNA, 18 bp, Homo sapiens
catcttgggggtcaccca

SEQ ID NO: 3839817 - DNA, 20 bp, Homo sapiens
catcttgggggtcacccatg

SEQ ID NO: 3839818 - DNA, 19 bp, Homo sapiens
catgaaaactttttaatgg

SEQ ID NO: 3839819 - DNA, 14 bp, Homo sapiens
catgaacactggct

SEQ ID NO: 3839820 - DNA, 20 bp, Homo sapiens
catgaacactggctgcaagt

SEQ ID NO: 3839821 - DNA, 14 bp, Homo sapiens
catgaactgtgttt

SEQ ID NO: 3839822 - DNA, 16 bp, Homo sapiens
catgcccaccccctgc

SEQ ID NO: 3839823 - DNA, 22 bp, Homo sapiens
catgcccaccccctgccctgca

SEQ ID NO: 3839824 - DNA, 18 bp, Homo sapiens
catgccccggccacctct

SEQ ID NO: 3839825 - DNA, 17 bp, Homo sapiens
catgcgtctctggccct

SEQ ID NO: 3839826 - DNA, 21 bp, Homo sapiens
catgcgtctctggccctcgtg

SEQ ID NO: 3839827 - DNA, 15 bp, Homo sapiens
catgctggagcctgt

SEQ ID NO: 3839828 - DNA, 16 bp, Homo sapiens
catgctggagcctgtg

SEQ ID NO: 3839829 - DNA, 17 bp, Homo sapiens
catggaatgactgaaga

SEQ ID NO: 3839830 - DNA, 12 bp, Homo sapiens
catggctggggg

SEQ ID NO: 3839831 - DNA, 22 bp, Homo sapiens
catggctggggggtctcagcat

SEQ ID NO: 3839832 - DNA, 18 bp, Homo sapiens
catggctttgtgctgctg

SEQ ID NO: 3839833 - DNA, 14 bp, Homo sapiens
catggctttttctt

SEQ ID NO: 3839834 - DNA, 14 bp, Homo sapiens
catggggcagcctc

SEQ ID NO: 3839835 - DNA, 21 bp, Homo sapiens
catggggcagcctccagtctg

SEQ ID NO: 3839836 - DNA, 15 bp, Homo sapiens
catggtgcctgagag

SEQ ID NO: 3839837 - DNA, 19 bp, Homo sapiens
catggtgcctgagaggcag

SEQ ID NO: 3839838 - DNA, 21 bp, Homo sapiens
catggtgcctgagaggcaggc

SEQ ID NO: 3839839 - DNA, 21 bp, Homo sapiens
catggtgctaagcgggcccgg

SEQ ID NO: 3839840 - DNA, 17 bp, Homo sapiens
catggttttaaagctaa

SEQ ID NO: 3839841 - DNA, 15 bp, Homo sapiens
catgtagaacttgaa

SEQ ID NO: 3839842 - DNA, 22 bp, Homo sapiens
catgtagaacttgaactaacat

SEQ ID NO: 3839843 - DNA, 15 bp, Homo sapiens
catgtcccagcctgg

SEQ ID NO: 3839844 - DNA, 14 bp, Homo sapiens
catgtccccttccc

SEQ ID NO: 3839845 - DNA, 13 bp, Homo sapiens
catgtctctttgg

SEQ ID NO: 3839846 - DNA, 20 bp, Homo sapiens
catgtctctttggggagagc

SEQ ID NO: 3839847 - DNA, 17 bp, Homo sapiens
catgtgaaactcatctc

SEQ ID NO: 3839848 - DNA, 18 bp, Homo sapiens
catgtgaaactcatctca

SEQ ID NO: 3839849 - DNA, 15 bp, Homo sapiens
catgttactgccaaa

SEQ ID NO: 3839850 - DNA, 15 bp, Homo sapiens
catgttcaaaagaag

SEQ ID NO: 3839851 - DNA, 19 bp, Homo sapiens
catgttccaataaacagga

SEQ ID NO: 3839852 - DNA, 18 bp, Homo sapiens
catgttttgtcattgttt

SEQ ID NO: 3839853 - DNA, 21 bp, Homo sapiens
cattaataatccttccaggcc

SEQ ID NO: 3839854 - DNA, 16 bp, Homo sapiens
cattacattaacattt

SEQ ID NO: 3839855 - DNA, 14 bp, Homo sapiens
cattacccaaaagc

SEQ ID NO: 3839856 - DNA, 17 bp, Homo sapiens
cattagaagttaccaaa

SEQ ID NO: 3839857 - DNA, 16 bp, Homo sapiens
cattattaataattaa

SEQ ID NO: 3839858 - DNA, 12 bp, Homo sapiens
cattatttggaa

SEQ ID NO: 3839859 - DNA, 13 bp, Homo sapiens
cattatttggaaa

SEQ ID NO: 3839860 - DNA, 19 bp, Homo sapiens
cattattttaaaatcaaag

SEQ ID NO: 3839861 - DNA, 15 bp, Homo sapiens
cattcctctaatgtt

SEQ ID NO: 3839862 - DNA, 13 bp, Homo sapiens
cattctaaaatca

SEQ ID NO: 3839863 - DNA, 19 bp, Homo sapiens
cattctaatgatggcccat

SEQ ID NO: 3839864 - DNA, 11 bp, Homo sapiens
cattctacttg

SEQ ID NO: 3839865 - DNA, 12 bp, Homo sapiens
cattctacttgc

SEQ ID NO: 3839866 - DNA, 22 bp, Homo sapiens
cattctacttgctctggacctg

SEQ ID NO: 3839867 - DNA, 12 bp, Homo sapiens
cattctcccagg

SEQ ID NO: 3839868 - DNA, 17 bp, Homo sapiens
cattgaaggcgaggctg

SEQ ID NO: 3839869 - DNA, 20 bp, Homo sapiens
cattgaaggcgaggctgccc

SEQ ID NO: 3839870 - DNA, 19 bp, Homo sapiens
cattgcccacttctgtgta

SEQ ID NO: 3839871 - DNA, 17 bp, Homo sapiens
cattgcgttattttctt

SEQ ID NO: 3839872 - DNA, 14 bp, Homo sapiens
cattggcctctgtc

SEQ ID NO: 3839873 - DNA, 16 bp, Homo sapiens
cattggcctctgtctc

SEQ ID NO: 3839874 - DNA, 15 bp, Homo sapiens
cattgtaacttggat

SEQ ID NO: 3839875 - DNA, 19 bp, Homo sapiens
cattgtacagtttgtttac

SEQ ID NO: 3839876 - DNA, 13 bp, Homo sapiens
cattgttttgcat

SEQ ID NO: 3839877 - DNA, 12 bp, Homo sapiens
catttacgaatt

SEQ ID NO: 3839878 - DNA, 20 bp, Homo sapiens
catttatccacctccatctt

SEQ ID NO: 3839879 - DNA, 20 bp, Homo sapiens
catttattaagtatatttgt

SEQ ID NO: 3839880 - DNA, 22 bp, Homo sapiens
catttattaagtatatttgtaa

SEQ ID NO: 3839881 - DNA, 17 bp, Homo sapiens
catttcatgctttgatt

SEQ ID NO: 3839882 - DNA, 22 bp, Homo sapiens
catttctctgcgagtagttcca

SEQ ID NO: 3839883 - DNA, 14 bp, Homo sapiens
catttctttatatg

SEQ ID NO: 3839884 - DNA, 17 bp, Homo sapiens
catttggggcatttgta

SEQ ID NO: 3839885 - DNA, 20 bp, Homo sapiens
catttggggcatttgtaaaa

SEQ ID NO: 3839886 - DNA, 12 bp, Homo sapiens
cattttctgcaa

SEQ ID NO: 3839887 - DNA, 16 bp, Homo sapiens
cattttttaaaacaag

SEQ ID NO: 3839888 - DNA, 12 bp, Homo sapiens
catttttttcct

SEQ ID NO: 3839889 - DNA, 18 bp, Homo sapiens
catttttttcctttatgt

SEQ ID NO: 3839890 - DNA, 21 bp, Homo sapiens
ccaaaattttgtcccatctct

SEQ ID NO: 3839891 - DNA, 16 bp, Homo sapiens
ccaaagatctgctcct

SEQ ID NO: 3839892 - DNA, 19 bp, Homo sapiens
ccaaattatcaagctaata

SEQ ID NO: 3839893 - DNA, 13 bp, Homo sapiens
ccaaattctaaag

SEQ ID NO: 3839894 - DNA, 22 bp, Homo sapiens
ccaacccaataaaactgatgtt

SEQ ID NO: 3839895 - DNA, 17 bp, Homo sapiens
ccaacctgtaataaata

SEQ ID NO: 3839896 - DNA, 21 bp, Homo sapiens
ccaacctgtaataaatatgag

SEQ ID NO: 3839897 - DNA, 16 bp, Homo sapiens
ccaactatggcctgtg

SEQ ID NO: 3839898 - DNA, 23 bp, Homo sapiens
ccaacttgtctctgtagaagctc

SEQ ID NO: 3839899 - DNA, 19 bp, Homo sapiens
ccaactttttcattccctg

SEQ ID NO: 3839900 - DNA, 13 bp, Homo sapiens
ccaagcagggagg

SEQ ID NO: 3839901 - DNA, 16 bp, Homo sapiens
ccaaggacagtcagca

SEQ ID NO: 3839902 - DNA, 21 bp, Homo sapiens
ccaagggaaaggggtgctttt

SEQ ID NO: 3839903 - DNA, 14 bp, Homo sapiens
ccaagggacacagg

SEQ ID NO: 3839904 - DNA, 23 bp, Homo sapiens
ccaagggacacaggagaccaccc

SEQ ID NO: 3839905 - DNA, 16 bp, Homo sapiens
ccaaggtcaggaggcc

SEQ ID NO: 3839906 - DNA, 16 bp, Homo sapiens
ccaagtattaaactgt

SEQ ID NO: 3839907 - DNA, 22 bp, Homo sapiens
ccaagtggggtgctgggaggag

SEQ ID NO: 3839908 - DNA, 14 bp, Homo sapiens
ccaatcctcaccta

SEQ ID NO: 3839909 - DNA, 23 bp, Homo sapiens
ccaatgggtttgccaagcccttt

SEQ ID NO: 3839910 - DNA, 15 bp, Homo sapiens
ccacacagcccagaa

SEQ ID NO: 3839911 - DNA, 23 bp, Homo sapiens
ccacacagtggccggggctgaag

SEQ ID NO: 3839912 - DNA, 22 bp, Homo sapiens
ccacaccagtaataaaaagcca

SEQ ID NO: 3839913 - DNA, 14 bp, Homo sapiens
ccacaccatctggc

SEQ ID NO: 3839914 - DNA, 20 bp, Homo sapiens
ccacaccatctggcccaggc

SEQ ID NO: 3839915 - DNA, 23 bp, Homo sapiens
ccacaccatctggcccaggctgg

SEQ ID NO: 3839916 - DNA, 14 bp, Homo sapiens
ccacacccagcctc

SEQ ID NO: 3839917 - DNA, 17 bp, Homo sapiens
ccacacccagcctcagt

SEQ ID NO: 3839918 - DNA, 17 bp, Homo sapiens
ccacaccccagactcca

SEQ ID NO: 3839919 - DNA, 19 bp, Homo sapiens
ccacaggccctttcctcag

SEQ ID NO: 3839920 - DNA, 21 bp, Homo sapiens
ccacaggccctttcctcaggc

SEQ ID NO: 3839921 - DNA, 23 bp, Homo sapiens
ccacaggccctttcctcaggcaa

SEQ ID NO: 3839922 - DNA, 22 bp, Homo sapiens
ccaccaacacacaggaactctg

SEQ ID NO: 3839923 - DNA, 20 bp, Homo sapiens
ccaccaagtattaaactgta

SEQ ID NO: 3839924 - DNA, 16 bp, Homo sapiens
ccgtggtgacccctgc

SEQ ID NO: 3839925 - DNA, 11 bp, Homo sapiens
ccgttggccac

SEQ ID NO: 3839926 - DNA, 16 bp, Homo sapiens
cctaaatatattttaa

SEQ ID NO: 3839927 - DNA, 19 bp, Homo sapiens
cctaaggcccagctgccag

SEQ ID NO: 3839928 - DNA, 20 bp, Homo sapiens
cctaaggcccagctgccagg

SEQ ID NO: 3839929 - DNA, 15 bp, Homo sapiens
cctaatagaaagaaa

SEQ ID NO: 3839930 - DNA, 20 bp, Homo sapiens
cctaatcccttcctctccca

SEQ ID NO: 3839931 - DNA, 21 bp, Homo sapiens
cctaatcccttcctctcccat

SEQ ID NO: 3839932 - DNA, 20 bp, Homo sapiens
cctaatttctcctcccttcc

SEQ ID NO: 3839933 - DNA, 22 bp, Homo sapiens
cctactgcccctgccctgagga

SEQ ID NO: 3839934 - DNA, 17 bp, Homo sapiens
cctagctttagaccctg

SEQ ID NO: 3839935 - DNA, 18 bp, Homo sapiens
cctagctttagaccctgg

SEQ ID NO: 3839936 - DNA, 15 bp, Homo sapiens
cctaggtgggagcca

SEQ ID NO: 3839937 - DNA, 23 bp, Homo sapiens
cctaggtgggagccaccactcct

SEQ ID NO: 3839938 - DNA, 20 bp, Homo sapiens
cctatcaatccaaattccct

SEQ ID NO: 3839939 - DNA, 18 bp, Homo sapiens
cctatttttatattttta

SEQ ID NO: 3839940 - DNA, 18 bp, Homo sapiens
cctcacagcctctgaccc

SEQ ID NO: 3839941 - DNA, 19 bp, Homo sapiens
cctcacagcctctgacccc

SEQ ID NO: 3839942 - DNA, 19 bp, Homo sapiens
cctcacctcatgcccaccc

SEQ ID NO: 3839943 - DNA, 20 bp, Homo sapiens
cctcacctgggttccccacc

SEQ ID NO: 3839944 - DNA, 15 bp, Homo sapiens
cctcactcttgccaa

SEQ ID NO: 3839945 - DNA, 17 bp, Homo sapiens
cctcactcttgccaacc

SEQ ID NO: 3839946 - DNA, 17 bp, Homo sapiens
cctcactgctccctgaa

SEQ ID NO: 3839947 - DNA, 14 bp, Homo sapiens
cctcagaatagtga

SEQ ID NO: 3839948 - DNA, 22 bp, Homo sapiens
cctcagaatagtgatgtgttcg

SEQ ID NO: 3839949 - DNA, 22 bp, Homo sapiens
cctcagatgatggggtcagcag

SEQ ID NO: 3839950 - DNA, 14 bp, Homo sapiens
cctcagctgcttct

SEQ ID NO: 3839951 - DNA, 17 bp, Homo sapiens
cctcagggccaagccgg

SEQ ID NO: 3839952 - DNA, 12 bp, Homo sapiens
cctcagtcctcc

SEQ ID NO: 3839953 - DNA, 16 bp, Homo sapiens
cctcagtcctcccctc

SEQ ID NO: 3839954 - DNA, 13 bp, Homo sapiens
cctcatgcccacc

SEQ ID NO: 3839955 - DNA, 14 bp, Homo sapiens
cctcatgcccaccc

SEQ ID NO: 3839956 - DNA, 21 bp, Homo sapiens
cctcatgcccaccccctgccc

SEQ ID NO: 3839957 - DNA, 24 bp, Homo sapiens
cctcatgcccaccccctgccctgc

SEQ ID NO: 3839958 - DNA, 22 bp, Homo sapiens
cctccaactccagctgagtcct

SEQ ID NO: 3839959 - DNA, 13 bp, Homo sapiens
cctccagcacgcg

SEQ ID NO: 3839960 - DNA, 17 bp, Homo sapiens
cctccagtctgctctca

SEQ ID NO: 3839961 - DNA, 19 bp, Homo sapiens
cctccatcccttccccaga

SEQ ID NO: 3839962 - DNA, 12 bp, Homo sapiens
cctcccacccaa

SEQ ID NO: 3839963 - DNA, 20 bp, Homo sapiens
cctccccaaatcaatacact

SEQ ID NO: 3839964 - DNA, 17 bp, Homo sapiens
cctccccactccagcag

SEQ ID NO: 3839965 - DNA, 13 bp, Homo sapiens
cctccccagacag

SEQ ID NO: 3839966 - DNA, 24 bp, Homo sapiens
cctccccagacagggctccagcct

SEQ ID NO: 3839967 - DNA, 20 bp, Homo sapiens
cctccccagatctgtcctgg

SEQ ID NO: 3839968 - DNA, 22 bp, Homo sapiens
cctccccagatctgtcctgggg

SEQ ID NO: 3839969 - DNA, 12 bp, Homo sapiens
cctccccagccc

SEQ ID NO: 3839970 - DNA, 17 bp, Homo sapiens
cctccccagcccctagc

SEQ ID NO: 3839971 - DNA, 16 bp, Homo sapiens
cctccccagctcctcg

SEQ ID NO: 3839972 - DNA, 22 bp, Homo sapiens
cctccccatttcccatctgcac

SEQ ID NO: 3839973 - DNA, 15 bp, Homo sapiens
cctccccggaagtgc

SEQ ID NO: 3839974 - DNA, 15 bp, Homo sapiens
cctcccctcacagcc

SEQ ID NO: 3839975 - DNA, 19 bp, Homo sapiens
cctcccctcacagcctctg

SEQ ID NO: 3839976 - DNA, 13 bp, Homo sapiens
cctcccctgctgc

SEQ ID NO: 3839977 - DNA, 14 bp, Homo sapiens
cctcccctgctgca

SEQ ID NO: 3839978 - DNA, 16 bp, Homo sapiens
cctcccctgctgcagg

SEQ ID NO: 3839979 - DNA, 13 bp, Homo sapiens
cctccctcctgcc

SEQ ID NO: 3839980 - DNA, 13 bp, Homo sapiens
cctcccttccttt

SEQ ID NO: 3839981 - DNA, 21 bp, Homo sapiens
cctcccttccttttccctgct

SEQ ID NO: 3839982 - DNA, 19 bp, Homo sapiens
cctccgagagggagagaga

SEQ ID NO: 3839983 - DNA, 18 bp, Homo sapiens
cctccggcctgcactccc

SEQ ID NO: 3839984 - DNA, 14 bp, Homo sapiens
cctccgtgcttcct

SEQ ID NO: 3839985 - DNA, 21 bp, Homo sapiens
cctcctagctggagtgccatg

SEQ ID NO: 3839986 - DNA, 15 bp, Homo sapiens
cctcctcctgagagc

SEQ ID NO: 3839987 - DNA, 15 bp, Homo sapiens
cctcgagccatagag

SEQ ID NO: 3839988 - DNA, 20 bp, Homo sapiens
cctcgagccatagagcctga

SEQ ID NO: 3839989 - DNA, 15 bp, Homo sapiens
cctcgctctctgtct

SEQ ID NO: 3839990 - DNA, 21 bp, Homo sapiens
cctcgggaacctcactcttgc

SEQ ID NO: 3839991 - DNA, 23 bp, Homo sapiens
cctcgggaacctcactcttgcca

SEQ ID NO: 3839992 - DNA, 18 bp, Homo sapiens
cctcgtggtccccaacag

SEQ ID NO: 3839993 - DNA, 19 bp, Homo sapiens
cctcgttaggacaaggctg

SEQ ID NO: 3839994 - DNA, 18 bp, Homo sapiens
cctctagaagccaaggga

SEQ ID NO: 3839995 - DNA, 12 bp, Homo sapiens
cctctcccaccc

SEQ ID NO: 3839996 - DNA, 13 bp, Homo sapiens
cctctccgagctg

SEQ ID NO: 3839997 - DNA, 14 bp, Homo sapiens
cctctcctttgtag

SEQ ID NO: 3839998 - DNA, 23 bp, Homo sapiens
cctctgacatcaagtgtaattag

SEQ ID NO: 3839999 - DNA, 14 bp, Homo sapiens
cctctgacccctcc

SEQ ID NO: 3840000 - DNA, 19 bp, Homo sapiens
cctctgacccctcctcact

SEQ ID NO: 3840001 - DNA, 17 bp, Homo sapiens
cctctgaggctcagccc

SEQ ID NO: 3840002 - DNA, 19 bp, Homo sapiens
cctctgaggctcagccctg

SEQ ID NO: 3840003 - DNA, 22 bp, Homo sapiens
cctctgaggctcagccctgagc

SEQ ID NO: 3840004 - DNA, 17 bp, Homo sapiens
cctctgccaccagagac

SEQ ID NO: 3840005 - DNA, 24 bp, Homo sapiens
cctctgccaccagagaccgtcctc

SEQ ID NO: 3840006 - DNA, 11 bp, Homo sapiens
cctctgcctgc

SEQ ID NO: 3840007 - DNA, 21 bp, Homo sapiens
cctctgcctgccccgccccca

SEQ ID NO: 3840008 - DNA, 17 bp, Homo sapiens
cctctgcggaccccagc

SEQ ID NO: 3840009 - DNA, 18 bp, Homo sapiens
cctctgcggaccccagct

SEQ ID NO: 3840010 - DNA, 15 bp, Homo sapiens
cctctggacggcagg

SEQ ID NO: 3840011 - DNA, 14 bp, Homo sapiens
cctctgtccccata

SEQ ID NO: 3840012 - DNA, 19 bp, Homo sapiens
cctctgtgctgcatcccac

SEQ ID NO: 3840013 - DNA, 17 bp, Homo sapiens
cctgaaatatattttaa

SEQ ID NO: 3840014 - DNA, 17 bp, Homo sapiens
cctgaagccagccttct

SEQ ID NO: 3840015 - DNA, 18 bp, Homo sapiens
cctgaagccagccttctt

SEQ ID NO: 3840016 - DNA, 22 bp, Homo sapiens
cctgaagctatcgtaaaattaa

SEQ ID NO: 3840017 - DNA, 15 bp, Homo sapiens
cctgagagctgttcc

SEQ ID NO: 3840018 - DNA, 13 bp, Homo sapiens
cctgagaggcagg

SEQ ID NO: 3840019 - DNA, 14 bp, Homo sapiens
cctgagaggcaggc

SEQ ID NO: 3840020 - DNA, 15 bp, Homo sapiens
cctgagaggcaggca

SEQ ID NO: 3840021 - DNA, 16 bp, Homo sapiens
cctgagccccctgagt

SEQ ID NO: 3840022 - DNA, 15 bp, Homo sapiens
cctgagcctggccat

SEQ ID NO: 3840023 - DNA, 12 bp, Homo sapiens
cctgaggaataa

SEQ ID NO: 3840024 - DNA, 13 bp, Homo sapiens
cctgaggaataaa

SEQ ID NO: 3840025 - DNA, 17 bp, Homo sapiens
cctgaggaataaagctt

SEQ ID NO: 3840026 - DNA, 15 bp, Homo sapiens
cctgaggtctggctg

SEQ ID NO: 3840027 - DNA, 17 bp, Homo sapiens
cctgaggtctggctgct

SEQ ID NO: 3840028 - DNA, 21 bp, Homo sapiens
cctgagttcccaaagggaggg

SEQ ID NO: 3840029 - DNA, 20 bp, Homo sapiens
cctgagttggcatcacctgc

SEQ ID NO: 3840030 - DNA, 14 bp, Homo sapiens
cctgatccaggaaa

SEQ ID NO: 3840031 - DNA, 12 bp, Homo sapiens
cctgcacctctc

SEQ ID NO: 3840032 - DNA, 18 bp, Homo sapiens
cctgcacgtcatgggagg

SEQ ID NO: 3840033 - DNA, 23 bp, Homo sapiens
cctgcactcccccagttcccggg

SEQ ID NO: 3840034 - DNA, 15 bp, Homo sapiens
cctgcagccatccca

SEQ ID NO: 3840035 - DNA, 18 bp, Homo sapiens
cctgcccccacacccact

SEQ ID NO: 3840036 - DNA, 19 bp, Homo sapiens
cctgcccccgcatcccctg

SEQ ID NO: 3840037 - DNA, 20 bp, Homo sapiens
cctgcccccgcatcccctgc

SEQ ID NO: 3840038 - DNA, 13 bp, Homo sapiens
cctgccccgcccc

SEQ ID NO: 3840039 - DNA, 19 bp, Homo sapiens
cctgccctcatctctctcc

SEQ ID NO: 3840040 - DNA, 12 bp, Homo sapiens
cctgccctcctg

SEQ ID NO: 3840041 - DNA, 14 bp, Homo sapiens
cctgccctgaggag

SEQ ID NO: 3840042 - DNA, 13 bp, Homo sapiens
cctgcctctgccc

SEQ ID NO: 3840043 - DNA, 13 bp, Homo sapiens
cctgcctgccccc

SEQ ID NO: 3840044 - DNA, 15 bp, Homo sapiens
cctgcctgcccccac

SEQ ID NO: 3840045 - DNA, 19 bp, Homo sapiens
cctgccttaccgagagcca

SEQ ID NO: 3840046 - DNA, 20 bp, Homo sapiens
cctgccttagagccaggcac

SEQ ID NO: 3840047 - DNA, 15 bp, Homo sapiens
cctgcgggaagctga

SEQ ID NO: 3840048 - DNA, 15 bp, Homo sapiens
cctgcgtcctcctca

SEQ ID NO: 3840049 - DNA, 16 bp, Homo sapiens
cctgcgtcctcctcac

SEQ ID NO: 3840050 - DNA, 17 bp, Homo sapiens
cctgcgtcctcctcacc

SEQ ID NO: 3840051 - DNA, 20 bp, Homo sapiens
cctgcgtcctcctcacctca

SEQ ID NO: 3840052 - DNA, 22 bp, Homo sapiens
cctgcgtcctcctcacctcatg

SEQ ID NO: 3840053 - DNA, 15 bp, Homo sapiens
cctgctagcacctcc

SEQ ID NO: 3840054 - DNA, 16 bp, Homo sapiens
cctgctagcacctccc

SEQ ID NO: 3840055 - DNA, 22 bp, Homo sapiens
cctgctagcacctccccagaca

SEQ ID NO: 3840056 - DNA, 12 bp, Homo sapiens
cctgctgcaggg

SEQ ID NO: 3840057 - DNA, 19 bp, Homo sapiens
ctcctcacctcatgcccac

SEQ ID NO: 3840058 - DNA, 14 bp, Homo sapiens
ctcctcagggatgg

SEQ ID NO: 3840059 - DNA, 22 bp, Homo sapiens
ctcctcccacccaacttcccct

SEQ ID NO: 3840060 - DNA, 14 bp, Homo sapiens
ctcctccccaaatc

SEQ ID NO: 3840061 - DNA, 21 bp, Homo sapiens
ctcctcccttccttttccctg

SEQ ID NO: 3840062 - DNA, 20 bp, Homo sapiens
ctcctccgtgcttcctcagt

SEQ ID NO: 3840063 - DNA, 17 bp, Homo sapiens
ctcctcctagctggagt

SEQ ID NO: 3840064 - DNA, 14 bp, Homo sapiens
ctcctcggcctggc

SEQ ID NO: 3840065 - DNA, 15 bp, Homo sapiens
ctcctcggcctggct

SEQ ID NO: 3840066 - DNA, 16 bp, Homo sapiens
ctcctcggcctggctc

SEQ ID NO: 3840067 - DNA, 11 bp, Homo sapiens
ctcctctgtcc

SEQ ID NO: 3840068 - DNA, 17 bp, Homo sapiens
ctcctgaagggtgctca

SEQ ID NO: 3840069 - DNA, 22 bp, Homo sapiens
ctcctgagtggaatcaagttct

SEQ ID NO: 3840070 - DNA, 21 bp, Homo sapiens
ctcctgcccgccctccctcct

SEQ ID NO: 3840071 - DNA, 20 bp, Homo sapiens
ctcctgggcaccccaggcag

SEQ ID NO: 3840072 - DNA, 18 bp, Homo sapiens
ctcctggggatggccagg

SEQ ID NO: 3840073 - DNA, 14 bp, Homo sapiens
ctcctggtggggca

SEQ ID NO: 3840074 - DNA, 15 bp, Homo sapiens
ctcctggtggggcag

SEQ ID NO: 3840075 - DNA, 20 bp, Homo sapiens
ctcctggtggggcagaaagg

SEQ ID NO: 3840076 - DNA, 23 bp, Homo sapiens
ctcctgtttggaaatggggagct

SEQ ID NO: 3840077 - DNA, 13 bp, Homo sapiens
ctccttgggagga

SEQ ID NO: 3840078 - DNA, 20 bp, Homo sapiens
ctccttgggaggaagcagaa

SEQ ID NO: 3840079 - DNA, 23 bp, Homo sapiens
ctccttgggaggaagcagaataa

SEQ ID NO: 3840080 - DNA, 12 bp, Homo sapiens
ctcgctctctgt

SEQ ID NO: 3840081 - DNA, 17 bp, Homo sapiens
ctcggggcccccatctt

SEQ ID NO: 3840082 - DNA, 18 bp, Homo sapiens
ctcggggcccccatcttg

SEQ ID NO: 3840083 - DNA, 16 bp, Homo sapiens
ctcgttaggacaaggc

SEQ ID NO: 3840084 - DNA, 19 bp, Homo sapiens
ctcgttaggacaaggctgt

SEQ ID NO: 3840085 - DNA, 13 bp, Homo sapiens
ctctaacaaatga

SEQ ID NO: 3840086 - DNA, 21 bp, Homo sapiens
ctctaagatgaatccaaatgt

SEQ ID NO: 3840087 - DNA, 13 bp, Homo sapiens
ctctaccccctca

SEQ ID NO: 3840088 - DNA, 15 bp, Homo sapiens
ctctagaagccaagg

SEQ ID NO: 3840089 - DNA, 19 bp, Homo sapiens
ctctagaagtgccatctca

SEQ ID NO: 3840090 - DNA, 15 bp, Homo sapiens
ctctaggcagaagaa

SEQ ID NO: 3840091 - DNA, 21 bp, Homo sapiens
ctctaggcagaagaagctggg

SEQ ID NO: 3840092 - DNA, 14 bp, Homo sapiens
ctctagtttcccct

SEQ ID NO: 3840093 - DNA, 14 bp, Homo sapiens
ctctcatgtctctt

SEQ ID NO: 3840094 - DNA, 11 bp, Homo sapiens
ctctccagagc

SEQ ID NO: 3840095 - DNA, 13 bp, Homo sapiens
ctctcccaggggc

SEQ ID NO: 3840096 - DNA, 14 bp, Homo sapiens
ctctcccatggctt

SEQ ID NO: 3840097 - DNA, 20 bp, Homo sapiens
ctctcccatggctttgtgct

SEQ ID NO: 3840098 - DNA, 15 bp, Homo sapiens
ctctcctccccaaat

SEQ ID NO: 3840099 - DNA, 15 bp, Homo sapiens
ctctcgaatactttg

SEQ ID NO: 3840100 - DNA, 18 bp, Homo sapiens
ctctctgtctccaggcag

SEQ ID NO: 3840101 - DNA, 15 bp, Homo sapiens
ctctctttccttctt

SEQ ID NO: 3840102 - DNA, 12 bp, Homo sapiens
ctctgacccctc

SEQ ID NO: 3840103 - DNA, 12 bp, Homo sapiens
ctctgaggctca

SEQ ID NO: 3840104 - DNA, 17 bp, Homo sapiens
ctctgaggctcagccct

SEQ ID NO: 3840105 - DNA, 22 bp, Homo sapiens
ctctgcatttgtctattctcca

SEQ ID NO: 3840106 - DNA, 16 bp, Homo sapiens
ctctgccagccctgca

SEQ ID NO: 3840107 - DNA, 20 bp, Homo sapiens
ctctgccccccaagttcaag

SEQ ID NO: 3840108 - DNA, 11 bp, Homo sapiens
ctctgcctgcc

SEQ ID NO: 3840109 - DNA, 13 bp, Homo sapiens
ctctgcctgcccc

SEQ ID NO: 3840110 - DNA, 15 bp, Homo sapiens
ctctgcggaccccag

SEQ ID NO: 3840111 - DNA, 18 bp, Homo sapiens
ctctggaaaactcaggat

SEQ ID NO: 3840112 - DNA, 21 bp, Homo sapiens
ctctggaaaactcaggattct

SEQ ID NO: 3840113 - DNA, 12 bp, Homo sapiens
ctctggacctgc

SEQ ID NO: 3840114 - DNA, 15 bp, Homo sapiens
ctctggacggcaggc

SEQ ID NO: 3840115 - DNA, 16 bp, Homo sapiens
ctctggacggcaggct

SEQ ID NO: 3840116 - DNA, 17 bp, Homo sapiens
ctctggacggcaggctc

SEQ ID NO: 3840117 - DNA, 15 bp, Homo sapiens
ctctggagacagccc

SEQ ID NO: 3840118 - DNA, 18 bp, Homo sapiens
ctctggagacagccccag

SEQ ID NO: 3840119 - DNA, 22 bp, Homo sapiens
ctctggggctcagccctgagct

SEQ ID NO: 3840120 - DNA, 11 bp, Homo sapiens
ctctgtaatta

SEQ ID NO: 3840121 - DNA, 12 bp, Homo sapiens
ctctgtccccat

SEQ ID NO: 3840122 - DNA, 14 bp, Homo sapiens
ctctgtgacctcag

SEQ ID NO: 3840123 - DNA, 20 bp, Homo sapiens
ctctgtgcagtcactggagg

SEQ ID NO: 3840124 - DNA, 19 bp, Homo sapiens
ctctgtgctgcatcccacc

SEQ ID NO: 3840125 - DNA, 19 bp, Homo sapiens
ctcttactttttgtaaatg

SEQ ID NO: 3840126 - DNA, 12 bp, Homo sapiens
ctcttccagagt

SEQ ID NO: 3840127 - DNA, 20 bp, Homo sapiens
ctcttcgtttcagtgtcaaa

SEQ ID NO: 3840128 - DNA, 15 bp, Homo sapiens
ctcttctcctcagct

SEQ ID NO: 3840129 - DNA, 18 bp, Homo sapiens
ctctttcttctctgctgc

SEQ ID NO: 3840130 - DNA, 18 bp, Homo sapiens
ctctttggggagagctgg

SEQ ID NO: 3840131 - DNA, 21 bp, Homo sapiens
ctctttggggagagctggcag

SEQ ID NO: 3840132 - DNA, 19 bp, Homo sapiens
ctgaaaaatgcctgctgct

SEQ ID NO: 3840133 - DNA, 19 bp, Homo sapiens
ctgaaatatattttaaatg

SEQ ID NO: 3840134 - DNA, 18 bp, Homo sapiens
ctgaagcataaacatcac

SEQ ID NO: 3840135 - DNA, 13 bp, Homo sapiens
ctgaagccacaca

SEQ ID NO: 3840136 - DNA, 22 bp, Homo sapiens
ctgaagccacacagcccagaag

SEQ ID NO: 3840137 - DNA, 13 bp, Homo sapiens
ctgaagccagcct

SEQ ID NO: 3840138 - DNA, 17 bp, Homo sapiens
ctgaagccagccttctt

SEQ ID NO: 3840139 - DNA, 15 bp, Homo sapiens
ctgaagcctggacgc

SEQ ID NO: 3840140 - DNA, 21 bp, Homo sapiens
ctgaagctatcgtaaaattaa

SEQ ID NO: 3840141 - DNA, 18 bp, Homo sapiens
ctgaagctgcttaacagt

SEQ ID NO: 3840142 - DNA, 18 bp, Homo sapiens
ctgaagcttattaatgct

SEQ ID NO: 3840143 - DNA, 21 bp, Homo sapiens
ctgaagcttattaatgctaag

SEQ ID NO: 3840144 - DNA, 12 bp, Homo sapiens
ctgaattatttt

SEQ ID NO: 3840145 - DNA, 19 bp, Homo sapiens
ctgacaccacgctggagct

SEQ ID NO: 3840146 - DNA, 17 bp, Homo sapiens
ctgaccccgacctcaga

SEQ ID NO: 3840147 - DNA, 22 bp, Homo sapiens
ctgacctttaactgagggctga

SEQ ID NO: 3840148 - DNA, 11 bp, Homo sapiens
ctgagaaattt

SEQ ID NO: 3840149 - DNA, 18 bp, Homo sapiens
ctgagaccttcaggcctt

SEQ ID NO: 3840150 - DNA, 12 bp, Homo sapiens
ctgagaggcagg

SEQ ID NO: 3840151 - DNA, 14 bp, Homo sapiens
ctgagaggcaggca

SEQ ID NO: 3840152 - DNA, 23 bp, Homo sapiens
ctgagccccgcagacctccccag

SEQ ID NO: 3840153 - DNA, 19 bp, Homo sapiens
ctgagcctggccatgtcct

SEQ ID NO: 3840154 - DNA, 12 bp, Homo sapiens
ctgagctccagc

SEQ ID NO: 3840155 - DNA, 13 bp, Homo sapiens
ctgagctccagcc

SEQ ID NO: 3840156 - DNA, 16 bp, Homo sapiens
ctgagctccagccacc

SEQ ID NO: 3840157 - DNA, 12 bp, Homo sapiens
ctgaggaataaa

SEQ ID NO: 3840158 - DNA, 15 bp, Homo sapiens
ctgaggaataaagct

SEQ ID NO: 3840159 - DNA, 17 bp, Homo sapiens
ctgaggaataaagcttc

SEQ ID NO: 3840160 - DNA, 24 bp, Homo sapiens
ctgaggaataaagcttctctctga

SEQ ID NO: 3840161 - DNA, 22 bp, Homo sapiens
ctgaggaccctcagccccagga

SEQ ID NO: 3840162 - DNA, 12 bp, Homo sapiens
ctgaggagggcc

SEQ ID NO: 3840163 - DNA, 17 bp, Homo sapiens
ctgaggagggccctgag

SEQ ID NO: 3840164 - DNA, 18 bp, Homo sapiens
ctgaggagggccctgagg

SEQ ID NO: 3840165 - DNA, 19 bp, Homo sapiens
ctgaggagggccctgagga

SEQ ID NO: 3840166 - DNA, 15 bp, Homo sapiens
ctgaggttcctctgc

SEQ ID NO: 3840167 - DNA, 16 bp, Homo sapiens
ctgaggttcctctgcc

SEQ ID NO: 3840168 - DNA, 17 bp, Homo sapiens
ctgaggttcctctgcct

SEQ ID NO: 3840169 - DNA, 21 bp, Homo sapiens
ctgaggttcctctgcctgccc

SEQ ID NO: 3840170 - DNA, 19 bp, Homo sapiens
ctgagtcgctctcatgaag

SEQ ID NO: 3840171 - DNA, 14 bp, Homo sapiens
ctgagttcccaaag

SEQ ID NO: 3840172 - DNA, 21 bp, Homo sapiens
ctgagttcccaaagggagggt

SEQ ID NO: 3840173 - DNA, 18 bp, Homo sapiens
ctgagttggcatcacctg

SEQ ID NO: 3840174 - DNA, 15 bp, Homo sapiens
ctgatgactcaagat

SEQ ID NO: 3840175 - DNA, 18 bp, Homo sapiens
ctgatgcttttagctcaa

SEQ ID NO: 3840176 - DNA, 17 bp, Homo sapiens
ctgatgttactagcctc

SEQ ID NO: 3840177 - DNA, 23 bp, Homo sapiens
ctgattcccgcatggtttttata

SEQ ID NO: 3840178 - DNA, 16 bp, Homo sapiens
ctgattcctaaggccc

SEQ ID NO: 3840179 - DNA, 21 bp, Homo sapiens
ctgattcctaaggcccagctg

SEQ ID NO: 3840180 - DNA, 23 bp, Homo sapiens
ctgattcctaaggcccagctgcc

SEQ ID NO: 3840181 - DNA, 17 bp, Homo sapiens
ctgcacagggccctctg

SEQ ID NO: 3840182 - DNA, 21 bp, Homo sapiens
ctgcaccccttctctcctccc

SEQ ID NO: 3840183 - DNA, 14 bp, Homo sapiens
ctgcagccatccca

SEQ ID NO: 3840184 - DNA, 20 bp, Homo sapiens
ctgcaggattgattatgcag

SEQ ID NO: 3840185 - DNA, 21 bp, Homo sapiens
ctgcaggattgattatgcaga

SEQ ID NO: 3840186 - DNA, 14 bp, Homo sapiens
ctgcagggccagga

SEQ ID NO: 3840187 - DNA, 11 bp, Homo sapiens
ctgcaggggct

SEQ ID NO: 3840188 - DNA, 14 bp, Homo sapiens
ctgcaggggctctg

SEQ ID NO: 3840189 - DNA, 16 bp, Homo sapiens
ctgcaggggctctgga

SEQ ID NO: 3840190 - DNA, 16 bp, Homo sapiens
gaagcagaataaagca

SEQ ID NO: 3840191 - DNA, 17 bp, Homo sapiens
gaagcagaataaagcaa

SEQ ID NO: 3840192 - DNA, 18 bp, Homo sapiens
gaagcagaataaagcaat

SEQ ID NO: 3840193 - DNA, 22 bp, Homo sapiens
gaagcagaataaagcaattttc

SEQ ID NO: 3840194 - DNA, 13 bp, Homo sapiens
gaagccaaagaaa

SEQ ID NO: 3840195 - DNA, 14 bp, Homo sapiens
gaagccaaagaaaa

SEQ ID NO: 3840196 - DNA, 19 bp, Homo sapiens
gaagccaagggaaaggggt

SEQ ID NO: 3840197 - DNA, 19 bp, Homo sapiens
gaagccaagggacacagga

SEQ ID NO: 3840198 - DNA, 13 bp, Homo sapiens
gaagccaagtggg

SEQ ID NO: 3840199 - DNA, 15 bp, Homo sapiens
gaagccacacagccc

SEQ ID NO: 3840200 - DNA, 21 bp, Homo sapiens
gaagccacacagcccagaagg

SEQ ID NO: 3840201 - DNA, 12 bp, Homo sapiens
gaagccagcctt

SEQ ID NO: 3840202 - DNA, 20 bp, Homo sapiens
gaagccagccttcttccatc

SEQ ID NO: 3840203 - DNA, 15 bp, Homo sapiens
gaagcccttagggag

SEQ ID NO: 3840204 - DNA, 14 bp, Homo sapiens
gaagccgctcccgg

SEQ ID NO: 3840205 - DNA, 18 bp, Homo sapiens
gaagcctctaacaaatga

SEQ ID NO: 3840206 - DNA, 23 bp, Homo sapiens
gaagcctctaacaaatgatctag

SEQ ID NO: 3840207 - DNA, 12 bp, Homo sapiens
gaagcctggacg

SEQ ID NO: 3840208 - DNA, 20 bp, Homo sapiens
gaagctatcgtaaaattaag

SEQ ID NO: 3840209 - DNA, 15 bp, Homo sapiens
gaagctgacctttaa

SEQ ID NO: 3840210 - DNA, 15 bp, Homo sapiens
gaagctgctgtctct

SEQ ID NO: 3840211 - DNA, 16 bp, Homo sapiens
gaagcttattaatgct

SEQ ID NO: 3840212 - DNA, 21 bp, Homo sapiens
gaagcttattaatgctaaggg

SEQ ID NO: 3840213 - DNA, 22 bp, Homo sapiens
gaagcttattaatgctaagggc

SEQ ID NO: 3840214 - DNA, 19 bp, Homo sapiens
gaaggactcaacattacat

SEQ ID NO: 3840215 - DNA, 12 bp, Homo sapiens
gaaggagagaaa

SEQ ID NO: 3840216 - DNA, 13 bp, Homo sapiens
gaaggagagaaag

SEQ ID NO: 3840217 - DNA, 16 bp, Homo sapiens
gaaggagagaaagtgg

SEQ ID NO: 3840218 - DNA, 21 bp, Homo sapiens
gaaggagagaaagtgggtgag

SEQ ID NO: 3840219 - DNA, 16 bp, Homo sapiens
gaaggcaagagggggt

SEQ ID NO: 3840220 - DNA, 17 bp, Homo sapiens
gaaggcaagagggggtg

SEQ ID NO: 3840221 - DNA, 22 bp, Homo sapiens
gaaggcaagagggggtggaggg

SEQ ID NO: 3840222 - DNA, 21 bp, Homo sapiens
gaaggccagaaaaggcagcca

SEQ ID NO: 3840223 - DNA, 22 bp, Homo sapiens
gaaggccagaaaaggcagccag

SEQ ID NO: 3840224 - DNA, 18 bp, Homo sapiens
gaaggccatggggcagcc

SEQ ID NO: 3840225 - DNA, 19 bp, Homo sapiens
gaaggccatggggcagcct

SEQ ID NO: 3840226 - DNA, 16 bp, Homo sapiens
gaagggagaagaaagg

SEQ ID NO: 3840227 - DNA, 16 bp, Homo sapiens
gaaggtgctggaggtg

SEQ ID NO: 3840228 - DNA, 19 bp, Homo sapiens
gaaggtgctggaggtggga

SEQ ID NO: 3840229 - DNA, 21 bp, Homo sapiens
gaagttattttctacagtggt

SEQ ID NO: 3840230 - DNA, 12 bp, Homo sapiens
gaataaaatttt

SEQ ID NO: 3840231 - DNA, 12 bp, Homo sapiens
gaataaagcaat

SEQ ID NO: 3840232 - DNA, 18 bp, Homo sapiens
gaataaagcaattttcct

SEQ ID NO: 3840233 - DNA, 13 bp, Homo sapiens
gaataaagcttct

SEQ ID NO: 3840234 - DNA, 18 bp, Homo sapiens
gaataaagcttctctctg

SEQ ID NO: 3840235 - DNA, 13 bp, Homo sapiens
gaataaatgtttt

SEQ ID NO: 3840236 - DNA, 16 bp, Homo sapiens
gaatacatattacaag

SEQ ID NO: 3840237 - DNA, 19 bp, Homo sapiens
gaatactttgaatgttgtg

SEQ ID NO: 3840238 - DNA, 23 bp, Homo sapiens
gaatatgtgccttctagaataca

SEQ ID NO: 3840239 - DNA, 23 bp, Homo sapiens
gaatccctttctcacttttggaa

SEQ ID NO: 3840240 - DNA, 15 bp, Homo sapiens
gaatcctagggcctg

SEQ ID NO: 3840241 - DNA, 14 bp, Homo sapiens
gaatgatgtatata

SEQ ID NO: 3840242 - DNA, 17 bp, Homo sapiens
gaatggattttcctgaa

SEQ ID NO: 3840243 - DNA, 20 bp, Homo sapiens
gaatgggagaggcaataaat

SEQ ID NO: 3840244 - DNA, 18 bp, Homo sapiens
gaattaggaaggccatgg

SEQ ID NO: 3840245 - DNA, 23 bp, Homo sapiens
gaattgcattttttaaaacaaga

SEQ ID NO: 3840246 - DNA, 16 bp, Homo sapiens
gaattgtgtctgcagg

SEQ ID NO: 3840247 - DNA, 15 bp, Homo sapiens
gaattgtgtttataa

SEQ ID NO: 3840248 - DNA, 14 bp, Homo sapiens
gaattttgtaagta

SEQ ID NO: 3840249 - DNA, 16 bp, Homo sapiens
gacaaggctgtgccag

SEQ ID NO: 3840250 - DNA, 17 bp, Homo sapiens
gacaaggctgtgccagg

SEQ ID NO: 3840251 - DNA, 19 bp, Homo sapiens
gacaaggctgtgccaggct

SEQ ID NO: 3840252 - DNA, 12 bp, Homo sapiens
gacacattcaca

SEQ ID NO: 3840253 - DNA, 16 bp, Homo sapiens
gacaccacacccagcc

SEQ ID NO: 3840254 - DNA, 17 bp, Homo sapiens
gacaccacgctggagct

SEQ ID NO: 3840255 - DNA, 20 bp, Homo sapiens
gacaccacgctggagctgtg

SEQ ID NO: 3840256 - DNA, 19 bp, Homo sapiens
gacagagcaggctttgtga

SEQ ID NO: 3840257 - DNA, 21 bp, Homo sapiens
gacagagcaggctttgtgaga

SEQ ID NO: 3840258 - DNA, 21 bp, Homo sapiens
gacagatgaagaaggagcaga

SEQ ID NO: 3840259 - DNA, 20 bp, Homo sapiens
gacagccccagagcagggtg

SEQ ID NO: 3840260 - DNA, 15 bp, Homo sapiens
gacagcttgagccgg

SEQ ID NO: 3840261 - DNA, 13 bp, Homo sapiens
gacagggctccag

SEQ ID NO: 3840262 - DNA, 16 bp, Homo sapiens
gacaggttaaatatat

SEQ ID NO: 3840263 - DNA, 16 bp, Homo sapiens
gacagtaagagtttac

SEQ ID NO: 3840264 - DNA, 20 bp, Homo sapiens
gacataatttaaaataaata

SEQ ID NO: 3840265 - DNA, 18 bp, Homo sapiens
gacatagcccatccctgc

SEQ ID NO: 3840266 - DNA, 15 bp, Homo sapiens
gacatctcaaataca

SEQ ID NO: 3840267 - DNA, 17 bp, Homo sapiens
gacatggtgcctgagag

SEQ ID NO: 3840268 - DNA, 19 bp, Homo sapiens
gacatggtgcctgagaggc

SEQ ID NO: 3840269 - DNA, 23 bp, Homo sapiens
gacatggtgcctgagaggcaggc

SEQ ID NO: 3840270 - DNA, 17 bp, Homo sapiens
gacattgttggcagcat

SEQ ID NO: 3840271 - DNA, 21 bp, Homo sapiens
gaccaatgccttaattaaaga

SEQ ID NO: 3840272 - DNA, 21 bp, Homo sapiens
gaccaatgggtttgccaagcc

SEQ ID NO: 3840273 - DNA, 19 bp, Homo sapiens
gaccacccccgagcttgcc

SEQ ID NO: 3840274 - DNA, 24 bp, Homo sapiens
gaccacccccgagcttgcctcagg

SEQ ID NO: 3840275 - DNA, 18 bp, Homo sapiens
gaccccagctgtgagcct

SEQ ID NO: 3840276 - DNA, 19 bp, Homo sapiens
gacccctcctcactggcca

SEQ ID NO: 3840277 - DNA, 14 bp, Homo sapiens
gaccctcagcccca

SEQ ID NO: 3840278 - DNA, 20 bp, Homo sapiens
gaccctcagccccaggagaa

SEQ ID NO: 3840279 - DNA, 21 bp, Homo sapiens
gaccctcagccccaggagaag

SEQ ID NO: 3840280 - DNA, 11 bp, Homo sapiens
gaccctctcaa

SEQ ID NO: 3840281 - DNA, 15 bp, Homo sapiens
gaccctctgccacca

SEQ ID NO: 3840282 - DNA, 17 bp, Homo sapiens
gaccctgggtgggctct

SEQ ID NO: 3840283 - DNA, 18 bp, Homo sapiens
gaccctgggtgggctctg

SEQ ID NO: 3840284 - DNA, 21 bp, Homo sapiens
gaccctgtgacatggtgcctg

SEQ ID NO: 3840285 - DNA, 14 bp, Homo sapiens
gaccggcctggacc

SEQ ID NO: 3840286 - DNA, 22 bp, Homo sapiens
gacctatcagtatggtgctaat

SEQ ID NO: 3840287 - DNA, 21 bp, Homo sapiens
gacctcaggcactagcctttg

SEQ ID NO: 3840288 - DNA, 12 bp, Homo sapiens
gacctccatgcc

SEQ ID NO: 3840289 - DNA, 13 bp, Homo sapiens
gacctccatgccc

SEQ ID NO: 3840290 - DNA, 14 bp, Homo sapiens
gacctccatgcccc

SEQ ID NO: 3840291 - DNA, 16 bp, Homo sapiens
gacctccatgcccccg

SEQ ID NO: 3840292 - DNA, 18 bp, Homo sapiens
gacctccatgcccccgcc

SEQ ID NO: 3840293 - DNA, 16 bp, Homo sapiens
gacctccccagcccct

SEQ ID NO: 3840294 - DNA, 19 bp, Homo sapiens
gacctgatttacagtttca

SEQ ID NO: 3840295 - DNA, 16 bp, Homo sapiens
gacggcaggctcactg

SEQ ID NO: 3840296 - DNA, 21 bp, Homo sapiens
gacggtattatgcttcttgga

SEQ ID NO: 3840297 - DNA, 21 bp, Homo sapiens
gacggtttcaaaccaggattt

SEQ ID NO: 3840298 - DNA, 19 bp, Homo sapiens
gactagatcacaactgaag

SEQ ID NO: 3840299 - DNA, 21 bp, Homo sapiens
gactagcccctgtggagactg

SEQ ID NO: 3840300 - DNA, 23 bp, Homo sapiens
gactagcccctgtggagactggg

SEQ ID NO: 3840301 - DNA, 13 bp, Homo sapiens
gactagtgctgaa

SEQ ID NO: 3840302 - DNA, 17 bp, Homo sapiens
gactagtgctgaagctt

SEQ ID NO: 3840303 - DNA, 18 bp, Homo sapiens
gactagtgctgaagctta

SEQ ID NO: 3840304 - DNA, 19 bp, Homo sapiens
gactagtgctgaagcttat

SEQ ID NO: 3840305 - DNA, 19 bp, Homo sapiens
gactatttataactaatat

SEQ ID NO: 3840306 - DNA, 16 bp, Homo sapiens
gactcaagattcccag

SEQ ID NO: 3840307 - DNA, 23 bp, Homo sapiens
gactccctccccagatctgtcct

SEQ ID NO: 3840308 - DNA, 17 bp, Homo sapiens
gactccgcctgaggcca

SEQ ID NO: 3840309 - DNA, 18 bp, Homo sapiens
gactcctcggcctggctc

SEQ ID NO: 3840310 - DNA, 21 bp, Homo sapiens
gactgaagacaggcacaaaat

SEQ ID NO: 3840311 - DNA, 11 bp, Homo sapiens
gactgagaaat

SEQ ID NO: 3840312 - DNA, 22 bp, Homo sapiens
gactgagccccgcagacctccc

SEQ ID NO: 3840313 - DNA, 21 bp, Homo sapiens
gactgtggaggggagctgctg

SEQ ID NO: 3840314 - DNA, 16 bp, Homo sapiens
gacttaaggagaaata

SEQ ID NO: 3840315 - DNA, 17 bp, Homo sapiens
gacttcaccaaatatat

SEQ ID NO: 3840316 - DNA, 17 bp, Homo sapiens
gagaaacaataaagaga

SEQ ID NO: 3840317 - DNA, 15 bp, Homo sapiens
gagaaagccaggcag

SEQ ID NO: 3840318 - DNA, 20 bp, Homo sapiens
gagaaagccaggcaggtagc

SEQ ID NO: 3840319 - DNA, 14 bp, Homo sapiens
gagaaatttataaa

SEQ ID NO: 3840320 - DNA, 14 bp, Homo sapiens
gagaacttgaacaa

SEQ ID NO: 3840321 - DNA, 12 bp, Homo sapiens
gagaagagagga

SEQ ID NO: 3840322 - DNA, 14 bp, Homo sapiens
gcccccatcttggg

SEQ ID NO: 3840323 - DNA, 22 bp, Homo sapiens
gcccccatgcagtgaccgcttc

SEQ ID NO: 3840324 - DNA, 24 bp, Homo sapiens
gcccccgccacctccccactccag

SEQ ID NO: 3840325 - DNA, 15 bp, Homo sapiens
gccccgcagacctcc

SEQ ID NO: 3840326 - DNA, 18 bp, Homo sapiens
gccccgcagacctcccca

SEQ ID NO: 3840327 - DNA, 14 bp, Homo sapiens
gccccggccacctc

SEQ ID NO: 3840328 - DNA, 21 bp, Homo sapiens
gccccgtctcctgagggtcct

SEQ ID NO: 3840329 - DNA, 13 bp, Homo sapiens
gcccctagcccag

SEQ ID NO: 3840330 - DNA, 15 bp, Homo sapiens
gcccctagcccagga

SEQ ID NO: 3840331 - DNA, 15 bp, Homo sapiens
gcccctgccctgagg

SEQ ID NO: 3840332 - DNA, 12 bp, Homo sapiens
gcccctgggctt

SEQ ID NO: 3840333 - DNA, 20 bp, Homo sapiens
gcccctgggcttggcctgct

SEQ ID NO: 3840334 - DNA, 22 bp, Homo sapiens
gcccctgggcttggcctgctgt

SEQ ID NO: 3840335 - DNA, 15 bp, Homo sapiens
gcccgccctccctcc

SEQ ID NO: 3840336 - DNA, 13 bp, Homo sapiens
gcccgccctgggc

SEQ ID NO: 3840337 - DNA, 16 bp, Homo sapiens
gcccgcctctgcctcc

SEQ ID NO: 3840338 - DNA, 22 bp, Homo sapiens
gcccgggtcccacacggccagc

SEQ ID NO: 3840339 - DNA, 14 bp, Homo sapiens
gccctacagccctg

SEQ ID NO: 3840340 - DNA, 22 bp, Homo sapiens
gccctaggaggagaacttgaac

SEQ ID NO: 3840341 - DNA, 13 bp, Homo sapiens
gccctcccctccc

SEQ ID NO: 3840342 - DNA, 18 bp, Homo sapiens
gccctcccctcccctgct

SEQ ID NO: 3840343 - DNA, 21 bp, Homo sapiens
gccctcccctcccctgctgca

SEQ ID NO: 3840344 - DNA, 13 bp, Homo sapiens
gccctccctcctg

SEQ ID NO: 3840345 - DNA, 16 bp, Homo sapiens
gccctcctgcccgccc

SEQ ID NO: 3840346 - DNA, 14 bp, Homo sapiens
gccctctccgagct

SEQ ID NO: 3840347 - DNA, 13 bp, Homo sapiens
gccctctgaggct

SEQ ID NO: 3840348 - DNA, 20 bp, Homo sapiens
gccctctgaggctcagccct

SEQ ID NO: 3840349 - DNA, 20 bp, Homo sapiens
gccctctggggctcagccct

SEQ ID NO: 3840350 - DNA, 21 bp, Homo sapiens
gccctgagctagtgtcacctg

SEQ ID NO: 3840351 - DNA, 22 bp, Homo sapiens
gccctgagctggcctcacctgg

SEQ ID NO: 3840352 - DNA, 21 bp, Homo sapiens
gccctgagctggcgtcacctg

SEQ ID NO: 3840353 - DNA, 22 bp, Homo sapiens
gccctgagctggcgtcacctgt

SEQ ID NO: 3840354 - DNA, 14 bp, Homo sapiens
gccctgaggaataa

SEQ ID NO: 3840355 - DNA, 21 bp, Homo sapiens
gccctgaggaataaagcttct

SEQ ID NO: 3840356 - DNA, 23 bp, Homo sapiens
gccctgaggaataaagcttctct

SEQ ID NO: 3840357 - DNA, 18 bp, Homo sapiens
gccctgaggagggccctg

SEQ ID NO: 3840358 - DNA, 20 bp, Homo sapiens
gccctgaggagggccctgag

SEQ ID NO: 3840359 - DNA, 23 bp, Homo sapiens
gccctgagttggcatcacctgcg

SEQ ID NO: 3840360 - DNA, 22 bp, Homo sapiens
gccctgggcgcagctgaagcct

SEQ ID NO: 3840361 - DNA, 15 bp, Homo sapiens
gccctgtccctccca

SEQ ID NO: 3840362 - DNA, 16 bp, Homo sapiens
gccctgtccctcccac

SEQ ID NO: 3840363 - DNA, 21 bp, Homo sapiens
gccctgtccctcccacctctg

SEQ ID NO: 3840364 - DNA, 22 bp, Homo sapiens
gccctgtccctcccacctctgt

SEQ ID NO: 3840365 - DNA, 20 bp, Homo sapiens
gcccttagggagagcacctg

SEQ ID NO: 3840366 - DNA, 19 bp, Homo sapiens
gcccttcctggctaggact

SEQ ID NO: 3840367 - DNA, 14 bp, Homo sapiens
gcccttgcctcccc

SEQ ID NO: 3840368 - DNA, 16 bp, Homo sapiens
gcccttgcctccccat

SEQ ID NO: 3840369 - DNA, 12 bp, Homo sapiens
gcccttggccag

SEQ ID NO: 3840370 - DNA, 14 bp, Homo sapiens
gccctttcctcagg

SEQ ID NO: 3840371 - DNA, 15 bp, Homo sapiens
gccctttgctgttcg

SEQ ID NO: 3840372 - DNA, 22 bp, Homo sapiens
gccctttgctgttcgcagcctc

SEQ ID NO: 3840373 - DNA, 19 bp, Homo sapiens
gccgaaccaggagctgctc

SEQ ID NO: 3840374 - DNA, 14 bp, Homo sapiens
gccgagcccacacc

SEQ ID NO: 3840375 - DNA, 15 bp, Homo sapiens
gccgagcccacacca

SEQ ID NO: 3840376 - DNA, 22 bp, Homo sapiens
gccgagcccacaccatctggcc

SEQ ID NO: 3840377 - DNA, 21 bp, Homo sapiens
gccgcactagcctccctctcc

SEQ ID NO: 3840378 - DNA, 13 bp, Homo sapiens
gccgccgccgtgg

SEQ ID NO: 3840379 - DNA, 24 bp, Homo sapiens
gccgctcccggttccctccccagc

SEQ ID NO: 3840380 - DNA, 18 bp, Homo sapiens
gccggcccaacccaacca

SEQ ID NO: 3840381 - DNA, 22 bp, Homo sapiens
gccggcccaacccaaccactcg

SEQ ID NO: 3840382 - DNA, 17 bp, Homo sapiens
gccgggcccctgggctt

SEQ ID NO: 3840383 - DNA, 17 bp, Homo sapiens
gccggggctgaagccac

SEQ ID NO: 3840384 - DNA, 21 bp, Homo sapiens
gccggggctgaagccacacag

SEQ ID NO: 3840385 - DNA, 14 bp, Homo sapiens
gccgttgcagacat

SEQ ID NO: 3840386 - DNA, 12 bp, Homo sapiens
gccgttggccac

SEQ ID NO: 3840387 - DNA, 20 bp, Homo sapiens
gcctaaaagattttgtgaaa

SEQ ID NO: 3840388 - DNA, 23 bp, Homo sapiens
gcctactgcccctgccctgagga

SEQ ID NO: 3840389 - DNA, 14 bp, Homo sapiens
gcctaggcagccag

SEQ ID NO: 3840390 - DNA, 14 bp, Homo sapiens
gcctaggtgggagc

SEQ ID NO: 3840391 - DNA, 14 bp, Homo sapiens
gcctataatcccag

SEQ ID NO: 3840392 - DNA, 17 bp, Homo sapiens
gcctcacattcccccgg

SEQ ID NO: 3840393 - DNA, 22 bp, Homo sapiens
gcctcacattcccccggtgcct

SEQ ID NO: 3840394 - DNA, 23 bp, Homo sapiens
gcctcacattcccccggtgcctc

SEQ ID NO: 3840395 - DNA, 14 bp, Homo sapiens
gcctcagggccaag

SEQ ID NO: 3840396 - DNA, 18 bp, Homo sapiens
gcctcagggccaagccgg

SEQ ID NO: 3840397 - DNA, 22 bp, Homo sapiens
gcctcagtcctcccctcacagc

SEQ ID NO: 3840398 - DNA, 14 bp, Homo sapiens
gcctcatgaacact

SEQ ID NO: 3840399 - DNA, 20 bp, Homo sapiens
gcctcatgaacactggctgc

SEQ ID NO: 3840400 - DNA, 22 bp, Homo sapiens
gcctccaactccagctgagtcc

SEQ ID NO: 3840401 - DNA, 18 bp, Homo sapiens
gcctccagtctgctctca

SEQ ID NO: 3840402 - DNA, 13 bp, Homo sapiens
gcctccatgtaga

SEQ ID NO: 3840403 - DNA, 13 bp, Homo sapiens
gcctccccatttc

SEQ ID NO: 3840404 - DNA, 19 bp, Homo sapiens
gcctccccatttcccatct

SEQ ID NO: 3840405 - DNA, 15 bp, Homo sapiens
gcctccgagagggag

SEQ ID NO: 3840406 - DNA, 18 bp, Homo sapiens
gcctccgagagggagaga

SEQ ID NO: 3840407 - DNA, 19 bp, Homo sapiens
gcctccggcctgcactccc

SEQ ID NO: 3840408 - DNA, 13 bp, Homo sapiens
gcctcctcctagc

SEQ ID NO: 3840409 - DNA, 15 bp, Homo sapiens
gcctcctcctagctg

SEQ ID NO: 3840410 - DNA, 18 bp, Homo sapiens
gcctcctcctagctggag

SEQ ID NO: 3840411 - DNA, 20 bp, Homo sapiens
gcctcctctggacggcaggc

SEQ ID NO: 3840412 - DNA, 20 bp, Homo sapiens
gcctcggagtgtggcctgga

SEQ ID NO: 3840413 - DNA, 21 bp, Homo sapiens
gcctcggagtgtggcctggat

SEQ ID NO: 3840414 - DNA, 23 bp, Homo sapiens
gcctcgggaacctcactcttgcc

SEQ ID NO: 3840415 - DNA, 21 bp, Homo sapiens
gcctcgttaggacaaggctgt

SEQ ID NO: 3840416 - DNA, 22 bp, Homo sapiens
gcctcgttaggacaaggctgtg

SEQ ID NO: 3840417 - DNA, 18 bp, Homo sapiens
gcctctaacaaatgatct

SEQ ID NO: 3840418 - DNA, 17 bp, Homo sapiens
gcctctgacccctcctc

SEQ ID NO: 3840419 - DNA, 18 bp, Homo sapiens
gcctctgacccctcctca

SEQ ID NO: 3840420 - DNA, 20 bp, Homo sapiens
gcctctgacccctcctcact

SEQ ID NO: 3840421 - DNA, 21 bp, Homo sapiens
gcctctgacccctcctcactg

SEQ ID NO: 3840422 - DNA, 15 bp, Homo sapiens
gcctgagaggcaggc

SEQ ID NO: 3840423 - DNA, 20 bp, Homo sapiens
gcctgagcaagacgccctct

SEQ ID NO: 3840424 - DNA, 20 bp, Homo sapiens
gcctgccttaccgagagcca

SEQ ID NO: 3840425 - DNA, 11 bp, Homo sapiens
gcctgctgctg

SEQ ID NO: 3840426 - DNA, 22 bp, Homo sapiens
gcctgctggcacccaccgtgga

SEQ ID NO: 3840427 - DNA, 16 bp, Homo sapiens
gcctggacgcagccac

SEQ ID NO: 3840428 - DNA, 20 bp, Homo sapiens
gcctggacgcagccacacag

SEQ ID NO: 3840429 - DNA, 15 bp, Homo sapiens
gcctggatccatcct

SEQ ID NO: 3840430 - DNA, 19 bp, Homo sapiens
gcctggatccatcctgcta

SEQ ID NO: 3840431 - DNA, 16 bp, Homo sapiens
gcctggccatgtcctc

SEQ ID NO: 3840432 - DNA, 10 bp, Homo sapiens
gcctggctct

SEQ ID NO: 3840433 - DNA, 19 bp, Homo sapiens
gcctggctcttgtgctgga

SEQ ID NO: 3840434 - DNA, 19 bp, Homo sapiens
gcctggctggtttgcccag

SEQ ID NO: 3840435 - DNA, 22 bp, Homo sapiens
gcctggctggtttgcccagagc

SEQ ID NO: 3840436 - DNA, 17 bp, Homo sapiens
gcctgggcctcctccta

SEQ ID NO: 3840437 - DNA, 20 bp, Homo sapiens
gcctgggcctcctcctagct

SEQ ID NO: 3840438 - DNA, 17 bp, Homo sapiens
gcctggtcacagggcat

SEQ ID NO: 3840439 - DNA, 18 bp, Homo sapiens
gcctgtcggccacacccc

SEQ ID NO: 3840440 - DNA, 21 bp, Homo sapiens
gcctgtcggccacaccccaga

SEQ ID NO: 3840441 - DNA, 22 bp, Homo sapiens
gcctgtcggccacaccccagac

SEQ ID NO: 3840442 - DNA, 23 bp, Homo sapiens
gcctgtgagctaggaattgtgtt

SEQ ID NO: 3840443 - DNA, 14 bp, Homo sapiens
gcctgtgtagccag

SEQ ID NO: 3840444 - DNA, 15 bp, Homo sapiens
gcctgtgtgcagtgg

SEQ ID NO: 3840445 - DNA, 22 bp, Homo sapiens
gcctgtgtgcagtggagctggc

SEQ ID NO: 3840446 - DNA, 14 bp, Homo sapiens
gccttaaaaccaaa

SEQ ID NO: 3840447 - DNA, 20 bp, Homo sapiens
gccttaagtctttttgaagt

SEQ ID NO: 3840448 - DNA, 22 bp, Homo sapiens
gccttaagtctttttgaagtgt

SEQ ID NO: 3840449 - DNA, 18 bp, Homo sapiens
gccttaccgagagccaaa

SEQ ID NO: 3840450 - DNA, 13 bp, Homo sapiens
gccttagagccag

SEQ ID NO: 3840451 - DNA, 24 bp, Homo sapiens
gccttccctagctttagaccctgg

SEQ ID NO: 3840452 - DNA, 22 bp, Homo sapiens
gccttcttccatcccaggacac

SEQ ID NO: 3840453 - DNA, 20 bp, Homo sapiens
ggctaggactgtggagggga

SEQ ID NO: 3840454 - DNA, 22 bp, Homo sapiens
ggctaggactgtggaggggagc

SEQ ID NO: 3840455 - DNA, 14 bp, Homo sapiens
ggctcactgccagg

SEQ ID NO: 3840456 - DNA, 15 bp, Homo sapiens
ggctcactgccaggc

SEQ ID NO: 3840457 - DNA, 20 bp, Homo sapiens
ggctcactgccaggccagcc

SEQ ID NO: 3840458 - DNA, 21 bp, Homo sapiens
ggctcactgccaggccagcct

SEQ ID NO: 3840459 - DNA, 12 bp, Homo sapiens
ggctcagaaaat

SEQ ID NO: 3840460 - DNA, 15 bp, Homo sapiens
ggctcagccctgagc

SEQ ID NO: 3840461 - DNA, 12 bp, Homo sapiens
ggctccagcctg

SEQ ID NO: 3840462 - DNA, 17 bp, Homo sapiens
ggctccccacgccccca

SEQ ID NO: 3840463 - DNA, 13 bp, Homo sapiens
ggctcctgaagga

SEQ ID NO: 3840464 - DNA, 20 bp, Homo sapiens
ggctcctgaagggtgctcag

SEQ ID NO: 3840465 - DNA, 21 bp, Homo sapiens
ggctcggggctccccacgccc

SEQ ID NO: 3840466 - DNA, 23 bp, Homo sapiens
ggctctctttccttcttgccttc

SEQ ID NO: 3840467 - DNA, 16 bp, Homo sapiens
ggctctggagacagcc

SEQ ID NO: 3840468 - DNA, 17 bp, Homo sapiens
ggctctggagacagccc

SEQ ID NO: 3840469 - DNA, 17 bp, Homo sapiens
ggctgaagccacacagc

SEQ ID NO: 3840470 - DNA, 18 bp, Homo sapiens
ggctgaagccacacagcc

SEQ ID NO: 3840471 - DNA, 19 bp, Homo sapiens
ggctgaagccacacagccc

SEQ ID NO: 3840472 - DNA, 19 bp, Homo sapiens
ggctgaggttcctctgcct

SEQ ID NO: 3840473 - DNA, 22 bp, Homo sapiens
ggctgaggttcctctgcctgcc

SEQ ID NO: 3840474 - DNA, 23 bp, Homo sapiens
ggctgaggttcctctgcctgccc

SEQ ID NO: 3840475 - DNA, 23 bp, Homo sapiens
ggctgccctccatcccttcccca

SEQ ID NO: 3840476 - DNA, 23 bp, Homo sapiens
ggctgcctcctcctgagagctgt

SEQ ID NO: 3840477 - DNA, 10 bp, Homo sapiens
ggctgctgcc

SEQ ID NO: 3840478 - DNA, 18 bp, Homo sapiens
ggctgctgcccccacccc

SEQ ID NO: 3840479 - DNA, 12 bp, Homo sapiens
ggctggccccca

SEQ ID NO: 3840480 - DNA, 24 bp, Homo sapiens
ggctggctcctggggatggccagg

SEQ ID NO: 3840481 - DNA, 13 bp, Homo sapiens
ggctggcttcagg

SEQ ID NO: 3840482 - DNA, 16 bp, Homo sapiens
ggctggcttcaggagg

SEQ ID NO: 3840483 - DNA, 14 bp, Homo sapiens
ggctgggaggctcg

SEQ ID NO: 3840484 - DNA, 19 bp, Homo sapiens
ggctgggcccttcctggct

SEQ ID NO: 3840485 - DNA, 13 bp, Homo sapiens
ggctggtgggagg

SEQ ID NO: 3840486 - DNA, 17 bp, Homo sapiens
ggctggtttgcccagag

SEQ ID NO: 3840487 - DNA, 13 bp, Homo sapiens
ggctgtgccaggc

SEQ ID NO: 3840488 - DNA, 16 bp, Homo sapiens
ggctgtgccaggctgg

SEQ ID NO: 3840489 - DNA, 17 bp, Homo sapiens
ggctgtgccaggctggg

SEQ ID NO: 3840490 - DNA, 17 bp, Homo sapiens
ggctgttggcagtgagt

SEQ ID NO: 3840491 - DNA, 14 bp, Homo sapiens
ggcttaattgaaac

SEQ ID NO: 3840492 - DNA, 14 bp, Homo sapiens
ggcttcctcagggg

SEQ ID NO: 3840493 - DNA, 19 bp, Homo sapiens
ggcttcctgcgtcctcctc

SEQ ID NO: 3840494 - DNA, 13 bp, Homo sapiens
ggcttgaagccaa

SEQ ID NO: 3840495 - DNA, 12 bp, Homo sapiens
ggcttggcctgc

SEQ ID NO: 3840496 - DNA, 16 bp, Homo sapiens
ggcttggcctgctgtg

SEQ ID NO: 3840497 - DNA, 14 bp, Homo sapiens
ggctttgtgagaga

SEQ ID NO: 3840498 - DNA, 12 bp, Homo sapiens
gggaacatcctg

SEQ ID NO: 3840499 - DNA, 19 bp, Homo sapiens
gggaacctcactcttgcca

SEQ ID NO: 3840500 - DNA, 15 bp, Homo sapiens
gggaagacagagcag

SEQ ID NO: 3840501 - DNA, 22 bp, Homo sapiens
gggaaggaagcttggctgctca

SEQ ID NO: 3840502 - DNA, 22 bp, Homo sapiens
gggaatccccgaaggtgctgga

SEQ ID NO: 3840503 - DNA, 20 bp, Homo sapiens
gggacacaggagaccacccc

SEQ ID NO: 3840504 - DNA, 21 bp, Homo sapiens
gggacaggcctttctggcctg

SEQ ID NO: 3840505 - DNA, 22 bp, Homo sapiens
gggacaggcctttctggcctgc

SEQ ID NO: 3840506 - DNA, 19 bp, Homo sapiens
gggacctgccaggcagggg

SEQ ID NO: 3840507 - DNA, 12 bp, Homo sapiens
gggagagcctgc

SEQ ID NO: 3840508 - DNA, 17 bp, Homo sapiens
gggagagtccttagcct

SEQ ID NO: 3840509 - DNA, 20 bp, Homo sapiens
gggagagtccttagcctggg

SEQ ID NO: 3840510 - DNA, 21 bp, Homo sapiens
gggagagtccttagcctgggc

SEQ ID NO: 3840511 - DNA, 15 bp, Homo sapiens
gggagcaatctggaa

SEQ ID NO: 3840512 - DNA, 18 bp, Homo sapiens
gggagcaggagattgaga

SEQ ID NO: 3840513 - DNA, 21 bp, Homo sapiens
gggagcaggagattgagaagg

SEQ ID NO: 3840514 - DNA, 13 bp, Homo sapiens
gggagccagaggc

SEQ ID NO: 3840515 - DNA, 17 bp, Homo sapiens
gggagccagaggccagg

SEQ ID NO: 3840516 - DNA, 13 bp, Homo sapiens
gggaggaagcaga

SEQ ID NO: 3840517 - DNA, 15 bp, Homo sapiens
gggaggaagcagaat

SEQ ID NO: 3840518 - DNA, 21 bp, Homo sapiens
gggaggaagcagaataaagca

SEQ ID NO: 3840519 - DNA, 23 bp, Homo sapiens
gggaggaagcagaataaagcaat

SEQ ID NO: 3840520 - DNA, 17 bp, Homo sapiens
gggagggtggcagagac

SEQ ID NO: 3840521 - DNA, 15 bp, Homo sapiens
gggaggtcactggaa

SEQ ID NO: 3840522 - DNA, 21 bp, Homo sapiens
gggaggtgaaaagggcagagg

SEQ ID NO: 3840523 - DNA, 13 bp, Homo sapiens
gggatactgcagg

SEQ ID NO: 3840524 - DNA, 14 bp, Homo sapiens
gggatagtctggaa

SEQ ID NO: 3840525 - DNA, 16 bp, Homo sapiens
gggatagtctggaaag

SEQ ID NO: 3840526 - DNA, 17 bp, Homo sapiens
gggatgaagagggtaga

SEQ ID NO: 3840527 - DNA, 12 bp, Homo sapiens
gggcaagaggtg

SEQ ID NO: 3840528 - DNA, 20 bp, Homo sapiens
gggcaagaggtgcctgggag

SEQ ID NO: 3840529 - DNA, 15 bp, Homo sapiens
gggcaccccaggcag

SEQ ID NO: 3840530 - DNA, 22 bp, Homo sapiens
gggcaccccaggcagctcctgt

SEQ ID NO: 3840531 - DNA, 16 bp, Homo sapiens
gggcagaaaggctgca

SEQ ID NO: 3840532 - DNA, 14 bp, Homo sapiens
gggcagaggcaagg

SEQ ID NO: 3840533 - DNA, 15 bp, Homo sapiens
gggcagaggcaagga

SEQ ID NO: 3840534 - DNA, 18 bp, Homo sapiens
gggcagaggcaaggatgg

SEQ ID NO: 3840535 - DNA, 14 bp, Homo sapiens
gggcagccagccct

SEQ ID NO: 3840536 - DNA, 19 bp, Homo sapiens
gggcagccagccctggctt

SEQ ID NO: 3840537 - DNA, 18 bp, Homo sapiens
gggcagccattggcctct

SEQ ID NO: 3840538 - DNA, 24 bp, Homo sapiens
gggcagcctccagtctgctctcag

SEQ ID NO: 3840539 - DNA, 16 bp, Homo sapiens
gggcaggggtgtcctg

SEQ ID NO: 3840540 - DNA, 20 bp, Homo sapiens
gggcatgccccggccacctc

SEQ ID NO: 3840541 - DNA, 23 bp, Homo sapiens
gggcatgccccggccacctctgc

SEQ ID NO: 3840542 - DNA, 18 bp, Homo sapiens
gggcatttaatcaggagg

SEQ ID NO: 3840543 - DNA, 14 bp, Homo sapiens
gggcatttgtaaaa

SEQ ID NO: 3840544 - DNA, 20 bp, Homo sapiens
gggccagcacagctgaggac

SEQ ID NO: 3840545 - DNA, 20 bp, Homo sapiens
gggccctcctgggcacccca

SEQ ID NO: 3840546 - DNA, 19 bp, Homo sapiens
gggcccttcctggctagga

SEQ ID NO: 3840547 - DNA, 22 bp, Homo sapiens
gggcccttcctggctaggactg

SEQ ID NO: 3840548 - DNA, 20 bp, Homo sapiens
gggcgcagctgaagcctgga

SEQ ID NO: 3840549 - DNA, 22 bp, Homo sapiens
gggcggctgagctccagccacc

SEQ ID NO: 3840550 - DNA, 20 bp, Homo sapiens
gggctaggggaggggggagc

SEQ ID NO: 3840551 - DNA, 15 bp, Homo sapiens
gggctcagccctgag

SEQ ID NO: 3840552 - DNA, 12 bp, Homo sapiens
gggctccagcct

SEQ ID NO: 3840553 - DNA, 14 bp, Homo sapiens
gggctccagcctgt

SEQ ID NO: 3840554 - DNA, 23 bp, Homo sapiens
gggctccagcctgtcggccacac

SEQ ID NO: 3840555 - DNA, 11 bp, Homo sapiens
gggctctcctg

SEQ ID NO: 3840556 - DNA, 16 bp, Homo sapiens
gggctctggagagaaa

SEQ ID NO: 3840557 - DNA, 12 bp, Homo sapiens
gggctgaagcca

SEQ ID NO: 3840558 - DNA, 19 bp, Homo sapiens
gggctgaagccacacagcc

SEQ ID NO: 3840559 - DNA, 19 bp, Homo sapiens
gggctgggcccttcctggc

SEQ ID NO: 3840560 - DNA, 23 bp, Homo sapiens
gggctgggcccttcctggctagg

SEQ ID NO: 3840561 - DNA, 15 bp, Homo sapiens
gggcttgaagccaaa

SEQ ID NO: 3840562 - DNA, 17 bp, Homo sapiens
gggcttgaagccaaaga

SEQ ID NO: 3840563 - DNA, 16 bp, Homo sapiens
gggcttggcctgctgt

SEQ ID NO: 3840564 - DNA, 21 bp, Homo sapiens
ggggactagcccctgtggaga

SEQ ID NO: 3840565 - DNA, 16 bp, Homo sapiens
ggggagagcctgctgg

SEQ ID NO: 3840566 - DNA, 18 bp, Homo sapiens
ggggagagcctgctggca

SEQ ID NO: 3840567 - DNA, 12 bp, Homo sapiens
ggggagagctgg

SEQ ID NO: 3840568 - DNA, 13 bp, Homo sapiens
ggggagagctggc

SEQ ID NO: 3840569 - DNA, 11 bp, Homo sapiens
ggggagctggc

SEQ ID NO: 3840570 - DNA, 23 bp, Homo sapiens
ggggagctggcctaggtgggagc

SEQ ID NO: 3840571 - DNA, 21 bp, Homo sapiens
ggggatgcaaataaagcctgc

SEQ ID NO: 3840572 - DNA, 22 bp, Homo sapiens
ggggcacagacctctcccaccc

SEQ ID NO: 3840573 - DNA, 17 bp, Homo sapiens
ggggcggctgagctcca

SEQ ID NO: 3840574 - DNA, 14 bp, Homo sapiens
ggggctacaagagg

SEQ ID NO: 3840575 - DNA, 17 bp, Homo sapiens
ggggctacaagagggaa

SEQ ID NO: 3840576 - DNA, 14 bp, Homo sapiens
ggggctaggggagg

SEQ ID NO: 3840577 - DNA, 19 bp, Homo sapiens
ggggctcagccctgagctg

SEQ ID NO: 3840578 - DNA, 19 bp, Homo sapiens
ggggctccccacgccccca

SEQ ID NO: 3840579 - DNA, 13 bp, Homo sapiens
ggggctctggaga

SEQ ID NO: 3840580 - DNA, 16 bp, Homo sapiens
ggggctctggagagaa

SEQ ID NO: 3840581 - DNA, 15 bp, Homo sapiens
ggggctgaagccaca

SEQ ID NO: 3840582 - DNA, 17 bp, Homo sapiens
ggggcttgaagccaaag

SEQ ID NO: 3840583 - DNA, 14 bp, Homo sapiens
gggggtcacccatg

SEQ ID NO: 3840584 - DNA, 13 bp, Homo sapiens
gggggtggaggct

SEQ ID NO: 3840585 - DNA, 14 bp, Homo sapiens
gggggtgtggcagg

SEQ ID NO: 3840586 - DNA, 20 bp, Homo sapiens
taacagttataaagaaagat

SEQ ID NO: 3840587 - DNA, 20 bp, Homo sapiens
taacatgaatatttagtgtt

SEQ ID NO: 3840588 - DNA, 21 bp, Homo sapiens
taacatgaatatttagtgttc

SEQ ID NO: 3840589 - DNA, 19 bp, Homo sapiens
taacatttacgaattattt

SEQ ID NO: 3840590 - DNA, 17 bp, Homo sapiens
taacgtataaaagcctg

SEQ ID NO: 3840591 - DNA, 13 bp, Homo sapiens
taactaatatggt

SEQ ID NO: 3840592 - DNA, 15 bp, Homo sapiens
taactgaagcataaa

SEQ ID NO: 3840593 - DNA, 18 bp, Homo sapiens
taactgaagcataaacat

SEQ ID NO: 3840594 - DNA, 17 bp, Homo sapiens
taactggaaggctgctt

SEQ ID NO: 3840595 - DNA, 19 bp, Homo sapiens
taacttgccatttctttat

SEQ ID NO: 3840596 - DNA, 20 bp, Homo sapiens
taagaaaactacatgtaaaa

SEQ ID NO: 3840597 - DNA, 18 bp, Homo sapiens
taagaaagattaaatata

SEQ ID NO: 3840598 - DNA, 12 bp, Homo sapiens
taagacctctga

SEQ ID NO: 3840599 - DNA, 13 bp, Homo sapiens
taagacctctgag

SEQ ID NO: 3840600 - DNA, 23 bp, Homo sapiens
taagactcctcggcctggctcct

SEQ ID NO: 3840601 - DNA, 21 bp, Homo sapiens
taagacttcctctaccaccac

SEQ ID NO: 3840602 - DNA, 14 bp, Homo sapiens
taagagtttacaag

SEQ ID NO: 3840603 - DNA, 22 bp, Homo sapiens
taaggaattttatttttttctg

SEQ ID NO: 3840604 - DNA, 17 bp, Homo sapiens
taaggagctttgctctt

SEQ ID NO: 3840605 - DNA, 12 bp, Homo sapiens
taaggcccagct

SEQ ID NO: 3840606 - DNA, 15 bp, Homo sapiens
taaggcccagctgcc

SEQ ID NO: 3840607 - DNA, 17 bp, Homo sapiens
taaggcccagctgccag

SEQ ID NO: 3840608 - DNA, 17 bp, Homo sapiens
taaggccgagcccacac

SEQ ID NO: 3840609 - DNA, 13 bp, Homo sapiens
taagtaagaaaga

SEQ ID NO: 3840610 - DNA, 15 bp, Homo sapiens
taagtaagtttcatt

SEQ ID NO: 3840611 - DNA, 18 bp, Homo sapiens
taagtaagtttcattcta

SEQ ID NO: 3840612 - DNA, 22 bp, Homo sapiens
taagtaattgccagcttttata

SEQ ID NO: 3840613 - DNA, 23 bp, Homo sapiens
taagtatatttgtaaaagctaag

SEQ ID NO: 3840614 - DNA, 13 bp, Homo sapiens
taagtctgttatt

SEQ ID NO: 3840615 - DNA, 20 bp, Homo sapiens
taagtctgttattgttttgt

SEQ ID NO: 3840616 - DNA, 12 bp, Homo sapiens
taagtgaaattt

SEQ ID NO: 3840617 - DNA, 16 bp, Homo sapiens
taagtgaaattttaaa

SEQ ID NO: 3840618 - DNA, 20 bp, Homo sapiens
taagtgaaattttaaatgca

SEQ ID NO: 3840619 - DNA, 19 bp, Homo sapiens
taagtttcattctaaaatc

SEQ ID NO: 3840620 - DNA, 20 bp, Homo sapiens
taagtttcattctaaaatca

SEQ ID NO: 3840621 - DNA, 18 bp, Homo sapiens
taataaaatatcattcag

SEQ ID NO: 3840622 - DNA, 21 bp, Homo sapiens
taataaaatatcattcagcaa

SEQ ID NO: 3840623 - DNA, 23 bp, Homo sapiens
taataattaattaattaacatca

SEQ ID NO: 3840624 - DNA, 18 bp, Homo sapiens
taatacttgctttggaaa

SEQ ID NO: 3840625 - DNA, 14 bp, Homo sapiens
taatagaaagaaat

SEQ ID NO: 3840626 - DNA, 21 bp, Homo sapiens
taatagaaagaaattacttct

SEQ ID NO: 3840627 - DNA, 22 bp, Homo sapiens
taatagaaagaaattacttcta

SEQ ID NO: 3840628 - DNA, 15 bp, Homo sapiens
taatagcctaaaaga

SEQ ID NO: 3840629 - DNA, 22 bp, Homo sapiens
taatagcctaaaagattttgtg

SEQ ID NO: 3840630 - DNA, 22 bp, Homo sapiens
taatataagtttctttgcttca

SEQ ID NO: 3840631 - DNA, 19 bp, Homo sapiens
taatatggttttgttttca

SEQ ID NO: 3840632 - DNA, 17 bp, Homo sapiens
taatattcatacaacaa

SEQ ID NO: 3840633 - DNA, 14 bp, Homo sapiens
taatatttattgct

SEQ ID NO: 3840634 - DNA, 18 bp, Homo sapiens
taatatttattgctttat

SEQ ID NO: 3840635 - DNA, 15 bp, Homo sapiens
taatatttgtctgtg

SEQ ID NO: 3840636 - DNA, 18 bp, Homo sapiens
taatatttgtctgtgtgc

SEQ ID NO: 3840637 - DNA, 22 bp, Homo sapiens
taatccaagcaaatgtgaatca

SEQ ID NO: 3840638 - DNA, 17 bp, Homo sapiens
taatctttaattttaca

SEQ ID NO: 3840639 - DNA, 14 bp, Homo sapiens
taatgatggcccat

SEQ ID NO: 3840640 - DNA, 18 bp, Homo sapiens
taatgatggcccattcta

SEQ ID NO: 3840641 - DNA, 13 bp, Homo sapiens
taatgcaaatgtc

SEQ ID NO: 3840642 - DNA, 19 bp, Homo sapiens
taatgtaactgaagcataa

SEQ ID NO: 3840643 - DNA, 19 bp, Homo sapiens
taatgtatgaattttgtaa

SEQ ID NO: 3840644 - DNA, 23 bp, Homo sapiens
taatgtatgaattttgtaagtat

SEQ ID NO: 3840645 - DNA, 22 bp, Homo sapiens
taatgtatttttgtaaatagtt

SEQ ID NO: 3840646 - DNA, 19 bp, Homo sapiens
taatgttaggggtatttaa

SEQ ID NO: 3840647 - DNA, 20 bp, Homo sapiens
taatgttaggggtatttaat

SEQ ID NO: 3840648 - DNA, 17 bp, Homo sapiens
taattaattaacatcaa

SEQ ID NO: 3840649 - DNA, 16 bp, Homo sapiens
taattagcttttggag

SEQ ID NO: 3840650 - DNA, 20 bp, Homo sapiens
taattgaaacaacattattt

SEQ ID NO: 3840651 - DNA, 17 bp, Homo sapiens
taattgccagcttttat

SEQ ID NO: 3840652 - DNA, 20 bp, Homo sapiens
taatttaaaataaataaact

SEQ ID NO: 3840653 - DNA, 18 bp, Homo sapiens
taatttacgtcttgagaa

SEQ ID NO: 3840654 - DNA, 13 bp, Homo sapiens
taatttctcctcc

SEQ ID NO: 3840655 - DNA, 19 bp, Homo sapiens
taatttctcctcccttcct

SEQ ID NO: 3840656 - DNA, 17 bp, Homo sapiens
taattttaaaatgttta

SEQ ID NO: 3840657 - DNA, 18 bp, Homo sapiens
taattttgcaaatctgtt

SEQ ID NO: 3840658 - DNA, 14 bp, Homo sapiens
taattttgttttaa

SEQ ID NO: 3840659 - DNA, 16 bp, Homo sapiens
taattttgttttaatc

SEQ ID NO: 3840660 - DNA, 16 bp, Homo sapiens
tacaaaaattagctgg

SEQ ID NO: 3840661 - DNA, 18 bp, Homo sapiens
tacaaaaattagctgggt

SEQ ID NO: 3840662 - DNA, 12 bp, Homo sapiens
tacaaagaaact

SEQ ID NO: 3840663 - DNA, 15 bp, Homo sapiens
tacaaagaaactttt

SEQ ID NO: 3840664 - DNA, 20 bp, Homo sapiens
tacaagaaataaatctatat

SEQ ID NO: 3840665 - DNA, 18 bp, Homo sapiens
tacaatatatattttgtg

SEQ ID NO: 3840666 - DNA, 18 bp, Homo sapiens
tacaatgatttgtaaagg

SEQ ID NO: 3840667 - DNA, 9 bp, Homo sapiens
tacacacac

SEQ ID NO: 3840668 - DNA, 13 bp, Homo sapiens
tacacctggctga

SEQ ID NO: 3840669 - DNA, 14 bp, Homo sapiens
tacacctggctgag

SEQ ID NO: 3840670 - DNA, 12 bp, Homo sapiens
tacactcgaact

SEQ ID NO: 3840671 - DNA, 20 bp, Homo sapiens
tacagagtaacaaaaaataa

SEQ ID NO: 3840672 - DNA, 22 bp, Homo sapiens
tacagagtaacaaaaaataaag

SEQ ID NO: 3840673 - DNA, 13 bp, Homo sapiens
tacagtagtataa

SEQ ID NO: 3840674 - DNA, 14 bp, Homo sapiens
tacagtagtataat

SEQ ID NO: 3840675 - DNA, 15 bp, Homo sapiens
tacagtagtataatg

SEQ ID NO: 3840676 - DNA, 19 bp, Homo sapiens
tacagtagtataatgtatg

SEQ ID NO: 3840677 - DNA, 17 bp, Homo sapiens
tacagtttgtttacaca

SEQ ID NO: 3840678 - DNA, 22 bp, Homo sapiens
tacatagcatttgtgtaaagac

SEQ ID NO: 3840679 - DNA, 19 bp, Homo sapiens
tacatataagtgattgctg

SEQ ID NO: 3840680 - DNA, 16 bp, Homo sapiens
tacatattacaagaaa

SEQ ID NO: 3840681 - DNA, 14 bp, Homo sapiens
tacatgaagatttg

SEQ ID NO: 3840682 - DNA, 14 bp, Homo sapiens
tacatgtaaaatct

SEQ ID NO: 3840683 - DNA, 15 bp, Homo sapiens
tacatgtaaaatctt

SEQ ID NO: 3840684 - DNA, 17 bp, Homo sapiens
taccaaatgctttaaaa

SEQ ID NO: 3840685 - DNA, 20 bp, Homo sapiens
taccaaatgctttaaaaact

SEQ ID NO: 3840686 - DNA, 20 bp, Homo sapiens
taccaagtaagacatctcaa

SEQ ID NO: 3840687 - DNA, 14 bp, Homo sapiens
taccagctgcgctt

SEQ ID NO: 3840688 - DNA, 21 bp, Homo sapiens
taccagctgcgcttgcttttc

SEQ ID NO: 3840689 - DNA, 22 bp, Homo sapiens
tacccaaggatttttaaaactc

SEQ ID NO: 3840690 - DNA, 19 bp, Homo sapiens
tacccagtccccattttct

SEQ ID NO: 3840691 - DNA, 17 bp, Homo sapiens
taccgagagccaaacag

SEQ ID NO: 3840692 - DNA, 21 bp, Homo sapiens
tacctctgacatcaagtgtaa

SEQ ID NO: 3840693 - DNA, 18 bp, Homo sapiens
taccttagcttcactcag

SEQ ID NO: 3840694 - DNA, 20 bp, Homo sapiens
taccttccagtcaggatgac

SEQ ID NO: 3840695 - DNA, 21 bp, Homo sapiens
tacgaattatttttttaaact

SEQ ID NO: 3840696 - DNA, 18 bp, Homo sapiens
tactagaacacagaaagc

SEQ ID NO: 3840697 - DNA, 18 bp, Homo sapiens
tactatagttatatagat

SEQ ID NO: 3840698 - DNA, 21 bp, Homo sapiens
tactatagttatatagataaa

SEQ ID NO: 3840699 - DNA, 23 bp, Homo sapiens
tactcgcaggggcgctggctgca

SEQ ID NO: 3840700 - DNA, 20 bp, Homo sapiens
tactctttcatgccatttta

SEQ ID NO: 3840701 - DNA, 14 bp, Homo sapiens
tactgaaggaaaaa

SEQ ID NO: 3840702 - DNA, 19 bp, Homo sapiens
tactgaaggaaaaacacaa

SEQ ID NO: 3840703 - DNA, 20 bp, Homo sapiens
tactgagttcttacttgagt

SEQ ID NO: 3840704 - DNA, 10 bp, Homo sapiens
tactgcaggg

SEQ ID NO: 3840705 - DNA, 19 bp, Homo sapiens
tactgccaaaaccaaattg

SEQ ID NO: 3840706 - DNA, 20 bp, Homo sapiens
tactgccaaaaccaaattga

SEQ ID NO: 3840707 - DNA, 14 bp, Homo sapiens
tactgcccctgccc

SEQ ID NO: 3840708 - DNA, 19 bp, Homo sapiens
tactgcccctgccctgagg

SEQ ID NO: 3840709 - DNA, 21 bp, Homo sapiens
tactgcccctgccctgaggag

SEQ ID NO: 3840710 - DNA, 23 bp, Homo sapiens
tactgtgtatctcaataaagcac

SEQ ID NO: 3840711 - DNA, 16 bp, Homo sapiens
tacttgagtatcataa

SEQ ID NO: 3840712 - DNA, 18 bp, Homo sapiens
tacttgagtatcataata

SEQ ID NO: 3840713 - DNA, 12 bp, Homo sapiens
tacttgctctgg

SEQ ID NO: 3840714 - DNA, 16 bp, Homo sapiens
tacttgctctggacct

SEQ ID NO: 3840715 - DNA, 17 bp, Homo sapiens
tacttgctctggacctg

SEQ ID NO: 3840716 - DNA, 20 bp, Homo sapiens
tacttgctctggacctgccc

SEQ ID NO: 3840717 - DNA, 22 bp, Homo sapiens
tacttgctctggacctgccccc

SEQ ID NO: 3840718 - DNA, 23 bp, Homo sapiens
tcctcactgctccctgaagccag

SEQ ID NO: 3840719 - DNA, 13 bp, Homo sapiens
tcctcactggcca

SEQ ID NO: 3840720 - DNA, 22 bp, Homo sapiens
tcctcactggccatccctcgtg

SEQ ID NO: 3840721 - DNA, 21 bp, Homo sapiens
tcctccccaaatcaatacact

SEQ ID NO: 3840722 - DNA, 14 bp, Homo sapiens
tcctcccctcacag

SEQ ID NO: 3840723 - DNA, 18 bp, Homo sapiens
tcctcccctcacagcctc

SEQ ID NO: 3840724 - DNA, 17 bp, Homo sapiens
tcctcccttccttttcc

SEQ ID NO: 3840725 - DNA, 18 bp, Homo sapiens
tcctcccttccttttccc

SEQ ID NO: 3840726 - DNA, 12 bp, Homo sapiens
tcctcctcacct

SEQ ID NO: 3840727 - DNA, 16 bp, Homo sapiens
tcctcctcacctcatg

SEQ ID NO: 3840728 - DNA, 18 bp, Homo sapiens
tcctcctcacctcatgcc

SEQ ID NO: 3840729 - DNA, 14 bp, Homo sapiens
tcctctaatgttgt

SEQ ID NO: 3840730 - DNA, 17 bp, Homo sapiens
tcctctagaagccaagg

SEQ ID NO: 3840731 - DNA, 13 bp, Homo sapiens
tcctctgcctgcc

SEQ ID NO: 3840732 - DNA, 17 bp, Homo sapiens
tcctctggacggcaggc

SEQ ID NO: 3840733 - DNA, 16 bp, Homo sapiens
tcctgagggtcctgct

SEQ ID NO: 3840734 - DNA, 21 bp, Homo sapiens
tcctgataattgtgcacacct

SEQ ID NO: 3840735 - DNA, 20 bp, Homo sapiens
tcctgcccgccctccctcct

SEQ ID NO: 3840736 - DNA, 23 bp, Homo sapiens
tcctgcctactgcccctgccctg

SEQ ID NO: 3840737 - DNA, 13 bp, Homo sapiens
tcctgcgtcctcc

SEQ ID NO: 3840738 - DNA, 14 bp, Homo sapiens
tcctgcgtcctcct

SEQ ID NO: 3840739 - DNA, 18 bp, Homo sapiens
tcctgcgtcctcctcacc

SEQ ID NO: 3840740 - DNA, 21 bp, Homo sapiens
tcctgcgtcctcctcacctca

SEQ ID NO: 3840741 - DNA, 18 bp, Homo sapiens
tcctgctagcacctcccc

SEQ ID NO: 3840742 - DNA, 13 bp, Homo sapiens
tcctgctgcatga

SEQ ID NO: 3840743 - DNA, 16 bp, Homo sapiens
tcctgggcaccccagg

SEQ ID NO: 3840744 - DNA, 18 bp, Homo sapiens
tcctgggggatgcaaata

SEQ ID NO: 3840745 - DNA, 17 bp, Homo sapiens
tcctggggttggggagg

SEQ ID NO: 3840746 - DNA, 17 bp, Homo sapiens
tccttagcctgggcctc

SEQ ID NO: 3840747 - DNA, 23 bp, Homo sapiens
tccttagtatcagtcatgacaga

SEQ ID NO: 3840748 - DNA, 22 bp, Homo sapiens
tccttcaccaaagatctgctcc

SEQ ID NO: 3840749 - DNA, 16 bp, Homo sapiens
tccttcataattttca

SEQ ID NO: 3840750 - DNA, 18 bp, Homo sapiens
tccttcataattttcaaa

SEQ ID NO: 3840751 - DNA, 13 bp, Homo sapiens
tccttccctaccc

SEQ ID NO: 3840752 - DNA, 18 bp, Homo sapiens
tccttccctgtgtctttt

SEQ ID NO: 3840753 - DNA, 18 bp, Homo sapiens
tccttctgcctgagcttc

SEQ ID NO: 3840754 - DNA, 18 bp, Homo sapiens
tccttgggaggaagcaga

SEQ ID NO: 3840755 - DNA, 20 bp, Homo sapiens
tccttgggaggaagcagaat

SEQ ID NO: 3840756 - DNA, 23 bp, Homo sapiens
tccttgggaggaagcagaataaa

SEQ ID NO: 3840757 - DNA, 18 bp, Homo sapiens
tcctttataattctttct

SEQ ID NO: 3840758 - DNA, 13 bp, Homo sapiens
tcctttccccagc

SEQ ID NO: 3840759 - DNA, 15 bp, Homo sapiens
tcctttccccagccc

SEQ ID NO: 3840760 - DNA, 18 bp, Homo sapiens
tcctttccccagcccagg

SEQ ID NO: 3840761 - DNA, 15 bp, Homo sapiens
tcctttgctagtgtc

SEQ ID NO: 3840762 - DNA, 21 bp, Homo sapiens
tcctttgctagtgtctttgtc

SEQ ID NO: 3840763 - DNA, 23 bp, Homo sapiens
tcctttgctagtgtctttgtcat

SEQ ID NO: 3840764 - DNA, 22 bp, Homo sapiens
tccttttggcgtgatatccata

SEQ ID NO: 3840765 - DNA, 17 bp, Homo sapiens
tcgaatactttgaatgt

SEQ ID NO: 3840766 - DNA, 18 bp, Homo sapiens
tcgacctgatttacagtt

SEQ ID NO: 3840767 - DNA, 19 bp, Homo sapiens
tcgacctgatttacagttt

SEQ ID NO: 3840768 - DNA, 18 bp, Homo sapiens
tcgccaacttgtctctgt

SEQ ID NO: 3840769 - DNA, 16 bp, Homo sapiens
tcgccagctgatgact

SEQ ID NO: 3840770 - DNA, 20 bp, Homo sapiens
tcgctctctgtctccaggca

SEQ ID NO: 3840771 - DNA, 11 bp, Homo sapiens
tcgctgctgcg

SEQ ID NO: 3840772 - DNA, 15 bp, Homo sapiens
tcggccacaccccag

SEQ ID NO: 3840773 - DNA, 17 bp, Homo sapiens
tcggccacaccccagac

SEQ ID NO: 3840774 - DNA, 20 bp, Homo sapiens
tcggccacaccccagactcc

SEQ ID NO: 3840775 - DNA, 19 bp, Homo sapiens
tcggctttgggcttttatt

SEQ ID NO: 3840776 - DNA, 16 bp, Homo sapiens
tcgggaacctcactct

SEQ ID NO: 3840777 - DNA, 14 bp, Homo sapiens
tcggggcccccatc

SEQ ID NO: 3840778 - DNA, 14 bp, Homo sapiens
tcggggctccccac

SEQ ID NO: 3840779 - DNA, 13 bp, Homo sapiens
tcgtaaaattaag

SEQ ID NO: 3840780 - DNA, 22 bp, Homo sapiens
tcgttttcaaaattgttacaaa

SEQ ID NO: 3840781 - DNA, 21 bp, Homo sapiens
tctaaaatcagaggtaaatag

SEQ ID NO: 3840782 - DNA, 16 bp, Homo sapiens
tctaaattctttcatg

SEQ ID NO: 3840783 - DNA, 13 bp, Homo sapiens
tctaacaaatgat

SEQ ID NO: 3840784 - DNA, 18 bp, Homo sapiens
tctaagatgaatccaaat

SEQ ID NO: 3840785 - DNA, 15 bp, Homo sapiens
tctaaggtaacaaat

SEQ ID NO: 3840786 - DNA, 22 bp, Homo sapiens
tctaatatttattgctttataa

SEQ ID NO: 3840787 - DNA, 16 bp, Homo sapiens
tctaatgatggcccat

SEQ ID NO: 3840788 - DNA, 23 bp, Homo sapiens
tctaatgatggcccattctactt

SEQ ID NO: 3840789 - DNA, 11 bp, Homo sapiens
tctacaaattt

SEQ ID NO: 3840790 - DNA, 13 bp, Homo sapiens
tctacagtggttt

SEQ ID NO: 3840791 - DNA, 21 bp, Homo sapiens
tctacagtggttttatactga

SEQ ID NO: 3840792 - DNA, 23 bp, Homo sapiens
tctacagtggttttatactgaag

SEQ ID NO: 3840793 - DNA, 20 bp, Homo sapiens
tctacttgctctggacctgc

SEQ ID NO: 3840794 - DNA, 21 bp, Homo sapiens
tctacttgctctggacctgcc

SEQ ID NO: 3840795 - DNA, 14 bp, Homo sapiens
tctagaatggattt

SEQ ID NO: 3840796 - DNA, 18 bp, Homo sapiens
tctaggcagaagaagctg

SEQ ID NO: 3840797 - DNA, 23 bp, Homo sapiens
tctaggcagaagaagctgggagg

SEQ ID NO: 3840798 - DNA, 16 bp, Homo sapiens
tctataagtatataaa

SEQ ID NO: 3840799 - DNA, 18 bp, Homo sapiens
tctatatgtctataagta

SEQ ID NO: 3840800 - DNA, 16 bp, Homo sapiens
tctatatttttgtgaa

SEQ ID NO: 3840801 - DNA, 12 bp, Homo sapiens
tctatctcatct

SEQ ID NO: 3840802 - DNA, 14 bp, Homo sapiens
tctatgcaattgta

SEQ ID NO: 3840803 - DNA, 16 bp, Homo sapiens
tctatgcaattgtaca

SEQ ID NO: 3840804 - DNA, 20 bp, Homo sapiens
tctcaaatacagtagtataa

SEQ ID NO: 3840805 - DNA, 20 bp, Homo sapiens
tctcagcatgtagggcttct

SEQ ID NO: 3840806 - DNA, 13 bp, Homo sapiens
tctcaggacgacg

SEQ ID NO: 3840807 - DNA, 17 bp, Homo sapiens
tctcatctcctttgcta

SEQ ID NO: 3840808 - DNA, 15 bp, Homo sapiens
tctcatgaagccctt

SEQ ID NO: 3840809 - DNA, 17 bp, Homo sapiens
tctcatgaagcccttag

SEQ ID NO: 3840810 - DNA, 21 bp, Homo sapiens
tctcatggtgaaatctgctct

SEQ ID NO: 3840811 - DNA, 18 bp, Homo sapiens
tctcccaggggctggctt

SEQ ID NO: 3840812 - DNA, 22 bp, Homo sapiens
tctcccatggctttgtgctgct

SEQ ID NO: 3840813 - DNA, 20 bp, Homo sapiens
tctccgccagcctcctctgg

SEQ ID NO: 3840814 - DNA, 15 bp, Homo sapiens
tctcctcagcttggg

SEQ ID NO: 3840815 - DNA, 13 bp, Homo sapiens
tctcctcccttcc

SEQ ID NO: 3840816 - DNA, 23 bp, Homo sapiens
tctcctcccttccttttccctgc

SEQ ID NO: 3840817 - DNA, 16 bp, Homo sapiens
tctcctgccctgccct

SEQ ID NO: 3840818 - DNA, 13 bp, Homo sapiens
tctccttcctcag

SEQ ID NO: 3840819 - DNA, 19 bp, Homo sapiens
tctcctttcaccaccccct

SEQ ID NO: 3840820 - DNA, 19 bp, Homo sapiens
tctcctttgctagtgtctt

SEQ ID NO: 3840821 - DNA, 16 bp, Homo sapiens
tctcggggcctgtgcc

SEQ ID NO: 3840822 - DNA, 19 bp, Homo sapiens
tctctaagatgaatccaaa

SEQ ID NO: 3840823 - DNA, 17 bp, Homo sapiens
tctctccatctaccttc

SEQ ID NO: 3840824 - DNA, 18 bp, Homo sapiens
tctctcgaatactttgaa

SEQ ID NO: 3840825 - DNA, 15 bp, Homo sapiens
tctctcgtgagtata

SEQ ID NO: 3840826 - DNA, 15 bp, Homo sapiens
tctctctcttagcat

SEQ ID NO: 3840827 - DNA, 15 bp, Homo sapiens
tctctggaatttgaa

SEQ ID NO: 3840828 - DNA, 12 bp, Homo sapiens
tctctgtaatta

SEQ ID NO: 3840829 - DNA, 16 bp, Homo sapiens
tctctgtctccaggca

SEQ ID NO: 3840830 - DNA, 23 bp, Homo sapiens
tctctttggggagagctggcagt

SEQ ID NO: 3840831 - DNA, 24 bp, Homo sapiens
tctctttggggagagctggcagtg

SEQ ID NO: 3840832 - DNA, 20 bp, Homo sapiens
tctgaaggattttaaatgct

SEQ ID NO: 3840833 - DNA, 21 bp, Homo sapiens
tctgaccttgtgaacatcaga

SEQ ID NO: 3840834 - DNA, 15 bp, Homo sapiens
tctgaggctcagccc

SEQ ID NO: 3840835 - DNA, 18 bp, Homo sapiens
tctgcaccccttctctcc

SEQ ID NO: 3840836 - DNA, 19 bp, Homo sapiens
tctgcaccccttctctcct

SEQ ID NO: 3840837 - DNA, 21 bp, Homo sapiens
tctgcaccccttctctcctcc

SEQ ID NO: 3840838 - DNA, 22 bp, Homo sapiens
tctgcaggattgattatgcaga

SEQ ID NO: 3840839 - DNA, 15 bp, Homo sapiens
tctgcggaccccagc

SEQ ID NO: 3840840 - DNA, 14 bp, Homo sapiens
tctgctctcagctt

SEQ ID NO: 3840841 - DNA, 20 bp, Homo sapiens
tctgctctcagcttgtgcct

SEQ ID NO: 3840842 - DNA, 15 bp, Homo sapiens
tctgcttttctgccc

SEQ ID NO: 3840843 - DNA, 17 bp, Homo sapiens
tctgcttttctgccctg

SEQ ID NO: 3840844 - DNA, 18 bp, Homo sapiens
tctgcttttctgccctgg

SEQ ID NO: 3840845 - DNA, 20 bp, Homo sapiens
tctgcttttctgccctggct

SEQ ID NO: 3840846 - DNA, 19 bp, Homo sapiens
tctggaaaactcaggattc

SEQ ID NO: 3840847 - DNA, 20 bp, Homo sapiens
tctggaacgctctaggcaga

SEQ ID NO: 3840848 - DNA, 22 bp, Homo sapiens
tctggacggcaggctcactgcc

SEQ ID NO: 3840849 - DNA, 15 bp, Homo sapiens
tctggagacagcccc

SEQ ID NO: 3840850 - DNA, 16 bp, Homo sapiens
tgcctgagaggcaggc

SEQ ID NO: 3840851 - DNA, 14 bp, Homo sapiens
tgcctgagccccct

SEQ ID NO: 3840852 - DNA, 12 bp, Homo sapiens
tgcctgccccca

SEQ ID NO: 3840853 - DNA, 17 bp, Homo sapiens
tgcctgccccgccccca

SEQ ID NO: 3840854 - DNA, 14 bp, Homo sapiens
tgcctgctgctgcc

SEQ ID NO: 3840855 - DNA, 22 bp, Homo sapiens
tgcctgctttttatggcctgtg

SEQ ID NO: 3840856 - DNA, 22 bp, Homo sapiens
tgcctgggaggagtggccctga

SEQ ID NO: 3840857 - DNA, 14 bp, Homo sapiens
tgcctggttttgat

SEQ ID NO: 3840858 - DNA, 18 bp, Homo sapiens
tgcctgttgcaggcaaat

SEQ ID NO: 3840859 - DNA, 15 bp, Homo sapiens
tgccttaaaaccaaa

SEQ ID NO: 3840860 - DNA, 23 bp, Homo sapiens
tgccttactattgtattatagta

SEQ ID NO: 3840861 - DNA, 15 bp, Homo sapiens
tgccttagagccagg

SEQ ID NO: 3840862 - DNA, 17 bp, Homo sapiens
tgccttagagccaggca

SEQ ID NO: 3840863 - DNA, 18 bp, Homo sapiens
tgccttagagccaggcac

SEQ ID NO: 3840864 - DNA, 23 bp, Homo sapiens
tgccttagagccaggcacacact

SEQ ID NO: 3840865 - DNA, 16 bp, Homo sapiens
tgccttcagatgttct

SEQ ID NO: 3840866 - DNA, 16 bp, Homo sapiens
tgccttccctagcttt

SEQ ID NO: 3840867 - DNA, 11 bp, Homo sapiens
tgcgaccacca

SEQ ID NO: 3840868 - DNA, 20 bp, Homo sapiens
tgcgaccaccaacacacagg

SEQ ID NO: 3840869 - DNA, 14 bp, Homo sapiens
tgcgccctgggctc

SEQ ID NO: 3840870 - DNA, 13 bp, Homo sapiens
tgcggaccccagc

SEQ ID NO: 3840871 - DNA, 22 bp, Homo sapiens
tgcggaccccagctgtgagcct

SEQ ID NO: 3840872 - DNA, 14 bp, Homo sapiens
tgcgtcctcctcac

SEQ ID NO: 3840873 - DNA, 16 bp, Homo sapiens
tgcgtcctcctcacct

SEQ ID NO: 3840874 - DNA, 19 bp, Homo sapiens
tgcgtcctcctcacctcat

SEQ ID NO: 3840875 - DNA, 14 bp, Homo sapiens
tgcgttattttctt

SEQ ID NO: 3840876 - DNA, 22 bp, Homo sapiens
tgcgttattttctttttccttt

SEQ ID NO: 3840877 - DNA, 21 bp, Homo sapiens
tgctaatataagtttctttgc

SEQ ID NO: 3840878 - DNA, 12 bp, Homo sapiens
tgctactaacag

SEQ ID NO: 3840879 - DNA, 14 bp, Homo sapiens
tgctagcacctccc

SEQ ID NO: 3840880 - DNA, 17 bp, Homo sapiens
tgctagcacctccccag

SEQ ID NO: 3840881 - DNA, 18 bp, Homo sapiens
tgctagcacctccccaga

SEQ ID NO: 3840882 - DNA, 21 bp, Homo sapiens
tgctatctgaactaattcatt

SEQ ID NO: 3840883 - DNA, 22 bp, Homo sapiens
tgctatctgaactaattcattt

SEQ ID NO: 3840884 - DNA, 18 bp, Homo sapiens
tgctattctttctgatgt

SEQ ID NO: 3840885 - DNA, 22 bp, Homo sapiens
tgctcactcggacgacgccctg

SEQ ID NO: 3840886 - DNA, 19 bp, Homo sapiens
tgctccctgaagccagcct

SEQ ID NO: 3840887 - DNA, 22 bp, Homo sapiens
tgctccctgaagccagccttct

SEQ ID NO: 3840888 - DNA, 14 bp, Homo sapiens
tgctcctccctccc

SEQ ID NO: 3840889 - DNA, 16 bp, Homo sapiens
tgctcctccctctgac

SEQ ID NO: 3840890 - DNA, 15 bp, Homo sapiens
tgctctggacctgcc

SEQ ID NO: 3840891 - DNA, 20 bp, Homo sapiens
tgctctggacctgcccccgc

SEQ ID NO: 3840892 - DNA, 20 bp, Homo sapiens
tgctgaagcttattaatgct

SEQ ID NO: 3840893 - DNA, 21 bp, Homo sapiens
tgctgaagcttattaatgcta

SEQ ID NO: 3840894 - DNA, 22 bp, Homo sapiens
tgctgaagcttattaatgctaa

SEQ ID NO: 3840895 - DNA, 18 bp, Homo sapiens
tgctgaccttcacccaga

SEQ ID NO: 3840896 - DNA, 19 bp, Homo sapiens
tgctgcaggggctctggag

SEQ ID NO: 3840897 - DNA, 20 bp, Homo sapiens
tgctgcatttggctggagcc

SEQ ID NO: 3840898 - DNA, 17 bp, Homo sapiens
tgctgcattttaagcat

SEQ ID NO: 3840899 - DNA, 19 bp, Homo sapiens
tgctgcattttaagcataa

SEQ ID NO: 3840900 - DNA, 22 bp, Homo sapiens
tgctgcccccaccccggggacc

SEQ ID NO: 3840901 - DNA, 17 bp, Homo sapiens
tgctgccttctggattc

SEQ ID NO: 3840902 - DNA, 19 bp, Homo sapiens
tgctgctcctccctctgac

SEQ ID NO: 3840903 - DNA, 22 bp, Homo sapiens
tgctgctcctccctctgaccca

SEQ ID NO: 3840904 - DNA, 18 bp, Homo sapiens
tgctgctgagtcgctctc

SEQ ID NO: 3840905 - DNA, 18 bp, Homo sapiens
tgctggagaagagaggag

SEQ ID NO: 3840906 - DNA, 22 bp, Homo sapiens
tgctggagaagagaggagagga

SEQ ID NO: 3840907 - DNA, 14 bp, Homo sapiens
tgctggagcctgtg

SEQ ID NO: 3840908 - DNA, 22 bp, Homo sapiens
tgctggagcctgtgtaacagct

SEQ ID NO: 3840909 - DNA, 23 bp, Homo sapiens
tgctggagcctgtgtaacagctc

SEQ ID NO: 3840910 - DNA, 17 bp, Homo sapiens
tgctggaggtgggagca

SEQ ID NO: 3840911 - DNA, 17 bp, Homo sapiens
tgctgggaggagggaga

SEQ ID NO: 3840912 - DNA, 20 bp, Homo sapiens
tgctggtgaccggcctggac

SEQ ID NO: 3840913 - DNA, 17 bp, Homo sapiens
tgctgtaataaatgtat

SEQ ID NO: 3840914 - DNA, 18 bp, Homo sapiens
tgctgtaataaatgtatt

SEQ ID NO: 3840915 - DNA, 17 bp, Homo sapiens
tgctgttcgcagcctca

SEQ ID NO: 3840916 - DNA, 23 bp, Homo sapiens
tgcttaacagttgctttggattc

SEQ ID NO: 3840917 - DNA, 16 bp, Homo sapiens
tgcttccaggaaactc

SEQ ID NO: 3840918 - DNA, 21 bp, Homo sapiens
tgcttgaacccaggaggtgga

SEQ ID NO: 3840919 - DNA, 17 bp, Homo sapiens
tgcttgaactgctgcca

SEQ ID NO: 3840920 - DNA, 22 bp, Homo sapiens
tgcttgaactgctgccaactcc

SEQ ID NO: 3840921 - DNA, 16 bp, Homo sapiens
tgcttgaagattcagg

SEQ ID NO: 3840922 - DNA, 20 bp, Homo sapiens
tgcttgaagattcaggcttg

SEQ ID NO: 3840923 - DNA, 23 bp, Homo sapiens
tgctttaaaaactatttaacttg

SEQ ID NO: 3840924 - DNA, 12 bp, Homo sapiens
tgctttataaaa

SEQ ID NO: 3840925 - DNA, 14 bp, Homo sapiens
tgctttataaaaaa

SEQ ID NO: 3840926 - DNA, 13 bp, Homo sapiens
tgctttctattgt

SEQ ID NO: 3840927 - DNA, 14 bp, Homo sapiens
tgctttgccccact

SEQ ID NO: 3840928 - DNA, 19 bp, Homo sapiens
tgctttgtagtttgcccag

SEQ ID NO: 3840929 - DNA, 20 bp, Homo sapiens
tgctttgtagtttgcccaga

SEQ ID NO: 3840930 - DNA, 18 bp, Homo sapiens
tgcttttctgccctggct

SEQ ID NO: 3840931 - DNA, 16 bp, Homo sapiens
tgctttttatggcctg

SEQ ID NO: 3840932 - DNA, 12 bp, Homo sapiens
tggaaaactaac

SEQ ID NO: 3840933 - DNA, 14 bp, Homo sapiens
tggaaaggggagag

SEQ ID NO: 3840934 - DNA, 17 bp, Homo sapiens
tggaaaggggagagcct

SEQ ID NO: 3840935 - DNA, 17 bp, Homo sapiens
tggaaatggggagctgg

SEQ ID NO: 3840936 - DNA, 12 bp, Homo sapiens
tggaagaaggga

SEQ ID NO: 3840937 - DNA, 13 bp, Homo sapiens
tggaagaagggag

SEQ ID NO: 3840938 - DNA, 19 bp, Homo sapiens
tggaagaagggagaagaaa

SEQ ID NO: 3840939 - DNA, 15 bp, Homo sapiens
tggaatgactgaaga

SEQ ID NO: 3840940 - DNA, 18 bp, Homo sapiens
tggaatgatgtatataaa

SEQ ID NO: 3840941 - DNA, 11 bp, Homo sapiens
tggacctgccc

SEQ ID NO: 3840942 - DNA, 16 bp, Homo sapiens
tggacgcagccacaca

SEQ ID NO: 3840943 - DNA, 18 bp, Homo sapiens
tggacgcagccacacagt

SEQ ID NO: 3840944 - DNA, 13 bp, Homo sapiens
tggacggcaggct

SEQ ID NO: 3840945 - DNA, 18 bp, Homo sapiens
tggacggcaggctcactg

SEQ ID NO: 3840946 - DNA, 21 bp, Homo sapiens
tggacggcaggctcactgcca

SEQ ID NO: 3840947 - DNA, 23 bp, Homo sapiens
tggactggacatgagagcccctt

SEQ ID NO: 3840948 - DNA, 21 bp, Homo sapiens
tggacttagaaagcaggggct

SEQ ID NO: 3840949 - DNA, 16 bp, Homo sapiens
tggagaagagaggaga

SEQ ID NO: 3840950 - DNA, 22 bp, Homo sapiens
tggagacagccccagagcaggg

SEQ ID NO: 3840951 - DNA, 22 bp, Homo sapiens
tggagagaaacaataaagagat

SEQ ID NO: 3840952 - DNA, 23 bp, Homo sapiens
tggagagtgggctgacatcaagt

SEQ ID NO: 3840953 - DNA, 20 bp, Homo sapiens
tggagagttgggggccagca

SEQ ID NO: 3840954 - DNA, 15 bp, Homo sapiens
tggagcaagccctga

SEQ ID NO: 3840955 - DNA, 12 bp, Homo sapiens
tggagcagagca

SEQ ID NO: 3840956 - DNA, 20 bp, Homo sapiens
tggagcagagcaagtctgca

SEQ ID NO: 3840957 - DNA, 13 bp, Homo sapiens
tggagcccaggcg

SEQ ID NO: 3840958 - DNA, 22 bp, Homo sapiens
tggagcccaggcgggagcggtg

SEQ ID NO: 3840959 - DNA, 12 bp, Homo sapiens
tggagcctgtgt

SEQ ID NO: 3840960 - DNA, 20 bp, Homo sapiens
tggagcctgtgtaacagctc

SEQ ID NO: 3840961 - DNA, 13 bp, Homo sapiens
tggaggggagctg

SEQ ID NO: 3840962 - DNA, 19 bp, Homo sapiens
tggaggggagctgctggcc

SEQ ID NO: 3840963 - DNA, 18 bp, Homo sapiens
tggaggggtgtggcagtg

SEQ ID NO: 3840964 - DNA, 19 bp, Homo sapiens
tggaggggtgtggcagtgg

SEQ ID NO: 3840965 - DNA, 20 bp, Homo sapiens
tggaggtgccagcaaagccc

SEQ ID NO: 3840966 - DNA, 17 bp, Homo sapiens
tggaggtgggagcagga

SEQ ID NO: 3840967 - DNA, 22 bp, Homo sapiens
tggaggttgaagccaagtgggg

SEQ ID NO: 3840968 - DNA, 15 bp, Homo sapiens
tggagtgccatggct

SEQ ID NO: 3840969 - DNA, 19 bp, Homo sapiens
tggagtgccatggctgggg

SEQ ID NO: 3840970 - DNA, 17 bp, Homo sapiens
tggatataaatatatat

SEQ ID NO: 3840971 - DNA, 15 bp, Homo sapiens
tggatgattgttcat

SEQ ID NO: 3840972 - DNA, 20 bp, Homo sapiens
tggatgggaggctcctggtg

SEQ ID NO: 3840973 - DNA, 16 bp, Homo sapiens
tggcaaaccccaaaga

SEQ ID NO: 3840974 - DNA, 21 bp, Homo sapiens
tggcacccaccgtggaggagg

SEQ ID NO: 3840975 - DNA, 22 bp, Homo sapiens
tggcacccaccgtggaggagga

SEQ ID NO: 3840976 - DNA, 14 bp, Homo sapiens
tggcagcataaagg

SEQ ID NO: 3840977 - DNA, 14 bp, Homo sapiens
tggcaggttttaca

SEQ ID NO: 3840978 - DNA, 14 bp, Homo sapiens
tggcagtgagtgag

SEQ ID NO: 3840979 - DNA, 19 bp, Homo sapiens
tggcagtgagtgagcctgg

SEQ ID NO: 3840980 - DNA, 21 bp, Homo sapiens
tggcagtgagtgagcctggct

SEQ ID NO: 3840981 - DNA, 23 bp, Homo sapiens
tggccaagcagggaggaagaagc

SEQ ID NO: 3840982 - DNA, 18 bp, Homo sapiens
ttgatagctaaataactt

SEQ ID NO: 3840983 - DNA, 17 bp, Homo sapiens
ttgatctgctcagccct

SEQ ID NO: 3840984 - DNA, 21 bp, Homo sapiens
ttgatctgctcagccctggag

SEQ ID NO: 3840985 - DNA, 18 bp, Homo sapiens
ttgattcaaatgttacaa

SEQ ID NO: 3840986 - DNA, 15 bp, Homo sapiens
ttgcaggcaaatgta

SEQ ID NO: 3840987 - DNA, 16 bp, Homo sapiens
ttgcagtgagctgaga

SEQ ID NO: 3840988 - DNA, 16 bp, Homo sapiens
ttgcattaaaagactg

SEQ ID NO: 3840989 - DNA, 18 bp, Homo sapiens
ttgcattttttaaaacaa

SEQ ID NO: 3840990 - DNA, 17 bp, Homo sapiens
ttgcatttttttccttt

SEQ ID NO: 3840991 - DNA, 19 bp, Homo sapiens
ttgccaagccctttgctgt

SEQ ID NO: 3840992 - DNA, 15 bp, Homo sapiens
ttgccaccccaaccc

SEQ ID NO: 3840993 - DNA, 21 bp, Homo sapiens
ttgccatttctttatatggaa

SEQ ID NO: 3840994 - DNA, 12 bp, Homo sapiens
ttgcccacttct

SEQ ID NO: 3840995 - DNA, 22 bp, Homo sapiens
ttgcctaaaattcggaatggtt

SEQ ID NO: 3840996 - DNA, 20 bp, Homo sapiens
ttgcctgggatatcacttca

SEQ ID NO: 3840997 - DNA, 15 bp, Homo sapiens
ttgcgaccaccaaca

SEQ ID NO: 3840998 - DNA, 20 bp, Homo sapiens
ttgcgaccaccaacacacag

SEQ ID NO: 3840999 - DNA, 22 bp, Homo sapiens
ttgcgaccaccaacacacagga

SEQ ID NO: 3841000 - DNA, 18 bp, Homo sapiens
ttgctatctgaactaatt

SEQ ID NO: 3841001 - DNA, 13 bp, Homo sapiens
ttggaaaaagtga

SEQ ID NO: 3841002 - DNA, 16 bp, Homo sapiens
ttggaaatggggagct

SEQ ID NO: 3841003 - DNA, 20 bp, Homo sapiens
ttggaaatggggagctggcc

SEQ ID NO: 3841004 - DNA, 22 bp, Homo sapiens
ttggagagtgggctgacatcaa

SEQ ID NO: 3841005 - DNA, 17 bp, Homo sapiens
ttggatcaagcagaaaa

SEQ ID NO: 3841006 - DNA, 17 bp, Homo sapiens
ttggatgattgttcata

SEQ ID NO: 3841007 - DNA, 20 bp, Homo sapiens
ttggcagtgagtgagcctgg

SEQ ID NO: 3841008 - DNA, 13 bp, Homo sapiens
ttggcctctgtct

SEQ ID NO: 3841009 - DNA, 14 bp, Homo sapiens
ttggcctctgtctc

SEQ ID NO: 3841010 - DNA, 13 bp, Homo sapiens
ttggcctgctgtg

SEQ ID NO: 3841011 - DNA, 12 bp, Homo sapiens
ttggctgctcag

SEQ ID NO: 3841012 - DNA, 22 bp, Homo sapiens
ttggctggagcccggtgttcag

SEQ ID NO: 3841013 - DNA, 14 bp, Homo sapiens
ttgggactagatca

SEQ ID NO: 3841014 - DNA, 15 bp, Homo sapiens
ttgggaggaagcaga

SEQ ID NO: 3841015 - DNA, 21 bp, Homo sapiens
ttgggaggaagcagaataaag

SEQ ID NO: 3841016 - DNA, 19 bp, Homo sapiens
ttgggctccgctgtgcccg

SEQ ID NO: 3841017 - DNA, 16 bp, Homo sapiens
ttgggcttttattttt

SEQ ID NO: 3841018 - DNA, 18 bp, Homo sapiens
ttggggatagtctggaaa

SEQ ID NO: 3841019 - DNA, 15 bp, Homo sapiens
ttggggcatttgtaa

SEQ ID NO: 3841020 - DNA, 14 bp, Homo sapiens
ttggtaaacctttt

SEQ ID NO: 3841021 - DNA, 15 bp, Homo sapiens
ttggtccaggaaatg

SEQ ID NO: 3841022 - DNA, 20 bp, Homo sapiens
ttggtgattaaggtcctgct

SEQ ID NO: 3841023 - DNA, 19 bp, Homo sapiens
ttgtaaatgctgtaaatat

SEQ ID NO: 3841024 - DNA, 20 bp, Homo sapiens
ttgtaaatgctgtaaatatt

SEQ ID NO: 3841025 - DNA, 15 bp, Homo sapiens
ttgtaaattatttta

SEQ ID NO: 3841026 - DNA, 19 bp, Homo sapiens
ttgtaagtaagtaagaaag

SEQ ID NO: 3841027 - DNA, 13 bp, Homo sapiens
ttgtaatattaaa

SEQ ID NO: 3841028 - DNA, 22 bp, Homo sapiens
ttgtacaaaaaagttataagaa

SEQ ID NO: 3841029 - DNA, 22 bp, Homo sapiens
ttgtagatgctattctttctga

SEQ ID NO: 3841030 - DNA, 15 bp, Homo sapiens
ttgtagtttgcccag

SEQ ID NO: 3841031 - DNA, 20 bp, Homo sapiens
ttgtataaggagctttgctc

SEQ ID NO: 3841032 - DNA, 21 bp, Homo sapiens
ttgtattcagagttgatggtt

SEQ ID NO: 3841033 - DNA, 21 bp, Homo sapiens
ttgtcatgcgtctctggccct

SEQ ID NO: 3841034 - DNA, 18 bp, Homo sapiens
ttgtcccatctctacccc

SEQ ID NO: 3841035 - DNA, 20 bp, Homo sapiens
ttgtcccatctctaccccct

SEQ ID NO: 3841036 - DNA, 15 bp, Homo sapiens
ttgtccccgtggtct

SEQ ID NO: 3841037 - DNA, 11 bp, Homo sapiens
ttgtctctgta

SEQ ID NO: 3841038 - DNA, 13 bp, Homo sapiens
ttgtctgaaggat

SEQ ID NO: 3841039 - DNA, 15 bp, Homo sapiens
ttgtctgaaggattt

SEQ ID NO: 3841040 - DNA, 11 bp, Homo sapiens
ttgtctgtgtg

SEQ ID NO: 3841041 - DNA, 14 bp, Homo sapiens
ttgtcttgcatttt

SEQ ID NO: 3841042 - DNA, 18 bp, Homo sapiens
ttgtgaaatttcatgaaa

SEQ ID NO: 3841043 - DNA, 17 bp, Homo sapiens
ttgtgactagtgctgaa

SEQ ID NO: 3841044 - DNA, 15 bp, Homo sapiens
ttgtgctgctgagtc

SEQ ID NO: 3841045 - DNA, 15 bp, Homo sapiens
ttgtgctttgtatca

SEQ ID NO: 3841046 - DNA, 19 bp, Homo sapiens
ttgtggatgggaggctcct

SEQ ID NO: 3841047 - DNA, 15 bp, Homo sapiens
ttgttactgttctga

SEQ ID NO: 3841048 - DNA, 20 bp, Homo sapiens
ttgttggcagcataaaggcc

SEQ ID NO: 3841049 - DNA, 11 bp, Homo sapiens
ttgtttgtgct

SEQ ID NO: 3841050 - DNA, 12 bp, Homo sapiens
ttgtttgtgctt

SEQ ID NO: 3841051 - DNA, 19 bp, Homo sapiens
ttgttttgttaacaatggc

SEQ ID NO: 3841052 - DNA, 14 bp, Homo sapiens
tttaaaaactattt

SEQ ID NO: 3841053 - DNA, 21 bp, Homo sapiens
tttaaaaactatttaacttga

SEQ ID NO: 3841054 - DNA, 23 bp, Homo sapiens
tttaaaaactatttaacttgagc

SEQ ID NO: 3841055 - DNA, 11 bp, Homo sapiens
tttaaaaattt

SEQ ID NO: 3841056 - DNA, 15 bp, Homo sapiens
tttaaaacaagaaag

SEQ ID NO: 3841057 - DNA, 20 bp, Homo sapiens
tttaaaacaagaaagtttcc

SEQ ID NO: 3841058 - DNA, 21 bp, Homo sapiens
tttaaaacaagaaagtttccc

SEQ ID NO: 3841059 - DNA, 22 bp, Homo sapiens
tttaaaacaagaaagtttcccc

SEQ ID NO: 3841060 - DNA, 19 bp, Homo sapiens
tttaaaacaaggggttact

SEQ ID NO: 3841061 - DNA, 15 bp, Homo sapiens
tttaaaataaataaa

SEQ ID NO: 3841062 - DNA, 21 bp, Homo sapiens
tttaaacttcagttttactgc

SEQ ID NO: 3841063 - DNA, 24 bp, Homo sapiens
tttaaatgcacagttctatttgct

SEQ ID NO: 3841064 - DNA, 14 bp, Homo sapiens
tttaaatgtggaat

SEQ ID NO: 3841065 - DNA, 23 bp, Homo sapiens
tttaactaatatttgtctgtgtg

SEQ ID NO: 3841066 - DNA, 13 bp, Homo sapiens
tttaactgagggc

SEQ ID NO: 3841067 - DNA, 12 bp, Homo sapiens
tttaacttgagc

SEQ ID NO: 3841068 - DNA, 18 bp, Homo sapiens
tttaagggaatgtgagca

SEQ ID NO: 3841069 - DNA, 13 bp, Homo sapiens
tttaataaagtat

SEQ ID NO: 3841070 - DNA, 15 bp, Homo sapiens
tttaatcattgcctg

SEQ ID NO: 3841071 - DNA, 14 bp, Homo sapiens
tttacaactcctga

SEQ ID NO: 3841072 - DNA, 12 bp, Homo sapiens
tttacaagaaat

SEQ ID NO: 3841073 - DNA, 16 bp, Homo sapiens
tttacaatgatttgta

SEQ ID NO: 3841074 - DNA, 16 bp, Homo sapiens
tttacacgtctatgca

SEQ ID NO: 3841075 - DNA, 19 bp, Homo sapiens
tttacacgtctatgcaatt

SEQ ID NO: 3841076 - DNA, 12 bp, Homo sapiens
tttactctttca

SEQ ID NO: 3841077 - DNA, 18 bp, Homo sapiens
tttactgaatgttagaag

SEQ ID NO: 3841078 - DNA, 13 bp, Homo sapiens
tttactgcatttt

SEQ ID NO: 3841079 - DNA, 14 bp, Homo sapiens
tttactgcattttc

SEQ ID NO: 3841080 - DNA, 17 bp, Homo sapiens
tttactgcattttcaca

SEQ ID NO: 3841081 - DNA, 20 bp, Homo sapiens
tttactgcattttcacaaca

SEQ ID NO: 3841082 - DNA, 21 bp, Homo sapiens
tttactgtgtatctcaataaa

SEQ ID NO: 3841083 - DNA, 13 bp, Homo sapiens
tttagatttaatg

SEQ ID NO: 3841084 - DNA, 20 bp, Homo sapiens
tttagctcaaacgtggcttt

SEQ ID NO: 3841085 - DNA, 20 bp, Homo sapiens
tttaggggtagaaaatgttt

SEQ ID NO: 3841086 - DNA, 16 bp, Homo sapiens
tttagtatctttttat

SEQ ID NO: 3841087 - DNA, 23 bp, Homo sapiens
tttagttaagcatgactttagat

SEQ ID NO: 3841088 - DNA, 23 bp, Homo sapiens
tttataaaaacccctaaaaacaa

SEQ ID NO: 3841089 - DNA, 19 bp, Homo sapiens
tttataactaatatggttt

SEQ ID NO: 3841090 - DNA, 21 bp, Homo sapiens
tttataatattcatacaacaa

SEQ ID NO: 3841091 - DNA, 16 bp, Homo sapiens
tttatactgaaggaaa

SEQ ID NO: 3841092 - DNA, 19 bp, Homo sapiens
tttatgggtacttttagat

SEQ ID NO: 3841093 - DNA, 18 bp, Homo sapiens
tttatgtgaacattccta

SEQ ID NO: 3841094 - DNA, 21 bp, Homo sapiens
tttattaagtatatttgtaaa

SEQ ID NO: 3841095 - DNA, 23 bp, Homo sapiens
tttattgctgcattttaagcata

SEQ ID NO: 3841096 - DNA, 14 bp, Homo sapiens
tttattgctttata

SEQ ID NO: 3841097 - DNA, 17 bp, Homo sapiens
tttattgggcaataaaa

SEQ ID NO: 3841098 - DNA, 13 bp, Homo sapiens
tttattttctaaa

SEQ ID NO: 3841099 - DNA, 17 bp, Homo sapiens
tttatttttttctgaat

SEQ ID NO: 3841100 - DNA, 22 bp, Homo sapiens
tttcaaaattgttacaaattgt

SEQ ID NO: 3841101 - DNA, 20 bp, Homo sapiens
tttcagacctttgtctgaag

SEQ ID NO: 3841102 - DNA, 12 bp, Homo sapiens
tttcataaatta

SEQ ID NO: 3841103 - DNA, 19 bp, Homo sapiens
tttcatcaatcattgtaca

SEQ ID NO: 3841104 - DNA, 21 bp, Homo sapiens
tttcatcaatcattgtacagt

SEQ ID NO: 3841105 - DNA, 14 bp, Homo sapiens
tttcatgctttgat

SEQ ID NO: 3841106 - DNA, 19 bp, Homo sapiens
tttcatgttatgcctgttg

SEQ ID NO: 3841107 - DNA, 12 bp, Homo sapiens
tttcattccctg

SEQ ID NO: 3841108 - DNA, 16 bp, Homo sapiens
tttcattctaaaatca

SEQ ID NO: 3841109 - DNA, 14 bp, Homo sapiens
tttcattttctgca

SEQ ID NO: 3841110 - DNA, 21 bp, Homo sapiens
tttcccaatattgagcagttc

SEQ ID NO: 3841111 - DNA, 23 bp, Homo sapiens
tttcccctaattttccagagaag

SEQ ID NO: 3841112 - DNA, 20 bp, Homo sapiens
tttcctaaatatattttaag

SEQ ID NO: 3841113 - DNA, 21 bp, Homo sapiens
tttccttcataattttcaaaa

SEQ ID NO: 3841114 - DNA, 21 bp, Homo sapiens
aaaaagaggagaaaagctcaa

SEQ ID NO: 3841115 - DNA, 18 bp, Homo sapiens
aaaaagccaccacacact

SEQ ID NO: 3841116 - DNA, 12 bp, Homo sapiens
aaaaagctttac

SEQ ID NO: 3841117 - DNA, 16 bp, Homo sapiens
aaaaagttataagaaa

SEQ ID NO: 3841118 - DNA, 15 bp, Homo sapiens
aaaaagttgtttata

SEQ ID NO: 3841119 - DNA, 20 bp, Homo sapiens
aaaaatttataacagttata

SEQ ID NO: 3841120 - DNA, 18 bp, Homo sapiens
aaaacaagaaagtttccc

SEQ ID NO: 3841121 - DNA, 18 bp, Homo sapiens
aaaacaaggggttacttt

SEQ ID NO: 3841122 - DNA, 13 bp, Homo sapiens
aaaaccaaagagg

SEQ ID NO: 3841123 - DNA, 22 bp, Homo sapiens
aaaaccaaagagggcttcctct

SEQ ID NO: 3841124 - DNA, 17 bp, Homo sapiens
aaaagattttgtgaaat

SEQ ID NO: 3841125 - DNA, 18 bp, Homo sapiens
aaaagcctgtttaagaga

SEQ ID NO: 3841126 - DNA, 13 bp, Homo sapiens
aaaagttataaga

SEQ ID NO: 3841127 - DNA, 14 bp, Homo sapiens
aaaagttataagaa

SEQ ID NO: 3841128 - DNA, 16 bp, Homo sapiens
aaaagttcgaaagaaa

SEQ ID NO: 3841129 - DNA, 11 bp, Homo sapiens
aaaagttgttt

SEQ ID NO: 3841130 - DNA, 23 bp, Homo sapiens
aaaatatttgcctccatgtagaa

SEQ ID NO: 3841131 - DNA, 20 bp, Homo sapiens
aaaatcaaaggggatatatg

SEQ ID NO: 3841132 - DNA, 21 bp, Homo sapiens
aaaatcttgatagctaaataa

SEQ ID NO: 3841133 - DNA, 23 bp, Homo sapiens
aaaatcttgatagctaaataact

SEQ ID NO: 3841134 - DNA, 11 bp, Homo sapiens
aaaatgagaaa

SEQ ID NO: 3841135 - DNA, 20 bp, Homo sapiens
aaaattaagaaaggataaag

SEQ ID NO: 3841136 - DNA, 16 bp, Homo sapiens
aaaattcggaatggtt

SEQ ID NO: 3841137 - DNA, 12 bp, Homo sapiens
aaaatttataac

SEQ ID NO: 3841138 - DNA, 19 bp, Homo sapiens
aaaatttttaatctttaat

SEQ ID NO: 3841139 - DNA, 14 bp, Homo sapiens
aaacaaaaaatgtg

SEQ ID NO: 3841140 - DNA, 14 bp, Homo sapiens
aaacaaacacacac

SEQ ID NO: 3841141 - DNA, 15 bp, Homo sapiens
aaacaaacacacaca

SEQ ID NO: 3841142 - DNA, 13 bp, Homo sapiens
aaacaaagaaatt

SEQ ID NO: 3841143 - DNA, 17 bp, Homo sapiens
aaacaacgcaaacctct

SEQ ID NO: 3841144 - DNA, 18 bp, Homo sapiens
aaacaagaaagtttcccc

SEQ ID NO: 3841145 - DNA, 15 bp, Homo sapiens
aaacactgtgtaagc

SEQ ID NO: 3841146 - DNA, 17 bp, Homo sapiens
aaacagagcccagggag

SEQ ID NO: 3841147 - DNA, 17 bp, Homo sapiens
aaaccaaagagggcttc

SEQ ID NO: 3841148 - DNA, 21 bp, Homo sapiens
aaacccaaagctctaaggtaa

SEQ ID NO: 3841149 - DNA, 20 bp, Homo sapiens
aaacctgaaatatattttaa

SEQ ID NO: 3841150 - DNA, 20 bp, Homo sapiens
aaaccttcagattaatgact

SEQ ID NO: 3841151 - DNA, 15 bp, Homo sapiens
aaactacaccacact

SEQ ID NO: 3841152 - DNA, 17 bp, Homo sapiens
aaactacaccacactaa

SEQ ID NO: 3841153 - DNA, 17 bp, Homo sapiens
aaactatttaacttgag

SEQ ID NO: 3841154 - DNA, 19 bp, Homo sapiens
aaactccacatctgcctta

SEQ ID NO: 3841155 - DNA, 23 bp, Homo sapiens
aaactggggcctgtgtagccagt

SEQ ID NO: 3841156 - DNA, 23 bp, Homo sapiens
aaactggttctacaaatttttac

SEQ ID NO: 3841157 - DNA, 17 bp, Homo sapiens
aaactgtaaatcataat

SEQ ID NO: 3841158 - DNA, 18 bp, Homo sapiens
aaactgtaaatcataatg

SEQ ID NO: 3841159 - DNA, 22 bp, Homo sapiens
aaactgtattgatgacagtagt

SEQ ID NO: 3841160 - DNA, 15 bp, Homo sapiens
aaacttcagttttac

SEQ ID NO: 3841161 - DNA, 19 bp, Homo sapiens
aaactttgggaaaaggtgt

SEQ ID NO: 3841162 - DNA, 20 bp, Homo sapiens
aaactttttaataaagtata

SEQ ID NO: 3841163 - DNA, 14 bp, Homo sapiens
aaactttttaatgg

SEQ ID NO: 3841164 - DNA, 17 bp, Homo sapiens
aaagacaaaatttagat

SEQ ID NO: 3841165 - DNA, 23 bp, Homo sapiens
aaagacctgctgtaataaatgta

SEQ ID NO: 3841166 - DNA, 19 bp, Homo sapiens
aaagaccttgtgtgtatgt

SEQ ID NO: 3841167 - DNA, 15 bp, Homo sapiens
aaagagggcttcctc

SEQ ID NO: 3841168 - DNA, 19 bp, Homo sapiens
aaagagggcttcctctaga

SEQ ID NO: 3841169 - DNA, 12 bp, Homo sapiens
aaagagtactct

SEQ ID NO: 3841170 - DNA, 17 bp, Homo sapiens
aaagagtactcttgttt

SEQ ID NO: 3841171 - DNA, 15 bp, Homo sapiens
aaagataagacttcc

SEQ ID NO: 3841172 - DNA, 18 bp, Homo sapiens
aaagatctgctcctcgct

SEQ ID NO: 3841173 - DNA, 20 bp, Homo sapiens
aaagatgcatgttactgcca

SEQ ID NO: 3841174 - DNA, 19 bp, Homo sapiens
aaagattttatgtgcttga

SEQ ID NO: 3841175 - DNA, 22 bp, Homo sapiens
aaagattttgtgaaatttcatg

SEQ ID NO: 3841176 - DNA, 12 bp, Homo sapiens
aaagcaattttc

SEQ ID NO: 3841177 - DNA, 16 bp, Homo sapiens
aaagcaattttccttg

SEQ ID NO: 3841178 - DNA, 17 bp, Homo sapiens
aaagcaggcagaactca

SEQ ID NO: 3841179 - DNA, 21 bp, Homo sapiens
aaagcaggggctacaagaggg

SEQ ID NO: 3841180 - DNA, 14 bp, Homo sapiens
aaagcatgttgtga

SEQ ID NO: 3841181 - DNA, 15 bp, Homo sapiens
aaagccccatgctgg

SEQ ID NO: 3841182 - DNA, 16 bp, Homo sapiens
aaagctaatactaata

SEQ ID NO: 3841183 - DNA, 19 bp, Homo sapiens
aaagctctaaggtaacaaa

SEQ ID NO: 3841184 - DNA, 15 bp, Homo sapiens
aaagcttctctctga

SEQ ID NO: 3841185 - DNA, 16 bp, Homo sapiens
aaagggactgagaaat

SEQ ID NO: 3841186 - DNA, 20 bp, Homo sapiens
aaagggactgagaaatttat

SEQ ID NO: 3841187 - DNA, 14 bp, Homo sapiens
aaagggagggtggc

SEQ ID NO: 3841188 - DNA, 20 bp, Homo sapiens
aaaggtgagtttgagctgcc

SEQ ID NO: 3841189 - DNA, 22 bp, Homo sapiens
aaaggtgagtttgagctgcctt

SEQ ID NO: 3841190 - DNA, 15 bp, Homo sapiens
aaaggtgtaaaacag

SEQ ID NO: 3841191 - DNA, 18 bp, Homo sapiens
aaaggttcatgcaaactt

SEQ ID NO: 3841192 - DNA, 18 bp, Homo sapiens
aaaggtttggaaaactaa

SEQ ID NO: 3841193 - DNA, 19 bp, Homo sapiens
aaaggtttggaaaactaac

SEQ ID NO: 3841194 - DNA, 14 bp, Homo sapiens
aaagtactagctaa

SEQ ID NO: 3841195 - DNA, 22 bp, Homo sapiens
aaagtctagaaaataatgcaaa

SEQ ID NO: 3841196 - DNA, 19 bp, Homo sapiens
aaagtctctggaatttgaa

SEQ ID NO: 3841197 - DNA, 14 bp, Homo sapiens
aaagtctctgggtc

SEQ ID NO: 3841198 - DNA, 23 bp, Homo sapiens
aaagtcttgtgactagtgctgaa

SEQ ID NO: 3841199 - DNA, 15 bp, Homo sapiens
aaagtgcactgtgtc

SEQ ID NO: 3841200 - DNA, 14 bp, Homo sapiens
aaagtgtgctttat

SEQ ID NO: 3841201 - DNA, 17 bp, Homo sapiens
aaagttggtaaaccttt

SEQ ID NO: 3841202 - DNA, 12 bp, Homo sapiens
aaagttgtttat

SEQ ID NO: 3841203 - DNA, 14 bp, Homo sapiens
aaagttgtttataa

SEQ ID NO: 3841204 - DNA, 18 bp, Homo sapiens
aaagttgtttataaaaac

SEQ ID NO: 3841205 - DNA, 15 bp, Homo sapiens
aaataaataaacttt

SEQ ID NO: 3841206 - DNA, 11 bp, Homo sapiens
aaataaatata

SEQ ID NO: 3841207 - DNA, 12 bp, Homo sapiens
aaataaatatat

SEQ ID NO: 3841208 - DNA, 13 bp, Homo sapiens
aaataaatatata

SEQ ID NO: 3841209 - DNA, 14 bp, Homo sapiens
aaataaatatatat

SEQ ID NO: 3841210 - DNA, 12 bp, Homo sapiens
aaataaatgttt

SEQ ID NO: 3841211 - DNA, 17 bp, Homo sapiens
aaataattttgttttaa

SEQ ID NO: 3841212 - DNA, 19 bp, Homo sapiens
aaatacagtagtataatgt

SEQ ID NO: 3841213 - DNA, 20 bp, Homo sapiens
aaatagagtgcataaataat

SEQ ID NO: 3841214 - DNA, 19 bp, Homo sapiens
aaatagtttaacactttct

SEQ ID NO: 3841215 - DNA, 20 bp, Homo sapiens
aaatatatataaatatatat

SEQ ID NO: 3841216 - DNA, 15 bp, Homo sapiens
aaatatatatatcct

SEQ ID NO: 3841217 - DNA, 17 bp, Homo sapiens
aaatatatctttgtaaa

SEQ ID NO: 3841218 - DNA, 19 bp, Homo sapiens
aaatatatctttgtaaatt

SEQ ID NO: 3841219 - DNA, 21 bp, Homo sapiens
aaatatatgccttactattgt

SEQ ID NO: 3841220 - DNA, 19 bp, Homo sapiens
aaatatattttaaatgtgg

SEQ ID NO: 3841221 - DNA, 22 bp, Homo sapiens
aaatatattttaagacgaaaca

SEQ ID NO: 3841222 - DNA, 16 bp, Homo sapiens
aaatatcattcagcaa

SEQ ID NO: 3841223 - DNA, 14 bp, Homo sapiens
aaatatgatttgca

SEQ ID NO: 3841224 - DNA, 15 bp, Homo sapiens
aaatcaatacactag

SEQ ID NO: 3841225 - DNA, 22 bp, Homo sapiens
aaatcaatacactagttgtttc

SEQ ID NO: 3841226 - DNA, 14 bp, Homo sapiens
aaatcaatcagaag

SEQ ID NO: 3841227 - DNA, 23 bp, Homo sapiens
aaatcagtgccccagatgtacat

SEQ ID NO: 3841228 - DNA, 17 bp, Homo sapiens
aaatcataatgtaactg

SEQ ID NO: 3841229 - DNA, 14 bp, Homo sapiens
aaatcatgtgcata

SEQ ID NO: 3841230 - DNA, 20 bp, Homo sapiens
aaatcccccgactccctccc

SEQ ID NO: 3841231 - DNA, 23 bp, Homo sapiens
aaatcccccgactccctccccag

SEQ ID NO: 3841232 - DNA, 13 bp, Homo sapiens
aaatgactactac

SEQ ID NO: 3841233 - DNA, 14 bp, Homo sapiens
aaatgagaaatcta

SEQ ID NO: 3841234 - DNA, 16 bp, Homo sapiens
aaatgagaaatctaaa

SEQ ID NO: 3841235 - DNA, 18 bp, Homo sapiens
aaatgctgtaaatatttc

SEQ ID NO: 3841236 - DNA, 22 bp, Homo sapiens
aaatgctttaaaaactatttaa

SEQ ID NO: 3841237 - DNA, 16 bp, Homo sapiens
aaatggggagctggcc

SEQ ID NO: 3841238 - DNA, 13 bp, Homo sapiens
aaatgtgaaagat

SEQ ID NO: 3841239 - DNA, 19 bp, Homo sapiens
aaatgtgaaagatgcatgt

SEQ ID NO: 3841240 - DNA, 23 bp, Homo sapiens
aaatgttttcccctaattttcca

SEQ ID NO: 3841241 - DNA, 22 bp, Homo sapiens
aaatgtttttttttaaagactt

SEQ ID NO: 3841242 - DNA, 14 bp, Homo sapiens
aaattaagaaagga

SEQ ID NO: 3841243 - DNA, 15 bp, Homo sapiens
aaattatcaagctaa

SEQ ID NO: 3841244 - DNA, 17 bp, Homo sapiens
aaattatcaagctaata

SEQ ID NO: 3841245 - DNA, 18 bp, Homo sapiens
aaattattttatgtcata

SEQ ID NO: 3841246 - DNA, 18 bp, Homo sapiens
aaattcgacctgatttac

SEQ ID NO: 3841247 - DNA, 23 bp, Homo sapiens
aaattcgacctgatttacagttt

SEQ ID NO: 3841248 - DNA, 11 bp, Homo sapiens
aaattcttttt

SEQ ID NO: 3841249 - DNA, 21 bp, Homo sapiens
aaattgattcaaatgttacaa

SEQ ID NO: 3841250 - DNA, 15 bp, Homo sapiens
aaatttagatttaat

SEQ ID NO: 3841251 - DNA, 15 bp, Homo sapiens
aaatttataacagtt

SEQ ID NO: 3841252 - DNA, 16 bp, Homo sapiens
aaatttataacagtta

SEQ ID NO: 3841253 - DNA, 13 bp, Homo sapiens
aaatttatacaaa

SEQ ID NO: 3841254 - DNA, 14 bp, Homo sapiens
aaattttaaatgca

SEQ ID NO: 3841255 - DNA, 17 bp, Homo sapiens
aacaaagaaattatgtg

SEQ ID NO: 3841256 - DNA, 19 bp, Homo sapiens
aacaacttccgttgctgcc

SEQ ID NO: 3841257 - DNA, 16 bp, Homo sapiens
aacaagaaagtttccc

SEQ ID NO: 3841258 - DNA, 13 bp, Homo sapiens
aacacaagcaaaa

SEQ ID NO: 3841259 - DNA, 16 bp, Homo sapiens
aacactgtaacattta

SEQ ID NO: 3841260 - DNA, 18 bp, Homo sapiens
aacagattataataaatt

SEQ ID NO: 3841261 - DNA, 14 bp, Homo sapiens
aacagctccttggg

SEQ ID NO: 3841262 - DNA, 18 bp, Homo sapiens
aacagctccttgggagga

SEQ ID NO: 3841263 - DNA, 16 bp, Homo sapiens
aacagttataaagaaa

SEQ ID NO: 3841264 - DNA, 23 bp, Homo sapiens
aacagttataaagaaagattgta

SEQ ID NO: 3841265 - DNA, 22 bp, Homo sapiens
aacatcaaacacggcttctcat

SEQ ID NO: 3841266 - DNA, 22 bp, Homo sapiens
aacatcacatggcatgttttgt

SEQ ID NO: 3841267 - DNA, 14 bp, Homo sapiens
aacatcctgctgca

SEQ ID NO: 3841268 - DNA, 15 bp, Homo sapiens
aacatgtccccttcc

SEQ ID NO: 3841269 - DNA, 18 bp, Homo sapiens
aacatgtgaatgaataca

SEQ ID NO: 3841270 - DNA, 16 bp, Homo sapiens
aacattattttaaaat

SEQ ID NO: 3841271 - DNA, 22 bp, Homo sapiens
aacatttaagggaatgtgagca

SEQ ID NO: 3841272 - DNA, 20 bp, Homo sapiens
aacatttgttctatagcttt

SEQ ID NO: 3841273 - DNA, 19 bp, Homo sapiens
aaccaaagagggcttcctc

SEQ ID NO: 3841274 - DNA, 18 bp, Homo sapiens
aaccaggagctgctcact

SEQ ID NO: 3841275 - DNA, 15 bp, Homo sapiens
aaccataaaaagctg

SEQ ID NO: 3841276 - DNA, 20 bp, Homo sapiens
aaccccgtctgctcctccct

SEQ ID NO: 3841277 - DNA, 13 bp, Homo sapiens
aacctcactcttg

SEQ ID NO: 3841278 - DNA, 16 bp, Homo sapiens
aacctcactcttgcca

SEQ ID NO: 3841279 - DNA, 13 bp, Homo sapiens
aacctctccttcc

SEQ ID NO: 3841280 - DNA, 20 bp, Homo sapiens
aacctgtaagcccagcattt

SEQ ID NO: 3841281 - DNA, 13 bp, Homo sapiens
aacctgtaataaa

SEQ ID NO: 3841282 - DNA, 16 bp, Homo sapiens
aacctgtaataaatat

SEQ ID NO: 3841283 - DNA, 20 bp, Homo sapiens
aaccttgtaaattccccttc

SEQ ID NO: 3841284 - DNA, 18 bp, Homo sapiens
aacgcaaacctctccttc

SEQ ID NO: 3841285 - DNA, 19 bp, Homo sapiens
aacgcaaacctctccttcc

SEQ ID NO: 3841286 - DNA, 21 bp, Homo sapiens
aacgcaaacctctccttcctc

SEQ ID NO: 3841287 - DNA, 14 bp, Homo sapiens
aacgcattttgggt

SEQ ID NO: 3841288 - DNA, 20 bp, Homo sapiens
aacgcattttgggttgttta

SEQ ID NO: 3841289 - DNA, 15 bp, Homo sapiens
aacgttgcgaaaatt

SEQ ID NO: 3841290 - DNA, 22 bp, Homo sapiens
aactaatatggttttgttttca

SEQ ID NO: 3841291 - DNA, 23 bp, Homo sapiens
aactaatatttgtctgtgtgcta

SEQ ID NO: 3841292 - DNA, 21 bp, Homo sapiens
aactaattcatttattaagta

SEQ ID NO: 3841293 - DNA, 14 bp, Homo sapiens
aactacatgtaaaa

SEQ ID NO: 3841294 - DNA, 23 bp, Homo sapiens
aactatttaacttgagctttaaa

SEQ ID NO: 3841295 - DNA, 23 bp, Homo sapiens
aactcaaagcaagctcttctcct

SEQ ID NO: 3841296 - DNA, 13 bp, Homo sapiens
aactcagatttaa

SEQ ID NO: 3841297 - DNA, 17 bp, Homo sapiens
aactccacatctgcctt

SEQ ID NO: 3841298 - DNA, 16 bp, Homo sapiens
aactccagctgagtcc

SEQ ID NO: 3841299 - DNA, 17 bp, Homo sapiens
aactccagctgagtcct

SEQ ID NO: 3841300 - DNA, 22 bp, Homo sapiens
aactccagctgagtcctggggt

SEQ ID NO: 3841301 - DNA, 16 bp, Homo sapiens
aactctgtgtgagaga

SEQ ID NO: 3841302 - DNA, 21 bp, Homo sapiens
aactctgtgtgagagagaggg

SEQ ID NO: 3841303 - DNA, 14 bp, Homo sapiens
aactgcgagtggct

SEQ ID NO: 3841304 - DNA, 20 bp, Homo sapiens
aactgggtggtttggttttt

SEQ ID NO: 3841305 - DNA, 19 bp, Homo sapiens
aactggttctacaaatttt

SEQ ID NO: 3841306 - DNA, 21 bp, Homo sapiens
aactggttctacaaattttta

SEQ ID NO: 3841307 - DNA, 22 bp, Homo sapiens
aacttgagctttaaaaatcatt

SEQ ID NO: 3841308 - DNA, 15 bp, Homo sapiens
aacttgccatttctt

SEQ ID NO: 3841309 - DNA, 17 bp, Homo sapiens
aacttgccatttcttta

SEQ ID NO: 3841310 - DNA, 18 bp, Homo sapiens
aacttgccatttctttat

SEQ ID NO: 3841311 - DNA, 20 bp, Homo sapiens
aacttgccatttctttatat

SEQ ID NO: 3841312 - DNA, 15 bp, Homo sapiens
aacttgtctctgtag

SEQ ID NO: 3841313 - DNA, 20 bp, Homo sapiens
aactttccactgacaacgaa

SEQ ID NO: 3841314 - DNA, 21 bp, Homo sapiens
aactttgaggcagcgcattgt

SEQ ID NO: 3841315 - DNA, 22 bp, Homo sapiens
aacttttattacggtgatcctt

SEQ ID NO: 3841316 - DNA, 19 bp, Homo sapiens
aactttttaataaagtata

SEQ ID NO: 3841317 - DNA, 21 bp, Homo sapiens
aactttttaataaagtatatt

SEQ ID NO: 3841318 - DNA, 17 bp, Homo sapiens
aactttttcattccctg

SEQ ID NO: 3841319 - DNA, 21 bp, Homo sapiens
aagaaactttttaataaagta

SEQ ID NO: 3841320 - DNA, 15 bp, Homo sapiens
aagaaagaagactgt

SEQ ID NO: 3841321 - DNA, 20 bp, Homo sapiens
aagaaagattgtaaactaaa

SEQ ID NO: 3841322 - DNA, 14 bp, Homo sapiens
aagaaagattttat

SEQ ID NO: 3841323 - DNA, 19 bp, Homo sapiens
aagaaagattttatgtgct

SEQ ID NO: 3841324 - DNA, 20 bp, Homo sapiens
aagaaagcacctgtttttac

SEQ ID NO: 3841325 - DNA, 15 bp, Homo sapiens
aagaaagtttcccca

SEQ ID NO: 3841326 - DNA, 23 bp, Homo sapiens
aagaaagtttccccaccagtgaa

SEQ ID NO: 3841327 - DNA, 22 bp, Homo sapiens
aagaaataaatctatatttttg

SEQ ID NO: 3841328 - DNA, 13 bp, Homo sapiens
aagaaattatgtg

SEQ ID NO: 3841329 - DNA, 15 bp, Homo sapiens
aagaaattttattag

SEQ ID NO: 3841330 - DNA, 12 bp, Homo sapiens
aagaactcctcc

SEQ ID NO: 3841331 - DNA, 16 bp, Homo sapiens
aagaagcttaggcagg

SEQ ID NO: 3841332 - DNA, 19 bp, Homo sapiens
aagaaggagcagaataaat

SEQ ID NO: 3841333 - DNA, 14 bp, Homo sapiens
aagaagggagaaga

SEQ ID NO: 3841334 - DNA, 15 bp, Homo sapiens
aagaagggagaagaa

SEQ ID NO: 3841335 - DNA, 17 bp, Homo sapiens
aagaagttcattcctgt

SEQ ID NO: 3841336 - DNA, 16 bp, Homo sapiens
aagaatttaaaaaagt

SEQ ID NO: 3841337 - DNA, 14 bp, Homo sapiens
aagacaggcacaaa

SEQ ID NO: 3841338 - DNA, 20 bp, Homo sapiens
aagacaggcacaaaatgtga

SEQ ID NO: 3841339 - DNA, 16 bp, Homo sapiens
aagactcctcggcctg

SEQ ID NO: 3841340 - DNA, 14 bp, Homo sapiens
aagagaagttattt

SEQ ID NO: 3841341 - DNA, 15 bp, Homo sapiens
aagaggaaaagctaa

SEQ ID NO: 3841342 - DNA, 18 bp, Homo sapiens
aagaggagaaaagctcaa

SEQ ID NO: 3841343 - DNA, 19 bp, Homo sapiens
aagaggagaaaagctcaag

SEQ ID NO: 3841344 - DNA, 21 bp, Homo sapiens
aagaggtgcctgggaggagtg

SEQ ID NO: 3841345 - DNA, 15 bp, Homo sapiens
aagagtttacaagaa

SEQ ID NO: 3841346 - DNA, 20 bp, Homo sapiens
aagagtttacaagaaataaa

SEQ ID NO: 3841347 - DNA, 18 bp, Homo sapiens
aagatgaatccaaatgtg

SEQ ID NO: 3841348 - DNA, 23 bp, Homo sapiens
aagatgaatccaaatgtgaaaga

SEQ ID NO: 3841349 - DNA, 15 bp, Homo sapiens
aagattcccaggagt

SEQ ID NO: 3841350 - DNA, 16 bp, Homo sapiens
aagattcccaggagtt

SEQ ID NO: 3841351 - DNA, 17 bp, Homo sapiens
aagattcccaggagttc

SEQ ID NO: 3841352 - DNA, 14 bp, Homo sapiens
aagatttggcagga

SEQ ID NO: 3841353 - DNA, 19 bp, Homo sapiens
aagatttggtttttgtctt

SEQ ID NO: 3841354 - DNA, 13 bp, Homo sapiens
aagattttatgtg

SEQ ID NO: 3841355 - DNA, 15 bp, Homo sapiens
aagattttatgtgct

SEQ ID NO: 3841356 - DNA, 14 bp, Homo sapiens
aagattttgtgaaa

SEQ ID NO: 3841357 - DNA, 18 bp, Homo sapiens
aagcaagctcttctcctc

SEQ ID NO: 3841358 - DNA, 12 bp, Homo sapiens
aagcaagtgaca

SEQ ID NO: 3841359 - DNA, 13 bp, Homo sapiens
aagcaattttcct

SEQ ID NO: 3841360 - DNA, 14 bp, Homo sapiens
aagcaattttcctt

SEQ ID NO: 3841361 - DNA, 16 bp, Homo sapiens
aagcaattttccttga

SEQ ID NO: 3841362 - DNA, 17 bp, Homo sapiens
aagcaattttccttgaa

SEQ ID NO: 3841363 - DNA, 18 bp, Homo sapiens
aagcaattttccttgaag

SEQ ID NO: 3841364 - DNA, 20 bp, Homo sapiens
aagcaattttccttgaagcc

SEQ ID NO: 3841365 - DNA, 21 bp, Homo sapiens
aagcaattttccttgaagccg

SEQ ID NO: 3841366 - DNA, 11 bp, Homo sapiens
aagcagaaaac

SEQ ID NO: 3841367 - DNA, 12 bp, Homo sapiens
aagcagaataaa

SEQ ID NO: 3841368 - DNA, 21 bp, Homo sapiens
aagcagaataaagcaattttc

SEQ ID NO: 3841369 - DNA, 15 bp, Homo sapiens
aagcagaattgcttg

SEQ ID NO: 3841370 - DNA, 12 bp, Homo sapiens
aagcagggagga

SEQ ID NO: 3841371 - DNA, 20 bp, Homo sapiens
aagcaggggctacaagaggg

SEQ ID NO: 3841372 - DNA, 18 bp, Homo sapiens
aagcagtttttgaaagac

SEQ ID NO: 3841373 - DNA, 15 bp, Homo sapiens
aagcataaacatcac

SEQ ID NO: 3841374 - DNA, 14 bp, Homo sapiens
aagcatagggtagt

SEQ ID NO: 3841375 - DNA, 13 bp, Homo sapiens
aagccaaagaaaa

SEQ ID NO: 3841376 - DNA, 15 bp, Homo sapiens
aagccaaagaaaaat

SEQ ID NO: 3841377 - DNA, 21 bp, Homo sapiens
aagccaaagaaaaataaccct

SEQ ID NO: 3841378 - DNA, 10 bp, Homo sapiens
aagccaaggg

SEQ ID NO: 3841379 - DNA, 19 bp, Homo sapiens
aagccaagtggggtgctgg

SEQ ID NO: 3841380 - DNA, 15 bp, Homo sapiens
aagccacacagccca

SEQ ID NO: 3841381 - DNA, 16 bp, Homo sapiens
aagccacacagcccag

SEQ ID NO: 3841382 - DNA, 21 bp, Homo sapiens
aagccaggcaggtagccaggg

SEQ ID NO: 3841383 - DNA, 18 bp, Homo sapiens
aagccccatgctggagcc

SEQ ID NO: 3841384 - DNA, 22 bp, Homo sapiens
aagccccatgctggagcctgtg

SEQ ID NO: 3841385 - DNA, 12 bp, Homo sapiens
aagccctttgct

SEQ ID NO: 3841386 - DNA, 21 bp, Homo sapiens
aagcctatcaaagaccttgtg

SEQ ID NO: 3841387 - DNA, 17 bp, Homo sapiens
aagcctctaacaaatga

SEQ ID NO: 3841388 - DNA, 18 bp, Homo sapiens
aagcctctaacaaatgat

SEQ ID NO: 3841389 - DNA, 19 bp, Homo sapiens
aagcctggacgcagccaca

SEQ ID NO: 3841390 - DNA, 21 bp, Homo sapiens
aagcctgtgtatcgtggagaa

SEQ ID NO: 3841391 - DNA, 15 bp, Homo sapiens
aagcctgtttaagag

SEQ ID NO: 3841392 - DNA, 17 bp, Homo sapiens
aagctatcgtaaaatta

SEQ ID NO: 3841393 - DNA, 17 bp, Homo sapiens
aagctgaccacaggcag

SEQ ID NO: 3841394 - DNA, 12 bp, Homo sapiens
aagctgctgtct

SEQ ID NO: 3841395 - DNA, 13 bp, Homo sapiens
aagctgggaggga

SEQ ID NO: 3841396 - DNA, 14 bp, Homo sapiens
aagctgggagggag

SEQ ID NO: 3841397 - DNA, 18 bp, Homo sapiens
aagctgggagggaggggg

SEQ ID NO: 3841398 - DNA, 13 bp, Homo sapiens
aagcttaggcagg

SEQ ID NO: 3841399 - DNA, 14 bp, Homo sapiens
aagcttattaatgc

SEQ ID NO: 3841400 - DNA, 18 bp, Homo sapiens
aagcttattaatgctaag

SEQ ID NO: 3841401 - DNA, 13 bp, Homo sapiens
aagcttctctctg

SEQ ID NO: 3841402 - DNA, 16 bp, Homo sapiens
aagcttctctctgagc

SEQ ID NO: 3841403 - DNA, 21 bp, Homo sapiens
aaggactatttataactaata

SEQ ID NO: 3841404 - DNA, 12 bp, Homo sapiens
aaggagagaaag

SEQ ID NO: 3841405 - DNA, 16 bp, Homo sapiens
aaggagagaaagtggg

SEQ ID NO: 3841406 - DNA, 21 bp, Homo sapiens
aaggataaagttggtaaacct

SEQ ID NO: 3841407 - DNA, 11 bp, Homo sapiens
aaggattttaa

SEQ ID NO: 3841408 - DNA, 20 bp, Homo sapiens
aaggcaaattgattcaaatg

SEQ ID NO: 3841409 - DNA, 15 bp, Homo sapiens
aaggcagccagatcc

SEQ ID NO: 3841410 - DNA, 19 bp, Homo sapiens
aaggccagaaaaggcagcc

SEQ ID NO: 3841411 - DNA, 19 bp, Homo sapiens
aaggccatggggcagcctc

SEQ ID NO: 3841412 - DNA, 22 bp, Homo sapiens
aaggccatggggcagcctccag

SEQ ID NO: 3841413 - DNA, 17 bp, Homo sapiens
aaggcccagctgccagg

SEQ ID NO: 3841414 - DNA, 13 bp, Homo sapiens
aaggccccctttc

SEQ ID NO: 3841415 - DNA, 14 bp, Homo sapiens
aaggccgagcccac

SEQ ID NO: 3841416 - DNA, 15 bp, Homo sapiens
aaggctgcaacgctg

SEQ ID NO: 3841417 - DNA, 13 bp, Homo sapiens
aaggctgtgccag

SEQ ID NO: 3841418 - DNA, 18 bp, Homo sapiens
aaggctgtgccaggctgg

SEQ ID NO: 3841419 - DNA, 20 bp, Homo sapiens
aagggacacaggagaccacc

SEQ ID NO: 3841420 - DNA, 11 bp, Homo sapiens
aagggagggtg

SEQ ID NO: 3841421 - DNA, 15 bp, Homo sapiens
aagggcagaggcaag

SEQ ID NO: 3841422 - DNA, 22 bp, Homo sapiens
aagggcagaggcaaggatggtg

SEQ ID NO: 3841423 - DNA, 22 bp, Homo sapiens
aagggcaggcccaaattatcaa

SEQ ID NO: 3841424 - DNA, 15 bp, Homo sapiens
aaggggagagcctgc

SEQ ID NO: 3841425 - DNA, 19 bp, Homo sapiens
aaggggagagcctgctggc

SEQ ID NO: 3841426 - DNA, 13 bp, Homo sapiens
aagggtggagagt

SEQ ID NO: 3841427 - DNA, 14 bp, Homo sapiens
aaggtactggtgag

SEQ ID NO: 3841428 - DNA, 22 bp, Homo sapiens
aaggtgagtttgagctgccttc

SEQ ID NO: 3841429 - DNA, 15 bp, Homo sapiens
aaggtgctggaggtg

SEQ ID NO: 3841430 - DNA, 20 bp, Homo sapiens
aaggtgctggaggtgggagc

SEQ ID NO: 3841431 - DNA, 12 bp, Homo sapiens
aaggtgtaaaac

SEQ ID NO: 3841432 - DNA, 13 bp, Homo sapiens
aaggtgtaaaaca

SEQ ID NO: 3841433 - DNA, 17 bp, Homo sapiens
aaggtgtttaagtaatt

SEQ ID NO: 3841434 - DNA, 13 bp, Homo sapiens
aaggttgtgtaca

SEQ ID NO: 3841435 - DNA, 20 bp, Homo sapiens
aagtaaaaacaaagaaatta

SEQ ID NO: 3841436 - DNA, 22 bp, Homo sapiens
aagtaaaaacaaagaaattatg

SEQ ID NO: 3841437 - DNA, 13 bp, Homo sapiens
aagtaaagtaaag

SEQ ID NO: 3841438 - DNA, 15 bp, Homo sapiens
aagtaagacatctca

SEQ ID NO: 3841439 - DNA, 17 bp, Homo sapiens
aagtaagtttcattcta

SEQ ID NO: 3841440 - DNA, 20 bp, Homo sapiens
aagtaccaggccgtttgctt

SEQ ID NO: 3841441 - DNA, 13 bp, Homo sapiens
aagtatataaata

SEQ ID NO: 3841442 - DNA, 14 bp, Homo sapiens
aagtatataaatac

SEQ ID NO: 3841443 - DNA, 22 bp, Homo sapiens
aagtatataaatactatagtta

SEQ ID NO: 3841444 - DNA, 13 bp, Homo sapiens
aagtatatttgta

SEQ ID NO: 3841445 - DNA, 13 bp, Homo sapiens
aagtattaaactg

SEQ ID NO: 3841446 - DNA, 20 bp, Homo sapiens
aagtattaaactgtaaatca

SEQ ID NO: 3841447 - DNA, 22 bp, Homo sapiens
aagtcgcttttggtgcctggct

SEQ ID NO: 3841448 - DNA, 23 bp, Homo sapiens
aagtcgcttttggtgcctggctg

SEQ ID NO: 3841449 - DNA, 13 bp, Homo sapiens
aagtctagaaaat

SEQ ID NO: 3841450 - DNA, 16 bp, Homo sapiens
aagtgaaattttaaat

SEQ ID NO: 3841451 - DNA, 13 bp, Homo sapiens
aagtgccatctca

SEQ ID NO: 3841452 - DNA, 17 bp, Homo sapiens
aagtgggaaagttgcat

SEQ ID NO: 3841453 - DNA, 19 bp, Homo sapiens
aagtgggtgagatgctgga

SEQ ID NO: 3841454 - DNA, 13 bp, Homo sapiens
aagtggttaagaa

SEQ ID NO: 3841455 - DNA, 11 bp, Homo sapiens
aagtgtaatta

SEQ ID NO: 3841456 - DNA, 19 bp, Homo sapiens
aagtgtcactccataaaaa

SEQ ID NO: 3841457 - DNA, 18 bp, Homo sapiens
aagtgtgctttataaaaa

SEQ ID NO: 3841458 - DNA, 19 bp, Homo sapiens
aagtgtgctttataaaaaa

SEQ ID NO: 3841459 - DNA, 12 bp, Homo sapiens
aagttataagaa

SEQ ID NO: 3841460 - DNA, 15 bp, Homo sapiens
aagttataagaaaac

SEQ ID NO: 3841461 - DNA, 18 bp, Homo sapiens
aagttattttctacagtg

SEQ ID NO: 3841462 - DNA, 15 bp, Homo sapiens
aagttcattcctgtc

SEQ ID NO: 3841463 - DNA, 15 bp, Homo sapiens
aagttcgaaagaaaa

SEQ ID NO: 3841464 - DNA, 16 bp, Homo sapiens
aagttgcatttaatgt

SEQ ID NO: 3841465 - DNA, 18 bp, Homo sapiens
aagttgcatttaatgtta

SEQ ID NO: 3841466 - DNA, 11 bp, Homo sapiens
aagttgtttat

SEQ ID NO: 3841467 - DNA, 15 bp, Homo sapiens
aagttgtttataaaa

SEQ ID NO: 3841468 - DNA, 13 bp, Homo sapiens
aagtttctatatg

SEQ ID NO: 3841469 - DNA, 16 bp, Homo sapiens
aagtttctttgcttca

SEQ ID NO: 3841470 - DNA, 22 bp, Homo sapiens
aataaaaagccaccacacactg

SEQ ID NO: 3841471 - DNA, 19 bp, Homo sapiens
aataaaatatcattcagca

SEQ ID NO: 3841472 - DNA, 20 bp, Homo sapiens
aataaaatatcattcagcaa

SEQ ID NO: 3841473 - DNA, 12 bp, Homo sapiens
aataaagcaatt

SEQ ID NO: 3841474 - DNA, 22 bp, Homo sapiens
aataaagcacgcagttatgtta

SEQ ID NO: 3841475 - DNA, 13 bp, Homo sapiens
aataaagcctgct

SEQ ID NO: 3841476 - DNA, 17 bp, Homo sapiens
aataaagcttctctctg

SEQ ID NO: 3841477 - DNA, 14 bp, Homo sapiens
aataaataaacttt

SEQ ID NO: 3841478 - DNA, 12 bp, Homo sapiens
aataaatatata

SEQ ID NO: 3841479 - DNA, 15 bp, Homo sapiens
aataaatatatatat

SEQ ID NO: 3841480 - DNA, 11 bp, Homo sapiens
aataaatatga

SEQ ID NO: 3841481 - DNA, 18 bp, Homo sapiens
aataaatgtattaactga

SEQ ID NO: 3841482 - DNA, 15 bp, Homo sapiens
aataaatgttttaca

SEQ ID NO: 3841483 - DNA, 14 bp, Homo sapiens
aataacttgccatt

SEQ ID NO: 3841484 - DNA, 14 bp, Homo sapiens
aataatgcaaatgt

SEQ ID NO: 3841485 - DNA, 15 bp, Homo sapiens
aatacatattacaag

SEQ ID NO: 3841486 - DNA, 13 bp, Homo sapiens
aatactatagtta

SEQ ID NO: 3841487 - DNA, 17 bp, Homo sapiens
aatactttgaatgttgt

SEQ ID NO: 3841488 - DNA, 18 bp, Homo sapiens
aatagagtgcataaataa

SEQ ID NO: 3841489 - DNA, 16 bp, Homo sapiens
aatagcctaaaagatt

SEQ ID NO: 3841490 - DNA, 17 bp, Homo sapiens
aatagcctctcctttgt

SEQ ID NO: 3841491 - DNA, 13 bp, Homo sapiens
aatatatataaat

SEQ ID NO: 3841492 - DNA, 15 bp, Homo sapiens
aatatatataaataa

SEQ ID NO: 3841493 - DNA, 16 bp, Homo sapiens
aatatatataaataaa

SEQ ID NO: 3841494 - DNA, 14 bp, Homo sapiens
aatatatattttgt

SEQ ID NO: 3841495 - DNA, 17 bp, Homo sapiens
aatatatgccttactat

SEQ ID NO: 3841496 - DNA, 23 bp, Homo sapiens
aatatattgtgttttaacaccaa

SEQ ID NO: 3841497 - DNA, 18 bp, Homo sapiens
aatatattttaaatgtgg

SEQ ID NO: 3841498 - DNA, 18 bp, Homo sapiens
aatatattttaagacgaa

SEQ ID NO: 3841499 - DNA, 13 bp, Homo sapiens
aatatcattcagc

SEQ ID NO: 3841500 - DNA, 19 bp, Homo sapiens
aatatggttttgttttcaa

SEQ ID NO: 3841501 - DNA, 23 bp, Homo sapiens
aatattctattttcattttctgc

SEQ ID NO: 3841502 - DNA, 18 bp, Homo sapiens
aatattgacaagtgtctt

SEQ ID NO: 3841503 - DNA, 12 bp, Homo sapiens
aatatttagtgt

SEQ ID NO: 3841504 - DNA, 13 bp, Homo sapiens
aatatttattgct

SEQ ID NO: 3841505 - DNA, 16 bp, Homo sapiens
aatatttattgcttta

SEQ ID NO: 3841506 - DNA, 23 bp, Homo sapiens
aatatttattgctttataaataa

SEQ ID NO: 3841507 - DNA, 15 bp, Homo sapiens
aatatttgaacaaaa

SEQ ID NO: 3841508 - DNA, 16 bp, Homo sapiens
aatatttgtctgtgtg

SEQ ID NO: 3841509 - DNA, 21 bp, Homo sapiens
aatatttgtctgtgtgctact

SEQ ID NO: 3841510 - DNA, 19 bp, Homo sapiens
aatatttttggcattcctc

SEQ ID NO: 3841511 - DNA, 20 bp, Homo sapiens
aatatttttggcattcctct

SEQ ID NO: 3841512 - DNA, 23 bp, Homo sapiens
aatcaaatctggtattgaactgc

SEQ ID NO: 3841513 - DNA, 14 bp, Homo sapiens
aatcaatacactag

SEQ ID NO: 3841514 - DNA, 18 bp, Homo sapiens
aatcaatacactagttgt

SEQ ID NO: 3841515 - DNA, 19 bp, Homo sapiens
aatcaatacactagttgtt

SEQ ID NO: 3841516 - DNA, 19 bp, Homo sapiens
aatcaatagtgcaactgtt

SEQ ID NO: 3841517 - DNA, 12 bp, Homo sapiens
aatcagaagaaa

SEQ ID NO: 3841518 - DNA, 17 bp, Homo sapiens
aatcagactatgaagtt

SEQ ID NO: 3841519 - DNA, 13 bp, Homo sapiens
aatcataatgtaa

SEQ ID NO: 3841520 - DNA, 13 bp, Homo sapiens
aatcatctttgtt

SEQ ID NO: 3841521 - DNA, 17 bp, Homo sapiens
aatcattgtacagtttg

SEQ ID NO: 3841522 - DNA, 16 bp, Homo sapiens
aatccaaatgtgaaag

SEQ ID NO: 3841523 - DNA, 19 bp, Homo sapiens
aatccaaatgtgaaagatg

SEQ ID NO: 3841524 - DNA, 20 bp, Homo sapiens
aatccaaattccctctggag

SEQ ID NO: 3841525 - DNA, 18 bp, Homo sapiens
aatccaagcaaatgtgaa

SEQ ID NO: 3841526 - DNA, 23 bp, Homo sapiens
aatccagctgggctagaggctga

SEQ ID NO: 3841527 - DNA, 22 bp, Homo sapiens
aatcccccgactccctccccag

SEQ ID NO: 3841528 - DNA, 19 bp, Homo sapiens
aatcccttaatctatgtgc

SEQ ID NO: 3841529 - DNA, 16 bp, Homo sapiens
aatcccttcctctccc

SEQ ID NO: 3841530 - DNA, 19 bp, Homo sapiens
aatctatatttttgtgaag

SEQ ID NO: 3841531 - DNA, 24 bp, Homo sapiens
aatctggaacgctctaggcagaag

SEQ ID NO: 3841532 - DNA, 20 bp, Homo sapiens
aatctggtattgaactgcag

SEQ ID NO: 3841533 - DNA, 23 bp, Homo sapiens
aatgaaagtcttgtgactagtgc

SEQ ID NO: 3841534 - DNA, 19 bp, Homo sapiens
aatgaagtgttttacaatg

SEQ ID NO: 3841535 - DNA, 13 bp, Homo sapiens
aatgaattaagaa

SEQ ID NO: 3841536 - DNA, 14 bp, Homo sapiens
aatgactggctaca

SEQ ID NO: 3841537 - DNA, 22 bp, Homo sapiens
aatgagaaatctaaaaaacgaa

SEQ ID NO: 3841538 - DNA, 17 bp, Homo sapiens
aatgatctagttcagaa

SEQ ID NO: 3841539 - DNA, 20 bp, Homo sapiens
aatgatggcccattctactt

SEQ ID NO: 3841540 - DNA, 17 bp, Homo sapiens
aatgatgtatataaaat

SEQ ID NO: 3841541 - DNA, 12 bp, Homo sapiens
aatgatttgtaa

SEQ ID NO: 3841542 - DNA, 20 bp, Homo sapiens
acctgcacagggccctctga

SEQ ID NO: 3841543 - DNA, 13 bp, Homo sapiens
acctgccaggcag

SEQ ID NO: 3841544 - DNA, 19 bp, Homo sapiens
acctgcctccggcctgcac

SEQ ID NO: 3841545 - DNA, 19 bp, Homo sapiens
acctgcgcagggccctctg

SEQ ID NO: 3841546 - DNA, 20 bp, Homo sapiens
acctgcgcagggccctctgg

SEQ ID NO: 3841547 - DNA, 19 bp, Homo sapiens
acctggctgaggttcctct

SEQ ID NO: 3841548 - DNA, 21 bp, Homo sapiens
acctggctgaggttcctctgc

SEQ ID NO: 3841549 - DNA, 18 bp, Homo sapiens
acctgtaataaatatgag

SEQ ID NO: 3841550 - DNA, 21 bp, Homo sapiens
acctgtaataaatatgagtgc

SEQ ID NO: 3841551 - DNA, 23 bp, Homo sapiens
acctgtaataaatatgagtgcca

SEQ ID NO: 3841552 - DNA, 20 bp, Homo sapiens
acctgtgcagggccctctgg

SEQ ID NO: 3841553 - DNA, 16 bp, Homo sapiens
acctgttgtgtgcctg

SEQ ID NO: 3841554 - DNA, 21 bp, Homo sapiens
accttcacccagagctgccta

SEQ ID NO: 3841555 - DNA, 17 bp, Homo sapiens
accttccagtcaggatg

SEQ ID NO: 3841556 - DNA, 20 bp, Homo sapiens
accttgtaaattccccttcc

SEQ ID NO: 3841557 - DNA, 16 bp, Homo sapiens
accttgtgaacatcag

SEQ ID NO: 3841558 - DNA, 17 bp, Homo sapiens
acctttgacaaaggtaa

SEQ ID NO: 3841559 - DNA, 18 bp, Homo sapiens
acctttgacaaaggtaaa

SEQ ID NO: 3841560 - DNA, 14 bp, Homo sapiens
acgaatttctatag

SEQ ID NO: 3841561 - DNA, 20 bp, Homo sapiens
acgaggtcaggagatcgaga

SEQ ID NO: 3841562 - DNA, 15 bp, Homo sapiens
acgcaaacctctcct

SEQ ID NO: 3841563 - DNA, 20 bp, Homo sapiens
acgcaaacctctccttcctc

SEQ ID NO: 3841564 - DNA, 15 bp, Homo sapiens
acgcagccacacagt

SEQ ID NO: 3841565 - DNA, 21 bp, Homo sapiens
acgcattttgggttgtttaaa

SEQ ID NO: 3841566 - DNA, 12 bp, Homo sapiens
acgccctcccct

SEQ ID NO: 3841567 - DNA, 21 bp, Homo sapiens
acgccctcccctcccctgctg

SEQ ID NO: 3841568 - DNA, 22 bp, Homo sapiens
acgccctcccctcccctgctgc

SEQ ID NO: 3841569 - DNA, 23 bp, Homo sapiens
acgccctcccctcccctgctgca

SEQ ID NO: 3841570 - DNA, 22 bp, Homo sapiens
acgccctgggcctgcacctctc

SEQ ID NO: 3841571 - DNA, 23 bp, Homo sapiens
acgccctgggcctgcacctctcc

SEQ ID NO: 3841572 - DNA, 16 bp, Homo sapiens
acgctaaagagccctt

SEQ ID NO: 3841573 - DNA, 17 bp, Homo sapiens
acgctgattcctaaggc

SEQ ID NO: 3841574 - DNA, 18 bp, Homo sapiens
acgctgattcctaaggcc

SEQ ID NO: 3841575 - DNA, 22 bp, Homo sapiens
acgctgattcctaaggcccagc

SEQ ID NO: 3841576 - DNA, 24 bp, Homo sapiens
acgctgattcctaaggcccagctg

SEQ ID NO: 3841577 - DNA, 20 bp, Homo sapiens
acgctggaccttttctttac

SEQ ID NO: 3841578 - DNA, 13 bp, Homo sapiens
acgctggagctgt

SEQ ID NO: 3841579 - DNA, 17 bp, Homo sapiens
acggcaggctcactgcc

SEQ ID NO: 3841580 - DNA, 16 bp, Homo sapiens
acggcttctcatgcta

SEQ ID NO: 3841581 - DNA, 20 bp, Homo sapiens
acggtattatgcttcttgga

SEQ ID NO: 3841582 - DNA, 23 bp, Homo sapiens
acgtcttccttctgcctgagctt

SEQ ID NO: 3841583 - DNA, 20 bp, Homo sapiens
acgtgcaatttgtttgtgct

SEQ ID NO: 3841584 - DNA, 19 bp, Homo sapiens
actaaagtgtgctttataa

SEQ ID NO: 3841585 - DNA, 22 bp, Homo sapiens
actaaagtgtgctttataaaaa

SEQ ID NO: 3841586 - DNA, 18 bp, Homo sapiens
actacacactgctcattt

SEQ ID NO: 3841587 - DNA, 17 bp, Homo sapiens
actacctcctcagggat

SEQ ID NO: 3841588 - DNA, 15 bp, Homo sapiens
actagatttcaagct

SEQ ID NO: 3841589 - DNA, 23 bp, Homo sapiens
actagatttcaagctaattttct

SEQ ID NO: 3841590 - DNA, 21 bp, Homo sapiens
actagcccctgtggagactgg

SEQ ID NO: 3841591 - DNA, 21 bp, Homo sapiens
actagcctccctctcctctgt

SEQ ID NO: 3841592 - DNA, 16 bp, Homo sapiens
actagtgctgaagctt

SEQ ID NO: 3841593 - DNA, 14 bp, Homo sapiens
actatagttatata

SEQ ID NO: 3841594 - DNA, 11 bp, Homo sapiens
actatattaac

SEQ ID NO: 3841595 - DNA, 17 bp, Homo sapiens
actatattaacttttat

SEQ ID NO: 3841596 - DNA, 15 bp, Homo sapiens
actattgtattatag

SEQ ID NO: 3841597 - DNA, 20 bp, Homo sapiens
actcaaagcaagctcttctc

SEQ ID NO: 3841598 - DNA, 17 bp, Homo sapiens
actcagatttaaaacaa

SEQ ID NO: 3841599 - DNA, 16 bp, Homo sapiens
actcatctaggtaaat

SEQ ID NO: 3841600 - DNA, 21 bp, Homo sapiens
actcatctaggtaaattacag

SEQ ID NO: 3841601 - DNA, 17 bp, Homo sapiens
actccacaccagtaata

SEQ ID NO: 3841602 - DNA, 13 bp, Homo sapiens
actccacatctgc

SEQ ID NO: 3841603 - DNA, 16 bp, Homo sapiens
actccacatctgcctt

SEQ ID NO: 3841604 - DNA, 18 bp, Homo sapiens
actccacctccagcacgc

SEQ ID NO: 3841605 - DNA, 21 bp, Homo sapiens
actccagcagataaggccgag

SEQ ID NO: 3841606 - DNA, 11 bp, Homo sapiens
actccaggccc

SEQ ID NO: 3841607 - DNA, 12 bp, Homo sapiens
actccaggcccc

SEQ ID NO: 3841608 - DNA, 18 bp, Homo sapiens
actccataaaaagaaagc

SEQ ID NO: 3841609 - DNA, 21 bp, Homo sapiens
actccataaaaagaaagctaa

SEQ ID NO: 3841610 - DNA, 23 bp, Homo sapiens
actccatgtcagggaagtcgctt

SEQ ID NO: 3841611 - DNA, 15 bp, Homo sapiens
actccctccccagat

SEQ ID NO: 3841612 - DNA, 16 bp, Homo sapiens
actcctcggcctggct

SEQ ID NO: 3841613 - DNA, 19 bp, Homo sapiens
actcctcggcctggctcct

SEQ ID NO: 3841614 - DNA, 16 bp, Homo sapiens
actctgcctgcttaca

SEQ ID NO: 3841615 - DNA, 21 bp, Homo sapiens
actctgtgtgagagagagggc

SEQ ID NO: 3841616 - DNA, 13 bp, Homo sapiens
actgaagacaggc

SEQ ID NO: 3841617 - DNA, 22 bp, Homo sapiens
actgaagacaggcacaaaatgt

SEQ ID NO: 3841618 - DNA, 17 bp, Homo sapiens
actgaagcataaacatc

SEQ ID NO: 3841619 - DNA, 18 bp, Homo sapiens
actgactttttccatttt

SEQ ID NO: 3841620 - DNA, 12 bp, Homo sapiens
actgagaaattt

SEQ ID NO: 3841621 - DNA, 17 bp, Homo sapiens
actgagaaatttataaa

SEQ ID NO: 3841622 - DNA, 18 bp, Homo sapiens
actgagccccgcagacct

SEQ ID NO: 3841623 - DNA, 21 bp, Homo sapiens
actgagccccgcagacctccc

SEQ ID NO: 3841624 - DNA, 17 bp, Homo sapiens
actgatgttactagcct

SEQ ID NO: 3841625 - DNA, 15 bp, Homo sapiens
actgcagggccagga

SEQ ID NO: 3841626 - DNA, 17 bp, Homo sapiens
actgcagggccaggact

SEQ ID NO: 3841627 - DNA, 20 bp, Homo sapiens
actgcagggccaggactgag

SEQ ID NO: 3841628 - DNA, 15 bp, Homo sapiens
actgcattttcacaa

SEQ ID NO: 3841629 - DNA, 17 bp, Homo sapiens
actgcattttcacaaca

SEQ ID NO: 3841630 - DNA, 15 bp, Homo sapiens
actgccaaaaccaaa

SEQ ID NO: 3841631 - DNA, 18 bp, Homo sapiens
actgccaaaaccaaattg

SEQ ID NO: 3841632 - DNA, 19 bp, Homo sapiens
actgccaaaaccaaattga

SEQ ID NO: 3841633 - DNA, 15 bp, Homo sapiens
actgccaggccagcc

SEQ ID NO: 3841634 - DNA, 17 bp, Homo sapiens
actgccaggccagcctc

SEQ ID NO: 3841635 - DNA, 19 bp, Homo sapiens
actgccaggccagcctccg

SEQ ID NO: 3841636 - DNA, 16 bp, Homo sapiens
actgcccctgccctga

SEQ ID NO: 3841637 - DNA, 20 bp, Homo sapiens
actgcccctgccctgaggag

SEQ ID NO: 3841638 - DNA, 17 bp, Homo sapiens
actgctccctgaagcca

SEQ ID NO: 3841639 - DNA, 18 bp, Homo sapiens
actgctccctgaagccag

SEQ ID NO: 3841640 - DNA, 19 bp, Homo sapiens
actgctccctgaagccagc

SEQ ID NO: 3841641 - DNA, 22 bp, Homo sapiens
actgctccctgaagccagcctt

SEQ ID NO: 3841642 - DNA, 13 bp, Homo sapiens
actgctttactgt

SEQ ID NO: 3841643 - DNA, 20 bp, Homo sapiens
actggaaaggggagagcctg

SEQ ID NO: 3841644 - DNA, 23 bp, Homo sapiens
actggaaaggggagagcctgctg

SEQ ID NO: 3841645 - DNA, 17 bp, Homo sapiens
actggaaggctgctttc

SEQ ID NO: 3841646 - DNA, 19 bp, Homo sapiens
actggctgccagctatttt

SEQ ID NO: 3841647 - DNA, 14 bp, Homo sapiens
actggggcctggac

SEQ ID NO: 3841648 - DNA, 17 bp, Homo sapiens
actggttctacaaattt

SEQ ID NO: 3841649 - DNA, 16 bp, Homo sapiens
actgtatcatttcatg

SEQ ID NO: 3841650 - DNA, 11 bp, Homo sapiens
actgtatggaa

SEQ ID NO: 3841651 - DNA, 15 bp, Homo sapiens
actgtctgtgtcctt

SEQ ID NO: 3841652 - DNA, 22 bp, Homo sapiens
actgtgctttctattgtacaga

SEQ ID NO: 3841653 - DNA, 14 bp, Homo sapiens
actgtggaggggag

SEQ ID NO: 3841654 - DNA, 16 bp, Homo sapiens
acttagaaagcagggg

SEQ ID NO: 3841655 - DNA, 12 bp, Homo sapiens
acttattatatc

SEQ ID NO: 3841656 - DNA, 17 bp, Homo sapiens
acttattatatcagagt

SEQ ID NO: 3841657 - DNA, 16 bp, Homo sapiens
acttcaccaaatatat

SEQ ID NO: 3841658 - DNA, 18 bp, Homo sapiens
acttcagttttactgcat

SEQ ID NO: 3841659 - DNA, 12 bp, Homo sapiens
acttctcaggac

SEQ ID NO: 3841660 - DNA, 10 bp, Homo sapiens
acttctccca

SEQ ID NO: 3841661 - DNA, 18 bp, Homo sapiens
acttgaaaattaacatga

SEQ ID NO: 3841662 - DNA, 11 bp, Homo sapiens
acttgaacaaa

SEQ ID NO: 3841663 - DNA, 23 bp, Homo sapiens
acttgagctttaaaaatcattgt

SEQ ID NO: 3841664 - DNA, 15 bp, Homo sapiens
acttgccatttcttt

SEQ ID NO: 3841665 - DNA, 15 bp, Homo sapiens
acttgctctggacct

SEQ ID NO: 3841666 - DNA, 20 bp, Homo sapiens
acttgggaggttgaagcaga

SEQ ID NO: 3841667 - DNA, 21 bp, Homo sapiens
acttgggctccgctgtgcccg

SEQ ID NO: 3841668 - DNA, 18 bp, Homo sapiens
acttgtattatgtgtgtt

SEQ ID NO: 3841669 - DNA, 17 bp, Homo sapiens
actttcccttgccctgg

SEQ ID NO: 3841670 - DNA, 19 bp, Homo sapiens
actttcccttgccctgggc

SEQ ID NO: 3841671 - DNA, 21 bp, Homo sapiens
actttcccttgccctgggctg

SEQ ID NO: 3841672 - DNA, 23 bp, Homo sapiens
actttcccttgccctgggctgcc

SEQ ID NO: 3841673 - DNA, 18 bp, Homo sapiens
actttcctttccccagcc

SEQ ID NO: 3841674 - DNA, 12 bp, Homo sapiens
actttgaatgtt

SEQ ID NO: 3841675 - DNA, 13 bp, Homo sapiens
actttgaatgttg

SEQ ID NO: 3841676 - DNA, 23 bp, Homo sapiens
actttggttttggggtgttcctg

SEQ ID NO: 3841677 - DNA, 16 bp, Homo sapiens
acttttatgatacttg

SEQ ID NO: 3841678 - DNA, 14 bp, Homo sapiens
aatgatttgtaaag

SEQ ID NO: 3841679 - DNA, 23 bp, Homo sapiens
aatgatttgtaaaggactattta

SEQ ID NO: 3841680 - DNA, 21 bp, Homo sapiens
aatgcacagttctatttgcta

SEQ ID NO: 3841681 - DNA, 22 bp, Homo sapiens
aatgcacagttctatttgctat

SEQ ID NO: 3841682 - DNA, 18 bp, Homo sapiens
aatgccttaattaaagaa

SEQ ID NO: 3841683 - DNA, 17 bp, Homo sapiens
aatgctaagggcaggcc

SEQ ID NO: 3841684 - DNA, 15 bp, Homo sapiens
aatgctgtaaatatt

SEQ ID NO: 3841685 - DNA, 19 bp, Homo sapiens
aatgctgtaaatatttcat

SEQ ID NO: 3841686 - DNA, 20 bp, Homo sapiens
aatgctgtaaatatttcata

SEQ ID NO: 3841687 - DNA, 18 bp, Homo sapiens
aatgctttaaaaactatt

SEQ ID NO: 3841688 - DNA, 15 bp, Homo sapiens
aatggattttcctga

SEQ ID NO: 3841689 - DNA, 13 bp, Homo sapiens
aatggggagctgg

SEQ ID NO: 3841690 - DNA, 14 bp, Homo sapiens
aatggggagctggc

SEQ ID NO: 3841691 - DNA, 16 bp, Homo sapiens
aatggggagctggcct

SEQ ID NO: 3841692 - DNA, 18 bp, Homo sapiens
aatggtctcatctccttt

SEQ ID NO: 3841693 - DNA, 19 bp, Homo sapiens
aatgtaactgaagcataaa

SEQ ID NO: 3841694 - DNA, 22 bp, Homo sapiens
aatgtaactgaagcataaacat

SEQ ID NO: 3841695 - DNA, 14 bp, Homo sapiens
aatgtatgaatttt

SEQ ID NO: 3841696 - DNA, 20 bp, Homo sapiens
aatgtatgaattttgtaagt

SEQ ID NO: 3841697 - DNA, 21 bp, Homo sapiens
aatgtgcgaggatcctggtat

SEQ ID NO: 3841698 - DNA, 15 bp, Homo sapiens
aatgtgtctgtggac

SEQ ID NO: 3841699 - DNA, 22 bp, Homo sapiens
aatgttaggggtatttaatgta

SEQ ID NO: 3841700 - DNA, 20 bp, Homo sapiens
aatgtttattgggcaataaa

SEQ ID NO: 3841701 - DNA, 18 bp, Homo sapiens
aatgttttcgcaaatgtt

SEQ ID NO: 3841702 - DNA, 20 bp, Homo sapiens
aatgtttttttttaaagact

SEQ ID NO: 3841703 - DNA, 18 bp, Homo sapiens
aattaaagaatttaaaaa

SEQ ID NO: 3841704 - DNA, 12 bp, Homo sapiens
aattaacatcaa

SEQ ID NO: 3841705 - DNA, 13 bp, Homo sapiens
aattaattaatta

SEQ ID NO: 3841706 - DNA, 16 bp, Homo sapiens
aattacaactaaatta

SEQ ID NO: 3841707 - DNA, 19 bp, Homo sapiens
aattacatgaagatttggt

SEQ ID NO: 3841708 - DNA, 15 bp, Homo sapiens
aattacttctagtca

SEQ ID NO: 3841709 - DNA, 21 bp, Homo sapiens
aattagcttttggagagtggg

SEQ ID NO: 3841710 - DNA, 22 bp, Homo sapiens
aattatgtgccagatttatgca

SEQ ID NO: 3841711 - DNA, 15 bp, Homo sapiens
aattattttatgtca

SEQ ID NO: 3841712 - DNA, 19 bp, Homo sapiens
aattatttttttaaacttc

SEQ ID NO: 3841713 - DNA, 15 bp, Homo sapiens
aattcatggcttttt

SEQ ID NO: 3841714 - DNA, 19 bp, Homo sapiens
aattctttctttttccttc

SEQ ID NO: 3841715 - DNA, 18 bp, Homo sapiens
aattgaaacaacattatt

SEQ ID NO: 3841716 - DNA, 21 bp, Homo sapiens
aattgcattgctaccaagttt

SEQ ID NO: 3841717 - DNA, 20 bp, Homo sapiens
aattgcattttttaaaacaa

SEQ ID NO: 3841718 - DNA, 23 bp, Homo sapiens
aattggtctaccaagtaagacat

SEQ ID NO: 3841719 - DNA, 13 bp, Homo sapiens
aattgtgctttgt

SEQ ID NO: 3841720 - DNA, 14 bp, Homo sapiens
aatttaaaaaagtt

SEQ ID NO: 3841721 - DNA, 16 bp, Homo sapiens
aatttaaaataaataa

SEQ ID NO: 3841722 - DNA, 17 bp, Homo sapiens
aatttaaaataaataaa

SEQ ID NO: 3841723 - DNA, 19 bp, Homo sapiens
aatttacgtcttgagaaat

SEQ ID NO: 3841724 - DNA, 23 bp, Homo sapiens
aatttacgtcttgagaaatacta

SEQ ID NO: 3841725 - DNA, 22 bp, Homo sapiens
aatttataaacttttttcttac

SEQ ID NO: 3841726 - DNA, 17 bp, Homo sapiens
aatttataacagttata

SEQ ID NO: 3841727 - DNA, 15 bp, Homo sapiens
aatttatacaaagaa

SEQ ID NO: 3841728 - DNA, 18 bp, Homo sapiens
aatttatacaaagaaact

SEQ ID NO: 3841729 - DNA, 11 bp, Homo sapiens
aatttcatgaa

SEQ ID NO: 3841730 - DNA, 15 bp, Homo sapiens
aatttgaaacacttt

SEQ ID NO: 3841731 - DNA, 16 bp, Homo sapiens
aatttgccagttttat

SEQ ID NO: 3841732 - DNA, 21 bp, Homo sapiens
aatttggacattatttcgtgt

SEQ ID NO: 3841733 - DNA, 14 bp, Homo sapiens
aatttgtttgtgct

SEQ ID NO: 3841734 - DNA, 17 bp, Homo sapiens
aatttgtttgtgcttct

SEQ ID NO: 3841735 - DNA, 15 bp, Homo sapiens
aattttaaaatgttt

SEQ ID NO: 3841736 - DNA, 23 bp, Homo sapiens
aattttccagagaagcctatttt

SEQ ID NO: 3841737 - DNA, 14 bp, Homo sapiens
aattttccttgaag

SEQ ID NO: 3841738 - DNA, 15 bp, Homo sapiens
aattttccttgaagc

SEQ ID NO: 3841739 - DNA, 16 bp, Homo sapiens
aattttccttgaagcc

SEQ ID NO: 3841740 - DNA, 22 bp, Homo sapiens
aattttctttttctgaagcctc

SEQ ID NO: 3841741 - DNA, 18 bp, Homo sapiens
aattttgcaaatctgtta

SEQ ID NO: 3841742 - DNA, 14 bp, Homo sapiens
aattttgtaagtat

SEQ ID NO: 3841743 - DNA, 14 bp, Homo sapiens
acaaaaaagaaaaa

SEQ ID NO: 3841744 - DNA, 16 bp, Homo sapiens
acaaaaaataaagaat

SEQ ID NO: 3841745 - DNA, 18 bp, Homo sapiens
acaaaaattgagagcttt

SEQ ID NO: 3841746 - DNA, 16 bp, Homo sapiens
acaaaacaaacacaca

SEQ ID NO: 3841747 - DNA, 11 bp, Homo sapiens
acaaaactttg

SEQ ID NO: 3841748 - DNA, 16 bp, Homo sapiens
acaaaattatgctgca

SEQ ID NO: 3841749 - DNA, 12 bp, Homo sapiens
acaaacacacac

SEQ ID NO: 3841750 - DNA, 18 bp, Homo sapiens
acaaagaaactttttaat

SEQ ID NO: 3841751 - DNA, 12 bp, Homo sapiens
acaaagaaatta

SEQ ID NO: 3841752 - DNA, 16 bp, Homo sapiens
acaaagaaattatgtg

SEQ ID NO: 3841753 - DNA, 17 bp, Homo sapiens
acaaagtactagctaaa

SEQ ID NO: 3841754 - DNA, 12 bp, Homo sapiens
acaaatgcttta

SEQ ID NO: 3841755 - DNA, 20 bp, Homo sapiens
acaaattaccaaattacatg

SEQ ID NO: 3841756 - DNA, 13 bp, Homo sapiens
acaacatatcaga

SEQ ID NO: 3841757 - DNA, 15 bp, Homo sapiens
acaacatatcagact

SEQ ID NO: 3841758 - DNA, 13 bp, Homo sapiens
acaagaaataaat

SEQ ID NO: 3841759 - DNA, 21 bp, Homo sapiens
acaagagaccaactttttcat

SEQ ID NO: 3841760 - DNA, 12 bp, Homo sapiens
acaaggctgtgc

SEQ ID NO: 3841761 - DNA, 17 bp, Homo sapiens
acaaggctgtgccaggc

SEQ ID NO: 3841762 - DNA, 18 bp, Homo sapiens
acaaggctgtgccaggct

SEQ ID NO: 3841763 - DNA, 19 bp, Homo sapiens
acaaggctgtgccaggctg

SEQ ID NO: 3841764 - DNA, 20 bp, Homo sapiens
acaaggggttactttacatc

SEQ ID NO: 3841765 - DNA, 17 bp, Homo sapiens
acaatgatttgtaaagg

SEQ ID NO: 3841766 - DNA, 19 bp, Homo sapiens
acaatggataggcacagga

SEQ ID NO: 3841767 - DNA, 18 bp, Homo sapiens
acaatggcaggttttaca

SEQ ID NO: 3841768 - DNA, 17 bp, Homo sapiens
acacaacgctgctgcct

SEQ ID NO: 3841769 - DNA, 10 bp, Homo sapiens
acacacacac

SEQ ID NO: 3841770 - DNA, 11 bp, Homo sapiens
acacacacaca

SEQ ID NO: 3841771 - DNA, 12 bp, Homo sapiens
acacacacacac

SEQ ID NO: 3841772 - DNA, 13 bp, Homo sapiens
acacacacacaca

SEQ ID NO: 3841773 - DNA, 14 bp, Homo sapiens
acacacacacacaa

SEQ ID NO: 3841774 - DNA, 15 bp, Homo sapiens
acacacacacataca

SEQ ID NO: 3841775 - DNA, 21 bp, Homo sapiens
acacacaggaactctgtgtga

SEQ ID NO: 3841776 - DNA, 16 bp, Homo sapiens
acacactgtgctttct

SEQ ID NO: 3841777 - DNA, 18 bp, Homo sapiens
acacagcccagaaggcca

SEQ ID NO: 3841778 - DNA, 12 bp, Homo sapiens
acacaggaactc

SEQ ID NO: 3841779 - DNA, 21 bp, Homo sapiens
acacaggaactctgtgtgaga

SEQ ID NO: 3841780 - DNA, 16 bp, Homo sapiens
acacaggagaccaccc

SEQ ID NO: 3841781 - DNA, 14 bp, Homo sapiens
acacaggtttgtaa

SEQ ID NO: 3841782 - DNA, 13 bp, Homo sapiens
acaccaaatgact

SEQ ID NO: 3841783 - DNA, 15 bp, Homo sapiens
acaccaacactgtaa

SEQ ID NO: 3841784 - DNA, 16 bp, Homo sapiens
acaccacacccagcct

SEQ ID NO: 3841785 - DNA, 16 bp, Homo sapiens
acaccacgctggagct

SEQ ID NO: 3841786 - DNA, 14 bp, Homo sapiens
acaccatctggccc

SEQ ID NO: 3841787 - DNA, 17 bp, Homo sapiens
acacccagcctcagtcc

SEQ ID NO: 3841788 - DNA, 12 bp, Homo sapiens
acaccccagact

SEQ ID NO: 3841789 - DNA, 17 bp, Homo sapiens
acaccccagactccagg

SEQ ID NO: 3841790 - DNA, 21 bp, Homo sapiens
acaccccagactccaggcccc

SEQ ID NO: 3841791 - DNA, 12 bp, Homo sapiens
acaccctgccct

SEQ ID NO: 3841792 - DNA, 17 bp, Homo sapiens
acaccctgccctcatgc

SEQ ID NO: 3841793 - DNA, 23 bp, Homo sapiens
acacctggctgaggttcctctgc

SEQ ID NO: 3841794 - DNA, 13 bp, Homo sapiens
acactaaaacatt

SEQ ID NO: 3841795 - DNA, 15 bp, Homo sapiens
acactaaaacattgt

SEQ ID NO: 3841796 - DNA, 17 bp, Homo sapiens
acactaaaacattgtct

SEQ ID NO: 3841797 - DNA, 13 bp, Homo sapiens
acactgctcattt

SEQ ID NO: 3841798 - DNA, 14 bp, Homo sapiens
acactggctgccag

SEQ ID NO: 3841799 - DNA, 16 bp, Homo sapiens
acactggctgccagct

SEQ ID NO: 3841800 - DNA, 21 bp, Homo sapiens
acactggctgccagctatttt

SEQ ID NO: 3841801 - DNA, 19 bp, Homo sapiens
acactgtaacatttacgaa

SEQ ID NO: 3841802 - DNA, 14 bp, Homo sapiens
acactgtgctttct

SEQ ID NO: 3841803 - DNA, 17 bp, Homo sapiens
acactttctttttttac

SEQ ID NO: 3841804 - DNA, 14 bp, Homo sapiens
acagacctctccca

SEQ ID NO: 3841805 - DNA, 13 bp, Homo sapiens
acagagcaggctt

SEQ ID NO: 3841806 - DNA, 19 bp, Homo sapiens
acagagcaggctttgtgag

SEQ ID NO: 3841807 - DNA, 15 bp, Homo sapiens
acagcccagaaggcc

SEQ ID NO: 3841808 - DNA, 18 bp, Homo sapiens
acagcctctgacccctcc

SEQ ID NO: 3841809 - DNA, 23 bp, Homo sapiens
acagcctctgacccctcctcact

SEQ ID NO: 3841810 - DNA, 14 bp, Homo sapiens
acagcctctgcagt

SEQ ID NO: 3841811 - DNA, 16 bp, Homo sapiens
acagcctgtgtgcagt

SEQ ID NO: 3841812 - DNA, 20 bp, Homo sapiens
acagcctgtgtgcagtggag

SEQ ID NO: 3841813 - DNA, 19 bp, Homo sapiens
acagctccttgggaggaag

SEQ ID NO: 3841814 - DNA, 20 bp, Homo sapiens
acagctccttgggaggaagc

SEQ ID NO: 3841815 - DNA, 21 bp, Homo sapiens
acagctccttgggaggaagca

SEQ ID NO: 3841816 - DNA, 19 bp, Homo sapiens
acagctgaggaccctcagc

SEQ ID NO: 3841817 - DNA, 20 bp, Homo sapiens
acagctgaggaccctcagcc

SEQ ID NO: 3841818 - DNA, 22 bp, Homo sapiens
acagcttgagccgggcccctgg

SEQ ID NO: 3841819 - DNA, 19 bp, Homo sapiens
acaggaactctgtgtgaga

SEQ ID NO: 3841820 - DNA, 20 bp, Homo sapiens
acaggaactctgtgtgagag

SEQ ID NO: 3841821 - DNA, 18 bp, Homo sapiens
acaggagaccacccccga

SEQ ID NO: 3841822 - DNA, 12 bp, Homo sapiens
acaggcacaaaa

SEQ ID NO: 3841823 - DNA, 13 bp, Homo sapiens
acaggcacaaaat

SEQ ID NO: 3841824 - DNA, 19 bp, Homo sapiens
acaggcacaaaatgtgaca

SEQ ID NO: 3841825 - DNA, 19 bp, Homo sapiens
acaggcagttacttctgag

SEQ ID NO: 3841826 - DNA, 20 bp, Homo sapiens
acaggccctttcctcaggca

SEQ ID NO: 3841827 - DNA, 24 bp, Homo sapiens
acagggccctctgaggctcagccc

SEQ ID NO: 3841828 - DNA, 12 bp, Homo sapiens
acagggctccag

SEQ ID NO: 3841829 - DNA, 13 bp, Homo sapiens
acagggctccagc

SEQ ID NO: 3841830 - DNA, 21 bp, Homo sapiens
acaggttaaatatataaacaa

SEQ ID NO: 3841831 - DNA, 13 bp, Homo sapiens
acagtaagagttt

SEQ ID NO: 3841832 - DNA, 15 bp, Homo sapiens
acagtaagagtttac

SEQ ID NO: 3841833 - DNA, 20 bp, Homo sapiens
acagtagccccatcacattt

SEQ ID NO: 3841834 - DNA, 23 bp, Homo sapiens
acagtagtataatgtatgaattt

SEQ ID NO: 3841835 - DNA, 22 bp, Homo sapiens
acagtggttttatactgaagga

SEQ ID NO: 3841836 - DNA, 16 bp, Homo sapiens
acagttagccactgct

SEQ ID NO: 3841837 - DNA, 19 bp, Homo sapiens
acagttagccactgctggt

SEQ ID NO: 3841838 - DNA, 13 bp, Homo sapiens
acagttataaaga

SEQ ID NO: 3841839 - DNA, 14 bp, Homo sapiens
acagttataaagaa

SEQ ID NO: 3841840 - DNA, 17 bp, Homo sapiens
acagttataaagaaaga

SEQ ID NO: 3841841 - DNA, 15 bp, Homo sapiens
acagttctatttgct

SEQ ID NO: 3841842 - DNA, 15 bp, Homo sapiens
acagtttgtttacac

SEQ ID NO: 3841843 - DNA, 21 bp, Homo sapiens
acataatcttaaactcttgaa

SEQ ID NO: 3841844 - DNA, 19 bp, Homo sapiens
acataatttaaaataaata

SEQ ID NO: 3841845 - DNA, 21 bp, Homo sapiens
acataatttaaaataaataaa

SEQ ID NO: 3841846 - DNA, 13 bp, Homo sapiens
acatacacacaca

SEQ ID NO: 3841847 - DNA, 15 bp, Homo sapiens
acatacacacacaca

SEQ ID NO: 3841848 - DNA, 19 bp, Homo sapiens
acatagcccatccctgcct

SEQ ID NO: 3841849 - DNA, 13 bp, Homo sapiens
acatatcagactt

SEQ ID NO: 3841850 - DNA, 15 bp, Homo sapiens
acatatcagacttca

SEQ ID NO: 3841851 - DNA, 16 bp, Homo sapiens
acatattacaagaaaa

SEQ ID NO: 3841852 - DNA, 13 bp, Homo sapiens
acatcaagtgtaa

SEQ ID NO: 3841853 - DNA, 16 bp, Homo sapiens
acatcaagtgtaatta

SEQ ID NO: 3841854 - DNA, 16 bp, Homo sapiens
acatcacatggcatgt

SEQ ID NO: 3841855 - DNA, 19 bp, Homo sapiens
acatcatatacctcttgaa

SEQ ID NO: 3841856 - DNA, 18 bp, Homo sapiens
acatcctaatagaaagaa

SEQ ID NO: 3841857 - DNA, 19 bp, Homo sapiens
acatcctaatagaaagaaa

SEQ ID NO: 3841858 - DNA, 22 bp, Homo sapiens
acatcctaatagaaagaaatta

SEQ ID NO: 3841859 - DNA, 22 bp, Homo sapiens
acatcttgatctgctcagccct

SEQ ID NO: 3841860 - DNA, 19 bp, Homo sapiens
acatgcaccacgcccggct

SEQ ID NO: 3841861 - DNA, 15 bp, Homo sapiens
acatggcagatgatt

SEQ ID NO: 3841862 - DNA, 21 bp, Homo sapiens
acatggcatgttttgtcattg

SEQ ID NO: 3841863 - DNA, 19 bp, Homo sapiens
acatggtgcctgagaggca

SEQ ID NO: 3841864 - DNA, 23 bp, Homo sapiens
acatggtgcctgagaggcaggca

SEQ ID NO: 3841865 - DNA, 21 bp, Homo sapiens
acatgtcattgcccacttctg

SEQ ID NO: 3841866 - DNA, 15 bp, Homo sapiens
acattacattaacat

SEQ ID NO: 3841867 - DNA, 20 bp, Homo sapiens
acattctcttactttttgta

SEQ ID NO: 3841868 - DNA, 16 bp, Homo sapiens
acatttcctaaatata

SEQ ID NO: 3841869 - DNA, 17 bp, Homo sapiens
acatttcctaaatatat

SEQ ID NO: 3841870 - DNA, 22 bp, Homo sapiens
accaaaattttgtcccatctct

SEQ ID NO: 3841871 - DNA, 11 bp, Homo sapiens
accaaatgctt

SEQ ID NO: 3841872 - DNA, 14 bp, Homo sapiens
accaacacacagga

SEQ ID NO: 3841873 - DNA, 22 bp, Homo sapiens
accaacctggccaacatggtga

SEQ ID NO: 3841874 - DNA, 17 bp, Homo sapiens
accacacccagcctcag

SEQ ID NO: 3841875 - DNA, 12 bp, Homo sapiens
accaccaacaca

SEQ ID NO: 3841876 - DNA, 15 bp, Homo sapiens
accaccaagtattaa

SEQ ID NO: 3841877 - DNA, 12 bp, Homo sapiens
accaccacacca

SEQ ID NO: 3841878 - DNA, 12 bp, Homo sapiens
accactcctgcc

SEQ ID NO: 3841879 - DNA, 13 bp, Homo sapiens
accactcctgcct

SEQ ID NO: 3841880 - DNA, 14 bp, Homo sapiens
accactcctgcctg

SEQ ID NO: 3841881 - DNA, 15 bp, Homo sapiens
accactcctgcctgc

SEQ ID NO: 3841882 - DNA, 17 bp, Homo sapiens
accactcggggccccca

SEQ ID NO: 3841883 - DNA, 22 bp, Homo sapiens
accactcggggcccccatcttg

SEQ ID NO: 3841884 - DNA, 16 bp, Homo sapiens
accagagaccgtcctc

SEQ ID NO: 3841885 - DNA, 17 bp, Homo sapiens
accagagctgtggagag

SEQ ID NO: 3841886 - DNA, 14 bp, Homo sapiens
accaggagctgctc

SEQ ID NO: 3841887 - DNA, 18 bp, Homo sapiens
accaggccgtttgctttt

SEQ ID NO: 3841888 - DNA, 15 bp, Homo sapiens
accagtaataaaaag

SEQ ID NO: 3841889 - DNA, 9 bp, Homo sapiens
accagtccc

SEQ ID NO: 3841890 - DNA, 14 bp, Homo sapiens
acccaacttcccct

SEQ ID NO: 3841891 - DNA, 19 bp, Homo sapiens
acccacaagaactcctccc

SEQ ID NO: 3841892 - DNA, 15 bp, Homo sapiens
acccaccgcccttgc

SEQ ID NO: 3841893 - DNA, 13 bp, Homo sapiens
acccagagctgcc

SEQ ID NO: 3841894 - DNA, 12 bp, Homo sapiens
acccagcctcag

SEQ ID NO: 3841895 - DNA, 12 bp, Homo sapiens
accccaacccaa

SEQ ID NO: 3841896 - DNA, 14 bp, Homo sapiens
accccagactccag

SEQ ID NO: 3841897 - DNA, 17 bp, Homo sapiens
accccaggcagctcctg

SEQ ID NO: 3841898 - DNA, 19 bp, Homo sapiens
accccaggcagctcctgtt

SEQ ID NO: 3841899 - DNA, 20 bp, Homo sapiens
accccaggctggagtgcagt

SEQ ID NO: 3841900 - DNA, 21 bp, Homo sapiens
accccaggctggagtgcagtg

SEQ ID NO: 3841901 - DNA, 15 bp, Homo sapiens
accccctgccctgca

SEQ ID NO: 3841902 - DNA, 14 bp, Homo sapiens
accccgcagtcact

SEQ ID NO: 3841903 - DNA, 16 bp, Homo sapiens
accccggggaccctgt

SEQ ID NO: 3841904 - DNA, 17 bp, Homo sapiens
accccggggaccctgtg

SEQ ID NO: 3841905 - DNA, 13 bp, Homo sapiens
acccctccccact

SEQ ID NO: 3841906 - DNA, 13 bp, Homo sapiens
acccctcctcact

SEQ ID NO: 3841907 - DNA, 23 bp, Homo sapiens
acccctcctcactggccatccct

SEQ ID NO: 3841908 - DNA, 10 bp, Homo sapiens
acccctgccc

SEQ ID NO: 3841909 - DNA, 13 bp, Homo sapiens
acccctgccccca

SEQ ID NO: 3841910 - DNA, 18 bp, Homo sapiens
acccctgctttgccccac

SEQ ID NO: 3841911 - DNA, 15 bp, Homo sapiens
acccctgtcctcact

SEQ ID NO: 3841912 - DNA, 16 bp, Homo sapiens
acccgcctccctctca

SEQ ID NO: 3841913 - DNA, 16 bp, Homo sapiens
accctcagccccagga

SEQ ID NO: 3841914 - DNA, 21 bp, Homo sapiens
accctcagccccaggagaagg

SEQ ID NO: 3841915 - DNA, 21 bp, Homo sapiens
accctcgagattaacggtgct

SEQ ID NO: 3841916 - DNA, 15 bp, Homo sapiens
accctcgctctctgt

SEQ ID NO: 3841917 - DNA, 16 bp, Homo sapiens
accctcgctctctgtc

SEQ ID NO: 3841918 - DNA, 13 bp, Homo sapiens
accctctgccacc

SEQ ID NO: 3841919 - DNA, 19 bp, Homo sapiens
accctgggtgggctctgtg

SEQ ID NO: 3841920 - DNA, 20 bp, Homo sapiens
accctgggtgggctctgtgc

SEQ ID NO: 3841921 - DNA, 21 bp, Homo sapiens
accctgtcctcccacccctcc

SEQ ID NO: 3841922 - DNA, 19 bp, Homo sapiens
accctgtgacatggtgcct

SEQ ID NO: 3841923 - DNA, 15 bp, Homo sapiens
accgacccttcctgg

SEQ ID NO: 3841924 - DNA, 16 bp, Homo sapiens
accgacccttcctggc

SEQ ID NO: 3841925 - DNA, 12 bp, Homo sapiens
accgtcctcacc

SEQ ID NO: 3841926 - DNA, 13 bp, Homo sapiens
accgtcctcaccc

SEQ ID NO: 3841927 - DNA, 15 bp, Homo sapiens
accgtggaggaggaa

SEQ ID NO: 3841928 - DNA, 18 bp, Homo sapiens
accgtggaggaggaaggc

SEQ ID NO: 3841929 - DNA, 22 bp, Homo sapiens
accgtggaggaggaaggcaaga

SEQ ID NO: 3841930 - DNA, 22 bp, Homo sapiens
acctacctggcccctgagctct

SEQ ID NO: 3841931 - DNA, 16 bp, Homo sapiens
acctataattttgcaa

SEQ ID NO: 3841932 - DNA, 17 bp, Homo sapiens
acctcactttggttttg

SEQ ID NO: 3841933 - DNA, 18 bp, Homo sapiens
acctcaggcactagcctt

SEQ ID NO: 3841934 - DNA, 23 bp, Homo sapiens
acctcaggcactagcctttggct

SEQ ID NO: 3841935 - DNA, 22 bp, Homo sapiens
acctcatgcccaccccctgccc

SEQ ID NO: 3841936 - DNA, 14 bp, Homo sapiens
acctcattgttctg

SEQ ID NO: 3841937 - DNA, 16 bp, Homo sapiens
acctccagcacgcgac

SEQ ID NO: 3841938 - DNA, 10 bp, Homo sapiens
acctccatct

SEQ ID NO: 3841939 - DNA, 14 bp, Homo sapiens
acctccccacgccc

SEQ ID NO: 3841940 - DNA, 21 bp, Homo sapiens
acctccccagacagggctcca

SEQ ID NO: 3841941 - DNA, 22 bp, Homo sapiens
acctccccagacagggctccag

SEQ ID NO: 3841942 - DNA, 12 bp, Homo sapiens
acctccccagcc

SEQ ID NO: 3841943 - DNA, 23 bp, Homo sapiens
acctccccagcccctagcccagg

SEQ ID NO: 3841944 - DNA, 14 bp, Homo sapiens
acctcctcagggat

SEQ ID NO: 3841945 - DNA, 13 bp, Homo sapiens
acctctcccaccc

SEQ ID NO: 3841946 - DNA, 14 bp, Homo sapiens
acctctccttcctc

SEQ ID NO: 3841947 - DNA, 17 bp, Homo sapiens
acctctgcggaccccag

SEQ ID NO: 3841948 - DNA, 14 bp, Homo sapiens
acctctgtgacctc

SEQ ID NO: 3841949 - DNA, 17 bp, Homo sapiens
acctctgtgacctcagg

SEQ ID NO: 3841950 - DNA, 18 bp, Homo sapiens
acctctgtgacctcaggc

SEQ ID NO: 3841951 - DNA, 22 bp, Homo sapiens
acctgaaatatattttaaatgt

SEQ ID NO: 3841952 - DNA, 15 bp, Homo sapiens
acctgcacagggccc

SEQ ID NO: 3841953 - DNA, 19 bp, Homo sapiens
acctgcacagggccctctg

SEQ ID NO: 3841954 - DNA, 16 bp, Homo sapiens
atgaattaagaaagat

SEQ ID NO: 3841955 - DNA, 12 bp, Homo sapiens
atgacagatgaa

SEQ ID NO: 3841956 - DNA, 15 bp, Homo sapiens
atgacagatgaagaa

SEQ ID NO: 3841957 - DNA, 15 bp, Homo sapiens
atgacctatcagtat

SEQ ID NO: 3841958 - DNA, 13 bp, Homo sapiens
atgaccttacatt

SEQ ID NO: 3841959 - DNA, 16 bp, Homo sapiens
atgaccttacatttcc

SEQ ID NO: 3841960 - DNA, 21 bp, Homo sapiens
atgactaaagacctgctgtaa

SEQ ID NO: 3841961 - DNA, 15 bp, Homo sapiens
atgactcaagattcc

SEQ ID NO: 3841962 - DNA, 20 bp, Homo sapiens
atgactgaagacaggcacaa

SEQ ID NO: 3841963 - DNA, 15 bp, Homo sapiens
atgaggttttggaaa

SEQ ID NO: 3841964 - DNA, 17 bp, Homo sapiens
atgatacttgaaaatta

SEQ ID NO: 3841965 - DNA, 17 bp, Homo sapiens
atgatggggtcagcagg

SEQ ID NO: 3841966 - DNA, 18 bp, Homo sapiens
atgatggggtcagcaggc

SEQ ID NO: 3841967 - DNA, 20 bp, Homo sapiens
atgatgtatataaaatgtgc

SEQ ID NO: 3841968 - DNA, 15 bp, Homo sapiens
atgcaacctctgccc

SEQ ID NO: 3841969 - DNA, 16 bp, Homo sapiens
atgcaattgtacaaaa

SEQ ID NO: 3841970 - DNA, 22 bp, Homo sapiens
atgcacagttctatttgctatc

SEQ ID NO: 3841971 - DNA, 16 bp, Homo sapiens
atgcatattattttat

SEQ ID NO: 3841972 - DNA, 24 bp, Homo sapiens
atgcatattattttatgttgcata

SEQ ID NO: 3841973 - DNA, 18 bp, Homo sapiens
atgcatgagctattgcta

SEQ ID NO: 3841974 - DNA, 12 bp, Homo sapiens
atgcatttcaat

SEQ ID NO: 3841975 - DNA, 13 bp, Homo sapiens
atgcccagcctcc

SEQ ID NO: 3841976 - DNA, 23 bp, Homo sapiens
atgcccccgccacctccccactc

SEQ ID NO: 3841977 - DNA, 15 bp, Homo sapiens
atgccccggccacct

SEQ ID NO: 3841978 - DNA, 22 bp, Homo sapiens
atgccctttcttgaattgcatt

SEQ ID NO: 3841979 - DNA, 15 bp, Homo sapiens
atgcctgagccccct

SEQ ID NO: 3841980 - DNA, 17 bp, Homo sapiens
atgcctgctgctgccaa

SEQ ID NO: 3841981 - DNA, 15 bp, Homo sapiens
atgcctgttgcaggc

SEQ ID NO: 3841982 - DNA, 19 bp, Homo sapiens
atgctcaatcatgtgccag

SEQ ID NO: 3841983 - DNA, 18 bp, Homo sapiens
atgctggagaagagagga

SEQ ID NO: 3841984 - DNA, 17 bp, Homo sapiens
atgcttggaatgggaga

SEQ ID NO: 3841985 - DNA, 20 bp, Homo sapiens
atggaccttctctccagagc

SEQ ID NO: 3841986 - DNA, 16 bp, Homo sapiens
atggactgatgctttt

SEQ ID NO: 3841987 - DNA, 14 bp, Homo sapiens
atggagcccaggcg

SEQ ID NO: 3841988 - DNA, 12 bp, Homo sapiens
atggattttcct

SEQ ID NO: 3841989 - DNA, 15 bp, Homo sapiens
atggcatgttttgtc

SEQ ID NO: 3841990 - DNA, 18 bp, Homo sapiens
atggcatgttttgtcatt

SEQ ID NO: 3841991 - DNA, 13 bp, Homo sapiens
atggcctcagatg

SEQ ID NO: 3841992 - DNA, 19 bp, Homo sapiens
atggctggggggtctcagc

SEQ ID NO: 3841993 - DNA, 20 bp, Homo sapiens
atggctggggggtctcagca

SEQ ID NO: 3841994 - DNA, 13 bp, Homo sapiens
atggctttgtgct

SEQ ID NO: 3841995 - DNA, 16 bp, Homo sapiens
atggctttgtgctgct

SEQ ID NO: 3841996 - DNA, 17 bp, Homo sapiens
atgggaatgaggtggga

SEQ ID NO: 3841997 - DNA, 14 bp, Homo sapiens
atggggagctggcc

SEQ ID NO: 3841998 - DNA, 16 bp, Homo sapiens
atggggcagcctccag

SEQ ID NO: 3841999 - DNA, 19 bp, Homo sapiens
atggggtagggtgagaagg

SEQ ID NO: 3842000 - DNA, 19 bp, Homo sapiens
atggggtcagcaggcccag

SEQ ID NO: 3842001 - DNA, 16 bp, Homo sapiens
atggtaagacctctga

SEQ ID NO: 3842002 - DNA, 18 bp, Homo sapiens
atggtctcatctcctttg

SEQ ID NO: 3842003 - DNA, 16 bp, Homo sapiens
atggtgcctgagaggc

SEQ ID NO: 3842004 - DNA, 18 bp, Homo sapiens
atggtgcctgagaggcag

SEQ ID NO: 3842005 - DNA, 10 bp, Homo sapiens
atggtgctaa

SEQ ID NO: 3842006 - DNA, 19 bp, Homo sapiens
atggtggggcccccagcac

SEQ ID NO: 3842007 - DNA, 20 bp, Homo sapiens
atggtggggcccccagcacc

SEQ ID NO: 3842008 - DNA, 15 bp, Homo sapiens
atggttgccacccca

SEQ ID NO: 3842009 - DNA, 20 bp, Homo sapiens
atggttgccaccccaaccca

SEQ ID NO: 3842010 - DNA, 21 bp, Homo sapiens
atggtttttataatattcata

SEQ ID NO: 3842011 - DNA, 19 bp, Homo sapiens
atgtaaaatcttgatagct

SEQ ID NO: 3842012 - DNA, 17 bp, Homo sapiens
atgtaaagtctagaaaa

SEQ ID NO: 3842013 - DNA, 17 bp, Homo sapiens
atgtaactgaagcataa

SEQ ID NO: 3842014 - DNA, 15 bp, Homo sapiens
atgtactctcctttt

SEQ ID NO: 3842015 - DNA, 23 bp, Homo sapiens
atgtagccatgaccttacatttc

SEQ ID NO: 3842016 - DNA, 14 bp, Homo sapiens
atgtatataaaatg

SEQ ID NO: 3842017 - DNA, 18 bp, Homo sapiens
atgtatttttgtaaatag

SEQ ID NO: 3842018 - DNA, 20 bp, Homo sapiens
atgtatttttgtaaatagtt

SEQ ID NO: 3842019 - DNA, 23 bp, Homo sapiens
atgtcacatcctaatagaaagaa

SEQ ID NO: 3842020 - DNA, 22 bp, Homo sapiens
atgtcattaaagtgcactgtgt

SEQ ID NO: 3842021 - DNA, 17 bp, Homo sapiens
atgtcattgcccacttc

SEQ ID NO: 3842022 - DNA, 18 bp, Homo sapiens
atgtcccacctctctgag

SEQ ID NO: 3842023 - DNA, 16 bp, Homo sapiens
atgtctataagtatat

SEQ ID NO: 3842024 - DNA, 19 bp, Homo sapiens
atgtctctttggggagagc

SEQ ID NO: 3842025 - DNA, 22 bp, Homo sapiens
atgtctctttggggagagctgg

SEQ ID NO: 3842026 - DNA, 23 bp, Homo sapiens
atgtctctttggggagagctggc

SEQ ID NO: 3842027 - DNA, 14 bp, Homo sapiens
atgtgaacattcct

SEQ ID NO: 3842028 - DNA, 20 bp, Homo sapiens
atgtgacgctggaccttttc

SEQ ID NO: 3842029 - DNA, 22 bp, Homo sapiens
atgtgagccgcctcggagtgtg

SEQ ID NO: 3842030 - DNA, 21 bp, Homo sapiens
atgtgggatgagtttttaaat

SEQ ID NO: 3842031 - DNA, 17 bp, Homo sapiens
atgtgtgacaagtgtgt

SEQ ID NO: 3842032 - DNA, 15 bp, Homo sapiens
atgtgtgttttaaaa

SEQ ID NO: 3842033 - DNA, 13 bp, Homo sapiens
atgttacaaaaaa

SEQ ID NO: 3842034 - DNA, 15 bp, Homo sapiens
atgttactgccaaaa

SEQ ID NO: 3842035 - DNA, 18 bp, Homo sapiens
atgttgcatagaataaaa

SEQ ID NO: 3842036 - DNA, 22 bp, Homo sapiens
atgttgccagtttaatcattgc

SEQ ID NO: 3842037 - DNA, 19 bp, Homo sapiens
atgttgtgatgtacacatt

SEQ ID NO: 3842038 - DNA, 14 bp, Homo sapiens
atgtttaggaaatt

SEQ ID NO: 3842039 - DNA, 23 bp, Homo sapiens
atgtttctcattttaaacaactt

SEQ ID NO: 3842040 - DNA, 12 bp, Homo sapiens
atgttttacaac

SEQ ID NO: 3842041 - DNA, 10 bp, Homo sapiens
attaaacctt

SEQ ID NO: 3842042 - DNA, 20 bp, Homo sapiens
attaaactgtaaatcataat

SEQ ID NO: 3842043 - DNA, 18 bp, Homo sapiens
attaaagaatttaaaaaa

SEQ ID NO: 3842044 - DNA, 21 bp, Homo sapiens
attaaagaatttaaaaaagtt

SEQ ID NO: 3842045 - DNA, 19 bp, Homo sapiens
attaaatatatctttgtaa

SEQ ID NO: 3842046 - DNA, 19 bp, Homo sapiens
attaacatcaaacacggct

SEQ ID NO: 3842047 - DNA, 20 bp, Homo sapiens
attaagaaagattaaatata

SEQ ID NO: 3842048 - DNA, 17 bp, Homo sapiens
attaagtatatttgtaa

SEQ ID NO: 3842049 - DNA, 18 bp, Homo sapiens
attaagtatatttgtaaa

SEQ ID NO: 3842050 - DNA, 18 bp, Homo sapiens
attaagtgaaattttaaa

SEQ ID NO: 3842051 - DNA, 23 bp, Homo sapiens
attaatgctaagggcaggcccaa

SEQ ID NO: 3842052 - DNA, 15 bp, Homo sapiens
attaattaacatcaa

SEQ ID NO: 3842053 - DNA, 16 bp, Homo sapiens
attaattaacatcaaa

SEQ ID NO: 3842054 - DNA, 15 bp, Homo sapiens
attaattaattaaca

SEQ ID NO: 3842055 - DNA, 13 bp, Homo sapiens
attacaactaaat

SEQ ID NO: 3842056 - DNA, 13 bp, Homo sapiens
attacattaacat

SEQ ID NO: 3842057 - DNA, 17 bp, Homo sapiens
attagacaggttaaata

SEQ ID NO: 3842058 - DNA, 22 bp, Homo sapiens
attagacagtaagagtttacaa

SEQ ID NO: 3842059 - DNA, 15 bp, Homo sapiens
attaggaaggccatg

SEQ ID NO: 3842060 - DNA, 13 bp, Homo sapiens
attaggtcacatt

SEQ ID NO: 3842061 - DNA, 14 bp, Homo sapiens
attataataaattg

SEQ ID NO: 3842062 - DNA, 23 bp, Homo sapiens
attatactgtagatttcagtagt

SEQ ID NO: 3842063 - DNA, 22 bp, Homo sapiens
attatcaagctaataaaatatc

SEQ ID NO: 3842064 - DNA, 23 bp, Homo sapiens
attatcaagctaataaaatatca

SEQ ID NO: 3842065 - DNA, 12 bp, Homo sapiens
attatgcttctt

SEQ ID NO: 3842066 - DNA, 23 bp, Homo sapiens
attatgtgccagatttatgcata

SEQ ID NO: 3842067 - DNA, 21 bp, Homo sapiens
attatgtgtgttttaaaatga

SEQ ID NO: 3842068 - DNA, 18 bp, Homo sapiens
attattttatgttgcata

SEQ ID NO: 3842069 - DNA, 17 bp, Homo sapiens
attcagagttgatggtt

SEQ ID NO: 3842070 - DNA, 17 bp, Homo sapiens
attccactacacctggc

SEQ ID NO: 3842071 - DNA, 19 bp, Homo sapiens
attccactacacctggctg

SEQ ID NO: 3842072 - DNA, 22 bp, Homo sapiens
attccactacacctggctgagg

SEQ ID NO: 3842073 - DNA, 23 bp, Homo sapiens
attccaggaggagttagccaaac

SEQ ID NO: 3842074 - DNA, 11 bp, Homo sapiens
attcccaggag

SEQ ID NO: 3842075 - DNA, 20 bp, Homo sapiens
attcccaggagttctgctca

SEQ ID NO: 3842076 - DNA, 21 bp, Homo sapiens
attcccaggagttctgctcat

SEQ ID NO: 3842077 - DNA, 17 bp, Homo sapiens
attcccgcatggttttt

SEQ ID NO: 3842078 - DNA, 18 bp, Homo sapiens
attcctaaaactctgcca

SEQ ID NO: 3842079 - DNA, 19 bp, Homo sapiens
attcctaaaactctgccag

SEQ ID NO: 3842080 - DNA, 22 bp, Homo sapiens
attcctaaaactctgccagccc

SEQ ID NO: 3842081 - DNA, 22 bp, Homo sapiens
attcctaaggcccagctgccag

SEQ ID NO: 3842082 - DNA, 18 bp, Homo sapiens
attcgacctgatttacag

SEQ ID NO: 3842083 - DNA, 20 bp, Homo sapiens
attcgacctgatttacagtt

SEQ ID NO: 3842084 - DNA, 16 bp, Homo sapiens
attctaccctgttgca

SEQ ID NO: 3842085 - DNA, 22 bp, Homo sapiens
attctacttgctctggacctgc

SEQ ID NO: 3842086 - DNA, 15 bp, Homo sapiens
attctctaagatgaa

SEQ ID NO: 3842087 - DNA, 11 bp, Homo sapiens
attcttgaaag

SEQ ID NO: 3842088 - DNA, 21 bp, Homo sapiens
attcttggcccgcacagagct

SEQ ID NO: 3842089 - DNA, 18 bp, Homo sapiens
attctttctttttccttc

SEQ ID NO: 3842090 - DNA, 14 bp, Homo sapiens
attgaaatttatac

SEQ ID NO: 3842091 - DNA, 15 bp, Homo sapiens
attgacaagtgtctt

SEQ ID NO: 3842092 - DNA, 16 bp, Homo sapiens
attgacaagtgtcttt

SEQ ID NO: 3842093 - DNA, 14 bp, Homo sapiens
attgagaaggagag

SEQ ID NO: 3842094 - DNA, 15 bp, Homo sapiens
attgagaaggagaga

SEQ ID NO: 3842095 - DNA, 16 bp, Homo sapiens
attgagaaggagagaa

SEQ ID NO: 3842096 - DNA, 16 bp, Homo sapiens
attgatccagaaagaa

SEQ ID NO: 3842097 - DNA, 18 bp, Homo sapiens
attgatccagaaagaaaa

SEQ ID NO: 3842098 - DNA, 19 bp, Homo sapiens
attgcattttttaaaacaa

SEQ ID NO: 3842099 - DNA, 20 bp, Homo sapiens
attgcattttttaaaacaag

SEQ ID NO: 3842100 - DNA, 21 bp, Homo sapiens
attgcattttttaaaacaaga

SEQ ID NO: 3842101 - DNA, 18 bp, Homo sapiens
attgcccacttctgtgta

SEQ ID NO: 3842102 - DNA, 19 bp, Homo sapiens
attgcccacttctgtgtag

SEQ ID NO: 3842103 - DNA, 14 bp, Homo sapiens
attgctcaaaaaag

SEQ ID NO: 3842104 - DNA, 12 bp, Homo sapiens
attgctgcattt

SEQ ID NO: 3842105 - DNA, 14 bp, Homo sapiens
attgctgcatttta

SEQ ID NO: 3842106 - DNA, 17 bp, Homo sapiens
attgctgcattttaagc

SEQ ID NO: 3842107 - DNA, 22 bp, Homo sapiens
attgctgcattttaagcataat

SEQ ID NO: 3842108 - DNA, 20 bp, Homo sapiens
attgcttgaacccaggaggt

SEQ ID NO: 3842109 - DNA, 22 bp, Homo sapiens
attgctttcctgcctccttgaa

SEQ ID NO: 3842110 - DNA, 14 bp, Homo sapiens
attggcctctgtct

SEQ ID NO: 3842111 - DNA, 20 bp, Homo sapiens
attggcttaaaatgtactct

SEQ ID NO: 3842112 - DNA, 19 bp, Homo sapiens
attgggagcaatctggaaa

SEQ ID NO: 3842113 - DNA, 14 bp, Homo sapiens
attgtaaactaaag

SEQ ID NO: 3842114 - DNA, 22 bp, Homo sapiens
attgtaaactaaagtgtgcttt

SEQ ID NO: 3842115 - DNA, 15 bp, Homo sapiens
attgtaacttggatg

SEQ ID NO: 3842116 - DNA, 23 bp, Homo sapiens
attgtaacttggatgtagccatg

SEQ ID NO: 3842117 - DNA, 14 bp, Homo sapiens
attgtacagtttgt

SEQ ID NO: 3842118 - DNA, 16 bp, Homo sapiens
attgtacagtttgttt

SEQ ID NO: 3842119 - DNA, 18 bp, Homo sapiens
attgtacagtttgtttac

SEQ ID NO: 3842120 - DNA, 23 bp, Homo sapiens
attgtattatagtactgctttac

SEQ ID NO: 3842121 - DNA, 16 bp, Homo sapiens
attgtgtttatgcatt

SEQ ID NO: 3842122 - DNA, 13 bp, Homo sapiens
attgtgttttaac

SEQ ID NO: 3842123 - DNA, 13 bp, Homo sapiens
attgttcataata

SEQ ID NO: 3842124 - DNA, 13 bp, Homo sapiens
attgttttcaggt

SEQ ID NO: 3842125 - DNA, 13 bp, Homo sapiens
attgttttgcatc

SEQ ID NO: 3842126 - DNA, 14 bp, Homo sapiens
atttaaaataaata

SEQ ID NO: 3842127 - DNA, 24 bp, Homo sapiens
atttacagtttcaaaaactgtatt

SEQ ID NO: 3842128 - DNA, 19 bp, Homo sapiens
atttaggggtagaaaatgt

SEQ ID NO: 3842129 - DNA, 20 bp, Homo sapiens
atttagtatctttttattca

SEQ ID NO: 3842130 - DNA, 16 bp, Homo sapiens
atttagtgttcataaa

SEQ ID NO: 3842131 - DNA, 20 bp, Homo sapiens
atttataactaatatggttt

SEQ ID NO: 3842132 - DNA, 15 bp, Homo sapiens
atttatacaaagaaa

SEQ ID NO: 3842133 - DNA, 20 bp, Homo sapiens
atttattaagtatatttgta

SEQ ID NO: 3842134 - DNA, 13 bp, Homo sapiens
atttattgcttta

SEQ ID NO: 3842135 - DNA, 15 bp, Homo sapiens
atttcaatggtgttg

SEQ ID NO: 3842136 - DNA, 16 bp, Homo sapiens
atttcagtagtttcta

SEQ ID NO: 3842137 - DNA, 13 bp, Homo sapiens
atttcataaatta

SEQ ID NO: 3842138 - DNA, 19 bp, Homo sapiens
atttcatgaaaacttttta

SEQ ID NO: 3842139 - DNA, 15 bp, Homo sapiens
atttcccatctgcac

SEQ ID NO: 3842140 - DNA, 18 bp, Homo sapiens
atttcgtgttgtgttctt

SEQ ID NO: 3842141 - DNA, 23 bp, Homo sapiens
atttcgtgttgtgttctttataa

SEQ ID NO: 3842142 - DNA, 21 bp, Homo sapiens
atttctagacttccacaaaat

SEQ ID NO: 3842143 - DNA, 14 bp, Homo sapiens
atttgaacaaaaat

SEQ ID NO: 3842144 - DNA, 19 bp, Homo sapiens
atttggggcatttgtaaaa

SEQ ID NO: 3842145 - DNA, 11 bp, Homo sapiens
atttgtaaaaa

SEQ ID NO: 3842146 - DNA, 18 bp, Homo sapiens
atttgtaaaaagtagatt

SEQ ID NO: 3842147 - DNA, 13 bp, Homo sapiens
atttgtaaaacat

SEQ ID NO: 3842148 - DNA, 14 bp, Homo sapiens
atttgtaaaagcta

SEQ ID NO: 3842149 - DNA, 20 bp, Homo sapiens
atttgtaaaggactatttat

SEQ ID NO: 3842150 - DNA, 17 bp, Homo sapiens
atttgtctattctccag

SEQ ID NO: 3842151 - DNA, 18 bp, Homo sapiens
atttgtctgtgtgctact

SEQ ID NO: 3842152 - DNA, 22 bp, Homo sapiens
atttgtctgtgtgctactaaca

SEQ ID NO: 3842153 - DNA, 21 bp, Homo sapiens
atttgttcatagaccctctca

SEQ ID NO: 3842154 - DNA, 22 bp, Homo sapiens
atttgttcatagaccctctcaa

SEQ ID NO: 3842155 - DNA, 20 bp, Homo sapiens
attttaaaccataaaaagct

SEQ ID NO: 3842156 - DNA, 21 bp, Homo sapiens
attttaaaccataaaaagctg

SEQ ID NO: 3842157 - DNA, 14 bp, Homo sapiens
attttaaatgctgt

SEQ ID NO: 3842158 - DNA, 17 bp, Homo sapiens
attttaaatgctgtatg

SEQ ID NO: 3842159 - DNA, 13 bp, Homo sapiens
attttaagcataa

SEQ ID NO: 3842160 - DNA, 14 bp, Homo sapiens
attttaagcataat

SEQ ID NO: 3842161 - DNA, 18 bp, Homo sapiens
attttaattttaaaatgt

SEQ ID NO: 3842162 - DNA, 16 bp, Homo sapiens
attttatgtgcttgaa

SEQ ID NO: 3842163 - DNA, 19 bp, Homo sapiens
attttatgtgcttgaagat

SEQ ID NO: 3842164 - DNA, 18 bp, Homo sapiens
attttatgttgcatagaa

SEQ ID NO: 3842165 - DNA, 18 bp, Homo sapiens
attttattagacattctc

SEQ ID NO: 3842166 - DNA, 20 bp, Homo sapiens
attttcaaaagaaaacccaa

SEQ ID NO: 3842167 - DNA, 15 bp, Homo sapiens
attttcacaacatat

SEQ ID NO: 3842168 - DNA, 15 bp, Homo sapiens
attttcattttctgc

SEQ ID NO: 3842169 - DNA, 16 bp, Homo sapiens
attttccttgaagccg

SEQ ID NO: 3842170 - DNA, 14 bp, Homo sapiens
attttctttttcct

SEQ ID NO: 3842171 - DNA, 20 bp, Homo sapiens
attttctttttcctttataa

SEQ ID NO: 3842172 - DNA, 21 bp, Homo sapiens
attttgtcccatctctacccc

SEQ ID NO: 3842173 - DNA, 17 bp, Homo sapiens
attttgtgaaatttcat

SEQ ID NO: 3842174 - DNA, 14 bp, Homo sapiens
attttgtgggctta

SEQ ID NO: 3842175 - DNA, 17 bp, Homo sapiens
attttgtgtttaggaac

SEQ ID NO: 3842176 - DNA, 18 bp, Homo sapiens
atttttaaaactcagatt

SEQ ID NO: 3842177 - DNA, 16 bp, Homo sapiens
atttttacttgaagta

SEQ ID NO: 3842178 - DNA, 15 bp, Homo sapiens
atttttggcattcct

SEQ ID NO: 3842179 - DNA, 15 bp, Homo sapiens
atttttttctgaatt

SEQ ID NO: 3842180 - DNA, 14 bp, Homo sapiens
atttttttttctaa

SEQ ID NO: 3842181 - DNA, 17 bp, Homo sapiens
caaaaaagttataagaa

SEQ ID NO: 3842182 - DNA, 22 bp, Homo sapiens
caaaaactgtattgatgacagt

SEQ ID NO: 3842183 - DNA, 19 bp, Homo sapiens
caaaaattgagagctttat

SEQ ID NO: 3842184 - DNA, 21 bp, Homo sapiens
caaaattcgacctgatttaca

SEQ ID NO: 3842185 - DNA, 16 bp, Homo sapiens
caaaattgttacaaat

SEQ ID NO: 3842186 - DNA, 12 bp, Homo sapiens
caaaccaggatt

SEQ ID NO: 3842187 - DNA, 23 bp, Homo sapiens
caaacgctaaagagcccttgcct

SEQ ID NO: 3842188 - DNA, 22 bp, Homo sapiens
caaactgtctctgcctcttccc

SEQ ID NO: 3842189 - DNA, 13 bp, Homo sapiens
caaagaaactttt

SEQ ID NO: 3842190 - DNA, 12 bp, Homo sapiens
caaagaaattat

SEQ ID NO: 3842191 - DNA, 16 bp, Homo sapiens
caaagaccttgtgtgt

SEQ ID NO: 3842192 - DNA, 14 bp, Homo sapiens
caaagagggcttcc

SEQ ID NO: 3842193 - DNA, 15 bp, Homo sapiens
caaagagggcttcct

SEQ ID NO: 3842194 - DNA, 15 bp, Homo sapiens
caaagccccatgctg

SEQ ID NO: 3842195 - DNA, 16 bp, Homo sapiens
caaagccccatgctgg

SEQ ID NO: 3842196 - DNA, 20 bp, Homo sapiens
caaagggagggtggcagaga

SEQ ID NO: 3842197 - DNA, 21 bp, Homo sapiens
caaagggagggtggcagagac

SEQ ID NO: 3842198 - DNA, 14 bp, Homo sapiens
caaaggtaaatcag

SEQ ID NO: 3842199 - DNA, 16 bp, Homo sapiens
caaagtactagctaaa

SEQ ID NO: 3842200 - DNA, 12 bp, Homo sapiens
caaataaacact

SEQ ID NO: 3842201 - DNA, 20 bp, Homo sapiens
caaataaacactgtgtaagc

SEQ ID NO: 3842202 - DNA, 20 bp, Homo sapiens
caaatagcctctcctttgta

SEQ ID NO: 3842203 - DNA, 15 bp, Homo sapiens
caaatatatgcctta

SEQ ID NO: 3842204 - DNA, 22 bp, Homo sapiens
caaatccagcctgctgcctgct

SEQ ID NO: 3842205 - DNA, 21 bp, Homo sapiens
caaatcccccgactccctccc

SEQ ID NO: 3842206 - DNA, 16 bp, Homo sapiens
caaatctgttacctct

SEQ ID NO: 3842207 - DNA, 16 bp, Homo sapiens
caaatgactactacac

SEQ ID NO: 3842208 - DNA, 23 bp, Homo sapiens
caaatgatctagttcagaaggaa

SEQ ID NO: 3842209 - DNA, 18 bp, Homo sapiens
caaatgtaaagtctagaa

SEQ ID NO: 3842210 - DNA, 16 bp, Homo sapiens
caaattatcaagctaa

SEQ ID NO: 3842211 - DNA, 18 bp, Homo sapiens
caaattatcaagctaata

SEQ ID NO: 3842212 - DNA, 20 bp, Homo sapiens
caaattatcaagctaataaa

SEQ ID NO: 3842213 - DNA, 14 bp, Homo sapiens
caaattccctctgg

SEQ ID NO: 3842214 - DNA, 15 bp, Homo sapiens
caaattccctctgga

SEQ ID NO: 3842215 - DNA, 23 bp, Homo sapiens
caaattgattcaaatgttacaaa

SEQ ID NO: 3842216 - DNA, 15 bp, Homo sapiens
caacatatcagactt

SEQ ID NO: 3842217 - DNA, 20 bp, Homo sapiens
caaccactcggggcccccat

SEQ ID NO: 3842218 - DNA, 18 bp, Homo sapiens
caacgctgctgcctgctt

SEQ ID NO: 3842219 - DNA, 18 bp, Homo sapiens
caactccagctgagtcct

SEQ ID NO: 3842220 - DNA, 16 bp, Homo sapiens
caacttgtctctgtag

SEQ ID NO: 3842221 - DNA, 21 bp, Homo sapiens
caactttccactgacaacgaa

SEQ ID NO: 3842222 - DNA, 18 bp, Homo sapiens
caactttttcattccctg

SEQ ID NO: 3842223 - DNA, 22 bp, Homo sapiens
caagaaacaatgtctggggaca

SEQ ID NO: 3842224 - DNA, 14 bp, Homo sapiens
caagaaagtttccc

SEQ ID NO: 3842225 - DNA, 16 bp, Homo sapiens
caagaactcctcccac

SEQ ID NO: 3842226 - DNA, 22 bp, Homo sapiens
caagaactcctcccacccaact

SEQ ID NO: 3842227 - DNA, 16 bp, Homo sapiens
agtaagtaagaaagaa

SEQ ID NO: 3842228 - DNA, 18 bp, Homo sapiens
agtaataaaaagccacca

SEQ ID NO: 3842229 - DNA, 19 bp, Homo sapiens
agtaccaggccgtttgctt

SEQ ID NO: 3842230 - DNA, 14 bp, Homo sapiens
agtactgctttact

SEQ ID NO: 3842231 - DNA, 15 bp, Homo sapiens
agtactgctttactg

SEQ ID NO: 3842232 - DNA, 17 bp, Homo sapiens
agtagctgggattacag

SEQ ID NO: 3842233 - DNA, 12 bp, Homo sapiens
agtagtttctaa

SEQ ID NO: 3842234 - DNA, 13 bp, Homo sapiens
agtataatgtatg

SEQ ID NO: 3842235 - DNA, 22 bp, Homo sapiens
agtatattgatccagaaagaaa

SEQ ID NO: 3842236 - DNA, 14 bp, Homo sapiens
agtatatttgtaaa

SEQ ID NO: 3842237 - DNA, 17 bp, Homo sapiens
agtatatttgtaaaagc

SEQ ID NO: 3842238 - DNA, 18 bp, Homo sapiens
agtatatttgtaaaagct

SEQ ID NO: 3842239 - DNA, 20 bp, Homo sapiens
agtatatttgtaaaagctaa

SEQ ID NO: 3842240 - DNA, 14 bp, Homo sapiens
agtattaaactgta

SEQ ID NO: 3842241 - DNA, 20 bp, Homo sapiens
agtattaaactgtaaatcat

SEQ ID NO: 3842242 - DNA, 23 bp, Homo sapiens
agtattaagtgaaattttaaatg

SEQ ID NO: 3842243 - DNA, 20 bp, Homo sapiens
agtcacaattttctgtgcca

SEQ ID NO: 3842244 - DNA, 23 bp, Homo sapiens
agtcactttctttgtaacaactt

SEQ ID NO: 3842245 - DNA, 12 bp, Homo sapiens
agtcagtgctgg

SEQ ID NO: 3842246 - DNA, 16 bp, Homo sapiens
agtccattctcccagg

SEQ ID NO: 3842247 - DNA, 19 bp, Homo sapiens
agtcccaccctgctgctgc

SEQ ID NO: 3842248 - DNA, 11 bp, Homo sapiens
agtccccaccc

SEQ ID NO: 3842249 - DNA, 12 bp, Homo sapiens
agtccccacccc

SEQ ID NO: 3842250 - DNA, 16 bp, Homo sapiens
agtccccacccctgcc

SEQ ID NO: 3842251 - DNA, 17 bp, Homo sapiens
agtccccacccctgccc

SEQ ID NO: 3842252 - DNA, 18 bp, Homo sapiens
agtccccattttctggta

SEQ ID NO: 3842253 - DNA, 13 bp, Homo sapiens
agtcctcccctca

SEQ ID NO: 3842254 - DNA, 15 bp, Homo sapiens
agtcctcccctcaca

SEQ ID NO: 3842255 - DNA, 18 bp, Homo sapiens
agtcctcccctcacagcc

SEQ ID NO: 3842256 - DNA, 23 bp, Homo sapiens
agtcctcccctcacagcctctga

SEQ ID NO: 3842257 - DNA, 19 bp, Homo sapiens
agtcctgagtgggtgttgc

SEQ ID NO: 3842258 - DNA, 21 bp, Homo sapiens
agtcctgagtgggtgttgcac

SEQ ID NO: 3842259 - DNA, 14 bp, Homo sapiens
agtccttagcctgg

SEQ ID NO: 3842260 - DNA, 17 bp, Homo sapiens
agtccttagcctgggcc

SEQ ID NO: 3842261 - DNA, 18 bp, Homo sapiens
agtccttagcctgggcct

SEQ ID NO: 3842262 - DNA, 19 bp, Homo sapiens
agtccttagcctgggcctc

SEQ ID NO: 3842263 - DNA, 21 bp, Homo sapiens
agtccttagcctgggcctcct

SEQ ID NO: 3842264 - DNA, 19 bp, Homo sapiens
agtcgctctcatgaagccc

SEQ ID NO: 3842265 - DNA, 22 bp, Homo sapiens
agtcgctctcatgaagccctta

SEQ ID NO: 3842266 - DNA, 22 bp, Homo sapiens
agtcgcttttggtgcctggctg

SEQ ID NO: 3842267 - DNA, 23 bp, Homo sapiens
agtctagaaaataatgcaaatgt

SEQ ID NO: 3842268 - DNA, 17 bp, Homo sapiens
agtctggaaagttggga

SEQ ID NO: 3842269 - DNA, 14 bp, Homo sapiens
agtctgtcataata

SEQ ID NO: 3842270 - DNA, 22 bp, Homo sapiens
agtctgtcataatatttgaaca

SEQ ID NO: 3842271 - DNA, 18 bp, Homo sapiens
agtctgtggcccaagaga

SEQ ID NO: 3842272 - DNA, 15 bp, Homo sapiens
agtctgttattgttt

SEQ ID NO: 3842273 - DNA, 19 bp, Homo sapiens
agtctgttattgttttgtt

SEQ ID NO: 3842274 - DNA, 21 bp, Homo sapiens
agtctgttattgttttgttaa

SEQ ID NO: 3842275 - DNA, 14 bp, Homo sapiens
agtcttccaaacca

SEQ ID NO: 3842276 - DNA, 17 bp, Homo sapiens
agtcttgtgactagtgc

SEQ ID NO: 3842277 - DNA, 20 bp, Homo sapiens
agtcttgtgactagtgctga

SEQ ID NO: 3842278 - DNA, 15 bp, Homo sapiens
agtgaccgcttcccc

SEQ ID NO: 3842279 - DNA, 22 bp, Homo sapiens
agtgaccgcttccccgatgtga

SEQ ID NO: 3842280 - DNA, 14 bp, Homo sapiens
agtgatgttgaaat

SEQ ID NO: 3842281 - DNA, 12 bp, Homo sapiens
agtgcagtggct

SEQ ID NO: 3842282 - DNA, 12 bp, Homo sapiens
agtgccatggct

SEQ ID NO: 3842283 - DNA, 14 bp, Homo sapiens
agtgccatggctgg

SEQ ID NO: 3842284 - DNA, 22 bp, Homo sapiens
agtgctgaagcttattaatgct

SEQ ID NO: 3842285 - DNA, 14 bp, Homo sapiens
agtgctggagaaat

SEQ ID NO: 3842286 - DNA, 20 bp, Homo sapiens
agtggacattgttggcagca

SEQ ID NO: 3842287 - DNA, 14 bp, Homo sapiens
agtggccggggctg

SEQ ID NO: 3842288 - DNA, 19 bp, Homo sapiens
agtggccggggctgaagcc

SEQ ID NO: 3842289 - DNA, 16 bp, Homo sapiens
agtggggtgctgggag

SEQ ID NO: 3842290 - DNA, 21 bp, Homo sapiens
agtggggtgctgggaggaggg

SEQ ID NO: 3842291 - DNA, 16 bp, Homo sapiens
agtggtccctgccctc

SEQ ID NO: 3842292 - DNA, 17 bp, Homo sapiens
agtggttttatactgaa

SEQ ID NO: 3842293 - DNA, 20 bp, Homo sapiens
agtggttttatactgaagga

SEQ ID NO: 3842294 - DNA, 15 bp, Homo sapiens
agtgtgctttataaa

SEQ ID NO: 3842295 - DNA, 22 bp, Homo sapiens
agtgtgctttataaaaaaaagt

SEQ ID NO: 3842296 - DNA, 18 bp, Homo sapiens
agtgtgtgtttttcataa

SEQ ID NO: 3842297 - DNA, 13 bp, Homo sapiens
agtgttttacaat

SEQ ID NO: 3842298 - DNA, 18 bp, Homo sapiens
agttaaatatgatttgca

SEQ ID NO: 3842299 - DNA, 17 bp, Homo sapiens
agttagccaaacaacaa

SEQ ID NO: 3842300 - DNA, 15 bp, Homo sapiens
agttagccactgctg

SEQ ID NO: 3842301 - DNA, 16 bp, Homo sapiens
agttagccactgctgg

SEQ ID NO: 3842302 - DNA, 13 bp, Homo sapiens
agttataagaaaa

SEQ ID NO: 3842303 - DNA, 14 bp, Homo sapiens
agttatatagataa

SEQ ID NO: 3842304 - DNA, 14 bp, Homo sapiens
agttattttctaca

SEQ ID NO: 3842305 - DNA, 23 bp, Homo sapiens
agttattttctacagtggtttta

SEQ ID NO: 3842306 - DNA, 11 bp, Homo sapiens
agttcaagtga

SEQ ID NO: 3842307 - DNA, 19 bp, Homo sapiens
agttcccgggccctcctgg

SEQ ID NO: 3842308 - DNA, 21 bp, Homo sapiens
agttcccgggccctcctgggc

SEQ ID NO: 3842309 - DNA, 13 bp, Homo sapiens
agttctatttgct

SEQ ID NO: 3842310 - DNA, 16 bp, Homo sapiens
agttctatttgctatc

SEQ ID NO: 3842311 - DNA, 17 bp, Homo sapiens
agttctctcgaatactt

SEQ ID NO: 3842312 - DNA, 21 bp, Homo sapiens
agttctgctcattctaatgat

SEQ ID NO: 3842313 - DNA, 19 bp, Homo sapiens
agttgcaactttgtataaa

SEQ ID NO: 3842314 - DNA, 17 bp, Homo sapiens
agttggcatcacctgcg

SEQ ID NO: 3842315 - DNA, 21 bp, Homo sapiens
agttgggggccagcacagctg

SEQ ID NO: 3842316 - DNA, 20 bp, Homo sapiens
agttgggggctaggggaggg

SEQ ID NO: 3842317 - DNA, 13 bp, Homo sapiens
agttgtttataaa

SEQ ID NO: 3842318 - DNA, 15 bp, Homo sapiens
agttgtttataaaaa

SEQ ID NO: 3842319 - DNA, 15 bp, Homo sapiens
agtttacaagaaata

SEQ ID NO: 3842320 - DNA, 16 bp, Homo sapiens
agtttacaagaaataa

SEQ ID NO: 3842321 - DNA, 15 bp, Homo sapiens
agtttctaagtctgt

SEQ ID NO: 3842322 - DNA, 16 bp, Homo sapiens
agtttgagctgccttc

SEQ ID NO: 3842323 - DNA, 13 bp, Homo sapiens
agtttgcccagag

SEQ ID NO: 3842324 - DNA, 14 bp, Homo sapiens
agtttgcccagagt

SEQ ID NO: 3842325 - DNA, 16 bp, Homo sapiens
agtttgcccagagttg

SEQ ID NO: 3842326 - DNA, 17 bp, Homo sapiens
agtttgcccagagttgg

SEQ ID NO: 3842327 - DNA, 14 bp, Homo sapiens
agtttgtttacaca

SEQ ID NO: 3842328 - DNA, 19 bp, Homo sapiens
agttttactgcattttcac

SEQ ID NO: 3842329 - DNA, 13 bp, Homo sapiens
agtttttgaaaga

SEQ ID NO: 3842330 - DNA, 22 bp, Homo sapiens
agtttttgaaagacaaaattta

SEQ ID NO: 3842331 - DNA, 12 bp, Homo sapiens
ataaaaagctga

SEQ ID NO: 3842332 - DNA, 20 bp, Homo sapiens
ataaaagcctgtttaagaga

SEQ ID NO: 3842333 - DNA, 22 bp, Homo sapiens
ataaaagggactgagaaattta

SEQ ID NO: 3842334 - DNA, 20 bp, Homo sapiens
ataaacttttttcttactgt

SEQ ID NO: 3842335 - DNA, 22 bp, Homo sapiens
ataaagaaagattgtaaactaa

SEQ ID NO: 3842336 - DNA, 10 bp, Homo sapiens
ataaagcaat

SEQ ID NO: 3842337 - DNA, 12 bp, Homo sapiens
ataaagcaattt

SEQ ID NO: 3842338 - DNA, 13 bp, Homo sapiens
ataaagcaatttt

SEQ ID NO: 3842339 - DNA, 15 bp, Homo sapiens
ataaagcaattttcc

SEQ ID NO: 3842340 - DNA, 18 bp, Homo sapiens
ataaagcaattttccttg

SEQ ID NO: 3842341 - DNA, 14 bp, Homo sapiens
ataaaggctctgga

SEQ ID NO: 3842342 - DNA, 15 bp, Homo sapiens
ataaaggttcatgca

SEQ ID NO: 3842343 - DNA, 13 bp, Homo sapiens
ataaataaagttt

SEQ ID NO: 3842344 - DNA, 19 bp, Homo sapiens
ataaataaagtttgttgaa

SEQ ID NO: 3842345 - DNA, 22 bp, Homo sapiens
ataaataattttgttttaatct

SEQ ID NO: 3842346 - DNA, 12 bp, Homo sapiens
ataaattaacaa

SEQ ID NO: 3842347 - DNA, 22 bp, Homo sapiens
ataaattaacaaagtgtcactc

SEQ ID NO: 3842348 - DNA, 14 bp, Homo sapiens
ataacagttataaa

SEQ ID NO: 3842349 - DNA, 20 bp, Homo sapiens
ataacagttataaagaaaga

SEQ ID NO: 3842350 - DNA, 24 bp, Homo sapiens
ataacagttataaagaaagattgt

SEQ ID NO: 3842351 - DNA, 14 bp, Homo sapiens
ataacgtataaaag

SEQ ID NO: 3842352 - DNA, 14 bp, Homo sapiens
ataacttgccattt

SEQ ID NO: 3842353 - DNA, 13 bp, Homo sapiens
ataagaaaactac

SEQ ID NO: 3842354 - DNA, 21 bp, Homo sapiens
ataagaaaactacatgtaaaa

SEQ ID NO: 3842355 - DNA, 12 bp, Homo sapiens
ataagaaatttt

SEQ ID NO: 3842356 - DNA, 21 bp, Homo sapiens
ataagaaattttattagacat

SEQ ID NO: 3842357 - DNA, 21 bp, Homo sapiens
ataaggagctttgctcttgga

SEQ ID NO: 3842358 - DNA, 17 bp, Homo sapiens
ataaggccgagcccaca

SEQ ID NO: 3842359 - DNA, 15 bp, Homo sapiens
ataatacataaagtt

SEQ ID NO: 3842360 - DNA, 18 bp, Homo sapiens
ataatattcatacaacaa

SEQ ID NO: 3842361 - DNA, 16 bp, Homo sapiens
ataatatttgaacaaa

SEQ ID NO: 3842362 - DNA, 20 bp, Homo sapiens
ataatgcttggaatgggaga

SEQ ID NO: 3842363 - DNA, 13 bp, Homo sapiens
ataatgtaactga

SEQ ID NO: 3842364 - DNA, 21 bp, Homo sapiens
ataatgtaactgaagcataaa

SEQ ID NO: 3842365 - DNA, 12 bp, Homo sapiens
ataatgtcttta

SEQ ID NO: 3842366 - DNA, 13 bp, Homo sapiens
ataattttaaatg

SEQ ID NO: 3842367 - DNA, 12 bp, Homo sapiens
ataattttgcaa

SEQ ID NO: 3842368 - DNA, 18 bp, Homo sapiens
ataattttgcaaatctgt

SEQ ID NO: 3842369 - DNA, 17 bp, Homo sapiens
atacaatatatattttg

SEQ ID NO: 3842370 - DNA, 11 bp, Homo sapiens
atacacacaca

SEQ ID NO: 3842371 - DNA, 20 bp, Homo sapiens
atacagaattgtgtctgcag

SEQ ID NO: 3842372 - DNA, 12 bp, Homo sapiens
atacataaagtt

SEQ ID NO: 3842373 - DNA, 17 bp, Homo sapiens
atactatattaactttt

SEQ ID NO: 3842374 - DNA, 13 bp, Homo sapiens
atactgaaggaaa

SEQ ID NO: 3842375 - DNA, 13 bp, Homo sapiens
atactttgaatgt

SEQ ID NO: 3842376 - DNA, 16 bp, Homo sapiens
atactttgaatgttgt

SEQ ID NO: 3842377 - DNA, 15 bp, Homo sapiens
atagaaagaaattac

SEQ ID NO: 3842378 - DNA, 13 bp, Homo sapiens
atagaaggcaggt

SEQ ID NO: 3842379 - DNA, 14 bp, Homo sapiens
atagaataaaattt

SEQ ID NO: 3842380 - DNA, 15 bp, Homo sapiens
atagaccctctcaag

SEQ ID NO: 3842381 - DNA, 16 bp, Homo sapiens
atagactgactttttc

SEQ ID NO: 3842382 - DNA, 17 bp, Homo sapiens
atagaggagaggaaaag

SEQ ID NO: 3842383 - DNA, 12 bp, Homo sapiens
atagaggctagc

SEQ ID NO: 3842384 - DNA, 17 bp, Homo sapiens
atagagtgcataaataa

SEQ ID NO: 3842385 - DNA, 20 bp, Homo sapiens
atagatgagtttttcattat

SEQ ID NO: 3842386 - DNA, 22 bp, Homo sapiens
atagatgagtttttcattattt

SEQ ID NO: 3842387 - DNA, 18 bp, Homo sapiens
atagcccatccctgcctg

SEQ ID NO: 3842388 - DNA, 23 bp, Homo sapiens
atagcctaaaagattttgtgaaa

SEQ ID NO: 3842389 - DNA, 13 bp, Homo sapiens
atagctaaataac

SEQ ID NO: 3842390 - DNA, 20 bp, Homo sapiens
atagggtagtttgcaaacaa

SEQ ID NO: 3842391 - DNA, 23 bp, Homo sapiens
ataggtatttcttccagtgatgt

SEQ ID NO: 3842392 - DNA, 16 bp, Homo sapiens
atagtactgctttact

SEQ ID NO: 3842393 - DNA, 15 bp, Homo sapiens
atagtattaagtgaa

SEQ ID NO: 3842394 - DNA, 18 bp, Homo sapiens
atagtattaagtgaaatt

SEQ ID NO: 3842395 - DNA, 14 bp, Homo sapiens
atataaataaatat

SEQ ID NO: 3842396 - DNA, 15 bp, Homo sapiens
atataaatactatag

SEQ ID NO: 3842397 - DNA, 20 bp, Homo sapiens
atataaatatatataaatat

SEQ ID NO: 3842398 - DNA, 15 bp, Homo sapiens
atataagtgtgtgtt

SEQ ID NO: 3842399 - DNA, 14 bp, Homo sapiens
atatataaacaaac

SEQ ID NO: 3842400 - DNA, 17 bp, Homo sapiens
atatataaacaaacaaa

SEQ ID NO: 3842401 - DNA, 10 bp, Homo sapiens
atatataaat

SEQ ID NO: 3842402 - DNA, 14 bp, Homo sapiens
atatatataaataa

SEQ ID NO: 3842403 - DNA, 13 bp, Homo sapiens
atatatattttgt

SEQ ID NO: 3842404 - DNA, 12 bp, Homo sapiens
atatatctatat

SEQ ID NO: 3842405 - DNA, 18 bp, Homo sapiens
atatatctttgtaaatta

SEQ ID NO: 3842406 - DNA, 20 bp, Homo sapiens
atatatctttgtaaattatt

SEQ ID NO: 3842407 - DNA, 20 bp, Homo sapiens
atatatgccttactattgta

SEQ ID NO: 3842408 - DNA, 23 bp, Homo sapiens
atatatgtttgtggaatggattt

SEQ ID NO: 3842409 - DNA, 16 bp, Homo sapiens
atatattttaaatgtg

SEQ ID NO: 3842410 - DNA, 18 bp, Homo sapiens
atatattttaaatgtgga

SEQ ID NO: 3842411 - DNA, 13 bp, Homo sapiens
atatcattcagca

SEQ ID NO: 3842412 - DNA, 14 bp, Homo sapiens
atatcattcagcaa

SEQ ID NO: 3842413 - DNA, 15 bp, Homo sapiens
atatcattcagcaac

SEQ ID NO: 3842414 - DNA, 13 bp, Homo sapiens
atatccatatgaa

SEQ ID NO: 3842415 - DNA, 18 bp, Homo sapiens
atatctatatgtctataa

SEQ ID NO: 3842416 - DNA, 20 bp, Homo sapiens
atatctttgtaaattatttt

SEQ ID NO: 3842417 - DNA, 15 bp, Homo sapiens
atatgatttgcattt

SEQ ID NO: 3842418 - DNA, 14 bp, Homo sapiens
atatgtttgtggaa

SEQ ID NO: 3842419 - DNA, 22 bp, Homo sapiens
atatgtttgtggaatggatttt

SEQ ID NO: 3842420 - DNA, 15 bp, Homo sapiens
atattattttatgtt

SEQ ID NO: 3842421 - DNA, 17 bp, Homo sapiens
atattcatacaacaaag

SEQ ID NO: 3842422 - DNA, 23 bp, Homo sapiens
atattctattttcattttctgca

SEQ ID NO: 3842423 - DNA, 15 bp, Homo sapiens
atattgatccagaaa

SEQ ID NO: 3842424 - DNA, 18 bp, Homo sapiens
atattgtgttttaacacc

SEQ ID NO: 3842425 - DNA, 18 bp, Homo sapiens
atatttagtgttcataaa

SEQ ID NO: 3842426 - DNA, 14 bp, Homo sapiens
atatttattgcttt

SEQ ID NO: 3842427 - DNA, 18 bp, Homo sapiens
atatttcataaattaaca

SEQ ID NO: 3842428 - DNA, 16 bp, Homo sapiens
atatttgtaaaagcta

SEQ ID NO: 3842429 - DNA, 19 bp, Homo sapiens
atatttttggcattcctct

SEQ ID NO: 3842430 - DNA, 14 bp, Homo sapiens
atcaagtgtaatta

SEQ ID NO: 3842431 - DNA, 19 bp, Homo sapiens
atcaagtgtaattagcttt

SEQ ID NO: 3842432 - DNA, 17 bp, Homo sapiens
atcaatacactagttgt

SEQ ID NO: 3842433 - DNA, 19 bp, Homo sapiens
atcaatacactagttgttt

SEQ ID NO: 3842434 - DNA, 13 bp, Homo sapiens
atcaatcattgta

SEQ ID NO: 3842435 - DNA, 17 bp, Homo sapiens
atcaatcattgtacagt

SEQ ID NO: 3842436 - DNA, 22 bp, Homo sapiens
atcacctgcgcagggccctctg

SEQ ID NO: 3842437 - DNA, 17 bp, Homo sapiens
atcacttgaatcctagg

SEQ ID NO: 3842438 - DNA, 21 bp, Homo sapiens
atcagaaggtattttttaact

SEQ ID NO: 3842439 - DNA, 21 bp, Homo sapiens
atcagtcagtgctggagaaat

SEQ ID NO: 3842440 - DNA, 19 bp, Homo sapiens
atcagtcatgacagatgaa

SEQ ID NO: 3842441 - DNA, 15 bp, Homo sapiens
atcattgtacagttt

SEQ ID NO: 3842442 - DNA, 16 bp, Homo sapiens
atcattgtacagtttg

SEQ ID NO: 3842443 - DNA, 16 bp, Homo sapiens
atcatttcatgctttg

SEQ ID NO: 3842444 - DNA, 16 bp, Homo sapiens
atccaaatgtgaaaga

SEQ ID NO: 3842445 - DNA, 20 bp, Homo sapiens
atccaaattccctctggagt

SEQ ID NO: 3842446 - DNA, 16 bp, Homo sapiens
atccaagcaaatgtga

SEQ ID NO: 3842447 - DNA, 18 bp, Homo sapiens
atccaagcaaatgtgaat

SEQ ID NO: 3842448 - DNA, 12 bp, Homo sapiens
atccacctccat

SEQ ID NO: 3842449 - DNA, 23 bp, Homo sapiens
atccatcctgctagcacctcccc

SEQ ID NO: 3842450 - DNA, 18 bp, Homo sapiens
atcccagcattttgagag

SEQ ID NO: 3842451 - DNA, 21 bp, Homo sapiens
atcccaggacaccacacccag

SEQ ID NO: 3842452 - DNA, 13 bp, Homo sapiens
atcccaggtgagg

SEQ ID NO: 3842453 - DNA, 14 bp, Homo sapiens
atccccagggcagc

SEQ ID NO: 3842454 - DNA, 13 bp, Homo sapiens
atcccctgcctcc

SEQ ID NO: 3842455 - DNA, 14 bp, Homo sapiens
atccctgcctggtc

SEQ ID NO: 3842456 - DNA, 12 bp, Homo sapiens
atcccttcccca

SEQ ID NO: 3842457 - DNA, 16 bp, Homo sapiens
atcctaatttctcctc

SEQ ID NO: 3842458 - DNA, 20 bp, Homo sapiens
atcctaatttctcctccctt

SEQ ID NO: 3842459 - DNA, 23 bp, Homo sapiens
atcctaatttctcctcccttcct

SEQ ID NO: 3842460 - DNA, 20 bp, Homo sapiens
atcctgctagcacctcccca

SEQ ID NO: 3842461 - DNA, 16 bp, Homo sapiens
atcctggtattgtaat

SEQ ID NO: 3842462 - DNA, 18 bp, Homo sapiens
atcctggtattgtaatat

SEQ ID NO: 3842463 - DNA, 19 bp, Homo sapiens
atcctggtattgtaatatt

SEQ ID NO: 3842464 - DNA, 14 bp, Homo sapiens
atcctttgcatttc

SEQ ID NO: 3842465 - DNA, 19 bp, Homo sapiens
atcggcttcctcaggggca

SEQ ID NO: 3842466 - DNA, 12 bp, Homo sapiens
atcgtaaaatta

SEQ ID NO: 3842467 - DNA, 14 bp, Homo sapiens
atcgtggagaaaca

SEQ ID NO: 3842468 - DNA, 15 bp, Homo sapiens
atcgtggagaaacaa

SEQ ID NO: 3842469 - DNA, 19 bp, Homo sapiens
atcgtggagaaacaagaga

SEQ ID NO: 3842470 - DNA, 16 bp, Homo sapiens
atctataacaaatgct

SEQ ID NO: 3842471 - DNA, 18 bp, Homo sapiens
atctatatttttgtgaag

SEQ ID NO: 3842472 - DNA, 19 bp, Homo sapiens
atctatctcatctatctca

SEQ ID NO: 3842473 - DNA, 17 bp, Homo sapiens
atctcaattgtgctttg

SEQ ID NO: 3842474 - DNA, 16 bp, Homo sapiens
atctcatcccaataaa

SEQ ID NO: 3842475 - DNA, 15 bp, Homo sapiens
atctcatctatctca

SEQ ID NO: 3842476 - DNA, 10 bp, Homo sapiens
atctgcaccc

SEQ ID NO: 3842477 - DNA, 13 bp, Homo sapiens
atctgccaaaatg

SEQ ID NO: 3842478 - DNA, 15 bp, Homo sapiens
atctgccaaaatgta

SEQ ID NO: 3842479 - DNA, 17 bp, Homo sapiens
atctgccttaaaaccaa

SEQ ID NO: 3842480 - DNA, 21 bp, Homo sapiens
atctgccttaaaaccaaagag

SEQ ID NO: 3842481 - DNA, 13 bp, Homo sapiens
atctgctcagccc

SEQ ID NO: 3842482 - DNA, 14 bp, Homo sapiens
atctgctcagccct

SEQ ID NO: 3842483 - DNA, 15 bp, Homo sapiens
atctgctcagccctg

SEQ ID NO: 3842484 - DNA, 20 bp, Homo sapiens
atctgctcagccctggaggt

SEQ ID NO: 3842485 - DNA, 14 bp, Homo sapiens
atctggcccaggct

SEQ ID NO: 3842486 - DNA, 14 bp, Homo sapiens
atctggctgtgaca

SEQ ID NO: 3842487 - DNA, 20 bp, Homo sapiens
atctggctgtgacagcctct

SEQ ID NO: 3842488 - DNA, 18 bp, Homo sapiens
atcttgaatagcttatgt

SEQ ID NO: 3842489 - DNA, 16 bp, Homo sapiens
atcttgatagctaaat

SEQ ID NO: 3842490 - DNA, 20 bp, Homo sapiens
atcttgatctgctcagccct

SEQ ID NO: 3842491 - DNA, 23 bp, Homo sapiens
atcttgatctgctcagccctgga

SEQ ID NO: 3842492 - DNA, 23 bp, Homo sapiens
atcttggtccaggaaatgtgcac

SEQ ID NO: 3842493 - DNA, 22 bp, Homo sapiens
atctttaattttacatttccta

SEQ ID NO: 3842494 - DNA, 12 bp, Homo sapiens
atctttgtaaat

SEQ ID NO: 3842495 - DNA, 16 bp, Homo sapiens
atctttgtaaattatt

SEQ ID NO: 3842496 - DNA, 19 bp, Homo sapiens
atctttgttggctcagaaa

SEQ ID NO: 3842497 - DNA, 16 bp, Homo sapiens
atctttttgtttttct

SEQ ID NO: 3842498 - DNA, 19 bp, Homo sapiens
atgaaagtcttgtgactag

SEQ ID NO: 3842499 - DNA, 20 bp, Homo sapiens
atgaaagtcttgtgactagt

SEQ ID NO: 3842500 - DNA, 13 bp, Homo sapiens
atgaacactggct

SEQ ID NO: 3842501 - DNA, 17 bp, Homo sapiens
atgaagtgttttacaat

SEQ ID NO: 3842502 - DNA, 22 bp, Homo sapiens
agcctgtcggccacaccccaga

SEQ ID NO: 3842503 - DNA, 17 bp, Homo sapiens
agcctgtgtaacagctc

SEQ ID NO: 3842504 - DNA, 18 bp, Homo sapiens
agcctgtgtaacagctcc

SEQ ID NO: 3842505 - DNA, 19 bp, Homo sapiens
agcctgtgtaacagctcct

SEQ ID NO: 3842506 - DNA, 20 bp, Homo sapiens
agcctgtgtaacagctcctt

SEQ ID NO: 3842507 - DNA, 21 bp, Homo sapiens
agcctgtgtaacagctccttg

SEQ ID NO: 3842508 - DNA, 14 bp, Homo sapiens
agcctgtgtgcagt

SEQ ID NO: 3842509 - DNA, 23 bp, Homo sapiens
agcctgtgtgcagtggagctggc

SEQ ID NO: 3842510 - DNA, 20 bp, Homo sapiens
agccttcttagaactctgct

SEQ ID NO: 3842511 - DNA, 18 bp, Homo sapiens
agccttcttccatcccag

SEQ ID NO: 3842512 - DNA, 21 bp, Homo sapiens
agcctttggctctggagacag

SEQ ID NO: 3842513 - DNA, 13 bp, Homo sapiens
agcgcattgtttt

SEQ ID NO: 3842514 - DNA, 17 bp, Homo sapiens
agcgcattgttttgcat

SEQ ID NO: 3842515 - DNA, 16 bp, Homo sapiens
agcgcccctggctgcc

SEQ ID NO: 3842516 - DNA, 16 bp, Homo sapiens
agctaataaaatatca

SEQ ID NO: 3842517 - DNA, 17 bp, Homo sapiens
agctaataaaatatcat

SEQ ID NO: 3842518 - DNA, 18 bp, Homo sapiens
agctacttgggaggttga

SEQ ID NO: 3842519 - DNA, 16 bp, Homo sapiens
agctatttttactaga

SEQ ID NO: 3842520 - DNA, 21 bp, Homo sapiens
agctatttttactagaacaca

SEQ ID NO: 3842521 - DNA, 18 bp, Homo sapiens
agctcagaaaggttgagg

SEQ ID NO: 3842522 - DNA, 13 bp, Homo sapiens
agctcagcttcct

SEQ ID NO: 3842523 - DNA, 22 bp, Homo sapiens
agctctggagcaagccctgacc

SEQ ID NO: 3842524 - DNA, 14 bp, Homo sapiens
agctcttctcctca

SEQ ID NO: 3842525 - DNA, 18 bp, Homo sapiens
agctcttctcctcagctt

SEQ ID NO: 3842526 - DNA, 20 bp, Homo sapiens
agctgaagcctggacgcagc

SEQ ID NO: 3842527 - DNA, 15 bp, Homo sapiens
agctgaggaccctca

SEQ ID NO: 3842528 - DNA, 19 bp, Homo sapiens
agctgaggaccctcagccc

SEQ ID NO: 3842529 - DNA, 22 bp, Homo sapiens
agctgaggaccctcagccccag

SEQ ID NO: 3842530 - DNA, 23 bp, Homo sapiens
agctgagtcctggggttggggag

SEQ ID NO: 3842531 - DNA, 19 bp, Homo sapiens
agctgccagggaagacaga

SEQ ID NO: 3842532 - DNA, 21 bp, Homo sapiens
agctgccagggaagacagagc

SEQ ID NO: 3842533 - DNA, 19 bp, Homo sapiens
agctgcctatgcccagcct

SEQ ID NO: 3842534 - DNA, 22 bp, Homo sapiens
agctgcctatgcccagcctcca

SEQ ID NO: 3842535 - DNA, 14 bp, Homo sapiens
agctgccttcccta

SEQ ID NO: 3842536 - DNA, 16 bp, Homo sapiens
agctgccttccctagc

SEQ ID NO: 3842537 - DNA, 17 bp, Homo sapiens
agctgccttccctagct

SEQ ID NO: 3842538 - DNA, 18 bp, Homo sapiens
agctgcgcttgcttttct

SEQ ID NO: 3842539 - DNA, 11 bp, Homo sapiens
agctgctggcc

SEQ ID NO: 3842540 - DNA, 17 bp, Homo sapiens
agctgctggccatggct

SEQ ID NO: 3842541 - DNA, 19 bp, Homo sapiens
agctgcttaacagttgctt

SEQ ID NO: 3842542 - DNA, 12 bp, Homo sapiens
agctgcttctcc

SEQ ID NO: 3842543 - DNA, 13 bp, Homo sapiens
agctggagtgcca

SEQ ID NO: 3842544 - DNA, 20 bp, Homo sapiens
agctggagtgccatggctgg

SEQ ID NO: 3842545 - DNA, 19 bp, Homo sapiens
agctggcctaggtgggagc

SEQ ID NO: 3842546 - DNA, 16 bp, Homo sapiens
agctggcgtcacctgt

SEQ ID NO: 3842547 - DNA, 15 bp, Homo sapiens
agctgggagggaggg

SEQ ID NO: 3842548 - DNA, 21 bp, Homo sapiens
agctgggctagaggctgagca

SEQ ID NO: 3842549 - DNA, 21 bp, Homo sapiens
agctggggcaaggggcagcca

SEQ ID NO: 3842550 - DNA, 22 bp, Homo sapiens
agctggggcaaggggcagccag

SEQ ID NO: 3842551 - DNA, 23 bp, Homo sapiens
agctgtatagatgagtttttcat

SEQ ID NO: 3842552 - DNA, 15 bp, Homo sapiens
agctgtgagccttgg

SEQ ID NO: 3842553 - DNA, 17 bp, Homo sapiens
agcttaaaaaagaaaga

SEQ ID NO: 3842554 - DNA, 19 bp, Homo sapiens
agcttatgtacaaaacttt

SEQ ID NO: 3842555 - DNA, 14 bp, Homo sapiens
agcttattaatgct

SEQ ID NO: 3842556 - DNA, 21 bp, Homo sapiens
agcttattaatgctaagggca

SEQ ID NO: 3842557 - DNA, 15 bp, Homo sapiens
agcttcactcagctg

SEQ ID NO: 3842558 - DNA, 22 bp, Homo sapiens
agcttcccccccaccacaggcc

SEQ ID NO: 3842559 - DNA, 13 bp, Homo sapiens
agcttctctctga

SEQ ID NO: 3842560 - DNA, 16 bp, Homo sapiens
agcttctctctgagct

SEQ ID NO: 3842561 - DNA, 17 bp, Homo sapiens
agcttctctctgagctg

SEQ ID NO: 3842562 - DNA, 12 bp, Homo sapiens
agcttctgcttt

SEQ ID NO: 3842563 - DNA, 20 bp, Homo sapiens
agcttctgcttttctgccct

SEQ ID NO: 3842564 - DNA, 23 bp, Homo sapiens
agcttgagccgggcccctgggct

SEQ ID NO: 3842565 - DNA, 17 bp, Homo sapiens
agctttaagatatcttt

SEQ ID NO: 3842566 - DNA, 23 bp, Homo sapiens
agctttactctttcatgccattt

SEQ ID NO: 3842567 - DNA, 19 bp, Homo sapiens
agctttattgctgcatttt

SEQ ID NO: 3842568 - DNA, 21 bp, Homo sapiens
agcttttccctttttttaagt

SEQ ID NO: 3842569 - DNA, 19 bp, Homo sapiens
aggaaactccacatctgcc

SEQ ID NO: 3842570 - DNA, 23 bp, Homo sapiens
aggaaatttatacaaagaaactt

SEQ ID NO: 3842571 - DNA, 13 bp, Homo sapiens
aggaactctgtgt

SEQ ID NO: 3842572 - DNA, 21 bp, Homo sapiens
aggaactctgtgtgagagaga

SEQ ID NO: 3842573 - DNA, 23 bp, Homo sapiens
aggaactctgtgtgagagagagg

SEQ ID NO: 3842574 - DNA, 14 bp, Homo sapiens
aggaagcagaataa

SEQ ID NO: 3842575 - DNA, 17 bp, Homo sapiens
aggaagcagaataaagc

SEQ ID NO: 3842576 - DNA, 21 bp, Homo sapiens
aggaagcagaataaagcaatt

SEQ ID NO: 3842577 - DNA, 13 bp, Homo sapiens
aggaaggcaagag

SEQ ID NO: 3842578 - DNA, 23 bp, Homo sapiens
aggaaggccatggggcagcctcc

SEQ ID NO: 3842579 - DNA, 17 bp, Homo sapiens
aggaataaagcttctct

SEQ ID NO: 3842580 - DNA, 20 bp, Homo sapiens
aggaataaagcttctctctg

SEQ ID NO: 3842581 - DNA, 22 bp, Homo sapiens
aggaataaagcttctctctgag

SEQ ID NO: 3842582 - DNA, 21 bp, Homo sapiens
aggaatttgaagctcagaaag

SEQ ID NO: 3842583 - DNA, 20 bp, Homo sapiens
aggaattttatttttttctg

SEQ ID NO: 3842584 - DNA, 13 bp, Homo sapiens
aggacaaggctgt

SEQ ID NO: 3842585 - DNA, 15 bp, Homo sapiens
aggacaaggctgtgc

SEQ ID NO: 3842586 - DNA, 18 bp, Homo sapiens
aggacaaggctgtgccag

SEQ ID NO: 3842587 - DNA, 21 bp, Homo sapiens
aggacaaggctgtgccaggct

SEQ ID NO: 3842588 - DNA, 15 bp, Homo sapiens
aggacaccacaccca

SEQ ID NO: 3842589 - DNA, 21 bp, Homo sapiens
aggacaccacacccagcctca

SEQ ID NO: 3842590 - DNA, 22 bp, Homo sapiens
aggacaccacacccagcctcag

SEQ ID NO: 3842591 - DNA, 16 bp, Homo sapiens
aggaccctcagcccca

SEQ ID NO: 3842592 - DNA, 17 bp, Homo sapiens
aggaccctcagccccag

SEQ ID NO: 3842593 - DNA, 24 bp, Homo sapiens
aggaccctcagccccaggagaagg

SEQ ID NO: 3842594 - DNA, 18 bp, Homo sapiens
aggacctcagctgcttct

SEQ ID NO: 3842595 - DNA, 15 bp, Homo sapiens
aggacctccatgccc

SEQ ID NO: 3842596 - DNA, 22 bp, Homo sapiens
aggactgtggaggggagctgct

SEQ ID NO: 3842597 - DNA, 13 bp, Homo sapiens
aggagaaatagct

SEQ ID NO: 3842598 - DNA, 16 bp, Homo sapiens
aggagaacttgaacaa

SEQ ID NO: 3842599 - DNA, 20 bp, Homo sapiens
aggagaatggcatgaacccc

SEQ ID NO: 3842600 - DNA, 17 bp, Homo sapiens
aggagaattaggaaggc

SEQ ID NO: 3842601 - DNA, 11 bp, Homo sapiens
aggagagagaa

SEQ ID NO: 3842602 - DNA, 19 bp, Homo sapiens
aggagagagaaagccaggc

SEQ ID NO: 3842603 - DNA, 21 bp, Homo sapiens
aggagagagaaagccaggcag

SEQ ID NO: 3842604 - DNA, 10 bp, Homo sapiens
aggagagagg

SEQ ID NO: 3842605 - DNA, 13 bp, Homo sapiens
aggagagaggcag

SEQ ID NO: 3842606 - DNA, 15 bp, Homo sapiens
aggagaggagagagg

SEQ ID NO: 3842607 - DNA, 16 bp, Homo sapiens
aggagaggagagaggc

SEQ ID NO: 3842608 - DNA, 22 bp, Homo sapiens
aggagattgagaaggagagaaa

SEQ ID NO: 3842609 - DNA, 16 bp, Homo sapiens
aggagcagaataaatg

SEQ ID NO: 3842610 - DNA, 14 bp, Homo sapiens
aggagctttgctct

SEQ ID NO: 3842611 - DNA, 12 bp, Homo sapiens
aggagggagagg

SEQ ID NO: 3842612 - DNA, 14 bp, Homo sapiens
aggagggccctgag

SEQ ID NO: 3842613 - DNA, 16 bp, Homo sapiens
aggagggccctgagga

SEQ ID NO: 3842614 - DNA, 19 bp, Homo sapiens
aggagggccctgaggaata

SEQ ID NO: 3842615 - DNA, 13 bp, Homo sapiens
aggaggtggaggt

SEQ ID NO: 3842616 - DNA, 14 bp, Homo sapiens
aggagttctgctca

SEQ ID NO: 3842617 - DNA, 15 bp, Homo sapiens
aggagttctgctcat

SEQ ID NO: 3842618 - DNA, 18 bp, Homo sapiens
aggatcctggtattgtaa

SEQ ID NO: 3842619 - DNA, 18 bp, Homo sapiens
aggatcggcttcctcagg

SEQ ID NO: 3842620 - DNA, 20 bp, Homo sapiens
aggatgacggtattatgctt

SEQ ID NO: 3842621 - DNA, 23 bp, Homo sapiens
aggatgacggtattatgcttctt

SEQ ID NO: 3842622 - DNA, 13 bp, Homo sapiens
aggatgcctgagc

SEQ ID NO: 3842623 - DNA, 14 bp, Homo sapiens
aggatgcctgagcc

SEQ ID NO: 3842624 - DNA, 13 bp, Homo sapiens
aggatggtggggc

SEQ ID NO: 3842625 - DNA, 23 bp, Homo sapiens
aggatggtggggcccccagcacc

SEQ ID NO: 3842626 - DNA, 20 bp, Homo sapiens
aggattagacagtaagagtt

SEQ ID NO: 3842627 - DNA, 21 bp, Homo sapiens
aggattagacagtaagagttt

SEQ ID NO: 3842628 - DNA, 14 bp, Homo sapiens
aggattggatgatt

SEQ ID NO: 3842629 - DNA, 16 bp, Homo sapiens
aggattttgtgttttt

SEQ ID NO: 3842630 - DNA, 22 bp, Homo sapiens
aggcagaactcatctaggtaaa

SEQ ID NO: 3842631 - DNA, 18 bp, Homo sapiens
aggcagaagaagctggga

SEQ ID NO: 3842632 - DNA, 12 bp, Homo sapiens
aggcagccagat

SEQ ID NO: 3842633 - DNA, 18 bp, Homo sapiens
aggcagccagatccccag

SEQ ID NO: 3842634 - DNA, 19 bp, Homo sapiens
aggcagccagatccccagg

SEQ ID NO: 3842635 - DNA, 17 bp, Homo sapiens
aggcagcgcattgtttt

SEQ ID NO: 3842636 - DNA, 18 bp, Homo sapiens
aggcagctcctgtttgga

SEQ ID NO: 3842637 - DNA, 22 bp, Homo sapiens
aggcagggctctctttccttct

SEQ ID NO: 3842638 - DNA, 15 bp, Homo sapiens
aggcaggggtggggg

SEQ ID NO: 3842639 - DNA, 20 bp, Homo sapiens
aggcaggggtgggggtggag

SEQ ID NO: 3842640 - DNA, 22 bp, Homo sapiens
aggcaggggtgggggtggaggc

SEQ ID NO: 3842641 - DNA, 23 bp, Homo sapiens
aggcaggggtgggggtggaggct

SEQ ID NO: 3842642 - DNA, 13 bp, Homo sapiens
aggcattccagct

SEQ ID NO: 3842643 - DNA, 20 bp, Homo sapiens
aggccagaaaaggcagccag

SEQ ID NO: 3842644 - DNA, 21 bp, Homo sapiens
aggccagaaaaggcagccaga

SEQ ID NO: 3842645 - DNA, 23 bp, Homo sapiens
aggccagaaaaggcagccagatc

SEQ ID NO: 3842646 - DNA, 10 bp, Homo sapiens
aggccagcct

SEQ ID NO: 3842647 - DNA, 14 bp, Homo sapiens
aggccagcctccga

SEQ ID NO: 3842648 - DNA, 16 bp, Homo sapiens
aggccagcctgcggga

SEQ ID NO: 3842649 - DNA, 14 bp, Homo sapiens
aggccatggggcag

SEQ ID NO: 3842650 - DNA, 17 bp, Homo sapiens
aggccatggggcagcct

SEQ ID NO: 3842651 - DNA, 12 bp, Homo sapiens
aggcccagctgc

SEQ ID NO: 3842652 - DNA, 13 bp, Homo sapiens
aggcccagctgcc

SEQ ID NO: 3842653 - DNA, 14 bp, Homo sapiens
aggcccagctgcca

SEQ ID NO: 3842654 - DNA, 23 bp, Homo sapiens
aggcccagctgccagggaagaca

SEQ ID NO: 3842655 - DNA, 16 bp, Homo sapiens
aggccctttcctcagg

SEQ ID NO: 3842656 - DNA, 14 bp, Homo sapiens
aggccgagcccaca

SEQ ID NO: 3842657 - DNA, 15 bp, Homo sapiens
aggccgctgctgacc

SEQ ID NO: 3842658 - DNA, 16 bp, Homo sapiens
aggccgctgctgacca

SEQ ID NO: 3842659 - DNA, 15 bp, Homo sapiens
aggcctttctggcct

SEQ ID NO: 3842660 - DNA, 15 bp, Homo sapiens
aggctagcttctgct

SEQ ID NO: 3842661 - DNA, 18 bp, Homo sapiens
aggctatggttgccaccc

SEQ ID NO: 3842662 - DNA, 19 bp, Homo sapiens
aggctatggttgccacccc

SEQ ID NO: 3842663 - DNA, 22 bp, Homo sapiens
aggctcactgccaggccagcct

SEQ ID NO: 3842664 - DNA, 23 bp, Homo sapiens
aggctcactgccaggccagcctc

SEQ ID NO: 3842665 - DNA, 13 bp, Homo sapiens
aggctcctggtgg

SEQ ID NO: 3842666 - DNA, 17 bp, Homo sapiens
aggctcggggctcccca

SEQ ID NO: 3842667 - DNA, 19 bp, Homo sapiens
aggctgcccggcctccctc

SEQ ID NO: 3842668 - DNA, 14 bp, Homo sapiens
aggctggagtgcag

SEQ ID NO: 3842669 - DNA, 19 bp, Homo sapiens
aggctggagtgcagtggct

SEQ ID NO: 3842670 - DNA, 15 bp, Homo sapiens
aggctggcccccacc

SEQ ID NO: 3842671 - DNA, 15 bp, Homo sapiens
aggctgggaggctcg

SEQ ID NO: 3842672 - DNA, 18 bp, Homo sapiens
aggctggtgggaggggcg

SEQ ID NO: 3842673 - DNA, 14 bp, Homo sapiens
aggctgtgccaggc

SEQ ID NO: 3842674 - DNA, 16 bp, Homo sapiens
aggctgtgccaggctg

SEQ ID NO: 3842675 - DNA, 20 bp, Homo sapiens
aggcttcctgcgtcctcctc

SEQ ID NO: 3842676 - DNA, 21 bp, Homo sapiens
aggcttcctgcgtcctcctca

SEQ ID NO: 3842677 - DNA, 15 bp, Homo sapiens
aggcttctccgccag

SEQ ID NO: 3842678 - DNA, 18 bp, Homo sapiens
aggcttctccgccagcct

SEQ ID NO: 3842679 - DNA, 20 bp, Homo sapiens
aggcttctccgccagcctcc

SEQ ID NO: 3842680 - DNA, 22 bp, Homo sapiens
aggcttctccgccagcctcctc

SEQ ID NO: 3842681 - DNA, 23 bp, Homo sapiens
aggcttctccgccagcctcctct

SEQ ID NO: 3842682 - DNA, 17 bp, Homo sapiens
aggcttgagttttcatt

SEQ ID NO: 3842683 - DNA, 22 bp, Homo sapiens
aggcttgagttttcatttcata

SEQ ID NO: 3842684 - DNA, 19 bp, Homo sapiens
aggctttgtgagagaggac

SEQ ID NO: 3842685 - DNA, 22 bp, Homo sapiens
aggctttgtgagagaggacctc

SEQ ID NO: 3842686 - DNA, 21 bp, Homo sapiens
agggaacatcctgctgcatga

SEQ ID NO: 3842687 - DNA, 15 bp, Homo sapiens
agggaagacagagca

SEQ ID NO: 3842688 - DNA, 17 bp, Homo sapiens
agggaagacagagcagg

SEQ ID NO: 3842689 - DNA, 19 bp, Homo sapiens
agggaagacagagcaggct

SEQ ID NO: 3842690 - DNA, 20 bp, Homo sapiens
agggaagacagagcaggctt

SEQ ID NO: 3842691 - DNA, 22 bp, Homo sapiens
agggaagacagagcaggctttg

SEQ ID NO: 3842692 - DNA, 18 bp, Homo sapiens
agggaatccccgaaggtg

SEQ ID NO: 3842693 - DNA, 11 bp, Homo sapiens
agggacacagg

SEQ ID NO: 3842694 - DNA, 13 bp, Homo sapiens
agggacacaggag

SEQ ID NO: 3842695 - DNA, 19 bp, Homo sapiens
agggacacaggagaccacc

SEQ ID NO: 3842696 - DNA, 15 bp, Homo sapiens
agggactgagaaatt

SEQ ID NO: 3842697 - DNA, 23 bp, Homo sapiens
agggagagagagagagagaggac

SEQ ID NO: 3842698 - DNA, 14 bp, Homo sapiens
agggagagggaggt

SEQ ID NO: 3842699 - DNA, 20 bp, Homo sapiens
agggagcatagaaggcaggt

SEQ ID NO: 3842700 - DNA, 23 bp, Homo sapiens
agggaggaagaagcttaggcagg

SEQ ID NO: 3842701 - DNA, 12 bp, Homo sapiens
agggagggggag

SEQ ID NO: 3842702 - DNA, 12 bp, Homo sapiens
agggagggtggc

SEQ ID NO: 3842703 - DNA, 15 bp, Homo sapiens
agggagggtggcaga

SEQ ID NO: 3842704 - DNA, 20 bp, Homo sapiens
agggagggtggcagagacag

SEQ ID NO: 3842705 - DNA, 20 bp, Homo sapiens
agggaggtcactggaaaggg

SEQ ID NO: 3842706 - DNA, 22 bp, Homo sapiens
agggatcctaatcccttcctct

SEQ ID NO: 3842707 - DNA, 18 bp, Homo sapiens
agggatggactgatgctt

SEQ ID NO: 3842708 - DNA, 15 bp, Homo sapiens
agggatggccgttgg

SEQ ID NO: 3842709 - DNA, 16 bp, Homo sapiens
agggcaagaggtgcct

SEQ ID NO: 3842710 - DNA, 17 bp, Homo sapiens
agggcaaggggtttcca

SEQ ID NO: 3842711 - DNA, 19 bp, Homo sapiens
agggcagaggcaaggatgg

SEQ ID NO: 3842712 - DNA, 22 bp, Homo sapiens
agggcagaggcaaggatggtgg

SEQ ID NO: 3842713 - DNA, 22 bp, Homo sapiens
agggcatgccccggccacctct

SEQ ID NO: 3842714 - DNA, 17 bp, Homo sapiens
agggccaagccggccca

SEQ ID NO: 3842715 - DNA, 20 bp, Homo sapiens
agggccaagccggcccaacc

SEQ ID NO: 3842716 - DNA, 17 bp, Homo sapiens
agggccaggactgagcc

SEQ ID NO: 3842717 - DNA, 19 bp, Homo sapiens
agggccaggactgagcccc

SEQ ID NO: 3842718 - DNA, 21 bp, Homo sapiens
agggccaggactgagccccgc

SEQ ID NO: 3842719 - DNA, 17 bp, Homo sapiens
agggccctctgaggctc

SEQ ID NO: 3842720 - DNA, 20 bp, Homo sapiens
agggccctctgaggctcagc

SEQ ID NO: 3842721 - DNA, 22 bp, Homo sapiens
agggccctctgaggctcagccc

SEQ ID NO: 3842722 - DNA, 14 bp, Homo sapiens
agggccctctgggg

SEQ ID NO: 3842723 - DNA, 16 bp, Homo sapiens
agggccctctggggct

SEQ ID NO: 3842724 - DNA, 15 bp, Homo sapiens
agggccctgaggaat

SEQ ID NO: 3842725 - DNA, 16 bp, Homo sapiens
agggccctgaggaata

SEQ ID NO: 3842726 - DNA, 21 bp, Homo sapiens
agggccctgaggaataaagct

SEQ ID NO: 3842727 - DNA, 16 bp, Homo sapiens
agggcctgaggtctgg

SEQ ID NO: 3842728 - DNA, 22 bp, Homo sapiens
agggcctgggttttcatgtttt

SEQ ID NO: 3842729 - DNA, 14 bp, Homo sapiens
agggcgcccagccc

SEQ ID NO: 3842730 - DNA, 23 bp, Homo sapiens
agggcgcccagcccaggcctggt

SEQ ID NO: 3842731 - DNA, 14 bp, Homo sapiens
agggctccagcctg

SEQ ID NO: 3842732 - DNA, 16 bp, Homo sapiens
agggctccagcctgtc

SEQ ID NO: 3842733 - DNA, 17 bp, Homo sapiens
agggctccagcctgtcg

SEQ ID NO: 3842734 - DNA, 23 bp, Homo sapiens
agggctccagcctgtcggccaca

SEQ ID NO: 3842735 - DNA, 18 bp, Homo sapiens
agggctttgtgtctggcc

SEQ ID NO: 3842736 - DNA, 12 bp, Homo sapiens
aggggaatgttt

SEQ ID NO: 3842737 - DNA, 14 bp, Homo sapiens
aggggagctgctgg

SEQ ID NO: 3842738 - DNA, 14 bp, Homo sapiens
aggggaggggggag

SEQ ID NO: 3842739 - DNA, 14 bp, Homo sapiens
aggggatatatgtt

SEQ ID NO: 3842740 - DNA, 16 bp, Homo sapiens
aggggcagccagccct

SEQ ID NO: 3842741 - DNA, 16 bp, Homo sapiens
aggggcgcccacctcc

SEQ ID NO: 3842742 - DNA, 17 bp, Homo sapiens
aggggctggcttcagga

SEQ ID NO: 3842743 - DNA, 17 bp, Homo sapiens
aggggggagccagaggc

SEQ ID NO: 3842744 - DNA, 18 bp, Homo sapiens
aggggggagccagaggcc

SEQ ID NO: 3842745 - DNA, 15 bp, Homo sapiens
agggtcgtgagccca

SEQ ID NO: 3842746 - DNA, 17 bp, Homo sapiens
agggtgagaagggcagg

SEQ ID NO: 3842747 - DNA, 22 bp, Homo sapiens
agggtggacttagaaagcaggg

SEQ ID NO: 3842748 - DNA, 16 bp, Homo sapiens
agggtggcagagacag

SEQ ID NO: 3842749 - DNA, 21 bp, Homo sapiens
aggtaaatagagtgcataaat

SEQ ID NO: 3842750 - DNA, 18 bp, Homo sapiens
aggtaaatcagactatga

SEQ ID NO: 3842751 - DNA, 13 bp, Homo sapiens
aggtaccagctgc

SEQ ID NO: 3842752 - DNA, 20 bp, Homo sapiens
aggtattctgaccttgtgaa

SEQ ID NO: 3842753 - DNA, 16 bp, Homo sapiens
aggtattttttaactc

SEQ ID NO: 3842754 - DNA, 23 bp, Homo sapiens
aggtcctgcttgaactgctgcca

SEQ ID NO: 3842755 - DNA, 20 bp, Homo sapiens
aggtgaaaaatattcagtaa

SEQ ID NO: 3842756 - DNA, 22 bp, Homo sapiens
aggtgagcaaccagttggctag

SEQ ID NO: 3842757 - DNA, 18 bp, Homo sapiens
aggtgaggaatttgaagc

SEQ ID NO: 3842758 - DNA, 19 bp, Homo sapiens
aggtgagtttgagctgcct

SEQ ID NO: 3842759 - DNA, 18 bp, Homo sapiens
aggtgccagcaaagcccc

SEQ ID NO: 3842760 - DNA, 20 bp, Homo sapiens
aggtgccagcaaagccccat

SEQ ID NO: 3842761 - DNA, 13 bp, Homo sapiens
aggtgcctgggag

SEQ ID NO: 3842762 - DNA, 23 bp, Homo sapiens
aggtgctggaggtgggagcagga

SEQ ID NO: 3842763 - DNA, 16 bp, Homo sapiens
aggtggaagaagggag

SEQ ID NO: 3842764 - DNA, 14 bp, Homo sapiens
aggtgggagcagga

SEQ ID NO: 3842765 - DNA, 17 bp, Homo sapiens
aggtgggagcaggagat

SEQ ID NO: 3842766 - DNA, 20 bp, Homo sapiens
aggtgggagcaggagattga

SEQ ID NO: 3842767 - DNA, 23 bp, Homo sapiens
aggtgggccgcaggcgggaaaag

SEQ ID NO: 3842768 - DNA, 20 bp, Homo sapiens
aggttaaatatataaacaaa

SEQ ID NO: 3842769 - DNA, 16 bp, Homo sapiens
aggtttggaaaactaa

SEQ ID NO: 3842770 - DNA, 20 bp, Homo sapiens
agtaacaaaaaataaagaat

SEQ ID NO: 3842771 - DNA, 14 bp, Homo sapiens
agtaacttaagtta

SEQ ID NO: 3842772 - DNA, 16 bp, Homo sapiens
agtaagagtttacaag

SEQ ID NO: 3842773 - DNA, 17 bp, Homo sapiens
agagtgctgtgagatga

SEQ ID NO: 3842774 - DNA, 22 bp, Homo sapiens
agagtttacaagaaataaatct

SEQ ID NO: 3842775 - DNA, 17 bp, Homo sapiens
agataaggccgagccca

SEQ ID NO: 3842776 - DNA, 22 bp, Homo sapiens
agataaggccgagcccacacca

SEQ ID NO: 3842777 - DNA, 20 bp, Homo sapiens
agatcacaactgaagataac

SEQ ID NO: 3842778 - DNA, 22 bp, Homo sapiens
agatcccaccgacccttcctgg

SEQ ID NO: 3842779 - DNA, 14 bp, Homo sapiens
agatccccagggca

SEQ ID NO: 3842780 - DNA, 16 bp, Homo sapiens
agatccccagggcagc

SEQ ID NO: 3842781 - DNA, 19 bp, Homo sapiens
agatccccagggcagcctc

SEQ ID NO: 3842782 - DNA, 13 bp, Homo sapiens
agatctgtcctgg

SEQ ID NO: 3842783 - DNA, 16 bp, Homo sapiens
agatctgtcctggggg

SEQ ID NO: 3842784 - DNA, 13 bp, Homo sapiens
agatgaaaagcta

SEQ ID NO: 3842785 - DNA, 22 bp, Homo sapiens
agatgaatccaaatgtgaaaga

SEQ ID NO: 3842786 - DNA, 15 bp, Homo sapiens
agatgagtttttcat

SEQ ID NO: 3842787 - DNA, 18 bp, Homo sapiens
agatgatggggtcagcag

SEQ ID NO: 3842788 - DNA, 16 bp, Homo sapiens
agatgatttgggcaga

SEQ ID NO: 3842789 - DNA, 17 bp, Homo sapiens
agatgatttgggcagag

SEQ ID NO: 3842790 - DNA, 18 bp, Homo sapiens
agatgctggagaagagag

SEQ ID NO: 3842791 - DNA, 22 bp, Homo sapiens
agatgctggagaagagaggaga

SEQ ID NO: 3842792 - DNA, 18 bp, Homo sapiens
agatgggaatgaggtggg

SEQ ID NO: 3842793 - DNA, 15 bp, Homo sapiens
agatgtgttcacaat

SEQ ID NO: 3842794 - DNA, 20 bp, Homo sapiens
agatgttctctcccaggggc

SEQ ID NO: 3842795 - DNA, 19 bp, Homo sapiens
agatgtttctcattttaaa

SEQ ID NO: 3842796 - DNA, 17 bp, Homo sapiens
agattaaaatatttgcc

SEQ ID NO: 3842797 - DNA, 12 bp, Homo sapiens
agattaaatata

SEQ ID NO: 3842798 - DNA, 14 bp, Homo sapiens
agattatacagaat

SEQ ID NO: 3842799 - DNA, 12 bp, Homo sapiens
agattcaggctt

SEQ ID NO: 3842800 - DNA, 15 bp, Homo sapiens
agattcaggcttgca

SEQ ID NO: 3842801 - DNA, 12 bp, Homo sapiens
agattcccttgc

SEQ ID NO: 3842802 - DNA, 15 bp, Homo sapiens
agattgagaaggaga

SEQ ID NO: 3842803 - DNA, 17 bp, Homo sapiens
agattgagatgtgttca

SEQ ID NO: 3842804 - DNA, 15 bp, Homo sapiens
agattgtaaactaaa

SEQ ID NO: 3842805 - DNA, 16 bp, Homo sapiens
agatttaatgatgctt

SEQ ID NO: 3842806 - DNA, 18 bp, Homo sapiens
agattttatgtgcttgaa

SEQ ID NO: 3842807 - DNA, 22 bp, Homo sapiens
agattttatgtgcttgaagatt

SEQ ID NO: 3842808 - DNA, 22 bp, Homo sapiens
agcaaagccccatgctggagcc

SEQ ID NO: 3842809 - DNA, 15 bp, Homo sapiens
agcaagctcttctcc

SEQ ID NO: 3842810 - DNA, 16 bp, Homo sapiens
agcaagctcttctcct

SEQ ID NO: 3842811 - DNA, 13 bp, Homo sapiens
agcaagtctgcag

SEQ ID NO: 3842812 - DNA, 15 bp, Homo sapiens
agcaagtctgcaggt

SEQ ID NO: 3842813 - DNA, 14 bp, Homo sapiens
agcaatctggaaaa

SEQ ID NO: 3842814 - DNA, 14 bp, Homo sapiens
agcaattttccttg

SEQ ID NO: 3842815 - DNA, 14 bp, Homo sapiens
agcacctccccaga

SEQ ID NO: 3842816 - DNA, 16 bp, Homo sapiens
agcacctccccagaca

SEQ ID NO: 3842817 - DNA, 17 bp, Homo sapiens
agcacctccccagacag

SEQ ID NO: 3842818 - DNA, 20 bp, Homo sapiens
agcacctttggaaacaacat

SEQ ID NO: 3842819 - DNA, 19 bp, Homo sapiens
agcacgcgacttctcagga

SEQ ID NO: 3842820 - DNA, 21 bp, Homo sapiens
agcagaaaacaagagaaagaa

SEQ ID NO: 3842821 - DNA, 12 bp, Homo sapiens
agcagaataaag

SEQ ID NO: 3842822 - DNA, 13 bp, Homo sapiens
agcagaataaagc

SEQ ID NO: 3842823 - DNA, 15 bp, Homo sapiens
agcagaataaagcaa

SEQ ID NO: 3842824 - DNA, 18 bp, Homo sapiens
agcagaataaagcaattt

SEQ ID NO: 3842825 - DNA, 21 bp, Homo sapiens
agcagaataaagcaattttcc

SEQ ID NO: 3842826 - DNA, 22 bp, Homo sapiens
agcagaataaagcaattttcct

SEQ ID NO: 3842827 - DNA, 23 bp, Homo sapiens
agcagaataaagcaattttcctt

SEQ ID NO: 3842828 - DNA, 20 bp, Homo sapiens
agcagaataaatgttttaca

SEQ ID NO: 3842829 - DNA, 23 bp, Homo sapiens
agcagaataaatgttttacaact

SEQ ID NO: 3842830 - DNA, 21 bp, Homo sapiens
agcagaattgcttgaacccag

SEQ ID NO: 3842831 - DNA, 21 bp, Homo sapiens
agcagataaggccgagcccac

SEQ ID NO: 3842832 - DNA, 22 bp, Homo sapiens
agcagataaggccgagcccaca

SEQ ID NO: 3842833 - DNA, 16 bp, Homo sapiens
agcagcccttggccag

SEQ ID NO: 3842834 - DNA, 21 bp, Homo sapiens
agcaggagattgagaaggaga

SEQ ID NO: 3842835 - DNA, 11 bp, Homo sapiens
agcaggcccag

SEQ ID NO: 3842836 - DNA, 12 bp, Homo sapiens
agcaggcccagg

SEQ ID NO: 3842837 - DNA, 21 bp, Homo sapiens
agcaggggctacaagagggaa

SEQ ID NO: 3842838 - DNA, 22 bp, Homo sapiens
agcagtacacttggatgcagtg

SEQ ID NO: 3842839 - DNA, 18 bp, Homo sapiens
agcagttcccaaggacag

SEQ ID NO: 3842840 - DNA, 16 bp, Homo sapiens
agcatatgtgttggct

SEQ ID NO: 3842841 - DNA, 19 bp, Homo sapiens
agcatgtagggcttctgtg

SEQ ID NO: 3842842 - DNA, 13 bp, Homo sapiens
agccaagctgggg

SEQ ID NO: 3842843 - DNA, 17 bp, Homo sapiens
agccaagggacacagga

SEQ ID NO: 3842844 - DNA, 11 bp, Homo sapiens
agccacacagc

SEQ ID NO: 3842845 - DNA, 13 bp, Homo sapiens
agccacacagccc

SEQ ID NO: 3842846 - DNA, 22 bp, Homo sapiens
agccacacagtggccggggctg

SEQ ID NO: 3842847 - DNA, 14 bp, Homo sapiens
agccaccactcctg

SEQ ID NO: 3842848 - DNA, 15 bp, Homo sapiens
agccacggtgttctg

SEQ ID NO: 3842849 - DNA, 16 bp, Homo sapiens
agccagaggccaggat

SEQ ID NO: 3842850 - DNA, 13 bp, Homo sapiens
agccagatcccca

SEQ ID NO: 3842851 - DNA, 15 bp, Homo sapiens
agccagatccccagg

SEQ ID NO: 3842852 - DNA, 16 bp, Homo sapiens
agccagatccccaggg

SEQ ID NO: 3842853 - DNA, 21 bp, Homo sapiens
agccagatccccagggcagcc

SEQ ID NO: 3842854 - DNA, 14 bp, Homo sapiens
agccagccctggct

SEQ ID NO: 3842855 - DNA, 19 bp, Homo sapiens
agccagccctggcttccaa

SEQ ID NO: 3842856 - DNA, 21 bp, Homo sapiens
agccagccttcttccatccca

SEQ ID NO: 3842857 - DNA, 17 bp, Homo sapiens
agccaggcacacactgt

SEQ ID NO: 3842858 - DNA, 20 bp, Homo sapiens
agccaggcacacactgtgct

SEQ ID NO: 3842859 - DNA, 11 bp, Homo sapiens
agccaggctat

SEQ ID NO: 3842860 - DNA, 20 bp, Homo sapiens
agccaggctatggttgccac

SEQ ID NO: 3842861 - DNA, 21 bp, Homo sapiens
agccaggctatggttgccacc

SEQ ID NO: 3842862 - DNA, 18 bp, Homo sapiens
agccatagagcctgaaat

SEQ ID NO: 3842863 - DNA, 17 bp, Homo sapiens
agccatgaccttacatt

SEQ ID NO: 3842864 - DNA, 18 bp, Homo sapiens
agccatgaccttacattt

SEQ ID NO: 3842865 - DNA, 22 bp, Homo sapiens
agccatgtgaaactcatctcat

SEQ ID NO: 3842866 - DNA, 21 bp, Homo sapiens
agcccacaccatctggcccag

SEQ ID NO: 3842867 - DNA, 16 bp, Homo sapiens
agcccagaaggccaga

SEQ ID NO: 3842868 - DNA, 13 bp, Homo sapiens
agcccaggagaga

SEQ ID NO: 3842869 - DNA, 17 bp, Homo sapiens
agcccaggagagagaaa

SEQ ID NO: 3842870 - DNA, 19 bp, Homo sapiens
agcccaggagagagaaagc

SEQ ID NO: 3842871 - DNA, 11 bp, Homo sapiens
agcccaggcct

SEQ ID NO: 3842872 - DNA, 12 bp, Homo sapiens
agcccaggcctg

SEQ ID NO: 3842873 - DNA, 21 bp, Homo sapiens
agcccaggcgggagcggtggc

SEQ ID NO: 3842874 - DNA, 15 bp, Homo sapiens
agcccatccctgcct

SEQ ID NO: 3842875 - DNA, 18 bp, Homo sapiens
agccccacccccagccag

SEQ ID NO: 3842876 - DNA, 21 bp, Homo sapiens
agccccacccccagccaggct

SEQ ID NO: 3842877 - DNA, 22 bp, Homo sapiens
agccccatgctggagcctgtgt

SEQ ID NO: 3842878 - DNA, 16 bp, Homo sapiens
agccccgcagacctcc

SEQ ID NO: 3842879 - DNA, 19 bp, Homo sapiens
agccccgcagacctcccca

SEQ ID NO: 3842880 - DNA, 18 bp, Homo sapiens
agcccctagcccaggaga

SEQ ID NO: 3842881 - DNA, 14 bp, Homo sapiens
agcccctgtggaga

SEQ ID NO: 3842882 - DNA, 16 bp, Homo sapiens
agcccggtgttcagtg

SEQ ID NO: 3842883 - DNA, 12 bp, Homo sapiens
agccctggaggt

SEQ ID NO: 3842884 - DNA, 13 bp, Homo sapiens
agccctggcttcc

SEQ ID NO: 3842885 - DNA, 22 bp, Homo sapiens
agccgcctcggagtgtggcctg

SEQ ID NO: 3842886 - DNA, 14 bp, Homo sapiens
agccggcccaaccc

SEQ ID NO: 3842887 - DNA, 20 bp, Homo sapiens
agcctaaaagattttgtgaa

SEQ ID NO: 3842888 - DNA, 15 bp, Homo sapiens
agcctagagtgaggg

SEQ ID NO: 3842889 - DNA, 15 bp, Homo sapiens
agcctatttttatat

SEQ ID NO: 3842890 - DNA, 16 bp, Homo sapiens
agcctcagtcctcccc

SEQ ID NO: 3842891 - DNA, 17 bp, Homo sapiens
agcctcagtcctcccct

SEQ ID NO: 3842892 - DNA, 19 bp, Homo sapiens
agcctcagtcctcccctca

SEQ ID NO: 3842893 - DNA, 13 bp, Homo sapiens
agcctccagtctg

SEQ ID NO: 3842894 - DNA, 21 bp, Homo sapiens
agcctccctctcctctgtccc

SEQ ID NO: 3842895 - DNA, 14 bp, Homo sapiens
agcctccgagaggg

SEQ ID NO: 3842896 - DNA, 16 bp, Homo sapiens
agcctccgagagggag

SEQ ID NO: 3842897 - DNA, 13 bp, Homo sapiens
agcctcctctgga

SEQ ID NO: 3842898 - DNA, 19 bp, Homo sapiens
agcctcctctggacggcag

SEQ ID NO: 3842899 - DNA, 19 bp, Homo sapiens
agcctctaacaaatgatct

SEQ ID NO: 3842900 - DNA, 13 bp, Homo sapiens
agcctctcctttg

SEQ ID NO: 3842901 - DNA, 15 bp, Homo sapiens
agcctctcctttgta

SEQ ID NO: 3842902 - DNA, 19 bp, Homo sapiens
agcctctgacccctcctca

SEQ ID NO: 3842903 - DNA, 12 bp, Homo sapiens
agcctctgcagt

SEQ ID NO: 3842904 - DNA, 23 bp, Homo sapiens
agcctggcctgtggctgccctcc

SEQ ID NO: 3842905 - DNA, 12 bp, Homo sapiens
agcctggctctt

SEQ ID NO: 3842906 - DNA, 17 bp, Homo sapiens
agcctgggcctcctcct

SEQ ID NO: 3842907 - DNA, 22 bp, Homo sapiens
agcctgggcctcctcctagctg

SEQ ID NO: 3842908 - DNA, 16 bp, Homo sapiens
agcctgtcggccacac

SEQ ID NO: 3842909 - DNA, 17 bp, Homo sapiens
agcctgtcggccacacc

SEQ ID NO: 3842910 - DNA, 13 bp, Homo sapiens
ttctgcaagcctg

SEQ ID NO: 3842911 - DNA, 15 bp, Homo sapiens
ttctgcaagcctgcg

SEQ ID NO: 3842912 - DNA, 18 bp, Homo sapiens
ttctgccctggctgctgc

SEQ ID NO: 3842913 - DNA, 23 bp, Homo sapiens
ttctgtacaaagtactagctaaa

SEQ ID NO: 3842914 - DNA, 22 bp, Homo sapiens
ttctgtatttttttttctaaga

SEQ ID NO: 3842915 - DNA, 13 bp, Homo sapiens
ttcttacttgagt

SEQ ID NO: 3842916 - DNA, 20 bp, Homo sapiens
ttcttccagtgatgttgaaa

SEQ ID NO: 3842917 - DNA, 13 bp, Homo sapiens
ttcttctgtattt

SEQ ID NO: 3842918 - DNA, 19 bp, Homo sapiens
ttcttgaaagtattgtgtt

SEQ ID NO: 3842919 - DNA, 11 bp, Homo sapiens
ttctttataac

SEQ ID NO: 3842920 - DNA, 14 bp, Homo sapiens
ttctttttttgcat

SEQ ID NO: 3842921 - DNA, 18 bp, Homo sapiens
ttctttttttgcatatta

SEQ ID NO: 3842922 - DNA, 16 bp, Homo sapiens
ttgaaacaacattatt

SEQ ID NO: 3842923 - DNA, 17 bp, Homo sapiens
ttgaaagacaaaattta

SEQ ID NO: 3842924 - DNA, 20 bp, Homo sapiens
ttgaagccaagtggggtgct

SEQ ID NO: 3842925 - DNA, 15 bp, Homo sapiens
ttgaagctcagaaag

SEQ ID NO: 3842926 - DNA, 14 bp, Homo sapiens
ttgaagctgctgtc

SEQ ID NO: 3842927 - DNA, 17 bp, Homo sapiens
ttgaagctgctgtctct

SEQ ID NO: 3842928 - DNA, 18 bp, Homo sapiens
ttgaaggcgaggctgccc

SEQ ID NO: 3842929 - DNA, 22 bp, Homo sapiens
ttgaagtaccaggccgtttgct

SEQ ID NO: 3842930 - DNA, 14 bp, Homo sapiens
ttgaatagcttatg

SEQ ID NO: 3842931 - DNA, 14 bp, Homo sapiens
ttgagagctttatt

SEQ ID NO: 3842932 - DNA, 15 bp, Homo sapiens
ttgagagctttattg

SEQ ID NO: 3842933 - DNA, 21 bp, Homo sapiens
ttgagattcacatgctggctc

SEQ ID NO: 3842934 - DNA, 17 bp, Homo sapiens
ttgagcgtattcttgaa

SEQ ID NO: 3842935 - DNA, 13 bp, Homo sapiens
ttgaggtcaggag

SEQ ID NO: 3842936 - DNA, 21 bp, Homo sapiens
ttgagtagctgggattacagg

SEQ ID NO: 3842937 - DNA, 15 bp, Homo sapiens
ttgatagctaaataa

SEQ ID NO: 3842938 - DNA, 18 bp, Homo sapiens
ttgatctgctcagccctg

SEQ ID NO: 3842939 - DNA, 19 bp, Homo sapiens
ttgatctgctcagccctgg

SEQ ID NO: 3842940 - DNA, 22 bp, Homo sapiens
ttgatctgctcagccctggagg

SEQ ID NO: 3842941 - DNA, 13 bp, Homo sapiens
ttgattatgcaga

SEQ ID NO: 3842942 - DNA, 15 bp, Homo sapiens
ttgattcaaatgtta

SEQ ID NO: 3842943 - DNA, 19 bp, Homo sapiens
ttgcaaataaaggctctgg

SEQ ID NO: 3842944 - DNA, 22 bp, Homo sapiens
ttgcaaataaaggctctggaag

SEQ ID NO: 3842945 - DNA, 16 bp, Homo sapiens
ttgcaactttgtataa

SEQ ID NO: 3842946 - DNA, 17 bp, Homo sapiens
ttgcaactttgtataaa

SEQ ID NO: 3842947 - DNA, 15 bp, Homo sapiens
ttgcagtgagctgag

SEQ ID NO: 3842948 - DNA, 20 bp, Homo sapiens
ttgcattaataatccttcca

SEQ ID NO: 3842949 - DNA, 17 bp, Homo sapiens
ttgcattttttaaattt

SEQ ID NO: 3842950 - DNA, 19 bp, Homo sapiens
ttgccaacctgtaataaat

SEQ ID NO: 3842951 - DNA, 23 bp, Homo sapiens
ttgccaacctgtaataaatatga

SEQ ID NO: 3842952 - DNA, 13 bp, Homo sapiens
ttgccaagccctt

SEQ ID NO: 3842953 - DNA, 13 bp, Homo sapiens
ttgccatttcttt

SEQ ID NO: 3842954 - DNA, 15 bp, Homo sapiens
ttgccatttctttat

SEQ ID NO: 3842955 - DNA, 13 bp, Homo sapiens
ttgcccacttctg

SEQ ID NO: 3842956 - DNA, 17 bp, Homo sapiens
ttgccctgggctgcctc

SEQ ID NO: 3842957 - DNA, 12 bp, Homo sapiens
ttgcctaaaatt

SEQ ID NO: 3842958 - DNA, 22 bp, Homo sapiens
ttgcctcagggccaagccggcc

SEQ ID NO: 3842959 - DNA, 13 bp, Homo sapiens
ttgcctcatgaac

SEQ ID NO: 3842960 - DNA, 15 bp, Homo sapiens
ttgcctcatgaacac

SEQ ID NO: 3842961 - DNA, 22 bp, Homo sapiens
ttgcgaaaattgcgaaatctgt

SEQ ID NO: 3842962 - DNA, 14 bp, Homo sapiens
ttgctaccaagttt

SEQ ID NO: 3842963 - DNA, 21 bp, Homo sapiens
ttgctaccaagtttcatacca

SEQ ID NO: 3842964 - DNA, 19 bp, Homo sapiens
ttgctagagcatcatcctt

SEQ ID NO: 3842965 - DNA, 22 bp, Homo sapiens
ttgctcttggaattactgaaag

SEQ ID NO: 3842966 - DNA, 18 bp, Homo sapiens
ttgctgcattttaagcat

SEQ ID NO: 3842967 - DNA, 21 bp, Homo sapiens
ttgctgcattttaagcataat

SEQ ID NO: 3842968 - DNA, 17 bp, Homo sapiens
ttgctgccatcgtaaac

SEQ ID NO: 3842969 - DNA, 20 bp, Homo sapiens
ttgctggtgtctgagcttca

SEQ ID NO: 3842970 - DNA, 14 bp, Homo sapiens
ttgcttggttcatt

SEQ ID NO: 3842971 - DNA, 14 bp, Homo sapiens
ttgctttttcaggt

SEQ ID NO: 3842972 - DNA, 17 bp, Homo sapiens
ttggaaatggggagctg

SEQ ID NO: 3842973 - DNA, 15 bp, Homo sapiens
ttggaattactgaaa

SEQ ID NO: 3842974 - DNA, 15 bp, Homo sapiens
ttggagtcttccaaa

SEQ ID NO: 3842975 - DNA, 18 bp, Homo sapiens
ttggatcaagcagaaaac

SEQ ID NO: 3842976 - DNA, 21 bp, Homo sapiens
ttggatgattgttcataatac

SEQ ID NO: 3842977 - DNA, 23 bp, Homo sapiens
ttggcagtgagtgagcctggctc

SEQ ID NO: 3842978 - DNA, 14 bp, Homo sapiens
ttggcatcacctgc

SEQ ID NO: 3842979 - DNA, 15 bp, Homo sapiens
ttggccaagcaggga

SEQ ID NO: 3842980 - DNA, 13 bp, Homo sapiens
ttggctcagaaaa

SEQ ID NO: 3842981 - DNA, 14 bp, Homo sapiens
ttggctcagaaaat

SEQ ID NO: 3842982 - DNA, 13 bp, Homo sapiens
ttggctctggaga

SEQ ID NO: 3842983 - DNA, 19 bp, Homo sapiens
ttggctctggagacagccc

SEQ ID NO: 3842984 - DNA, 13 bp, Homo sapiens
ttggctggagccc

SEQ ID NO: 3842985 - DNA, 13 bp, Homo sapiens
ttgggaggaagca

SEQ ID NO: 3842986 - DNA, 14 bp, Homo sapiens
ttgggaggaagcag

SEQ ID NO: 3842987 - DNA, 17 bp, Homo sapiens
ttgggaggaagcagaat

SEQ ID NO: 3842988 - DNA, 18 bp, Homo sapiens
ttgggaggaagcagaata

SEQ ID NO: 3842989 - DNA, 19 bp, Homo sapiens
ttgggaggaagcagaataa

SEQ ID NO: 3842990 - DNA, 20 bp, Homo sapiens
ttgggctccgctgtgcccgc

SEQ ID NO: 3842991 - DNA, 19 bp, Homo sapiens
ttggggatagtctggaaag

SEQ ID NO: 3842992 - DNA, 16 bp, Homo sapiens
ttggggcatttgtaaa

SEQ ID NO: 3842993 - DNA, 21 bp, Homo sapiens
ttggtttttgtcttgcatttt

SEQ ID NO: 3842994 - DNA, 22 bp, Homo sapiens
ttggtttttgtcttgcattttt

SEQ ID NO: 3842995 - DNA, 11 bp, Homo sapiens
ttgtaaattat

SEQ ID NO: 3842996 - DNA, 22 bp, Homo sapiens
ttgtaaattattttatgtcata

SEQ ID NO: 3842997 - DNA, 20 bp, Homo sapiens
ttgtaagtaagtaagaaaga

SEQ ID NO: 3842998 - DNA, 13 bp, Homo sapiens
ttgtaagtataag

SEQ ID NO: 3842999 - DNA, 21 bp, Homo sapiens
ttgtaagtataagaaatttta

SEQ ID NO: 3843000 - DNA, 14 bp, Homo sapiens
ttgtacaaaaaagt

SEQ ID NO: 3843001 - DNA, 11 bp, Homo sapiens
ttgtacagttt

SEQ ID NO: 3843002 - DNA, 20 bp, Homo sapiens
ttgtacagtttgtttacaca

SEQ ID NO: 3843003 - DNA, 15 bp, Homo sapiens
ttgtcattgttttca

SEQ ID NO: 3843004 - DNA, 21 bp, Homo sapiens
ttgtccattgcgttattttct

SEQ ID NO: 3843005 - DNA, 23 bp, Homo sapiens
ttgtccattgcgttattttcttt

SEQ ID NO: 3843006 - DNA, 13 bp, Homo sapiens
ttgtctgtgtgct

SEQ ID NO: 3843007 - DNA, 19 bp, Homo sapiens
ttgtctgtgtgctactaac

SEQ ID NO: 3843008 - DNA, 13 bp, Homo sapiens
ttgtcttgcattt

SEQ ID NO: 3843009 - DNA, 14 bp, Homo sapiens
ttgtgaaatttcat

SEQ ID NO: 3843010 - DNA, 15 bp, Homo sapiens
ttgtgaaatttcatg

SEQ ID NO: 3843011 - DNA, 16 bp, Homo sapiens
ttgtgaaatttcatga

SEQ ID NO: 3843012 - DNA, 21 bp, Homo sapiens
ttgtgactagtgctgaagctt

SEQ ID NO: 3843013 - DNA, 23 bp, Homo sapiens
ttgtgactagtgctgaagcttat

SEQ ID NO: 3843014 - DNA, 17 bp, Homo sapiens
ttgtgccttgtaaataa

SEQ ID NO: 3843015 - DNA, 18 bp, Homo sapiens
ttgtgctggatggagccc

SEQ ID NO: 3843016 - DNA, 12 bp, Homo sapiens
ttgtgctttgta

SEQ ID NO: 3843017 - DNA, 15 bp, Homo sapiens
ttgtggatgggaggc

SEQ ID NO: 3843018 - DNA, 13 bp, Homo sapiens
ttgtgtctgcagg

SEQ ID NO: 3843019 - DNA, 17 bp, Homo sapiens
ttgtgtctgcaggattg

SEQ ID NO: 3843020 - DNA, 13 bp, Homo sapiens
ttgtgttttaaca

SEQ ID NO: 3843021 - DNA, 12 bp, Homo sapiens
ttgttcataata

SEQ ID NO: 3843022 - DNA, 11 bp, Homo sapiens
ttgttgctttt

SEQ ID NO: 3843023 - DNA, 17 bp, Homo sapiens
ttgtttggttggtttta

SEQ ID NO: 3843024 - DNA, 13 bp, Homo sapiens
ttgttttaatctt

SEQ ID NO: 3843025 - DNA, 16 bp, Homo sapiens
tttaaaatgagaaatc

SEQ ID NO: 3843026 - DNA, 15 bp, Homo sapiens
tttaaacttcagttt

SEQ ID NO: 3843027 - DNA, 14 bp, Homo sapiens
tttaaatcattcat

SEQ ID NO: 3843028 - DNA, 17 bp, Homo sapiens
tttaaatgcacagttct

SEQ ID NO: 3843029 - DNA, 20 bp, Homo sapiens
tttaaatgctgtatgtcatt

SEQ ID NO: 3843030 - DNA, 23 bp, Homo sapiens
tttaaatgctgtatgtcattaaa

SEQ ID NO: 3843031 - DNA, 20 bp, Homo sapiens
tttaactgagggctgatctt

SEQ ID NO: 3843032 - DNA, 20 bp, Homo sapiens
tttaagtaagtaagtttcat

SEQ ID NO: 3843033 - DNA, 13 bp, Homo sapiens
tttaatcaggagg

SEQ ID NO: 3843034 - DNA, 14 bp, Homo sapiens
tttaatcattgcct

SEQ ID NO: 3843035 - DNA, 19 bp, Homo sapiens
tttaatctttttgtttttc

SEQ ID NO: 3843036 - DNA, 14 bp, Homo sapiens
tttaattttaattt

SEQ ID NO: 3843037 - DNA, 12 bp, Homo sapiens
tttaattttaca

SEQ ID NO: 3843038 - DNA, 15 bp, Homo sapiens
tttacaagaaataaa

SEQ ID NO: 3843039 - DNA, 13 bp, Homo sapiens
tttacaatgattt

SEQ ID NO: 3843040 - DNA, 18 bp, Homo sapiens
tttacaatgatttgtaaa

SEQ ID NO: 3843041 - DNA, 15 bp, Homo sapiens
tttacatagcatttg

SEQ ID NO: 3843042 - DNA, 14 bp, Homo sapiens
tttagacactggct

SEQ ID NO: 3843043 - DNA, 19 bp, Homo sapiens
tttagatgggaagcctgtg

SEQ ID NO: 3843044 - DNA, 16 bp, Homo sapiens
tttaggaaatttatac

SEQ ID NO: 3843045 - DNA, 19 bp, Homo sapiens
tttaggaaatttatacaaa

SEQ ID NO: 3843046 - DNA, 17 bp, Homo sapiens
tttaggggtagaaaatg

SEQ ID NO: 3843047 - DNA, 20 bp, Homo sapiens
tttataaacatgtccccttc

SEQ ID NO: 3843048 - DNA, 20 bp, Homo sapiens
tttataacagttataaagaa

SEQ ID NO: 3843049 - DNA, 21 bp, Homo sapiens
tttataacagttataaagaaa

SEQ ID NO: 3843050 - DNA, 14 bp, Homo sapiens
tttataatattcat

SEQ ID NO: 3843051 - DNA, 16 bp, Homo sapiens
tttatacaaagaaact

SEQ ID NO: 3843052 - DNA, 17 bp, Homo sapiens
tttatatggaacgcatt

SEQ ID NO: 3843053 - DNA, 14 bp, Homo sapiens
tttatgcatattat

SEQ ID NO: 3843054 - DNA, 11 bp, Homo sapiens
tttatgcattt

SEQ ID NO: 3843055 - DNA, 14 bp, Homo sapiens
tttatgtgaacatt

SEQ ID NO: 3843056 - DNA, 19 bp, Homo sapiens
tttattaagtatatttgta

SEQ ID NO: 3843057 - DNA, 22 bp, Homo sapiens
tttattagacattctcttactt

SEQ ID NO: 3843058 - DNA, 16 bp, Homo sapiens
tttattttgtgtttag

SEQ ID NO: 3843059 - DNA, 14 bp, Homo sapiens
tttcaagctaattt

SEQ ID NO: 3843060 - DNA, 16 bp, Homo sapiens
tttcaatgaattaaga

SEQ ID NO: 3843061 - DNA, 15 bp, Homo sapiens
tttcacaacatatca

SEQ ID NO: 3843062 - DNA, 22 bp, Homo sapiens
tttcagtgtcaaataaacactg

SEQ ID NO: 3843063 - DNA, 23 bp, Homo sapiens
tttcagtgtcaaataaacactgt

SEQ ID NO: 3843064 - DNA, 14 bp, Homo sapiens
tttcatgaaaactt

SEQ ID NO: 3843065 - DNA, 16 bp, Homo sapiens
tttcattatttggaaa

SEQ ID NO: 3843066 - DNA, 13 bp, Homo sapiens
tttcattccctgc

SEQ ID NO: 3843067 - DNA, 15 bp, Homo sapiens
tttcatttcatatat

SEQ ID NO: 3843068 - DNA, 22 bp, Homo sapiens
tttcatttggggcatttgtaaa

SEQ ID NO: 3843069 - DNA, 16 bp, Homo sapiens
tttccatcctttgcat

SEQ ID NO: 3843070 - DNA, 14 bp, Homo sapiens
tttccttcataatt

SEQ ID NO: 3843071 - DNA, 16 bp, Homo sapiens
tttccttcttgccttc

SEQ ID NO: 3843072 - DNA, 21 bp, Homo sapiens
tttcgtgttgtgttctttata

SEQ ID NO: 3843073 - DNA, 14 bp, Homo sapiens
tttctaaagtaaaa

SEQ ID NO: 3843074 - DNA, 17 bp, Homo sapiens
tttctaaagtaaaaaca

SEQ ID NO: 3843075 - DNA, 22 bp, Homo sapiens
tttctaaagtaaaaacaaagaa

SEQ ID NO: 3843076 - DNA, 11 bp, Homo sapiens
tttctaagaga

SEQ ID NO: 3843077 - DNA, 13 bp, Homo sapiens
tttctattgtaca

SEQ ID NO: 3843078 - DNA, 15 bp, Homo sapiens
tttctcacttttgga

SEQ ID NO: 3843079 - DNA, 17 bp, Homo sapiens
tttctcattttaaacaa

SEQ ID NO: 3843080 - DNA, 16 bp, Homo sapiens
tttctcctcagaagtg

SEQ ID NO: 3843081 - DNA, 16 bp, Homo sapiens
tttctcctcccttcct

SEQ ID NO: 3843082 - DNA, 21 bp, Homo sapiens
tttctgaagcctctaacaaat

SEQ ID NO: 3843083 - DNA, 12 bp, Homo sapiens
tttctgccctgg

SEQ ID NO: 3843084 - DNA, 20 bp, Homo sapiens
tttctttttccttcataatt

SEQ ID NO: 3843085 - DNA, 17 bp, Homo sapiens
tttgaaacactttgcat

SEQ ID NO: 3843086 - DNA, 22 bp, Homo sapiens
tttgaaataaagaaccagtccc

SEQ ID NO: 3843087 - DNA, 12 bp, Homo sapiens
tttgaacaaaaa

SEQ ID NO: 3843088 - DNA, 18 bp, Homo sapiens
tttgcattttttaaattt

SEQ ID NO: 3843089 - DNA, 20 bp, Homo sapiens
tttgccaagccctttgctgt

SEQ ID NO: 3843090 - DNA, 22 bp, Homo sapiens
tttgcctcatgaacactggctg

SEQ ID NO: 3843091 - DNA, 11 bp, Homo sapiens
tttgctgttcg

SEQ ID NO: 3843092 - DNA, 19 bp, Homo sapiens
tttggaaatggggagctgg

SEQ ID NO: 3843093 - DNA, 15 bp, Homo sapiens
tttggcattcctcta

SEQ ID NO: 3843094 - DNA, 16 bp, Homo sapiens
tttggggcatttgtaa

SEQ ID NO: 3843095 - DNA, 21 bp, Homo sapiens
tttggggcatttgtaaaaagt

SEQ ID NO: 3843096 - DNA, 13 bp, Homo sapiens
tttggtgcctggc

SEQ ID NO: 3843097 - DNA, 21 bp, Homo sapiens
tttgtaaatagtttaacactt

SEQ ID NO: 3843098 - DNA, 17 bp, Homo sapiens
tttgtaaatgctgtaaa

SEQ ID NO: 3843099 - DNA, 19 bp, Homo sapiens
tttgtaaatgctgtaaata

SEQ ID NO: 3843100 - DNA, 20 bp, Homo sapiens
tttgtaagtaagtaagaaag

SEQ ID NO: 3843101 - DNA, 18 bp, Homo sapiens
tttgtaagtataagaaat

SEQ ID NO: 3843102 - DNA, 20 bp, Homo sapiens
tttgtatcagtcagtgctgg

SEQ ID NO: 3843103 - DNA, 13 bp, Homo sapiens
tttgtcattgttt

SEQ ID NO: 3843104 - DNA, 15 bp, Homo sapiens
tttgtctgaaggatt

SEQ ID NO: 3843105 - DNA, 12 bp, Homo sapiens
tttgtctgtgtg

SEQ ID NO: 3843106 - DNA, 14 bp, Homo sapiens
tttgtctgtgtgct

SEQ ID NO: 3843107 - DNA, 17 bp, Homo sapiens
tttgtctgtgtgctact

SEQ ID NO: 3843108 - DNA, 13 bp, Homo sapiens
tttgtcttgcatt

SEQ ID NO: 3843109 - DNA, 16 bp, Homo sapiens
tttgtcttgcattttt

SEQ ID NO: 3843110 - DNA, 12 bp, Homo sapiens
tttgtgaaattt

SEQ ID NO: 3843111 - DNA, 17 bp, Homo sapiens
tttgtgaaatttcatga

SEQ ID NO: 3843112 - DNA, 21 bp, Homo sapiens
tttgtgaaatttcatgaaaac

SEQ ID NO: 3843113 - DNA, 12 bp, Homo sapiens
tttgtgctgctg

SEQ ID NO: 3843114 - DNA, 15 bp, Homo sapiens
tttgtttgtgcttct

SEQ ID NO: 3843115 - DNA, 22 bp, Homo sapiens
ttttaaaatgagaaatctaaaa

SEQ ID NO: 3843116 - DNA, 14 bp, Homo sapiens
ttttaaatgcacag

SEQ ID NO: 3843117 - DNA, 19 bp, Homo sapiens
ttttaaatgttcatgtcac

SEQ ID NO: 3843118 - DNA, 20 bp, Homo sapiens
ttttaaatttgccagtttta

SEQ ID NO: 3843119 - DNA, 17 bp, Homo sapiens
ttttaattttaaaatgt

SEQ ID NO: 3843120 - DNA, 14 bp, Homo sapiens
ttttacaatgattt

SEQ ID NO: 3843121 - DNA, 17 bp, Homo sapiens
ttttacaatgatttgta

SEQ ID NO: 3843122 - DNA, 14 bp, Homo sapiens
ttttactgcatttt

SEQ ID NO: 3843123 - DNA, 19 bp, Homo sapiens
ttttactgcattttcacaa

SEQ ID NO: 3843124 - DNA, 21 bp, Homo sapiens
ttttattcagctcatggactt

SEQ ID NO: 3843125 - DNA, 22 bp, Homo sapiens
ttttatttctttttgattttta

SEQ ID NO: 3843126 - DNA, 14 bp, Homo sapiens
ttttattttctaaa

SEQ ID NO: 3843127 - DNA, 19 bp, Homo sapiens
ttttattttctaaattctt

SEQ ID NO: 3843128 - DNA, 21 bp, Homo sapiens
ttttcaaaattgttacaaatt

SEQ ID NO: 3843129 - DNA, 21 bp, Homo sapiens
ttttcaatgaattaagaaaga

SEQ ID NO: 3843130 - DNA, 18 bp, Homo sapiens
ttttcacaacatatcaga

SEQ ID NO: 3843131 - DNA, 13 bp, Homo sapiens
ttttccttcataa

SEQ ID NO: 3843132 - DNA, 14 bp, Homo sapiens
ttttccttgaagcc

SEQ ID NO: 3843133 - DNA, 18 bp, Homo sapiens
ttttctaaagtaaaaaca

SEQ ID NO: 3843134 - DNA, 14 bp, Homo sapiens
ttttctaaattctt

SEQ ID NO: 3843135 - DNA, 18 bp, Homo sapiens
ttttctacagtggtttta

SEQ ID NO: 3843136 - DNA, 21 bp, Homo sapiens
ttttctgaagcctctaacaaa

SEQ ID NO: 3843137 - DNA, 12 bp, Homo sapiens
ttttctgccctg

SEQ ID NO: 3843138 - DNA, 15 bp, Homo sapiens
ttttctgccctggct

SEQ ID NO: 3843139 - DNA, 16 bp, Homo sapiens
ttttctgccctggctg

SEQ ID NO: 3843140 - DNA, 12 bp, Homo sapiens
ttttctgtattt

SEQ ID NO: 3843141 - DNA, 19 bp, Homo sapiens
ttttgaaagacaaaattta

SEQ ID NO: 3843142 - DNA, 22 bp, Homo sapiens
ttttgatttttaaatcattcat

SEQ ID NO: 3843143 - DNA, 19 bp, Homo sapiens
ttttgctccttctgtgttt

SEQ ID NO: 3843144 - DNA, 19 bp, Homo sapiens
ttttgctggtgtctgagct

SEQ ID NO: 3843145 - DNA, 14 bp, Homo sapiens
ttttggcattcctc

SEQ ID NO: 3843146 - DNA, 23 bp, Homo sapiens
ttttgtaaatgctgtaaatattt

SEQ ID NO: 3843147 - DNA, 17 bp, Homo sapiens
ttttgtagcaaccattt

SEQ ID NO: 3843148 - DNA, 17 bp, Homo sapiens
ttttgtccattattaat

SEQ ID NO: 3843149 - DNA, 16 bp, Homo sapiens
ttttgtgtgtgctgga

SEQ ID NO: 3843150 - DNA, 12 bp, Homo sapiens
tttttaaagact

SEQ ID NO: 3843151 - DNA, 13 bp, Homo sapiens
tttttaaagactt

SEQ ID NO: 3843152 - DNA, 22 bp, Homo sapiens
tttttaaatcattcattcaata

SEQ ID NO: 3843153 - DNA, 13 bp, Homo sapiens
tttttataatatt

SEQ ID NO: 3843154 - DNA, 16 bp, Homo sapiens
tttttggcattcctct

SEQ ID NO: 3843155 - DNA, 23 bp, Homo sapiens
tttttgtaaatgctgtaaatatt

SEQ ID NO: 3843156 - DNA, 13 bp, Homo sapiens
ttttttcttactg

SEQ ID NO: 3843157 - DNA, 13 bp, Homo sapiens
tttttttacgtaa

SEQ ID NO: 3843158 - DNA, 13 bp, Homo sapiens
tttttttgctggt

SEQ ID NO: 3843159 - DNA, 13 bp, Homo sapiens
ttaatgctaaggg

SEQ ID NO: 3843160 - DNA, 21 bp, Homo sapiens
ttaatgctaagggcaggccca

SEQ ID NO: 3843161 - DNA, 20 bp, Homo sapiens
ttaatgtatttttgtaaata

SEQ ID NO: 3843162 - DNA, 16 bp, Homo sapiens
ttaattaattaacatc

SEQ ID NO: 3843163 - DNA, 15 bp, Homo sapiens
ttaattgctttcctg

SEQ ID NO: 3843164 - DNA, 18 bp, Homo sapiens
ttacaagaaataaatcta

SEQ ID NO: 3843165 - DNA, 21 bp, Homo sapiens
ttacaagaaataaatctatat

SEQ ID NO: 3843166 - DNA, 17 bp, Homo sapiens
ttacaatgatttgtaaa

SEQ ID NO: 3843167 - DNA, 18 bp, Homo sapiens
ttacaatgatttgtaaag

SEQ ID NO: 3843168 - DNA, 23 bp, Homo sapiens
ttacacacgtgcaatttgtttgt

SEQ ID NO: 3843169 - DNA, 19 bp, Homo sapiens
ttacactcgaactcgggag

SEQ ID NO: 3843170 - DNA, 14 bp, Homo sapiens
ttacatgaagattt

SEQ ID NO: 3843171 - DNA, 17 bp, Homo sapiens
ttacgtcttgagaaata

SEQ ID NO: 3843172 - DNA, 13 bp, Homo sapiens
ttactagaacaca

SEQ ID NO: 3843173 - DNA, 13 bp, Homo sapiens
ttactgaatgtta

SEQ ID NO: 3843174 - DNA, 13 bp, Homo sapiens
ttactgcattttc

SEQ ID NO: 3843175 - DNA, 18 bp, Homo sapiens
ttactgcattttcacaac

SEQ ID NO: 3843176 - DNA, 17 bp, Homo sapiens
ttactgtcttttttcta

SEQ ID NO: 3843177 - DNA, 16 bp, Homo sapiens
ttactgtgtatctcaa

SEQ ID NO: 3843178 - DNA, 21 bp, Homo sapiens
ttactttcctttccccagccc

SEQ ID NO: 3843179 - DNA, 14 bp, Homo sapiens
ttactttttgtaaa

SEQ ID NO: 3843180 - DNA, 22 bp, Homo sapiens
ttactttttgtaaatgctgtaa

SEQ ID NO: 3843181 - DNA, 16 bp, Homo sapiens
ttagacaagagatggg

SEQ ID NO: 3843182 - DNA, 23 bp, Homo sapiens
ttagacactggctgccagctatt

SEQ ID NO: 3843183 - DNA, 22 bp, Homo sapiens
ttagacattctcttactttttg

SEQ ID NO: 3843184 - DNA, 13 bp, Homo sapiens
ttagaccctgggt

SEQ ID NO: 3843185 - DNA, 16 bp, Homo sapiens
ttagagccaggcacac

SEQ ID NO: 3843186 - DNA, 14 bp, Homo sapiens
ttagccaaacaaca

SEQ ID NO: 3843187 - DNA, 17 bp, Homo sapiens
ttagccatgtgaaactc

SEQ ID NO: 3843188 - DNA, 23 bp, Homo sapiens
ttagccatgtgaaactcatctca

SEQ ID NO: 3843189 - DNA, 17 bp, Homo sapiens
ttagcctgggcctcctc

SEQ ID NO: 3843190 - DNA, 15 bp, Homo sapiens
ttagctattgggagc

SEQ ID NO: 3843191 - DNA, 14 bp, Homo sapiens
ttaggacaaggctg

SEQ ID NO: 3843192 - DNA, 20 bp, Homo sapiens
ttaggacaaggctgtgccag

SEQ ID NO: 3843193 - DNA, 22 bp, Homo sapiens
ttaggacaaggctgtgccaggc

SEQ ID NO: 3843194 - DNA, 17 bp, Homo sapiens
ttaggggtatttaatgt

SEQ ID NO: 3843195 - DNA, 22 bp, Homo sapiens
ttaggtcacattacattaacat

SEQ ID NO: 3843196 - DNA, 21 bp, Homo sapiens
ttataaaaacccctaaaaaca

SEQ ID NO: 3843197 - DNA, 12 bp, Homo sapiens
ttataaactttt

SEQ ID NO: 3843198 - DNA, 17 bp, Homo sapiens
ttataacagttataaag

SEQ ID NO: 3843199 - DNA, 22 bp, Homo sapiens
ttataacagttataaagaaaga

SEQ ID NO: 3843200 - DNA, 15 bp, Homo sapiens
ttataactaatatgg

SEQ ID NO: 3843201 - DNA, 13 bp, Homo sapiens
ttataataaattg

SEQ ID NO: 3843202 - DNA, 13 bp, Homo sapiens
ttataattctttc

SEQ ID NO: 3843203 - DNA, 23 bp, Homo sapiens
ttataattctttctttttccttc

SEQ ID NO: 3843204 - DNA, 21 bp, Homo sapiens
ttatagaggctagcttctgct

SEQ ID NO: 3843205 - DNA, 15 bp, Homo sapiens
ttatagtactgcttt

SEQ ID NO: 3843206 - DNA, 17 bp, Homo sapiens
ttatagtactgctttac

SEQ ID NO: 3843207 - DNA, 19 bp, Homo sapiens
ttatagtactgctttactg

SEQ ID NO: 3843208 - DNA, 18 bp, Homo sapiens
ttatagtattaagtgaaa

SEQ ID NO: 3843209 - DNA, 19 bp, Homo sapiens
ttatagtattaagtgaaat

SEQ ID NO: 3843210 - DNA, 22 bp, Homo sapiens
ttatgctgcatttggctggagc

SEQ ID NO: 3843211 - DNA, 17 bp, Homo sapiens
ttatgtgaacattccta

SEQ ID NO: 3843212 - DNA, 22 bp, Homo sapiens
ttatgtgccagatttatgcata

SEQ ID NO: 3843213 - DNA, 17 bp, Homo sapiens
ttatgttgcatagaata

SEQ ID NO: 3843214 - DNA, 15 bp, Homo sapiens
ttattaatgctaagg

SEQ ID NO: 3843215 - DNA, 16 bp, Homo sapiens
ttattaatgctaaggg

SEQ ID NO: 3843216 - DNA, 14 bp, Homo sapiens
ttatttagacaaga

SEQ ID NO: 3843217 - DNA, 15 bp, Homo sapiens
ttatttagacaagag

SEQ ID NO: 3843218 - DNA, 16 bp, Homo sapiens
ttatttagacaagaga

SEQ ID NO: 3843219 - DNA, 22 bp, Homo sapiens
ttatttcgtgttgtgttcttta

SEQ ID NO: 3843220 - DNA, 13 bp, Homo sapiens
ttatttggaaatt

SEQ ID NO: 3843221 - DNA, 20 bp, Homo sapiens
ttattttatgttgcatagaa

SEQ ID NO: 3843222 - DNA, 14 bp, Homo sapiens
ttcaaaagaagttc

SEQ ID NO: 3843223 - DNA, 15 bp, Homo sapiens
ttcaccaaagatctg

SEQ ID NO: 3843224 - DNA, 19 bp, Homo sapiens
ttcaccaaagatctgctcc

SEQ ID NO: 3843225 - DNA, 23 bp, Homo sapiens
ttcagcttcctgctgctagcaat

SEQ ID NO: 3843226 - DNA, 23 bp, Homo sapiens
ttcaggcttgcattaaaagactg

SEQ ID NO: 3843227 - DNA, 21 bp, Homo sapiens
ttcaggttgttttgttttata

SEQ ID NO: 3843228 - DNA, 23 bp, Homo sapiens
ttcagtaacttgtttacatagca

SEQ ID NO: 3843229 - DNA, 16 bp, Homo sapiens
ttcagtggaaatcaat

SEQ ID NO: 3843230 - DNA, 23 bp, Homo sapiens
ttcagtgtcaaataaacactgtg

SEQ ID NO: 3843231 - DNA, 12 bp, Homo sapiens
ttcagttttact

SEQ ID NO: 3843232 - DNA, 19 bp, Homo sapiens
ttcagttttactgcatttt

SEQ ID NO: 3843233 - DNA, 14 bp, Homo sapiens
ttcataaattaaca

SEQ ID NO: 3843234 - DNA, 18 bp, Homo sapiens
ttcataatacataaagtt

SEQ ID NO: 3843235 - DNA, 13 bp, Homo sapiens
ttcataattttca

SEQ ID NO: 3843236 - DNA, 14 bp, Homo sapiens
ttcatacaacaaag

SEQ ID NO: 3843237 - DNA, 16 bp, Homo sapiens
ttcatcaatcattgta

SEQ ID NO: 3843238 - DNA, 22 bp, Homo sapiens
ttcatcaatcattgtacagttt

SEQ ID NO: 3843239 - DNA, 17 bp, Homo sapiens
ttcatgcaaactttatt

SEQ ID NO: 3843240 - DNA, 16 bp, Homo sapiens
ttcattcaatagatac

SEQ ID NO: 3843241 - DNA, 12 bp, Homo sapiens
ttcattcctgtc

SEQ ID NO: 3843242 - DNA, 20 bp, Homo sapiens
ttcatttggggcatttgtaa

SEQ ID NO: 3843243 - DNA, 14 bp, Homo sapiens
ttcattttctgcaa

SEQ ID NO: 3843244 - DNA, 16 bp, Homo sapiens
ttccactacacctggc

SEQ ID NO: 3843245 - DNA, 21 bp, Homo sapiens
ttccaggaaactccacatctg

SEQ ID NO: 3843246 - DNA, 24 bp, Homo sapiens
ttccaggaaactccacatctgcct

SEQ ID NO: 3843247 - DNA, 23 bp, Homo sapiens
ttccaggaggagttagccaaaca

SEQ ID NO: 3843248 - DNA, 21 bp, Homo sapiens
ttccatcctttgcatttctct

SEQ ID NO: 3843249 - DNA, 15 bp, Homo sapiens
ttcccaaagggaggg

SEQ ID NO: 3843250 - DNA, 19 bp, Homo sapiens
ttcccaggagttctgctca

SEQ ID NO: 3843251 - DNA, 12 bp, Homo sapiens
ttcccatctgca

SEQ ID NO: 3843252 - DNA, 21 bp, Homo sapiens
ttccccaccagtgaatgaaag

SEQ ID NO: 3843253 - DNA, 13 bp, Homo sapiens
ttccccagcccag

SEQ ID NO: 3843254 - DNA, 14 bp, Homo sapiens
ttccccagcccagg

SEQ ID NO: 3843255 - DNA, 21 bp, Homo sapiens
ttccccgatgtgagccgcctc

SEQ ID NO: 3843256 - DNA, 12 bp, Homo sapiens
ttccctccccag

SEQ ID NO: 3843257 - DNA, 14 bp, Homo sapiens
ttccctccccagct

SEQ ID NO: 3843258 - DNA, 14 bp, Homo sapiens
ttccctctggagtt

SEQ ID NO: 3843259 - DNA, 13 bp, Homo sapiens
ttccctgcttcca

SEQ ID NO: 3843260 - DNA, 15 bp, Homo sapiens
ttccctgcttccagg

SEQ ID NO: 3843261 - DNA, 21 bp, Homo sapiens
ttcctaaatatattttaagac

SEQ ID NO: 3843262 - DNA, 16 bp, Homo sapiens
ttcctaaggcccagct

SEQ ID NO: 3843263 - DNA, 22 bp, Homo sapiens
ttcctaaggcccagctgccagg

SEQ ID NO: 3843264 - DNA, 22 bp, Homo sapiens
ttcctcaggcaaggtctggcct

SEQ ID NO: 3843265 - DNA, 17 bp, Homo sapiens
ttcctcagttacacaaa

SEQ ID NO: 3843266 - DNA, 22 bp, Homo sapiens
ttcctcatcatgaaaactggga

SEQ ID NO: 3843267 - DNA, 12 bp, Homo sapiens
ttcctctgcctg

SEQ ID NO: 3843268 - DNA, 13 bp, Homo sapiens
ttcctctgcctgc

SEQ ID NO: 3843269 - DNA, 17 bp, Homo sapiens
ttcctgcgtcctcctca

SEQ ID NO: 3843270 - DNA, 17 bp, Homo sapiens
ttccttctgcctgagct

SEQ ID NO: 3843271 - DNA, 13 bp, Homo sapiens
ttccttgaagccg

SEQ ID NO: 3843272 - DNA, 13 bp, Homo sapiens
ttccttgcgacca

SEQ ID NO: 3843273 - DNA, 16 bp, Homo sapiens
ttccttgcgaccacca

SEQ ID NO: 3843274 - DNA, 17 bp, Homo sapiens
ttcctttccccagccca

SEQ ID NO: 3843275 - DNA, 13 bp, Homo sapiens
ttctaaagtaaaa

SEQ ID NO: 3843276 - DNA, 23 bp, Homo sapiens
ttctaatgatggcccattctact

SEQ ID NO: 3843277 - DNA, 16 bp, Homo sapiens
ttctacttgctctgga

SEQ ID NO: 3843278 - DNA, 19 bp, Homo sapiens
ttctacttgctctggacct

SEQ ID NO: 3843279 - DNA, 22 bp, Homo sapiens
ttctacttgctctggacctgcc

SEQ ID NO: 3843280 - DNA, 14 bp, Homo sapiens
ttctattgtacaga

SEQ ID NO: 3843281 - DNA, 15 bp, Homo sapiens
ttctattgtacagaa

SEQ ID NO: 3843282 - DNA, 17 bp, Homo sapiens
ttctattttcattttct

SEQ ID NO: 3843283 - DNA, 20 bp, Homo sapiens
ttctcacttttggaaggtga

SEQ ID NO: 3843284 - DNA, 17 bp, Homo sapiens
ttctcatgctatttcta

SEQ ID NO: 3843285 - DNA, 20 bp, Homo sapiens
ttctcccaggtaccagctgc

SEQ ID NO: 3843286 - DNA, 14 bp, Homo sapiens
ttctccgccagcct

SEQ ID NO: 3843287 - DNA, 19 bp, Homo sapiens
ttctccgccagcctcctct

SEQ ID NO: 3843288 - DNA, 20 bp, Homo sapiens
ttctcctcccttccttttcc

SEQ ID NO: 3843289 - DNA, 20 bp, Homo sapiens
ttctctaagatgaatccaaa

SEQ ID NO: 3843290 - DNA, 21 bp, Homo sapiens
ttctctaagatgaatccaaat

SEQ ID NO: 3843291 - DNA, 22 bp, Homo sapiens
ttctctaagatgaatccaaatg

SEQ ID NO: 3843292 - DNA, 14 bp, Homo sapiens
ttctctcctcccca

SEQ ID NO: 3843293 - DNA, 17 bp, Homo sapiens
ttctgaagcctctaaca

SEQ ID NO: 3843294 - DNA, 16 bp, Homo sapiens
ttctgaccttgtgaac

SEQ ID NO: 3843295 - DNA, 19 bp, Homo sapiens
tggatgattgttcataata

SEQ ID NO: 3843296 - DNA, 14 bp, Homo sapiens
tggatgggaggctc

SEQ ID NO: 3843297 - DNA, 17 bp, Homo sapiens
tggcaaacgctaaagag

SEQ ID NO: 3843298 - DNA, 17 bp, Homo sapiens
tggcaataatgactaaa

SEQ ID NO: 3843299 - DNA, 19 bp, Homo sapiens
tggcaccctggccacccca

SEQ ID NO: 3843300 - DNA, 15 bp, Homo sapiens
tggcagagacagtgg

SEQ ID NO: 3843301 - DNA, 11 bp, Homo sapiens
tggcagatgat

SEQ ID NO: 3843302 - DNA, 19 bp, Homo sapiens
tggcagatgatttgggcag

SEQ ID NO: 3843303 - DNA, 20 bp, Homo sapiens
tggcagatgatttgggcaga

SEQ ID NO: 3843304 - DNA, 20 bp, Homo sapiens
tggcagcataaaggcctttt

SEQ ID NO: 3843305 - DNA, 22 bp, Homo sapiens
tggcaggatcggcttcctcagg

SEQ ID NO: 3843306 - DNA, 18 bp, Homo sapiens
tggcagtgagtgagcctg

SEQ ID NO: 3843307 - DNA, 12 bp, Homo sapiens
tggcagtggttt

SEQ ID NO: 3843308 - DNA, 19 bp, Homo sapiens
tggcagtttgttgatcttt

SEQ ID NO: 3843309 - DNA, 19 bp, Homo sapiens
tggcatgtgcctataatcc

SEQ ID NO: 3843310 - DNA, 19 bp, Homo sapiens
tggcatgttttgtcattgt

SEQ ID NO: 3843311 - DNA, 21 bp, Homo sapiens
tggcatgttttgtcattgttt

SEQ ID NO: 3843312 - DNA, 11 bp, Homo sapiens
tggcattcctc

SEQ ID NO: 3843313 - DNA, 12 bp, Homo sapiens
tggcattcctct

SEQ ID NO: 3843314 - DNA, 15 bp, Homo sapiens
tggcattcctctaat

SEQ ID NO: 3843315 - DNA, 21 bp, Homo sapiens
tggcattcctctaatgttgtg

SEQ ID NO: 3843316 - DNA, 22 bp, Homo sapiens
tggccaacatcatatacctctt

SEQ ID NO: 3843317 - DNA, 11 bp, Homo sapiens
tggccatggct

SEQ ID NO: 3843318 - DNA, 13 bp, Homo sapiens
tggcccaggctgg

SEQ ID NO: 3843319 - DNA, 14 bp, Homo sapiens
tggcccaggctggc

SEQ ID NO: 3843320 - DNA, 16 bp, Homo sapiens
tggcccaggctggccc

SEQ ID NO: 3843321 - DNA, 20 bp, Homo sapiens
tggcccattctacttgctct

SEQ ID NO: 3843322 - DNA, 22 bp, Homo sapiens
tggcccattctacttgctctgg

SEQ ID NO: 3843323 - DNA, 23 bp, Homo sapiens
tggcccattctacttgctctgga

SEQ ID NO: 3843324 - DNA, 14 bp, Homo sapiens
tggcccccacccac

SEQ ID NO: 3843325 - DNA, 15 bp, Homo sapiens
tggcccccacccacc

SEQ ID NO: 3843326 - DNA, 19 bp, Homo sapiens
tggcccccacccaccttcc

SEQ ID NO: 3843327 - DNA, 15 bp, Homo sapiens
tggccctgtccctcc

SEQ ID NO: 3843328 - DNA, 21 bp, Homo sapiens
tggccctgtccctcccacctc

SEQ ID NO: 3843329 - DNA, 23 bp, Homo sapiens
tggccctgtccctcccacctctg

SEQ ID NO: 3843330 - DNA, 16 bp, Homo sapiens
tggcctaggtgggagc

SEQ ID NO: 3843331 - DNA, 23 bp, Homo sapiens
tggcctcacctgggttccccacc

SEQ ID NO: 3843332 - DNA, 23 bp, Homo sapiens
tggctcagaaaataccttagctt

SEQ ID NO: 3843333 - DNA, 14 bp, Homo sapiens
tggctctggagaca

SEQ ID NO: 3843334 - DNA, 22 bp, Homo sapiens
tggctctggagacagccccaga

SEQ ID NO: 3843335 - DNA, 17 bp, Homo sapiens
tggctgaggttcctctg

SEQ ID NO: 3843336 - DNA, 12 bp, Homo sapiens
tggctgctgccc

SEQ ID NO: 3843337 - DNA, 18 bp, Homo sapiens
tggctgttggcagtgagt

SEQ ID NO: 3843338 - DNA, 12 bp, Homo sapiens
tggcttcaggag

SEQ ID NO: 3843339 - DNA, 23 bp, Homo sapiens
tgggaaggaagcttggctgctca

SEQ ID NO: 3843340 - DNA, 14 bp, Homo sapiens
tgggaatgaggtgg

SEQ ID NO: 3843341 - DNA, 21 bp, Homo sapiens
tgggagagtccttagcctggg

SEQ ID NO: 3843342 - DNA, 18 bp, Homo sapiens
tgggagcaatctggaaaa

SEQ ID NO: 3843343 - DNA, 16 bp, Homo sapiens
tgggagccaccactcc

SEQ ID NO: 3843344 - DNA, 17 bp, Homo sapiens
tgggaggaagcagaata

SEQ ID NO: 3843345 - DNA, 18 bp, Homo sapiens
tgggaggaagcagaataa

SEQ ID NO: 3843346 - DNA, 19 bp, Homo sapiens
tgggaggaagcagaataaa

SEQ ID NO: 3843347 - DNA, 13 bp, Homo sapiens
tgggaggagggag

SEQ ID NO: 3843348 - DNA, 14 bp, Homo sapiens
tgggaggagggaga

SEQ ID NO: 3843349 - DNA, 18 bp, Homo sapiens
tgggaggagggagaggga

SEQ ID NO: 3843350 - DNA, 15 bp, Homo sapiens
tgggaggctcctggt

SEQ ID NO: 3843351 - DNA, 22 bp, Homo sapiens
tgggaggctcggggctccccac

SEQ ID NO: 3843352 - DNA, 20 bp, Homo sapiens
tgggaggggcgcccacctcc

SEQ ID NO: 3843353 - DNA, 23 bp, Homo sapiens
tgggagggggcttgaagccaaag

SEQ ID NO: 3843354 - DNA, 18 bp, Homo sapiens
tgggaggtggaagaaggg

SEQ ID NO: 3843355 - DNA, 19 bp, Homo sapiens
tgggaggtggaagaaggga

SEQ ID NO: 3843356 - DNA, 22 bp, Homo sapiens
tgggaggtggaagaagggagaa

SEQ ID NO: 3843357 - DNA, 15 bp, Homo sapiens
tgggcaataaaagat

SEQ ID NO: 3843358 - DNA, 19 bp, Homo sapiens
tgggcaccccaggcagctc

SEQ ID NO: 3843359 - DNA, 16 bp, Homo sapiens
tgggcccttcctggct

SEQ ID NO: 3843360 - DNA, 19 bp, Homo sapiens
tgggcctcctcctagctgg

SEQ ID NO: 3843361 - DNA, 23 bp, Homo sapiens
tgggcctcctcctagctggagtg

SEQ ID NO: 3843362 - DNA, 17 bp, Homo sapiens
tgggctccgctgtgccc

SEQ ID NO: 3843363 - DNA, 23 bp, Homo sapiens
tgggctgggcccttcctggctag

SEQ ID NO: 3843364 - DNA, 15 bp, Homo sapiens
tgggcttggcctgct

SEQ ID NO: 3843365 - DNA, 17 bp, Homo sapiens
tgggcttggcctgctgt

SEQ ID NO: 3843366 - DNA, 23 bp, Homo sapiens
tggggacaggcctttctggcctg

SEQ ID NO: 3843367 - DNA, 12 bp, Homo sapiens
tggggagagctg

SEQ ID NO: 3843368 - DNA, 11 bp, Homo sapiens
tggggagctgg

SEQ ID NO: 3843369 - DNA, 16 bp, Homo sapiens
tggggcagaaaggctg

SEQ ID NO: 3843370 - DNA, 17 bp, Homo sapiens
tggggcagaaaggctgc

SEQ ID NO: 3843371 - DNA, 14 bp, Homo sapiens
tggggcccccagca

SEQ ID NO: 3843372 - DNA, 15 bp, Homo sapiens
tggggcccccagcac

SEQ ID NO: 3843373 - DNA, 17 bp, Homo sapiens
tggggcccccagcaccc

SEQ ID NO: 3843374 - DNA, 17 bp, Homo sapiens
tggggcctggactggac

SEQ ID NO: 3843375 - DNA, 22 bp, Homo sapiens
tgggggccagcacagctgagga

SEQ ID NO: 3843376 - DNA, 22 bp, Homo sapiens
tgggggtcacccatggcctcag

SEQ ID NO: 3843377 - DNA, 18 bp, Homo sapiens
tgggggtggaggcttcct

SEQ ID NO: 3843378 - DNA, 15 bp, Homo sapiens
tggggtagggtgaga

SEQ ID NO: 3843379 - DNA, 14 bp, Homo sapiens
tggggtcagcaggc

SEQ ID NO: 3843380 - DNA, 16 bp, Homo sapiens
tggggtcagcaggccc

SEQ ID NO: 3843381 - DNA, 19 bp, Homo sapiens
tggggtcagcaggcccagg

SEQ ID NO: 3843382 - DNA, 18 bp, Homo sapiens
tggggtgctgggaggagg

SEQ ID NO: 3843383 - DNA, 21 bp, Homo sapiens
tgggtgagatgctggagaaga

SEQ ID NO: 3843384 - DNA, 16 bp, Homo sapiens
tgggtgggctctgtgc

SEQ ID NO: 3843385 - DNA, 15 bp, Homo sapiens
tgggtttgaagctgc

SEQ ID NO: 3843386 - DNA, 17 bp, Homo sapiens
tgggtttgaagctgctg

SEQ ID NO: 3843387 - DNA, 20 bp, Homo sapiens
tggtattgaatctaaaacca

SEQ ID NO: 3843388 - DNA, 16 bp, Homo sapiens
tggtattgtaatatta

SEQ ID NO: 3843389 - DNA, 13 bp, Homo sapiens
tggtcacagggca

SEQ ID NO: 3843390 - DNA, 19 bp, Homo sapiens
tggtctagaatggattttt

SEQ ID NO: 3843391 - DNA, 19 bp, Homo sapiens
tggtgattaaggtcctgct

SEQ ID NO: 3843392 - DNA, 20 bp, Homo sapiens
tggtgattaaggtcctgctt

SEQ ID NO: 3843393 - DNA, 23 bp, Homo sapiens
tggtgcctggctggtttgcccag

SEQ ID NO: 3843394 - DNA, 17 bp, Homo sapiens
tggtggagggggagggg

SEQ ID NO: 3843395 - DNA, 21 bp, Homo sapiens
tggtggagggggaggggagaa

SEQ ID NO: 3843396 - DNA, 12 bp, Homo sapiens
tggtgggagggg

SEQ ID NO: 3843397 - DNA, 13 bp, Homo sapiens
tggtggggcagaa

SEQ ID NO: 3843398 - DNA, 22 bp, Homo sapiens
tggtggggcccccagcaccctc

SEQ ID NO: 3843399 - DNA, 20 bp, Homo sapiens
tggtgtaatctctcatggtg

SEQ ID NO: 3843400 - DNA, 21 bp, Homo sapiens
tggttaagaatgtatatcagg

SEQ ID NO: 3843401 - DNA, 19 bp, Homo sapiens
tggttctacaaatttttac

SEQ ID NO: 3843402 - DNA, 22 bp, Homo sapiens
tggttttaaagctaaacgtaat

SEQ ID NO: 3843403 - DNA, 20 bp, Homo sapiens
tggttttatactatattaac

SEQ ID NO: 3843404 - DNA, 13 bp, Homo sapiens
tggtttttataat

SEQ ID NO: 3843405 - DNA, 19 bp, Homo sapiens
tggtttttataatattcat

SEQ ID NO: 3843406 - DNA, 13 bp, Homo sapiens
tggtttttcccac

SEQ ID NO: 3843407 - DNA, 20 bp, Homo sapiens
tgtaaaaagtagattaaaat

SEQ ID NO: 3843408 - DNA, 15 bp, Homo sapiens
tgtaaaatcttgata

SEQ ID NO: 3843409 - DNA, 16 bp, Homo sapiens
tgtaaaggactattta

SEQ ID NO: 3843410 - DNA, 19 bp, Homo sapiens
tgtaaatagtttaacactt

SEQ ID NO: 3843411 - DNA, 19 bp, Homo sapiens
tgtaaatatttcataaatt

SEQ ID NO: 3843412 - DNA, 21 bp, Homo sapiens
tgtaaatatttcataaattaa

SEQ ID NO: 3843413 - DNA, 13 bp, Homo sapiens
tgtaaatcataat

SEQ ID NO: 3843414 - DNA, 13 bp, Homo sapiens
tgtaaatgctgta

SEQ ID NO: 3843415 - DNA, 22 bp, Homo sapiens
tgtaaatgctgtaaatatttca

SEQ ID NO: 3843416 - DNA, 15 bp, Homo sapiens
tgtaaattattttat

SEQ ID NO: 3843417 - DNA, 16 bp, Homo sapiens
tgtaaattccccttcc

SEQ ID NO: 3843418 - DNA, 12 bp, Homo sapiens
tgtaacagctcc

SEQ ID NO: 3843419 - DNA, 16 bp, Homo sapiens
tgtaacagctccttgg

SEQ ID NO: 3843420 - DNA, 16 bp, Homo sapiens
tgtaacatttacgaat

SEQ ID NO: 3843421 - DNA, 13 bp, Homo sapiens
tgtaagtataaga

SEQ ID NO: 3843422 - DNA, 12 bp, Homo sapiens
tgtaataaatgt

SEQ ID NO: 3843423 - DNA, 15 bp, Homo sapiens
tgtaataaatgtatt

SEQ ID NO: 3843424 - DNA, 17 bp, Homo sapiens
tgtaatagagaatattt

SEQ ID NO: 3843425 - DNA, 12 bp, Homo sapiens
tgtaatattaaa

SEQ ID NO: 3843426 - DNA, 21 bp, Homo sapiens
tgtaatattaaaaagaagttt

SEQ ID NO: 3843427 - DNA, 13 bp, Homo sapiens
tgtaattacaact

SEQ ID NO: 3843428 - DNA, 18 bp, Homo sapiens
tgtacaaaaaagttataa

SEQ ID NO: 3843429 - DNA, 21 bp, Homo sapiens
tgtacaaaaaagttataagaa

SEQ ID NO: 3843430 - DNA, 21 bp, Homo sapiens
tgtagatttcagtagtttcta

SEQ ID NO: 3843431 - DNA, 14 bp, Homo sapiens
tgtagcaaccattt

SEQ ID NO: 3843432 - DNA, 16 bp, Homo sapiens
tgtagcaaccatttgt

SEQ ID NO: 3843433 - DNA, 22 bp, Homo sapiens
tgtagccatgaccttacatttc

SEQ ID NO: 3843434 - DNA, 15 bp, Homo sapiens
tgtatgaattttgta

SEQ ID NO: 3843435 - DNA, 21 bp, Homo sapiens
tgtatggatagtaaaattcta

SEQ ID NO: 3843436 - DNA, 13 bp, Homo sapiens
tgtattaatacca

SEQ ID NO: 3843437 - DNA, 11 bp, Homo sapiens
tgtattatgtg

SEQ ID NO: 3843438 - DNA, 21 bp, Homo sapiens
tgtatttttttttctaagaga

SEQ ID NO: 3843439 - DNA, 15 bp, Homo sapiens
tgtcaaataaacact

SEQ ID NO: 3843440 - DNA, 18 bp, Homo sapiens
tgtcaaataaacactgtg

SEQ ID NO: 3843441 - DNA, 16 bp, Homo sapiens
tgtcactccataaaaa

SEQ ID NO: 3843442 - DNA, 22 bp, Homo sapiens
tgtcataatatttgaacaaaaa

SEQ ID NO: 3843443 - DNA, 16 bp, Homo sapiens
tgtcatagtttaattg

SEQ ID NO: 3843444 - DNA, 16 bp, Homo sapiens
tgtcattgcccacttc

SEQ ID NO: 3843445 - DNA, 22 bp, Homo sapiens
tgtcattgcccacttctgtgta

SEQ ID NO: 3843446 - DNA, 16 bp, Homo sapiens
tgtcccagcctggcct

SEQ ID NO: 3843447 - DNA, 13 bp, Homo sapiens
tgtccccatagct

SEQ ID NO: 3843448 - DNA, 11 bp, Homo sapiens
tgtccccttcc

SEQ ID NO: 3843449 - DNA, 12 bp, Homo sapiens
tgtccctcccac

SEQ ID NO: 3843450 - DNA, 15 bp, Homo sapiens
tgtccctcccacctc

SEQ ID NO: 3843451 - DNA, 14 bp, Homo sapiens
tgtcctcactgctc

SEQ ID NO: 3843452 - DNA, 19 bp, Homo sapiens
tgtcctccccaccccgata

SEQ ID NO: 3843453 - DNA, 11 bp, Homo sapiens
tgtcctggggg

SEQ ID NO: 3843454 - DNA, 21 bp, Homo sapiens
tgtcctgggggatgcaaataa

SEQ ID NO: 3843455 - DNA, 17 bp, Homo sapiens
tgtctataagtatataa

SEQ ID NO: 3843456 - DNA, 13 bp, Homo sapiens
tgtctccaggcag

SEQ ID NO: 3843457 - DNA, 20 bp, Homo sapiens
tgtctctagaagtgccatct

SEQ ID NO: 3843458 - DNA, 22 bp, Homo sapiens
tgtctctagaagtgccatctca

SEQ ID NO: 3843459 - DNA, 13 bp, Homo sapiens
tgtctctgcctct

SEQ ID NO: 3843460 - DNA, 19 bp, Homo sapiens
tgtctgaaaaatgcctgct

SEQ ID NO: 3843461 - DNA, 23 bp, Homo sapiens
tgtctgaaaaatgcctgctgctg

SEQ ID NO: 3843462 - DNA, 12 bp, Homo sapiens
tgtctgaaggat

SEQ ID NO: 3843463 - DNA, 18 bp, Homo sapiens
tgtctgtgtgctactaac

SEQ ID NO: 3843464 - DNA, 22 bp, Homo sapiens
tgtctgtgtgctactaacagat

SEQ ID NO: 3843465 - DNA, 13 bp, Homo sapiens
tgtcttgcatttt

SEQ ID NO: 3843466 - DNA, 23 bp, Homo sapiens
tgtcttgcatttttttcctttat

SEQ ID NO: 3843467 - DNA, 14 bp, Homo sapiens
tgtctttttcgcca

SEQ ID NO: 3843468 - DNA, 18 bp, Homo sapiens
tgtgaaatttcatgaaaa

SEQ ID NO: 3843469 - DNA, 22 bp, Homo sapiens
tgtgaaatttcatgaaaacttt

SEQ ID NO: 3843470 - DNA, 17 bp, Homo sapiens
tgtgacagcctctgcag

SEQ ID NO: 3843471 - DNA, 20 bp, Homo sapiens
tgtgacctcaggcactagcc

SEQ ID NO: 3843472 - DNA, 21 bp, Homo sapiens
tgtgacctcaggcactagcct

SEQ ID NO: 3843473 - DNA, 19 bp, Homo sapiens
tgtgactagtgctgaagct

SEQ ID NO: 3843474 - DNA, 23 bp, Homo sapiens
tgtgactagtgctgaagcttatt

SEQ ID NO: 3843475 - DNA, 16 bp, Homo sapiens
tgtgagatgagagtgg

SEQ ID NO: 3843476 - DNA, 10 bp, Homo sapiens
tgtgagcaca

SEQ ID NO: 3843477 - DNA, 14 bp, Homo sapiens
tgtgagccttggct

SEQ ID NO: 3843478 - DNA, 13 bp, Homo sapiens
tgtgatataagtg

SEQ ID NO: 3843479 - DNA, 16 bp, Homo sapiens
tgtgatgtacacattt

SEQ ID NO: 3843480 - DNA, 22 bp, Homo sapiens
tgtgattccactacacctggct

SEQ ID NO: 3843481 - DNA, 18 bp, Homo sapiens
tgtgcagggccctctggg

SEQ ID NO: 3843482 - DNA, 22 bp, Homo sapiens
tgtgcagggccctctggggctc

SEQ ID NO: 3843483 - DNA, 18 bp, Homo sapiens
tgtgcagtcactggaggt

SEQ ID NO: 3843484 - DNA, 17 bp, Homo sapiens
tgtgcagtggagctggc

SEQ ID NO: 3843485 - DNA, 13 bp, Homo sapiens
tgtgccaggctgg

SEQ ID NO: 3843486 - DNA, 19 bp, Homo sapiens
tgtgccatgttcaaaagaa

SEQ ID NO: 3843487 - DNA, 21 bp, Homo sapiens
tgtgccgcactagcctccctc

SEQ ID NO: 3843488 - DNA, 13 bp, Homo sapiens
tgtgctgctgagt

SEQ ID NO: 3843489 - DNA, 21 bp, Homo sapiens
tgtgcttctaatatttattgc

SEQ ID NO: 3843490 - DNA, 16 bp, Homo sapiens
tgtgctttataaaaaa

SEQ ID NO: 3843491 - DNA, 22 bp, Homo sapiens
tgtggaatgatgtatataaaat

SEQ ID NO: 3843492 - DNA, 18 bp, Homo sapiens
tgtggatgggaggctcct

SEQ ID NO: 3843493 - DNA, 20 bp, Homo sapiens
tgtggcaaaccccaaagaga

SEQ ID NO: 3843494 - DNA, 21 bp, Homo sapiens
tgtggcaaaccccaaagagag

SEQ ID NO: 3843495 - DNA, 19 bp, Homo sapiens
tgtggcacagacccccgtc

SEQ ID NO: 3843496 - DNA, 16 bp, Homo sapiens
tgtggcagtggttttg

SEQ ID NO: 3843497 - DNA, 13 bp, Homo sapiens
tgtggcctggatc

SEQ ID NO: 3843498 - DNA, 20 bp, Homo sapiens
tgtgggtggatataaatata

SEQ ID NO: 3843499 - DNA, 17 bp, Homo sapiens
tgtggttgtggatggga

SEQ ID NO: 3843500 - DNA, 17 bp, Homo sapiens
tgtgtgcagtggagctg

SEQ ID NO: 3843501 - DNA, 13 bp, Homo sapiens
tgtgtgctactaa

SEQ ID NO: 3843502 - DNA, 22 bp, Homo sapiens
tgtgtgggtggatataaatata

SEQ ID NO: 3843503 - DNA, 23 bp, Homo sapiens
tgtgtgggtggatataaatatat

SEQ ID NO: 3843504 - DNA, 14 bp, Homo sapiens
tgtgttctttataa

SEQ ID NO: 3843505 - DNA, 21 bp, Homo sapiens
tgtgttttaacaccaacactg

SEQ ID NO: 3843506 - DNA, 12 bp, Homo sapiens
tgttactagcct

SEQ ID NO: 3843507 - DNA, 15 bp, Homo sapiens
tgttactagcctctc

SEQ ID NO: 3843508 - DNA, 14 bp, Homo sapiens
tgttactgccaaaa

SEQ ID NO: 3843509 - DNA, 22 bp, Homo sapiens
tgttactgccaaaaccaaattg

SEQ ID NO: 3843510 - DNA, 19 bp, Homo sapiens
tgttccccaccgccctgcc

SEQ ID NO: 3843511 - DNA, 15 bp, Homo sapiens
tgttcgcgtgtgtgg

SEQ ID NO: 3843512 - DNA, 15 bp, Homo sapiens
tgttctctcccaggg

SEQ ID NO: 3843513 - DNA, 19 bp, Homo sapiens
tgttgagcgtattcttgaa

SEQ ID NO: 3843514 - DNA, 16 bp, Homo sapiens
tgttggctcagaaaat

SEQ ID NO: 3843515 - DNA, 14 bp, Homo sapiens
tgtttaaaaattta

SEQ ID NO: 3843516 - DNA, 16 bp, Homo sapiens
tgtttaaaaatttata

SEQ ID NO: 3843517 - DNA, 17 bp, Homo sapiens
tgtttaaaaatttataa

SEQ ID NO: 3843518 - DNA, 18 bp, Homo sapiens
tgtttaaaaatttataac

SEQ ID NO: 3843519 - DNA, 12 bp, Homo sapiens
tgtttataaaaa

SEQ ID NO: 3843520 - DNA, 12 bp, Homo sapiens
tgtttatgcatt

SEQ ID NO: 3843521 - DNA, 21 bp, Homo sapiens
tgtttatgcatttcaatttca

SEQ ID NO: 3843522 - DNA, 19 bp, Homo sapiens
tgtttatgtgaacattcct

SEQ ID NO: 3843523 - DNA, 14 bp, Homo sapiens
tgtttctcatttta

SEQ ID NO: 3843524 - DNA, 24 bp, Homo sapiens
tgtttggaaatggggagctggcct

SEQ ID NO: 3843525 - DNA, 14 bp, Homo sapiens
tgtttgtgcttcta

SEQ ID NO: 3843526 - DNA, 16 bp, Homo sapiens
tgtttgtggaatggat

SEQ ID NO: 3843527 - DNA, 18 bp, Homo sapiens
tgttttaaaatgagaaat

SEQ ID NO: 3843528 - DNA, 17 bp, Homo sapiens
tgttttacaactcctga

SEQ ID NO: 3843529 - DNA, 16 bp, Homo sapiens
tgttttacaatgattt

SEQ ID NO: 3843530 - DNA, 14 bp, Homo sapiens
tgttttatagtatt

SEQ ID NO: 3843531 - DNA, 19 bp, Homo sapiens
tgttttgtagcaaccattt

SEQ ID NO: 3843532 - DNA, 20 bp, Homo sapiens
tgttttttttttgtgtgtgc

SEQ ID NO: 3843533 - DNA, 20 bp, Homo sapiens
ttaaaaagaagtttctatat

SEQ ID NO: 3843534 - DNA, 14 bp, Homo sapiens
ttaaaaatttataa

SEQ ID NO: 3843535 - DNA, 11 bp, Homo sapiens
ttaaaacaaga

SEQ ID NO: 3843536 - DNA, 14 bp, Homo sapiens
ttaaaaccaaagag

SEQ ID NO: 3843537 - DNA, 22 bp, Homo sapiens
ttaaaactcagatttaaaacaa

SEQ ID NO: 3843538 - DNA, 18 bp, Homo sapiens
ttaaaataaataaacttt

SEQ ID NO: 3843539 - DNA, 12 bp, Homo sapiens
ttaaaatgagaa

SEQ ID NO: 3843540 - DNA, 13 bp, Homo sapiens
ttaaacataaata

SEQ ID NO: 3843541 - DNA, 15 bp, Homo sapiens
ttaaactcttgaata

SEQ ID NO: 3843542 - DNA, 19 bp, Homo sapiens
ttaaacttcagttttactg

SEQ ID NO: 3843543 - DNA, 20 bp, Homo sapiens
ttaaacttcagttttactgc

SEQ ID NO: 3843544 - DNA, 14 bp, Homo sapiens
ttaaagacttttat

SEQ ID NO: 3843545 - DNA, 15 bp, Homo sapiens
ttaaatatataaaca

SEQ ID NO: 3843546 - DNA, 16 bp, Homo sapiens
ttaaatatataaacaa

SEQ ID NO: 3843547 - DNA, 19 bp, Homo sapiens
ttaaatatataaacaaaca

SEQ ID NO: 3843548 - DNA, 19 bp, Homo sapiens
ttaaatatatctttgtaaa

SEQ ID NO: 3843549 - DNA, 13 bp, Homo sapiens
ttaaatatgattt

SEQ ID NO: 3843550 - DNA, 22 bp, Homo sapiens
ttaaatgcacagttctatttgc

SEQ ID NO: 3843551 - DNA, 23 bp, Homo sapiens
ttaaatgcacagttctatttgct

SEQ ID NO: 3843552 - DNA, 23 bp, Homo sapiens
ttaaatgtggaatgatgtatata

SEQ ID NO: 3843553 - DNA, 15 bp, Homo sapiens
ttaaatgttcatgtc

SEQ ID NO: 3843554 - DNA, 23 bp, Homo sapiens
ttaactaatatttgtctgtgtgc

SEQ ID NO: 3843555 - DNA, 21 bp, Homo sapiens
ttaagaaagattaaatatatc

SEQ ID NO: 3843556 - DNA, 23 bp, Homo sapiens
ttaagaatgtatatcagggttta

SEQ ID NO: 3843557 - DNA, 22 bp, Homo sapiens
ttaagacgaaacatttgttcta

SEQ ID NO: 3843558 - DNA, 16 bp, Homo sapiens
ttaaggagaaatagct

SEQ ID NO: 3843559 - DNA, 15 bp, Homo sapiens
ttaaggtcctgcttg

SEQ ID NO: 3843560 - DNA, 12 bp, Homo sapiens
ttaagtaattgc

SEQ ID NO: 3843561 - DNA, 23 bp, Homo sapiens
ttaagtaattgccagcttttata

SEQ ID NO: 3843562 - DNA, 14 bp, Homo sapiens
ttaagtatatttgt

SEQ ID NO: 3843563 - DNA, 15 bp, Homo sapiens
ttaagtatatttgta

SEQ ID NO: 3843564 - DNA, 18 bp, Homo sapiens
ttaagtatatttgtaaaa

SEQ ID NO: 3843565 - DNA, 13 bp, Homo sapiens
ttaatcattgcct

SEQ ID NO: 3843566 - DNA, 17 bp, Homo sapiens
ttaatctttaattttac

SEQ ID NO: 3843567 - DNA, 18 bp, Homo sapiens
ttaatctttttgtttttc

SEQ ID NO: 3843568 - DNA, 14 bp, Homo sapiens
tctccttcctcaga

SEQ ID NO: 3843569 - DNA, 20 bp, Homo sapiens
tctcgaatactttgaatgtt

SEQ ID NO: 3843570 - DNA, 21 bp, Homo sapiens
tctctaagatgaatccaaatg

SEQ ID NO: 3843571 - DNA, 12 bp, Homo sapiens
tctctccagagc

SEQ ID NO: 3843572 - DNA, 14 bp, Homo sapiens
tctctcccaggggc

SEQ ID NO: 3843573 - DNA, 20 bp, Homo sapiens
tctctcccaggggctggctt

SEQ ID NO: 3843574 - DNA, 13 bp, Homo sapiens
tctctcctcccca

SEQ ID NO: 3843575 - DNA, 11 bp, Homo sapiens
tctctctgagc

SEQ ID NO: 3843576 - DNA, 19 bp, Homo sapiens
tctctggaatttgaaacac

SEQ ID NO: 3843577 - DNA, 22 bp, Homo sapiens
tctcttactttttgtaaatgct

SEQ ID NO: 3843578 - DNA, 19 bp, Homo sapiens
tctctttccttcttgcctt

SEQ ID NO: 3843579 - DNA, 19 bp, Homo sapiens
tctctttcttctctgctgc

SEQ ID NO: 3843580 - DNA, 21 bp, Homo sapiens
tctgaaaaatgcctgctgctg

SEQ ID NO: 3843581 - DNA, 15 bp, Homo sapiens
tctgaagcctctaac

SEQ ID NO: 3843582 - DNA, 15 bp, Homo sapiens
tctgaattattttct

SEQ ID NO: 3843583 - DNA, 13 bp, Homo sapiens
tctgacatcaagt

SEQ ID NO: 3843584 - DNA, 14 bp, Homo sapiens
tctgacatcaagtg

SEQ ID NO: 3843585 - DNA, 20 bp, Homo sapiens
tctgacatcaagtgtaatta

SEQ ID NO: 3843586 - DNA, 15 bp, Homo sapiens
tctgacccctcctca

SEQ ID NO: 3843587 - DNA, 22 bp, Homo sapiens
tctgagaccaaaattttgtccc

SEQ ID NO: 3843588 - DNA, 17 bp, Homo sapiens
tctgaggctcagccctg

SEQ ID NO: 3843589 - DNA, 14 bp, Homo sapiens
tctgcaagcctgcg

SEQ ID NO: 3843590 - DNA, 15 bp, Homo sapiens
tctgcaccccttctc

SEQ ID NO: 3843591 - DNA, 15 bp, Homo sapiens
tctgccaccagagac

SEQ ID NO: 3843592 - DNA, 14 bp, Homo sapiens
tctgccctggctgc

SEQ ID NO: 3843593 - DNA, 15 bp, Homo sapiens
tctgccctggctgct

SEQ ID NO: 3843594 - DNA, 17 bp, Homo sapiens
tctgccctggctgctgc

SEQ ID NO: 3843595 - DNA, 21 bp, Homo sapiens
tctgccctggctgctgccccc

SEQ ID NO: 3843596 - DNA, 14 bp, Homo sapiens
tctgcctgccccgc

SEQ ID NO: 3843597 - DNA, 17 bp, Homo sapiens
tctgccttaaaaccaaa

SEQ ID NO: 3843598 - DNA, 20 bp, Homo sapiens
tctgccttaaaaccaaagag

SEQ ID NO: 3843599 - DNA, 17 bp, Homo sapiens
tctgctcagccctggag

SEQ ID NO: 3843600 - DNA, 18 bp, Homo sapiens
tctgctcagccctggagg

SEQ ID NO: 3843601 - DNA, 15 bp, Homo sapiens
tctgctcctccctcc

SEQ ID NO: 3843602 - DNA, 16 bp, Homo sapiens
tctgctcctccctccc

SEQ ID NO: 3843603 - DNA, 19 bp, Homo sapiens
tctgcttttctgccctggc

SEQ ID NO: 3843604 - DNA, 21 bp, Homo sapiens
tctgcttttctgccctggctg

SEQ ID NO: 3843605 - DNA, 20 bp, Homo sapiens
tctggaaaactcaggattct

SEQ ID NO: 3843606 - DNA, 23 bp, Homo sapiens
tctggaacgctctaggcagaaga

SEQ ID NO: 3843607 - DNA, 12 bp, Homo sapiens
tctggacctgcc

SEQ ID NO: 3843608 - DNA, 21 bp, Homo sapiens
tctggacggcaggctcactgc

SEQ ID NO: 3843609 - DNA, 16 bp, Homo sapiens
tctggagacagcccca

SEQ ID NO: 3843610 - DNA, 17 bp, Homo sapiens
tctggagacagccccag

SEQ ID NO: 3843611 - DNA, 15 bp, Homo sapiens
tctggagtttcatgt

SEQ ID NO: 3843612 - DNA, 16 bp, Homo sapiens
tctggattcttggccc

SEQ ID NO: 3843613 - DNA, 21 bp, Homo sapiens
tctggcccaggctggccccca

SEQ ID NO: 3843614 - DNA, 20 bp, Homo sapiens
tctgggacctgccaggcagg

SEQ ID NO: 3843615 - DNA, 21 bp, Homo sapiens
tctgggcagatgaaaagctac

SEQ ID NO: 3843616 - DNA, 18 bp, Homo sapiens
tctgtaattacaactaaa

SEQ ID NO: 3843617 - DNA, 12 bp, Homo sapiens
tctgtcctgggg

SEQ ID NO: 3843618 - DNA, 14 bp, Homo sapiens
tctgtgacctcagg

SEQ ID NO: 3843619 - DNA, 18 bp, Homo sapiens
tctgtgtgctactaacag

SEQ ID NO: 3843620 - DNA, 21 bp, Homo sapiens
tctgtgtgctactaacagatt

SEQ ID NO: 3843621 - DNA, 22 bp, Homo sapiens
tctgtgtgctactaacagatta

SEQ ID NO: 3843622 - DNA, 23 bp, Homo sapiens
tctgttaggtgtacatcctgcag

SEQ ID NO: 3843623 - DNA, 19 bp, Homo sapiens
tcttactgtcttttttcta

SEQ ID NO: 3843624 - DNA, 14 bp, Homo sapiens
tcttacttgagtat

SEQ ID NO: 3843625 - DNA, 22 bp, Homo sapiens
tcttactttcctttccccagcc

SEQ ID NO: 3843626 - DNA, 17 bp, Homo sapiens
tcttactttttgtaaat

SEQ ID NO: 3843627 - DNA, 16 bp, Homo sapiens
tcttagcatcctgcct

SEQ ID NO: 3843628 - DNA, 15 bp, Homo sapiens
tcttccatcccagga

SEQ ID NO: 3843629 - DNA, 14 bp, Homo sapiens
tcttctgtattttt

SEQ ID NO: 3843630 - DNA, 15 bp, Homo sapiens
tcttcttactagggg

SEQ ID NO: 3843631 - DNA, 20 bp, Homo sapiens
tcttgatctgctcagccctg

SEQ ID NO: 3843632 - DNA, 21 bp, Homo sapiens
tcttgatctgctcagccctgg

SEQ ID NO: 3843633 - DNA, 22 bp, Homo sapiens
tcttgatctgctcagccctgga

SEQ ID NO: 3843634 - DNA, 22 bp, Homo sapiens
tcttgccaacctgtaataaata

SEQ ID NO: 3843635 - DNA, 23 bp, Homo sapiens
tcttgccaacctgtaataaatat

SEQ ID NO: 3843636 - DNA, 15 bp, Homo sapiens
tcttggaaaaagtga

SEQ ID NO: 3843637 - DNA, 16 bp, Homo sapiens
tcttgggggtcaccca

SEQ ID NO: 3843638 - DNA, 17 bp, Homo sapiens
tcttgggggtcacccat

SEQ ID NO: 3843639 - DNA, 11 bp, Homo sapiens
tcttgtgacta

SEQ ID NO: 3843640 - DNA, 16 bp, Homo sapiens
tcttgtgactagtgct

SEQ ID NO: 3843641 - DNA, 18 bp, Homo sapiens
tcttgtgactagtgctga

SEQ ID NO: 3843642 - DNA, 23 bp, Homo sapiens
tcttgtgctggatggagcccagg

SEQ ID NO: 3843643 - DNA, 20 bp, Homo sapiens
tctttacccaaggattttta

SEQ ID NO: 3843644 - DNA, 17 bp, Homo sapiens
tctttataaccaccaag

SEQ ID NO: 3843645 - DNA, 21 bp, Homo sapiens
tctttgtaaattattttatgt

SEQ ID NO: 3843646 - DNA, 20 bp, Homo sapiens
tctttttctgaagcctctaa

SEQ ID NO: 3843647 - DNA, 13 bp, Homo sapiens
tctttttttgcat

SEQ ID NO: 3843648 - DNA, 17 bp, Homo sapiens
tctttttttgcatatta

SEQ ID NO: 3843649 - DNA, 19 bp, Homo sapiens
tgaaaaatgcctgctgctg

SEQ ID NO: 3843650 - DNA, 22 bp, Homo sapiens
tgaaaaatgcctgctgctgcca

SEQ ID NO: 3843651 - DNA, 17 bp, Homo sapiens
tgaaaagggcagaggca

SEQ ID NO: 3843652 - DNA, 16 bp, Homo sapiens
tgaaagacaaaattta

SEQ ID NO: 3843653 - DNA, 18 bp, Homo sapiens
tgaaagtcttgtgactag

SEQ ID NO: 3843654 - DNA, 15 bp, Homo sapiens
tgaaatttcatgaaa

SEQ ID NO: 3843655 - DNA, 16 bp, Homo sapiens
tgaaatttcatgaaaa

SEQ ID NO: 3843656 - DNA, 13 bp, Homo sapiens
tgaacatcagaag

SEQ ID NO: 3843657 - DNA, 21 bp, Homo sapiens
tgaacatcagaaggtattttt

SEQ ID NO: 3843658 - DNA, 18 bp, Homo sapiens
tgaaccatatccatgttg

SEQ ID NO: 3843659 - DNA, 21 bp, Homo sapiens
tgaactaacataatcttaaac

SEQ ID NO: 3843660 - DNA, 24 bp, Homo sapiens
tgaactaattcatttattaagtat

SEQ ID NO: 3843661 - DNA, 18 bp, Homo sapiens
tgaactcctgacctcagg

SEQ ID NO: 3843662 - DNA, 14 bp, Homo sapiens
tgaactgctgccaa

SEQ ID NO: 3843663 - DNA, 14 bp, Homo sapiens
tgaagagggtagag

SEQ ID NO: 3843664 - DNA, 18 bp, Homo sapiens
tgaagagggtagagtggg

SEQ ID NO: 3843665 - DNA, 15 bp, Homo sapiens
tgaagcataaacatc

SEQ ID NO: 3843666 - DNA, 21 bp, Homo sapiens
tgaagccaagtggggtgctgg

SEQ ID NO: 3843667 - DNA, 14 bp, Homo sapiens
tgaagccacacagc

SEQ ID NO: 3843668 - DNA, 16 bp, Homo sapiens
tgaagccacacagccc

SEQ ID NO: 3843669 - DNA, 17 bp, Homo sapiens
tgaagccacacagccca

SEQ ID NO: 3843670 - DNA, 21 bp, Homo sapiens
tgaagccacacagcccagaag

SEQ ID NO: 3843671 - DNA, 12 bp, Homo sapiens
tgaagccagcct

SEQ ID NO: 3843672 - DNA, 16 bp, Homo sapiens
tgaagcctctaacaaa

SEQ ID NO: 3843673 - DNA, 19 bp, Homo sapiens
tgaagcctctaacaaatga

SEQ ID NO: 3843674 - DNA, 19 bp, Homo sapiens
tgaagcctggacgcagcca

SEQ ID NO: 3843675 - DNA, 20 bp, Homo sapiens
tgaagcctggacgcagccac

SEQ ID NO: 3843676 - DNA, 14 bp, Homo sapiens
tgaagctcagaaag

SEQ ID NO: 3843677 - DNA, 21 bp, Homo sapiens
tgaaggaaaaacacaagcaaa

SEQ ID NO: 3843678 - DNA, 21 bp, Homo sapiens
tgaaggagcgggggtgtggca

SEQ ID NO: 3843679 - DNA, 15 bp, Homo sapiens
tgaaggattttaaat

SEQ ID NO: 3843680 - DNA, 17 bp, Homo sapiens
tgaaggcgaggctgccc

SEQ ID NO: 3843681 - DNA, 17 bp, Homo sapiens
tgaagggtgctcagtct

SEQ ID NO: 3843682 - DNA, 23 bp, Homo sapiens
tgaagtgttatttcatccaggga

SEQ ID NO: 3843683 - DNA, 12 bp, Homo sapiens
tgaagtgtttta

SEQ ID NO: 3843684 - DNA, 14 bp, Homo sapiens
tgaagtgttttaca

SEQ ID NO: 3843685 - DNA, 22 bp, Homo sapiens
tgaatcattttacctttgacaa

SEQ ID NO: 3843686 - DNA, 19 bp, Homo sapiens
tgaatccaaatgtgaaaga

SEQ ID NO: 3843687 - DNA, 20 bp, Homo sapiens
tgaatgaaagtcttgtgact

SEQ ID NO: 3843688 - DNA, 16 bp, Homo sapiens
tgaattaagaaagatt

SEQ ID NO: 3843689 - DNA, 12 bp, Homo sapiens
tgaattttgtaa

SEQ ID NO: 3843690 - DNA, 13 bp, Homo sapiens
tgaattttgtaag

SEQ ID NO: 3843691 - DNA, 21 bp, Homo sapiens
tgaattttgtaagtataagaa

SEQ ID NO: 3843692 - DNA, 14 bp, Homo sapiens
tgacaagtgtcttt

SEQ ID NO: 3843693 - DNA, 20 bp, Homo sapiens
tgacagggcccagttaaata

SEQ ID NO: 3843694 - DNA, 21 bp, Homo sapiens
tgacagggcccagttaaatat

SEQ ID NO: 3843695 - DNA, 22 bp, Homo sapiens
tgacagggcccagttaaatatg

SEQ ID NO: 3843696 - DNA, 15 bp, Homo sapiens
tgacatcaagtgtaa

SEQ ID NO: 3843697 - DNA, 16 bp, Homo sapiens
tgacatcaagtgtaat

SEQ ID NO: 3843698 - DNA, 16 bp, Homo sapiens
tgacatggtgcctgag

SEQ ID NO: 3843699 - DNA, 18 bp, Homo sapiens
tgacatggtgcctgagag

SEQ ID NO: 3843700 - DNA, 13 bp, Homo sapiens
tgaccacaggcag

SEQ ID NO: 3843701 - DNA, 15 bp, Homo sapiens
tgacccctcctcact

SEQ ID NO: 3843702 - DNA, 20 bp, Homo sapiens
tgacccctcctcactggcca

SEQ ID NO: 3843703 - DNA, 17 bp, Homo sapiens
tgacccctgctttgccc

SEQ ID NO: 3843704 - DNA, 19 bp, Homo sapiens
tgacccctgctttgcccca

SEQ ID NO: 3843705 - DNA, 14 bp, Homo sapiens
tgaccgcttccccg

SEQ ID NO: 3843706 - DNA, 17 bp, Homo sapiens
tgaccgcttccccgatg

SEQ ID NO: 3843707 - DNA, 19 bp, Homo sapiens
tgacctatcagtatggtgc

SEQ ID NO: 3843708 - DNA, 19 bp, Homo sapiens
tgacctcaggcactagcct

SEQ ID NO: 3843709 - DNA, 21 bp, Homo sapiens
tgacgctggaccttttcttta

SEQ ID NO: 3843710 - DNA, 15 bp, Homo sapiens
tgactactacacact

SEQ ID NO: 3843711 - DNA, 18 bp, Homo sapiens
tgactagtgctgaagctt

SEQ ID NO: 3843712 - DNA, 21 bp, Homo sapiens
tgactagtgctgaagcttatt

SEQ ID NO: 3843713 - DNA, 16 bp, Homo sapiens
tgactcaagattccca

SEQ ID NO: 3843714 - DNA, 20 bp, Homo sapiens
tgactcaagattcccaggag

SEQ ID NO: 3843715 - DNA, 21 bp, Homo sapiens
tgactcaagattcccaggagt

SEQ ID NO: 3843716 - DNA, 23 bp, Homo sapiens
tgacttgggctccgctgtgcccg

SEQ ID NO: 3843717 - DNA, 14 bp, Homo sapiens
tgagaaatactata

SEQ ID NO: 3843718 - DNA, 14 bp, Homo sapiens
tgagaaggagagaa

SEQ ID NO: 3843719 - DNA, 21 bp, Homo sapiens
tgagagaggacctccatgccc

SEQ ID NO: 3843720 - DNA, 12 bp, Homo sapiens
tgagagctttat

SEQ ID NO: 3843721 - DNA, 15 bp, Homo sapiens
tgagatgagagtggg

SEQ ID NO: 3843722 - DNA, 13 bp, Homo sapiens
tgagatgctggag

SEQ ID NO: 3843723 - DNA, 19 bp, Homo sapiens
tgagatgctggagaagaga

SEQ ID NO: 3843724 - DNA, 20 bp, Homo sapiens
tgagatgctggagaagagag

SEQ ID NO: 3843725 - DNA, 22 bp, Homo sapiens
tgagattcacatgctggctcct

SEQ ID NO: 3843726 - DNA, 20 bp, Homo sapiens
tgagcagttcccaaggacag

SEQ ID NO: 3843727 - DNA, 23 bp, Homo sapiens
tgagccgcctcggagtgtggcct

SEQ ID NO: 3843728 - DNA, 15 bp, Homo sapiens
tgagccgggcccctg

SEQ ID NO: 3843729 - DNA, 18 bp, Homo sapiens
tgagcctggctcttgtgc

SEQ ID NO: 3843730 - DNA, 22 bp, Homo sapiens
tgagctctgcatttgtctattc

SEQ ID NO: 3843731 - DNA, 15 bp, Homo sapiens
tgagctgccttccct

SEQ ID NO: 3843732 - DNA, 16 bp, Homo sapiens
tgagctgccttcccta

SEQ ID NO: 3843733 - DNA, 19 bp, Homo sapiens
tgagctggcctcacctggg

SEQ ID NO: 3843734 - DNA, 12 bp, Homo sapiens
tgagctttaaaa

SEQ ID NO: 3843735 - DNA, 14 bp, Homo sapiens
tgaggaataaagct

SEQ ID NO: 3843736 - DNA, 15 bp, Homo sapiens
tgaggaataaagctt

SEQ ID NO: 3843737 - DNA, 17 bp, Homo sapiens
tgaggaataaagcttct

SEQ ID NO: 3843738 - DNA, 15 bp, Homo sapiens
tgaggaatttgaagc

SEQ ID NO: 3843739 - DNA, 19 bp, Homo sapiens
tgaggaccctcagccccag

SEQ ID NO: 3843740 - DNA, 19 bp, Homo sapiens
tgaggagggccctgaggaa

SEQ ID NO: 3843741 - DNA, 21 bp, Homo sapiens
tgaggagggccctgaggaata

SEQ ID NO: 3843742 - DNA, 17 bp, Homo sapiens
tgaggctcagccctgag

SEQ ID NO: 3843743 - DNA, 19 bp, Homo sapiens
tgaggctcagccctgagct

SEQ ID NO: 3843744 - DNA, 20 bp, Homo sapiens
tgaggctcagccctgagctg

SEQ ID NO: 3843745 - DNA, 21 bp, Homo sapiens
tgagggcaagaggtgcctggg

SEQ ID NO: 3843746 - DNA, 15 bp, Homo sapiens
tgagggctgatcttt

SEQ ID NO: 3843747 - DNA, 13 bp, Homo sapiens
tgaggtgggaggt

SEQ ID NO: 3843748 - DNA, 14 bp, Homo sapiens
tgaggttcctctgc

SEQ ID NO: 3843749 - DNA, 15 bp, Homo sapiens
tgaggttttggaaaa

SEQ ID NO: 3843750 - DNA, 17 bp, Homo sapiens
tgagtatcataatatat

SEQ ID NO: 3843751 - DNA, 19 bp, Homo sapiens
tgagtccattctcccaggt

SEQ ID NO: 3843752 - DNA, 22 bp, Homo sapiens
tgagtccattctcccaggtacc

SEQ ID NO: 3843753 - DNA, 17 bp, Homo sapiens
tgagtttgagctgcctt

SEQ ID NO: 3843754 - DNA, 15 bp, Homo sapiens
tgagttttcatttca

SEQ ID NO: 3843755 - DNA, 15 bp, Homo sapiens
tgagtttttaaatgc

SEQ ID NO: 3843756 - DNA, 16 bp, Homo sapiens
tgatagctaaataact

SEQ ID NO: 3843757 - DNA, 22 bp, Homo sapiens
tgatagctaaataacttgccat

SEQ ID NO: 3843758 - DNA, 13 bp, Homo sapiens
tgatccagaaaga

SEQ ID NO: 3843759 - DNA, 20 bp, Homo sapiens
tgatccgcccgcctctgcct

SEQ ID NO: 3843760 - DNA, 22 bp, Homo sapiens
tgatccgcccgcctctgcctcc

SEQ ID NO: 3843761 - DNA, 23 bp, Homo sapiens
tgatctcatcccaataaaatgat

SEQ ID NO: 3843762 - DNA, 14 bp, Homo sapiens
tgatctgctcagcc

SEQ ID NO: 3843763 - DNA, 15 bp, Homo sapiens
tgatctgctcagccc

SEQ ID NO: 3843764 - DNA, 16 bp, Homo sapiens
tgatctgctcagccct

SEQ ID NO: 3843765 - DNA, 17 bp, Homo sapiens
tgatctgctcagccctg

SEQ ID NO: 3843766 - DNA, 20 bp, Homo sapiens
tgatctgctcagccctggag

SEQ ID NO: 3843767 - DNA, 21 bp, Homo sapiens
tgatctgctcagccctggagg

SEQ ID NO: 3843768 - DNA, 23 bp, Homo sapiens
tgatggggtcagcaggcccagga

SEQ ID NO: 3843769 - DNA, 13 bp, Homo sapiens
tgatggttgtaca

SEQ ID NO: 3843770 - DNA, 16 bp, Homo sapiens
tgattaaggtcctgct

SEQ ID NO: 3843771 - DNA, 21 bp, Homo sapiens
tgattccactacacctggctg

SEQ ID NO: 3843772 - DNA, 22 bp, Homo sapiens
tgattccactacacctggctga

SEQ ID NO: 3843773 - DNA, 23 bp, Homo sapiens
tgattccaggaggagttagccaa

SEQ ID NO: 3843774 - DNA, 19 bp, Homo sapiens
tgattcccgcatggttttt

SEQ ID NO: 3843775 - DNA, 20 bp, Homo sapiens
tgattcctaaaactctgcca

SEQ ID NO: 3843776 - DNA, 19 bp, Homo sapiens
tgattcctaaggcccagct

SEQ ID NO: 3843777 - DNA, 18 bp, Homo sapiens
tgattgttcataatacat

SEQ ID NO: 3843778 - DNA, 15 bp, Homo sapiens
tgatttacagtttca

SEQ ID NO: 3843779 - DNA, 12 bp, Homo sapiens
tgatttagccat

SEQ ID NO: 3843780 - DNA, 13 bp, Homo sapiens
tgatttgcatttt

SEQ ID NO: 3843781 - DNA, 21 bp, Homo sapiens
tgcaaataaaggctctggaag

SEQ ID NO: 3843782 - DNA, 13 bp, Homo sapiens
tgcaacctctgcc

SEQ ID NO: 3843783 - DNA, 17 bp, Homo sapiens
tgcaagtggttaagaat

SEQ ID NO: 3843784 - DNA, 21 bp, Homo sapiens
tgcaatttgtttgtgcttcta

SEQ ID NO: 3843785 - DNA, 16 bp, Homo sapiens
tgcacagggccctctg

SEQ ID NO: 3843786 - DNA, 15 bp, Homo sapiens
tgcaccgttgggacc

SEQ ID NO: 3843787 - DNA, 12 bp, Homo sapiens
tgcactccccca

SEQ ID NO: 3843788 - DNA, 22 bp, Homo sapiens
tgcactcccccagttcccgggc

SEQ ID NO: 3843789 - DNA, 15 bp, Homo sapiens
tgcactgtatcattt

SEQ ID NO: 3843790 - DNA, 14 bp, Homo sapiens
tgcaggggctctgg

SEQ ID NO: 3843791 - DNA, 16 bp, Homo sapiens
tgcagtaatctccagg

SEQ ID NO: 3843792 - DNA, 18 bp, Homo sapiens
tgcagtaatctccagggc

SEQ ID NO: 3843793 - DNA, 15 bp, Homo sapiens
tgcagtcactggagg

SEQ ID NO: 3843794 - DNA, 11 bp, Homo sapiens
tgcataaataa

SEQ ID NO: 3843795 - DNA, 19 bp, Homo sapiens
tgcatatatctttcagatt

SEQ ID NO: 3843796 - DNA, 16 bp, Homo sapiens
tgcattaaaagactgt

SEQ ID NO: 3843797 - DNA, 22 bp, Homo sapiens
tgcattaataatccttccaggc

SEQ ID NO: 3843798 - DNA, 12 bp, Homo sapiens
tgcatttaatgt

SEQ ID NO: 3843799 - DNA, 23 bp, Homo sapiens
tgcatttcaatttcaatggtgtt

SEQ ID NO: 3843800 - DNA, 19 bp, Homo sapiens
tgcatttgtctattctcca

SEQ ID NO: 3843801 - DNA, 20 bp, Homo sapiens
tgcatttgtctattctccag

SEQ ID NO: 3843802 - DNA, 15 bp, Homo sapiens
tgcattttcacaaca

SEQ ID NO: 3843803 - DNA, 18 bp, Homo sapiens
tgcattttcacaacatat

SEQ ID NO: 3843804 - DNA, 16 bp, Homo sapiens
tgcattttttaaattt

SEQ ID NO: 3843805 - DNA, 14 bp, Homo sapiens
tgcatttttttcct

SEQ ID NO: 3843806 - DNA, 20 bp, Homo sapiens
tgccaactccatgtcaggga

SEQ ID NO: 3843807 - DNA, 20 bp, Homo sapiens
tgccaagccctttgctgttc

SEQ ID NO: 3843808 - DNA, 21 bp, Homo sapiens
tgccaagccctttgctgttcg

SEQ ID NO: 3843809 - DNA, 22 bp, Homo sapiens
tgccaagttagctattgggagc

SEQ ID NO: 3843810 - DNA, 15 bp, Homo sapiens
tgccagcaaagcccc

SEQ ID NO: 3843811 - DNA, 18 bp, Homo sapiens
tgccagccccgtgccagg

SEQ ID NO: 3843812 - DNA, 13 bp, Homo sapiens
tgccagctatttt

SEQ ID NO: 3843813 - DNA, 15 bp, Homo sapiens
tgccaggcaggggtg

SEQ ID NO: 3843814 - DNA, 18 bp, Homo sapiens
tgccaggcaggggtgggg

SEQ ID NO: 3843815 - DNA, 15 bp, Homo sapiens
tgccaggccagcctc

SEQ ID NO: 3843816 - DNA, 18 bp, Homo sapiens
tgccaggccagcctccga

SEQ ID NO: 3843817 - DNA, 20 bp, Homo sapiens
tgccagggaagacagagcag

SEQ ID NO: 3843818 - DNA, 12 bp, Homo sapiens
tgccatggctgg

SEQ ID NO: 3843819 - DNA, 14 bp, Homo sapiens
tgcccaccccctgc

SEQ ID NO: 3843820 - DNA, 19 bp, Homo sapiens
tgcccaccccctgccctgc

SEQ ID NO: 3843821 - DNA, 12 bp, Homo sapiens
tgcccacttctg

SEQ ID NO: 3843822 - DNA, 20 bp, Homo sapiens
tgcccacttctgtgtagaca

SEQ ID NO: 3843823 - DNA, 16 bp, Homo sapiens
tgcccagcctccaact

SEQ ID NO: 3843824 - DNA, 22 bp, Homo sapiens
tgccccactgggagagtcctta

SEQ ID NO: 3843825 - DNA, 15 bp, Homo sapiens
tgcccccacacccac

SEQ ID NO: 3843826 - DNA, 16 bp, Homo sapiens
tgcccccagccccggg

SEQ ID NO: 3843827 - DNA, 20 bp, Homo sapiens
tgcccccagccccggggtga

SEQ ID NO: 3843828 - DNA, 18 bp, Homo sapiens
tgcccccgcatcccctgc

SEQ ID NO: 3843829 - DNA, 20 bp, Homo sapiens
tgcccccgcatcccctgcct

SEQ ID NO: 3843830 - DNA, 22 bp, Homo sapiens
tgccccgcccccagtccccacc

SEQ ID NO: 3843831 - DNA, 14 bp, Homo sapiens
tgccccggccacct

SEQ ID NO: 3843832 - DNA, 17 bp, Homo sapiens
tgccccggccacctctg

SEQ ID NO: 3843833 - DNA, 18 bp, Homo sapiens
tgccccggccacctctgc

SEQ ID NO: 3843834 - DNA, 23 bp, Homo sapiens
tgccccggccacctctgcggacc

SEQ ID NO: 3843835 - DNA, 17 bp, Homo sapiens
tgcccctgccctgagga

SEQ ID NO: 3843836 - DNA, 20 bp, Homo sapiens
tgcccgaggtcgctgcagcc

SEQ ID NO: 3843837 - DNA, 13 bp, Homo sapiens
tgcccgccctccc

SEQ ID NO: 3843838 - DNA, 16 bp, Homo sapiens
tgcccgccctccctcc

SEQ ID NO: 3843839 - DNA, 14 bp, Homo sapiens
tgcccggcctccct

SEQ ID NO: 3843840 - DNA, 21 bp, Homo sapiens
tgccctcttctcacagtcaaa

SEQ ID NO: 3843841 - DNA, 16 bp, Homo sapiens
tgccctgaggagggcc

SEQ ID NO: 3843842 - DNA, 18 bp, Homo sapiens
tgccctgaggagggccct

SEQ ID NO: 3843843 - DNA, 15 bp, Homo sapiens
tgccctgccctcctg

SEQ ID NO: 3843844 - DNA, 18 bp, Homo sapiens
tgccctggctgctgcccc

SEQ ID NO: 3843845 - DNA, 14 bp, Homo sapiens
tgccctgggctgcc

SEQ ID NO: 3843846 - DNA, 15 bp, Homo sapiens
tgccctgggctgcct

SEQ ID NO: 3843847 - DNA, 16 bp, Homo sapiens
tgccctgggctgcctc

SEQ ID NO: 3843848 - DNA, 14 bp, Homo sapiens
tgccgccgccgtgg

SEQ ID NO: 3843849 - DNA, 17 bp, Homo sapiens
tgccgccgccgtggtga

SEQ ID NO: 3843850 - DNA, 16 bp, Homo sapiens
tgcctactgcccctgc

SEQ ID NO: 3843851 - DNA, 23 bp, Homo sapiens
tgcctactgcccctgccctgagg

SEQ ID NO: 3843852 - DNA, 20 bp, Homo sapiens
tgcctcagggccaagccggc

SEQ ID NO: 3843853 - DNA, 21 bp, Homo sapiens
tgcctcagggccaagccggcc

SEQ ID NO: 3843854 - DNA, 12 bp, Homo sapiens
tgcctcatgaac

SEQ ID NO: 3843855 - DNA, 12 bp, Homo sapiens
tgcctccatcct

SEQ ID NO: 3843856 - DNA, 16 bp, Homo sapiens
tgcctccatgtagaac

SEQ ID NO: 3843857 - DNA, 21 bp, Homo sapiens
tgcctccccatttcccatctg

SEQ ID NO: 3843858 - DNA, 23 bp, Homo sapiens
tgcctccccggaagtgccttaac

SEQ ID NO: 3843859 - DNA, 16 bp, Homo sapiens
tgcctccggcctgcac

SEQ ID NO: 3843860 - DNA, 14 bp, Homo sapiens
tgcctcctcctgag

SEQ ID NO: 3843861 - DNA, 12 bp, Homo sapiens
tgcctccttgaa

SEQ ID NO: 3843862 - DNA, 18 bp, Homo sapiens
tgcctccttgaaagaaag

SEQ ID NO: 3843863 - DNA, 17 bp, Homo sapiens
tgcctgagaggcaggca

SEQ ID NO: 3843864 - DNA, 11 bp, Homo sapiens
tgcctgagctt

SEQ ID NO: 3843865 - DNA, 11 bp, Homo sapiens
tgcctgctgct

SEQ ID NO: 3843866 - DNA, 20 bp, Homo sapiens
tgcctgctttttatggcctg

SEQ ID NO: 3843867 - DNA, 11 bp, Homo sapiens
tgcctgggagg

SEQ ID NO: 3843868 - DNA, 18 bp, Homo sapiens
tgccttaaaaccaaagag

SEQ ID NO: 3843869 - DNA, 22 bp, Homo sapiens
tgccttaaaaccaaagagggct

SEQ ID NO: 3843870 - DNA, 15 bp, Homo sapiens
tgccttaattaaaga

SEQ ID NO: 3843871 - DNA, 19 bp, Homo sapiens
tgccttaccgagagccaaa

SEQ ID NO: 3843872 - DNA, 21 bp, Homo sapiens
tgccttaccgagagccaaaca

SEQ ID NO: 3843873 - DNA, 17 bp, Homo sapiens
tgccttactattgtatt

SEQ ID NO: 3843874 - DNA, 19 bp, Homo sapiens
tgccttctagaatacatat

SEQ ID NO: 3843875 - DNA, 16 bp, Homo sapiens
tgcgatgggggatcag

SEQ ID NO: 3843876 - DNA, 18 bp, Homo sapiens
tgcgcagggccctctggg

SEQ ID NO: 3843877 - DNA, 21 bp, Homo sapiens
tgcgtctctggccctcgtggg

SEQ ID NO: 3843878 - DNA, 20 bp, Homo sapiens
tgcgttattttctttttcct

SEQ ID NO: 3843879 - DNA, 18 bp, Homo sapiens
tgctaatgtgtctgtgga

SEQ ID NO: 3843880 - DNA, 20 bp, Homo sapiens
tgctaatgtgtctgtggacc

SEQ ID NO: 3843881 - DNA, 22 bp, Homo sapiens
tgctaatgtgtctgtggaccct

SEQ ID NO: 3843882 - DNA, 14 bp, Homo sapiens
tgctactaacagat

SEQ ID NO: 3843883 - DNA, 16 bp, Homo sapiens
tgctactaacagatta

SEQ ID NO: 3843884 - DNA, 20 bp, Homo sapiens
tgctcactacctcctcaggg

SEQ ID NO: 3843885 - DNA, 11 bp, Homo sapiens
tgctcagccct

SEQ ID NO: 3843886 - DNA, 15 bp, Homo sapiens
tgctcagccctggag

SEQ ID NO: 3843887 - DNA, 21 bp, Homo sapiens
tgctcagccctggaggtgcca

SEQ ID NO: 3843888 - DNA, 23 bp, Homo sapiens
tgctcattctaatgatggcccat

SEQ ID NO: 3843889 - DNA, 22 bp, Homo sapiens
tgctcccaggagggctttgtgt

SEQ ID NO: 3843890 - DNA, 14 bp, Homo sapiens
tgctccctgaagcc

SEQ ID NO: 3843891 - DNA, 15 bp, Homo sapiens
tgctccctgaagcca

SEQ ID NO: 3843892 - DNA, 21 bp, Homo sapiens
tgctccctgaagccagccttc

SEQ ID NO: 3843893 - DNA, 16 bp, Homo sapiens
tgctctcagcttgtgc

SEQ ID NO: 3843894 - DNA, 18 bp, Homo sapiens
tgctgcaggggctctgga

SEQ ID NO: 3843895 - DNA, 16 bp, Homo sapiens
tgctgcatcccaccag

SEQ ID NO: 3843896 - DNA, 15 bp, Homo sapiens
tgctgcctgcttttt

SEQ ID NO: 3843897 - DNA, 19 bp, Homo sapiens
tgctgcgatgggggatcag

SEQ ID NO: 3843898 - DNA, 15 bp, Homo sapiens
tgctgctcctccctc

SEQ ID NO: 3843899 - DNA, 18 bp, Homo sapiens
tgctgctcctccctctga

SEQ ID NO: 3843900 - DNA, 16 bp, Homo sapiens
tgctggagaaatcttg

SEQ ID NO: 3843901 - DNA, 10 bp, Homo sapiens
tgctggagcc

SEQ ID NO: 3843902 - DNA, 11 bp, Homo sapiens
tgctggagcct

SEQ ID NO: 3843903 - DNA, 21 bp, Homo sapiens
tgctggagcctgtgtaacagc

SEQ ID NO: 3843904 - DNA, 18 bp, Homo sapiens
tgctggaggtgggagcag

SEQ ID NO: 3843905 - DNA, 20 bp, Homo sapiens
tgctggatggagcccaggcg

SEQ ID NO: 3843906 - DNA, 14 bp, Homo sapiens
tgctggccatggct

SEQ ID NO: 3843907 - DNA, 15 bp, Homo sapiens
tgctggtgtttatgt

SEQ ID NO: 3843908 - DNA, 13 bp, Homo sapiens
tgctggttttagt

SEQ ID NO: 3843909 - DNA, 13 bp, Homo sapiens
tgctgtaaatatt

SEQ ID NO: 3843910 - DNA, 19 bp, Homo sapiens
tgctgtaaatatttcataa

SEQ ID NO: 3843911 - DNA, 22 bp, Homo sapiens
tgctgtaaatatttcataaatt

SEQ ID NO: 3843912 - DNA, 17 bp, Homo sapiens
tgctgtatgtcattaaa

SEQ ID NO: 3843913 - DNA, 17 bp, Homo sapiens
tgcttaacagttgcttt

SEQ ID NO: 3843914 - DNA, 19 bp, Homo sapiens
tgcttccaggaaactccac

SEQ ID NO: 3843915 - DNA, 13 bp, Homo sapiens
tgcttgaagattc

SEQ ID NO: 3843916 - DNA, 18 bp, Homo sapiens
tgcttgcccccatgctgg

SEQ ID NO: 3843917 - DNA, 16 bp, Homo sapiens
tgctttaaaaactatt

SEQ ID NO: 3843918 - DNA, 14 bp, Homo sapiens
tgctttataaataa

SEQ ID NO: 3843919 - DNA, 14 bp, Homo sapiens
tgctttcctgcctc

SEQ ID NO: 3843920 - DNA, 18 bp, Homo sapiens
tgctttctattgtacaga

SEQ ID NO: 3843921 - DNA, 23 bp, Homo sapiens
tgctttggattctctaagatgaa

SEQ ID NO: 3843922 - DNA, 15 bp, Homo sapiens
tgcttttctgccctg

SEQ ID NO: 3843923 - DNA, 13 bp, Homo sapiens
tggaaaactaact

SEQ ID NO: 3843924 - DNA, 19 bp, Homo sapiens
tggaaaggggagagcctgc

SEQ ID NO: 3843925 - DNA, 21 bp, Homo sapiens
tggaaaggggagagcctgctg

SEQ ID NO: 3843926 - DNA, 20 bp, Homo sapiens
tggaaatcaatcagaaggta

SEQ ID NO: 3843927 - DNA, 24 bp, Homo sapiens
tggaaatcaatcagaaggtattct

SEQ ID NO: 3843928 - DNA, 16 bp, Homo sapiens
tggaaatggggagctg

SEQ ID NO: 3843929 - DNA, 20 bp, Homo sapiens
tggaaatggggagctggcct

SEQ ID NO: 3843930 - DNA, 14 bp, Homo sapiens
tggaacgctctagg

SEQ ID NO: 3843931 - DNA, 16 bp, Homo sapiens
tggaacgctctaggca

SEQ ID NO: 3843932 - DNA, 15 bp, Homo sapiens
tggaagaagggagaa

SEQ ID NO: 3843933 - DNA, 17 bp, Homo sapiens
tggaagaagggagaaga

SEQ ID NO: 3843934 - DNA, 22 bp, Homo sapiens
tggaatgggagaggcaataaat

SEQ ID NO: 3843935 - DNA, 19 bp, Homo sapiens
tggaccctcgctctctgtc

SEQ ID NO: 3843936 - DNA, 18 bp, Homo sapiens
tggaccttctctccagag

SEQ ID NO: 3843937 - DNA, 16 bp, Homo sapiens
tggaccttttctttac

SEQ ID NO: 3843938 - DNA, 14 bp, Homo sapiens
tggacgcagccaca

SEQ ID NO: 3843939 - DNA, 17 bp, Homo sapiens
tggacgcagccacacag

SEQ ID NO: 3843940 - DNA, 20 bp, Homo sapiens
tggacgcagccacacagtgg

SEQ ID NO: 3843941 - DNA, 22 bp, Homo sapiens
tggacggcaggctcactgccag

SEQ ID NO: 3843942 - DNA, 21 bp, Homo sapiens
tggactgcattgaaggcgagg

SEQ ID NO: 3843943 - DNA, 18 bp, Homo sapiens
tggacttagaaagcaggg

SEQ ID NO: 3843944 - DNA, 12 bp, Homo sapiens
tggagaagagag

SEQ ID NO: 3843945 - DNA, 20 bp, Homo sapiens
tggagacagccccagagcag

SEQ ID NO: 3843946 - DNA, 21 bp, Homo sapiens
tggagacagccccagagcagg

SEQ ID NO: 3843947 - DNA, 21 bp, Homo sapiens
tggagagaaacaataaagaga

SEQ ID NO: 3843948 - DNA, 17 bp, Homo sapiens
tggagagtgggttttgt

SEQ ID NO: 3843949 - DNA, 17 bp, Homo sapiens
tggagagttgggggcca

SEQ ID NO: 3843950 - DNA, 18 bp, Homo sapiens
tggagagttgggggccag

SEQ ID NO: 3843951 - DNA, 21 bp, Homo sapiens
tggagcagagcaagtctgcag

SEQ ID NO: 3843952 - DNA, 14 bp, Homo sapiens
tggagcctgtgtaa

SEQ ID NO: 3843953 - DNA, 18 bp, Homo sapiens
tggagcctgtgtaacagc

SEQ ID NO: 3843954 - DNA, 13 bp, Homo sapiens
tggaggaggaagg

SEQ ID NO: 3843955 - DNA, 16 bp, Homo sapiens
tggaggaggaaggcaa

SEQ ID NO: 3843956 - DNA, 21 bp, Homo sapiens
tggaggaggaaggcaagaggg

SEQ ID NO: 3843957 - DNA, 13 bp, Homo sapiens
tggaggcttcctg

SEQ ID NO: 3843958 - DNA, 15 bp, Homo sapiens
tggaggcttcctgcg

SEQ ID NO: 3843959 - DNA, 17 bp, Homo sapiens
tggaggcttcctgcgtc

SEQ ID NO: 3843960 - DNA, 20 bp, Homo sapiens
tggaggcttcctgcgtcctc

SEQ ID NO: 3843961 - DNA, 19 bp, Homo sapiens
tggagggaggggatttaat

SEQ ID NO: 3843962 - DNA, 20 bp, Homo sapiens
tggagggcaaggggtttcca

SEQ ID NO: 3843963 - DNA, 18 bp, Homo sapiens
tggaggggagctgctggc

SEQ ID NO: 3843964 - DNA, 22 bp, Homo sapiens
tggagggggaggggagaagcca

SEQ ID NO: 3843965 - DNA, 17 bp, Homo sapiens
tggaggggtgtggcagt

SEQ ID NO: 3843966 - DNA, 17 bp, Homo sapiens
tggaggtgccagcaaag

SEQ ID NO: 3843967 - DNA, 17 bp, Homo sapiens
tggaggttgaagccaag

SEQ ID NO: 3843968 - DNA, 18 bp, Homo sapiens
tggaggttgaagccaagt

SEQ ID NO: 3843969 - DNA, 12 bp, Homo sapiens
tggatataaata

SEQ ID NO: 3843970 - DNA, 13 bp, Homo sapiens
tggatataaatat

SEQ ID NO: 3843971 - DNA, 14 bp, Homo sapiens
tggatataaatata

SEQ ID NO: 3843972 - DNA, 17 bp, Homo sapiens
tggatcaagcagaaaac

SEQ ID NO: 3843973 - DNA, 23 bp, Homo sapiens
tggatcaagcagaaaacaagaga

SEQ ID NO: 3843974 - DNA, 18 bp, Homo sapiens
tggatcatgtccccctta

SEQ ID NO: 3843975 - DNA, 14 bp, Homo sapiens
tggatccatcctgc

SEQ ID NO: 3843976 - DNA, 18 bp, Homo sapiens
tggatctttggggtaaaa

SEQ ID NO: 3843977 - DNA, 14 bp, Homo sapiens
tcccctcacagcct

SEQ ID NO: 3843978 - DNA, 18 bp, Homo sapiens
tcccctcacagcctctga

SEQ ID NO: 3843979 - DNA, 19 bp, Homo sapiens
tcccctcacagcctctgac

SEQ ID NO: 3843980 - DNA, 21 bp, Homo sapiens
tcccctcacagcctctgaccc

SEQ ID NO: 3843981 - DNA, 15 bp, Homo sapiens
tcccctcccctgctg

SEQ ID NO: 3843982 - DNA, 13 bp, Homo sapiens
tcccctgcctcca

SEQ ID NO: 3843983 - DNA, 19 bp, Homo sapiens
tcccgcagagactggggcc

SEQ ID NO: 3843984 - DNA, 15 bp, Homo sapiens
tcccgtactgtctgt

SEQ ID NO: 3843985 - DNA, 18 bp, Homo sapiens
tccctaggcacctctgtg

SEQ ID NO: 3843986 - DNA, 20 bp, Homo sapiens
tccctaggcacctctgtgct

SEQ ID NO: 3843987 - DNA, 13 bp, Homo sapiens
tccctcccacctc

SEQ ID NO: 3843988 - DNA, 20 bp, Homo sapiens
tccctccccagatctgtcct

SEQ ID NO: 3843989 - DNA, 13 bp, Homo sapiens
tccctccccagct

SEQ ID NO: 3843990 - DNA, 16 bp, Homo sapiens
tccctccccagctcct

SEQ ID NO: 3843991 - DNA, 17 bp, Homo sapiens
tccctccccagctcctc

SEQ ID NO: 3843992 - DNA, 16 bp, Homo sapiens
tccctctcaaccttgt

SEQ ID NO: 3843993 - DNA, 13 bp, Homo sapiens
tccctctggagtt

SEQ ID NO: 3843994 - DNA, 15 bp, Homo sapiens
tccctgaagccagcc

SEQ ID NO: 3843995 - DNA, 17 bp, Homo sapiens
tccctgccctcatctct

SEQ ID NO: 3843996 - DNA, 12 bp, Homo sapiens
tccctgcttcca

SEQ ID NO: 3843997 - DNA, 19 bp, Homo sapiens
tcccttgccctgggctgcc

SEQ ID NO: 3843998 - DNA, 21 bp, Homo sapiens
tcccttgccctgggctgcctc

SEQ ID NO: 3843999 - DNA, 14 bp, Homo sapiens
tccctttggggata

SEQ ID NO: 3844000 - DNA, 18 bp, Homo sapiens
tccgccagcctcctctgg

SEQ ID NO: 3844001 - DNA, 16 bp, Homo sapiens
tcctaaaactctgcca

SEQ ID NO: 3844002 - DNA, 19 bp, Homo sapiens
tcctaaggcccagctgcca

SEQ ID NO: 3844003 - DNA, 21 bp, Homo sapiens
tcctaaggcccagctgccagg

SEQ ID NO: 3844004 - DNA, 21 bp, Homo sapiens
tcctacagttggaaatccatc

SEQ ID NO: 3844005 - DNA, 14 bp, Homo sapiens
tcctactaagaagt

SEQ ID NO: 3844006 - DNA, 20 bp, Homo sapiens
tcctagctggagtgccatgg

SEQ ID NO: 3844007 - DNA, 17 bp, Homo sapiens
tcctatacatttctgtt

SEQ ID NO: 3844008 - DNA, 15 bp, Homo sapiens
tcctcacccctgtcc

SEQ ID NO: 3844009 - DNA, 15 bp, Homo sapiens
tcctcacctcatgcc

SEQ ID NO: 3844010 - DNA, 13 bp, Homo sapiens
tcctcactgctcc

SEQ ID NO: 3844011 - DNA, 18 bp, Homo sapiens
tcctcactggccatccct

SEQ ID NO: 3844012 - DNA, 23 bp, Homo sapiens
tcctcagaatagtgatgtgttcg

SEQ ID NO: 3844013 - DNA, 15 bp, Homo sapiens
tcctcccacccctcc

SEQ ID NO: 3844014 - DNA, 19 bp, Homo sapiens
tcctcccacggggtccccg

SEQ ID NO: 3844015 - DNA, 19 bp, Homo sapiens
tcctcccctcacagcctct

SEQ ID NO: 3844016 - DNA, 16 bp, Homo sapiens
tcctccctctgaccca

SEQ ID NO: 3844017 - DNA, 15 bp, Homo sapiens
tcctccggggctcag

SEQ ID NO: 3844018 - DNA, 18 bp, Homo sapiens
tcctccgtgcttcctcag

SEQ ID NO: 3844019 - DNA, 19 bp, Homo sapiens
tcctccgtgcttcctcagt

SEQ ID NO: 3844020 - DNA, 12 bp, Homo sapiens
tcctcctagctg

SEQ ID NO: 3844021 - DNA, 17 bp, Homo sapiens
tcctcctagctggagtg

SEQ ID NO: 3844022 - DNA, 14 bp, Homo sapiens
tcctcggcctggct

SEQ ID NO: 3844023 - DNA, 14 bp, Homo sapiens
tcctctagaagcca

SEQ ID NO: 3844024 - DNA, 18 bp, Homo sapiens
tcctctagaagccaaggg

SEQ ID NO: 3844025 - DNA, 14 bp, Homo sapiens
tcctctgcctgccc

SEQ ID NO: 3844026 - DNA, 22 bp, Homo sapiens
tcctctgcctgccccgccccca

SEQ ID NO: 3844027 - DNA, 18 bp, Homo sapiens
tcctctggacggcaggct

SEQ ID NO: 3844028 - DNA, 20 bp, Homo sapiens
tcctctggacggcaggctca

SEQ ID NO: 3844029 - DNA, 24 bp, Homo sapiens
tcctctggacggcaggctcactgc

SEQ ID NO: 3844030 - DNA, 17 bp, Homo sapiens
tcctctgtccccatagc

SEQ ID NO: 3844031 - DNA, 17 bp, Homo sapiens
tcctgagggtcctgctg

SEQ ID NO: 3844032 - DNA, 13 bp, Homo sapiens
tcctgataattgt

SEQ ID NO: 3844033 - DNA, 18 bp, Homo sapiens
tcctgcccgccctccctc

SEQ ID NO: 3844034 - DNA, 14 bp, Homo sapiens
tcctgcctgccccc

SEQ ID NO: 3844035 - DNA, 18 bp, Homo sapiens
tcctgccttagagccagg

SEQ ID NO: 3844036 - DNA, 23 bp, Homo sapiens
tcctgctagcacctccccagaca

SEQ ID NO: 3844037 - DNA, 16 bp, Homo sapiens
tcctgctgcatgacct

SEQ ID NO: 3844038 - DNA, 17 bp, Homo sapiens
tcctggctaggactgtg

SEQ ID NO: 3844039 - DNA, 18 bp, Homo sapiens
tcctgggcaccccaggca

SEQ ID NO: 3844040 - DNA, 16 bp, Homo sapiens
tcctggggatggccag

SEQ ID NO: 3844041 - DNA, 17 bp, Homo sapiens
tcctggggatggccagg

SEQ ID NO: 3844042 - DNA, 16 bp, Homo sapiens
tcctgggggatgcaaa

SEQ ID NO: 3844043 - DNA, 19 bp, Homo sapiens
tcctgggggatgcaaataa

SEQ ID NO: 3844044 - DNA, 20 bp, Homo sapiens
tcctgggggatgcaaataaa

SEQ ID NO: 3844045 - DNA, 16 bp, Homo sapiens
tcctggtggggcagaa

SEQ ID NO: 3844046 - DNA, 14 bp, Homo sapiens
tccttagcctgggc

SEQ ID NO: 3844047 - DNA, 16 bp, Homo sapiens
tccttagcctgggcct

SEQ ID NO: 3844048 - DNA, 23 bp, Homo sapiens
tccttcaccaaagatctgctcct

SEQ ID NO: 3844049 - DNA, 22 bp, Homo sapiens
tccttccctaggcacctctgtg

SEQ ID NO: 3844050 - DNA, 18 bp, Homo sapiens
tccttctctagtttcccc

SEQ ID NO: 3844051 - DNA, 17 bp, Homo sapiens
tccttcttgccttcaga

SEQ ID NO: 3844052 - DNA, 14 bp, Homo sapiens
tccttgggaggaag

SEQ ID NO: 3844053 - DNA, 16 bp, Homo sapiens
tcctttccccagccca

SEQ ID NO: 3844054 - DNA, 14 bp, Homo sapiens
tcctttgctagtgt

SEQ ID NO: 3844055 - DNA, 14 bp, Homo sapiens
tccttttccctgct

SEQ ID NO: 3844056 - DNA, 18 bp, Homo sapiens
tcgaatactttgaatgtt

SEQ ID NO: 3844057 - DNA, 19 bp, Homo sapiens
tcgagttaaaacaatgaag

SEQ ID NO: 3844058 - DNA, 23 bp, Homo sapiens
tcgcacctgcctccggcctgcac

SEQ ID NO: 3844059 - DNA, 21 bp, Homo sapiens
tcgcaggggcgctggctgcac

SEQ ID NO: 3844060 - DNA, 16 bp, Homo sapiens
tcgccaaactgtctct

SEQ ID NO: 3844061 - DNA, 20 bp, Homo sapiens
tcgccagctgatgactcaag

SEQ ID NO: 3844062 - DNA, 22 bp, Homo sapiens
tcgctctctgtctccaggcagt

SEQ ID NO: 3844063 - DNA, 13 bp, Homo sapiens
tcgctgcagcccc

SEQ ID NO: 3844064 - DNA, 16 bp, Homo sapiens
tcgcttttggtgcctg

SEQ ID NO: 3844065 - DNA, 14 bp, Homo sapiens
tcggagtgtggcct

SEQ ID NO: 3844066 - DNA, 16 bp, Homo sapiens
tcggagtgtggcctgg

SEQ ID NO: 3844067 - DNA, 19 bp, Homo sapiens
tcggagtgtggcctggatc

SEQ ID NO: 3844068 - DNA, 14 bp, Homo sapiens
tcggccacacccca

SEQ ID NO: 3844069 - DNA, 16 bp, Homo sapiens
tcgtaaactgacacag

SEQ ID NO: 3844070 - DNA, 10 bp, Homo sapiens
tcgtctttgc

SEQ ID NO: 3844071 - DNA, 14 bp, Homo sapiens
tcgtgttgtgttct

SEQ ID NO: 3844072 - DNA, 22 bp, Homo sapiens
tcgtgttgtgttctttataacc

SEQ ID NO: 3844073 - DNA, 18 bp, Homo sapiens
tcgttaggacaaggctgt

SEQ ID NO: 3844074 - DNA, 14 bp, Homo sapiens
tctaaagtgggaaa

SEQ ID NO: 3844075 - DNA, 18 bp, Homo sapiens
tctaacaaatgatctagt

SEQ ID NO: 3844076 - DNA, 21 bp, Homo sapiens
tctaagatgaatccaaatgtg

SEQ ID NO: 3844077 - DNA, 14 bp, Homo sapiens
tctaagtctgttat

SEQ ID NO: 3844078 - DNA, 18 bp, Homo sapiens
tctaagtctgttattgtt

SEQ ID NO: 3844079 - DNA, 19 bp, Homo sapiens
tctaagtctgttattgttt

SEQ ID NO: 3844080 - DNA, 19 bp, Homo sapiens
tctacagctccagatgttt

SEQ ID NO: 3844081 - DNA, 21 bp, Homo sapiens
tctacagctccagatgtttct

SEQ ID NO: 3844082 - DNA, 22 bp, Homo sapiens
tctacagtggttttatactgaa

SEQ ID NO: 3844083 - DNA, 15 bp, Homo sapiens
tctaccttccagtca

SEQ ID NO: 3844084 - DNA, 21 bp, Homo sapiens
tctaccttccagtcaggatga

SEQ ID NO: 3844085 - DNA, 15 bp, Homo sapiens
tctacttgctctgga

SEQ ID NO: 3844086 - DNA, 17 bp, Homo sapiens
tctacttgctctggacc

SEQ ID NO: 3844087 - DNA, 21 bp, Homo sapiens
tctagaagccaagggaaaggg

SEQ ID NO: 3844088 - DNA, 18 bp, Homo sapiens
tctagaagtgccatctca

SEQ ID NO: 3844089 - DNA, 22 bp, Homo sapiens
tctaggcagaagaagctgggag

SEQ ID NO: 3844090 - DNA, 16 bp, Homo sapiens
tctagttcagaaggaa

SEQ ID NO: 3844091 - DNA, 14 bp, Homo sapiens
tctataacaaatgc

SEQ ID NO: 3844092 - DNA, 19 bp, Homo sapiens
tctataagtatataaatac

SEQ ID NO: 3844093 - DNA, 16 bp, Homo sapiens
tctattctccagctga

SEQ ID NO: 3844094 - DNA, 13 bp, Homo sapiens
tctattgtacaga

SEQ ID NO: 3844095 - DNA, 12 bp, Homo sapiens
tctatttgctat

SEQ ID NO: 3844096 - DNA, 16 bp, Homo sapiens
tctattttcattttct

SEQ ID NO: 3844097 - DNA, 22 bp, Homo sapiens
tctcaatcctaatttctcctcc

SEQ ID NO: 3844098 - DNA, 23 bp, Homo sapiens
tctcaatcctaatttctcctccc

SEQ ID NO: 3844099 - DNA, 22 bp, Homo sapiens
tctcagcatgtagggcttctgt

SEQ ID NO: 3844100 - DNA, 15 bp, Homo sapiens
tctcagcttgtgcct

SEQ ID NO: 3844101 - DNA, 18 bp, Homo sapiens
tctcaggctggtgggagg

SEQ ID NO: 3844102 - DNA, 15 bp, Homo sapiens
tctcatgctatttct

SEQ ID NO: 3844103 - DNA, 16 bp, Homo sapiens
tctcatgctatttcta

SEQ ID NO: 3844104 - DNA, 19 bp, Homo sapiens
tctcattacccttttctgg

SEQ ID NO: 3844105 - DNA, 15 bp, Homo sapiens
tctcattttaaacaa

SEQ ID NO: 3844106 - DNA, 17 bp, Homo sapiens
tctcattttaaacaact

SEQ ID NO: 3844107 - DNA, 12 bp, Homo sapiens
tctcccaggggc

SEQ ID NO: 3844108 - DNA, 18 bp, Homo sapiens
tctcccaggtaccagctg

SEQ ID NO: 3844109 - DNA, 19 bp, Homo sapiens
tctcccaggtaccagctgc

SEQ ID NO: 3844110 - DNA, 23 bp, Homo sapiens
tctcccatggctttgtgctgctg

SEQ ID NO: 3844111 - DNA, 18 bp, Homo sapiens
tctccgccagcctcctct

SEQ ID NO: 3844112 - DNA, 21 bp, Homo sapiens
tctccgccagcctcctctgga

SEQ ID NO: 3844113 - DNA, 12 bp, Homo sapiens
tctcctctgtcc

SEQ ID NO: 3844114 - DNA, 18 bp, Homo sapiens
tcactacctcctcaggga

SEQ ID NO: 3844115 - DNA, 19 bp, Homo sapiens
tcactacctcctcagggat

SEQ ID NO: 3844116 - DNA, 11 bp, Homo sapiens
tcactcagctg

SEQ ID NO: 3844117 - DNA, 13 bp, Homo sapiens
tcactccataaaa

SEQ ID NO: 3844118 - DNA, 14 bp, Homo sapiens
tcactgactcaggc

SEQ ID NO: 3844119 - DNA, 16 bp, Homo sapiens
tcactgccaggccagc

SEQ ID NO: 3844120 - DNA, 23 bp, Homo sapiens
tcactgccaggccagcctccgag

SEQ ID NO: 3844121 - DNA, 14 bp, Homo sapiens
tcactgctccctga

SEQ ID NO: 3844122 - DNA, 23 bp, Homo sapiens
tcactgctccctgaagccagcct

SEQ ID NO: 3844123 - DNA, 15 bp, Homo sapiens
tcactggaaagggga

SEQ ID NO: 3844124 - DNA, 12 bp, Homo sapiens
tcacttctccca

SEQ ID NO: 3844125 - DNA, 12 bp, Homo sapiens
tcagaaggaagc

SEQ ID NO: 3844126 - DNA, 21 bp, Homo sapiens
tcagacctttgtctgaaggat

SEQ ID NO: 3844127 - DNA, 17 bp, Homo sapiens
tcagacttcaccaaata

SEQ ID NO: 3844128 - DNA, 22 bp, Homo sapiens
tcagagtaatccaagcaaatgt

SEQ ID NO: 3844129 - DNA, 13 bp, Homo sapiens
tcagcaggcccag

SEQ ID NO: 3844130 - DNA, 15 bp, Homo sapiens
tcagcaggcccagga

SEQ ID NO: 3844131 - DNA, 18 bp, Homo sapiens
tcagccatcgccaacttg

SEQ ID NO: 3844132 - DNA, 12 bp, Homo sapiens
tcagccccagga

SEQ ID NO: 3844133 - DNA, 16 bp, Homo sapiens
tcagccccaggagaag

SEQ ID NO: 3844134 - DNA, 19 bp, Homo sapiens
tcagccccaggagaaggga

SEQ ID NO: 3844135 - DNA, 12 bp, Homo sapiens
tcagctcatgga

SEQ ID NO: 3844136 - DNA, 14 bp, Homo sapiens
tcagcttgtgcctt

SEQ ID NO: 3844137 - DNA, 15 bp, Homo sapiens
tcagcttgtgccttg

SEQ ID NO: 3844138 - DNA, 19 bp, Homo sapiens
tcagctttaagatatcttt

SEQ ID NO: 3844139 - DNA, 17 bp, Homo sapiens
tcaggcaaggtctggcc

SEQ ID NO: 3844140 - DNA, 21 bp, Homo sapiens
tcaggcactagcctttggctc

SEQ ID NO: 3844141 - DNA, 17 bp, Homo sapiens
tcaggtactgagttctt

SEQ ID NO: 3844142 - DNA, 21 bp, Homo sapiens
tcaggtctttactgaatgtta

SEQ ID NO: 3844143 - DNA, 20 bp, Homo sapiens
tcagtatggtgctaatgtgt

SEQ ID NO: 3844144 - DNA, 23 bp, Homo sapiens
tcagtcctcccctcacagcctct

SEQ ID NO: 3844145 - DNA, 16 bp, Homo sapiens
tcagtgctggagaaat

SEQ ID NO: 3844146 - DNA, 22 bp, Homo sapiens
tcagtgctggagaaatcttgaa

SEQ ID NO: 3844147 - DNA, 13 bp, Homo sapiens
tcagttttactgc

SEQ ID NO: 3844148 - DNA, 19 bp, Homo sapiens
tcataaattaacaaagtgt

SEQ ID NO: 3844149 - DNA, 14 bp, Homo sapiens
tcataatacataaa

SEQ ID NO: 3844150 - DNA, 21 bp, Homo sapiens
tcataatatattgtgttttaa

SEQ ID NO: 3844151 - DNA, 23 bp, Homo sapiens
tcataatgtaactgaagcataaa

SEQ ID NO: 3844152 - DNA, 18 bp, Homo sapiens
tcatccttagaaatcagt

SEQ ID NO: 3844153 - DNA, 18 bp, Homo sapiens
tcatctgccaaaatgtag

SEQ ID NO: 3844154 - DNA, 14 bp, Homo sapiens
tcatgacagatgaa

SEQ ID NO: 3844155 - DNA, 20 bp, Homo sapiens
tcatgccattttatttcttt

SEQ ID NO: 3844156 - DNA, 18 bp, Homo sapiens
tcatgcccaccccctgcc

SEQ ID NO: 3844157 - DNA, 21 bp, Homo sapiens
tcatgcccaccccctgccctg

SEQ ID NO: 3844158 - DNA, 14 bp, Homo sapiens
tcatgctatttcta

SEQ ID NO: 3844159 - DNA, 24 bp, Homo sapiens
tcatggacttctgccagcataata

SEQ ID NO: 3844160 - DNA, 14 bp, Homo sapiens
tcatggctttttct

SEQ ID NO: 3844161 - DNA, 19 bp, Homo sapiens
tcatgtctgaaaaatgcct

SEQ ID NO: 3844162 - DNA, 15 bp, Homo sapiens
tcatgttatgcctgt

SEQ ID NO: 3844163 - DNA, 14 bp, Homo sapiens
tcattgcccacttc

SEQ ID NO: 3844164 - DNA, 15 bp, Homo sapiens
tcattgcccacttct

SEQ ID NO: 3844165 - DNA, 18 bp, Homo sapiens
tcattgcccacttctgtg

SEQ ID NO: 3844166 - DNA, 20 bp, Homo sapiens
tcattgcccacttctgtgta

SEQ ID NO: 3844167 - DNA, 12 bp, Homo sapiens
tcattgttctgt

SEQ ID NO: 3844168 - DNA, 18 bp, Homo sapiens
tcatttattaagtatatt

SEQ ID NO: 3844169 - DNA, 12 bp, Homo sapiens
tcatttcatata

SEQ ID NO: 3844170 - DNA, 14 bp, Homo sapiens
tcatttcatatatc

SEQ ID NO: 3844171 - DNA, 13 bp, Homo sapiens
tcatttcatgctt

SEQ ID NO: 3844172 - DNA, 18 bp, Homo sapiens
tcatttggggcatttgta

SEQ ID NO: 3844173 - DNA, 20 bp, Homo sapiens
tcatttggggcatttgtaaa

SEQ ID NO: 3844174 - DNA, 21 bp, Homo sapiens
tcatttggggcatttgtaaaa

SEQ ID NO: 3844175 - DNA, 18 bp, Homo sapiens
tcattttctgcaagcctg

SEQ ID NO: 3844176 - DNA, 16 bp, Homo sapiens
tcattttgtttttgtt

SEQ ID NO: 3844177 - DNA, 22 bp, Homo sapiens
tccaaataattccacagtcctg

SEQ ID NO: 3844178 - DNA, 14 bp, Homo sapiens
tccaaattccctct

SEQ ID NO: 3844179 - DNA, 15 bp, Homo sapiens
tccaaattccctctg

SEQ ID NO: 3844180 - DNA, 17 bp, Homo sapiens
tccaaattccctctgga

SEQ ID NO: 3844181 - DNA, 20 bp, Homo sapiens
tccaactccagctgagtcct

SEQ ID NO: 3844182 - DNA, 13 bp, Homo sapiens
tccaagcaaatgt

SEQ ID NO: 3844183 - DNA, 19 bp, Homo sapiens
tccacaaaattatgctgca

SEQ ID NO: 3844184 - DNA, 19 bp, Homo sapiens
tccacagtcctgaagcagc

SEQ ID NO: 3844185 - DNA, 13 bp, Homo sapiens
tccacatctgcct

SEQ ID NO: 3844186 - DNA, 14 bp, Homo sapiens
tccacatctgcctt

SEQ ID NO: 3844187 - DNA, 18 bp, Homo sapiens
tccacatctgccttaaaa

SEQ ID NO: 3844188 - DNA, 13 bp, Homo sapiens
tccacatggcaga

SEQ ID NO: 3844189 - DNA, 20 bp, Homo sapiens
tccacatggcagatgatttg

SEQ ID NO: 3844190 - DNA, 13 bp, Homo sapiens
tccacctccatct

SEQ ID NO: 3844191 - DNA, 16 bp, Homo sapiens
tccactacacctggct

SEQ ID NO: 3844192 - DNA, 15 bp, Homo sapiens
tccagatgtttctca

SEQ ID NO: 3844193 - DNA, 22 bp, Homo sapiens
tccagcacgcgacttctcagga

SEQ ID NO: 3844194 - DNA, 17 bp, Homo sapiens
tccagccaccccgcagt

SEQ ID NO: 3844195 - DNA, 21 bp, Homo sapiens
tccagccaccccgcagtcact

SEQ ID NO: 3844196 - DNA, 17 bp, Homo sapiens
tccagcctgtcggccac

SEQ ID NO: 3844197 - DNA, 21 bp, Homo sapiens
tccagcctgtcggccacaccc

SEQ ID NO: 3844198 - DNA, 22 bp, Homo sapiens
tccagcctgtcggccacacccc

SEQ ID NO: 3844199 - DNA, 23 bp, Homo sapiens
tccagcctgtcggccacacccca

SEQ ID NO: 3844200 - DNA, 13 bp, Homo sapiens
tccagctgagtcc

SEQ ID NO: 3844201 - DNA, 17 bp, Homo sapiens
tccagctgagtcctggg

SEQ ID NO: 3844202 - DNA, 21 bp, Homo sapiens
tccagctgggctagaggctga

SEQ ID NO: 3844203 - DNA, 20 bp, Homo sapiens
tccaggaggagttagccaaa

SEQ ID NO: 3844204 - DNA, 16 bp, Homo sapiens
tccagtctgctctcag

SEQ ID NO: 3844205 - DNA, 18 bp, Homo sapiens
tccagtctgctctcagct

SEQ ID NO: 3844206 - DNA, 21 bp, Homo sapiens
tccatcccaggacaccacacc

SEQ ID NO: 3844207 - DNA, 15 bp, Homo sapiens
tccatcccttcccca

SEQ ID NO: 3844208 - DNA, 19 bp, Homo sapiens
tccatcctgctagcacctc

SEQ ID NO: 3844209 - DNA, 21 bp, Homo sapiens
tccatgcccccgccacctccc

SEQ ID NO: 3844210 - DNA, 12 bp, Homo sapiens
tccatggtgcta

SEQ ID NO: 3844211 - DNA, 16 bp, Homo sapiens
tccattctcccaggta

SEQ ID NO: 3844212 - DNA, 19 bp, Homo sapiens
tccattgcgttattttctt

SEQ ID NO: 3844213 - DNA, 20 bp, Homo sapiens
tccattgcgttattttcttt

SEQ ID NO: 3844214 - DNA, 20 bp, Homo sapiens
tccattttttaaatgttcat

SEQ ID NO: 3844215 - DNA, 14 bp, Homo sapiens
tcccaaagggaggg

SEQ ID NO: 3844216 - DNA, 17 bp, Homo sapiens
tcccaccaatcctcacc

SEQ ID NO: 3844217 - DNA, 16 bp, Homo sapiens
tcccaccagcctgagc

SEQ ID NO: 3844218 - DNA, 18 bp, Homo sapiens
tcccacccaacttcccct

SEQ ID NO: 3844219 - DNA, 17 bp, Homo sapiens
tcccaccctgctgctgc

SEQ ID NO: 3844220 - DNA, 14 bp, Homo sapiens
tcccagcctggcct

SEQ ID NO: 3844221 - DNA, 16 bp, Homo sapiens
tcccagctactcggga

SEQ ID NO: 3844222 - DNA, 15 bp, Homo sapiens
tcccaggacaccaca

SEQ ID NO: 3844223 - DNA, 21 bp, Homo sapiens
tcccaggacaccacacccagc

SEQ ID NO: 3844224 - DNA, 22 bp, Homo sapiens
tcccaggacaccacacccagcc

SEQ ID NO: 3844225 - DNA, 23 bp, Homo sapiens
tcccaggacaccacacccagcct

SEQ ID NO: 3844226 - DNA, 17 bp, Homo sapiens
tcccaggacctgagcct

SEQ ID NO: 3844227 - DNA, 18 bp, Homo sapiens
tcccaggggctggcttca

SEQ ID NO: 3844228 - DNA, 17 bp, Homo sapiens
tcccaggtaccagctgc

SEQ ID NO: 3844229 - DNA, 22 bp, Homo sapiens
tcccaggtgaggaatttgaagc

SEQ ID NO: 3844230 - DNA, 16 bp, Homo sapiens
tcccatggctttgtgc

SEQ ID NO: 3844231 - DNA, 20 bp, Homo sapiens
tcccatggctttgtgctgct

SEQ ID NO: 3844232 - DNA, 20 bp, Homo sapiens
tcccatgtgggatgagtttt

SEQ ID NO: 3844233 - DNA, 16 bp, Homo sapiens
tcccattcaccctgtg

SEQ ID NO: 3844234 - DNA, 18 bp, Homo sapiens
tccccaaatcaatacact

SEQ ID NO: 3844235 - DNA, 15 bp, Homo sapiens
tccccacccctgccc

SEQ ID NO: 3844236 - DNA, 22 bp, Homo sapiens
tccccacccctgcccccagccc

SEQ ID NO: 3844237 - DNA, 18 bp, Homo sapiens
tccccaccgccctgcctc

SEQ ID NO: 3844238 - DNA, 19 bp, Homo sapiens
tccccacgccctcccctcc

SEQ ID NO: 3844239 - DNA, 15 bp, Homo sapiens
tccccactccagcag

SEQ ID NO: 3844240 - DNA, 16 bp, Homo sapiens
tccccactccagcaga

SEQ ID NO: 3844241 - DNA, 12 bp, Homo sapiens
tccccagacagg

SEQ ID NO: 3844242 - DNA, 18 bp, Homo sapiens
tccccagatctgtcctgg

SEQ ID NO: 3844243 - DNA, 19 bp, Homo sapiens
tccccagatctgtcctggg

SEQ ID NO: 3844244 - DNA, 20 bp, Homo sapiens
tccccagatctgtcctgggg

SEQ ID NO: 3844245 - DNA, 13 bp, Homo sapiens
tccccagcccagg

SEQ ID NO: 3844246 - DNA, 14 bp, Homo sapiens
tccccagcccaggg

SEQ ID NO: 3844247 - DNA, 15 bp, Homo sapiens
tccccagcccctagc

SEQ ID NO: 3844248 - DNA, 19 bp, Homo sapiens
tccccagcccctagcccag

SEQ ID NO: 3844249 - DNA, 16 bp, Homo sapiens
tccccagggcagcctc

SEQ ID NO: 3844250 - DNA, 18 bp, Homo sapiens
tccccatttcccatctgc

SEQ ID NO: 3844251 - DNA, 19 bp, Homo sapiens
taatgtgtctgtggaccct

SEQ ID NO: 3844252 - DNA, 15 bp, Homo sapiens
taattcatttattaa

SEQ ID NO: 3844253 - DNA, 11 bp, Homo sapiens
taattctttct

SEQ ID NO: 3844254 - DNA, 14 bp, Homo sapiens
taattctttctttt

SEQ ID NO: 3844255 - DNA, 17 bp, Homo sapiens
taattctttctttttcc

SEQ ID NO: 3844256 - DNA, 21 bp, Homo sapiens
taattgcatgttaatttattt

SEQ ID NO: 3844257 - DNA, 21 bp, Homo sapiens
taattgctttcctgcctcctt

SEQ ID NO: 3844258 - DNA, 17 bp, Homo sapiens
taatttaaaataaataa

SEQ ID NO: 3844259 - DNA, 18 bp, Homo sapiens
taatttaaaataaataaa

SEQ ID NO: 3844260 - DNA, 22 bp, Homo sapiens
taatttaaaataaataaacttt

SEQ ID NO: 3844261 - DNA, 15 bp, Homo sapiens
taattttaaaatgtt

SEQ ID NO: 3844262 - DNA, 11 bp, Homo sapiens
taattttgcaa

SEQ ID NO: 3844263 - DNA, 15 bp, Homo sapiens
tacaaatttttactt

SEQ ID NO: 3844264 - DNA, 18 bp, Homo sapiens
tacaaatttttacttgaa

SEQ ID NO: 3844265 - DNA, 13 bp, Homo sapiens
tacaatgatttgt

SEQ ID NO: 3844266 - DNA, 15 bp, Homo sapiens
tacaatgatttgtaa

SEQ ID NO: 3844267 - DNA, 16 bp, Homo sapiens
tacaatgatttgtaaa

SEQ ID NO: 3844268 - DNA, 14 bp, Homo sapiens
tacacacacacaca

SEQ ID NO: 3844269 - DNA, 19 bp, Homo sapiens
tacacaggacttattatat

SEQ ID NO: 3844270 - DNA, 18 bp, Homo sapiens
tacaccacactaaaacat

SEQ ID NO: 3844271 - DNA, 24 bp, Homo sapiens
tacaccacactaaaacattgtcta

SEQ ID NO: 3844272 - DNA, 23 bp, Homo sapiens
tacacctggctgaggttcctctg

SEQ ID NO: 3844273 - DNA, 17 bp, Homo sapiens
tacactcgaactcggga

SEQ ID NO: 3844274 - DNA, 21 bp, Homo sapiens
tacagaattgtgtctgcagga

SEQ ID NO: 3844275 - DNA, 20 bp, Homo sapiens
tacaggatgatgactatgga

SEQ ID NO: 3844276 - DNA, 16 bp, Homo sapiens
tacagtagtataatgt

SEQ ID NO: 3844277 - DNA, 11 bp, Homo sapiens
tacagtggttt

SEQ ID NO: 3844278 - DNA, 22 bp, Homo sapiens
tacagtggttttatactgaagg

SEQ ID NO: 3844279 - DNA, 18 bp, Homo sapiens
tacagttcctaggtataa

SEQ ID NO: 3844280 - DNA, 15 bp, Homo sapiens
tacataaagttctct

SEQ ID NO: 3844281 - DNA, 18 bp, Homo sapiens
tacatagcatttgtgtaa

SEQ ID NO: 3844282 - DNA, 23 bp, Homo sapiens
tacatagcatttgtgtaaagact

SEQ ID NO: 3844283 - DNA, 22 bp, Homo sapiens
tacatataagtgattgctggtt

SEQ ID NO: 3844284 - DNA, 19 bp, Homo sapiens
tacatgaagatttggtttt

SEQ ID NO: 3844285 - DNA, 23 bp, Homo sapiens
taccaagtaagacatctcaaata

SEQ ID NO: 3844286 - DNA, 16 bp, Homo sapiens
taccaccacaccaaat

SEQ ID NO: 3844287 - DNA, 19 bp, Homo sapiens
taccaggccgtttgctttt

SEQ ID NO: 3844288 - DNA, 13 bp, Homo sapiens
taccgagagccaa

SEQ ID NO: 3844289 - DNA, 22 bp, Homo sapiens
taccgagagccaaacagagccc

SEQ ID NO: 3844290 - DNA, 15 bp, Homo sapiens
tacctcctcagggat

SEQ ID NO: 3844291 - DNA, 18 bp, Homo sapiens
tacctctgacatcaagtg

SEQ ID NO: 3844292 - DNA, 17 bp, Homo sapiens
tacctcttgaagaagaa

SEQ ID NO: 3844293 - DNA, 19 bp, Homo sapiens
tacctgcttggtctagaat

SEQ ID NO: 3844294 - DNA, 12 bp, Homo sapiens
tactaacagatt

SEQ ID NO: 3844295 - DNA, 20 bp, Homo sapiens
tactaacagattataataaa

SEQ ID NO: 3844296 - DNA, 22 bp, Homo sapiens
tactaacagattataataaatt

SEQ ID NO: 3844297 - DNA, 17 bp, Homo sapiens
tactaagaagtttaagt

SEQ ID NO: 3844298 - DNA, 19 bp, Homo sapiens
tactaatagcctaaaagat

SEQ ID NO: 3844299 - DNA, 11 bp, Homo sapiens
tactatattaa

SEQ ID NO: 3844300 - DNA, 12 bp, Homo sapiens
tactatattaac

SEQ ID NO: 3844301 - DNA, 12 bp, Homo sapiens
tactgaaggaaa

SEQ ID NO: 3844302 - DNA, 16 bp, Homo sapiens
tactgcagggccagga

SEQ ID NO: 3844303 - DNA, 18 bp, Homo sapiens
tactgcagggccaggact

SEQ ID NO: 3844304 - DNA, 19 bp, Homo sapiens
tactgcagggccaggactg

SEQ ID NO: 3844305 - DNA, 19 bp, Homo sapiens
tactgcattttcacaacat

SEQ ID NO: 3844306 - DNA, 18 bp, Homo sapiens
tactgccaaaaccaaatt

SEQ ID NO: 3844307 - DNA, 20 bp, Homo sapiens
tactgcccctgccctgagga

SEQ ID NO: 3844308 - DNA, 12 bp, Homo sapiens
tactgctttact

SEQ ID NO: 3844309 - DNA, 14 bp, Homo sapiens
tactgctttactgt

SEQ ID NO: 3844310 - DNA, 15 bp, Homo sapiens
tactgctttactgtg

SEQ ID NO: 3844311 - DNA, 16 bp, Homo sapiens
tactgtagatttcagt

SEQ ID NO: 3844312 - DNA, 18 bp, Homo sapiens
tactgtagatttcagtag

SEQ ID NO: 3844313 - DNA, 15 bp, Homo sapiens
tacttgagtatcata

SEQ ID NO: 3844314 - DNA, 15 bp, Homo sapiens
tacttgctctggacc

SEQ ID NO: 3844315 - DNA, 22 bp, Homo sapiens
tactttttgtaaatgctgtaaa

SEQ ID NO: 3844316 - DNA, 22 bp, Homo sapiens
tagaaagcaggggctacaagag

SEQ ID NO: 3844317 - DNA, 14 bp, Homo sapiens
tagaacacagaaag

SEQ ID NO: 3844318 - DNA, 16 bp, Homo sapiens
tagaagtgccatctca

SEQ ID NO: 3844319 - DNA, 17 bp, Homo sapiens
tagacactggctgccag

SEQ ID NO: 3844320 - DNA, 22 bp, Homo sapiens
tagacactggctgccagctatt

SEQ ID NO: 3844321 - DNA, 23 bp, Homo sapiens
tagacaggttaaatatataaaca

SEQ ID NO: 3844322 - DNA, 15 bp, Homo sapiens
tagacattctcttac

SEQ ID NO: 3844323 - DNA, 20 bp, Homo sapiens
tagaccctgggtgggctctg

SEQ ID NO: 3844324 - DNA, 16 bp, Homo sapiens
tagagtgagggcctga

SEQ ID NO: 3844325 - DNA, 22 bp, Homo sapiens
tagatgagtttttcattatttg

SEQ ID NO: 3844326 - DNA, 13 bp, Homo sapiens
tagatttattgtc

SEQ ID NO: 3844327 - DNA, 16 bp, Homo sapiens
tagatttcagtagttt

SEQ ID NO: 3844328 - DNA, 22 bp, Homo sapiens
tagcacctccccagacagggct

SEQ ID NO: 3844329 - DNA, 18 bp, Homo sapiens
tagcccaggagagagaaa

SEQ ID NO: 3844330 - DNA, 15 bp, Homo sapiens
tagcccatccctgcc

SEQ ID NO: 3844331 - DNA, 14 bp, Homo sapiens
tagccccggccccc

SEQ ID NO: 3844332 - DNA, 16 bp, Homo sapiens
tagcctccctctcctc

SEQ ID NO: 3844333 - DNA, 17 bp, Homo sapiens
tagcctctcctttgtag

SEQ ID NO: 3844334 - DNA, 16 bp, Homo sapiens
tagcctgggcctcctc

SEQ ID NO: 3844335 - DNA, 17 bp, Homo sapiens
tagcctgggcctcctcc

SEQ ID NO: 3844336 - DNA, 16 bp, Homo sapiens
tagcctttggctctgg

SEQ ID NO: 3844337 - DNA, 14 bp, Homo sapiens
tagctaaataactt

SEQ ID NO: 3844338 - DNA, 21 bp, Homo sapiens
tagctaaataacttgccattt

SEQ ID NO: 3844339 - DNA, 21 bp, Homo sapiens
tagctggagtgccatggctgg

SEQ ID NO: 3844340 - DNA, 17 bp, Homo sapiens
taggaaaaagctttact

SEQ ID NO: 3844341 - DNA, 17 bp, Homo sapiens
taggacaaggctgtgcc

SEQ ID NO: 3844342 - DNA, 17 bp, Homo sapiens
taggactgtggagggga

SEQ ID NO: 3844343 - DNA, 18 bp, Homo sapiens
taggactgtggaggggag

SEQ ID NO: 3844344 - DNA, 17 bp, Homo sapiens
taggcacctctgtgctg

SEQ ID NO: 3844345 - DNA, 20 bp, Homo sapiens
taggcagaagaagctgggag

SEQ ID NO: 3844346 - DNA, 21 bp, Homo sapiens
taggcattacccaaaagcaag

SEQ ID NO: 3844347 - DNA, 20 bp, Homo sapiens
taggggaggggggagccaga

SEQ ID NO: 3844348 - DNA, 20 bp, Homo sapiens
taggtcacattacattaaca

SEQ ID NO: 3844349 - DNA, 13 bp, Homo sapiens
tagtactgcttta

SEQ ID NO: 3844350 - DNA, 15 bp, Homo sapiens
tagtactgctttact

SEQ ID NO: 3844351 - DNA, 17 bp, Homo sapiens
tagtactgctttactgt

SEQ ID NO: 3844352 - DNA, 14 bp, Homo sapiens
tagtataatgtatg

SEQ ID NO: 3844353 - DNA, 22 bp, Homo sapiens
tagtattaagtgaaattttaaa

SEQ ID NO: 3844354 - DNA, 11 bp, Homo sapiens
tagtctggaaa

SEQ ID NO: 3844355 - DNA, 13 bp, Homo sapiens
tagtgacaggttt

SEQ ID NO: 3844356 - DNA, 14 bp, Homo sapiens
tagtgctgaagctt

SEQ ID NO: 3844357 - DNA, 17 bp, Homo sapiens
tagtgctgaagcttatt

SEQ ID NO: 3844358 - DNA, 22 bp, Homo sapiens
tagtgctgaagcttattaatgc

SEQ ID NO: 3844359 - DNA, 14 bp, Homo sapiens
tagtggtattatac

SEQ ID NO: 3844360 - DNA, 13 bp, Homo sapiens
tagtgttcataaa

SEQ ID NO: 3844361 - DNA, 18 bp, Homo sapiens
tagttaagcatgacttta

SEQ ID NO: 3844362 - DNA, 16 bp, Homo sapiens
tataaaagacaaaact

SEQ ID NO: 3844363 - DNA, 22 bp, Homo sapiens
tataaaagggactgagaaattt

SEQ ID NO: 3844364 - DNA, 19 bp, Homo sapiens
tataaacaaacaaacaaaa

SEQ ID NO: 3844365 - DNA, 21 bp, Homo sapiens
tataaagaaagattgtaaact

SEQ ID NO: 3844366 - DNA, 22 bp, Homo sapiens
tataaagaaagattgtaaacta

SEQ ID NO: 3844367 - DNA, 12 bp, Homo sapiens
tataaataaata

SEQ ID NO: 3844368 - DNA, 15 bp, Homo sapiens
tataaataaatatat

SEQ ID NO: 3844369 - DNA, 19 bp, Homo sapiens
tataaatactatagttata

SEQ ID NO: 3844370 - DNA, 20 bp, Homo sapiens
tataaatactatagttatat

SEQ ID NO: 3844371 - DNA, 12 bp, Homo sapiens
tataaatatata

SEQ ID NO: 3844372 - DNA, 19 bp, Homo sapiens
tataacagttataaagaaa

SEQ ID NO: 3844373 - DNA, 22 bp, Homo sapiens
tataagaaaactacatgtaaaa

SEQ ID NO: 3844374 - DNA, 14 bp, Homo sapiens
tataagaaatttta

SEQ ID NO: 3844375 - DNA, 17 bp, Homo sapiens
tataagaaattttatta

SEQ ID NO: 3844376 - DNA, 19 bp, Homo sapiens
tataagtgattgctggttt

SEQ ID NO: 3844377 - DNA, 15 bp, Homo sapiens
tataatattcataca

SEQ ID NO: 3844378 - DNA, 21 bp, Homo sapiens
tataatattcatacaacaaag

SEQ ID NO: 3844379 - DNA, 22 bp, Homo sapiens
tataatattcatacaacaaaga

SEQ ID NO: 3844380 - DNA, 22 bp, Homo sapiens
tataatgtatgaattttgtaag

SEQ ID NO: 3844381 - DNA, 24 bp, Homo sapiens
tataatgtatgaattttgtaagta

SEQ ID NO: 3844382 - DNA, 15 bp, Homo sapiens
tataattcacattgt

SEQ ID NO: 3844383 - DNA, 14 bp, Homo sapiens
tataattctttctt

SEQ ID NO: 3844384 - DNA, 13 bp, Homo sapiens
tataattttgcaa

SEQ ID NO: 3844385 - DNA, 15 bp, Homo sapiens
tatacaaagaaactt

SEQ ID NO: 3844386 - DNA, 17 bp, Homo sapiens
tatacaaagaaactttt

SEQ ID NO: 3844387 - DNA, 12 bp, Homo sapiens
tatacctcttga

SEQ ID NO: 3844388 - DNA, 13 bp, Homo sapiens
tatacctcttgaa

SEQ ID NO: 3844389 - DNA, 15 bp, Homo sapiens
tatacctcttgaaga

SEQ ID NO: 3844390 - DNA, 16 bp, Homo sapiens
tatactatattaactt

SEQ ID NO: 3844391 - DNA, 21 bp, Homo sapiens
tatacttttgcttggttcatt

SEQ ID NO: 3844392 - DNA, 21 bp, Homo sapiens
tatagaggctagcttctgctt

SEQ ID NO: 3844393 - DNA, 17 bp, Homo sapiens
tatagtactgctttact

SEQ ID NO: 3844394 - DNA, 13 bp, Homo sapiens
tatagtattaagt

SEQ ID NO: 3844395 - DNA, 16 bp, Homo sapiens
tatataaataaatata

SEQ ID NO: 3844396 - DNA, 19 bp, Homo sapiens
tatataaataaatatatat

SEQ ID NO: 3844397 - DNA, 15 bp, Homo sapiens
tatataaatactata

SEQ ID NO: 3844398 - DNA, 13 bp, Homo sapiens
tatataaatatat

SEQ ID NO: 3844399 - DNA, 15 bp, Homo sapiens
tatataaatatatat

SEQ ID NO: 3844400 - DNA, 16 bp, Homo sapiens
tatataaatatatata

SEQ ID NO: 3844401 - DNA, 12 bp, Homo sapiens
tatatataaaag

SEQ ID NO: 3844402 - DNA, 13 bp, Homo sapiens
tatatattttgtg

SEQ ID NO: 3844403 - DNA, 18 bp, Homo sapiens
tatatattttgtgggctt

SEQ ID NO: 3844404 - DNA, 16 bp, Homo sapiens
tatatgccttactatt

SEQ ID NO: 3844405 - DNA, 17 bp, Homo sapiens
tatatggaacgcatttt

SEQ ID NO: 3844406 - DNA, 21 bp, Homo sapiens
tatattaaaccttcagattaa

SEQ ID NO: 3844407 - DNA, 14 bp, Homo sapiens
tatatttgtaaaag

SEQ ID NO: 3844408 - DNA, 16 bp, Homo sapiens
tatatttgtaaaagct

SEQ ID NO: 3844409 - DNA, 16 bp, Homo sapiens
tatattttaaatgtgg

SEQ ID NO: 3844410 - DNA, 13 bp, Homo sapiens
tatattttaagac

SEQ ID NO: 3844411 - DNA, 14 bp, Homo sapiens
tatattttaagacg

SEQ ID NO: 3844412 - DNA, 14 bp, Homo sapiens
tatatttttgtgaa

SEQ ID NO: 3844413 - DNA, 12 bp, Homo sapiens
tatcaagctaat

SEQ ID NO: 3844414 - DNA, 15 bp, Homo sapiens
tatcaagctaataaa

SEQ ID NO: 3844415 - DNA, 20 bp, Homo sapiens
tatcaatccaaattccctct

SEQ ID NO: 3844416 - DNA, 21 bp, Homo sapiens
tatcaatccaaattccctctg

SEQ ID NO: 3844417 - DNA, 22 bp, Homo sapiens
tatcaatccaaattccctctgg

SEQ ID NO: 3844418 - DNA, 13 bp, Homo sapiens
tatcagacttcac

SEQ ID NO: 3844419 - DNA, 21 bp, Homo sapiens
tatcagtatggtgctaatgtg

SEQ ID NO: 3844420 - DNA, 16 bp, Homo sapiens
tatcataatatattgt

SEQ ID NO: 3844421 - DNA, 13 bp, Homo sapiens
tatcatttcatgc

SEQ ID NO: 3844422 - DNA, 19 bp, Homo sapiens
tatcatttcatgctttgat

SEQ ID NO: 3844423 - DNA, 15 bp, Homo sapiens
tatcgtaaaattaag

SEQ ID NO: 3844424 - DNA, 18 bp, Homo sapiens
tatcgtaaaattaagaaa

SEQ ID NO: 3844425 - DNA, 14 bp, Homo sapiens
tatctttgtaaatt

SEQ ID NO: 3844426 - DNA, 20 bp, Homo sapiens
tatgaagttttttttataca

SEQ ID NO: 3844427 - DNA, 18 bp, Homo sapiens
tatgcaattgtacaaaaa

SEQ ID NO: 3844428 - DNA, 13 bp, Homo sapiens
tatgcatttcaat

SEQ ID NO: 3844429 - DNA, 23 bp, Homo sapiens
tatgcctgttgcaggcaaatgta

SEQ ID NO: 3844430 - DNA, 14 bp, Homo sapiens
tatggaggcaggag

SEQ ID NO: 3844431 - DNA, 14 bp, Homo sapiens
tatggcctgtggat

SEQ ID NO: 3844432 - DNA, 13 bp, Homo sapiens
tatgtcattaaag

SEQ ID NO: 3844433 - DNA, 17 bp, Homo sapiens
tatgtgaacattcctat

SEQ ID NO: 3844434 - DNA, 19 bp, Homo sapiens
tatgtgccagatttatgca

SEQ ID NO: 3844435 - DNA, 14 bp, Homo sapiens
tatgtgcttgaaga

SEQ ID NO: 3844436 - DNA, 16 bp, Homo sapiens
tatgtgcttgaagatt

SEQ ID NO: 3844437 - DNA, 17 bp, Homo sapiens
tatgtgtgacaagtgtg

SEQ ID NO: 3844438 - DNA, 13 bp, Homo sapiens
tatgtgtgtttta

SEQ ID NO: 3844439 - DNA, 14 bp, Homo sapiens
tatgtgttggcttg

SEQ ID NO: 3844440 - DNA, 14 bp, Homo sapiens
tattaaaaagaagt

SEQ ID NO: 3844441 - DNA, 20 bp, Homo sapiens
tattaaaaagaagtttctat

SEQ ID NO: 3844442 - DNA, 15 bp, Homo sapiens
tattaaactgtaaat

SEQ ID NO: 3844443 - DNA, 22 bp, Homo sapiens
tattaaactgtaaatcataatg

SEQ ID NO: 3844444 - DNA, 14 bp, Homo sapiens
tattaagtgaaatt

SEQ ID NO: 3844445 - DNA, 16 bp, Homo sapiens
tattacaagaaaacta

SEQ ID NO: 3844446 - DNA, 20 bp, Homo sapiens
tattatagtactgctttact

SEQ ID NO: 3844447 - DNA, 22 bp, Homo sapiens
tattatagtactgctttactgt

SEQ ID NO: 3844448 - DNA, 15 bp, Homo sapiens
tattcatacaacaaa

SEQ ID NO: 3844449 - DNA, 17 bp, Homo sapiens
tattctgaccttgtgaa

SEQ ID NO: 3844450 - DNA, 22 bp, Homo sapiens
tattctgaccttgtgaacatca

SEQ ID NO: 3844451 - DNA, 16 bp, Homo sapiens
tattcttgaaagtatt

SEQ ID NO: 3844452 - DNA, 22 bp, Homo sapiens
tattgctgcattttaagcataa

SEQ ID NO: 3844453 - DNA, 20 bp, Homo sapiens
tattgggagcaatctggaaa

SEQ ID NO: 3844454 - DNA, 18 bp, Homo sapiens
tattgggcaataaaagat

SEQ ID NO: 3844455 - DNA, 18 bp, Homo sapiens
tattgtaatattaaaaag

SEQ ID NO: 3844456 - DNA, 20 bp, Homo sapiens
tattgtaatattaaaaagaa

SEQ ID NO: 3844457 - DNA, 16 bp, Homo sapiens
tattgtgttttaacac

SEQ ID NO: 3844458 - DNA, 13 bp, Homo sapiens
tatttaacttgag

SEQ ID NO: 3844459 - DNA, 13 bp, Homo sapiens
tatttagacaaga

SEQ ID NO: 3844460 - DNA, 19 bp, Homo sapiens
tatttagacaagagatggg

SEQ ID NO: 3844461 - DNA, 14 bp, Homo sapiens
tatttattgcttta

SEQ ID NO: 3844462 - DNA, 15 bp, Homo sapiens
tatttcataaattaa

SEQ ID NO: 3844463 - DNA, 22 bp, Homo sapiens
tatttcataaattaacaaagtg

SEQ ID NO: 3844464 - DNA, 19 bp, Homo sapiens
tatttgcctccatgtagaa

SEQ ID NO: 3844465 - DNA, 11 bp, Homo sapiens
tatttgtaaaa

SEQ ID NO: 3844466 - DNA, 17 bp, Homo sapiens
tatttgtaaaagctaag

SEQ ID NO: 3844467 - DNA, 13 bp, Homo sapiens
tatttgtctgtgt

SEQ ID NO: 3844468 - DNA, 14 bp, Homo sapiens
tatttgtctgtgtg

SEQ ID NO: 3844469 - DNA, 17 bp, Homo sapiens
tatttgtctgtgtgcta

SEQ ID NO: 3844470 - DNA, 19 bp, Homo sapiens
tatttgtctgtgtgctact

SEQ ID NO: 3844471 - DNA, 21 bp, Homo sapiens
tatttgtctgtgtgctactaa

SEQ ID NO: 3844472 - DNA, 23 bp, Homo sapiens
tatttgtctgtgtgctactaaca

SEQ ID NO: 3844473 - DNA, 18 bp, Homo sapiens
tattttatgtcatagttt

SEQ ID NO: 3844474 - DNA, 20 bp, Homo sapiens
tattttatttagacaagaga

SEQ ID NO: 3844475 - DNA, 15 bp, Homo sapiens
tattttctacagtgg

SEQ ID NO: 3844476 - DNA, 17 bp, Homo sapiens
tattttgtgtttaggaa

SEQ ID NO: 3844477 - DNA, 14 bp, Homo sapiens
tatttttgtaaata

SEQ ID NO: 3844478 - DNA, 13 bp, Homo sapiens
tatttttgtgaag

SEQ ID NO: 3844479 - DNA, 20 bp, Homo sapiens
tattttttaactcccaagca

SEQ ID NO: 3844480 - DNA, 15 bp, Homo sapiens
tatttttttaaactt

SEQ ID NO: 3844481 - DNA, 17 bp, Homo sapiens
tatttttttaaacttca

SEQ ID NO: 3844482 - DNA, 19 bp, Homo sapiens
tatttttttaaacttcagt

SEQ ID NO: 3844483 - DNA, 13 bp, Homo sapiens
tcaaaaactgtat

SEQ ID NO: 3844484 - DNA, 12 bp, Homo sapiens
tcaaaagaaaac

SEQ ID NO: 3844485 - DNA, 20 bp, Homo sapiens
tcaaaagaagttcattcctg

SEQ ID NO: 3844486 - DNA, 19 bp, Homo sapiens
tcaaaattgttacaaattg

SEQ ID NO: 3844487 - DNA, 21 bp, Homo sapiens
tcaaagaccttgtgtgtatgt

SEQ ID NO: 3844488 - DNA, 11 bp, Homo sapiens
tcaaataaaca

SEQ ID NO: 3844489 - DNA, 23 bp, Homo sapiens
tcaaccttgtaaattccccttcc

SEQ ID NO: 3844490 - DNA, 15 bp, Homo sapiens
tcaagattcccagga

SEQ ID NO: 3844491 - DNA, 19 bp, Homo sapiens
tcaagattcccaggagttc

SEQ ID NO: 3844492 - DNA, 22 bp, Homo sapiens
tcaagattcccaggagttctgc

SEQ ID NO: 3844493 - DNA, 16 bp, Homo sapiens
tcaagatttggcagga

SEQ ID NO: 3844494 - DNA, 20 bp, Homo sapiens
tcaagcagaaaacaagagaa

SEQ ID NO: 3844495 - DNA, 20 bp, Homo sapiens
tcaagctaataaaatatcat

SEQ ID NO: 3844496 - DNA, 18 bp, Homo sapiens
tcaagtgattctcctgcc

SEQ ID NO: 3844497 - DNA, 23 bp, Homo sapiens
tcaagtgccctctccgagctggt

SEQ ID NO: 3844498 - DNA, 14 bp, Homo sapiens
tcaatacactagtt

SEQ ID NO: 3844499 - DNA, 15 bp, Homo sapiens
tcaatcatgtgccag

SEQ ID NO: 3844500 - DNA, 14 bp, Homo sapiens
tcaatcattgtaca

SEQ ID NO: 3844501 - DNA, 15 bp, Homo sapiens
tcaatcattgtacag

SEQ ID NO: 3844502 - DNA, 16 bp, Homo sapiens
tcaatcattgtacagt

SEQ ID NO: 3844503 - DNA, 22 bp, Homo sapiens
tcaatccaaattccctctggag

SEQ ID NO: 3844504 - DNA, 22 bp, Homo sapiens
tcaatcctaatttctcctccct

SEQ ID NO: 3844505 - DNA, 16 bp, Homo sapiens
tcaatgaattaagaaa

SEQ ID NO: 3844506 - DNA, 18 bp, Homo sapiens
tcaatgaattaagaaaga

SEQ ID NO: 3844507 - DNA, 18 bp, Homo sapiens
tcaatgcaacctctgccc

SEQ ID NO: 3844508 - DNA, 20 bp, Homo sapiens
tcacaacatatcagacttca

SEQ ID NO: 3844509 - DNA, 12 bp, Homo sapiens
tcacagcctctg

SEQ ID NO: 3844510 - DNA, 20 bp, Homo sapiens
tcacagcctctgacccctcc

SEQ ID NO: 3844511 - DNA, 15 bp, Homo sapiens
tcacatcctaataga

SEQ ID NO: 3844512 - DNA, 21 bp, Homo sapiens
tcacatcctaatagaaagaaa

SEQ ID NO: 3844513 - DNA, 17 bp, Homo sapiens
tcacatgctggctcctg

SEQ ID NO: 3844514 - DNA, 17 bp, Homo sapiens
tcacatggcatgttttg

SEQ ID NO: 3844515 - DNA, 19 bp, Homo sapiens
tcacatggcatgttttgtc

SEQ ID NO: 3844516 - DNA, 22 bp, Homo sapiens
tcacattgtattcagagttgat

SEQ ID NO: 3844517 - DNA, 11 bp, Homo sapiens
tcacatttgtg

SEQ ID NO: 3844518 - DNA, 17 bp, Homo sapiens
tcaccaccccctccttc

SEQ ID NO: 3844519 - DNA, 20 bp, Homo sapiens
tcaccatgttggccaggctg

SEQ ID NO: 3844520 - DNA, 13 bp, Homo sapiens
tcacctcatgccc

SEQ ID NO: 3844521 - DNA, 18 bp, Homo sapiens
tcacctgcgcagggccct

SEQ ID NO: 3844522 - DNA, 22 bp, Homo sapiens
tcacctgcgcagggccctctgg

SEQ ID NO: 3844523 - DNA, 16 bp, Homo sapiens
tcacgcctgtaatccc

SEQ ID NO: 3844524 - DNA, 15 bp, Homo sapiens
tcactacctcctcag

SEQ ID NO: 3844525 - DNA, 22 bp, Homo sapiens
ggaggagtggccctgatccagg

SEQ ID NO: 3844526 - DNA, 18 bp, Homo sapiens
ggagggccctgaggaata

SEQ ID NO: 3844527 - DNA, 20 bp, Homo sapiens
ggagggccctgaggaataaa

SEQ ID NO: 3844528 - DNA, 17 bp, Homo sapiens
ggaggggagctgctggc

SEQ ID NO: 3844529 - DNA, 18 bp, Homo sapiens
ggagggggcttgaagcca

SEQ ID NO: 3844530 - DNA, 19 bp, Homo sapiens
ggaggggggagccagaggc

SEQ ID NO: 3844531 - DNA, 23 bp, Homo sapiens
ggaggggggagccagaggccagg

SEQ ID NO: 3844532 - DNA, 17 bp, Homo sapiens
ggaggtgaaaagggcag

SEQ ID NO: 3844533 - DNA, 18 bp, Homo sapiens
ggaggtgaaaagggcaga

SEQ ID NO: 3844534 - DNA, 22 bp, Homo sapiens
ggaggtgaaaagggcagaggca

SEQ ID NO: 3844535 - DNA, 14 bp, Homo sapiens
ggaggttgaagcca

SEQ ID NO: 3844536 - DNA, 16 bp, Homo sapiens
ggaggttgaagccaag

SEQ ID NO: 3844537 - DNA, 18 bp, Homo sapiens
ggaggttgtgtcactgac

SEQ ID NO: 3844538 - DNA, 16 bp, Homo sapiens
ggagtgtggcctggat

SEQ ID NO: 3844539 - DNA, 17 bp, Homo sapiens
ggagtgtggcctggatc

SEQ ID NO: 3844540 - DNA, 14 bp, Homo sapiens
ggagttagccaaac

SEQ ID NO: 3844541 - DNA, 16 bp, Homo sapiens
ggatactgcagggcca

SEQ ID NO: 3844542 - DNA, 21 bp, Homo sapiens
ggatactgcagggccaggact

SEQ ID NO: 3844543 - DNA, 15 bp, Homo sapiens
ggatagtctggaaag

SEQ ID NO: 3844544 - DNA, 16 bp, Homo sapiens
ggatcaagcagaaaac

SEQ ID NO: 3844545 - DNA, 22 bp, Homo sapiens
ggatgacggtattatgcttctt

SEQ ID NO: 3844546 - DNA, 23 bp, Homo sapiens
ggatgacggtattatgcttcttg

SEQ ID NO: 3844547 - DNA, 13 bp, Homo sapiens
ggatgcaaataaa

SEQ ID NO: 3844548 - DNA, 15 bp, Homo sapiens
ggatgcctgagcccc

SEQ ID NO: 3844549 - DNA, 16 bp, Homo sapiens
ggatggccaggtacaa

SEQ ID NO: 3844550 - DNA, 14 bp, Homo sapiens
ggatgggaggctcc

SEQ ID NO: 3844551 - DNA, 19 bp, Homo sapiens
ggatgggaggctcctggtg

SEQ ID NO: 3844552 - DNA, 21 bp, Homo sapiens
ggatggtggggcccccagcac

SEQ ID NO: 3844553 - DNA, 13 bp, Homo sapiens
ggattagacaggt

SEQ ID NO: 3844554 - DNA, 13 bp, Homo sapiens
ggattcttggccc

SEQ ID NO: 3844555 - DNA, 15 bp, Homo sapiens
ggattttaaatgctg

SEQ ID NO: 3844556 - DNA, 22 bp, Homo sapiens
ggattttcctgaagctgcttaa

SEQ ID NO: 3844557 - DNA, 17 bp, Homo sapiens
ggcaacgacggtttcaa

SEQ ID NO: 3844558 - DNA, 14 bp, Homo sapiens
ggcaagaggtgcct

SEQ ID NO: 3844559 - DNA, 19 bp, Homo sapiens
ggcaagaggtgcctgggag

SEQ ID NO: 3844560 - DNA, 17 bp, Homo sapiens
ggcaaggatggtggggc

SEQ ID NO: 3844561 - DNA, 21 bp, Homo sapiens
ggcaaggatggtggggccccc

SEQ ID NO: 3844562 - DNA, 17 bp, Homo sapiens
ggcaaggggcagccagc

SEQ ID NO: 3844563 - DNA, 17 bp, Homo sapiens
ggcaataaataaatgtt

SEQ ID NO: 3844564 - DNA, 15 bp, Homo sapiens
ggcacaaaatgtgac

SEQ ID NO: 3844565 - DNA, 16 bp, Homo sapiens
ggcacaaaatgtgaca

SEQ ID NO: 3844566 - DNA, 13 bp, Homo sapiens
ggcacacactgtg

SEQ ID NO: 3844567 - DNA, 18 bp, Homo sapiens
ggcacagacctctcccac

SEQ ID NO: 3844568 - DNA, 21 bp, Homo sapiens
ggcaccccaggcagctcctgt

SEQ ID NO: 3844569 - DNA, 14 bp, Homo sapiens
ggcactagcctttg

SEQ ID NO: 3844570 - DNA, 15 bp, Homo sapiens
ggcactagcctttgg

SEQ ID NO: 3844571 - DNA, 18 bp, Homo sapiens
ggcagaagaagctgggag

SEQ ID NO: 3844572 - DNA, 14 bp, Homo sapiens
ggcagagacagtgg

SEQ ID NO: 3844573 - DNA, 9 bp, Homo sapiens
ggcagagag

SEQ ID NO: 3844574 - DNA, 17 bp, Homo sapiens
ggcagagctgtggcaca

SEQ ID NO: 3844575 - DNA, 17 bp, Homo sapiens
ggcagaggcaaggatgg

SEQ ID NO: 3844576 - DNA, 14 bp, Homo sapiens
ggcagccagatccc

SEQ ID NO: 3844577 - DNA, 19 bp, Homo sapiens
ggcagccagatccccaggg

SEQ ID NO: 3844578 - DNA, 21 bp, Homo sapiens
ggcagccattggcctctgtct

SEQ ID NO: 3844579 - DNA, 19 bp, Homo sapiens
ggcagcctccagtctgctc

SEQ ID NO: 3844580 - DNA, 13 bp, Homo sapiens
ggcaggctcactg
